United States Patent 7,314,750 (ADDRESSABLE OLIGONUCLEOTIDE ARRAY OF THE RAT GENOME) - sequence listing, part 9

SEQ ID NO: 302623 - DNA, 25 bp, Rattus norvegicus
gaagctggcgcttgacatcgagatc

SEQ ID NO: 302624 - DNA, 25 bp, Rattus norvegicus
gaagctggcggccatcatctgacac

SEQ ID NO: 302625 - DNA, 25 bp, Rattus norvegicus
gaagctggcggcctccagttacact

SEQ ID NO: 302626 - DNA, 25 bp, Rattus norvegicus
gaagctggcggcgatcatctgacac

SEQ ID NO: 302627 - DNA, 25 bp, Rattus norvegicus
gaagctggcggcgtccagttacact

SEQ ID NO: 302628 - DNA, 25 bp, Rattus norvegicus
gaagctggcgtgctttttcggaaat

SEQ ID NO: 302629 - DNA, 25 bp, Rattus norvegicus
gaagctggcgtggtttttcggaaat

SEQ ID NO: 302630 - DNA, 25 bp, Rattus norvegicus
gaagctggctaacaacacaacggtg

SEQ ID NO: 302631 - DNA, 25 bp, Rattus norvegicus
gaagctggctaagaacacaacggtg

SEQ ID NO: 302632 - DNA, 25 bp, Rattus norvegicus
gaagctggctacagtgctggccttc

SEQ ID NO: 302633 - DNA, 25 bp, Rattus norvegicus
gaagctggctactgtgctggccttc

SEQ ID NO: 302634 - DNA, 25 bp, Rattus norvegicus
gaagctggctgaatccttttgctac

SEQ ID NO: 302635 - DNA, 25 bp, Rattus norvegicus
gaagctggctgaatgcatccgctgg

SEQ ID NO: 302636 - DNA, 25 bp, Rattus norvegicus
gaagctggctgattccttttgctac

SEQ ID NO: 302637 - DNA, 25 bp, Rattus norvegicus
gaagctggctgattgcatccgctgg

SEQ ID NO: 302638 - DNA, 25 bp, Rattus norvegicus
gaagctggcttcagaaacgtctgct

SEQ ID NO: 302639 - DNA, 25 bp, Rattus norvegicus
gaagctggcttcctccttaaagtaa

SEQ ID NO: 302640 - DNA, 25 bp, Rattus norvegicus
gaagctggcttcgtccttaaagtaa

SEQ ID NO: 302641 - DNA, 25 bp, Rattus norvegicus
gaagctggcttctgaaacgtctgct

SEQ ID NO: 302642 - DNA, 25 bp, Rattus norvegicus
gaagctggctttacatatcaagtca

SEQ ID NO: 302643 - DNA, 25 bp, Rattus norvegicus
gaagctggcttttcatatcaagtca

SEQ ID NO: 302644 - DNA, 25 bp, Rattus norvegicus
gaagctgggcctagaaactcacaga

SEQ ID NO: 302645 - DNA, 25 bp, Rattus norvegicus
gaagctgggcctctattgaataaac

SEQ ID NO: 302646 - DNA, 25 bp, Rattus norvegicus
gaagctgggcctgtattgaataaac

SEQ ID NO: 302647 - DNA, 25 bp, Rattus norvegicus
gaagctgggccttgaaactcacaga

SEQ ID NO: 302648 - DNA, 25 bp, Rattus norvegicus
gaagctgggcttactgagaccaatt

SEQ ID NO: 302649 - DNA, 25 bp, Rattus norvegicus
gaagctgggctttctgagaccaatt

SEQ ID NO: 302650 - DNA, 25 bp, Rattus norvegicus
gaagctgggtggctcagacgcggag

SEQ ID NO: 302651 - DNA, 25 bp, Rattus norvegicus
gaagctgggtgggtcagacgcggag

SEQ ID NO: 302652 - DNA, 25 bp, Rattus norvegicus
gaagctgggttgaatcattcctgaa

SEQ ID NO: 302653 - DNA, 25 bp, Rattus norvegicus
gaagctgggttgtatcattcctgaa

SEQ ID NO: 302654 - DNA, 25 bp, Rattus norvegicus
gaagctggtactctcctgggtacag

SEQ ID NO: 302655 - DNA, 25 bp, Rattus norvegicus
gaagctggtactgtcctgggtacag

SEQ ID NO: 302656 - DNA, 25 bp, Rattus norvegicus
gaagctggtagtaaatacccatgac

SEQ ID NO: 302657 - DNA, 25 bp, Rattus norvegicus
gaagctggtagttaatacccatgac

SEQ ID NO: 302658 - DNA, 25 bp, Rattus norvegicus
gaagctggtcaaagtcatctagagt

SEQ ID NO: 302659 - DNA, 25 bp, Rattus norvegicus
gaagctggtcaatgtcatctagagt

SEQ ID NO: 302660 - DNA, 25 bp, Rattus norvegicus
gaagctggtgtgactcctgagtgcc

SEQ ID NO: 302661 - DNA, 25 bp, Rattus norvegicus
gaagctggtgtgtctcctgagtgcc

SEQ ID NO: 302662 - DNA, 25 bp, Rattus norvegicus
gaagctgtaactcacattggctatt

SEQ ID NO: 302663 - DNA, 25 bp, Rattus norvegicus
gaagctgtaactgacattggctatt

SEQ ID NO: 302664 - DNA, 25 bp, Rattus norvegicus
gaagctgtaagtaccctttaccaat

SEQ ID NO: 302665 - DNA, 25 bp, Rattus norvegicus
gaagctgtaagttccctttaccaat

SEQ ID NO: 302666 - DNA, 25 bp, Rattus norvegicus
gaagctgtagcaaccattgggccca

SEQ ID NO: 302667 - DNA, 25 bp, Rattus norvegicus
gaagctgtagcatccattgggccca

SEQ ID NO: 302668 - DNA, 25 bp, Rattus norvegicus
gaagctgtagccagggacagaacca

SEQ ID NO: 302669 - DNA, 25 bp, Rattus norvegicus
gaagctgtagccagtcactacatga

SEQ ID NO: 302670 - DNA, 25 bp, Rattus norvegicus
gaagctgtagcctgggacagaacca

SEQ ID NO: 302671 - DNA, 25 bp, Rattus norvegicus
gaagctgtagcctgtcactacatga

SEQ ID NO: 302672 - DNA, 25 bp, Rattus norvegicus
gaagctgtatgaaacttgtcccatt

SEQ ID NO: 302673 - DNA, 25 bp, Rattus norvegicus
gaagctgtatgatacttgtcccatt

SEQ ID NO: 302674 - DNA, 25 bp, Rattus norvegicus
gaagctgtatggcagactgtcattg

SEQ ID NO: 302675 - DNA, 25 bp, Rattus norvegicus
gaagctgtatgggagactgtcattg

SEQ ID NO: 302676 - DNA, 25 bp, Rattus norvegicus
gaagctgtcagtattcgttcttgta

SEQ ID NO: 302677 - DNA, 25 bp, Rattus norvegicus
gaagctgtcagttttcgttcttgta

SEQ ID NO: 302678 - DNA, 25 bp, Rattus norvegicus
gaagctgtccagctaatggtcacag

SEQ ID NO: 302679 - DNA, 25 bp, Rattus norvegicus
gaagctgtccaggtaatggtcacag

SEQ ID NO: 302680 - DNA, 25 bp, Rattus norvegicus
gaagctgtccatcaggtcctgatgc

SEQ ID NO: 302681 - DNA, 25 bp, Rattus norvegicus
gaagctgtccatgaggtcctgatgc

SEQ ID NO: 302682 - DNA, 25 bp, Rattus norvegicus
gaagctgtcgatcagtttgttttct

SEQ ID NO: 302683 - DNA, 25 bp, Rattus norvegicus
gaagctgtcgatgagtttgttttct

SEQ ID NO: 302684 - DNA, 25 bp, Rattus norvegicus
gaagctgtcgctctcaagcacacat

SEQ ID NO: 302685 - DNA, 25 bp, Rattus norvegicus
gaagctgtcgctgtcaagcacacat

SEQ ID NO: 302686 - DNA, 25 bp, Rattus norvegicus
gaagctgtcgtcatgatcgagagac

SEQ ID NO: 302687 - DNA, 25 bp, Rattus norvegicus
gaagctgtcgtcttgatcgagagac

SEQ ID NO: 302688 - DNA, 25 bp, Rattus norvegicus
gaagctgtctccagggttgtgcgct

SEQ ID NO: 302689 - DNA, 25 bp, Rattus norvegicus
gaagctgtctcctgggttgtgcgct

SEQ ID NO: 302690 - DNA, 25 bp, Rattus norvegicus
gaagctgtctctatgcagaaccgta

SEQ ID NO: 302691 - DNA, 25 bp, Rattus norvegicus
gaagctgtctctttgcagaaccgta

SEQ ID NO: 302692 - DNA, 25 bp, Rattus norvegicus
gaagctgtcttccttgaggcaaggc

SEQ ID NO: 302693 - DNA, 25 bp, Rattus norvegicus
gaagctgtcttcgttgaggcaaggc

SEQ ID NO: 302694 - DNA, 25 bp, Rattus norvegicus
gaagctgtgactagtgaccaaatgc

SEQ ID NO: 302695 - DNA, 25 bp, Rattus norvegicus
gaagctgtgacttgtgaccaaatgc

SEQ ID NO: 302696 - DNA, 25 bp, Rattus norvegicus
gaagctgtgaggaggcccactctgt

SEQ ID NO: 302697 - DNA, 25 bp, Rattus norvegicus
gaagctgtgaggtggcccactctgt

SEQ ID NO: 302698 - DNA, 25 bp, Rattus norvegicus
gaagctgtgcaacagtgactcgctg

SEQ ID NO: 302699 - DNA, 25 bp, Rattus norvegicus
gaagctgtgcaagagtgactcgctg

SEQ ID NO: 302700 - DNA, 25 bp, Rattus norvegicus
gaagctgtgccacccattctgcaaa

SEQ ID NO: 302701 - DNA, 25 bp, Rattus norvegicus
gaagctgtgccagccattctgcaaa

SEQ ID NO: 302702 - DNA, 25 bp, Rattus norvegicus
gaagctgtgctaagttgccctagac

SEQ ID NO: 302703 - DNA, 25 bp, Rattus norvegicus
gaagctgtgctatgttgccctagac

SEQ ID NO: 302704 - DNA, 25 bp, Rattus norvegicus
gaagctgtgctcaaccacaaccaga

SEQ ID NO: 302705 - DNA, 25 bp, Rattus norvegicus
gaagctgtgctcatgtaattgcgac

SEQ ID NO: 302706 - DNA, 25 bp, Rattus norvegicus
gaagctgtgctctaccacaaccaga

SEQ ID NO: 302707 - DNA, 25 bp, Rattus norvegicus
gaagctgtgctcttgtaattgcgac

SEQ ID NO: 302708 - DNA, 25 bp, Rattus norvegicus
gaagctgtgcttaggcaagcaactc

SEQ ID NO: 302709 - DNA, 25 bp, Rattus norvegicus
gaagctgtgcttattacaatttcat

SEQ ID NO: 302710 - DNA, 25 bp, Rattus norvegicus
gaagctgtgcttcgttacctgtctc

SEQ ID NO: 302711 - DNA, 25 bp, Rattus norvegicus
gaagctgtgcttggttacctgtctc

SEQ ID NO: 302712 - DNA, 25 bp, Rattus norvegicus
gaagctgtgctttggcaagcaactc

SEQ ID NO: 302713 - DNA, 25 bp, Rattus norvegicus
gaagctgtgctttttacaatttcat

SEQ ID NO: 302714 - DNA, 25 bp, Rattus norvegicus
gaagctgtggaaaccatggcctgtg

SEQ ID NO: 302715 - DNA, 25 bp, Rattus norvegicus
gaagctgtggaatccatggcctgtg

SEQ ID NO: 302716 - DNA, 25 bp, Rattus norvegicus
gaagctgtggatattttgccatctg

SEQ ID NO: 302717 - DNA, 25 bp, Rattus norvegicus
gaagctgtggattttttgccatctg

SEQ ID NO: 302718 - DNA, 25 bp, Rattus norvegicus
gaagctgtggcgcaatgccttcctg

SEQ ID NO: 302719 - DNA, 25 bp, Rattus norvegicus
gaagctgtggcggaatgccttcctg

SEQ ID NO: 302720 - DNA, 25 bp, Rattus norvegicus
gaagctgtgggaatccttgaaccca

SEQ ID NO: 302721 - DNA, 25 bp, Rattus norvegicus
gaagctgtgggattccttgaaccca

SEQ ID NO: 302722 - DNA, 25 bp, Rattus norvegicus
gaagctgtgtctactttgacctttt

SEQ ID NO: 302723 - DNA, 25 bp, Rattus norvegicus
gaagctgtgtcttctttgacctttt

SEQ ID NO: 302724 - DNA, 25 bp, Rattus norvegicus
gaagctgtgtgactacctccaaact

SEQ ID NO: 302725 - DNA, 25 bp, Rattus norvegicus
gaagctgtgtgagtacctccaaact

SEQ ID NO: 302726 - DNA, 25 bp, Rattus norvegicus
gaagctgtgtggactgcactagccg

SEQ ID NO: 302727 - DNA, 25 bp, Rattus norvegicus
gaagctgtgtggtctgcactagccg

SEQ ID NO: 302728 - DNA, 25 bp, Rattus norvegicus
gaagctgtgtgtcaagtctctacct

SEQ ID NO: 302729 - DNA, 25 bp, Rattus norvegicus
gaagctgtgtgtgaagtctctacct

SEQ ID NO: 302730 - DNA, 25 bp, Rattus norvegicus
gaagctgtgtttactgttgggaccc

SEQ ID NO: 302731 - DNA, 25 bp, Rattus norvegicus
gaagctgtgttttctgttgggaccc

SEQ ID NO: 302732 - DNA, 25 bp, Rattus norvegicus
gaagctgttaacagtctacagagca

SEQ ID NO: 302733 - DNA, 25 bp, Rattus norvegicus
gaagctgttaactgtctacagagca

SEQ ID NO: 302734 - DNA, 25 bp, Rattus norvegicus
gaagctgttaatacactctgcaccc

SEQ ID NO: 302735 - DNA, 25 bp, Rattus norvegicus
gaagctgttaattcactctgcaccc

SEQ ID NO: 302736 - DNA, 25 bp, Rattus norvegicus
gaagctgttacactgcaggacgagc

SEQ ID NO: 302737 - DNA, 25 bp, Rattus norvegicus
gaagctgttacagtgcaggacgagc

SEQ ID NO: 302738 - DNA, 25 bp, Rattus norvegicus
gaagctgttattactgccctatcat

SEQ ID NO: 302739 - DNA, 25 bp, Rattus norvegicus
gaagctgttatttctgccctatcat

SEQ ID NO: 302740 - DNA, 25 bp, Rattus norvegicus
gaagctgttcctcttatggctggag

SEQ ID NO: 302741 - DNA, 25 bp, Rattus norvegicus
gaagctgttcctgttatggctggag

SEQ ID NO: 302742 - DNA, 25 bp, Rattus norvegicus
gaagctgttctactaaatccgtttt

SEQ ID NO: 302743 - DNA, 25 bp, Rattus norvegicus
gaagctgttctagtaaatccgtttt

SEQ ID NO: 302744 - DNA, 25 bp, Rattus norvegicus
gaagctgttctcaggcgtttcatta

SEQ ID NO: 302745 - DNA, 25 bp, Rattus norvegicus
gaagctgttctctggcgtttcatta

SEQ ID NO: 302746 - DNA, 25 bp, Rattus norvegicus
gaagctgttgtacgccgcatacgag

SEQ ID NO: 302747 - DNA, 25 bp, Rattus norvegicus
gaagctgttgtaggccgcatacgag

SEQ ID NO: 302748 - DNA, 25 bp, Rattus norvegicus
gaagctgtttaccatgtgcatccaa

SEQ ID NO: 302749 - DNA, 25 bp, Rattus norvegicus
gaagctgtttacgatgtgcatccaa

SEQ ID NO: 302750 - DNA, 25 bp, Rattus norvegicus
gaagctgtttccatgagggtgacca

SEQ ID NO: 302751 - DNA, 25 bp, Rattus norvegicus
gaagctgtttccttgagggtgacca

SEQ ID NO: 302752 - DNA, 25 bp, Rattus norvegicus
gaagctgtttgactgattgttttaa

SEQ ID NO: 302753 - DNA, 25 bp, Rattus norvegicus
gaagctgtttgagtgattgttttaa

SEQ ID NO: 302754 - DNA, 25 bp, Rattus norvegicus
gaagctgtttgtaatcagtcacatc

SEQ ID NO: 302755 - DNA, 25 bp, Rattus norvegicus
gaagctgtttgttatcagtcacatc

SEQ ID NO: 302756 - DNA, 25 bp, Rattus norvegicus
gaagctgttttacctagggctacct

SEQ ID NO: 302757 - DNA, 25 bp, Rattus norvegicus
gaagctgttttacgaacaccccatt

SEQ ID NO: 302758 - DNA, 25 bp, Rattus norvegicus
gaagctgttttagctagggctacct

SEQ ID NO: 302759 - DNA, 25 bp, Rattus norvegicus
gaagctgttttaggaacaccccatt

SEQ ID NO: 302760 - DNA, 25 bp, Rattus norvegicus
gaagctgttttccaaggattatcta

SEQ ID NO: 302761 - DNA, 25 bp, Rattus norvegicus
gaagctgttttcgaaggattatcta

SEQ ID NO: 302762 - DNA, 25 bp, Rattus norvegicus
gaagctgtttttaccatgcagtgtt

SEQ ID NO: 302763 - DNA, 25 bp, Rattus norvegicus
gaagctgttttttccatgcagtgtt

SEQ ID NO: 302764 - DNA, 25 bp, Rattus norvegicus
gaagcttaaagcaaatgtggccaag

SEQ ID NO: 302765 - DNA, 25 bp, Rattus norvegicus
gaagcttaaagctaatgtggccaag

SEQ ID NO: 302766 - DNA, 25 bp, Rattus norvegicus
gaagcttaagcacagttctcagtat

SEQ ID NO: 302767 - DNA, 25 bp, Rattus norvegicus
gaagcttaagcagagttctcagtat

SEQ ID NO: 302768 - DNA, 25 bp, Rattus norvegicus
gaagcttaagccaccagacctcaat

SEQ ID NO: 302769 - DNA, 25 bp, Rattus norvegicus
gaagcttaagcctccagacctcaat

SEQ ID NO: 302770 - DNA, 25 bp, Rattus norvegicus
gaagcttaaggcaacactttaacca

SEQ ID NO: 302771 - DNA, 25 bp, Rattus norvegicus
gaagcttaaggctacactttaacca

SEQ ID NO: 302772 - DNA, 25 bp, Rattus norvegicus
gaagcttaattacagcctatctcta

SEQ ID NO: 302773 - DNA, 25 bp, Rattus norvegicus
gaagcttaattagagcctatctcta

SEQ ID NO: 302774 - DNA, 25 bp, Rattus norvegicus
gaagcttacaggactcagaggccca

SEQ ID NO: 302775 - DNA, 25 bp, Rattus norvegicus
gaagcttacaggtctcagaggccca

SEQ ID NO: 302776 - DNA, 25 bp, Rattus norvegicus
gaagcttaccggaaatttccctgct

SEQ ID NO: 302777 - DNA, 25 bp, Rattus norvegicus
gaagcttaccggtaatttccctgct

SEQ ID NO: 302778 - DNA, 25 bp, Rattus norvegicus
gaagcttacctactctttctgtttg

SEQ ID NO: 302779 - DNA, 25 bp, Rattus norvegicus
gaagcttacctagtctttctgtttg

SEQ ID NO: 302780 - DNA, 25 bp, Rattus norvegicus
gaagcttagactctctggcctggga

SEQ ID NO: 302781 - DNA, 25 bp, Rattus norvegicus
gaagcttagactgtctggcctggga

SEQ ID NO: 302782 - DNA, 25 bp, Rattus norvegicus
gaagcttagcagaggccaccaacat

SEQ ID NO: 302783 - DNA, 25 bp, Rattus norvegicus
gaagcttagcagtggccaccaacat

SEQ ID NO: 302784 - DNA, 25 bp, Rattus norvegicus
gaagcttagccaagatctgatccta

SEQ ID NO: 302785 - DNA, 25 bp, Rattus norvegicus
gaagcttagccatgatctgatccta

SEQ ID NO: 302786 - DNA, 25 bp, Rattus norvegicus
gaagcttagcctaatcttgcggcag

SEQ ID NO: 302787 - DNA, 25 bp, Rattus norvegicus
gaagcttagccttatcttgcggcag

SEQ ID NO: 302788 - DNA, 25 bp, Rattus norvegicus
gaagcttagtcccaagtgtaatagt

SEQ ID NO: 302789 - DNA, 25 bp, Rattus norvegicus
gaagcttagtccgaagtgtaatagt

SEQ ID NO: 302790 - DNA, 25 bp, Rattus norvegicus
gaagcttagtgtcagtgtctgatct

SEQ ID NO: 302791 - DNA, 25 bp, Rattus norvegicus
gaagcttagtgtgagtgtctgatct

SEQ ID NO: 302792 - DNA, 25 bp, Rattus norvegicus
gaagcttagttcacaagaatcagca

SEQ ID NO: 302793 - DNA, 25 bp, Rattus norvegicus
gaagcttagttctcaagaatcagca

SEQ ID NO: 302794 - DNA, 25 bp, Rattus norvegicus
gaagcttatacccaggataacatga

SEQ ID NO: 302795 - DNA, 25 bp, Rattus norvegicus
gaagcttataccgaggataacatga

SEQ ID NO: 302796 - DNA, 25 bp, Rattus norvegicus
gaagcttatcatacctttcatacag

SEQ ID NO: 302797 - DNA, 25 bp, Rattus norvegicus
gaagcttatcattcctttcatacag

SEQ ID NO: 302798 - DNA, 25 bp, Rattus norvegicus
gaagcttatctcataaactccatca

SEQ ID NO: 302799 - DNA, 25 bp, Rattus norvegicus
gaagcttatctcttaaactccatca

SEQ ID NO: 302800 - DNA, 25 bp, Rattus norvegicus
gaagcttattacactcatacaattg

SEQ ID NO: 302801 - DNA, 25 bp, Rattus norvegicus
gaagcttattactctcatacaattg

SEQ ID NO: 302802 - DNA, 25 bp, Rattus norvegicus
gaagcttattttagctaacctcctg

SEQ ID NO: 302803 - DNA, 25 bp, Rattus norvegicus
gaagcttatttttgctaacctcctg

SEQ ID NO: 302804 - DNA, 25 bp, Rattus norvegicus
gaagcttcaaagcacatggcacttg

SEQ ID NO: 302805 - DNA, 25 bp, Rattus norvegicus
gaagcttcaaaggacatggcacttg

SEQ ID NO: 302806 - DNA, 25 bp, Rattus norvegicus
gaagcttcaaatctccacggctaag

SEQ ID NO: 302807 - DNA, 25 bp, Rattus norvegicus
gaagcttcaaatgtccacggctaag

SEQ ID NO: 302808 - DNA, 25 bp, Rattus norvegicus
gaagcttcaaggaaatgtcccctag

SEQ ID NO: 302809 - DNA, 25 bp, Rattus norvegicus
gaagcttcaaggtaatgtcccctag

SEQ ID NO: 302810 - DNA, 25 bp, Rattus norvegicus
gaagcttcaattagcagcctagaca

SEQ ID NO: 302811 - DNA, 25 bp, Rattus norvegicus
gaagcttcaatttgcagcctagaca

SEQ ID NO: 302812 - DNA, 25 bp, Rattus norvegicus
gaagcttcacaacgagtacccagaa

SEQ ID NO: 302813 - DNA, 25 bp, Rattus norvegicus
gaagcttcacaaggagtacccagaa

SEQ ID NO: 302814 - DNA, 25 bp, Rattus norvegicus
gaagcttcagctcctcagggaaagg

SEQ ID NO: 302815 - DNA, 25 bp, Rattus norvegicus
gaagcttcagctgctcagggaaagg

SEQ ID NO: 302816 - DNA, 25 bp, Rattus norvegicus
gaagcttcaggtatatgtcactaga

SEQ ID NO: 302817 - DNA, 25 bp, Rattus norvegicus
gaagcttcaggtttatgtcactaga

SEQ ID NO: 302818 - DNA, 25 bp, Rattus norvegicus
gaagcttcagttctgggaccacact

SEQ ID NO: 302819 - DNA, 25 bp, Rattus norvegicus
gaagcttcagttgtgggaccacact

SEQ ID NO: 302820 - DNA, 25 bp, Rattus norvegicus
gaagcttcatccagcggagtgacgc

SEQ ID NO: 302821 - DNA, 25 bp, Rattus norvegicus
gaagcttcatcctgcggagtgacgc

SEQ ID NO: 302822 - DNA, 25 bp, Rattus norvegicus
gaagcttcatgaccagccatctgtc

SEQ ID NO: 302823 - DNA, 25 bp, Rattus norvegicus
gaagcttcatgagcagccatctgtc

SEQ ID NO: 302824 - DNA, 25 bp, Rattus norvegicus
gaagcttccacaagtagcaccacag

SEQ ID NO: 302825 - DNA, 25 bp, Rattus norvegicus
gaagcttccacactgcctatcagta

SEQ ID NO: 302826 - DNA, 25 bp, Rattus norvegicus
gaagcttccacagtgcctatcagta

SEQ ID NO: 302827 - DNA, 25 bp, Rattus norvegicus
gaagcttccacatgtagcaccacag

SEQ ID NO: 302828 - DNA, 25 bp, Rattus norvegicus
gaagcttccaggatacgacaggcct

SEQ ID NO: 302829 - DNA, 25 bp, Rattus norvegicus
gaagcttccaggttacgacaggcct

SEQ ID NO: 302830 - DNA, 25 bp, Rattus norvegicus
gaagcttcctgaattgccttttcat

SEQ ID NO: 302831 - DNA, 25 bp, Rattus norvegicus
gaagcttcctgatttgccttttcat

SEQ ID NO: 302832 - DNA, 25 bp, Rattus norvegicus
gaagcttcctggacgggagaacaaa

SEQ ID NO: 302833 - DNA, 25 bp, Rattus norvegicus
gaagcttcctggcaacttggaacaa

SEQ ID NO: 302834 - DNA, 25 bp, Rattus norvegicus
gaagcttcctgggaacttggaacaa

SEQ ID NO: 302835 - DNA, 25 bp, Rattus norvegicus
gaagcttcctggtcgggagaacaaa

SEQ ID NO: 302836 - DNA, 25 bp, Rattus norvegicus
gaagcttcctgtaatctttactagg

SEQ ID NO: 302837 - DNA, 25 bp, Rattus norvegicus
gaagcttcctgttatctttactagg

SEQ ID NO: 302838 - DNA, 25 bp, Rattus norvegicus
gaagcttcgaaccaaatctcagggc

SEQ ID NO: 302839 - DNA, 25 bp, Rattus norvegicus
gaagcttcgaacgaaatctcagggc

SEQ ID NO: 302840 - DNA, 25 bp, Rattus norvegicus
gaagcttcgattcctcgtgttttaa

SEQ ID NO: 302841 - DNA, 25 bp, Rattus norvegicus
gaagcttcgattgctcgtgttttaa

SEQ ID NO: 302842 - DNA, 25 bp, Rattus norvegicus
gaagcttcgctcattcagcaagaca

SEQ ID NO: 302843 - DNA, 25 bp, Rattus norvegicus
gaagcttcgctctttcagcaagaca

SEQ ID NO: 302844 - DNA, 25 bp, Rattus norvegicus
gaagcttcggaacatcctggatctc

SEQ ID NO: 302845 - DNA, 25 bp, Rattus norvegicus
gaagcttcggaagatcctggatctc

SEQ ID NO: 302846 - DNA, 25 bp, Rattus norvegicus
gaagcttctacaagttgagtccctc

SEQ ID NO: 302847 - DNA, 25 bp, Rattus norvegicus
gaagcttctacatgttgagtccctc

SEQ ID NO: 302848 - DNA, 25 bp, Rattus norvegicus
gaagcttctagaatccagagcacag

SEQ ID NO: 302849 - DNA, 25 bp, Rattus norvegicus
gaagcttctagattccagagcacag

SEQ ID NO: 302850 - DNA, 25 bp, Rattus norvegicus
gaagcttctagcactttgtccaggg

SEQ ID NO: 302851 - DNA, 25 bp, Rattus norvegicus
gaagcttctagctctttgtccaggg

SEQ ID NO: 302852 - DNA, 25 bp, Rattus norvegicus
gaagcttctcatattggtctgttta

SEQ ID NO: 302853 - DNA, 25 bp, Rattus norvegicus
gaagcttctcatcagaaccctccaa

SEQ ID NO: 302854 - DNA, 25 bp, Rattus norvegicus
gaagcttctcatgagaaccctccaa

SEQ ID NO: 302855 - DNA, 25 bp, Rattus norvegicus
gaagcttctcattttggtctgttta

SEQ ID NO: 302856 - DNA, 25 bp, Rattus norvegicus
gaagcttctgaactgccgactgatc

SEQ ID NO: 302857 - DNA, 25 bp, Rattus norvegicus
gaagcttctgaagtgccgactgatc

SEQ ID NO: 302858 - DNA, 25 bp, Rattus norvegicus
gaagcttctgacacaggaatccaga

SEQ ID NO: 302859 - DNA, 25 bp, Rattus norvegicus
gaagcttctgactcaggaatccaga

SEQ ID NO: 302860 - DNA, 25 bp, Rattus norvegicus
gaagcttctggaagacctttctcac

SEQ ID NO: 302861 - DNA, 25 bp, Rattus norvegicus
gaagcttctggatgacctttctcac

SEQ ID NO: 302862 - DNA, 25 bp, Rattus norvegicus
gaagcttctggcctagggatagtac

SEQ ID NO: 302863 - DNA, 25 bp, Rattus norvegicus
gaagcttctggcgtagggatagtac

SEQ ID NO: 302864 - DNA, 25 bp, Rattus norvegicus
gaagcttctgtgcatgatctaacct

SEQ ID NO: 302865 - DNA, 25 bp, Rattus norvegicus
gaagcttctgtggatgatctaacct

SEQ ID NO: 302866 - DNA, 25 bp, Rattus norvegicus
gaagcttcttctctatttccttttg

SEQ ID NO: 302867 - DNA, 25 bp, Rattus norvegicus
gaagcttcttctgtatttccttttg

SEQ ID NO: 302868 - DNA, 25 bp, Rattus norvegicus
gaagcttcttggcaggatgacatgt

SEQ ID NO: 302869 - DNA, 25 bp, Rattus norvegicus
gaagcttcttgggaggatgacatgt

SEQ ID NO: 302870 - DNA, 25 bp, Rattus norvegicus
gaagcttctttacggcacacatatg

SEQ ID NO: 302871 - DNA, 25 bp, Rattus norvegicus
gaagcttctttagggcacacatatg

SEQ ID NO: 302872 - DNA, 25 bp, Rattus norvegicus
gaagcttgaattcttattcctgtag

SEQ ID NO: 302873 - DNA, 25 bp, Rattus norvegicus
gaagcttgaattgttattcctgtag

SEQ ID NO: 302874 - DNA, 25 bp, Rattus norvegicus
gaagcttgacgcaccaagcggaact

SEQ ID NO: 302875 - DNA, 25 bp, Rattus norvegicus
gaagcttgacgctccaagcggaact

SEQ ID NO: 302876 - DNA, 25 bp, Rattus norvegicus
gaagcttgagggaaccatggtttca

SEQ ID NO: 302877 - DNA, 25 bp, Rattus norvegicus
gaagcttgagggtaccatggtttca

SEQ ID NO: 302878 - DNA, 25 bp, Rattus norvegicus
gaagcttgattgcaagcctcaccaa

SEQ ID NO: 302879 - DNA, 25 bp, Rattus norvegicus
gaagcttgattggaagcctcaccaa

SEQ ID NO: 302880 - DNA, 25 bp, Rattus norvegicus
gaagcttgcaaacatgtgagctgga

SEQ ID NO: 302881 - DNA, 25 bp, Rattus norvegicus
gaagcttgcaaagatgtgagctgga

SEQ ID NO: 302882 - DNA, 25 bp, Rattus norvegicus
gaagcttgcaatagtctataactcc

SEQ ID NO: 302883 - DNA, 25 bp, Rattus norvegicus
gaagcttgcaattgtctataactcc

SEQ ID NO: 302884 - DNA, 25 bp, Rattus norvegicus
gaagcttgcagcaggtagtgccttc

SEQ ID NO: 302885 - DNA, 25 bp, Rattus norvegicus
gaagcttgcagctggtagtgccttc

SEQ ID NO: 302886 - DNA, 25 bp, Rattus norvegicus
gaagcttgcatcacccaggtttaat

SEQ ID NO: 302887 - DNA, 25 bp, Rattus norvegicus
gaagcttgcatctcccaggtttaat

SEQ ID NO: 302888 - DNA, 25 bp, Rattus norvegicus
gaagcttgccctagtgattgcaaaa

SEQ ID NO: 302889 - DNA, 25 bp, Rattus norvegicus
gaagcttgcccttgtgattgcaaaa

SEQ ID NO: 302890 - DNA, 25 bp, Rattus norvegicus
gaagcttgccttccaaagtttgata

SEQ ID NO: 302891 - DNA, 25 bp, Rattus norvegicus
gaagcttgccttgcaaagtttgata

SEQ ID NO: 302892 - DNA, 25 bp, Rattus norvegicus
gaagcttgcgcacgtaacgtgttcc

SEQ ID NO: 302893 - DNA, 25 bp, Rattus norvegicus
gaagcttgcgcaggtaacgtgttcc

SEQ ID NO: 302894 - DNA, 25 bp, Rattus norvegicus
gaagcttgctctacctatagtcaac

SEQ ID NO: 302895 - DNA, 25 bp, Rattus norvegicus
gaagcttgctcttcctatagtcaac

SEQ ID NO: 302896 - DNA, 25 bp, Rattus norvegicus
gaagcttgctgcacgaagggcccgt

SEQ ID NO: 302897 - DNA, 25 bp, Rattus norvegicus
gaagcttgctgctcgaagggcccgt

SEQ ID NO: 302898 - DNA, 25 bp, Rattus norvegicus
gaagcttgcttcagacacttagctc

SEQ ID NO: 302899 - DNA, 25 bp, Rattus norvegicus
gaagcttgcttctgacacttagctc

SEQ ID NO: 302900 - DNA, 25 bp, Rattus norvegicus
gaagcttgctttatgctgtagccat

SEQ ID NO: 302901 - DNA, 25 bp, Rattus norvegicus
gaagcttgctttttgctgtagccat

SEQ ID NO: 302902 - DNA, 25 bp, Rattus norvegicus
gaagcttggaacaccggagaatcgt

SEQ ID NO: 302903 - DNA, 25 bp, Rattus norvegicus
gaagcttggaacaggaaggtaacca

SEQ ID NO: 302904 - DNA, 25 bp, Rattus norvegicus
gaagcttggaactccggagaatcgt

SEQ ID NO: 302905 - DNA, 25 bp, Rattus norvegicus
gaagcttggaactggaaggtaacca

SEQ ID NO: 302906 - DNA, 25 bp, Rattus norvegicus
gaagcttggagcacctcagtctcaa

SEQ ID NO: 302907 - DNA, 25 bp, Rattus norvegicus
gaagcttggagctcctcagtctcaa

SEQ ID NO: 302908 - DNA, 25 bp, Rattus norvegicus
gaagcttggatcacagtcttccatt

SEQ ID NO: 302909 - DNA, 25 bp, Rattus norvegicus
gaagcttggatctcagtcttccatt

SEQ ID NO: 302910 - DNA, 25 bp, Rattus norvegicus
gaagcttggcaacgatgtcatctcc

SEQ ID NO: 302911 - DNA, 25 bp, Rattus norvegicus
gaagcttggcaaggatgtcatctcc

SEQ ID NO: 302912 - DNA, 25 bp, Rattus norvegicus
gaagcttggcatactgctgcctctc

SEQ ID NO: 302913 - DNA, 25 bp, Rattus norvegicus
gaagcttggcattctgctgcctctc

SEQ ID NO: 302914 - DNA, 25 bp, Rattus norvegicus
gaagcttgggtcagaagcctgccca

SEQ ID NO: 302915 - DNA, 25 bp, Rattus norvegicus
gaagcttgggtctgaagcctgccca

SEQ ID NO: 302916 - DNA, 25 bp, Rattus norvegicus
gaagcttggtctagatgtgggtctt

SEQ ID NO: 302917 - DNA, 25 bp, Rattus norvegicus
gaagcttggtcttgatgtgggtctt

SEQ ID NO: 302918 - DNA, 25 bp, Rattus norvegicus
gaagcttgtagcagcagacatcaga

SEQ ID NO: 302919 - DNA, 25 bp, Rattus norvegicus
gaagcttgtagctgcagacatcaga

SEQ ID NO: 302920 - DNA, 25 bp, Rattus norvegicus
gaagcttgtattatcagaccagaag

SEQ ID NO: 302921 - DNA, 25 bp, Rattus norvegicus
gaagcttgtattttcagaccagaag

SEQ ID NO: 302922 - DNA, 25 bp, Rattus norvegicus
gaagcttgtcagaattccagcatgg

SEQ ID NO: 302923 - DNA, 25 bp, Rattus norvegicus
gaagcttgtcagtattccagcatgg

SEQ ID NO: 302924 - DNA, 25 bp, Rattus norvegicus
gaagcttgtcccatatttctgaatg

SEQ ID NO: 302925 - DNA, 25 bp, Rattus norvegicus
gaagcttgtcccttatttctgaatg

SEQ ID NO: 302926 - DNA, 25 bp, Rattus norvegicus
gaagcttgtgtcagcagttgttgaa

SEQ ID NO: 302927 - DNA, 25 bp, Rattus norvegicus
gaagcttgtgtctgcagttgttgaa

SEQ ID NO: 302928 - DNA, 25 bp, Rattus norvegicus
gaagcttgttctcatggcatgtacc

SEQ ID NO: 302929 - DNA, 25 bp, Rattus norvegicus
gaagcttgttctgatggcatgtacc

SEQ ID NO: 302930 - DNA, 25 bp, Rattus norvegicus
gaagctttactcaaggagcccttgg

SEQ ID NO: 302931 - DNA, 25 bp, Rattus norvegicus
gaagctttactctaggagcccttgg

SEQ ID NO: 302932 - DNA, 25 bp, Rattus norvegicus
gaagctttactgatgagttctccat

SEQ ID NO: 302933 - DNA, 25 bp, Rattus norvegicus
gaagctttactgttgagttctccat

SEQ ID NO: 302934 - DNA, 25 bp, Rattus norvegicus
gaagctttagagaagaaccacagta

SEQ ID NO: 302935 - DNA, 25 bp, Rattus norvegicus
gaagctttagagtagaaccacagta

SEQ ID NO: 302936 - DNA, 25 bp, Rattus norvegicus
gaagctttagttcgtctccctggaa

SEQ ID NO: 302937 - DNA, 25 bp, Rattus norvegicus
gaagctttagttggtctccctggaa

SEQ ID NO: 302938 - DNA, 25 bp, Rattus norvegicus
gaagctttcaatacaagactcagaa

SEQ ID NO: 302939 - DNA, 25 bp, Rattus norvegicus
gaagctttcaattcaagactcagaa

SEQ ID NO: 302940 - DNA, 25 bp, Rattus norvegicus
gaagctttcagaagccagctctgtt

SEQ ID NO: 302941 - DNA, 25 bp, Rattus norvegicus
gaagctttcagacaggctcttcctt

SEQ ID NO: 302942 - DNA, 25 bp, Rattus norvegicus
gaagctttcagagaggctcttcctt

SEQ ID NO: 302943 - DNA, 25 bp, Rattus norvegicus
gaagctttcagatgccagctctgtt

SEQ ID NO: 302944 - DNA, 25 bp, Rattus norvegicus
gaagctttcatgctcagacactcat

SEQ ID NO: 302945 - DNA, 25 bp, Rattus norvegicus
gaagctttcatggtcagacactcat

SEQ ID NO: 302946 - DNA, 25 bp, Rattus norvegicus
gaagctttcattaccctacctttct

SEQ ID NO: 302947 - DNA, 25 bp, Rattus norvegicus
gaagctttcatttccctacctttct

SEQ ID NO: 302948 - DNA, 25 bp, Rattus norvegicus
gaagctttccatcaccaaaggcacg

SEQ ID NO: 302949 - DNA, 25 bp, Rattus norvegicus
gaagctttccatgaccaaaggcacg

SEQ ID NO: 302950 - DNA, 25 bp, Rattus norvegicus
gaagctttccctataagacattccg

SEQ ID NO: 302951 - DNA, 25 bp, Rattus norvegicus
gaagctttccctttaagacattccg

SEQ ID NO: 302952 - DNA, 25 bp, Rattus norvegicus
gaagctttcggtcaaaaaagtgcaa

SEQ ID NO: 302953 - DNA, 25 bp, Rattus norvegicus
gaagctttcggtgaaaaaagtgcaa

SEQ ID NO: 302954 - DNA, 25 bp, Rattus norvegicus
gaagctttcgttccgtgagcgcagt

SEQ ID NO: 302955 - DNA, 25 bp, Rattus norvegicus
gaagctttcgttgcgtgagcgcagt

SEQ ID NO: 302956 - DNA, 25 bp, Rattus norvegicus
gaagctttctatagtgacttttatg

SEQ ID NO: 302957 - DNA, 25 bp, Rattus norvegicus
gaagctttctattgtgacttttatg

SEQ ID NO: 302958 - DNA, 25 bp, Rattus norvegicus
gaagctttctcaaggaatgtatata

SEQ ID NO: 302959 - DNA, 25 bp, Rattus norvegicus
gaagctttctcactgcactttgaac

SEQ ID NO: 302960 - DNA, 25 bp, Rattus norvegicus
gaagctttctcagtgcactttgaac

SEQ ID NO: 302961 - DNA, 25 bp, Rattus norvegicus
gaagctttctcatggaatgtatata

SEQ ID NO: 302962 - DNA, 25 bp, Rattus norvegicus
gaagctttctccaaaggctgtgttt

SEQ ID NO: 302963 - DNA, 25 bp, Rattus norvegicus
gaagctttctcctaaggctgtgttt

SEQ ID NO: 302964 - DNA, 25 bp, Rattus norvegicus
gaagctttctctactgtgtaacacg

SEQ ID NO: 302965 - DNA, 25 bp, Rattus norvegicus
gaagctttctcttctgtgtaacacg

SEQ ID NO: 302966 - DNA, 25 bp, Rattus norvegicus
gaagctttctgaacctgtcagctct

SEQ ID NO: 302967 - DNA, 25 bp, Rattus norvegicus
gaagctttctgatcctgtcagctct

SEQ ID NO: 302968 - DNA, 25 bp, Rattus norvegicus
gaagctttcttgaggcgacaggcaa

SEQ ID NO: 302969 - DNA, 25 bp, Rattus norvegicus
gaagctttcttgtggcgacaggcaa

SEQ ID NO: 302970 - DNA, 25 bp, Rattus norvegicus
gaagctttgaaaccatcagagagaa

SEQ ID NO: 302971 - DNA, 25 bp, Rattus norvegicus
gaagctttgaaagcatcagagagaa

SEQ ID NO: 302972 - DNA, 25 bp, Rattus norvegicus
gaagctttgaatacctgcaatcttt

SEQ ID NO: 302973 - DNA, 25 bp, Rattus norvegicus
gaagctttgaattcctgcaatcttt

SEQ ID NO: 302974 - DNA, 25 bp, Rattus norvegicus
gaagctttgcccctgtggagtctaa

SEQ ID NO: 302975 - DNA, 25 bp, Rattus norvegicus
gaagctttgcccgtgtggagtctaa

SEQ ID NO: 302976 - DNA, 25 bp, Rattus norvegicus
gaagctttgcttatttccttcttgc

SEQ ID NO: 302977 - DNA, 25 bp, Rattus norvegicus
gaagctttgcttcctctcaatgatt

SEQ ID NO: 302978 - DNA, 25 bp, Rattus norvegicus
gaagctttgcttgctctcaatgatt

SEQ ID NO: 302979 - DNA, 25 bp, Rattus norvegicus
gaagctttgcttttttccttcttgc

SEQ ID NO: 302980 - DNA, 25 bp, Rattus norvegicus
gaagctttggaacgagcagtcaaga

SEQ ID NO: 302981 - DNA, 25 bp, Rattus norvegicus
gaagctttggaaggagcagtcaaga

SEQ ID NO: 302982 - DNA, 25 bp, Rattus norvegicus
gaagctttggctataggctcaccaa

SEQ ID NO: 302983 - DNA, 25 bp, Rattus norvegicus
gaagctttggctttaggctcaccaa

SEQ ID NO: 302984 - DNA, 25 bp, Rattus norvegicus
gaagctttgtcaccacctgaccaat

SEQ ID NO: 302985 - DNA, 25 bp, Rattus norvegicus
gaagctttgtcagcacctgaccaat

SEQ ID NO: 302986 - DNA, 25 bp, Rattus norvegicus
gaagctttgtgtaacagctgctact

SEQ ID NO: 302987 - DNA, 25 bp, Rattus norvegicus
gaagctttgtgtatgaagttataac

SEQ ID NO: 302988 - DNA, 25 bp, Rattus norvegicus
gaagctttgtgttacagctgctact

SEQ ID NO: 302989 - DNA, 25 bp, Rattus norvegicus
gaagctttgtgtttgaagttataac

SEQ ID NO: 302990 - DNA, 25 bp, Rattus norvegicus
gaagcttttcacacgacagcttttg

SEQ ID NO: 302991 - DNA, 25 bp, Rattus norvegicus
gaagcttttcactcgacagcttttg

SEQ ID NO: 302992 - DNA, 25 bp, Rattus norvegicus
gaagcttttcccatgaactgttcaa

SEQ ID NO: 302993 - DNA, 25 bp, Rattus norvegicus
gaagcttttcccttgaactgttcaa

SEQ ID NO: 302994 - DNA, 25 bp, Rattus norvegicus
gaagcttttcctcagttcctatacc

SEQ ID NO: 302995 - DNA, 25 bp, Rattus norvegicus
gaagcttttcctgagttcctatacc

SEQ ID NO: 302996 - DNA, 25 bp, Rattus norvegicus
gaagcttttcgccttcagtgaggtc

SEQ ID NO: 302997 - DNA, 25 bp, Rattus norvegicus
gaagcttttcgcgttcagtgaggtc

SEQ ID NO: 302998 - DNA, 25 bp, Rattus norvegicus
gaagcttttcttccaatggtacgtt

SEQ ID NO: 302999 - DNA, 25 bp, Rattus norvegicus
gaagcttttcttgcaatggtacgtt

SEQ ID NO: 303000 - DNA, 25 bp, Rattus norvegicus
gaagcttttgaaccatccctactct

SEQ ID NO: 303001 - DNA, 25 bp, Rattus norvegicus
gaagcttttgaagcatccctactct

SEQ ID NO: 303002 - DNA, 25 bp, Rattus norvegicus
gaagcttttgcaattcttgaaggac

SEQ ID NO: 303003 - DNA, 25 bp, Rattus norvegicus
gaagcttttgcacaggatcgactct

SEQ ID NO: 303004 - DNA, 25 bp, Rattus norvegicus
gaagcttttgcagaggatcgactct

SEQ ID NO: 303005 - DNA, 25 bp, Rattus norvegicus
gaagcttttgcatttcttgaaggac

SEQ ID NO: 303006 - DNA, 25 bp, Rattus norvegicus
gaagcttttggtagccaaggtcttt

SEQ ID NO: 303007 - DNA, 25 bp, Rattus norvegicus
gaagcttttggttgccaaggtcttt

SEQ ID NO: 303008 - DNA, 25 bp, Rattus norvegicus
gaagcttttgtacttttctataaat

SEQ ID NO: 303009 - DNA, 25 bp, Rattus norvegicus
gaagcttttgtagttttctataaat

SEQ ID NO: 303010 - DNA, 25 bp, Rattus norvegicus
gaagctttttccctctatgtatgat

SEQ ID NO: 303011 - DNA, 25 bp, Rattus norvegicus
gaagctttttccgtctatgtatgat

SEQ ID NO: 303012 - DNA, 25 bp, Rattus norvegicus
gaagcttttttaactggtctatata

SEQ ID NO: 303013 - DNA, 25 bp, Rattus norvegicus
gaagcttttttatctggtctatata

SEQ ID NO: 303014 - DNA, 25 bp, Rattus norvegicus
gaagcttttttccttaatatctgaa

SEQ ID NO: 303015 - DNA, 25 bp, Rattus norvegicus
gaagcttttttcgttaatatctgaa

SEQ ID NO: 303016 - DNA, 25 bp, Rattus norvegicus
gaagcttttttgacatccagcgagg

SEQ ID NO: 303017 - DNA, 25 bp, Rattus norvegicus
gaagcttttttgtcatccagcgagg

SEQ ID NO: 303018 - DNA, 25 bp, Rattus norvegicus
gaaggaaaaacacctccgctcactt

SEQ ID NO: 303019 - DNA, 25 bp, Rattus norvegicus
gaaggaaaaacagctccgctcactt

SEQ ID NO: 303020 - DNA, 25 bp, Rattus norvegicus
gaaggaaaaccacctaatcaccatt

SEQ ID NO: 303021 - DNA, 25 bp, Rattus norvegicus
gaaggaaaaccagctaatcaccatt

SEQ ID NO: 303022 - DNA, 25 bp, Rattus norvegicus
gaaggaaaacctaatcagtcattat

SEQ ID NO: 303023 - DNA, 25 bp, Rattus norvegicus
gaaggaaaaccttatcagtcattat

SEQ ID NO: 303024 - DNA, 25 bp, Rattus norvegicus
gaaggaaaagcccacgacgttcttg

SEQ ID NO: 303025 - DNA, 25 bp, Rattus norvegicus
gaaggaaaagccgacgacgttcttg

SEQ ID NO: 303026 - DNA, 25 bp, Rattus norvegicus
gaaggaaaatcccattctaagaatg

SEQ ID NO: 303027 - DNA, 25 bp, Rattus norvegicus
gaaggaaaatccgattctaagaatg

SEQ ID NO: 303028 - DNA, 25 bp, Rattus norvegicus
gaaggaaaccagagcccatcagaat

SEQ ID NO: 303029 - DNA, 25 bp, Rattus norvegicus
gaaggaaaccagtgcccatcagaat

SEQ ID NO: 303030 - DNA, 25 bp, Rattus norvegicus
gaaggaaaccatctttgagcttgaa

SEQ ID NO: 303031 - DNA, 25 bp, Rattus norvegicus
gaaggaaaccatgtttgagcttgaa

SEQ ID NO: 303032 - DNA, 25 bp, Rattus norvegicus
gaaggaaacctactactagcccact

SEQ ID NO: 303033 - DNA, 25 bp, Rattus norvegicus
gaaggaaacctagtactagcccact

SEQ ID NO: 303034 - DNA, 25 bp, Rattus norvegicus
gaaggaaactgcaactggtcacatt

SEQ ID NO: 303035 - DNA, 25 bp, Rattus norvegicus
gaaggaaactgctactggtcacatt

SEQ ID NO: 303036 - DNA, 25 bp, Rattus norvegicus
gaaggaaacttccactttcagcaag

SEQ ID NO: 303037 - DNA, 25 bp, Rattus norvegicus
gaaggaaacttcgactttcagcaag

SEQ ID NO: 303038 - DNA, 25 bp, Rattus norvegicus
gaaggaaatcgcaactctctttttt

SEQ ID NO: 303039 - DNA, 25 bp, Rattus norvegicus
gaaggaaatcgctactctctttttt

SEQ ID NO: 303040 - DNA, 25 bp, Rattus norvegicus
gaaggaaatgtacagtcacctccct

SEQ ID NO: 303041 - DNA, 25 bp, Rattus norvegicus
gaaggaaatgtagagtcacctccct

SEQ ID NO: 303042 - DNA, 25 bp, Rattus norvegicus
gaaggaaatttcacatgccaggcat

SEQ ID NO: 303043 - DNA, 25 bp, Rattus norvegicus
gaaggaaatttctcatgccaggcat

SEQ ID NO: 303044 - DNA, 25 bp, Rattus norvegicus
gaaggaacaaagactgcagggaaca

SEQ ID NO: 303045 - DNA, 25 bp, Rattus norvegicus
gaaggaacaaagtctgcagggaaca

SEQ ID NO: 303046 - DNA, 25 bp, Rattus norvegicus
gaaggaacacgaatcaaagaccagt

SEQ ID NO: 303047 - DNA, 25 bp, Rattus norvegicus
gaaggaacacgattcaaagaccagt

SEQ ID NO: 303048 - DNA, 25 bp, Rattus norvegicus
gaaggaacactccagagcctcttcc

SEQ ID NO: 303049 - DNA, 25 bp, Rattus norvegicus
gaaggaacactcgagagcctcttcc

SEQ ID NO: 303050 - DNA, 25 bp, Rattus norvegicus
gaaggaaccacacctttaccgacag

SEQ ID NO: 303051 - DNA, 25 bp, Rattus norvegicus
gaaggaaccacagctttaccgacag

SEQ ID NO: 303052 - DNA, 25 bp, Rattus norvegicus
gaaggaaccacgacaagcacaataa

SEQ ID NO: 303053 - DNA, 25 bp, Rattus norvegicus
gaaggaaccacgtcaagcacaataa

SEQ ID NO: 303054 - DNA, 25 bp, Rattus norvegicus
gaaggaaccattccaggaccctaac

SEQ ID NO: 303055 - DNA, 25 bp, Rattus norvegicus
gaaggaaccattcgtacagcacgta

SEQ ID NO: 303056 - DNA, 25 bp, Rattus norvegicus
gaaggaaccattgcaggaccctaac

SEQ ID NO: 303057 - DNA, 25 bp, Rattus norvegicus
gaaggaaccattggtacagcacgta

SEQ ID NO: 303058 - DNA, 25 bp, Rattus norvegicus
gaaggaaccctgctcatctgggaag

SEQ ID NO: 303059 - DNA, 25 bp, Rattus norvegicus
gaaggaaccctggtcatctgggaag

SEQ ID NO: 303060 - DNA, 25 bp, Rattus norvegicus
gaaggaacccttcagagccgtacct

SEQ ID NO: 303061 - DNA, 25 bp, Rattus norvegicus
gaaggaacccttgagagccgtacct

SEQ ID NO: 303062 - DNA, 25 bp, Rattus norvegicus
gaaggaacctgcattttaacattga

SEQ ID NO: 303063 - DNA, 25 bp, Rattus norvegicus
gaaggaacctgctttttaacattga

SEQ ID NO: 303064 - DNA, 25 bp, Rattus norvegicus
gaaggaacctggagtttgccctgtt

SEQ ID NO: 303065 - DNA, 25 bp, Rattus norvegicus
gaaggaacctggtgtttgccctgtt

SEQ ID NO: 303066 - DNA, 25 bp, Rattus norvegicus
gaaggaacgaccaacctgttagcat

SEQ ID NO: 303067 - DNA, 25 bp, Rattus norvegicus
gaaggaacgacctacctgttagcat

SEQ ID NO: 303068 - DNA, 25 bp, Rattus norvegicus
gaaggaacggctacccacggaggct

SEQ ID NO: 303069 - DNA, 25 bp, Rattus norvegicus
gaaggaacggcttcccacggaggct

SEQ ID NO: 303070 - DNA, 25 bp, Rattus norvegicus
gaaggaacgttcaagcactactgta

SEQ ID NO: 303071 - DNA, 25 bp, Rattus norvegicus
gaaggaacgttcacttcatacccca

SEQ ID NO: 303072 - DNA, 25 bp, Rattus norvegicus
gaaggaacgttctagcactactgta

SEQ ID NO: 303073 - DNA, 25 bp, Rattus norvegicus
gaaggaacgttctcttcatacccca

SEQ ID NO: 303074 - DNA, 25 bp, Rattus norvegicus
gaaggaactacaagacagctaacaa

SEQ ID NO: 303075 - DNA, 25 bp, Rattus norvegicus
gaaggaactacatgacagctaacaa

SEQ ID NO: 303076 - DNA, 25 bp, Rattus norvegicus
gaaggaactattactgaagactgcc

SEQ ID NO: 303077 - DNA, 25 bp, Rattus norvegicus
gaaggaactatttctgaagactgcc

SEQ ID NO: 303078 - DNA, 25 bp, Rattus norvegicus
gaaggaactcacaaccctaaagaca

SEQ ID NO: 303079 - DNA, 25 bp, Rattus norvegicus
gaaggaactcactaccctaaagaca

SEQ ID NO: 303080 - DNA, 25 bp, Rattus norvegicus
gaaggaactcagcttttcttgccgt

SEQ ID NO: 303081 - DNA, 25 bp, Rattus norvegicus
gaaggaactcaggttttcttgccgt

SEQ ID NO: 303082 - DNA, 25 bp, Rattus norvegicus
gaaggaactcttacgaggccatgat

SEQ ID NO: 303083 - DNA, 25 bp, Rattus norvegicus
gaaggaactctttcgaggccatgat

SEQ ID NO: 303084 - DNA, 25 bp, Rattus norvegicus
gaaggaactgaccatcttttttgta

SEQ ID NO: 303085 - DNA, 25 bp, Rattus norvegicus
gaaggaactgacgatcttttttgta

SEQ ID NO: 303086 - DNA, 25 bp, Rattus norvegicus
gaaggaactgtaatggactctgcca

SEQ ID NO: 303087 - DNA, 25 bp, Rattus norvegicus
gaaggaactgtattggactctgcca

SEQ ID NO: 303088 - DNA, 25 bp, Rattus norvegicus
gaaggaactgtcaagtgcagcttct

SEQ ID NO: 303089 - DNA, 25 bp, Rattus norvegicus
gaaggaactgtctagtgcagcttct

SEQ ID NO: 303090 - DNA, 25 bp, Rattus norvegicus
gaaggaacttaactattgcactgaa

SEQ ID NO: 303091 - DNA, 25 bp, Rattus norvegicus
gaaggaacttaagtattgcactgaa

SEQ ID NO: 303092 - DNA, 25 bp, Rattus norvegicus
gaaggaacttccaacatccagctga

SEQ ID NO: 303093 - DNA, 25 bp, Rattus norvegicus
gaaggaacttcctacatccagctga

SEQ ID NO: 303094 - DNA, 25 bp, Rattus norvegicus
gaaggaagacatcatctgcagctca

SEQ ID NO: 303095 - DNA, 25 bp, Rattus norvegicus
gaaggaagacatgatctgcagctca

SEQ ID NO: 303096 - DNA, 25 bp, Rattus norvegicus
gaaggaagacccagcgtgcctatga

SEQ ID NO: 303097 - DNA, 25 bp, Rattus norvegicus
gaaggaagaccctgcgtgcctatga

SEQ ID NO: 303098 - DNA, 25 bp, Rattus norvegicus
gaaggaagacctcgttctagcccct

SEQ ID NO: 303099 - DNA, 25 bp, Rattus norvegicus
gaaggaagacctggttctagcccct

SEQ ID NO: 303100 - DNA, 25 bp, Rattus norvegicus
gaaggaagacttctacactgtggaa

SEQ ID NO: 303101 - DNA, 25 bp, Rattus norvegicus
gaaggaagacttgtacactgtggaa

SEQ ID NO: 303102 - DNA, 25 bp, Rattus norvegicus
gaaggaagagaacctggaccctcat

SEQ ID NO: 303103 - DNA, 25 bp, Rattus norvegicus
gaaggaagagaagctggaccctcat

SEQ ID NO: 303104 - DNA, 25 bp, Rattus norvegicus
gaaggaagatttcaatccaggcagt

SEQ ID NO: 303105 - DNA, 25 bp, Rattus norvegicus
gaaggaagatttgaatccaggcagt

SEQ ID NO: 303106 - DNA, 25 bp, Rattus norvegicus
gaaggaagcaacaaccgccggagca

SEQ ID NO: 303107 - DNA, 25 bp, Rattus norvegicus
gaaggaagcaactaccgccggagca

SEQ ID NO: 303108 - DNA, 25 bp, Rattus norvegicus
gaaggaagcatgaggtgccactgtt

SEQ ID NO: 303109 - DNA, 25 bp, Rattus norvegicus
gaaggaagcatgtggtgccactgtt

SEQ ID NO: 303110 - DNA, 25 bp, Rattus norvegicus
gaaggaagccaccactgagcagcag

SEQ ID NO: 303111 - DNA, 25 bp, Rattus norvegicus
gaaggaagccacgactgagcagcag

SEQ ID NO: 303112 - DNA, 25 bp, Rattus norvegicus
gaaggaagccagcacccatttggag

SEQ ID NO: 303113 - DNA, 25 bp, Rattus norvegicus
gaaggaagccaggacccatttggag

SEQ ID NO: 303114 - DNA, 25 bp, Rattus norvegicus
gaaggaagcctaacatctgtccctg

SEQ ID NO: 303115 - DNA, 25 bp, Rattus norvegicus
gaaggaagcctatcatctgtccctg

SEQ ID NO: 303116 - DNA, 25 bp, Rattus norvegicus
gaaggaagccttagctctttgcctg

SEQ ID NO: 303117 - DNA, 25 bp, Rattus norvegicus
gaaggaagcctttgctctttgcctg

SEQ ID NO: 303118 - DNA, 25 bp, Rattus norvegicus
gaaggaagctatagctcaagcgcct

SEQ ID NO: 303119 - DNA, 25 bp, Rattus norvegicus
gaaggaagctattgctcaagcgcct

SEQ ID NO: 303120 - DNA, 25 bp, Rattus norvegicus
gaaggaaggactcagtttgcaccct

SEQ ID NO: 303121 - DNA, 25 bp, Rattus norvegicus
gaaggaaggactgagtttgcaccct

SEQ ID NO: 303122 - DNA, 25 bp, Rattus norvegicus
gaaggaaggcagacttgtctctacc

SEQ ID NO: 303123 - DNA, 25 bp, Rattus norvegicus
gaaggaaggcagtcttgtctctacc

SEQ ID NO: 303124 - DNA, 25 bp, Rattus norvegicus
gaaggaagggccaccatggtctttg

SEQ ID NO: 303125 - DNA, 25 bp, Rattus norvegicus
gaaggaagggccaggttccactcca

SEQ ID NO: 303126 - DNA, 25 bp, Rattus norvegicus
gaaggaagggcctccatggtctttg

SEQ ID NO: 303127 - DNA, 25 bp, Rattus norvegicus
gaaggaagggcctggttccactcca

SEQ ID NO: 303128 - DNA, 25 bp, Rattus norvegicus
gaaggaaggtctagttctctcctgc

SEQ ID NO: 303129 - DNA, 25 bp, Rattus norvegicus
gaaggaaggtcttgttctctcctgc

SEQ ID NO: 303130 - DNA, 25 bp, Rattus norvegicus
gaaggaagtaaccagcccttgtgcc

SEQ ID NO: 303131 - DNA, 25 bp, Rattus norvegicus
gaaggaagtaacgagcccttgtgcc

SEQ ID NO: 303132 - DNA, 25 bp, Rattus norvegicus
gaaggaagtatgctatttcccaaat

SEQ ID NO: 303133 - DNA, 25 bp, Rattus norvegicus
gaaggaagtatggtatttcccaaat

SEQ ID NO: 303134 - DNA, 25 bp, Rattus norvegicus
gaaggaagtcatctcttcggccgcc

SEQ ID NO: 303135 - DNA, 25 bp, Rattus norvegicus
gaaggaagtcatgtcttcggccgcc

SEQ ID NO: 303136 - DNA, 25 bp, Rattus norvegicus
gaaggaagtccccaggaatggcaat

SEQ ID NO: 303137 - DNA, 25 bp, Rattus norvegicus
gaaggaagtcccgaggaatggcaat

SEQ ID NO: 303138 - DNA, 25 bp, Rattus norvegicus
gaaggaagtcctaaatgctgtgaaa

SEQ ID NO: 303139 - DNA, 25 bp, Rattus norvegicus
gaaggaagtccttaatgctgtgaaa

SEQ ID NO: 303140 - DNA, 25 bp, Rattus norvegicus
gaaggaagtcttagcgctctcttca

SEQ ID NO: 303141 - DNA, 25 bp, Rattus norvegicus
gaaggaagtcttagtactcaggctg

SEQ ID NO: 303142 - DNA, 25 bp, Rattus norvegicus
gaaggaagtctttgcgctctcttca

SEQ ID NO: 303143 - DNA, 25 bp, Rattus norvegicus
gaaggaagtctttgtactcaggctg

SEQ ID NO: 303144 - DNA, 25 bp, Rattus norvegicus
gaaggaatacaacgcgctgcaccag

SEQ ID NO: 303145 - DNA, 25 bp, Rattus norvegicus
gaaggaatacaaggcgctgcaccag

SEQ ID NO: 303146 - DNA, 25 bp, Rattus norvegicus
gaaggaatagacaccatcagcaagg

SEQ ID NO: 303147 - DNA, 25 bp, Rattus norvegicus
gaaggaatagactccatcagcaagg

SEQ ID NO: 303148 - DNA, 25 bp, Rattus norvegicus
gaaggaatcatcaacagcatctttt

SEQ ID NO: 303149 - DNA, 25 bp, Rattus norvegicus
gaaggaatcatctacagcatctttt

SEQ ID NO: 303150 - DNA, 25 bp, Rattus norvegicus
gaaggaatccgtctgacctaggcct

SEQ ID NO: 303151 - DNA, 25 bp, Rattus norvegicus
gaaggaatccgtgtgacctaggcct

SEQ ID NO: 303152 - DNA, 25 bp, Rattus norvegicus
gaaggaatcctcagagagcaccaac

SEQ ID NO: 303153 - DNA, 25 bp, Rattus norvegicus
gaaggaatcctctgagagcaccaac

SEQ ID NO: 303154 - DNA, 25 bp, Rattus norvegicus
gaaggaatctgcacagtcaccaaga

SEQ ID NO: 303155 - DNA, 25 bp, Rattus norvegicus
gaaggaatctgctcagtcaccaaga

SEQ ID NO: 303156 - DNA, 25 bp, Rattus norvegicus
gaaggaatcttgactgttgctggat

SEQ ID NO: 303157 - DNA, 25 bp, Rattus norvegicus
gaaggaatcttgtctgttgctggat

SEQ ID NO: 303158 - DNA, 25 bp, Rattus norvegicus
gaaggaatgaacaggcctgaaacac

SEQ ID NO: 303159 - DNA, 25 bp, Rattus norvegicus
gaaggaatgaactggcctgaaacac

SEQ ID NO: 303160 - DNA, 25 bp, Rattus norvegicus
gaaggaatgcaacaccccaagcaga

SEQ ID NO: 303161 - DNA, 25 bp, Rattus norvegicus
gaaggaatgcaagaccccaagcaga

SEQ ID NO: 303162 - DNA, 25 bp, Rattus norvegicus
gaaggaatgtgaaacctagctccaa

SEQ ID NO: 303163 - DNA, 25 bp, Rattus norvegicus
gaaggaatgtgatacctagctccaa

SEQ ID NO: 303164 - DNA, 25 bp, Rattus norvegicus
gaaggaatgtgcattaccaataaaa

SEQ ID NO: 303165 - DNA, 25 bp, Rattus norvegicus
gaaggaatgtgctttaccaataaaa

SEQ ID NO: 303166 - DNA, 25 bp, Rattus norvegicus
gaaggaatgtttagccccattagtg

SEQ ID NO: 303167 - DNA, 25 bp, Rattus norvegicus
gaaggaatgttttgccccattagtg

SEQ ID NO: 303168 - DNA, 25 bp, Rattus norvegicus
gaaggaattcctcctgatcagcaga

SEQ ID NO: 303169 - DNA, 25 bp, Rattus norvegicus
gaaggaattcctgctgatcagcaga

SEQ ID NO: 303170 - DNA, 25 bp, Rattus norvegicus
gaaggacaacgacatcaccacctct

SEQ ID NO: 303171 - DNA, 25 bp, Rattus norvegicus
gaaggacaacgagatcaccacctct

SEQ ID NO: 303172 - DNA, 25 bp, Rattus norvegicus
gaaggacaagcaccaactttggcgg

SEQ ID NO: 303173 - DNA, 25 bp, Rattus norvegicus
gaaggacaagcagcaactttggcgg

SEQ ID NO: 303174 - DNA, 25 bp, Rattus norvegicus
gaaggacaagcccaagagccgtgcc

SEQ ID NO: 303175 - DNA, 25 bp, Rattus norvegicus
gaaggacaagccgaagagccgtgcc

SEQ ID NO: 303176 - DNA, 25 bp, Rattus norvegicus
gaaggacaagcgctcccgtcagatg

SEQ ID NO: 303177 - DNA, 25 bp, Rattus norvegicus
gaaggacaagcggtcccgtcagatg

SEQ ID NO: 303178 - DNA, 25 bp, Rattus norvegicus
gaaggacaagctaagcacctgtgtt

SEQ ID NO: 303179 - DNA, 25 bp, Rattus norvegicus
gaaggacaagcttagcacctgtgtt

SEQ ID NO: 303180 - DNA, 25 bp, Rattus norvegicus
gaaggacacaacctttgcccaggtg

SEQ ID NO: 303181 - DNA, 25 bp, Rattus norvegicus
gaaggacacaacgtttgcccaggtg

SEQ ID NO: 303182 - DNA, 25 bp, Rattus norvegicus
gaaggacacagcaactactacatct

SEQ ID NO: 303183 - DNA, 25 bp, Rattus norvegicus
gaaggacacagctactactacatct

SEQ ID NO: 303184 - DNA, 25 bp, Rattus norvegicus
gaaggacacagtactactgatggaa

SEQ ID NO: 303185 - DNA, 25 bp, Rattus norvegicus
gaaggacacagttctactgatggaa

SEQ ID NO: 303186 - DNA, 25 bp, Rattus norvegicus
gaaggacaccaccatggacttacac

SEQ ID NO: 303187 - DNA, 25 bp, Rattus norvegicus
gaaggacaccacgatggacttacac

SEQ ID NO: 303188 - DNA, 25 bp, Rattus norvegicus
gaaggacacccgactctatttctta

SEQ ID NO: 303189 - DNA, 25 bp, Rattus norvegicus
gaaggacacccgtctctatttctta

SEQ ID NO: 303190 - DNA, 25 bp, Rattus norvegicus
gaaggacaccgtaaacccagatcct

SEQ ID NO: 303191 - DNA, 25 bp, Rattus norvegicus
gaaggacaccgttaacccagatcct

SEQ ID NO: 303192 - DNA, 25 bp, Rattus norvegicus
gaaggacacctacagttacttggct

SEQ ID NO: 303193 - DNA, 25 bp, Rattus norvegicus
gaaggacacctagagttacttggct

SEQ ID NO: 303194 - DNA, 25 bp, Rattus norvegicus
gaaggacacctcaggtttttgtctg

SEQ ID NO: 303195 - DNA, 25 bp, Rattus norvegicus
gaaggacacctctggtttttgtctg

SEQ ID NO: 303196 - DNA, 25 bp, Rattus norvegicus
gaaggacaccttcagccagcagata

SEQ ID NO: 303197 - DNA, 25 bp, Rattus norvegicus
gaaggacaccttgagccagcagata

SEQ ID NO: 303198 - DNA, 25 bp, Rattus norvegicus
gaaggacactgactctaccttcctt

SEQ ID NO: 303199 - DNA, 25 bp, Rattus norvegicus
gaaggacactgagtctaccttcctt

SEQ ID NO: 303200 - DNA, 25 bp, Rattus norvegicus
gaaggacactgcaccaactcagtaa

SEQ ID NO: 303201 - DNA, 25 bp, Rattus norvegicus
gaaggacactgctccaactcagtaa

SEQ ID NO: 303202 - DNA, 25 bp, Rattus norvegicus
gaaggacacttacgctggttcagac

SEQ ID NO: 303203 - DNA, 25 bp, Rattus norvegicus
gaaggacacttaggctggttcagac

SEQ ID NO: 303204 - DNA, 25 bp, Rattus norvegicus
gaaggacactttctagcttgccaaa

SEQ ID NO: 303205 - DNA, 25 bp, Rattus norvegicus
gaaggacactttgtagcttgccaaa

SEQ ID NO: 303206 - DNA, 25 bp, Rattus norvegicus
gaaggacagaaacggacctggccgg

SEQ ID NO: 303207 - DNA, 25 bp, Rattus norvegicus
gaaggacagaaagggacctggccgg

SEQ ID NO: 303208 - DNA, 25 bp, Rattus norvegicus
gaaggacagaacatgcccggagaca

SEQ ID NO: 303209 - DNA, 25 bp, Rattus norvegicus
gaaggacagaacttgcccggagaca

SEQ ID NO: 303210 - DNA, 25 bp, Rattus norvegicus
gaaggacagaccatgagaacactca

SEQ ID NO: 303211 - DNA, 25 bp, Rattus norvegicus
gaaggacagaccttgagaacactca

SEQ ID NO: 303212 - DNA, 25 bp, Rattus norvegicus
gaaggacagactccgctttgaccct

SEQ ID NO: 303213 - DNA, 25 bp, Rattus norvegicus
gaaggacagactgcgctttgaccct

SEQ ID NO: 303214 - DNA, 25 bp, Rattus norvegicus
gaaggacagagtcccatctccacag

SEQ ID NO: 303215 - DNA, 25 bp, Rattus norvegicus
gaaggacagagtgccatctccacag

SEQ ID NO: 303216 - DNA, 25 bp, Rattus norvegicus
gaaggacagcaacgactctctccac

SEQ ID NO: 303217 - DNA, 25 bp, Rattus norvegicus
gaaggacagcaaggactctctccac

SEQ ID NO: 303218 - DNA, 25 bp, Rattus norvegicus
gaaggacagcgccagacccaggaat

SEQ ID NO: 303219 - DNA, 25 bp, Rattus norvegicus
gaaggacagcgcgagacccaggaat

SEQ ID NO: 303220 - DNA, 25 bp, Rattus norvegicus
gaaggacaggagatgcctcctttcc

SEQ ID NO: 303221 - DNA, 25 bp, Rattus norvegicus
gaaggacaggagttgcctcctttcc

SEQ ID NO: 303222 - DNA, 25 bp, Rattus norvegicus
gaaggacaggatcgactctcgaaaa

SEQ ID NO: 303223 - DNA, 25 bp, Rattus norvegicus
gaaggacaggatggactctcgaaaa

SEQ ID NO: 303224 - DNA, 25 bp, Rattus norvegicus
gaaggacaggtgacagcagtctgaa

SEQ ID NO: 303225 - DNA, 25 bp, Rattus norvegicus
gaaggacaggtgtcagcagtctgaa

SEQ ID NO: 303226 - DNA, 25 bp, Rattus norvegicus
gaaggacatcaaacctcacctgaaa

SEQ ID NO: 303227 - DNA, 25 bp, Rattus norvegicus
gaaggacatcaacgctctggttctg

SEQ ID NO: 303228 - DNA, 25 bp, Rattus norvegicus
gaaggacatcaaggctctggttctg

SEQ ID NO: 303229 - DNA, 25 bp, Rattus norvegicus
gaaggacatcaatcctcacctgaaa

SEQ ID NO: 303230 - DNA, 25 bp, Rattus norvegicus
gaaggacatcacagatcaccgggct

SEQ ID NO: 303231 - DNA, 25 bp, Rattus norvegicus
gaaggacatcactgatcaccgggct

SEQ ID NO: 303232 - DNA, 25 bp, Rattus norvegicus
gaaggacatcgcagtcaagaccaac

SEQ ID NO: 303233 - DNA, 25 bp, Rattus norvegicus
gaaggacatcgctgtcaagaccaac

SEQ ID NO: 303234 - DNA, 25 bp, Rattus norvegicus
gaaggacatggacctggcccacaga

SEQ ID NO: 303235 - DNA, 25 bp, Rattus norvegicus
gaaggacatggagctggcccacaga

SEQ ID NO: 303236 - DNA, 25 bp, Rattus norvegicus
gaaggacattttagcaacgaccaaa

SEQ ID NO: 303237 - DNA, 25 bp, Rattus norvegicus
gaaggacatttttgcaacgaccaaa

SEQ ID NO: 303238 - DNA, 25 bp, Rattus norvegicus
gaaggaccaaccacaggtagccatg

SEQ ID NO: 303239 - DNA, 25 bp, Rattus norvegicus
gaaggaccaacctcaggtagccatg

SEQ ID NO: 303240 - DNA, 25 bp, Rattus norvegicus
gaaggaccacaaatttctgccggtg

SEQ ID NO: 303241 - DNA, 25 bp, Rattus norvegicus
gaaggaccacaattttctgccggtg

SEQ ID NO: 303242 - DNA, 25 bp, Rattus norvegicus
gaaggaccagaacgccaagggcatc

SEQ ID NO: 303243 - DNA, 25 bp, Rattus norvegicus
gaaggaccagaaggccaagggcatc

SEQ ID NO: 303244 - DNA, 25 bp, Rattus norvegicus
gaaggaccagacacttctatcttcc

SEQ ID NO: 303245 - DNA, 25 bp, Rattus norvegicus
gaaggaccagactcttctatcttcc

SEQ ID NO: 303246 - DNA, 25 bp, Rattus norvegicus
gaaggaccagttcttacttcctgaa

SEQ ID NO: 303247 - DNA, 25 bp, Rattus norvegicus
gaaggaccagttgttacttcctgaa

SEQ ID NO: 303248 - DNA, 25 bp, Rattus norvegicus
gaaggaccatgtagttaacggacat

SEQ ID NO: 303249 - DNA, 25 bp, Rattus norvegicus
gaaggaccatgttgttaacggacat

SEQ ID NO: 303250 - DNA, 25 bp, Rattus norvegicus
gaaggacccaggaactcagtcctga

SEQ ID NO: 303251 - DNA, 25 bp, Rattus norvegicus
gaaggacccaggtactcagtcctga

SEQ ID NO: 303252 - DNA, 25 bp, Rattus norvegicus
gaaggacccattccttgaggccgtt

SEQ ID NO: 303253 - DNA, 25 bp, Rattus norvegicus
gaaggacccattgcttgaggccgtt

SEQ ID NO: 303254 - DNA, 25 bp, Rattus norvegicus
gaaggaccctaaccacactgttcag

SEQ ID NO: 303255 - DNA, 25 bp, Rattus norvegicus
gaaggaccctaacgcctcagattaa

SEQ ID NO: 303256 - DNA, 25 bp, Rattus norvegicus
gaaggaccctaagcacactgttcag

SEQ ID NO: 303257 - DNA, 25 bp, Rattus norvegicus
gaaggaccctaaggcctcagattaa

SEQ ID NO: 303258 - DNA, 25 bp, Rattus norvegicus
gaaggaccctgacctgtggccataa

SEQ ID NO: 303259 - DNA, 25 bp, Rattus norvegicus
gaaggaccctgagctgtggccataa

SEQ ID NO: 303260 - DNA, 25 bp, Rattus norvegicus
gaaggacccttccaaatcggtggtg

SEQ ID NO: 303261 - DNA, 25 bp, Rattus norvegicus
gaaggacccttcgaaatcggtggtg

SEQ ID NO: 303262 - DNA, 25 bp, Rattus norvegicus
gaaggaccgcagactcagctaacta

SEQ ID NO: 303263 - DNA, 25 bp, Rattus norvegicus
gaaggaccgcagtctcagctaacta

SEQ ID NO: 303264 - DNA, 25 bp, Rattus norvegicus
gaaggaccggcaccctttttcaaag

SEQ ID NO: 303265 - DNA, 25 bp, Rattus norvegicus
gaaggaccggcagcctttttcaaag

SEQ ID NO: 303266 - DNA, 25 bp, Rattus norvegicus
gaaggaccggcgaggtgattctctc

SEQ ID NO: 303267 - DNA, 25 bp, Rattus norvegicus
gaaggaccggcgtggtgattctctc

SEQ ID NO: 303268 - DNA, 25 bp, Rattus norvegicus
gaaggaccggtcagcactgagcaca

SEQ ID NO: 303269 - DNA, 25 bp, Rattus norvegicus
gaaggaccggtctgcactgagcaca

SEQ ID NO: 303270 - DNA, 25 bp, Rattus norvegicus
gaaggaccgtccacatggaagtgca

SEQ ID NO: 303271 - DNA, 25 bp, Rattus norvegicus
gaaggaccgtcctcatggaagtgca

SEQ ID NO: 303272 - DNA, 25 bp, Rattus norvegicus
gaaggacctaaaagccatcacaacg

SEQ ID NO: 303273 - DNA, 25 bp, Rattus norvegicus
gaaggacctaaatgccatcacaacg

SEQ ID NO: 303274 - DNA, 25 bp, Rattus norvegicus
gaaggacctcatctatgttagacaa

SEQ ID NO: 303275 - DNA, 25 bp, Rattus norvegicus
gaaggacctcatgtatgttagacaa

SEQ ID NO: 303276 - DNA, 25 bp, Rattus norvegicus
gaaggacctccaacaggttatatcc

SEQ ID NO: 303277 - DNA, 25 bp, Rattus norvegicus
gaaggacctccatcaggttatatcc

SEQ ID NO: 303278 - DNA, 25 bp, Rattus norvegicus
gaaggacctcctacagcagctgctg

SEQ ID NO: 303279 - DNA, 25 bp, Rattus norvegicus
gaaggacctccttcagcagctgctg

SEQ ID NO: 303280 - DNA, 25 bp, Rattus norvegicus
gaaggacctctcagggctcaagaaa

SEQ ID NO: 303281 - DNA, 25 bp, Rattus norvegicus
gaaggacctctctgggctcaagaaa

SEQ ID NO: 303282 - DNA, 25 bp, Rattus norvegicus
gaaggacctcttatcatgcctggat

SEQ ID NO: 303283 - DNA, 25 bp, Rattus norvegicus
gaaggacctcttttcatgcctggat

SEQ ID NO: 303284 - DNA, 25 bp, Rattus norvegicus
gaaggacctgaacgtcccacgcaca

SEQ ID NO: 303285 - DNA, 25 bp, Rattus norvegicus
gaaggacctgaaggtcccacgcaca

SEQ ID NO: 303286 - DNA, 25 bp, Rattus norvegicus
gaaggacctgacatgccgttggaca

SEQ ID NO: 303287 - DNA, 25 bp, Rattus norvegicus
gaaggacctgacttgccgttggaca

SEQ ID NO: 303288 - DNA, 25 bp, Rattus norvegicus
gaaggacctgctaatccaggagcca

SEQ ID NO: 303289 - DNA, 25 bp, Rattus norvegicus
gaaggacctgcttatccaggagcca

SEQ ID NO: 303290 - DNA, 25 bp, Rattus norvegicus
gaaggacctggaacagccggcagac

SEQ ID NO: 303291 - DNA, 25 bp, Rattus norvegicus
gaaggacctggatcagccggcagac

SEQ ID NO: 303292 - DNA, 25 bp, Rattus norvegicus
gaaggacctgttccatcaaagacga

SEQ ID NO: 303293 - DNA, 25 bp, Rattus norvegicus
gaaggacctgttgcatcaaagacga

SEQ ID NO: 303294 - DNA, 25 bp, Rattus norvegicus
gaaggaccttcacagtaccagacta

SEQ ID NO: 303295 - DNA, 25 bp, Rattus norvegicus
gaaggaccttcagagtaccagacta

SEQ ID NO: 303296 - DNA, 25 bp, Rattus norvegicus
gaaggacgaactatttcactttgaa

SEQ ID NO: 303297 - DNA, 25 bp, Rattus norvegicus
gaaggacgaactttttcactttgaa

SEQ ID NO: 303298 - DNA, 25 bp, Rattus norvegicus
gaaggacgactcagcaattcacagc

SEQ ID NO: 303299 - DNA, 25 bp, Rattus norvegicus
gaaggacgactctgcaattcacagc

SEQ ID NO: 303300 - DNA, 25 bp, Rattus norvegicus
gaaggacgcctcagtggcaggtttc

SEQ ID NO: 303301 - DNA, 25 bp, Rattus norvegicus
gaaggacgcctctgtggcaggtttc

SEQ ID NO: 303302 - DNA, 25 bp, Rattus norvegicus
gaaggacgccttacagaatgcctac

SEQ ID NO: 303303 - DNA, 25 bp, Rattus norvegicus
gaaggacgcctttcagaatgcctac

SEQ ID NO: 303304 - DNA, 25 bp, Rattus norvegicus
gaaggacggctcaggagaccaaact

SEQ ID NO: 303305 - DNA, 25 bp, Rattus norvegicus
gaaggacggctctggagaccaaact

SEQ ID NO: 303306 - DNA, 25 bp, Rattus norvegicus
gaaggacgtcctaccaatgactgtt

SEQ ID NO: 303307 - DNA, 25 bp, Rattus norvegicus
gaaggacgtccttccaatgactgtt

SEQ ID NO: 303308 - DNA, 25 bp, Rattus norvegicus
gaaggacgtgaactcaccgtgactt

SEQ ID NO: 303309 - DNA, 25 bp, Rattus norvegicus
gaaggacgtgaagtcaccgtgactt

SEQ ID NO: 303310 - DNA, 25 bp, Rattus norvegicus
gaaggacgtgtgacttctctttttc

SEQ ID NO: 303311 - DNA, 25 bp, Rattus norvegicus
gaaggacgtgtgtcttctctttttc

SEQ ID NO: 303312 - DNA, 25 bp, Rattus norvegicus
gaaggacgttcccaatagccaactg

SEQ ID NO: 303313 - DNA, 25 bp, Rattus norvegicus
gaaggacgttccgaatagccaactg

SEQ ID NO: 303314 - DNA, 25 bp, Rattus norvegicus
gaaggacgttgtctatcttgaccac

SEQ ID NO: 303315 - DNA, 25 bp, Rattus norvegicus
gaaggacgttgtgtatcttgaccac

SEQ ID NO: 303316 - DNA, 25 bp, Rattus norvegicus
gaaggactaggtacatcctctgcca

SEQ ID NO: 303317 - DNA, 25 bp, Rattus norvegicus
gaaggactaggttcatcctctgcca

SEQ ID NO: 303318 - DNA, 25 bp, Rattus norvegicus
gaaggactcacccaagtgcaactaa

SEQ ID NO: 303319 - DNA, 25 bp, Rattus norvegicus
gaaggactcaccgaagtgcaactaa

SEQ ID NO: 303320 - DNA, 25 bp, Rattus norvegicus
gaaggactcccactgtccaggagta

SEQ ID NO: 303321 - DNA, 25 bp, Rattus norvegicus
gaaggactcccagtgtccaggagta

SEQ ID NO: 303322 - DNA, 25 bp, Rattus norvegicus
gaaggactccggatgtcggacatca

SEQ ID NO: 303323 - DNA, 25 bp, Rattus norvegicus
gaaggactccggttgtcggacatca

SEQ ID NO: 303324 - DNA, 25 bp, Rattus norvegicus
gaaggactcctgaagtaggacccat

SEQ ID NO: 303325 - DNA, 25 bp, Rattus norvegicus
gaaggactcctgtagtaggacccat

SEQ ID NO: 303326 - DNA, 25 bp, Rattus norvegicus
gaaggactcgaacgttcccctggca

SEQ ID NO: 303327 - DNA, 25 bp, Rattus norvegicus
gaaggactcgaaggttcccctggca

SEQ ID NO: 303328 - DNA, 25 bp, Rattus norvegicus
gaaggactcgtacaccaggaagctg

SEQ ID NO: 303329 - DNA, 25 bp, Rattus norvegicus
gaaggactcgtagaccaggaagctg

SEQ ID NO: 303330 - DNA, 25 bp, Rattus norvegicus
gaaggactctccaagacagtaacag

SEQ ID NO: 303331 - DNA, 25 bp, Rattus norvegicus
gaaggactctcctagacagtaacag

SEQ ID NO: 303332 - DNA, 25 bp, Rattus norvegicus
gaaggactctgaacccaaagcccct

SEQ ID NO: 303333 - DNA, 25 bp, Rattus norvegicus
gaaggactctgaagccgagctccag

SEQ ID NO: 303334 - DNA, 25 bp, Rattus norvegicus
gaaggactctgatcccaaagcccct

SEQ ID NO: 303335 - DNA, 25 bp, Rattus norvegicus
gaaggactctgatgccgagctccag

SEQ ID NO: 303336 - DNA, 25 bp, Rattus norvegicus
gaaggactctgtcaccagacttgaa

SEQ ID NO: 303337 - DNA, 25 bp, Rattus norvegicus
gaaggactctgtctagagcttccta

SEQ ID NO: 303338 - DNA, 25 bp, Rattus norvegicus
gaaggactctgtgaccagacttgaa

SEQ ID NO: 303339 - DNA, 25 bp, Rattus norvegicus
gaaggactctgtgtagagcttccta

SEQ ID NO: 303340 - DNA, 25 bp, Rattus norvegicus
gaaggactctttcccaagtgttatg

SEQ ID NO: 303341 - DNA, 25 bp, Rattus norvegicus
gaaggactctttgccaagtgttatg

SEQ ID NO: 303342 - DNA, 25 bp, Rattus norvegicus
gaaggactgagacacgctttcccct

SEQ ID NO: 303343 - DNA, 25 bp, Rattus norvegicus
gaaggactgagagacgctttcccct

SEQ ID NO: 303344 - DNA, 25 bp, Rattus norvegicus
gaaggactgcccctgtattaataaa

SEQ ID NO: 303345 - DNA, 25 bp, Rattus norvegicus
gaaggactgcccgtgtattaataaa

SEQ ID NO: 303346 - DNA, 25 bp, Rattus norvegicus
gaaggactgctcactttggcctcgg

SEQ ID NO: 303347 - DNA, 25 bp, Rattus norvegicus
gaaggactgctctctttggcctcgg

SEQ ID NO: 303348 - DNA, 25 bp, Rattus norvegicus
gaaggactgcttctcatgcgctcat

SEQ ID NO: 303349 - DNA, 25 bp, Rattus norvegicus
gaaggactgcttgtcatgcgctcat

SEQ ID NO: 303350 - DNA, 25 bp, Rattus norvegicus
gaaggactggctccctaagagccca

SEQ ID NO: 303351 - DNA, 25 bp, Rattus norvegicus
gaaggactggctgcctaagagccca

SEQ ID NO: 303352 - DNA, 25 bp, Rattus norvegicus
gaaggactgggtactcaaaccacag

SEQ ID NO: 303353 - DNA, 25 bp, Rattus norvegicus
gaaggactgggttctcaaaccacag

SEQ ID NO: 303354 - DNA, 25 bp, Rattus norvegicus
gaaggactggttatccctgaaattg

SEQ ID NO: 303355 - DNA, 25 bp, Rattus norvegicus
gaaggactggttttccctgaaattg

SEQ ID NO: 303356 - DNA, 25 bp, Rattus norvegicus
gaaggactgtagcattttatctgag

SEQ ID NO: 303357 - DNA, 25 bp, Rattus norvegicus
gaaggactgtaggattttatctgag

SEQ ID NO: 303358 - DNA, 25 bp, Rattus norvegicus
gaaggactgtcaattacggaaatca

SEQ ID NO: 303359 - DNA, 25 bp, Rattus norvegicus
gaaggactgtcatttacggaaatca

SEQ ID NO: 303360 - DNA, 25 bp, Rattus norvegicus
gaaggactgtgaacgattttctaat

SEQ ID NO: 303361 - DNA, 25 bp, Rattus norvegicus
gaaggactgtgatcgattttctaat

SEQ ID NO: 303362 - DNA, 25 bp, Rattus norvegicus
gaaggactgtgtacccttgaggtaa

SEQ ID NO: 303363 - DNA, 25 bp, Rattus norvegicus
gaaggactgtgttcccttgaggtaa

SEQ ID NO: 303364 - DNA, 25 bp, Rattus norvegicus
gaaggactgttaccttctctcacca

SEQ ID NO: 303365 - DNA, 25 bp, Rattus norvegicus
gaaggactgttagcttctctcacca

SEQ ID NO: 303366 - DNA, 25 bp, Rattus norvegicus
gaaggactgtttactgtcagcaatg

SEQ ID NO: 303367 - DNA, 25 bp, Rattus norvegicus
gaaggactgttttctgtcagcaatg

SEQ ID NO: 303368 - DNA, 25 bp, Rattus norvegicus
gaaggacttcacctacagcaaggac

SEQ ID NO: 303369 - DNA, 25 bp, Rattus norvegicus
gaaggacttcacgtacagcaaggac

SEQ ID NO: 303370 - DNA, 25 bp, Rattus norvegicus
gaaggacttcctaaaaattgtgcct

SEQ ID NO: 303371 - DNA, 25 bp, Rattus norvegicus
gaaggacttccttaaaattgtgcct

SEQ ID NO: 303372 - DNA, 25 bp, Rattus norvegicus
gaaggacttcgtctcctcagttgtt

SEQ ID NO: 303373 - DNA, 25 bp, Rattus norvegicus
gaaggacttcgtgtcctcagttgtt

SEQ ID NO: 303374 - DNA, 25 bp, Rattus norvegicus
gaaggacttctcagacttggctccc

SEQ ID NO: 303375 - DNA, 25 bp, Rattus norvegicus
gaaggacttctcagagttcactaca

SEQ ID NO: 303376 - DNA, 25 bp, Rattus norvegicus
gaaggacttctctgacttggctccc

SEQ ID NO: 303377 - DNA, 25 bp, Rattus norvegicus
gaaggacttctctgagttcactaca

SEQ ID NO: 303378 - DNA, 25 bp, Rattus norvegicus
gaaggacttctgcattctatcttag

SEQ ID NO: 303379 - DNA, 25 bp, Rattus norvegicus
gaaggacttctggattctatcttag

SEQ ID NO: 303380 - DNA, 25 bp, Rattus norvegicus
gaaggacttcttatcctaacccctg

SEQ ID NO: 303381 - DNA, 25 bp, Rattus norvegicus
gaaggacttcttttcctaacccctg

SEQ ID NO: 303382 - DNA, 25 bp, Rattus norvegicus
gaaggacttggaagatgctccattt

SEQ ID NO: 303383 - DNA, 25 bp, Rattus norvegicus
gaaggacttggatgatgctccattt

SEQ ID NO: 303384 - DNA, 25 bp, Rattus norvegicus
gaaggacttgtaccatctgaaccca

SEQ ID NO: 303385 - DNA, 25 bp, Rattus norvegicus
gaaggacttgtagcatctgaaccca

SEQ ID NO: 303386 - DNA, 25 bp, Rattus norvegicus
gaaggacttgtcagaatctgccact

SEQ ID NO: 303387 - DNA, 25 bp, Rattus norvegicus
gaaggacttgtctgaatctgccact

SEQ ID NO: 303388 - DNA, 25 bp, Rattus norvegicus
gaaggactttctcaggtattccatg

SEQ ID NO: 303389 - DNA, 25 bp, Rattus norvegicus
gaaggactttctgaggtattccatg

SEQ ID NO: 303390 - DNA, 25 bp, Rattus norvegicus
gaaggactttgacccacaacctggt

SEQ ID NO: 303391 - DNA, 25 bp, Rattus norvegicus
gaaggactttgagccacaacctggt

SEQ ID NO: 303392 - DNA, 25 bp, Rattus norvegicus
gaaggactttggaagcatcgcgaat

SEQ ID NO: 303393 - DNA, 25 bp, Rattus norvegicus
gaaggactttggtagcatcgcgaat

SEQ ID NO: 303394 - DNA, 25 bp, Rattus norvegicus
gaaggacttttgctctgctaaatta

SEQ ID NO: 303395 - DNA, 25 bp, Rattus norvegicus
gaaggacttttggtctgctaaatta

SEQ ID NO: 303396 - DNA, 25 bp, Rattus norvegicus
gaaggagaacttccagctgcagctt

SEQ ID NO: 303397 - DNA, 25 bp, Rattus norvegicus
gaaggagaacttgcagctgcagctt

SEQ ID NO: 303398 - DNA, 25 bp, Rattus norvegicus
gaaggagaagcgcaggcacggcctc

SEQ ID NO: 303399 - DNA, 25 bp, Rattus norvegicus
gaaggagaagcggaggcacggcctc

SEQ ID NO: 303400 - DNA, 25 bp, Rattus norvegicus
gaaggagaaggacacctctcacaga

SEQ ID NO: 303401 - DNA, 25 bp, Rattus norvegicus
gaaggagaaggagacctctcacaga

SEQ ID NO: 303402 - DNA, 25 bp, Rattus norvegicus
gaaggagaattgacacactgtgctg

SEQ ID NO: 303403 - DNA, 25 bp, Rattus norvegicus
gaaggagaattgtcacactgtgctg

SEQ ID NO: 303404 - DNA, 25 bp, Rattus norvegicus
gaaggagacatgacctcagcactgt

SEQ ID NO: 303405 - DNA, 25 bp, Rattus norvegicus
gaaggagacatgtcctcagcactgt

SEQ ID NO: 303406 - DNA, 25 bp, Rattus norvegicus
gaaggagacattcccactgtttctc

SEQ ID NO: 303407 - DNA, 25 bp, Rattus norvegicus
gaaggagacattgccactgtttctc

SEQ ID NO: 303408 - DNA, 25 bp, Rattus norvegicus
gaaggagaccagatcagcagccacc

SEQ ID NO: 303409 - DNA, 25 bp, Rattus norvegicus
gaaggagaccagttcagcagccacc

SEQ ID NO: 303410 - DNA, 25 bp, Rattus norvegicus
gaaggagaccatactattttctgaa

SEQ ID NO: 303411 - DNA, 25 bp, Rattus norvegicus
gaaggagaccattctattttctgaa

SEQ ID NO: 303412 - DNA, 25 bp, Rattus norvegicus
gaaggagacccactactatgacatc

SEQ ID NO: 303413 - DNA, 25 bp, Rattus norvegicus
gaaggagacccagtactatgacatc

SEQ ID NO: 303414 - DNA, 25 bp, Rattus norvegicus
gaaggagaccttcacagcttcttca

SEQ ID NO: 303415 - DNA, 25 bp, Rattus norvegicus
gaaggagaccttgacagcttcttca

SEQ ID NO: 303416 - DNA, 25 bp, Rattus norvegicus
gaaggagactagctgatccaccttt

SEQ ID NO: 303417 - DNA, 25 bp, Rattus norvegicus
gaaggagactaggtgatccaccttt

SEQ ID NO: 303418 - DNA, 25 bp, Rattus norvegicus
gaaggagactcaaggtcctcgtccg

SEQ ID NO: 303419 - DNA, 25 bp, Rattus norvegicus
gaaggagactcatggtcctcgtccg

SEQ ID NO: 303420 - DNA, 25 bp, Rattus norvegicus
gaaggagactccagtgctatcacag

SEQ ID NO: 303421 - DNA, 25 bp, Rattus norvegicus
gaaggagactcctgtgctatcacag

SEQ ID NO: 303422 - DNA, 25 bp, Rattus norvegicus
gaaggagactgtaacttgtcccatg

SEQ ID NO: 303423 - DNA, 25 bp, Rattus norvegicus
gaaggagactgtacattgcccaatg

SEQ ID NO: 303424 - DNA, 25 bp, Rattus norvegicus
gaaggagactgttacttgtcccatg

SEQ ID NO: 303425 - DNA, 25 bp, Rattus norvegicus
gaaggagactgttcattgcccaatg

SEQ ID NO: 303426 - DNA, 25 bp, Rattus norvegicus
gaaggagacttaatcccagctcggg

SEQ ID NO: 303427 - DNA, 25 bp, Rattus norvegicus
gaaggagacttattcccagctcggg

SEQ ID NO: 303428 - DNA, 25 bp, Rattus norvegicus
gaaggagagcaacccctgagcagaa

SEQ ID NO: 303429 - DNA, 25 bp, Rattus norvegicus
gaaggagagcaagccctgagcagaa

SEQ ID NO: 303430 - DNA, 25 bp, Rattus norvegicus
gaaggagagcacacctggctgcagt

SEQ ID NO: 303431 - DNA, 25 bp, Rattus norvegicus
gaaggagagcactcctggctgcagt

SEQ ID NO: 303432 - DNA, 25 bp, Rattus norvegicus
gaaggagagccaacccactcgagga

SEQ ID NO: 303433 - DNA, 25 bp, Rattus norvegicus
gaaggagagccatcccactcgagga

SEQ ID NO: 303434 - DNA, 25 bp, Rattus norvegicus
gaaggagaggccacctgagtgctaa

SEQ ID NO: 303435 - DNA, 25 bp, Rattus norvegicus
gaaggagaggcctcctgagtgctaa

SEQ ID NO: 303436 - DNA, 25 bp, Rattus norvegicus
gaaggagagtggctttcccttttct

SEQ ID NO: 303437 - DNA, 25 bp, Rattus norvegicus
gaaggagagtgggtttcccttttct

SEQ ID NO: 303438 - DNA, 25 bp, Rattus norvegicus
gaaggagatcagaacccatgtgggt

SEQ ID NO: 303439 - DNA, 25 bp, Rattus norvegicus
gaaggagatcagtacccatgtgggt

SEQ ID NO: 303440 - DNA, 25 bp, Rattus norvegicus
gaaggagatccacctggtgctcagt

SEQ ID NO: 303441 - DNA, 25 bp, Rattus norvegicus
gaaggagatccagctggtgctcagt

SEQ ID NO: 303442 - DNA, 25 bp, Rattus norvegicus
gaaggagatcgccagcaccctgatg

SEQ ID NO: 303443 - DNA, 25 bp, Rattus norvegicus
gaaggagatcgcgagcaccctgatg

SEQ ID NO: 303444 - DNA, 25 bp, Rattus norvegicus
gaaggagcacagacaacctgaattt

SEQ ID NO: 303445 - DNA, 25 bp, Rattus norvegicus
gaaggagcacagtcaacctgaattt

SEQ ID NO: 303446 - DNA, 25 bp, Rattus norvegicus
gaaggagcaccactttccatcacag

SEQ ID NO: 303447 - DNA, 25 bp, Rattus norvegicus
gaaggagcaccagtttccatcacag

SEQ ID NO: 303448 - DNA, 25 bp, Rattus norvegicus
gaaggagcagaaataccatgagtgt

SEQ ID NO: 303449 - DNA, 25 bp, Rattus norvegicus
gaaggagcagaattaccatgagtgt

SEQ ID NO: 303450 - DNA, 25 bp, Rattus norvegicus
gaaggagcagcaccggctcgcggct

SEQ ID NO: 303451 - DNA, 25 bp, Rattus norvegicus
gaaggagcagcagcggctcgcggct

SEQ ID NO: 303452 - DNA, 25 bp, Rattus norvegicus
gaaggagcagccacgggtgttcttc

SEQ ID NO: 303453 - DNA, 25 bp, Rattus norvegicus
gaaggagcagcctcgggtgttcttc

SEQ ID NO: 303454 - DNA, 25 bp, Rattus norvegicus
gaaggagcagttcccctgcatggct

SEQ ID NO: 303455 - DNA, 25 bp, Rattus norvegicus
gaaggagcagttcttcatgccctgg

SEQ ID NO: 303456 - DNA, 25 bp, Rattus norvegicus
gaaggagcagttgccctgcatggct

SEQ ID NO: 303457 - DNA, 25 bp, Rattus norvegicus
gaaggagcagttgttcatgccctgg

SEQ ID NO: 303458 - DNA, 25 bp, Rattus norvegicus
gaaggagcatccctatacttcctga

SEQ ID NO: 303459 - DNA, 25 bp, Rattus norvegicus
gaaggagcatccgtatacttcctga

SEQ ID NO: 303460 - DNA, 25 bp, Rattus norvegicus
gaaggagcatctatacattggaaag

SEQ ID NO: 303461 - DNA, 25 bp, Rattus norvegicus
gaaggagcatctttacattggaaag

SEQ ID NO: 303462 - DNA, 25 bp, Rattus norvegicus
gaaggagcatttagtcccacttgga

SEQ ID NO: 303463 - DNA, 25 bp, Rattus norvegicus
gaaggagcattttgtcccacttgga

SEQ ID NO: 303464 - DNA, 25 bp, Rattus norvegicus
gaaggagccaaaccacaaaacagat

SEQ ID NO: 303465 - DNA, 25 bp, Rattus norvegicus
gaaggagccaaagcacaaaacagat

SEQ ID NO: 303466 - DNA, 25 bp, Rattus norvegicus
gaaggagccactactgggagctcat

SEQ ID NO: 303467 - DNA, 25 bp, Rattus norvegicus
gaaggagccacttctgggagctcat

SEQ ID NO: 303468 - DNA, 25 bp, Rattus norvegicus
gaaggagcccctcgaattagtctgg

SEQ ID NO: 303469 - DNA, 25 bp, Rattus norvegicus
gaaggagcccctggaattagtctgg

SEQ ID NO: 303470 - DNA, 25 bp, Rattus norvegicus
gaaggagcccgcactgtccatcaag

SEQ ID NO: 303471 - DNA, 25 bp, Rattus norvegicus
gaaggagcccgctctgtccatcaag

SEQ ID NO: 303472 - DNA, 25 bp, Rattus norvegicus
gaaggagccgctcaagcctgatctt

SEQ ID NO: 303473 - DNA, 25 bp, Rattus norvegicus
gaaggagccgctgaagcctgatctt

SEQ ID NO: 303474 - DNA, 25 bp, Rattus norvegicus
gaaggagcctaccaggaagcacctg

SEQ ID NO: 303475 - DNA, 25 bp, Rattus norvegicus
gaaggagcctacctcttccagctga

SEQ ID NO: 303476 - DNA, 25 bp, Rattus norvegicus
gaaggagcctacgaggaagcacctg

SEQ ID NO: 303477 - DNA, 25 bp, Rattus norvegicus
gaaggagcctacgtcttccagctga

SEQ ID NO: 303478 - DNA, 25 bp, Rattus norvegicus
gaaggagcctcacctctggtgtcct

SEQ ID NO: 303479 - DNA, 25 bp, Rattus norvegicus
gaaggagcctcagctctggtgtcct

SEQ ID NO: 303480 - DNA, 25 bp, Rattus norvegicus
gaaggagcctgaatgtctccggttc

SEQ ID NO: 303481 - DNA, 25 bp, Rattus norvegicus
gaaggagcctgattgtctccggttc

SEQ ID NO: 303482 - DNA, 25 bp, Rattus norvegicus
gaaggagcctggatgtccttgccac

SEQ ID NO: 303483 - DNA, 25 bp, Rattus norvegicus
gaaggagcctggttgtccttgccac

SEQ ID NO: 303484 - DNA, 25 bp, Rattus norvegicus
gaaggagcgctgaagcacatgctga

SEQ ID NO: 303485 - DNA, 25 bp, Rattus norvegicus
gaaggagcgctgtagcacatgctga

SEQ ID NO: 303486 - DNA, 25 bp, Rattus norvegicus
gaaggagcggtacctcttgccacag

SEQ ID NO: 303487 - DNA, 25 bp, Rattus norvegicus
gaaggagcggtagctcttgccacag

SEQ ID NO: 303488 - DNA, 25 bp, Rattus norvegicus
gaaggagcgttcagaacctctgcac

SEQ ID NO: 303489 - DNA, 25 bp, Rattus norvegicus
gaaggagcgttctgaacctctgcac

SEQ ID NO: 303490 - DNA, 25 bp, Rattus norvegicus
gaaggagctactcacggacatttgg

SEQ ID NO: 303491 - DNA, 25 bp, Rattus norvegicus
gaaggagctactgacggacatttgg

SEQ ID NO: 303492 - DNA, 25 bp, Rattus norvegicus
gaaggagctattctcagggactgaa

SEQ ID NO: 303493 - DNA, 25 bp, Rattus norvegicus
gaaggagctattgtcagggactgaa

SEQ ID NO: 303494 - DNA, 25 bp, Rattus norvegicus
gaaggagctcccaaggcaggaatat

SEQ ID NO: 303495 - DNA, 25 bp, Rattus norvegicus
gaaggagctcccagctattttagaa

SEQ ID NO: 303496 - DNA, 25 bp, Rattus norvegicus
gaaggagctccctaggcaggaatat

SEQ ID NO: 303497 - DNA, 25 bp, Rattus norvegicus
gaaggagctccctgctattttagaa

SEQ ID NO: 303498 - DNA, 25 bp, Rattus norvegicus
gaaggagctcctacagagaatcaga

SEQ ID NO: 303499 - DNA, 25 bp, Rattus norvegicus
gaaggagctccttcagagaatcaga

SEQ ID NO: 303500 - DNA, 25 bp, Rattus norvegicus
gaaggagctctcatgccactattgt

SEQ ID NO: 303501 - DNA, 25 bp, Rattus norvegicus
gaaggagctctcttgccactattgt

SEQ ID NO: 303502 - DNA, 25 bp, Rattus norvegicus
gaaggagctcttagacaaggccaac

SEQ ID NO: 303503 - DNA, 25 bp, Rattus norvegicus
gaaggagctctttgacaaggccaac

SEQ ID NO: 303504 - DNA, 25 bp, Rattus norvegicus
gaaggagctgaactccacaatgaaa

SEQ ID NO: 303505 - DNA, 25 bp, Rattus norvegicus
gaaggagctgaagtccacaatgaaa

SEQ ID NO: 303506 - DNA, 25 bp, Rattus norvegicus
gaaggagctgacagattccgtctaa

SEQ ID NO: 303507 - DNA, 25 bp, Rattus norvegicus
gaaggagctgactgattccgtctaa

SEQ ID NO: 303508 - DNA, 25 bp, Rattus norvegicus
gaaggagctgcaagcccactgactt

SEQ ID NO: 303509 - DNA, 25 bp, Rattus norvegicus
gaaggagctgcatgcccactgactt

SEQ ID NO: 303510 - DNA, 25 bp, Rattus norvegicus
gaaggagctggtatcctgttgacca

SEQ ID NO: 303511 - DNA, 25 bp, Rattus norvegicus
gaaggagctggtttcctgttgacca

SEQ ID NO: 303512 - DNA, 25 bp, Rattus norvegicus
gaaggagcttacataccagacagaa

SEQ ID NO: 303513 - DNA, 25 bp, Rattus norvegicus
gaaggagcttacttaccagacagaa

SEQ ID NO: 303514 - DNA, 25 bp, Rattus norvegicus
gaaggagcttccagaaccagtctgt

SEQ ID NO: 303515 - DNA, 25 bp, Rattus norvegicus
gaaggagcttcctgaaccagtctgt

SEQ ID NO: 303516 - DNA, 25 bp, Rattus norvegicus
gaaggaggaacccaagtagctttgt

SEQ ID NO: 303517 - DNA, 25 bp, Rattus norvegicus
gaaggaggaaccgaagtagctttgt

SEQ ID NO: 303518 - DNA, 25 bp, Rattus norvegicus
gaaggaggaactcttgtgcccactc

SEQ ID NO: 303519 - DNA, 25 bp, Rattus norvegicus
gaaggaggaactgttgtgcccactc

SEQ ID NO: 303520 - DNA, 25 bp, Rattus norvegicus
gaaggaggaccgctttgagaacaat

SEQ ID NO: 303521 - DNA, 25 bp, Rattus norvegicus
gaaggaggaccggtttgagaacaat

SEQ ID NO: 303522 - DNA, 25 bp, Rattus norvegicus
gaaggaggagtcatgtcccattcct

SEQ ID NO: 303523 - DNA, 25 bp, Rattus norvegicus
gaaggaggagtcttgtcccattcct

SEQ ID NO: 303524 - DNA, 25 bp, Rattus norvegicus
gaaggaggagttccccacagacctg

SEQ ID NO: 303525 - DNA, 25 bp, Rattus norvegicus
gaaggaggagttgcccacagacctg

SEQ ID NO: 303526 - DNA, 25 bp, Rattus norvegicus
gaaggaggcccaaacaaacagaact

SEQ ID NO: 303527 - DNA, 25 bp, Rattus norvegicus
gaaggaggcccatacaaacagaact

SEQ ID NO: 303528 - DNA, 25 bp, Rattus norvegicus
gaaggaggcgtcacatcggaaccag

SEQ ID NO: 303529 - DNA, 25 bp, Rattus norvegicus
gaaggaggcgtctcatcggaaccag

SEQ ID NO: 303530 - DNA, 25 bp, Rattus norvegicus
gaaggaggctgcagcatcagcaccc

SEQ ID NO: 303531 - DNA, 25 bp, Rattus norvegicus
gaaggaggctgctgcatcagcaccc

SEQ ID NO: 303532 - DNA, 25 bp, Rattus norvegicus
gaaggaggctgtcccttcttctgaa

SEQ ID NO: 303533 - DNA, 25 bp, Rattus norvegicus
gaaggaggctgtgccttcttctgaa

SEQ ID NO: 303534 - DNA, 25 bp, Rattus norvegicus
gaaggagggcatccagacccgaaac

SEQ ID NO: 303535 - DNA, 25 bp, Rattus norvegicus
gaaggagggcatgcagacccgaaac

SEQ ID NO: 303536 - DNA, 25 bp, Rattus norvegicus
gaaggaggtcacagcccagcaaact

SEQ ID NO: 303537 - DNA, 25 bp, Rattus norvegicus
gaaggaggtcactgcccagcaaact

SEQ ID NO: 303538 - DNA, 25 bp, Rattus norvegicus
gaaggagtaccgcaagcccgtcgat

SEQ ID NO: 303539 - DNA, 25 bp, Rattus norvegicus
gaaggagtaccgctccaagctcata

SEQ ID NO: 303540 - DNA, 25 bp, Rattus norvegicus
gaaggagtaccggaagcccgtcgat

SEQ ID NO: 303541 - DNA, 25 bp, Rattus norvegicus
gaaggagtaccggtccaagctcata

SEQ ID NO: 303542 - DNA, 25 bp, Rattus norvegicus
gaaggagtacgtagcccttagcaaa

SEQ ID NO: 303543 - DNA, 25 bp, Rattus norvegicus
gaaggagtacgttgcccttagcaaa

SEQ ID NO: 303544 - DNA, 25 bp, Rattus norvegicus
gaaggagtactcaacgcaggcagtg

SEQ ID NO: 303545 - DNA, 25 bp, Rattus norvegicus
gaaggagtactctacgcaggcagtg

SEQ ID NO: 303546 - DNA, 25 bp, Rattus norvegicus
gaaggagtagcccagcctgactgaa

SEQ ID NO: 303547 - DNA, 25 bp, Rattus norvegicus
gaaggagtagccgagcctgactgaa

SEQ ID NO: 303548 - DNA, 25 bp, Rattus norvegicus
gaaggagtcagacccctcctctaag

SEQ ID NO: 303549 - DNA, 25 bp, Rattus norvegicus
gaaggagtcagagccctcctctaag

SEQ ID NO: 303550 - DNA, 25 bp, Rattus norvegicus
gaaggagtcatgctttgtcacaagt

SEQ ID NO: 303551 - DNA, 25 bp, Rattus norvegicus
gaaggagtcatggtttgtcacaagt

SEQ ID NO: 303552 - DNA, 25 bp, Rattus norvegicus
gaaggagtcccgcagctcccacaaa

SEQ ID NO: 303553 - DNA, 25 bp, Rattus norvegicus
gaaggagtcccggagctcccacaaa

SEQ ID NO: 303554 - DNA, 25 bp, Rattus norvegicus
gaaggagtctaaccgccagttcatc

SEQ ID NO: 303555 - DNA, 25 bp, Rattus norvegicus
gaaggagtctaagcgccagttcatc

SEQ ID NO: 303556 - DNA, 25 bp, Rattus norvegicus
gaaggagtctacagggccctcagtg

SEQ ID NO: 303557 - DNA, 25 bp, Rattus norvegicus
gaaggagtctactgggccctcagtg

SEQ ID NO: 303558 - DNA, 25 bp, Rattus norvegicus
gaaggagtctgtcacgtcagtcgat

SEQ ID NO: 303559 - DNA, 25 bp, Rattus norvegicus
gaaggagtctgtgacgtcagtcgat

SEQ ID NO: 303560 - DNA, 25 bp, Rattus norvegicus
gaaggagtgggcactgcagtcctct

SEQ ID NO: 303561 - DNA, 25 bp, Rattus norvegicus
gaaggagtgggctctgcagtcctct

SEQ ID NO: 303562 - DNA, 25 bp, Rattus norvegicus
gaaggagtgtgcacgctacacagag

SEQ ID NO: 303563 - DNA, 25 bp, Rattus norvegicus
gaaggagtgtgctcgctacacagag

SEQ ID NO: 303564 - DNA, 25 bp, Rattus norvegicus
gaaggagttacacagcgtcagctca

SEQ ID NO: 303565 - DNA, 25 bp, Rattus norvegicus
gaaggagttacagagcgtcagctca

SEQ ID NO: 303566 - DNA, 25 bp, Rattus norvegicus
gaaggagttcccctttggagactgt

SEQ ID NO: 303567 - DNA, 25 bp, Rattus norvegicus
gaaggagttcccgtttggagactgt

SEQ ID NO: 303568 - DNA, 25 bp, Rattus norvegicus
gaaggagttccgaatgtcagggcaa

SEQ ID NO: 303569 - DNA, 25 bp, Rattus norvegicus
gaaggagttccgtatgtcagggcaa

SEQ ID NO: 303570 - DNA, 25 bp, Rattus norvegicus
gaaggagttctaccggagactgtct

SEQ ID NO: 303571 - DNA, 25 bp, Rattus norvegicus
gaaggagttctagcggagactgtct

SEQ ID NO: 303572 - DNA, 25 bp, Rattus norvegicus
gaaggagttgttagcctaccacttt

SEQ ID NO: 303573 - DNA, 25 bp, Rattus norvegicus
gaaggagttgtttgcctaccacttt

SEQ ID NO: 303574 - DNA, 25 bp, Rattus norvegicus
gaaggagtttccatatgccgatgcc

SEQ ID NO: 303575 - DNA, 25 bp, Rattus norvegicus
gaaggagtttccttatgccgatgcc

SEQ ID NO: 303576 - DNA, 25 bp, Rattus norvegicus
gaaggataaaaaccctcggtgcttc

SEQ ID NO: 303577 - DNA, 25 bp, Rattus norvegicus
gaaggataaaaagcctcggtgcttc

SEQ ID NO: 303578 - DNA, 25 bp, Rattus norvegicus
gaaggatacgctcaccacagcacca

SEQ ID NO: 303579 - DNA, 25 bp, Rattus norvegicus
gaaggatacgctgaccacagcacca

SEQ ID NO: 303580 - DNA, 25 bp, Rattus norvegicus
gaaggatacgttattaccacagtgt

SEQ ID NO: 303581 - DNA, 25 bp, Rattus norvegicus
gaaggatacgtttttaccacagtgt

SEQ ID NO: 303582 - DNA, 25 bp, Rattus norvegicus
gaaggatagcttcatctgtcaaact

SEQ ID NO: 303583 - DNA, 25 bp, Rattus norvegicus
gaaggatagcttgatctgtcaaact

SEQ ID NO: 303584 - DNA, 25 bp, Rattus norvegicus
gaaggatagttcaccacgagctgct

SEQ ID NO: 303585 - DNA, 25 bp, Rattus norvegicus
gaaggatagttctccacgagctgct

SEQ ID NO: 303586 - DNA, 25 bp, Rattus norvegicus
gaaggatatcgacctcttgtacccc

SEQ ID NO: 303587 - DNA, 25 bp, Rattus norvegicus
gaaggatatcgagctcttgtacccc

SEQ ID NO: 303588 - DNA, 25 bp, Rattus norvegicus
gaaggatatggtcctctatttctaa

SEQ ID NO: 303589 - DNA, 25 bp, Rattus norvegicus
gaaggatatggtgctctatttctaa

SEQ ID NO: 303590 - DNA, 25 bp, Rattus norvegicus
gaaggatatgttccatcagccgtac

SEQ ID NO: 303591 - DNA, 25 bp, Rattus norvegicus
gaaggatatgttgcatcagccgtac

SEQ ID NO: 303592 - DNA, 25 bp, Rattus norvegicus
gaaggatcacaacctcaatggaagg

SEQ ID NO: 303593 - DNA, 25 bp, Rattus norvegicus
gaaggatcacaagctcaatggaagg

SEQ ID NO: 303594 - DNA, 25 bp, Rattus norvegicus
gaaggatcactgaccatttgagagt

SEQ ID NO: 303595 - DNA, 25 bp, Rattus norvegicus
gaaggatcactgtccatttgagagt

SEQ ID NO: 303596 - DNA, 25 bp, Rattus norvegicus
gaaggatcagaactttaagtctata

SEQ ID NO: 303597 - DNA, 25 bp, Rattus norvegicus
gaaggatcagaagtttaagtctata

SEQ ID NO: 303598 - DNA, 25 bp, Rattus norvegicus
gaaggatcagctaagtggcactaga

SEQ ID NO: 303599 - DNA, 25 bp, Rattus norvegicus
gaaggatcagcttagtggcactaga

SEQ ID NO: 303600 - DNA, 25 bp, Rattus norvegicus
gaaggatcattcacacaattgccga

SEQ ID NO: 303601 - DNA, 25 bp, Rattus norvegicus
gaaggatcattctcacaattgccga

SEQ ID NO: 303602 - DNA, 25 bp, Rattus norvegicus
gaaggatccactcctccaggacaag

SEQ ID NO: 303603 - DNA, 25 bp, Rattus norvegicus
gaaggatccactgctccaggacaag

SEQ ID NO: 303604 - DNA, 25 bp, Rattus norvegicus
gaaggatccagaatgcgctgtctcc

SEQ ID NO: 303605 - DNA, 25 bp, Rattus norvegicus
gaaggatccagattgcgctgtctcc

SEQ ID NO: 303606 - DNA, 25 bp, Rattus norvegicus
gaaggatccagcacctgtacatata

SEQ ID NO: 303607 - DNA, 25 bp, Rattus norvegicus
gaaggatccagctcctgtacatata

SEQ ID NO: 303608 - DNA, 25 bp, Rattus norvegicus
gaaggatccatgatctcagccagaa

SEQ ID NO: 303609 - DNA, 25 bp, Rattus norvegicus
gaaggatccatgttctcagccagaa

SEQ ID NO: 303610 - DNA, 25 bp, Rattus norvegicus
gaaggatccctgagcctgaggataa

SEQ ID NO: 303611 - DNA, 25 bp, Rattus norvegicus
gaaggatccctgtgcctgaggataa

SEQ ID NO: 303612 - DNA, 25 bp, Rattus norvegicus
gaaggatccttaatgaattgccact

SEQ ID NO: 303613 - DNA, 25 bp, Rattus norvegicus
gaaggatccttactgtcacaagttt

SEQ ID NO: 303614 - DNA, 25 bp, Rattus norvegicus
gaaggatccttagtgtcacaagttt

SEQ ID NO: 303615 - DNA, 25 bp, Rattus norvegicus
gaaggatccttattgaattgccact

SEQ ID NO: 303616 - DNA, 25 bp, Rattus norvegicus
gaaggatctctactcactacatttt

SEQ ID NO: 303617 - DNA, 25 bp, Rattus norvegicus
gaaggatctctagtcactacatttt

SEQ ID NO: 303618 - DNA, 25 bp, Rattus norvegicus
gaaggatctctgagctgtaaactaa

SEQ ID NO: 303619 - DNA, 25 bp, Rattus norvegicus
gaaggatctctgtgctgtaaactaa

SEQ ID NO: 303620 - DNA, 25 bp, Rattus norvegicus
gaaggatctcttcagtttacgacca

SEQ ID NO: 303621 - DNA, 25 bp, Rattus norvegicus
gaaggatctcttgagtttacgacca

SEQ ID NO: 303622 - DNA, 25 bp, Rattus norvegicus
gaaggatctgaacccatgcagcgat

SEQ ID NO: 303623 - DNA, 25 bp, Rattus norvegicus
gaaggatctgaagccatgcagcgat

SEQ ID NO: 303624 - DNA, 25 bp, Rattus norvegicus
gaaggatctggtatgacctcctggc

SEQ ID NO: 303625 - DNA, 25 bp, Rattus norvegicus
gaaggatctggtttgacctcctggc

SEQ ID NO: 303626 - DNA, 25 bp, Rattus norvegicus
gaaggatcttaaatgcagtgcgtaa

SEQ ID NO: 303627 - DNA, 25 bp, Rattus norvegicus
gaaggatcttaattgcagtgcgtaa

SEQ ID NO: 303628 - DNA, 25 bp, Rattus norvegicus
gaaggatcttccatcacagtgactt

SEQ ID NO: 303629 - DNA, 25 bp, Rattus norvegicus
gaaggatcttccttcacagtgactt

SEQ ID NO: 303630 - DNA, 25 bp, Rattus norvegicus
gaaggatctttgaaattgtcataac

SEQ ID NO: 303631 - DNA, 25 bp, Rattus norvegicus
gaaggatctttgtaattgtcataac

SEQ ID NO: 303632 - DNA, 25 bp, Rattus norvegicus
gaaggatgacaaagaaacgccagct

SEQ ID NO: 303633 - DNA, 25 bp, Rattus norvegicus
gaaggatgacaactgagggctctct

SEQ ID NO: 303634 - DNA, 25 bp, Rattus norvegicus
gaaggatgacaagtgagggctctct

SEQ ID NO: 303635 - DNA, 25 bp, Rattus norvegicus
gaaggatgacaatgaaacgccagct

SEQ ID NO: 303636 - DNA, 25 bp, Rattus norvegicus
gaaggatgagcgcacccaccacgaa

SEQ ID NO: 303637 - DNA, 25 bp, Rattus norvegicus
gaaggatgagcggacccaccacgaa

SEQ ID NO: 303638 - DNA, 25 bp, Rattus norvegicus
gaaggatgcaatcccaaagccaccc

SEQ ID NO: 303639 - DNA, 25 bp, Rattus norvegicus
gaaggatgcaatgccaaagccaccc

SEQ ID NO: 303640 - DNA, 25 bp, Rattus norvegicus
gaaggatgccaaatctgtcaagatc

SEQ ID NO: 303641 - DNA, 25 bp, Rattus norvegicus
gaaggatgccaaccagggcctgccc

SEQ ID NO: 303642 - DNA, 25 bp, Rattus norvegicus
gaaggatgccaagcagggcctgccc

SEQ ID NO: 303643 - DNA, 25 bp, Rattus norvegicus
gaaggatgccaattctgtcaagatc

SEQ ID NO: 303644 - DNA, 25 bp, Rattus norvegicus
gaaggatgccatcttgttaaccgat

SEQ ID NO: 303645 - DNA, 25 bp, Rattus norvegicus
gaaggatgccatgttgttaaccgat

SEQ ID NO: 303646 - DNA, 25 bp, Rattus norvegicus
gaaggatgccccacctgccaattgg

SEQ ID NO: 303647 - DNA, 25 bp, Rattus norvegicus
gaaggatgcccctcctgccaattgg

SEQ ID NO: 303648 - DNA, 25 bp, Rattus norvegicus
gaaggatgccggaaagtcggccaaa

SEQ ID NO: 303649 - DNA, 25 bp, Rattus norvegicus
gaaggatgccggtaagtcggccaaa

SEQ ID NO: 303650 - DNA, 25 bp, Rattus norvegicus
gaaggatgccttccacactgttgta

SEQ ID NO: 303651 - DNA, 25 bp, Rattus norvegicus
gaaggatgccttgcacactgttgta

SEQ ID NO: 303652 - DNA, 25 bp, Rattus norvegicus
gaaggatgctttatgttattagctg

SEQ ID NO: 303653 - DNA, 25 bp, Rattus norvegicus
gaaggatgctttttgttattagctg

SEQ ID NO: 303654 - DNA, 25 bp, Rattus norvegicus
gaaggatggctaagttctggctttt

SEQ ID NO: 303655 - DNA, 25 bp, Rattus norvegicus
gaaggatggctatgttctggctttt

SEQ ID NO: 303656 - DNA, 25 bp, Rattus norvegicus
gaaggatggcttcccagaatcttct

SEQ ID NO: 303657 - DNA, 25 bp, Rattus norvegicus
gaaggatggcttgccagaatcttct

SEQ ID NO: 303658 - DNA, 25 bp, Rattus norvegicus
gaaggatgtataaccctcagggctg

SEQ ID NO: 303659 - DNA, 25 bp, Rattus norvegicus
gaaggatgtatatccctcagggctg

SEQ ID NO: 303660 - DNA, 25 bp, Rattus norvegicus
gaaggatgtcagcagtccctcactt

SEQ ID NO: 303661 - DNA, 25 bp, Rattus norvegicus
gaaggatgtcaggagtccctcactt

SEQ ID NO: 303662 - DNA, 25 bp, Rattus norvegicus
gaaggatgtctgatcccaacagcag

SEQ ID NO: 303663 - DNA, 25 bp, Rattus norvegicus
gaaggatgtctgttcccaacagcag

SEQ ID NO: 303664 - DNA, 25 bp, Rattus norvegicus
gaaggatgtgaaccccagtcctctt

SEQ ID NO: 303665 - DNA, 25 bp, Rattus norvegicus
gaaggatgtgaagcccagtcctctt

SEQ ID NO: 303666 - DNA, 25 bp, Rattus norvegicus
gaaggatgtgttccacctagcactg

SEQ ID NO: 303667 - DNA, 25 bp, Rattus norvegicus
gaaggatgtgttctccattctcact

SEQ ID NO: 303668 - DNA, 25 bp, Rattus norvegicus
gaaggatgtgttgcacctagcactg

SEQ ID NO: 303669 - DNA, 25 bp, Rattus norvegicus
gaaggatgtgttgtccattctcact

SEQ ID NO: 303670 - DNA, 25 bp, Rattus norvegicus
gaaggatgttccaacagctctacct

SEQ ID NO: 303671 - DNA, 25 bp, Rattus norvegicus
gaaggatgttcctacagctctacct

SEQ ID NO: 303672 - DNA, 25 bp, Rattus norvegicus
gaaggatgtttcctgtggttccaga

SEQ ID NO: 303673 - DNA, 25 bp, Rattus norvegicus
gaaggatgtttcgtgtggttccaga

SEQ ID NO: 303674 - DNA, 25 bp, Rattus norvegicus
gaaggattatctaagattcctcaga

SEQ ID NO: 303675 - DNA, 25 bp, Rattus norvegicus
gaaggattatcttagattcctcaga

SEQ ID NO: 303676 - DNA, 25 bp, Rattus norvegicus
gaaggattattgactctgtattaga

SEQ ID NO: 303677 - DNA, 25 bp, Rattus norvegicus
gaaggattattgtctctgtattaga

SEQ ID NO: 303678 - DNA, 25 bp, Rattus norvegicus
gaaggattatttccaacaatctttg

SEQ ID NO: 303679 - DNA, 25 bp, Rattus norvegicus
gaaggattatttgcaacaatctttg

SEQ ID NO: 303680 - DNA, 25 bp, Rattus norvegicus
gaaggattcagtatatccccgcctg

SEQ ID NO: 303681 - DNA, 25 bp, Rattus norvegicus
gaaggattcagtttatccccgcctg

SEQ ID NO: 303682 - DNA, 25 bp, Rattus norvegicus
gaaggattccctatttcatatggtt

SEQ ID NO: 303683 - DNA, 25 bp, Rattus norvegicus
gaaggattccctcagcaccacaggg

SEQ ID NO: 303684 - DNA, 25 bp, Rattus norvegicus
gaaggattccctgagcaccacaggg

SEQ ID NO: 303685 - DNA, 25 bp, Rattus norvegicus
gaaggattccctttttcatatggtt

SEQ ID NO: 303686 - DNA, 25 bp, Rattus norvegicus
gaaggattctccactgtcataacaa

SEQ ID NO: 303687 - DNA, 25 bp, Rattus norvegicus
gaaggattctcctctgtcataacaa

SEQ ID NO: 303688 - DNA, 25 bp, Rattus norvegicus
gaaggattctctcagtgttgcacat

SEQ ID NO: 303689 - DNA, 25 bp, Rattus norvegicus
gaaggattctctgagtgttgcacat

SEQ ID NO: 303690 - DNA, 25 bp, Rattus norvegicus
gaaggattcttcataccattttgct

SEQ ID NO: 303691 - DNA, 25 bp, Rattus norvegicus
gaaggattcttcttaccattttgct

SEQ ID NO: 303692 - DNA, 25 bp, Rattus norvegicus
gaaggattctttaactgcccagagt

SEQ ID NO: 303693 - DNA, 25 bp, Rattus norvegicus
gaaggattcttttactgcccagagt

SEQ ID NO: 303694 - DNA, 25 bp, Rattus norvegicus
gaaggattgagaccttcccaccgtc

SEQ ID NO: 303695 - DNA, 25 bp, Rattus norvegicus
gaaggattgagagcttcccaccgtc

SEQ ID NO: 303696 - DNA, 25 bp, Rattus norvegicus
gaaggattgcacctgccgggacctc

SEQ ID NO: 303697 - DNA, 25 bp, Rattus norvegicus
gaaggattgcacgtgccgggacctc

SEQ ID NO: 303698 - DNA, 25 bp, Rattus norvegicus
gaaggattgccgaccagtttttggg

SEQ ID NO: 303699 - DNA, 25 bp, Rattus norvegicus
gaaggattgccgtccagtttttggg

SEQ ID NO: 303700 - DNA, 25 bp, Rattus norvegicus
gaaggattggtacttctccatgtta

SEQ ID NO: 303701 - DNA, 25 bp, Rattus norvegicus
gaaggattggtagttctccatgtta

SEQ ID NO: 303702 - DNA, 25 bp, Rattus norvegicus
gaaggatttcagagcagccagcaga

SEQ ID NO: 303703 - DNA, 25 bp, Rattus norvegicus
gaaggatttcagtgcagccagcaga

SEQ ID NO: 303704 - DNA, 25 bp, Rattus norvegicus
gaaggatttcctcacagctttagaa

SEQ ID NO: 303705 - DNA, 25 bp, Rattus norvegicus
gaaggatttcctgacagctttagaa

SEQ ID NO: 303706 - DNA, 25 bp, Rattus norvegicus
gaaggatttctgcttccagctccaa

SEQ ID NO: 303707 - DNA, 25 bp, Rattus norvegicus
gaaggatttctggttccagctccaa

SEQ ID NO: 303708 - DNA, 25 bp, Rattus norvegicus
gaaggatttgttcctggcatcagca

SEQ ID NO: 303709 - DNA, 25 bp, Rattus norvegicus
gaaggatttgttgctggcatcagca

SEQ ID NO: 303710 - DNA, 25 bp, Rattus norvegicus
gaaggattttcacatactcatgcac

SEQ ID NO: 303711 - DNA, 25 bp, Rattus norvegicus
gaaggattttcagatactcatgcac

SEQ ID NO: 303712 - DNA, 25 bp, Rattus norvegicus
gaaggattttctatgctaactccct

SEQ ID NO: 303713 - DNA, 25 bp, Rattus norvegicus
gaaggattttctttgctaactccct

SEQ ID NO: 303714 - DNA, 25 bp, Rattus norvegicus
gaaggcaaaactactccctgtttca

SEQ ID NO: 303715 - DNA, 25 bp, Rattus norvegicus
gaaggcaaaacttctccctgtttca

SEQ ID NO: 303716 - DNA, 25 bp, Rattus norvegicus
gaaggcaaaagcctccatctgactt

SEQ ID NO: 303717 - DNA, 25 bp, Rattus norvegicus
gaaggcaaaagcgtccatctgactt

SEQ ID NO: 303718 - DNA, 25 bp, Rattus norvegicus
gaaggcaaatcgcttcctgctggcc

SEQ ID NO: 303719 - DNA, 25 bp, Rattus norvegicus
gaaggcaaatcggttcctgctggcc

SEQ ID NO: 303720 - DNA, 25 bp, Rattus norvegicus
gaaggcaacagtattctaccagtgc

SEQ ID NO: 303721 - DNA, 25 bp, Rattus norvegicus
gaaggcaacagttttctaccagtgc

SEQ ID NO: 303722 - DNA, 25 bp, Rattus norvegicus
gaaggcaacccacgaagctttcatg

SEQ ID NO: 303723 - DNA, 25 bp, Rattus norvegicus
gaaggcaacccaggaagctttcatg

SEQ ID NO: 303724 - DNA, 25 bp, Rattus norvegicus
gaaggcaacgctctgctgagacgac

SEQ ID NO: 303725 - DNA, 25 bp, Rattus norvegicus
gaaggcaacgctgtgctgagacgac

SEQ ID NO: 303726 - DNA, 25 bp, Rattus norvegicus
gaaggcaacggaacgctgagtgtct

SEQ ID NO: 303727 - DNA, 25 bp, Rattus norvegicus
gaaggcaacggatcgctgagtgtct

SEQ ID NO: 303728 - DNA, 25 bp, Rattus norvegicus
gaaggcaagaaaccttttcaccaaa

SEQ ID NO: 303729 - DNA, 25 bp, Rattus norvegicus
gaaggcaagaaagcttttcaccaaa

SEQ ID NO: 303730 - DNA, 25 bp, Rattus norvegicus
gaaggcaagccacgttacctcgggc

SEQ ID NO: 303731 - DNA, 25 bp, Rattus norvegicus
gaaggcaagccaggttacctcgggc

SEQ ID NO: 303732 - DNA, 25 bp, Rattus norvegicus
gaaggcaagccccagctcaagtttg

SEQ ID NO: 303733 - DNA, 25 bp, Rattus norvegicus
gaaggcaagcccgagctcaagtttg

SEQ ID NO: 303734 - DNA, 25 bp, Rattus norvegicus
gaaggcaaggcacactgagctagaa

SEQ ID NO: 303735 - DNA, 25 bp, Rattus norvegicus
gaaggcaaggcagactgagctagaa

SEQ ID NO: 303736 - DNA, 25 bp, Rattus norvegicus
gaaggcaaggctcccgtgtccacaa

SEQ ID NO: 303737 - DNA, 25 bp, Rattus norvegicus
gaaggcaaggctgccgtgtccacaa

SEQ ID NO: 303738 - DNA, 25 bp, Rattus norvegicus
gaaggcaataaactccagattcagc

SEQ ID NO: 303739 - DNA, 25 bp, Rattus norvegicus
gaaggcaataaagtccagattcagc

SEQ ID NO: 303740 - DNA, 25 bp, Rattus norvegicus
gaaggcaatgacacgattatgtgcg

SEQ ID NO: 303741 - DNA, 25 bp, Rattus norvegicus
gaaggcaatgactcgattatgtgcg

SEQ ID NO: 303742 - DNA, 25 bp, Rattus norvegicus
gaaggcacaagtagactgtacatca

SEQ ID NO: 303743 - DNA, 25 bp, Rattus norvegicus
gaaggcacaagttgactgtacatca

SEQ ID NO: 303744 - DNA, 25 bp, Rattus norvegicus
gaaggcacacccctgaaatggtgag

SEQ ID NO: 303745 - DNA, 25 bp, Rattus norvegicus
gaaggcacacccgtgaaatggtgag

SEQ ID NO: 303746 - DNA, 25 bp, Rattus norvegicus
gaaggcacagccaatgatttttgta

SEQ ID NO: 303747 - DNA, 25 bp, Rattus norvegicus
gaaggcacagcctatgatttttgta

SEQ ID NO: 303748 - DNA, 25 bp, Rattus norvegicus
gaaggcacatggatccctctaaaaa

SEQ ID NO: 303749 - DNA, 25 bp, Rattus norvegicus
gaaggcacatggttccctctaaaaa

SEQ ID NO: 303750 - DNA, 25 bp, Rattus norvegicus
gaaggcaccaagctcgatgatgact

SEQ ID NO: 303751 - DNA, 25 bp, Rattus norvegicus
gaaggcaccaaggtcgatgatgact

SEQ ID NO: 303752 - DNA, 25 bp, Rattus norvegicus
gaaggcaccatacatcactgtatgt

SEQ ID NO: 303753 - DNA, 25 bp, Rattus norvegicus
gaaggcaccatagatcactgtatgt

SEQ ID NO: 303754 - DNA, 25 bp, Rattus norvegicus
gaaggcaccccacgatcaaatagga

SEQ ID NO: 303755 - DNA, 25 bp, Rattus norvegicus
gaaggcaccccaggatcaaatagga

SEQ ID NO: 303756 - DNA, 25 bp, Rattus norvegicus
gaaggcaccctaattgtcaatgact

SEQ ID NO: 303757 - DNA, 25 bp, Rattus norvegicus
gaaggcaccctatttgtcaatgact

SEQ ID NO: 303758 - DNA, 25 bp, Rattus norvegicus
gaaggcaccctcacgtcggtaggtc

SEQ ID NO: 303759 - DNA, 25 bp, Rattus norvegicus
gaaggcaccctctcgtcggtaggtc

SEQ ID NO: 303760 - DNA, 25 bp, Rattus norvegicus
gaaggcaccgcgagacagcgcagct

SEQ ID NO: 303761 - DNA, 25 bp, Rattus norvegicus
gaaggcaccgcgtgacagcgcagct

SEQ ID NO: 303762 - DNA, 25 bp, Rattus norvegicus
gaaggcacctgtcactaagacagca

SEQ ID NO: 303763 - DNA, 25 bp, Rattus norvegicus
gaaggcacctgtgactaagacagca

SEQ ID NO: 303764 - DNA, 25 bp, Rattus norvegicus
gaaggcacgcacctgacggctgcac

SEQ ID NO: 303765 - DNA, 25 bp, Rattus norvegicus
gaaggcacgcacctggtccatgaag

SEQ ID NO: 303766 - DNA, 25 bp, Rattus norvegicus
gaaggcacgcacgtgacggctgcac

SEQ ID NO: 303767 - DNA, 25 bp, Rattus norvegicus
gaaggcacgcacgtggtccatgaag

SEQ ID NO: 303768 - DNA, 25 bp, Rattus norvegicus
gaaggcacgcccctttaccaactgg

SEQ ID NO: 303769 - DNA, 25 bp, Rattus norvegicus
gaaggcacgcccgtttaccaactgg

SEQ ID NO: 303770 - DNA, 25 bp, Rattus norvegicus
gaaggcactcagcttccctgaggag

SEQ ID NO: 303771 - DNA, 25 bp, Rattus norvegicus
gaaggcactcaggttccctgaggag

SEQ ID NO: 303772 - DNA, 25 bp, Rattus norvegicus
gaaggcactcgaagcacaagtgtgc

SEQ ID NO: 303773 - DNA, 25 bp, Rattus norvegicus
gaaggcactcgatgcacaagtgtgc

SEQ ID NO: 303774 - DNA, 25 bp, Rattus norvegicus
gaaggcactgacagtgcctcctgag

SEQ ID NO: 303775 - DNA, 25 bp, Rattus norvegicus
gaaggcactgaccactatcgtcatt

SEQ ID NO: 303776 - DNA, 25 bp, Rattus norvegicus
gaaggcactgacgactatcgtcatt

SEQ ID NO: 303777 - DNA, 25 bp, Rattus norvegicus
gaaggcactgactgtgcctcctgag

SEQ ID NO: 303778 - DNA, 25 bp, Rattus norvegicus
gaaggcactgatctcaaaccctggc

SEQ ID NO: 303779 - DNA, 25 bp, Rattus norvegicus
gaaggcactgatgtcaaaccctggc

SEQ ID NO: 303780 - DNA, 25 bp, Rattus norvegicus
gaaggcactggaatgaagagacaca

SEQ ID NO: 303781 - DNA, 25 bp, Rattus norvegicus
gaaggcactggattgaagagacaca

SEQ ID NO: 303782 - DNA, 25 bp, Rattus norvegicus
gaaggcactgggatgccacctgttg

SEQ ID NO: 303783 - DNA, 25 bp, Rattus norvegicus
gaaggcactgggttgccacctgttg

SEQ ID NO: 303784 - DNA, 25 bp, Rattus norvegicus
gaaggcactgtgacacgatcacacc

SEQ ID NO: 303785 - DNA, 25 bp, Rattus norvegicus
gaaggcactgtgtcacgatcacacc

SEQ ID NO: 303786 - DNA, 25 bp, Rattus norvegicus
gaaggcacttctagcgtcaaaatga

SEQ ID NO: 303787 - DNA, 25 bp, Rattus norvegicus
gaaggcacttcttgcgtcaaaatga

SEQ ID NO: 303788 - DNA, 25 bp, Rattus norvegicus
gaaggcactttaagacttactattg

SEQ ID NO: 303789 - DNA, 25 bp, Rattus norvegicus
gaaggcactttatgacttactattg

SEQ ID NO: 303790 - DNA, 25 bp, Rattus norvegicus
gaaggcagaactaaaccagctctca

SEQ ID NO: 303791 - DNA, 25 bp, Rattus norvegicus
gaaggcagaactacaagcctcgcct

SEQ ID NO: 303792 - DNA, 25 bp, Rattus norvegicus
gaaggcagaacttaaccagctctca

SEQ ID NO: 303793 - DNA, 25 bp, Rattus norvegicus
gaaggcagaacttcaagcctcgcct

SEQ ID NO: 303794 - DNA, 25 bp, Rattus norvegicus
gaaggcagacccctaccagtatgtg

SEQ ID NO: 303795 - DNA, 25 bp, Rattus norvegicus
gaaggcagacccgtaccagtatgtg

SEQ ID NO: 303796 - DNA, 25 bp, Rattus norvegicus
gaaggcagagaccaatctgtggttt

SEQ ID NO: 303797 - DNA, 25 bp, Rattus norvegicus
gaaggcagagaccaggatcccctga

SEQ ID NO: 303798 - DNA, 25 bp, Rattus norvegicus
gaaggcagagacgaatctgtggttt

SEQ ID NO: 303799 - DNA, 25 bp, Rattus norvegicus
gaaggcagagacgaggatcccctga

SEQ ID NO: 303800 - DNA, 25 bp, Rattus norvegicus
gaaggcagagagacaaaggtcacat

SEQ ID NO: 303801 - DNA, 25 bp, Rattus norvegicus
gaaggcagagagtcaaaggtcacat

SEQ ID NO: 303802 - DNA, 25 bp, Rattus norvegicus
gaaggcagatgcagctctaacacta

SEQ ID NO: 303803 - DNA, 25 bp, Rattus norvegicus
gaaggcagatgctgctctaacacta

SEQ ID NO: 303804 - DNA, 25 bp, Rattus norvegicus
gaaggcagcacacgtcttggagtat

SEQ ID NO: 303805 - DNA, 25 bp, Rattus norvegicus
gaaggcagcacaggtcttggagtat

SEQ ID NO: 303806 - DNA, 25 bp, Rattus norvegicus
gaaggcagcagaaagcaccagctcc

SEQ ID NO: 303807 - DNA, 25 bp, Rattus norvegicus
gaaggcagcagacgtctacacccgg

SEQ ID NO: 303808 - DNA, 25 bp, Rattus norvegicus
gaaggcagcagaggtctacacccgg

SEQ ID NO: 303809 - DNA, 25 bp, Rattus norvegicus
gaaggcagcagatagcaccagctcc

SEQ ID NO: 303810 - DNA, 25 bp, Rattus norvegicus
gaaggcagcaggagccaccggaaac

SEQ ID NO: 303811 - DNA, 25 bp, Rattus norvegicus
gaaggcagcaggtgccaccggaaac

SEQ ID NO: 303812 - DNA, 25 bp, Rattus norvegicus
gaaggcagcatacaacgctttctag

SEQ ID NO: 303813 - DNA, 25 bp, Rattus norvegicus
gaaggcagcatagaacgctttctag

SEQ ID NO: 303814 - DNA, 25 bp, Rattus norvegicus
gaaggcagccctattgataacattg

SEQ ID NO: 303815 - DNA, 25 bp, Rattus norvegicus
gaaggcagcccttttgataacattg

SEQ ID NO: 303816 - DNA, 25 bp, Rattus norvegicus
gaaggcagccttcggtaaaaggcct

SEQ ID NO: 303817 - DNA, 25 bp, Rattus norvegicus
gaaggcagccttgggtaaaaggcct

SEQ ID NO: 303818 - DNA, 25 bp, Rattus norvegicus
gaaggcagcgtaatttcatcagtac

SEQ ID NO: 303819 - DNA, 25 bp, Rattus norvegicus
gaaggcagcgtattttcatcagtac

SEQ ID NO: 303820 - DNA, 25 bp, Rattus norvegicus
gaaggcagctacctgggccagcact

SEQ ID NO: 303821 - DNA, 25 bp, Rattus norvegicus
gaaggcagctacgtgggccagcact

SEQ ID NO: 303822 - DNA, 25 bp, Rattus norvegicus
gaaggcagctcccatcacagctcaa

SEQ ID NO: 303823 - DNA, 25 bp, Rattus norvegicus
gaaggcagctccgatcacagctcaa

SEQ ID NO: 303824 - DNA, 25 bp, Rattus norvegicus
gaaggcagctgcacctctcaagaag

SEQ ID NO: 303825 - DNA, 25 bp, Rattus norvegicus
gaaggcagctgctcctctcaagaag

SEQ ID NO: 303826 - DNA, 25 bp, Rattus norvegicus
gaaggcagcttcaggcaacgacaag

SEQ ID NO: 303827 - DNA, 25 bp, Rattus norvegicus
gaaggcagcttctggcaacgacaag

SEQ ID NO: 303828 - DNA, 25 bp, Rattus norvegicus
gaaggcagcttgagcatcctgacat

SEQ ID NO: 303829 - DNA, 25 bp, Rattus norvegicus
gaaggcagcttgtgcatcctgacat

SEQ ID NO: 303830 - DNA, 25 bp, Rattus norvegicus
gaaggcagctttagtcattgctcct

SEQ ID NO: 303831 - DNA, 25 bp, Rattus norvegicus
gaaggcagcttttgtcattgctcct

SEQ ID NO: 303832 - DNA, 25 bp, Rattus norvegicus
gaaggcaggaaaataccgtagttgt

SEQ ID NO: 303833 - DNA, 25 bp, Rattus norvegicus
gaaggcaggaaattaccgtagttgt

SEQ ID NO: 303834 - DNA, 25 bp, Rattus norvegicus
gaaggcaggaacacttagctctaat

SEQ ID NO: 303835 - DNA, 25 bp, Rattus norvegicus
gaaggcaggaactcttagctctaat

SEQ ID NO: 303836 - DNA, 25 bp, Rattus norvegicus
gaaggcaggaccaagtcgtttttga

SEQ ID NO: 303837 - DNA, 25 bp, Rattus norvegicus
gaaggcaggacctagtcgtttttga

SEQ ID NO: 303838 - DNA, 25 bp, Rattus norvegicus
gaaggcaggcacacaacggtaactt

SEQ ID NO: 303839 - DNA, 25 bp, Rattus norvegicus
gaaggcaggcactcaacggtaactt

SEQ ID NO: 303840 - DNA, 25 bp, Rattus norvegicus
gaaggcaggcccactgggacttaaa

SEQ ID NO: 303841 - DNA, 25 bp, Rattus norvegicus
gaaggcaggccctctgggacttaaa

SEQ ID NO: 303842 - DNA, 25 bp, Rattus norvegicus
gaaggcaggcgcagggactccacat

SEQ ID NO: 303843 - DNA, 25 bp, Rattus norvegicus
gaaggcaggcgctgggactccacat

SEQ ID NO: 303844 - DNA, 25 bp, Rattus norvegicus
gaaggcaggctgaacaactcaacca

SEQ ID NO: 303845 - DNA, 25 bp, Rattus norvegicus
gaaggcaggctgtacaactcaacca

SEQ ID NO: 303846 - DNA, 25 bp, Rattus norvegicus
gaaggcagggaccacctctttgtct

SEQ ID NO: 303847 - DNA, 25 bp, Rattus norvegicus
gaaggcagggacgacctctttgtct

SEQ ID NO: 303848 - DNA, 25 bp, Rattus norvegicus
gaaggcaggtaactcttatgacact

SEQ ID NO: 303849 - DNA, 25 bp, Rattus norvegicus
gaaggcaggtaagtcttatgacact

SEQ ID NO: 303850 - DNA, 25 bp, Rattus norvegicus
gaaggcagtatgatgtagttccaca

SEQ ID NO: 303851 - DNA, 25 bp, Rattus norvegicus
gaaggcagtatgttgtagttccaca

SEQ ID NO: 303852 - DNA, 25 bp, Rattus norvegicus
gaaggcagtcaacagtctcagatca

SEQ ID NO: 303853 - DNA, 25 bp, Rattus norvegicus
gaaggcagtcaagagtctcagatca

SEQ ID NO: 303854 - DNA, 25 bp, Rattus norvegicus
gaaggcagtgaacgccaccctggtc

SEQ ID NO: 303855 - DNA, 25 bp, Rattus norvegicus
gaaggcagtgaaggccaccctggtc

SEQ ID NO: 303856 - DNA, 25 bp, Rattus norvegicus
gaaggcagtgatcgagcccttccct

SEQ ID NO: 303857 - DNA, 25 bp, Rattus norvegicus
gaaggcagtgatggagcccttccct

SEQ ID NO: 303858 - DNA, 25 bp, Rattus norvegicus
gaaggcagtgctctgcccaatccga

SEQ ID NO: 303859 - DNA, 25 bp, Rattus norvegicus
gaaggcagtgctgtgcccaatccga

SEQ ID NO: 303860 - DNA, 25 bp, Rattus norvegicus
gaaggcagtggcatgcaatccagaa

SEQ ID NO: 303861 - DNA, 25 bp, Rattus norvegicus
gaaggcagtggcttgcaatccagaa

SEQ ID NO: 303862 - DNA, 25 bp, Rattus norvegicus
gaaggcagttctcatactaagatct

SEQ ID NO: 303863 - DNA, 25 bp, Rattus norvegicus
gaaggcagttctgatactaagatct

SEQ ID NO: 303864 - DNA, 25 bp, Rattus norvegicus
gaaggcagtttcagaacggttcatt

SEQ ID NO: 303865 - DNA, 25 bp, Rattus norvegicus
gaaggcagtttctgaacggttcatt

SEQ ID NO: 303866 - DNA, 25 bp, Rattus norvegicus
gaaggcataccacaatatctcttaa

SEQ ID NO: 303867 - DNA, 25 bp, Rattus norvegicus
gaaggcataccagaatatctcttaa

SEQ ID NO: 303868 - DNA, 25 bp, Rattus norvegicus
gaaggcatagatactcttgccaaat

SEQ ID NO: 303869 - DNA, 25 bp, Rattus norvegicus
gaaggcatagattctcttgccaaat

SEQ ID NO: 303870 - DNA, 25 bp, Rattus norvegicus
gaaggcatagtcctggttcatccca

SEQ ID NO: 303871 - DNA, 25 bp, Rattus norvegicus
gaaggcatagtcgtggttcatccca

SEQ ID NO: 303872 - DNA, 25 bp, Rattus norvegicus
gaaggcatatcccaaggctctggtc

SEQ ID NO: 303873 - DNA, 25 bp, Rattus norvegicus
gaaggcatatccgaaggctctggtc

SEQ ID NO: 303874 - DNA, 25 bp, Rattus norvegicus
gaaggcatatgcaccactgtctggt

SEQ ID NO: 303875 - DNA, 25 bp, Rattus norvegicus
gaaggcatatgctccactgtctggt

SEQ ID NO: 303876 - DNA, 25 bp, Rattus norvegicus
gaaggcatcaacagactcactggct

SEQ ID NO: 303877 - DNA, 25 bp, Rattus norvegicus
gaaggcatcaactgactcactggct

SEQ ID NO: 303878 - DNA, 25 bp, Rattus norvegicus
gaaggcatcaagactgacccgggaa

SEQ ID NO: 303879 - DNA, 25 bp, Rattus norvegicus
gaaggcatcaagtctgacccgggaa

SEQ ID NO: 303880 - DNA, 25 bp, Rattus norvegicus
gaaggcatcactacttgacatggaa

SEQ ID NO: 303881 - DNA, 25 bp, Rattus norvegicus
gaaggcatcacttcttgacatggaa

SEQ ID NO: 303882 - DNA, 25 bp, Rattus norvegicus
gaaggcatcagcagacgacagtaca

SEQ ID NO: 303883 - DNA, 25 bp, Rattus norvegicus
gaaggcatcagctgacgacagtaca

SEQ ID NO: 303884 - DNA, 25 bp, Rattus norvegicus
gaaggcatccacagcgcagctgaaa

SEQ ID NO: 303885 - DNA, 25 bp, Rattus norvegicus
gaaggcatccactgcgcagctgaaa

SEQ ID NO: 303886 - DNA, 25 bp, Rattus norvegicus
gaaggcatctaaatccacagctgaa

SEQ ID NO: 303887 - DNA, 25 bp, Rattus norvegicus
gaaggcatctaattccacagctgaa

SEQ ID NO: 303888 - DNA, 25 bp, Rattus norvegicus
gaaggcatctccctagctcaaataa

SEQ ID NO: 303889 - DNA, 25 bp, Rattus norvegicus
gaaggcatctccgtagctcaaataa

SEQ ID NO: 303890 - DNA, 25 bp, Rattus norvegicus
gaaggcatctctatctaatcccaga

SEQ ID NO: 303891 - DNA, 25 bp, Rattus norvegicus
gaaggcatctctcgtgtctgaataa

SEQ ID NO: 303892 - DNA, 25 bp, Rattus norvegicus
gaaggcatctctggtgtctgaataa

SEQ ID NO: 303893 - DNA, 25 bp, Rattus norvegicus
gaaggcatctctttctaatcccaga

SEQ ID NO: 303894 - DNA, 25 bp, Rattus norvegicus
gaaggcatctgtatacaaacgccac

SEQ ID NO: 303895 - DNA, 25 bp, Rattus norvegicus
gaaggcatctgtttacaaacgccac

SEQ ID NO: 303896 - DNA, 25 bp, Rattus norvegicus
gaaggcatcttcacttaagtgcaca

SEQ ID NO: 303897 - DNA, 25 bp, Rattus norvegicus
gaaggcatcttctcttaagtgcaca

SEQ ID NO: 303898 - DNA, 25 bp, Rattus norvegicus
gaaggcatgctcaacagcaggactt

SEQ ID NO: 303899 - DNA, 25 bp, Rattus norvegicus
gaaggcatgctctacagcaggactt

SEQ ID NO: 303900 - DNA, 25 bp, Rattus norvegicus
gaaggcatgtacatcctcatccact

SEQ ID NO: 303901 - DNA, 25 bp, Rattus norvegicus
gaaggcatgtacttcctcatccact

SEQ ID NO: 303902 - DNA, 25 bp, Rattus norvegicus
gaaggcatgttcagactaagattgt

SEQ ID NO: 303903 - DNA, 25 bp, Rattus norvegicus
gaaggcatgttcagatccaaagtgt

SEQ ID NO: 303904 - DNA, 25 bp, Rattus norvegicus
gaaggcatgttctgactaagattgt

SEQ ID NO: 303905 - DNA, 25 bp, Rattus norvegicus
gaaggcatgttctgatccaaagtgt

SEQ ID NO: 303906 - DNA, 25 bp, Rattus norvegicus
gaaggcatgttgctacttttggcat

SEQ ID NO: 303907 - DNA, 25 bp, Rattus norvegicus
gaaggcatgttggtacttttggcat

SEQ ID NO: 303908 - DNA, 25 bp, Rattus norvegicus
gaaggcatgtttctcacttgtacac

SEQ ID NO: 303909 - DNA, 25 bp, Rattus norvegicus
gaaggcatgtttgtcacttgtacac

SEQ ID NO: 303910 - DNA, 25 bp, Rattus norvegicus
gaaggcattaatcgaaaccccaaca

SEQ ID NO: 303911 - DNA, 25 bp, Rattus norvegicus
gaaggcattaatggaaaccccaaca

SEQ ID NO: 303912 - DNA, 25 bp, Rattus norvegicus
gaaggcattaggaaaccggagtgtc

SEQ ID NO: 303913 - DNA, 25 bp, Rattus norvegicus
gaaggcattaggtaaccggagtgtc

SEQ ID NO: 303914 - DNA, 25 bp, Rattus norvegicus
gaaggcattcacagccatgatggaa

SEQ ID NO: 303915 - DNA, 25 bp, Rattus norvegicus
gaaggcattcactgccatgatggaa

SEQ ID NO: 303916 - DNA, 25 bp, Rattus norvegicus
gaaggcattcatcggcctcttgacg

SEQ ID NO: 303917 - DNA, 25 bp, Rattus norvegicus
gaaggcattcatgggcctcttgacg

SEQ ID NO: 303918 - DNA, 25 bp, Rattus norvegicus
gaaggcattcccatcaagagcacaa

SEQ ID NO: 303919 - DNA, 25 bp, Rattus norvegicus
gaaggcattcccatgcctacaaaaa

SEQ ID NO: 303920 - DNA, 25 bp, Rattus norvegicus
gaaggcattcccttcaagagcacaa

SEQ ID NO: 303921 - DNA, 25 bp, Rattus norvegicus
gaaggcattcccttgcctacaaaaa

SEQ ID NO: 303922 - DNA, 25 bp, Rattus norvegicus
gaaggcattcggatttgattactac

SEQ ID NO: 303923 - DNA, 25 bp, Rattus norvegicus
gaaggcattcggttttgattactac

SEQ ID NO: 303924 - DNA, 25 bp, Rattus norvegicus
gaaggcattgagctagttacctaaa

SEQ ID NO: 303925 - DNA, 25 bp, Rattus norvegicus
gaaggcattgaggtagttacctaaa

SEQ ID NO: 303926 - DNA, 25 bp, Rattus norvegicus
gaaggcattgcaccagctacagtgt

SEQ ID NO: 303927 - DNA, 25 bp, Rattus norvegicus
gaaggcattgcagcagctacagtgt

SEQ ID NO: 303928 - DNA, 25 bp, Rattus norvegicus
gaaggcatttgaccacttacaacaa

SEQ ID NO: 303929 - DNA, 25 bp, Rattus norvegicus
gaaggcatttgagcacttacaacaa

SEQ ID NO: 303930 - DNA, 25 bp, Rattus norvegicus
gaaggcattttaatacaagagctaa

SEQ ID NO: 303931 - DNA, 25 bp, Rattus norvegicus
gaaggcattttattacaagagctaa

SEQ ID NO: 303932 - DNA, 25 bp, Rattus norvegicus
gaaggccaaaaccacaaagaagatt

SEQ ID NO: 303933 - DNA, 25 bp, Rattus norvegicus
gaaggccaaaacgacaaagaagatt

SEQ ID NO: 303934 - DNA, 25 bp, Rattus norvegicus
gaaggccaaacgaatccttggctat

SEQ ID NO: 303935 - DNA, 25 bp, Rattus norvegicus
gaaggccaaacgtatccttggctat

SEQ ID NO: 303936 - DNA, 25 bp, Rattus norvegicus
gaaggccaacagacattccatcttt

SEQ ID NO: 303937 - DNA, 25 bp, Rattus norvegicus
gaaggccaacagtcattccatcttt

SEQ ID NO: 303938 - DNA, 25 bp, Rattus norvegicus
gaaggccaactgagtgtttgcccaa

SEQ ID NO: 303939 - DNA, 25 bp, Rattus norvegicus
gaaggccaactgtgtgtttgcccaa

SEQ ID NO: 303940 - DNA, 25 bp, Rattus norvegicus
gaaggccaacttcaacatccgggaa

SEQ ID NO: 303941 - DNA, 25 bp, Rattus norvegicus
gaaggccaacttgaacatccgggaa

SEQ ID NO: 303942 - DNA, 25 bp, Rattus norvegicus
gaaggccaagaaacctcaggaacag

SEQ ID NO: 303943 - DNA, 25 bp, Rattus norvegicus
gaaggccaagaatcctcaggaacag

SEQ ID NO: 303944 - DNA, 25 bp, Rattus norvegicus
gaaggccaagacactagttgttagt

SEQ ID NO: 303945 - DNA, 25 bp, Rattus norvegicus
gaaggccaagactctagttgttagt

SEQ ID NO: 303946 - DNA, 25 bp, Rattus norvegicus
gaaggccaagatctctgaagctata

SEQ ID NO: 303947 - DNA, 25 bp, Rattus norvegicus
gaaggccaagatgtctgaagctata

SEQ ID NO: 303948 - DNA, 25 bp, Rattus norvegicus
gaaggccaaggaatatagtttacag

SEQ ID NO: 303949 - DNA, 25 bp, Rattus norvegicus
gaaggccaaggattatagtttacag

SEQ ID NO: 303950 - DNA, 25 bp, Rattus norvegicus
gaaggccaaggcagttaagtatccc

SEQ ID NO: 303951 - DNA, 25 bp, Rattus norvegicus
gaaggccaaggctgttaagtatccc

SEQ ID NO: 303952 - DNA, 25 bp, Rattus norvegicus
gaaggccaagtcattgcctcgtatt

SEQ ID NO: 303953 - DNA, 25 bp, Rattus norvegicus
gaaggccaagtctttgcctcgtatt

SEQ ID NO: 303954 - DNA, 25 bp, Rattus norvegicus
gaaggccacatacatcaacctcaag

SEQ ID NO: 303955 - DNA, 25 bp, Rattus norvegicus
gaaggccacatagatcaacctcaag

SEQ ID NO: 303956 - DNA, 25 bp, Rattus norvegicus
gaaggccaccgtcttgtaccaaggg

SEQ ID NO: 303957 - DNA, 25 bp, Rattus norvegicus
gaaggccaccgtgttgtaccaaggg

SEQ ID NO: 303958 - DNA, 25 bp, Rattus norvegicus
gaaggccacctccagccaatttgta

SEQ ID NO: 303959 - DNA, 25 bp, Rattus norvegicus
gaaggccacctcgagccaatttgta

SEQ ID NO: 303960 - DNA, 25 bp, Rattus norvegicus
gaaggccacgatcgctgtgctccag

SEQ ID NO: 303961 - DNA, 25 bp, Rattus norvegicus
gaaggccacgatggctgtgctccag

SEQ ID NO: 303962 - DNA, 25 bp, Rattus norvegicus
gaaggccacgcaaggtagctctcat

SEQ ID NO: 303963 - DNA, 25 bp, Rattus norvegicus
gaaggccacgcatggtagctctcat

SEQ ID NO: 303964 - DNA, 25 bp, Rattus norvegicus
gaaggccacggtatgtcttgaaatt

SEQ ID NO: 303965 - DNA, 25 bp, Rattus norvegicus
gaaggccacggtttgtcttgaaatt

SEQ ID NO: 303966 - DNA, 25 bp, Rattus norvegicus
gaaggccactctcggtaactgtgaa

SEQ ID NO: 303967 - DNA, 25 bp, Rattus norvegicus
gaaggccactctgggtaactgtgaa

SEQ ID NO: 303968 - DNA, 25 bp, Rattus norvegicus
gaaggccactgcaaattccaagttt

SEQ ID NO: 303969 - DNA, 25 bp, Rattus norvegicus
gaaggccactgctaattccaagttt

SEQ ID NO: 303970 - DNA, 25 bp, Rattus norvegicus
gaaggccactttcgtcctggtgttc

SEQ ID NO: 303971 - DNA, 25 bp, Rattus norvegicus
gaaggccactttggtcctggtgttc

SEQ ID NO: 303972 - DNA, 25 bp, Rattus norvegicus
gaaggccagaatatgcccgactgca

SEQ ID NO: 303973 - DNA, 25 bp, Rattus norvegicus
gaaggccagaatttgcccgactgca

SEQ ID NO: 303974 - DNA, 25 bp, Rattus norvegicus
gaaggccagaccatatcggttcctt

SEQ ID NO: 303975 - DNA, 25 bp, Rattus norvegicus
gaaggccagaccctacaacacgatg

SEQ ID NO: 303976 - DNA, 25 bp, Rattus norvegicus
gaaggccagaccgtacaacacgatg

SEQ ID NO: 303977 - DNA, 25 bp, Rattus norvegicus
gaaggccagaccttatcggttcctt

SEQ ID NO: 303978 - DNA, 25 bp, Rattus norvegicus
gaaggccagattatccagctgcaca

SEQ ID NO: 303979 - DNA, 25 bp, Rattus norvegicus
gaaggccagattcattgagaagttt

SEQ ID NO: 303980 - DNA, 25 bp, Rattus norvegicus
gaaggccagattgattgagaagttt

SEQ ID NO: 303981 - DNA, 25 bp, Rattus norvegicus
gaaggccagattttccagctgcaca

SEQ ID NO: 303982 - DNA, 25 bp, Rattus norvegicus
gaaggccagcatcctgtgtgaaaac

SEQ ID NO: 303983 - DNA, 25 bp, Rattus norvegicus
gaaggccagcatgctgtgtgaaaac

SEQ ID NO: 303984 - DNA, 25 bp, Rattus norvegicus
gaaggccagcggatggtcactgccc

SEQ ID NO: 303985 - DNA, 25 bp, Rattus norvegicus
gaaggccagcggttggtcactgccc

SEQ ID NO: 303986 - DNA, 25 bp, Rattus norvegicus
gaaggccagctcagagctgcagcat

SEQ ID NO: 303987 - DNA, 25 bp, Rattus norvegicus
gaaggccagctctgagctgcagcat

SEQ ID NO: 303988 - DNA, 25 bp, Rattus norvegicus
gaaggccaggataacatctctctaa

SEQ ID NO: 303989 - DNA, 25 bp, Rattus norvegicus
gaaggccaggattacatctctctaa

SEQ ID NO: 303990 - DNA, 25 bp, Rattus norvegicus
gaaggccagggaagctgcacaacaa

SEQ ID NO: 303991 - DNA, 25 bp, Rattus norvegicus
gaaggccagggatgctgcacaacaa

SEQ ID NO: 303992 - DNA, 25 bp, Rattus norvegicus
gaaggccagtttatcaaatgctcaa

SEQ ID NO: 303993 - DNA, 25 bp, Rattus norvegicus
gaaggccagtttttcaaatgctcaa

SEQ ID NO: 303994 - DNA, 25 bp, Rattus norvegicus
gaaggccatacacgttggtaactac

SEQ ID NO: 303995 - DNA, 25 bp, Rattus norvegicus
gaaggccatacaggttggtaactac

SEQ ID NO: 303996 - DNA, 25 bp, Rattus norvegicus
gaaggccatagaagggctcccttat

SEQ ID NO: 303997 - DNA, 25 bp, Rattus norvegicus
gaaggccatagatgggctcccttat

SEQ ID NO: 303998 - DNA, 25 bp, Rattus norvegicus
gaaggccatcgccatcatggaaata

SEQ ID NO: 303999 - DNA, 25 bp, Rattus norvegicus
gaaggccatcgcgatcatggaaata

SEQ ID NO: 304000 - DNA, 25 bp, Rattus norvegicus
gaaggccatcttcctgacatggagg

SEQ ID NO: 304001 - DNA, 25 bp, Rattus norvegicus
gaaggccatcttgctgacatggagg

SEQ ID NO: 304002 - DNA, 25 bp, Rattus norvegicus
gaaggccatgacacaattcttaggt

SEQ ID NO: 304003 - DNA, 25 bp, Rattus norvegicus
gaaggccatgactcaattcttaggt

SEQ ID NO: 304004 - DNA, 25 bp, Rattus norvegicus
gaaggccatgccaaattttagagtg

SEQ ID NO: 304005 - DNA, 25 bp, Rattus norvegicus
gaaggccatgcctaattttagagtg

SEQ ID NO: 304006 - DNA, 25 bp, Rattus norvegicus
gaaggccatggacacttccactcag

SEQ ID NO: 304007 - DNA, 25 bp, Rattus norvegicus
gaaggccatggagacttccactcag

SEQ ID NO: 304008 - DNA, 25 bp, Rattus norvegicus
gaaggccatggcagacgctctctag

SEQ ID NO: 304009 - DNA, 25 bp, Rattus norvegicus
gaaggccatggctgacgctctctag

SEQ ID NO: 304010 - DNA, 25 bp, Rattus norvegicus
gaaggccatgtcagctcttcagtga

SEQ ID NO: 304011 - DNA, 25 bp, Rattus norvegicus
gaaggccatgtccaaactgggtctt

SEQ ID NO: 304012 - DNA, 25 bp, Rattus norvegicus
gaaggccatgtcgaaactgggtctt

SEQ ID NO: 304013 - DNA, 25 bp, Rattus norvegicus
gaaggccatgtctgctcttcagtga

SEQ ID NO: 304014 - DNA, 25 bp, Rattus norvegicus
gaaggccattggagctcgaaacttg

SEQ ID NO: 304015 - DNA, 25 bp, Rattus norvegicus
gaaggccattggtgctcgaaacttg

SEQ ID NO: 304016 - DNA, 25 bp, Rattus norvegicus
gaaggcccaaaacaccaaggcgaag

SEQ ID NO: 304017 - DNA, 25 bp, Rattus norvegicus
gaaggcccaaaagaccaaggcgaag

SEQ ID NO: 304018 - DNA, 25 bp, Rattus norvegicus
gaaggcccagacagcgcttcagcaa

SEQ ID NO: 304019 - DNA, 25 bp, Rattus norvegicus
gaaggcccagacatctaaactgtga

SEQ ID NO: 304020 - DNA, 25 bp, Rattus norvegicus
gaaggcccagactgcgcttcagcaa

SEQ ID NO: 304021 - DNA, 25 bp, Rattus norvegicus
gaaggcccagacttctaaactgtga

SEQ ID NO: 304022 - DNA, 25 bp, Rattus norvegicus
gaaggcccagagacggttacccaag

SEQ ID NO: 304023 - DNA, 25 bp, Rattus norvegicus
gaaggcccagagtcggttacccaag

SEQ ID NO: 304024 - DNA, 25 bp, Rattus norvegicus
gaaggcccagatatgcatcatccta

SEQ ID NO: 304025 - DNA, 25 bp, Rattus norvegicus
gaaggcccagatttgcatcatccta

SEQ ID NO: 304026 - DNA, 25 bp, Rattus norvegicus
gaaggcccaggtcgagatcatcact

SEQ ID NO: 304027 - DNA, 25 bp, Rattus norvegicus
gaaggcccaggtggagatcatcact

SEQ ID NO: 304028 - DNA, 25 bp, Rattus norvegicus
gaaggcccatgtacaaaagctccgc

SEQ ID NO: 304029 - DNA, 25 bp, Rattus norvegicus
gaaggcccatgttcaaaagctccgc

SEQ ID NO: 304030 - DNA, 25 bp, Rattus norvegicus
gaaggccccaacaacgtgcaactta

SEQ ID NO: 304031 - DNA, 25 bp, Rattus norvegicus
gaaggccccaactacgtgcaactta

SEQ ID NO: 304032 - DNA, 25 bp, Rattus norvegicus
gaaggccccagtaataaatattgac

SEQ ID NO: 304033 - DNA, 25 bp, Rattus norvegicus
gaaggccccagttataaatattgac

SEQ ID NO: 304034 - DNA, 25 bp, Rattus norvegicus
gaaggccccatacaaaagggtcttg

SEQ ID NO: 304035 - DNA, 25 bp, Rattus norvegicus
gaaggccccatagaaaagggtcttg

SEQ ID NO: 304036 - DNA, 25 bp, Rattus norvegicus
gaaggccccatgcaacaggtgttac

SEQ ID NO: 304037 - DNA, 25 bp, Rattus norvegicus
gaaggccccatgctaggctgagaat

SEQ ID NO: 304038 - DNA, 25 bp, Rattus norvegicus
gaaggccccatggaacaggtgttac

SEQ ID NO: 304039 - DNA, 25 bp, Rattus norvegicus
gaaggccccatggtaggctgagaat

SEQ ID NO: 304040 - DNA, 25 bp, Rattus norvegicus
gaaggcccccaacagagaaacagca

SEQ ID NO: 304041 - DNA, 25 bp, Rattus norvegicus
gaaggcccccaagagagaaacagca

SEQ ID NO: 304042 - DNA, 25 bp, Rattus norvegicus
gaaggcccctcgatgtggatgtgtt

SEQ ID NO: 304043 - DNA, 25 bp, Rattus norvegicus
gaaggcccctcgttgtggatgtgtt

SEQ ID NO: 304044 - DNA, 25 bp, Rattus norvegicus
gaaggcccctctatctaggacaaag

SEQ ID NO: 304045 - DNA, 25 bp, Rattus norvegicus
gaaggcccctctttctaggacaaag

SEQ ID NO: 304046 - DNA, 25 bp, Rattus norvegicus
gaaggcccctgcactgagaagcaca

SEQ ID NO: 304047 - DNA, 25 bp, Rattus norvegicus
gaaggcccctgctctgagaagcaca

SEQ ID NO: 304048 - DNA, 25 bp, Rattus norvegicus
gaaggcccgatcctccaaggtgcag

SEQ ID NO: 304049 - DNA, 25 bp, Rattus norvegicus
gaaggcccgatcgtccaaggtgcag

SEQ ID NO: 304050 - DNA, 25 bp, Rattus norvegicus
gaaggccctagacagctttgagaag

SEQ ID NO: 304051 - DNA, 25 bp, Rattus norvegicus
gaaggccctagagagctttgagaag

SEQ ID NO: 304052 - DNA, 25 bp, Rattus norvegicus
gaaggccctcacctacttcgtggcg

SEQ ID NO: 304053 - DNA, 25 bp, Rattus norvegicus
gaaggccctcacgtacttcgtggcg

SEQ ID NO: 304054 - DNA, 25 bp, Rattus norvegicus
gaaggccctcatatacttcgtggtg

SEQ ID NO: 304055 - DNA, 25 bp, Rattus norvegicus
gaaggccctcatcgaacaaggacat

SEQ ID NO: 304056 - DNA, 25 bp, Rattus norvegicus
gaaggccctcatggaacaaggacat

SEQ ID NO: 304057 - DNA, 25 bp, Rattus norvegicus
gaaggccctcatttacttcgtggtg

SEQ ID NO: 304058 - DNA, 25 bp, Rattus norvegicus
gaaggccctcggaatacatcagact

SEQ ID NO: 304059 - DNA, 25 bp, Rattus norvegicus
gaaggccctcggtatacatcagact

SEQ ID NO: 304060 - DNA, 25 bp, Rattus norvegicus
gaaggccctgatcccatgtatgtga

SEQ ID NO: 304061 - DNA, 25 bp, Rattus norvegicus
gaaggccctgatgccatgtatgtga

SEQ ID NO: 304062 - DNA, 25 bp, Rattus norvegicus
gaaggccctgcgagaccattgtcaa

SEQ ID NO: 304063 - DNA, 25 bp, Rattus norvegicus
gaaggccctgcgagagctcacagca

SEQ ID NO: 304064 - DNA, 25 bp, Rattus norvegicus
gaaggccctgcgtgaccattgtcaa

SEQ ID NO: 304065 - DNA, 25 bp, Rattus norvegicus
gaaggccctgcgtgagctcacagca

SEQ ID NO: 304066 - DNA, 25 bp, Rattus norvegicus
gaaggccctgttcggtctgttcctg

SEQ ID NO: 304067 - DNA, 25 bp, Rattus norvegicus
gaaggccctgttgggtctgttcctg

SEQ ID NO: 304068 - DNA, 25 bp, Rattus norvegicus
gaaggccctttcaagtgaatccttt

SEQ ID NO: 304069 - DNA, 25 bp, Rattus norvegicus
gaaggccctttctagtgaatccttt

SEQ ID NO: 304070 - DNA, 25 bp, Rattus norvegicus
gaaggccgaaaaagtctgcagaaat

SEQ ID NO: 304071 - DNA, 25 bp, Rattus norvegicus
gaaggccgaaaatgtctgcagaaat

SEQ ID NO: 304072 - DNA, 25 bp, Rattus norvegicus
gaaggccgcactcaagactgctacg

SEQ ID NO: 304073 - DNA, 25 bp, Rattus norvegicus
gaaggccgcactcagtgtgtcctga

SEQ ID NO: 304074 - DNA, 25 bp, Rattus norvegicus
gaaggccgcactgaagactgctacg

SEQ ID NO: 304075 - DNA, 25 bp, Rattus norvegicus
gaaggccgcactgagtgtgtcctga

SEQ ID NO: 304076 - DNA, 25 bp, Rattus norvegicus
gaaggccgtcaactaccagagcaag

SEQ ID NO: 304077 - DNA, 25 bp, Rattus norvegicus
gaaggccgtcaagtaccagagcaag

SEQ ID NO: 304078 - DNA, 25 bp, Rattus norvegicus
gaaggccgtgaaccaaccgaggaac

SEQ ID NO: 304079 - DNA, 25 bp, Rattus norvegicus
gaaggccgtgaagcaaccgaggaac

SEQ ID NO: 304080 - DNA, 25 bp, Rattus norvegicus
gaaggccgtgccaggcaagctagaa

SEQ ID NO: 304081 - DNA, 25 bp, Rattus norvegicus
gaaggccgtgcctggcaagctagaa

SEQ ID NO: 304082 - DNA, 25 bp, Rattus norvegicus
gaaggccgtttgaccctggttgaat

SEQ ID NO: 304083 - DNA, 25 bp, Rattus norvegicus
gaaggccgtttgtccctggttgaat

SEQ ID NO: 304084 - DNA, 25 bp, Rattus norvegicus
gaaggccgttttagatatcatgcat

SEQ ID NO: 304085 - DNA, 25 bp, Rattus norvegicus
gaaggccgtttttgatatcatgcat

SEQ ID NO: 304086 - DNA, 25 bp, Rattus norvegicus
gaaggcctacaaactaaaccgaacg

SEQ ID NO: 304087 - DNA, 25 bp, Rattus norvegicus
gaaggcctacaatctaaaccgaacg

SEQ ID NO: 304088 - DNA, 25 bp, Rattus norvegicus
gaaggcctaccaagagcagctgtca

SEQ ID NO: 304089 - DNA, 25 bp, Rattus norvegicus
gaaggcctaccatgagcagctgtca

SEQ ID NO: 304090 - DNA, 25 bp, Rattus norvegicus
gaaggcctactaaatgcgcgcacgg

SEQ ID NO: 304091 - DNA, 25 bp, Rattus norvegicus
gaaggcctactatatgcgcgcacgg

SEQ ID NO: 304092 - DNA, 25 bp, Rattus norvegicus
gaaggcctagtgatggtaagattcc

SEQ ID NO: 304093 - DNA, 25 bp, Rattus norvegicus
gaaggcctagtgttggtaagattcc

SEQ ID NO: 304094 - DNA, 25 bp, Rattus norvegicus
gaaggcctattcctactccagtagg

SEQ ID NO: 304095 - DNA, 25 bp, Rattus norvegicus
gaaggcctattcgtactccagtagg

SEQ ID NO: 304096 - DNA, 25 bp, Rattus norvegicus
gaaggcctcaagaatgtaacatctc

SEQ ID NO: 304097 - DNA, 25 bp, Rattus norvegicus
gaaggcctcaagtatgtaacatctc

SEQ ID NO: 304098 - DNA, 25 bp, Rattus norvegicus
gaaggcctcaatattgctgctgtac

SEQ ID NO: 304099 - DNA, 25 bp, Rattus norvegicus
gaaggcctcaattttgctgctgtac

SEQ ID NO: 304100 - DNA, 25 bp, Rattus norvegicus
gaaggcctcaccacactatgggagc

SEQ ID NO: 304101 - DNA, 25 bp, Rattus norvegicus
gaaggcctcacctcactatgggagc

SEQ ID NO: 304102 - DNA, 25 bp, Rattus norvegicus
gaaggcctcagtcggtttgtaacag

SEQ ID NO: 304103 - DNA, 25 bp, Rattus norvegicus
gaaggcctcagtgggtttgtaacag

SEQ ID NO: 304104 - DNA, 25 bp, Rattus norvegicus
gaaggcctcatacttcttcaggcag

SEQ ID NO: 304105 - DNA, 25 bp, Rattus norvegicus
gaaggcctcatagttcttcaggcag

SEQ ID NO: 304106 - DNA, 25 bp, Rattus norvegicus
gaaggcctcatcaccatatgcagag

SEQ ID NO: 304107 - DNA, 25 bp, Rattus norvegicus
gaaggcctcatctccatatgcagag

SEQ ID NO: 304108 - DNA, 25 bp, Rattus norvegicus
gaaggcctcgagctcaagactcaga

SEQ ID NO: 304109 - DNA, 25 bp, Rattus norvegicus
gaaggcctcgaggtcaagactcaga

SEQ ID NO: 304110 - DNA, 25 bp, Rattus norvegicus
gaaggcctctctctgtcttcaatat

SEQ ID NO: 304111 - DNA, 25 bp, Rattus norvegicus
gaaggcctctctgtgtcttcaatat

SEQ ID NO: 304112 - DNA, 25 bp, Rattus norvegicus
gaaggcctctgaatgcaaacaatct

SEQ ID NO: 304113 - DNA, 25 bp, Rattus norvegicus
gaaggcctctgattgcaaacaatct

SEQ ID NO: 304114 - DNA, 25 bp, Rattus norvegicus
gaaggcctctgtatcacatttgaag

SEQ ID NO: 304115 - DNA, 25 bp, Rattus norvegicus
gaaggcctctgtcgctgccttggtt

SEQ ID NO: 304116 - DNA, 25 bp, Rattus norvegicus
gaaggcctctgtggctgccttggtt

SEQ ID NO: 304117 - DNA, 25 bp, Rattus norvegicus
gaaggcctctgtttcacatttgaag

SEQ ID NO: 304118 - DNA, 25 bp, Rattus norvegicus
gaaggcctcttacacaagactgaaa

SEQ ID NO: 304119 - DNA, 25 bp, Rattus norvegicus
gaaggcctcttaccttgggaaatct

SEQ ID NO: 304120 - DNA, 25 bp, Rattus norvegicus
gaaggcctcttagacaagactgaaa

SEQ ID NO: 304121 - DNA, 25 bp, Rattus norvegicus
gaaggcctcttagcttgggaaatct

SEQ ID NO: 304122 - DNA, 25 bp, Rattus norvegicus
gaaggcctcttcaattcagaagcat

SEQ ID NO: 304123 - DNA, 25 bp, Rattus norvegicus
gaaggcctcttctattcagaagcat

SEQ ID NO: 304124 - DNA, 25 bp, Rattus norvegicus
gaaggcctcttgaagatgcgaatct

SEQ ID NO: 304125 - DNA, 25 bp, Rattus norvegicus
gaaggcctcttgtagatgcgaatct

SEQ ID NO: 304126 - DNA, 25 bp, Rattus norvegicus
gaaggcctgagacttggatctccca

SEQ ID NO: 304127 - DNA, 25 bp, Rattus norvegicus
gaaggcctgagagttggatctccca

SEQ ID NO: 304128 - DNA, 25 bp, Rattus norvegicus
gaaggcctgcaacacgtattcgagt

SEQ ID NO: 304129 - DNA, 25 bp, Rattus norvegicus
gaaggcctgcaacatttcacgtttt

SEQ ID NO: 304130 - DNA, 25 bp, Rattus norvegicus
gaaggcctgcaagacgtattcgagt

SEQ ID NO: 304131 - DNA, 25 bp, Rattus norvegicus
gaaggcctgcaagatttcacgtttt

SEQ ID NO: 304132 - DNA, 25 bp, Rattus norvegicus
gaaggcctgctaagcatttggaagc

SEQ ID NO: 304133 - DNA, 25 bp, Rattus norvegicus
gaaggcctgctatgcatttggaagc

SEQ ID NO: 304134 - DNA, 25 bp, Rattus norvegicus
gaaggcctggttaagtcaagccctc

SEQ ID NO: 304135 - DNA, 25 bp, Rattus norvegicus
gaaggcctggtttagtcaagccctc

SEQ ID NO: 304136 - DNA, 25 bp, Rattus norvegicus
gaaggcctgtgtagtttagtcaaat

SEQ ID NO: 304137 - DNA, 25 bp, Rattus norvegicus
gaaggcctgtgttgtttagtcaaat

SEQ ID NO: 304138 - DNA, 25 bp, Rattus norvegicus
gaaggccttacacctccaaaaaata

SEQ ID NO: 304139 - DNA, 25 bp, Rattus norvegicus
gaaggccttacagctccaaaaaata

SEQ ID NO: 304140 - DNA, 25 bp, Rattus norvegicus
gaaggccttattactattttcagat

SEQ ID NO: 304141 - DNA, 25 bp, Rattus norvegicus
gaaggccttatttctattttcagat

SEQ ID NO: 304142 - DNA, 25 bp, Rattus norvegicus
gaaggccttctgagttctgctgaca

SEQ ID NO: 304143 - DNA, 25 bp, Rattus norvegicus
gaaggccttctgtgttctgctgaca

SEQ ID NO: 304144 - DNA, 25 bp, Rattus norvegicus
gaaggccttgagactttcagtgaag

SEQ ID NO: 304145 - DNA, 25 bp, Rattus norvegicus
gaaggccttgagcaacgtcattgaa

SEQ ID NO: 304146 - DNA, 25 bp, Rattus norvegicus
gaaggccttgaggaacgtcattgaa

SEQ ID NO: 304147 - DNA, 25 bp, Rattus norvegicus
gaaggccttgagtctttcagtgaag

SEQ ID NO: 304148 - DNA, 25 bp, Rattus norvegicus
gaaggccttggcagggatgcttcaa

SEQ ID NO: 304149 - DNA, 25 bp, Rattus norvegicus
gaaggccttggctgggatgcttcaa

SEQ ID NO: 304150 - DNA, 25 bp, Rattus norvegicus
gaaggccttgtgcattctgagtttg

SEQ ID NO: 304151 - DNA, 25 bp, Rattus norvegicus
gaaggccttgtggattctgagtttg

SEQ ID NO: 304152 - DNA, 25 bp, Rattus norvegicus
gaaggcctttgacaggcactgcaac

SEQ ID NO: 304153 - DNA, 25 bp, Rattus norvegicus
gaaggcctttgagaggcactgcaac

SEQ ID NO: 304154 - DNA, 25 bp, Rattus norvegicus
gaaggcctttgcacgtttgaactgt

SEQ ID NO: 304155 - DNA, 25 bp, Rattus norvegicus
gaaggcctttgctcgtttgaactgt

SEQ ID NO: 304156 - DNA, 25 bp, Rattus norvegicus
gaaggcctttgtcactcaggacatt

SEQ ID NO: 304157 - DNA, 25 bp, Rattus norvegicus
gaaggcctttgtgactcaggacatt

SEQ ID NO: 304158 - DNA, 25 bp, Rattus norvegicus
gaaggcgaacagacagggccacaca

SEQ ID NO: 304159 - DNA, 25 bp, Rattus norvegicus
gaaggcgaacagtcagggccacaca

SEQ ID NO: 304160 - DNA, 25 bp, Rattus norvegicus
gaaggcgaagcgacagggccataca

SEQ ID NO: 304161 - DNA, 25 bp, Rattus norvegicus
gaaggcgaagcgtcagggccataca

SEQ ID NO: 304162 - DNA, 25 bp, Rattus norvegicus
gaaggcgacccaatgaccggtccaa

SEQ ID NO: 304163 - DNA, 25 bp, Rattus norvegicus
gaaggcgacccattgaccggtccaa

SEQ ID NO: 304164 - DNA, 25 bp, Rattus norvegicus
gaaggcgacgagaccacctcgatct

SEQ ID NO: 304165 - DNA, 25 bp, Rattus norvegicus
gaaggcgacgagtccacctcgatct

SEQ ID NO: 304166 - DNA, 25 bp, Rattus norvegicus
gaaggcgagcttatccatgatttat

SEQ ID NO: 304167 - DNA, 25 bp, Rattus norvegicus
gaaggcgagcttttccatgatttat

SEQ ID NO: 304168 - DNA, 25 bp, Rattus norvegicus
gaaggcgaggacattctgctcacca

SEQ ID NO: 304169 - DNA, 25 bp, Rattus norvegicus
gaaggcgaggactttctgctcacca

SEQ ID NO: 304170 - DNA, 25 bp, Rattus norvegicus
gaaggcgataggactgaggtcttta

SEQ ID NO: 304171 - DNA, 25 bp, Rattus norvegicus
gaaggcgataggtctgaggtcttta

SEQ ID NO: 304172 - DNA, 25 bp, Rattus norvegicus
gaaggcgatccacgcatcaattaga

SEQ ID NO: 304173 - DNA, 25 bp, Rattus norvegicus
gaaggcgatccaggcatcaattaga

SEQ ID NO: 304174 - DNA, 25 bp, Rattus norvegicus
gaaggcgatgacctcatcctagaga

SEQ ID NO: 304175 - DNA, 25 bp, Rattus norvegicus
gaaggcgatgacgtcatcctagaga

SEQ ID NO: 304176 - DNA, 25 bp, Rattus norvegicus
gaaggcgcacctcgaagactactac

SEQ ID NO: 304177 - DNA, 25 bp, Rattus norvegicus
gaaggcgcacctggaagactactac

SEQ ID NO: 304178 - DNA, 25 bp, Rattus norvegicus
gaaggcgccgcgcatttatggcccc

SEQ ID NO: 304179 - DNA, 25 bp, Rattus norvegicus
gaaggcgccgcggatttatggcccc

SEQ ID NO: 304180 - DNA, 25 bp, Rattus norvegicus
gaaggcgcgcgtaactgcgaaacaa

SEQ ID NO: 304181 - DNA, 25 bp, Rattus norvegicus
gaaggcgcgcgttactgcgaaacaa

SEQ ID NO: 304182 - DNA, 25 bp, Rattus norvegicus
gaaggcgcgtgcaagcgcgtacaca

SEQ ID NO: 304183 - DNA, 25 bp, Rattus norvegicus
gaaggcgcgtgctagcgcgtacaca

SEQ ID NO: 304184 - DNA, 25 bp, Rattus norvegicus
gaaggcgctcgcattttctgaggtc

SEQ ID NO: 304185 - DNA, 25 bp, Rattus norvegicus
gaaggcgctcgctttttctgaggtc

SEQ ID NO: 304186 - DNA, 25 bp, Rattus norvegicus
gaaggcgctctgcagcttacaggat

SEQ ID NO: 304187 - DNA, 25 bp, Rattus norvegicus
gaaggcgctctggagcttacaggat

SEQ ID NO: 304188 - DNA, 25 bp, Rattus norvegicus
gaaggcgctgccatggcaaccctag

SEQ ID NO: 304189 - DNA, 25 bp, Rattus norvegicus
gaaggcgctgccttggcaaccctag

SEQ ID NO: 304190 - DNA, 25 bp, Rattus norvegicus
gaaggcgctggcacaaccattaact

SEQ ID NO: 304191 - DNA, 25 bp, Rattus norvegicus
gaaggcgctggctcaaccattaact

SEQ ID NO: 304192 - DNA, 25 bp, Rattus norvegicus
gaaggcggcactacaagcagcggct

SEQ ID NO: 304193 - DNA, 25 bp, Rattus norvegicus
gaaggcggcacttcaagcagcggct

SEQ ID NO: 304194 - DNA, 25 bp, Rattus norvegicus
gaaggcggtcaccagcccgcacggg

SEQ ID NO: 304195 - DNA, 25 bp, Rattus norvegicus
gaaggcggtcacgagcccgcacggg

SEQ ID NO: 304196 - DNA, 25 bp, Rattus norvegicus
gaaggcggttgtccgtacgaccaca

SEQ ID NO: 304197 - DNA, 25 bp, Rattus norvegicus
gaaggcggttgtgcgtacgaccaca

SEQ ID NO: 304198 - DNA, 25 bp, Rattus norvegicus
gaaggcgtcaagaacctggtattga

SEQ ID NO: 304199 - DNA, 25 bp, Rattus norvegicus
gaaggcgtcaagtacctggtattga

SEQ ID NO: 304200 - DNA, 25 bp, Rattus norvegicus
gaaggcgtccagaacattgcagacc

SEQ ID NO: 304201 - DNA, 25 bp, Rattus norvegicus
gaaggcgtccagtacattgcagacc

SEQ ID NO: 304202 - DNA, 25 bp, Rattus norvegicus
gaaggcgtccgcagagccggcgcag

SEQ ID NO: 304203 - DNA, 25 bp, Rattus norvegicus
gaaggcgtccgctgagccggcgcag

SEQ ID NO: 304204 - DNA, 25 bp, Rattus norvegicus
gaaggcgtccttaacgtcggaagca

SEQ ID NO: 304205 - DNA, 25 bp, Rattus norvegicus
gaaggcgtcctttacgtcggaagca

SEQ ID NO: 304206 - DNA, 25 bp, Rattus norvegicus
gaaggcgtcgtgagtttcagctgac

SEQ ID NO: 304207 - DNA, 25 bp, Rattus norvegicus
gaaggcgtcgtgtgtttcagctgac

SEQ ID NO: 304208 - DNA, 25 bp, Rattus norvegicus
gaaggcgtgtttcctggactcatcc

SEQ ID NO: 304209 - DNA, 25 bp, Rattus norvegicus
gaaggcgtgtttgctggactcatcc

SEQ ID NO: 304210 - DNA, 25 bp, Rattus norvegicus
gaaggcgttacacgacataccggaa

SEQ ID NO: 304211 - DNA, 25 bp, Rattus norvegicus
gaaggcgttacaggacataccggaa

SEQ ID NO: 304212 - DNA, 25 bp, Rattus norvegicus
gaaggcgttcacagacactttgctc

SEQ ID NO: 304213 - DNA, 25 bp, Rattus norvegicus
gaaggcgttcactgacactttgctc

SEQ ID NO: 304214 - DNA, 25 bp, Rattus norvegicus
gaaggcgtttatcagaccagcttcc

SEQ ID NO: 304215 - DNA, 25 bp, Rattus norvegicus
gaaggcgtttatgagaccagcttcc

SEQ ID NO: 304216 - DNA, 25 bp, Rattus norvegicus
gaaggcgtttgcactgcagtctgac

SEQ ID NO: 304217 - DNA, 25 bp, Rattus norvegicus
gaaggcgtttgctctgcagtctgac

SEQ ID NO: 304218 - DNA, 25 bp, Rattus norvegicus
gaaggctaaatgaatattatcccta

SEQ ID NO: 304219 - DNA, 25 bp, Rattus norvegicus
gaaggctaaatgtatattatcccta

SEQ ID NO: 304220 - DNA, 25 bp, Rattus norvegicus
gaaggctaacggcacaactgtccat

SEQ ID NO: 304221 - DNA, 25 bp, Rattus norvegicus
gaaggctaacgggacaactgtccat

SEQ ID NO: 304222 - DNA, 25 bp, Rattus norvegicus
gaaggctaactcattcttgacaacc

SEQ ID NO: 304223 - DNA, 25 bp, Rattus norvegicus
gaaggctaactctttcttgacaacc

SEQ ID NO: 304224 - DNA, 25 bp, Rattus norvegicus
gaaggctaagtaaccatccgcataa

SEQ ID NO: 304225 - DNA, 25 bp, Rattus norvegicus
gaaggctaagtatccatccgcataa

SEQ ID NO: 304226 - DNA, 25 bp, Rattus norvegicus
gaaggctacaggacatgatcccata

SEQ ID NO: 304227 - DNA, 25 bp, Rattus norvegicus
gaaggctacaggtcatgatcccata

SEQ ID NO: 304228 - DNA, 25 bp, Rattus norvegicus
gaaggctaccgcagctaccgagtgg

SEQ ID NO: 304229 - DNA, 25 bp, Rattus norvegicus
gaaggctaccgctgctaccgagtgg

SEQ ID NO: 304230 - DNA, 25 bp, Rattus norvegicus
gaaggctacctacgacaaggcttac

SEQ ID NO: 304231 - DNA, 25 bp, Rattus norvegicus
gaaggctacctaggacaaggcttac

SEQ ID NO: 304232 - DNA, 25 bp, Rattus norvegicus
gaaggctaccttctagtctgcatct

SEQ ID NO: 304233 - DNA, 25 bp, Rattus norvegicus
gaaggctaccttgtagtctgcatct

SEQ ID NO: 304234 - DNA, 25 bp, Rattus norvegicus
gaaggctactgaacctgatgactca

SEQ ID NO: 304235 - DNA, 25 bp, Rattus norvegicus
gaaggctactgatcctgatgactca

SEQ ID NO: 304236 - DNA, 25 bp, Rattus norvegicus
gaaggctaggttctcacaggcagct

SEQ ID NO: 304237 - DNA, 25 bp, Rattus norvegicus
gaaggctaggttgtcacaggcagct

SEQ ID NO: 304238 - DNA, 25 bp, Rattus norvegicus
gaaggctatatgctccagttagaaa

SEQ ID NO: 304239 - DNA, 25 bp, Rattus norvegicus
gaaggctatatggtccagttagaaa

SEQ ID NO: 304240 - DNA, 25 bp, Rattus norvegicus
gaaggctatgtgatgagatttgtcc

SEQ ID NO: 304241 - DNA, 25 bp, Rattus norvegicus
gaaggctatgtgttgagatttgtcc

SEQ ID NO: 304242 - DNA, 25 bp, Rattus norvegicus
gaaggctattacaaccgtcagatct

SEQ ID NO: 304243 - DNA, 25 bp, Rattus norvegicus
gaaggctattactaccgtcagatct

SEQ ID NO: 304244 - DNA, 25 bp, Rattus norvegicus
gaaggctattcactacggaaccagt

SEQ ID NO: 304245 - DNA, 25 bp, Rattus norvegicus
gaaggctattcagtacggaaccagt

SEQ ID NO: 304246 - DNA, 25 bp, Rattus norvegicus
gaaggctcaagtccatagcaaccaa

SEQ ID NO: 304247 - DNA, 25 bp, Rattus norvegicus
gaaggctcaagtgcatagcaaccaa

SEQ ID NO: 304248 - DNA, 25 bp, Rattus norvegicus
gaaggctcaattccctagtatggag

SEQ ID NO: 304249 - DNA, 25 bp, Rattus norvegicus
gaaggctcaattgcctagtatggag

SEQ ID NO: 304250 - DNA, 25 bp, Rattus norvegicus
gaaggctcacagattgatgatcaga

SEQ ID NO: 304251 - DNA, 25 bp, Rattus norvegicus
gaaggctcacagtttgatgatcaga

SEQ ID NO: 304252 - DNA, 25 bp, Rattus norvegicus
gaaggctcaccaatgaggacctact

SEQ ID NO: 304253 - DNA, 25 bp, Rattus norvegicus
gaaggctcaccacgcttggctttgg

SEQ ID NO: 304254 - DNA, 25 bp, Rattus norvegicus
gaaggctcaccaggcttggctttgg

SEQ ID NO: 304255 - DNA, 25 bp, Rattus norvegicus
gaaggctcaccattgaggacctact

SEQ ID NO: 304256 - DNA, 25 bp, Rattus norvegicus
gaaggctcactgattctctggcgag

SEQ ID NO: 304257 - DNA, 25 bp, Rattus norvegicus
gaaggctcactgtttctctggcgag

SEQ ID NO: 304258 - DNA, 25 bp, Rattus norvegicus
gaaggctcacttcgagtctcacatg

SEQ ID NO: 304259 - DNA, 25 bp, Rattus norvegicus
gaaggctcacttggagtctcacatg

SEQ ID NO: 304260 - DNA, 25 bp, Rattus norvegicus
gaaggctcagggaattggtgtcact

SEQ ID NO: 304261 - DNA, 25 bp, Rattus norvegicus
gaaggctcagggtattggtgtcact

SEQ ID NO: 304262 - DNA, 25 bp, Rattus norvegicus
gaaggctcagttaacctagtttgga

SEQ ID NO: 304263 - DNA, 25 bp, Rattus norvegicus
gaaggctcagtttacctagtttgga

SEQ ID NO: 304264 - DNA, 25 bp, Rattus norvegicus
gaaggctcatcgatgggcagttcat

SEQ ID NO: 304265 - DNA, 25 bp, Rattus norvegicus
gaaggctcatcgttgggcagttcat

SEQ ID NO: 304266 - DNA, 25 bp, Rattus norvegicus
gaaggctcattcatgtttttctgca

SEQ ID NO: 304267 - DNA, 25 bp, Rattus norvegicus
gaaggctcattcttgtttttctgca

SEQ ID NO: 304268 - DNA, 25 bp, Rattus norvegicus
gaaggctcatttcgtgtgttttaca

SEQ ID NO: 304269 - DNA, 25 bp, Rattus norvegicus
gaaggctcatttggtgtgttttaca

SEQ ID NO: 304270 - DNA, 25 bp, Rattus norvegicus
gaaggctccaacagcctaggtaagg

SEQ ID NO: 304271 - DNA, 25 bp, Rattus norvegicus
gaaggctccaactgcctaggtaagg

SEQ ID NO: 304272 - DNA, 25 bp, Rattus norvegicus
gaaggctccacaatgtcagtgctca

SEQ ID NO: 304273 - DNA, 25 bp, Rattus norvegicus
gaaggctccacattgtcagtgctca

SEQ ID NO: 304274 - DNA, 25 bp, Rattus norvegicus
gaaggctccaccaggttttgtgtta

SEQ ID NO: 304275 - DNA, 25 bp, Rattus norvegicus
gaaggctccacctggttttgtgtta

SEQ ID NO: 304276 - DNA, 25 bp, Rattus norvegicus
gaaggctccataactgggcagacat

SEQ ID NO: 304277 - DNA, 25 bp, Rattus norvegicus
gaaggctccatatctgggcagacat

SEQ ID NO: 304278 - DNA, 25 bp, Rattus norvegicus
gaaggctccattctagtgaactctc

SEQ ID NO: 304279 - DNA, 25 bp, Rattus norvegicus
gaaggctccattgtagtgaactctc

SEQ ID NO: 304280 - DNA, 25 bp, Rattus norvegicus
gaaggctccccaatctatcttactt

SEQ ID NO: 304281 - DNA, 25 bp, Rattus norvegicus
gaaggctccccattctatcttactt

SEQ ID NO: 304282 - DNA, 25 bp, Rattus norvegicus
gaaggctcccttcgtatagacctgc

SEQ ID NO: 304283 - DNA, 25 bp, Rattus norvegicus
gaaggctcccttggtatagacctgc

SEQ ID NO: 304284 - DNA, 25 bp, Rattus norvegicus
gaaggctcctaacgtcccaggtttg

SEQ ID NO: 304285 - DNA, 25 bp, Rattus norvegicus
gaaggctcctaaggtcccaggtttg

SEQ ID NO: 304286 - DNA, 25 bp, Rattus norvegicus
gaaggctcctgacaacagcacagac

SEQ ID NO: 304287 - DNA, 25 bp, Rattus norvegicus
gaaggctcctgagaacagcacagac

SEQ ID NO: 304288 - DNA, 25 bp, Rattus norvegicus
gaaggctcctgtctatttccaggat

SEQ ID NO: 304289 - DNA, 25 bp, Rattus norvegicus
gaaggctcctgtgtatttccaggat

SEQ ID NO: 304290 - DNA, 25 bp, Rattus norvegicus
gaaggctcgcaacgcccaggagaaa

SEQ ID NO: 304291 - DNA, 25 bp, Rattus norvegicus
gaaggctcgcaaggcccaggagaaa

SEQ ID NO: 304292 - DNA, 25 bp, Rattus norvegicus
gaaggctcgctcagccactggcgag

SEQ ID NO: 304293 - DNA, 25 bp, Rattus norvegicus
gaaggctcgctctgccactggcgag

SEQ ID NO: 304294 - DNA, 25 bp, Rattus norvegicus
gaaggctcggctagtgcaccggctc

SEQ ID NO: 304295 - DNA, 25 bp, Rattus norvegicus
gaaggctcggcttgtgcaccggctc

SEQ ID NO: 304296 - DNA, 25 bp, Rattus norvegicus
gaaggctctatacctgttatcctga

SEQ ID NO: 304297 - DNA, 25 bp, Rattus norvegicus
gaaggctctatagctgttatcctga

SEQ ID NO: 304298 - DNA, 25 bp, Rattus norvegicus
gaaggctctcggattccagcaggaa

SEQ ID NO: 304299 - DNA, 25 bp, Rattus norvegicus
gaaggctctcggtttccagcaggaa

SEQ ID NO: 304300 - DNA, 25 bp, Rattus norvegicus
gaaggctctgcaagcacatttgcat

SEQ ID NO: 304301 - DNA, 25 bp, Rattus norvegicus
gaaggctctgcacaaatagttctct

SEQ ID NO: 304302 - DNA, 25 bp, Rattus norvegicus
gaaggctctgcagaaatagttctct

SEQ ID NO: 304303 - DNA, 25 bp, Rattus norvegicus
gaaggctctgcatgcacatttgcat

SEQ ID NO: 304304 - DNA, 25 bp, Rattus norvegicus
gaaggctctgccaagtggctgattt

SEQ ID NO: 304305 - DNA, 25 bp, Rattus norvegicus
gaaggctctgcctagtggctgattt

SEQ ID NO: 304306 - DNA, 25 bp, Rattus norvegicus
gaaggctctgctcatcagccgggaa

SEQ ID NO: 304307 - DNA, 25 bp, Rattus norvegicus
gaaggctctgctgatcagccgggaa

SEQ ID NO: 304308 - DNA, 25 bp, Rattus norvegicus
gaaggctctggaccgagtgttcaca

SEQ ID NO: 304309 - DNA, 25 bp, Rattus norvegicus
gaaggctctggagcgagtgttcaca

SEQ ID NO: 304310 - DNA, 25 bp, Rattus norvegicus
gaaggctctggcaatgagactccaa

SEQ ID NO: 304311 - DNA, 25 bp, Rattus norvegicus
gaaggctctggctatgagactccaa

SEQ ID NO: 304312 - DNA, 25 bp, Rattus norvegicus
gaaggctctgggaaattcccctgtc

SEQ ID NO: 304313 - DNA, 25 bp, Rattus norvegicus
gaaggctctgggtaattcccctgtc

SEQ ID NO: 304314 - DNA, 25 bp, Rattus norvegicus
gaaggctctgtccaacatgatgcat

SEQ ID NO: 304315 - DNA, 25 bp, Rattus norvegicus
gaaggctctgtcgaacatgatgcat

SEQ ID NO: 304316 - DNA, 25 bp, Rattus norvegicus
gaaggctctgttcatactcacctgt

SEQ ID NO: 304317 - DNA, 25 bp, Rattus norvegicus
gaaggctctgttgatactcacctgt

SEQ ID NO: 304318 - DNA, 25 bp, Rattus norvegicus
gaaggctcttaaaaaacctctcaga

SEQ ID NO: 304319 - DNA, 25 bp, Rattus norvegicus
gaaggctcttaataaacctctcaga

SEQ ID NO: 304320 - DNA, 25 bp, Rattus norvegicus
gaaggctcttatcaccggtatctga

SEQ ID NO: 304321 - DNA, 25 bp, Rattus norvegicus
gaaggctcttatgaccggtatctga

SEQ ID NO: 304322 - DNA, 25 bp, Rattus norvegicus
gaaggctcttgaaaactcatccagg

SEQ ID NO: 304323 - DNA, 25 bp, Rattus norvegicus
gaaggctcttgaaggctctggccct

SEQ ID NO: 304324 - DNA, 25 bp, Rattus norvegicus
gaaggctcttgaatccttgtacaag

SEQ ID NO: 304325 - DNA, 25 bp, Rattus norvegicus
gaaggctcttgataactcatccagg

SEQ ID NO: 304326 - DNA, 25 bp, Rattus norvegicus
gaaggctcttgatggctctggccct

SEQ ID NO: 304327 - DNA, 25 bp, Rattus norvegicus
gaaggctcttgattccttgtacaag

SEQ ID NO: 304328 - DNA, 25 bp, Rattus norvegicus
gaaggctctttcaggcagcatacta

SEQ ID NO: 304329 - DNA, 25 bp, Rattus norvegicus
gaaggctctttctggcagcatacta

SEQ ID NO: 304330 - DNA, 25 bp, Rattus norvegicus
gaaggctgaaaaccaggagaaacct

SEQ ID NO: 304331 - DNA, 25 bp, Rattus norvegicus
gaaggctgaaaagcaggagaaacct

SEQ ID NO: 304332 - DNA, 25 bp, Rattus norvegicus
gaaggctgacagacaagaggctact

SEQ ID NO: 304333 - DNA, 25 bp, Rattus norvegicus
gaaggctgacagtcaagaggctact

SEQ ID NO: 304334 - DNA, 25 bp, Rattus norvegicus
gaaggctgacatactcgtttgttag

SEQ ID NO: 304335 - DNA, 25 bp, Rattus norvegicus
gaaggctgacattctcgtttgttag

SEQ ID NO: 304336 - DNA, 25 bp, Rattus norvegicus
gaaggctgaccgagatgagtcctct

SEQ ID NO: 304337 - DNA, 25 bp, Rattus norvegicus
gaaggctgaccgtgatgagtcctct

SEQ ID NO: 304338 - DNA, 25 bp, Rattus norvegicus
gaaggctgactgcacaatcaccatg

SEQ ID NO: 304339 - DNA, 25 bp, Rattus norvegicus
gaaggctgactggacaatcaccatg

SEQ ID NO: 304340 - DNA, 25 bp, Rattus norvegicus
gaaggctgagccatactgatgggca

SEQ ID NO: 304341 - DNA, 25 bp, Rattus norvegicus
gaaggctgagccttactgatgggca

SEQ ID NO: 304342 - DNA, 25 bp, Rattus norvegicus
gaaggctgaggtaggctcatctctt

SEQ ID NO: 304343 - DNA, 25 bp, Rattus norvegicus
gaaggctgaggttggctcatctctt

SEQ ID NO: 304344 - DNA, 25 bp, Rattus norvegicus
gaaggctgagtcactccatgtagct

SEQ ID NO: 304345 - DNA, 25 bp, Rattus norvegicus
gaaggctgagtctctccatgtagct

SEQ ID NO: 304346 - DNA, 25 bp, Rattus norvegicus
gaaggctgagtgatcaagccctcct

SEQ ID NO: 304347 - DNA, 25 bp, Rattus norvegicus
gaaggctgagtgttcaagccctcct

SEQ ID NO: 304348 - DNA, 25 bp, Rattus norvegicus
gaaggctgagttctgaactggccat

SEQ ID NO: 304349 - DNA, 25 bp, Rattus norvegicus
gaaggctgagttgtgaactggccat

SEQ ID NO: 304350 - DNA, 25 bp, Rattus norvegicus
gaaggctgattcaccccaagagtgg

SEQ ID NO: 304351 - DNA, 25 bp, Rattus norvegicus
gaaggctgattctccccaagagtgg

SEQ ID NO: 304352 - DNA, 25 bp, Rattus norvegicus
gaaggctgcagcaacctttgacttc

SEQ ID NO: 304353 - DNA, 25 bp, Rattus norvegicus
gaaggctgcagctacctttgacttc

SEQ ID NO: 304354 - DNA, 25 bp, Rattus norvegicus
gaaggctgcaggaatcactgagaga

SEQ ID NO: 304355 - DNA, 25 bp, Rattus norvegicus
gaaggctgcaggtatcactgagaga

SEQ ID NO: 304356 - DNA, 25 bp, Rattus norvegicus
gaaggctgcagtaaccagggaatat

SEQ ID NO: 304357 - DNA, 25 bp, Rattus norvegicus
gaaggctgcagttaccagggaatat

SEQ ID NO: 304358 - DNA, 25 bp, Rattus norvegicus
gaaggctgccggacactaattttag

SEQ ID NO: 304359 - DNA, 25 bp, Rattus norvegicus
gaaggctgccggtcactaattttag

SEQ ID NO: 304360 - DNA, 25 bp, Rattus norvegicus
gaaggctgcctgagaacctttataa

SEQ ID NO: 304361 - DNA, 25 bp, Rattus norvegicus
gaaggctgcctgagttcttggcttg

SEQ ID NO: 304362 - DNA, 25 bp, Rattus norvegicus
gaaggctgcctgtgaacctttataa

SEQ ID NO: 304363 - DNA, 25 bp, Rattus norvegicus
gaaggctgcctgtgttcttggcttg

SEQ ID NO: 304364 - DNA, 25 bp, Rattus norvegicus
gaaggctgccttccgttttaacgat

SEQ ID NO: 304365 - DNA, 25 bp, Rattus norvegicus
gaaggctgccttgcgttttaacgat

SEQ ID NO: 304366 - DNA, 25 bp, Rattus norvegicus
gaaggctgctaaaggaagactaact

SEQ ID NO: 304367 - DNA, 25 bp, Rattus norvegicus
gaaggctgctaatggaagactaact

SEQ ID NO: 304368 - DNA, 25 bp, Rattus norvegicus
gaaggctgctcaataaaatccgtca

SEQ ID NO: 304369 - DNA, 25 bp, Rattus norvegicus
gaaggctgctcattaaaatccgtca

SEQ ID NO: 304370 - DNA, 25 bp, Rattus norvegicus
gaaggctgctctagccaatcaagta

SEQ ID NO: 304371 - DNA, 25 bp, Rattus norvegicus
gaaggctgctcttgccaatcaagta

SEQ ID NO: 304372 - DNA, 25 bp, Rattus norvegicus
gaaggctgctgaagtgtgaccacca

SEQ ID NO: 304373 - DNA, 25 bp, Rattus norvegicus
gaaggctgctgatgtgtgaccacca

SEQ ID NO: 304374 - DNA, 25 bp, Rattus norvegicus
gaaggctgcttcagagcacacacag

SEQ ID NO: 304375 - DNA, 25 bp, Rattus norvegicus
gaaggctgcttctgagcacacacag

SEQ ID NO: 304376 - DNA, 25 bp, Rattus norvegicus
gaaggctgctttaaactgttttata

SEQ ID NO: 304377 - DNA, 25 bp, Rattus norvegicus
gaaggctgcttttaactgttttata

SEQ ID NO: 304378 - DNA, 25 bp, Rattus norvegicus
gaaggctggagcatgtttgccacct

SEQ ID NO: 304379 - DNA, 25 bp, Rattus norvegicus
gaaggctggagcttgtttgccacct

SEQ ID NO: 304380 - DNA, 25 bp, Rattus norvegicus
gaaggctggcacatgtttctacagt

SEQ ID NO: 304381 - DNA, 25 bp, Rattus norvegicus
gaaggctggcacttgtttctacagt

SEQ ID NO: 304382 - DNA, 25 bp, Rattus norvegicus
gaaggctggcggacatcagtctgaa

SEQ ID NO: 304383 - DNA, 25 bp, Rattus norvegicus
gaaggctggcggtcatcagtctgaa

SEQ ID NO: 304384 - DNA, 25 bp, Rattus norvegicus
gaaggctggctgatcactgtaacca

SEQ ID NO: 304385 - DNA, 25 bp, Rattus norvegicus
gaaggctggctgttcactgtaacca

SEQ ID NO: 304386 - DNA, 25 bp, Rattus norvegicus
gaaggctggcttagcgggtgatgat

SEQ ID NO: 304387 - DNA, 25 bp, Rattus norvegicus
gaaggctggcttcttcaagcggaat

SEQ ID NO: 304388 - DNA, 25 bp, Rattus norvegicus
gaaggctggcttgttcaagcggaat

SEQ ID NO: 304389 - DNA, 25 bp, Rattus norvegicus
gaaggctggctttgcgggtgatgat

SEQ ID NO: 304390 - DNA, 25 bp, Rattus norvegicus
gaaggctgggttaaatattgcacat

SEQ ID NO: 304391 - DNA, 25 bp, Rattus norvegicus
gaaggctgggttcacgcacgaccat

SEQ ID NO: 304392 - DNA, 25 bp, Rattus norvegicus
gaaggctgggttgacgcacgaccat

SEQ ID NO: 304393 - DNA, 25 bp, Rattus norvegicus
gaaggctgggtttaatattgcacat

SEQ ID NO: 304394 - DNA, 25 bp, Rattus norvegicus
gaaggctgtataaccttgcaaaggt

SEQ ID NO: 304395 - DNA, 25 bp, Rattus norvegicus
gaaggctgtatatccttgcaaaggt

SEQ ID NO: 304396 - DNA, 25 bp, Rattus norvegicus
gaaggctgtcctcacatggattaaa

SEQ ID NO: 304397 - DNA, 25 bp, Rattus norvegicus
gaaggctgtcctgacatggattaaa

SEQ ID NO: 304398 - DNA, 25 bp, Rattus norvegicus
gaaggctgtctgcaacaagaacttg

SEQ ID NO: 304399 - DNA, 25 bp, Rattus norvegicus
gaaggctgtctggaacaagaacttg

SEQ ID NO: 304400 - DNA, 25 bp, Rattus norvegicus
gaaggctgtgaccaaggaggaattc

SEQ ID NO: 304401 - DNA, 25 bp, Rattus norvegicus
gaaggctgtgacgaaggaggaattc

SEQ ID NO: 304402 - DNA, 25 bp, Rattus norvegicus
gaaggctgtggcagctagtgacctc

SEQ ID NO: 304403 - DNA, 25 bp, Rattus norvegicus
gaaggctgtggctgctagtgacctc

SEQ ID NO: 304404 - DNA, 25 bp, Rattus norvegicus
gaaggcttaagccacagcagcaggt

SEQ ID NO: 304405 - DNA, 25 bp, Rattus norvegicus
gaaggcttaagcgacagcagcaggt

SEQ ID NO: 304406 - DNA, 25 bp, Rattus norvegicus
gaaggcttagccacatgtggtttaa

SEQ ID NO: 304407 - DNA, 25 bp, Rattus norvegicus
gaaggcttagcctcatgtggtttaa

SEQ ID NO: 304408 - DNA, 25 bp, Rattus norvegicus
gaaggcttattactcacccgtgtga

SEQ ID NO: 304409 - DNA, 25 bp, Rattus norvegicus
gaaggcttattagtcacccgtgtga

SEQ ID NO: 304410 - DNA, 25 bp, Rattus norvegicus
gaaggcttcaaactaccagggtatc

SEQ ID NO: 304411 - DNA, 25 bp, Rattus norvegicus
gaaggcttcaaagtaccagggtatc

SEQ ID NO: 304412 - DNA, 25 bp, Rattus norvegicus
gaaggcttcaagaactctagacaat

SEQ ID NO: 304413 - DNA, 25 bp, Rattus norvegicus
gaaggcttcaagtactctagacaat

SEQ ID NO: 304414 - DNA, 25 bp, Rattus norvegicus
gaaggcttccagagcatactttatc

SEQ ID NO: 304415 - DNA, 25 bp, Rattus norvegicus
gaaggcttccagtgcatactttatc

SEQ ID NO: 304416 - DNA, 25 bp, Rattus norvegicus
gaaggcttccctctctcacataggt

SEQ ID NO: 304417 - DNA, 25 bp, Rattus norvegicus
gaaggcttccctgtctcacataggt

SEQ ID NO: 304418 - DNA, 25 bp, Rattus norvegicus
gaaggcttcctcatttggatatgtg

SEQ ID NO: 304419 - DNA, 25 bp, Rattus norvegicus
gaaggcttcctcttttggatatgtg

SEQ ID NO: 304420 - DNA, 25 bp, Rattus norvegicus
gaaggcttccttctgtttctcgaag

SEQ ID NO: 304421 - DNA, 25 bp, Rattus norvegicus
gaaggcttccttgtgtttctcgaag

SEQ ID NO: 304422 - DNA, 25 bp, Rattus norvegicus
gaaggcttcgaaaagcagcgtctct

SEQ ID NO: 304423 - DNA, 25 bp, Rattus norvegicus
gaaggcttcgaatagcagcgtctct

SEQ ID NO: 304424 - DNA, 25 bp, Rattus norvegicus
gaaggcttcgcgaaggccccgcagc

SEQ ID NO: 304425 - DNA, 25 bp, Rattus norvegicus
gaaggcttcgcgtaggccccgcagc

SEQ ID NO: 304426 - DNA, 25 bp, Rattus norvegicus
gaaggcttcgggaaggcttcgcgaa

SEQ ID NO: 304427 - DNA, 25 bp, Rattus norvegicus
gaaggcttcgggtaggcttcgcgaa

SEQ ID NO: 304428 - DNA, 25 bp, Rattus norvegicus
gaaggcttctttaaactctattgat

SEQ ID NO: 304429 - DNA, 25 bp, Rattus norvegicus
gaaggcttcttttaactctattgat

SEQ ID NO: 304430 - DNA, 25 bp, Rattus norvegicus
gaaggcttgccacgtatacatccag

SEQ ID NO: 304431 - DNA, 25 bp, Rattus norvegicus
gaaggcttgccaggtatacatccag

SEQ ID NO: 304432 - DNA, 25 bp, Rattus norvegicus
gaaggcttgcctatgaacggtggcc

SEQ ID NO: 304433 - DNA, 25 bp, Rattus norvegicus
gaaggcttgcctttgaacggtggcc

SEQ ID NO: 304434 - DNA, 25 bp, Rattus norvegicus
gaaggcttgcggatttatccaaatt

SEQ ID NO: 304435 - DNA, 25 bp, Rattus norvegicus
gaaggcttgcggttttatccaaatt

SEQ ID NO: 304436 - DNA, 25 bp, Rattus norvegicus
gaaggcttgctcactttcctagaat

SEQ ID NO: 304437 - DNA, 25 bp, Rattus norvegicus
gaaggcttgctctctttcctagaat

SEQ ID NO: 304438 - DNA, 25 bp, Rattus norvegicus
gaaggcttgggcaacttactgggct

SEQ ID NO: 304439 - DNA, 25 bp, Rattus norvegicus
gaaggcttgggcagtcagactcata

SEQ ID NO: 304440 - DNA, 25 bp, Rattus norvegicus
gaaggcttgggctacttactgggct

SEQ ID NO: 304441 - DNA, 25 bp, Rattus norvegicus
gaaggcttgggctgtcagactcata

SEQ ID NO: 304442 - DNA, 25 bp, Rattus norvegicus
gaaggcttggttctccgctgtatcc

SEQ ID NO: 304443 - DNA, 25 bp, Rattus norvegicus
gaaggcttggttgtccgctgtatcc

SEQ ID NO: 304444 - DNA, 25 bp, Rattus norvegicus
gaaggctttaatctccgcagggatg

SEQ ID NO: 304445 - DNA, 25 bp, Rattus norvegicus
gaaggctttaatgtccgcagggatg

SEQ ID NO: 304446 - DNA, 25 bp, Rattus norvegicus
gaaggctttcaaatgctttccagaa

SEQ ID NO: 304447 - DNA, 25 bp, Rattus norvegicus
gaaggctttcaattgctttccagaa

SEQ ID NO: 304448 - DNA, 25 bp, Rattus norvegicus
gaaggctttcagcttgtttgatgat

SEQ ID NO: 304449 - DNA, 25 bp, Rattus norvegicus
gaaggctttcaggttgtttgatgat

SEQ ID NO: 304450 - DNA, 25 bp, Rattus norvegicus
gaaggctttcatcatccttgtccag

SEQ ID NO: 304451 - DNA, 25 bp, Rattus norvegicus
gaaggctttcatgatccttgtccag

SEQ ID NO: 304452 - DNA, 25 bp, Rattus norvegicus
gaaggctttcccaaaggaaccatag

SEQ ID NO: 304453 - DNA, 25 bp, Rattus norvegicus
gaaggctttccctaaggaaccatag

SEQ ID NO: 304454 - DNA, 25 bp, Rattus norvegicus
gaaggctttgtcattcttcgaaaga

SEQ ID NO: 304455 - DNA, 25 bp, Rattus norvegicus
gaaggctttgtctttcttcgaaaga

SEQ ID NO: 304456 - DNA, 25 bp, Rattus norvegicus
gaaggctttgtgatacctgacgagg

SEQ ID NO: 304457 - DNA, 25 bp, Rattus norvegicus
gaaggctttgtgttacctgacgagg

SEQ ID NO: 304458 - DNA, 25 bp, Rattus norvegicus
gaaggcttttatcttccctctctga

SEQ ID NO: 304459 - DNA, 25 bp, Rattus norvegicus
gaaggcttttatgttccctctctga

SEQ ID NO: 304460 - DNA, 25 bp, Rattus norvegicus
gaaggcttttggacttttgtctcat

SEQ ID NO: 304461 - DNA, 25 bp, Rattus norvegicus
gaaggcttttggcatccgctttgat

SEQ ID NO: 304462 - DNA, 25 bp, Rattus norvegicus
gaaggcttttgggatccgctttgat

SEQ ID NO: 304463 - DNA, 25 bp, Rattus norvegicus
gaaggcttttggtcttttgtctcat

SEQ ID NO: 304464 - DNA, 25 bp, Rattus norvegicus
gaaggcttttgtaattgtgtttgta

SEQ ID NO: 304465 - DNA, 25 bp, Rattus norvegicus
gaaggcttttgttattgtgtttgta

SEQ ID NO: 304466 - DNA, 25 bp, Rattus norvegicus
gaagggaaagctcacttcagaggcc

SEQ ID NO: 304467 - DNA, 25 bp, Rattus norvegicus
gaagggaaagctgacttcagaggcc

SEQ ID NO: 304468 - DNA, 25 bp, Rattus norvegicus
gaagggaaattgctgcctctggttc

SEQ ID NO: 304469 - DNA, 25 bp, Rattus norvegicus
gaagggaaattggtgcctctggttc

SEQ ID NO: 304470 - DNA, 25 bp, Rattus norvegicus
gaagggaacagtagcttgcggccaa

SEQ ID NO: 304471 - DNA, 25 bp, Rattus norvegicus
gaagggaacagttgcttgcggccaa

SEQ ID NO: 304472 - DNA, 25 bp, Rattus norvegicus
gaagggaaccagctttagctctttt

SEQ ID NO: 304473 - DNA, 25 bp, Rattus norvegicus
gaagggaaccaggtttagctctttt

SEQ ID NO: 304474 - DNA, 25 bp, Rattus norvegicus
gaagggaacctcagggatctcgctg

SEQ ID NO: 304475 - DNA, 25 bp, Rattus norvegicus
gaagggaacctctgggatctcgctg

SEQ ID NO: 304476 - DNA, 25 bp, Rattus norvegicus
gaagggaaggtcactgcctgtcagc

SEQ ID NO: 304477 - DNA, 25 bp, Rattus norvegicus
gaagggaaggtctctgcctgtcagc

SEQ ID NO: 304478 - DNA, 25 bp, Rattus norvegicus
gaagggaagtggcttcatctctccc

SEQ ID NO: 304479 - DNA, 25 bp, Rattus norvegicus
gaagggaagtgggttcatctctccc

SEQ ID NO: 304480 - DNA, 25 bp, Rattus norvegicus
gaagggaatctcaaccttgtaaaat

SEQ ID NO: 304481 - DNA, 25 bp, Rattus norvegicus
gaagggaatctccatggtttcaagt

SEQ ID NO: 304482 - DNA, 25 bp, Rattus norvegicus
gaagggaatctcgatggtttcaagt

SEQ ID NO: 304483 - DNA, 25 bp, Rattus norvegicus
gaagggaatctctaccttgtaaaat

SEQ ID NO: 304484 - DNA, 25 bp, Rattus norvegicus
gaagggacacctcagtccctgatca

SEQ ID NO: 304485 - DNA, 25 bp, Rattus norvegicus
gaagggacacctgagtccctgatca

SEQ ID NO: 304486 - DNA, 25 bp, Rattus norvegicus
gaagggacactactgagaccacact

SEQ ID NO: 304487 - DNA, 25 bp, Rattus norvegicus
gaagggacactagtgagaccacact

SEQ ID NO: 304488 - DNA, 25 bp, Rattus norvegicus
gaagggacagacaactccagacact

SEQ ID NO: 304489 - DNA, 25 bp, Rattus norvegicus
gaagggacagactactccagacact

SEQ ID NO: 304490 - DNA, 25 bp, Rattus norvegicus
gaagggacaggcagctctttcctca

SEQ ID NO: 304491 - DNA, 25 bp, Rattus norvegicus
gaagggacaggctgctctttcctca

SEQ ID NO: 304492 - DNA, 25 bp, Rattus norvegicus
gaagggacagttccaacccatctag

SEQ ID NO: 304493 - DNA, 25 bp, Rattus norvegicus
gaagggacagttgcaacccatctag

SEQ ID NO: 304494 - DNA, 25 bp, Rattus norvegicus
gaagggacatctcccatgtgagaga

SEQ ID NO: 304495 - DNA, 25 bp, Rattus norvegicus
gaagggacatctgccatgtgagaga

SEQ ID NO: 304496 - DNA, 25 bp, Rattus norvegicus
gaagggaccaagctgcagacacaca

SEQ ID NO: 304497 - DNA, 25 bp, Rattus norvegicus
gaagggaccaaggtgcagacacaca

SEQ ID NO: 304498 - DNA, 25 bp, Rattus norvegicus
gaagggaccccaagagcatagagca

SEQ ID NO: 304499 - DNA, 25 bp, Rattus norvegicus
gaagggaccccatgagcatagagca

SEQ ID NO: 304500 - DNA, 25 bp, Rattus norvegicus
gaagggaccccgatgctcagagctc

SEQ ID NO: 304501 - DNA, 25 bp, Rattus norvegicus
gaagggaccccgttgctcagagctc

SEQ ID NO: 304502 - DNA, 25 bp, Rattus norvegicus
gaagggaccggtcgcagcatccctc

SEQ ID NO: 304503 - DNA, 25 bp, Rattus norvegicus
gaagggaccggtggcagcatccctc

SEQ ID NO: 304504 - DNA, 25 bp, Rattus norvegicus
gaagggacctaaccctctcatgaga

SEQ ID NO: 304505 - DNA, 25 bp, Rattus norvegicus
gaagggacctaagcctctcatgaga

SEQ ID NO: 304506 - DNA, 25 bp, Rattus norvegicus
gaagggacctttaccagtgatgtga

SEQ ID NO: 304507 - DNA, 25 bp, Rattus norvegicus
gaagggaccttttccagtgatgtga

SEQ ID NO: 304508 - DNA, 25 bp, Rattus norvegicus
gaagggacgcccaagttgtcggaca

SEQ ID NO: 304509 - DNA, 25 bp, Rattus norvegicus
gaagggacgccctagttgtcggaca

SEQ ID NO: 304510 - DNA, 25 bp, Rattus norvegicus
gaagggactctgatgtcaccggcag

SEQ ID NO: 304511 - DNA, 25 bp, Rattus norvegicus
gaagggactctgttgtcaccggcag

SEQ ID NO: 304512 - DNA, 25 bp, Rattus norvegicus
gaagggactcttccaattatcctgc

SEQ ID NO: 304513 - DNA, 25 bp, Rattus norvegicus
gaagggactcttgcaattatcctgc

SEQ ID NO: 304514 - DNA, 25 bp, Rattus norvegicus
gaagggactgacaactagactgtaa

SEQ ID NO: 304515 - DNA, 25 bp, Rattus norvegicus
gaagggactgactactagactgtaa

SEQ ID NO: 304516 - DNA, 25 bp, Rattus norvegicus
gaagggacttcaacttcctgtaact

SEQ ID NO: 304517 - DNA, 25 bp, Rattus norvegicus
gaagggacttcatcttcctgtaact

SEQ ID NO: 304518 - DNA, 25 bp, Rattus norvegicus
gaagggagaaccacctttctcttgt

SEQ ID NO: 304519 - DNA, 25 bp, Rattus norvegicus
gaagggagaacctcctttctcttgt

SEQ ID NO: 304520 - DNA, 25 bp, Rattus norvegicus
gaagggagaactatgcctcgggcca

SEQ ID NO: 304521 - DNA, 25 bp, Rattus norvegicus
gaagggagaactccatctctgctgt

SEQ ID NO: 304522 - DNA, 25 bp, Rattus norvegicus
gaagggagaactgcatctctgctgt

SEQ ID NO: 304523 - DNA, 25 bp, Rattus norvegicus
gaagggagaactttgcctcgggcca

SEQ ID NO: 304524 - DNA, 25 bp, Rattus norvegicus
gaagggagacttagacaggtctaaa

SEQ ID NO: 304525 - DNA, 25 bp, Rattus norvegicus
gaagggagactttgacaggtctaaa

SEQ ID NO: 304526 - DNA, 25 bp, Rattus norvegicus
gaagggagcagccactgatttcctt

SEQ ID NO: 304527 - DNA, 25 bp, Rattus norvegicus
gaagggagcagcgactgatttcctt

SEQ ID NO: 304528 - DNA, 25 bp, Rattus norvegicus
gaagggagcagtcatcagaacaaga

SEQ ID NO: 304529 - DNA, 25 bp, Rattus norvegicus
gaagggagcagtgatcagaacaaga

SEQ ID NO: 304530 - DNA, 25 bp, Rattus norvegicus
gaagggagcctaattagcaagccac

SEQ ID NO: 304531 - DNA, 25 bp, Rattus norvegicus
gaagggagcctatttagcaagccac

SEQ ID NO: 304532 - DNA, 25 bp, Rattus norvegicus
gaagggagcctcacagattccagac

SEQ ID NO: 304533 - DNA, 25 bp, Rattus norvegicus
gaagggagcctctcagattccagac

SEQ ID NO: 304534 - DNA, 25 bp, Rattus norvegicus
gaagggagccttacagaggcaccca

SEQ ID NO: 304535 - DNA, 25 bp, Rattus norvegicus
gaagggagcctttcagaggcaccca

SEQ ID NO: 304536 - DNA, 25 bp, Rattus norvegicus
gaagggagctgtaccttaccgagct

SEQ ID NO: 304537 - DNA, 25 bp, Rattus norvegicus
gaagggagctgttccttaccgagct

SEQ ID NO: 304538 - DNA, 25 bp, Rattus norvegicus
gaagggagggagacccttgctccac

SEQ ID NO: 304539 - DNA, 25 bp, Rattus norvegicus
gaagggagggagtcccttgctccac

SEQ ID NO: 304540 - DNA, 25 bp, Rattus norvegicus
gaagggagtttgaccccaaatgctt

SEQ ID NO: 304541 - DNA, 25 bp, Rattus norvegicus
gaagggagtttgtccccaaatgctt

SEQ ID NO: 304542 - DNA, 25 bp, Rattus norvegicus
gaagggatattgatatatctgcatg

SEQ ID NO: 304543 - DNA, 25 bp, Rattus norvegicus
gaagggatattgttatatctgcatg

SEQ ID NO: 304544 - DNA, 25 bp, Rattus norvegicus
gaagggatcactaaccctccagtgt

SEQ ID NO: 304545 - DNA, 25 bp, Rattus norvegicus
gaagggatcacttaccctccagtgt

SEQ ID NO: 304546 - DNA, 25 bp, Rattus norvegicus
gaagggatcagaaaccaccatagct

SEQ ID NO: 304547 - DNA, 25 bp, Rattus norvegicus
gaagggatcagataccaccatagct

SEQ ID NO: 304548 - DNA, 25 bp, Rattus norvegicus
gaagggatcatccacacgctcattg

SEQ ID NO: 304549 - DNA, 25 bp, Rattus norvegicus
gaagggatcatcgacacgctcattg

SEQ ID NO: 304550 - DNA, 25 bp, Rattus norvegicus
gaagggatcctacccacgcctgaag

SEQ ID NO: 304551 - DNA, 25 bp, Rattus norvegicus
gaagggatcctagccacgcctgaag

SEQ ID NO: 304552 - DNA, 25 bp, Rattus norvegicus
gaagggatcggaaacctgtctcggt

SEQ ID NO: 304553 - DNA, 25 bp, Rattus norvegicus
gaagggatcggatacctgtctcggt

SEQ ID NO: 304554 - DNA, 25 bp, Rattus norvegicus
gaagggatcgtgctactccatgaga

SEQ ID NO: 304555 - DNA, 25 bp, Rattus norvegicus
gaagggatcgtggtactccatgaga

SEQ ID NO: 304556 - DNA, 25 bp, Rattus norvegicus
gaagggatctgtatgcccatctggc

SEQ ID NO: 304557 - DNA, 25 bp, Rattus norvegicus
gaagggatctgtttgcccatctggc

SEQ ID NO: 304558 - DNA, 25 bp, Rattus norvegicus
gaagggatgcagagacctgcccatc

SEQ ID NO: 304559 - DNA, 25 bp, Rattus norvegicus
gaagggatgcagtgacctgcccatc

SEQ ID NO: 304560 - DNA, 25 bp, Rattus norvegicus
gaagggatgggcatgtttttcaccg

SEQ ID NO: 304561 - DNA, 25 bp, Rattus norvegicus
gaagggatgggcttgtttttcaccg

SEQ ID NO: 304562 - DNA, 25 bp, Rattus norvegicus
gaagggatgtagctctgcttttatt

SEQ ID NO: 304563 - DNA, 25 bp, Rattus norvegicus
gaagggatgtaggtctgcttttatt

SEQ ID NO: 304564 - DNA, 25 bp, Rattus norvegicus
gaagggatgtgcatctgcttgtgaa

SEQ ID NO: 304565 - DNA, 25 bp, Rattus norvegicus
gaagggatgtgcttctgcttgtgaa

SEQ ID NO: 304566 - DNA, 25 bp, Rattus norvegicus
gaagggattttgatacaccgtgtat

SEQ ID NO: 304567 - DNA, 25 bp, Rattus norvegicus
gaagggattttgttacaccgtgtat

SEQ ID NO: 304568 - DNA, 25 bp, Rattus norvegicus
gaagggcaacaccatgcagcagttc

SEQ ID NO: 304569 - DNA, 25 bp, Rattus norvegicus
gaagggcaacacgatgcagcagttc

SEQ ID NO: 304570 - DNA, 25 bp, Rattus norvegicus
gaagggcaacatcgtttttgctgaa

SEQ ID NO: 304571 - DNA, 25 bp, Rattus norvegicus
gaagggcaacatggtttttgctgaa

SEQ ID NO: 304572 - DNA, 25 bp, Rattus norvegicus
gaagggcaagtcctccatcttcaga

SEQ ID NO: 304573 - DNA, 25 bp, Rattus norvegicus
gaagggcaagtcgtccatcttcaga

SEQ ID NO: 304574 - DNA, 25 bp, Rattus norvegicus
gaagggcaagtgatactcgatgaca

SEQ ID NO: 304575 - DNA, 25 bp, Rattus norvegicus
gaagggcaagtgttactcgatgaca

SEQ ID NO: 304576 - DNA, 25 bp, Rattus norvegicus
gaagggcacagaactcaaaggtttt

SEQ ID NO: 304577 - DNA, 25 bp, Rattus norvegicus
gaagggcacagatctcaaaggtttt

SEQ ID NO: 304578 - DNA, 25 bp, Rattus norvegicus
gaagggcacagtagcatcctcacaa

SEQ ID NO: 304579 - DNA, 25 bp, Rattus norvegicus
gaagggcacagtcaccatgttcaga

SEQ ID NO: 304580 - DNA, 25 bp, Rattus norvegicus
gaagggcacagtgaccatgttcaga

SEQ ID NO: 304581 - DNA, 25 bp, Rattus norvegicus
gaagggcacagttgcatcctcacaa

SEQ ID NO: 304582 - DNA, 25 bp, Rattus norvegicus
gaagggcactgaagactccatgacc

SEQ ID NO: 304583 - DNA, 25 bp, Rattus norvegicus
gaagggcactgatgactccatgacc

SEQ ID NO: 304584 - DNA, 25 bp, Rattus norvegicus
gaagggcagaaacgaactgggctat

SEQ ID NO: 304585 - DNA, 25 bp, Rattus norvegicus
gaagggcagaaaggaactgggctat

SEQ ID NO: 304586 - DNA, 25 bp, Rattus norvegicus
gaagggcagacaattttagacatat

SEQ ID NO: 304587 - DNA, 25 bp, Rattus norvegicus
gaagggcagacatttttagacatat

SEQ ID NO: 304588 - DNA, 25 bp, Rattus norvegicus
gaagggcagagcaaaagccacaaca

SEQ ID NO: 304589 - DNA, 25 bp, Rattus norvegicus
gaagggcagagctaaagccacaaca

SEQ ID NO: 304590 - DNA, 25 bp, Rattus norvegicus
gaagggcagctccaagtatcccaat

SEQ ID NO: 304591 - DNA, 25 bp, Rattus norvegicus
gaagggcagctcgaagtatcccaat

SEQ ID NO: 304592 - DNA, 25 bp, Rattus norvegicus
gaagggcagggtccatctcaaagca

SEQ ID NO: 304593 - DNA, 25 bp, Rattus norvegicus
gaagggcagggtgcatctcaaagca

SEQ ID NO: 304594 - DNA, 25 bp, Rattus norvegicus
gaagggcaggtgacaaccttccact

SEQ ID NO: 304595 - DNA, 25 bp, Rattus norvegicus
gaagggcaggtgtcaaccttccact

SEQ ID NO: 304596 - DNA, 25 bp, Rattus norvegicus
gaagggcagtacagctctactcggc

SEQ ID NO: 304597 - DNA, 25 bp, Rattus norvegicus
gaagggcagtactgctctactcggc

SEQ ID NO: 304598 - DNA, 25 bp, Rattus norvegicus
gaagggcagtgcagactggctcaaa

SEQ ID NO: 304599 - DNA, 25 bp, Rattus norvegicus
gaagggcagtgcctggaacccaccc

SEQ ID NO: 304600 - DNA, 25 bp, Rattus norvegicus
gaagggcagtgcgtggaacccaccc

SEQ ID NO: 304601 - DNA, 25 bp, Rattus norvegicus
gaagggcagtgctgactggctcaaa

SEQ ID NO: 304602 - DNA, 25 bp, Rattus norvegicus
gaagggcataggctgcaccatcgat

SEQ ID NO: 304603 - DNA, 25 bp, Rattus norvegicus
gaagggcatagggtgcaccatcgat

SEQ ID NO: 304604 - DNA, 25 bp, Rattus norvegicus
gaagggcatcacaagcgacggctgt

SEQ ID NO: 304605 - DNA, 25 bp, Rattus norvegicus
gaagggcatcactagcgacggctgt

SEQ ID NO: 304606 - DNA, 25 bp, Rattus norvegicus
gaagggcatctaacatctggcctct

SEQ ID NO: 304607 - DNA, 25 bp, Rattus norvegicus
gaagggcatctaactatccagtaac

SEQ ID NO: 304608 - DNA, 25 bp, Rattus norvegicus
gaagggcatctatcatctggcctct

SEQ ID NO: 304609 - DNA, 25 bp, Rattus norvegicus
gaagggcatctatctatccagtaac

SEQ ID NO: 304610 - DNA, 25 bp, Rattus norvegicus
gaagggccacagcaagttatttgct

SEQ ID NO: 304611 - DNA, 25 bp, Rattus norvegicus
gaagggccacaggaagttatttgct

SEQ ID NO: 304612 - DNA, 25 bp, Rattus norvegicus
gaagggccaggcagcaaccacatgc

SEQ ID NO: 304613 - DNA, 25 bp, Rattus norvegicus
gaagggccaggctgcaaccacatgc

SEQ ID NO: 304614 - DNA, 25 bp, Rattus norvegicus
gaagggccagttaacttcctcacat

SEQ ID NO: 304615 - DNA, 25 bp, Rattus norvegicus
gaagggccagtttacttcctcacat

SEQ ID NO: 304616 - DNA, 25 bp, Rattus norvegicus
gaagggccatgtattaaatttgcaa

SEQ ID NO: 304617 - DNA, 25 bp, Rattus norvegicus
gaagggccatgttttaaatttgcaa

SEQ ID NO: 304618 - DNA, 25 bp, Rattus norvegicus
gaagggccattgaattccctgagct

SEQ ID NO: 304619 - DNA, 25 bp, Rattus norvegicus
gaagggccattgtattccctgagct

SEQ ID NO: 304620 - DNA, 25 bp, Rattus norvegicus
gaagggccctttatggactagccag

SEQ ID NO: 304621 - DNA, 25 bp, Rattus norvegicus
gaagggccctttttggactagccag

SEQ ID NO: 304622 - DNA, 25 bp, Rattus norvegicus
gaagggccgactccacctccaggaa

SEQ ID NO: 304623 - DNA, 25 bp, Rattus norvegicus
gaagggccgactgcacctccaggaa

SEQ ID NO: 304624 - DNA, 25 bp, Rattus norvegicus
gaagggccgggaatccttactcagc

SEQ ID NO: 304625 - DNA, 25 bp, Rattus norvegicus
gaagggccgggattccttactcagc

SEQ ID NO: 304626 - DNA, 25 bp, Rattus norvegicus
gaagggccgttcataagctgatgtt

SEQ ID NO: 304627 - DNA, 25 bp, Rattus norvegicus
gaagggccgttcttaagctgatgtt

SEQ ID NO: 304628 - DNA, 25 bp, Rattus norvegicus
gaagggcctctgaccttagtgacaa

SEQ ID NO: 304629 - DNA, 25 bp, Rattus norvegicus
gaagggcctctgtccttagtgacaa

SEQ ID NO: 304630 - DNA, 25 bp, Rattus norvegicus
gaagggcctgagatcctgaagaccc

SEQ ID NO: 304631 - DNA, 25 bp, Rattus norvegicus
gaagggcctgagttcctgaagaccc

SEQ ID NO: 304632 - DNA, 25 bp, Rattus norvegicus
gaagggcctgccagaggcaacactt

SEQ ID NO: 304633 - DNA, 25 bp, Rattus norvegicus
gaagggcctgcctgaggcaacactt

SEQ ID NO: 304634 - DNA, 25 bp, Rattus norvegicus
gaagggcctgggattttgctagtta

SEQ ID NO: 304635 - DNA, 25 bp, Rattus norvegicus
gaagggcctgggtttttgctagtta

SEQ ID NO: 304636 - DNA, 25 bp, Rattus norvegicus
gaagggccttgtagtgtcagactcc

SEQ ID NO: 304637 - DNA, 25 bp, Rattus norvegicus
gaagggccttgttgtgtcagactcc

SEQ ID NO: 304638 - DNA, 25 bp, Rattus norvegicus
gaagggcgcataaggaacggctctc

SEQ ID NO: 304639 - DNA, 25 bp, Rattus norvegicus
gaagggcgcatatggaacggctctc

SEQ ID NO: 304640 - DNA, 25 bp, Rattus norvegicus
gaagggcgcatcactccagagctgc

SEQ ID NO: 304641 - DNA, 25 bp, Rattus norvegicus
gaagggcgcatctctccagagctgc

SEQ ID NO: 304642 - DNA, 25 bp, Rattus norvegicus
gaagggcgcccacacatgaaaacag

SEQ ID NO: 304643 - DNA, 25 bp, Rattus norvegicus
gaagggcgcccagacatgaaaacag

SEQ ID NO: 304644 - DNA, 25 bp, Rattus norvegicus
gaagggcgcctcaagagcagtctgt

SEQ ID NO: 304645 - DNA, 25 bp, Rattus norvegicus
gaagggcgcctctagagcagtctgt

SEQ ID NO: 304646 - DNA, 25 bp, Rattus norvegicus
gaagggcgtgctacacaagcatcag

SEQ ID NO: 304647 - DNA, 25 bp, Rattus norvegicus
gaagggcgtgcttcacaagcatcag

SEQ ID NO: 304648 - DNA, 25 bp, Rattus norvegicus
gaagggcgtgttccacaagcaccag

SEQ ID NO: 304649 - DNA, 25 bp, Rattus norvegicus
gaagggcgtgttgcacaagcaccag

SEQ ID NO: 304650 - DNA, 25 bp, Rattus norvegicus
gaagggctaacgattaacatggaga

SEQ ID NO: 304651 - DNA, 25 bp, Rattus norvegicus
gaagggctaacgtttaacatggaga

SEQ ID NO: 304652 - DNA, 25 bp, Rattus norvegicus
gaagggctacagaccaaaattgttg

SEQ ID NO: 304653 - DNA, 25 bp, Rattus norvegicus
gaagggctacagtccaaaattgttg

SEQ ID NO: 304654 - DNA, 25 bp, Rattus norvegicus
gaagggctaccacagcgatcacttt

SEQ ID NO: 304655 - DNA, 25 bp, Rattus norvegicus
gaagggctaccagagcgatcacttt

SEQ ID NO: 304656 - DNA, 25 bp, Rattus norvegicus
gaagggctagagacctattttcctt

SEQ ID NO: 304657 - DNA, 25 bp, Rattus norvegicus
gaagggctagagtcctattttcctt

SEQ ID NO: 304658 - DNA, 25 bp, Rattus norvegicus
gaagggctagctcatgttctgccaa

SEQ ID NO: 304659 - DNA, 25 bp, Rattus norvegicus
gaagggctagctgatgttctgccaa

SEQ ID NO: 304660 - DNA, 25 bp, Rattus norvegicus
gaagggctcaaaagactaagtacct

SEQ ID NO: 304661 - DNA, 25 bp, Rattus norvegicus
gaagggctcaaatgactaagtacct

SEQ ID NO: 304662 - DNA, 25 bp, Rattus norvegicus
gaagggctcacaaagctcactctgt

SEQ ID NO: 304663 - DNA, 25 bp, Rattus norvegicus
gaagggctcacaccagatgatgtcc

SEQ ID NO: 304664 - DNA, 25 bp, Rattus norvegicus
gaagggctcacagcagatgatgtcc

SEQ ID NO: 304665 - DNA, 25 bp, Rattus norvegicus
gaagggctcacatagctcactctgt

SEQ ID NO: 304666 - DNA, 25 bp, Rattus norvegicus
gaagggctcaggcttgcacagcaaa

SEQ ID NO: 304667 - DNA, 25 bp, Rattus norvegicus
gaagggctcagggttgcacagcaaa

SEQ ID NO: 304668 - DNA, 25 bp, Rattus norvegicus
gaagggctcatgagttcatagcagc

SEQ ID NO: 304669 - DNA, 25 bp, Rattus norvegicus
gaagggctcatgtgttcatagcagc

SEQ ID NO: 304670 - DNA, 25 bp, Rattus norvegicus
gaagggctccacagttgttatatgt

SEQ ID NO: 304671 - DNA, 25 bp, Rattus norvegicus
gaagggctccactgttgttatatgt

SEQ ID NO: 304672 - DNA, 25 bp, Rattus norvegicus
gaagggctccatccagctatacata

SEQ ID NO: 304673 - DNA, 25 bp, Rattus norvegicus
gaagggctccatgcagctatacata

SEQ ID NO: 304674 - DNA, 25 bp, Rattus norvegicus
gaagggctcttgagggttattgaat

SEQ ID NO: 304675 - DNA, 25 bp, Rattus norvegicus
gaagggctcttgtgggttattgaat

SEQ ID NO: 304676 - DNA, 25 bp, Rattus norvegicus
gaagggctgactacgaaacaccacc

SEQ ID NO: 304677 - DNA, 25 bp, Rattus norvegicus
gaagggctgacttcgaaacaccacc

SEQ ID NO: 304678 - DNA, 25 bp, Rattus norvegicus
gaagggctgatgcttttccaattct

SEQ ID NO: 304679 - DNA, 25 bp, Rattus norvegicus
gaagggctgatggttttccaattct

SEQ ID NO: 304680 - DNA, 25 bp, Rattus norvegicus
gaagggctgcagacaacaactccac

SEQ ID NO: 304681 - DNA, 25 bp, Rattus norvegicus
gaagggctgcagtcaacaactccac

SEQ ID NO: 304682 - DNA, 25 bp, Rattus norvegicus
gaagggctgttcatttactaagcac

SEQ ID NO: 304683 - DNA, 25 bp, Rattus norvegicus
gaagggctgttcttttactaagcac

SEQ ID NO: 304684 - DNA, 25 bp, Rattus norvegicus
gaagggcttattctatacgtctgaa

SEQ ID NO: 304685 - DNA, 25 bp, Rattus norvegicus
gaagggcttattgtatacgtctgaa

SEQ ID NO: 304686 - DNA, 25 bp, Rattus norvegicus
gaagggcttgatatcagtcattcat

SEQ ID NO: 304687 - DNA, 25 bp, Rattus norvegicus
gaagggcttgatttcagtcattcat

SEQ ID NO: 304688 - DNA, 25 bp, Rattus norvegicus
gaagggcttggcagttctgtttttt

SEQ ID NO: 304689 - DNA, 25 bp, Rattus norvegicus
gaagggcttggctgttctgtttttt

SEQ ID NO: 304690 - DNA, 25 bp, Rattus norvegicus
gaagggcttgtccaaaggctgcttt

SEQ ID NO: 304691 - DNA, 25 bp, Rattus norvegicus
gaagggcttgtcgaaaggctgcttt

SEQ ID NO: 304692 - DNA, 25 bp, Rattus norvegicus
gaagggctttgtaactcgaaaaatg

SEQ ID NO: 304693 - DNA, 25 bp, Rattus norvegicus
gaagggctttgttactcgaaaaatg

SEQ ID NO: 304694 - DNA, 25 bp, Rattus norvegicus
gaagggcttttccagcatgttggaa

SEQ ID NO: 304695 - DNA, 25 bp, Rattus norvegicus
gaagggcttttcgagcatgttggaa

SEQ ID NO: 304696 - DNA, 25 bp, Rattus norvegicus
gaaggggttccacaaagctccactc

SEQ ID NO: 304697 - DNA, 25 bp, Rattus norvegicus
gaaggggttccagaaagctccactc

SEQ ID NO: 304698 - DNA, 25 bp, Rattus norvegicus
gaagggtaacacacatttggctcca

SEQ ID NO: 304699 - DNA, 25 bp, Rattus norvegicus
gaagggtaacactcatttggctcca

SEQ ID NO: 304700 - DNA, 25 bp, Rattus norvegicus
gaagggtaccgtatgtttgctcagt

SEQ ID NO: 304701 - DNA, 25 bp, Rattus norvegicus
gaagggtaccgtttgtttgctcagt

SEQ ID NO: 304702 - DNA, 25 bp, Rattus norvegicus
gaagggtacctgcttcgactatctc

SEQ ID NO: 304703 - DNA, 25 bp, Rattus norvegicus
gaagggtacctggttcgactatctc

SEQ ID NO: 304704 - DNA, 25 bp, Rattus norvegicus
gaagggtagagaacacctctcccat

SEQ ID NO: 304705 - DNA, 25 bp, Rattus norvegicus
gaagggtagagatcacctctcccat

SEQ ID NO: 304706 - DNA, 25 bp, Rattus norvegicus
gaagggtagcatagtttgcacacac

SEQ ID NO: 304707 - DNA, 25 bp, Rattus norvegicus
gaagggtagcattgtttgcacacac

SEQ ID NO: 304708 - DNA, 25 bp, Rattus norvegicus
gaagggtaggcacctcaaccccgag

SEQ ID NO: 304709 - DNA, 25 bp, Rattus norvegicus
gaagggtaggcagctcaaccccgag

SEQ ID NO: 304710 - DNA, 25 bp, Rattus norvegicus
gaagggtattcccaggtactgagaa

SEQ ID NO: 304711 - DNA, 25 bp, Rattus norvegicus
gaagggtattccgaggtactgagaa

SEQ ID NO: 304712 - DNA, 25 bp, Rattus norvegicus
gaagggtattctcggtttcccacag

SEQ ID NO: 304713 - DNA, 25 bp, Rattus norvegicus
gaagggtattctgggtttcccacag

SEQ ID NO: 304714 - DNA, 25 bp, Rattus norvegicus
gaagggtcaacacacttgacatttt

SEQ ID NO: 304715 - DNA, 25 bp, Rattus norvegicus
gaagggtcaacagacttgacatttt

SEQ ID NO: 304716 - DNA, 25 bp, Rattus norvegicus
gaagggtcacttcatggtccctcat

SEQ ID NO: 304717 - DNA, 25 bp, Rattus norvegicus
gaagggtcacttgatggtccctcat

SEQ ID NO: 304718 - DNA, 25 bp, Rattus norvegicus
gaagggtcaggcctttctgcacttg

SEQ ID NO: 304719 - DNA, 25 bp, Rattus norvegicus
gaagggtcaggcgtttctgcacttg

SEQ ID NO: 304720 - DNA, 25 bp, Rattus norvegicus
gaagggtccaaaagactcttgtcta

SEQ ID NO: 304721 - DNA, 25 bp, Rattus norvegicus
gaagggtccaaatgactcttgtcta

SEQ ID NO: 304722 - DNA, 25 bp, Rattus norvegicus
gaagggtccactcccagagacagat

SEQ ID NO: 304723 - DNA, 25 bp, Rattus norvegicus
gaagggtccactgccagagacagat

SEQ ID NO: 304724 - DNA, 25 bp, Rattus norvegicus
gaagggtccatcaaccagcaacctg

SEQ ID NO: 304725 - DNA, 25 bp, Rattus norvegicus
gaagggtccatctaccagcaacctg

SEQ ID NO: 304726 - DNA, 25 bp, Rattus norvegicus
gaagggtccccaatgtaaagataag

SEQ ID NO: 304727 - DNA, 25 bp, Rattus norvegicus
gaagggtccccattgtaaagataag

SEQ ID NO: 304728 - DNA, 25 bp, Rattus norvegicus
gaagggtcctcgctagctgaaagcc

SEQ ID NO: 304729 - DNA, 25 bp, Rattus norvegicus
gaagggtcctcggtagctgaaagcc

SEQ ID NO: 304730 - DNA, 25 bp, Rattus norvegicus
gaagggtccttgaaatatctgtggt

SEQ ID NO: 304731 - DNA, 25 bp, Rattus norvegicus
gaagggtccttgtaatatctgtggt

SEQ ID NO: 304732 - DNA, 25 bp, Rattus norvegicus
gaagggtcgcctactgaaggacaca

SEQ ID NO: 304733 - DNA, 25 bp, Rattus norvegicus
gaagggtcgccttctgaaggacaca

SEQ ID NO: 304734 - DNA, 25 bp, Rattus norvegicus
gaagggtctagtcccatggttcagt

SEQ ID NO: 304735 - DNA, 25 bp, Rattus norvegicus
gaagggtctagtgccatggttcagt

SEQ ID NO: 304736 - DNA, 25 bp, Rattus norvegicus
gaagggtctctaccagggtttcagt

SEQ ID NO: 304737 - DNA, 25 bp, Rattus norvegicus
gaagggtctctagcagggtttcagt

SEQ ID NO: 304738 - DNA, 25 bp, Rattus norvegicus
gaagggtctgacatccctctttggg

SEQ ID NO: 304739 - DNA, 25 bp, Rattus norvegicus
gaagggtctgacttccctctttggg

SEQ ID NO: 304740 - DNA, 25 bp, Rattus norvegicus
gaagggtctgccaggttttgatgca

SEQ ID NO: 304741 - DNA, 25 bp, Rattus norvegicus
gaagggtctgccctaaagctcggca

SEQ ID NO: 304742 - DNA, 25 bp, Rattus norvegicus
gaagggtctgccgtaaagctcggca

SEQ ID NO: 304743 - DNA, 25 bp, Rattus norvegicus
gaagggtctgcctggttttgatgca

SEQ ID NO: 304744 - DNA, 25 bp, Rattus norvegicus
gaagggtctgcgacagacaccagcg

SEQ ID NO: 304745 - DNA, 25 bp, Rattus norvegicus
gaagggtctgcgatgcttccagaga

SEQ ID NO: 304746 - DNA, 25 bp, Rattus norvegicus
gaagggtctgcgtcagacaccagcg

SEQ ID NO: 304747 - DNA, 25 bp, Rattus norvegicus
gaagggtctgcgttgcttccagaga

SEQ ID NO: 304748 - DNA, 25 bp, Rattus norvegicus
gaagggtctgtgatctccttcttaa

SEQ ID NO: 304749 - DNA, 25 bp, Rattus norvegicus
gaagggtctgtgttctccttcttaa

SEQ ID NO: 304750 - DNA, 25 bp, Rattus norvegicus
gaagggtcttggaacagtcctgcct

SEQ ID NO: 304751 - DNA, 25 bp, Rattus norvegicus
gaagggtcttggtacagtcctgcct

SEQ ID NO: 304752 - DNA, 25 bp, Rattus norvegicus
gaagggtctttaacacaagttcgag

SEQ ID NO: 304753 - DNA, 25 bp, Rattus norvegicus
gaagggtctttatcacaagttcgag

SEQ ID NO: 304754 - DNA, 25 bp, Rattus norvegicus
gaagggtgactcagatataccacaa

SEQ ID NO: 304755 - DNA, 25 bp, Rattus norvegicus
gaagggtgactctgatataccacaa

SEQ ID NO: 304756 - DNA, 25 bp, Rattus norvegicus
gaagggtgcaacacgtgtcaaataa

SEQ ID NO: 304757 - DNA, 25 bp, Rattus norvegicus
gaagggtgcaactcgtgtcaaataa

SEQ ID NO: 304758 - DNA, 25 bp, Rattus norvegicus
gaagggtgcacgatatactcacgca

SEQ ID NO: 304759 - DNA, 25 bp, Rattus norvegicus
gaagggtgcacgttatactcacgca

SEQ ID NO: 304760 - DNA, 25 bp, Rattus norvegicus
gaagggtgccaaaacttcactctaa

SEQ ID NO: 304761 - DNA, 25 bp, Rattus norvegicus
gaagggtgccaatacttcactctaa

SEQ ID NO: 304762 - DNA, 25 bp, Rattus norvegicus
gaagggtggaatctgtcacactcat

SEQ ID NO: 304763 - DNA, 25 bp, Rattus norvegicus
gaagggtggaatgtgtcacactcat

SEQ ID NO: 304764 - DNA, 25 bp, Rattus norvegicus
gaagggtgtgaacgctgaacaatca

SEQ ID NO: 304765 - DNA, 25 bp, Rattus norvegicus
gaagggtgtgaaggctgaacaatca

SEQ ID NO: 304766 - DNA, 25 bp, Rattus norvegicus
gaagggtgtgttacttttggatgac

SEQ ID NO: 304767 - DNA, 25 bp, Rattus norvegicus
gaagggtgtgtttcttttggatgac

SEQ ID NO: 304768 - DNA, 25 bp, Rattus norvegicus
gaagggtgttgaactgctcctagaa

SEQ ID NO: 304769 - DNA, 25 bp, Rattus norvegicus
gaagggtgttgatctgctcctagaa

SEQ ID NO: 304770 - DNA, 25 bp, Rattus norvegicus
gaagggttaccaacacagctttcgc

SEQ ID NO: 304771 - DNA, 25 bp, Rattus norvegicus
gaagggttaccatcacagctttcgc

SEQ ID NO: 304772 - DNA, 25 bp, Rattus norvegicus
gaagggttactgacacagcagcagt

SEQ ID NO: 304773 - DNA, 25 bp, Rattus norvegicus
gaagggttactgtcacagcagcagt

SEQ ID NO: 304774 - DNA, 25 bp, Rattus norvegicus
gaagggttcatccacggtgtccaca

SEQ ID NO: 304775 - DNA, 25 bp, Rattus norvegicus
gaagggttcatcgacggtgtccaca

SEQ ID NO: 304776 - DNA, 25 bp, Rattus norvegicus
gaagggttcccaccatatcaaccgg

SEQ ID NO: 304777 - DNA, 25 bp, Rattus norvegicus
gaagggttcccagcatatcaaccgg

SEQ ID NO: 304778 - DNA, 25 bp, Rattus norvegicus
gaagggttcgtcaccacattgaatg

SEQ ID NO: 304779 - DNA, 25 bp, Rattus norvegicus
gaagggttcgtctccacattgaatg

SEQ ID NO: 304780 - DNA, 25 bp, Rattus norvegicus
gaagggttctttcgagcaactcccg

SEQ ID NO: 304781 - DNA, 25 bp, Rattus norvegicus
gaagggttctttggagcaactcccg

SEQ ID NO: 304782 - DNA, 25 bp, Rattus norvegicus
gaagggttgctcactgtaacttatt

SEQ ID NO: 304783 - DNA, 25 bp, Rattus norvegicus
gaagggttgctctctgtaacttatt

SEQ ID NO: 304784 - DNA, 25 bp, Rattus norvegicus
gaagggtttactcatcatcactggc

SEQ ID NO: 304785 - DNA, 25 bp, Rattus norvegicus
gaagggtttactgatcatcactggc

SEQ ID NO: 304786 - DNA, 25 bp, Rattus norvegicus
gaagggtttccaatgctgtatgtca

SEQ ID NO: 304787 - DNA, 25 bp, Rattus norvegicus
gaagggtttccacaactttccattg

SEQ ID NO: 304788 - DNA, 25 bp, Rattus norvegicus
gaagggtttccaccaggaatgaact

SEQ ID NO: 304789 - DNA, 25 bp, Rattus norvegicus
gaagggtttccagaactttccattg

SEQ ID NO: 304790 - DNA, 25 bp, Rattus norvegicus
gaagggtttccagcaggaatgaact

SEQ ID NO: 304791 - DNA, 25 bp, Rattus norvegicus
gaagggtttccattgctgtatgtca

SEQ ID NO: 304792 - DNA, 25 bp, Rattus norvegicus
gaagggtttctcacctgcagacatc

SEQ ID NO: 304793 - DNA, 25 bp, Rattus norvegicus
gaagggtttctctcctgcagacatc

SEQ ID NO: 304794 - DNA, 25 bp, Rattus norvegicus
gaagggtttgagagaaatcagcccc

SEQ ID NO: 304795 - DNA, 25 bp, Rattus norvegicus
gaagggtttgagtgaaatcagcccc

SEQ ID NO: 304796 - DNA, 25 bp, Rattus norvegicus
gaagggttttcacttcaaatcttgg

SEQ ID NO: 304797 - DNA, 25 bp, Rattus norvegicus
gaagggttttcagttcaaatcttgg

SEQ ID NO: 304798 - DNA, 25 bp, Rattus norvegicus
gaagggttttctcagtctccagtat

SEQ ID NO: 304799 - DNA, 25 bp, Rattus norvegicus
gaagggttttctgagtctccagtat

SEQ ID NO: 304800 - DNA, 25 bp, Rattus norvegicus
gaaggtaacagccacaaccacaaag

SEQ ID NO: 304801 - DNA, 25 bp, Rattus norvegicus
gaaggtaacagcgacaaccacaaag

SEQ ID NO: 304802 - DNA, 25 bp, Rattus norvegicus
gaaggtaagagtccacagagcacat

SEQ ID NO: 304803 - DNA, 25 bp, Rattus norvegicus
gaaggtaagagtgcacagagcacat

SEQ ID NO: 304804 - DNA, 25 bp, Rattus norvegicus
gaaggtaagtgtacagatccggctg

SEQ ID NO: 304805 - DNA, 25 bp, Rattus norvegicus
gaaggtaagtgttcagatccggctg

SEQ ID NO: 304806 - DNA, 25 bp, Rattus norvegicus
gaaggtacaactaggcccacagtgc

SEQ ID NO: 304807 - DNA, 25 bp, Rattus norvegicus
gaaggtacaacttggcccacagtgc

SEQ ID NO: 304808 - DNA, 25 bp, Rattus norvegicus
gaaggtacagacaccaacatgtgga

SEQ ID NO: 304809 - DNA, 25 bp, Rattus norvegicus
gaaggtacagactccaacatgtgga

SEQ ID NO: 304810 - DNA, 25 bp, Rattus norvegicus
gaaggtacagtcactgcaagccgca

SEQ ID NO: 304811 - DNA, 25 bp, Rattus norvegicus
gaaggtacagtctctgcaagccgca

SEQ ID NO: 304812 - DNA, 25 bp, Rattus norvegicus
gaaggtaccaccagttctgcaagtg

SEQ ID NO: 304813 - DNA, 25 bp, Rattus norvegicus
gaaggtaccacctgttctgcaagtg

SEQ ID NO: 304814 - DNA, 25 bp, Rattus norvegicus
gaaggtaccagacttggcccaccaa

SEQ ID NO: 304815 - DNA, 25 bp, Rattus norvegicus
gaaggtaccagagttggcccaccaa

SEQ ID NO: 304816 - DNA, 25 bp, Rattus norvegicus
gaaggtaccagccaaatccagagac

SEQ ID NO: 304817 - DNA, 25 bp, Rattus norvegicus
gaaggtaccagcgaaatccagagac

SEQ ID NO: 304818 - DNA, 25 bp, Rattus norvegicus
gaaggtaccaggcatctgtgaaagt

SEQ ID NO: 304819 - DNA, 25 bp, Rattus norvegicus
gaaggtaccagggatctgtgaaagt

SEQ ID NO: 304820 - DNA, 25 bp, Rattus norvegicus
gaaggtaccataaaccctgaaactg

SEQ ID NO: 304821 - DNA, 25 bp, Rattus norvegicus
gaaggtaccatataccctgaaactg

SEQ ID NO: 304822 - DNA, 25 bp, Rattus norvegicus
gaaggtaccattatgccatgttgct

SEQ ID NO: 304823 - DNA, 25 bp, Rattus norvegicus
gaaggtaccattttgccatgttgct

SEQ ID NO: 304824 - DNA, 25 bp, Rattus norvegicus
gaaggtaccccaccactttgtattg

SEQ ID NO: 304825 - DNA, 25 bp, Rattus norvegicus
gaaggtaccccagcactttgtattg

SEQ ID NO: 304826 - DNA, 25 bp, Rattus norvegicus
gaaggtacctgaagtttctcagaga

SEQ ID NO: 304827 - DNA, 25 bp, Rattus norvegicus
gaaggtacctgatgtttctcagaga

SEQ ID NO: 304828 - DNA, 25 bp, Rattus norvegicus
gaaggtactggtcatcgccctgtgt

SEQ ID NO: 304829 - DNA, 25 bp, Rattus norvegicus
gaaggtactggtgatcgccctgtgt

SEQ ID NO: 304830 - DNA, 25 bp, Rattus norvegicus
gaaggtacttctaactgctcagttt

SEQ ID NO: 304831 - DNA, 25 bp, Rattus norvegicus
gaaggtacttcttactgctcagttt

SEQ ID NO: 304832 - DNA, 25 bp, Rattus norvegicus
gaaggtactttccaccaaggctgac

SEQ ID NO: 304833 - DNA, 25 bp, Rattus norvegicus
gaaggtactttcgaccaaggctgac

SEQ ID NO: 304834 - DNA, 25 bp, Rattus norvegicus
gaaggtagaactccctgagaccctg

SEQ ID NO: 304835 - DNA, 25 bp, Rattus norvegicus
gaaggtagaactgcctgagaccctg

SEQ ID NO: 304836 - DNA, 25 bp, Rattus norvegicus
gaaggtagaccccaatacgctggaa

SEQ ID NO: 304837 - DNA, 25 bp, Rattus norvegicus
gaaggtagacccgaatacgctggaa

SEQ ID NO: 304838 - DNA, 25 bp, Rattus norvegicus
gaaggtagcagtcccgaagccgcct

SEQ ID NO: 304839 - DNA, 25 bp, Rattus norvegicus
gaaggtagcagtgccgaagccgcct

SEQ ID NO: 304840 - DNA, 25 bp, Rattus norvegicus
gaaggtagccgtccttccatggatt

SEQ ID NO: 304841 - DNA, 25 bp, Rattus norvegicus
gaaggtagccgtgcttccatggatt

SEQ ID NO: 304842 - DNA, 25 bp, Rattus norvegicus
gaaggtagcttgctacctggctgcc

SEQ ID NO: 304843 - DNA, 25 bp, Rattus norvegicus
gaaggtagcttggtacctggctgcc

SEQ ID NO: 304844 - DNA, 25 bp, Rattus norvegicus
gaaggtaggcatacctcgatggcta

SEQ ID NO: 304845 - DNA, 25 bp, Rattus norvegicus
gaaggtaggcattcctcgatggcta

SEQ ID NO: 304846 - DNA, 25 bp, Rattus norvegicus
gaaggtaggcctaggttcacatcta

SEQ ID NO: 304847 - DNA, 25 bp, Rattus norvegicus
gaaggtaggccttggttcacatcta

SEQ ID NO: 304848 - DNA, 25 bp, Rattus norvegicus
gaaggtaggtccaagccatcctggg

SEQ ID NO: 304849 - DNA, 25 bp, Rattus norvegicus
gaaggtaggtcctagccatcctggg

SEQ ID NO: 304850 - DNA, 25 bp, Rattus norvegicus
gaaggtagtagccagctgctgacat

SEQ ID NO: 304851 - DNA, 25 bp, Rattus norvegicus
gaaggtagtagcgagctgctgacat

SEQ ID NO: 304852 - DNA, 25 bp, Rattus norvegicus
gaaggtagtgctctagtaactcaag

SEQ ID NO: 304853 - DNA, 25 bp, Rattus norvegicus
gaaggtagtgctgtagtaactcaag

SEQ ID NO: 304854 - DNA, 25 bp, Rattus norvegicus
gaaggtagttcccagcaggtacaat

SEQ ID NO: 304855 - DNA, 25 bp, Rattus norvegicus
gaaggtagttccgagcaggtacaat

SEQ ID NO: 304856 - DNA, 25 bp, Rattus norvegicus
gaaggtagttctccagatacacagt

SEQ ID NO: 304857 - DNA, 25 bp, Rattus norvegicus
gaaggtagttctgcagatacacagt

SEQ ID NO: 304858 - DNA, 25 bp, Rattus norvegicus
gaaggtatacatactctcttgaggg

SEQ ID NO: 304859 - DNA, 25 bp, Rattus norvegicus
gaaggtatacattctctcttgaggg

SEQ ID NO: 304860 - DNA, 25 bp, Rattus norvegicus
gaaggtatatagatttttccccact

SEQ ID NO: 304861 - DNA, 25 bp, Rattus norvegicus
gaaggtatatagttttttccccact

SEQ ID NO: 304862 - DNA, 25 bp, Rattus norvegicus
gaaggtatcctcaggttgccatgca

SEQ ID NO: 304863 - DNA, 25 bp, Rattus norvegicus
gaaggtatcctctggttgccatgca

SEQ ID NO: 304864 - DNA, 25 bp, Rattus norvegicus
gaaggtatctatcactttgcaacaa

SEQ ID NO: 304865 - DNA, 25 bp, Rattus norvegicus
gaaggtatctatgactttgcaacaa

SEQ ID NO: 304866 - DNA, 25 bp, Rattus norvegicus
gaaggtatcttaccatcctgactcc

SEQ ID NO: 304867 - DNA, 25 bp, Rattus norvegicus
gaaggtatcttagcatcctgactcc

SEQ ID NO: 304868 - DNA, 25 bp, Rattus norvegicus
gaaggtatctttaattgcatccgtg

SEQ ID NO: 304869 - DNA, 25 bp, Rattus norvegicus
gaaggtatcttttattgcatccgtg

SEQ ID NO: 304870 - DNA, 25 bp, Rattus norvegicus
gaaggtatgggcacctgaccaacac

SEQ ID NO: 304871 - DNA, 25 bp, Rattus norvegicus
gaaggtatgggctcctgaccaacac

SEQ ID NO: 304872 - DNA, 25 bp, Rattus norvegicus
gaaggtatgtttacgatcactgagt

SEQ ID NO: 304873 - DNA, 25 bp, Rattus norvegicus
gaaggtatgttttcgatcactgagt

SEQ ID NO: 304874 - DNA, 25 bp, Rattus norvegicus
gaaggtattaggatgctctcccatc

SEQ ID NO: 304875 - DNA, 25 bp, Rattus norvegicus
gaaggtattaggttgctctcccatc

SEQ ID NO: 304876 - DNA, 25 bp, Rattus norvegicus
gaaggtcaaacacgaagatactcgt

SEQ ID NO: 304877 - DNA, 25 bp, Rattus norvegicus
gaaggtcaaacaggaagatactcgt

SEQ ID NO: 304878 - DNA, 25 bp, Rattus norvegicus
gaaggtcaaagtccctggtctgtac

SEQ ID NO: 304879 - DNA, 25 bp, Rattus norvegicus
gaaggtcaaagtgcctggtctgtac

SEQ ID NO: 304880 - DNA, 25 bp, Rattus norvegicus
gaaggtcaagaaccctctgtaccta

SEQ ID NO: 304881 - DNA, 25 bp, Rattus norvegicus
gaaggtcaagaagcctctgtaccta

SEQ ID NO: 304882 - DNA, 25 bp, Rattus norvegicus
gaaggtcaagcactcactgagggct

SEQ ID NO: 304883 - DNA, 25 bp, Rattus norvegicus
gaaggtcaagcagtcactgagggct

SEQ ID NO: 304884 - DNA, 25 bp, Rattus norvegicus
gaaggtcaatctagccaatgagcca

SEQ ID NO: 304885 - DNA, 25 bp, Rattus norvegicus
gaaggtcaatcttgccaatgagcca

SEQ ID NO: 304886 - DNA, 25 bp, Rattus norvegicus
gaaggtcacatcagttgcctggaat

SEQ ID NO: 304887 - DNA, 25 bp, Rattus norvegicus
gaaggtcacatctgttgcctggaat

SEQ ID NO: 304888 - DNA, 25 bp, Rattus norvegicus
gaaggtcagaaccaaggcctctgcc

SEQ ID NO: 304889 - DNA, 25 bp, Rattus norvegicus
gaaggtcagaacgaaggcctctgcc

SEQ ID NO: 304890 - DNA, 25 bp, Rattus norvegicus
gaaggtcagcacaaagtcctgtgga

SEQ ID NO: 304891 - DNA, 25 bp, Rattus norvegicus
gaaggtcagcactaagtcctgtgga

SEQ ID NO: 304892 - DNA, 25 bp, Rattus norvegicus
gaaggtcagctgaagggcagccatg

SEQ ID NO: 304893 - DNA, 25 bp, Rattus norvegicus
gaaggtcagctgtagggcagccatg

SEQ ID NO: 304894 - DNA, 25 bp, Rattus norvegicus
gaaggtcagtcaccctcagctatgc

SEQ ID NO: 304895 - DNA, 25 bp, Rattus norvegicus
gaaggtcagtcagcctcagctatgc

SEQ ID NO: 304896 - DNA, 25 bp, Rattus norvegicus
gaaggtcagtgcatcagctgttcct

SEQ ID NO: 304897 - DNA, 25 bp, Rattus norvegicus
gaaggtcagtgcttcagctgttcct

SEQ ID NO: 304898 - DNA, 25 bp, Rattus norvegicus
gaaggtcatctccagtcaggaatgt

SEQ ID NO: 304899 - DNA, 25 bp, Rattus norvegicus
gaaggtcatctcgagtcaggaatgt

SEQ ID NO: 304900 - DNA, 25 bp, Rattus norvegicus
gaaggtcatggaacggtactcggct

SEQ ID NO: 304901 - DNA, 25 bp, Rattus norvegicus
gaaggtcatggatcggtactcggct

SEQ ID NO: 304902 - DNA, 25 bp, Rattus norvegicus
gaaggtcatgttcaatggtgtcaaa

SEQ ID NO: 304903 - DNA, 25 bp, Rattus norvegicus
gaaggtcatgttgaatggtgtcaaa

SEQ ID NO: 304904 - DNA, 25 bp, Rattus norvegicus
gaaggtcattccacatcagtttgat

SEQ ID NO: 304905 - DNA, 25 bp, Rattus norvegicus
gaaggtcattcctcatcagtttgat

SEQ ID NO: 304906 - DNA, 25 bp, Rattus norvegicus
gaaggtcattctcagcaacatagta

SEQ ID NO: 304907 - DNA, 25 bp, Rattus norvegicus
gaaggtcattctgagcaacatagta

SEQ ID NO: 304908 - DNA, 25 bp, Rattus norvegicus
gaaggtccaaggaacgatccgccca

SEQ ID NO: 304909 - DNA, 25 bp, Rattus norvegicus
gaaggtccaaggtacgatccgccca

SEQ ID NO: 304910 - DNA, 25 bp, Rattus norvegicus
gaaggtccaatcaaggtttccagag

SEQ ID NO: 304911 - DNA, 25 bp, Rattus norvegicus
gaaggtccaatctaggtttccagag

SEQ ID NO: 304912 - DNA, 25 bp, Rattus norvegicus
gaaggtccacttctcttacatgatg

SEQ ID NO: 304913 - DNA, 25 bp, Rattus norvegicus
gaaggtccacttgtcttacatgatg

SEQ ID NO: 304914 - DNA, 25 bp, Rattus norvegicus
gaaggtccagagctctcaagcctgt

SEQ ID NO: 304915 - DNA, 25 bp, Rattus norvegicus
gaaggtccagaggtctcaagcctgt

SEQ ID NO: 304916 - DNA, 25 bp, Rattus norvegicus
gaaggtccatagacccaaagagagc

SEQ ID NO: 304917 - DNA, 25 bp, Rattus norvegicus
gaaggtccatagtcccaaagagagc

SEQ ID NO: 304918 - DNA, 25 bp, Rattus norvegicus
gaaggtccatcactgtgttctctca

SEQ ID NO: 304919 - DNA, 25 bp, Rattus norvegicus
gaaggtccatcagtgtgttctctca

SEQ ID NO: 304920 - DNA, 25 bp, Rattus norvegicus
gaaggtcccaaaagctgtttacata

SEQ ID NO: 304921 - DNA, 25 bp, Rattus norvegicus
gaaggtcccaaatgctgtttacata

SEQ ID NO: 304922 - DNA, 25 bp, Rattus norvegicus
gaaggtcccactcagtctgaatagg

SEQ ID NO: 304923 - DNA, 25 bp, Rattus norvegicus
gaaggtcccactgagtctgaatagg

SEQ ID NO: 304924 - DNA, 25 bp, Rattus norvegicus
gaaggtcccaggcttctgatgtctt

SEQ ID NO: 304925 - DNA, 25 bp, Rattus norvegicus
gaaggtcccagggttctgatgtctt

SEQ ID NO: 304926 - DNA, 25 bp, Rattus norvegicus
gaaggtcccatgctctagatggctt

SEQ ID NO: 304927 - DNA, 25 bp, Rattus norvegicus
gaaggtcccatggtctagatggctt

SEQ ID NO: 304928 - DNA, 25 bp, Rattus norvegicus
gaaggtccccttcgtcatcacacta

SEQ ID NO: 304929 - DNA, 25 bp, Rattus norvegicus
gaaggtccccttggtcatcacacta

SEQ ID NO: 304930 - DNA, 25 bp, Rattus norvegicus
gaaggtccctcacggagctgtagta

SEQ ID NO: 304931 - DNA, 25 bp, Rattus norvegicus
gaaggtccctcagggagctgtagta

SEQ ID NO: 304932 - DNA, 25 bp, Rattus norvegicus
gaaggtccgaaactttggcatgcta

SEQ ID NO: 304933 - DNA, 25 bp, Rattus norvegicus
gaaggtccgaaagtttggcatgcta

SEQ ID NO: 304934 - DNA, 25 bp, Rattus norvegicus
gaaggtccggcaccagattcgagat

SEQ ID NO: 304935 - DNA, 25 bp, Rattus norvegicus
gaaggtccggcagcagattcgagat

SEQ ID NO: 304936 - DNA, 25 bp, Rattus norvegicus
gaaggtcctcgcagggaaatcgaag

SEQ ID NO: 304937 - DNA, 25 bp, Rattus norvegicus
gaaggtcctcgctgggaaatcgaag

SEQ ID NO: 304938 - DNA, 25 bp, Rattus norvegicus
gaaggtcctgaaagcgagaccccgg

SEQ ID NO: 304939 - DNA, 25 bp, Rattus norvegicus
gaaggtcctgaatgcgagaccccgg

SEQ ID NO: 304940 - DNA, 25 bp, Rattus norvegicus
gaaggtcctgagcagcctgccctgc

SEQ ID NO: 304941 - DNA, 25 bp, Rattus norvegicus
gaaggtcctgaggagcctgccctgc

SEQ ID NO: 304942 - DNA, 25 bp, Rattus norvegicus
gaaggtcctggccattcgcaagaag

SEQ ID NO: 304943 - DNA, 25 bp, Rattus norvegicus
gaaggtcctggcgattcgcaagaag

SEQ ID NO: 304944 - DNA, 25 bp, Rattus norvegicus
gaaggtcctgggaacatttgcagac

SEQ ID NO: 304945 - DNA, 25 bp, Rattus norvegicus
gaaggtcctgggtacatttgcagac

SEQ ID NO: 304946 - DNA, 25 bp, Rattus norvegicus
gaaggtccttctctaggtgtcagtt

SEQ ID NO: 304947 - DNA, 25 bp, Rattus norvegicus
gaaggtccttctgtaggtgtcagtt

SEQ ID NO: 304948 - DNA, 25 bp, Rattus norvegicus
gaaggtccttgacaggtatagttct

SEQ ID NO: 304949 - DNA, 25 bp, Rattus norvegicus
gaaggtccttgagaggtatagttct

SEQ ID NO: 304950 - DNA, 25 bp, Rattus norvegicus
gaaggtcgacccagacgtgctgtaa

SEQ ID NO: 304951 - DNA, 25 bp, Rattus norvegicus
gaaggtcgaccctgacgtgctgtaa

SEQ ID NO: 304952 - DNA, 25 bp, Rattus norvegicus
gaaggtcgacgtatccattttcatt

SEQ ID NO: 304953 - DNA, 25 bp, Rattus norvegicus
gaaggtcgacgtttccattttcatt

SEQ ID NO: 304954 - DNA, 25 bp, Rattus norvegicus
gaaggtcgcccacatgggcctgaac

SEQ ID NO: 304955 - DNA, 25 bp, Rattus norvegicus
gaaggtcgcccagatgggcctgaac

SEQ ID NO: 304956 - DNA, 25 bp, Rattus norvegicus
gaaggtcggactcttatctgtgaat

SEQ ID NO: 304957 - DNA, 25 bp, Rattus norvegicus
gaaggtcggactgttatctgtgaat

SEQ ID NO: 304958 - DNA, 25 bp, Rattus norvegicus
gaaggtcggagtctgctgctaatta

SEQ ID NO: 304959 - DNA, 25 bp, Rattus norvegicus
gaaggtcggagtgtgctgctaatta

SEQ ID NO: 304960 - DNA, 25 bp, Rattus norvegicus
gaaggtcgtcctcttcgaacgaacg

SEQ ID NO: 304961 - DNA, 25 bp, Rattus norvegicus
gaaggtcgtcctgttcgaacgaacg

SEQ ID NO: 304962 - DNA, 25 bp, Rattus norvegicus
gaaggtctaaaactctgatagccta

SEQ ID NO: 304963 - DNA, 25 bp, Rattus norvegicus
gaaggtctaaaagtctgatagccta

SEQ ID NO: 304964 - DNA, 25 bp, Rattus norvegicus
gaaggtctagtcagcttcatcctgg

SEQ ID NO: 304965 - DNA, 25 bp, Rattus norvegicus
gaaggtctagtctgcttcatcctgg

SEQ ID NO: 304966 - DNA, 25 bp, Rattus norvegicus
gaaggtctcaatactctggactctt

SEQ ID NO: 304967 - DNA, 25 bp, Rattus norvegicus
gaaggtctcaatcaagacttcatgt

SEQ ID NO: 304968 - DNA, 25 bp, Rattus norvegicus
gaaggtctcaatgaagacttcatgt

SEQ ID NO: 304969 - DNA, 25 bp, Rattus norvegicus
gaaggtctcaattctctggactctt

SEQ ID NO: 304970 - DNA, 25 bp, Rattus norvegicus
gaaggtctcaccatgtgccttgttg

SEQ ID NO: 304971 - DNA, 25 bp, Rattus norvegicus
gaaggtctcaccttgtgccttgttg

SEQ ID NO: 304972 - DNA, 25 bp, Rattus norvegicus
gaaggtctccaaatcagtatcagct

SEQ ID NO: 304973 - DNA, 25 bp, Rattus norvegicus
gaaggtctccaattcagtatcagct

SEQ ID NO: 304974 - DNA, 25 bp, Rattus norvegicus
gaaggtctccacaagactctgggct

SEQ ID NO: 304975 - DNA, 25 bp, Rattus norvegicus
gaaggtctccactagactctgggct

SEQ ID NO: 304976 - DNA, 25 bp, Rattus norvegicus
gaaggtctccatatcctgagtttca

SEQ ID NO: 304977 - DNA, 25 bp, Rattus norvegicus
gaaggtctccatctgggaacgtgct

SEQ ID NO: 304978 - DNA, 25 bp, Rattus norvegicus
gaaggtctccatgtgggaacgtgct

SEQ ID NO: 304979 - DNA, 25 bp, Rattus norvegicus
gaaggtctccatttcctgagtttca

SEQ ID NO: 304980 - DNA, 25 bp, Rattus norvegicus
gaaggtctcccacctgagaatgcca

SEQ ID NO: 304981 - DNA, 25 bp, Rattus norvegicus
gaaggtctcccagctgagaatgcca

SEQ ID NO: 304982 - DNA, 25 bp, Rattus norvegicus
gaaggtctccggaggcctcagaagt

SEQ ID NO: 304983 - DNA, 25 bp, Rattus norvegicus
gaaggtctccggtggcctcagaagt

SEQ ID NO: 304984 - DNA, 25 bp, Rattus norvegicus
gaaggtctcgtgctacatcatgcag

SEQ ID NO: 304985 - DNA, 25 bp, Rattus norvegicus
gaaggtctcgtggtacatcatgcag

SEQ ID NO: 304986 - DNA, 25 bp, Rattus norvegicus
gaaggtctcttgaagcactcatctt

SEQ ID NO: 304987 - DNA, 25 bp, Rattus norvegicus
gaaggtctcttgtagcactcatctt

SEQ ID NO: 304988 - DNA, 25 bp, Rattus norvegicus
gaaggtctgacaccagcctaagaac

SEQ ID NO: 304989 - DNA, 25 bp, Rattus norvegicus
gaaggtctgacagcagcctaagaac

SEQ ID NO: 304990 - DNA, 25 bp, Rattus norvegicus
gaaggtctgaggatcctatgctaag

SEQ ID NO: 304991 - DNA, 25 bp, Rattus norvegicus
gaaggtctgaggttcctatgctaag

SEQ ID NO: 304992 - DNA, 25 bp, Rattus norvegicus
gaaggtctgcccaatctggacatgg

SEQ ID NO: 304993 - DNA, 25 bp, Rattus norvegicus
gaaggtctgccctatctggacatgg

SEQ ID NO: 304994 - DNA, 25 bp, Rattus norvegicus
gaaggtctggatcaacacccatcat

SEQ ID NO: 304995 - DNA, 25 bp, Rattus norvegicus
gaaggtctggatgaacacccatcat

SEQ ID NO: 304996 - DNA, 25 bp, Rattus norvegicus
gaaggtctgtatacctgcaggtgaa

SEQ ID NO: 304997 - DNA, 25 bp, Rattus norvegicus
gaaggtctgtattcctgcaggtgaa

SEQ ID NO: 304998 - DNA, 25 bp, Rattus norvegicus
gaaggtctgttcaaagcttccctca

SEQ ID NO: 304999 - DNA, 25 bp, Rattus norvegicus
gaaggtctgttctaagcttccctca

SEQ ID NO: 305000 - DNA, 25 bp, Rattus norvegicus
gaaggtcttcaaccctgtttggctg

SEQ ID NO: 305001 - DNA, 25 bp, Rattus norvegicus
gaaggtcttcaagcctgtttggctg

SEQ ID NO: 305002 - DNA, 25 bp, Rattus norvegicus
gaaggtcttcatacagaagtcagta

SEQ ID NO: 305003 - DNA, 25 bp, Rattus norvegicus
gaaggtcttcattcagaagtcagta

SEQ ID NO: 305004 - DNA, 25 bp, Rattus norvegicus
gaaggtcttgaaccagcctatgcca

SEQ ID NO: 305005 - DNA, 25 bp, Rattus norvegicus
gaaggtcttgaagcagcctatgcca

SEQ ID NO: 305006 - DNA, 25 bp, Rattus norvegicus
gaaggtctttgaagtgtctctgtct

SEQ ID NO: 305007 - DNA, 25 bp, Rattus norvegicus
gaaggtctttgatgtgtctctgtct

SEQ ID NO: 305008 - DNA, 25 bp, Rattus norvegicus
gaaggtctttttccttgttcacatc

SEQ ID NO: 305009 - DNA, 25 bp, Rattus norvegicus
gaaggtctttttgcttgttcacatc

SEQ ID NO: 305010 - DNA, 25 bp, Rattus norvegicus
gaaggtgaactaattccaacagatg

SEQ ID NO: 305011 - DNA, 25 bp, Rattus norvegicus
gaaggtgaactatttccaacagatg

SEQ ID NO: 305012 - DNA, 25 bp, Rattus norvegicus
gaaggtgaactgaccccaatgggaa

SEQ ID NO: 305013 - DNA, 25 bp, Rattus norvegicus
gaaggtgaactgtccccaatgggaa

SEQ ID NO: 305014 - DNA, 25 bp, Rattus norvegicus
gaaggtgaatctcgccagactcgcc

SEQ ID NO: 305015 - DNA, 25 bp, Rattus norvegicus
gaaggtgaatctggccagactcgcc

SEQ ID NO: 305016 - DNA, 25 bp, Rattus norvegicus
gaaggtgaattcagatctgcaaaat

SEQ ID NO: 305017 - DNA, 25 bp, Rattus norvegicus
gaaggtgaattctgatctgcaaaat

SEQ ID NO: 305018 - DNA, 25 bp, Rattus norvegicus
gaaggtgacacaatgagcatccagg

SEQ ID NO: 305019 - DNA, 25 bp, Rattus norvegicus
gaaggtgacacattgagcatccagg

SEQ ID NO: 305020 - DNA, 25 bp, Rattus norvegicus
gaaggtgacactcagtccaattaaa

SEQ ID NO: 305021 - DNA, 25 bp, Rattus norvegicus
gaaggtgacactgagtccaattaaa

SEQ ID NO: 305022 - DNA, 25 bp, Rattus norvegicus
gaaggtgacagacagctgcttccac

SEQ ID NO: 305023 - DNA, 25 bp, Rattus norvegicus
gaaggtgacagagagctgcttccac

SEQ ID NO: 305024 - DNA, 25 bp, Rattus norvegicus
gaaggtgacataactgcacaactgt

SEQ ID NO: 305025 - DNA, 25 bp, Rattus norvegicus
gaaggtgacatatctgcacaactgt

SEQ ID NO: 305026 - DNA, 25 bp, Rattus norvegicus
gaaggtgaccatctctgtgtccaca

SEQ ID NO: 305027 - DNA, 25 bp, Rattus norvegicus
gaaggtgaccatgtctgtgtccaca

SEQ ID NO: 305028 - DNA, 25 bp, Rattus norvegicus
gaaggtgaccctaatgtaagtttct

SEQ ID NO: 305029 - DNA, 25 bp, Rattus norvegicus
gaaggtgacccttatgtaagtttct

SEQ ID NO: 305030 - DNA, 25 bp, Rattus norvegicus
gaaggtgacgcacctttaaacaagt

SEQ ID NO: 305031 - DNA, 25 bp, Rattus norvegicus
gaaggtgacgcagctttaaacaagt

SEQ ID NO: 305032 - DNA, 25 bp, Rattus norvegicus
gaaggtgactcaactttctgccaca

SEQ ID NO: 305033 - DNA, 25 bp, Rattus norvegicus
gaaggtgactcatctttctgccaca

SEQ ID NO: 305034 - DNA, 25 bp, Rattus norvegicus
gaaggtgactgtccccttaaatcac

SEQ ID NO: 305035 - DNA, 25 bp, Rattus norvegicus
gaaggtgactgtgcccttaaatcac

SEQ ID NO: 305036 - DNA, 25 bp, Rattus norvegicus
gaaggtgaggttagcctagtgcccc

SEQ ID NO: 305037 - DNA, 25 bp, Rattus norvegicus
gaaggtgaggtttgcctagtgcccc

SEQ ID NO: 305038 - DNA, 25 bp, Rattus norvegicus
gaaggtgatacgacactacacagct

SEQ ID NO: 305039 - DNA, 25 bp, Rattus norvegicus
gaaggtgatacgtcactacacagct

SEQ ID NO: 305040 - DNA, 25 bp, Rattus norvegicus
gaaggtgatccgagacaagcgcaca

SEQ ID NO: 305041 - DNA, 25 bp, Rattus norvegicus
gaaggtgatccgtgacaagcgcaca

SEQ ID NO: 305042 - DNA, 25 bp, Rattus norvegicus
gaaggtgatcgcaaaaccctcatgt

SEQ ID NO: 305043 - DNA, 25 bp, Rattus norvegicus
gaaggtgatcgctaaaccctcatgt

SEQ ID NO: 305044 - DNA, 25 bp, Rattus norvegicus
gaaggtgatgttattgcccaagaaa

SEQ ID NO: 305045 - DNA, 25 bp, Rattus norvegicus
gaaggtgatgtttttgcccaagaaa

SEQ ID NO: 305046 - DNA, 25 bp, Rattus norvegicus
gaaggtgatttactgccatgttata

SEQ ID NO: 305047 - DNA, 25 bp, Rattus norvegicus
gaaggtgatttagtgccatgttata

SEQ ID NO: 305048 - DNA, 25 bp, Rattus norvegicus
gaaggtgcacatagttagccgggaa

SEQ ID NO: 305049 - DNA, 25 bp, Rattus norvegicus
gaaggtgcacattgttagccgggaa

SEQ ID NO: 305050 - DNA, 25 bp, Rattus norvegicus
gaaggtgcacgaacctctgggcctt

SEQ ID NO: 305051 - DNA, 25 bp, Rattus norvegicus
gaaggtgcacgatcctctgggcctt

SEQ ID NO: 305052 - DNA, 25 bp, Rattus norvegicus
gaaggtgcacgtcttcacggtcgtc

SEQ ID NO: 305053 - DNA, 25 bp, Rattus norvegicus
gaaggtgcacgtgttcacggtcgtc

SEQ ID NO: 305054 - DNA, 25 bp, Rattus norvegicus
gaaggtgcactgagttttccaagta

SEQ ID NO: 305055 - DNA, 25 bp, Rattus norvegicus
gaaggtgcactgtgttttccaagta

SEQ ID NO: 305056 - DNA, 25 bp, Rattus norvegicus
gaaggtgcatgtctgtactccaaag

SEQ ID NO: 305057 - DNA, 25 bp, Rattus norvegicus
gaaggtgcatgtgtgtactccaaag

SEQ ID NO: 305058 - DNA, 25 bp, Rattus norvegicus
gaaggtgccacacccactgacggga

SEQ ID NO: 305059 - DNA, 25 bp, Rattus norvegicus
gaaggtgccacagccactgacggga

SEQ ID NO: 305060 - DNA, 25 bp, Rattus norvegicus
gaaggtgccactaacctgggccaaa

SEQ ID NO: 305061 - DNA, 25 bp, Rattus norvegicus
gaaggtgccactcgtcggcagacca

SEQ ID NO: 305062 - DNA, 25 bp, Rattus norvegicus
gaaggtgccactggtcggcagacca

SEQ ID NO: 305063 - DNA, 25 bp, Rattus norvegicus
gaaggtgccacttacctgggccaaa

SEQ ID NO: 305064 - DNA, 25 bp, Rattus norvegicus
gaaggtgccagcattaagagttcat

SEQ ID NO: 305065 - DNA, 25 bp, Rattus norvegicus
gaaggtgccagctttaagagttcat

SEQ ID NO: 305066 - DNA, 25 bp, Rattus norvegicus
gaaggtgcccacaagtaacactgag

SEQ ID NO: 305067 - DNA, 25 bp, Rattus norvegicus
gaaggtgcccacaggttacttttct

SEQ ID NO: 305068 - DNA, 25 bp, Rattus norvegicus
gaaggtgcccactagtaacactgag

SEQ ID NO: 305069 - DNA, 25 bp, Rattus norvegicus
gaaggtgcccactggttacttttct

SEQ ID NO: 305070 - DNA, 25 bp, Rattus norvegicus
gaaggtgcccttaaactagcctaga

SEQ ID NO: 305071 - DNA, 25 bp, Rattus norvegicus
gaaggtgccctttaactagcctaga

SEQ ID NO: 305072 - DNA, 25 bp, Rattus norvegicus
gaaggtgccggaattactgctgagt

SEQ ID NO: 305073 - DNA, 25 bp, Rattus norvegicus
gaaggtgccggatttactgctgagt

SEQ ID NO: 305074 - DNA, 25 bp, Rattus norvegicus
gaaggtgcctagatcacccacgaat

SEQ ID NO: 305075 - DNA, 25 bp, Rattus norvegicus
gaaggtgcctagttcacccacgaat

SEQ ID NO: 305076 - DNA, 25 bp, Rattus norvegicus
gaaggtgcctgccaattcagtaaca

SEQ ID NO: 305077 - DNA, 25 bp, Rattus norvegicus
gaaggtgcctgcgaattcagtaaca

SEQ ID NO: 305078 - DNA, 25 bp, Rattus norvegicus
gaaggtgcgatgatgacttccccga

SEQ ID NO: 305079 - DNA, 25 bp, Rattus norvegicus
gaaggtgcgatgttgacttccccga

SEQ ID NO: 305080 - DNA, 25 bp, Rattus norvegicus
gaaggtgctacgatcgaagccatcc

SEQ ID NO: 305081 - DNA, 25 bp, Rattus norvegicus
gaaggtgctacgttcgaagccatcc

SEQ ID NO: 305082 - DNA, 25 bp, Rattus norvegicus
gaaggtgctcaaaggcagttctatc

SEQ ID NO: 305083 - DNA, 25 bp, Rattus norvegicus
gaaggtgctcaatggcagttctatc

SEQ ID NO: 305084 - DNA, 25 bp, Rattus norvegicus
gaaggtgctcagcactcggtatata

SEQ ID NO: 305085 - DNA, 25 bp, Rattus norvegicus
gaaggtgctcaggactcggtatata

SEQ ID NO: 305086 - DNA, 25 bp, Rattus norvegicus
gaaggtgctgcaagatgcccacata

SEQ ID NO: 305087 - DNA, 25 bp, Rattus norvegicus
gaaggtgctgcatgatgcccacata

SEQ ID NO: 305088 - DNA, 25 bp, Rattus norvegicus
gaaggtgctgcgaattccaagcgga

SEQ ID NO: 305089 - DNA, 25 bp, Rattus norvegicus
gaaggtgctgcgtattccaagcgga

SEQ ID NO: 305090 - DNA, 25 bp, Rattus norvegicus
gaaggtgctgctcgacaacctggac

SEQ ID NO: 305091 - DNA, 25 bp, Rattus norvegicus
gaaggtgctgctggacaacctggac

SEQ ID NO: 305092 - DNA, 25 bp, Rattus norvegicus
gaaggtgctgggactgtcactagcc

SEQ ID NO: 305093 - DNA, 25 bp, Rattus norvegicus
gaaggtgctgggtctgtcactagcc

SEQ ID NO: 305094 - DNA, 25 bp, Rattus norvegicus
gaaggtgcttagaccatctgtaatt

SEQ ID NO: 305095 - DNA, 25 bp, Rattus norvegicus
gaaggtgcttagtccatctgtaatt

SEQ ID NO: 305096 - DNA, 25 bp, Rattus norvegicus
gaaggtgcttctagtttacccctga

SEQ ID NO: 305097 - DNA, 25 bp, Rattus norvegicus
gaaggtgcttcttgtttacccctga

SEQ ID NO: 305098 - DNA, 25 bp, Rattus norvegicus
gaaggtgctttcacacagcagcgaa

SEQ ID NO: 305099 - DNA, 25 bp, Rattus norvegicus
gaaggtgctttcaccatttatttaa

SEQ ID NO: 305100 - DNA, 25 bp, Rattus norvegicus
gaaggtgctttcatcggcgaagcca

SEQ ID NO: 305101 - DNA, 25 bp, Rattus norvegicus
gaaggtgctttctcacagcagcgaa

SEQ ID NO: 305102 - DNA, 25 bp, Rattus norvegicus
gaaggtgctttctccatttatttaa

SEQ ID NO: 305103 - DNA, 25 bp, Rattus norvegicus
gaaggtgctttcttcggcgaagcca

SEQ ID NO: 305104 - DNA, 25 bp, Rattus norvegicus
gaaggtggaaacatcttccgactct

SEQ ID NO: 305105 - DNA, 25 bp, Rattus norvegicus
gaaggtggaaacttcttccgactct

SEQ ID NO: 305106 - DNA, 25 bp, Rattus norvegicus
gaaggtggacaaatgcagcctgctg

SEQ ID NO: 305107 - DNA, 25 bp, Rattus norvegicus
gaaggtggacaattgcagcctgctg

SEQ ID NO: 305108 - DNA, 25 bp, Rattus norvegicus
gaaggtggacagcttcagcttgacc

SEQ ID NO: 305109 - DNA, 25 bp, Rattus norvegicus
gaaggtggacaggttcagcttgacc

SEQ ID NO: 305110 - DNA, 25 bp, Rattus norvegicus
gaaggtggatcaactgtcaagaatg

SEQ ID NO: 305111 - DNA, 25 bp, Rattus norvegicus
gaaggtggatcaaggtctttgtttt

SEQ ID NO: 305112 - DNA, 25 bp, Rattus norvegicus
gaaggtggatcatctgtcaagaatg

SEQ ID NO: 305113 - DNA, 25 bp, Rattus norvegicus
gaaggtggatcatggtctttgtttt

SEQ ID NO: 305114 - DNA, 25 bp, Rattus norvegicus
gaaggtggatctacagtccttgccc

SEQ ID NO: 305115 - DNA, 25 bp, Rattus norvegicus
gaaggtggatcttcagtccttgccc

SEQ ID NO: 305116 - DNA, 25 bp, Rattus norvegicus
gaaggtggcacaagacaaagggtcc

SEQ ID NO: 305117 - DNA, 25 bp, Rattus norvegicus
gaaggtggcacatgacaaagggtcc

SEQ ID NO: 305118 - DNA, 25 bp, Rattus norvegicus
gaaggtggccgtaatttcggccctg

SEQ ID NO: 305119 - DNA, 25 bp, Rattus norvegicus
gaaggtggccgttatttcggccctg

SEQ ID NO: 305120 - DNA, 25 bp, Rattus norvegicus
gaaggtggcctcatattgcttaaaa

SEQ ID NO: 305121 - DNA, 25 bp, Rattus norvegicus
gaaggtggcctcttattgcttaaaa

SEQ ID NO: 305122 - DNA, 25 bp, Rattus norvegicus
gaaggtggctcaccgggcactaaaa

SEQ ID NO: 305123 - DNA, 25 bp, Rattus norvegicus
gaaggtggctcagcgggcactaaaa

SEQ ID NO: 305124 - DNA, 25 bp, Rattus norvegicus
gaaggtggctgactttttcctcctg

SEQ ID NO: 305125 - DNA, 25 bp, Rattus norvegicus
gaaggtggctgagtttttcctcctg

SEQ ID NO: 305126 - DNA, 25 bp, Rattus norvegicus
gaaggtggctgtagataggtatttt

SEQ ID NO: 305127 - DNA, 25 bp, Rattus norvegicus
gaaggtggctgttgataggtatttt

SEQ ID NO: 305128 - DNA, 25 bp, Rattus norvegicus
gaaggtggcttcagcatgttcctca

SEQ ID NO: 305129 - DNA, 25 bp, Rattus norvegicus
gaaggtggcttcatacaacacatgt

SEQ ID NO: 305130 - DNA, 25 bp, Rattus norvegicus
gaaggtggcttctgcatgttcctca

SEQ ID NO: 305131 - DNA, 25 bp, Rattus norvegicus
gaaggtggcttcttacaacacatgt

SEQ ID NO: 305132 - DNA, 25 bp, Rattus norvegicus
gaaggtggctttaaactctgtgttg

SEQ ID NO: 305133 - DNA, 25 bp, Rattus norvegicus
gaaggtggctttatatatgttatat

SEQ ID NO: 305134 - DNA, 25 bp, Rattus norvegicus
gaaggtggcttttaactctgtgttg

SEQ ID NO: 305135 - DNA, 25 bp, Rattus norvegicus
gaaggtggctttttatatgttatat

SEQ ID NO: 305136 - DNA, 25 bp, Rattus norvegicus
gaaggtgggctcagctttaaatcta

SEQ ID NO: 305137 - DNA, 25 bp, Rattus norvegicus
gaaggtgggctctgctttaaatcta

SEQ ID NO: 305138 - DNA, 25 bp, Rattus norvegicus
gaaggtggtacgctacttagtcaaa

SEQ ID NO: 305139 - DNA, 25 bp, Rattus norvegicus
gaaggtggtacggtacttagtcaaa

SEQ ID NO: 305140 - DNA, 25 bp, Rattus norvegicus
gaaggtggtcaaccccacagcatag

SEQ ID NO: 305141 - DNA, 25 bp, Rattus norvegicus
gaaggtggtcaagcccacagcatag

SEQ ID NO: 305142 - DNA, 25 bp, Rattus norvegicus
gaaggtggtctactcactttgccaa

SEQ ID NO: 305143 - DNA, 25 bp, Rattus norvegicus
gaaggtggtctagtcactttgccaa

SEQ ID NO: 305144 - DNA, 25 bp, Rattus norvegicus
gaaggtggtcttcaccattgcccaa

SEQ ID NO: 305145 - DNA, 25 bp, Rattus norvegicus
gaaggtggtcttgaccattgcccaa

SEQ ID NO: 305146 - DNA, 25 bp, Rattus norvegicus
gaaggtggtgatactgtcagctgac

SEQ ID NO: 305147 - DNA, 25 bp, Rattus norvegicus
gaaggtggtgattctgtcagctgac

SEQ ID NO: 305148 - DNA, 25 bp, Rattus norvegicus
gaaggtggttgaagcccagcccgtt

SEQ ID NO: 305149 - DNA, 25 bp, Rattus norvegicus
gaaggtggttgatgcccagcccgtt

SEQ ID NO: 305150 - DNA, 25 bp, Rattus norvegicus
gaaggtgtacacctgactgcccagt

SEQ ID NO: 305151 - DNA, 25 bp, Rattus norvegicus
gaaggtgtacacgtgactgcccagt

SEQ ID NO: 305152 - DNA, 25 bp, Rattus norvegicus
gaaggtgtaccccaacgttgctgag

SEQ ID NO: 305153 - DNA, 25 bp, Rattus norvegicus
gaaggtgtacccgaacgttgctgag

SEQ ID NO: 305154 - DNA, 25 bp, Rattus norvegicus
gaaggtgtatttcgtctccaccgga

SEQ ID NO: 305155 - DNA, 25 bp, Rattus norvegicus
gaaggtgtatttggtctccaccgga

SEQ ID NO: 305156 - DNA, 25 bp, Rattus norvegicus
gaaggtgtcagacatcctatttttt

SEQ ID NO: 305157 - DNA, 25 bp, Rattus norvegicus
gaaggtgtcagagatcctatttttt

SEQ ID NO: 305158 - DNA, 25 bp, Rattus norvegicus
gaaggtgtcattacacccgtgtatc

SEQ ID NO: 305159 - DNA, 25 bp, Rattus norvegicus
gaaggtgtcatttcacccgtgtatc

SEQ ID NO: 305160 - DNA, 25 bp, Rattus norvegicus
gaaggtgtccatctatctgcttact

SEQ ID NO: 305161 - DNA, 25 bp, Rattus norvegicus
gaaggtgtccatgtatctgcttact

SEQ ID NO: 305162 - DNA, 25 bp, Rattus norvegicus
gaaggtgtctctatagccattcaaa

SEQ ID NO: 305163 - DNA, 25 bp, Rattus norvegicus
gaaggtgtctctttagccattcaaa

SEQ ID NO: 305164 - DNA, 25 bp, Rattus norvegicus
gaaggtgtcttactgttttcactac

SEQ ID NO: 305165 - DNA, 25 bp, Rattus norvegicus
gaaggtgtcttagtgttttcactac

SEQ ID NO: 305166 - DNA, 25 bp, Rattus norvegicus
gaaggtgtcttcagtgttctatacc

SEQ ID NO: 305167 - DNA, 25 bp, Rattus norvegicus
gaaggtgtcttctgtgttctatacc

SEQ ID NO: 305168 - DNA, 25 bp, Rattus norvegicus
gaaggtgtctttcctcctgttgatt

SEQ ID NO: 305169 - DNA, 25 bp, Rattus norvegicus
gaaggtgtctttgctcctgttgatt

SEQ ID NO: 305170 - DNA, 25 bp, Rattus norvegicus
gaaggtgtgagcactggcgactcca

SEQ ID NO: 305171 - DNA, 25 bp, Rattus norvegicus
gaaggtgtgagctctggcgactcca

SEQ ID NO: 305172 - DNA, 25 bp, Rattus norvegicus
gaaggtgtgcacaaaccactctcag

SEQ ID NO: 305173 - DNA, 25 bp, Rattus norvegicus
gaaggtgtgcactaaccactctcag

SEQ ID NO: 305174 - DNA, 25 bp, Rattus norvegicus
gaaggtgtgtctagcaaatgccatg

SEQ ID NO: 305175 - DNA, 25 bp, Rattus norvegicus
gaaggtgtgtcttgcaaatgccatg

SEQ ID NO: 305176 - DNA, 25 bp, Rattus norvegicus
gaaggtgtgtgcaatgttcacagta

SEQ ID NO: 305177 - DNA, 25 bp, Rattus norvegicus
gaaggtgtgtgctatgttcacagta

SEQ ID NO: 305178 - DNA, 25 bp, Rattus norvegicus
gaaggtgtgttcaacttggatcaga

SEQ ID NO: 305179 - DNA, 25 bp, Rattus norvegicus
gaaggtgtgttctacttggatcaga

SEQ ID NO: 305180 - DNA, 25 bp, Rattus norvegicus
gaaggtgttcacattccagaagctt

SEQ ID NO: 305181 - DNA, 25 bp, Rattus norvegicus
gaaggtgttcactttccagaagctt

SEQ ID NO: 305182 - DNA, 25 bp, Rattus norvegicus
gaaggtgttccacattctggacaaa

SEQ ID NO: 305183 - DNA, 25 bp, Rattus norvegicus
gaaggtgttccagattctggacaaa

SEQ ID NO: 305184 - DNA, 25 bp, Rattus norvegicus
gaaggtgttccgagttctaagaagc

SEQ ID NO: 305185 - DNA, 25 bp, Rattus norvegicus
gaaggtgttccgtgttctaagaagc

SEQ ID NO: 305186 - DNA, 25 bp, Rattus norvegicus
gaaggtgtttacatcccagccatct

SEQ ID NO: 305187 - DNA, 25 bp, Rattus norvegicus
gaaggtgtttacttcccagccatct

SEQ ID NO: 305188 - DNA, 25 bp, Rattus norvegicus
gaaggtgtttgcacccaagtttatt

SEQ ID NO: 305189 - DNA, 25 bp, Rattus norvegicus
gaaggtgtttgctcccaagtttatt

SEQ ID NO: 305190 - DNA, 25 bp, Rattus norvegicus
gaaggttacacacggccagactcaa

SEQ ID NO: 305191 - DNA, 25 bp, Rattus norvegicus
gaaggttacacagggccagactcaa

SEQ ID NO: 305192 - DNA, 25 bp, Rattus norvegicus
gaaggttacactaggtttgcaccaa

SEQ ID NO: 305193 - DNA, 25 bp, Rattus norvegicus
gaaggttacacttggtttgcaccaa

SEQ ID NO: 305194 - DNA, 25 bp, Rattus norvegicus
gaaggttactatagtactcccctct

SEQ ID NO: 305195 - DNA, 25 bp, Rattus norvegicus
gaaggttactattgtactcccctct

SEQ ID NO: 305196 - DNA, 25 bp, Rattus norvegicus
gaaggttagcacattctctaatgga

SEQ ID NO: 305197 - DNA, 25 bp, Rattus norvegicus
gaaggttagcactttctctaatgga

SEQ ID NO: 305198 - DNA, 25 bp, Rattus norvegicus
gaaggttatcagaaccatcgacatg

SEQ ID NO: 305199 - DNA, 25 bp, Rattus norvegicus
gaaggttatcagtaccatcgacatg

SEQ ID NO: 305200 - DNA, 25 bp, Rattus norvegicus
gaaggttattggcatccctagtgaa

SEQ ID NO: 305201 - DNA, 25 bp, Rattus norvegicus
gaaggttattgggatccctagtgaa

SEQ ID NO: 305202 - DNA, 25 bp, Rattus norvegicus
gaaggttcagttatcagcaatttta

SEQ ID NO: 305203 - DNA, 25 bp, Rattus norvegicus
gaaggttcagttttcagcaatttta

SEQ ID NO: 305204 - DNA, 25 bp, Rattus norvegicus
gaaggttcatctcatgggctctgct

SEQ ID NO: 305205 - DNA, 25 bp, Rattus norvegicus
gaaggttcatctgatgggctctgct

SEQ ID NO: 305206 - DNA, 25 bp, Rattus norvegicus
gaaggttcatggctgatcctgcacc

SEQ ID NO: 305207 - DNA, 25 bp, Rattus norvegicus
gaaggttcatgggtgatcctgcacc

SEQ ID NO: 305208 - DNA, 25 bp, Rattus norvegicus
gaaggttccaatccctacagttcct

SEQ ID NO: 305209 - DNA, 25 bp, Rattus norvegicus
gaaggttccaatgcctacagttcct

SEQ ID NO: 305210 - DNA, 25 bp, Rattus norvegicus
gaaggttcccagagtctaattcggt

SEQ ID NO: 305211 - DNA, 25 bp, Rattus norvegicus
gaaggttcccagtgtctaattcggt

SEQ ID NO: 305212 - DNA, 25 bp, Rattus norvegicus
gaaggttccgaaaattcagttcatc

SEQ ID NO: 305213 - DNA, 25 bp, Rattus norvegicus
gaaggttccgaatattcagttcatc

SEQ ID NO: 305214 - DNA, 25 bp, Rattus norvegicus
gaaggttcctcaacggtggtgcatc

SEQ ID NO: 305215 - DNA, 25 bp, Rattus norvegicus
gaaggttcctcatcggtggtgcatc

SEQ ID NO: 305216 - DNA, 25 bp, Rattus norvegicus
gaaggttcgggacggacggagaatg

SEQ ID NO: 305217 - DNA, 25 bp, Rattus norvegicus
gaaggttcgggagggacggagaatg

SEQ ID NO: 305218 - DNA, 25 bp, Rattus norvegicus
gaaggttctcacaggcacaggtaat

SEQ ID NO: 305219 - DNA, 25 bp, Rattus norvegicus
gaaggttctcactggcacaggtaat

SEQ ID NO: 305220 - DNA, 25 bp, Rattus norvegicus
gaaggttctcggaacattgtgttta

SEQ ID NO: 305221 - DNA, 25 bp, Rattus norvegicus
gaaggttctcggcaaccctagcaat

SEQ ID NO: 305222 - DNA, 25 bp, Rattus norvegicus
gaaggttctcgggaaccctagcaat

SEQ ID NO: 305223 - DNA, 25 bp, Rattus norvegicus
gaaggttctcggtacattgtgttta

SEQ ID NO: 305224 - DNA, 25 bp, Rattus norvegicus
gaaggttctctcaggactcttacag

SEQ ID NO: 305225 - DNA, 25 bp, Rattus norvegicus
gaaggttctctctggactcttacag

SEQ ID NO: 305226 - DNA, 25 bp, Rattus norvegicus
gaaggttctgccattacgaacccat

SEQ ID NO: 305227 - DNA, 25 bp, Rattus norvegicus
gaaggttctgcctttacgaacccat

SEQ ID NO: 305228 - DNA, 25 bp, Rattus norvegicus
gaaggttctgggatctaatgagata

SEQ ID NO: 305229 - DNA, 25 bp, Rattus norvegicus
gaaggttctgggttctaatgagata

SEQ ID NO: 305230 - DNA, 25 bp, Rattus norvegicus
gaaggttctggtattattcctgcct

SEQ ID NO: 305231 - DNA, 25 bp, Rattus norvegicus
gaaggttctggttttattcctgcct

SEQ ID NO: 305232 - DNA, 25 bp, Rattus norvegicus
gaaggttcttctcatagttctacca

SEQ ID NO: 305233 - DNA, 25 bp, Rattus norvegicus
gaaggttcttctgatagttctacca

SEQ ID NO: 305234 - DNA, 25 bp, Rattus norvegicus
gaaggttctttgcacagagcccact

SEQ ID NO: 305235 - DNA, 25 bp, Rattus norvegicus
gaaggttctttggacagagcccact

SEQ ID NO: 305236 - DNA, 25 bp, Rattus norvegicus
gaaggttgaagcagttgcctgaaca

SEQ ID NO: 305237 - DNA, 25 bp, Rattus norvegicus
gaaggttgaagctgttgcctgaaca

SEQ ID NO: 305238 - DNA, 25 bp, Rattus norvegicus
gaaggttgagtcactttgctgcgca

SEQ ID NO: 305239 - DNA, 25 bp, Rattus norvegicus
gaaggttgagtctctttgctgcgca

SEQ ID NO: 305240 - DNA, 25 bp, Rattus norvegicus
gaaggttgcccaaggtggtcactca

SEQ ID NO: 305241 - DNA, 25 bp, Rattus norvegicus
gaaggttgcccaccaaactggaagg

SEQ ID NO: 305242 - DNA, 25 bp, Rattus norvegicus
gaaggttgcccagcaaactggaagg

SEQ ID NO: 305243 - DNA, 25 bp, Rattus norvegicus
gaaggttgcccatggtggtcactca

SEQ ID NO: 305244 - DNA, 25 bp, Rattus norvegicus
gaaggttgccgtctactcagtggat

SEQ ID NO: 305245 - DNA, 25 bp, Rattus norvegicus
gaaggttgccgtgtactcagtggat

SEQ ID NO: 305246 - DNA, 25 bp, Rattus norvegicus
gaaggttggagtctcatcagcctgt

SEQ ID NO: 305247 - DNA, 25 bp, Rattus norvegicus
gaaggttggagtgtcatcagcctgt

SEQ ID NO: 305248 - DNA, 25 bp, Rattus norvegicus
gaaggttggcaactcctggtgcaca

SEQ ID NO: 305249 - DNA, 25 bp, Rattus norvegicus
gaaggttggcaagtcctggtgcaca

SEQ ID NO: 305250 - DNA, 25 bp, Rattus norvegicus
gaaggttgggctacttcataatttt

SEQ ID NO: 305251 - DNA, 25 bp, Rattus norvegicus
gaaggttgggcttcttcataatttt

SEQ ID NO: 305252 - DNA, 25 bp, Rattus norvegicus
gaaggttgtacgatcttacgaaaat

SEQ ID NO: 305253 - DNA, 25 bp, Rattus norvegicus
gaaggttgtacgttcttacgaaaat

SEQ ID NO: 305254 - DNA, 25 bp, Rattus norvegicus
gaaggttgtctcctctaagttctag

SEQ ID NO: 305255 - DNA, 25 bp, Rattus norvegicus
gaaggttgtctcgtctaagttctag

SEQ ID NO: 305256 - DNA, 25 bp, Rattus norvegicus
gaaggtttagaaccaaggcatcagg

SEQ ID NO: 305257 - DNA, 25 bp, Rattus norvegicus
gaaggtttagaagcaaggcatcagg

SEQ ID NO: 305258 - DNA, 25 bp, Rattus norvegicus
gaaggtttcaagctttttgccacag

SEQ ID NO: 305259 - DNA, 25 bp, Rattus norvegicus
gaaggtttcaaggtttttgccacag

SEQ ID NO: 305260 - DNA, 25 bp, Rattus norvegicus
gaaggtttcacaattgggcttgttt

SEQ ID NO: 305261 - DNA, 25 bp, Rattus norvegicus
gaaggtttcacatttgggcttgttt

SEQ ID NO: 305262 - DNA, 25 bp, Rattus norvegicus
gaaggtttcaccatgctacacttgg

SEQ ID NO: 305263 - DNA, 25 bp, Rattus norvegicus
gaaggtttcaccttgctacacttgg

SEQ ID NO: 305264 - DNA, 25 bp, Rattus norvegicus
gaaggtttcagacttctttccccat

SEQ ID NO: 305265 - DNA, 25 bp, Rattus norvegicus
gaaggtttcagagttctttccccat

SEQ ID NO: 305266 - DNA, 25 bp, Rattus norvegicus
gaaggtttcatccacacacagtatg

SEQ ID NO: 305267 - DNA, 25 bp, Rattus norvegicus
gaaggtttcatcgacacacagtatg

SEQ ID NO: 305268 - DNA, 25 bp, Rattus norvegicus
gaaggtttcattatgtagtcctggc

SEQ ID NO: 305269 - DNA, 25 bp, Rattus norvegicus
gaaggtttcattttgtagtcctggc

SEQ ID NO: 305270 - DNA, 25 bp, Rattus norvegicus
gaaggtttccagatttgttgtacag

SEQ ID NO: 305271 - DNA, 25 bp, Rattus norvegicus
gaaggtttccagttttgttgtacag

SEQ ID NO: 305272 - DNA, 25 bp, Rattus norvegicus
gaaggtttctatctacgcagatgat

SEQ ID NO: 305273 - DNA, 25 bp, Rattus norvegicus
gaaggtttctatgtacgcagatgat

SEQ ID NO: 305274 - DNA, 25 bp, Rattus norvegicus
gaaggtttgcagcttcccttatgtg

SEQ ID NO: 305275 - DNA, 25 bp, Rattus norvegicus
gaaggtttgcaggttcccttatgtg

SEQ ID NO: 305276 - DNA, 25 bp, Rattus norvegicus
gaaggtttgcttagcatgcaccaag

SEQ ID NO: 305277 - DNA, 25 bp, Rattus norvegicus
gaaggtttgctttgcatgcaccaag

SEQ ID NO: 305278 - DNA, 25 bp, Rattus norvegicus
gaaggtttgtacctcgccgtggatc

SEQ ID NO: 305279 - DNA, 25 bp, Rattus norvegicus
gaaggtttgtacgtcgccgtggatc

SEQ ID NO: 305280 - DNA, 25 bp, Rattus norvegicus
gaaggtttgtatccagcgcgaatga

SEQ ID NO: 305281 - DNA, 25 bp, Rattus norvegicus
gaaggtttgtatgcagcgcgaatga

SEQ ID NO: 305282 - DNA, 25 bp, Rattus norvegicus
gaaggttttcatcaactctctttga

SEQ ID NO: 305283 - DNA, 25 bp, Rattus norvegicus
gaaggttttcatcttccttgttgga

SEQ ID NO: 305284 - DNA, 25 bp, Rattus norvegicus
gaaggttttcatgaactctctttga

SEQ ID NO: 305285 - DNA, 25 bp, Rattus norvegicus
gaaggttttcatgttccttgttgga

SEQ ID NO: 305286 - DNA, 25 bp, Rattus norvegicus
gaaggttttccactccctccgagat

SEQ ID NO: 305287 - DNA, 25 bp, Rattus norvegicus
gaaggttttccagtccctccgagat

SEQ ID NO: 305288 - DNA, 25 bp, Rattus norvegicus
gaaggttttctgaagccaagtcagt

SEQ ID NO: 305289 - DNA, 25 bp, Rattus norvegicus
gaaggttttctgtagccaagtcagt

SEQ ID NO: 305290 - DNA, 25 bp, Rattus norvegicus
gaaggttttgcaatgtgtttactat

SEQ ID NO: 305291 - DNA, 25 bp, Rattus norvegicus
gaaggttttgcattgtgtttactat

SEQ ID NO: 305292 - DNA, 25 bp, Rattus norvegicus
gaaggttttgtgaacttgtatttct

SEQ ID NO: 305293 - DNA, 25 bp, Rattus norvegicus
gaaggttttgtgtacttgtatttct

SEQ ID NO: 305294 - DNA, 25 bp, Rattus norvegicus
gaagtaaaccacaagtgccagtgca

SEQ ID NO: 305295 - DNA, 25 bp, Rattus norvegicus
gaagtaaaccactagtgccagtgca

SEQ ID NO: 305296 - DNA, 25 bp, Rattus norvegicus
gaagtaaacttcagccccagagacc

SEQ ID NO: 305297 - DNA, 25 bp, Rattus norvegicus
gaagtaaacttctgccccagagacc

SEQ ID NO: 305298 - DNA, 25 bp, Rattus norvegicus
gaagtaaagcttaccttctgccttt

SEQ ID NO: 305299 - DNA, 25 bp, Rattus norvegicus
gaagtaaagctttccttctgccttt

SEQ ID NO: 305300 - DNA, 25 bp, Rattus norvegicus
gaagtaaataaacgcgccgcacacg

SEQ ID NO: 305301 - DNA, 25 bp, Rattus norvegicus
gaagtaaataaaggcgccgcacacg

SEQ ID NO: 305302 - DNA, 25 bp, Rattus norvegicus
gaagtaaataccagctctggtttag

SEQ ID NO: 305303 - DNA, 25 bp, Rattus norvegicus
gaagtaaatacctgctctggtttag

SEQ ID NO: 305304 - DNA, 25 bp, Rattus norvegicus
gaagtaaatcgcacctgtcattgta

SEQ ID NO: 305305 - DNA, 25 bp, Rattus norvegicus
gaagtaaatcgctcctgtcattgta

SEQ ID NO: 305306 - DNA, 25 bp, Rattus norvegicus
gaagtaaatctgatctgatacttgc

SEQ ID NO: 305307 - DNA, 25 bp, Rattus norvegicus
gaagtaaatctgttctgatacttgc

SEQ ID NO: 305308 - DNA, 25 bp, Rattus norvegicus
gaagtaaatcttctcatccaaggta

SEQ ID NO: 305309 - DNA, 25 bp, Rattus norvegicus
gaagtaaatcttgtcatccaaggta

SEQ ID NO: 305310 - DNA, 25 bp, Rattus norvegicus
gaagtaaatgtaagcgccgtgaaaa

SEQ ID NO: 305311 - DNA, 25 bp, Rattus norvegicus
gaagtaaatgtatgcgccgtgaaaa

SEQ ID NO: 305312 - DNA, 25 bp, Rattus norvegicus
gaagtaacacacaacatccactatg

SEQ ID NO: 305313 - DNA, 25 bp, Rattus norvegicus
gaagtaacacactacatccactatg

SEQ ID NO: 305314 - DNA, 25 bp, Rattus norvegicus
gaagtaacacgtcatagagctcctg

SEQ ID NO: 305315 - DNA, 25 bp, Rattus norvegicus
gaagtaacacgtgatagagctcctg

SEQ ID NO: 305316 - DNA, 25 bp, Rattus norvegicus
gaagtaacatatcccacatccttgg

SEQ ID NO: 305317 - DNA, 25 bp, Rattus norvegicus
gaagtaacatatgccacatccttgg

SEQ ID NO: 305318 - DNA, 25 bp, Rattus norvegicus
gaagtaacatcgagccaggctttgc

SEQ ID NO: 305319 - DNA, 25 bp, Rattus norvegicus
gaagtaacatcgtgccaggctttgc

SEQ ID NO: 305320 - DNA, 25 bp, Rattus norvegicus
gaagtaaccaacaagatgctctttt

SEQ ID NO: 305321 - DNA, 25 bp, Rattus norvegicus
gaagtaaccaactagatgctctttt

SEQ ID NO: 305322 - DNA, 25 bp, Rattus norvegicus
gaagtaacctggcaattcatcccta

SEQ ID NO: 305323 - DNA, 25 bp, Rattus norvegicus
gaagtaacctgggaattcatcccta

SEQ ID NO: 305324 - DNA, 25 bp, Rattus norvegicus
gaagtaacgtctactcctgatgaca

SEQ ID NO: 305325 - DNA, 25 bp, Rattus norvegicus
gaagtaacgtcttctcctgatgaca

SEQ ID NO: 305326 - DNA, 25 bp, Rattus norvegicus
gaagtaactggactcacacccaagt

SEQ ID NO: 305327 - DNA, 25 bp, Rattus norvegicus
gaagtaactggagtcacacccaagt

SEQ ID NO: 305328 - DNA, 25 bp, Rattus norvegicus
gaagtaactgtcacttgtgccctag

SEQ ID NO: 305329 - DNA, 25 bp, Rattus norvegicus
gaagtaactgtctcttgtgccctag

SEQ ID NO: 305330 - DNA, 25 bp, Rattus norvegicus
gaagtaacttttccatgaatgcttt

SEQ ID NO: 305331 - DNA, 25 bp, Rattus norvegicus
gaagtaacttttgcatgaatgcttt

SEQ ID NO: 305332 - DNA, 25 bp, Rattus norvegicus
gaagtaagacctccctattccagcc

SEQ ID NO: 305333 - DNA, 25 bp, Rattus norvegicus
gaagtaagacctgcctattccagcc

SEQ ID NO: 305334 - DNA, 25 bp, Rattus norvegicus
gaagtaaggcctagtcaccacccct

SEQ ID NO: 305335 - DNA, 25 bp, Rattus norvegicus
gaagtaaggccttgtcaccacccct

SEQ ID NO: 305336 - DNA, 25 bp, Rattus norvegicus
gaagtaagtagaatccaggcctttc

SEQ ID NO: 305337 - DNA, 25 bp, Rattus norvegicus
gaagtaagtagaattggtttcctgt

SEQ ID NO: 305338 - DNA, 25 bp, Rattus norvegicus
gaagtaagtagattccaggcctttc

SEQ ID NO: 305339 - DNA, 25 bp, Rattus norvegicus
gaagtaagtagatttggtttcctgt

SEQ ID NO: 305340 - DNA, 25 bp, Rattus norvegicus
gaagtaagtcttctgtacctcctta

SEQ ID NO: 305341 - DNA, 25 bp, Rattus norvegicus
gaagtaagtcttgtgtacctcctta

SEQ ID NO: 305342 - DNA, 25 bp, Rattus norvegicus
gaagtaataaacaccccaagccaga

SEQ ID NO: 305343 - DNA, 25 bp, Rattus norvegicus
gaagtaataaactccccaagccaga

SEQ ID NO: 305344 - DNA, 25 bp, Rattus norvegicus
gaagtaatactgaggagatcttttg

SEQ ID NO: 305345 - DNA, 25 bp, Rattus norvegicus
gaagtaatactgtggagatcttttg

SEQ ID NO: 305346 - DNA, 25 bp, Rattus norvegicus
gaagtaatcccacaggcacgttagc

SEQ ID NO: 305347 - DNA, 25 bp, Rattus norvegicus
gaagtaatcccagaggcacgttagc

SEQ ID NO: 305348 - DNA, 25 bp, Rattus norvegicus
gaagtaatcgttcagcttctacgtg

SEQ ID NO: 305349 - DNA, 25 bp, Rattus norvegicus
gaagtaatcgttgagcttctacgtg

SEQ ID NO: 305350 - DNA, 25 bp, Rattus norvegicus
gaagtaatgccaactttccttgtgg

SEQ ID NO: 305351 - DNA, 25 bp, Rattus norvegicus
gaagtaatgccatctttccttgtgg

SEQ ID NO: 305352 - DNA, 25 bp, Rattus norvegicus
gaagtaatggctcctttgttccctt

SEQ ID NO: 305353 - DNA, 25 bp, Rattus norvegicus
gaagtaatggctgctttgttccctt

SEQ ID NO: 305354 - DNA, 25 bp, Rattus norvegicus
gaagtaatgtatattctccttaaag

SEQ ID NO: 305355 - DNA, 25 bp, Rattus norvegicus
gaagtaatgtattttctccttaaag

SEQ ID NO: 305356 - DNA, 25 bp, Rattus norvegicus
gaagtaatgtggactgctagcaaat

SEQ ID NO: 305357 - DNA, 25 bp, Rattus norvegicus
gaagtaatgtggtctgctagcaaat

SEQ ID NO: 305358 - DNA, 25 bp, Rattus norvegicus
gaagtaatgtttcgtgttgctgcat

SEQ ID NO: 305359 - DNA, 25 bp, Rattus norvegicus
gaagtaatgtttggtgttgctgcat

SEQ ID NO: 305360 - DNA, 25 bp, Rattus norvegicus
gaagtaattaccatggctacagcag

SEQ ID NO: 305361 - DNA, 25 bp, Rattus norvegicus
gaagtaattaccttggctacagcag

SEQ ID NO: 305362 - DNA, 25 bp, Rattus norvegicus
gaagtaattctacccaacctgcctt

SEQ ID NO: 305363 - DNA, 25 bp, Rattus norvegicus
gaagtaattctagccaacctgcctt

SEQ ID NO: 305364 - DNA, 25 bp, Rattus norvegicus
gaagtaattgacctgggctcggcca

SEQ ID NO: 305365 - DNA, 25 bp, Rattus norvegicus
gaagtaattgacgtgggctcggcca

SEQ ID NO: 305366 - DNA, 25 bp, Rattus norvegicus
gaagtaattgcaacataacagtcta

SEQ ID NO: 305367 - DNA, 25 bp, Rattus norvegicus
gaagtaattgcatcataacagtcta

SEQ ID NO: 305368 - DNA, 25 bp, Rattus norvegicus
gaagtaatttatcacgactccctaa

SEQ ID NO: 305369 - DNA, 25 bp, Rattus norvegicus
gaagtaatttatgacgactccctaa

SEQ ID NO: 305370 - DNA, 25 bp, Rattus norvegicus
gaagtacaaacaacatcccgtggat

SEQ ID NO: 305371 - DNA, 25 bp, Rattus norvegicus
gaagtacaaacatcatcccgtggat

SEQ ID NO: 305372 - DNA, 25 bp, Rattus norvegicus
gaagtacaagccactgtgtcctcag

SEQ ID NO: 305373 - DNA, 25 bp, Rattus norvegicus
gaagtacaagcctctgtgtcctcag

SEQ ID NO: 305374 - DNA, 25 bp, Rattus norvegicus
gaagtacaagtcactacctgagtct

SEQ ID NO: 305375 - DNA, 25 bp, Rattus norvegicus
gaagtacaagtctctacctgagtct

SEQ ID NO: 305376 - DNA, 25 bp, Rattus norvegicus
gaagtacacaagcacagatccaagt

SEQ ID NO: 305377 - DNA, 25 bp, Rattus norvegicus
gaagtacacaaggacagatccaagt

SEQ ID NO: 305378 - DNA, 25 bp, Rattus norvegicus
gaagtacacccacgagcaagcccgg

SEQ ID NO: 305379 - DNA, 25 bp, Rattus norvegicus
gaagtacacccaggagcaagcccgg

SEQ ID NO: 305380 - DNA, 25 bp, Rattus norvegicus
gaagtacaccttataccggaccatg

SEQ ID NO: 305381 - DNA, 25 bp, Rattus norvegicus
gaagtacaccttttaccggaccatg

SEQ ID NO: 305382 - DNA, 25 bp, Rattus norvegicus
gaagtacacggtcctgcgtaaggca

SEQ ID NO: 305383 - DNA, 25 bp, Rattus norvegicus
gaagtacacggtgctgcgtaaggca

SEQ ID NO: 305384 - DNA, 25 bp, Rattus norvegicus
gaagtacactaaatcctttcaactt

SEQ ID NO: 305385 - DNA, 25 bp, Rattus norvegicus
gaagtacactaattcctttcaactt

SEQ ID NO: 305386 - DNA, 25 bp, Rattus norvegicus
gaagtacactgaacacgcccaacga

SEQ ID NO: 305387 - DNA, 25 bp, Rattus norvegicus
gaagtacactgaacctttgctgcta

SEQ ID NO: 305388 - DNA, 25 bp, Rattus norvegicus
gaagtacactgatcacgcccaacga

SEQ ID NO: 305389 - DNA, 25 bp, Rattus norvegicus
gaagtacactgatcctttgctgcta

SEQ ID NO: 305390 - DNA, 25 bp, Rattus norvegicus
gaagtacactgcctttagccagcgg

SEQ ID NO: 305391 - DNA, 25 bp, Rattus norvegicus
gaagtacactgcgtttagccagcgg

SEQ ID NO: 305392 - DNA, 25 bp, Rattus norvegicus
gaagtacacttcctcttttgaacat

SEQ ID NO: 305393 - DNA, 25 bp, Rattus norvegicus
gaagtacacttcgtcttttgaacat

SEQ ID NO: 305394 - DNA, 25 bp, Rattus norvegicus
gaagtacagtgacagctgacccaat

SEQ ID NO: 305395 - DNA, 25 bp, Rattus norvegicus
gaagtacagtgagagctgacccaat

SEQ ID NO: 305396 - DNA, 25 bp, Rattus norvegicus
gaagtacatcttacaatggtttaca

SEQ ID NO: 305397 - DNA, 25 bp, Rattus norvegicus
gaagtacatctttcaatggtttaca

SEQ ID NO: 305398 - DNA, 25 bp, Rattus norvegicus
gaagtacatgaactcagggcctgtg

SEQ ID NO: 305399 - DNA, 25 bp, Rattus norvegicus
gaagtacatgaagtcagggcctgtg

SEQ ID NO: 305400 - DNA, 25 bp, Rattus norvegicus
gaagtacatggtatggcccagccaa

SEQ ID NO: 305401 - DNA, 25 bp, Rattus norvegicus
gaagtacatggtttggcccagccaa

SEQ ID NO: 305402 - DNA, 25 bp, Rattus norvegicus
gaagtaccacatacaggtctgcact

SEQ ID NO: 305403 - DNA, 25 bp, Rattus norvegicus
gaagtaccacattcaggtctgcact

SEQ ID NO: 305404 - DNA, 25 bp, Rattus norvegicus
gaagtaccagagaccccacagagtg

SEQ ID NO: 305405 - DNA, 25 bp, Rattus norvegicus
gaagtaccagagtccccacagagtg

SEQ ID NO: 305406 - DNA, 25 bp, Rattus norvegicus
gaagtaccagcaaatccaccagaag

SEQ ID NO: 305407 - DNA, 25 bp, Rattus norvegicus
gaagtaccagcatatccaccagaag

SEQ ID NO: 305408 - DNA, 25 bp, Rattus norvegicus
gaagtaccattcagggctaaactgg

SEQ ID NO: 305409 - DNA, 25 bp, Rattus norvegicus
gaagtaccattctgggctaaactgg

SEQ ID NO: 305410 - DNA, 25 bp, Rattus norvegicus
gaagtaccatttacacagcgtctga

SEQ ID NO: 305411 - DNA, 25 bp, Rattus norvegicus
gaagtaccattttcacagcgtctga

SEQ ID NO: 305412 - DNA, 25 bp, Rattus norvegicus
gaagtacccactcatggagaccatg

SEQ ID NO: 305413 - DNA, 25 bp, Rattus norvegicus
gaagtacccactgatggagaccatg

SEQ ID NO: 305414 - DNA, 25 bp, Rattus norvegicus
gaagtacccagccaatactcaggag

SEQ ID NO: 305415 - DNA, 25 bp, Rattus norvegicus
gaagtacccagcgaatactcaggag

SEQ ID NO: 305416 - DNA, 25 bp, Rattus norvegicus
gaagtaccccttatgaggccaagag

SEQ ID NO: 305417 - DNA, 25 bp, Rattus norvegicus
gaagtaccccttttgaggccaagag

SEQ ID NO: 305418 - DNA, 25 bp, Rattus norvegicus
gaagtaccgtgtcgcagtgttacct

SEQ ID NO: 305419 - DNA, 25 bp, Rattus norvegicus
gaagtaccgtgtggcagtgttacct

SEQ ID NO: 305420 - DNA, 25 bp, Rattus norvegicus
gaagtacctaatacatgtagaccag

SEQ ID NO: 305421 - DNA, 25 bp, Rattus norvegicus
gaagtacctaattcatgtagaccag

SEQ ID NO: 305422 - DNA, 25 bp, Rattus norvegicus
gaagtacctcatcttgaatgttatt

SEQ ID NO: 305423 - DNA, 25 bp, Rattus norvegicus
gaagtacctcatgttgaatgttatt

SEQ ID NO: 305424 - DNA, 25 bp, Rattus norvegicus
gaagtacctctaactaaagactatg

SEQ ID NO: 305425 - DNA, 25 bp, Rattus norvegicus
gaagtacctctatctaaagactatg

SEQ ID NO: 305426 - DNA, 25 bp, Rattus norvegicus
gaagtacctgacaccagtttcaaac

SEQ ID NO: 305427 - DNA, 25 bp, Rattus norvegicus
gaagtacctgacactgtccgttaag

SEQ ID NO: 305428 - DNA, 25 bp, Rattus norvegicus
gaagtacctgactccagtttcaaac

SEQ ID NO: 305429 - DNA, 25 bp, Rattus norvegicus
gaagtacctgactctgtccgttaag

SEQ ID NO: 305430 - DNA, 25 bp, Rattus norvegicus
gaagtacctggtcgttctccggaga

SEQ ID NO: 305431 - DNA, 25 bp, Rattus norvegicus
gaagtacctggtggttctccggaga

SEQ ID NO: 305432 - DNA, 25 bp, Rattus norvegicus
gaagtacctgtaccttgtggtgtcc

SEQ ID NO: 305433 - DNA, 25 bp, Rattus norvegicus
gaagtacctgtagcttgtggtgtcc

SEQ ID NO: 305434 - DNA, 25 bp, Rattus norvegicus
gaagtaccttccatgggcacggcgg

SEQ ID NO: 305435 - DNA, 25 bp, Rattus norvegicus
gaagtaccttccttgggcacggcgg

SEQ ID NO: 305436 - DNA, 25 bp, Rattus norvegicus
gaagtacgaagtcctgctgctttcc

SEQ ID NO: 305437 - DNA, 25 bp, Rattus norvegicus
gaagtacgaagtgctgctgctttcc

SEQ ID NO: 305438 - DNA, 25 bp, Rattus norvegicus
gaagtacggtggcatgttctgcaac

SEQ ID NO: 305439 - DNA, 25 bp, Rattus norvegicus
gaagtacggtgggatgttctgcaac

SEQ ID NO: 305440 - DNA, 25 bp, Rattus norvegicus
gaagtacgtcagatcccttctggaa

SEQ ID NO: 305441 - DNA, 25 bp, Rattus norvegicus
gaagtacgtcagttcccttctggaa

SEQ ID NO: 305442 - DNA, 25 bp, Rattus norvegicus
gaagtactaacgatgcagggcatgg

SEQ ID NO: 305443 - DNA, 25 bp, Rattus norvegicus
gaagtactaacgttgcagggcatgg

SEQ ID NO: 305444 - DNA, 25 bp, Rattus norvegicus
gaagtactaagcctggccttccttc

SEQ ID NO: 305445 - DNA, 25 bp, Rattus norvegicus
gaagtactaagcgtggccttccttc

SEQ ID NO: 305446 - DNA, 25 bp, Rattus norvegicus
gaagtactaatgctttgtgtggaaa

SEQ ID NO: 305447 - DNA, 25 bp, Rattus norvegicus
gaagtactaatggtttgtgtggaaa

SEQ ID NO: 305448 - DNA, 25 bp, Rattus norvegicus
gaagtactacagaaatgccccatgt

SEQ ID NO: 305449 - DNA, 25 bp, Rattus norvegicus
gaagtactacagtaatgccccatgt

SEQ ID NO: 305450 - DNA, 25 bp, Rattus norvegicus
gaagtactagcaaacggcgccttgt

SEQ ID NO: 305451 - DNA, 25 bp, Rattus norvegicus
gaagtactagcatacggcgccttgt

SEQ ID NO: 305452 - DNA, 25 bp, Rattus norvegicus
gaagtactatttaacatctcagaaa

SEQ ID NO: 305453 - DNA, 25 bp, Rattus norvegicus
gaagtactattttacatctcagaaa

SEQ ID NO: 305454 - DNA, 25 bp, Rattus norvegicus
gaagtactcaagactcttgggtaga

SEQ ID NO: 305455 - DNA, 25 bp, Rattus norvegicus
gaagtactcaagtctcttgggtaga

SEQ ID NO: 305456 - DNA, 25 bp, Rattus norvegicus
gaagtactccaaactgtctcgaagg

SEQ ID NO: 305457 - DNA, 25 bp, Rattus norvegicus
gaagtactccaatctgtctcgaagg

SEQ ID NO: 305458 - DNA, 25 bp, Rattus norvegicus
gaagtactctggagtctggtaatca

SEQ ID NO: 305459 - DNA, 25 bp, Rattus norvegicus
gaagtactctggtgtctggtaatca

SEQ ID NO: 305460 - DNA, 25 bp, Rattus norvegicus
gaagtactgaagagccacagggtct

SEQ ID NO: 305461 - DNA, 25 bp, Rattus norvegicus
gaagtactgaagtgccacagggtct

SEQ ID NO: 305462 - DNA, 25 bp, Rattus norvegicus
gaagtactgaccacctaaatattta

SEQ ID NO: 305463 - DNA, 25 bp, Rattus norvegicus
gaagtactgacccatgcaataagac

SEQ ID NO: 305464 - DNA, 25 bp, Rattus norvegicus
gaagtactgaccgatgcaataagac

SEQ ID NO: 305465 - DNA, 25 bp, Rattus norvegicus
gaagtactgacctcctaaatattta

SEQ ID NO: 305466 - DNA, 25 bp, Rattus norvegicus
gaagtactgatcactactgataata

SEQ ID NO: 305467 - DNA, 25 bp, Rattus norvegicus
gaagtactgatctctactgataata

SEQ ID NO: 305468 - DNA, 25 bp, Rattus norvegicus
gaagtactggacattacgtcacggg

SEQ ID NO: 305469 - DNA, 25 bp, Rattus norvegicus
gaagtactggactttacgtcacggg

SEQ ID NO: 305470 - DNA, 25 bp, Rattus norvegicus
gaagtactgtggctacaagttgatt

SEQ ID NO: 305471 - DNA, 25 bp, Rattus norvegicus
gaagtactgtgggtacaagttgatt

SEQ ID NO: 305472 - DNA, 25 bp, Rattus norvegicus
gaagtacttatccagtgcctaccct

SEQ ID NO: 305473 - DNA, 25 bp, Rattus norvegicus
gaagtacttatcgagtgcctaccct

SEQ ID NO: 305474 - DNA, 25 bp, Rattus norvegicus
gaagtacttcccagaacatggtcct

SEQ ID NO: 305475 - DNA, 25 bp, Rattus norvegicus
gaagtacttccctgaacatggtcct

SEQ ID NO: 305476 - DNA, 25 bp, Rattus norvegicus
gaagtacttcctcgcttctgtctag

SEQ ID NO: 305477 - DNA, 25 bp, Rattus norvegicus
gaagtacttcctcggcctcgggtca

SEQ ID NO: 305478 - DNA, 25 bp, Rattus norvegicus
gaagtacttcctggcttctgtctag

SEQ ID NO: 305479 - DNA, 25 bp, Rattus norvegicus
gaagtacttcctgggcctcgggtca

SEQ ID NO: 305480 - DNA, 25 bp, Rattus norvegicus
gaagtacttcttccacgatgacaga

SEQ ID NO: 305481 - DNA, 25 bp, Rattus norvegicus
gaagtacttcttgcacgatgacaga

SEQ ID NO: 305482 - DNA, 25 bp, Rattus norvegicus
gaagtacttgtaactttgcaacgtg

SEQ ID NO: 305483 - DNA, 25 bp, Rattus norvegicus
gaagtacttgtaccccttcagtcac

SEQ ID NO: 305484 - DNA, 25 bp, Rattus norvegicus
gaagtacttgtacgtgacccctgaa

SEQ ID NO: 305485 - DNA, 25 bp, Rattus norvegicus
gaagtacttgtagcccttcagtcac

SEQ ID NO: 305486 - DNA, 25 bp, Rattus norvegicus
gaagtacttgtaggtgacccctgaa

SEQ ID NO: 305487 - DNA, 25 bp, Rattus norvegicus
gaagtacttgtatctttgcaacgtg

SEQ ID NO: 305488 - DNA, 25 bp, Rattus norvegicus
gaagtactttgcagtttgaacactg

SEQ ID NO: 305489 - DNA, 25 bp, Rattus norvegicus
gaagtactttgctgtttgaacactg

SEQ ID NO: 305490 - DNA, 25 bp, Rattus norvegicus
gaagtactttgtcctgttcacaatg

SEQ ID NO: 305491 - DNA, 25 bp, Rattus norvegicus
gaagtactttgtgctgttcacaatg

SEQ ID NO: 305492 - DNA, 25 bp, Rattus norvegicus
gaagtagaaggtatacaccccagac

SEQ ID NO: 305493 - DNA, 25 bp, Rattus norvegicus
gaagtagaaggtttacaccccagac

SEQ ID NO: 305494 - DNA, 25 bp, Rattus norvegicus
gaagtagacaccagagtcctgcaca

SEQ ID NO: 305495 - DNA, 25 bp, Rattus norvegicus
gaagtagacaccagtactgctaaga

SEQ ID NO: 305496 - DNA, 25 bp, Rattus norvegicus
gaagtagacacctgagtcctgcaca

SEQ ID NO: 305497 - DNA, 25 bp, Rattus norvegicus
gaagtagacacctgtactgctaaga

SEQ ID NO: 305498 - DNA, 25 bp, Rattus norvegicus
gaagtagacatcagggaatcccagg

SEQ ID NO: 305499 - DNA, 25 bp, Rattus norvegicus
gaagtagacatcctcagcccggcag

SEQ ID NO: 305500 - DNA, 25 bp, Rattus norvegicus
gaagtagacatcgtcagcccggcag

SEQ ID NO: 305501 - DNA, 25 bp, Rattus norvegicus
gaagtagacatctgggaatcccagg

SEQ ID NO: 305502 - DNA, 25 bp, Rattus norvegicus
gaagtagacgtaacctcggttgaag

SEQ ID NO: 305503 - DNA, 25 bp, Rattus norvegicus
gaagtagacgtatcctcggttgaag

SEQ ID NO: 305504 - DNA, 25 bp, Rattus norvegicus
gaagtagactctagacacgcattca

SEQ ID NO: 305505 - DNA, 25 bp, Rattus norvegicus
gaagtagactcttgacacgcattca

SEQ ID NO: 305506 - DNA, 25 bp, Rattus norvegicus
gaagtagaggaaaccctgggccctg

SEQ ID NO: 305507 - DNA, 25 bp, Rattus norvegicus
gaagtagaggaatccctgggccctg

SEQ ID NO: 305508 - DNA, 25 bp, Rattus norvegicus
gaagtagaggctatatcagacacgg

SEQ ID NO: 305509 - DNA, 25 bp, Rattus norvegicus
gaagtagaggctttatcagacacgg

SEQ ID NO: 305510 - DNA, 25 bp, Rattus norvegicus
gaagtagagggcatgtccactgacc

SEQ ID NO: 305511 - DNA, 25 bp, Rattus norvegicus
gaagtagagggcttgtccactgacc

SEQ ID NO: 305512 - DNA, 25 bp, Rattus norvegicus
gaagtagatcagacgcctgctctca

SEQ ID NO: 305513 - DNA, 25 bp, Rattus norvegicus
gaagtagatcagtcgcctgctctca

SEQ ID NO: 305514 - DNA, 25 bp, Rattus norvegicus
gaagtagatgaacgccaccaggcaa

SEQ ID NO: 305515 - DNA, 25 bp, Rattus norvegicus
gaagtagatgaaggccaccaggcaa

SEQ ID NO: 305516 - DNA, 25 bp, Rattus norvegicus
gaagtagcacctcctcccaaatcat

SEQ ID NO: 305517 - DNA, 25 bp, Rattus norvegicus
gaagtagcacctgctcccaaatcat

SEQ ID NO: 305518 - DNA, 25 bp, Rattus norvegicus
gaagtagcatcgatgtcctctcagc

SEQ ID NO: 305519 - DNA, 25 bp, Rattus norvegicus
gaagtagcatcgttgtcctctcagc

SEQ ID NO: 305520 - DNA, 25 bp, Rattus norvegicus
gaagtagccatcacatgaacaaagc

SEQ ID NO: 305521 - DNA, 25 bp, Rattus norvegicus
gaagtagccatctcatgaacaaagc

SEQ ID NO: 305522 - DNA, 25 bp, Rattus norvegicus
gaagtagcgacgacacagttctcta

SEQ ID NO: 305523 - DNA, 25 bp, Rattus norvegicus
gaagtagcgacgtcacagttctcta

SEQ ID NO: 305524 - DNA, 25 bp, Rattus norvegicus
gaagtagcgatgaccagcttcgcac

SEQ ID NO: 305525 - DNA, 25 bp, Rattus norvegicus
gaagtagcgatgtccagcttcgcac

SEQ ID NO: 305526 - DNA, 25 bp, Rattus norvegicus
gaagtagctgctctttagtggacca

SEQ ID NO: 305527 - DNA, 25 bp, Rattus norvegicus
gaagtagctgctgtttagtggacca

SEQ ID NO: 305528 - DNA, 25 bp, Rattus norvegicus
gaagtagctgtcaggtccagagcca

SEQ ID NO: 305529 - DNA, 25 bp, Rattus norvegicus
gaagtagctgtctggtccagagcca

SEQ ID NO: 305530 - DNA, 25 bp, Rattus norvegicus
gaagtagctgttactaatcaaagga

SEQ ID NO: 305531 - DNA, 25 bp, Rattus norvegicus
gaagtagctgtttctaatcaaagga

SEQ ID NO: 305532 - DNA, 25 bp, Rattus norvegicus
gaagtagcttgcaaggctctttctt

SEQ ID NO: 305533 - DNA, 25 bp, Rattus norvegicus
gaagtagcttgctaggctctttctt

SEQ ID NO: 305534 - DNA, 25 bp, Rattus norvegicus
gaagtagcttttctcagtgattgtt

SEQ ID NO: 305535 - DNA, 25 bp, Rattus norvegicus
gaagtagcttttgtcagtgattgtt

SEQ ID NO: 305536 - DNA, 25 bp, Rattus norvegicus
gaagtaggaatcagcacccacacag

SEQ ID NO: 305537 - DNA, 25 bp, Rattus norvegicus
gaagtaggaatctgcacccacacag

SEQ ID NO: 305538 - DNA, 25 bp, Rattus norvegicus
gaagtaggactcaccagagcactcc

SEQ ID NO: 305539 - DNA, 25 bp, Rattus norvegicus
gaagtaggactctccagagcactcc

SEQ ID NO: 305540 - DNA, 25 bp, Rattus norvegicus
gaagtaggatctcagctggcatcaa

SEQ ID NO: 305541 - DNA, 25 bp, Rattus norvegicus
gaagtaggatctgagctggcatcaa

SEQ ID NO: 305542 - DNA, 25 bp, Rattus norvegicus
gaagtaggcaacagtaaccctcaaa

SEQ ID NO: 305543 - DNA, 25 bp, Rattus norvegicus
gaagtaggcaactgtaaccctcaaa

SEQ ID NO: 305544 - DNA, 25 bp, Rattus norvegicus
gaagtaggcttgacactttcagacc

SEQ ID NO: 305545 - DNA, 25 bp, Rattus norvegicus
gaagtaggcttgtcactttcagacc

SEQ ID NO: 305546 - DNA, 25 bp, Rattus norvegicus
gaagtagggccaccttgcttcctag

SEQ ID NO: 305547 - DNA, 25 bp, Rattus norvegicus
gaagtagggccagcttgcttcctag

SEQ ID NO: 305548 - DNA, 25 bp, Rattus norvegicus
gaagtaggtgaaagcacttggcttc

SEQ ID NO: 305549 - DNA, 25 bp, Rattus norvegicus
gaagtaggtgaatgcacttggcttc

SEQ ID NO: 305550 - DNA, 25 bp, Rattus norvegicus
gaagtaggtgacatgtgcacaagtt

SEQ ID NO: 305551 - DNA, 25 bp, Rattus norvegicus
gaagtaggtgacttgtgcacaagtt

SEQ ID NO: 305552 - DNA, 25 bp, Rattus norvegicus
gaagtagtagccacagctgccctac

SEQ ID NO: 305553 - DNA, 25 bp, Rattus norvegicus
gaagtagtagcctcagctgccctac

SEQ ID NO: 305554 - DNA, 25 bp, Rattus norvegicus
gaagtagtcagtaacagccatgcta

SEQ ID NO: 305555 - DNA, 25 bp, Rattus norvegicus
gaagtagtcagttacagccatgcta

SEQ ID NO: 305556 - DNA, 25 bp, Rattus norvegicus
gaagtagtcatgcttggtccaatta

SEQ ID NO: 305557 - DNA, 25 bp, Rattus norvegicus
gaagtagtcatggttggtccaatta

SEQ ID NO: 305558 - DNA, 25 bp, Rattus norvegicus
gaagtagtcccgatttggcccagag

SEQ ID NO: 305559 - DNA, 25 bp, Rattus norvegicus
gaagtagtcccgttttggcccagag

SEQ ID NO: 305560 - DNA, 25 bp, Rattus norvegicus
gaagtagtgataacttgaatcttga

SEQ ID NO: 305561 - DNA, 25 bp, Rattus norvegicus
gaagtagtgatatcttgaatcttga

SEQ ID NO: 305562 - DNA, 25 bp, Rattus norvegicus
gaagtagtggctcctttgttctgga

SEQ ID NO: 305563 - DNA, 25 bp, Rattus norvegicus
gaagtagtggctgctttgttctgga

SEQ ID NO: 305564 - DNA, 25 bp, Rattus norvegicus
gaagtagtgtaacacacttctgtga

SEQ ID NO: 305565 - DNA, 25 bp, Rattus norvegicus
gaagtagtgtaagacacttctgtga

SEQ ID NO: 305566 - DNA, 25 bp, Rattus norvegicus
gaagtagtttccaaccgagcgctga

SEQ ID NO: 305567 - DNA, 25 bp, Rattus norvegicus
gaagtagtttccacttcttgcttat

SEQ ID NO: 305568 - DNA, 25 bp, Rattus norvegicus
gaagtagtttcctaccgagcgctga

SEQ ID NO: 305569 - DNA, 25 bp, Rattus norvegicus
gaagtagtttcctcttcttgcttat

SEQ ID NO: 305570 - DNA, 25 bp, Rattus norvegicus
gaagtagtttgcagctaatatatac

SEQ ID NO: 305571 - DNA, 25 bp, Rattus norvegicus
gaagtagtttgctgctaatatatac

SEQ ID NO: 305572 - DNA, 25 bp, Rattus norvegicus
gaagtataccgaacaccatgactcc

SEQ ID NO: 305573 - DNA, 25 bp, Rattus norvegicus
gaagtataccgatcaccatgactcc

SEQ ID NO: 305574 - DNA, 25 bp, Rattus norvegicus
gaagtatacttacgctggaggacac

SEQ ID NO: 305575 - DNA, 25 bp, Rattus norvegicus
gaagtatacttaggctggaggacac

SEQ ID NO: 305576 - DNA, 25 bp, Rattus norvegicus
gaagtatatccgaccactgatgctc

SEQ ID NO: 305577 - DNA, 25 bp, Rattus norvegicus
gaagtatatccgtccactgatgctc

SEQ ID NO: 305578 - DNA, 25 bp, Rattus norvegicus
gaagtatatgctcttgatccataca

SEQ ID NO: 305579 - DNA, 25 bp, Rattus norvegicus
gaagtatatgctgttgatccataca

SEQ ID NO: 305580 - DNA, 25 bp, Rattus norvegicus
gaagtatcagggacaggctcgaaag

SEQ ID NO: 305581 - DNA, 25 bp, Rattus norvegicus
gaagtatcagggtcaggctcgaaag

SEQ ID NO: 305582 - DNA, 25 bp, Rattus norvegicus
gaagtatcatccagcggccttccag

SEQ ID NO: 305583 - DNA, 25 bp, Rattus norvegicus
gaagtatcatcctgcggccttccag

SEQ ID NO: 305584 - DNA, 25 bp, Rattus norvegicus
gaagtatccctcagcactagtttag

SEQ ID NO: 305585 - DNA, 25 bp, Rattus norvegicus
gaagtatccctctgcactagtttag

SEQ ID NO: 305586 - DNA, 25 bp, Rattus norvegicus
gaagtatccgagacctcactgggca

SEQ ID NO: 305587 - DNA, 25 bp, Rattus norvegicus
gaagtatccgagtcctcactgggca

SEQ ID NO: 305588 - DNA, 25 bp, Rattus norvegicus
gaagtatccgtactagttggaaacg

SEQ ID NO: 305589 - DNA, 25 bp, Rattus norvegicus
gaagtatccgtagtagttggaaacg

SEQ ID NO: 305590 - DNA, 25 bp, Rattus norvegicus
gaagtatcctttacattgttaccat

SEQ ID NO: 305591 - DNA, 25 bp, Rattus norvegicus
gaagtatccttttcattgttaccat

SEQ ID NO: 305592 - DNA, 25 bp, Rattus norvegicus
gaagtatcgtggaatgggctctctt

SEQ ID NO: 305593 - DNA, 25 bp, Rattus norvegicus
gaagtatcgtggtatgggctctctt

SEQ ID NO: 305594 - DNA, 25 bp, Rattus norvegicus
gaagtatctcaacgtttatcttttt

SEQ ID NO: 305595 - DNA, 25 bp, Rattus norvegicus
gaagtatctcaaggtttatcttttt

SEQ ID NO: 305596 - DNA, 25 bp, Rattus norvegicus
gaagtatctgaacagacccagaaca

SEQ ID NO: 305597 - DNA, 25 bp, Rattus norvegicus
gaagtatctgaacccctgaggtata

SEQ ID NO: 305598 - DNA, 25 bp, Rattus norvegicus
gaagtatctgaagagacccagaaca

SEQ ID NO: 305599 - DNA, 25 bp, Rattus norvegicus
gaagtatctgaagccctgaggtata

SEQ ID NO: 305600 - DNA, 25 bp, Rattus norvegicus
gaagtatctgccaacagccaagact

SEQ ID NO: 305601 - DNA, 25 bp, Rattus norvegicus
gaagtatctgcctacagccaagact

SEQ ID NO: 305602 - DNA, 25 bp, Rattus norvegicus
gaagtatgacctacgtcgcagttta

SEQ ID NO: 305603 - DNA, 25 bp, Rattus norvegicus
gaagtatgaccttcgtcgcagttta

SEQ ID NO: 305604 - DNA, 25 bp, Rattus norvegicus
gaagtatgattacctttagctgata

SEQ ID NO: 305605 - DNA, 25 bp, Rattus norvegicus
gaagtatgattagctttagctgata

SEQ ID NO: 305606 - DNA, 25 bp, Rattus norvegicus
gaagtatgcttccagagtgggccct

SEQ ID NO: 305607 - DNA, 25 bp, Rattus norvegicus
gaagtatgcttcgagagtgggccct

SEQ ID NO: 305608 - DNA, 25 bp, Rattus norvegicus
gaagtatggacaacctgacaccctg

SEQ ID NO: 305609 - DNA, 25 bp, Rattus norvegicus
gaagtatggacatcctgacaccctg

SEQ ID NO: 305610 - DNA, 25 bp, Rattus norvegicus
gaagtatggtggaattttaacagta

SEQ ID NO: 305611 - DNA, 25 bp, Rattus norvegicus
gaagtatggtggtattttaacagta

SEQ ID NO: 305612 - DNA, 25 bp, Rattus norvegicus
gaagtatgtactcccggaaaccaag

SEQ ID NO: 305613 - DNA, 25 bp, Rattus norvegicus
gaagtatgtactgccggaaaccaag

SEQ ID NO: 305614 - DNA, 25 bp, Rattus norvegicus
gaagtatgtcatcaagtcacagcat

SEQ ID NO: 305615 - DNA, 25 bp, Rattus norvegicus
gaagtatgtcatgaagtcacagcat

SEQ ID NO: 305616 - DNA, 25 bp, Rattus norvegicus
gaagtattaaatatggatcctggag

SEQ ID NO: 305617 - DNA, 25 bp, Rattus norvegicus
gaagtattaaatttggatcctggag

SEQ ID NO: 305618 - DNA, 25 bp, Rattus norvegicus
gaagtattcatgaacctaaaccata

SEQ ID NO: 305619 - DNA, 25 bp, Rattus norvegicus
gaagtattcatgtacctaaaccata

SEQ ID NO: 305620 - DNA, 25 bp, Rattus norvegicus
gaagtattcgctacacgcctgtggg

SEQ ID NO: 305621 - DNA, 25 bp, Rattus norvegicus
gaagtattcgcttcacgcctgtggg

SEQ ID NO: 305622 - DNA, 25 bp, Rattus norvegicus
gaagtattcggaaatcatggctgaa

SEQ ID NO: 305623 - DNA, 25 bp, Rattus norvegicus
gaagtattcggatatcatggctgaa

SEQ ID NO: 305624 - DNA, 25 bp, Rattus norvegicus
gaagtattgcccaatgattcgatat

SEQ ID NO: 305625 - DNA, 25 bp, Rattus norvegicus
gaagtattgccctatgattcgatat

SEQ ID NO: 305626 - DNA, 25 bp, Rattus norvegicus
gaagtattgctacctggagccagtt

SEQ ID NO: 305627 - DNA, 25 bp, Rattus norvegicus
gaagtattgctagctggagccagtt

SEQ ID NO: 305628 - DNA, 25 bp, Rattus norvegicus
gaagtattggccatgggttcacaaa

SEQ ID NO: 305629 - DNA, 25 bp, Rattus norvegicus
gaagtattggccttgggttcacaaa

SEQ ID NO: 305630 - DNA, 25 bp, Rattus norvegicus
gaagtatttcctatgctgggctctg

SEQ ID NO: 305631 - DNA, 25 bp, Rattus norvegicus
gaagtatttcctttgctgggctctg

SEQ ID NO: 305632 - DNA, 25 bp, Rattus norvegicus
gaagtatttgaaagcaggccagaac

SEQ ID NO: 305633 - DNA, 25 bp, Rattus norvegicus
gaagtatttgaatgcaggccagaac

SEQ ID NO: 305634 - DNA, 25 bp, Rattus norvegicus
gaagtattttgaaagcttttcattt

SEQ ID NO: 305635 - DNA, 25 bp, Rattus norvegicus
gaagtattttgacatcctccagcct

SEQ ID NO: 305636 - DNA, 25 bp, Rattus norvegicus
gaagtattttgagatcctccagcct

SEQ ID NO: 305637 - DNA, 25 bp, Rattus norvegicus
gaagtattttgatagcttttcattt

SEQ ID NO: 305638 - DNA, 25 bp, Rattus norvegicus
gaagtattttgtaacctcagtcttg

SEQ ID NO: 305639 - DNA, 25 bp, Rattus norvegicus
gaagtattttgttacctcagtcttg

SEQ ID NO: 305640 - DNA, 25 bp, Rattus norvegicus
gaagtatttttgactccctgtccca

SEQ ID NO: 305641 - DNA, 25 bp, Rattus norvegicus
gaagtatttttgcatcattctacca

SEQ ID NO: 305642 - DNA, 25 bp, Rattus norvegicus
gaagtatttttggatcattctacca

SEQ ID NO: 305643 - DNA, 25 bp, Rattus norvegicus
gaagtatttttgtctccctgtccca

SEQ ID NO: 305644 - DNA, 25 bp, Rattus norvegicus
gaagtcaaaccaacccaattagtat

SEQ ID NO: 305645 - DNA, 25 bp, Rattus norvegicus
gaagtcaaaccatcccaattagtat

SEQ ID NO: 305646 - DNA, 25 bp, Rattus norvegicus
gaagtcaaagcgctctacctagcgt

SEQ ID NO: 305647 - DNA, 25 bp, Rattus norvegicus
gaagtcaaagcggtctacctagcgt

SEQ ID NO: 305648 - DNA, 25 bp, Rattus norvegicus
gaagtcaaattcaatgccacctcca

SEQ ID NO: 305649 - DNA, 25 bp, Rattus norvegicus
gaagtcaaattctatgccacctcca

SEQ ID NO: 305650 - DNA, 25 bp, Rattus norvegicus
gaagtcaaccgtcctgttttaaccg

SEQ ID NO: 305651 - DNA, 25 bp, Rattus norvegicus
gaagtcaaccgtgctgttttaaccg

SEQ ID NO: 305652 - DNA, 25 bp, Rattus norvegicus
gaagtcaacctgacctggaacagaa

SEQ ID NO: 305653 - DNA, 25 bp, Rattus norvegicus
gaagtcaacctgtcctggaacagaa

SEQ ID NO: 305654 - DNA, 25 bp, Rattus norvegicus
gaagtcaagacgctccccaatgaag

SEQ ID NO: 305655 - DNA, 25 bp, Rattus norvegicus
gaagtcaagacggtccccaatgaag

SEQ ID NO: 305656 - DNA, 25 bp, Rattus norvegicus
gaagtcaagattcctttctccaaat

SEQ ID NO: 305657 - DNA, 25 bp, Rattus norvegicus
gaagtcaagattgctttctccaaat

SEQ ID NO: 305658 - DNA, 25 bp, Rattus norvegicus
gaagtcaagcacagcgtcggagcgc

SEQ ID NO: 305659 - DNA, 25 bp, Rattus norvegicus
gaagtcaagcactgcgtcggagcgc

SEQ ID NO: 305660 - DNA, 25 bp, Rattus norvegicus
gaagtcaagggtattcctaccatct

SEQ ID NO: 305661 - DNA, 25 bp, Rattus norvegicus
gaagtcaagggttttcctaccatct

SEQ ID NO: 305662 - DNA, 25 bp, Rattus norvegicus
gaagtcaatcgaagacgttcgtaat

SEQ ID NO: 305663 - DNA, 25 bp, Rattus norvegicus
gaagtcaatcgatgacgttcgtaat

SEQ ID NO: 305664 - DNA, 25 bp, Rattus norvegicus
gaagtcaatgacatggaggcccaga

SEQ ID NO: 305665 - DNA, 25 bp, Rattus norvegicus
gaagtcaatgacttggaggcccaga

SEQ ID NO: 305666 - DNA, 25 bp, Rattus norvegicus
gaagtcaattagctccgctctctgc

SEQ ID NO: 305667 - DNA, 25 bp, Rattus norvegicus
gaagtcaattaggtccgctctctgc

SEQ ID NO: 305668 - DNA, 25 bp, Rattus norvegicus
gaagtcacaactaacatgggcttta

SEQ ID NO: 305669 - DNA, 25 bp, Rattus norvegicus
gaagtcacaacttacatgggcttta

SEQ ID NO: 305670 - DNA, 25 bp, Rattus norvegicus
gaagtcacaatcatacagactgtta

SEQ ID NO: 305671 - DNA, 25 bp, Rattus norvegicus
gaagtcacaatcttacagactgtta

SEQ ID NO: 305672 - DNA, 25 bp, Rattus norvegicus
gaagtcacacctctccatattagtg

SEQ ID NO: 305673 - DNA, 25 bp, Rattus norvegicus
gaagtcacacctgtccatattagtg

SEQ ID NO: 305674 - DNA, 25 bp, Rattus norvegicus
gaagtcacagcaaggctacttatac

SEQ ID NO: 305675 - DNA, 25 bp, Rattus norvegicus
gaagtcacagcatggctacttatac

SEQ ID NO: 305676 - DNA, 25 bp, Rattus norvegicus
gaagtcacagctatctttacctatg

SEQ ID NO: 305677 - DNA, 25 bp, Rattus norvegicus
gaagtcacagctttctttacctatg

SEQ ID NO: 305678 - DNA, 25 bp, Rattus norvegicus
gaagtcacagtgaccctagtctgta

SEQ ID NO: 305679 - DNA, 25 bp, Rattus norvegicus
gaagtcacagtgattggaagatgcc

SEQ ID NO: 305680 - DNA, 25 bp, Rattus norvegicus
gaagtcacagtgtccctagtctgta

SEQ ID NO: 305681 - DNA, 25 bp, Rattus norvegicus
gaagtcacagtgtttggaagatgcc

SEQ ID NO: 305682 - DNA, 25 bp, Rattus norvegicus
gaagtcacatggaacatctcttccc

SEQ ID NO: 305683 - DNA, 25 bp, Rattus norvegicus
gaagtcacatggtacatctcttccc

SEQ ID NO: 305684 - DNA, 25 bp, Rattus norvegicus
gaagtcacattacagttctggtctg

SEQ ID NO: 305685 - DNA, 25 bp, Rattus norvegicus
gaagtcacattagagttctggtctg

SEQ ID NO: 305686 - DNA, 25 bp, Rattus norvegicus
gaagtcaccattccatttgattatg

SEQ ID NO: 305687 - DNA, 25 bp, Rattus norvegicus
gaagtcaccattgcatttgattatg

SEQ ID NO: 305688 - DNA, 25 bp, Rattus norvegicus
gaagtcacccagatgtttttatttg

SEQ ID NO: 305689 - DNA, 25 bp, Rattus norvegicus
gaagtcacccagttgtttttatttg

SEQ ID NO: 305690 - DNA, 25 bp, Rattus norvegicus
gaagtcacccatcagggcctgagct

SEQ ID NO: 305691 - DNA, 25 bp, Rattus norvegicus
gaagtcacccatgagggcctgagct

SEQ ID NO: 305692 - DNA, 25 bp, Rattus norvegicus
gaagtcacctccagaatgattccca

SEQ ID NO: 305693 - DNA, 25 bp, Rattus norvegicus
gaagtcacctcctgaatgattccca

SEQ ID NO: 305694 - DNA, 25 bp, Rattus norvegicus
gaagtcacctgcctcaggaagtcac

SEQ ID NO: 305695 - DNA, 25 bp, Rattus norvegicus
gaagtcacctgcgtcaggaagtcac

SEQ ID NO: 305696 - DNA, 25 bp, Rattus norvegicus
gaagtcacctgtcaccctggtgtca

SEQ ID NO: 305697 - DNA, 25 bp, Rattus norvegicus
gaagtcacctgtgaccctggtgtca

SEQ ID NO: 305698 - DNA, 25 bp, Rattus norvegicus
gaagtcaccttcatttatttcacaa

SEQ ID NO: 305699 - DNA, 25 bp, Rattus norvegicus
gaagtcaccttcttttatttcacaa

SEQ ID NO: 305700 - DNA, 25 bp, Rattus norvegicus
gaagtcacgagccaatgattttgta

SEQ ID NO: 305701 - DNA, 25 bp, Rattus norvegicus
gaagtcacgagcgaatgattttgta

SEQ ID NO: 305702 - DNA, 25 bp, Rattus norvegicus
gaagtcacgtgaccttggtttcctt

SEQ ID NO: 305703 - DNA, 25 bp, Rattus norvegicus
gaagtcacgtgagcttggtttcctt

SEQ ID NO: 305704 - DNA, 25 bp, Rattus norvegicus
gaagtcactcaaaggctgtaaagct

SEQ ID NO: 305705 - DNA, 25 bp, Rattus norvegicus
gaagtcactcaatggctgtaaagct

SEQ ID NO: 305706 - DNA, 25 bp, Rattus norvegicus
gaagtcactctacagcatagtctat

SEQ ID NO: 305707 - DNA, 25 bp, Rattus norvegicus
gaagtcactctagagcatagtctat

SEQ ID NO: 305708 - DNA, 25 bp, Rattus norvegicus
gaagtcactgtccagagggtttcat

SEQ ID NO: 305709 - DNA, 25 bp, Rattus norvegicus
gaagtcactgtcgagagggtttcat

SEQ ID NO: 305710 - DNA, 25 bp, Rattus norvegicus
gaagtcactgtgatagaaacaggtt

SEQ ID NO: 305711 - DNA, 25 bp, Rattus norvegicus
gaagtcactgtgttagaaacaggtt

SEQ ID NO: 305712 - DNA, 25 bp, Rattus norvegicus
gaagtcacttatctgctcagccaaa

SEQ ID NO: 305713 - DNA, 25 bp, Rattus norvegicus
gaagtcacttatgtgctcagccaaa

SEQ ID NO: 305714 - DNA, 25 bp, Rattus norvegicus
gaagtcacttggatctgtgttcacc

SEQ ID NO: 305715 - DNA, 25 bp, Rattus norvegicus
gaagtcacttggttctgtgttcacc

SEQ ID NO: 305716 - DNA, 25 bp, Rattus norvegicus
gaagtcacttgtccagtttgcaaat

SEQ ID NO: 305717 - DNA, 25 bp, Rattus norvegicus
gaagtcacttgtgcagtttgcaaat

SEQ ID NO: 305718 - DNA, 25 bp, Rattus norvegicus
gaagtcactttaagctgtctccctt

SEQ ID NO: 305719 - DNA, 25 bp, Rattus norvegicus
gaagtcactttatgctgtctccctt

SEQ ID NO: 305720 - DNA, 25 bp, Rattus norvegicus
gaagtcacttttaccatgtgttttc

SEQ ID NO: 305721 - DNA, 25 bp, Rattus norvegicus
gaagtcactttttccatgtgttttc

SEQ ID NO: 305722 - DNA, 25 bp, Rattus norvegicus
gaagtcagaaagaccaccctggcct

SEQ ID NO: 305723 - DNA, 25 bp, Rattus norvegicus
gaagtcagaaagtccaccctggcct

SEQ ID NO: 305724 - DNA, 25 bp, Rattus norvegicus
gaagtcagaaatactccctagaaga

SEQ ID NO: 305725 - DNA, 25 bp, Rattus norvegicus
gaagtcagaaatctgctctgcccat

SEQ ID NO: 305726 - DNA, 25 bp, Rattus norvegicus
gaagtcagaaatgtgctctgcccat

SEQ ID NO: 305727 - DNA, 25 bp, Rattus norvegicus
gaagtcagaaattctccctagaaga

SEQ ID NO: 305728 - DNA, 25 bp, Rattus norvegicus
gaagtcagaacacaacctttcccct

SEQ ID NO: 305729 - DNA, 25 bp, Rattus norvegicus
gaagtcagaacagaacctttcccct

SEQ ID NO: 305730 - DNA, 25 bp, Rattus norvegicus
gaagtcagaactagccttgtatcgt

SEQ ID NO: 305731 - DNA, 25 bp, Rattus norvegicus
gaagtcagaactctcgttaatagct

SEQ ID NO: 305732 - DNA, 25 bp, Rattus norvegicus
gaagtcagaactgtcgttaatagct

SEQ ID NO: 305733 - DNA, 25 bp, Rattus norvegicus
gaagtcagaacttgccttgtatcgt

SEQ ID NO: 305734 - DNA, 25 bp, Rattus norvegicus
gaagtcagaagccaagctttctccc

SEQ ID NO: 305735 - DNA, 25 bp, Rattus norvegicus
gaagtcagaagcgaagctttctccc

SEQ ID NO: 305736 - DNA, 25 bp, Rattus norvegicus
gaagtcagaccgaccagtttctaac

SEQ ID NO: 305737 - DNA, 25 bp, Rattus norvegicus
gaagtcagaccgtccagtttctaac

SEQ ID NO: 305738 - DNA, 25 bp, Rattus norvegicus
gaagtcagactcattacacactcag

SEQ ID NO: 305739 - DNA, 25 bp, Rattus norvegicus
gaagtcagactctttacacactcag

SEQ ID NO: 305740 - DNA, 25 bp, Rattus norvegicus
gaagtcagcattctccagatttaaa

SEQ ID NO: 305741 - DNA, 25 bp, Rattus norvegicus
gaagtcagcattgtccagatttaaa

SEQ ID NO: 305742 - DNA, 25 bp, Rattus norvegicus
gaagtcagcccacgcgggataaact

SEQ ID NO: 305743 - DNA, 25 bp, Rattus norvegicus
gaagtcagcccaggcgggataaact

SEQ ID NO: 305744 - DNA, 25 bp, Rattus norvegicus
gaagtcagcccgcaagttggccaac

SEQ ID NO: 305745 - DNA, 25 bp, Rattus norvegicus
gaagtcagcccggaagttggccaac

SEQ ID NO: 305746 - DNA, 25 bp, Rattus norvegicus
gaagtcagccctcgcactttaagat

SEQ ID NO: 305747 - DNA, 25 bp, Rattus norvegicus
gaagtcagccctggcactttaagat

SEQ ID NO: 305748 - DNA, 25 bp, Rattus norvegicus
gaagtcagcctgactgtgatactgt

SEQ ID NO: 305749 - DNA, 25 bp, Rattus norvegicus
gaagtcagcctgtctgtgatactgt

SEQ ID NO: 305750 - DNA, 25 bp, Rattus norvegicus
gaagtcagccttaccaagagctctg

SEQ ID NO: 305751 - DNA, 25 bp, Rattus norvegicus
gaagtcagcctttccaagagctctg

SEQ ID NO: 305752 - DNA, 25 bp, Rattus norvegicus
gaagtcaggactagtccactggcct

SEQ ID NO: 305753 - DNA, 25 bp, Rattus norvegicus
gaagtcaggacttgtccactggcct

SEQ ID NO: 305754 - DNA, 25 bp, Rattus norvegicus
gaagtcaggctgagcgttccgctga

SEQ ID NO: 305755 - DNA, 25 bp, Rattus norvegicus
gaagtcaggctgtgcgttccgctga

SEQ ID NO: 305756 - DNA, 25 bp, Rattus norvegicus
gaagtcaggcttccattcaagcaaa

SEQ ID NO: 305757 - DNA, 25 bp, Rattus norvegicus
gaagtcaggcttgcattcaagcaaa

SEQ ID NO: 305758 - DNA, 25 bp, Rattus norvegicus
gaagtcagggctagaacaaccagca

SEQ ID NO: 305759 - DNA, 25 bp, Rattus norvegicus
gaagtcagggcttgaacaaccagca

SEQ ID NO: 305760 - DNA, 25 bp, Rattus norvegicus
gaagtcagtactctgtgagcagcct

SEQ ID NO: 305761 - DNA, 25 bp, Rattus norvegicus
gaagtcagtactgtgtgagcagcct

SEQ ID NO: 305762 - DNA, 25 bp, Rattus norvegicus
gaagtcagtatgatgtttctcagaa

SEQ ID NO: 305763 - DNA, 25 bp, Rattus norvegicus
gaagtcagtatgttgtttctcagaa

SEQ ID NO: 305764 - DNA, 25 bp, Rattus norvegicus
gaagtcagtattccaaccaggcagc

SEQ ID NO: 305765 - DNA, 25 bp, Rattus norvegicus
gaagtcagtattgcaaccaggcagc

SEQ ID NO: 305766 - DNA, 25 bp, Rattus norvegicus
gaagtcagtctacccattaaaatgt

SEQ ID NO: 305767 - DNA, 25 bp, Rattus norvegicus
gaagtcagtctagccattaaaatgt

SEQ ID NO: 305768 - DNA, 25 bp, Rattus norvegicus
gaagtcagtgacaccagacccgaag

SEQ ID NO: 305769 - DNA, 25 bp, Rattus norvegicus
gaagtcagtgactccagacccgaag

SEQ ID NO: 305770 - DNA, 25 bp, Rattus norvegicus
gaagtcagtgcgcttcacataaaca

SEQ ID NO: 305771 - DNA, 25 bp, Rattus norvegicus
gaagtcagtgcggttcacataaaca

SEQ ID NO: 305772 - DNA, 25 bp, Rattus norvegicus
gaagtcagtgttaagcaggtacaga

SEQ ID NO: 305773 - DNA, 25 bp, Rattus norvegicus
gaagtcagtgtttagcaggtacaga

SEQ ID NO: 305774 - DNA, 25 bp, Rattus norvegicus
gaagtcagttaacgtcacccaaaag

SEQ ID NO: 305775 - DNA, 25 bp, Rattus norvegicus
gaagtcagttaaggtcacccaaaag

SEQ ID NO: 305776 - DNA, 25 bp, Rattus norvegicus
gaagtcagttttagtcatgttgcta

SEQ ID NO: 305777 - DNA, 25 bp, Rattus norvegicus
gaagtcagtttttgtcatgttgcta

SEQ ID NO: 305778 - DNA, 25 bp, Rattus norvegicus
gaagtcatagctcagtaatagccac

SEQ ID NO: 305779 - DNA, 25 bp, Rattus norvegicus
gaagtcatagctgagtaatagccac

SEQ ID NO: 305780 - DNA, 25 bp, Rattus norvegicus
gaagtcatatgcctcgtgcagtctg

SEQ ID NO: 305781 - DNA, 25 bp, Rattus norvegicus
gaagtcatatgcgtcgtgcagtctg

SEQ ID NO: 305782 - DNA, 25 bp, Rattus norvegicus
gaagtcatcagcatacaggccacac

SEQ ID NO: 305783 - DNA, 25 bp, Rattus norvegicus
gaagtcatcagcttacaggccacac

SEQ ID NO: 305784 - DNA, 25 bp, Rattus norvegicus
gaagtcatccacaacattgccaggc

SEQ ID NO: 305785 - DNA, 25 bp, Rattus norvegicus
gaagtcatccactacattgccaggc

SEQ ID NO: 305786 - DNA, 25 bp, Rattus norvegicus
gaagtcatcctactgttctttaatg

SEQ ID NO: 305787 - DNA, 25 bp, Rattus norvegicus
gaagtcatcctagtgttctttaatg

SEQ ID NO: 305788 - DNA, 25 bp, Rattus norvegicus
gaagtcatcgggactaaggccagct

SEQ ID NO: 305789 - DNA, 25 bp, Rattus norvegicus
gaagtcatcgggtctaaggccagct

SEQ ID NO: 305790 - DNA, 25 bp, Rattus norvegicus
gaagtcatctccaattattcccaat

SEQ ID NO: 305791 - DNA, 25 bp, Rattus norvegicus
gaagtcatctccaggcaccaagcag

SEQ ID NO: 305792 - DNA, 25 bp, Rattus norvegicus
gaagtcatctcctattattcccaat

SEQ ID NO: 305793 - DNA, 25 bp, Rattus norvegicus
gaagtcatctcctggcaccaagcag

SEQ ID NO: 305794 - DNA, 25 bp, Rattus norvegicus
gaagtcatcttgctaccagtattta

SEQ ID NO: 305795 - DNA, 25 bp, Rattus norvegicus
gaagtcatcttggtaccagtattta

SEQ ID NO: 305796 - DNA, 25 bp, Rattus norvegicus
gaagtcatctttatatttgtgtctg

SEQ ID NO: 305797 - DNA, 25 bp, Rattus norvegicus
gaagtcatctttttatttgtgtctg

SEQ ID NO: 305798 - DNA, 25 bp, Rattus norvegicus
gaagtcatgactccagagatcttag

SEQ ID NO: 305799 - DNA, 25 bp, Rattus norvegicus
gaagtcatgactgcagagatcttag

SEQ ID NO: 305800 - DNA, 25 bp, Rattus norvegicus
gaagtcatgcacacttgttgaagtt

SEQ ID NO: 305801 - DNA, 25 bp, Rattus norvegicus
gaagtcatgcactcttgttgaagtt

SEQ ID NO: 305802 - DNA, 25 bp, Rattus norvegicus
gaagtcatgtatcgtggcgtacacc

SEQ ID NO: 305803 - DNA, 25 bp, Rattus norvegicus
gaagtcatgtatggtggcgtacacc

SEQ ID NO: 305804 - DNA, 25 bp, Rattus norvegicus
gaagtcatgttacagttcgtcagca

SEQ ID NO: 305805 - DNA, 25 bp, Rattus norvegicus
gaagtcatgttagagttcgtcagca

SEQ ID NO: 305806 - DNA, 25 bp, Rattus norvegicus
gaagtcattcccacagagaggtctt

SEQ ID NO: 305807 - DNA, 25 bp, Rattus norvegicus
gaagtcattccctcagagaggtctt

SEQ ID NO: 305808 - DNA, 25 bp, Rattus norvegicus
gaagtcattctactgttggtatatc

SEQ ID NO: 305809 - DNA, 25 bp, Rattus norvegicus
gaagtcattctagtgttggtatatc

SEQ ID NO: 305810 - DNA, 25 bp, Rattus norvegicus
gaagtcattcttcagtggtgcatgg

SEQ ID NO: 305811 - DNA, 25 bp, Rattus norvegicus
gaagtcattcttgagtggtgcatgg

SEQ ID NO: 305812 - DNA, 25 bp, Rattus norvegicus
gaagtcatttgaacctggttcattc

SEQ ID NO: 305813 - DNA, 25 bp, Rattus norvegicus
gaagtcatttgatcctggttcattc

SEQ ID NO: 305814 - DNA, 25 bp, Rattus norvegicus
gaagtcatttttctcggtttgtgag

SEQ ID NO: 305815 - DNA, 25 bp, Rattus norvegicus
gaagtcatttttgtcggtttgtgag

SEQ ID NO: 305816 - DNA, 25 bp, Rattus norvegicus
gaagtccaaagacacccctagcagt

SEQ ID NO: 305817 - DNA, 25 bp, Rattus norvegicus
gaagtccaaagagacccctagcagt

SEQ ID NO: 305818 - DNA, 25 bp, Rattus norvegicus
gaagtccaaattccatcagctttga

SEQ ID NO: 305819 - DNA, 25 bp, Rattus norvegicus
gaagtccaaattgcatcagctttga

SEQ ID NO: 305820 - DNA, 25 bp, Rattus norvegicus
gaagtccaacaactccaagtcatgt

SEQ ID NO: 305821 - DNA, 25 bp, Rattus norvegicus
gaagtccaacaagtccaagtcatgt

SEQ ID NO: 305822 - DNA, 25 bp, Rattus norvegicus
gaagtccaacttacaggaaccaagg

SEQ ID NO: 305823 - DNA, 25 bp, Rattus norvegicus
gaagtccaacttcaaatgggctagc

SEQ ID NO: 305824 - DNA, 25 bp, Rattus norvegicus
gaagtccaacttgaaatgggctagc

SEQ ID NO: 305825 - DNA, 25 bp, Rattus norvegicus
gaagtccaactttcaggaaccaagg

SEQ ID NO: 305826 - DNA, 25 bp, Rattus norvegicus
gaagtccaagcaactgcagttccag

SEQ ID NO: 305827 - DNA, 25 bp, Rattus norvegicus
gaagtccaagcatctgcagttccag

SEQ ID NO: 305828 - DNA, 25 bp, Rattus norvegicus
gaagtccaaggtactgtcagcctga

SEQ ID NO: 305829 - DNA, 25 bp, Rattus norvegicus
gaagtccaaggtcaacccactttga

SEQ ID NO: 305830 - DNA, 25 bp, Rattus norvegicus
gaagtccaaggtgaacccactttga

SEQ ID NO: 305831 - DNA, 25 bp, Rattus norvegicus
gaagtccaaggttctgtcagcctga

SEQ ID NO: 305832 - DNA, 25 bp, Rattus norvegicus
gaagtccaagtgaaatctaccatgt

SEQ ID NO: 305833 - DNA, 25 bp, Rattus norvegicus
gaagtccaagtgtaatctaccatgt

SEQ ID NO: 305834 - DNA, 25 bp, Rattus norvegicus
gaagtccacagcaaaacagttttct

SEQ ID NO: 305835 - DNA, 25 bp, Rattus norvegicus
gaagtccacagctaaacagttttct

SEQ ID NO: 305836 - DNA, 25 bp, Rattus norvegicus
gaagtccagaccacggagaagctga

SEQ ID NO: 305837 - DNA, 25 bp, Rattus norvegicus
gaagtccagacctcggagaagctga

SEQ ID NO: 305838 - DNA, 25 bp, Rattus norvegicus
gaagtccagcatacctgtgttggaa

SEQ ID NO: 305839 - DNA, 25 bp, Rattus norvegicus
gaagtccagcattcctgtgttggaa

SEQ ID NO: 305840 - DNA, 25 bp, Rattus norvegicus
gaagtccagctaagctttggcagat

SEQ ID NO: 305841 - DNA, 25 bp, Rattus norvegicus
gaagtccagctatgctttggcagat

SEQ ID NO: 305842 - DNA, 25 bp, Rattus norvegicus
gaagtccaggcccagtagctgtaga

SEQ ID NO: 305843 - DNA, 25 bp, Rattus norvegicus
gaagtccaggccgagtagctgtaga

SEQ ID NO: 305844 - DNA, 25 bp, Rattus norvegicus
gaagtccaggcgatgatggccacct

SEQ ID NO: 305845 - DNA, 25 bp, Rattus norvegicus
gaagtccaggcgttgatggccacct

SEQ ID NO: 305846 - DNA, 25 bp, Rattus norvegicus
gaagtccagggtaccatatcactgt

SEQ ID NO: 305847 - DNA, 25 bp, Rattus norvegicus
gaagtccagggtccctttctagtgt

SEQ ID NO: 305848 - DNA, 25 bp, Rattus norvegicus
gaagtccagggtgcctttctagtgt

SEQ ID NO: 305849 - DNA, 25 bp, Rattus norvegicus
gaagtccagggttccatatcactgt

SEQ ID NO: 305850 - DNA, 25 bp, Rattus norvegicus
gaagtccagtcacagttcttactct

SEQ ID NO: 305851 - DNA, 25 bp, Rattus norvegicus
gaagtccagtcagagttcttactct

SEQ ID NO: 305852 - DNA, 25 bp, Rattus norvegicus
gaagtccatcaaagcgagcatcagt

SEQ ID NO: 305853 - DNA, 25 bp, Rattus norvegicus
gaagtccatcaatgcgagcatcagt

SEQ ID NO: 305854 - DNA, 25 bp, Rattus norvegicus
gaagtccattctatccttattcttg

SEQ ID NO: 305855 - DNA, 25 bp, Rattus norvegicus
gaagtccattctcatgaagcagcta

SEQ ID NO: 305856 - DNA, 25 bp, Rattus norvegicus
gaagtccattctgatgaagcagcta

SEQ ID NO: 305857 - DNA, 25 bp, Rattus norvegicus
gaagtccattctttccttattcttg

SEQ ID NO: 305858 - DNA, 25 bp, Rattus norvegicus
gaagtcccaatcataaacaagaagt

SEQ ID NO: 305859 - DNA, 25 bp, Rattus norvegicus
gaagtcccaatcttaaacaagaagt

SEQ ID NO: 305860 - DNA, 25 bp, Rattus norvegicus
gaagtcccagtaactgactcaggag

SEQ ID NO: 305861 - DNA, 25 bp, Rattus norvegicus
gaagtcccagtatctgactcaggag

SEQ ID NO: 305862 - DNA, 25 bp, Rattus norvegicus
gaagtcccattactcagctctggat

SEQ ID NO: 305863 - DNA, 25 bp, Rattus norvegicus
gaagtcccattagtcagctctggat

SEQ ID NO: 305864 - DNA, 25 bp, Rattus norvegicus
gaagtcccattcctgaagcactgga

SEQ ID NO: 305865 - DNA, 25 bp, Rattus norvegicus
gaagtcccattcgtgaagcactgga

SEQ ID NO: 305866 - DNA, 25 bp, Rattus norvegicus
gaagtccccacgagctagcaatgtg

SEQ ID NO: 305867 - DNA, 25 bp, Rattus norvegicus
gaagtccccacgatgacactgagtc

SEQ ID NO: 305868 - DNA, 25 bp, Rattus norvegicus
gaagtccccacgtgctagcaatgtg

SEQ ID NO: 305869 - DNA, 25 bp, Rattus norvegicus
gaagtccccacgttgacactgagtc

SEQ ID NO: 305870 - DNA, 25 bp, Rattus norvegicus
gaagtccccagtactgtcctctgaa

SEQ ID NO: 305871 - DNA, 25 bp, Rattus norvegicus
gaagtccccagttctgtcctctgaa

SEQ ID NO: 305872 - DNA, 25 bp, Rattus norvegicus
gaagtccccattaccttgtctataa

SEQ ID NO: 305873 - DNA, 25 bp, Rattus norvegicus
gaagtccccatttccttgtctataa

SEQ ID NO: 305874 - DNA, 25 bp, Rattus norvegicus
gaagtcccgccccaaacctgaaatg

SEQ ID NO: 305875 - DNA, 25 bp, Rattus norvegicus
gaagtcccgcccgaaacctgaaatg

SEQ ID NO: 305876 - DNA, 25 bp, Rattus norvegicus
gaagtccctctcatggaggcggaaa

SEQ ID NO: 305877 - DNA, 25 bp, Rattus norvegicus
gaagtccctctcttggaggcggaaa

SEQ ID NO: 305878 - DNA, 25 bp, Rattus norvegicus
gaagtccctctgatttacatttggt

SEQ ID NO: 305879 - DNA, 25 bp, Rattus norvegicus
gaagtccctctgttttacatttggt

SEQ ID NO: 305880 - DNA, 25 bp, Rattus norvegicus
gaagtccctgagacttgaataattc

SEQ ID NO: 305881 - DNA, 25 bp, Rattus norvegicus
gaagtccctgagtcttgaataattc

SEQ ID NO: 305882 - DNA, 25 bp, Rattus norvegicus
gaagtccctgccaaaggctgactga

SEQ ID NO: 305883 - DNA, 25 bp, Rattus norvegicus
gaagtccctgcctaaggctgactga

SEQ ID NO: 305884 - DNA, 25 bp, Rattus norvegicus
gaagtccctgtgcagattcatctca

SEQ ID NO: 305885 - DNA, 25 bp, Rattus norvegicus
gaagtccctgtggagattcatctca

SEQ ID NO: 305886 - DNA, 25 bp, Rattus norvegicus
gaagtcccttctatgtttgcaataa

SEQ ID NO: 305887 - DNA, 25 bp, Rattus norvegicus
gaagtcccttctttgtttgcaataa

SEQ ID NO: 305888 - DNA, 25 bp, Rattus norvegicus
gaagtcccttttaagccatgagttc

SEQ ID NO: 305889 - DNA, 25 bp, Rattus norvegicus
gaagtccctttttagccatgagttc

SEQ ID NO: 305890 - DNA, 25 bp, Rattus norvegicus
gaagtccgagaacacgtactccgtg

SEQ ID NO: 305891 - DNA, 25 bp, Rattus norvegicus
gaagtccgagaagacgtactccgtg

SEQ ID NO: 305892 - DNA, 25 bp, Rattus norvegicus
gaagtccgatcaacctgccctaagt

SEQ ID NO: 305893 - DNA, 25 bp, Rattus norvegicus
gaagtccgatcatcctgccctaagt

SEQ ID NO: 305894 - DNA, 25 bp, Rattus norvegicus
gaagtccgcctgaggagcgtgtatc

SEQ ID NO: 305895 - DNA, 25 bp, Rattus norvegicus
gaagtccgcctgtggagcgtgtatc

SEQ ID NO: 305896 - DNA, 25 bp, Rattus norvegicus
gaagtccgttgaattcccagttcat

SEQ ID NO: 305897 - DNA, 25 bp, Rattus norvegicus
gaagtccgttgatttcccagttcat

SEQ ID NO: 305898 - DNA, 25 bp, Rattus norvegicus
gaagtcctattgcaggtgtgacagt

SEQ ID NO: 305899 - DNA, 25 bp, Rattus norvegicus
gaagtcctattggaggtgtgacagt

SEQ ID NO: 305900 - DNA, 25 bp, Rattus norvegicus
gaagtcctcagcaagagtgtacctt

SEQ ID NO: 305901 - DNA, 25 bp, Rattus norvegicus
gaagtcctcagctagagtgtacctt

SEQ ID NO: 305902 - DNA, 25 bp, Rattus norvegicus
gaagtcctcaggcatgtgcatggat

SEQ ID NO: 305903 - DNA, 25 bp, Rattus norvegicus
gaagtcctcagggatgtgcatggat

SEQ ID NO: 305904 - DNA, 25 bp, Rattus norvegicus
gaagtcctccctcccgagctgggag

SEQ ID NO: 305905 - DNA, 25 bp, Rattus norvegicus
gaagtcctccctgccgagctgggag

SEQ ID NO: 305906 - DNA, 25 bp, Rattus norvegicus
gaagtcctctagaacacagtcccag

SEQ ID NO: 305907 - DNA, 25 bp, Rattus norvegicus
gaagtcctctagtacacagtcccag

SEQ ID NO: 305908 - DNA, 25 bp, Rattus norvegicus
gaagtcctctccaatggctgtgcta

SEQ ID NO: 305909 - DNA, 25 bp, Rattus norvegicus
gaagtcctctcctatggctgtgcta

SEQ ID NO: 305910 - DNA, 25 bp, Rattus norvegicus
gaagtcctgcagagagtggcattct

SEQ ID NO: 305911 - DNA, 25 bp, Rattus norvegicus
gaagtcctgcagagggacccgagct

SEQ ID NO: 305912 - DNA, 25 bp, Rattus norvegicus
gaagtcctgcagtgagtggcattct

SEQ ID NO: 305913 - DNA, 25 bp, Rattus norvegicus
gaagtcctgcagtgggacccgagct

SEQ ID NO: 305914 - DNA, 25 bp, Rattus norvegicus
gaagtcctgctacacattctctgca

SEQ ID NO: 305915 - DNA, 25 bp, Rattus norvegicus
gaagtcctgctagacattctctgca

SEQ ID NO: 305916 - DNA, 25 bp, Rattus norvegicus
gaagtcctgctgcaaatggtatctt

SEQ ID NO: 305917 - DNA, 25 bp, Rattus norvegicus
gaagtcctgctggaaatggtatctt

SEQ ID NO: 305918 - DNA, 25 bp, Rattus norvegicus
gaagtcctgcttagtatcctgtctg

SEQ ID NO: 305919 - DNA, 25 bp, Rattus norvegicus
gaagtcctgctttgtatcctgtctg

SEQ ID NO: 305920 - DNA, 25 bp, Rattus norvegicus
gaagtcctggtcaacttgcaagcct

SEQ ID NO: 305921 - DNA, 25 bp, Rattus norvegicus
gaagtcctggtctacttgcaagcct

SEQ ID NO: 305922 - DNA, 25 bp, Rattus norvegicus
gaagtcctgtaacttgctaactaaa

SEQ ID NO: 305923 - DNA, 25 bp, Rattus norvegicus
gaagtcctgtaagttgctaactaaa

SEQ ID NO: 305924 - DNA, 25 bp, Rattus norvegicus
gaagtcctgtccatggcgccaccaa

SEQ ID NO: 305925 - DNA, 25 bp, Rattus norvegicus
gaagtcctgtccttggcgccaccaa

SEQ ID NO: 305926 - DNA, 25 bp, Rattus norvegicus
gaagtcctgtgcacatgtttggatt

SEQ ID NO: 305927 - DNA, 25 bp, Rattus norvegicus
gaagtcctgtgctcatgtttggatt

SEQ ID NO: 305928 - DNA, 25 bp, Rattus norvegicus
gaagtcctgttgctttacatagcaa

SEQ ID NO: 305929 - DNA, 25 bp, Rattus norvegicus
gaagtcctgttggtttacatagcaa

SEQ ID NO: 305930 - DNA, 25 bp, Rattus norvegicus
gaagtccttcagataccaagctctc

SEQ ID NO: 305931 - DNA, 25 bp, Rattus norvegicus
gaagtccttcagttaccaagctctc

SEQ ID NO: 305932 - DNA, 25 bp, Rattus norvegicus
gaagtccttcatcaacacacctagg

SEQ ID NO: 305933 - DNA, 25 bp, Rattus norvegicus
gaagtccttcatcacccaaatttaa

SEQ ID NO: 305934 - DNA, 25 bp, Rattus norvegicus
gaagtccttcatgaacacacctagg

SEQ ID NO: 305935 - DNA, 25 bp, Rattus norvegicus
gaagtccttcatgacccaaatttaa

SEQ ID NO: 305936 - DNA, 25 bp, Rattus norvegicus
gaagtccttccccatgcaaatcgga

SEQ ID NO: 305937 - DNA, 25 bp, Rattus norvegicus
gaagtccttcccgatgcaaatcgga

SEQ ID NO: 305938 - DNA, 25 bp, Rattus norvegicus
gaagtccttcctattagctattgga

SEQ ID NO: 305939 - DNA, 25 bp, Rattus norvegicus
gaagtccttccttttagctattgga

SEQ ID NO: 305940 - DNA, 25 bp, Rattus norvegicus
gaagtccttgacaactggctgcaga

SEQ ID NO: 305941 - DNA, 25 bp, Rattus norvegicus
gaagtccttgactactggctgcaga

SEQ ID NO: 305942 - DNA, 25 bp, Rattus norvegicus
gaagtccttgccagactagaactca

SEQ ID NO: 305943 - DNA, 25 bp, Rattus norvegicus
gaagtccttgcctgactagaactca

SEQ ID NO: 305944 - DNA, 25 bp, Rattus norvegicus
gaagtccttttgaatgccaaaccca

SEQ ID NO: 305945 - DNA, 25 bp, Rattus norvegicus
gaagtccttttgtatgccaaaccca

SEQ ID NO: 305946 - DNA, 25 bp, Rattus norvegicus
gaagtcgaaaacctcaaccactgtg

SEQ ID NO: 305947 - DNA, 25 bp, Rattus norvegicus
gaagtcgaaaacgtcaaccactgtg

SEQ ID NO: 305948 - DNA, 25 bp, Rattus norvegicus
gaagtcgattacctgtcttagtaca

SEQ ID NO: 305949 - DNA, 25 bp, Rattus norvegicus
gaagtcgattacgtgtcttagtaca

SEQ ID NO: 305950 - DNA, 25 bp, Rattus norvegicus
gaagtcgatttccagcatcatctag

SEQ ID NO: 305951 - DNA, 25 bp, Rattus norvegicus
gaagtcgatttcgagcatcatctag

SEQ ID NO: 305952 - DNA, 25 bp, Rattus norvegicus
gaagtcgcactcacaggaactgatt

SEQ ID NO: 305953 - DNA, 25 bp, Rattus norvegicus
gaagtcgcactctcaggaactgatt

SEQ ID NO: 305954 - DNA, 25 bp, Rattus norvegicus
gaagtcgcgcagcttccctggcgaa

SEQ ID NO: 305955 - DNA, 25 bp, Rattus norvegicus
gaagtcgcgcaggttccctggcgaa

SEQ ID NO: 305956 - DNA, 25 bp, Rattus norvegicus
gaagtcgcgtagctcgctcgctata

SEQ ID NO: 305957 - DNA, 25 bp, Rattus norvegicus
gaagtcgcgtaggtcgctcgctata

SEQ ID NO: 305958 - DNA, 25 bp, Rattus norvegicus
gaagtcgctcagctcattcagggag

SEQ ID NO: 305959 - DNA, 25 bp, Rattus norvegicus
gaagtcgctcaggtcattcagggag

SEQ ID NO: 305960 - DNA, 25 bp, Rattus norvegicus
gaagtcgcttttccagagtggatac

SEQ ID NO: 305961 - DNA, 25 bp, Rattus norvegicus
gaagtcgcttttgcagagtggatac

SEQ ID NO: 305962 - DNA, 25 bp, Rattus norvegicus
gaagtcggacgcatctagtttcctt

SEQ ID NO: 305963 - DNA, 25 bp, Rattus norvegicus
gaagtcggacgcttctagtttcctt

SEQ ID NO: 305964 - DNA, 25 bp, Rattus norvegicus
gaagtcggcggaagaaacaccaact

SEQ ID NO: 305965 - DNA, 25 bp, Rattus norvegicus
gaagtcggcggatgaaacaccaact

SEQ ID NO: 305966 - DNA, 25 bp, Rattus norvegicus
gaagtcggcgtccacctggagggaa

SEQ ID NO: 305967 - DNA, 25 bp, Rattus norvegicus
gaagtcggcgtcgacctggagggaa

SEQ ID NO: 305968 - DNA, 25 bp, Rattus norvegicus
gaagtcggctcacaacaaagggtct

SEQ ID NO: 305969 - DNA, 25 bp, Rattus norvegicus
gaagtcggctcagaacaaagggtct

SEQ ID NO: 305970 - DNA, 25 bp, Rattus norvegicus
gaagtcggctccaggagactctaga

SEQ ID NO: 305971 - DNA, 25 bp, Rattus norvegicus
gaagtcggctcctggagactctaga

SEQ ID NO: 305972 - DNA, 25 bp, Rattus norvegicus
gaagtcggtgacacagttggataga

SEQ ID NO: 305973 - DNA, 25 bp, Rattus norvegicus
gaagtcggtgactcagttggataga

SEQ ID NO: 305974 - DNA, 25 bp, Rattus norvegicus
gaagtcgtaaacatccagacctgga

SEQ ID NO: 305975 - DNA, 25 bp, Rattus norvegicus
gaagtcgtaaacttccagacctgga

SEQ ID NO: 305976 - DNA, 25 bp, Rattus norvegicus
gaagtcgtaaatagtcctgcagagg

SEQ ID NO: 305977 - DNA, 25 bp, Rattus norvegicus
gaagtcgtaaattgtcctgcagagg

SEQ ID NO: 305978 - DNA, 25 bp, Rattus norvegicus
gaagtcgtcttcagtgttcctttaa

SEQ ID NO: 305979 - DNA, 25 bp, Rattus norvegicus
gaagtcgtcttctgtgttcctttaa

SEQ ID NO: 305980 - DNA, 25 bp, Rattus norvegicus
gaagtcgtgcatcaatgtgcctggc

SEQ ID NO: 305981 - DNA, 25 bp, Rattus norvegicus
gaagtcgtgcatgaatgtgcctggc

SEQ ID NO: 305982 - DNA, 25 bp, Rattus norvegicus
gaagtcgtgtccagtgtggtcgccc

SEQ ID NO: 305983 - DNA, 25 bp, Rattus norvegicus
gaagtcgtgtcctgtgtggtcgccc

SEQ ID NO: 305984 - DNA, 25 bp, Rattus norvegicus
gaagtcgttaatactgttgggttga

SEQ ID NO: 305985 - DNA, 25 bp, Rattus norvegicus
gaagtcgttaattctgttgggttga

SEQ ID NO: 305986 - DNA, 25 bp, Rattus norvegicus
gaagtctaacaaaaagctcccgtgt

SEQ ID NO: 305987 - DNA, 25 bp, Rattus norvegicus
gaagtctaacaataagctcccgtgt

SEQ ID NO: 305988 - DNA, 25 bp, Rattus norvegicus
gaagtctaataacgtatccatccag

SEQ ID NO: 305989 - DNA, 25 bp, Rattus norvegicus
gaagtctaataaggtatccatccag

SEQ ID NO: 305990 - DNA, 25 bp, Rattus norvegicus
gaagtctaatagcttgcacacaact

SEQ ID NO: 305991 - DNA, 25 bp, Rattus norvegicus
gaagtctaataggttgcacacaact

SEQ ID NO: 305992 - DNA, 25 bp, Rattus norvegicus
gaagtctacacaatgaacctatata

SEQ ID NO: 305993 - DNA, 25 bp, Rattus norvegicus
gaagtctacacattgaacctatata

SEQ ID NO: 305994 - DNA, 25 bp, Rattus norvegicus
gaagtctacactattttcaggtaag

SEQ ID NO: 305995 - DNA, 25 bp, Rattus norvegicus
gaagtctacacttttttcaggtaag

SEQ ID NO: 305996 - DNA, 25 bp, Rattus norvegicus
gaagtctacagcactacagctctaa

SEQ ID NO: 305997 - DNA, 25 bp, Rattus norvegicus
gaagtctacagctctacagctctaa

SEQ ID NO: 305998 - DNA, 25 bp, Rattus norvegicus
gaagtctaccacacgagaacgcaac

SEQ ID NO: 305999 - DNA, 25 bp, Rattus norvegicus
gaagtctaccactcgagaacgcaac

SEQ ID NO: 306000 - DNA, 25 bp, Rattus norvegicus
gaagtctacttgaacattgtcaaat

SEQ ID NO: 306001 - DNA, 25 bp, Rattus norvegicus
gaagtctacttgtacattgtcaaat

SEQ ID NO: 306002 - DNA, 25 bp, Rattus norvegicus
gaagtctagagaaggcgaacacagc

SEQ ID NO: 306003 - DNA, 25 bp, Rattus norvegicus
gaagtctagagatggcgaacacagc

SEQ ID NO: 306004 - DNA, 25 bp, Rattus norvegicus
gaagtctatcacctgaagccaagaa

SEQ ID NO: 306005 - DNA, 25 bp, Rattus norvegicus
gaagtctatcacgtgaagccaagaa

SEQ ID NO: 306006 - DNA, 25 bp, Rattus norvegicus
gaagtctatccacggacctattctg

SEQ ID NO: 306007 - DNA, 25 bp, Rattus norvegicus
gaagtctatccagggacctattctg

SEQ ID NO: 306008 - DNA, 25 bp, Rattus norvegicus
gaagtctatcctcgagaagtgtcag

SEQ ID NO: 306009 - DNA, 25 bp, Rattus norvegicus
gaagtctatcctggagaagtgtcag

SEQ ID NO: 306010 - DNA, 25 bp, Rattus norvegicus
gaagtctatgagacttgtgtataca

SEQ ID NO: 306011 - DNA, 25 bp, Rattus norvegicus
gaagtctatgagtcttgtgtataca

SEQ ID NO: 306012 - DNA, 25 bp, Rattus norvegicus
gaagtctcaaaaagtgctaatcttg

SEQ ID NO: 306013 - DNA, 25 bp, Rattus norvegicus
gaagtctcaaaatgtgctaatcttg

SEQ ID NO: 306014 - DNA, 25 bp, Rattus norvegicus
gaagtctcaaatcacacgctcatca

SEQ ID NO: 306015 - DNA, 25 bp, Rattus norvegicus
gaagtctcaaatgacacgctcatca

SEQ ID NO: 306016 - DNA, 25 bp, Rattus norvegicus
gaagtctcacttctttctgtgtagt

SEQ ID NO: 306017 - DNA, 25 bp, Rattus norvegicus
gaagtctcacttgtttctgtgtagt

SEQ ID NO: 306018 - DNA, 25 bp, Rattus norvegicus
gaagtctcagtgacaggccttaaga

SEQ ID NO: 306019 - DNA, 25 bp, Rattus norvegicus
gaagtctcagtgtcaggccttaaga

SEQ ID NO: 306020 - DNA, 25 bp, Rattus norvegicus
gaagtctcatagataatgtgccatg

SEQ ID NO: 306021 - DNA, 25 bp, Rattus norvegicus
gaagtctcatagttaatgtgccatg

SEQ ID NO: 306022 - DNA, 25 bp, Rattus norvegicus
gaagtctcatccaaagctgagccag

SEQ ID NO: 306023 - DNA, 25 bp, Rattus norvegicus
gaagtctcatcctaagctgagccag

SEQ ID NO: 306024 - DNA, 25 bp, Rattus norvegicus
gaagtctccattctgacatatttgg

SEQ ID NO: 306025 - DNA, 25 bp, Rattus norvegicus
gaagtctccattgtgacatatttgg

SEQ ID NO: 306026 - DNA, 25 bp, Rattus norvegicus
gaagtctcccaaattttgcagttat

SEQ ID NO: 306027 - DNA, 25 bp, Rattus norvegicus
gaagtctcccaatttttgcagttat

SEQ ID NO: 306028 - DNA, 25 bp, Rattus norvegicus
gaagtctcgaagatgatggtcagga

SEQ ID NO: 306029 - DNA, 25 bp, Rattus norvegicus
gaagtctcgaagttgatggtcagga

SEQ ID NO: 306030 - DNA, 25 bp, Rattus norvegicus
gaagtctctaccacattgttgtaca

SEQ ID NO: 306031 - DNA, 25 bp, Rattus norvegicus
gaagtctctacctcattgttgtaca

SEQ ID NO: 306032 - DNA, 25 bp, Rattus norvegicus
gaagtctctagtctttctgtacctt

SEQ ID NO: 306033 - DNA, 25 bp, Rattus norvegicus
gaagtctctagtgtttctgtacctt

SEQ ID NO: 306034 - DNA, 25 bp, Rattus norvegicus
gaagtctctctcacggcagtacaaa

SEQ ID NO: 306035 - DNA, 25 bp, Rattus norvegicus
gaagtctctctctcggcagtacaaa

SEQ ID NO: 306036 - DNA, 25 bp, Rattus norvegicus
gaagtctctctgctccattgtaagc

SEQ ID NO: 306037 - DNA, 25 bp, Rattus norvegicus
gaagtctctctggtccattgtaagc

SEQ ID NO: 306038 - DNA, 25 bp, Rattus norvegicus
gaagtctctgatctgatgtcaactc

SEQ ID NO: 306039 - DNA, 25 bp, Rattus norvegicus
gaagtctctgatgtgatgtcaactc

SEQ ID NO: 306040 - DNA, 25 bp, Rattus norvegicus
gaagtctctgccagttgtaaaaccc

SEQ ID NO: 306041 - DNA, 25 bp, Rattus norvegicus
gaagtctctgcctgttgtaaaaccc

SEQ ID NO: 306042 - DNA, 25 bp, Rattus norvegicus
gaagtctctggtagaccctaaggat

SEQ ID NO: 306043 - DNA, 25 bp, Rattus norvegicus
gaagtctctggttgaccctaaggat

SEQ ID NO: 306044 - DNA, 25 bp, Rattus norvegicus
gaagtctctgtaccttatgctcaat

SEQ ID NO: 306045 - DNA, 25 bp, Rattus norvegicus
gaagtctctgtactccatagttgga

SEQ ID NO: 306046 - DNA, 25 bp, Rattus norvegicus
gaagtctctgtagcttatgctcaat

SEQ ID NO: 306047 - DNA, 25 bp, Rattus norvegicus
gaagtctctgtagtccatagttgga

SEQ ID NO: 306048 - DNA, 25 bp, Rattus norvegicus
gaagtctgaactcggcacgtacgtg

SEQ ID NO: 306049 - DNA, 25 bp, Rattus norvegicus
gaagtctgaactgggcacgtacgtg

SEQ ID NO: 306050 - DNA, 25 bp, Rattus norvegicus
gaagtctgacaaatgccagtcacag

SEQ ID NO: 306051 - DNA, 25 bp, Rattus norvegicus
gaagtctgacaattgccagtcacag

SEQ ID NO: 306052 - DNA, 25 bp, Rattus norvegicus
gaagtctgacctatagttttgctat

SEQ ID NO: 306053 - DNA, 25 bp, Rattus norvegicus
gaagtctgacctttagttttgctat

SEQ ID NO: 306054 - DNA, 25 bp, Rattus norvegicus
gaagtctgacttcattttgccagca

SEQ ID NO: 306055 - DNA, 25 bp, Rattus norvegicus
gaagtctgacttgattttgccagca

SEQ ID NO: 306056 - DNA, 25 bp, Rattus norvegicus
gaagtctgagtcaagcagccacata

SEQ ID NO: 306057 - DNA, 25 bp, Rattus norvegicus
gaagtctgagtctagcagccacata

SEQ ID NO: 306058 - DNA, 25 bp, Rattus norvegicus
gaagtctgcagtcatttcttagccc

SEQ ID NO: 306059 - DNA, 25 bp, Rattus norvegicus
gaagtctgcagtgatttcttagccc

SEQ ID NO: 306060 - DNA, 25 bp, Rattus norvegicus
gaagtctgccatctgcatgacgctg

SEQ ID NO: 306061 - DNA, 25 bp, Rattus norvegicus
gaagtctgccatgtgcatgacgctg

SEQ ID NO: 306062 - DNA, 25 bp, Rattus norvegicus
gaagtctgcgaccacgccagaaacc

SEQ ID NO: 306063 - DNA, 25 bp, Rattus norvegicus
gaagtctgcgacgacgccagaaacc

SEQ ID NO: 306064 - DNA, 25 bp, Rattus norvegicus
gaagtctgctatcttttgtttataa

SEQ ID NO: 306065 - DNA, 25 bp, Rattus norvegicus
gaagtctgctatgttttgtttataa

SEQ ID NO: 306066 - DNA, 25 bp, Rattus norvegicus
gaagtctgctgcataccttagtcag

SEQ ID NO: 306067 - DNA, 25 bp, Rattus norvegicus
gaagtctgctgcttaccttagtcag

SEQ ID NO: 306068 - DNA, 25 bp, Rattus norvegicus
gaagtctggcacaccatggatgaca

SEQ ID NO: 306069 - DNA, 25 bp, Rattus norvegicus
gaagtctggcactccatggatgaca

SEQ ID NO: 306070 - DNA, 25 bp, Rattus norvegicus
gaagtctggcccaaagagccctgtt

SEQ ID NO: 306071 - DNA, 25 bp, Rattus norvegicus
gaagtctggccctaagagccctgtt

SEQ ID NO: 306072 - DNA, 25 bp, Rattus norvegicus
gaagtctgggcacccacgtcctttt

SEQ ID NO: 306073 - DNA, 25 bp, Rattus norvegicus
gaagtctgggcagccacgtcctttt

SEQ ID NO: 306074 - DNA, 25 bp, Rattus norvegicus
gaagtctggtggacctgcctttttt

SEQ ID NO: 306075 - DNA, 25 bp, Rattus norvegicus
gaagtctggtggtcctgcctttttt

SEQ ID NO: 306076 - DNA, 25 bp, Rattus norvegicus
gaagtctggtgtctgtctttctagc

SEQ ID NO: 306077 - DNA, 25 bp, Rattus norvegicus
gaagtctggtgtgtgtctttctagc

SEQ ID NO: 306078 - DNA, 25 bp, Rattus norvegicus
gaagtctgtactctaaagattacaa

SEQ ID NO: 306079 - DNA, 25 bp, Rattus norvegicus
gaagtctgtactgtaaagattacaa

SEQ ID NO: 306080 - DNA, 25 bp, Rattus norvegicus
gaagtctgtgacaagccttggccac

SEQ ID NO: 306081 - DNA, 25 bp, Rattus norvegicus
gaagtctgtgacctcacgaagccaa

SEQ ID NO: 306082 - DNA, 25 bp, Rattus norvegicus
gaagtctgtgacgtcacgaagccaa

SEQ ID NO: 306083 - DNA, 25 bp, Rattus norvegicus
gaagtctgtgactagccttggccac

SEQ ID NO: 306084 - DNA, 25 bp, Rattus norvegicus
gaagtctgtgctactttgtggcatt

SEQ ID NO: 306085 - DNA, 25 bp, Rattus norvegicus
gaagtctgtgcttctttgtggcatt

SEQ ID NO: 306086 - DNA, 25 bp, Rattus norvegicus
gaagtctgtggaatcctgtcacaat

SEQ ID NO: 306087 - DNA, 25 bp, Rattus norvegicus
gaagtctgtggattcctgtcacaat

SEQ ID NO: 306088 - DNA, 25 bp, Rattus norvegicus
gaagtctgtggcaattccacgtcat

SEQ ID NO: 306089 - DNA, 25 bp, Rattus norvegicus
gaagtctgtggctattccacgtcat

SEQ ID NO: 306090 - DNA, 25 bp, Rattus norvegicus
gaagtctgtgttcgtaagggcccca

SEQ ID NO: 306091 - DNA, 25 bp, Rattus norvegicus
gaagtctgtgttggtaagggcccca

SEQ ID NO: 306092 - DNA, 25 bp, Rattus norvegicus
gaagtctgttaccttattttctgta

SEQ ID NO: 306093 - DNA, 25 bp, Rattus norvegicus
gaagtctgttacgttattttctgta

SEQ ID NO: 306094 - DNA, 25 bp, Rattus norvegicus
gaagtctgttcaattaatagcccgt

SEQ ID NO: 306095 - DNA, 25 bp, Rattus norvegicus
gaagtctgttcatttaatagcccgt

SEQ ID NO: 306096 - DNA, 25 bp, Rattus norvegicus
gaagtctgttccatttaatggtttg

SEQ ID NO: 306097 - DNA, 25 bp, Rattus norvegicus
gaagtctgttccttttaatggtttg

SEQ ID NO: 306098 - DNA, 25 bp, Rattus norvegicus
gaagtcttaacaactaccactaaat

SEQ ID NO: 306099 - DNA, 25 bp, Rattus norvegicus
gaagtcttaacatctaccactaaat

SEQ ID NO: 306100 - DNA, 25 bp, Rattus norvegicus
gaagtcttaatcaccaactacgagg

SEQ ID NO: 306101 - DNA, 25 bp, Rattus norvegicus
gaagtcttaatctccaactacgagg

SEQ ID NO: 306102 - DNA, 25 bp, Rattus norvegicus
gaagtcttactaaccagaggccatt

SEQ ID NO: 306103 - DNA, 25 bp, Rattus norvegicus
gaagtcttactatccagaggccatt

SEQ ID NO: 306104 - DNA, 25 bp, Rattus norvegicus
gaagtcttcacacaggtggccaatc

SEQ ID NO: 306105 - DNA, 25 bp, Rattus norvegicus
gaagtcttcacagaggtggccaatc

SEQ ID NO: 306106 - DNA, 25 bp, Rattus norvegicus
gaagtcttcagtaagagatggcagt

SEQ ID NO: 306107 - DNA, 25 bp, Rattus norvegicus
gaagtcttcagttagagatggcagt

SEQ ID NO: 306108 - DNA, 25 bp, Rattus norvegicus
gaagtcttcatcaagtgttctaagg

SEQ ID NO: 306109 - DNA, 25 bp, Rattus norvegicus
gaagtcttcatctagtgttctaagg

SEQ ID NO: 306110 - DNA, 25 bp, Rattus norvegicus
gaagtcttcccacgattctgagctc

SEQ ID NO: 306111 - DNA, 25 bp, Rattus norvegicus
gaagtcttcccaggattctgagctc

SEQ ID NO: 306112 - DNA, 25 bp, Rattus norvegicus
gaagtcttccttcgcccaacaggac

SEQ ID NO: 306113 - DNA, 25 bp, Rattus norvegicus
gaagtcttccttggcccaacaggac

SEQ ID NO: 306114 - DNA, 25 bp, Rattus norvegicus
gaagtcttcgagctctttagtgtca

SEQ ID NO: 306115 - DNA, 25 bp, Rattus norvegicus
gaagtcttcgaggtctttagtgtca

SEQ ID NO: 306116 - DNA, 25 bp, Rattus norvegicus
gaagtcttctacattgaggtaacca

SEQ ID NO: 306117 - DNA, 25 bp, Rattus norvegicus
gaagtcttctactttgaggtaacca

SEQ ID NO: 306118 - DNA, 25 bp, Rattus norvegicus
gaagtcttctcacatcggtttttta

SEQ ID NO: 306119 - DNA, 25 bp, Rattus norvegicus
gaagtcttctcagatcggtttttta

SEQ ID NO: 306120 - DNA, 25 bp, Rattus norvegicus
gaagtcttctgaccatgggcaccag

SEQ ID NO: 306121 - DNA, 25 bp, Rattus norvegicus
gaagtcttctgagcatgggcaccag

SEQ ID NO: 306122 - DNA, 25 bp, Rattus norvegicus
gaagtcttgaacacctgaacgtcat

SEQ ID NO: 306123 - DNA, 25 bp, Rattus norvegicus
gaagtcttgaactcctgaacgtcat

SEQ ID NO: 306124 - DNA, 25 bp, Rattus norvegicus
gaagtcttgacccaaaagcaatgaa

SEQ ID NO: 306125 - DNA, 25 bp, Rattus norvegicus
gaagtcttgaccgaaaagcaatgaa

SEQ ID NO: 306126 - DNA, 25 bp, Rattus norvegicus
gaagtcttgagtattggcccttgct

SEQ ID NO: 306127 - DNA, 25 bp, Rattus norvegicus
gaagtcttgagttttggcccttgct

SEQ ID NO: 306128 - DNA, 25 bp, Rattus norvegicus
gaagtcttggagctcacagtcttga

SEQ ID NO: 306129 - DNA, 25 bp, Rattus norvegicus
gaagtcttggaggtcacagtcttga

SEQ ID NO: 306130 - DNA, 25 bp, Rattus norvegicus
gaagtcttggttacagctcccaaaa

SEQ ID NO: 306131 - DNA, 25 bp, Rattus norvegicus
gaagtcttggtttcagctcccaaaa

SEQ ID NO: 306132 - DNA, 25 bp, Rattus norvegicus
gaagtcttgtccagatttcatgcgc

SEQ ID NO: 306133 - DNA, 25 bp, Rattus norvegicus
gaagtcttgtcctgatttcatgcgc

SEQ ID NO: 306134 - DNA, 25 bp, Rattus norvegicus
gaagtcttgtctcatttggtaggaa

SEQ ID NO: 306135 - DNA, 25 bp, Rattus norvegicus
gaagtcttgtctgatttggtaggaa

SEQ ID NO: 306136 - DNA, 25 bp, Rattus norvegicus
gaagtcttgttcagtaagtacacac

SEQ ID NO: 306137 - DNA, 25 bp, Rattus norvegicus
gaagtcttgttctgtaagtacacac

SEQ ID NO: 306138 - DNA, 25 bp, Rattus norvegicus
gaagtctttaaccagttctctgtgt

SEQ ID NO: 306139 - DNA, 25 bp, Rattus norvegicus
gaagtctttaacgagttctctgtgt

SEQ ID NO: 306140 - DNA, 25 bp, Rattus norvegicus
gaagtctttattctttcccagtctg

SEQ ID NO: 306141 - DNA, 25 bp, Rattus norvegicus
gaagtctttattgtttcccagtctg

SEQ ID NO: 306142 - DNA, 25 bp, Rattus norvegicus
gaagtctttcctaaccatttatcaa

SEQ ID NO: 306143 - DNA, 25 bp, Rattus norvegicus
gaagtctttccttaccatttatcaa

SEQ ID NO: 306144 - DNA, 25 bp, Rattus norvegicus
gaagtctttctcagaggcttctcat

SEQ ID NO: 306145 - DNA, 25 bp, Rattus norvegicus
gaagtctttctctgaggcttctcat

SEQ ID NO: 306146 - DNA, 25 bp, Rattus norvegicus
gaagtcttttgtccaagctggagaa

SEQ ID NO: 306147 - DNA, 25 bp, Rattus norvegicus
gaagtcttttgtgcaagctggagaa

SEQ ID NO: 306148 - DNA, 25 bp, Rattus norvegicus
gaagtctttttcagtttaggcttat

SEQ ID NO: 306149 - DNA, 25 bp, Rattus norvegicus
gaagtctttttctgtttaggcttat

SEQ ID NO: 306150 - DNA, 25 bp, Rattus norvegicus
gaagtcttttttccagccttgtact

SEQ ID NO: 306151 - DNA, 25 bp, Rattus norvegicus
gaagtcttttttgcagccttgtact

SEQ ID NO: 306152 - DNA, 25 bp, Rattus norvegicus
gaagtgaaaacacgcctcaggttag

SEQ ID NO: 306153 - DNA, 25 bp, Rattus norvegicus
gaagtgaaaacaggcctcaggttag

SEQ ID NO: 306154 - DNA, 25 bp, Rattus norvegicus
gaagtgaaactcctttctccaaggg

SEQ ID NO: 306155 - DNA, 25 bp, Rattus norvegicus
gaagtgaaactcgtttctccaaggg

SEQ ID NO: 306156 - DNA, 25 bp, Rattus norvegicus
gaagtgaacactaccgatctcatcc

SEQ ID NO: 306157 - DNA, 25 bp, Rattus norvegicus
gaagtgaacacttccgatctcatcc

SEQ ID NO: 306158 - DNA, 25 bp, Rattus norvegicus
gaagtgaaccagctaactccctcct

SEQ ID NO: 306159 - DNA, 25 bp, Rattus norvegicus
gaagtgaaccaggtaactccctcct

SEQ ID NO: 306160 - DNA, 25 bp, Rattus norvegicus
gaagtgaacgcacccatggtctatg

SEQ ID NO: 306161 - DNA, 25 bp, Rattus norvegicus
gaagtgaacgcagccatggtctatg

SEQ ID NO: 306162 - DNA, 25 bp, Rattus norvegicus
gaagtgaactcaaccatataatcta

SEQ ID NO: 306163 - DNA, 25 bp, Rattus norvegicus
gaagtgaactcatccatataatcta

SEQ ID NO: 306164 - DNA, 25 bp, Rattus norvegicus
gaagtgaagcccctagtgtccagca

SEQ ID NO: 306165 - DNA, 25 bp, Rattus norvegicus
gaagtgaagcccgtagtgtccagca

SEQ ID NO: 306166 - DNA, 25 bp, Rattus norvegicus
gaagtgaatttcctagcatcttttt

SEQ ID NO: 306167 - DNA, 25 bp, Rattus norvegicus
gaagtgaatttcgtagcatcttttt

SEQ ID NO: 306168 - DNA, 25 bp, Rattus norvegicus
gaagtgacacatactctaggtccac

SEQ ID NO: 306169 - DNA, 25 bp, Rattus norvegicus
gaagtgacacattctctaggtccac

SEQ ID NO: 306170 - DNA, 25 bp, Rattus norvegicus
gaagtgacactcagcaaacccattc

SEQ ID NO: 306171 - DNA, 25 bp, Rattus norvegicus
gaagtgacactctgcaaacccattc

SEQ ID NO: 306172 - DNA, 25 bp, Rattus norvegicus
gaagtgacatggatctcaccctgcg

SEQ ID NO: 306173 - DNA, 25 bp, Rattus norvegicus
gaagtgacatggttctcaccctgcg

SEQ ID NO: 306174 - DNA, 25 bp, Rattus norvegicus
gaagtgacatttaacccagggtgtg

SEQ ID NO: 306175 - DNA, 25 bp, Rattus norvegicus
gaagtgacattttacccagggtgtg

SEQ ID NO: 306176 - DNA, 25 bp, Rattus norvegicus
gaagtgaccacaatctaagctttac

SEQ ID NO: 306177 - DNA, 25 bp, Rattus norvegicus
gaagtgaccacattctaagctttac

SEQ ID NO: 306178 - DNA, 25 bp, Rattus norvegicus
gaagtgaccactagttcaatgctaa

SEQ ID NO: 306179 - DNA, 25 bp, Rattus norvegicus
gaagtgaccacttgttcaatgctaa

SEQ ID NO: 306180 - DNA, 25 bp, Rattus norvegicus
gaagtgaccagcacacatcaacgct

SEQ ID NO: 306181 - DNA, 25 bp, Rattus norvegicus
gaagtgaccagctcacatcaacgct

SEQ ID NO: 306182 - DNA, 25 bp, Rattus norvegicus
gaagtgaccattaactcagacagca

SEQ ID NO: 306183 - DNA, 25 bp, Rattus norvegicus
gaagtgaccatttactcagacagca

SEQ ID NO: 306184 - DNA, 25 bp, Rattus norvegicus
gaagtgacccaaaatgtctgtctga

SEQ ID NO: 306185 - DNA, 25 bp, Rattus norvegicus
gaagtgacccaacccgacgcaagta

SEQ ID NO: 306186 - DNA, 25 bp, Rattus norvegicus
gaagtgacccaagccgacgcaagta

SEQ ID NO: 306187 - DNA, 25 bp, Rattus norvegicus
gaagtgacccaatatgtctgtctga

SEQ ID NO: 306188 - DNA, 25 bp, Rattus norvegicus
gaagtgacccgcaaactttctgaag

SEQ ID NO: 306189 - DNA, 25 bp, Rattus norvegicus
gaagtgacccgctaactttctgaag

SEQ ID NO: 306190 - DNA, 25 bp, Rattus norvegicus
gaagtgaccgctcagaacagcctca

SEQ ID NO: 306191 - DNA, 25 bp, Rattus norvegicus
gaagtgaccgctgagaacagcctca

SEQ ID NO: 306192 - DNA, 25 bp, Rattus norvegicus
gaagtgacctcactgctcgtttgca

SEQ ID NO: 306193 - DNA, 25 bp, Rattus norvegicus
gaagtgacctcagtgctcgtttgca

SEQ ID NO: 306194 - DNA, 25 bp, Rattus norvegicus
gaagtgacctcccacagtcttttga

SEQ ID NO: 306195 - DNA, 25 bp, Rattus norvegicus
gaagtgacctccgacagtcttttga

SEQ ID NO: 306196 - DNA, 25 bp, Rattus norvegicus
gaagtgaccttcatgtctctgtaat

SEQ ID NO: 306197 - DNA, 25 bp, Rattus norvegicus
gaagtgaccttcttgtctctgtaat

SEQ ID NO: 306198 - DNA, 25 bp, Rattus norvegicus
gaagtgaccttgatcatgggcacag

SEQ ID NO: 306199 - DNA, 25 bp, Rattus norvegicus
gaagtgaccttgttcatgggcacag

SEQ ID NO: 306200 - DNA, 25 bp, Rattus norvegicus
gaagtgacggacaacaagttgtaat

SEQ ID NO: 306201 - DNA, 25 bp, Rattus norvegicus
gaagtgacggactacaagttgtaat

SEQ ID NO: 306202 - DNA, 25 bp, Rattus norvegicus
gaagtgactaatcccaccaatgctc

SEQ ID NO: 306203 - DNA, 25 bp, Rattus norvegicus
gaagtgactaatgccaccaatgctc

SEQ ID NO: 306204 - DNA, 25 bp, Rattus norvegicus
gaagtgactactcatccatcctgta

SEQ ID NO: 306205 - DNA, 25 bp, Rattus norvegicus
gaagtgactactgatccatcctgta

SEQ ID NO: 306206 - DNA, 25 bp, Rattus norvegicus
gaagtgactcatcttggctttagta

SEQ ID NO: 306207 - DNA, 25 bp, Rattus norvegicus
gaagtgactcatgttggctttagta

SEQ ID NO: 306208 - DNA, 25 bp, Rattus norvegicus
gaagtgactctcagttccttataga

SEQ ID NO: 306209 - DNA, 25 bp, Rattus norvegicus
gaagtgactctctgttccttataga

SEQ ID NO: 306210 - DNA, 25 bp, Rattus norvegicus
gaagtgactgcaccagttccgctaa

SEQ ID NO: 306211 - DNA, 25 bp, Rattus norvegicus
gaagtgactgcagcagttccgctaa

SEQ ID NO: 306212 - DNA, 25 bp, Rattus norvegicus
gaagtgactgcccatatatttttat

SEQ ID NO: 306213 - DNA, 25 bp, Rattus norvegicus
gaagtgactgccgatatatttttat

SEQ ID NO: 306214 - DNA, 25 bp, Rattus norvegicus
gaagtgactggaatggtcccatgat

SEQ ID NO: 306215 - DNA, 25 bp, Rattus norvegicus
gaagtgactggattggtcccatgat

SEQ ID NO: 306216 - DNA, 25 bp, Rattus norvegicus
gaagtgactgtcatcttttaaatac

SEQ ID NO: 306217 - DNA, 25 bp, Rattus norvegicus
gaagtgactgtcttcttttaaatac

SEQ ID NO: 306218 - DNA, 25 bp, Rattus norvegicus
gaagtgagaagcaggtctcccgcct

SEQ ID NO: 306219 - DNA, 25 bp, Rattus norvegicus
gaagtgagaagctggtctcccgcct

SEQ ID NO: 306220 - DNA, 25 bp, Rattus norvegicus
gaagtgagaccactgcattaatttt

SEQ ID NO: 306221 - DNA, 25 bp, Rattus norvegicus
gaagtgagaccagtgcattaatttt

SEQ ID NO: 306222 - DNA, 25 bp, Rattus norvegicus
gaagtgagagttaaggcccagcaaa

SEQ ID NO: 306223 - DNA, 25 bp, Rattus norvegicus
gaagtgagagtttaggcccagcaaa

SEQ ID NO: 306224 - DNA, 25 bp, Rattus norvegicus
gaagtgagatgaaaactctgttgat

SEQ ID NO: 306225 - DNA, 25 bp, Rattus norvegicus
gaagtgagatgataactctgttgat

SEQ ID NO: 306226 - DNA, 25 bp, Rattus norvegicus
gaagtgagcctactccagttttttg

SEQ ID NO: 306227 - DNA, 25 bp, Rattus norvegicus
gaagtgagcctagtccagttttttg

SEQ ID NO: 306228 - DNA, 25 bp, Rattus norvegicus
gaagtgagctccacgagactcggca

SEQ ID NO: 306229 - DNA, 25 bp, Rattus norvegicus
gaagtgagctcctcgagactcggca

SEQ ID NO: 306230 - DNA, 25 bp, Rattus norvegicus
gaagtgagcttgatccttgggagct

SEQ ID NO: 306231 - DNA, 25 bp, Rattus norvegicus
gaagtgagcttgttccttgggagct

SEQ ID NO: 306232 - DNA, 25 bp, Rattus norvegicus
gaagtgaggctcaaggaccttaccc

SEQ ID NO: 306233 - DNA, 25 bp, Rattus norvegicus
gaagtgaggctctaggaccttaccc

SEQ ID NO: 306234 - DNA, 25 bp, Rattus norvegicus
gaagtgaggtgtccaggactccctt

SEQ ID NO: 306235 - DNA, 25 bp, Rattus norvegicus
gaagtgaggtgtgcaggactccctt

SEQ ID NO: 306236 - DNA, 25 bp, Rattus norvegicus
gaagtgagtcagcaatgcccttgaa

SEQ ID NO: 306237 - DNA, 25 bp, Rattus norvegicus
gaagtgagtcaggaatgcccttgaa

SEQ ID NO: 306238 - DNA, 25 bp, Rattus norvegicus
gaagtgagtgtgagcctcgagcctc

SEQ ID NO: 306239 - DNA, 25 bp, Rattus norvegicus
gaagtgagtgtgtgcctcgagcctc

SEQ ID NO: 306240 - DNA, 25 bp, Rattus norvegicus
gaagtgatacccctgttgagaccca

SEQ ID NO: 306241 - DNA, 25 bp, Rattus norvegicus
gaagtgatacccgtgttgagaccca

SEQ ID NO: 306242 - DNA, 25 bp, Rattus norvegicus
gaagtgatccaacgcatccctgtct

SEQ ID NO: 306243 - DNA, 25 bp, Rattus norvegicus
gaagtgatccaaggcatccctgtct

SEQ ID NO: 306244 - DNA, 25 bp, Rattus norvegicus
gaagtgatccagatcctccaagatc

SEQ ID NO: 306245 - DNA, 25 bp, Rattus norvegicus
gaagtgatccagttcctccaagatc

SEQ ID NO: 306246 - DNA, 25 bp, Rattus norvegicus
gaagtgatcccacctttgattgaga

SEQ ID NO: 306247 - DNA, 25 bp, Rattus norvegicus
gaagtgatcccagctttgattgaga

SEQ ID NO: 306248 - DNA, 25 bp, Rattus norvegicus
gaagtgatcctccatcgttttgtcc

SEQ ID NO: 306249 - DNA, 25 bp, Rattus norvegicus
gaagtgatcctcgatcgttttgtcc

SEQ ID NO: 306250 - DNA, 25 bp, Rattus norvegicus
gaagtgatcgatacacctgtgtttg

SEQ ID NO: 306251 - DNA, 25 bp, Rattus norvegicus
gaagtgatcgattcacctgtgtttg

SEQ ID NO: 306252 - DNA, 25 bp, Rattus norvegicus
gaagtgatcgccatggcacctgcca

SEQ ID NO: 306253 - DNA, 25 bp, Rattus norvegicus
gaagtgatcgccttggcacctgcca

SEQ ID NO: 306254 - DNA, 25 bp, Rattus norvegicus
gaagtgatcgtcaaatataagtaag

SEQ ID NO: 306255 - DNA, 25 bp, Rattus norvegicus
gaagtgatcgtctaatataagtaag

SEQ ID NO: 306256 - DNA, 25 bp, Rattus norvegicus
gaagtgatctgactgctttggcaaa

SEQ ID NO: 306257 - DNA, 25 bp, Rattus norvegicus
gaagtgatctgagtgctttggcaaa

SEQ ID NO: 306258 - DNA, 25 bp, Rattus norvegicus
gaagtgatgcctacaagctctgcac

SEQ ID NO: 306259 - DNA, 25 bp, Rattus norvegicus
gaagtgatgccttcaagctctgcac

SEQ ID NO: 306260 - DNA, 25 bp, Rattus norvegicus
gaagtgatggcgatctttcaggcac

SEQ ID NO: 306261 - DNA, 25 bp, Rattus norvegicus
gaagtgatggcgttctttcaggcac

SEQ ID NO: 306262 - DNA, 25 bp, Rattus norvegicus
gaagtgatggttcgcattctaaaat

SEQ ID NO: 306263 - DNA, 25 bp, Rattus norvegicus
gaagtgatggttggcattctaaaat

SEQ ID NO: 306264 - DNA, 25 bp, Rattus norvegicus
gaagtgatgttgcatatgtttgaat

SEQ ID NO: 306265 - DNA, 25 bp, Rattus norvegicus
gaagtgatgttggatatgtttgaat

SEQ ID NO: 306266 - DNA, 25 bp, Rattus norvegicus
gaagtgattccacggagccacagtc

SEQ ID NO: 306267 - DNA, 25 bp, Rattus norvegicus
gaagtgattccagggagccacagtc

SEQ ID NO: 306268 - DNA, 25 bp, Rattus norvegicus
gaagtgattcctcgcttctacacac

SEQ ID NO: 306269 - DNA, 25 bp, Rattus norvegicus
gaagtgattcctggcttctacacac

SEQ ID NO: 306270 - DNA, 25 bp, Rattus norvegicus
gaagtgattggaagcaacgctctcc

SEQ ID NO: 306271 - DNA, 25 bp, Rattus norvegicus
gaagtgattggatgcaacgctctcc

SEQ ID NO: 306272 - DNA, 25 bp, Rattus norvegicus
gaagtgatttcccttactgggtcct

SEQ ID NO: 306273 - DNA, 25 bp, Rattus norvegicus
gaagtgatttccgttactgggtcct

SEQ ID NO: 306274 - DNA, 25 bp, Rattus norvegicus
gaagtgatttctcctcacacagtga

SEQ ID NO: 306275 - DNA, 25 bp, Rattus norvegicus
gaagtgatttctgctcacacagtga

SEQ ID NO: 306276 - DNA, 25 bp, Rattus norvegicus
gaagtgcaaataaccacctctgtga

SEQ ID NO: 306277 - DNA, 25 bp, Rattus norvegicus
gaagtgcaaatatccacctctgtga

SEQ ID NO: 306278 - DNA, 25 bp, Rattus norvegicus
gaagtgcaaccaccaaacccaggaa

SEQ ID NO: 306279 - DNA, 25 bp, Rattus norvegicus
gaagtgcaaccagcaaacccaggaa

SEQ ID NO: 306280 - DNA, 25 bp, Rattus norvegicus
gaagtgcaatacagtgtctcccgtc

SEQ ID NO: 306281 - DNA, 25 bp, Rattus norvegicus
gaagtgcaatactgtgtctcccgtc

SEQ ID NO: 306282 - DNA, 25 bp, Rattus norvegicus
gaagtgcacagccttgtgctccagc

SEQ ID NO: 306283 - DNA, 25 bp, Rattus norvegicus
gaagtgcacagcgttgtgctccagc

SEQ ID NO: 306284 - DNA, 25 bp, Rattus norvegicus
gaagtgcacaggaggcgactcctta

SEQ ID NO: 306285 - DNA, 25 bp, Rattus norvegicus
gaagtgcacaggtggcgactcctta

SEQ ID NO: 306286 - DNA, 25 bp, Rattus norvegicus
gaagtgcagaaactgtacgagctaa

SEQ ID NO: 306287 - DNA, 25 bp, Rattus norvegicus
gaagtgcagaaagtgtacgagctaa

SEQ ID NO: 306288 - DNA, 25 bp, Rattus norvegicus
gaagtgcagacacacatgccggcaa

SEQ ID NO: 306289 - DNA, 25 bp, Rattus norvegicus
gaagtgcagacagacatgccggcaa

SEQ ID NO: 306290 - DNA, 25 bp, Rattus norvegicus
gaagtgcagcagcagcatctacacc

SEQ ID NO: 306291 - DNA, 25 bp, Rattus norvegicus
gaagtgcagcaggagcatctacacc

SEQ ID NO: 306292 - DNA, 25 bp, Rattus norvegicus
gaagtgcagcgtcaacatctcgaac

SEQ ID NO: 306293 - DNA, 25 bp, Rattus norvegicus
gaagtgcagcgtgaacatctcgaac

SEQ ID NO: 306294 - DNA, 25 bp, Rattus norvegicus
gaagtgcaggacatgggctccgtct

SEQ ID NO: 306295 - DNA, 25 bp, Rattus norvegicus
gaagtgcaggacttgggctccgtct

SEQ ID NO: 306296 - DNA, 25 bp, Rattus norvegicus
gaagtgcagtgtacacccagagtca

SEQ ID NO: 306297 - DNA, 25 bp, Rattus norvegicus
gaagtgcagtgtccctttccaccgc

SEQ ID NO: 306298 - DNA, 25 bp, Rattus norvegicus
gaagtgcagtgtgcctttccaccgc

SEQ ID NO: 306299 - DNA, 25 bp, Rattus norvegicus
gaagtgcagtgttcacccagagtca

SEQ ID NO: 306300 - DNA, 25 bp, Rattus norvegicus
gaagtgcatctccaggcagatccta

SEQ ID NO: 306301 - DNA, 25 bp, Rattus norvegicus
gaagtgcatctcgaggcagatccta

SEQ ID NO: 306302 - DNA, 25 bp, Rattus norvegicus
gaagtgcatgaaactccaggtccgc

SEQ ID NO: 306303 - DNA, 25 bp, Rattus norvegicus
gaagtgcatgaatctccaggtccgc

SEQ ID NO: 306304 - DNA, 25 bp, Rattus norvegicus
gaagtgcattagattcccagcccag

SEQ ID NO: 306305 - DNA, 25 bp, Rattus norvegicus
gaagtgcattagtttcccagcccag

SEQ ID NO: 306306 - DNA, 25 bp, Rattus norvegicus
gaagtgcatttgactacggctgtca

SEQ ID NO: 306307 - DNA, 25 bp, Rattus norvegicus
gaagtgcatttgtctacggctgtca

SEQ ID NO: 306308 - DNA, 25 bp, Rattus norvegicus
gaagtgccaagacgactagcgctgt

SEQ ID NO: 306309 - DNA, 25 bp, Rattus norvegicus
gaagtgccaagaggactagcgctgt

SEQ ID NO: 306310 - DNA, 25 bp, Rattus norvegicus
gaagtgccagcaccagtcacaccaa

SEQ ID NO: 306311 - DNA, 25 bp, Rattus norvegicus
gaagtgccagcagcagtcacaccaa

SEQ ID NO: 306312 - DNA, 25 bp, Rattus norvegicus
gaagtgccagtgagaagcctgccat

SEQ ID NO: 306313 - DNA, 25 bp, Rattus norvegicus
gaagtgccagtgtgaagcctgccat

SEQ ID NO: 306314 - DNA, 25 bp, Rattus norvegicus
gaagtgcccaaaaatttgttccaga

SEQ ID NO: 306315 - DNA, 25 bp, Rattus norvegicus
gaagtgcccaaatatttgttccaga

SEQ ID NO: 306316 - DNA, 25 bp, Rattus norvegicus
gaagtgcccacacgacaccatgaaa

SEQ ID NO: 306317 - DNA, 25 bp, Rattus norvegicus
gaagtgcccacaggacaccatgaaa

SEQ ID NO: 306318 - DNA, 25 bp, Rattus norvegicus
gaagtgcccaccacttaacactact

SEQ ID NO: 306319 - DNA, 25 bp, Rattus norvegicus
gaagtgcccacctcttaacactact

SEQ ID NO: 306320 - DNA, 25 bp, Rattus norvegicus
gaagtgcccatcaatggactcccat

SEQ ID NO: 306321 - DNA, 25 bp, Rattus norvegicus
gaagtgcccatctatggactcccat

SEQ ID NO: 306322 - DNA, 25 bp, Rattus norvegicus
gaagtgcccctgacctttaataagg

SEQ ID NO: 306323 - DNA, 25 bp, Rattus norvegicus
gaagtgcccctgtcctttaataagg

SEQ ID NO: 306324 - DNA, 25 bp, Rattus norvegicus
gaagtgcccgcgatgttggaagcat

SEQ ID NO: 306325 - DNA, 25 bp, Rattus norvegicus
gaagtgcccgcgttgttggaagcat

SEQ ID NO: 306326 - DNA, 25 bp, Rattus norvegicus
gaagtgcccgtcaccatgagaagaa

SEQ ID NO: 306327 - DNA, 25 bp, Rattus norvegicus
gaagtgcccgtctccatgagaagaa

SEQ ID NO: 306328 - DNA, 25 bp, Rattus norvegicus
gaagtgccctgcacggacgggaaaa

SEQ ID NO: 306329 - DNA, 25 bp, Rattus norvegicus
gaagtgccctgctcggacgggaaaa

SEQ ID NO: 306330 - DNA, 25 bp, Rattus norvegicus
gaagtgcccttgagtccaggtcctg

SEQ ID NO: 306331 - DNA, 25 bp, Rattus norvegicus
gaagtgcccttgtgtccaggtcctg

SEQ ID NO: 306332 - DNA, 25 bp, Rattus norvegicus
gaagtgccggacagcatcgatgccc

SEQ ID NO: 306333 - DNA, 25 bp, Rattus norvegicus
gaagtgccggactgcatcgatgccc

SEQ ID NO: 306334 - DNA, 25 bp, Rattus norvegicus
gaagtgcctaaacagcaagctgctt

SEQ ID NO: 306335 - DNA, 25 bp, Rattus norvegicus
gaagtgcctaaagagcaagctgctt

SEQ ID NO: 306336 - DNA, 25 bp, Rattus norvegicus
gaagtgcctctaacacaagattcaa

SEQ ID NO: 306337 - DNA, 25 bp, Rattus norvegicus
gaagtgcctctaccataagtaagtc

SEQ ID NO: 306338 - DNA, 25 bp, Rattus norvegicus
gaagtgcctctagcataagtaagtc

SEQ ID NO: 306339 - DNA, 25 bp, Rattus norvegicus
gaagtgcctctatcacaagattcaa

SEQ ID NO: 306340 - DNA, 25 bp, Rattus norvegicus
gaagtgcctcttatgtagactgctt

SEQ ID NO: 306341 - DNA, 25 bp, Rattus norvegicus
gaagtgcctcttttgtagactgctt

SEQ ID NO: 306342 - DNA, 25 bp, Rattus norvegicus
gaagtgcctgttacgttgagatgac

SEQ ID NO: 306343 - DNA, 25 bp, Rattus norvegicus
gaagtgcctgtttcgttgagatgac

SEQ ID NO: 306344 - DNA, 25 bp, Rattus norvegicus
gaagtgcctttcagaacaagtcgga

SEQ ID NO: 306345 - DNA, 25 bp, Rattus norvegicus
gaagtgcctttctgaacaagtcgga

SEQ ID NO: 306346 - DNA, 25 bp, Rattus norvegicus
gaagtgcgccttcatggagacctcg

SEQ ID NO: 306347 - DNA, 25 bp, Rattus norvegicus
gaagtgcgccttgatggagacctcg

SEQ ID NO: 306348 - DNA, 25 bp, Rattus norvegicus
gaagtgcgtaaaccactccatgtcc

SEQ ID NO: 306349 - DNA, 25 bp, Rattus norvegicus
gaagtgcgtaaagcactccatgtcc

SEQ ID NO: 306350 - DNA, 25 bp, Rattus norvegicus
gaagtgcgtcgacgcacacaaagaa

SEQ ID NO: 306351 - DNA, 25 bp, Rattus norvegicus
gaagtgcgtcgaggcacacaaagaa

SEQ ID NO: 306352 - DNA, 25 bp, Rattus norvegicus
gaagtgctaccgagccttcttgcgt

SEQ ID NO: 306353 - DNA, 25 bp, Rattus norvegicus
gaagtgctaccgtgccttcttgcgt

SEQ ID NO: 306354 - DNA, 25 bp, Rattus norvegicus
gaagtgctactgactgagcagccct

SEQ ID NO: 306355 - DNA, 25 bp, Rattus norvegicus
gaagtgctactgtctgagcagccct

SEQ ID NO: 306356 - DNA, 25 bp, Rattus norvegicus
gaagtgctagtgctcagctgttttt

SEQ ID NO: 306357 - DNA, 25 bp, Rattus norvegicus
gaagtgctagtggtcagctgttttt

SEQ ID NO: 306358 - DNA, 25 bp, Rattus norvegicus
gaagtgctatataccacaagggtta

SEQ ID NO: 306359 - DNA, 25 bp, Rattus norvegicus
gaagtgctatattccacaagggtta

SEQ ID NO: 306360 - DNA, 25 bp, Rattus norvegicus
gaagtgctcacgcagattgcctgac

SEQ ID NO: 306361 - DNA, 25 bp, Rattus norvegicus
gaagtgctcacggagattgcctgac

SEQ ID NO: 306362 - DNA, 25 bp, Rattus norvegicus
gaagtgctcactcttgtacaagcgt

SEQ ID NO: 306363 - DNA, 25 bp, Rattus norvegicus
gaagtgctcactgttgtacaagcgt

SEQ ID NO: 306364 - DNA, 25 bp, Rattus norvegicus
gaagtgctcagaatacctgtaatag

SEQ ID NO: 306365 - DNA, 25 bp, Rattus norvegicus
gaagtgctcagattacctgtaatag

SEQ ID NO: 306366 - DNA, 25 bp, Rattus norvegicus
gaagtgctcagcaatagttctttgg

SEQ ID NO: 306367 - DNA, 25 bp, Rattus norvegicus
gaagtgctcagctatagttctttgg

SEQ ID NO: 306368 - DNA, 25 bp, Rattus norvegicus
gaagtgctcataattctgatgggaa

SEQ ID NO: 306369 - DNA, 25 bp, Rattus norvegicus
gaagtgctcatatttctgatgggaa

SEQ ID NO: 306370 - DNA, 25 bp, Rattus norvegicus
gaagtgctcccacctgacagactgt

SEQ ID NO: 306371 - DNA, 25 bp, Rattus norvegicus
gaagtgctcccacggctgcatctgc

SEQ ID NO: 306372 - DNA, 25 bp, Rattus norvegicus
gaagtgctcccagctgacagactgt

SEQ ID NO: 306373 - DNA, 25 bp, Rattus norvegicus
gaagtgctcccagggctgcatctgc

SEQ ID NO: 306374 - DNA, 25 bp, Rattus norvegicus
gaagtgctctgaaaacaatcaacca

SEQ ID NO: 306375 - DNA, 25 bp, Rattus norvegicus
gaagtgctctgataacaatcaacca

SEQ ID NO: 306376 - DNA, 25 bp, Rattus norvegicus
gaagtgctgactcacccatagcctg

SEQ ID NO: 306377 - DNA, 25 bp, Rattus norvegicus
gaagtgctgactgacccatagcctg

SEQ ID NO: 306378 - DNA, 25 bp, Rattus norvegicus
gaagtgctgatgaggcctggaccca

SEQ ID NO: 306379 - DNA, 25 bp, Rattus norvegicus
gaagtgctgatgtggcctggaccca

SEQ ID NO: 306380 - DNA, 25 bp, Rattus norvegicus
gaagtgctgcacatctctcaggatt

SEQ ID NO: 306381 - DNA, 25 bp, Rattus norvegicus
gaagtgctgcacttctctcaggatt

SEQ ID NO: 306382 - DNA, 25 bp, Rattus norvegicus
gaagtgctgccactgggaatgaact

SEQ ID NO: 306383 - DNA, 25 bp, Rattus norvegicus
gaagtgctgccagtgggaatgaact

SEQ ID NO: 306384 - DNA, 25 bp, Rattus norvegicus
gaagtgctggtcagattccaagcca

SEQ ID NO: 306385 - DNA, 25 bp, Rattus norvegicus
gaagtgctggtctgattccaagcca

SEQ ID NO: 306386 - DNA, 25 bp, Rattus norvegicus
gaagtgctgtttctatggacataaa

SEQ ID NO: 306387 - DNA, 25 bp, Rattus norvegicus
gaagtgctgtttgtatggacataaa

SEQ ID NO: 306388 - DNA, 25 bp, Rattus norvegicus
gaagtgcttatgattttctgactaa

SEQ ID NO: 306389 - DNA, 25 bp, Rattus norvegicus
gaagtgcttatgtttttctgactaa

SEQ ID NO: 306390 - DNA, 25 bp, Rattus norvegicus
gaagtgcttcctatacacaggtttg

SEQ ID NO: 306391 - DNA, 25 bp, Rattus norvegicus
gaagtgcttcctttacacaggtttg

SEQ ID NO: 306392 - DNA, 25 bp, Rattus norvegicus
gaagtgcttctcagtatttccttga

SEQ ID NO: 306393 - DNA, 25 bp, Rattus norvegicus
gaagtgcttctctgtatttccttga

SEQ ID NO: 306394 - DNA, 25 bp, Rattus norvegicus
gaagtgcttgctccctgtgcataga

SEQ ID NO: 306395 - DNA, 25 bp, Rattus norvegicus
gaagtgcttgctgcctgtgcataga

SEQ ID NO: 306396 - DNA, 25 bp, Rattus norvegicus
gaagtgcttggacctacagcccagg

SEQ ID NO: 306397 - DNA, 25 bp, Rattus norvegicus
gaagtgcttggagctacagcccagg

SEQ ID NO: 306398 - DNA, 25 bp, Rattus norvegicus
gaagtgcttgtcatgcttgggaaag

SEQ ID NO: 306399 - DNA, 25 bp, Rattus norvegicus
gaagtgcttgtccaccgtacggaaa

SEQ ID NO: 306400 - DNA, 25 bp, Rattus norvegicus
gaagtgcttgtcgaccgtacggaaa

SEQ ID NO: 306401 - DNA, 25 bp, Rattus norvegicus
gaagtgcttgtcttgcttgggaaag

SEQ ID NO: 306402 - DNA, 25 bp, Rattus norvegicus
gaagtgcttgttcatactggatcca

SEQ ID NO: 306403 - DNA, 25 bp, Rattus norvegicus
gaagtgcttgttgatactggatcca

SEQ ID NO: 306404 - DNA, 25 bp, Rattus norvegicus
gaagtgctttccaattcgtgttagt

SEQ ID NO: 306405 - DNA, 25 bp, Rattus norvegicus
gaagtgctttcctattcgtgttagt

SEQ ID NO: 306406 - DNA, 25 bp, Rattus norvegicus
gaagtgctttgcaatgtggtcacag

SEQ ID NO: 306407 - DNA, 25 bp, Rattus norvegicus
gaagtgctttgctatgtggtcacag

SEQ ID NO: 306408 - DNA, 25 bp, Rattus norvegicus
gaagtggaacatcttgtcaccccag

SEQ ID NO: 306409 - DNA, 25 bp, Rattus norvegicus
gaagtggaacatgttgtcaccccag

SEQ ID NO: 306410 - DNA, 25 bp, Rattus norvegicus
gaagtggaacgccaacgccaagaaa

SEQ ID NO: 306411 - DNA, 25 bp, Rattus norvegicus
gaagtggaacgcgaacgccaagaaa

SEQ ID NO: 306412 - DNA, 25 bp, Rattus norvegicus
gaagtggaagccagtaccccagcag

SEQ ID NO: 306413 - DNA, 25 bp, Rattus norvegicus
gaagtggaagcctgtaccccagcag

SEQ ID NO: 306414 - DNA, 25 bp, Rattus norvegicus
gaagtggacacgaacacccagaaag

SEQ ID NO: 306415 - DNA, 25 bp, Rattus norvegicus
gaagtggacacgtacacccagaaag

SEQ ID NO: 306416 - DNA, 25 bp, Rattus norvegicus
gaagtggacagcattcactttccat

SEQ ID NO: 306417 - DNA, 25 bp, Rattus norvegicus
gaagtggacagctttcactttccat

SEQ ID NO: 306418 - DNA, 25 bp, Rattus norvegicus
gaagtggacattccatactttcccc

SEQ ID NO: 306419 - DNA, 25 bp, Rattus norvegicus
gaagtggacattgcatactttcccc

SEQ ID NO: 306420 - DNA, 25 bp, Rattus norvegicus
gaagtggaccatccagatttctgta

SEQ ID NO: 306421 - DNA, 25 bp, Rattus norvegicus
gaagtggaccatgcagatttctgta

SEQ ID NO: 306422 - DNA, 25 bp, Rattus norvegicus
gaagtggacctaattcgcttttctt

SEQ ID NO: 306423 - DNA, 25 bp, Rattus norvegicus
gaagtggacctatttcgcttttctt

SEQ ID NO: 306424 - DNA, 25 bp, Rattus norvegicus
gaagtggactgaagcctatgtagaa

SEQ ID NO: 306425 - DNA, 25 bp, Rattus norvegicus
gaagtggactgatgcctatgtagaa

SEQ ID NO: 306426 - DNA, 25 bp, Rattus norvegicus
gaagtggacttgcaatctctggaat

SEQ ID NO: 306427 - DNA, 25 bp, Rattus norvegicus
gaagtggacttggaatctctggaat

SEQ ID NO: 306428 - DNA, 25 bp, Rattus norvegicus
gaagtggagcccagtgaacctgaat

SEQ ID NO: 306429 - DNA, 25 bp, Rattus norvegicus
gaagtggagccctgtgaacctgaat

SEQ ID NO: 306430 - DNA, 25 bp, Rattus norvegicus
gaagtggagcctccacatctgttaa

SEQ ID NO: 306431 - DNA, 25 bp, Rattus norvegicus
gaagtggagcctgcacatctgttaa

SEQ ID NO: 306432 - DNA, 25 bp, Rattus norvegicus
gaagtggagctgatctctgctgcag

SEQ ID NO: 306433 - DNA, 25 bp, Rattus norvegicus
gaagtggagctgttctctgctgcag

SEQ ID NO: 306434 - DNA, 25 bp, Rattus norvegicus
gaagtggagttcatatcaccctgcc

SEQ ID NO: 306435 - DNA, 25 bp, Rattus norvegicus
gaagtggagttcttatcaccctgcc

SEQ ID NO: 306436 - DNA, 25 bp, Rattus norvegicus
gaagtggatccaccacagcatcaga

SEQ ID NO: 306437 - DNA, 25 bp, Rattus norvegicus
gaagtggatccagcacagcatcaga

SEQ ID NO: 306438 - DNA, 25 bp, Rattus norvegicus
gaagtggattctcaagagccctttt

SEQ ID NO: 306439 - DNA, 25 bp, Rattus norvegicus
gaagtggattctgaagagccctttt

SEQ ID NO: 306440 - DNA, 25 bp, Rattus norvegicus
gaagtggcaaatcgcttatctgaca

SEQ ID NO: 306441 - DNA, 25 bp, Rattus norvegicus
gaagtggcaaatggcttatctgaca

SEQ ID NO: 306442 - DNA, 25 bp, Rattus norvegicus
gaagtggcatctccaggccatgaga

SEQ ID NO: 306443 - DNA, 25 bp, Rattus norvegicus
gaagtggcatctgcaggccatgaga

SEQ ID NO: 306444 - DNA, 25 bp, Rattus norvegicus
gaagtggcatttacgaaacccgctg

SEQ ID NO: 306445 - DNA, 25 bp, Rattus norvegicus
gaagtggcattttcgaaacccgctg

SEQ ID NO: 306446 - DNA, 25 bp, Rattus norvegicus
gaagtggccactcttaatcgccctt

SEQ ID NO: 306447 - DNA, 25 bp, Rattus norvegicus
gaagtggccactgttaatcgccctt

SEQ ID NO: 306448 - DNA, 25 bp, Rattus norvegicus
gaagtggccatcagctgtacagtgt

SEQ ID NO: 306449 - DNA, 25 bp, Rattus norvegicus
gaagtggccatctgctgtacagtgt

SEQ ID NO: 306450 - DNA, 25 bp, Rattus norvegicus
gaagtggcccacagtcattgcgaag

SEQ ID NO: 306451 - DNA, 25 bp, Rattus norvegicus
gaagtggcccactgtcattgcgaag

SEQ ID NO: 306452 - DNA, 25 bp, Rattus norvegicus
gaagtggcctcccttgcgcagaaag

SEQ ID NO: 306453 - DNA, 25 bp, Rattus norvegicus
gaagtggcctccgttgcgcagaaag

SEQ ID NO: 306454 - DNA, 25 bp, Rattus norvegicus
gaagtggcctctatggttgtagaaa

SEQ ID NO: 306455 - DNA, 25 bp, Rattus norvegicus
gaagtggcctctttggttgtagaaa

SEQ ID NO: 306456 - DNA, 25 bp, Rattus norvegicus
gaagtggcctttacgctaaaatcca

SEQ ID NO: 306457 - DNA, 25 bp, Rattus norvegicus
gaagtggccttttcgctaaaatcca

SEQ ID NO: 306458 - DNA, 25 bp, Rattus norvegicus
gaagtggcgctcaaacagtttcgtt

SEQ ID NO: 306459 - DNA, 25 bp, Rattus norvegicus
gaagtggcgctctaacagtttcgtt

SEQ ID NO: 306460 - DNA, 25 bp, Rattus norvegicus
gaagtggctaaactcttggatctaa

SEQ ID NO: 306461 - DNA, 25 bp, Rattus norvegicus
gaagtggctaaagtcttggatctaa

SEQ ID NO: 306462 - DNA, 25 bp, Rattus norvegicus
gaagtggctactcaggtgccgttcc

SEQ ID NO: 306463 - DNA, 25 bp, Rattus norvegicus
gaagtggctactgaggtgccgttcc

SEQ ID NO: 306464 - DNA, 25 bp, Rattus norvegicus
gaagtggctatcacctacaacgaaa

SEQ ID NO: 306465 - DNA, 25 bp, Rattus norvegicus
gaagtggctatctcctacaacgaaa

SEQ ID NO: 306466 - DNA, 25 bp, Rattus norvegicus
gaagtggctcacaatagctgctaga

SEQ ID NO: 306467 - DNA, 25 bp, Rattus norvegicus
gaagtggctcactatagctgctaga

SEQ ID NO: 306468 - DNA, 25 bp, Rattus norvegicus
gaagtggctcagacagagggtcttt

SEQ ID NO: 306469 - DNA, 25 bp, Rattus norvegicus
gaagtggctcagtcagagggtcttt

SEQ ID NO: 306470 - DNA, 25 bp, Rattus norvegicus
gaagtggctccaagataacctgatt

SEQ ID NO: 306471 - DNA, 25 bp, Rattus norvegicus
gaagtggctccatgataacctgatt

SEQ ID NO: 306472 - DNA, 25 bp, Rattus norvegicus
gaagtggctcttaagtttgtacatt

SEQ ID NO: 306473 - DNA, 25 bp, Rattus norvegicus
gaagtggctctttagtttgtacatt

SEQ ID NO: 306474 - DNA, 25 bp, Rattus norvegicus
gaagtggctgtaacctagactccgc

SEQ ID NO: 306475 - DNA, 25 bp, Rattus norvegicus
gaagtggctgtatcctagactccgc

SEQ ID NO: 306476 - DNA, 25 bp, Rattus norvegicus
gaagtggcttgtatgctgcgcagaa

SEQ ID NO: 306477 - DNA, 25 bp, Rattus norvegicus
gaagtggcttgtttgctgcgcagaa

SEQ ID NO: 306478 - DNA, 25 bp, Rattus norvegicus
gaagtggctttcatttaggatctgt

SEQ ID NO: 306479 - DNA, 25 bp, Rattus norvegicus
gaagtggctttcttttaggatctgt

SEQ ID NO: 306480 - DNA, 25 bp, Rattus norvegicus
gaagtgggaaacatggtcaggacac

SEQ ID NO: 306481 - DNA, 25 bp, Rattus norvegicus
gaagtgggaaacttggtcaggacac

SEQ ID NO: 306482 - DNA, 25 bp, Rattus norvegicus
gaagtgggaggcatctcaccctcca

SEQ ID NO: 306483 - DNA, 25 bp, Rattus norvegicus
gaagtgggaggcttctcaccctcca

SEQ ID NO: 306484 - DNA, 25 bp, Rattus norvegicus
gaagtgggcaagcaatagctattga

SEQ ID NO: 306485 - DNA, 25 bp, Rattus norvegicus
gaagtgggcaaggaatagctattga

SEQ ID NO: 306486 - DNA, 25 bp, Rattus norvegicus
gaagtgggcagacacccctgtaaat

SEQ ID NO: 306487 - DNA, 25 bp, Rattus norvegicus
gaagtgggcagagacccctgtaaat

SEQ ID NO: 306488 - DNA, 25 bp, Rattus norvegicus
gaagtgggcagccacagtccatgac

SEQ ID NO: 306489 - DNA, 25 bp, Rattus norvegicus
gaagtgggcagcgacagtccatgac

SEQ ID NO: 306490 - DNA, 25 bp, Rattus norvegicus
gaagtgggcagtacagctccatatc

SEQ ID NO: 306491 - DNA, 25 bp, Rattus norvegicus
gaagtgggcagttcagctccatatc

SEQ ID NO: 306492 - DNA, 25 bp, Rattus norvegicus
gaagtgggcatgcacagcctccctg

SEQ ID NO: 306493 - DNA, 25 bp, Rattus norvegicus
gaagtgggcatggacagcctccctg

SEQ ID NO: 306494 - DNA, 25 bp, Rattus norvegicus
gaagtgggcattcaactttctgaat

SEQ ID NO: 306495 - DNA, 25 bp, Rattus norvegicus
gaagtgggcattgaactttctgaat

SEQ ID NO: 306496 - DNA, 25 bp, Rattus norvegicus
gaagtgggccaaacccttgtcaatt

SEQ ID NO: 306497 - DNA, 25 bp, Rattus norvegicus
gaagtgggccaatcccttgtcaatt

SEQ ID NO: 306498 - DNA, 25 bp, Rattus norvegicus
gaagtgggccagacagtacctgaag

SEQ ID NO: 306499 - DNA, 25 bp, Rattus norvegicus
gaagtgggccagtcagtacctgaag

SEQ ID NO: 306500 - DNA, 25 bp, Rattus norvegicus
gaagtgggcttcactgggaactgct

SEQ ID NO: 306501 - DNA, 25 bp, Rattus norvegicus
gaagtgggcttctctgggaactgct

SEQ ID NO: 306502 - DNA, 25 bp, Rattus norvegicus
gaagtgggctttattcttaggaagg

SEQ ID NO: 306503 - DNA, 25 bp, Rattus norvegicus
gaagtgggcttttttcttaggaagg

SEQ ID NO: 306504 - DNA, 25 bp, Rattus norvegicus
gaagtgggtatacccctggttctgt

SEQ ID NO: 306505 - DNA, 25 bp, Rattus norvegicus
gaagtgggtatagccctggttctgt

SEQ ID NO: 306506 - DNA, 25 bp, Rattus norvegicus
gaagtgggtcagaccattcagtcca

SEQ ID NO: 306507 - DNA, 25 bp, Rattus norvegicus
gaagtgggtcagtccattcagtcca

SEQ ID NO: 306508 - DNA, 25 bp, Rattus norvegicus
gaagtgggtctgatagcccacaccc

SEQ ID NO: 306509 - DNA, 25 bp, Rattus norvegicus
gaagtgggtctgttagcccacaccc

SEQ ID NO: 306510 - DNA, 25 bp, Rattus norvegicus
gaagtgggtcttctcatatgagcat

SEQ ID NO: 306511 - DNA, 25 bp, Rattus norvegicus
gaagtgggtcttgtcatatgagcat

SEQ ID NO: 306512 - DNA, 25 bp, Rattus norvegicus
gaagtgggtggacgctcctcttttc

SEQ ID NO: 306513 - DNA, 25 bp, Rattus norvegicus
gaagtgggtggaggctcctcttttc

SEQ ID NO: 306514 - DNA, 25 bp, Rattus norvegicus
gaagtgggttccagtctcatgaccg

SEQ ID NO: 306515 - DNA, 25 bp, Rattus norvegicus
gaagtgggttcctgtctcatgaccg

SEQ ID NO: 306516 - DNA, 25 bp, Rattus norvegicus
gaagtgggttggaagaagcctcctc

SEQ ID NO: 306517 - DNA, 25 bp, Rattus norvegicus
gaagtgggttggtagaagcctcctc

SEQ ID NO: 306518 - DNA, 25 bp, Rattus norvegicus
gaagtgggttttaccatctcaagat

SEQ ID NO: 306519 - DNA, 25 bp, Rattus norvegicus
gaagtgggtttttccatctcaagat

SEQ ID NO: 306520 - DNA, 25 bp, Rattus norvegicus
gaagtggtaaacacccatggccctg

SEQ ID NO: 306521 - DNA, 25 bp, Rattus norvegicus
gaagtggtaaactcccatggccctg

SEQ ID NO: 306522 - DNA, 25 bp, Rattus norvegicus
gaagtggtaattagtttcacagcta

SEQ ID NO: 306523 - DNA, 25 bp, Rattus norvegicus
gaagtggtaatttgtttcacagcta

SEQ ID NO: 306524 - DNA, 25 bp, Rattus norvegicus
gaagtggtaccaaccctcaggtgga

SEQ ID NO: 306525 - DNA, 25 bp, Rattus norvegicus
gaagtggtaccatccctcaggtgga

SEQ ID NO: 306526 - DNA, 25 bp, Rattus norvegicus
gaagtggtactacctccatatacat

SEQ ID NO: 306527 - DNA, 25 bp, Rattus norvegicus
gaagtggtactagctccatatacat

SEQ ID NO: 306528 - DNA, 25 bp, Rattus norvegicus
gaagtggtcacaacccaggaagcct

SEQ ID NO: 306529 - DNA, 25 bp, Rattus norvegicus
gaagtggtcacatcccaggaagcct

SEQ ID NO: 306530 - DNA, 25 bp, Rattus norvegicus
gaagtggtccaaagctagtgagaga

SEQ ID NO: 306531 - DNA, 25 bp, Rattus norvegicus
gaagtggtccaaaggcaaagttcgg

SEQ ID NO: 306532 - DNA, 25 bp, Rattus norvegicus
gaagtggtccaatgctagtgagaga

SEQ ID NO: 306533 - DNA, 25 bp, Rattus norvegicus
gaagtggtccaatggcaaagttcgg

SEQ ID NO: 306534 - DNA, 25 bp, Rattus norvegicus
gaagtggtccggctgctaaactgca

SEQ ID NO: 306535 - DNA, 25 bp, Rattus norvegicus
gaagtggtccgggtgctaaactgca

SEQ ID NO: 306536 - DNA, 25 bp, Rattus norvegicus
gaagtggtgagtatttcctgttttt

SEQ ID NO: 306537 - DNA, 25 bp, Rattus norvegicus
gaagtggtgagtttttcctgttttt

SEQ ID NO: 306538 - DNA, 25 bp, Rattus norvegicus
gaagtggtgcatacaggctatccct

SEQ ID NO: 306539 - DNA, 25 bp, Rattus norvegicus
gaagtggtgcattcaggctatccct

SEQ ID NO: 306540 - DNA, 25 bp, Rattus norvegicus
gaagtggtgcctagttccagctttt

SEQ ID NO: 306541 - DNA, 25 bp, Rattus norvegicus
gaagtggtgccttgttccagctttt

SEQ ID NO: 306542 - DNA, 25 bp, Rattus norvegicus
gaagtggttctacgtttcagtcttt

SEQ ID NO: 306543 - DNA, 25 bp, Rattus norvegicus
gaagtggttctaggtttcagtcttt

SEQ ID NO: 306544 - DNA, 25 bp, Rattus norvegicus
gaagtgtaaaccagcccatgacagt

SEQ ID NO: 306545 - DNA, 25 bp, Rattus norvegicus
gaagtgtaaaccctgaatgctctca

SEQ ID NO: 306546 - DNA, 25 bp, Rattus norvegicus
gaagtgtaaaccgtgaatgctctca

SEQ ID NO: 306547 - DNA, 25 bp, Rattus norvegicus
gaagtgtaaacctgcccatgacagt

SEQ ID NO: 306548 - DNA, 25 bp, Rattus norvegicus
gaagtgtaaactcaaaccccattat

SEQ ID NO: 306549 - DNA, 25 bp, Rattus norvegicus
gaagtgtaaactgaaaccccattat

SEQ ID NO: 306550 - DNA, 25 bp, Rattus norvegicus
gaagtgtaaagcattacgtccacta

SEQ ID NO: 306551 - DNA, 25 bp, Rattus norvegicus
gaagtgtaaagctttacgtccacta

SEQ ID NO: 306552 - DNA, 25 bp, Rattus norvegicus
gaagtgtaaccgcttttccagcttt

SEQ ID NO: 306553 - DNA, 25 bp, Rattus norvegicus
gaagtgtaaccggttttccagcttt

SEQ ID NO: 306554 - DNA, 25 bp, Rattus norvegicus
gaagtgtacagcatgcaacgagaat

SEQ ID NO: 306555 - DNA, 25 bp, Rattus norvegicus
gaagtgtacagcttgcaacgagaat

SEQ ID NO: 306556 - DNA, 25 bp, Rattus norvegicus
gaagtgtacgtgaagcccgggacct

SEQ ID NO: 306557 - DNA, 25 bp, Rattus norvegicus
gaagtgtacgtgtagcccgggacct

SEQ ID NO: 306558 - DNA, 25 bp, Rattus norvegicus
gaagtgtacttgctgctctgggtca

SEQ ID NO: 306559 - DNA, 25 bp, Rattus norvegicus
gaagtgtacttggtgctctgggtca

SEQ ID NO: 306560 - DNA, 25 bp, Rattus norvegicus
gaagtgtagatactgcctttccatt

SEQ ID NO: 306561 - DNA, 25 bp, Rattus norvegicus
gaagtgtagatagtgcctttccatt

SEQ ID NO: 306562 - DNA, 25 bp, Rattus norvegicus
gaagtgtatcatccctacgctgagc

SEQ ID NO: 306563 - DNA, 25 bp, Rattus norvegicus
gaagtgtatcatgcctacgctgagc

SEQ ID NO: 306564 - DNA, 25 bp, Rattus norvegicus
gaagtgtatgccacggatgatacca

SEQ ID NO: 306565 - DNA, 25 bp, Rattus norvegicus
gaagtgtatgcctcggatgatacca

SEQ ID NO: 306566 - DNA, 25 bp, Rattus norvegicus
gaagtgtcaagcacaactatcaaga

SEQ ID NO: 306567 - DNA, 25 bp, Rattus norvegicus
gaagtgtcaagctcaactatcaaga

SEQ ID NO: 306568 - DNA, 25 bp, Rattus norvegicus
gaagtgtcacagactaggactcata

SEQ ID NO: 306569 - DNA, 25 bp, Rattus norvegicus
gaagtgtcacagcagtcgccacaaa

SEQ ID NO: 306570 - DNA, 25 bp, Rattus norvegicus
gaagtgtcacaggagtcgccacaaa

SEQ ID NO: 306571 - DNA, 25 bp, Rattus norvegicus
gaagtgtcacagtctaggactcata

SEQ ID NO: 306572 - DNA, 25 bp, Rattus norvegicus
gaagtgtcactcatttggaagccaa

SEQ ID NO: 306573 - DNA, 25 bp, Rattus norvegicus
gaagtgtcactcttttggaagccaa

SEQ ID NO: 306574 - DNA, 25 bp, Rattus norvegicus
gaagtgtcacttatcaagaactcaa

SEQ ID NO: 306575 - DNA, 25 bp, Rattus norvegicus
gaagtgtcacttttcaagaactcaa

SEQ ID NO: 306576 - DNA, 25 bp, Rattus norvegicus
gaagtgtcagttaatgctagagcta

SEQ ID NO: 306577 - DNA, 25 bp, Rattus norvegicus
gaagtgtcagtttatgctagagcta

SEQ ID NO: 306578 - DNA, 25 bp, Rattus norvegicus
gaagtgtcatcccacagatcatcat

SEQ ID NO: 306579 - DNA, 25 bp, Rattus norvegicus
gaagtgtcatccgacagatcatcat

SEQ ID NO: 306580 - DNA, 25 bp, Rattus norvegicus
gaagtgtcatctagtgatttcagaa

SEQ ID NO: 306581 - DNA, 25 bp, Rattus norvegicus
gaagtgtcatcttgtgatttcagaa

SEQ ID NO: 306582 - DNA, 25 bp, Rattus norvegicus
gaagtgtcatttaccgacctagggc

SEQ ID NO: 306583 - DNA, 25 bp, Rattus norvegicus
gaagtgtcattttccgacctagggc

SEQ ID NO: 306584 - DNA, 25 bp, Rattus norvegicus
gaagtgtccacacaggcttctggcc

SEQ ID NO: 306585 - DNA, 25 bp, Rattus norvegicus
gaagtgtccacagaggcttctggcc

SEQ ID NO: 306586 - DNA, 25 bp, Rattus norvegicus
gaagtgtccatcaaggtcatgcaac

SEQ ID NO: 306587 - DNA, 25 bp, Rattus norvegicus
gaagtgtccatctaggtcatgcaac

SEQ ID NO: 306588 - DNA, 25 bp, Rattus norvegicus
gaagtgtcccagataccaggaaagg

SEQ ID NO: 306589 - DNA, 25 bp, Rattus norvegicus
gaagtgtcccagttaccaggaaagg

SEQ ID NO: 306590 - DNA, 25 bp, Rattus norvegicus
gaagtgtccggtctgttttcgaaag

SEQ ID NO: 306591 - DNA, 25 bp, Rattus norvegicus
gaagtgtccggtgtgttttcgaaag

SEQ ID NO: 306592 - DNA, 25 bp, Rattus norvegicus
gaagtgtcctatcggtcgtggtacc

SEQ ID NO: 306593 - DNA, 25 bp, Rattus norvegicus
gaagtgtcctatgggtcgtggtacc

SEQ ID NO: 306594 - DNA, 25 bp, Rattus norvegicus
gaagtgtcctcgacagcgaaggtca

SEQ ID NO: 306595 - DNA, 25 bp, Rattus norvegicus
gaagtgtcctcgtcagcgaaggtca

SEQ ID NO: 306596 - DNA, 25 bp, Rattus norvegicus
gaagtgtcctctcattaaatccaaa

SEQ ID NO: 306597 - DNA, 25 bp, Rattus norvegicus
gaagtgtcctctgattaaatccaaa

SEQ ID NO: 306598 - DNA, 25 bp, Rattus norvegicus
gaagtgtccttaaaactcccagtgc

SEQ ID NO: 306599 - DNA, 25 bp, Rattus norvegicus
gaagtgtccttataactcccagtgc

SEQ ID NO: 306600 - DNA, 25 bp, Rattus norvegicus
gaagtgtctatgcatgctggcttaa

SEQ ID NO: 306601 - DNA, 25 bp, Rattus norvegicus
gaagtgtctatggatgctggcttaa

SEQ ID NO: 306602 - DNA, 25 bp, Rattus norvegicus
gaagtgtctcagagccagattcata

SEQ ID NO: 306603 - DNA, 25 bp, Rattus norvegicus
gaagtgtctcagtgccagattcata

SEQ ID NO: 306604 - DNA, 25 bp, Rattus norvegicus
gaagtgtctcttcatagtttcttga

SEQ ID NO: 306605 - DNA, 25 bp, Rattus norvegicus
gaagtgtctcttgatagtttcttga

SEQ ID NO: 306606 - DNA, 25 bp, Rattus norvegicus
gaagtgtctgacaccatgacagctg

SEQ ID NO: 306607 - DNA, 25 bp, Rattus norvegicus
gaagtgtctgactccatgacagctg

SEQ ID NO: 306608 - DNA, 25 bp, Rattus norvegicus
gaagtgtctgtaaatagctcaggct

SEQ ID NO: 306609 - DNA, 25 bp, Rattus norvegicus
gaagtgtctgtatatagctcaggct

SEQ ID NO: 306610 - DNA, 25 bp, Rattus norvegicus
gaagtgtcttgtaccttaatgtcat

SEQ ID NO: 306611 - DNA, 25 bp, Rattus norvegicus
gaagtgtcttgttccttaatgtcat

SEQ ID NO: 306612 - DNA, 25 bp, Rattus norvegicus
gaagtgtctttcaaggttctactgt

SEQ ID NO: 306613 - DNA, 25 bp, Rattus norvegicus
gaagtgtctttctaggttctactgt

SEQ ID NO: 306614 - DNA, 25 bp, Rattus norvegicus
gaagtgtgaagacatgtccagaaac

SEQ ID NO: 306615 - DNA, 25 bp, Rattus norvegicus
gaagtgtgaagagatgtccagaaac

SEQ ID NO: 306616 - DNA, 25 bp, Rattus norvegicus
gaagtgtgacgtagacatccgtaaa

SEQ ID NO: 306617 - DNA, 25 bp, Rattus norvegicus
gaagtgtgacgttgacatccgtaaa

SEQ ID NO: 306618 - DNA, 25 bp, Rattus norvegicus
gaagtgtgccccaattggcgaacgt

SEQ ID NO: 306619 - DNA, 25 bp, Rattus norvegicus
gaagtgtgcccctattggcgaacgt

SEQ ID NO: 306620 - DNA, 25 bp, Rattus norvegicus
gaagtgtgctaaatgctcttgacat

SEQ ID NO: 306621 - DNA, 25 bp, Rattus norvegicus
gaagtgtgctaattgctcttgacat

SEQ ID NO: 306622 - DNA, 25 bp, Rattus norvegicus
gaagtgtgctttcactcagatcctg

SEQ ID NO: 306623 - DNA, 25 bp, Rattus norvegicus
gaagtgtgctttgactcagatcctg

SEQ ID NO: 306624 - DNA, 25 bp, Rattus norvegicus
gaagtgtggcaactccatgttcgga

SEQ ID NO: 306625 - DNA, 25 bp, Rattus norvegicus
gaagtgtggcaagtccatgttcgga

SEQ ID NO: 306626 - DNA, 25 bp, Rattus norvegicus
gaagtgtgggctagttcctgaccca

SEQ ID NO: 306627 - DNA, 25 bp, Rattus norvegicus
gaagtgtgggcttgttcctgaccca

SEQ ID NO: 306628 - DNA, 25 bp, Rattus norvegicus
gaagtgtggtccaagccaccggagc

SEQ ID NO: 306629 - DNA, 25 bp, Rattus norvegicus
gaagtgtggtcctagccaccggagc

SEQ ID NO: 306630 - DNA, 25 bp, Rattus norvegicus
gaagtgtggtctcataggacaagaa

SEQ ID NO: 306631 - DNA, 25 bp, Rattus norvegicus
gaagtgtggtctgataggacaagaa

SEQ ID NO: 306632 - DNA, 25 bp, Rattus norvegicus
gaagtgtgtacgaactccccggaga

SEQ ID NO: 306633 - DNA, 25 bp, Rattus norvegicus
gaagtgtgtacgtactccccggaga

SEQ ID NO: 306634 - DNA, 25 bp, Rattus norvegicus
gaagtgtgtgagagtctatcagtct

SEQ ID NO: 306635 - DNA, 25 bp, Rattus norvegicus
gaagtgtgtgagtgtctatcagtct

SEQ ID NO: 306636 - DNA, 25 bp, Rattus norvegicus
gaagtgtgtgtaccagtctgcctcg

SEQ ID NO: 306637 - DNA, 25 bp, Rattus norvegicus
gaagtgtgtgtagcagtctgcctcg

SEQ ID NO: 306638 - DNA, 25 bp, Rattus norvegicus
gaagtgtgttccattggttgttggt

SEQ ID NO: 306639 - DNA, 25 bp, Rattus norvegicus
gaagtgtgttcctttggttgttggt

SEQ ID NO: 306640 - DNA, 25 bp, Rattus norvegicus
gaagtgtgtttgaatccgtctgtga

SEQ ID NO: 306641 - DNA, 25 bp, Rattus norvegicus
gaagtgtgtttgtatccgtctgtga

SEQ ID NO: 306642 - DNA, 25 bp, Rattus norvegicus
gaagtgttaactatcatgctcaata

SEQ ID NO: 306643 - DNA, 25 bp, Rattus norvegicus
gaagtgttaactttcatgctcaata

SEQ ID NO: 306644 - DNA, 25 bp, Rattus norvegicus
gaagtgttacagacatccctttaat

SEQ ID NO: 306645 - DNA, 25 bp, Rattus norvegicus
gaagtgttacagctaccttttcagt

SEQ ID NO: 306646 - DNA, 25 bp, Rattus norvegicus
gaagtgttacaggtaccttttcagt

SEQ ID NO: 306647 - DNA, 25 bp, Rattus norvegicus
gaagtgttacagtcatccctttaat

SEQ ID NO: 306648 - DNA, 25 bp, Rattus norvegicus
gaagtgttactcatcgtcatagata

SEQ ID NO: 306649 - DNA, 25 bp, Rattus norvegicus
gaagtgttactcttcgtcatagata

SEQ ID NO: 306650 - DNA, 25 bp, Rattus norvegicus
gaagtgttatccagtaacctgtcaa

SEQ ID NO: 306651 - DNA, 25 bp, Rattus norvegicus
gaagtgttatcctgtaacctgtcaa

SEQ ID NO: 306652 - DNA, 25 bp, Rattus norvegicus
gaagtgttcaatctggcagcccgca

SEQ ID NO: 306653 - DNA, 25 bp, Rattus norvegicus
gaagtgttcaatgtggcagcccgca

SEQ ID NO: 306654 - DNA, 25 bp, Rattus norvegicus
gaagtgttcaccaagtcagtctctt

SEQ ID NO: 306655 - DNA, 25 bp, Rattus norvegicus
gaagtgttcacctagtcagtctctt

SEQ ID NO: 306656 - DNA, 25 bp, Rattus norvegicus
gaagtgttcattatagagctcattt

SEQ ID NO: 306657 - DNA, 25 bp, Rattus norvegicus
gaagtgttcattttagagctcattt

SEQ ID NO: 306658 - DNA, 25 bp, Rattus norvegicus
gaagtgttcccaacagacagtcatg

SEQ ID NO: 306659 - DNA, 25 bp, Rattus norvegicus
gaagtgttcccatcagacagtcatg

SEQ ID NO: 306660 - DNA, 25 bp, Rattus norvegicus
gaagtgttcctaaacaccggcacaa

SEQ ID NO: 306661 - DNA, 25 bp, Rattus norvegicus
gaagtgttcctatacaccggcacaa

SEQ ID NO: 306662 - DNA, 25 bp, Rattus norvegicus
gaagtgttccttatgtaccacagtc

SEQ ID NO: 306663 - DNA, 25 bp, Rattus norvegicus
gaagtgttccttttgtaccacagtc

SEQ ID NO: 306664 - DNA, 25 bp, Rattus norvegicus
gaagtgttctagcactcactcgaac

SEQ ID NO: 306665 - DNA, 25 bp, Rattus norvegicus
gaagtgttctaggactcactcgaac

SEQ ID NO: 306666 - DNA, 25 bp, Rattus norvegicus
gaagtgttctgaaggccttgtggcc

SEQ ID NO: 306667 - DNA, 25 bp, Rattus norvegicus
gaagtgttctgatggccttgtggcc

SEQ ID NO: 306668 - DNA, 25 bp, Rattus norvegicus
gaagtgttcttacaactgttgagcc

SEQ ID NO: 306669 - DNA, 25 bp, Rattus norvegicus
gaagtgttcttagaactgttgagcc

SEQ ID NO: 306670 - DNA, 25 bp, Rattus norvegicus
gaagtgttcttgagaccatgtgtcc

SEQ ID NO: 306671 - DNA, 25 bp, Rattus norvegicus
gaagtgttcttgtgaccatgtgtcc

SEQ ID NO: 306672 - DNA, 25 bp, Rattus norvegicus
gaagtgttctttatctatagctcag

SEQ ID NO: 306673 - DNA, 25 bp, Rattus norvegicus
gaagtgttctttttctatagctcag

SEQ ID NO: 306674 - DNA, 25 bp, Rattus norvegicus
gaagtgttgagtcgcagtgttccct

SEQ ID NO: 306675 - DNA, 25 bp, Rattus norvegicus
gaagtgttgagtggcagtgttccct

SEQ ID NO: 306676 - DNA, 25 bp, Rattus norvegicus
gaagtgttgcatctcaccaagccag

SEQ ID NO: 306677 - DNA, 25 bp, Rattus norvegicus
gaagtgttgcatgtcaccaagccag

SEQ ID NO: 306678 - DNA, 25 bp, Rattus norvegicus
gaagtgttgctcacatcgtgtaact

SEQ ID NO: 306679 - DNA, 25 bp, Rattus norvegicus
gaagtgttgctctcatcgtgtaact

SEQ ID NO: 306680 - DNA, 25 bp, Rattus norvegicus
gaagtgttgtccagatgttcttgta

SEQ ID NO: 306681 - DNA, 25 bp, Rattus norvegicus
gaagtgttgtcctgatgttcttgta

SEQ ID NO: 306682 - DNA, 25 bp, Rattus norvegicus
gaagtgtttactactgattcctgct

SEQ ID NO: 306683 - DNA, 25 bp, Rattus norvegicus
gaagtgtttacttctgattcctgct

SEQ ID NO: 306684 - DNA, 25 bp, Rattus norvegicus
gaagtgtttattaaggctgaacctg

SEQ ID NO: 306685 - DNA, 25 bp, Rattus norvegicus
gaagtgtttatttaggctgaacctg

SEQ ID NO: 306686 - DNA, 25 bp, Rattus norvegicus
gaagtgtttcacacttccaagcttt

SEQ ID NO: 306687 - DNA, 25 bp, Rattus norvegicus
gaagtgtttcactcttccaagcttt

SEQ ID NO: 306688 - DNA, 25 bp, Rattus norvegicus
gaagtgtttctaccacattcacaga

SEQ ID NO: 306689 - DNA, 25 bp, Rattus norvegicus
gaagtgtttctagcacattcacaga

SEQ ID NO: 306690 - DNA, 25 bp, Rattus norvegicus
gaagtgtttctgaacatagagactt

SEQ ID NO: 306691 - DNA, 25 bp, Rattus norvegicus
gaagtgtttctgtacatagagactt

SEQ ID NO: 306692 - DNA, 25 bp, Rattus norvegicus
gaagtgtttgaacctttctcatgga

SEQ ID NO: 306693 - DNA, 25 bp, Rattus norvegicus
gaagtgtttgaagctttctcatgga

SEQ ID NO: 306694 - DNA, 25 bp, Rattus norvegicus
gaagtgtttgctagctatttgctga

SEQ ID NO: 306695 - DNA, 25 bp, Rattus norvegicus
gaagtgtttgcttgctatttgctga

SEQ ID NO: 306696 - DNA, 25 bp, Rattus norvegicus
gaagtgtttgttccgaatgttgtaa

SEQ ID NO: 306697 - DNA, 25 bp, Rattus norvegicus
gaagtgtttgttgcgaatgttgtaa

SEQ ID NO: 306698 - DNA, 25 bp, Rattus norvegicus
gaagtgttttctacagactgaccat

SEQ ID NO: 306699 - DNA, 25 bp, Rattus norvegicus
gaagtgttttcttcagactgaccat

SEQ ID NO: 306700 - DNA, 25 bp, Rattus norvegicus
gaagttaaaactcgcccacctggtg

SEQ ID NO: 306701 - DNA, 25 bp, Rattus norvegicus
gaagttaaaactggcccacctggtg

SEQ ID NO: 306702 - DNA, 25 bp, Rattus norvegicus
gaagttaaagggaggcaccaccatg

SEQ ID NO: 306703 - DNA, 25 bp, Rattus norvegicus
gaagttaaagggtggcaccaccatg

SEQ ID NO: 306704 - DNA, 25 bp, Rattus norvegicus
gaagttaacattacagaaggcctag

SEQ ID NO: 306705 - DNA, 25 bp, Rattus norvegicus
gaagttaacatttcagaaggcctag

SEQ ID NO: 306706 - DNA, 25 bp, Rattus norvegicus
gaagttaatctcagtactagccgga

SEQ ID NO: 306707 - DNA, 25 bp, Rattus norvegicus
gaagttaatctctgtactagccgga

SEQ ID NO: 306708 - DNA, 25 bp, Rattus norvegicus
gaagttaatgccacagtttgccttt

SEQ ID NO: 306709 - DNA, 25 bp, Rattus norvegicus
gaagttaatgcctcagtttgccttt

SEQ ID NO: 306710 - DNA, 25 bp, Rattus norvegicus
gaagttaattgaagcccgcagcaag

SEQ ID NO: 306711 - DNA, 25 bp, Rattus norvegicus
gaagttaattgatgcccgcagcaag

SEQ ID NO: 306712 - DNA, 25 bp, Rattus norvegicus
gaagttaatttaccagctcctcggc

SEQ ID NO: 306713 - DNA, 25 bp, Rattus norvegicus
gaagttaatttagcagctcctcggc

SEQ ID NO: 306714 - DNA, 25 bp, Rattus norvegicus
gaagttacaaagacacccacagaag

SEQ ID NO: 306715 - DNA, 25 bp, Rattus norvegicus
gaagttacaaagacagcctccactg

SEQ ID NO: 306716 - DNA, 25 bp, Rattus norvegicus
gaagttacaaagtcacccacagaag

SEQ ID NO: 306717 - DNA, 25 bp, Rattus norvegicus
gaagttacaaagtcagcctccactg

SEQ ID NO: 306718 - DNA, 25 bp, Rattus norvegicus
gaagttacaaccagcagtgatcaca

SEQ ID NO: 306719 - DNA, 25 bp, Rattus norvegicus
gaagttacaacctgcagtgatcaca

SEQ ID NO: 306720 - DNA, 25 bp, Rattus norvegicus
gaagttacacaactatatcactgga

SEQ ID NO: 306721 - DNA, 25 bp, Rattus norvegicus
gaagttacacaagtatatcactgga

SEQ ID NO: 306722 - DNA, 25 bp, Rattus norvegicus
gaagttacatccacggtgcgacagg

SEQ ID NO: 306723 - DNA, 25 bp, Rattus norvegicus
gaagttacatcctcggtgcgacagg

SEQ ID NO: 306724 - DNA, 25 bp, Rattus norvegicus
gaagttaccaagagagtttccccag

SEQ ID NO: 306725 - DNA, 25 bp, Rattus norvegicus
gaagttaccaagtgagtttccccag

SEQ ID NO: 306726 - DNA, 25 bp, Rattus norvegicus
gaagttacccaacccttgaaatctg

SEQ ID NO: 306727 - DNA, 25 bp, Rattus norvegicus
gaagttacccaagccttgaaatctg

SEQ ID NO: 306728 - DNA, 25 bp, Rattus norvegicus
gaagttaccctgagttgagtccctt

SEQ ID NO: 306729 - DNA, 25 bp, Rattus norvegicus
gaagttaccctgtgttgagtccctt

SEQ ID NO: 306730 - DNA, 25 bp, Rattus norvegicus
gaagttacggatccggcttgccgac

SEQ ID NO: 306731 - DNA, 25 bp, Rattus norvegicus
gaagttacggatgcggcttgccgac

SEQ ID NO: 306732 - DNA, 25 bp, Rattus norvegicus
gaagttactagcaagcccaggcttg

SEQ ID NO: 306733 - DNA, 25 bp, Rattus norvegicus
gaagttactagctagcccaggcttg

SEQ ID NO: 306734 - DNA, 25 bp, Rattus norvegicus
gaagttactagtacttagaatgcag

SEQ ID NO: 306735 - DNA, 25 bp, Rattus norvegicus
gaagttactagttcttagaatgcag

SEQ ID NO: 306736 - DNA, 25 bp, Rattus norvegicus
gaagttactcaactcctagaaggaa

SEQ ID NO: 306737 - DNA, 25 bp, Rattus norvegicus
gaagttactcaagtcctagaaggaa

SEQ ID NO: 306738 - DNA, 25 bp, Rattus norvegicus
gaagttactgaacagcccctccctg

SEQ ID NO: 306739 - DNA, 25 bp, Rattus norvegicus
gaagttactgaagagcccctccctg

SEQ ID NO: 306740 - DNA, 25 bp, Rattus norvegicus
gaagttactgtacgagaggccacca

SEQ ID NO: 306741 - DNA, 25 bp, Rattus norvegicus
gaagttactgtaggagaggccacca

SEQ ID NO: 306742 - DNA, 25 bp, Rattus norvegicus
gaagttagaaatcacctgtcaggga

SEQ ID NO: 306743 - DNA, 25 bp, Rattus norvegicus
gaagttagaaatgacctgtcaggga

SEQ ID NO: 306744 - DNA, 25 bp, Rattus norvegicus
gaagttagagagctgtttccccact

SEQ ID NO: 306745 - DNA, 25 bp, Rattus norvegicus
gaagttagagaggtgtttccccact

SEQ ID NO: 306746 - DNA, 25 bp, Rattus norvegicus
gaagttagccttcacagtgagtcat

SEQ ID NO: 306747 - DNA, 25 bp, Rattus norvegicus
gaagttagccttgacagtgagtcat

SEQ ID NO: 306748 - DNA, 25 bp, Rattus norvegicus
gaagttagggtcatctgattcctta

SEQ ID NO: 306749 - DNA, 25 bp, Rattus norvegicus
gaagttagggtcttctgattcctta

SEQ ID NO: 306750 - DNA, 25 bp, Rattus norvegicus
gaagttaggtagcaacaactccact

SEQ ID NO: 306751 - DNA, 25 bp, Rattus norvegicus
gaagttaggtaggaacaactccact

SEQ ID NO: 306752 - DNA, 25 bp, Rattus norvegicus
gaagttagtaacagcagctcaccta

SEQ ID NO: 306753 - DNA, 25 bp, Rattus norvegicus
gaagttagtaactgcagctcaccta

SEQ ID NO: 306754 - DNA, 25 bp, Rattus norvegicus
gaagttagtagcctgaagcccgctg

SEQ ID NO: 306755 - DNA, 25 bp, Rattus norvegicus
gaagttagtagcgtgaagcccgctg

SEQ ID NO: 306756 - DNA, 25 bp, Rattus norvegicus
gaagttagtctacgatgcccaaaat

SEQ ID NO: 306757 - DNA, 25 bp, Rattus norvegicus
gaagttagtctaggatgcccaaaat

SEQ ID NO: 306758 - DNA, 25 bp, Rattus norvegicus
gaagttagtcttcaggcagctcaaa

SEQ ID NO: 306759 - DNA, 25 bp, Rattus norvegicus
gaagttagtcttgaggcagctcaaa

SEQ ID NO: 306760 - DNA, 25 bp, Rattus norvegicus
gaagttagttccacagttgcctgat

SEQ ID NO: 306761 - DNA, 25 bp, Rattus norvegicus
gaagttagttcctcagttgcctgat

SEQ ID NO: 306762 - DNA, 25 bp, Rattus norvegicus
gaagttataaggatccccatggatt

SEQ ID NO: 306763 - DNA, 25 bp, Rattus norvegicus
gaagttataaggttccccatggatt

SEQ ID NO: 306764 - DNA, 25 bp, Rattus norvegicus
gaagttatatatagaggctgcctct

SEQ ID NO: 306765 - DNA, 25 bp, Rattus norvegicus
gaagttatatattgaggctgcctct

SEQ ID NO: 306766 - DNA, 25 bp, Rattus norvegicus
gaagttatattcaggcctatgccgc

SEQ ID NO: 306767 - DNA, 25 bp, Rattus norvegicus
gaagttatattctggcctatgccgc

SEQ ID NO: 306768 - DNA, 25 bp, Rattus norvegicus
gaagttatcattacacatcctgcgt

SEQ ID NO: 306769 - DNA, 25 bp, Rattus norvegicus
gaagttatcatttcacatcctgcgt

SEQ ID NO: 306770 - DNA, 25 bp, Rattus norvegicus
gaagttatctgaccctctaatcttt

SEQ ID NO: 306771 - DNA, 25 bp, Rattus norvegicus
gaagttatctgagcctctaatcttt

SEQ ID NO: 306772 - DNA, 25 bp, Rattus norvegicus
gaagttatggtgctgcttgcaacag

SEQ ID NO: 306773 - DNA, 25 bp, Rattus norvegicus
gaagttatggtggtgcttgcaacag

SEQ ID NO: 306774 - DNA, 25 bp, Rattus norvegicus
gaagttatgtcaacacagccgaagt

SEQ ID NO: 306775 - DNA, 25 bp, Rattus norvegicus
gaagttatgtcactgaagctatcct

SEQ ID NO: 306776 - DNA, 25 bp, Rattus norvegicus
gaagttatgtcagtgaagctatcct

SEQ ID NO: 306777 - DNA, 25 bp, Rattus norvegicus
gaagttatgtcatcacagccgaagt

SEQ ID NO: 306778 - DNA, 25 bp, Rattus norvegicus
gaagttatgtgtccctaccaatgtc

SEQ ID NO: 306779 - DNA, 25 bp, Rattus norvegicus
gaagttatgtgtgcctaccaatgtc

SEQ ID NO: 306780 - DNA, 25 bp, Rattus norvegicus
gaagttattcatcgcggacttacag

SEQ ID NO: 306781 - DNA, 25 bp, Rattus norvegicus
gaagttattcatggcggacttacag

SEQ ID NO: 306782 - DNA, 25 bp, Rattus norvegicus
gaagttatttcaaccagcagaagga

SEQ ID NO: 306783 - DNA, 25 bp, Rattus norvegicus
gaagttatttcatccagcagaagga

SEQ ID NO: 306784 - DNA, 25 bp, Rattus norvegicus
gaagttatttgaaacctcctgggta

SEQ ID NO: 306785 - DNA, 25 bp, Rattus norvegicus
gaagttatttgatacctcctgggta

SEQ ID NO: 306786 - DNA, 25 bp, Rattus norvegicus
gaagttcaaacactgccctacagag

SEQ ID NO: 306787 - DNA, 25 bp, Rattus norvegicus
gaagttcaaacagtgccctacagag

SEQ ID NO: 306788 - DNA, 25 bp, Rattus norvegicus
gaagttcaaatcacattcaccacca

SEQ ID NO: 306789 - DNA, 25 bp, Rattus norvegicus
gaagttcaaatctcattcaccacca

SEQ ID NO: 306790 - DNA, 25 bp, Rattus norvegicus
gaagttcaaccgatacctggacgtg

SEQ ID NO: 306791 - DNA, 25 bp, Rattus norvegicus
gaagttcaaccgttacctggacgtg

SEQ ID NO: 306792 - DNA, 25 bp, Rattus norvegicus
gaagttcaagccagactgcgtgaat

SEQ ID NO: 306793 - DNA, 25 bp, Rattus norvegicus
gaagttcaagcctgactgcgtgaat

SEQ ID NO: 306794 - DNA, 25 bp, Rattus norvegicus
gaagttcaaggcaactgttgtcaac

SEQ ID NO: 306795 - DNA, 25 bp, Rattus norvegicus
gaagttcaaggctactgttgtcaac

SEQ ID NO: 306796 - DNA, 25 bp, Rattus norvegicus
gaagttcaaggtcccctcagagtcc

SEQ ID NO: 306797 - DNA, 25 bp, Rattus norvegicus
gaagttcaaggtgccctcagagtcc

SEQ ID NO: 306798 - DNA, 25 bp, Rattus norvegicus
gaagttcaatttcaagacctccttg

SEQ ID NO: 306799 - DNA, 25 bp, Rattus norvegicus
gaagttcaatttgaagacctccttg

SEQ ID NO: 306800 - DNA, 25 bp, Rattus norvegicus
gaagttcacaagagcccgggacatc

SEQ ID NO: 306801 - DNA, 25 bp, Rattus norvegicus
gaagttcacaagtgcccgggacatc

SEQ ID NO: 306802 - DNA, 25 bp, Rattus norvegicus
gaagttcacaggctcagacgaccgg

SEQ ID NO: 306803 - DNA, 25 bp, Rattus norvegicus
gaagttcacagggtcagacgaccgg

SEQ ID NO: 306804 - DNA, 25 bp, Rattus norvegicus
gaagttcaccagaatcagatcatgc

SEQ ID NO: 306805 - DNA, 25 bp, Rattus norvegicus
gaagttcaccagtatcagatcatgc

SEQ ID NO: 306806 - DNA, 25 bp, Rattus norvegicus
gaagttcacccaagggatggtttca

SEQ ID NO: 306807 - DNA, 25 bp, Rattus norvegicus
gaagttcacccatgggatggtttca

SEQ ID NO: 306808 - DNA, 25 bp, Rattus norvegicus
gaagttcaccctaaaggccgggcag

SEQ ID NO: 306809 - DNA, 25 bp, Rattus norvegicus
gaagttcacccttaaggccgggcag

SEQ ID NO: 306810 - DNA, 25 bp, Rattus norvegicus
gaagttcacgccagttaatccaaga

SEQ ID NO: 306811 - DNA, 25 bp, Rattus norvegicus
gaagttcacgcctgttaatccaaga

SEQ ID NO: 306812 - DNA, 25 bp, Rattus norvegicus
gaagttcacttcctgtgtcactcca

SEQ ID NO: 306813 - DNA, 25 bp, Rattus norvegicus
gaagttcacttcgtgtgtcactcca

SEQ ID NO: 306814 - DNA, 25 bp, Rattus norvegicus
gaagttcagattccatacatcctaa

SEQ ID NO: 306815 - DNA, 25 bp, Rattus norvegicus
gaagttcagattgcatacatcctaa

SEQ ID NO: 306816 - DNA, 25 bp, Rattus norvegicus
gaagttcagccaatctttcttgatg

SEQ ID NO: 306817 - DNA, 25 bp, Rattus norvegicus
gaagttcagccaatttgtatcaaac

SEQ ID NO: 306818 - DNA, 25 bp, Rattus norvegicus
gaagttcagccattctttcttgatg

SEQ ID NO: 306819 - DNA, 25 bp, Rattus norvegicus
gaagttcagccattttgtatcaaac

SEQ ID NO: 306820 - DNA, 25 bp, Rattus norvegicus
gaagttcagcgtagtatgtctctct

SEQ ID NO: 306821 - DNA, 25 bp, Rattus norvegicus
gaagttcagcgttgtatgtctctct

SEQ ID NO: 306822 - DNA, 25 bp, Rattus norvegicus
gaagttcagctaccctctagaatag

SEQ ID NO: 306823 - DNA, 25 bp, Rattus norvegicus
gaagttcagctagcctctagaatag

SEQ ID NO: 306824 - DNA, 25 bp, Rattus norvegicus
gaagttcaggacagtgtcagatgag

SEQ ID NO: 306825 - DNA, 25 bp, Rattus norvegicus
gaagttcaggactgtgtcagatgag

SEQ ID NO: 306826 - DNA, 25 bp, Rattus norvegicus
gaagttcagggcctttctggattat

SEQ ID NO: 306827 - DNA, 25 bp, Rattus norvegicus
gaagttcagggcgtttctggattat

SEQ ID NO: 306828 - DNA, 25 bp, Rattus norvegicus
gaagttcatactaagcctctgctaa

SEQ ID NO: 306829 - DNA, 25 bp, Rattus norvegicus
gaagttcatacttagcctctgctaa

SEQ ID NO: 306830 - DNA, 25 bp, Rattus norvegicus
gaagttcatcggctaaaccgtacag

SEQ ID NO: 306831 - DNA, 25 bp, Rattus norvegicus
gaagttcatcgggtaaaccgtacag

SEQ ID NO: 306832 - DNA, 25 bp, Rattus norvegicus
gaagttcatcttcacgcccgtggaa

SEQ ID NO: 306833 - DNA, 25 bp, Rattus norvegicus
gaagttcatcttgacgcccgtggaa

SEQ ID NO: 306834 - DNA, 25 bp, Rattus norvegicus
gaagttcatgcaatggtgttttcga

SEQ ID NO: 306835 - DNA, 25 bp, Rattus norvegicus
gaagttcatgcattggtgttttcga

SEQ ID NO: 306836 - DNA, 25 bp, Rattus norvegicus
gaagttcatggaacagcacccagag

SEQ ID NO: 306837 - DNA, 25 bp, Rattus norvegicus
gaagttcatggatcagcacccagag

SEQ ID NO: 306838 - DNA, 25 bp, Rattus norvegicus
gaagttcatgtcaacattagctcaa

SEQ ID NO: 306839 - DNA, 25 bp, Rattus norvegicus
gaagttcatgtctacattagctcaa

SEQ ID NO: 306840 - DNA, 25 bp, Rattus norvegicus
gaagttcatgtgactccattgtttg

SEQ ID NO: 306841 - DNA, 25 bp, Rattus norvegicus
gaagttcatgtgtctccattgtttg

SEQ ID NO: 306842 - DNA, 25 bp, Rattus norvegicus
gaagttcattccagtctaaatcaaa

SEQ ID NO: 306843 - DNA, 25 bp, Rattus norvegicus
gaagttcattcctgtctaaatcaaa

SEQ ID NO: 306844 - DNA, 25 bp, Rattus norvegicus
gaagttcattctcttgctgtgacag

SEQ ID NO: 306845 - DNA, 25 bp, Rattus norvegicus
gaagttcattctgttgctgtgacag

SEQ ID NO: 306846 - DNA, 25 bp, Rattus norvegicus
gaagttcattgaagccgcccaaagg

SEQ ID NO: 306847 - DNA, 25 bp, Rattus norvegicus
gaagttcattgacccaccattgcag

SEQ ID NO: 306848 - DNA, 25 bp, Rattus norvegicus
gaagttcattgagccaccattgcag

SEQ ID NO: 306849 - DNA, 25 bp, Rattus norvegicus
gaagttcattgatgccgcccaaagg

SEQ ID NO: 306850 - DNA, 25 bp, Rattus norvegicus
gaagttcatttcagtccaattttta

SEQ ID NO: 306851 - DNA, 25 bp, Rattus norvegicus
gaagttcatttcctacaagtacggt

SEQ ID NO: 306852 - DNA, 25 bp, Rattus norvegicus
gaagttcatttcgtacaagtacggt

SEQ ID NO: 306853 - DNA, 25 bp, Rattus norvegicus
gaagttcatttctgtccaattttta

SEQ ID NO: 306854 - DNA, 25 bp, Rattus norvegicus
gaagttcattttatagtctcaagga

SEQ ID NO: 306855 - DNA, 25 bp, Rattus norvegicus
gaagttcattttttagtctcaagga

SEQ ID NO: 306856 - DNA, 25 bp, Rattus norvegicus
gaagttccaaaacgctctggctatt

SEQ ID NO: 306857 - DNA, 25 bp, Rattus norvegicus
gaagttccaaaaggctctggctatt

SEQ ID NO: 306858 - DNA, 25 bp, Rattus norvegicus
gaagttccaaatcctttgattgaag

SEQ ID NO: 306859 - DNA, 25 bp, Rattus norvegicus
gaagttccaaatgctttgattgaag

SEQ ID NO: 306860 - DNA, 25 bp, Rattus norvegicus
gaagttccaagacagccactgagca

SEQ ID NO: 306861 - DNA, 25 bp, Rattus norvegicus
gaagttccaagacgcctggagccca

SEQ ID NO: 306862 - DNA, 25 bp, Rattus norvegicus
gaagttccaagagagccactgagca

SEQ ID NO: 306863 - DNA, 25 bp, Rattus norvegicus
gaagttccaagaggcctggagccca

SEQ ID NO: 306864 - DNA, 25 bp, Rattus norvegicus
gaagttccaaggacgggatcccagg

SEQ ID NO: 306865 - DNA, 25 bp, Rattus norvegicus
gaagttccaaggtcgggatcccagg

SEQ ID NO: 306866 - DNA, 25 bp, Rattus norvegicus
gaagttccagacagtttctccctct

SEQ ID NO: 306867 - DNA, 25 bp, Rattus norvegicus
gaagttccagactgtttctccctct

SEQ ID NO: 306868 - DNA, 25 bp, Rattus norvegicus
gaagttccagagatagccagctact

SEQ ID NO: 306869 - DNA, 25 bp, Rattus norvegicus
gaagttccagagttagccagctact

SEQ ID NO: 306870 - DNA, 25 bp, Rattus norvegicus
gaagttccaggtagatcacaggcgg

SEQ ID NO: 306871 - DNA, 25 bp, Rattus norvegicus
gaagttccaggttgatcacaggcgg

SEQ ID NO: 306872 - DNA, 25 bp, Rattus norvegicus
gaagttccattaagccagactaagg

SEQ ID NO: 306873 - DNA, 25 bp, Rattus norvegicus
gaagttccattatgccagactaagg

SEQ ID NO: 306874 - DNA, 25 bp, Rattus norvegicus
gaagttcccaaaagccaaggccctg

SEQ ID NO: 306875 - DNA, 25 bp, Rattus norvegicus
gaagttcccaaatgccaaggccctg

SEQ ID NO: 306876 - DNA, 25 bp, Rattus norvegicus
gaagttcccacaataaatctcccga

SEQ ID NO: 306877 - DNA, 25 bp, Rattus norvegicus
gaagttcccacattaaatctcccga

SEQ ID NO: 306878 - DNA, 25 bp, Rattus norvegicus
gaagttcccatcctgtagttagtaa

SEQ ID NO: 306879 - DNA, 25 bp, Rattus norvegicus
gaagttcccatcgtgtagttagtaa

SEQ ID NO: 306880 - DNA, 25 bp, Rattus norvegicus
gaagttcccatgattcttttcaaag

SEQ ID NO: 306881 - DNA, 25 bp, Rattus norvegicus
gaagttcccatgtttcttttcaaag

SEQ ID NO: 306882 - DNA, 25 bp, Rattus norvegicus
gaagttccccatatatgctacttga

SEQ ID NO: 306883 - DNA, 25 bp, Rattus norvegicus
gaagttccccatttatgctacttga

SEQ ID NO: 306884 - DNA, 25 bp, Rattus norvegicus
gaagttcccccacagatgaaagtca

SEQ ID NO: 306885 - DNA, 25 bp, Rattus norvegicus
gaagttcccccagagatgaaagtca

SEQ ID NO: 306886 - DNA, 25 bp, Rattus norvegicus
gaagttccccgcctggcagaacagc

SEQ ID NO: 306887 - DNA, 25 bp, Rattus norvegicus
gaagttccccgcgtggcagaacagc

SEQ ID NO: 306888 - DNA, 25 bp, Rattus norvegicus
gaagttccccttcgttgtctcaggt

SEQ ID NO: 306889 - DNA, 25 bp, Rattus norvegicus
gaagttccccttggttgtctcaggt

SEQ ID NO: 306890 - DNA, 25 bp, Rattus norvegicus
gaagttcccgaacctctgagataga

SEQ ID NO: 306891 - DNA, 25 bp, Rattus norvegicus
gaagttcccgaagctctgagataga

SEQ ID NO: 306892 - DNA, 25 bp, Rattus norvegicus
gaagttccctccacagaatgtctga

SEQ ID NO: 306893 - DNA, 25 bp, Rattus norvegicus
gaagttccctcctcagaatgtctga

SEQ ID NO: 306894 - DNA, 25 bp, Rattus norvegicus
gaagttccctgtagaaggtctcagc

SEQ ID NO: 306895 - DNA, 25 bp, Rattus norvegicus
gaagttccctgttgaaggtctcagc

SEQ ID NO: 306896 - DNA, 25 bp, Rattus norvegicus
gaagttccctttatatttatgttat

SEQ ID NO: 306897 - DNA, 25 bp, Rattus norvegicus
gaagttccctttttatttatgttat

SEQ ID NO: 306898 - DNA, 25 bp, Rattus norvegicus
gaagttccggaaatatctctctgtg

SEQ ID NO: 306899 - DNA, 25 bp, Rattus norvegicus
gaagttccggaattatctctctgtg

SEQ ID NO: 306900 - DNA, 25 bp, Rattus norvegicus
gaagttcctaacagttgctctgcat

SEQ ID NO: 306901 - DNA, 25 bp, Rattus norvegicus
gaagttcctaactgttgctctgcat

SEQ ID NO: 306902 - DNA, 25 bp, Rattus norvegicus
gaagttcctaagcattctctgttcc

SEQ ID NO: 306903 - DNA, 25 bp, Rattus norvegicus
gaagttcctaaggattctctgttcc

SEQ ID NO: 306904 - DNA, 25 bp, Rattus norvegicus
gaagttcctacaatcagctgtacat

SEQ ID NO: 306905 - DNA, 25 bp, Rattus norvegicus
gaagttcctacattcagctgtacat

SEQ ID NO: 306906 - DNA, 25 bp, Rattus norvegicus
gaagttcctcaactagctgctatct

SEQ ID NO: 306907 - DNA, 25 bp, Rattus norvegicus
gaagttcctcaagtagctgctatct

SEQ ID NO: 306908 - DNA, 25 bp, Rattus norvegicus
gaagttcctcatattgcacaagtgg

SEQ ID NO: 306909 - DNA, 25 bp, Rattus norvegicus
gaagttcctcattttgcacaagtgg

SEQ ID NO: 306910 - DNA, 25 bp, Rattus norvegicus
gaagttcctctcaacttaccacgta

SEQ ID NO: 306911 - DNA, 25 bp, Rattus norvegicus
gaagttcctctctacttaccacgta

SEQ ID NO: 306912 - DNA, 25 bp, Rattus norvegicus
gaagttcctgatagtgtttctcccc

SEQ ID NO: 306913 - DNA, 25 bp, Rattus norvegicus
gaagttcctgatattattcctttgg

SEQ ID NO: 306914 - DNA, 25 bp, Rattus norvegicus
gaagttcctgattgtgtttctcccc

SEQ ID NO: 306915 - DNA, 25 bp, Rattus norvegicus
gaagttcctgattttattcctttgg

SEQ ID NO: 306916 - DNA, 25 bp, Rattus norvegicus
gaagttcctgcacaagccatagcta

SEQ ID NO: 306917 - DNA, 25 bp, Rattus norvegicus
gaagttcctgcagaagccatagcta

SEQ ID NO: 306918 - DNA, 25 bp, Rattus norvegicus
gaagttcctgcgatggaagctcaca

SEQ ID NO: 306919 - DNA, 25 bp, Rattus norvegicus
gaagttcctgcgttggaagctcaca

SEQ ID NO: 306920 - DNA, 25 bp, Rattus norvegicus
gaagttcctggtcctgttcagctca

SEQ ID NO: 306921 - DNA, 25 bp, Rattus norvegicus
gaagttcctggtcgtgctaatagaa

SEQ ID NO: 306922 - DNA, 25 bp, Rattus norvegicus
gaagttcctggtgctgttcagctca

SEQ ID NO: 306923 - DNA, 25 bp, Rattus norvegicus
gaagttcctggtggtgctaatagaa

SEQ ID NO: 306924 - DNA, 25 bp, Rattus norvegicus
gaagttcctgtgaagcctatgtgca

SEQ ID NO: 306925 - DNA, 25 bp, Rattus norvegicus
gaagttcctgtgtagcctatgtgca

SEQ ID NO: 306926 - DNA, 25 bp, Rattus norvegicus
gaagttcctgttccttttgtatgat

SEQ ID NO: 306927 - DNA, 25 bp, Rattus norvegicus
gaagttcctgttgcttttgtatgat

SEQ ID NO: 306928 - DNA, 25 bp, Rattus norvegicus
gaagttccttatccttgcgtattaa

SEQ ID NO: 306929 - DNA, 25 bp, Rattus norvegicus
gaagttccttatgcttgcgtattaa

SEQ ID NO: 306930 - DNA, 25 bp, Rattus norvegicus
gaagttccttcaccaacagcttatt

SEQ ID NO: 306931 - DNA, 25 bp, Rattus norvegicus
gaagttccttcagcaacagcttatt

SEQ ID NO: 306932 - DNA, 25 bp, Rattus norvegicus
gaagttccttgaacccctgggagga

SEQ ID NO: 306933 - DNA, 25 bp, Rattus norvegicus
gaagttccttgatcccctgggagga

SEQ ID NO: 306934 - DNA, 25 bp, Rattus norvegicus
gaagttcgccatcaaaaatcgcata

SEQ ID NO: 306935 - DNA, 25 bp, Rattus norvegicus
gaagttcgccatgaaaaatcgcata

SEQ ID NO: 306936 - DNA, 25 bp, Rattus norvegicus
gaagttcgcctgctttgaacggact

SEQ ID NO: 306937 - DNA, 25 bp, Rattus norvegicus
gaagttcgcctggtttgaacggact

SEQ ID NO: 306938 - DNA, 25 bp, Rattus norvegicus
gaagttcggaatcccaggaaggtca

SEQ ID NO: 306939 - DNA, 25 bp, Rattus norvegicus
gaagttcggaatgccaggaaggtca

SEQ ID NO: 306940 - DNA, 25 bp, Rattus norvegicus
gaagttcgggctctgcttttaggaa

SEQ ID NO: 306941 - DNA, 25 bp, Rattus norvegicus
gaagttcgggctgtgcttttaggaa

SEQ ID NO: 306942 - DNA, 25 bp, Rattus norvegicus
gaagttcgtgatatccagtctccac

SEQ ID NO: 306943 - DNA, 25 bp, Rattus norvegicus
gaagttcgtgatttccagtctccac

SEQ ID NO: 306944 - DNA, 25 bp, Rattus norvegicus
gaagttctactaacatccacacaaa

SEQ ID NO: 306945 - DNA, 25 bp, Rattus norvegicus
gaagttctactatcatccacacaaa

SEQ ID NO: 306946 - DNA, 25 bp, Rattus norvegicus
gaagttctagtgacagcgtgcttta

SEQ ID NO: 306947 - DNA, 25 bp, Rattus norvegicus
gaagttctagtgtcagcgtgcttta

SEQ ID NO: 306948 - DNA, 25 bp, Rattus norvegicus
gaagttctatatcgagggctctgag

SEQ ID NO: 306949 - DNA, 25 bp, Rattus norvegicus
gaagttctatatggagggctctgag

SEQ ID NO: 306950 - DNA, 25 bp, Rattus norvegicus
gaagttctatgtcccctgcaagcag

SEQ ID NO: 306951 - DNA, 25 bp, Rattus norvegicus
gaagttctatgtgccctgcaagcag

SEQ ID NO: 306952 - DNA, 25 bp, Rattus norvegicus
gaagttctcaagatgggactcagca

SEQ ID NO: 306953 - DNA, 25 bp, Rattus norvegicus
gaagttctcaagttgggactcagca

SEQ ID NO: 306954 - DNA, 25 bp, Rattus norvegicus
gaagttctcaatccagcttttgatg

SEQ ID NO: 306955 - DNA, 25 bp, Rattus norvegicus
gaagttctcaatgcagcttttgatg

SEQ ID NO: 306956 - DNA, 25 bp, Rattus norvegicus
gaagttctcacgcagcaccatcaga

SEQ ID NO: 306957 - DNA, 25 bp, Rattus norvegicus
gaagttctcacggagcaccatcaga

SEQ ID NO: 306958 - DNA, 25 bp, Rattus norvegicus
gaagttctcagcaacgtctagaaga

SEQ ID NO: 306959 - DNA, 25 bp, Rattus norvegicus
gaagttctcagctacgtctagaaga

SEQ ID NO: 306960 - DNA, 25 bp, Rattus norvegicus
gaagttctccaacaagactccatgc

SEQ ID NO: 306961 - DNA, 25 bp, Rattus norvegicus
gaagttctccaagaagactccatgc

SEQ ID NO: 306962 - DNA, 25 bp, Rattus norvegicus
gaagttctccatctcatttagtggc

SEQ ID NO: 306963 - DNA, 25 bp, Rattus norvegicus
gaagttctccatgtcatttagtggc

SEQ ID NO: 306964 - DNA, 25 bp, Rattus norvegicus
gaagttctccctcagggactgcagc

SEQ ID NO: 306965 - DNA, 25 bp, Rattus norvegicus
gaagttctccctgagggactgcagc

SEQ ID NO: 306966 - DNA, 25 bp, Rattus norvegicus
gaagttctcctgacatgtgtcctct

SEQ ID NO: 306967 - DNA, 25 bp, Rattus norvegicus
gaagttctcctgtcatgtgtcctct

SEQ ID NO: 306968 - DNA, 25 bp, Rattus norvegicus
gaagttctcggacgtgctcaagcga

SEQ ID NO: 306969 - DNA, 25 bp, Rattus norvegicus
gaagttctcggaggtgctcaagcga

SEQ ID NO: 306970 - DNA, 25 bp, Rattus norvegicus
gaagttctctctacctgggaaaatc

SEQ ID NO: 306971 - DNA, 25 bp, Rattus norvegicus
gaagttctctcttcctgggaaaatc

SEQ ID NO: 306972 - DNA, 25 bp, Rattus norvegicus
gaagttctgaaaacaccactaagtt

SEQ ID NO: 306973 - DNA, 25 bp, Rattus norvegicus
gaagttctgaaatcaccactaagtt

SEQ ID NO: 306974 - DNA, 25 bp, Rattus norvegicus
gaagttctgaagacaatacccagtg

SEQ ID NO: 306975 - DNA, 25 bp, Rattus norvegicus
gaagttctgaagtcaatacccagtg

SEQ ID NO: 306976 - DNA, 25 bp, Rattus norvegicus
gaagttctgataaaatggccattca

SEQ ID NO: 306977 - DNA, 25 bp, Rattus norvegicus
gaagttctgataacaaggttttcat

SEQ ID NO: 306978 - DNA, 25 bp, Rattus norvegicus
gaagttctgatataatggccattca

SEQ ID NO: 306979 - DNA, 25 bp, Rattus norvegicus
gaagttctgatatcaaggttttcat

SEQ ID NO: 306980 - DNA, 25 bp, Rattus norvegicus
gaagttctgattatccctcttaatc

SEQ ID NO: 306981 - DNA, 25 bp, Rattus norvegicus
gaagttctgattttccctcttaatc

SEQ ID NO: 306982 - DNA, 25 bp, Rattus norvegicus
gaagttctgctgactgaaccacctg

SEQ ID NO: 306983 - DNA, 25 bp, Rattus norvegicus
gaagttctgctgtctgaaccacctg

SEQ ID NO: 306984 - DNA, 25 bp, Rattus norvegicus
gaagttctggttactaccctgatga

SEQ ID NO: 306985 - DNA, 25 bp, Rattus norvegicus
gaagttctggttcctggatttggtc

SEQ ID NO: 306986 - DNA, 25 bp, Rattus norvegicus
gaagttctggttgctggatttggtc

SEQ ID NO: 306987 - DNA, 25 bp, Rattus norvegicus
gaagttctggtttctaccctgatga

SEQ ID NO: 306988 - DNA, 25 bp, Rattus norvegicus
gaagttctgtatccattttatgacc

SEQ ID NO: 306989 - DNA, 25 bp, Rattus norvegicus
gaagttctgtatcccaactttaatg

SEQ ID NO: 306990 - DNA, 25 bp, Rattus norvegicus
gaagttctgtatgcattttatgacc

SEQ ID NO: 306991 - DNA, 25 bp, Rattus norvegicus
gaagttctgtatgccaactttaatg

SEQ ID NO: 306992 - DNA, 25 bp, Rattus norvegicus
gaagttctgtctcagttgacatcct

SEQ ID NO: 306993 - DNA, 25 bp, Rattus norvegicus
gaagttctgtctcttgttccattcc

SEQ ID NO: 306994 - DNA, 25 bp, Rattus norvegicus
gaagttctgtctgagttgacatcct

SEQ ID NO: 306995 - DNA, 25 bp, Rattus norvegicus
gaagttctgtctgttgttccattcc

SEQ ID NO: 306996 - DNA, 25 bp, Rattus norvegicus
gaagttctgttgcatgataggagct

SEQ ID NO: 306997 - DNA, 25 bp, Rattus norvegicus
gaagttctgttggatgataggagct

SEQ ID NO: 306998 - DNA, 25 bp, Rattus norvegicus
gaagttctgtttcagtgtccagcgc

SEQ ID NO: 306999 - DNA, 25 bp, Rattus norvegicus
gaagttctgtttgagtgtccagcgc

SEQ ID NO: 307000 - DNA, 25 bp, Rattus norvegicus
gaagttcttacaagcccatagtggg

SEQ ID NO: 307001 - DNA, 25 bp, Rattus norvegicus
gaagttcttacatgcccatagtggg

SEQ ID NO: 307002 - DNA, 25 bp, Rattus norvegicus
gaagttcttcagaactgccaggaga

SEQ ID NO: 307003 - DNA, 25 bp, Rattus norvegicus
gaagttcttcagtactgccaggaga

SEQ ID NO: 307004 - DNA, 25 bp, Rattus norvegicus
gaagttcttccgcaaggctaaactg

SEQ ID NO: 307005 - DNA, 25 bp, Rattus norvegicus
gaagttcttccgctcagctgtctgc

SEQ ID NO: 307006 - DNA, 25 bp, Rattus norvegicus
gaagttcttccggaaggctaaactg

SEQ ID NO: 307007 - DNA, 25 bp, Rattus norvegicus
gaagttcttccggtcagctgtctgc

SEQ ID NO: 307008 - DNA, 25 bp, Rattus norvegicus
gaagttcttctgagctcttacgtaa

SEQ ID NO: 307009 - DNA, 25 bp, Rattus norvegicus
gaagttcttctgtgctcttacgtaa

SEQ ID NO: 307010 - DNA, 25 bp, Rattus norvegicus
gaagttcttgatactcaactagtac

SEQ ID NO: 307011 - DNA, 25 bp, Rattus norvegicus
gaagttcttgattctcaactagtac

SEQ ID NO: 307012 - DNA, 25 bp, Rattus norvegicus
gaagttcttgccacactctgtgcag

SEQ ID NO: 307013 - DNA, 25 bp, Rattus norvegicus
gaagttcttgcctcactctgtgcag

SEQ ID NO: 307014 - DNA, 25 bp, Rattus norvegicus
gaagttcttggcaagcccgaggtta

SEQ ID NO: 307015 - DNA, 25 bp, Rattus norvegicus
gaagttcttggccagtctcacgtca

SEQ ID NO: 307016 - DNA, 25 bp, Rattus norvegicus
gaagttcttggcgagtctcacgtca

SEQ ID NO: 307017 - DNA, 25 bp, Rattus norvegicus
gaagttcttggctagcccgaggtta

SEQ ID NO: 307018 - DNA, 25 bp, Rattus norvegicus
gaagttctttctcattctctttcac

SEQ ID NO: 307019 - DNA, 25 bp, Rattus norvegicus
gaagttctttctgattctctttcac

SEQ ID NO: 307020 - DNA, 25 bp, Rattus norvegicus
gaagttctttgtcaccaaccatgaa

SEQ ID NO: 307021 - DNA, 25 bp, Rattus norvegicus
gaagttctttgtgaccaaccatgaa

SEQ ID NO: 307022 - DNA, 25 bp, Rattus norvegicus
gaagttcttttcatacctcatacac

SEQ ID NO: 307023 - DNA, 25 bp, Rattus norvegicus
gaagttcttttcttacctcatacac

SEQ ID NO: 307024 - DNA, 25 bp, Rattus norvegicus
gaagttgaaactcactaatcctcct

SEQ ID NO: 307025 - DNA, 25 bp, Rattus norvegicus
gaagttgaaactgactaatcctcct

SEQ ID NO: 307026 - DNA, 25 bp, Rattus norvegicus
gaagttgacgttcccttttaagcct

SEQ ID NO: 307027 - DNA, 25 bp, Rattus norvegicus
gaagttgacgttgccttttaagcct

SEQ ID NO: 307028 - DNA, 25 bp, Rattus norvegicus
gaagttgactatcctgcttgctggc

SEQ ID NO: 307029 - DNA, 25 bp, Rattus norvegicus
gaagttgactatgctgcttgctggc

SEQ ID NO: 307030 - DNA, 25 bp, Rattus norvegicus
gaagttgagactcacctgggctaca

SEQ ID NO: 307031 - DNA, 25 bp, Rattus norvegicus
gaagttgagactgacctgggctaca

SEQ ID NO: 307032 - DNA, 25 bp, Rattus norvegicus
gaagttgaggtgactctcctcttcc

SEQ ID NO: 307033 - DNA, 25 bp, Rattus norvegicus
gaagttgaggtgtctctcctcttcc

SEQ ID NO: 307034 - DNA, 25 bp, Rattus norvegicus
gaagttgagttcaccctaggaatgt

SEQ ID NO: 307035 - DNA, 25 bp, Rattus norvegicus
gaagttgagttctccctaggaatgt

SEQ ID NO: 307036 - DNA, 25 bp, Rattus norvegicus
gaagttgatcatcgttttcatttta

SEQ ID NO: 307037 - DNA, 25 bp, Rattus norvegicus
gaagttgatcatggttttcatttta

SEQ ID NO: 307038 - DNA, 25 bp, Rattus norvegicus
gaagttgatccaaaccctgcaaatt

SEQ ID NO: 307039 - DNA, 25 bp, Rattus norvegicus
gaagttgatccataccctgcaaatt

SEQ ID NO: 307040 - DNA, 25 bp, Rattus norvegicus
gaagttgatgtcacatttggtcaga

SEQ ID NO: 307041 - DNA, 25 bp, Rattus norvegicus
gaagttgatgtctcatttggtcaga

SEQ ID NO: 307042 - DNA, 25 bp, Rattus norvegicus
gaagttgcagacaacgttgtgttct

SEQ ID NO: 307043 - DNA, 25 bp, Rattus norvegicus
gaagttgcagactacgttgtgttct

SEQ ID NO: 307044 - DNA, 25 bp, Rattus norvegicus
gaagttgcatatcgccaagttcttg

SEQ ID NO: 307045 - DNA, 25 bp, Rattus norvegicus
gaagttgcatatggccaagttcttg

SEQ ID NO: 307046 - DNA, 25 bp, Rattus norvegicus
gaagttgcatccaaactgttcagat

SEQ ID NO: 307047 - DNA, 25 bp, Rattus norvegicus
gaagttgcatcctaactgttcagat

SEQ ID NO: 307048 - DNA, 25 bp, Rattus norvegicus
gaagttgcatttccaagccacatct

SEQ ID NO: 307049 - DNA, 25 bp, Rattus norvegicus
gaagttgcatttgcaagccacatct

SEQ ID NO: 307050 - DNA, 25 bp, Rattus norvegicus
gaagttgccgttaagacacatgttt

SEQ ID NO: 307051 - DNA, 25 bp, Rattus norvegicus
gaagttgccgtttagacacatgttt

SEQ ID NO: 307052 - DNA, 25 bp, Rattus norvegicus
gaagttgcctacacgctttcatgtc

SEQ ID NO: 307053 - DNA, 25 bp, Rattus norvegicus
gaagttgcctactcgctttcatgtc

SEQ ID NO: 307054 - DNA, 25 bp, Rattus norvegicus
gaagttgcctcactgttgaacggga

SEQ ID NO: 307055 - DNA, 25 bp, Rattus norvegicus
gaagttgcctcagtgttgaacggga

SEQ ID NO: 307056 - DNA, 25 bp, Rattus norvegicus
gaagttgctcacagttatttgacag

SEQ ID NO: 307057 - DNA, 25 bp, Rattus norvegicus
gaagttgctcactgttatttgacag

SEQ ID NO: 307058 - DNA, 25 bp, Rattus norvegicus
gaagttgctctacctacagtgctgt

SEQ ID NO: 307059 - DNA, 25 bp, Rattus norvegicus
gaagttgctctagctacagtgctgt

SEQ ID NO: 307060 - DNA, 25 bp, Rattus norvegicus
gaagttgctcttagcttatctcaga

SEQ ID NO: 307061 - DNA, 25 bp, Rattus norvegicus
gaagttgctctttgcttatctcaga

SEQ ID NO: 307062 - DNA, 25 bp, Rattus norvegicus
gaagttgctgccaataatttcacag

SEQ ID NO: 307063 - DNA, 25 bp, Rattus norvegicus
gaagttgctgcctataatttcacag

SEQ ID NO: 307064 - DNA, 25 bp, Rattus norvegicus
gaagttggaagtccagccacctata

SEQ ID NO: 307065 - DNA, 25 bp, Rattus norvegicus
gaagttggaagtgcagccacctata

SEQ ID NO: 307066 - DNA, 25 bp, Rattus norvegicus
gaagttggaatccttgtgccctgaa

SEQ ID NO: 307067 - DNA, 25 bp, Rattus norvegicus
gaagttggaatcgttgtgccctgaa

SEQ ID NO: 307068 - DNA, 25 bp, Rattus norvegicus
gaagttggaggcacgcacaccaggc

SEQ ID NO: 307069 - DNA, 25 bp, Rattus norvegicus
gaagttggaggctcgcacaccaggc

SEQ ID NO: 307070 - DNA, 25 bp, Rattus norvegicus
gaagttggccgaaatcagcctagga

SEQ ID NO: 307071 - DNA, 25 bp, Rattus norvegicus
gaagttggccgatatcagcctagga

SEQ ID NO: 307072 - DNA, 25 bp, Rattus norvegicus
gaagttggctgacagaacgtttttg

SEQ ID NO: 307073 - DNA, 25 bp, Rattus norvegicus
gaagttggctgagagaacgtttttg

SEQ ID NO: 307074 - DNA, 25 bp, Rattus norvegicus
gaagttggcttccagtacatgaata

SEQ ID NO: 307075 - DNA, 25 bp, Rattus norvegicus
gaagttggcttcgagtacatgaata

SEQ ID NO: 307076 - DNA, 25 bp, Rattus norvegicus
gaagttggcttgacttcctgccaag

SEQ ID NO: 307077 - DNA, 25 bp, Rattus norvegicus
gaagttggcttgtcttcctgccaag

SEQ ID NO: 307078 - DNA, 25 bp, Rattus norvegicus
gaagttggctttcaatccagagcat

SEQ ID NO: 307079 - DNA, 25 bp, Rattus norvegicus
gaagttggctttgaatccagagcat

SEQ ID NO: 307080 - DNA, 25 bp, Rattus norvegicus
gaagttgggtgacacgaccatgcca

SEQ ID NO: 307081 - DNA, 25 bp, Rattus norvegicus
gaagttgggtgagacgaccatgcca

SEQ ID NO: 307082 - DNA, 25 bp, Rattus norvegicus
gaagttggtcttcactgtagagcag

SEQ ID NO: 307083 - DNA, 25 bp, Rattus norvegicus
gaagttggtcttgactgtagagcag

SEQ ID NO: 307084 - DNA, 25 bp, Rattus norvegicus
gaagttggtgggacaattttatatc

SEQ ID NO: 307085 - DNA, 25 bp, Rattus norvegicus
gaagttggtgggtcaattttatatc

SEQ ID NO: 307086 - DNA, 25 bp, Rattus norvegicus
gaagttggttatcccttattctagt

SEQ ID NO: 307087 - DNA, 25 bp, Rattus norvegicus
gaagttggttatgccttattctagt

SEQ ID NO: 307088 - DNA, 25 bp, Rattus norvegicus
gaagttgtaaggctcctctctacga

SEQ ID NO: 307089 - DNA, 25 bp, Rattus norvegicus
gaagttgtaagggtcctctctacga

SEQ ID NO: 307090 - DNA, 25 bp, Rattus norvegicus
gaagttgtagcacgagctctatctc

SEQ ID NO: 307091 - DNA, 25 bp, Rattus norvegicus
gaagttgtagcaggagctctatctc

SEQ ID NO: 307092 - DNA, 25 bp, Rattus norvegicus
gaagttgtcagtcagagctttgcct

SEQ ID NO: 307093 - DNA, 25 bp, Rattus norvegicus
gaagttgtcagtgagagctttgcct

SEQ ID NO: 307094 - DNA, 25 bp, Rattus norvegicus
gaagttgtcatcacaggtagaagaa

SEQ ID NO: 307095 - DNA, 25 bp, Rattus norvegicus
gaagttgtcatctcaggtagaagaa

SEQ ID NO: 307096 - DNA, 25 bp, Rattus norvegicus
gaagttgtccatatgggcccagatc

SEQ ID NO: 307097 - DNA, 25 bp, Rattus norvegicus
gaagttgtccatttgggcccagatc

SEQ ID NO: 307098 - DNA, 25 bp, Rattus norvegicus
gaagttgtccctcccagacagtggc

SEQ ID NO: 307099 - DNA, 25 bp, Rattus norvegicus
gaagttgtccctgccagacagtggc

SEQ ID NO: 307100 - DNA, 25 bp, Rattus norvegicus
gaagttgtctcaattggaagtccgt

SEQ ID NO: 307101 - DNA, 25 bp, Rattus norvegicus
gaagttgtctcatttggaagtccgt

SEQ ID NO: 307102 - DNA, 25 bp, Rattus norvegicus
gaagttgtctttctatagtttggac

SEQ ID NO: 307103 - DNA, 25 bp, Rattus norvegicus
gaagttgtctttgtatagtttggac

SEQ ID NO: 307104 - DNA, 25 bp, Rattus norvegicus
gaagttgtttcactccaccaaatgc

SEQ ID NO: 307105 - DNA, 25 bp, Rattus norvegicus
gaagttgtttcagtccaccaaatgc

SEQ ID NO: 307106 - DNA, 25 bp, Rattus norvegicus
gaagtttaacctatagagcctctgg

SEQ ID NO: 307107 - DNA, 25 bp, Rattus norvegicus
gaagtttaacctttagagcctctgg

SEQ ID NO: 307108 - DNA, 25 bp, Rattus norvegicus
gaagtttaactacagccccagacct

SEQ ID NO: 307109 - DNA, 25 bp, Rattus norvegicus
gaagtttaactagagccccagacct

SEQ ID NO: 307110 - DNA, 25 bp, Rattus norvegicus
gaagtttaattaccgccgccctatg

SEQ ID NO: 307111 - DNA, 25 bp, Rattus norvegicus
gaagtttaattagcgccgccctatg

SEQ ID NO: 307112 - DNA, 25 bp, Rattus norvegicus
gaagtttaattcagctaggcggaaa

SEQ ID NO: 307113 - DNA, 25 bp, Rattus norvegicus
gaagtttaattctgctaggcggaaa

SEQ ID NO: 307114 - DNA, 25 bp, Rattus norvegicus
gaagtttaccagaagttccagcctc

SEQ ID NO: 307115 - DNA, 25 bp, Rattus norvegicus
gaagtttaccagtagttccagcctc

SEQ ID NO: 307116 - DNA, 25 bp, Rattus norvegicus
gaagtttaccatctaagtggctgaa

SEQ ID NO: 307117 - DNA, 25 bp, Rattus norvegicus
gaagtttaccatgtaagtggctgaa

SEQ ID NO: 307118 - DNA, 25 bp, Rattus norvegicus
gaagtttacctgcaagaagcgctga

SEQ ID NO: 307119 - DNA, 25 bp, Rattus norvegicus
gaagtttacctggaagaagcgctga

SEQ ID NO: 307120 - DNA, 25 bp, Rattus norvegicus
gaagtttagatcagttcctcattaa

SEQ ID NO: 307121 - DNA, 25 bp, Rattus norvegicus
gaagtttagatctgttcctcattaa

SEQ ID NO: 307122 - DNA, 25 bp, Rattus norvegicus
gaagtttagcttacctgtgtacact

SEQ ID NO: 307123 - DNA, 25 bp, Rattus norvegicus
gaagtttagctttcctgtgtacact

SEQ ID NO: 307124 - DNA, 25 bp, Rattus norvegicus
gaagtttagtaactgctcctgccag

SEQ ID NO: 307125 - DNA, 25 bp, Rattus norvegicus
gaagtttagtaagtgctcctgccag

SEQ ID NO: 307126 - DNA, 25 bp, Rattus norvegicus
gaagtttatcctatggatcctgcaa

SEQ ID NO: 307127 - DNA, 25 bp, Rattus norvegicus
gaagtttatcctttggatcctgcaa

SEQ ID NO: 307128 - DNA, 25 bp, Rattus norvegicus
gaagtttatggaaccctactggtca

SEQ ID NO: 307129 - DNA, 25 bp, Rattus norvegicus
gaagtttatggatccctactggtca

SEQ ID NO: 307130 - DNA, 25 bp, Rattus norvegicus
gaagtttcaattctgcacaattaga

SEQ ID NO: 307131 - DNA, 25 bp, Rattus norvegicus
gaagtttcaattgtgcacaattaga

SEQ ID NO: 307132 - DNA, 25 bp, Rattus norvegicus
gaagtttcacccacggtacactagg

SEQ ID NO: 307133 - DNA, 25 bp, Rattus norvegicus
gaagtttcaccctcggtacactagg

SEQ ID NO: 307134 - DNA, 25 bp, Rattus norvegicus
gaagtttcactaaacatttgctcta

SEQ ID NO: 307135 - DNA, 25 bp, Rattus norvegicus
gaagtttcactatacatttgctcta

SEQ ID NO: 307136 - DNA, 25 bp, Rattus norvegicus
gaagtttcagcacatcctgcgagta

SEQ ID NO: 307137 - DNA, 25 bp, Rattus norvegicus
gaagtttcagcagatcctgcgagta

SEQ ID NO: 307138 - DNA, 25 bp, Rattus norvegicus
gaagtttcaggaactgctggtgcag

SEQ ID NO: 307139 - DNA, 25 bp, Rattus norvegicus
gaagtttcaggatctgctggtgcag

SEQ ID NO: 307140 - DNA, 25 bp, Rattus norvegicus
gaagtttcaggccaaacttaaggca

SEQ ID NO: 307141 - DNA, 25 bp, Rattus norvegicus
gaagtttcaggcgaaacttaaggca

SEQ ID NO: 307142 - DNA, 25 bp, Rattus norvegicus
gaagtttcagttacttcaccttcct

SEQ ID NO: 307143 - DNA, 25 bp, Rattus norvegicus
gaagtttcagtttcttcaccttcct

SEQ ID NO: 307144 - DNA, 25 bp, Rattus norvegicus
gaagtttcattgctgtaagtttcac

SEQ ID NO: 307145 - DNA, 25 bp, Rattus norvegicus
gaagtttcattggtgtaagtttcac

SEQ ID NO: 307146 - DNA, 25 bp, Rattus norvegicus
gaagtttccacccacagtatatgtt

SEQ ID NO: 307147 - DNA, 25 bp, Rattus norvegicus
gaagtttccaccgacagtatatgtt

SEQ ID NO: 307148 - DNA, 25 bp, Rattus norvegicus
gaagtttccatcaattcaggacatc

SEQ ID NO: 307149 - DNA, 25 bp, Rattus norvegicus
gaagtttccatctattcaggacatc

SEQ ID NO: 307150 - DNA, 25 bp, Rattus norvegicus
gaagtttccattactgcaactagac

SEQ ID NO: 307151 - DNA, 25 bp, Rattus norvegicus
gaagtttccatttctgcaactagac

SEQ ID NO: 307152 - DNA, 25 bp, Rattus norvegicus
gaagtttcccagcagttttgtattg

SEQ ID NO: 307153 - DNA, 25 bp, Rattus norvegicus
gaagtttcccaggagttttgtattg

SEQ ID NO: 307154 - DNA, 25 bp, Rattus norvegicus
gaagtttcctgactaaaccgagaat

SEQ ID NO: 307155 - DNA, 25 bp, Rattus norvegicus
gaagtttcctgagtaaaccgagaat

SEQ ID NO: 307156 - DNA, 25 bp, Rattus norvegicus
gaagtttcggtcactgggctttcta

SEQ ID NO: 307157 - DNA, 25 bp, Rattus norvegicus
gaagtttcggtctctgggctttcta

SEQ ID NO: 307158 - DNA, 25 bp, Rattus norvegicus
gaagtttcggttcttctgccaaaga

SEQ ID NO: 307159 - DNA, 25 bp, Rattus norvegicus
gaagtttcggttgttctgccaaaga

SEQ ID NO: 307160 - DNA, 25 bp, Rattus norvegicus
gaagtttcgtgcctggacaacccat

SEQ ID NO: 307161 - DNA, 25 bp, Rattus norvegicus
gaagtttcgtgcgtggacaacccat

SEQ ID NO: 307162 - DNA, 25 bp, Rattus norvegicus
gaagtttcgtttcacctacatggcc

SEQ ID NO: 307163 - DNA, 25 bp, Rattus norvegicus
gaagtttcgtttgacctacatggcc

SEQ ID NO: 307164 - DNA, 25 bp, Rattus norvegicus
gaagtttctacaagatggcctgccc

SEQ ID NO: 307165 - DNA, 25 bp, Rattus norvegicus
gaagtttctacatgatggcctgccc

SEQ ID NO: 307166 - DNA, 25 bp, Rattus norvegicus
gaagtttctagacaccttaatgtga

SEQ ID NO: 307167 - DNA, 25 bp, Rattus norvegicus
gaagtttctagagaccttaatgtga

SEQ ID NO: 307168 - DNA, 25 bp, Rattus norvegicus
gaagtttctcaaacccattcttttg

SEQ ID NO: 307169 - DNA, 25 bp, Rattus norvegicus
gaagtttctcaatcccattcttttg

SEQ ID NO: 307170 - DNA, 25 bp, Rattus norvegicus
gaagtttctgagaccagcatggtac

SEQ ID NO: 307171 - DNA, 25 bp, Rattus norvegicus
gaagtttctgagagatgcgtccgtc

SEQ ID NO: 307172 - DNA, 25 bp, Rattus norvegicus
gaagtttctgagatcgtctttcctt

SEQ ID NO: 307173 - DNA, 25 bp, Rattus norvegicus
gaagtttctgagtccagcatggtac

SEQ ID NO: 307174 - DNA, 25 bp, Rattus norvegicus
gaagtttctgagtgatgcgtccgtc

SEQ ID NO: 307175 - DNA, 25 bp, Rattus norvegicus
gaagtttctgagttcgtctttcctt

SEQ ID NO: 307176 - DNA, 25 bp, Rattus norvegicus
gaagtttctgatactgcctatctgg

SEQ ID NO: 307177 - DNA, 25 bp, Rattus norvegicus
gaagtttctgattctgcctatctgg

SEQ ID NO: 307178 - DNA, 25 bp, Rattus norvegicus
gaagtttctggaccctttcttagca

SEQ ID NO: 307179 - DNA, 25 bp, Rattus norvegicus
gaagtttctggagcctttcttagca

SEQ ID NO: 307180 - DNA, 25 bp, Rattus norvegicus
gaagtttctgggactcagcttcatt

SEQ ID NO: 307181 - DNA, 25 bp, Rattus norvegicus
gaagtttctgggtctcagcttcatt

SEQ ID NO: 307182 - DNA, 25 bp, Rattus norvegicus
gaagtttctgtgactgttgcactgc

SEQ ID NO: 307183 - DNA, 25 bp, Rattus norvegicus
gaagtttctgtgtctgttgcactgc

SEQ ID NO: 307184 - DNA, 25 bp, Rattus norvegicus
gaagtttctgttactccttactaga

SEQ ID NO: 307185 - DNA, 25 bp, Rattus norvegicus
gaagtttctgtttctccttactaga

SEQ ID NO: 307186 - DNA, 25 bp, Rattus norvegicus
gaagtttcttaaagccttctcgata

SEQ ID NO: 307187 - DNA, 25 bp, Rattus norvegicus
gaagtttcttaatgccttctcgata

SEQ ID NO: 307188 - DNA, 25 bp, Rattus norvegicus
gaagtttcttagagtctccttttat

SEQ ID NO: 307189 - DNA, 25 bp, Rattus norvegicus
gaagtttcttagtgtctccttttat

SEQ ID NO: 307190 - DNA, 25 bp, Rattus norvegicus
gaagtttctttgagagacccagctg

SEQ ID NO: 307191 - DNA, 25 bp, Rattus norvegicus
gaagtttctttgtgagacccagctg

SEQ ID NO: 307192 - DNA, 25 bp, Rattus norvegicus
gaagtttgacccacacatttataaa

SEQ ID NO: 307193 - DNA, 25 bp, Rattus norvegicus
gaagtttgaccctcacatttataaa

SEQ ID NO: 307194 - DNA, 25 bp, Rattus norvegicus
gaagtttgcacaagcaaccgtgtat

SEQ ID NO: 307195 - DNA, 25 bp, Rattus norvegicus
gaagtttgcacatgcaaccgtgtat

SEQ ID NO: 307196 - DNA, 25 bp, Rattus norvegicus
gaagtttgcaccaatcacagagatg

SEQ ID NO: 307197 - DNA, 25 bp, Rattus norvegicus
gaagtttgcacctatcacagagatg

SEQ ID NO: 307198 - DNA, 25 bp, Rattus norvegicus
gaagtttgcccgaagccttcagtct

SEQ ID NO: 307199 - DNA, 25 bp, Rattus norvegicus
gaagtttgcccgtagccttcagtct

SEQ ID NO: 307200 - DNA, 25 bp, Rattus norvegicus
gaagtttgctatatatctgctgttt

SEQ ID NO: 307201 - DNA, 25 bp, Rattus norvegicus
gaagtttgctatttatctgctgttt

SEQ ID NO: 307202 - DNA, 25 bp, Rattus norvegicus
gaagtttggatcactgaccaaccca

SEQ ID NO: 307203 - DNA, 25 bp, Rattus norvegicus
gaagtttggatctctgaccaaccca

SEQ ID NO: 307204 - DNA, 25 bp, Rattus norvegicus
gaagtttggcctcgtgttcgaccat

SEQ ID NO: 307205 - DNA, 25 bp, Rattus norvegicus
gaagtttggcctggtgttcgaccat

SEQ ID NO: 307206 - DNA, 25 bp, Rattus norvegicus
gaagtttgggagacgtggccccatc

SEQ ID NO: 307207 - DNA, 25 bp, Rattus norvegicus
gaagtttgggagtcgtggccccatc

SEQ ID NO: 307208 - DNA, 25 bp, Rattus norvegicus
gaagtttgggatagcacacaggtga

SEQ ID NO: 307209 - DNA, 25 bp, Rattus norvegicus
gaagtttgggattgcacacaggtga

SEQ ID NO: 307210 - DNA, 25 bp, Rattus norvegicus
gaagtttggtctcggtcttctagtc

SEQ ID NO: 307211 - DNA, 25 bp, Rattus norvegicus
gaagtttggtctgggtcttctagtc

SEQ ID NO: 307212 - DNA, 25 bp, Rattus norvegicus
gaagtttggttgctcagtgtttccc

SEQ ID NO: 307213 - DNA, 25 bp, Rattus norvegicus
gaagtttggttggtcagtgtttccc

SEQ ID NO: 307214 - DNA, 25 bp, Rattus norvegicus
gaagtttggtttcctgtctatgctt

SEQ ID NO: 307215 - DNA, 25 bp, Rattus norvegicus
gaagtttggtttgctgtctatgctt

SEQ ID NO: 307216 - DNA, 25 bp, Rattus norvegicus
gaagtttgtataccataccattgat

SEQ ID NO: 307217 - DNA, 25 bp, Rattus norvegicus
gaagtttgtatagcataccattgat

SEQ ID NO: 307218 - DNA, 25 bp, Rattus norvegicus
gaagtttgtcatacggaacattgta

SEQ ID NO: 307219 - DNA, 25 bp, Rattus norvegicus
gaagtttgtcattcggaacattgta

SEQ ID NO: 307220 - DNA, 25 bp, Rattus norvegicus
gaagtttgtcctaagctatctgaat

SEQ ID NO: 307221 - DNA, 25 bp, Rattus norvegicus
gaagtttgtccttagctatctgaat

SEQ ID NO: 307222 - DNA, 25 bp, Rattus norvegicus
gaagtttgtcttactcctgttgaac

SEQ ID NO: 307223 - DNA, 25 bp, Rattus norvegicus
gaagtttgtctttctcctgttgaac

SEQ ID NO: 307224 - DNA, 25 bp, Rattus norvegicus
gaagtttgtttacgtttctcattag

SEQ ID NO: 307225 - DNA, 25 bp, Rattus norvegicus
gaagtttgtttaggtttctcattag

SEQ ID NO: 307226 - DNA, 25 bp, Rattus norvegicus
gaagttttaaaacccgagcgtccag

SEQ ID NO: 307227 - DNA, 25 bp, Rattus norvegicus
gaagttttaaaagccgagcgtccag

SEQ ID NO: 307228 - DNA, 25 bp, Rattus norvegicus
gaagttttaagtaacatcgctatta

SEQ ID NO: 307229 - DNA, 25 bp, Rattus norvegicus
gaagttttaagttacatcgctatta

SEQ ID NO: 307230 - DNA, 25 bp, Rattus norvegicus
gaagttttacaactgcctccaatga

SEQ ID NO: 307231 - DNA, 25 bp, Rattus norvegicus
gaagttttacaagtgcctccaatga

SEQ ID NO: 307232 - DNA, 25 bp, Rattus norvegicus
gaagttttactcagcctcgagatag

SEQ ID NO: 307233 - DNA, 25 bp, Rattus norvegicus
gaagttttactctgcctcgagatag

SEQ ID NO: 307234 - DNA, 25 bp, Rattus norvegicus
gaagttttatacactacggtcaacg

SEQ ID NO: 307235 - DNA, 25 bp, Rattus norvegicus
gaagttttatactctacggtcaacg

SEQ ID NO: 307236 - DNA, 25 bp, Rattus norvegicus
gaagttttatgtcatttcaccttgt

SEQ ID NO: 307237 - DNA, 25 bp, Rattus norvegicus
gaagttttatgtgatttcaccttgt

SEQ ID NO: 307238 - DNA, 25 bp, Rattus norvegicus
gaagttttcactatgatggttctat

SEQ ID NO: 307239 - DNA, 25 bp, Rattus norvegicus
gaagttttcactccttagtacataa

SEQ ID NO: 307240 - DNA, 25 bp, Rattus norvegicus
gaagttttcactgcttagtacataa

SEQ ID NO: 307241 - DNA, 25 bp, Rattus norvegicus
gaagttttcactttgatggttctat

SEQ ID NO: 307242 - DNA, 25 bp, Rattus norvegicus
gaagttttccgcagatgcatttgca

SEQ ID NO: 307243 - DNA, 25 bp, Rattus norvegicus
gaagttttccgctgatgcatttgca

SEQ ID NO: 307244 - DNA, 25 bp, Rattus norvegicus
gaagttttccttattccatcaatgg

SEQ ID NO: 307245 - DNA, 25 bp, Rattus norvegicus
gaagttttcctttttccatcaatgg

SEQ ID NO: 307246 - DNA, 25 bp, Rattus norvegicus
gaagttttcgtgctcataatcatgt

SEQ ID NO: 307247 - DNA, 25 bp, Rattus norvegicus
gaagttttcgtggtcataatcatgt

SEQ ID NO: 307248 - DNA, 25 bp, Rattus norvegicus
gaagttttctagaaagctccagctc

SEQ ID NO: 307249 - DNA, 25 bp, Rattus norvegicus
gaagttttctagtaagctccagctc

SEQ ID NO: 307250 - DNA, 25 bp, Rattus norvegicus
gaagttttctatactccttttctct

SEQ ID NO: 307251 - DNA, 25 bp, Rattus norvegicus
gaagttttctattctccttttctct

SEQ ID NO: 307252 - DNA, 25 bp, Rattus norvegicus
gaagttttctttccaagacgcctga

SEQ ID NO: 307253 - DNA, 25 bp, Rattus norvegicus
gaagttttctttctggtccctggat

SEQ ID NO: 307254 - DNA, 25 bp, Rattus norvegicus
gaagttttctttgcaagacgcctga

SEQ ID NO: 307255 - DNA, 25 bp, Rattus norvegicus
gaagttttctttgtggtccctggat

SEQ ID NO: 307256 - DNA, 25 bp, Rattus norvegicus
gaagttttgcaaactatttacacct

SEQ ID NO: 307257 - DNA, 25 bp, Rattus norvegicus
gaagttttgcaatctatttacacct

SEQ ID NO: 307258 - DNA, 25 bp, Rattus norvegicus
gaagttttgccactgtaccctggaa

SEQ ID NO: 307259 - DNA, 25 bp, Rattus norvegicus
gaagttttgccagtgtaccctggaa

SEQ ID NO: 307260 - DNA, 25 bp, Rattus norvegicus
gaagttttgggcaagcctctgccag

SEQ ID NO: 307261 - DNA, 25 bp, Rattus norvegicus
gaagttttgggctagcctctgccag

SEQ ID NO: 307262 - DNA, 25 bp, Rattus norvegicus
gaagtttttaatcttagccccagct

SEQ ID NO: 307263 - DNA, 25 bp, Rattus norvegicus
gaagtttttaatgttagccccagct

SEQ ID NO: 307264 - DNA, 25 bp, Rattus norvegicus
gaagtttttacaccatgactcctct

SEQ ID NO: 307265 - DNA, 25 bp, Rattus norvegicus
gaagtttttacagcatgactcctct

SEQ ID NO: 307266 - DNA, 25 bp, Rattus norvegicus
gaagtttttacccagtgcattctgt

SEQ ID NO: 307267 - DNA, 25 bp, Rattus norvegicus
gaagtttttaccgagtgcattctgt

SEQ ID NO: 307268 - DNA, 25 bp, Rattus norvegicus
gaagtttttatcactgcccatttga

SEQ ID NO: 307269 - DNA, 25 bp, Rattus norvegicus
gaagtttttatctctgcccatttga

SEQ ID NO: 307270 - DNA, 25 bp, Rattus norvegicus
gaagtttttcaactgccagtgtcaa

SEQ ID NO: 307271 - DNA, 25 bp, Rattus norvegicus
gaagtttttcaagtgccagtgtcaa

SEQ ID NO: 307272 - DNA, 25 bp, Rattus norvegicus
gaagtttttgtcacttggtccacaa

SEQ ID NO: 307273 - DNA, 25 bp, Rattus norvegicus
gaagtttttgtctcttggtccacaa

SEQ ID NO: 307274 - DNA, 25 bp, Rattus norvegicus
gaagtttttgttatccattgtgtgt

SEQ ID NO: 307275 - DNA, 25 bp, Rattus norvegicus
gaagtttttgttttccattgtgtgt

SEQ ID NO: 307276 - DNA, 25 bp, Rattus norvegicus
gaataaaagcttctcccttaatcct

SEQ ID NO: 307277 - DNA, 25 bp, Rattus norvegicus
gaataaaagcttgtcccttaatcct

SEQ ID NO: 307278 - DNA, 25 bp, Rattus norvegicus
gaataaaattccatcaaccccatgt

SEQ ID NO: 307279 - DNA, 25 bp, Rattus norvegicus
gaataaaattccttcaaccccatgt

SEQ ID NO: 307280 - DNA, 25 bp, Rattus norvegicus
gaataaacccaccttggtacatgtt

SEQ ID NO: 307281 - DNA, 25 bp, Rattus norvegicus
gaataaacccacgttggtacatgtt

SEQ ID NO: 307282 - DNA, 25 bp, Rattus norvegicus
gaataaacctctcggcagcaatgcc

SEQ ID NO: 307283 - DNA, 25 bp, Rattus norvegicus
gaataaacctctgggcagcaatgcc

SEQ ID NO: 307284 - DNA, 25 bp, Rattus norvegicus
gaataaacgctaaccttcccactag

SEQ ID NO: 307285 - DNA, 25 bp, Rattus norvegicus
gaataaacgctatccttcccactag

SEQ ID NO: 307286 - DNA, 25 bp, Rattus norvegicus
gaataaactatgacatggaaagcca

SEQ ID NO: 307287 - DNA, 25 bp, Rattus norvegicus
gaataaactatgtcatggaaagcca

SEQ ID NO: 307288 - DNA, 25 bp, Rattus norvegicus
gaataaactcaacggctaactacag

SEQ ID NO: 307289 - DNA, 25 bp, Rattus norvegicus
gaataaactcaagggctaactacag

SEQ ID NO: 307290 - DNA, 25 bp, Rattus norvegicus
gaataaactgttagatcatctaaag

SEQ ID NO: 307291 - DNA, 25 bp, Rattus norvegicus
gaataaactgtttgatcatctaaag

SEQ ID NO: 307292 - DNA, 25 bp, Rattus norvegicus
gaataaacttgcagcctgtgtgcta

SEQ ID NO: 307293 - DNA, 25 bp, Rattus norvegicus
gaataaacttgccaccgccacgtgt

SEQ ID NO: 307294 - DNA, 25 bp, Rattus norvegicus
gaataaacttgcgaccgccacgtgt

SEQ ID NO: 307295 - DNA, 25 bp, Rattus norvegicus
gaataaacttgctgcctgtgtgcta

SEQ ID NO: 307296 - DNA, 25 bp, Rattus norvegicus
gaataaagacggctcaccccgggag

SEQ ID NO: 307297 - DNA, 25 bp, Rattus norvegicus
gaataaagacgggtcaccccgggag

SEQ ID NO: 307298 - DNA, 25 bp, Rattus norvegicus
gaataaagactgagcgaactggaca

SEQ ID NO: 307299 - DNA, 25 bp, Rattus norvegicus
gaataaagactgtgcgaactggaca

SEQ ID NO: 307300 - DNA, 25 bp, Rattus norvegicus
gaataaagcaacagggagccaccct

SEQ ID NO: 307301 - DNA, 25 bp, Rattus norvegicus
gaataaagcaactgggagccaccct

SEQ ID NO: 307302 - DNA, 25 bp, Rattus norvegicus
gaataaagccagatcttcccgaggg

SEQ ID NO: 307303 - DNA, 25 bp, Rattus norvegicus
gaataaagccagttcttcccgaggg

SEQ ID NO: 307304 - DNA, 25 bp, Rattus norvegicus
gaataaagcccaccgttttaatgag

SEQ ID NO: 307305 - DNA, 25 bp, Rattus norvegicus
gaataaagcccagcgttttaatgag

SEQ ID NO: 307306 - DNA, 25 bp, Rattus norvegicus
gaataaagctgtctgacccaggaaa

SEQ ID NO: 307307 - DNA, 25 bp, Rattus norvegicus
gaataaagctgtgtgacccaggaaa

SEQ ID NO: 307308 - DNA, 25 bp, Rattus norvegicus
gaataaaggaaacccctgagcccag

SEQ ID NO: 307309 - DNA, 25 bp, Rattus norvegicus
gaataaaggaaagccctgagcccag

SEQ ID NO: 307310 - DNA, 25 bp, Rattus norvegicus
gaataaaggcagctacgtcacctat

SEQ ID NO: 307311 - DNA, 25 bp, Rattus norvegicus
gaataaaggcaggtacgtcacctat

SEQ ID NO: 307312 - DNA, 25 bp, Rattus norvegicus
gaataaaggtctatggtcggcttcg

SEQ ID NO: 307313 - DNA, 25 bp, Rattus norvegicus
gaataaaggtctttggtcggcttcg

SEQ ID NO: 307314 - DNA, 25 bp, Rattus norvegicus
gaataaagtaatccccgtttctcac

SEQ ID NO: 307315 - DNA, 25 bp, Rattus norvegicus
gaataaagtaatgcccgtttctcac

SEQ ID NO: 307316 - DNA, 25 bp, Rattus norvegicus
gaataaagtggtctaattaccggag

SEQ ID NO: 307317 - DNA, 25 bp, Rattus norvegicus
gaataaagtggtgtaattaccggag

SEQ ID NO: 307318 - DNA, 25 bp, Rattus norvegicus
gaataaatcccacgaggctgccacc

SEQ ID NO: 307319 - DNA, 25 bp, Rattus norvegicus
gaataaatcccaggaggctgccacc

SEQ ID NO: 307320 - DNA, 25 bp, Rattus norvegicus
gaataaatgccacatcttcagctac

SEQ ID NO: 307321 - DNA, 25 bp, Rattus norvegicus
gaataaatgccacgaatcccagctg

SEQ ID NO: 307322 - DNA, 25 bp, Rattus norvegicus
gaataaatgccagatcttcagctac

SEQ ID NO: 307323 - DNA, 25 bp, Rattus norvegicus
gaataaatgccaggaatcccagctg

SEQ ID NO: 307324 - DNA, 25 bp, Rattus norvegicus
gaataaatgctgctgcatctgcacg

SEQ ID NO: 307325 - DNA, 25 bp, Rattus norvegicus
gaataaatgctggtgcatctgcacg

SEQ ID NO: 307326 - DNA, 25 bp, Rattus norvegicus
gaataaatgtttccctgctgagtta

SEQ ID NO: 307327 - DNA, 25 bp, Rattus norvegicus
gaataaatgtttgcctgctgagtta

SEQ ID NO: 307328 - DNA, 25 bp, Rattus norvegicus
gaataaattcctctgtgacagtggc

SEQ ID NO: 307329 - DNA, 25 bp, Rattus norvegicus
gaataaattcctgtgtgacagtggc

SEQ ID NO: 307330 - DNA, 25 bp, Rattus norvegicus
gaataaattgtcagaggtctgcatg

SEQ ID NO: 307331 - DNA, 25 bp, Rattus norvegicus
gaataaattgtctgaggtctgcatg

SEQ ID NO: 307332 - DNA, 25 bp, Rattus norvegicus
gaataacaactgaacttcctgccct

SEQ ID NO: 307333 - DNA, 25 bp, Rattus norvegicus
gaataacaactgtacttcctgccct

SEQ ID NO: 307334 - DNA, 25 bp, Rattus norvegicus
gaataacactggacatattaagcat

SEQ ID NO: 307335 - DNA, 25 bp, Rattus norvegicus
gaataacactggtcatattaagcat

SEQ ID NO: 307336 - DNA, 25 bp, Rattus norvegicus
gaataacagcataaaaccctcttcc

SEQ ID NO: 307337 - DNA, 25 bp, Rattus norvegicus
gaataacagcattaaaccctcttcc

SEQ ID NO: 307338 - DNA, 25 bp, Rattus norvegicus
gaataacagccgcatcaagctcggg

SEQ ID NO: 307339 - DNA, 25 bp, Rattus norvegicus
gaataacagccggatcaagctcggg

SEQ ID NO: 307340 - DNA, 25 bp, Rattus norvegicus
gaataaccaaatcaactcttaacat

SEQ ID NO: 307341 - DNA, 25 bp, Rattus norvegicus
gaataaccaaatgaactcttaacat

SEQ ID NO: 307342 - DNA, 25 bp, Rattus norvegicus
gaataaccacttagagtctcccaaa

SEQ ID NO: 307343 - DNA, 25 bp, Rattus norvegicus
gaataaccactttgagtctcccaaa

SEQ ID NO: 307344 - DNA, 25 bp, Rattus norvegicus
gaataaccagtcactgtaccactgt

SEQ ID NO: 307345 - DNA, 25 bp, Rattus norvegicus
gaataaccagtctctgtaccactgt

SEQ ID NO: 307346 - DNA, 25 bp, Rattus norvegicus
gaataacccggcatcaccgtgcaca

SEQ ID NO: 307347 - DNA, 25 bp, Rattus norvegicus
gaataacccggcttcaccgtgcaca

SEQ ID NO: 307348 - DNA, 25 bp, Rattus norvegicus
gaataaccctctcatttgctctaga

SEQ ID NO: 307349 - DNA, 25 bp, Rattus norvegicus
gaataaccctctgatttgctctaga

SEQ ID NO: 307350 - DNA, 25 bp, Rattus norvegicus
gaataaccctgcacattagtttgga

SEQ ID NO: 307351 - DNA, 25 bp, Rattus norvegicus
gaataaccctgctcattagtttgga

SEQ ID NO: 307352 - DNA, 25 bp, Rattus norvegicus
gaataaccgagtcatcgtgagtagt

SEQ ID NO: 307353 - DNA, 25 bp, Rattus norvegicus
gaataaccgagtgatcgtgagtagt

SEQ ID NO: 307354 - DNA, 25 bp, Rattus norvegicus
gaataaccggccattgtgtttctga

SEQ ID NO: 307355 - DNA, 25 bp, Rattus norvegicus
gaataaccggcctttgtgtttctga

SEQ ID NO: 307356 - DNA, 25 bp, Rattus norvegicus
gaataacctgcaatatagctggaat

SEQ ID NO: 307357 - DNA, 25 bp, Rattus norvegicus
gaataacctgcattatagctggaat

SEQ ID NO: 307358 - DNA, 25 bp, Rattus norvegicus
gaataacctttcagcttggcatctc

SEQ ID NO: 307359 - DNA, 25 bp, Rattus norvegicus
gaataacctttctgcttggcatctc

SEQ ID NO: 307360 - DNA, 25 bp, Rattus norvegicus
gaataactacaacccatactgagag

SEQ ID NO: 307361 - DNA, 25 bp, Rattus norvegicus
gaataactacaagccatactgagag

SEQ ID NO: 307362 - DNA, 25 bp, Rattus norvegicus
gaataactactaacccattgaaacg

SEQ ID NO: 307363 - DNA, 25 bp, Rattus norvegicus
gaataactactatcccattgaaacg

SEQ ID NO: 307364 - DNA, 25 bp, Rattus norvegicus
gaataactatgaaaccagcaacgtg

SEQ ID NO: 307365 - DNA, 25 bp, Rattus norvegicus
gaataactatgataccagcaacgtg

SEQ ID NO: 307366 - DNA, 25 bp, Rattus norvegicus
gaataactcagtctgaccctggact

SEQ ID NO: 307367 - DNA, 25 bp, Rattus norvegicus
gaataactcagtgtgaccctggact

SEQ ID NO: 307368 - DNA, 25 bp, Rattus norvegicus
gaataactccagagcactgcggtgt

SEQ ID NO: 307369 - DNA, 25 bp, Rattus norvegicus
gaataactccagtgcactgcggtgt

SEQ ID NO: 307370 - DNA, 25 bp, Rattus norvegicus
gaataactccttccagaccttttca

SEQ ID NO: 307371 - DNA, 25 bp, Rattus norvegicus
gaataactccttgcagaccttttca

SEQ ID NO: 307372 - DNA, 25 bp, Rattus norvegicus
gaataactctacatttgcctaacta

SEQ ID NO: 307373 - DNA, 25 bp, Rattus norvegicus
gaataactctacttttgcctaacta

SEQ ID NO: 307374 - DNA, 25 bp, Rattus norvegicus
gaataactctcccttcaatcaatta

SEQ ID NO: 307375 - DNA, 25 bp, Rattus norvegicus
gaataactctccgttcaatcaatta

SEQ ID NO: 307376 - DNA, 25 bp, Rattus norvegicus
gaataactgagtctggtaagccatt

SEQ ID NO: 307377 - DNA, 25 bp, Rattus norvegicus
gaataactgagtgtggtaagccatt

SEQ ID NO: 307378 - DNA, 25 bp, Rattus norvegicus
gaataactgcccagtctcatcagct

SEQ ID NO: 307379 - DNA, 25 bp, Rattus norvegicus
gaataactgccctgtctcatcagct

SEQ ID NO: 307380 - DNA, 25 bp, Rattus norvegicus
gaataactgcgtcaattgcctccct

SEQ ID NO: 307381 - DNA, 25 bp, Rattus norvegicus
gaataactgcgtgaattgcctccct

SEQ ID NO: 307382 - DNA, 25 bp, Rattus norvegicus
gaataactgtcaatcctctgtcctg

SEQ ID NO: 307383 - DNA, 25 bp, Rattus norvegicus
gaataactgtcattcctctgtcctg

SEQ ID NO: 307384 - DNA, 25 bp, Rattus norvegicus
gaataacttctcagataccggcaac

SEQ ID NO: 307385 - DNA, 25 bp, Rattus norvegicus
gaataacttctctgataccggcaac

SEQ ID NO: 307386 - DNA, 25 bp, Rattus norvegicus
gaataacttgacatgcgttgacctt

SEQ ID NO: 307387 - DNA, 25 bp, Rattus norvegicus
gaataacttgacttgcgttgacctt

SEQ ID NO: 307388 - DNA, 25 bp, Rattus norvegicus
gaataacttggcacaatgtcgtaaa

SEQ ID NO: 307389 - DNA, 25 bp, Rattus norvegicus
gaataacttggctcaatgtcgtaaa

SEQ ID NO: 307390 - DNA, 25 bp, Rattus norvegicus
gaataagaagccactccatcaaggg

SEQ ID NO: 307391 - DNA, 25 bp, Rattus norvegicus
gaataagaagcctctccatcaaggg

SEQ ID NO: 307392 - DNA, 25 bp, Rattus norvegicus
gaataagaatctcagctgtgtagct

SEQ ID NO: 307393 - DNA, 25 bp, Rattus norvegicus
gaataagaatctgagctgtgtagct

SEQ ID NO: 307394 - DNA, 25 bp, Rattus norvegicus
gaataagacatcacaatgccagaaa

SEQ ID NO: 307395 - DNA, 25 bp, Rattus norvegicus
gaataagacatctcaatgccagaaa

SEQ ID NO: 307396 - DNA, 25 bp, Rattus norvegicus
gaataagacattactctacagctgt

SEQ ID NO: 307397 - DNA, 25 bp, Rattus norvegicus
gaataagacatttctctacagctgt

SEQ ID NO: 307398 - DNA, 25 bp, Rattus norvegicus
gaataagacgagctctccagaggga

SEQ ID NO: 307399 - DNA, 25 bp, Rattus norvegicus
gaataagacgaggtctccagaggga

SEQ ID NO: 307400 - DNA, 25 bp, Rattus norvegicus
gaataagattgtatacccgcctcag

SEQ ID NO: 307401 - DNA, 25 bp, Rattus norvegicus
gaataagattgtttacccgcctcag

SEQ ID NO: 307402 - DNA, 25 bp, Rattus norvegicus
gaataagcagcaatgtgaccacagg

SEQ ID NO: 307403 - DNA, 25 bp, Rattus norvegicus
gaataagcagcattgtgaccacagg

SEQ ID NO: 307404 - DNA, 25 bp, Rattus norvegicus
gaataagcctttagcccaatcagga

SEQ ID NO: 307405 - DNA, 25 bp, Rattus norvegicus
gaataagccttttgcccaatcagga

SEQ ID NO: 307406 - DNA, 25 bp, Rattus norvegicus
gaataagctgatatctgtgtaacat

SEQ ID NO: 307407 - DNA, 25 bp, Rattus norvegicus
gaataagctgatttctgtgtaacat

SEQ ID NO: 307408 - DNA, 25 bp, Rattus norvegicus
gaataagctgtgcagggtcccatga

SEQ ID NO: 307409 - DNA, 25 bp, Rattus norvegicus
gaataagctgtggagggtcccatga

SEQ ID NO: 307410 - DNA, 25 bp, Rattus norvegicus
gaataaggatttaatactactttat

SEQ ID NO: 307411 - DNA, 25 bp, Rattus norvegicus
gaataaggattttatactactttat

SEQ ID NO: 307412 - DNA, 25 bp, Rattus norvegicus
gaataaggcactctcttggcttcct

SEQ ID NO: 307413 - DNA, 25 bp, Rattus norvegicus
gaataaggcactgtcttggcttcct

SEQ ID NO: 307414 - DNA, 25 bp, Rattus norvegicus
gaataaggctacagtaacacccgaa

SEQ ID NO: 307415 - DNA, 25 bp, Rattus norvegicus
gaataaggctactgtaacacccgaa

SEQ ID NO: 307416 - DNA, 25 bp, Rattus norvegicus
gaataaggcttactcgtcctttcta

SEQ ID NO: 307417 - DNA, 25 bp, Rattus norvegicus
gaataaggcttagtcgtcctttcta

SEQ ID NO: 307418 - DNA, 25 bp, Rattus norvegicus
gaataagtatctctcctaaagtgtg

SEQ ID NO: 307419 - DNA, 25 bp, Rattus norvegicus
gaataagtatctgtcctaaagtgtg

SEQ ID NO: 307420 - DNA, 25 bp, Rattus norvegicus
gaataagtcatcacagttcctggcc

SEQ ID NO: 307421 - DNA, 25 bp, Rattus norvegicus
gaataagtcatctcagttcctggcc

SEQ ID NO: 307422 - DNA, 25 bp, Rattus norvegicus
gaataagtcctccaaatgcaactaa

SEQ ID NO: 307423 - DNA, 25 bp, Rattus norvegicus
gaataagtcctcgaaatgcaactaa

SEQ ID NO: 307424 - DNA, 25 bp, Rattus norvegicus
gaataagtgccaagcctcacgcagg

SEQ ID NO: 307425 - DNA, 25 bp, Rattus norvegicus
gaataagtgccatgcctcacgcagg

SEQ ID NO: 307426 - DNA, 25 bp, Rattus norvegicus
gaataagtgtacctcttgtcagcta

SEQ ID NO: 307427 - DNA, 25 bp, Rattus norvegicus
gaataagtgtacgtcttgtcagcta

SEQ ID NO: 307428 - DNA, 25 bp, Rattus norvegicus
gaataagtgttcactttttcctaat

SEQ ID NO: 307429 - DNA, 25 bp, Rattus norvegicus
gaataagtgttctctttttcctaat

SEQ ID NO: 307430 - DNA, 25 bp, Rattus norvegicus
gaataagttaaaaggccctcggaat

SEQ ID NO: 307431 - DNA, 25 bp, Rattus norvegicus
gaataagttaaatggccctcggaat

SEQ ID NO: 307432 - DNA, 25 bp, Rattus norvegicus
gaataagttcacagcctttaagaag

SEQ ID NO: 307433 - DNA, 25 bp, Rattus norvegicus
gaataagttcactgcctttaagaag

SEQ ID NO: 307434 - DNA, 25 bp, Rattus norvegicus
gaataagttcctccagggctcacga

SEQ ID NO: 307435 - DNA, 25 bp, Rattus norvegicus
gaataagttcctgcagggctcacga

SEQ ID NO: 307436 - DNA, 25 bp, Rattus norvegicus
gaataagtttctccagtctgccaga

SEQ ID NO: 307437 - DNA, 25 bp, Rattus norvegicus
gaataagtttctgcagtctgccaga

SEQ ID NO: 307438 - DNA, 25 bp, Rattus norvegicus
gaataatatcaaatactttcaagga

SEQ ID NO: 307439 - DNA, 25 bp, Rattus norvegicus
gaataatatcaattactttcaagga

SEQ ID NO: 307440 - DNA, 25 bp, Rattus norvegicus
gaataatcacgaagtaacaggaaat

SEQ ID NO: 307441 - DNA, 25 bp, Rattus norvegicus
gaataatcacgatgtaacaggaaat

SEQ ID NO: 307442 - DNA, 25 bp, Rattus norvegicus
gaataatccacaagcctcaagcagt

SEQ ID NO: 307443 - DNA, 25 bp, Rattus norvegicus
gaataatccacatgcctcaagcagt

SEQ ID NO: 307444 - DNA, 25 bp, Rattus norvegicus
gaataatccagacctctgatgcaca

SEQ ID NO: 307445 - DNA, 25 bp, Rattus norvegicus
gaataatccagacctgtggcacaca

SEQ ID NO: 307446 - DNA, 25 bp, Rattus norvegicus
gaataatccagagctctgatgcaca

SEQ ID NO: 307447 - DNA, 25 bp, Rattus norvegicus
gaataatccagagctgtggcacaca

SEQ ID NO: 307448 - DNA, 25 bp, Rattus norvegicus
gaataatcccaaaataccactgagt

SEQ ID NO: 307449 - DNA, 25 bp, Rattus norvegicus
gaataatcccaatataccactgagt

SEQ ID NO: 307450 - DNA, 25 bp, Rattus norvegicus
gaataatctccaagctttccttgaa

SEQ ID NO: 307451 - DNA, 25 bp, Rattus norvegicus
gaataatctccatgctttccttgaa

SEQ ID NO: 307452 - DNA, 25 bp, Rattus norvegicus
gaataatctcctattcctttggaag

SEQ ID NO: 307453 - DNA, 25 bp, Rattus norvegicus
gaataatctccttttcctttggaag

SEQ ID NO: 307454 - DNA, 25 bp, Rattus norvegicus
gaataatctctcatctggataggag

SEQ ID NO: 307455 - DNA, 25 bp, Rattus norvegicus
gaataatctctcttctggataggag

SEQ ID NO: 307456 - DNA, 25 bp, Rattus norvegicus
gaataatgaatgctctccctcaact

SEQ ID NO: 307457 - DNA, 25 bp, Rattus norvegicus
gaataatgaatggtctccctcaact

SEQ ID NO: 307458 - DNA, 25 bp, Rattus norvegicus
gaataatgagtactcaggcctgttt

SEQ ID NO: 307459 - DNA, 25 bp, Rattus norvegicus
gaataatgagtagtcaggcctgttt

SEQ ID NO: 307460 - DNA, 25 bp, Rattus norvegicus
gaataatgattaccagacccttggt

SEQ ID NO: 307461 - DNA, 25 bp, Rattus norvegicus
gaataatgattagcagacccttggt

SEQ ID NO: 307462 - DNA, 25 bp, Rattus norvegicus
gaataatgcataacttctcttttta

SEQ ID NO: 307463 - DNA, 25 bp, Rattus norvegicus
gaataatgcatatcttctcttttta

SEQ ID NO: 307464 - DNA, 25 bp, Rattus norvegicus
gaataatgccaaatcagaccccaag

SEQ ID NO: 307465 - DNA, 25 bp, Rattus norvegicus
gaataatgccaattcagaccccaag

SEQ ID NO: 307466 - DNA, 25 bp, Rattus norvegicus
gaataatgccacacactccaaaggg

SEQ ID NO: 307467 - DNA, 25 bp, Rattus norvegicus
gaataatgccactcactccaaaggg

SEQ ID NO: 307468 - DNA, 25 bp, Rattus norvegicus
gaataatggccgacacttgttaggg

SEQ ID NO: 307469 - DNA, 25 bp, Rattus norvegicus
gaataatggccgtcacttgttaggg

SEQ ID NO: 307470 - DNA, 25 bp, Rattus norvegicus
gaataatggttcaccacagggcacc

SEQ ID NO: 307471 - DNA, 25 bp, Rattus norvegicus
gaataatggttctccacagggcacc

SEQ ID NO: 307472 - DNA, 25 bp, Rattus norvegicus
gaataatgtacccacgtcatctctt

SEQ ID NO: 307473 - DNA, 25 bp, Rattus norvegicus
gaataatgtaccgacgtcatctctt

SEQ ID NO: 307474 - DNA, 25 bp, Rattus norvegicus
gaataatgtcttcagtttacttaca

SEQ ID NO: 307475 - DNA, 25 bp, Rattus norvegicus
gaataatgtcttgagtttacttaca

SEQ ID NO: 307476 - DNA, 25 bp, Rattus norvegicus
gaataatgttctactagggccttat

SEQ ID NO: 307477 - DNA, 25 bp, Rattus norvegicus
gaataatgttcttctagggccttat

SEQ ID NO: 307478 - DNA, 25 bp, Rattus norvegicus
gaataatgtttaattctgccgccaa

SEQ ID NO: 307479 - DNA, 25 bp, Rattus norvegicus
gaataatgtttatttctgccgccaa

SEQ ID NO: 307480 - DNA, 25 bp, Rattus norvegicus
gaataattcatgaggcactatcgct

SEQ ID NO: 307481 - DNA, 25 bp, Rattus norvegicus
gaataattcatgtggcactatcgct

SEQ ID NO: 307482 - DNA, 25 bp, Rattus norvegicus
gaataattcttgctcttctccaaag

SEQ ID NO: 307483 - DNA, 25 bp, Rattus norvegicus
gaataattcttggtcttctccaaag

SEQ ID NO: 307484 - DNA, 25 bp, Rattus norvegicus
gaataattgcacatgatctcataga

SEQ ID NO: 307485 - DNA, 25 bp, Rattus norvegicus
gaataattgcacttgatctcataga

SEQ ID NO: 307486 - DNA, 25 bp, Rattus norvegicus
gaataatttccaagtttccacccat

SEQ ID NO: 307487 - DNA, 25 bp, Rattus norvegicus
gaataatttccatgtttccacccat

SEQ ID NO: 307488 - DNA, 25 bp, Rattus norvegicus
gaataatttctcattatatatccaa

SEQ ID NO: 307489 - DNA, 25 bp, Rattus norvegicus
gaataatttctctttatatatccaa

SEQ ID NO: 307490 - DNA, 25 bp, Rattus norvegicus
gaataatttgtcatcacctccttcc

SEQ ID NO: 307491 - DNA, 25 bp, Rattus norvegicus
gaataatttgtcttcacctccttcc

SEQ ID NO: 307492 - DNA, 25 bp, Rattus norvegicus
gaataattttagatcccctgcataa

SEQ ID NO: 307493 - DNA, 25 bp, Rattus norvegicus
gaataattttagttcccctgcataa

SEQ ID NO: 307494 - DNA, 25 bp, Rattus norvegicus
gaataattttgaacttcgccctggg

SEQ ID NO: 307495 - DNA, 25 bp, Rattus norvegicus
gaataattttgatcttcgccctggg

SEQ ID NO: 307496 - DNA, 25 bp, Rattus norvegicus
gaatacaaatgccttccgtgttcca

SEQ ID NO: 307497 - DNA, 25 bp, Rattus norvegicus
gaatacaaatgcgttccgtgttcca

SEQ ID NO: 307498 - DNA, 25 bp, Rattus norvegicus
gaatacacaactccaaacgttaagc

SEQ ID NO: 307499 - DNA, 25 bp, Rattus norvegicus
gaatacacaactgcaaacgttaagc

SEQ ID NO: 307500 - DNA, 25 bp, Rattus norvegicus
gaatacacaagcacttttccatccc

SEQ ID NO: 307501 - DNA, 25 bp, Rattus norvegicus
gaatacacaagctcttttccatccc

SEQ ID NO: 307502 - DNA, 25 bp, Rattus norvegicus
gaatacacaggtaccaatacgtacg

SEQ ID NO: 307503 - DNA, 25 bp, Rattus norvegicus
gaatacacaggttccaatacgtacg

SEQ ID NO: 307504 - DNA, 25 bp, Rattus norvegicus
gaatacacagtcacagacattctca

SEQ ID NO: 307505 - DNA, 25 bp, Rattus norvegicus
gaatacacagtctcagacattctca

SEQ ID NO: 307506 - DNA, 25 bp, Rattus norvegicus
gaatacacctatccgtggctgcagg

SEQ ID NO: 307507 - DNA, 25 bp, Rattus norvegicus
gaatacacctatgcgtggctgcagg

SEQ ID NO: 307508 - DNA, 25 bp, Rattus norvegicus
gaatacactgtgacttaagaagcct

SEQ ID NO: 307509 - DNA, 25 bp, Rattus norvegicus
gaatacactgtgtcttaagaagcct

SEQ ID NO: 307510 - DNA, 25 bp, Rattus norvegicus
gaatacacttaaccccacagcactg

SEQ ID NO: 307511 - DNA, 25 bp, Rattus norvegicus
gaatacacttaagcccacagcactg

SEQ ID NO: 307512 - DNA, 25 bp, Rattus norvegicus
gaatacagaactcacattgtcagaa

SEQ ID NO: 307513 - DNA, 25 bp, Rattus norvegicus
gaatacagaactgacattgtcagaa

SEQ ID NO: 307514 - DNA, 25 bp, Rattus norvegicus
gaatacagaagcacaccctcatcat

SEQ ID NO: 307515 - DNA, 25 bp, Rattus norvegicus
gaatacagaagctcaccctcatcat

SEQ ID NO: 307516 - DNA, 25 bp, Rattus norvegicus
gaatacagacttctgggcccagcaa

SEQ ID NO: 307517 - DNA, 25 bp, Rattus norvegicus
gaatacagacttgtgggcccagcaa

SEQ ID NO: 307518 - DNA, 25 bp, Rattus norvegicus
gaatacagagggattgactttttga

SEQ ID NO: 307519 - DNA, 25 bp, Rattus norvegicus
gaatacagagggtttgactttttga

SEQ ID NO: 307520 - DNA, 25 bp, Rattus norvegicus
gaatacagatgcatacagtcttggc

SEQ ID NO: 307521 - DNA, 25 bp, Rattus norvegicus
gaatacagatgcttacagtcttggc

SEQ ID NO: 307522 - DNA, 25 bp, Rattus norvegicus
gaatacagcctgagggtttaccagt

SEQ ID NO: 307523 - DNA, 25 bp, Rattus norvegicus
gaatacagcctgatttgtcactgtt

SEQ ID NO: 307524 - DNA, 25 bp, Rattus norvegicus
gaatacagcctgtgggtttaccagt

SEQ ID NO: 307525 - DNA, 25 bp, Rattus norvegicus
gaatacagcctgttttgtcactgtt

SEQ ID NO: 307526 - DNA, 25 bp, Rattus norvegicus
gaatacagtagactggactcctaaa

SEQ ID NO: 307527 - DNA, 25 bp, Rattus norvegicus
gaatacagtagagtggactcctaaa

SEQ ID NO: 307528 - DNA, 25 bp, Rattus norvegicus
gaatacagtgaccaccaggtgatgt

SEQ ID NO: 307529 - DNA, 25 bp, Rattus norvegicus
gaatacagtgacgaccaggtgatgt

SEQ ID NO: 307530 - DNA, 25 bp, Rattus norvegicus
gaatacagtgttactcggctttgtg

SEQ ID NO: 307531 - DNA, 25 bp, Rattus norvegicus
gaatacagtgtttctcggctttgtg

SEQ ID NO: 307532 - DNA, 25 bp, Rattus norvegicus
gaatacagttttcctgatcacttga

SEQ ID NO: 307533 - DNA, 25 bp, Rattus norvegicus
gaatacagttttgctgatcacttga

SEQ ID NO: 307534 - DNA, 25 bp, Rattus norvegicus
gaatacataagcatataacacacac

SEQ ID NO: 307535 - DNA, 25 bp, Rattus norvegicus
gaatacataagcttataacacacac

SEQ ID NO: 307536 - DNA, 25 bp, Rattus norvegicus
gaatacatacgtccatgaatcccat

SEQ ID NO: 307537 - DNA, 25 bp, Rattus norvegicus
gaatacatacgtgcatgaatcccat

SEQ ID NO: 307538 - DNA, 25 bp, Rattus norvegicus
gaatacatgatgattacagcacaga

SEQ ID NO: 307539 - DNA, 25 bp, Rattus norvegicus
gaatacatgatgtttacagcacaga

SEQ ID NO: 307540 - DNA, 25 bp, Rattus norvegicus
gaatacatgctgactgtacctgtag

SEQ ID NO: 307541 - DNA, 25 bp, Rattus norvegicus
gaatacatgctgtctgtacctgtag

SEQ ID NO: 307542 - DNA, 25 bp, Rattus norvegicus
gaatacattctgagcttcgtggtgc

SEQ ID NO: 307543 - DNA, 25 bp, Rattus norvegicus
gaatacattctgtgcttcgtggtgc

SEQ ID NO: 307544 - DNA, 25 bp, Rattus norvegicus
gaatacattgccaagtgcctcaagg

SEQ ID NO: 307545 - DNA, 25 bp, Rattus norvegicus
gaatacattgcctagtgcctcaagg

SEQ ID NO: 307546 - DNA, 25 bp, Rattus norvegicus
gaatacatttggacagagttctgac

SEQ ID NO: 307547 - DNA, 25 bp, Rattus norvegicus
gaatacatttggactagagcctttg

SEQ ID NO: 307548 - DNA, 25 bp, Rattus norvegicus
gaatacatttggtcagagttctgac

SEQ ID NO: 307549 - DNA, 25 bp, Rattus norvegicus
gaatacatttggtctagagcctttg

SEQ ID NO: 307550 - DNA, 25 bp, Rattus norvegicus
gaataccaactgaccagtcatcaca

SEQ ID NO: 307551 - DNA, 25 bp, Rattus norvegicus
gaataccaactgtccagtcatcaca

SEQ ID NO: 307552 - DNA, 25 bp, Rattus norvegicus
gaataccaagagaagccgctgctga

SEQ ID NO: 307553 - DNA, 25 bp, Rattus norvegicus
gaataccaagagtagccgctgctga

SEQ ID NO: 307554 - DNA, 25 bp, Rattus norvegicus
gaataccacaagcacacgcagcagt

SEQ ID NO: 307555 - DNA, 25 bp, Rattus norvegicus
gaataccacaaggacacgcagcagt

SEQ ID NO: 307556 - DNA, 25 bp, Rattus norvegicus
gaataccacaggaccgtcttgaggg

SEQ ID NO: 307557 - DNA, 25 bp, Rattus norvegicus
gaataccacaggtccgtcttgaggg

SEQ ID NO: 307558 - DNA, 25 bp, Rattus norvegicus
gaataccacatgatccagagggaga

SEQ ID NO: 307559 - DNA, 25 bp, Rattus norvegicus
gaataccacatgttccagagggaga

SEQ ID NO: 307560 - DNA, 25 bp, Rattus norvegicus
gaataccacgctagatgggcagctt

SEQ ID NO: 307561 - DNA, 25 bp, Rattus norvegicus
gaataccacgcttgatgggcagctt

SEQ ID NO: 307562 - DNA, 25 bp, Rattus norvegicus
gaataccactctctaattgcaaaaa

SEQ ID NO: 307563 - DNA, 25 bp, Rattus norvegicus
gaataccactctgtaattgcaaaaa

SEQ ID NO: 307564 - DNA, 25 bp, Rattus norvegicus
gaataccagaagactcaccatgcat

SEQ ID NO: 307565 - DNA, 25 bp, Rattus norvegicus
gaataccagaagtctcaccatgcat

SEQ ID NO: 307566 - DNA, 25 bp, Rattus norvegicus
gaataccagcagagacaaatgacct

SEQ ID NO: 307567 - DNA, 25 bp, Rattus norvegicus
gaataccagcagattttactctaag

SEQ ID NO: 307568 - DNA, 25 bp, Rattus norvegicus
gaataccagcagtgacaaatgacct

SEQ ID NO: 307569 - DNA, 25 bp, Rattus norvegicus
gaataccagcagtttttactctaag

SEQ ID NO: 307570 - DNA, 25 bp, Rattus norvegicus
gaataccagcatacatctttgtgct

SEQ ID NO: 307571 - DNA, 25 bp, Rattus norvegicus
gaataccagcattcatctttgtgct

SEQ ID NO: 307572 - DNA, 25 bp, Rattus norvegicus
gaataccagctgactccagatagca

SEQ ID NO: 307573 - DNA, 25 bp, Rattus norvegicus
gaataccagctgtctccagatagca

SEQ ID NO: 307574 - DNA, 25 bp, Rattus norvegicus
gaataccaggacacaaaagatgtta

SEQ ID NO: 307575 - DNA, 25 bp, Rattus norvegicus
gaataccaggactcaaaagatgtta

SEQ ID NO: 307576 - DNA, 25 bp, Rattus norvegicus
gaataccaggcgagaagtgttcttt

SEQ ID NO: 307577 - DNA, 25 bp, Rattus norvegicus
gaataccaggcgtgaagtgttcttt

SEQ ID NO: 307578 - DNA, 25 bp, Rattus norvegicus
gaataccagggtcctgtagctccaa

SEQ ID NO: 307579 - DNA, 25 bp, Rattus norvegicus
gaataccagggtgctgtagctccaa

SEQ ID NO: 307580 - DNA, 25 bp, Rattus norvegicus
gaataccagtttcaatccgtccatg

SEQ ID NO: 307581 - DNA, 25 bp, Rattus norvegicus
gaataccagtttgaatccgtccatg

SEQ ID NO: 307582 - DNA, 25 bp, Rattus norvegicus
gaataccatttaatcgactccccat

SEQ ID NO: 307583 - DNA, 25 bp, Rattus norvegicus
gaataccatttattcgactccccat

SEQ ID NO: 307584 - DNA, 25 bp, Rattus norvegicus
gaataccatttcagtttttagatta

SEQ ID NO: 307585 - DNA, 25 bp, Rattus norvegicus
gaataccatttctgtttttagatta

SEQ ID NO: 307586 - DNA, 25 bp, Rattus norvegicus
gaatacccacctcatcaggaagctg

SEQ ID NO: 307587 - DNA, 25 bp, Rattus norvegicus
gaatacccacctgatcaggaagctg

SEQ ID NO: 307588 - DNA, 25 bp, Rattus norvegicus
gaatacccatgaacctattcttcac

SEQ ID NO: 307589 - DNA, 25 bp, Rattus norvegicus
gaatacccatgatcctattcttcac

SEQ ID NO: 307590 - DNA, 25 bp, Rattus norvegicus
gaatacccattactgctttttggag

SEQ ID NO: 307591 - DNA, 25 bp, Rattus norvegicus
gaatacccattagtgctttttggag

SEQ ID NO: 307592 - DNA, 25 bp, Rattus norvegicus
gaatacccctatagtaacagtgtgt

SEQ ID NO: 307593 - DNA, 25 bp, Rattus norvegicus
gaatacccctattgtaacagtgtgt

SEQ ID NO: 307594 - DNA, 25 bp, Rattus norvegicus
gaatacccctttccatatttgtatg

SEQ ID NO: 307595 - DNA, 25 bp, Rattus norvegicus
gaatacccctttgcatatttgtatg

SEQ ID NO: 307596 - DNA, 25 bp, Rattus norvegicus
gaataccctctaatgtgttcagaca

SEQ ID NO: 307597 - DNA, 25 bp, Rattus norvegicus
gaataccctctattgtgttcagaca

SEQ ID NO: 307598 - DNA, 25 bp, Rattus norvegicus
gaataccctgaacgaagtcaccccg

SEQ ID NO: 307599 - DNA, 25 bp, Rattus norvegicus
gaataccctgaaggaagtcaccccg

SEQ ID NO: 307600 - DNA, 25 bp, Rattus norvegicus
gaataccctgagctgtcagtcctta

SEQ ID NO: 307601 - DNA, 25 bp, Rattus norvegicus
gaataccctgaggtgtcagtcctta

SEQ ID NO: 307602 - DNA, 25 bp, Rattus norvegicus
gaataccgaagcagtttaccatgtg

SEQ ID NO: 307603 - DNA, 25 bp, Rattus norvegicus
gaataccgaagctgtttaccatgtg

SEQ ID NO: 307604 - DNA, 25 bp, Rattus norvegicus
gaataccgccataaccgatttcaga

SEQ ID NO: 307605 - DNA, 25 bp, Rattus norvegicus
gaataccgccattaccgatttcaga

SEQ ID NO: 307606 - DNA, 25 bp, Rattus norvegicus
gaatacctcagtcctacatgttttt

SEQ ID NO: 307607 - DNA, 25 bp, Rattus norvegicus
gaatacctcagtgctacatgttttt

SEQ ID NO: 307608 - DNA, 25 bp, Rattus norvegicus
gaatacctcatcagtgttcttggat

SEQ ID NO: 307609 - DNA, 25 bp, Rattus norvegicus
gaatacctcatctgtgttcttggat

SEQ ID NO: 307610 - DNA, 25 bp, Rattus norvegicus
gaatacctcgttaatcatcttcgtc

SEQ ID NO: 307611 - DNA, 25 bp, Rattus norvegicus
gaatacctcgtttatcatcttcgtc

SEQ ID NO: 307612 - DNA, 25 bp, Rattus norvegicus
gaatacctgcttctttctatttatg

SEQ ID NO: 307613 - DNA, 25 bp, Rattus norvegicus
gaatacctgcttgtttctatttatg

SEQ ID NO: 307614 - DNA, 25 bp, Rattus norvegicus
gaatacctggatctggactgcgtct

SEQ ID NO: 307615 - DNA, 25 bp, Rattus norvegicus
gaatacctggatgtggactgcgtct

SEQ ID NO: 307616 - DNA, 25 bp, Rattus norvegicus
gaataccttctacacatgatccctc

SEQ ID NO: 307617 - DNA, 25 bp, Rattus norvegicus
gaataccttctagacatgatccctc

SEQ ID NO: 307618 - DNA, 25 bp, Rattus norvegicus
gaatacctttagactcagaactctg

SEQ ID NO: 307619 - DNA, 25 bp, Rattus norvegicus
gaatacctttagtctcagaactctg

SEQ ID NO: 307620 - DNA, 25 bp, Rattus norvegicus
gaatacgaagccctgttgaacatca

SEQ ID NO: 307621 - DNA, 25 bp, Rattus norvegicus
gaatacgaagccgtgttgaacatca

SEQ ID NO: 307622 - DNA, 25 bp, Rattus norvegicus
gaatacgagtcgcatcacagagcta

SEQ ID NO: 307623 - DNA, 25 bp, Rattus norvegicus
gaatacgagtcggatcacagagcta

SEQ ID NO: 307624 - DNA, 25 bp, Rattus norvegicus
gaatacgcatgtctgcgggcacata

SEQ ID NO: 307625 - DNA, 25 bp, Rattus norvegicus
gaatacgcatgtgtgcgggcacata

SEQ ID NO: 307626 - DNA, 25 bp, Rattus norvegicus
gaatacgcgggtcagataacactaa

SEQ ID NO: 307627 - DNA, 25 bp, Rattus norvegicus
gaatacgcgggtgagataacactaa

SEQ ID NO: 307628 - DNA, 25 bp, Rattus norvegicus
gaatacgctaaccagtatcatgcta

SEQ ID NO: 307629 - DNA, 25 bp, Rattus norvegicus
gaatacgctaacgagtatcatgcta

SEQ ID NO: 307630 - DNA, 25 bp, Rattus norvegicus
gaatacggacacattgggtttacag

SEQ ID NO: 307631 - DNA, 25 bp, Rattus norvegicus
gaatacggacactttgggtttacag

SEQ ID NO: 307632 - DNA, 25 bp, Rattus norvegicus
gaatacggctgtcgaaatcacttta

SEQ ID NO: 307633 - DNA, 25 bp, Rattus norvegicus
gaatacggctgtggaaatcacttta

SEQ ID NO: 307634 - DNA, 25 bp, Rattus norvegicus
gaatacggtaaaaccatgccttgag

SEQ ID NO: 307635 - DNA, 25 bp, Rattus norvegicus
gaatacggtaaatccatgccttgag

SEQ ID NO: 307636 - DNA, 25 bp, Rattus norvegicus
gaatacgtatagacctagcacttga

SEQ ID NO: 307637 - DNA, 25 bp, Rattus norvegicus
gaatacgtatagtcctagcacttga

SEQ ID NO: 307638 - DNA, 25 bp, Rattus norvegicus
gaatacgtgctcaagttctgtgccc

SEQ ID NO: 307639 - DNA, 25 bp, Rattus norvegicus
gaatacgtgctctagttctgtgccc

SEQ ID NO: 307640 - DNA, 25 bp, Rattus norvegicus
gaatacgtggtcaatgagcccatct

SEQ ID NO: 307641 - DNA, 25 bp, Rattus norvegicus
gaatacgtggtctatgagcccatct

SEQ ID NO: 307642 - DNA, 25 bp, Rattus norvegicus
gaatacgttagacacttctgggttt

SEQ ID NO: 307643 - DNA, 25 bp, Rattus norvegicus
gaatacgttagagacttctgggttt

SEQ ID NO: 307644 - DNA, 25 bp, Rattus norvegicus
gaatacgttcaacctgatgtactag

SEQ ID NO: 307645 - DNA, 25 bp, Rattus norvegicus
gaatacgttcaagctgatgtactag

SEQ ID NO: 307646 - DNA, 25 bp, Rattus norvegicus
gaatactaaggccacatctctacgt

SEQ ID NO: 307647 - DNA, 25 bp, Rattus norvegicus
gaatactaaggcgacatctctacgt

SEQ ID NO: 307648 - DNA, 25 bp, Rattus norvegicus
gaatactacagcacctgcatgacaa

SEQ ID NO: 307649 - DNA, 25 bp, Rattus norvegicus
gaatactacagctcctgcatgacaa

SEQ ID NO: 307650 - DNA, 25 bp, Rattus norvegicus
gaatactatacaacagtgcccaccg

SEQ ID NO: 307651 - DNA, 25 bp, Rattus norvegicus
gaatactatacatcagtgcccaccg

SEQ ID NO: 307652 - DNA, 25 bp, Rattus norvegicus
gaatactatgtaccaattatgaatc

SEQ ID NO: 307653 - DNA, 25 bp, Rattus norvegicus
gaatactatgtagcaattatgaatc

SEQ ID NO: 307654 - DNA, 25 bp, Rattus norvegicus
gaatactattccactttctcggaaa

SEQ ID NO: 307655 - DNA, 25 bp, Rattus norvegicus
gaatactattcctctttctcggaaa

SEQ ID NO: 307656 - DNA, 25 bp, Rattus norvegicus
gaatactattggagcacacttttaa

SEQ ID NO: 307657 - DNA, 25 bp, Rattus norvegicus
gaatactattggtgcacacttttaa

SEQ ID NO: 307658 - DNA, 25 bp, Rattus norvegicus
gaatactcacaaaccgtgacctgtc

SEQ ID NO: 307659 - DNA, 25 bp, Rattus norvegicus
gaatactcacaatccgtgacctgtc

SEQ ID NO: 307660 - DNA, 25 bp, Rattus norvegicus
gaatactcacgcacacatatctgcc

SEQ ID NO: 307661 - DNA, 25 bp, Rattus norvegicus
gaatactcacgctcacatatctgcc

SEQ ID NO: 307662 - DNA, 25 bp, Rattus norvegicus
gaatactcagatcatttcagtccgt

SEQ ID NO: 307663 - DNA, 25 bp, Rattus norvegicus
gaatactcagatgatttcagtccgt

SEQ ID NO: 307664 - DNA, 25 bp, Rattus norvegicus
gaatactcatgaagagcctcagtta

SEQ ID NO: 307665 - DNA, 25 bp, Rattus norvegicus
gaatactcatgatgagcctcagtta

SEQ ID NO: 307666 - DNA, 25 bp, Rattus norvegicus
gaatactccgatacttctctggtgg

SEQ ID NO: 307667 - DNA, 25 bp, Rattus norvegicus
gaatactccgattcttctctggtgg

SEQ ID NO: 307668 - DNA, 25 bp, Rattus norvegicus
gaatactcggagctctaggtccaag

SEQ ID NO: 307669 - DNA, 25 bp, Rattus norvegicus
gaatactcggaggtctaggtccaag

SEQ ID NO: 307670 - DNA, 25 bp, Rattus norvegicus
gaatactcgtttctgatgccatcac

SEQ ID NO: 307671 - DNA, 25 bp, Rattus norvegicus
gaatactcgtttgtgatgccatcac

SEQ ID NO: 307672 - DNA, 25 bp, Rattus norvegicus
gaatactctataattttgctcccta

SEQ ID NO: 307673 - DNA, 25 bp, Rattus norvegicus
gaatactctatatttttgctcccta

SEQ ID NO: 307674 - DNA, 25 bp, Rattus norvegicus
gaatactctctcatgaggctgcaat

SEQ ID NO: 307675 - DNA, 25 bp, Rattus norvegicus
gaatactctctcttgaggctgcaat

SEQ ID NO: 307676 - DNA, 25 bp, Rattus norvegicus
gaatactctgggaacctttgcacta

SEQ ID NO: 307677 - DNA, 25 bp, Rattus norvegicus
gaatactctgggtacctttgcacta

SEQ ID NO: 307678 - DNA, 25 bp, Rattus norvegicus
gaatactgacccctagctttgaagg

SEQ ID NO: 307679 - DNA, 25 bp, Rattus norvegicus
gaatactgacccgtagctttgaagg

SEQ ID NO: 307680 - DNA, 25 bp, Rattus norvegicus
gaatactgcccaatactgtcacagt

SEQ ID NO: 307681 - DNA, 25 bp, Rattus norvegicus
gaatactgcccacattttgttctga

SEQ ID NO: 307682 - DNA, 25 bp, Rattus norvegicus
gaatactgcccagattttgttctga

SEQ ID NO: 307683 - DNA, 25 bp, Rattus norvegicus
gaatactgcccattactgtcacagt

SEQ ID NO: 307684 - DNA, 25 bp, Rattus norvegicus
gaatactgcctaccatacccaatga

SEQ ID NO: 307685 - DNA, 25 bp, Rattus norvegicus
gaatactgcctagcatacccaatga

SEQ ID NO: 307686 - DNA, 25 bp, Rattus norvegicus
gaatactgcttcaccaaaataaagg

SEQ ID NO: 307687 - DNA, 25 bp, Rattus norvegicus
gaatactgcttctccaaaataaagg

SEQ ID NO: 307688 - DNA, 25 bp, Rattus norvegicus
gaatactggctaatcctccagatga

SEQ ID NO: 307689 - DNA, 25 bp, Rattus norvegicus
gaatactggctattcctccagatga

SEQ ID NO: 307690 - DNA, 25 bp, Rattus norvegicus
gaatactggctgctcatcagaagga

SEQ ID NO: 307691 - DNA, 25 bp, Rattus norvegicus
gaatactggctggtcatcagaagga

SEQ ID NO: 307692 - DNA, 25 bp, Rattus norvegicus
gaatactgggtactccctggtgcct

SEQ ID NO: 307693 - DNA, 25 bp, Rattus norvegicus
gaatactgggtagtccctggtgcct

SEQ ID NO: 307694 - DNA, 25 bp, Rattus norvegicus
gaatactgtctcaccttggactgat

SEQ ID NO: 307695 - DNA, 25 bp, Rattus norvegicus
gaatactgtctctccttggactgat

SEQ ID NO: 307696 - DNA, 25 bp, Rattus norvegicus
gaatactgtcttccatcaggctggg

SEQ ID NO: 307697 - DNA, 25 bp, Rattus norvegicus
gaatactgtcttgcatcaggctggg

SEQ ID NO: 307698 - DNA, 25 bp, Rattus norvegicus
gaatactgtggtctgagctcagcta

SEQ ID NO: 307699 - DNA, 25 bp, Rattus norvegicus
gaatactgtggtgtgagctcagcta

SEQ ID NO: 307700 - DNA, 25 bp, Rattus norvegicus
gaatactgtgttcgtgagcccctca

SEQ ID NO: 307701 - DNA, 25 bp, Rattus norvegicus
gaatactgtgttggtgagcccctca

SEQ ID NO: 307702 - DNA, 25 bp, Rattus norvegicus
gaatactgttagcattcccagataa

SEQ ID NO: 307703 - DNA, 25 bp, Rattus norvegicus
gaatactgttaggattcccagataa

SEQ ID NO: 307704 - DNA, 25 bp, Rattus norvegicus
gaatactgttctcccgtttacattg

SEQ ID NO: 307705 - DNA, 25 bp, Rattus norvegicus
gaatactgttctgccgtttacattg

SEQ ID NO: 307706 - DNA, 25 bp, Rattus norvegicus
gaatacttagggacttttgatagct

SEQ ID NO: 307707 - DNA, 25 bp, Rattus norvegicus
gaatacttagggtcttttgatagct

SEQ ID NO: 307708 - DNA, 25 bp, Rattus norvegicus
gaatacttatgtatacctcactggt

SEQ ID NO: 307709 - DNA, 25 bp, Rattus norvegicus
gaatacttatgtttacctcactggt

SEQ ID NO: 307710 - DNA, 25 bp, Rattus norvegicus
gaatacttattacccttcagaatat

SEQ ID NO: 307711 - DNA, 25 bp, Rattus norvegicus
gaatacttattagccttcagaatat

SEQ ID NO: 307712 - DNA, 25 bp, Rattus norvegicus
gaatacttcaatagtgcctctcaat

SEQ ID NO: 307713 - DNA, 25 bp, Rattus norvegicus
gaatacttcaattgtgcctctcaat

SEQ ID NO: 307714 - DNA, 25 bp, Rattus norvegicus
gaatacttccccagagttctgttag

SEQ ID NO: 307715 - DNA, 25 bp, Rattus norvegicus
gaatacttcccctgagttctgttag

SEQ ID NO: 307716 - DNA, 25 bp, Rattus norvegicus
gaatacttgaaacgccctcctgaat

SEQ ID NO: 307717 - DNA, 25 bp, Rattus norvegicus
gaatacttgaaaggccctcctgaat

SEQ ID NO: 307718 - DNA, 25 bp, Rattus norvegicus
gaatacttgattactctcactcaac

SEQ ID NO: 307719 - DNA, 25 bp, Rattus norvegicus
gaatacttgatttctctcactcaac

SEQ ID NO: 307720 - DNA, 25 bp, Rattus norvegicus
gaatacttgcctatttctacctgag

SEQ ID NO: 307721 - DNA, 25 bp, Rattus norvegicus
gaatacttgcctttttctacctgag

SEQ ID NO: 307722 - DNA, 25 bp, Rattus norvegicus
gaatacttggatattctgatactga

SEQ ID NO: 307723 - DNA, 25 bp, Rattus norvegicus
gaatacttggattttctgatactga

SEQ ID NO: 307724 - DNA, 25 bp, Rattus norvegicus
gaatacttggttcccatctggtgga

SEQ ID NO: 307725 - DNA, 25 bp, Rattus norvegicus
gaatacttggttgccatctggtgga

SEQ ID NO: 307726 - DNA, 25 bp, Rattus norvegicus
gaatacttgtccagccgtgaggagc

SEQ ID NO: 307727 - DNA, 25 bp, Rattus norvegicus
gaatacttgtcctgccgtgaggagc

SEQ ID NO: 307728 - DNA, 25 bp, Rattus norvegicus
gaatactttactctgcctgcagaac

SEQ ID NO: 307729 - DNA, 25 bp, Rattus norvegicus
gaatactttactgtgcctgcagaac

SEQ ID NO: 307730 - DNA, 25 bp, Rattus norvegicus
gaatactttcacatacttccatcca

SEQ ID NO: 307731 - DNA, 25 bp, Rattus norvegicus
gaatactttcacttacttccatcca

SEQ ID NO: 307732 - DNA, 25 bp, Rattus norvegicus
gaatactttcttctttgccagagga

SEQ ID NO: 307733 - DNA, 25 bp, Rattus norvegicus
gaatactttcttgtttgccagagga

SEQ ID NO: 307734 - DNA, 25 bp, Rattus norvegicus
gaatacttttgacagggatcaccca

SEQ ID NO: 307735 - DNA, 25 bp, Rattus norvegicus
gaatacttttgagagggatcaccca

SEQ ID NO: 307736 - DNA, 25 bp, Rattus norvegicus
gaatactttttaaacctcactgtgt

SEQ ID NO: 307737 - DNA, 25 bp, Rattus norvegicus
gaatactttttatacctcactgtgt

SEQ ID NO: 307738 - DNA, 25 bp, Rattus norvegicus
gaatactttttcacaccatttatga

SEQ ID NO: 307739 - DNA, 25 bp, Rattus norvegicus
gaatactttttctcaccatttatga

SEQ ID NO: 307740 - DNA, 25 bp, Rattus norvegicus
gaatagaaaataatcctcggaggaa

SEQ ID NO: 307741 - DNA, 25 bp, Rattus norvegicus
gaatagaaaatattcctcggaggaa

SEQ ID NO: 307742 - DNA, 25 bp, Rattus norvegicus
gaatagaaacatccagcccacagag

SEQ ID NO: 307743 - DNA, 25 bp, Rattus norvegicus
gaatagaaacatgcagcccacagag

SEQ ID NO: 307744 - DNA, 25 bp, Rattus norvegicus
gaatagaacaccagcctagcgttta

SEQ ID NO: 307745 - DNA, 25 bp, Rattus norvegicus
gaatagaacacctgcctagcgttta

SEQ ID NO: 307746 - DNA, 25 bp, Rattus norvegicus
gaatagaacccacgttccctgaaag

SEQ ID NO: 307747 - DNA, 25 bp, Rattus norvegicus
gaatagaacccaggttccctgaaag

SEQ ID NO: 307748 - DNA, 25 bp, Rattus norvegicus
gaatagaagcccagatactccattt

SEQ ID NO: 307749 - DNA, 25 bp, Rattus norvegicus
gaatagaagccctgatactccattt

SEQ ID NO: 307750 - DNA, 25 bp, Rattus norvegicus
gaatagacacttcattgttccagct

SEQ ID NO: 307751 - DNA, 25 bp, Rattus norvegicus
gaatagacacttgattgttccagct

SEQ ID NO: 307752 - DNA, 25 bp, Rattus norvegicus
gaatagacagaccacgcctgcacaa

SEQ ID NO: 307753 - DNA, 25 bp, Rattus norvegicus
gaatagacagacgacgcctgcacaa

SEQ ID NO: 307754 - DNA, 25 bp, Rattus norvegicus
gaatagacctgtcactcaaggctct

SEQ ID NO: 307755 - DNA, 25 bp, Rattus norvegicus
gaatagacctgtgactcaaggctct

SEQ ID NO: 307756 - DNA, 25 bp, Rattus norvegicus
gaatagaccttcaccctttaggaat

SEQ ID NO: 307757 - DNA, 25 bp, Rattus norvegicus
gaatagaccttctccctttaggaat

SEQ ID NO: 307758 - DNA, 25 bp, Rattus norvegicus
gaatagactggaacactgcgacagc

SEQ ID NO: 307759 - DNA, 25 bp, Rattus norvegicus
gaatagactggatcactgcgacagc

SEQ ID NO: 307760 - DNA, 25 bp, Rattus norvegicus
gaatagagtccacacatgggtcctg

SEQ ID NO: 307761 - DNA, 25 bp, Rattus norvegicus
gaatagagtccagacatgggtcctg

SEQ ID NO: 307762 - DNA, 25 bp, Rattus norvegicus
gaatagatagctacgcaccacacag

SEQ ID NO: 307763 - DNA, 25 bp, Rattus norvegicus
gaatagatagcttcgcaccacacag

SEQ ID NO: 307764 - DNA, 25 bp, Rattus norvegicus
gaatagatgctaatattttacagat

SEQ ID NO: 307765 - DNA, 25 bp, Rattus norvegicus
gaatagatgctattattttacagat

SEQ ID NO: 307766 - DNA, 25 bp, Rattus norvegicus
gaatagatggctagtgtgcctgttt

SEQ ID NO: 307767 - DNA, 25 bp, Rattus norvegicus
gaatagatggcttgtgtgcctgttt

SEQ ID NO: 307768 - DNA, 25 bp, Rattus norvegicus
gaatagatgttccaataatgagctg

SEQ ID NO: 307769 - DNA, 25 bp, Rattus norvegicus
gaatagatgttcgaataatgagctg

SEQ ID NO: 307770 - DNA, 25 bp, Rattus norvegicus
gaatagatgttgctcctgaccatag

SEQ ID NO: 307771 - DNA, 25 bp, Rattus norvegicus
gaatagatgttggtcctgaccatag

SEQ ID NO: 307772 - DNA, 25 bp, Rattus norvegicus
gaatagcacatcactgagtctgttc

SEQ ID NO: 307773 - DNA, 25 bp, Rattus norvegicus
gaatagcacatctctgagtctgttc

SEQ ID NO: 307774 - DNA, 25 bp, Rattus norvegicus
gaatagcacatgacttcagaacggc

SEQ ID NO: 307775 - DNA, 25 bp, Rattus norvegicus
gaatagcacatgtcttcagaacggc

SEQ ID NO: 307776 - DNA, 25 bp, Rattus norvegicus
gaatagcaccatcagagagctgtag

SEQ ID NO: 307777 - DNA, 25 bp, Rattus norvegicus
gaatagcaccatgagagagctgtag

SEQ ID NO: 307778 - DNA, 25 bp, Rattus norvegicus
gaatagcatctcagtcaaaagttgt

SEQ ID NO: 307779 - DNA, 25 bp, Rattus norvegicus
gaatagcatctctgtcaaaagttgt

SEQ ID NO: 307780 - DNA, 25 bp, Rattus norvegicus
gaatagcatggtccctatgaactac

SEQ ID NO: 307781 - DNA, 25 bp, Rattus norvegicus
gaatagcatggtgcctatgaactac

SEQ ID NO: 307782 - DNA, 25 bp, Rattus norvegicus
gaatagcattccacaactggtaccg

SEQ ID NO: 307783 - DNA, 25 bp, Rattus norvegicus
gaatagcattcctcaactggtaccg

SEQ ID NO: 307784 - DNA, 25 bp, Rattus norvegicus
gaatagccactcagctgaaatctga

SEQ ID NO: 307785 - DNA, 25 bp, Rattus norvegicus
gaatagccactctgctgaaatctga

SEQ ID NO: 307786 - DNA, 25 bp, Rattus norvegicus
gaatagccagctacggtgatacata

SEQ ID NO: 307787 - DNA, 25 bp, Rattus norvegicus
gaatagccagcttcggtgatacata

SEQ ID NO: 307788 - DNA, 25 bp, Rattus norvegicus
gaatagccctcaaggttattaaatc

SEQ ID NO: 307789 - DNA, 25 bp, Rattus norvegicus
gaatagccctcatggttattaaatc

SEQ ID NO: 307790 - DNA, 25 bp, Rattus norvegicus
gaatagccctgaatagcagccattc

SEQ ID NO: 307791 - DNA, 25 bp, Rattus norvegicus
gaatagccctgattagcagccattc

SEQ ID NO: 307792 - DNA, 25 bp, Rattus norvegicus
gaatagcccttcatgaaggctgatg

SEQ ID NO: 307793 - DNA, 25 bp, Rattus norvegicus
gaatagcccttcttgaaggctgatg

SEQ ID NO: 307794 - DNA, 25 bp, Rattus norvegicus
gaatagcctacaaatgagtttgtgc

SEQ ID NO: 307795 - DNA, 25 bp, Rattus norvegicus
gaatagcctacatatgagtttgtgc

SEQ ID NO: 307796 - DNA, 25 bp, Rattus norvegicus
gaatagcctcggagtgtgagcacat

SEQ ID NO: 307797 - DNA, 25 bp, Rattus norvegicus
gaatagcctcggtgtgtgagcacat

SEQ ID NO: 307798 - DNA, 25 bp, Rattus norvegicus
gaatagcctgttagcgtcacgtcac

SEQ ID NO: 307799 - DNA, 25 bp, Rattus norvegicus
gaatagcctgtttgcgtcacgtcac

SEQ ID NO: 307800 - DNA, 25 bp, Rattus norvegicus
gaatagccttgcatgcttgagtcac

SEQ ID NO: 307801 - DNA, 25 bp, Rattus norvegicus
gaatagccttgcttgcttgagtcac

SEQ ID NO: 307802 - DNA, 25 bp, Rattus norvegicus
gaatagccttttctaaccgtatcat

SEQ ID NO: 307803 - DNA, 25 bp, Rattus norvegicus
gaatagccttttgtaaccgtatcat

SEQ ID NO: 307804 - DNA, 25 bp, Rattus norvegicus
gaatagctacttatacattaaatat

SEQ ID NO: 307805 - DNA, 25 bp, Rattus norvegicus
gaatagctacttttacattaaatat

SEQ ID NO: 307806 - DNA, 25 bp, Rattus norvegicus
gaatagctatgtcaggctgatgtaa

SEQ ID NO: 307807 - DNA, 25 bp, Rattus norvegicus
gaatagctatgtgaggctgatgtaa

SEQ ID NO: 307808 - DNA, 25 bp, Rattus norvegicus
gaatagctcaataccttctgttgaa

SEQ ID NO: 307809 - DNA, 25 bp, Rattus norvegicus
gaatagctcaattccttctgttgaa

SEQ ID NO: 307810 - DNA, 25 bp, Rattus norvegicus
gaatagctctgcagaagtcttggta

SEQ ID NO: 307811 - DNA, 25 bp, Rattus norvegicus
gaatagctctgctgaagtcttggta

SEQ ID NO: 307812 - DNA, 25 bp, Rattus norvegicus
gaatagctgcgacctcctttaggaa

SEQ ID NO: 307813 - DNA, 25 bp, Rattus norvegicus
gaatagctgcgagctcctttaggaa

SEQ ID NO: 307814 - DNA, 25 bp, Rattus norvegicus
gaatagctggccattgcctgaaagg

SEQ ID NO: 307815 - DNA, 25 bp, Rattus norvegicus
gaatagctggcctttgcctgaaagg

SEQ ID NO: 307816 - DNA, 25 bp, Rattus norvegicus
gaatagctgtagcacctccaatcac

SEQ ID NO: 307817 - DNA, 25 bp, Rattus norvegicus
gaatagctgtaggacctccaatcac

SEQ ID NO: 307818 - DNA, 25 bp, Rattus norvegicus
gaatagctgtctctagatgccttcc

SEQ ID NO: 307819 - DNA, 25 bp, Rattus norvegicus
gaatagctgtctgtagatgccttcc

SEQ ID NO: 307820 - DNA, 25 bp, Rattus norvegicus
gaatagcttctgaatccatttagta

SEQ ID NO: 307821 - DNA, 25 bp, Rattus norvegicus
gaatagcttctgtatccatttagta

SEQ ID NO: 307822 - DNA, 25 bp, Rattus norvegicus
gaatagcttcttcaacctagcccat

SEQ ID NO: 307823 - DNA, 25 bp, Rattus norvegicus
gaatagcttcttgaacctagcccat

SEQ ID NO: 307824 - DNA, 25 bp, Rattus norvegicus
gaatagcttgacatcaggtgccttt

SEQ ID NO: 307825 - DNA, 25 bp, Rattus norvegicus
gaatagcttgacttcaggtgccttt

SEQ ID NO: 307826 - DNA, 25 bp, Rattus norvegicus
gaatagcttgagagcctcgtgtact

SEQ ID NO: 307827 - DNA, 25 bp, Rattus norvegicus
gaatagcttgagtgcctcgtgtact

SEQ ID NO: 307828 - DNA, 25 bp, Rattus norvegicus
gaatagcttgctatcatttgtcagc

SEQ ID NO: 307829 - DNA, 25 bp, Rattus norvegicus
gaatagcttgctttcatttgtcagc

SEQ ID NO: 307830 - DNA, 25 bp, Rattus norvegicus
gaatagcttggtcactttatgaagg

SEQ ID NO: 307831 - DNA, 25 bp, Rattus norvegicus
gaatagcttggtgactttatgaagg

SEQ ID NO: 307832 - DNA, 25 bp, Rattus norvegicus
gaatagcttgtaacctaaccctgtg

SEQ ID NO: 307833 - DNA, 25 bp, Rattus norvegicus
gaatagcttgtaccacatgacggaa

SEQ ID NO: 307834 - DNA, 25 bp, Rattus norvegicus
gaatagcttgtagcacatgacggaa

SEQ ID NO: 307835 - DNA, 25 bp, Rattus norvegicus
gaatagcttgtatcctaaccctgtg

SEQ ID NO: 307836 - DNA, 25 bp, Rattus norvegicus
gaatagctttatctactctgtaatg

SEQ ID NO: 307837 - DNA, 25 bp, Rattus norvegicus
gaatagctttatctttgtgcctcag

SEQ ID NO: 307838 - DNA, 25 bp, Rattus norvegicus
gaatagctttatgtactctgtaatg

SEQ ID NO: 307839 - DNA, 25 bp, Rattus norvegicus
gaatagctttatgtttgtgcctcag

SEQ ID NO: 307840 - DNA, 25 bp, Rattus norvegicus
gaatagcttttcatagttgctcaat

SEQ ID NO: 307841 - DNA, 25 bp, Rattus norvegicus
gaatagcttttcttagttgctcaat

SEQ ID NO: 307842 - DNA, 25 bp, Rattus norvegicus
gaataggaaaacacgctcttcagag

SEQ ID NO: 307843 - DNA, 25 bp, Rattus norvegicus
gaataggaaaaccaccatctttctt

SEQ ID NO: 307844 - DNA, 25 bp, Rattus norvegicus
gaataggaaaacgaccatctttctt

SEQ ID NO: 307845 - DNA, 25 bp, Rattus norvegicus
gaataggaaaactcgctcttcagag

SEQ ID NO: 307846 - DNA, 25 bp, Rattus norvegicus
gaataggacccaagcttgattccca

SEQ ID NO: 307847 - DNA, 25 bp, Rattus norvegicus
gaataggacccatgcttgattccca

SEQ ID NO: 307848 - DNA, 25 bp, Rattus norvegicus
gaataggaccttcagactgccacta

SEQ ID NO: 307849 - DNA, 25 bp, Rattus norvegicus
gaataggaccttctatgccatatat

SEQ ID NO: 307850 - DNA, 25 bp, Rattus norvegicus
gaataggaccttgagactgccacta

SEQ ID NO: 307851 - DNA, 25 bp, Rattus norvegicus
gaataggaccttgtatgccatatat

SEQ ID NO: 307852 - DNA, 25 bp, Rattus norvegicus
gaataggagcctatgcctcacagat

SEQ ID NO: 307853 - DNA, 25 bp, Rattus norvegicus
gaataggagcctttgcctcacagat

SEQ ID NO: 307854 - DNA, 25 bp, Rattus norvegicus
gaataggattctactcagttgaaaa

SEQ ID NO: 307855 - DNA, 25 bp, Rattus norvegicus
gaataggattcttctcagttgaaaa

SEQ ID NO: 307856 - DNA, 25 bp, Rattus norvegicus
gaataggcaaaacactcaacatata

SEQ ID NO: 307857 - DNA, 25 bp, Rattus norvegicus
gaataggcaaaagactcaacatata

SEQ ID NO: 307858 - DNA, 25 bp, Rattus norvegicus
gaataggccagcatcttggagcctg

SEQ ID NO: 307859 - DNA, 25 bp, Rattus norvegicus
gaataggccagcttcttggagcctg

SEQ ID NO: 307860 - DNA, 25 bp, Rattus norvegicus
gaataggccattcactgtccagtcg

SEQ ID NO: 307861 - DNA, 25 bp, Rattus norvegicus
gaataggccattgactgtccagtcg

SEQ ID NO: 307862 - DNA, 25 bp, Rattus norvegicus
gaataggccccacagcagtgggctt

SEQ ID NO: 307863 - DNA, 25 bp, Rattus norvegicus
gaataggccccagagcagtgggctt

SEQ ID NO: 307864 - DNA, 25 bp, Rattus norvegicus
gaataggctatcctgtctggcgaga

SEQ ID NO: 307865 - DNA, 25 bp, Rattus norvegicus
gaataggctatcgtgtctggcgaga

SEQ ID NO: 307866 - DNA, 25 bp, Rattus norvegicus
gaatagggtacaaagtctatctcaa

SEQ ID NO: 307867 - DNA, 25 bp, Rattus norvegicus
gaatagggtacatagtctatctcaa

SEQ ID NO: 307868 - DNA, 25 bp, Rattus norvegicus
gaatagggtgtgatctctgacgtca

SEQ ID NO: 307869 - DNA, 25 bp, Rattus norvegicus
gaatagggtgtgttctctgacgtca

SEQ ID NO: 307870 - DNA, 25 bp, Rattus norvegicus
gaataggtacacctgctggtactcc

SEQ ID NO: 307871 - DNA, 25 bp, Rattus norvegicus
gaataggtacacgtgctggtactcc

SEQ ID NO: 307872 - DNA, 25 bp, Rattus norvegicus
gaataggtcctcaaatccaaacatg

SEQ ID NO: 307873 - DNA, 25 bp, Rattus norvegicus
gaataggtcctctaatccaaacatg

SEQ ID NO: 307874 - DNA, 25 bp, Rattus norvegicus
gaataggtctgactggataccaaat

SEQ ID NO: 307875 - DNA, 25 bp, Rattus norvegicus
gaataggtctgagtggataccaaat

SEQ ID NO: 307876 - DNA, 25 bp, Rattus norvegicus
gaataggtgctcaactctaacccag

SEQ ID NO: 307877 - DNA, 25 bp, Rattus norvegicus
gaataggtgctctactctaacccag

SEQ ID NO: 307878 - DNA, 25 bp, Rattus norvegicus
gaataggtttcaccacagttttgtt

SEQ ID NO: 307879 - DNA, 25 bp, Rattus norvegicus
gaataggtttcagcacagttttgtt

SEQ ID NO: 307880 - DNA, 25 bp, Rattus norvegicus
gaatagtaaaatcgcaaccctagaa

SEQ ID NO: 307881 - DNA, 25 bp, Rattus norvegicus
gaatagtaaaatggcaaccctagaa

SEQ ID NO: 307882 - DNA, 25 bp, Rattus norvegicus
gaatagtaatagaaacatctgtgtt

SEQ ID NO: 307883 - DNA, 25 bp, Rattus norvegicus
gaatagtaatagtaacatctgtgtt

SEQ ID NO: 307884 - DNA, 25 bp, Rattus norvegicus
gaatagtagttacatcctgccccag

SEQ ID NO: 307885 - DNA, 25 bp, Rattus norvegicus
gaatagtagttagatcctgccccag

SEQ ID NO: 307886 - DNA, 25 bp, Rattus norvegicus
gaatagtcacagatctttggtaaat

SEQ ID NO: 307887 - DNA, 25 bp, Rattus norvegicus
gaatagtcacagttctttggtaaat

SEQ ID NO: 307888 - DNA, 25 bp, Rattus norvegicus
gaatagtcactgctccgaggaagct

SEQ ID NO: 307889 - DNA, 25 bp, Rattus norvegicus
gaatagtcactggtccgaggaagct

SEQ ID NO: 307890 - DNA, 25 bp, Rattus norvegicus
gaatagtccaaaagtttctgaagaa

SEQ ID NO: 307891 - DNA, 25 bp, Rattus norvegicus
gaatagtccaaatgtttctgaagaa

SEQ ID NO: 307892 - DNA, 25 bp, Rattus norvegicus
gaatagtcgttgatagtttcaccta

SEQ ID NO: 307893 - DNA, 25 bp, Rattus norvegicus
gaatagtcgttgttagtttcaccta

SEQ ID NO: 307894 - DNA, 25 bp, Rattus norvegicus
gaatagtctagtaatgtctcgtcct

SEQ ID NO: 307895 - DNA, 25 bp, Rattus norvegicus
gaatagtctagttatgtctcgtcct

SEQ ID NO: 307896 - DNA, 25 bp, Rattus norvegicus
gaatagtctgacagcatggacacag

SEQ ID NO: 307897 - DNA, 25 bp, Rattus norvegicus
gaatagtctgactgcatggacacag

SEQ ID NO: 307898 - DNA, 25 bp, Rattus norvegicus
gaatagtcttctctggtgcatgctc

SEQ ID NO: 307899 - DNA, 25 bp, Rattus norvegicus
gaatagtcttctgtggtgcatgctc

SEQ ID NO: 307900 - DNA, 25 bp, Rattus norvegicus
gaatagtgacgcacttctacttccc

SEQ ID NO: 307901 - DNA, 25 bp, Rattus norvegicus
gaatagtgacgctcttctacttccc

SEQ ID NO: 307902 - DNA, 25 bp, Rattus norvegicus
gaatagtgaggacgctgctctgcac

SEQ ID NO: 307903 - DNA, 25 bp, Rattus norvegicus
gaatagtgaggaggctgctctgcac

SEQ ID NO: 307904 - DNA, 25 bp, Rattus norvegicus
gaatagtgctgcagcctgtgtgctc

SEQ ID NO: 307905 - DNA, 25 bp, Rattus norvegicus
gaatagtgctgctgcctgtgtgctc

SEQ ID NO: 307906 - DNA, 25 bp, Rattus norvegicus
gaatagtgctttccccttatcaatg

SEQ ID NO: 307907 - DNA, 25 bp, Rattus norvegicus
gaatagtgctttgcccttatcaatg

SEQ ID NO: 307908 - DNA, 25 bp, Rattus norvegicus
gaatagtggactccacctttaagca

SEQ ID NO: 307909 - DNA, 25 bp, Rattus norvegicus
gaatagtggactgcacctttaagca

SEQ ID NO: 307910 - DNA, 25 bp, Rattus norvegicus
gaatagttcacaaagttttgccttg

SEQ ID NO: 307911 - DNA, 25 bp, Rattus norvegicus
gaatagttcacaccagtctttttta

SEQ ID NO: 307912 - DNA, 25 bp, Rattus norvegicus
gaatagttcacagcagtctttttta

SEQ ID NO: 307913 - DNA, 25 bp, Rattus norvegicus
gaatagttcacatagttttgccttg

SEQ ID NO: 307914 - DNA, 25 bp, Rattus norvegicus
gaatagttcctaaggttcctcggct

SEQ ID NO: 307915 - DNA, 25 bp, Rattus norvegicus
gaatagttcctatggttcctcggct

SEQ ID NO: 307916 - DNA, 25 bp, Rattus norvegicus
gaatagttcttcagcgctttttaac

SEQ ID NO: 307917 - DNA, 25 bp, Rattus norvegicus
gaatagttcttctgcgctttttaac

SEQ ID NO: 307918 - DNA, 25 bp, Rattus norvegicus
gaatagttgcttccttgccagttac

SEQ ID NO: 307919 - DNA, 25 bp, Rattus norvegicus
gaatagttgcttgcttgccagttac

SEQ ID NO: 307920 - DNA, 25 bp, Rattus norvegicus
gaatagtttaccacatccatgcact

SEQ ID NO: 307921 - DNA, 25 bp, Rattus norvegicus
gaatagtttacctcatccatgcact

SEQ ID NO: 307922 - DNA, 25 bp, Rattus norvegicus
gaatagtttagtcgctgtcaagatt

SEQ ID NO: 307923 - DNA, 25 bp, Rattus norvegicus
gaatagtttagtggctgtcaagatt

SEQ ID NO: 307924 - DNA, 25 bp, Rattus norvegicus
gaatagtttatgctccacacaaatg

SEQ ID NO: 307925 - DNA, 25 bp, Rattus norvegicus
gaatagtttatggtccacacaaatg

SEQ ID NO: 307926 - DNA, 25 bp, Rattus norvegicus
gaatagtttccacaaggtccctaag

SEQ ID NO: 307927 - DNA, 25 bp, Rattus norvegicus
gaatagtttccagaaggtccctaag

SEQ ID NO: 307928 - DNA, 25 bp, Rattus norvegicus
gaatagtttgaacccttccttgtca

SEQ ID NO: 307929 - DNA, 25 bp, Rattus norvegicus
gaatagtttgaagccttccttgtca

SEQ ID NO: 307930 - DNA, 25 bp, Rattus norvegicus
gaatagtttgatacatgtgtaccca

SEQ ID NO: 307931 - DNA, 25 bp, Rattus norvegicus
gaatagtttgattcatgtgtaccca

SEQ ID NO: 307932 - DNA, 25 bp, Rattus norvegicus
gaatagtttgtccagtgggtctctt

SEQ ID NO: 307933 - DNA, 25 bp, Rattus norvegicus
gaatagtttgtcgagtgggtctctt

SEQ ID NO: 307934 - DNA, 25 bp, Rattus norvegicus
gaatataaaggaccgctgttacaga

SEQ ID NO: 307935 - DNA, 25 bp, Rattus norvegicus
gaatataaaggagcgctgttacaga

SEQ ID NO: 307936 - DNA, 25 bp, Rattus norvegicus
gaatataactttaacacacactgtg

SEQ ID NO: 307937 - DNA, 25 bp, Rattus norvegicus
gaatataacttttacacacactgtg

SEQ ID NO: 307938 - DNA, 25 bp, Rattus norvegicus
gaatataagcaactctcttttccta

SEQ ID NO: 307939 - DNA, 25 bp, Rattus norvegicus
gaatataagcaagtctcttttccta

SEQ ID NO: 307940 - DNA, 25 bp, Rattus norvegicus
gaatatacatagactgcctcagcta

SEQ ID NO: 307941 - DNA, 25 bp, Rattus norvegicus
gaatatacatagtctgcctcagcta

SEQ ID NO: 307942 - DNA, 25 bp, Rattus norvegicus
gaatataccactatgcagtgcatca

SEQ ID NO: 307943 - DNA, 25 bp, Rattus norvegicus
gaatataccactttgcagtgcatca

SEQ ID NO: 307944 - DNA, 25 bp, Rattus norvegicus
gaatatacccaaatgatgccatcag

SEQ ID NO: 307945 - DNA, 25 bp, Rattus norvegicus
gaatatacccaattgatgccatcag

SEQ ID NO: 307946 - DNA, 25 bp, Rattus norvegicus
gaatatactctcattttgtttggga

SEQ ID NO: 307947 - DNA, 25 bp, Rattus norvegicus
gaatatactctctttttgtttggga

SEQ ID NO: 307948 - DNA, 25 bp, Rattus norvegicus
gaatatactgtaagtgctctggtga

SEQ ID NO: 307949 - DNA, 25 bp, Rattus norvegicus
gaatatactgtatgtgctctggtga

SEQ ID NO: 307950 - DNA, 25 bp, Rattus norvegicus
gaatatagatttagcccgagccaca

SEQ ID NO: 307951 - DNA, 25 bp, Rattus norvegicus
gaatatagattttgcccgagccaca

SEQ ID NO: 307952 - DNA, 25 bp, Rattus norvegicus
gaatatagccacacttcgaaatctg

SEQ ID NO: 307953 - DNA, 25 bp, Rattus norvegicus
gaatatagccactcttcgaaatctg

SEQ ID NO: 307954 - DNA, 25 bp, Rattus norvegicus
gaatatagctagcttccctggagaa

SEQ ID NO: 307955 - DNA, 25 bp, Rattus norvegicus
gaatatagctaggttccctggagaa

SEQ ID NO: 307956 - DNA, 25 bp, Rattus norvegicus
gaatatatacacatcaccccaacat

SEQ ID NO: 307957 - DNA, 25 bp, Rattus norvegicus
gaatatatacacttcaccccaacat

SEQ ID NO: 307958 - DNA, 25 bp, Rattus norvegicus
gaatatatcactctcttacttgtca

SEQ ID NO: 307959 - DNA, 25 bp, Rattus norvegicus
gaatatatcactgtcttacttgtca

SEQ ID NO: 307960 - DNA, 25 bp, Rattus norvegicus
gaatatatcatcagtcttacttaat

SEQ ID NO: 307961 - DNA, 25 bp, Rattus norvegicus
gaatatatcatctgtcttacttaat

SEQ ID NO: 307962 - DNA, 25 bp, Rattus norvegicus
gaatatatcccaaaaaattccattg

SEQ ID NO: 307963 - DNA, 25 bp, Rattus norvegicus
gaatatatcccataaaattccattg

SEQ ID NO: 307964 - DNA, 25 bp, Rattus norvegicus
gaatatatgaccacgctcacccgca

SEQ ID NO: 307965 - DNA, 25 bp, Rattus norvegicus
gaatatatgacctcgctcacccgca

SEQ ID NO: 307966 - DNA, 25 bp, Rattus norvegicus
gaatatatttctagcaaagtccgtt

SEQ ID NO: 307967 - DNA, 25 bp, Rattus norvegicus
gaatatatttcttgcaaagtccgtt

SEQ ID NO: 307968 - DNA, 25 bp, Rattus norvegicus
gaatatatttgcagctgtcgacttt

SEQ ID NO: 307969 - DNA, 25 bp, Rattus norvegicus
gaatatatttgctgctgtcgacttt

SEQ ID NO: 307970 - DNA, 25 bp, Rattus norvegicus
gaatatcaaacacatcctaatccat

SEQ ID NO: 307971 - DNA, 25 bp, Rattus norvegicus
gaatatcaaacagatcctaatccat

SEQ ID NO: 307972 - DNA, 25 bp, Rattus norvegicus
gaatatcaaccgcaagctctctgct

SEQ ID NO: 307973 - DNA, 25 bp, Rattus norvegicus
gaatatcaaccggaagctctctgct

SEQ ID NO: 307974 - DNA, 25 bp, Rattus norvegicus
gaatatcaagagaacaatccttatg

SEQ ID NO: 307975 - DNA, 25 bp, Rattus norvegicus
gaatatcaagagtacaatccttatg

SEQ ID NO: 307976 - DNA, 25 bp, Rattus norvegicus
gaatatcaagcaagccacacactct

SEQ ID NO: 307977 - DNA, 25 bp, Rattus norvegicus
gaatatcaagcatgccacacactct

SEQ ID NO: 307978 - DNA, 25 bp, Rattus norvegicus
gaatatcaagcgattcctttttact

SEQ ID NO: 307979 - DNA, 25 bp, Rattus norvegicus
gaatatcaagcgtttcctttttact

SEQ ID NO: 307980 - DNA, 25 bp, Rattus norvegicus
gaatatcaattcattctagatgtac

SEQ ID NO: 307981 - DNA, 25 bp, Rattus norvegicus
gaatatcaattctttctagatgtac

SEQ ID NO: 307982 - DNA, 25 bp, Rattus norvegicus
gaatatcacactatgttgtcctgtt

SEQ ID NO: 307983 - DNA, 25 bp, Rattus norvegicus
gaatatcacactttgttgtcctgtt

SEQ ID NO: 307984 - DNA, 25 bp, Rattus norvegicus
gaatatcaccagcttctgcgtcaag

SEQ ID NO: 307985 - DNA, 25 bp, Rattus norvegicus
gaatatcaccaggttctgcgtcaag

SEQ ID NO: 307986 - DNA, 25 bp, Rattus norvegicus
gaatatcactgtctacctaggctag

SEQ ID NO: 307987 - DNA, 25 bp, Rattus norvegicus
gaatatcactgtgtacctaggctag

SEQ ID NO: 307988 - DNA, 25 bp, Rattus norvegicus
gaatatcacttcaagtcaccttgtt

SEQ ID NO: 307989 - DNA, 25 bp, Rattus norvegicus
gaatatcacttctagtcaccttgtt

SEQ ID NO: 307990 - DNA, 25 bp, Rattus norvegicus
gaatatcactttacctgtttctccc

SEQ ID NO: 307991 - DNA, 25 bp, Rattus norvegicus
gaatatcacttttcctgtttctccc

SEQ ID NO: 307992 - DNA, 25 bp, Rattus norvegicus
gaatatcagaccaaggaacctgctg

SEQ ID NO: 307993 - DNA, 25 bp, Rattus norvegicus
gaatatcagacctaggaacctgctg

SEQ ID NO: 307994 - DNA, 25 bp, Rattus norvegicus
gaatatcagactatctcccaggttg

SEQ ID NO: 307995 - DNA, 25 bp, Rattus norvegicus
gaatatcagactttctcccaggttg

SEQ ID NO: 307996 - DNA, 25 bp, Rattus norvegicus
gaatatcagtgtatcggccaggcct

SEQ ID NO: 307997 - DNA, 25 bp, Rattus norvegicus
gaatatcagtgtttcggccaggcct

SEQ ID NO: 307998 - DNA, 25 bp, Rattus norvegicus
gaatatcatccccattgcagttgta

SEQ ID NO: 307999 - DNA, 25 bp, Rattus norvegicus
gaatatcatcccgattgcagttgta

SEQ ID NO: 308000 - DNA, 25 bp, Rattus norvegicus
gaatatcattttagtcctgtggaat

SEQ ID NO: 308001 - DNA, 25 bp, Rattus norvegicus
gaatatcatttttgtcctgtggaat

SEQ ID NO: 308002 - DNA, 25 bp, Rattus norvegicus
gaatatccactgatacaaggccctg

SEQ ID NO: 308003 - DNA, 25 bp, Rattus norvegicus
gaatatccactgttacaaggccctg

SEQ ID NO: 308004 - DNA, 25 bp, Rattus norvegicus
gaatatccagagaattctccgccgt

SEQ ID NO: 308005 - DNA, 25 bp, Rattus norvegicus
gaatatccagagtattctccgccgt

SEQ ID NO: 308006 - DNA, 25 bp, Rattus norvegicus
gaatatccagttaccccttgatagt

SEQ ID NO: 308007 - DNA, 25 bp, Rattus norvegicus
gaatatccagtttccccttgatagt

SEQ ID NO: 308008 - DNA, 25 bp, Rattus norvegicus
gaatatcccaggatacccagaggtt

SEQ ID NO: 308009 - DNA, 25 bp, Rattus norvegicus
gaatatcccaggttacccagaggtt

SEQ ID NO: 308010 - DNA, 25 bp, Rattus norvegicus
gaatatcccagtaatcaggcagcct

SEQ ID NO: 308011 - DNA, 25 bp, Rattus norvegicus
gaatatcccagttatcaggcagcct

SEQ ID NO: 308012 - DNA, 25 bp, Rattus norvegicus
gaatatcccctgcacattctatgtc

SEQ ID NO: 308013 - DNA, 25 bp, Rattus norvegicus
gaatatcccctggacattctatgtc

SEQ ID NO: 308014 - DNA, 25 bp, Rattus norvegicus
gaatatccgctaccgccagcaacag

SEQ ID NO: 308015 - DNA, 25 bp, Rattus norvegicus
gaatatccgctagcgccagcaacag

SEQ ID NO: 308016 - DNA, 25 bp, Rattus norvegicus
gaatatccgtgtacttccggcttaa

SEQ ID NO: 308017 - DNA, 25 bp, Rattus norvegicus
gaatatccgtgttcttccggcttaa

SEQ ID NO: 308018 - DNA, 25 bp, Rattus norvegicus
gaatatcctatcaccgctcagtgtt

SEQ ID NO: 308019 - DNA, 25 bp, Rattus norvegicus
gaatatcctatctccgctcagtgtt

SEQ ID NO: 308020 - DNA, 25 bp, Rattus norvegicus
gaatatcgtctcatatctgaggaaa

SEQ ID NO: 308021 - DNA, 25 bp, Rattus norvegicus
gaatatcgtctcttatctgaggaaa

SEQ ID NO: 308022 - DNA, 25 bp, Rattus norvegicus
gaatatctaaccagcaaccactcag

SEQ ID NO: 308023 - DNA, 25 bp, Rattus norvegicus
gaatatctaacctgcaaccactcag

SEQ ID NO: 308024 - DNA, 25 bp, Rattus norvegicus
gaatatctaccaagcatttggacaa

SEQ ID NO: 308025 - DNA, 25 bp, Rattus norvegicus
gaatatctaccatgcatttggacaa

SEQ ID NO: 308026 - DNA, 25 bp, Rattus norvegicus
gaatatctatcacctcaggaggcac

SEQ ID NO: 308027 - DNA, 25 bp, Rattus norvegicus
gaatatctatcagctcaggaggcac

SEQ ID NO: 308028 - DNA, 25 bp, Rattus norvegicus
gaatatctcaatcgtttgtctgcta

SEQ ID NO: 308029 - DNA, 25 bp, Rattus norvegicus
gaatatctcaatggtttgtctgcta

SEQ ID NO: 308030 - DNA, 25 bp, Rattus norvegicus
gaatatctccccaggtttgtctctg

SEQ ID NO: 308031 - DNA, 25 bp, Rattus norvegicus
gaatatctcccctggtttgtctctg

SEQ ID NO: 308032 - DNA, 25 bp, Rattus norvegicus
gaatatctccctagattatcatcag

SEQ ID NO: 308033 - DNA, 25 bp, Rattus norvegicus
gaatatctcccttgattatcatcag

SEQ ID NO: 308034 - DNA, 25 bp, Rattus norvegicus
gaatatctccggaggaccacagcaa

SEQ ID NO: 308035 - DNA, 25 bp, Rattus norvegicus
gaatatctccggtggaccacagcaa

SEQ ID NO: 308036 - DNA, 25 bp, Rattus norvegicus
gaatatctgactacatttttcatgt

SEQ ID NO: 308037 - DNA, 25 bp, Rattus norvegicus
gaatatctgacttcatttttcatgt

SEQ ID NO: 308038 - DNA, 25 bp, Rattus norvegicus
gaatatctgcagattggtgccacca

SEQ ID NO: 308039 - DNA, 25 bp, Rattus norvegicus
gaatatctgcagtttggtgccacca

SEQ ID NO: 308040 - DNA, 25 bp, Rattus norvegicus
gaatatcttcagacagggatgctta

SEQ ID NO: 308041 - DNA, 25 bp, Rattus norvegicus
gaatatcttcagatttcctccttcc

SEQ ID NO: 308042 - DNA, 25 bp, Rattus norvegicus
gaatatcttcagtcagggatgctta

SEQ ID NO: 308043 - DNA, 25 bp, Rattus norvegicus
gaatatcttcagttttcctccttcc

SEQ ID NO: 308044 - DNA, 25 bp, Rattus norvegicus
gaatatcttgtccttagaaccagtt

SEQ ID NO: 308045 - DNA, 25 bp, Rattus norvegicus
gaatatcttgtcgttagaaccagtt

SEQ ID NO: 308046 - DNA, 25 bp, Rattus norvegicus
gaatatctttccagtcttcttagta

SEQ ID NO: 308047 - DNA, 25 bp, Rattus norvegicus
gaatatctttcctgtcttcttagta

SEQ ID NO: 308048 - DNA, 25 bp, Rattus norvegicus
gaatatctttctctggtgatggctt

SEQ ID NO: 308049 - DNA, 25 bp, Rattus norvegicus
gaatatctttctgtggtgatggctt

SEQ ID NO: 308050 - DNA, 25 bp, Rattus norvegicus
gaatatgaggagattacgcccctgc

SEQ ID NO: 308051 - DNA, 25 bp, Rattus norvegicus
gaatatgaggagtttacgcccctgc

SEQ ID NO: 308052 - DNA, 25 bp, Rattus norvegicus
gaatatgagggtatcccatccgtac

SEQ ID NO: 308053 - DNA, 25 bp, Rattus norvegicus
gaatatgagggtttcccatccgtac

SEQ ID NO: 308054 - DNA, 25 bp, Rattus norvegicus
gaatatgaggttcactaatgtaggt

SEQ ID NO: 308055 - DNA, 25 bp, Rattus norvegicus
gaatatgaggttgactaatgtaggt

SEQ ID NO: 308056 - DNA, 25 bp, Rattus norvegicus
gaatatgataccattggtgaactaa

SEQ ID NO: 308057 - DNA, 25 bp, Rattus norvegicus
gaatatgatacctttggtgaactaa

SEQ ID NO: 308058 - DNA, 25 bp, Rattus norvegicus
gaatatgatatccacttacccatga

SEQ ID NO: 308059 - DNA, 25 bp, Rattus norvegicus
gaatatgatatcgacttacccatga

SEQ ID NO: 308060 - DNA, 25 bp, Rattus norvegicus
gaatatgcaccgatacctcgcagat

SEQ ID NO: 308061 - DNA, 25 bp, Rattus norvegicus
gaatatgcaccgttacctcgcagat

SEQ ID NO: 308062 - DNA, 25 bp, Rattus norvegicus
gaatatgcagatcagcggcttcgga

SEQ ID NO: 308063 - DNA, 25 bp, Rattus norvegicus
gaatatgcagatgagcggcttcgga

SEQ ID NO: 308064 - DNA, 25 bp, Rattus norvegicus
gaatatgcagttatggtgtccttcc

SEQ ID NO: 308065 - DNA, 25 bp, Rattus norvegicus
gaatatgcagttcacccaaggcctt

SEQ ID NO: 308066 - DNA, 25 bp, Rattus norvegicus
gaatatgcagttgacccaaggcctt

SEQ ID NO: 308067 - DNA, 25 bp, Rattus norvegicus
gaatatgcagttttggtgtccttcc

SEQ ID NO: 308068 - DNA, 25 bp, Rattus norvegicus
gaatatgcatctacacacaacactg

SEQ ID NO: 308069 - DNA, 25 bp, Rattus norvegicus
gaatatgcatcttcacacaacactg

SEQ ID NO: 308070 - DNA, 25 bp, Rattus norvegicus
gaatatgcatttaacctttgggaat

SEQ ID NO: 308071 - DNA, 25 bp, Rattus norvegicus
gaatatgcattttacctttgggaat

SEQ ID NO: 308072 - DNA, 25 bp, Rattus norvegicus
gaatatgccattcttcatctacgtg

SEQ ID NO: 308073 - DNA, 25 bp, Rattus norvegicus
gaatatgccattgttcatctacgtg

SEQ ID NO: 308074 - DNA, 25 bp, Rattus norvegicus
gaatatgcccatctggacgctgtaa

SEQ ID NO: 308075 - DNA, 25 bp, Rattus norvegicus
gaatatgcccatgtggacgctgtaa

SEQ ID NO: 308076 - DNA, 25 bp, Rattus norvegicus
gaatatgccccaatatgactactga

SEQ ID NO: 308077 - DNA, 25 bp, Rattus norvegicus
gaatatgccccattatgactactga

SEQ ID NO: 308078 - DNA, 25 bp, Rattus norvegicus
gaatatgccctacgacctgtgtgat

SEQ ID NO: 308079 - DNA, 25 bp, Rattus norvegicus
gaatatgccctaggacctgtgtgat

SEQ ID NO: 308080 - DNA, 25 bp, Rattus norvegicus
gaatatgctgttactctcaggagct

SEQ ID NO: 308081 - DNA, 25 bp, Rattus norvegicus
gaatatgctgtttctctcaggagct

SEQ ID NO: 308082 - DNA, 25 bp, Rattus norvegicus
gaatatgctttcacagcgcaccttg

SEQ ID NO: 308083 - DNA, 25 bp, Rattus norvegicus
gaatatgctttcactgcttcgacag

SEQ ID NO: 308084 - DNA, 25 bp, Rattus norvegicus
gaatatgctttctcagcgcaccttg

SEQ ID NO: 308085 - DNA, 25 bp, Rattus norvegicus
gaatatgctttctctgcttcgacag

SEQ ID NO: 308086 - DNA, 25 bp, Rattus norvegicus
gaatatggacctcgaactttagata

SEQ ID NO: 308087 - DNA, 25 bp, Rattus norvegicus
gaatatggacctggaactttagata

SEQ ID NO: 308088 - DNA, 25 bp, Rattus norvegicus
gaatatggatggagtaacggacccc

SEQ ID NO: 308089 - DNA, 25 bp, Rattus norvegicus
gaatatggatggtgtaacggacccc

SEQ ID NO: 308090 - DNA, 25 bp, Rattus norvegicus
gaatatggctctatatgccgacgtt

SEQ ID NO: 308091 - DNA, 25 bp, Rattus norvegicus
gaatatggctctttatgccgacgtt

SEQ ID NO: 308092 - DNA, 25 bp, Rattus norvegicus
gaatatgggaagctttttaatacct

SEQ ID NO: 308093 - DNA, 25 bp, Rattus norvegicus
gaatatgggaaggtttttaatacct

SEQ ID NO: 308094 - DNA, 25 bp, Rattus norvegicus
gaatatgggcctaagtcctgctgac

SEQ ID NO: 308095 - DNA, 25 bp, Rattus norvegicus
gaatatgggccttagtcctgctgac

SEQ ID NO: 308096 - DNA, 25 bp, Rattus norvegicus
gaatatgggcttacaggtcacactt

SEQ ID NO: 308097 - DNA, 25 bp, Rattus norvegicus
gaatatgggctttcaggtcacactt

SEQ ID NO: 308098 - DNA, 25 bp, Rattus norvegicus
gaatatgggttcatagacgcccgcc

SEQ ID NO: 308099 - DNA, 25 bp, Rattus norvegicus
gaatatgggttcttagacgcccgcc

SEQ ID NO: 308100 - DNA, 25 bp, Rattus norvegicus
gaatatggtgctatctaccccttta

SEQ ID NO: 308101 - DNA, 25 bp, Rattus norvegicus
gaatatggtgctttctaccccttta

SEQ ID NO: 308102 - DNA, 25 bp, Rattus norvegicus
gaatatggtggtctccttcgaagat

SEQ ID NO: 308103 - DNA, 25 bp, Rattus norvegicus
gaatatggtggtgtccttcgaagat

SEQ ID NO: 308104 - DNA, 25 bp, Rattus norvegicus
gaatatggtgtcaatttttcctccc

SEQ ID NO: 308105 - DNA, 25 bp, Rattus norvegicus
gaatatggtgtctatttttcctccc

SEQ ID NO: 308106 - DNA, 25 bp, Rattus norvegicus
gaatatgtccatacgcagaagctcg

SEQ ID NO: 308107 - DNA, 25 bp, Rattus norvegicus
gaatatgtccattcgcagaagctcg

SEQ ID NO: 308108 - DNA, 25 bp, Rattus norvegicus
gaatatgtccggcattatccccggg

SEQ ID NO: 308109 - DNA, 25 bp, Rattus norvegicus
gaatatgtccgggattatccccggg

SEQ ID NO: 308110 - DNA, 25 bp, Rattus norvegicus
gaatatgtcgaacatctggccaaaa

SEQ ID NO: 308111 - DNA, 25 bp, Rattus norvegicus
gaatatgtcgaagatctggccaaaa

SEQ ID NO: 308112 - DNA, 25 bp, Rattus norvegicus
gaatatgtctatagagtatctctgt

SEQ ID NO: 308113 - DNA, 25 bp, Rattus norvegicus
gaatatgtctattgagtatctctgt

SEQ ID NO: 308114 - DNA, 25 bp, Rattus norvegicus
gaatatgtgctacctgatttccaag

SEQ ID NO: 308115 - DNA, 25 bp, Rattus norvegicus
gaatatgtgctagctgatttccaag

SEQ ID NO: 308116 - DNA, 25 bp, Rattus norvegicus
gaatatgtgttcaagggtggatccc

SEQ ID NO: 308117 - DNA, 25 bp, Rattus norvegicus
gaatatgtgttctagggtggatccc

SEQ ID NO: 308118 - DNA, 25 bp, Rattus norvegicus
gaatatgttaacattgtccccaccc

SEQ ID NO: 308119 - DNA, 25 bp, Rattus norvegicus
gaatatgttaactttgtccccaccc

SEQ ID NO: 308120 - DNA, 25 bp, Rattus norvegicus
gaatatgttcagcatctgctcggcc

SEQ ID NO: 308121 - DNA, 25 bp, Rattus norvegicus
gaatatgttcaggatctgctcggcc

SEQ ID NO: 308122 - DNA, 25 bp, Rattus norvegicus
gaatatgttcccatcattaagtgat

SEQ ID NO: 308123 - DNA, 25 bp, Rattus norvegicus
gaatatgttcccttcattaagtgat

SEQ ID NO: 308124 - DNA, 25 bp, Rattus norvegicus
gaatatgttggtcaagagcctaccc

SEQ ID NO: 308125 - DNA, 25 bp, Rattus norvegicus
gaatatgttggtgaagagcctaccc

SEQ ID NO: 308126 - DNA, 25 bp, Rattus norvegicus
gaatatgtttaactcagcaagtgct

SEQ ID NO: 308127 - DNA, 25 bp, Rattus norvegicus
gaatatgtttaagtcagcaagtgct

SEQ ID NO: 308128 - DNA, 25 bp, Rattus norvegicus
gaatattaaaataatgtctccccgg

SEQ ID NO: 308129 - DNA, 25 bp, Rattus norvegicus
gaatattaaaattatgtctccccgg

SEQ ID NO: 308130 - DNA, 25 bp, Rattus norvegicus
gaatattaactcctgccagcaggtg

SEQ ID NO: 308131 - DNA, 25 bp, Rattus norvegicus
gaatattaactcgtgccagcaggtg

SEQ ID NO: 308132 - DNA, 25 bp, Rattus norvegicus
gaatattaattcactggaagtggaa

SEQ ID NO: 308133 - DNA, 25 bp, Rattus norvegicus
gaatattaattctctggaagtggaa

SEQ ID NO: 308134 - DNA, 25 bp, Rattus norvegicus
gaatattacaatctaccacctcaac

SEQ ID NO: 308135 - DNA, 25 bp, Rattus norvegicus
gaatattacaatgtaccacctcaac

SEQ ID NO: 308136 - DNA, 25 bp, Rattus norvegicus
gaatattacttccttctacccagcc

SEQ ID NO: 308137 - DNA, 25 bp, Rattus norvegicus
gaatattacttcgttctacccagcc

SEQ ID NO: 308138 - DNA, 25 bp, Rattus norvegicus
gaatattaggcacgcgcctgaccac

SEQ ID NO: 308139 - DNA, 25 bp, Rattus norvegicus
gaatattaggcaggcgcctgaccac

SEQ ID NO: 308140 - DNA, 25 bp, Rattus norvegicus
gaatattagtgcatactccttccta

SEQ ID NO: 308141 - DNA, 25 bp, Rattus norvegicus
gaatattagtgcttactccttccta

SEQ ID NO: 308142 - DNA, 25 bp, Rattus norvegicus
gaatattatcccaaacacctgccac

SEQ ID NO: 308143 - DNA, 25 bp, Rattus norvegicus
gaatattatccctaacacctgccac

SEQ ID NO: 308144 - DNA, 25 bp, Rattus norvegicus
gaatattcagcaccaggacttcaga

SEQ ID NO: 308145 - DNA, 25 bp, Rattus norvegicus
gaatattcagcagcaggacttcaga

SEQ ID NO: 308146 - DNA, 25 bp, Rattus norvegicus
gaatattcatctcacaacaccagta

SEQ ID NO: 308147 - DNA, 25 bp, Rattus norvegicus
gaatattcatctgacaacaccagta

SEQ ID NO: 308148 - DNA, 25 bp, Rattus norvegicus
gaatattcccgacgtcctggatgca

SEQ ID NO: 308149 - DNA, 25 bp, Rattus norvegicus
gaatattcccgaggtcctggatgca

SEQ ID NO: 308150 - DNA, 25 bp, Rattus norvegicus
gaatattccctactctgaaactcat

SEQ ID NO: 308151 - DNA, 25 bp, Rattus norvegicus
gaatattccctagtctgaaactcat

SEQ ID NO: 308152 - DNA, 25 bp, Rattus norvegicus
gaatattcccttagtattgagtgga

SEQ ID NO: 308153 - DNA, 25 bp, Rattus norvegicus
gaatattccctttgtattgagtgga

SEQ ID NO: 308154 - DNA, 25 bp, Rattus norvegicus
gaatattcctaactccatgtcccaa

SEQ ID NO: 308155 - DNA, 25 bp, Rattus norvegicus
gaatattcctaagtccatgtcccaa

SEQ ID NO: 308156 - DNA, 25 bp, Rattus norvegicus
gaatattcctggagggacctcttca

SEQ ID NO: 308157 - DNA, 25 bp, Rattus norvegicus
gaatattcctggtgggacctcttca

SEQ ID NO: 308158 - DNA, 25 bp, Rattus norvegicus
gaatattccttgatagcaagctcca

SEQ ID NO: 308159 - DNA, 25 bp, Rattus norvegicus
gaatattccttgttagcaagctcca

SEQ ID NO: 308160 - DNA, 25 bp, Rattus norvegicus
gaatattcctttcatctgggcaatc

SEQ ID NO: 308161 - DNA, 25 bp, Rattus norvegicus
gaatattcctttcttgagacctaag

SEQ ID NO: 308162 - DNA, 25 bp, Rattus norvegicus
gaatattcctttgatctgggcaatc

SEQ ID NO: 308163 - DNA, 25 bp, Rattus norvegicus
gaatattcctttgttgagacctaag

SEQ ID NO: 308164 - DNA, 25 bp, Rattus norvegicus
gaatattcgaagagctcagtgctga

SEQ ID NO: 308165 - DNA, 25 bp, Rattus norvegicus
gaatattcgaagtgctcagtgctga

SEQ ID NO: 308166 - DNA, 25 bp, Rattus norvegicus
gaatattctcatagctatcaccctc

SEQ ID NO: 308167 - DNA, 25 bp, Rattus norvegicus
gaatattctcattgctatcaccctc

SEQ ID NO: 308168 - DNA, 25 bp, Rattus norvegicus
gaatattctccgatttaccctcaat

SEQ ID NO: 308169 - DNA, 25 bp, Rattus norvegicus
gaatattctccgttttaccctcaat

SEQ ID NO: 308170 - DNA, 25 bp, Rattus norvegicus
gaatattctcctcacagtcaacatc

SEQ ID NO: 308171 - DNA, 25 bp, Rattus norvegicus
gaatattctcctgacagtcaacatc

SEQ ID NO: 308172 - DNA, 25 bp, Rattus norvegicus
gaatattctcttacctagccagatg

SEQ ID NO: 308173 - DNA, 25 bp, Rattus norvegicus
gaatattctctttcctagccagatg

SEQ ID NO: 308174 - DNA, 25 bp, Rattus norvegicus
gaatattctggaacctgggctcttt

SEQ ID NO: 308175 - DNA, 25 bp, Rattus norvegicus
gaatattctggatcctgggctcttt

SEQ ID NO: 308176 - DNA, 25 bp, Rattus norvegicus
gaatattctgtacgcactagggaac

SEQ ID NO: 308177 - DNA, 25 bp, Rattus norvegicus
gaatattctgtactttctgcaggtg

SEQ ID NO: 308178 - DNA, 25 bp, Rattus norvegicus
gaatattctgtaggcactagggaac

SEQ ID NO: 308179 - DNA, 25 bp, Rattus norvegicus
gaatattctgtagtttctgcaggtg

SEQ ID NO: 308180 - DNA, 25 bp, Rattus norvegicus
gaatattctgtgaacctggctgtag

SEQ ID NO: 308181 - DNA, 25 bp, Rattus norvegicus
gaatattctgtgctgcaacacgcag

SEQ ID NO: 308182 - DNA, 25 bp, Rattus norvegicus
gaatattctgtggtgcaacacgcag

SEQ ID NO: 308183 - DNA, 25 bp, Rattus norvegicus
gaatattctgtgtacctggctgtag

SEQ ID NO: 308184 - DNA, 25 bp, Rattus norvegicus
gaatattgaaggaccctgcggcaga

SEQ ID NO: 308185 - DNA, 25 bp, Rattus norvegicus
gaatattgaaggtccctgcggcaga

SEQ ID NO: 308186 - DNA, 25 bp, Rattus norvegicus
gaatattgaattccagggccacctg

SEQ ID NO: 308187 - DNA, 25 bp, Rattus norvegicus
gaatattgaattgcagggccacctg

SEQ ID NO: 308188 - DNA, 25 bp, Rattus norvegicus
gaatattgaccccttgaagccggag

SEQ ID NO: 308189 - DNA, 25 bp, Rattus norvegicus
gaatattgacccgttgaagccggag

SEQ ID NO: 308190 - DNA, 25 bp, Rattus norvegicus
gaatattgagtgatcaggctctatt

SEQ ID NO: 308191 - DNA, 25 bp, Rattus norvegicus
gaatattgagtgttcaggctctatt

SEQ ID NO: 308192 - DNA, 25 bp, Rattus norvegicus
gaatattgcagtaatccttccagct

SEQ ID NO: 308193 - DNA, 25 bp, Rattus norvegicus
gaatattgcagttatccttccagct

SEQ ID NO: 308194 - DNA, 25 bp, Rattus norvegicus
gaatattggctgacactgcctagtc

SEQ ID NO: 308195 - DNA, 25 bp, Rattus norvegicus
gaatattggctgtcactgcctagtc

SEQ ID NO: 308196 - DNA, 25 bp, Rattus norvegicus
gaatattggtctctaccaccacatt

SEQ ID NO: 308197 - DNA, 25 bp, Rattus norvegicus
gaatattggtctgtaccaccacatt

SEQ ID NO: 308198 - DNA, 25 bp, Rattus norvegicus
gaatattgtcacagtctctcagctt

SEQ ID NO: 308199 - DNA, 25 bp, Rattus norvegicus
gaatattgtcactgtctctcagctt

SEQ ID NO: 308200 - DNA, 25 bp, Rattus norvegicus
gaatattgttcactgcaagctggaa

SEQ ID NO: 308201 - DNA, 25 bp, Rattus norvegicus
gaatattgttcagtgcaagctggaa

SEQ ID NO: 308202 - DNA, 25 bp, Rattus norvegicus
gaatattgtttgatttgatcccaga

SEQ ID NO: 308203 - DNA, 25 bp, Rattus norvegicus
gaatattgtttgttttgatcccaga

SEQ ID NO: 308204 - DNA, 25 bp, Rattus norvegicus
gaatatttcctgagctttgaacttg

SEQ ID NO: 308205 - DNA, 25 bp, Rattus norvegicus
gaatatttcctgtgctttgaacttg

SEQ ID NO: 308206 - DNA, 25 bp, Rattus norvegicus
gaatatttgacaaggtactcacctt

SEQ ID NO: 308207 - DNA, 25 bp, Rattus norvegicus
gaatatttgacatggtactcacctt

SEQ ID NO: 308208 - DNA, 25 bp, Rattus norvegicus
gaatatttgctaaaattgtgcctgc

SEQ ID NO: 308209 - DNA, 25 bp, Rattus norvegicus
gaatatttgctataattgtgcctgc

SEQ ID NO: 308210 - DNA, 25 bp, Rattus norvegicus
gaatatttgctgctttagtcaaagg

SEQ ID NO: 308211 - DNA, 25 bp, Rattus norvegicus
gaatatttgctggtttagtcaaagg

SEQ ID NO: 308212 - DNA, 25 bp, Rattus norvegicus
gaatatttggatccctctactaaac

SEQ ID NO: 308213 - DNA, 25 bp, Rattus norvegicus
gaatatttggatgcctctactaaac

SEQ ID NO: 308214 - DNA, 25 bp, Rattus norvegicus
gaatatttgggtctgctcttaagat

SEQ ID NO: 308215 - DNA, 25 bp, Rattus norvegicus
gaatatttgggtgtgctcttaagat

SEQ ID NO: 308216 - DNA, 25 bp, Rattus norvegicus
gaatatttggttactgcattgacta

SEQ ID NO: 308217 - DNA, 25 bp, Rattus norvegicus
gaatatttggtttctgcattgacta

SEQ ID NO: 308218 - DNA, 25 bp, Rattus norvegicus
gaatattttaacaccatctggcaaa

SEQ ID NO: 308219 - DNA, 25 bp, Rattus norvegicus
gaatattttaacctcacactgcagt

SEQ ID NO: 308220 - DNA, 25 bp, Rattus norvegicus
gaatattttaacgtcacactgcagt

SEQ ID NO: 308221 - DNA, 25 bp, Rattus norvegicus
gaatattttaactccatctggcaaa

SEQ ID NO: 308222 - DNA, 25 bp, Rattus norvegicus
gaatattttcataggttgtctctgt

SEQ ID NO: 308223 - DNA, 25 bp, Rattus norvegicus
gaatattttcattggttgtctctgt

SEQ ID NO: 308224 - DNA, 25 bp, Rattus norvegicus
gaatattttctgcagtcacaagctg

SEQ ID NO: 308225 - DNA, 25 bp, Rattus norvegicus
gaatattttctggagtcacaagctg

SEQ ID NO: 308226 - DNA, 25 bp, Rattus norvegicus
gaatattttgctcggttacactgga

SEQ ID NO: 308227 - DNA, 25 bp, Rattus norvegicus
gaatattttgctgggttacactgga

SEQ ID NO: 308228 - DNA, 25 bp, Rattus norvegicus
gaatattttggcatctaatcccaga

SEQ ID NO: 308229 - DNA, 25 bp, Rattus norvegicus
gaatattttggcttctaatcccaga

SEQ ID NO: 308230 - DNA, 25 bp, Rattus norvegicus
gaatatttttcactgaccactcaaa

SEQ ID NO: 308231 - DNA, 25 bp, Rattus norvegicus
gaatatttttcagtgaccactcaaa

SEQ ID NO: 308232 - DNA, 25 bp, Rattus norvegicus
gaatatttttgtatctagctatggg

SEQ ID NO: 308233 - DNA, 25 bp, Rattus norvegicus
gaatatttttgtcagcctttcttag

SEQ ID NO: 308234 - DNA, 25 bp, Rattus norvegicus
gaatatttttgtgagcctttcttag

SEQ ID NO: 308235 - DNA, 25 bp, Rattus norvegicus
gaatatttttgtttctagctatggg

SEQ ID NO: 308236 - DNA, 25 bp, Rattus norvegicus
gaatcaaaaccccactttgtcaagc

SEQ ID NO: 308237 - DNA, 25 bp, Rattus norvegicus
gaatcaaaacccgactttgtcaagc

SEQ ID NO: 308238 - DNA, 25 bp, Rattus norvegicus
gaatcaaaatcgaccacaggccaga

SEQ ID NO: 308239 - DNA, 25 bp, Rattus norvegicus
gaatcaaaatcgtccacaggccaga

SEQ ID NO: 308240 - DNA, 25 bp, Rattus norvegicus
gaatcaaacagccaggagccaagag

SEQ ID NO: 308241 - DNA, 25 bp, Rattus norvegicus
gaatcaaacagcgaggagccaagag

SEQ ID NO: 308242 - DNA, 25 bp, Rattus norvegicus
gaatcaaaccttatctatttccgct

SEQ ID NO: 308243 - DNA, 25 bp, Rattus norvegicus
gaatcaaaccttttctatttccgct

SEQ ID NO: 308244 - DNA, 25 bp, Rattus norvegicus
gaatcaaactttacgggaggcctat

SEQ ID NO: 308245 - DNA, 25 bp, Rattus norvegicus
gaatcaaactttcgcgacgccgagt

SEQ ID NO: 308246 - DNA, 25 bp, Rattus norvegicus
gaatcaaactttggcgacgccgagt

SEQ ID NO: 308247 - DNA, 25 bp, Rattus norvegicus
gaatcaaacttttcgggaggcctat

SEQ ID NO: 308248 - DNA, 25 bp, Rattus norvegicus
gaatcaaagaaaccctccagtgcct

SEQ ID NO: 308249 - DNA, 25 bp, Rattus norvegicus
gaatcaaagaaagcctccagtgcct

SEQ ID NO: 308250 - DNA, 25 bp, Rattus norvegicus
gaatcaaagacaccatcacatccta

SEQ ID NO: 308251 - DNA, 25 bp, Rattus norvegicus
gaatcaaagacagcatcacatccta

SEQ ID NO: 308252 - DNA, 25 bp, Rattus norvegicus
gaatcaaaggcaacccaaacaacgt

SEQ ID NO: 308253 - DNA, 25 bp, Rattus norvegicus
gaatcaaaggcatcccaaacaacgt

SEQ ID NO: 308254 - DNA, 25 bp, Rattus norvegicus
gaatcaaatcaactgcccatccgtc

SEQ ID NO: 308255 - DNA, 25 bp, Rattus norvegicus
gaatcaaatcaagtgcccatccgtc

SEQ ID NO: 308256 - DNA, 25 bp, Rattus norvegicus
gaatcaaatggccacgcagtcccgg

SEQ ID NO: 308257 - DNA, 25 bp, Rattus norvegicus
gaatcaaatggcgacgcagtcccgg

SEQ ID NO: 308258 - DNA, 25 bp, Rattus norvegicus
gaatcaaatgtgagtcctaccatga

SEQ ID NO: 308259 - DNA, 25 bp, Rattus norvegicus
gaatcaaatgtgtgtcctaccatga

SEQ ID NO: 308260 - DNA, 25 bp, Rattus norvegicus
gaatcaaattccaggactgccggcc

SEQ ID NO: 308261 - DNA, 25 bp, Rattus norvegicus
gaatcaaattcctggactgccggcc

SEQ ID NO: 308262 - DNA, 25 bp, Rattus norvegicus
gaatcaacagtgctttcctgggccc

SEQ ID NO: 308263 - DNA, 25 bp, Rattus norvegicus
gaatcaacagtggtttcctgggccc

SEQ ID NO: 308264 - DNA, 25 bp, Rattus norvegicus
gaatcaacattcctgctggtaacca

SEQ ID NO: 308265 - DNA, 25 bp, Rattus norvegicus
gaatcaacattcgtgctggtaacca

SEQ ID NO: 308266 - DNA, 25 bp, Rattus norvegicus
gaatcaaccagtacgatttctttct

SEQ ID NO: 308267 - DNA, 25 bp, Rattus norvegicus
gaatcaaccagttcgatttctttct

SEQ ID NO: 308268 - DNA, 25 bp, Rattus norvegicus
gaatcaacccgacacttttcaagaa

SEQ ID NO: 308269 - DNA, 25 bp, Rattus norvegicus
gaatcaacccgagacttttcaagaa

SEQ ID NO: 308270 - DNA, 25 bp, Rattus norvegicus
gaatcaacctttctaccttaatgtc

SEQ ID NO: 308271 - DNA, 25 bp, Rattus norvegicus
gaatcaacctttgtaccttaatgtc

SEQ ID NO: 308272 - DNA, 25 bp, Rattus norvegicus
gaatcaacgcctaactctaatcaat

SEQ ID NO: 308273 - DNA, 25 bp, Rattus norvegicus
gaatcaacgccttactctaatcaat

SEQ ID NO: 308274 - DNA, 25 bp, Rattus norvegicus
gaatcaacgcttaaatatccacaac

SEQ ID NO: 308275 - DNA, 25 bp, Rattus norvegicus
gaatcaacgctttaatatccacaac

SEQ ID NO: 308276 - DNA, 25 bp, Rattus norvegicus
gaatcaactcccacaagtcctatga

SEQ ID NO: 308277 - DNA, 25 bp, Rattus norvegicus
gaatcaactccctcaagtcctatga

SEQ ID NO: 308278 - DNA, 25 bp, Rattus norvegicus
gaatcaactcgaccttcatgctgac

SEQ ID NO: 308279 - DNA, 25 bp, Rattus norvegicus
gaatcaactcgagcttcatgctgac

SEQ ID NO: 308280 - DNA, 25 bp, Rattus norvegicus
gaatcaactgacaccaaaatttcct

SEQ ID NO: 308281 - DNA, 25 bp, Rattus norvegicus
gaatcaactgactccaaaatttcct

SEQ ID NO: 308282 - DNA, 25 bp, Rattus norvegicus
gaatcaacttatcggtttcctctgc

SEQ ID NO: 308283 - DNA, 25 bp, Rattus norvegicus
gaatcaacttatgggtttcctctgc

SEQ ID NO: 308284 - DNA, 25 bp, Rattus norvegicus
gaatcaacttgcatcctagcagctc

SEQ ID NO: 308285 - DNA, 25 bp, Rattus norvegicus
gaatcaacttgcttcctagcagctc

SEQ ID NO: 308286 - DNA, 25 bp, Rattus norvegicus
gaatcaagaatacttcccctacgac

SEQ ID NO: 308287 - DNA, 25 bp, Rattus norvegicus
gaatcaagaatagttcccctacgac

SEQ ID NO: 308288 - DNA, 25 bp, Rattus norvegicus
gaatcaagacccagtaattccagta

SEQ ID NO: 308289 - DNA, 25 bp, Rattus norvegicus
gaatcaagaccctgtaattccagta

SEQ ID NO: 308290 - DNA, 25 bp, Rattus norvegicus
gaatcaagagcccaagtgatctggc

SEQ ID NO: 308291 - DNA, 25 bp, Rattus norvegicus
gaatcaagagccgaagtgatctggc

SEQ ID NO: 308292 - DNA, 25 bp, Rattus norvegicus
gaatcaagagttcccaacactgtgt

SEQ ID NO: 308293 - DNA, 25 bp, Rattus norvegicus
gaatcaagagttgccaacactgtgt

SEQ ID NO: 308294 - DNA, 25 bp, Rattus norvegicus
gaatcaagatcaccaggtgttctaa

SEQ ID NO: 308295 - DNA, 25 bp, Rattus norvegicus
gaatcaagatcagcaggtgttctaa

SEQ ID NO: 308296 - DNA, 25 bp, Rattus norvegicus
gaatcaagatgtctggttccaggac

SEQ ID NO: 308297 - DNA, 25 bp, Rattus norvegicus
gaatcaagatgtgtggttccaggac

SEQ ID NO: 308298 - DNA, 25 bp, Rattus norvegicus
gaatcaagcaacatccgaaacattg

SEQ ID NO: 308299 - DNA, 25 bp, Rattus norvegicus
gaatcaagcaacttccgaaacattg

SEQ ID NO: 308300 - DNA, 25 bp, Rattus norvegicus
gaatcaaggctcaggtttttcccca

SEQ ID NO: 308301 - DNA, 25 bp, Rattus norvegicus
gaatcaaggctctggtttttcccca

SEQ ID NO: 308302 - DNA, 25 bp, Rattus norvegicus
gaatcaaggctgaccgtgctttctt

SEQ ID NO: 308303 - DNA, 25 bp, Rattus norvegicus
gaatcaaggctgtccgtgctttctt

SEQ ID NO: 308304 - DNA, 25 bp, Rattus norvegicus
gaatcaagtcgcagccctggatgca

SEQ ID NO: 308305 - DNA, 25 bp, Rattus norvegicus
gaatcaagtcgctgccctggatgca

SEQ ID NO: 308306 - DNA, 25 bp, Rattus norvegicus
gaatcaatctagagtgcatctgtag

SEQ ID NO: 308307 - DNA, 25 bp, Rattus norvegicus
gaatcaatctagtgtgcatctgtag

SEQ ID NO: 308308 - DNA, 25 bp, Rattus norvegicus
gaatcaatgacaacagcctcggaga

SEQ ID NO: 308309 - DNA, 25 bp, Rattus norvegicus
gaatcaatgacatcagcctcggaga

SEQ ID NO: 308310 - DNA, 25 bp, Rattus norvegicus
gaatcaatggtacaagactttccct

SEQ ID NO: 308311 - DNA, 25 bp, Rattus norvegicus
gaatcaatggtagaagactttccct

SEQ ID NO: 308312 - DNA, 25 bp, Rattus norvegicus
gaatcaatgtagaactgctttgttt

SEQ ID NO: 308313 - DNA, 25 bp, Rattus norvegicus
gaatcaatgtagtactgctttgttt

SEQ ID NO: 308314 - DNA, 25 bp, Rattus norvegicus
gaatcaattggcactagaccctcaa

SEQ ID NO: 308315 - DNA, 25 bp, Rattus norvegicus
gaatcaattggctctagaccctcaa

SEQ ID NO: 308316 - DNA, 25 bp, Rattus norvegicus
gaatcacaacaaagaggtgactgta

SEQ ID NO: 308317 - DNA, 25 bp, Rattus norvegicus
gaatcacaacaatgaggtgactgta

SEQ ID NO: 308318 - DNA, 25 bp, Rattus norvegicus
gaatcacaactgcatctctccaggc

SEQ ID NO: 308319 - DNA, 25 bp, Rattus norvegicus
gaatcacaactggatctctccaggc

SEQ ID NO: 308320 - DNA, 25 bp, Rattus norvegicus
gaatcacaattccacgactgctttg

SEQ ID NO: 308321 - DNA, 25 bp, Rattus norvegicus
gaatcacaattcgacgactgctttg

SEQ ID NO: 308322 - DNA, 25 bp, Rattus norvegicus
gaatcacacagaagctccgtggatg

SEQ ID NO: 308323 - DNA, 25 bp, Rattus norvegicus
gaatcacacagatgctccgtggatg

SEQ ID NO: 308324 - DNA, 25 bp, Rattus norvegicus
gaatcacacaggaggttctggtttg

SEQ ID NO: 308325 - DNA, 25 bp, Rattus norvegicus
gaatcacacaggtggttctggtttg

SEQ ID NO: 308326 - DNA, 25 bp, Rattus norvegicus
gaatcacaccgcatttgtttggtta

SEQ ID NO: 308327 - DNA, 25 bp, Rattus norvegicus
gaatcacaccgcttttgtttggtta

SEQ ID NO: 308328 - DNA, 25 bp, Rattus norvegicus
gaatcacacggaaacctgcttctgt

SEQ ID NO: 308329 - DNA, 25 bp, Rattus norvegicus
gaatcacacggatacctgcttctgt

SEQ ID NO: 308330 - DNA, 25 bp, Rattus norvegicus
gaatcacagcctatgacggaaggtt

SEQ ID NO: 308331 - DNA, 25 bp, Rattus norvegicus
gaatcacagcctttgacggaaggtt

SEQ ID NO: 308332 - DNA, 25 bp, Rattus norvegicus
gaatcacagcgaaatttctccttgc

SEQ ID NO: 308333 - DNA, 25 bp, Rattus norvegicus
gaatcacagcgatatttctccttgc

SEQ ID NO: 308334 - DNA, 25 bp, Rattus norvegicus
gaatcacagctcaaattctggagag

SEQ ID NO: 308335 - DNA, 25 bp, Rattus norvegicus
gaatcacagctctaattctggagag

SEQ ID NO: 308336 - DNA, 25 bp, Rattus norvegicus
gaatcacatactcaatttgtaaacc

SEQ ID NO: 308337 - DNA, 25 bp, Rattus norvegicus
gaatcacatactgaatttgtaaacc

SEQ ID NO: 308338 - DNA, 25 bp, Rattus norvegicus
gaatcacatgtcagacttccggatc

SEQ ID NO: 308339 - DNA, 25 bp, Rattus norvegicus
gaatcacatgtctgacttccggatc

SEQ ID NO: 308340 - DNA, 25 bp, Rattus norvegicus
gaatcaccacagactttcttcttca

SEQ ID NO: 308341 - DNA, 25 bp, Rattus norvegicus
gaatcaccacagtctttcttcttca

SEQ ID NO: 308342 - DNA, 25 bp, Rattus norvegicus
gaatcaccaccactactgtaacttg

SEQ ID NO: 308343 - DNA, 25 bp, Rattus norvegicus
gaatcaccaccagtactgtaacttg

SEQ ID NO: 308344 - DNA, 25 bp, Rattus norvegicus
gaatcaccactgagtctattttatg

SEQ ID NO: 308345 - DNA, 25 bp, Rattus norvegicus
gaatcaccactgtgtctattttatg

SEQ ID NO: 308346 - DNA, 25 bp, Rattus norvegicus
gaatcaccagcaccaggtgtcccaa

SEQ ID NO: 308347 - DNA, 25 bp, Rattus norvegicus
gaatcaccagcagcaggtgtcccaa

SEQ ID NO: 308348 - DNA, 25 bp, Rattus norvegicus
gaatcaccatcaaatccaacagcgt

SEQ ID NO: 308349 - DNA, 25 bp, Rattus norvegicus
gaatcaccatcaaggcaatcccagg

SEQ ID NO: 308350 - DNA, 25 bp, Rattus norvegicus
gaatcaccatcatatccaacagcgt

SEQ ID NO: 308351 - DNA, 25 bp, Rattus norvegicus
gaatcaccatcatggcaatcccagg

SEQ ID NO: 308352 - DNA, 25 bp, Rattus norvegicus
gaatcaccatctcacaaacatacct

SEQ ID NO: 308353 - DNA, 25 bp, Rattus norvegicus
gaatcaccatctgacaaacatacct

SEQ ID NO: 308354 - DNA, 25 bp, Rattus norvegicus
gaatcaccatttccagctcttgtgg

SEQ ID NO: 308355 - DNA, 25 bp, Rattus norvegicus
gaatcaccatttgcagctcttgtgg

SEQ ID NO: 308356 - DNA, 25 bp, Rattus norvegicus
gaatcacccaaaagaactagttcta

SEQ ID NO: 308357 - DNA, 25 bp, Rattus norvegicus
gaatcacccaaatgaactagttcta

SEQ ID NO: 308358 - DNA, 25 bp, Rattus norvegicus
gaatcacccagcaagtcattggtaa

SEQ ID NO: 308359 - DNA, 25 bp, Rattus norvegicus
gaatcacccagctagtcattggtaa

SEQ ID NO: 308360 - DNA, 25 bp, Rattus norvegicus
gaatcacccaggattctgtcgtaga

SEQ ID NO: 308361 - DNA, 25 bp, Rattus norvegicus
gaatcacccaggtttctgtcgtaga

SEQ ID NO: 308362 - DNA, 25 bp, Rattus norvegicus
gaatcaccccggagaatgagcacca

SEQ ID NO: 308363 - DNA, 25 bp, Rattus norvegicus
gaatcaccccggtgaatgagcacca

SEQ ID NO: 308364 - DNA, 25 bp, Rattus norvegicus
gaatcaccgtgtacagacagctggc

SEQ ID NO: 308365 - DNA, 25 bp, Rattus norvegicus
gaatcaccgtgttcagacagctggc

SEQ ID NO: 308366 - DNA, 25 bp, Rattus norvegicus
gaatcacctgtgactatgacccact

SEQ ID NO: 308367 - DNA, 25 bp, Rattus norvegicus
gaatcacctgtgtctatgacccact

SEQ ID NO: 308368 - DNA, 25 bp, Rattus norvegicus
gaatcacctgttagttgatcttggg

SEQ ID NO: 308369 - DNA, 25 bp, Rattus norvegicus
gaatcacctgtttgttgatcttggg

SEQ ID NO: 308370 - DNA, 25 bp, Rattus norvegicus
gaatcaccttagcagagagccccag

SEQ ID NO: 308371 - DNA, 25 bp, Rattus norvegicus
gaatcaccttaggagagagccccag

SEQ ID NO: 308372 - DNA, 25 bp, Rattus norvegicus
gaatcacggtgaaccagacccaggt

SEQ ID NO: 308373 - DNA, 25 bp, Rattus norvegicus
gaatcacggtgatccagacccaggt

SEQ ID NO: 308374 - DNA, 25 bp, Rattus norvegicus
gaatcacgtatgcatttgtcttagg

SEQ ID NO: 308375 - DNA, 25 bp, Rattus norvegicus
gaatcacgtatggatttgtcttagg

SEQ ID NO: 308376 - DNA, 25 bp, Rattus norvegicus
gaatcacgtcgcatattgtgcatgt

SEQ ID NO: 308377 - DNA, 25 bp, Rattus norvegicus
gaatcacgtcgcttattgtgcatgt

SEQ ID NO: 308378 - DNA, 25 bp, Rattus norvegicus
gaatcacgtggaaaatggcacccaa

SEQ ID NO: 308379 - DNA, 25 bp, Rattus norvegicus
gaatcacgtggataatggcacccaa

SEQ ID NO: 308380 - DNA, 25 bp, Rattus norvegicus
gaatcacgtgtaacctgccagttag

SEQ ID NO: 308381 - DNA, 25 bp, Rattus norvegicus
gaatcacgtgtatcctgccagttag

SEQ ID NO: 308382 - DNA, 25 bp, Rattus norvegicus
gaatcactaagaaactggccctcca

SEQ ID NO: 308383 - DNA, 25 bp, Rattus norvegicus
gaatcactaagatactggccctcca

SEQ ID NO: 308384 - DNA, 25 bp, Rattus norvegicus
gaatcactagataatgggtctctgg

SEQ ID NO: 308385 - DNA, 25 bp, Rattus norvegicus
gaatcactagattatgggtctctgg

SEQ ID NO: 308386 - DNA, 25 bp, Rattus norvegicus
gaatcactagctcacattccacact

SEQ ID NO: 308387 - DNA, 25 bp, Rattus norvegicus
gaatcactagctgacattccacact

SEQ ID NO: 308388 - DNA, 25 bp, Rattus norvegicus
gaatcactattgctatcagatgtac

SEQ ID NO: 308389 - DNA, 25 bp, Rattus norvegicus
gaatcactattggtatcagatgtac

SEQ ID NO: 308390 - DNA, 25 bp, Rattus norvegicus
gaatcactcactatcctggacaggt

SEQ ID NO: 308391 - DNA, 25 bp, Rattus norvegicus
gaatcactcactttcctggacaggt

SEQ ID NO: 308392 - DNA, 25 bp, Rattus norvegicus
gaatcactgacacagacttctggac

SEQ ID NO: 308393 - DNA, 25 bp, Rattus norvegicus
gaatcactgacagagacttctggac

SEQ ID NO: 308394 - DNA, 25 bp, Rattus norvegicus
gaatcactgattctatactagctct

SEQ ID NO: 308395 - DNA, 25 bp, Rattus norvegicus
gaatcactgattgtatactagctct

SEQ ID NO: 308396 - DNA, 25 bp, Rattus norvegicus
gaatcactgttaatctttctgccaa

SEQ ID NO: 308397 - DNA, 25 bp, Rattus norvegicus
gaatcactgttattctttctgccaa

SEQ ID NO: 308398 - DNA, 25 bp, Rattus norvegicus
gaatcactgttgctgttgggaccaa

SEQ ID NO: 308399 - DNA, 25 bp, Rattus norvegicus
gaatcactgttggtgttgggaccaa

SEQ ID NO: 308400 - DNA, 25 bp, Rattus norvegicus
gaatcactgtttatagacaccttca

SEQ ID NO: 308401 - DNA, 25 bp, Rattus norvegicus
gaatcactgtttttagacaccttca

SEQ ID NO: 308402 - DNA, 25 bp, Rattus norvegicus
gaatcacttccccttcggagcaggg

SEQ ID NO: 308403 - DNA, 25 bp, Rattus norvegicus
gaatcacttcccgttcggagcaggg

SEQ ID NO: 308404 - DNA, 25 bp, Rattus norvegicus
gaatcacttccgcaaacgtcgtctt

SEQ ID NO: 308405 - DNA, 25 bp, Rattus norvegicus
gaatcacttccggaaacgtcgtctt

SEQ ID NO: 308406 - DNA, 25 bp, Rattus norvegicus
gaatcacttcctcgtgtcatgcaga

SEQ ID NO: 308407 - DNA, 25 bp, Rattus norvegicus
gaatcacttcctggtgtcatgcaga

SEQ ID NO: 308408 - DNA, 25 bp, Rattus norvegicus
gaatcacttcttccagagggtcata

SEQ ID NO: 308409 - DNA, 25 bp, Rattus norvegicus
gaatcacttcttgcagagggtcata

SEQ ID NO: 308410 - DNA, 25 bp, Rattus norvegicus
gaatcacttgggagttgcagtcaaa

SEQ ID NO: 308411 - DNA, 25 bp, Rattus norvegicus
gaatcacttgggtgttgcagtcaaa

SEQ ID NO: 308412 - DNA, 25 bp, Rattus norvegicus
gaatcagaaggcaagcccagcagga

SEQ ID NO: 308413 - DNA, 25 bp, Rattus norvegicus
gaatcagaaggctagcccagcagga

SEQ ID NO: 308414 - DNA, 25 bp, Rattus norvegicus
gaatcagaatcccttattatccatg

SEQ ID NO: 308415 - DNA, 25 bp, Rattus norvegicus
gaatcagaatccgttattatccatg

SEQ ID NO: 308416 - DNA, 25 bp, Rattus norvegicus
gaatcagacaatagagcgcctcaca

SEQ ID NO: 308417 - DNA, 25 bp, Rattus norvegicus
gaatcagacaattgagcgcctcaca

SEQ ID NO: 308418 - DNA, 25 bp, Rattus norvegicus
gaatcagacagcaatgctatgccaa

SEQ ID NO: 308419 - DNA, 25 bp, Rattus norvegicus
gaatcagacagctatgctatgccaa

SEQ ID NO: 308420 - DNA, 25 bp, Rattus norvegicus
gaatcagacgcaatttaatagacta

SEQ ID NO: 308421 - DNA, 25 bp, Rattus norvegicus
gaatcagacgcattttaatagacta

SEQ ID NO: 308422 - DNA, 25 bp, Rattus norvegicus
gaatcagactttaatcccaaatcat

SEQ ID NO: 308423 - DNA, 25 bp, Rattus norvegicus
gaatcagacttttatcccaaatcat

SEQ ID NO: 308424 - DNA, 25 bp, Rattus norvegicus
gaatcagagaacatcgcaccggggc

SEQ ID NO: 308425 - DNA, 25 bp, Rattus norvegicus
gaatcagagaacttcgcaccggggc

SEQ ID NO: 308426 - DNA, 25 bp, Rattus norvegicus
gaatcagagataacaaagctactac

SEQ ID NO: 308427 - DNA, 25 bp, Rattus norvegicus
gaatcagagatatcaaagctactac

SEQ ID NO: 308428 - DNA, 25 bp, Rattus norvegicus
gaatcagaggtcatcaggcttgtaa

SEQ ID NO: 308429 - DNA, 25 bp, Rattus norvegicus
gaatcagaggtcttcaggcttgtaa

SEQ ID NO: 308430 - DNA, 25 bp, Rattus norvegicus
gaatcagatcttcaggcagacgaat

SEQ ID NO: 308431 - DNA, 25 bp, Rattus norvegicus
gaatcagatcttgaggcagacgaat

SEQ ID NO: 308432 - DNA, 25 bp, Rattus norvegicus
gaatcagatgttcttgtgctccaac

SEQ ID NO: 308433 - DNA, 25 bp, Rattus norvegicus
gaatcagatgttgttgtgctccaac

SEQ ID NO: 308434 - DNA, 25 bp, Rattus norvegicus
gaatcagattacattgcgcatgact

SEQ ID NO: 308435 - DNA, 25 bp, Rattus norvegicus
gaatcagattactttgcgcatgact

SEQ ID NO: 308436 - DNA, 25 bp, Rattus norvegicus
gaatcagattctcaggtgtgtgcat

SEQ ID NO: 308437 - DNA, 25 bp, Rattus norvegicus
gaatcagattctgaggtgtgtgcat

SEQ ID NO: 308438 - DNA, 25 bp, Rattus norvegicus
gaatcagcacacactgttacagttc

SEQ ID NO: 308439 - DNA, 25 bp, Rattus norvegicus
gaatcagcacactctgttacagttc

SEQ ID NO: 308440 - DNA, 25 bp, Rattus norvegicus
gaatcagcacagagggccggttaat

SEQ ID NO: 308441 - DNA, 25 bp, Rattus norvegicus
gaatcagcacagctgaggcccggcc

SEQ ID NO: 308442 - DNA, 25 bp, Rattus norvegicus
gaatcagcacaggtgaggcccggcc

SEQ ID NO: 308443 - DNA, 25 bp, Rattus norvegicus
gaatcagcacagtgggccggttaat

SEQ ID NO: 308444 - DNA, 25 bp, Rattus norvegicus
gaatcagcagcaacattagcttctg

SEQ ID NO: 308445 - DNA, 25 bp, Rattus norvegicus
gaatcagcagcatcattagcttctg

SEQ ID NO: 308446 - DNA, 25 bp, Rattus norvegicus
gaatcagcaggccagatgtcactcc

SEQ ID NO: 308447 - DNA, 25 bp, Rattus norvegicus
gaatcagcaggcgagatgtcactcc

SEQ ID NO: 308448 - DNA, 25 bp, Rattus norvegicus
gaatcagcatctcagcttttgttaa

SEQ ID NO: 308449 - DNA, 25 bp, Rattus norvegicus
gaatcagcatctgagcttttgttaa

SEQ ID NO: 308450 - DNA, 25 bp, Rattus norvegicus
gaatcagcattccaattgttttagg

SEQ ID NO: 308451 - DNA, 25 bp, Rattus norvegicus
gaatcagcattcgaattgttttagg

SEQ ID NO: 308452 - DNA, 25 bp, Rattus norvegicus
gaatcagccactagttcttccacaa

SEQ ID NO: 308453 - DNA, 25 bp, Rattus norvegicus
gaatcagccacttgttcttccacaa

SEQ ID NO: 308454 - DNA, 25 bp, Rattus norvegicus
gaatcagccctgcaacaggcagagg

SEQ ID NO: 308455 - DNA, 25 bp, Rattus norvegicus
gaatcagccctggaacaggcagagg

SEQ ID NO: 308456 - DNA, 25 bp, Rattus norvegicus
gaatcagcgtctaggctacttagga

SEQ ID NO: 308457 - DNA, 25 bp, Rattus norvegicus
gaatcagcgtcttggctacttagga

SEQ ID NO: 308458 - DNA, 25 bp, Rattus norvegicus
gaatcagcgtgtagggcatcagtgt

SEQ ID NO: 308459 - DNA, 25 bp, Rattus norvegicus
gaatcagcgtgttgggcatcagtgt

SEQ ID NO: 308460 - DNA, 25 bp, Rattus norvegicus
gaatcagctagtacacttcttagta

SEQ ID NO: 308461 - DNA, 25 bp, Rattus norvegicus
gaatcagctagttcacttcttagta

SEQ ID NO: 308462 - DNA, 25 bp, Rattus norvegicus
gaatcagctgcaaactgcgtgtcag

SEQ ID NO: 308463 - DNA, 25 bp, Rattus norvegicus
gaatcagctgcatactgcgtgtcag

SEQ ID NO: 308464 - DNA, 25 bp, Rattus norvegicus
gaatcagctgccaattttagcccat

SEQ ID NO: 308465 - DNA, 25 bp, Rattus norvegicus
gaatcagctgcctattttagcccat

SEQ ID NO: 308466 - DNA, 25 bp, Rattus norvegicus
gaatcagcttctcaagttttcccgc

SEQ ID NO: 308467 - DNA, 25 bp, Rattus norvegicus
gaatcagcttctgaagttttcccgc

SEQ ID NO: 308468 - DNA, 25 bp, Rattus norvegicus
gaatcagctttaaccattgctccaa

SEQ ID NO: 308469 - DNA, 25 bp, Rattus norvegicus
gaatcagctttatccattgctccaa

SEQ ID NO: 308470 - DNA, 25 bp, Rattus norvegicus
gaatcagctttcattttatgttaaa

SEQ ID NO: 308471 - DNA, 25 bp, Rattus norvegicus
gaatcagctttctttttatgttaaa

SEQ ID NO: 308472 - DNA, 25 bp, Rattus norvegicus
gaatcaggaaacagctctccctcag

SEQ ID NO: 308473 - DNA, 25 bp, Rattus norvegicus
gaatcaggaaactgctctccctcag

SEQ ID NO: 308474 - DNA, 25 bp, Rattus norvegicus
gaatcaggaattcctcacacagccc

SEQ ID NO: 308475 - DNA, 25 bp, Rattus norvegicus
gaatcaggaattgctcacacagccc

SEQ ID NO: 308476 - DNA, 25 bp, Rattus norvegicus
gaatcaggagttctggaccggcctt

SEQ ID NO: 308477 - DNA, 25 bp, Rattus norvegicus
gaatcaggagttgtggaccggcctt

SEQ ID NO: 308478 - DNA, 25 bp, Rattus norvegicus
gaatcaggcattacaactatttcgg

SEQ ID NO: 308479 - DNA, 25 bp, Rattus norvegicus
gaatcaggcatttcaactatttcgg

SEQ ID NO: 308480 - DNA, 25 bp, Rattus norvegicus
gaatcaggccccaagtgtcctaaaa

SEQ ID NO: 308481 - DNA, 25 bp, Rattus norvegicus
gaatcaggcccctagtgtcctaaaa

SEQ ID NO: 308482 - DNA, 25 bp, Rattus norvegicus
gaatcaggcctgagctccagtgctt

SEQ ID NO: 308483 - DNA, 25 bp, Rattus norvegicus
gaatcaggcctgtgctccagtgctt

SEQ ID NO: 308484 - DNA, 25 bp, Rattus norvegicus
gaatcaggcgtgactcatctgggct

SEQ ID NO: 308485 - DNA, 25 bp, Rattus norvegicus
gaatcaggcgtgtctcatctgggct

SEQ ID NO: 308486 - DNA, 25 bp, Rattus norvegicus
gaatcaggctcccaactgaggacaa

SEQ ID NO: 308487 - DNA, 25 bp, Rattus norvegicus
gaatcaggctccgaactgaggacaa

SEQ ID NO: 308488 - DNA, 25 bp, Rattus norvegicus
gaatcaggctgcaactaatgcccaa

SEQ ID NO: 308489 - DNA, 25 bp, Rattus norvegicus
gaatcaggctgctactaatgcccaa

SEQ ID NO: 308490 - DNA, 25 bp, Rattus norvegicus
gaatcaggcttacttcaaagctcag

SEQ ID NO: 308491 - DNA, 25 bp, Rattus norvegicus
gaatcaggcttagttcaaagctcag

SEQ ID NO: 308492 - DNA, 25 bp, Rattus norvegicus
gaatcagggataagtcatgacaacc

SEQ ID NO: 308493 - DNA, 25 bp, Rattus norvegicus
gaatcagggatatgtcatgacaacc

SEQ ID NO: 308494 - DNA, 25 bp, Rattus norvegicus
gaatcagggatcacttgggctttaa

SEQ ID NO: 308495 - DNA, 25 bp, Rattus norvegicus
gaatcagggatctcttgggctttaa

SEQ ID NO: 308496 - DNA, 25 bp, Rattus norvegicus
gaatcagggcaacctacatcactcc

SEQ ID NO: 308497 - DNA, 25 bp, Rattus norvegicus
gaatcagggcaagctacatcactcc

SEQ ID NO: 308498 - DNA, 25 bp, Rattus norvegicus
gaatcagggtttctctacacatatg

SEQ ID NO: 308499 - DNA, 25 bp, Rattus norvegicus
gaatcagggtttgtctacacatatg

SEQ ID NO: 308500 - DNA, 25 bp, Rattus norvegicus
gaatcaggtatgcttaggcttttaa

SEQ ID NO: 308501 - DNA, 25 bp, Rattus norvegicus
gaatcaggtatggttaggcttttaa

SEQ ID NO: 308502 - DNA, 25 bp, Rattus norvegicus
gaatcaggtgaaattgtacatggaa

SEQ ID NO: 308503 - DNA, 25 bp, Rattus norvegicus
gaatcaggtgaatttgtacatggaa

SEQ ID NO: 308504 - DNA, 25 bp, Rattus norvegicus
gaatcagtaacacactccagagccc

SEQ ID NO: 308505 - DNA, 25 bp, Rattus norvegicus
gaatcagtaacagactccagagccc

SEQ ID NO: 308506 - DNA, 25 bp, Rattus norvegicus
gaatcagtaccgatgtagtcagacc

SEQ ID NO: 308507 - DNA, 25 bp, Rattus norvegicus
gaatcagtaccgttgtagtcagacc

SEQ ID NO: 308508 - DNA, 25 bp, Rattus norvegicus
gaatcagtagctaggtatcacagtg

SEQ ID NO: 308509 - DNA, 25 bp, Rattus norvegicus
gaatcagtagcttggtatcacagtg

SEQ ID NO: 308510 - DNA, 25 bp, Rattus norvegicus
gaatcagtagggacacgcgaatgcc

SEQ ID NO: 308511 - DNA, 25 bp, Rattus norvegicus
gaatcagtagggtcacgcgaatgcc

SEQ ID NO: 308512 - DNA, 25 bp, Rattus norvegicus
gaatcagtatcaattctacactaaa

SEQ ID NO: 308513 - DNA, 25 bp, Rattus norvegicus
gaatcagtatcatttctacactaaa

SEQ ID NO: 308514 - DNA, 25 bp, Rattus norvegicus
gaatcagtcaacagcctcaagaatt

SEQ ID NO: 308515 - DNA, 25 bp, Rattus norvegicus
gaatcagtcaactgcctcaagaatt

SEQ ID NO: 308516 - DNA, 25 bp, Rattus norvegicus
gaatcagtcacaaacttcagcttgc

SEQ ID NO: 308517 - DNA, 25 bp, Rattus norvegicus
gaatcagtcacatacttcagcttgc

SEQ ID NO: 308518 - DNA, 25 bp, Rattus norvegicus
gaatcagtcatcactgtggtggcca

SEQ ID NO: 308519 - DNA, 25 bp, Rattus norvegicus
gaatcagtcatctctgtggtggcca

SEQ ID NO: 308520 - DNA, 25 bp, Rattus norvegicus
gaatcagtccttcatgatccacaca

SEQ ID NO: 308521 - DNA, 25 bp, Rattus norvegicus
gaatcagtccttgatgatccacaca

SEQ ID NO: 308522 - DNA, 25 bp, Rattus norvegicus
gaatcagtctttattaagccaaaat

SEQ ID NO: 308523 - DNA, 25 bp, Rattus norvegicus
gaatcagtcttttttaagccaaaat

SEQ ID NO: 308524 - DNA, 25 bp, Rattus norvegicus
gaatcagtgaatcagctcagtggct

SEQ ID NO: 308525 - DNA, 25 bp, Rattus norvegicus
gaatcagtgaatgagctcagtggct

SEQ ID NO: 308526 - DNA, 25 bp, Rattus norvegicus
gaatcagtgactacttggctttcct

SEQ ID NO: 308527 - DNA, 25 bp, Rattus norvegicus
gaatcagtgacttcttggctttcct

SEQ ID NO: 308528 - DNA, 25 bp, Rattus norvegicus
gaatcagtgagcacgcatcgggaga

SEQ ID NO: 308529 - DNA, 25 bp, Rattus norvegicus
gaatcagtgagctcgcatcgggaga

SEQ ID NO: 308530 - DNA, 25 bp, Rattus norvegicus
gaatcagtgcagagctactgccctg

SEQ ID NO: 308531 - DNA, 25 bp, Rattus norvegicus
gaatcagtgcagtgctactgccctg

SEQ ID NO: 308532 - DNA, 25 bp, Rattus norvegicus
gaatcagtgccacggattgcccatc

SEQ ID NO: 308533 - DNA, 25 bp, Rattus norvegicus
gaatcagtgccagggattgcccatc

SEQ ID NO: 308534 - DNA, 25 bp, Rattus norvegicus
gaatcagtggatatatgcagataac

SEQ ID NO: 308535 - DNA, 25 bp, Rattus norvegicus
gaatcagtggatttatgcagataac

SEQ ID NO: 308536 - DNA, 25 bp, Rattus norvegicus
gaatcagtggttcctggacccagtt

SEQ ID NO: 308537 - DNA, 25 bp, Rattus norvegicus
gaatcagtggttgctggacccagtt

SEQ ID NO: 308538 - DNA, 25 bp, Rattus norvegicus
gaatcagtgtttactcttaggactc

SEQ ID NO: 308539 - DNA, 25 bp, Rattus norvegicus
gaatcagtgttttctcttaggactc

SEQ ID NO: 308540 - DNA, 25 bp, Rattus norvegicus
gaatcagttaaacgtcatcctcagc

SEQ ID NO: 308541 - DNA, 25 bp, Rattus norvegicus
gaatcagttaaaggtcatcctcagc

SEQ ID NO: 308542 - DNA, 25 bp, Rattus norvegicus
gaatcagttatgagaactcttgact

SEQ ID NO: 308543 - DNA, 25 bp, Rattus norvegicus
gaatcagttatgtgaactcttgact

SEQ ID NO: 308544 - DNA, 25 bp, Rattus norvegicus
gaatcagttccaagcctctgcagga

SEQ ID NO: 308545 - DNA, 25 bp, Rattus norvegicus
gaatcagttccatgcctctgcagga

SEQ ID NO: 308546 - DNA, 25 bp, Rattus norvegicus
gaatcagttcttatcagcaggttac

SEQ ID NO: 308547 - DNA, 25 bp, Rattus norvegicus
gaatcagttcttttcagcaggttac

SEQ ID NO: 308548 - DNA, 25 bp, Rattus norvegicus
gaatcagttttccatgtaccaaaag

SEQ ID NO: 308549 - DNA, 25 bp, Rattus norvegicus
gaatcagttttcgatgtaccaaaag

SEQ ID NO: 308550 - DNA, 25 bp, Rattus norvegicus
gaatcataccagagcagagactgct

SEQ ID NO: 308551 - DNA, 25 bp, Rattus norvegicus
gaatcataccagtgcagagactgct

SEQ ID NO: 308552 - DNA, 25 bp, Rattus norvegicus
gaatcatacgctatggagatgcact

SEQ ID NO: 308553 - DNA, 25 bp, Rattus norvegicus
gaatcatacgctttggagatgcact

SEQ ID NO: 308554 - DNA, 25 bp, Rattus norvegicus
gaatcatatgaaatagcttgcctta

SEQ ID NO: 308555 - DNA, 25 bp, Rattus norvegicus
gaatcatatgaattagcttgcctta

SEQ ID NO: 308556 - DNA, 25 bp, Rattus norvegicus
gaatcatcagataaggcgaggagtt

SEQ ID NO: 308557 - DNA, 25 bp, Rattus norvegicus
gaatcatcagattaggcgaggagtt

SEQ ID NO: 308558 - DNA, 25 bp, Rattus norvegicus
gaatcatcagcaaggtgtgtgccat

SEQ ID NO: 308559 - DNA, 25 bp, Rattus norvegicus
gaatcatcagcatggtgtgtgccat

SEQ ID NO: 308560 - DNA, 25 bp, Rattus norvegicus
gaatcatcaggcacacaggtgcaga

SEQ ID NO: 308561 - DNA, 25 bp, Rattus norvegicus
gaatcatcaggctcacaggtgcaga

SEQ ID NO: 308562 - DNA, 25 bp, Rattus norvegicus
gaatcatcaggtacccaaaattttt

SEQ ID NO: 308563 - DNA, 25 bp, Rattus norvegicus
gaatcatcaggttcccaaaattttt

SEQ ID NO: 308564 - DNA, 25 bp, Rattus norvegicus
gaatcatcatgtattccaatggtct

SEQ ID NO: 308565 - DNA, 25 bp, Rattus norvegicus
gaatcatcatgttttccaatggtct

SEQ ID NO: 308566 - DNA, 25 bp, Rattus norvegicus
gaatcatccaatagtagagagctca

SEQ ID NO: 308567 - DNA, 25 bp, Rattus norvegicus
gaatcatccaattgtagagagctca

SEQ ID NO: 308568 - DNA, 25 bp, Rattus norvegicus
gaatcatccagacgaaccgcaccga

SEQ ID NO: 308569 - DNA, 25 bp, Rattus norvegicus
gaatcatccagaggaaccgcaccga

SEQ ID NO: 308570 - DNA, 25 bp, Rattus norvegicus
gaatcatcgcccatttttaagtcta

SEQ ID NO: 308571 - DNA, 25 bp, Rattus norvegicus
gaatcatcgcccttttttaagtcta

SEQ ID NO: 308572 - DNA, 25 bp, Rattus norvegicus
gaatcatcgcggaagcacagtgctt

SEQ ID NO: 308573 - DNA, 25 bp, Rattus norvegicus
gaatcatcgcggtagcacagtgctt

SEQ ID NO: 308574 - DNA, 25 bp, Rattus norvegicus
gaatcatctactctcattctgtaaa

SEQ ID NO: 308575 - DNA, 25 bp, Rattus norvegicus
gaatcatctactgtcattctgtaaa

SEQ ID NO: 308576 - DNA, 25 bp, Rattus norvegicus
gaatcatctctgaccctataaaacg

SEQ ID NO: 308577 - DNA, 25 bp, Rattus norvegicus
gaatcatctctgtccctataaaacg

SEQ ID NO: 308578 - DNA, 25 bp, Rattus norvegicus
gaatcatctgatctgtgctagaagt

SEQ ID NO: 308579 - DNA, 25 bp, Rattus norvegicus
gaatcatctgatgtgtgctagaagt

SEQ ID NO: 308580 - DNA, 25 bp, Rattus norvegicus
gaatcatctggaacaccacaagaag

SEQ ID NO: 308581 - DNA, 25 bp, Rattus norvegicus
gaatcatctggatcaccacaagaag

SEQ ID NO: 308582 - DNA, 25 bp, Rattus norvegicus
gaatcatctggcacctgtaaaacat

SEQ ID NO: 308583 - DNA, 25 bp, Rattus norvegicus
gaatcatctggctcctgtaaaacat

SEQ ID NO: 308584 - DNA, 25 bp, Rattus norvegicus
gaatcatcttcaaagtgagtcttta

SEQ ID NO: 308585 - DNA, 25 bp, Rattus norvegicus
gaatcatcttcatagtgagtcttta

SEQ ID NO: 308586 - DNA, 25 bp, Rattus norvegicus
gaatcatctttaactggttctcgga

SEQ ID NO: 308587 - DNA, 25 bp, Rattus norvegicus
gaatcatctttatctggttctcgga

SEQ ID NO: 308588 - DNA, 25 bp, Rattus norvegicus
gaatcatcttttcctatctgttttt

SEQ ID NO: 308589 - DNA, 25 bp, Rattus norvegicus
gaatcatcttttgctatctgttttt

SEQ ID NO: 308590 - DNA, 25 bp, Rattus norvegicus
gaatcatgactcaccttcacaaggt

SEQ ID NO: 308591 - DNA, 25 bp, Rattus norvegicus
gaatcatgactctccttcacaaggt

SEQ ID NO: 308592 - DNA, 25 bp, Rattus norvegicus
gaatcatgatccctttgctggtttt

SEQ ID NO: 308593 - DNA, 25 bp, Rattus norvegicus
gaatcatgatccgtttgctggtttt

SEQ ID NO: 308594 - DNA, 25 bp, Rattus norvegicus
gaatcatgatgtctggcgagtcaag

SEQ ID NO: 308595 - DNA, 25 bp, Rattus norvegicus
gaatcatgatgtgtggcgagtcaag

SEQ ID NO: 308596 - DNA, 25 bp, Rattus norvegicus
gaatcatgctccagtaatgtcacaa

SEQ ID NO: 308597 - DNA, 25 bp, Rattus norvegicus
gaatcatgctcctgtaatgtcacaa

SEQ ID NO: 308598 - DNA, 25 bp, Rattus norvegicus
gaatcatgctgtcgtctcacggaaa

SEQ ID NO: 308599 - DNA, 25 bp, Rattus norvegicus
gaatcatgctgtggtctcacggaaa

SEQ ID NO: 308600 - DNA, 25 bp, Rattus norvegicus
gaatcatgctttaggagagtatcag

SEQ ID NO: 308601 - DNA, 25 bp, Rattus norvegicus
gaatcatgcttttggagagtatcag

SEQ ID NO: 308602 - DNA, 25 bp, Rattus norvegicus
gaatcatggaaacgttaagcccact

SEQ ID NO: 308603 - DNA, 25 bp, Rattus norvegicus
gaatcatggaaaggttaagcccact

SEQ ID NO: 308604 - DNA, 25 bp, Rattus norvegicus
gaatcatgggatagcttcatcctca

SEQ ID NO: 308605 - DNA, 25 bp, Rattus norvegicus
gaatcatgggattgcttcatcctca

SEQ ID NO: 308606 - DNA, 25 bp, Rattus norvegicus
gaatcatgtccaacatcttggaagt

SEQ ID NO: 308607 - DNA, 25 bp, Rattus norvegicus
gaatcatgtccatcatcttggaagt

SEQ ID NO: 308608 - DNA, 25 bp, Rattus norvegicus
gaatcatgtcgcagttactgttgga

SEQ ID NO: 308609 - DNA, 25 bp, Rattus norvegicus
gaatcatgtcgctgttactgttgga

SEQ ID NO: 308610 - DNA, 25 bp, Rattus norvegicus
gaatcatgttccctgtgtacatttt

SEQ ID NO: 308611 - DNA, 25 bp, Rattus norvegicus
gaatcatgttccgtgtgtacatttt

SEQ ID NO: 308612 - DNA, 25 bp, Rattus norvegicus
gaatcatgttgcctactgttactct

SEQ ID NO: 308613 - DNA, 25 bp, Rattus norvegicus
gaatcatgttgcgtactgttactct

SEQ ID NO: 308614 - DNA, 25 bp, Rattus norvegicus
gaatcatgtttccagctgcttgacc

SEQ ID NO: 308615 - DNA, 25 bp, Rattus norvegicus
gaatcatgtttcgagctgcttgacc

SEQ ID NO: 308616 - DNA, 25 bp, Rattus norvegicus
gaatcatgtttgagtcatcagcgaa

SEQ ID NO: 308617 - DNA, 25 bp, Rattus norvegicus
gaatcatgtttgcatctcgggccct

SEQ ID NO: 308618 - DNA, 25 bp, Rattus norvegicus
gaatcatgtttggatctcgggccct

SEQ ID NO: 308619 - DNA, 25 bp, Rattus norvegicus
gaatcatgtttgtgtcatcagcgaa

SEQ ID NO: 308620 - DNA, 25 bp, Rattus norvegicus
gaatcattacgtactgtctacgcag

SEQ ID NO: 308621 - DNA, 25 bp, Rattus norvegicus
gaatcattacgttctgtctacgcag

SEQ ID NO: 308622 - DNA, 25 bp, Rattus norvegicus
gaatcattagtcagttcgccttggt

SEQ ID NO: 308623 - DNA, 25 bp, Rattus norvegicus
gaatcattagtctgttcgccttggt

SEQ ID NO: 308624 - DNA, 25 bp, Rattus norvegicus
gaatcattatccatcgtggtcacta

SEQ ID NO: 308625 - DNA, 25 bp, Rattus norvegicus
gaatcattatccttcgtggtcacta

SEQ ID NO: 308626 - DNA, 25 bp, Rattus norvegicus
gaatcattatgtagcacacttttgc

SEQ ID NO: 308627 - DNA, 25 bp, Rattus norvegicus
gaatcattatgttgcacacttttgc

SEQ ID NO: 308628 - DNA, 25 bp, Rattus norvegicus
gaatcattcaccctggcaaacattt

SEQ ID NO: 308629 - DNA, 25 bp, Rattus norvegicus
gaatcattcaccgtggcaaacattt

SEQ ID NO: 308630 - DNA, 25 bp, Rattus norvegicus
gaatcattcatcctctatgagagta

SEQ ID NO: 308631 - DNA, 25 bp, Rattus norvegicus
gaatcattcatcgtctatgagagta

SEQ ID NO: 308632 - DNA, 25 bp, Rattus norvegicus
gaatcattcattcaaatggacactt

SEQ ID NO: 308633 - DNA, 25 bp, Rattus norvegicus
gaatcattcattgaaatggacactt

SEQ ID NO: 308634 - DNA, 25 bp, Rattus norvegicus
gaatcattcgttatctctgggtgaa

SEQ ID NO: 308635 - DNA, 25 bp, Rattus norvegicus
gaatcattcgttttctctgggtgaa

SEQ ID NO: 308636 - DNA, 25 bp, Rattus norvegicus
gaatcattctccagttcacttggga

SEQ ID NO: 308637 - DNA, 25 bp, Rattus norvegicus
gaatcattctcctgttcacttggga

SEQ ID NO: 308638 - DNA, 25 bp, Rattus norvegicus
gaatcattctgtattggaaggcaca

SEQ ID NO: 308639 - DNA, 25 bp, Rattus norvegicus
gaatcattctgttttggaaggcaca

SEQ ID NO: 308640 - DNA, 25 bp, Rattus norvegicus
gaatcattcttgcaagacattccta

SEQ ID NO: 308641 - DNA, 25 bp, Rattus norvegicus
gaatcattcttggaagacattccta

SEQ ID NO: 308642 - DNA, 25 bp, Rattus norvegicus
gaatcattgccaatcatcttctgct

SEQ ID NO: 308643 - DNA, 25 bp, Rattus norvegicus
gaatcattgccattcatcttctgct

SEQ ID NO: 308644 - DNA, 25 bp, Rattus norvegicus
gaatcattgcttcctgtgctagaca

SEQ ID NO: 308645 - DNA, 25 bp, Rattus norvegicus
gaatcattgcttgctgtgctagaca

SEQ ID NO: 308646 - DNA, 25 bp, Rattus norvegicus
gaatcattggtaatgagcgccggat

SEQ ID NO: 308647 - DNA, 25 bp, Rattus norvegicus
gaatcattggtattgagcgccggat

SEQ ID NO: 308648 - DNA, 25 bp, Rattus norvegicus
gaatcattgtcactgacccctacca

SEQ ID NO: 308649 - DNA, 25 bp, Rattus norvegicus
gaatcattgtcagtgacccctacca

SEQ ID NO: 308650 - DNA, 25 bp, Rattus norvegicus
gaatcatttccaaacaactccgaga

SEQ ID NO: 308651 - DNA, 25 bp, Rattus norvegicus
gaatcatttccatacaactccgaga

SEQ ID NO: 308652 - DNA, 25 bp, Rattus norvegicus
gaatcatttcgaagtgttcctcaga

SEQ ID NO: 308653 - DNA, 25 bp, Rattus norvegicus
gaatcatttcgatgtgttcctcaga

SEQ ID NO: 308654 - DNA, 25 bp, Rattus norvegicus
gaatcatttgctcagtcatttcctc

SEQ ID NO: 308655 - DNA, 25 bp, Rattus norvegicus
gaatcatttgctctacacatgcctc

SEQ ID NO: 308656 - DNA, 25 bp, Rattus norvegicus
gaatcatttgctgagtcatttcctc

SEQ ID NO: 308657 - DNA, 25 bp, Rattus norvegicus
gaatcatttgctgtacacatgcctc

SEQ ID NO: 308658 - DNA, 25 bp, Rattus norvegicus
gaatcattttacatcgagtgcaaag

SEQ ID NO: 308659 - DNA, 25 bp, Rattus norvegicus
gaatcattttacttcgagtgcaaag

SEQ ID NO: 308660 - DNA, 25 bp, Rattus norvegicus
gaatcattttggcatctgttccctc

SEQ ID NO: 308661 - DNA, 25 bp, Rattus norvegicus
gaatcattttgggatctgttccctc

SEQ ID NO: 308662 - DNA, 25 bp, Rattus norvegicus
gaatcatttttgaactaaggcaagc

SEQ ID NO: 308663 - DNA, 25 bp, Rattus norvegicus
gaatcatttttgtactaaggcaagc

SEQ ID NO: 308664 - DNA, 25 bp, Rattus norvegicus
gaatccaaacagaccggccaatagc

SEQ ID NO: 308665 - DNA, 25 bp, Rattus norvegicus
gaatccaaacagtccggccaatagc

SEQ ID NO: 308666 - DNA, 25 bp, Rattus norvegicus
gaatccaaagatactgcctgcatag

SEQ ID NO: 308667 - DNA, 25 bp, Rattus norvegicus
gaatccaaagattctgcctgcatag

SEQ ID NO: 308668 - DNA, 25 bp, Rattus norvegicus
gaatccaaatgcagctttcttttat

SEQ ID NO: 308669 - DNA, 25 bp, Rattus norvegicus
gaatccaaatgctgctttcttttat

SEQ ID NO: 308670 - DNA, 25 bp, Rattus norvegicus
gaatccaacctacaaactcttttga

SEQ ID NO: 308671 - DNA, 25 bp, Rattus norvegicus
gaatccaacctagaaactcttttga

SEQ ID NO: 308672 - DNA, 25 bp, Rattus norvegicus
gaatccaacttcatcagcagcacag

SEQ ID NO: 308673 - DNA, 25 bp, Rattus norvegicus
gaatccaacttcctgggctatgttt

SEQ ID NO: 308674 - DNA, 25 bp, Rattus norvegicus
gaatccaacttcgtgggctatgttt

SEQ ID NO: 308675 - DNA, 25 bp, Rattus norvegicus
gaatccaacttcttcagcagcacag

SEQ ID NO: 308676 - DNA, 25 bp, Rattus norvegicus
gaatccaaggccacttgcatttgag

SEQ ID NO: 308677 - DNA, 25 bp, Rattus norvegicus
gaatccaaggcctcttgcatttgag

SEQ ID NO: 308678 - DNA, 25 bp, Rattus norvegicus
gaatccaaggtaattggccaggaaa

SEQ ID NO: 308679 - DNA, 25 bp, Rattus norvegicus
gaatccaaggtatttggccaggaaa

SEQ ID NO: 308680 - DNA, 25 bp, Rattus norvegicus
gaatccaaggttcccctgagcaata

SEQ ID NO: 308681 - DNA, 25 bp, Rattus norvegicus
gaatccaaggttgccctgagcaata

SEQ ID NO: 308682 - DNA, 25 bp, Rattus norvegicus
gaatccaagtggatcttcagggcga

SEQ ID NO: 308683 - DNA, 25 bp, Rattus norvegicus
gaatccaagtggttcttcagggcga

SEQ ID NO: 308684 - DNA, 25 bp, Rattus norvegicus
gaatccaatgccagcaaactccatt

SEQ ID NO: 308685 - DNA, 25 bp, Rattus norvegicus
gaatccaatgccatgtatgtgctat

SEQ ID NO: 308686 - DNA, 25 bp, Rattus norvegicus
gaatccaatgcctgcaaactccatt

SEQ ID NO: 308687 - DNA, 25 bp, Rattus norvegicus
gaatccaatgccttgtatgtgctat

SEQ ID NO: 308688 - DNA, 25 bp, Rattus norvegicus
gaatccaatgtcatcttctggtata

SEQ ID NO: 308689 - DNA, 25 bp, Rattus norvegicus
gaatccaatgtcttcttctggtata

SEQ ID NO: 308690 - DNA, 25 bp, Rattus norvegicus
gaatccaatgttctcttctgtattt

SEQ ID NO: 308691 - DNA, 25 bp, Rattus norvegicus
gaatccaatgttctgagtgtctcaa

SEQ ID NO: 308692 - DNA, 25 bp, Rattus norvegicus
gaatccaatgttctgggctctgcac

SEQ ID NO: 308693 - DNA, 25 bp, Rattus norvegicus
gaatccaatgttgtcttctgtattt

SEQ ID NO: 308694 - DNA, 25 bp, Rattus norvegicus
gaatccaatgttgtgagtgtctcaa

SEQ ID NO: 308695 - DNA, 25 bp, Rattus norvegicus
gaatccaatgttgtgggctctgcac

SEQ ID NO: 308696 - DNA, 25 bp, Rattus norvegicus
gaatccaatttaagcaatcctgtct

SEQ ID NO: 308697 - DNA, 25 bp, Rattus norvegicus
gaatccaatttatgcaatcctgtct

SEQ ID NO: 308698 - DNA, 25 bp, Rattus norvegicus
gaatccacaagccactcattgactt

SEQ ID NO: 308699 - DNA, 25 bp, Rattus norvegicus
gaatccacaagcgactcattgactt

SEQ ID NO: 308700 - DNA, 25 bp, Rattus norvegicus
gaatccacacctcagttttgagcaa

SEQ ID NO: 308701 - DNA, 25 bp, Rattus norvegicus
gaatccacacctgagttttgagcaa

SEQ ID NO: 308702 - DNA, 25 bp, Rattus norvegicus
gaatccacagcaccggtaaacctta

SEQ ID NO: 308703 - DNA, 25 bp, Rattus norvegicus
gaatccacagcagcggtaaacctta

SEQ ID NO: 308704 - DNA, 25 bp, Rattus norvegicus
gaatccacatgactctagcagcaga

SEQ ID NO: 308705 - DNA, 25 bp, Rattus norvegicus
gaatccacatgagtctagcagcaga

SEQ ID NO: 308706 - DNA, 25 bp, Rattus norvegicus
gaatccacattccagacaggcggtg

SEQ ID NO: 308707 - DNA, 25 bp, Rattus norvegicus
gaatccacattcgagacaggcggtg

SEQ ID NO: 308708 - DNA, 25 bp, Rattus norvegicus
gaatccacatttcctagataccact

SEQ ID NO: 308709 - DNA, 25 bp, Rattus norvegicus
gaatccacatttgctagataccact

SEQ ID NO: 308710 - DNA, 25 bp, Rattus norvegicus
gaatccacccaacgaccatttcgag

SEQ ID NO: 308711 - DNA, 25 bp, Rattus norvegicus
gaatccacccaaggaccatttcgag

SEQ ID NO: 308712 - DNA, 25 bp, Rattus norvegicus
gaatccacccatatcttaaaacact

SEQ ID NO: 308713 - DNA, 25 bp, Rattus norvegicus
gaatccacccatttcttaaaacact

SEQ ID NO: 308714 - DNA, 25 bp, Rattus norvegicus
gaatccacctacaacatgggccagg

SEQ ID NO: 308715 - DNA, 25 bp, Rattus norvegicus
gaatccacctactacatgggccagg

SEQ ID NO: 308716 - DNA, 25 bp, Rattus norvegicus
gaatccacgatgactttccatgtga

SEQ ID NO: 308717 - DNA, 25 bp, Rattus norvegicus
gaatccacgatgtctttccatgtga

SEQ ID NO: 308718 - DNA, 25 bp, Rattus norvegicus
gaatccacggtgatcagagctgacc

SEQ ID NO: 308719 - DNA, 25 bp, Rattus norvegicus
gaatccacggtgttcagagctgacc

SEQ ID NO: 308720 - DNA, 25 bp, Rattus norvegicus
gaatccactagaagtcctttaatcc

SEQ ID NO: 308721 - DNA, 25 bp, Rattus norvegicus
gaatccactagatgtcctttaatcc

SEQ ID NO: 308722 - DNA, 25 bp, Rattus norvegicus
gaatccactgtgacttttctgtaag

SEQ ID NO: 308723 - DNA, 25 bp, Rattus norvegicus
gaatccactgtgtcttttctgtaag

SEQ ID NO: 308724 - DNA, 25 bp, Rattus norvegicus
gaatccagaacgctctaccttagcc

SEQ ID NO: 308725 - DNA, 25 bp, Rattus norvegicus
gaatccagaacggtctaccttagcc

SEQ ID NO: 308726 - DNA, 25 bp, Rattus norvegicus
gaatccagacgaagtgagctacgct

SEQ ID NO: 308727 - DNA, 25 bp, Rattus norvegicus
gaatccagacgatgtgagctacgct

SEQ ID NO: 308728 - DNA, 25 bp, Rattus norvegicus
gaatccagagacctgtttgttactc

SEQ ID NO: 308729 - DNA, 25 bp, Rattus norvegicus
gaatccagagacgtgtttgttactc

SEQ ID NO: 308730 - DNA, 25 bp, Rattus norvegicus
gaatccagagatcaacttcttttat

SEQ ID NO: 308731 - DNA, 25 bp, Rattus norvegicus
gaatccagagatgaacttcttttat

SEQ ID NO: 308732 - DNA, 25 bp, Rattus norvegicus
gaatccagaggaaacatacaatact

SEQ ID NO: 308733 - DNA, 25 bp, Rattus norvegicus
gaatccagaggatacatacaatact

SEQ ID NO: 308734 - DNA, 25 bp, Rattus norvegicus
gaatccagaggcagctggtacccca

SEQ ID NO: 308735 - DNA, 25 bp, Rattus norvegicus
gaatccagaggctgctggtacccca

SEQ ID NO: 308736 - DNA, 25 bp, Rattus norvegicus
gaatccagcaaaagcttcccgataa

SEQ ID NO: 308737 - DNA, 25 bp, Rattus norvegicus
gaatccagcaaatgcttcccgataa

SEQ ID NO: 308738 - DNA, 25 bp, Rattus norvegicus
gaatccagcacacaatgcccatgct

SEQ ID NO: 308739 - DNA, 25 bp, Rattus norvegicus
gaatccagcacagaatgcccatgct

SEQ ID NO: 308740 - DNA, 25 bp, Rattus norvegicus
gaatccagcagaaacaagaaccgaa

SEQ ID NO: 308741 - DNA, 25 bp, Rattus norvegicus
gaatccagcagatacaagaaccgaa

SEQ ID NO: 308742 - DNA, 25 bp, Rattus norvegicus
gaatccagcataaaacgactccctg

SEQ ID NO: 308743 - DNA, 25 bp, Rattus norvegicus
gaatccagcatataacgactccctg

SEQ ID NO: 308744 - DNA, 25 bp, Rattus norvegicus
gaatccagccttagtcggcctctgt

SEQ ID NO: 308745 - DNA, 25 bp, Rattus norvegicus
gaatccagcctttgtcggcctctgt

SEQ ID NO: 308746 - DNA, 25 bp, Rattus norvegicus
gaatccagcgccagctagagatcac

SEQ ID NO: 308747 - DNA, 25 bp, Rattus norvegicus
gaatccagcgcctgctagagatcac

SEQ ID NO: 308748 - DNA, 25 bp, Rattus norvegicus
gaatccaggacccacacacgctaag

SEQ ID NO: 308749 - DNA, 25 bp, Rattus norvegicus
gaatccaggaccgacacacgctaag

SEQ ID NO: 308750 - DNA, 25 bp, Rattus norvegicus
gaatccaggacgcagacattagtag

SEQ ID NO: 308751 - DNA, 25 bp, Rattus norvegicus
gaatccaggacggagacattagtag

SEQ ID NO: 308752 - DNA, 25 bp, Rattus norvegicus
gaatccaggaggagcacagactgca

SEQ ID NO: 308753 - DNA, 25 bp, Rattus norvegicus
gaatccaggaggtgcacagactgca

SEQ ID NO: 308754 - DNA, 25 bp, Rattus norvegicus
gaatccaggatgatgctacccctat

SEQ ID NO: 308755 - DNA, 25 bp, Rattus norvegicus
gaatccaggatgttgctacccctat

SEQ ID NO: 308756 - DNA, 25 bp, Rattus norvegicus
gaatccagtagtagtccagtccatg

SEQ ID NO: 308757 - DNA, 25 bp, Rattus norvegicus
gaatccagtagttgtccagtccatg

SEQ ID NO: 308758 - DNA, 25 bp, Rattus norvegicus
gaatccagtgacagatccagggcca

SEQ ID NO: 308759 - DNA, 25 bp, Rattus norvegicus
gaatccagtgactgatccagggcca

SEQ ID NO: 308760 - DNA, 25 bp, Rattus norvegicus
gaatccagtgccatgttttggtctc

SEQ ID NO: 308761 - DNA, 25 bp, Rattus norvegicus
gaatccagtgccttgttttggtctc

SEQ ID NO: 308762 - DNA, 25 bp, Rattus norvegicus
gaatccagttttctgttgccagttt

SEQ ID NO: 308763 - DNA, 25 bp, Rattus norvegicus
gaatccagttttgtgttgccagttt

SEQ ID NO: 308764 - DNA, 25 bp, Rattus norvegicus
gaatccatacatcttaggacagcct

SEQ ID NO: 308765 - DNA, 25 bp, Rattus norvegicus
gaatccatacatgttaggacagcct

SEQ ID NO: 308766 - DNA, 25 bp, Rattus norvegicus
gaatccatcagaaaggccatcaagg

SEQ ID NO: 308767 - DNA, 25 bp, Rattus norvegicus
gaatccatcagataggccatcaagg

SEQ ID NO: 308768 - DNA, 25 bp, Rattus norvegicus
gaatccatctgaccatgtttaacat

SEQ ID NO: 308769 - DNA, 25 bp, Rattus norvegicus
gaatccatctgagcatgtttaacat

SEQ ID NO: 308770 - DNA, 25 bp, Rattus norvegicus
gaatccatgaatcttttgccttgtg

SEQ ID NO: 308771 - DNA, 25 bp, Rattus norvegicus
gaatccatgaatgttttgccttgtg

SEQ ID NO: 308772 - DNA, 25 bp, Rattus norvegicus
gaatccatgaggagctatctggcag

SEQ ID NO: 308773 - DNA, 25 bp, Rattus norvegicus
gaatccatgaggtgctatctggcag

SEQ ID NO: 308774 - DNA, 25 bp, Rattus norvegicus
gaatccatgattcattctagctggg

SEQ ID NO: 308775 - DNA, 25 bp, Rattus norvegicus
gaatccatgattgattctagctggg

SEQ ID NO: 308776 - DNA, 25 bp, Rattus norvegicus
gaatccatgcagacttcagagtgta

SEQ ID NO: 308777 - DNA, 25 bp, Rattus norvegicus
gaatccatgcagtcttcagagtgta

SEQ ID NO: 308778 - DNA, 25 bp, Rattus norvegicus
gaatccatgccaattgtgaacacag

SEQ ID NO: 308779 - DNA, 25 bp, Rattus norvegicus
gaatccatgccatttgtgaacacag

SEQ ID NO: 308780 - DNA, 25 bp, Rattus norvegicus
gaatccatgctcactgtgtttagac

SEQ ID NO: 308781 - DNA, 25 bp, Rattus norvegicus
gaatccatgctctctgtgtttagac

SEQ ID NO: 308782 - DNA, 25 bp, Rattus norvegicus
gaatccatgctgaccttggtggaaa

SEQ ID NO: 308783 - DNA, 25 bp, Rattus norvegicus
gaatccatgctgtccttggtggaaa

SEQ ID NO: 308784 - DNA, 25 bp, Rattus norvegicus
gaatccatgtaacctgttacactaa

SEQ ID NO: 308785 - DNA, 25 bp, Rattus norvegicus
gaatccatgtaagctgttacactaa

SEQ ID NO: 308786 - DNA, 25 bp, Rattus norvegicus
gaatccatgtgcacatcagcgatga

SEQ ID NO: 308787 - DNA, 25 bp, Rattus norvegicus
gaatccatgtgctcatcagcgatga

SEQ ID NO: 308788 - DNA, 25 bp, Rattus norvegicus
gaatccatgtttagttttgctgaac

SEQ ID NO: 308789 - DNA, 25 bp, Rattus norvegicus
gaatccatgttttgttttgctgaac

SEQ ID NO: 308790 - DNA, 25 bp, Rattus norvegicus
gaatccattcgacgtacttatcgca

SEQ ID NO: 308791 - DNA, 25 bp, Rattus norvegicus
gaatccattcgaggtacttatcgca

SEQ ID NO: 308792 - DNA, 25 bp, Rattus norvegicus
gaatccattctacacaagcggcagg

SEQ ID NO: 308793 - DNA, 25 bp, Rattus norvegicus
gaatccattctactccttggaaatg

SEQ ID NO: 308794 - DNA, 25 bp, Rattus norvegicus
gaatccattctagacaagcggcagg

SEQ ID NO: 308795 - DNA, 25 bp, Rattus norvegicus
gaatccattctagtccttggaaatg

SEQ ID NO: 308796 - DNA, 25 bp, Rattus norvegicus
gaatccattctcacctttaggaact

SEQ ID NO: 308797 - DNA, 25 bp, Rattus norvegicus
gaatccattctctcctttaggaact

SEQ ID NO: 308798 - DNA, 25 bp, Rattus norvegicus
gaatccattcttcccggtgtttgga

SEQ ID NO: 308799 - DNA, 25 bp, Rattus norvegicus
gaatccattcttgccggtgtttgga

SEQ ID NO: 308800 - DNA, 25 bp, Rattus norvegicus
gaatccattgatcctcttcaagtca

SEQ ID NO: 308801 - DNA, 25 bp, Rattus norvegicus
gaatccattgatgctcttcaagtca

SEQ ID NO: 308802 - DNA, 25 bp, Rattus norvegicus
gaatccattgtcagtgttctcattg

SEQ ID NO: 308803 - DNA, 25 bp, Rattus norvegicus
gaatccattgtctgtgttctcattg

SEQ ID NO: 308804 - DNA, 25 bp, Rattus norvegicus
gaatccattgtgatctttatagtaa

SEQ ID NO: 308805 - DNA, 25 bp, Rattus norvegicus
gaatccattgtgttctttatagtaa

SEQ ID NO: 308806 - DNA, 25 bp, Rattus norvegicus
gaatccattttcatgacctaatctg

SEQ ID NO: 308807 - DNA, 25 bp, Rattus norvegicus
gaatccattttccatccttgggtga

SEQ ID NO: 308808 - DNA, 25 bp, Rattus norvegicus
gaatccattttcgatccttgggtga

SEQ ID NO: 308809 - DNA, 25 bp, Rattus norvegicus
gaatccattttcttgacctaatctg

SEQ ID NO: 308810 - DNA, 25 bp, Rattus norvegicus
gaatcccaaatgaaactgaggacgt

SEQ ID NO: 308811 - DNA, 25 bp, Rattus norvegicus
gaatcccaaatgtaactgaggacgt

SEQ ID NO: 308812 - DNA, 25 bp, Rattus norvegicus
gaatcccaacaaccttgagtcctat

SEQ ID NO: 308813 - DNA, 25 bp, Rattus norvegicus
gaatcccaacaagcttgagtcctat

SEQ ID NO: 308814 - DNA, 25 bp, Rattus norvegicus
gaatcccaactgctctatatttctt

SEQ ID NO: 308815 - DNA, 25 bp, Rattus norvegicus
gaatcccaactggtctatatttctt

SEQ ID NO: 308816 - DNA, 25 bp, Rattus norvegicus
gaatcccaagaaacactcgtgagct

SEQ ID NO: 308817 - DNA, 25 bp, Rattus norvegicus
gaatcccaagaatcactcgtgagct

SEQ ID NO: 308818 - DNA, 25 bp, Rattus norvegicus
gaatcccaagagcatgctacctaaa

SEQ ID NO: 308819 - DNA, 25 bp, Rattus norvegicus
gaatcccaagaggatgctacctaaa

SEQ ID NO: 308820 - DNA, 25 bp, Rattus norvegicus
gaatcccaagtcatttctcattaaa

SEQ ID NO: 308821 - DNA, 25 bp, Rattus norvegicus
gaatcccaagtcttttctcattaaa

SEQ ID NO: 308822 - DNA, 25 bp, Rattus norvegicus
gaatcccacctaactcgaattttgt

SEQ ID NO: 308823 - DNA, 25 bp, Rattus norvegicus
gaatcccacctatctcgaattttgt

SEQ ID NO: 308824 - DNA, 25 bp, Rattus norvegicus
gaatcccactaacaagagttcttca

SEQ ID NO: 308825 - DNA, 25 bp, Rattus norvegicus
gaatcccactaagaagagttcttca

SEQ ID NO: 308826 - DNA, 25 bp, Rattus norvegicus
gaatcccagaatacattttacactt

SEQ ID NO: 308827 - DNA, 25 bp, Rattus norvegicus
gaatcccagaattcattttacactt

SEQ ID NO: 308828 - DNA, 25 bp, Rattus norvegicus
gaatcccagagacgctggcactcaa

SEQ ID NO: 308829 - DNA, 25 bp, Rattus norvegicus
gaatcccagagaggctggcactcaa

SEQ ID NO: 308830 - DNA, 25 bp, Rattus norvegicus
gaatcccagatacttctcacctgat

SEQ ID NO: 308831 - DNA, 25 bp, Rattus norvegicus
gaatcccagatactttcaaggctga

SEQ ID NO: 308832 - DNA, 25 bp, Rattus norvegicus
gaatcccagatagttctcacctgat

SEQ ID NO: 308833 - DNA, 25 bp, Rattus norvegicus
gaatcccagatagtttcaaggctga

SEQ ID NO: 308834 - DNA, 25 bp, Rattus norvegicus
gaatcccagcagaaggccccagaag

SEQ ID NO: 308835 - DNA, 25 bp, Rattus norvegicus
gaatcccagcagtaggccccagaag

SEQ ID NO: 308836 - DNA, 25 bp, Rattus norvegicus
gaatcccaggagaggttagcatttt

SEQ ID NO: 308837 - DNA, 25 bp, Rattus norvegicus
gaatcccaggagtggttagcatttt

SEQ ID NO: 308838 - DNA, 25 bp, Rattus norvegicus
gaatcccagggaacagcatctttca

SEQ ID NO: 308839 - DNA, 25 bp, Rattus norvegicus
gaatcccagggatcagcatctttca

SEQ ID NO: 308840 - DNA, 25 bp, Rattus norvegicus
gaatcccaggtgaaggctagcaaac

SEQ ID NO: 308841 - DNA, 25 bp, Rattus norvegicus
gaatcccaggtgtaggctagcaaac

SEQ ID NO: 308842 - DNA, 25 bp, Rattus norvegicus
gaatcccataggaatgcacacgtca

SEQ ID NO: 308843 - DNA, 25 bp, Rattus norvegicus
gaatcccataggtatgcacacgtca

SEQ ID NO: 308844 - DNA, 25 bp, Rattus norvegicus
gaatcccatctaccgtcataattaa

SEQ ID NO: 308845 - DNA, 25 bp, Rattus norvegicus
gaatcccatctagcgtcataattaa

SEQ ID NO: 308846 - DNA, 25 bp, Rattus norvegicus
gaatcccatctgagaatttgtctta

SEQ ID NO: 308847 - DNA, 25 bp, Rattus norvegicus
gaatcccatctgtgaatttgtctta

SEQ ID NO: 308848 - DNA, 25 bp, Rattus norvegicus
gaatcccatggccatgtaccgatat

SEQ ID NO: 308849 - DNA, 25 bp, Rattus norvegicus
gaatcccatggcgatgtaccgatat

SEQ ID NO: 308850 - DNA, 25 bp, Rattus norvegicus
gaatcccattaaagctatgttgtag

SEQ ID NO: 308851 - DNA, 25 bp, Rattus norvegicus
gaatcccattaatgctatgttgtag

SEQ ID NO: 308852 - DNA, 25 bp, Rattus norvegicus
gaatcccattgtactgccttttgaa

SEQ ID NO: 308853 - DNA, 25 bp, Rattus norvegicus
gaatcccattgttctgccttttgaa

SEQ ID NO: 308854 - DNA, 25 bp, Rattus norvegicus
gaatcccattttcagctgagagccc

SEQ ID NO: 308855 - DNA, 25 bp, Rattus norvegicus
gaatcccattttgagctgagagccc

SEQ ID NO: 308856 - DNA, 25 bp, Rattus norvegicus
gaatccccaaggagttttagcgtgt

SEQ ID NO: 308857 - DNA, 25 bp, Rattus norvegicus
gaatccccaaggtgttttagcgtgt

SEQ ID NO: 308858 - DNA, 25 bp, Rattus norvegicus
gaatccccaggcaaccgagcaagct

SEQ ID NO: 308859 - DNA, 25 bp, Rattus norvegicus
gaatccccaggctaccgagcaagct

SEQ ID NO: 308860 - DNA, 25 bp, Rattus norvegicus
gaatccccgatacatctgtaccaag

SEQ ID NO: 308861 - DNA, 25 bp, Rattus norvegicus
gaatccccgatagatctgtaccaag

SEQ ID NO: 308862 - DNA, 25 bp, Rattus norvegicus
gaatcccctgaactatctgtatccc

SEQ ID NO: 308863 - DNA, 25 bp, Rattus norvegicus
gaatcccctgaagtatctgtatccc

SEQ ID NO: 308864 - DNA, 25 bp, Rattus norvegicus
gaatcccgaaaacataagaagtcaa

SEQ ID NO: 308865 - DNA, 25 bp, Rattus norvegicus
gaatcccgaaaagataagaagtcaa

SEQ ID NO: 308866 - DNA, 25 bp, Rattus norvegicus
gaatcccgaacgaggtgtcgtcgga

SEQ ID NO: 308867 - DNA, 25 bp, Rattus norvegicus
gaatcccgaacgtggtgtcgtcgga

SEQ ID NO: 308868 - DNA, 25 bp, Rattus norvegicus
gaatcccgctagcttgtacatacag

SEQ ID NO: 308869 - DNA, 25 bp, Rattus norvegicus
gaatcccgctaggttgtacatacag

SEQ ID NO: 308870 - DNA, 25 bp, Rattus norvegicus
gaatcccggccacagataagtcgac

SEQ ID NO: 308871 - DNA, 25 bp, Rattus norvegicus
gaatcccggccagagataagtcgac

SEQ ID NO: 308872 - DNA, 25 bp, Rattus norvegicus
gaatcccgtcatcataattgctgtg

SEQ ID NO: 308873 - DNA, 25 bp, Rattus norvegicus
gaatcccgtcatgataattgctgtg

SEQ ID NO: 308874 - DNA, 25 bp, Rattus norvegicus
gaatccctactcaaagttctaatgc

SEQ ID NO: 308875 - DNA, 25 bp, Rattus norvegicus
gaatccctactctaagttctaatgc

SEQ ID NO: 308876 - DNA, 25 bp, Rattus norvegicus
gaatccctagaaagctgtatcaccc

SEQ ID NO: 308877 - DNA, 25 bp, Rattus norvegicus
gaatccctagaatgctgtatcaccc

SEQ ID NO: 308878 - DNA, 25 bp, Rattus norvegicus
gaatccctagtgagcgaagcacccg

SEQ ID NO: 308879 - DNA, 25 bp, Rattus norvegicus
gaatccctagtgtgcgaagcacccg

SEQ ID NO: 308880 - DNA, 25 bp, Rattus norvegicus
gaatccctcactagaagaccaagct

SEQ ID NO: 308881 - DNA, 25 bp, Rattus norvegicus
gaatccctcacttgaagaccaagct

SEQ ID NO: 308882 - DNA, 25 bp, Rattus norvegicus
gaatccctcattatctatgttcttc

SEQ ID NO: 308883 - DNA, 25 bp, Rattus norvegicus
gaatccctcattttctatgttcttc

SEQ ID NO: 308884 - DNA, 25 bp, Rattus norvegicus
gaatccctccaaccagaaggctcaa

SEQ ID NO: 308885 - DNA, 25 bp, Rattus norvegicus
gaatccctccaagcagaaggctcaa

SEQ ID NO: 308886 - DNA, 25 bp, Rattus norvegicus
gaatccctgatgacttattggaaca

SEQ ID NO: 308887 - DNA, 25 bp, Rattus norvegicus
gaatccctgatgtcttattggaaca

SEQ ID NO: 308888 - DNA, 25 bp, Rattus norvegicus
gaatccctgctcagtggtggactac

SEQ ID NO: 308889 - DNA, 25 bp, Rattus norvegicus
gaatccctgctctgtggtggactac

SEQ ID NO: 308890 - DNA, 25 bp, Rattus norvegicus
gaatccctggataggcctgcacaga

SEQ ID NO: 308891 - DNA, 25 bp, Rattus norvegicus
gaatccctggattggcctgcacaga

SEQ ID NO: 308892 - DNA, 25 bp, Rattus norvegicus
gaatccctgtatcgataccacttgg

SEQ ID NO: 308893 - DNA, 25 bp, Rattus norvegicus
gaatccctgtatggataccacttgg

SEQ ID NO: 308894 - DNA, 25 bp, Rattus norvegicus
gaatccctgttaaggcatgggtctt

SEQ ID NO: 308895 - DNA, 25 bp, Rattus norvegicus
gaatccctgttatggcatgggtctt

SEQ ID NO: 308896 - DNA, 25 bp, Rattus norvegicus
gaatccctgtttcgaatgagccttt

SEQ ID NO: 308897 - DNA, 25 bp, Rattus norvegicus
gaatccctgtttggaatgagccttt

SEQ ID NO: 308898 - DNA, 25 bp, Rattus norvegicus
gaatcccttattcccagcaagtgag

SEQ ID NO: 308899 - DNA, 25 bp, Rattus norvegicus
gaatcccttattgccagcaagtgag

SEQ ID NO: 308900 - DNA, 25 bp, Rattus norvegicus
gaatcccttcccatcgttaagaatg

SEQ ID NO: 308901 - DNA, 25 bp, Rattus norvegicus
gaatcccttcccttcgttaagaatg

SEQ ID NO: 308902 - DNA, 25 bp, Rattus norvegicus
gaatcccttctgactgtaggccgta

SEQ ID NO: 308903 - DNA, 25 bp, Rattus norvegicus
gaatcccttctgtctgtaggccgta

SEQ ID NO: 308904 - DNA, 25 bp, Rattus norvegicus
gaatcccttgagaagactgatagct

SEQ ID NO: 308905 - DNA, 25 bp, Rattus norvegicus
gaatcccttgagtagactgatagct

SEQ ID NO: 308906 - DNA, 25 bp, Rattus norvegicus
gaatcccttgggattagtatatctt

SEQ ID NO: 308907 - DNA, 25 bp, Rattus norvegicus
gaatcccttgggtttagtatatctt

SEQ ID NO: 308908 - DNA, 25 bp, Rattus norvegicus
gaatcccttgtgatgcaacagtata

SEQ ID NO: 308909 - DNA, 25 bp, Rattus norvegicus
gaatcccttgtgttgcaacagtata

SEQ ID NO: 308910 - DNA, 25 bp, Rattus norvegicus
gaatccctttggataaactacatgt

SEQ ID NO: 308911 - DNA, 25 bp, Rattus norvegicus
gaatccctttggttaaactacatgt

SEQ ID NO: 308912 - DNA, 25 bp, Rattus norvegicus
gaatccgactttacaggagcatact

SEQ ID NO: 308913 - DNA, 25 bp, Rattus norvegicus
gaatccgacttttcaggagcatact

SEQ ID NO: 308914 - DNA, 25 bp, Rattus norvegicus
gaatccgaggacatggcacagcgaa

SEQ ID NO: 308915 - DNA, 25 bp, Rattus norvegicus
gaatccgaggacttggcacagcgaa

SEQ ID NO: 308916 - DNA, 25 bp, Rattus norvegicus
gaatccgcatttctatttcaagata

SEQ ID NO: 308917 - DNA, 25 bp, Rattus norvegicus
gaatccgcatttgtatttcaagata

SEQ ID NO: 308918 - DNA, 25 bp, Rattus norvegicus
gaatccgctgagaagtctggcctgc

SEQ ID NO: 308919 - DNA, 25 bp, Rattus norvegicus
gaatccgctgagtagtctggcctgc

SEQ ID NO: 308920 - DNA, 25 bp, Rattus norvegicus
gaatccggaaagagtcactcggtag

SEQ ID NO: 308921 - DNA, 25 bp, Rattus norvegicus
gaatccggaaagtgtcactcggtag

SEQ ID NO: 308922 - DNA, 25 bp, Rattus norvegicus
gaatccggacaccaaacagattgaa

SEQ ID NO: 308923 - DNA, 25 bp, Rattus norvegicus
gaatccggacacgaaacagattgaa

SEQ ID NO: 308924 - DNA, 25 bp, Rattus norvegicus
gaatccggagacagaggttcgacca

SEQ ID NO: 308925 - DNA, 25 bp, Rattus norvegicus
gaatccggagactgaggttcgacca

SEQ ID NO: 308926 - DNA, 25 bp, Rattus norvegicus
gaatccggatcccatttgtgaataa

SEQ ID NO: 308927 - DNA, 25 bp, Rattus norvegicus
gaatccggatccgatttgtgaataa

SEQ ID NO: 308928 - DNA, 25 bp, Rattus norvegicus
gaatccggctctataacgcattgaa

SEQ ID NO: 308929 - DNA, 25 bp, Rattus norvegicus
gaatccggctctttaacgcattgaa

SEQ ID NO: 308930 - DNA, 25 bp, Rattus norvegicus
gaatccgggacactcttcggcgcgt

SEQ ID NO: 308931 - DNA, 25 bp, Rattus norvegicus
gaatccgggacagtcttcggcgcgt

SEQ ID NO: 308932 - DNA, 25 bp, Rattus norvegicus
gaatccgggagccttacccagagct

SEQ ID NO: 308933 - DNA, 25 bp, Rattus norvegicus
gaatccgggagcgttacccagagct

SEQ ID NO: 308934 - DNA, 25 bp, Rattus norvegicus
gaatccgggcgcagaaggctgccct

SEQ ID NO: 308935 - DNA, 25 bp, Rattus norvegicus
gaatccgggcgctgaaggctgccct

SEQ ID NO: 308936 - DNA, 25 bp, Rattus norvegicus
gaatccgggttcaaggtcattttca

SEQ ID NO: 308937 - DNA, 25 bp, Rattus norvegicus
gaatccgggttctaggtcattttca

SEQ ID NO: 308938 - DNA, 25 bp, Rattus norvegicus
gaatccgtaatcataagtaccgaag

SEQ ID NO: 308939 - DNA, 25 bp, Rattus norvegicus
gaatccgtaatcttaagtaccgaag

SEQ ID NO: 308940 - DNA, 25 bp, Rattus norvegicus
gaatccgtgtctctgctcaacctct

SEQ ID NO: 308941 - DNA, 25 bp, Rattus norvegicus
gaatccgtgtctgtgctcaacctct

SEQ ID NO: 308942 - DNA, 25 bp, Rattus norvegicus
gaatccgtgtttatccactctttat

SEQ ID NO: 308943 - DNA, 25 bp, Rattus norvegicus
gaatccgtgtttttccactctttat

SEQ ID NO: 308944 - DNA, 25 bp, Rattus norvegicus
gaatccgttggccatgttggtccct

SEQ ID NO: 308945 - DNA, 25 bp, Rattus norvegicus
gaatccgttggcgatgttggtccct

SEQ ID NO: 308946 - DNA, 25 bp, Rattus norvegicus
gaatcctaaggtaggtgtgtctcga

SEQ ID NO: 308947 - DNA, 25 bp, Rattus norvegicus
gaatcctaaggttggtgtgtctcga

SEQ ID NO: 308948 - DNA, 25 bp, Rattus norvegicus
gaatcctaagttatatcttgtttgt

SEQ ID NO: 308949 - DNA, 25 bp, Rattus norvegicus
gaatcctaagttttatcttgtttgt

SEQ ID NO: 308950 - DNA, 25 bp, Rattus norvegicus
gaatcctacaagctcctgccaggag

SEQ ID NO: 308951 - DNA, 25 bp, Rattus norvegicus
gaatcctacaaggtcctgccaggag

SEQ ID NO: 308952 - DNA, 25 bp, Rattus norvegicus
gaatcctacacgcttgtcactatgg

SEQ ID NO: 308953 - DNA, 25 bp, Rattus norvegicus
gaatcctacacggttgtcactatgg

SEQ ID NO: 308954 - DNA, 25 bp, Rattus norvegicus
gaatcctactagaggccagaaaaag

SEQ ID NO: 308955 - DNA, 25 bp, Rattus norvegicus
gaatcctactagtggccagaaaaag

SEQ ID NO: 308956 - DNA, 25 bp, Rattus norvegicus
gaatcctagaccacttggtttcctt

SEQ ID NO: 308957 - DNA, 25 bp, Rattus norvegicus
gaatcctagacctcttggtttcctt

SEQ ID NO: 308958 - DNA, 25 bp, Rattus norvegicus
gaatcctagggcagtgtggactaca

SEQ ID NO: 308959 - DNA, 25 bp, Rattus norvegicus
gaatcctagggctgtgtggactaca

SEQ ID NO: 308960 - DNA, 25 bp, Rattus norvegicus
gaatcctagttcaaggtctcactgg

SEQ ID NO: 308961 - DNA, 25 bp, Rattus norvegicus
gaatcctagttctaggtctcactgg

SEQ ID NO: 308962 - DNA, 25 bp, Rattus norvegicus
gaatcctatctgattgctgatgcct

SEQ ID NO: 308963 - DNA, 25 bp, Rattus norvegicus
gaatcctatctgtttgctgatgcct

SEQ ID NO: 308964 - DNA, 25 bp, Rattus norvegicus
gaatcctatgcacgaggcagcacct

SEQ ID NO: 308965 - DNA, 25 bp, Rattus norvegicus
gaatcctatgcaggaggcagcacct

SEQ ID NO: 308966 - DNA, 25 bp, Rattus norvegicus
gaatcctatgccctatgtatttaca

SEQ ID NO: 308967 - DNA, 25 bp, Rattus norvegicus
gaatcctatgccgtatgtatttaca

SEQ ID NO: 308968 - DNA, 25 bp, Rattus norvegicus
gaatcctatggaatcctttctctta

SEQ ID NO: 308969 - DNA, 25 bp, Rattus norvegicus
gaatcctatggattcctttctctta

SEQ ID NO: 308970 - DNA, 25 bp, Rattus norvegicus
gaatcctcaacgcatttcagaaggc

SEQ ID NO: 308971 - DNA, 25 bp, Rattus norvegicus
gaatcctcaacggatttcagaaggc

SEQ ID NO: 308972 - DNA, 25 bp, Rattus norvegicus
gaatcctcacaactttacctataga

SEQ ID NO: 308973 - DNA, 25 bp, Rattus norvegicus
gaatcctcacaagtttacctataga

SEQ ID NO: 308974 - DNA, 25 bp, Rattus norvegicus
gaatcctcagagcacaacctacatt

SEQ ID NO: 308975 - DNA, 25 bp, Rattus norvegicus
gaatcctcagaggacaacctacatt

SEQ ID NO: 308976 - DNA, 25 bp, Rattus norvegicus
gaatcctcagccatgtaaaatgcaa

SEQ ID NO: 308977 - DNA, 25 bp, Rattus norvegicus
gaatcctcagccttgtaaaatgcaa

SEQ ID NO: 308978 - DNA, 25 bp, Rattus norvegicus
gaatcctcagtcatgtgctattttc

SEQ ID NO: 308979 - DNA, 25 bp, Rattus norvegicus
gaatcctcagtcttgtgctattttc

SEQ ID NO: 308980 - DNA, 25 bp, Rattus norvegicus
gaatcctccaaacttctagacctgg

SEQ ID NO: 308981 - DNA, 25 bp, Rattus norvegicus
gaatcctccaaagttctagacctgg

SEQ ID NO: 308982 - DNA, 25 bp, Rattus norvegicus
gaatcctccaatcaatgtcacagtg

SEQ ID NO: 308983 - DNA, 25 bp, Rattus norvegicus
gaatcctccaatgaatgtcacagtg

SEQ ID NO: 308984 - DNA, 25 bp, Rattus norvegicus
gaatcctccctgagtgatgtgttcg

SEQ ID NO: 308985 - DNA, 25 bp, Rattus norvegicus
gaatcctccctgtgtgatgtgttcg

SEQ ID NO: 308986 - DNA, 25 bp, Rattus norvegicus
gaatcctcctataaatcttctcatt

SEQ ID NO: 308987 - DNA, 25 bp, Rattus norvegicus
gaatcctcctattaatcttctcatt

SEQ ID NO: 308988 - DNA, 25 bp, Rattus norvegicus
gaatcctcctgcagaaagtggccgg

SEQ ID NO: 308989 - DNA, 25 bp, Rattus norvegicus
gaatcctcctgctgaaagtggccgg

SEQ ID NO: 308990 - DNA, 25 bp, Rattus norvegicus
gaatcctcgaatctcctagaacttg

SEQ ID NO: 308991 - DNA, 25 bp, Rattus norvegicus
gaatcctcgaatgtcctagaacttg

SEQ ID NO: 308992 - DNA, 25 bp, Rattus norvegicus
gaatcctcgtaaatattgactgggc

SEQ ID NO: 308993 - DNA, 25 bp, Rattus norvegicus
gaatcctcgtaattattgactgggc

SEQ ID NO: 308994 - DNA, 25 bp, Rattus norvegicus
gaatcctctagcatgctgcatttta

SEQ ID NO: 308995 - DNA, 25 bp, Rattus norvegicus
gaatcctctagcttgctgcatttta

SEQ ID NO: 308996 - DNA, 25 bp, Rattus norvegicus
gaatcctctcaccagcttaagttag

SEQ ID NO: 308997 - DNA, 25 bp, Rattus norvegicus
gaatcctctcacgagcttaagttag

SEQ ID NO: 308998 - DNA, 25 bp, Rattus norvegicus
gaatcctctcctcattctccagaat

SEQ ID NO: 308999 - DNA, 25 bp, Rattus norvegicus
gaatcctctcctgattctccagaat

SEQ ID NO: 309000 - DNA, 25 bp, Rattus norvegicus
gaatcctctgggaggtgacagctct

SEQ ID NO: 309001 - DNA, 25 bp, Rattus norvegicus
gaatcctctgggtggtgacagctct

SEQ ID NO: 309002 - DNA, 25 bp, Rattus norvegicus
gaatcctcttctaacctctaaataa

SEQ ID NO: 309003 - DNA, 25 bp, Rattus norvegicus
gaatcctcttcttacctctaaataa

SEQ ID NO: 309004 - DNA, 25 bp, Rattus norvegicus
gaatcctcttggctagattatccag

SEQ ID NO: 309005 - DNA, 25 bp, Rattus norvegicus
gaatcctcttggctctgatggtcac

SEQ ID NO: 309006 - DNA, 25 bp, Rattus norvegicus
gaatcctcttgggtagattatccag

SEQ ID NO: 309007 - DNA, 25 bp, Rattus norvegicus
gaatcctcttgggtctgatggtcac

SEQ ID NO: 309008 - DNA, 25 bp, Rattus norvegicus
gaatcctgaatacgtccgtgtcccc

SEQ ID NO: 309009 - DNA, 25 bp, Rattus norvegicus
gaatcctgaataggtccgtgtcccc

SEQ ID NO: 309010 - DNA, 25 bp, Rattus norvegicus
gaatcctgaatgctgctggcctgac

SEQ ID NO: 309011 - DNA, 25 bp, Rattus norvegicus
gaatcctgaatggtgctggcctgac

SEQ ID NO: 309012 - DNA, 25 bp, Rattus norvegicus
gaatcctgacagaactggtgcccca

SEQ ID NO: 309013 - DNA, 25 bp, Rattus norvegicus
gaatcctgacagtactggtgcccca

SEQ ID NO: 309014 - DNA, 25 bp, Rattus norvegicus
gaatcctgaccaatgagcactagct

SEQ ID NO: 309015 - DNA, 25 bp, Rattus norvegicus
gaatcctgaccattgagcactagct

SEQ ID NO: 309016 - DNA, 25 bp, Rattus norvegicus
gaatcctgactgctattactgggta

SEQ ID NO: 309017 - DNA, 25 bp, Rattus norvegicus
gaatcctgactggtattactgggta

SEQ ID NO: 309018 - DNA, 25 bp, Rattus norvegicus
gaatcctgagcaaccatcatgtaga

SEQ ID NO: 309019 - DNA, 25 bp, Rattus norvegicus
gaatcctgagcatccatcatgtaga

SEQ ID NO: 309020 - DNA, 25 bp, Rattus norvegicus
gaatcctgagtgaatgtaatgcctt

SEQ ID NO: 309021 - DNA, 25 bp, Rattus norvegicus
gaatcctgagtgtatgtaatgcctt

SEQ ID NO: 309022 - DNA, 25 bp, Rattus norvegicus
gaatcctgatcaatcatatggagaa

SEQ ID NO: 309023 - DNA, 25 bp, Rattus norvegicus
gaatcctgatcattcatatggagaa

SEQ ID NO: 309024 - DNA, 25 bp, Rattus norvegicus
gaatcctgatgcagtcttaagtttt

SEQ ID NO: 309025 - DNA, 25 bp, Rattus norvegicus
gaatcctgatgctgtcttaagtttt

SEQ ID NO: 309026 - DNA, 25 bp, Rattus norvegicus
gaatcctgccccagacaggacagtt

SEQ ID NO: 309027 - DNA, 25 bp, Rattus norvegicus
gaatcctgcccctgacaggacagtt

SEQ ID NO: 309028 - DNA, 25 bp, Rattus norvegicus
gaatcctgccttcatgtattcacaa

SEQ ID NO: 309029 - DNA, 25 bp, Rattus norvegicus
gaatcctgccttgatgtattcacaa

SEQ ID NO: 309030 - DNA, 25 bp, Rattus norvegicus
gaatcctgcggcacatactagcaat

SEQ ID NO: 309031 - DNA, 25 bp, Rattus norvegicus
gaatcctgcggctcatactagcaat

SEQ ID NO: 309032 - DNA, 25 bp, Rattus norvegicus
gaatcctgcgggagatctggcgcac

SEQ ID NO: 309033 - DNA, 25 bp, Rattus norvegicus
gaatcctgcgggtgatctggcgcac

SEQ ID NO: 309034 - DNA, 25 bp, Rattus norvegicus
gaatcctgctagaagccagacacag

SEQ ID NO: 309035 - DNA, 25 bp, Rattus norvegicus
gaatcctgctagtagccagacacag

SEQ ID NO: 309036 - DNA, 25 bp, Rattus norvegicus
gaatcctggagccttgaattttgtt

SEQ ID NO: 309037 - DNA, 25 bp, Rattus norvegicus
gaatcctggagcgttgaattttgtt

SEQ ID NO: 309038 - DNA, 25 bp, Rattus norvegicus
gaatcctggagtagaatggccttaa

SEQ ID NO: 309039 - DNA, 25 bp, Rattus norvegicus
gaatcctggagttgaatggccttaa

SEQ ID NO: 309040 - DNA, 25 bp, Rattus norvegicus
gaatcctggatacaggcctctggga

SEQ ID NO: 309041 - DNA, 25 bp, Rattus norvegicus
gaatcctggatagaggcctctggga

SEQ ID NO: 309042 - DNA, 25 bp, Rattus norvegicus
gaatcctggctaattttaagacaaa

SEQ ID NO: 309043 - DNA, 25 bp, Rattus norvegicus
gaatcctggctatttttaagacaaa

SEQ ID NO: 309044 - DNA, 25 bp, Rattus norvegicus
gaatcctggctcaggactccaagat

SEQ ID NO: 309045 - DNA, 25 bp, Rattus norvegicus
gaatcctggctctggactccaagat

SEQ ID NO: 309046 - DNA, 25 bp, Rattus norvegicus
gaatcctggtagacgagtgcctcct

SEQ ID NO: 309047 - DNA, 25 bp, Rattus norvegicus
gaatcctggtagtcgagtgcctcct

SEQ ID NO: 309048 - DNA, 25 bp, Rattus norvegicus
gaatcctggttcaacactttcaatg

SEQ ID NO: 309049 - DNA, 25 bp, Rattus norvegicus
gaatcctggttctacactttcaatg

SEQ ID NO: 309050 - DNA, 25 bp, Rattus norvegicus
gaatcctgtcagatgccaaagagtt

SEQ ID NO: 309051 - DNA, 25 bp, Rattus norvegicus
gaatcctgtcagttgccaaagagtt

SEQ ID NO: 309052 - DNA, 25 bp, Rattus norvegicus
gaatcctgtcccctgatgttgaaat

SEQ ID NO: 309053 - DNA, 25 bp, Rattus norvegicus
gaatcctgtcccgtgatgttgaaat

SEQ ID NO: 309054 - DNA, 25 bp, Rattus norvegicus
gaatcctgtcctcctggtaataaca

SEQ ID NO: 309055 - DNA, 25 bp, Rattus norvegicus
gaatcctgtcctgctggtaataaca

SEQ ID NO: 309056 - DNA, 25 bp, Rattus norvegicus
gaatcctgtgcacattttatagttt

SEQ ID NO: 309057 - DNA, 25 bp, Rattus norvegicus
gaatcctgtgcagattttatagttt

SEQ ID NO: 309058 - DNA, 25 bp, Rattus norvegicus
gaatcctgtgtaacattacttgtcc

SEQ ID NO: 309059 - DNA, 25 bp, Rattus norvegicus
gaatcctgtgtatcattacttgtcc

SEQ ID NO: 309060 - DNA, 25 bp, Rattus norvegicus
gaatcctgttctagtctaaagcctg

SEQ ID NO: 309061 - DNA, 25 bp, Rattus norvegicus
gaatcctgttcttgtctaaagcctg

SEQ ID NO: 309062 - DNA, 25 bp, Rattus norvegicus
gaatccttaactctgggccattcat

SEQ ID NO: 309063 - DNA, 25 bp, Rattus norvegicus
gaatccttaactgtgggccattcat

SEQ ID NO: 309064 - DNA, 25 bp, Rattus norvegicus
gaatccttaagtccaaaggccttgc

SEQ ID NO: 309065 - DNA, 25 bp, Rattus norvegicus
gaatccttaagtgcaaaggccttgc

SEQ ID NO: 309066 - DNA, 25 bp, Rattus norvegicus
gaatccttaattagcagtactgttt

SEQ ID NO: 309067 - DNA, 25 bp, Rattus norvegicus
gaatccttaatttgcagtactgttt

SEQ ID NO: 309068 - DNA, 25 bp, Rattus norvegicus
gaatccttacatatagtcctacttt

SEQ ID NO: 309069 - DNA, 25 bp, Rattus norvegicus
gaatccttacatttagtcctacttt

SEQ ID NO: 309070 - DNA, 25 bp, Rattus norvegicus
gaatccttagagaccttaacaccat

SEQ ID NO: 309071 - DNA, 25 bp, Rattus norvegicus
gaatccttagagtccttaacaccat

SEQ ID NO: 309072 - DNA, 25 bp, Rattus norvegicus
gaatccttaggacctcggtgcgagc

SEQ ID NO: 309073 - DNA, 25 bp, Rattus norvegicus
gaatccttaggagctcggtgcgagc

SEQ ID NO: 309074 - DNA, 25 bp, Rattus norvegicus
gaatccttagttctacaacctccaa

SEQ ID NO: 309075 - DNA, 25 bp, Rattus norvegicus
gaatccttagttgtacaacctccaa

SEQ ID NO: 309076 - DNA, 25 bp, Rattus norvegicus
gaatccttcaaacgtgctgacatct

SEQ ID NO: 309077 - DNA, 25 bp, Rattus norvegicus
gaatccttcaaaggtgctgacatct

SEQ ID NO: 309078 - DNA, 25 bp, Rattus norvegicus
gaatccttcagtcagtcaagcatcc

SEQ ID NO: 309079 - DNA, 25 bp, Rattus norvegicus
gaatccttcagtgagtcaagcatcc

SEQ ID NO: 309080 - DNA, 25 bp, Rattus norvegicus
gaatccttctggctgtcgcttttgc

SEQ ID NO: 309081 - DNA, 25 bp, Rattus norvegicus
gaatccttctgggtgtcgcttttgc

SEQ ID NO: 309082 - DNA, 25 bp, Rattus norvegicus
gaatccttgaggagcatatcccttg

SEQ ID NO: 309083 - DNA, 25 bp, Rattus norvegicus
gaatccttgaggtgcatatcccttg

SEQ ID NO: 309084 - DNA, 25 bp, Rattus norvegicus
gaatccttgattactaatttggctt

SEQ ID NO: 309085 - DNA, 25 bp, Rattus norvegicus
gaatccttgatttctaatttggctt

SEQ ID NO: 309086 - DNA, 25 bp, Rattus norvegicus
gaatccttgcctagcttataaccat

SEQ ID NO: 309087 - DNA, 25 bp, Rattus norvegicus
gaatccttgccttgcttataaccat

SEQ ID NO: 309088 - DNA, 25 bp, Rattus norvegicus
gaatccttggaacctgccttatgag

SEQ ID NO: 309089 - DNA, 25 bp, Rattus norvegicus
gaatccttggaagctgccttatgag

SEQ ID NO: 309090 - DNA, 25 bp, Rattus norvegicus
gaatccttgggtattttgacagtac

SEQ ID NO: 309091 - DNA, 25 bp, Rattus norvegicus
gaatccttgggttttttgacagtac

SEQ ID NO: 309092 - DNA, 25 bp, Rattus norvegicus
gaatccttggtcagatgatgagtcc

SEQ ID NO: 309093 - DNA, 25 bp, Rattus norvegicus
gaatccttggtctgatgatgagtcc

SEQ ID NO: 309094 - DNA, 25 bp, Rattus norvegicus
gaatccttgttactggatgaccaac

SEQ ID NO: 309095 - DNA, 25 bp, Rattus norvegicus
gaatccttgttactgttatcctttg

SEQ ID NO: 309096 - DNA, 25 bp, Rattus norvegicus
gaatccttgttagtggatgaccaac

SEQ ID NO: 309097 - DNA, 25 bp, Rattus norvegicus
gaatccttgttagtgttatcctttg

SEQ ID NO: 309098 - DNA, 25 bp, Rattus norvegicus
gaatcctttactcaggctcagggaa

SEQ ID NO: 309099 - DNA, 25 bp, Rattus norvegicus
gaatcctttactgaggctcagggaa

SEQ ID NO: 309100 - DNA, 25 bp, Rattus norvegicus
gaatcctttattcttgtagtagtaa

SEQ ID NO: 309101 - DNA, 25 bp, Rattus norvegicus
gaatcctttattgttgtagtagtaa

SEQ ID NO: 309102 - DNA, 25 bp, Rattus norvegicus
gaatcctttcagataccaatttagt

SEQ ID NO: 309103 - DNA, 25 bp, Rattus norvegicus
gaatcctttcagttaccaatttagt

SEQ ID NO: 309104 - DNA, 25 bp, Rattus norvegicus
gaatcctttcgccagttaccaggat

SEQ ID NO: 309105 - DNA, 25 bp, Rattus norvegicus
gaatcctttcgcgagttaccaggat

SEQ ID NO: 309106 - DNA, 25 bp, Rattus norvegicus
gaatcctttcttaaattatcccatc

SEQ ID NO: 309107 - DNA, 25 bp, Rattus norvegicus
gaatcctttctttaattatcccatc

SEQ ID NO: 309108 - DNA, 25 bp, Rattus norvegicus
gaatcctttgacctcattctgcttt

SEQ ID NO: 309109 - DNA, 25 bp, Rattus norvegicus
gaatcctttgacgtcattctgcttt

SEQ ID NO: 309110 - DNA, 25 bp, Rattus norvegicus
gaatcctttgagctcccaacacttg

SEQ ID NO: 309111 - DNA, 25 bp, Rattus norvegicus
gaatcctttgaggtcccaacacttg

SEQ ID NO: 309112 - DNA, 25 bp, Rattus norvegicus
gaatcctttgcactgtgtggtcaga

SEQ ID NO: 309113 - DNA, 25 bp, Rattus norvegicus
gaatcctttgcagtgtgtggtcaga

SEQ ID NO: 309114 - DNA, 25 bp, Rattus norvegicus
gaatcctttgctataactgatgcta

SEQ ID NO: 309115 - DNA, 25 bp, Rattus norvegicus
gaatcctttgctttaactgatgcta

SEQ ID NO: 309116 - DNA, 25 bp, Rattus norvegicus
gaatccttttccctaggcctaggag

SEQ ID NO: 309117 - DNA, 25 bp, Rattus norvegicus
gaatccttttccgtaggcctaggag

SEQ ID NO: 309118 - DNA, 25 bp, Rattus norvegicus
gaatccttttgtaatgcaagccaac

SEQ ID NO: 309119 - DNA, 25 bp, Rattus norvegicus
gaatccttttgttatgcaagccaac

SEQ ID NO: 309120 - DNA, 25 bp, Rattus norvegicus
gaatcgaactatcaatcccactgtg

SEQ ID NO: 309121 - DNA, 25 bp, Rattus norvegicus
gaatcgaactatgaatcccactgtg

SEQ ID NO: 309122 - DNA, 25 bp, Rattus norvegicus
gaatcgaagaagcacttaactccct

SEQ ID NO: 309123 - DNA, 25 bp, Rattus norvegicus
gaatcgaagaaggacttaactccct

SEQ ID NO: 309124 - DNA, 25 bp, Rattus norvegicus
gaatcgaattctactcagcctttat

SEQ ID NO: 309125 - DNA, 25 bp, Rattus norvegicus
gaatcgaattcttctcagcctttat

SEQ ID NO: 309126 - DNA, 25 bp, Rattus norvegicus
gaatcgaatttgatcccatgctgga

SEQ ID NO: 309127 - DNA, 25 bp, Rattus norvegicus
gaatcgaatttgttcccatgctgga

SEQ ID NO: 309128 - DNA, 25 bp, Rattus norvegicus
gaatcgacaccaaatctcgagctgc

SEQ ID NO: 309129 - DNA, 25 bp, Rattus norvegicus
gaatcgacaccatatctcgagctgc

SEQ ID NO: 309130 - DNA, 25 bp, Rattus norvegicus
gaatcgacggtaatgcggcactgat

SEQ ID NO: 309131 - DNA, 25 bp, Rattus norvegicus
gaatcgacggtattgcggcactgat

SEQ ID NO: 309132 - DNA, 25 bp, Rattus norvegicus
gaatcgacggtcagttgcggttcct

SEQ ID NO: 309133 - DNA, 25 bp, Rattus norvegicus
gaatcgacggtctgttgcggttcct

SEQ ID NO: 309134 - DNA, 25 bp, Rattus norvegicus
gaatcgaggagacacgacttgagaa

SEQ ID NO: 309135 - DNA, 25 bp, Rattus norvegicus
gaatcgaggagagacgacttgagaa

SEQ ID NO: 309136 - DNA, 25 bp, Rattus norvegicus
gaatcgaggcctataccttgagtgt

SEQ ID NO: 309137 - DNA, 25 bp, Rattus norvegicus
gaatcgaggcctttaccttgagtgt

SEQ ID NO: 309138 - DNA, 25 bp, Rattus norvegicus
gaatcgaggcgacacttatacttaa

SEQ ID NO: 309139 - DNA, 25 bp, Rattus norvegicus
gaatcgaggcgagacttatacttaa

SEQ ID NO: 309140 - DNA, 25 bp, Rattus norvegicus
gaatcgaggtttccccaaatggcac

SEQ ID NO: 309141 - DNA, 25 bp, Rattus norvegicus
gaatcgaggtttgcccaaatggcac

SEQ ID NO: 309142 - DNA, 25 bp, Rattus norvegicus
gaatcgatatcacgttgatccccaa

SEQ ID NO: 309143 - DNA, 25 bp, Rattus norvegicus
gaatcgatatcaggttgatccccaa

SEQ ID NO: 309144 - DNA, 25 bp, Rattus norvegicus
gaatcgatccacagtacaggtactg

SEQ ID NO: 309145 - DNA, 25 bp, Rattus norvegicus
gaatcgatccactgtacaggtactg

SEQ ID NO: 309146 - DNA, 25 bp, Rattus norvegicus
gaatcgattcaacacgtctatgaca

SEQ ID NO: 309147 - DNA, 25 bp, Rattus norvegicus
gaatcgattcaagacgtctatgaca

SEQ ID NO: 309148 - DNA, 25 bp, Rattus norvegicus
gaatcgattcatccaagttgtcttg

SEQ ID NO: 309149 - DNA, 25 bp, Rattus norvegicus
gaatcgattcatgcaagttgtcttg

SEQ ID NO: 309150 - DNA, 25 bp, Rattus norvegicus
gaatcgattgttaaacttttcctgt

SEQ ID NO: 309151 - DNA, 25 bp, Rattus norvegicus
gaatcgattgtttaacttttcctgt

SEQ ID NO: 309152 - DNA, 25 bp, Rattus norvegicus
gaatcgcacagacgactagttgggt

SEQ ID NO: 309153 - DNA, 25 bp, Rattus norvegicus
gaatcgcacagaggactagttgggt

SEQ ID NO: 309154 - DNA, 25 bp, Rattus norvegicus
gaatcgcatgtcctagagagctgaa

SEQ ID NO: 309155 - DNA, 25 bp, Rattus norvegicus
gaatcgcatgtcgtagagagctgaa

SEQ ID NO: 309156 - DNA, 25 bp, Rattus norvegicus
gaatcgccatagctggagcagtgta

SEQ ID NO: 309157 - DNA, 25 bp, Rattus norvegicus
gaatcgccataggtggagcagtgta

SEQ ID NO: 309158 - DNA, 25 bp, Rattus norvegicus
gaatcgccattgcaggagccacaga

SEQ ID NO: 309159 - DNA, 25 bp, Rattus norvegicus
gaatcgccattggaggagccacaga

SEQ ID NO: 309160 - DNA, 25 bp, Rattus norvegicus
gaatcgcgagcacagtacgtcagga

SEQ ID NO: 309161 - DNA, 25 bp, Rattus norvegicus
gaatcgcgagcagagtacgtcagga

SEQ ID NO: 309162 - DNA, 25 bp, Rattus norvegicus
gaatcgcgcaccagaggaggagctc

SEQ ID NO: 309163 - DNA, 25 bp, Rattus norvegicus
gaatcgcgcacctgaggaggagctc

SEQ ID NO: 309164 - DNA, 25 bp, Rattus norvegicus
gaatcgcggcgaaatccgacagcca

SEQ ID NO: 309165 - DNA, 25 bp, Rattus norvegicus
gaatcgcggcgatatccgacagcca

SEQ ID NO: 309166 - DNA, 25 bp, Rattus norvegicus
gaatcgctcgtccagttttaacatt

SEQ ID NO: 309167 - DNA, 25 bp, Rattus norvegicus
gaatcgctcgtcgagttttaacatt

SEQ ID NO: 309168 - DNA, 25 bp, Rattus norvegicus
gaatcgctggaacttctgctgactg

SEQ ID NO: 309169 - DNA, 25 bp, Rattus norvegicus
gaatcgctggaagttctgctgactg

SEQ ID NO: 309170 - DNA, 25 bp, Rattus norvegicus
gaatcgctggctatggttatccctt

SEQ ID NO: 309171 - DNA, 25 bp, Rattus norvegicus
gaatcgctggctttggttatccctt

SEQ ID NO: 309172 - DNA, 25 bp, Rattus norvegicus
gaatcgctttacatagtccacttac

SEQ ID NO: 309173 - DNA, 25 bp, Rattus norvegicus
gaatcgctttacttagtccacttac

SEQ ID NO: 309174 - DNA, 25 bp, Rattus norvegicus
gaatcggaaactcggcacatgtggc

SEQ ID NO: 309175 - DNA, 25 bp, Rattus norvegicus
gaatcggaaactgggcacatgtggc

SEQ ID NO: 309176 - DNA, 25 bp, Rattus norvegicus
gaatcggaacgaaaccatatctact

SEQ ID NO: 309177 - DNA, 25 bp, Rattus norvegicus
gaatcggaacgataccatatctact

SEQ ID NO: 309178 - DNA, 25 bp, Rattus norvegicus
gaatcggacaaacatgactcccgcc

SEQ ID NO: 309179 - DNA, 25 bp, Rattus norvegicus
gaatcggacaaagatgactcccgcc

SEQ ID NO: 309180 - DNA, 25 bp, Rattus norvegicus
gaatcggaccaaacacctgtccact

SEQ ID NO: 309181 - DNA, 25 bp, Rattus norvegicus
gaatcggaccaacattgtcaagcca

SEQ ID NO: 309182 - DNA, 25 bp, Rattus norvegicus
gaatcggaccaagattgtcaagcca

SEQ ID NO: 309183 - DNA, 25 bp, Rattus norvegicus
gaatcggaccaatcacctgtccact

SEQ ID NO: 309184 - DNA, 25 bp, Rattus norvegicus
gaatcggactcacttgatgtctcct

SEQ ID NO: 309185 - DNA, 25 bp, Rattus norvegicus
gaatcggactcagttgatgtctcct

SEQ ID NO: 309186 - DNA, 25 bp, Rattus norvegicus
gaatcggagataccacagtcacaaa

SEQ ID NO: 309187 - DNA, 25 bp, Rattus norvegicus
gaatcggagatagcacagtcacaaa

SEQ ID NO: 309188 - DNA, 25 bp, Rattus norvegicus
gaatcggatacaatttctttatagt

SEQ ID NO: 309189 - DNA, 25 bp, Rattus norvegicus
gaatcggatacattttctttatagt

SEQ ID NO: 309190 - DNA, 25 bp, Rattus norvegicus
gaatcggatggtctcaggttgaact

SEQ ID NO: 309191 - DNA, 25 bp, Rattus norvegicus
gaatcggatggtgtcaggttgaact

SEQ ID NO: 309192 - DNA, 25 bp, Rattus norvegicus
gaatcggctggacactttcctaagc

SEQ ID NO: 309193 - DNA, 25 bp, Rattus norvegicus
gaatcggctggagactttcctaagc

SEQ ID NO: 309194 - DNA, 25 bp, Rattus norvegicus
gaatcggctgggatttggcaagcaa

SEQ ID NO: 309195 - DNA, 25 bp, Rattus norvegicus
gaatcggctgggttttggcaagcaa

SEQ ID NO: 309196 - DNA, 25 bp, Rattus norvegicus
gaatcggctggtcaagcattctttg

SEQ ID NO: 309197 - DNA, 25 bp, Rattus norvegicus
gaatcggctggtgaagcattctttg

SEQ ID NO: 309198 - DNA, 25 bp, Rattus norvegicus
gaatcgggaaccaaatacttcagag

SEQ ID NO: 309199 - DNA, 25 bp, Rattus norvegicus
gaatcgggaacctaatacttcagag

SEQ ID NO: 309200 - DNA, 25 bp, Rattus norvegicus
gaatcgggatgtatctctctccagt

SEQ ID NO: 309201 - DNA, 25 bp, Rattus norvegicus
gaatcgggatgtttctctctccagt

SEQ ID NO: 309202 - DNA, 25 bp, Rattus norvegicus
gaatcgggctggcagacttgaatct

SEQ ID NO: 309203 - DNA, 25 bp, Rattus norvegicus
gaatcgggctgggagacttgaatct

SEQ ID NO: 309204 - DNA, 25 bp, Rattus norvegicus
gaatcggtcgcaaaaatgtgacggt

SEQ ID NO: 309205 - DNA, 25 bp, Rattus norvegicus
gaatcggtcgcataaatgtgacggt

SEQ ID NO: 309206 - DNA, 25 bp, Rattus norvegicus
gaatcggtctgtataagcacttatc

SEQ ID NO: 309207 - DNA, 25 bp, Rattus norvegicus
gaatcggtctgtttaagcacttatc

SEQ ID NO: 309208 - DNA, 25 bp, Rattus norvegicus
gaatcggttcaaagacacgctccac

SEQ ID NO: 309209 - DNA, 25 bp, Rattus norvegicus
gaatcggttcaatgacacgctccac

SEQ ID NO: 309210 - DNA, 25 bp, Rattus norvegicus
gaatcggttcttcgtactgggcact

SEQ ID NO: 309211 - DNA, 25 bp, Rattus norvegicus
gaatcggttcttggtactgggcact

SEQ ID NO: 309212 - DNA, 25 bp, Rattus norvegicus
gaatcgtagtctcttgttcacagaa

SEQ ID NO: 309213 - DNA, 25 bp, Rattus norvegicus
gaatcgtagtctgttgttcacagaa

SEQ ID NO: 309214 - DNA, 25 bp, Rattus norvegicus
gaatcgtatcgtatgtccgctatcc

SEQ ID NO: 309215 - DNA, 25 bp, Rattus norvegicus
gaatcgtatcgtttgtccgctatcc

SEQ ID NO: 309216 - DNA, 25 bp, Rattus norvegicus
gaatcgtatttcctgacttactagt

SEQ ID NO: 309217 - DNA, 25 bp, Rattus norvegicus
gaatcgtatttcgtgacttactagt

SEQ ID NO: 309218 - DNA, 25 bp, Rattus norvegicus
gaatcgtcaaagatctagtaccaag

SEQ ID NO: 309219 - DNA, 25 bp, Rattus norvegicus
gaatcgtcaaagttctagtaccaag

SEQ ID NO: 309220 - DNA, 25 bp, Rattus norvegicus
gaatcgtcaatcctaaatctttata

SEQ ID NO: 309221 - DNA, 25 bp, Rattus norvegicus
gaatcgtcaatcgtaaatctttata

SEQ ID NO: 309222 - DNA, 25 bp, Rattus norvegicus
gaatcgtcacagaccattagttatt

SEQ ID NO: 309223 - DNA, 25 bp, Rattus norvegicus
gaatcgtcacagtccattagttatt

SEQ ID NO: 309224 - DNA, 25 bp, Rattus norvegicus
gaatcgtcacgccatgttaataagt

SEQ ID NO: 309225 - DNA, 25 bp, Rattus norvegicus
gaatcgtcacgcgatgttaataagt

SEQ ID NO: 309226 - DNA, 25 bp, Rattus norvegicus
gaatcgtcacttcagttgtatcttc

SEQ ID NO: 309227 - DNA, 25 bp, Rattus norvegicus
gaatcgtcacttgagttgtatcttc

SEQ ID NO: 309228 - DNA, 25 bp, Rattus norvegicus
gaatcgtcatcaagcaaagccctcg

SEQ ID NO: 309229 - DNA, 25 bp, Rattus norvegicus
gaatcgtcatcatgcaaagccctcg

SEQ ID NO: 309230 - DNA, 25 bp, Rattus norvegicus
gaatcgtcgcacaagagccactgaa

SEQ ID NO: 309231 - DNA, 25 bp, Rattus norvegicus
gaatcgtcgcactagagccactgaa

SEQ ID NO: 309232 - DNA, 25 bp, Rattus norvegicus
gaatcgtcgtaaacatagcaagcct

SEQ ID NO: 309233 - DNA, 25 bp, Rattus norvegicus
gaatcgtcgtaatcatagcaagcct

SEQ ID NO: 309234 - DNA, 25 bp, Rattus norvegicus
gaatcgtctcggctaggcaggcatt

SEQ ID NO: 309235 - DNA, 25 bp, Rattus norvegicus
gaatcgtctcgggtaggcaggcatt

SEQ ID NO: 309236 - DNA, 25 bp, Rattus norvegicus
gaatcgtctctaccagatcagctga

SEQ ID NO: 309237 - DNA, 25 bp, Rattus norvegicus
gaatcgtctctagcagatcagctga

SEQ ID NO: 309238 - DNA, 25 bp, Rattus norvegicus
gaatcgtcttgtcctactgttcttc

SEQ ID NO: 309239 - DNA, 25 bp, Rattus norvegicus
gaatcgtcttgtgctactgttcttc

SEQ ID NO: 309240 - DNA, 25 bp, Rattus norvegicus
gaatcgtgacgaacctcatgaatga

SEQ ID NO: 309241 - DNA, 25 bp, Rattus norvegicus
gaatcgtgacgatcctcatgaatga

SEQ ID NO: 309242 - DNA, 25 bp, Rattus norvegicus
gaatcgtgcaggatttctgtgacat

SEQ ID NO: 309243 - DNA, 25 bp, Rattus norvegicus
gaatcgtgcaggttttctgtgacat

SEQ ID NO: 309244 - DNA, 25 bp, Rattus norvegicus
gaatcgtgtgaacgccatacaggtt

SEQ ID NO: 309245 - DNA, 25 bp, Rattus norvegicus
gaatcgtgtgaaggccatacaggtt

SEQ ID NO: 309246 - DNA, 25 bp, Rattus norvegicus
gaatcgtgtgctattgctcaaggca

SEQ ID NO: 309247 - DNA, 25 bp, Rattus norvegicus
gaatcgtgtgcttttgctcaaggca

SEQ ID NO: 309248 - DNA, 25 bp, Rattus norvegicus
gaatcgtgttcacttacttgggcga

SEQ ID NO: 309249 - DNA, 25 bp, Rattus norvegicus
gaatcgtgttcagttacttgggcga

SEQ ID NO: 309250 - DNA, 25 bp, Rattus norvegicus
gaatcgtgttgcaacagtcagttgc

SEQ ID NO: 309251 - DNA, 25 bp, Rattus norvegicus
gaatcgtgttgctacagtcagttgc

SEQ ID NO: 309252 - DNA, 25 bp, Rattus norvegicus
gaatcgttcaggatccaagtcacga

SEQ ID NO: 309253 - DNA, 25 bp, Rattus norvegicus
gaatcgttcaggttccaagtcacga

SEQ ID NO: 309254 - DNA, 25 bp, Rattus norvegicus
gaatcgttgtccatatctctcaagg

SEQ ID NO: 309255 - DNA, 25 bp, Rattus norvegicus
gaatcgttgtccttatctctcaagg

SEQ ID NO: 309256 - DNA, 25 bp, Rattus norvegicus
gaatcgttttgccactttatggtag

SEQ ID NO: 309257 - DNA, 25 bp, Rattus norvegicus
gaatcgttttgcgactttatggtag

SEQ ID NO: 309258 - DNA, 25 bp, Rattus norvegicus
gaatcgtttttcaatttccacctag

SEQ ID NO: 309259 - DNA, 25 bp, Rattus norvegicus
gaatcgtttttctatttccacctag

SEQ ID NO: 309260 - DNA, 25 bp, Rattus norvegicus
gaatctaaacccagtctgtggtgat

SEQ ID NO: 309261 - DNA, 25 bp, Rattus norvegicus
gaatctaaacccatgaacagtctat

SEQ ID NO: 309262 - DNA, 25 bp, Rattus norvegicus
gaatctaaaccctgtctgtggtgat

SEQ ID NO: 309263 - DNA, 25 bp, Rattus norvegicus
gaatctaaacccttgaacagtctat

SEQ ID NO: 309264 - DNA, 25 bp, Rattus norvegicus
gaatctaaagctcacccctggttaa

SEQ ID NO: 309265 - DNA, 25 bp, Rattus norvegicus
gaatctaaagctgacccctggttaa

SEQ ID NO: 309266 - DNA, 25 bp, Rattus norvegicus
gaatctaaccataccactcttgggt

SEQ ID NO: 309267 - DNA, 25 bp, Rattus norvegicus
gaatctaaccattccactcttgggt

SEQ ID NO: 309268 - DNA, 25 bp, Rattus norvegicus
gaatctaaccggacttaacctcctg

SEQ ID NO: 309269 - DNA, 25 bp, Rattus norvegicus
gaatctaaccggtcttaacctcctg

SEQ ID NO: 309270 - DNA, 25 bp, Rattus norvegicus
gaatctaagcagacctgacctataa

SEQ ID NO: 309271 - DNA, 25 bp, Rattus norvegicus
gaatctaagcagtcctgacctataa

SEQ ID NO: 309272 - DNA, 25 bp, Rattus norvegicus
gaatctaaggccatttccagacaag

SEQ ID NO: 309273 - DNA, 25 bp, Rattus norvegicus
gaatctaaggccttttccagacaag

SEQ ID NO: 309274 - DNA, 25 bp, Rattus norvegicus
gaatctaagtaacacaatccatgga

SEQ ID NO: 309275 - DNA, 25 bp, Rattus norvegicus
gaatctaagtaagacaatccatgga

SEQ ID NO: 309276 - DNA, 25 bp, Rattus norvegicus
gaatctacaagaatccacaagcatg

SEQ ID NO: 309277 - DNA, 25 bp, Rattus norvegicus
gaatctacaagattccacaagcatg

SEQ ID NO: 309278 - DNA, 25 bp, Rattus norvegicus
gaatctacactaccagtctaggcat

SEQ ID NO: 309279 - DNA, 25 bp, Rattus norvegicus
gaatctacactagcagtctaggcat

SEQ ID NO: 309280 - DNA, 25 bp, Rattus norvegicus
gaatctacaggtcataagttgggat

SEQ ID NO: 309281 - DNA, 25 bp, Rattus norvegicus
gaatctacaggtgataagttgggat

SEQ ID NO: 309282 - DNA, 25 bp, Rattus norvegicus
gaatctaccacccttgatttacctt

SEQ ID NO: 309283 - DNA, 25 bp, Rattus norvegicus
gaatctaccaccgttgatttacctt

SEQ ID NO: 309284 - DNA, 25 bp, Rattus norvegicus
gaatctaccatacacacctgcatgt

SEQ ID NO: 309285 - DNA, 25 bp, Rattus norvegicus
gaatctaccatagacacctgcatgt

SEQ ID NO: 309286 - DNA, 25 bp, Rattus norvegicus
gaatctacccccaattttactagag

SEQ ID NO: 309287 - DNA, 25 bp, Rattus norvegicus
gaatctaccccctattttactagag

SEQ ID NO: 309288 - DNA, 25 bp, Rattus norvegicus
gaatctacgaccaggtggcagcaga

SEQ ID NO: 309289 - DNA, 25 bp, Rattus norvegicus
gaatctacgacctggtggcagcaga

SEQ ID NO: 309290 - DNA, 25 bp, Rattus norvegicus
gaatctactgatctccccaatggat

SEQ ID NO: 309291 - DNA, 25 bp, Rattus norvegicus
gaatctactgatgtccccaatggat

SEQ ID NO: 309292 - DNA, 25 bp, Rattus norvegicus
gaatctactgcaaggacatccagat

SEQ ID NO: 309293 - DNA, 25 bp, Rattus norvegicus
gaatctactgcatggacatccagat

SEQ ID NO: 309294 - DNA, 25 bp, Rattus norvegicus
gaatctactgcccatttgctgggta

SEQ ID NO: 309295 - DNA, 25 bp, Rattus norvegicus
gaatctactgccgatttgctgggta

SEQ ID NO: 309296 - DNA, 25 bp, Rattus norvegicus
gaatctactgttcctactgaacggc

SEQ ID NO: 309297 - DNA, 25 bp, Rattus norvegicus
gaatctactgttgctactgaacggc

SEQ ID NO: 309298 - DNA, 25 bp, Rattus norvegicus
gaatctacttcgaagtccgctcaag

SEQ ID NO: 309299 - DNA, 25 bp, Rattus norvegicus
gaatctacttcgctctgtgtgtgca

SEQ ID NO: 309300 - DNA, 25 bp, Rattus norvegicus
gaatctacttcggtctgtgtgtgca

SEQ ID NO: 309301 - DNA, 25 bp, Rattus norvegicus
gaatctacttcgtagtccgctcaag

SEQ ID NO: 309302 - DNA, 25 bp, Rattus norvegicus
gaatctagacccatcagcctgtcag

SEQ ID NO: 309303 - DNA, 25 bp, Rattus norvegicus
gaatctagacccttcagcctgtcag

SEQ ID NO: 309304 - DNA, 25 bp, Rattus norvegicus
gaatctagagatctgtccgtcctgt

SEQ ID NO: 309305 - DNA, 25 bp, Rattus norvegicus
gaatctagagatgtgtccgtcctgt

SEQ ID NO: 309306 - DNA, 25 bp, Rattus norvegicus
gaatctagaggaatgggccacggat

SEQ ID NO: 309307 - DNA, 25 bp, Rattus norvegicus
gaatctagaggattgggccacggat

SEQ ID NO: 309308 - DNA, 25 bp, Rattus norvegicus
gaatctagccagagaattacttcca

SEQ ID NO: 309309 - DNA, 25 bp, Rattus norvegicus
gaatctagccagtgaattacttcca

SEQ ID NO: 309310 - DNA, 25 bp, Rattus norvegicus
gaatctagcctgcagtagaacacta

SEQ ID NO: 309311 - DNA, 25 bp, Rattus norvegicus
gaatctagcctggagtagaacacta

SEQ ID NO: 309312 - DNA, 25 bp, Rattus norvegicus
gaatctagcttcatccagaggcaga

SEQ ID NO: 309313 - DNA, 25 bp, Rattus norvegicus
gaatctagcttcttccagaggcaga

SEQ ID NO: 309314 - DNA, 25 bp, Rattus norvegicus
gaatctaggtggctcttttatttcc

SEQ ID NO: 309315 - DNA, 25 bp, Rattus norvegicus
gaatctaggtgggtcttttatttcc

SEQ ID NO: 309316 - DNA, 25 bp, Rattus norvegicus
gaatctaggtttatggctgcctttt

SEQ ID NO: 309317 - DNA, 25 bp, Rattus norvegicus
gaatctaggtttttggctgcctttt

SEQ ID NO: 309318 - DNA, 25 bp, Rattus norvegicus
gaatctagtggaccccagagtccta

SEQ ID NO: 309319 - DNA, 25 bp, Rattus norvegicus
gaatctagtggagcccagagtccta

SEQ ID NO: 309320 - DNA, 25 bp, Rattus norvegicus
gaatctatcgacagcggctttctct

SEQ ID NO: 309321 - DNA, 25 bp, Rattus norvegicus
gaatctatcgactgcggctttctct

SEQ ID NO: 309322 - DNA, 25 bp, Rattus norvegicus
gaatctatgaccactttctttgacc

SEQ ID NO: 309323 - DNA, 25 bp, Rattus norvegicus
gaatctatgaccatataagcctaca

SEQ ID NO: 309324 - DNA, 25 bp, Rattus norvegicus
gaatctatgacctctttctttgacc

SEQ ID NO: 309325 - DNA, 25 bp, Rattus norvegicus
gaatctatgaccttataagcctaca

SEQ ID NO: 309326 - DNA, 25 bp, Rattus norvegicus
gaatctattatacatcttactcggt

SEQ ID NO: 309327 - DNA, 25 bp, Rattus norvegicus
gaatctattatagatcttactcggt

SEQ ID NO: 309328 - DNA, 25 bp, Rattus norvegicus
gaatctattcatatgtctccatcaa

SEQ ID NO: 309329 - DNA, 25 bp, Rattus norvegicus
gaatctattcatttgtctccatcaa

SEQ ID NO: 309330 - DNA, 25 bp, Rattus norvegicus
gaatctattcttaagaggccctcat

SEQ ID NO: 309331 - DNA, 25 bp, Rattus norvegicus
gaatctattctttagaggccctcat

SEQ ID NO: 309332 - DNA, 25 bp, Rattus norvegicus
gaatctatttaacgcgctgcgcggc

SEQ ID NO: 309333 - DNA, 25 bp, Rattus norvegicus
gaatctatttaaggcgctgcgcggc

SEQ ID NO: 309334 - DNA, 25 bp, Rattus norvegicus
gaatctatttccacaagttccctga

SEQ ID NO: 309335 - DNA, 25 bp, Rattus norvegicus
gaatctatttcctcaagttccctga

SEQ ID NO: 309336 - DNA, 25 bp, Rattus norvegicus
gaatctattttactaactgacctgt

SEQ ID NO: 309337 - DNA, 25 bp, Rattus norvegicus
gaatctattttagtaactgacctgt

SEQ ID NO: 309338 - DNA, 25 bp, Rattus norvegicus
gaatctcaagcaccgtgggtacttc

SEQ ID NO: 309339 - DNA, 25 bp, Rattus norvegicus
gaatctcaagcagcgtgggtacttc

SEQ ID NO: 309340 - DNA, 25 bp, Rattus norvegicus
gaatctcaagttccagagaccttgg

SEQ ID NO: 309341 - DNA, 25 bp, Rattus norvegicus
gaatctcaagttgcagagaccttgg

SEQ ID NO: 309342 - DNA, 25 bp, Rattus norvegicus
gaatctcaatgacctcaggtgcttt

SEQ ID NO: 309343 - DNA, 25 bp, Rattus norvegicus
gaatctcaatgagctcaggtgcttt

SEQ ID NO: 309344 - DNA, 25 bp, Rattus norvegicus
gaatctcaatggctgctgtgtgact

SEQ ID NO: 309345 - DNA, 25 bp, Rattus norvegicus
gaatctcaatgggtgctgtgtgact

SEQ ID NO: 309346 - DNA, 25 bp, Rattus norvegicus
gaatctcaccagaagctcaaagaag

SEQ ID NO: 309347 - DNA, 25 bp, Rattus norvegicus
gaatctcaccagtagctcaaagaag

SEQ ID NO: 309348 - DNA, 25 bp, Rattus norvegicus
gaatctcaccccatttgagtgtaca

SEQ ID NO: 309349 - DNA, 25 bp, Rattus norvegicus
gaatctcaccccttttgagtgtaca

SEQ ID NO: 309350 - DNA, 25 bp, Rattus norvegicus
gaatctcacgccaatgaagaacagg

SEQ ID NO: 309351 - DNA, 25 bp, Rattus norvegicus
gaatctcacgcctatgaagaacagg

SEQ ID NO: 309352 - DNA, 25 bp, Rattus norvegicus
gaatctcacggaccctgtgtcaata

SEQ ID NO: 309353 - DNA, 25 bp, Rattus norvegicus
gaatctcacggagcctgtgtcaata

SEQ ID NO: 309354 - DNA, 25 bp, Rattus norvegicus
gaatctcactctacgtgcagctgtg

SEQ ID NO: 309355 - DNA, 25 bp, Rattus norvegicus
gaatctcactcttcgtgcagctgtg

SEQ ID NO: 309356 - DNA, 25 bp, Rattus norvegicus
gaatctcagactaaggtgccagcac

SEQ ID NO: 309357 - DNA, 25 bp, Rattus norvegicus
gaatctcagacttaggtgccagcac

SEQ ID NO: 309358 - DNA, 25 bp, Rattus norvegicus
gaatctcagaggcagaagatacaat

SEQ ID NO: 309359 - DNA, 25 bp, Rattus norvegicus
gaatctcagagggagaagatacaat

SEQ ID NO: 309360 - DNA, 25 bp, Rattus norvegicus
gaatctcagcttagtaatacgtgta

SEQ ID NO: 309361 - DNA, 25 bp, Rattus norvegicus
gaatctcagctttgtaatacgtgta

SEQ ID NO: 309362 - DNA, 25 bp, Rattus norvegicus
gaatctcaggaaaacgcacccagtt

SEQ ID NO: 309363 - DNA, 25 bp, Rattus norvegicus
gaatctcaggaatacgcacccagtt

SEQ ID NO: 309364 - DNA, 25 bp, Rattus norvegicus
gaatctcagtataagtatacggtct

SEQ ID NO: 309365 - DNA, 25 bp, Rattus norvegicus
gaatctcagtattagtatacggtct

SEQ ID NO: 309366 - DNA, 25 bp, Rattus norvegicus
gaatctcagttcatacctagaggaa

SEQ ID NO: 309367 - DNA, 25 bp, Rattus norvegicus
gaatctcagttcttacctagaggaa

SEQ ID NO: 309368 - DNA, 25 bp, Rattus norvegicus
gaatctcagttgacttccatagcct

SEQ ID NO: 309369 - DNA, 25 bp, Rattus norvegicus
gaatctcagttgtcttccatagcct

SEQ ID NO: 309370 - DNA, 25 bp, Rattus norvegicus
gaatctcagtttcccggcatggtaa

SEQ ID NO: 309371 - DNA, 25 bp, Rattus norvegicus
gaatctcagtttgccggcatggtaa

SEQ ID NO: 309372 - DNA, 25 bp, Rattus norvegicus
gaatctcatcgacttggcagagctg

SEQ ID NO: 309373 - DNA, 25 bp, Rattus norvegicus
gaatctcatcgagttggcagagctg

SEQ ID NO: 309374 - DNA, 25 bp, Rattus norvegicus
gaatctcatcgcactgtacaaaaca

SEQ ID NO: 309375 - DNA, 25 bp, Rattus norvegicus
gaatctcatcgctctgtacaaaaca

SEQ ID NO: 309376 - DNA, 25 bp, Rattus norvegicus
gaatctcatgttcaaggctttcgtg

SEQ ID NO: 309377 - DNA, 25 bp, Rattus norvegicus
gaatctcatgttgaaggctttcgtg

SEQ ID NO: 309378 - DNA, 25 bp, Rattus norvegicus
gaatctcattccatgacatcaactg

SEQ ID NO: 309379 - DNA, 25 bp, Rattus norvegicus
gaatctcattccttgacatcaactg

SEQ ID NO: 309380 - DNA, 25 bp, Rattus norvegicus
gaatctcattcgcattggcctggca

SEQ ID NO: 309381 - DNA, 25 bp, Rattus norvegicus
gaatctcattcggattggcctggca

SEQ ID NO: 309382 - DNA, 25 bp, Rattus norvegicus
gaatctcattgtacttcaggtaaag

SEQ ID NO: 309383 - DNA, 25 bp, Rattus norvegicus
gaatctcattgttcttcaggtaaag

SEQ ID NO: 309384 - DNA, 25 bp, Rattus norvegicus
gaatctcatttgcttcctgaatcca

SEQ ID NO: 309385 - DNA, 25 bp, Rattus norvegicus
gaatctcatttggttcctgaatcca

SEQ ID NO: 309386 - DNA, 25 bp, Rattus norvegicus
gaatctccaaacacttactgaatct

SEQ ID NO: 309387 - DNA, 25 bp, Rattus norvegicus
gaatctccaaactcttactgaatct

SEQ ID NO: 309388 - DNA, 25 bp, Rattus norvegicus
gaatctccaagtagcacggttcaat

SEQ ID NO: 309389 - DNA, 25 bp, Rattus norvegicus
gaatctccaagttgcacggttcaat

SEQ ID NO: 309390 - DNA, 25 bp, Rattus norvegicus
gaatctccagagactgcagcagggc

SEQ ID NO: 309391 - DNA, 25 bp, Rattus norvegicus
gaatctccagagtctgcagcagggc

SEQ ID NO: 309392 - DNA, 25 bp, Rattus norvegicus
gaatctccaggcatctttatgtttc

SEQ ID NO: 309393 - DNA, 25 bp, Rattus norvegicus
gaatctccaggcttctttatgtttc

SEQ ID NO: 309394 - DNA, 25 bp, Rattus norvegicus
gaatctccagtgaccaccattgttg

SEQ ID NO: 309395 - DNA, 25 bp, Rattus norvegicus
gaatctccagtgatagtcaatgact

SEQ ID NO: 309396 - DNA, 25 bp, Rattus norvegicus
gaatctccagtgtccaccattgttg

SEQ ID NO: 309397 - DNA, 25 bp, Rattus norvegicus
gaatctccagtgttagtcaatgact

SEQ ID NO: 309398 - DNA, 25 bp, Rattus norvegicus
gaatctccattaaacaggcatggat

SEQ ID NO: 309399 - DNA, 25 bp, Rattus norvegicus
gaatctccattatacaggcatggat

SEQ ID NO: 309400 - DNA, 25 bp, Rattus norvegicus
gaatctcccattacagaccctggat

SEQ ID NO: 309401 - DNA, 25 bp, Rattus norvegicus
gaatctcccatttcagaccctggat

SEQ ID NO: 309402 - DNA, 25 bp, Rattus norvegicus
gaatctcccctaacttattgtgact

SEQ ID NO: 309403 - DNA, 25 bp, Rattus norvegicus
gaatctcccctatcttattgtgact

SEQ ID NO: 309404 - DNA, 25 bp, Rattus norvegicus
gaatctccctgcaagttaaggctcc

SEQ ID NO: 309405 - DNA, 25 bp, Rattus norvegicus
gaatctccctgctagttaaggctcc

SEQ ID NO: 309406 - DNA, 25 bp, Rattus norvegicus
gaatctcccttcataagaccttagt

SEQ ID NO: 309407 - DNA, 25 bp, Rattus norvegicus
gaatctcccttcttaagaccttagt

SEQ ID NO: 309408 - DNA, 25 bp, Rattus norvegicus
gaatctccgcacatgacagtggatg

SEQ ID NO: 309409 - DNA, 25 bp, Rattus norvegicus
gaatctccgcacttgacagtggatg

SEQ ID NO: 309410 - DNA, 25 bp, Rattus norvegicus
gaatctcctaggcttattggctccg

SEQ ID NO: 309411 - DNA, 25 bp, Rattus norvegicus
gaatctcctagggttattggctccg

SEQ ID NO: 309412 - DNA, 25 bp, Rattus norvegicus
gaatctcctgagactagtgcagttg

SEQ ID NO: 309413 - DNA, 25 bp, Rattus norvegicus
gaatctcctgagtctagtgcagttg

SEQ ID NO: 309414 - DNA, 25 bp, Rattus norvegicus
gaatctcctgcactgcacatgggaa

SEQ ID NO: 309415 - DNA, 25 bp, Rattus norvegicus
gaatctcctgcagtgcacatgggaa

SEQ ID NO: 309416 - DNA, 25 bp, Rattus norvegicus
gaatctccttccaataaagtatgct

SEQ ID NO: 309417 - DNA, 25 bp, Rattus norvegicus
gaatctccttcctataaagtatgct

SEQ ID NO: 309418 - DNA, 25 bp, Rattus norvegicus
gaatctcgagctcagcagaggctca

SEQ ID NO: 309419 - DNA, 25 bp, Rattus norvegicus
gaatctcgagctgagcagaggctca

SEQ ID NO: 309420 - DNA, 25 bp, Rattus norvegicus
gaatctcgattactctatcacatgg

SEQ ID NO: 309421 - DNA, 25 bp, Rattus norvegicus
gaatctcgattagtctatcacatgg

SEQ ID NO: 309422 - DNA, 25 bp, Rattus norvegicus
gaatctcgatttccaggcactagaa

SEQ ID NO: 309423 - DNA, 25 bp, Rattus norvegicus
gaatctcgatttgcaggcactagaa

SEQ ID NO: 309424 - DNA, 25 bp, Rattus norvegicus
gaatctcggcctcccttagggacag

SEQ ID NO: 309425 - DNA, 25 bp, Rattus norvegicus
gaatctcggcctgccttagggacag

SEQ ID NO: 309426 - DNA, 25 bp, Rattus norvegicus
gaatctctacccatgagtaatgtgg

SEQ ID NO: 309427 - DNA, 25 bp, Rattus norvegicus
gaatctctaccccaggtggctcata

SEQ ID NO: 309428 - DNA, 25 bp, Rattus norvegicus
gaatctctacccgaggtggctcata

SEQ ID NO: 309429 - DNA, 25 bp, Rattus norvegicus
gaatctctacccttgagtaatgtgg

SEQ ID NO: 309430 - DNA, 25 bp, Rattus norvegicus
gaatctctagagatttgcagcaaac

SEQ ID NO: 309431 - DNA, 25 bp, Rattus norvegicus
gaatctctagagttttgcagcaaac

SEQ ID NO: 309432 - DNA, 25 bp, Rattus norvegicus
gaatctctagcgaaggctgagctct

SEQ ID NO: 309433 - DNA, 25 bp, Rattus norvegicus
gaatctctagcgtaggctgagctct

SEQ ID NO: 309434 - DNA, 25 bp, Rattus norvegicus
gaatctctagctcacattgttttgt

SEQ ID NO: 309435 - DNA, 25 bp, Rattus norvegicus
gaatctctagctgacattgttttgt

SEQ ID NO: 309436 - DNA, 25 bp, Rattus norvegicus
gaatctctagtacctgctgcctgga

SEQ ID NO: 309437 - DNA, 25 bp, Rattus norvegicus
gaatctctagtagctgctgcctgga

SEQ ID NO: 309438 - DNA, 25 bp, Rattus norvegicus
gaatctctattccatgtcaggctat

SEQ ID NO: 309439 - DNA, 25 bp, Rattus norvegicus
gaatctctattcgatgtcaggctat

SEQ ID NO: 309440 - DNA, 25 bp, Rattus norvegicus
gaatctctcatgagcctgtctgtag

SEQ ID NO: 309441 - DNA, 25 bp, Rattus norvegicus
gaatctctcatgtgcctgtctgtag

SEQ ID NO: 309442 - DNA, 25 bp, Rattus norvegicus
gaatctctcggcatgaccgttggag

SEQ ID NO: 309443 - DNA, 25 bp, Rattus norvegicus
gaatctctcggcttgaccgttggag

SEQ ID NO: 309444 - DNA, 25 bp, Rattus norvegicus
gaatctctcttgaaaactgccactg

SEQ ID NO: 309445 - DNA, 25 bp, Rattus norvegicus
gaatctctcttgtaaactgccactg

SEQ ID NO: 309446 - DNA, 25 bp, Rattus norvegicus
gaatctctgaacctatgcacatcac

SEQ ID NO: 309447 - DNA, 25 bp, Rattus norvegicus
gaatctctgaacgtatgcacatcac

SEQ ID NO: 309448 - DNA, 25 bp, Rattus norvegicus
gaatctctgaagcataccgaaacga

SEQ ID NO: 309449 - DNA, 25 bp, Rattus norvegicus
gaatctctgaaggataccgaaacga

SEQ ID NO: 309450 - DNA, 25 bp, Rattus norvegicus
gaatctctgagcactggctatgcat

SEQ ID NO: 309451 - DNA, 25 bp, Rattus norvegicus
gaatctctgagctctggctatgcat

SEQ ID NO: 309452 - DNA, 25 bp, Rattus norvegicus
gaatctctgatgatatttcctatca

SEQ ID NO: 309453 - DNA, 25 bp, Rattus norvegicus
gaatctctgatgttatttcctatca

SEQ ID NO: 309454 - DNA, 25 bp, Rattus norvegicus
gaatctctgcaactctgtttgccta

SEQ ID NO: 309455 - DNA, 25 bp, Rattus norvegicus
gaatctctgcaagtctgtttgccta

SEQ ID NO: 309456 - DNA, 25 bp, Rattus norvegicus
gaatctctgcacactagcctggagt

SEQ ID NO: 309457 - DNA, 25 bp, Rattus norvegicus
gaatctctgcactctagcctggagt

SEQ ID NO: 309458 - DNA, 25 bp, Rattus norvegicus
gaatctctgcagatgaatctgacaa

SEQ ID NO: 309459 - DNA, 25 bp, Rattus norvegicus
gaatctctgcagttgaatctgacaa

SEQ ID NO: 309460 - DNA, 25 bp, Rattus norvegicus
gaatctctgcctatgtgttggtagg

SEQ ID NO: 309461 - DNA, 25 bp, Rattus norvegicus
gaatctctgcctttgtgttggtagg

SEQ ID NO: 309462 - DNA, 25 bp, Rattus norvegicus
gaatctctggtcattaataaatcct

SEQ ID NO: 309463 - DNA, 25 bp, Rattus norvegicus
gaatctctggtctttaataaatcct

SEQ ID NO: 309464 - DNA, 25 bp, Rattus norvegicus
gaatctctgtgacgcattcaacttt

SEQ ID NO: 309465 - DNA, 25 bp, Rattus norvegicus
gaatctctgtgaggcattcaacttt

SEQ ID NO: 309466 - DNA, 25 bp, Rattus norvegicus
gaatctctgttacttcgaagccaac

SEQ ID NO: 309467 - DNA, 25 bp, Rattus norvegicus
gaatctctgttagttcgaagccaac

SEQ ID NO: 309468 - DNA, 25 bp, Rattus norvegicus
gaatctcttattcaagtggtcatgt

SEQ ID NO: 309469 - DNA, 25 bp, Rattus norvegicus
gaatctcttattgaagtggtcatgt

SEQ ID NO: 309470 - DNA, 25 bp, Rattus norvegicus
gaatctcttcaaagtggtgggaact

SEQ ID NO: 309471 - DNA, 25 bp, Rattus norvegicus
gaatctcttcaatgtggtgggaact

SEQ ID NO: 309472 - DNA, 25 bp, Rattus norvegicus
gaatctcttcatagtggccttatca

SEQ ID NO: 309473 - DNA, 25 bp, Rattus norvegicus
gaatctcttcattgtggccttatca

SEQ ID NO: 309474 - DNA, 25 bp, Rattus norvegicus
gaatctcttggtcgatagcttgcag

SEQ ID NO: 309475 - DNA, 25 bp, Rattus norvegicus
gaatctcttggtggatagcttgcag

SEQ ID NO: 309476 - DNA, 25 bp, Rattus norvegicus
gaatctcttgttcacttgcaatgca

SEQ ID NO: 309477 - DNA, 25 bp, Rattus norvegicus
gaatctcttgttgacttgcaatgca

SEQ ID NO: 309478 - DNA, 25 bp, Rattus norvegicus
gaatctctttacaccttcaaatccc

SEQ ID NO: 309479 - DNA, 25 bp, Rattus norvegicus
gaatctctttactccttcaaatccc

SEQ ID NO: 309480 - DNA, 25 bp, Rattus norvegicus
gaatctctttatattcccaacacac

SEQ ID NO: 309481 - DNA, 25 bp, Rattus norvegicus
gaatctctttattttcccaacacac

SEQ ID NO: 309482 - DNA, 25 bp, Rattus norvegicus
gaatctctttttacagttgttcttg

SEQ ID NO: 309483 - DNA, 25 bp, Rattus norvegicus
gaatctcttttttcagttgttcttg

SEQ ID NO: 309484 - DNA, 25 bp, Rattus norvegicus
gaatctgaaatgaacctggaggctt

SEQ ID NO: 309485 - DNA, 25 bp, Rattus norvegicus
gaatctgaaatgacttgttctcacc

SEQ ID NO: 309486 - DNA, 25 bp, Rattus norvegicus
gaatctgaaatgtacctggaggctt

SEQ ID NO: 309487 - DNA, 25 bp, Rattus norvegicus
gaatctgaaatgtcttgttctcacc

SEQ ID NO: 309488 - DNA, 25 bp, Rattus norvegicus
gaatctgaacgcagtgctcacacgt

SEQ ID NO: 309489 - DNA, 25 bp, Rattus norvegicus
gaatctgaacgctgtgctcacacgt

SEQ ID NO: 309490 - DNA, 25 bp, Rattus norvegicus
gaatctgaactcagagtctccgtga

SEQ ID NO: 309491 - DNA, 25 bp, Rattus norvegicus
gaatctgaactctgagtctccgtga

SEQ ID NO: 309492 - DNA, 25 bp, Rattus norvegicus
gaatctgaagcaactggttacgttt

SEQ ID NO: 309493 - DNA, 25 bp, Rattus norvegicus
gaatctgaagcatctggttacgttt

SEQ ID NO: 309494 - DNA, 25 bp, Rattus norvegicus
gaatctgaagtcatgacagcctgtg

SEQ ID NO: 309495 - DNA, 25 bp, Rattus norvegicus
gaatctgaagtcttgacagcctgtg

SEQ ID NO: 309496 - DNA, 25 bp, Rattus norvegicus
gaatctgaatctatggctgaggcca

SEQ ID NO: 309497 - DNA, 25 bp, Rattus norvegicus
gaatctgaatctttggctgaggcca

SEQ ID NO: 309498 - DNA, 25 bp, Rattus norvegicus
gaatctgacactaagctttgcactg

SEQ ID NO: 309499 - DNA, 25 bp, Rattus norvegicus
gaatctgacacttagctttgcactg

SEQ ID NO: 309500 - DNA, 25 bp, Rattus norvegicus
gaatctgaccaaaatttatctccag

SEQ ID NO: 309501 - DNA, 25 bp, Rattus norvegicus
gaatctgaccaatatttatctccag

SEQ ID NO: 309502 - DNA, 25 bp, Rattus norvegicus
gaatctgaccacagagacgaactca

SEQ ID NO: 309503 - DNA, 25 bp, Rattus norvegicus
gaatctgaccactgagacgaactca

SEQ ID NO: 309504 - DNA, 25 bp, Rattus norvegicus
gaatctgactacactatgtctagtg

SEQ ID NO: 309505 - DNA, 25 bp, Rattus norvegicus
gaatctgactactctatgtctagtg

SEQ ID NO: 309506 - DNA, 25 bp, Rattus norvegicus
gaatctgactggcttttattttcct

SEQ ID NO: 309507 - DNA, 25 bp, Rattus norvegicus
gaatctgactgggttttattttcct

SEQ ID NO: 309508 - DNA, 25 bp, Rattus norvegicus
gaatctgagactatgctttatgtgt

SEQ ID NO: 309509 - DNA, 25 bp, Rattus norvegicus
gaatctgagactttgctttatgtgt

SEQ ID NO: 309510 - DNA, 25 bp, Rattus norvegicus
gaatctgagattcgcctgagctgct

SEQ ID NO: 309511 - DNA, 25 bp, Rattus norvegicus
gaatctgagattggcctgagctgct

SEQ ID NO: 309512 - DNA, 25 bp, Rattus norvegicus
gaatctgagcgaacgttcccgtatg

SEQ ID NO: 309513 - DNA, 25 bp, Rattus norvegicus
gaatctgagcgatcgttcccgtatg

SEQ ID NO: 309514 - DNA, 25 bp, Rattus norvegicus
gaatctgagctactgggcactgacc

SEQ ID NO: 309515 - DNA, 25 bp, Rattus norvegicus
gaatctgagctagtgggcactgacc

SEQ ID NO: 309516 - DNA, 25 bp, Rattus norvegicus
gaatctgaggaactgtacgcggtca

SEQ ID NO: 309517 - DNA, 25 bp, Rattus norvegicus
gaatctgaggaagtgtacgcggtca

SEQ ID NO: 309518 - DNA, 25 bp, Rattus norvegicus
gaatctgagggccatcttgccaccc

SEQ ID NO: 309519 - DNA, 25 bp, Rattus norvegicus
gaatctgagggcgatcttgccaccc

SEQ ID NO: 309520 - DNA, 25 bp, Rattus norvegicus
gaatctgaggtgctgtatgcataat

SEQ ID NO: 309521 - DNA, 25 bp, Rattus norvegicus
gaatctgaggtggtgtatgcataat

SEQ ID NO: 309522 - DNA, 25 bp, Rattus norvegicus
gaatctgagtatatcttccctcaca

SEQ ID NO: 309523 - DNA, 25 bp, Rattus norvegicus
gaatctgagtatttcttccctcaca

SEQ ID NO: 309524 - DNA, 25 bp, Rattus norvegicus
gaatctgagtccacccagaaggctg

SEQ ID NO: 309525 - DNA, 25 bp, Rattus norvegicus
gaatctgagtcctcccagaaggctg

SEQ ID NO: 309526 - DNA, 25 bp, Rattus norvegicus
gaatctgagtgacttgcccaggatc

SEQ ID NO: 309527 - DNA, 25 bp, Rattus norvegicus
gaatctgagtgagttgcccaggatc

SEQ ID NO: 309528 - DNA, 25 bp, Rattus norvegicus
gaatctgagtttcttcgtttttcat

SEQ ID NO: 309529 - DNA, 25 bp, Rattus norvegicus
gaatctgagtttgttcgtttttcat

SEQ ID NO: 309530 - DNA, 25 bp, Rattus norvegicus
gaatctgatcctcgtgcaactgaaa

SEQ ID NO: 309531 - DNA, 25 bp, Rattus norvegicus
gaatctgatcctggtgcaactgaaa

SEQ ID NO: 309532 - DNA, 25 bp, Rattus norvegicus
gaatctgatgctatgagttttaaaa

SEQ ID NO: 309533 - DNA, 25 bp, Rattus norvegicus
gaatctgatgctttgagttttaaaa

SEQ ID NO: 309534 - DNA, 25 bp, Rattus norvegicus
gaatctgatggacttcttaagccgt

SEQ ID NO: 309535 - DNA, 25 bp, Rattus norvegicus
gaatctgatggagttcttaagccgt

SEQ ID NO: 309536 - DNA, 25 bp, Rattus norvegicus
gaatctgatggcagtttttacccca

SEQ ID NO: 309537 - DNA, 25 bp, Rattus norvegicus
gaatctgatggctgtttttacccca

SEQ ID NO: 309538 - DNA, 25 bp, Rattus norvegicus
gaatctgattctagaagtttcccac

SEQ ID NO: 309539 - DNA, 25 bp, Rattus norvegicus
gaatctgattcttgaagtttcccac

SEQ ID NO: 309540 - DNA, 25 bp, Rattus norvegicus
gaatctgattggactcttgcccaag

SEQ ID NO: 309541 - DNA, 25 bp, Rattus norvegicus
gaatctgattggatctggctcccca

SEQ ID NO: 309542 - DNA, 25 bp, Rattus norvegicus
gaatctgattggtctcttgcccaag

SEQ ID NO: 309543 - DNA, 25 bp, Rattus norvegicus
gaatctgattggttctggctcccca

SEQ ID NO: 309544 - DNA, 25 bp, Rattus norvegicus
gaatctgcaaagacaagtggcccag

SEQ ID NO: 309545 - DNA, 25 bp, Rattus norvegicus
gaatctgcaaagtcaagtggcccag

SEQ ID NO: 309546 - DNA, 25 bp, Rattus norvegicus
gaatctgcaagtctcatggagtcat

SEQ ID NO: 309547 - DNA, 25 bp, Rattus norvegicus
gaatctgcaagtgtcatggagtcat

SEQ ID NO: 309548 - DNA, 25 bp, Rattus norvegicus
gaatctgcacgtattccataatcca

SEQ ID NO: 309549 - DNA, 25 bp, Rattus norvegicus
gaatctgcacgttttccataatcca

SEQ ID NO: 309550 - DNA, 25 bp, Rattus norvegicus
gaatctgcagaacaccttatctgaa

SEQ ID NO: 309551 - DNA, 25 bp, Rattus norvegicus
gaatctgcagaagaccttatctgaa

SEQ ID NO: 309552 - DNA, 25 bp, Rattus norvegicus
gaatctgcagatccaggccacctta

SEQ ID NO: 309553 - DNA, 25 bp, Rattus norvegicus
gaatctgcagatgcaggccacctta

SEQ ID NO: 309554 - DNA, 25 bp, Rattus norvegicus
gaatctgcagttaagatcttcagtt

SEQ ID NO: 309555 - DNA, 25 bp, Rattus norvegicus
gaatctgcagtttagatcttcagtt

SEQ ID NO: 309556 - DNA, 25 bp, Rattus norvegicus
gaatctgcattccaacagtccttgt

SEQ ID NO: 309557 - DNA, 25 bp, Rattus norvegicus
gaatctgcattcgaacagtccttgt

SEQ ID NO: 309558 - DNA, 25 bp, Rattus norvegicus
gaatctgccactaaattactccata

SEQ ID NO: 309559 - DNA, 25 bp, Rattus norvegicus
gaatctgccacttaattactccata

SEQ ID NO: 309560 - DNA, 25 bp, Rattus norvegicus
gaatctgcccatattctgttattgg

SEQ ID NO: 309561 - DNA, 25 bp, Rattus norvegicus
gaatctgcccatcagttgccaaaga

SEQ ID NO: 309562 - DNA, 25 bp, Rattus norvegicus
gaatctgcccatgagttgccaaaga

SEQ ID NO: 309563 - DNA, 25 bp, Rattus norvegicus
gaatctgcccattttctgttattgg

SEQ ID NO: 309564 - DNA, 25 bp, Rattus norvegicus
gaatctgcctcaatcgtggtagaaa

SEQ ID NO: 309565 - DNA, 25 bp, Rattus norvegicus
gaatctgcctcattcgtggtagaaa

SEQ ID NO: 309566 - DNA, 25 bp, Rattus norvegicus
gaatctgcgatgcaaccccggagtg

SEQ ID NO: 309567 - DNA, 25 bp, Rattus norvegicus
gaatctgcgatggaaccccggagtg

SEQ ID NO: 309568 - DNA, 25 bp, Rattus norvegicus
gaatctgcgcagcatcacccggatg

SEQ ID NO: 309569 - DNA, 25 bp, Rattus norvegicus
gaatctgcgcaggatcacccggatg

SEQ ID NO: 309570 - DNA, 25 bp, Rattus norvegicus
gaatctgcgctgatgaaatttccat

SEQ ID NO: 309571 - DNA, 25 bp, Rattus norvegicus
gaatctgcgctgttgaaatttccat

SEQ ID NO: 309572 - DNA, 25 bp, Rattus norvegicus
gaatctgctataaaacccaggctgg

SEQ ID NO: 309573 - DNA, 25 bp, Rattus norvegicus
gaatctgctatataacccaggctgg

SEQ ID NO: 309574 - DNA, 25 bp, Rattus norvegicus
gaatctgctatgaggcttaactgct

SEQ ID NO: 309575 - DNA, 25 bp, Rattus norvegicus
gaatctgctatgtggcttaactgct

SEQ ID NO: 309576 - DNA, 25 bp, Rattus norvegicus
gaatctgctcacagcagggtaccta

SEQ ID NO: 309577 - DNA, 25 bp, Rattus norvegicus
gaatctgctcactgcagggtaccta

SEQ ID NO: 309578 - DNA, 25 bp, Rattus norvegicus
gaatctgctcatatgtactttcagg

SEQ ID NO: 309579 - DNA, 25 bp, Rattus norvegicus
gaatctgctcatttgtactttcagg

SEQ ID NO: 309580 - DNA, 25 bp, Rattus norvegicus
gaatctgctctactagatcctccag

SEQ ID NO: 309581 - DNA, 25 bp, Rattus norvegicus
gaatctgctctagtagatcctccag

SEQ ID NO: 309582 - DNA, 25 bp, Rattus norvegicus
gaatctgctgatagtggctcacttc

SEQ ID NO: 309583 - DNA, 25 bp, Rattus norvegicus
gaatctgctgatctgcttagttagc

SEQ ID NO: 309584 - DNA, 25 bp, Rattus norvegicus
gaatctgctgatgtgcttagttagc

SEQ ID NO: 309585 - DNA, 25 bp, Rattus norvegicus
gaatctgctgattgtggctcacttc

SEQ ID NO: 309586 - DNA, 25 bp, Rattus norvegicus
gaatctgctgtcctttcctttaaaa

SEQ ID NO: 309587 - DNA, 25 bp, Rattus norvegicus
gaatctgctgtcgtttcctttaaaa

SEQ ID NO: 309588 - DNA, 25 bp, Rattus norvegicus
gaatctgcttatcccattagtgtga

SEQ ID NO: 309589 - DNA, 25 bp, Rattus norvegicus
gaatctgcttatgccattagtgtga

SEQ ID NO: 309590 - DNA, 25 bp, Rattus norvegicus
gaatctgctttacttcatctgttca

SEQ ID NO: 309591 - DNA, 25 bp, Rattus norvegicus
gaatctgctttagttcatctgttca

SEQ ID NO: 309592 - DNA, 25 bp, Rattus norvegicus
gaatctggaacccacttgttctaca

SEQ ID NO: 309593 - DNA, 25 bp, Rattus norvegicus
gaatctggaaccgacttgttctaca

SEQ ID NO: 309594 - DNA, 25 bp, Rattus norvegicus
gaatctggaaggacctttggcttta

SEQ ID NO: 309595 - DNA, 25 bp, Rattus norvegicus
gaatctggaaggtcctttggcttta

SEQ ID NO: 309596 - DNA, 25 bp, Rattus norvegicus
gaatctggaataaatcgtctgcaca

SEQ ID NO: 309597 - DNA, 25 bp, Rattus norvegicus
gaatctggaatatatcgtctgcaca

SEQ ID NO: 309598 - DNA, 25 bp, Rattus norvegicus
gaatctggaattcaccatggtctga

SEQ ID NO: 309599 - DNA, 25 bp, Rattus norvegicus
gaatctggaattgaccatggtctga

SEQ ID NO: 309600 - DNA, 25 bp, Rattus norvegicus
gaatctggacagaggtagggaccat

SEQ ID NO: 309601 - DNA, 25 bp, Rattus norvegicus
gaatctggacagtggtagggaccat

SEQ ID NO: 309602 - DNA, 25 bp, Rattus norvegicus
gaatctggaccaccttattccaaaa

SEQ ID NO: 309603 - DNA, 25 bp, Rattus norvegicus
gaatctggaccagcttattccaaaa

SEQ ID NO: 309604 - DNA, 25 bp, Rattus norvegicus
gaatctggacccctagctttatttt

SEQ ID NO: 309605 - DNA, 25 bp, Rattus norvegicus
gaatctggacccgtagctttatttt

SEQ ID NO: 309606 - DNA, 25 bp, Rattus norvegicus
gaatctggacttcgtcttgacccta

SEQ ID NO: 309607 - DNA, 25 bp, Rattus norvegicus
gaatctggacttggtcttgacccta

SEQ ID NO: 309608 - DNA, 25 bp, Rattus norvegicus
gaatctggagcaacagctagcacct

SEQ ID NO: 309609 - DNA, 25 bp, Rattus norvegicus
gaatctggagcatcagctagcacct

SEQ ID NO: 309610 - DNA, 25 bp, Rattus norvegicus
gaatctggagctcagcactaggctg

SEQ ID NO: 309611 - DNA, 25 bp, Rattus norvegicus
gaatctggagctcgccatccggaaa

SEQ ID NO: 309612 - DNA, 25 bp, Rattus norvegicus
gaatctggagctctggaactgtgaa

SEQ ID NO: 309613 - DNA, 25 bp, Rattus norvegicus
gaatctggagctgagcactaggctg

SEQ ID NO: 309614 - DNA, 25 bp, Rattus norvegicus
gaatctggagctggccatccggaaa

SEQ ID NO: 309615 - DNA, 25 bp, Rattus norvegicus
gaatctggagctgtggaactgtgaa

SEQ ID NO: 309616 - DNA, 25 bp, Rattus norvegicus
gaatctggattcatacctgtgtcat

SEQ ID NO: 309617 - DNA, 25 bp, Rattus norvegicus
gaatctggattcttacctgtgtcat

SEQ ID NO: 309618 - DNA, 25 bp, Rattus norvegicus
gaatctggcaagaaggttttctcca

SEQ ID NO: 309619 - DNA, 25 bp, Rattus norvegicus
gaatctggcaagcatggctgcacaa

SEQ ID NO: 309620 - DNA, 25 bp, Rattus norvegicus
gaatctggcaaggatggctgcacaa

SEQ ID NO: 309621 - DNA, 25 bp, Rattus norvegicus
gaatctggcaagtaggttttctcca

SEQ ID NO: 309622 - DNA, 25 bp, Rattus norvegicus
gaatctggcagcacagcatgcccgt

SEQ ID NO: 309623 - DNA, 25 bp, Rattus norvegicus
gaatctggcagctcagcatgcccgt

SEQ ID NO: 309624 - DNA, 25 bp, Rattus norvegicus
gaatctggcatcaatagtgatcact

SEQ ID NO: 309625 - DNA, 25 bp, Rattus norvegicus
gaatctggcatctatagtgatcact

SEQ ID NO: 309626 - DNA, 25 bp, Rattus norvegicus
gaatctggctagagttatagctcat

SEQ ID NO: 309627 - DNA, 25 bp, Rattus norvegicus
gaatctggctagtgttatagctcat

SEQ ID NO: 309628 - DNA, 25 bp, Rattus norvegicus
gaatctggctttcatcggtgctaaa

SEQ ID NO: 309629 - DNA, 25 bp, Rattus norvegicus
gaatctggctttgatcggtgctaaa

SEQ ID NO: 309630 - DNA, 25 bp, Rattus norvegicus
gaatctgggaatctgcgcaaagtaa

SEQ ID NO: 309631 - DNA, 25 bp, Rattus norvegicus
gaatctgggaatgtgcgcaaagtaa

SEQ ID NO: 309632 - DNA, 25 bp, Rattus norvegicus
gaatctgggactatcatattttaaa

SEQ ID NO: 309633 - DNA, 25 bp, Rattus norvegicus
gaatctgggactttcatattttaaa

SEQ ID NO: 309634 - DNA, 25 bp, Rattus norvegicus
gaatctgggtaaattctctatctca

SEQ ID NO: 309635 - DNA, 25 bp, Rattus norvegicus
gaatctgggtaatttctctatctca

SEQ ID NO: 309636 - DNA, 25 bp, Rattus norvegicus
gaatctgggtccatttgtggtccgt

SEQ ID NO: 309637 - DNA, 25 bp, Rattus norvegicus
gaatctgggtccttttgtggtccgt

SEQ ID NO: 309638 - DNA, 25 bp, Rattus norvegicus
gaatctgggtgcacactttggtaca

SEQ ID NO: 309639 - DNA, 25 bp, Rattus norvegicus
gaatctgggtgcagctctcctgaag

SEQ ID NO: 309640 - DNA, 25 bp, Rattus norvegicus
gaatctgggtgctcactttggtaca

SEQ ID NO: 309641 - DNA, 25 bp, Rattus norvegicus
gaatctgggtgctgctctcctgaag

SEQ ID NO: 309642 - DNA, 25 bp, Rattus norvegicus
gaatctgggtttccttctcaacgaa

SEQ ID NO: 309643 - DNA, 25 bp, Rattus norvegicus
gaatctgggtttgcttctcaacgaa

SEQ ID NO: 309644 - DNA, 25 bp, Rattus norvegicus
gaatctggtctaagacgtgactccc

SEQ ID NO: 309645 - DNA, 25 bp, Rattus norvegicus
gaatctggtctatgacgtgactccc

SEQ ID NO: 309646 - DNA, 25 bp, Rattus norvegicus
gaatctggttcacgcgctgtaaata

SEQ ID NO: 309647 - DNA, 25 bp, Rattus norvegicus
gaatctggttcaggcgctgtaaata

SEQ ID NO: 309648 - DNA, 25 bp, Rattus norvegicus
gaatctggttccaattgtgtggcac

SEQ ID NO: 309649 - DNA, 25 bp, Rattus norvegicus
gaatctggttcctattgtgtggcac

SEQ ID NO: 309650 - DNA, 25 bp, Rattus norvegicus
gaatctggttttctgtgtaccctcc

SEQ ID NO: 309651 - DNA, 25 bp, Rattus norvegicus
gaatctggttttgtgtgtaccctcc

SEQ ID NO: 309652 - DNA, 25 bp, Rattus norvegicus
gaatctgtaaagatggtgctctcta

SEQ ID NO: 309653 - DNA, 25 bp, Rattus norvegicus
gaatctgtaaagttggtgctctcta

SEQ ID NO: 309654 - DNA, 25 bp, Rattus norvegicus
gaatctgtaactcgatgcctctggc

SEQ ID NO: 309655 - DNA, 25 bp, Rattus norvegicus
gaatctgtaactggatgcctctggc

SEQ ID NO: 309656 - DNA, 25 bp, Rattus norvegicus
gaatctgtactcctgtttggtgtgt

SEQ ID NO: 309657 - DNA, 25 bp, Rattus norvegicus
gaatctgtactcgtgtttggtgtgt

SEQ ID NO: 309658 - DNA, 25 bp, Rattus norvegicus
gaatctgtacttccgtttgtactga

SEQ ID NO: 309659 - DNA, 25 bp, Rattus norvegicus
gaatctgtacttgcgtttgtactga

SEQ ID NO: 309660 - DNA, 25 bp, Rattus norvegicus
gaatctgtattccttcctttgaaaa

SEQ ID NO: 309661 - DNA, 25 bp, Rattus norvegicus
gaatctgtattcgttcctttgaaaa

SEQ ID NO: 309662 - DNA, 25 bp, Rattus norvegicus
gaatctgtcaagctttcccctttgc

SEQ ID NO: 309663 - DNA, 25 bp, Rattus norvegicus
gaatctgtcaaggtttcccctttgc

SEQ ID NO: 309664 - DNA, 25 bp, Rattus norvegicus
gaatctgtcactatctggatgctta

SEQ ID NO: 309665 - DNA, 25 bp, Rattus norvegicus
gaatctgtcactttctggatgctta

SEQ ID NO: 309666 - DNA, 25 bp, Rattus norvegicus
gaatctgtcattagctaccatctat

SEQ ID NO: 309667 - DNA, 25 bp, Rattus norvegicus
gaatctgtcatttgctaccatctat

SEQ ID NO: 309668 - DNA, 25 bp, Rattus norvegicus
gaatctgtccaaccagagggactct

SEQ ID NO: 309669 - DNA, 25 bp, Rattus norvegicus
gaatctgtccaagcagagggactct

SEQ ID NO: 309670 - DNA, 25 bp, Rattus norvegicus
gaatctgtctcaccgggaaagtttg

SEQ ID NO: 309671 - DNA, 25 bp, Rattus norvegicus
gaatctgtctcagcgggaaagtttg

SEQ ID NO: 309672 - DNA, 25 bp, Rattus norvegicus
gaatctgtcttgaggaaagcgttca

SEQ ID NO: 309673 - DNA, 25 bp, Rattus norvegicus
gaatctgtcttgtggaaagcgttca

SEQ ID NO: 309674 - DNA, 25 bp, Rattus norvegicus
gaatctgtgagaccatgctgttcaa

SEQ ID NO: 309675 - DNA, 25 bp, Rattus norvegicus
gaatctgtgagagcatgctgttcaa

SEQ ID NO: 309676 - DNA, 25 bp, Rattus norvegicus
gaatctgtgcatagtgttgctgcca

SEQ ID NO: 309677 - DNA, 25 bp, Rattus norvegicus
gaatctgtgcattgtgttgctgcca

SEQ ID NO: 309678 - DNA, 25 bp, Rattus norvegicus
gaatctgtgcccagcgctggaggct

SEQ ID NO: 309679 - DNA, 25 bp, Rattus norvegicus
gaatctgtgccctgcgctggaggct

SEQ ID NO: 309680 - DNA, 25 bp, Rattus norvegicus
gaatctgtgcttatagtgtggtcct

SEQ ID NO: 309681 - DNA, 25 bp, Rattus norvegicus
gaatctgtgcttttagtgtggtcct

SEQ ID NO: 309682 - DNA, 25 bp, Rattus norvegicus
gaatctgtggcaaggttgtcaccga

SEQ ID NO: 309683 - DNA, 25 bp, Rattus norvegicus
gaatctgtggcatggttgtcaccga

SEQ ID NO: 309684 - DNA, 25 bp, Rattus norvegicus
gaatctgtggccatcctaaagttat

SEQ ID NO: 309685 - DNA, 25 bp, Rattus norvegicus
gaatctgtggccttcctaaagttat

SEQ ID NO: 309686 - DNA, 25 bp, Rattus norvegicus
gaatctgttagtcgtttcttagcct

SEQ ID NO: 309687 - DNA, 25 bp, Rattus norvegicus
gaatctgttagtggtttcttagcct

SEQ ID NO: 309688 - DNA, 25 bp, Rattus norvegicus
gaatctgttgctcttagtggcttta

SEQ ID NO: 309689 - DNA, 25 bp, Rattus norvegicus
gaatctgttgctgttagtggcttta

SEQ ID NO: 309690 - DNA, 25 bp, Rattus norvegicus
gaatctgttgttagtcctctacaca

SEQ ID NO: 309691 - DNA, 25 bp, Rattus norvegicus
gaatctgttgtttgtcctctacaca

SEQ ID NO: 309692 - DNA, 25 bp, Rattus norvegicus
gaatctgtttatagggttactgccc

SEQ ID NO: 309693 - DNA, 25 bp, Rattus norvegicus
gaatctgtttattgggttactgccc

SEQ ID NO: 309694 - DNA, 25 bp, Rattus norvegicus
gaatctgtttggactttccattctg

SEQ ID NO: 309695 - DNA, 25 bp, Rattus norvegicus
gaatctgtttggtctttccattctg

SEQ ID NO: 309696 - DNA, 25 bp, Rattus norvegicus
gaatctgtttttacctttgaaattg

SEQ ID NO: 309697 - DNA, 25 bp, Rattus norvegicus
gaatctgttttttcctttgaaattg

SEQ ID NO: 309698 - DNA, 25 bp, Rattus norvegicus
gaatcttaactccttctgcatctta

SEQ ID NO: 309699 - DNA, 25 bp, Rattus norvegicus
gaatcttaactcgttctgcatctta

SEQ ID NO: 309700 - DNA, 25 bp, Rattus norvegicus
gaatcttaagaacatcgtgtctggt

SEQ ID NO: 309701 - DNA, 25 bp, Rattus norvegicus
gaatcttaagaagatcgtgtctggt

SEQ ID NO: 309702 - DNA, 25 bp, Rattus norvegicus
gaatcttaaggtcgagaccttgctt

SEQ ID NO: 309703 - DNA, 25 bp, Rattus norvegicus
gaatcttaaggtggagaccttgctt

SEQ ID NO: 309704 - DNA, 25 bp, Rattus norvegicus
gaatcttaccatattagtgctggct

SEQ ID NO: 309705 - DNA, 25 bp, Rattus norvegicus
gaatcttaccattttagtgctggct

SEQ ID NO: 309706 - DNA, 25 bp, Rattus norvegicus
gaatcttactcacggcagcgaatac

SEQ ID NO: 309707 - DNA, 25 bp, Rattus norvegicus
gaatcttactcagggcagcgaatac

SEQ ID NO: 309708 - DNA, 25 bp, Rattus norvegicus
gaatcttactgcagcacacttgggt

SEQ ID NO: 309709 - DNA, 25 bp, Rattus norvegicus
gaatcttactgctgcacacttgggt

SEQ ID NO: 309710 - DNA, 25 bp, Rattus norvegicus
gaatcttacttaaccccagttctct

SEQ ID NO: 309711 - DNA, 25 bp, Rattus norvegicus
gaatcttacttatccccagttctct

SEQ ID NO: 309712 - DNA, 25 bp, Rattus norvegicus
gaatcttagaccagtgtgaaccctt

SEQ ID NO: 309713 - DNA, 25 bp, Rattus norvegicus
gaatcttagacctgtgtgaaccctt

SEQ ID NO: 309714 - DNA, 25 bp, Rattus norvegicus
gaatcttagcacaatttcctcatgt

SEQ ID NO: 309715 - DNA, 25 bp, Rattus norvegicus
gaatcttagcactatttcctcatgt

SEQ ID NO: 309716 - DNA, 25 bp, Rattus norvegicus
gaatcttataaaacatccccactga

SEQ ID NO: 309717 - DNA, 25 bp, Rattus norvegicus
gaatcttataaatcatccccactga

SEQ ID NO: 309718 - DNA, 25 bp, Rattus norvegicus
gaatcttatatcctttgatgtggtc

SEQ ID NO: 309719 - DNA, 25 bp, Rattus norvegicus
gaatcttatatcgtttgatgtggtc

SEQ ID NO: 309720 - DNA, 25 bp, Rattus norvegicus
gaatcttatgctcgaggttttgaaa

SEQ ID NO: 309721 - DNA, 25 bp, Rattus norvegicus
gaatcttatgctggaggttttgaaa

SEQ ID NO: 309722 - DNA, 25 bp, Rattus norvegicus
gaatcttatttgatccttgctgaaa

SEQ ID NO: 309723 - DNA, 25 bp, Rattus norvegicus
gaatcttatttgttccttgctgaaa

SEQ ID NO: 309724 - DNA, 25 bp, Rattus norvegicus
gaatcttcacagaatacattgttaa

SEQ ID NO: 309725 - DNA, 25 bp, Rattus norvegicus
gaatcttcacagtatacattgttaa

SEQ ID NO: 309726 - DNA, 25 bp, Rattus norvegicus
gaatcttcagacagatgtccacagt

SEQ ID NO: 309727 - DNA, 25 bp, Rattus norvegicus
gaatcttcagacaggcttgcctgaa

SEQ ID NO: 309728 - DNA, 25 bp, Rattus norvegicus
gaatcttcagactgatgtccacagt

SEQ ID NO: 309729 - DNA, 25 bp, Rattus norvegicus
gaatcttcagactggcttgcctgaa

SEQ ID NO: 309730 - DNA, 25 bp, Rattus norvegicus
gaatcttcagtgattgccaccatgt

SEQ ID NO: 309731 - DNA, 25 bp, Rattus norvegicus
gaatcttcagtgtttgccaccatgt

SEQ ID NO: 309732 - DNA, 25 bp, Rattus norvegicus
gaatcttcattacactttgagccag

SEQ ID NO: 309733 - DNA, 25 bp, Rattus norvegicus
gaatcttcattagactttgagccag

SEQ ID NO: 309734 - DNA, 25 bp, Rattus norvegicus
gaatcttcattgcttgcccaaggct

SEQ ID NO: 309735 - DNA, 25 bp, Rattus norvegicus
gaatcttcattggttgcccaaggct

SEQ ID NO: 309736 - DNA, 25 bp, Rattus norvegicus
gaatcttccatgatggctgtgagca

SEQ ID NO: 309737 - DNA, 25 bp, Rattus norvegicus
gaatcttccatgttggctgtgagca

SEQ ID NO: 309738 - DNA, 25 bp, Rattus norvegicus
gaatcttcccaaatgctgttctaca

SEQ ID NO: 309739 - DNA, 25 bp, Rattus norvegicus
gaatcttcccaattgctgttctaca

SEQ ID NO: 309740 - DNA, 25 bp, Rattus norvegicus
gaatcttccctgaatgaaggacact

SEQ ID NO: 309741 - DNA, 25 bp, Rattus norvegicus
gaatcttccctgtatgaaggacact

SEQ ID NO: 309742 - DNA, 25 bp, Rattus norvegicus
gaatcttccgatcgcctaaggttca

SEQ ID NO: 309743 - DNA, 25 bp, Rattus norvegicus
gaatcttccgatggcctaaggttca

SEQ ID NO: 309744 - DNA, 25 bp, Rattus norvegicus
gaatcttcctctactgaaagggcca

SEQ ID NO: 309745 - DNA, 25 bp, Rattus norvegicus
gaatcttcctctcctgcagtataag

SEQ ID NO: 309746 - DNA, 25 bp, Rattus norvegicus
gaatcttcctctgctgcagtataag

SEQ ID NO: 309747 - DNA, 25 bp, Rattus norvegicus
gaatcttcctcttctgaaagggcca

SEQ ID NO: 309748 - DNA, 25 bp, Rattus norvegicus
gaatcttcctgacatcccaagaaat

SEQ ID NO: 309749 - DNA, 25 bp, Rattus norvegicus
gaatcttcctgagatcccaagaaat

SEQ ID NO: 309750 - DNA, 25 bp, Rattus norvegicus
gaatcttccttgagtttggcagtca

SEQ ID NO: 309751 - DNA, 25 bp, Rattus norvegicus
gaatcttccttgtgtttggcagtca

SEQ ID NO: 309752 - DNA, 25 bp, Rattus norvegicus
gaatcttcggaaacttgcacaaaca

SEQ ID NO: 309753 - DNA, 25 bp, Rattus norvegicus
gaatcttcggaatcttgcacaaaca

SEQ ID NO: 309754 - DNA, 25 bp, Rattus norvegicus
gaatcttctcacatttatttactgg

SEQ ID NO: 309755 - DNA, 25 bp, Rattus norvegicus
gaatcttctcacttttatttactgg

SEQ ID NO: 309756 - DNA, 25 bp, Rattus norvegicus
gaatcttctcggcatgatctttagc

SEQ ID NO: 309757 - DNA, 25 bp, Rattus norvegicus
gaatcttctcgggatgatctttagc

SEQ ID NO: 309758 - DNA, 25 bp, Rattus norvegicus
gaatcttctctaaactcactctcag

SEQ ID NO: 309759 - DNA, 25 bp, Rattus norvegicus
gaatcttctctacgtcatgcattga

SEQ ID NO: 309760 - DNA, 25 bp, Rattus norvegicus
gaatcttctctaggtcatgcattga

SEQ ID NO: 309761 - DNA, 25 bp, Rattus norvegicus
gaatcttctctatactcactctcag

SEQ ID NO: 309762 - DNA, 25 bp, Rattus norvegicus
gaatcttctgcacattctcactgtt

SEQ ID NO: 309763 - DNA, 25 bp, Rattus norvegicus
gaatcttctgcagattctcactgtt

SEQ ID NO: 309764 - DNA, 25 bp, Rattus norvegicus
gaatcttctgctattgagccttgat

SEQ ID NO: 309765 - DNA, 25 bp, Rattus norvegicus
gaatcttctgcttttgagccttgat

SEQ ID NO: 309766 - DNA, 25 bp, Rattus norvegicus
gaatcttctgtacggtgttcccatt

SEQ ID NO: 309767 - DNA, 25 bp, Rattus norvegicus
gaatcttctgtagggtgttcccatt

SEQ ID NO: 309768 - DNA, 25 bp, Rattus norvegicus
gaatcttcttaacggctgagagcta

SEQ ID NO: 309769 - DNA, 25 bp, Rattus norvegicus
gaatcttcttaagggctgagagcta

SEQ ID NO: 309770 - DNA, 25 bp, Rattus norvegicus
gaatcttcttttactcctgacgtag

SEQ ID NO: 309771 - DNA, 25 bp, Rattus norvegicus
gaatcttctttttctcctgacgtag

SEQ ID NO: 309772 - DNA, 25 bp, Rattus norvegicus
gaatcttgaataagcaattactctt

SEQ ID NO: 309773 - DNA, 25 bp, Rattus norvegicus
gaatcttgaatatgcaattactctt

SEQ ID NO: 309774 - DNA, 25 bp, Rattus norvegicus
gaatcttgacctagtttcctatgag

SEQ ID NO: 309775 - DNA, 25 bp, Rattus norvegicus
gaatcttgaccttgtttcctatgag

SEQ ID NO: 309776 - DNA, 25 bp, Rattus norvegicus
gaatcttgactgaccaaaaggcact

SEQ ID NO: 309777 - DNA, 25 bp, Rattus norvegicus
gaatcttgactgtccaaaaggcact

SEQ ID NO: 309778 - DNA, 25 bp, Rattus norvegicus
gaatcttgacttccatatgtatata

SEQ ID NO: 309779 - DNA, 25 bp, Rattus norvegicus
gaatcttgacttgcatatgtatata

SEQ ID NO: 309780 - DNA, 25 bp, Rattus norvegicus
gaatcttgagaacttccagctggtg

SEQ ID NO: 309781 - DNA, 25 bp, Rattus norvegicus
gaatcttgagaagttccagctggtg

SEQ ID NO: 309782 - DNA, 25 bp, Rattus norvegicus
gaatcttgagcaatactgagccatc

SEQ ID NO: 309783 - DNA, 25 bp, Rattus norvegicus
gaatcttgagcattactgagccatc

SEQ ID NO: 309784 - DNA, 25 bp, Rattus norvegicus
gaatcttgagtacgtttcctgcaaa

SEQ ID NO: 309785 - DNA, 25 bp, Rattus norvegicus
gaatcttgagtaggtttcctgcaaa

SEQ ID NO: 309786 - DNA, 25 bp, Rattus norvegicus
gaatcttgcctaaaacttggttgtt

SEQ ID NO: 309787 - DNA, 25 bp, Rattus norvegicus
gaatcttgcctataacttggttgtt

SEQ ID NO: 309788 - DNA, 25 bp, Rattus norvegicus
gaatcttgctcaactctgaagtcag

SEQ ID NO: 309789 - DNA, 25 bp, Rattus norvegicus
gaatcttgctcatctctgaagtcag

SEQ ID NO: 309790 - DNA, 25 bp, Rattus norvegicus
gaatcttgtaaaattaaagctcact

SEQ ID NO: 309791 - DNA, 25 bp, Rattus norvegicus
gaatcttgtaaatttaaagctcact

SEQ ID NO: 309792 - DNA, 25 bp, Rattus norvegicus
gaatcttgtctcaatgctcataacg

SEQ ID NO: 309793 - DNA, 25 bp, Rattus norvegicus
gaatcttgtctctatgctcataacg

SEQ ID NO: 309794 - DNA, 25 bp, Rattus norvegicus
gaatcttgtggccagggtctgtcat

SEQ ID NO: 309795 - DNA, 25 bp, Rattus norvegicus
gaatcttgtggcgagggtctgtcat

SEQ ID NO: 309796 - DNA, 25 bp, Rattus norvegicus
gaatcttgttatcttgctgtcctaa

SEQ ID NO: 309797 - DNA, 25 bp, Rattus norvegicus
gaatcttgttatgttgctgtcctaa

SEQ ID NO: 309798 - DNA, 25 bp, Rattus norvegicus
gaatctttacccatatgcttcataa

SEQ ID NO: 309799 - DNA, 25 bp, Rattus norvegicus
gaatctttacccttatgcttcataa

SEQ ID NO: 309800 - DNA, 25 bp, Rattus norvegicus
gaatctttagcaagtcgctttccta

SEQ ID NO: 309801 - DNA, 25 bp, Rattus norvegicus
gaatctttagcacaatcttctgtat

SEQ ID NO: 309802 - DNA, 25 bp, Rattus norvegicus
gaatctttagcagaatcttctgtat

SEQ ID NO: 309803 - DNA, 25 bp, Rattus norvegicus
gaatctttagcatgtcgctttccta

SEQ ID NO: 309804 - DNA, 25 bp, Rattus norvegicus
gaatctttagttactgccgtcaggt

SEQ ID NO: 309805 - DNA, 25 bp, Rattus norvegicus
gaatctttagtttctgccgtcaggt

SEQ ID NO: 309806 - DNA, 25 bp, Rattus norvegicus
gaatctttatccaggtgactcaaat

SEQ ID NO: 309807 - DNA, 25 bp, Rattus norvegicus
gaatctttatcctggtgactcaaat

SEQ ID NO: 309808 - DNA, 25 bp, Rattus norvegicus
gaatctttcaggatgtgttggcaca

SEQ ID NO: 309809 - DNA, 25 bp, Rattus norvegicus
gaatctttcaggttgtgttggcaca

SEQ ID NO: 309810 - DNA, 25 bp, Rattus norvegicus
gaatctttccaaagtgaatctgtga

SEQ ID NO: 309811 - DNA, 25 bp, Rattus norvegicus
gaatctttccaatgtgaatctgtga

SEQ ID NO: 309812 - DNA, 25 bp, Rattus norvegicus
gaatctttccatacagctaatgctt

SEQ ID NO: 309813 - DNA, 25 bp, Rattus norvegicus
gaatctttccatacggctttccaaa

SEQ ID NO: 309814 - DNA, 25 bp, Rattus norvegicus
gaatctttccattcagctaatgctt

SEQ ID NO: 309815 - DNA, 25 bp, Rattus norvegicus
gaatctttccattcggctttccaaa

SEQ ID NO: 309816 - DNA, 25 bp, Rattus norvegicus
gaatctttccgtaaaacagcacagt

SEQ ID NO: 309817 - DNA, 25 bp, Rattus norvegicus
gaatctttccgttaaacagcacagt

SEQ ID NO: 309818 - DNA, 25 bp, Rattus norvegicus
gaatctttccttaactctaaaatag

SEQ ID NO: 309819 - DNA, 25 bp, Rattus norvegicus
gaatctttccttcagtggagaggtg

SEQ ID NO: 309820 - DNA, 25 bp, Rattus norvegicus
gaatctttccttgagtggagaggtg

SEQ ID NO: 309821 - DNA, 25 bp, Rattus norvegicus
gaatctttcctttactctaaaatag

SEQ ID NO: 309822 - DNA, 25 bp, Rattus norvegicus
gaatctttcgcgctcatgtgtgtgt

SEQ ID NO: 309823 - DNA, 25 bp, Rattus norvegicus
gaatctttcgcggtcatgtgtgtgt

SEQ ID NO: 309824 - DNA, 25 bp, Rattus norvegicus
gaatctttctatagattgtccctag

SEQ ID NO: 309825 - DNA, 25 bp, Rattus norvegicus
gaatctttctattgattgtccctag

SEQ ID NO: 309826 - DNA, 25 bp, Rattus norvegicus
gaatctttgattacccctgtatgaa

SEQ ID NO: 309827 - DNA, 25 bp, Rattus norvegicus
gaatctttgattccttgtgtccgcc

SEQ ID NO: 309828 - DNA, 25 bp, Rattus norvegicus
gaatctttgattgcttgtgtccgcc

SEQ ID NO: 309829 - DNA, 25 bp, Rattus norvegicus
gaatctttgatttcccctgtatgaa

SEQ ID NO: 309830 - DNA, 25 bp, Rattus norvegicus
gaatctttgtcacgtgttccacgtt

SEQ ID NO: 309831 - DNA, 25 bp, Rattus norvegicus
gaatctttgtcaggtgttccacgtt

SEQ ID NO: 309832 - DNA, 25 bp, Rattus norvegicus
gaatcttttccacacaagggtacag

SEQ ID NO: 309833 - DNA, 25 bp, Rattus norvegicus
gaatcttttccagacaagggtacag

SEQ ID NO: 309834 - DNA, 25 bp, Rattus norvegicus
gaatcttttcctaatgcacttgctg

SEQ ID NO: 309835 - DNA, 25 bp, Rattus norvegicus
gaatcttttccttatgcacttgctg

SEQ ID NO: 309836 - DNA, 25 bp, Rattus norvegicus
gaatcttttctgaccagaccacaaa

SEQ ID NO: 309837 - DNA, 25 bp, Rattus norvegicus
gaatcttttctgtccagaccacaaa

SEQ ID NO: 309838 - DNA, 25 bp, Rattus norvegicus
gaatcttttgagacttctgctcctt

SEQ ID NO: 309839 - DNA, 25 bp, Rattus norvegicus
gaatcttttgagtcttctgctcctt

SEQ ID NO: 309840 - DNA, 25 bp, Rattus norvegicus
gaatctttttctataactggtggca

SEQ ID NO: 309841 - DNA, 25 bp, Rattus norvegicus
gaatctttttctcaagcctgcataa

SEQ ID NO: 309842 - DNA, 25 bp, Rattus norvegicus
gaatctttttctgaagcctgcataa

SEQ ID NO: 309843 - DNA, 25 bp, Rattus norvegicus
gaatctttttctttaactggtggca

SEQ ID NO: 309844 - DNA, 25 bp, Rattus norvegicus
gaatcttttttaaagcttggtcgct

SEQ ID NO: 309845 - DNA, 25 bp, Rattus norvegicus
gaatcttttttacttatgtttcaat

SEQ ID NO: 309846 - DNA, 25 bp, Rattus norvegicus
gaatcttttttagttatgtttcaat

SEQ ID NO: 309847 - DNA, 25 bp, Rattus norvegicus
gaatcttttttatagcttggtcgct

SEQ ID NO: 309848 - DNA, 25 bp, Rattus norvegicus
gaatgaaaaaaaaccctaatgaaga

SEQ ID NO: 309849 - DNA, 25 bp, Rattus norvegicus
gaatgaaaaaaatccctaatgaaga

SEQ ID NO: 309850 - DNA, 25 bp, Rattus norvegicus
gaatgaaaaattccgtgagtccctg

SEQ ID NO: 309851 - DNA, 25 bp, Rattus norvegicus
gaatgaaaaattgcgtgagtccctg

SEQ ID NO: 309852 - DNA, 25 bp, Rattus norvegicus
gaatgaaaaggaaccctcccatggg

SEQ ID NO: 309853 - DNA, 25 bp, Rattus norvegicus
gaatgaaaaggatccctcccatggg

SEQ ID NO: 309854 - DNA, 25 bp, Rattus norvegicus
gaatgaaaatatagcctgtgataaa

SEQ ID NO: 309855 - DNA, 25 bp, Rattus norvegicus
gaatgaaaatattgcctgtgataaa

SEQ ID NO: 309856 - DNA, 25 bp, Rattus norvegicus
gaatgaaactacctacaaagggcct

SEQ ID NO: 309857 - DNA, 25 bp, Rattus norvegicus
gaatgaaactacgtacaaagggcct

SEQ ID NO: 309858 - DNA, 25 bp, Rattus norvegicus
gaatgaaactatctgccggctggtt

SEQ ID NO: 309859 - DNA, 25 bp, Rattus norvegicus
gaatgaaactatgtgccggctggtt

SEQ ID NO: 309860 - DNA, 25 bp, Rattus norvegicus
gaatgaaagaccctctcccagaaag

SEQ ID NO: 309861 - DNA, 25 bp, Rattus norvegicus
gaatgaaagaccgtctcccagaaag

SEQ ID NO: 309862 - DNA, 25 bp, Rattus norvegicus
gaatgaaagactaaccccgggctca

SEQ ID NO: 309863 - DNA, 25 bp, Rattus norvegicus
gaatgaaagacttaccccgggctca

SEQ ID NO: 309864 - DNA, 25 bp, Rattus norvegicus
gaatgaaagcttcccgcgagcacaa

SEQ ID NO: 309865 - DNA, 25 bp, Rattus norvegicus
gaatgaaagcttgccgcgagcacaa

SEQ ID NO: 309866 - DNA, 25 bp, Rattus norvegicus
gaatgaaagtcaactacttcagagt

SEQ ID NO: 309867 - DNA, 25 bp, Rattus norvegicus
gaatgaaagtcatctacttcagagt

SEQ ID NO: 309868 - DNA, 25 bp, Rattus norvegicus
gaatgaaatcagctatagcacacac

SEQ ID NO: 309869 - DNA, 25 bp, Rattus norvegicus
gaatgaaatcaggtatagcacacac

SEQ ID NO: 309870 - DNA, 25 bp, Rattus norvegicus
gaatgaaatgcactctttgctggaa

SEQ ID NO: 309871 - DNA, 25 bp, Rattus norvegicus
gaatgaaatgcagtctttgctggaa

SEQ ID NO: 309872 - DNA, 25 bp, Rattus norvegicus
gaatgaaatgttcggcttctttaag

SEQ ID NO: 309873 - DNA, 25 bp, Rattus norvegicus
gaatgaaatgttgggcttctttaag

SEQ ID NO: 309874 - DNA, 25 bp, Rattus norvegicus
gaatgaaattccacacacagcctaa

SEQ ID NO: 309875 - DNA, 25 bp, Rattus norvegicus
gaatgaaattcctcacacagcctaa

SEQ ID NO: 309876 - DNA, 25 bp, Rattus norvegicus
gaatgaacaaagattatggcagcaa

SEQ ID NO: 309877 - DNA, 25 bp, Rattus norvegicus
gaatgaacaaagtttatggcagcaa

SEQ ID NO: 309878 - DNA, 25 bp, Rattus norvegicus
gaatgaacaccgcagcaaggctgag

SEQ ID NO: 309879 - DNA, 25 bp, Rattus norvegicus
gaatgaacaccggagcaaggctgag

SEQ ID NO: 309880 - DNA, 25 bp, Rattus norvegicus
gaatgaacacgcattttagaagcag

SEQ ID NO: 309881 - DNA, 25 bp, Rattus norvegicus
gaatgaacacgctttttagaagcag

SEQ ID NO: 309882 - DNA, 25 bp, Rattus norvegicus
gaatgaacacgtattcctagcgcac

SEQ ID NO: 309883 - DNA, 25 bp, Rattus norvegicus
gaatgaacacgttttcctagcgcac

SEQ ID NO: 309884 - DNA, 25 bp, Rattus norvegicus
gaatgaacatccctggtcacacagg

SEQ ID NO: 309885 - DNA, 25 bp, Rattus norvegicus
gaatgaacatccgtggtcacacagg

SEQ ID NO: 309886 - DNA, 25 bp, Rattus norvegicus
gaatgaacatcgatctctgtttttg

SEQ ID NO: 309887 - DNA, 25 bp, Rattus norvegicus
gaatgaacatcgttctctgtttttg

SEQ ID NO: 309888 - DNA, 25 bp, Rattus norvegicus
gaatgaaccagacgtacccggccct

SEQ ID NO: 309889 - DNA, 25 bp, Rattus norvegicus
gaatgaaccagaggtacccggccct

SEQ ID NO: 309890 - DNA, 25 bp, Rattus norvegicus
gaatgaacccatctggacctagtgc

SEQ ID NO: 309891 - DNA, 25 bp, Rattus norvegicus
gaatgaacccatgtggacctagtgc

SEQ ID NO: 309892 - DNA, 25 bp, Rattus norvegicus
gaatgaacccgaacagaggatgaat

SEQ ID NO: 309893 - DNA, 25 bp, Rattus norvegicus
gaatgaacccgatcagaggatgaat

SEQ ID NO: 309894 - DNA, 25 bp, Rattus norvegicus
gaatgaaccgcacccattgtagcca

SEQ ID NO: 309895 - DNA, 25 bp, Rattus norvegicus
gaatgaaccgcagccattgtagcca

SEQ ID NO: 309896 - DNA, 25 bp, Rattus norvegicus
gaatgaaccttcacagtcactggtg

SEQ ID NO: 309897 - DNA, 25 bp, Rattus norvegicus
gaatgaaccttcatcagaccagcat

SEQ ID NO: 309898 - DNA, 25 bp, Rattus norvegicus
gaatgaaccttcctcaagctgtata

SEQ ID NO: 309899 - DNA, 25 bp, Rattus norvegicus
gaatgaaccttcgtcaagctgtata

SEQ ID NO: 309900 - DNA, 25 bp, Rattus norvegicus
gaatgaaccttctcagtcactggtg

SEQ ID NO: 309901 - DNA, 25 bp, Rattus norvegicus
gaatgaaccttcttcagaccagcat

SEQ ID NO: 309902 - DNA, 25 bp, Rattus norvegicus
gaatgaactactaaacagcttgctt

SEQ ID NO: 309903 - DNA, 25 bp, Rattus norvegicus
gaatgaactacttaacagcttgctt

SEQ ID NO: 309904 - DNA, 25 bp, Rattus norvegicus
gaatgaactcatccattttccagat

SEQ ID NO: 309905 - DNA, 25 bp, Rattus norvegicus
gaatgaactcatcttcctgatgaat

SEQ ID NO: 309906 - DNA, 25 bp, Rattus norvegicus
gaatgaactcatgcattttccagat

SEQ ID NO: 309907 - DNA, 25 bp, Rattus norvegicus
gaatgaactcatgttcctgatgaat

SEQ ID NO: 309908 - DNA, 25 bp, Rattus norvegicus
gaatgaactgccattgacatgtgaa

SEQ ID NO: 309909 - DNA, 25 bp, Rattus norvegicus
gaatgaactgcctttgacatgtgaa

SEQ ID NO: 309910 - DNA, 25 bp, Rattus norvegicus
gaatgaactgctagagcccagctct

SEQ ID NO: 309911 - DNA, 25 bp, Rattus norvegicus
gaatgaactgcttgagcccagctct

SEQ ID NO: 309912 - DNA, 25 bp, Rattus norvegicus
gaatgaactgtaacttaagctcgaa

SEQ ID NO: 309913 - DNA, 25 bp, Rattus norvegicus
gaatgaactgtatcttaagctcgaa

SEQ ID NO: 309914 - DNA, 25 bp, Rattus norvegicus
gaatgaacttcgaatgcttgcatag

SEQ ID NO: 309915 - DNA, 25 bp, Rattus norvegicus
gaatgaacttcgtatgcttgcatag

SEQ ID NO: 309916 - DNA, 25 bp, Rattus norvegicus
gaatgaactttgctcctctccaaga

SEQ ID NO: 309917 - DNA, 25 bp, Rattus norvegicus
gaatgaactttggtcctctccaaga

SEQ ID NO: 309918 - DNA, 25 bp, Rattus norvegicus
gaatgaagattaaccctcgggctgt

SEQ ID NO: 309919 - DNA, 25 bp, Rattus norvegicus
gaatgaagattatccctcgggctgt

SEQ ID NO: 309920 - DNA, 25 bp, Rattus norvegicus
gaatgaagcagcctgtgcccaaagc

SEQ ID NO: 309921 - DNA, 25 bp, Rattus norvegicus
gaatgaagcagcgtgtgcccaaagc

SEQ ID NO: 309922 - DNA, 25 bp, Rattus norvegicus
gaatgaagccagctccactaactag

SEQ ID NO: 309923 - DNA, 25 bp, Rattus norvegicus
gaatgaagccaggtccactaactag

SEQ ID NO: 309924 - DNA, 25 bp, Rattus norvegicus
gaatgaagcctactctgtgctacct

SEQ ID NO: 309925 - DNA, 25 bp, Rattus norvegicus
gaatgaagcctagtctgtgctacct

SEQ ID NO: 309926 - DNA, 25 bp, Rattus norvegicus
gaatgaagccttcacaacagttgag

SEQ ID NO: 309927 - DNA, 25 bp, Rattus norvegicus
gaatgaagccttgacaacagttgag

SEQ ID NO: 309928 - DNA, 25 bp, Rattus norvegicus
gaatgaagcgctcagcatcccggga

SEQ ID NO: 309929 - DNA, 25 bp, Rattus norvegicus
gaatgaagcgctgagcatcccggga

SEQ ID NO: 309930 - DNA, 25 bp, Rattus norvegicus
gaatgaaggcctctctgtggccacc

SEQ ID NO: 309931 - DNA, 25 bp, Rattus norvegicus
gaatgaaggcctgtctgtggccacc

SEQ ID NO: 309932 - DNA, 25 bp, Rattus norvegicus
gaatgaagggatccgttctcactgc

SEQ ID NO: 309933 - DNA, 25 bp, Rattus norvegicus
gaatgaagggatgcgttctcactgc

SEQ ID NO: 309934 - DNA, 25 bp, Rattus norvegicus
gaatgaagtaacatcctcttcccac

SEQ ID NO: 309935 - DNA, 25 bp, Rattus norvegicus
gaatgaagtaacttcctcttcccac

SEQ ID NO: 309936 - DNA, 25 bp, Rattus norvegicus
gaatgaagtacacctgtccctcagg

SEQ ID NO: 309937 - DNA, 25 bp, Rattus norvegicus
gaatgaagtacagctgtccctcagg

SEQ ID NO: 309938 - DNA, 25 bp, Rattus norvegicus
gaatgaagtgagatgttcccagaga

SEQ ID NO: 309939 - DNA, 25 bp, Rattus norvegicus
gaatgaagtgagttgttcccagaga

SEQ ID NO: 309940 - DNA, 25 bp, Rattus norvegicus
gaatgaagttttcatcagttcccct

SEQ ID NO: 309941 - DNA, 25 bp, Rattus norvegicus
gaatgaagttttgatcagttcccct

SEQ ID NO: 309942 - DNA, 25 bp, Rattus norvegicus
gaatgaataaacaccttgcttttgc

SEQ ID NO: 309943 - DNA, 25 bp, Rattus norvegicus
gaatgaataaactccttgcttttgc

SEQ ID NO: 309944 - DNA, 25 bp, Rattus norvegicus
gaatgaatcaaaaacgtttctcctg

SEQ ID NO: 309945 - DNA, 25 bp, Rattus norvegicus
gaatgaatcaaatacgtttctcctg

SEQ ID NO: 309946 - DNA, 25 bp, Rattus norvegicus
gaatgaatcggccagtccaggtcca

SEQ ID NO: 309947 - DNA, 25 bp, Rattus norvegicus
gaatgaatcggcgagtccaggtcca

SEQ ID NO: 309948 - DNA, 25 bp, Rattus norvegicus
gaatgaatctaccacctttgttttg

SEQ ID NO: 309949 - DNA, 25 bp, Rattus norvegicus
gaatgaatctacgacctttgttttg

SEQ ID NO: 309950 - DNA, 25 bp, Rattus norvegicus
gaatgaatctagatccagccggact

SEQ ID NO: 309951 - DNA, 25 bp, Rattus norvegicus
gaatgaatctagttccagccggact

SEQ ID NO: 309952 - DNA, 25 bp, Rattus norvegicus
gaatgaatctcgatagtctacaaaa

SEQ ID NO: 309953 - DNA, 25 bp, Rattus norvegicus
gaatgaatctcgttagtctacaaaa

SEQ ID NO: 309954 - DNA, 25 bp, Rattus norvegicus
gaatgaatctctagtcaccttatcc

SEQ ID NO: 309955 - DNA, 25 bp, Rattus norvegicus
gaatgaatctcttgtcaccttatcc

SEQ ID NO: 309956 - DNA, 25 bp, Rattus norvegicus
gaatgaatctttcctattgactgta

SEQ ID NO: 309957 - DNA, 25 bp, Rattus norvegicus
gaatgaatctttgctattgactgta

SEQ ID NO: 309958 - DNA, 25 bp, Rattus norvegicus
gaatgaatgatgacctccctaacag

SEQ ID NO: 309959 - DNA, 25 bp, Rattus norvegicus
gaatgaatgatgtcctccctaacag

SEQ ID NO: 309960 - DNA, 25 bp, Rattus norvegicus
gaatgaatgcacactgtcatctgga

SEQ ID NO: 309961 - DNA, 25 bp, Rattus norvegicus
gaatgaatgcactctgtcatctgga

SEQ ID NO: 309962 - DNA, 25 bp, Rattus norvegicus
gaatgaatgcccatgagcctgtcct

SEQ ID NO: 309963 - DNA, 25 bp, Rattus norvegicus
gaatgaatgcccttgagcctgtcct

SEQ ID NO: 309964 - DNA, 25 bp, Rattus norvegicus
gaatgaattagtcccttaaggctgt

SEQ ID NO: 309965 - DNA, 25 bp, Rattus norvegicus
gaatgaattagtgccttaaggctgt

SEQ ID NO: 309966 - DNA, 25 bp, Rattus norvegicus
gaatgaattcccatccaactgaggt

SEQ ID NO: 309967 - DNA, 25 bp, Rattus norvegicus
gaatgaattcccttccaactgaggt

SEQ ID NO: 309968 - DNA, 25 bp, Rattus norvegicus
gaatgaattgacctctatccttccc

SEQ ID NO: 309969 - DNA, 25 bp, Rattus norvegicus
gaatgaattgacgtctatccttccc

SEQ ID NO: 309970 - DNA, 25 bp, Rattus norvegicus
gaatgaattgggatgctgtgcttga

SEQ ID NO: 309971 - DNA, 25 bp, Rattus norvegicus
gaatgaattgggttgctgtgcttga

SEQ ID NO: 309972 - DNA, 25 bp, Rattus norvegicus
gaatgaatttctccacggctgaagc

SEQ ID NO: 309973 - DNA, 25 bp, Rattus norvegicus
gaatgaatttctgcacggctgaagc

SEQ ID NO: 309974 - DNA, 25 bp, Rattus norvegicus
gaatgacaattcaccctccagtgga

SEQ ID NO: 309975 - DNA, 25 bp, Rattus norvegicus
gaatgacaattctccctccagtgga

SEQ ID NO: 309976 - DNA, 25 bp, Rattus norvegicus
gaatgacacacgatttcgagtggat

SEQ ID NO: 309977 - DNA, 25 bp, Rattus norvegicus
gaatgacacacgttttcgagtggat

SEQ ID NO: 309978 - DNA, 25 bp, Rattus norvegicus
gaatgacacgcacttctgtgctgat

SEQ ID NO: 309979 - DNA, 25 bp, Rattus norvegicus
gaatgacacgcagttctgtgctgat

SEQ ID NO: 309980 - DNA, 25 bp, Rattus norvegicus
gaatgacacgctatcctgtgaactg

SEQ ID NO: 309981 - DNA, 25 bp, Rattus norvegicus
gaatgacacgctttcctgtgaactg

SEQ ID NO: 309982 - DNA, 25 bp, Rattus norvegicus
gaatgacacggtaaccatccggacc

SEQ ID NO: 309983 - DNA, 25 bp, Rattus norvegicus
gaatgacacggttaccatccggacc

SEQ ID NO: 309984 - DNA, 25 bp, Rattus norvegicus
gaatgacactaaaggcctctggctc

SEQ ID NO: 309985 - DNA, 25 bp, Rattus norvegicus
gaatgacactaatggcctctggctc

SEQ ID NO: 309986 - DNA, 25 bp, Rattus norvegicus
gaatgacactgaacaacctgtgcat

SEQ ID NO: 309987 - DNA, 25 bp, Rattus norvegicus
gaatgacactgatcaacctgtgcat

SEQ ID NO: 309988 - DNA, 25 bp, Rattus norvegicus
gaatgacagaagaggcctcctccct

SEQ ID NO: 309989 - DNA, 25 bp, Rattus norvegicus
gaatgacagaagtggcctcctccct

SEQ ID NO: 309990 - DNA, 25 bp, Rattus norvegicus
gaatgacagcgtcctttggattcct

SEQ ID NO: 309991 - DNA, 25 bp, Rattus norvegicus
gaatgacagcgtgctttggattcct

SEQ ID NO: 309992 - DNA, 25 bp, Rattus norvegicus
gaatgacatattaattcccccctga

SEQ ID NO: 309993 - DNA, 25 bp, Rattus norvegicus
gaatgacatatttattcccccctga

SEQ ID NO: 309994 - DNA, 25 bp, Rattus norvegicus
gaatgacatcgtactggttgcctat

SEQ ID NO: 309995 - DNA, 25 bp, Rattus norvegicus
gaatgacatcgttctggttgcctat

SEQ ID NO: 309996 - DNA, 25 bp, Rattus norvegicus
gaatgacatggccatctccaggcac

SEQ ID NO: 309997 - DNA, 25 bp, Rattus norvegicus
gaatgacatggcgatctccaggcac

SEQ ID NO: 309998 - DNA, 25 bp, Rattus norvegicus
gaatgacattgtagcaacgccttat

SEQ ID NO: 309999 - DNA, 25 bp, Rattus norvegicus
gaatgacattgttgcaacgccttat

SEQ ID NO: 310000 - DNA, 25 bp, Rattus norvegicus
gaatgaccacaaagaagggctggct

SEQ ID NO: 310001 - DNA, 25 bp, Rattus norvegicus
gaatgaccacaatgaagggctggct

SEQ ID NO: 310002 - DNA, 25 bp, Rattus norvegicus
gaatgaccagcccacagtttgttag

SEQ ID NO: 310003 - DNA, 25 bp, Rattus norvegicus
gaatgaccagccgacagtttgttag

SEQ ID NO: 310004 - DNA, 25 bp, Rattus norvegicus
gaatgaccagggatatctcctgaaa

SEQ ID NO: 310005 - DNA, 25 bp, Rattus norvegicus
gaatgaccagggttatctcctgaaa

SEQ ID NO: 310006 - DNA, 25 bp, Rattus norvegicus
gaatgaccagtgatgcgaccagtta

SEQ ID NO: 310007 - DNA, 25 bp, Rattus norvegicus
gaatgaccagtgttgcgaccagtta

SEQ ID NO: 310008 - DNA, 25 bp, Rattus norvegicus
gaatgaccatatactgctcttctgg

SEQ ID NO: 310009 - DNA, 25 bp, Rattus norvegicus
gaatgaccatattctgctcttctgg

SEQ ID NO: 310010 - DNA, 25 bp, Rattus norvegicus
gaatgacccaataaggccaccgtac

SEQ ID NO: 310011 - DNA, 25 bp, Rattus norvegicus
gaatgacccaattaggccaccgtac

SEQ ID NO: 310012 - DNA, 25 bp, Rattus norvegicus
gaatgacccggaaacctgtgacaag

SEQ ID NO: 310013 - DNA, 25 bp, Rattus norvegicus
gaatgacccggatacctgtgacaag

SEQ ID NO: 310014 - DNA, 25 bp, Rattus norvegicus
gaatgacctcgtctctgagtatcag

SEQ ID NO: 310015 - DNA, 25 bp, Rattus norvegicus
gaatgacctcgtgtctgagtatcag

SEQ ID NO: 310016 - DNA, 25 bp, Rattus norvegicus
gaatgacctcttccttaaaggacct

SEQ ID NO: 310017 - DNA, 25 bp, Rattus norvegicus
gaatgacctcttgcttaaaggacct

SEQ ID NO: 310018 - DNA, 25 bp, Rattus norvegicus
gaatgacctgacatttcttaggatc

SEQ ID NO: 310019 - DNA, 25 bp, Rattus norvegicus
gaatgacctgacttttcttaggatc

SEQ ID NO: 310020 - DNA, 25 bp, Rattus norvegicus
gaatgacctgcacttatgtcgagag

SEQ ID NO: 310021 - DNA, 25 bp, Rattus norvegicus
gaatgacctgcagttatgtcgagag

SEQ ID NO: 310022 - DNA, 25 bp, Rattus norvegicus
gaatgacctgtcacatcagttgaag

SEQ ID NO: 310023 - DNA, 25 bp, Rattus norvegicus
gaatgacctgtctcatcagttgaag

SEQ ID NO: 310024 - DNA, 25 bp, Rattus norvegicus
gaatgacgacaacttcttaagcata

SEQ ID NO: 310025 - DNA, 25 bp, Rattus norvegicus
gaatgacgacaagttcttaagcata

SEQ ID NO: 310026 - DNA, 25 bp, Rattus norvegicus
gaatgacgagttagattgctctcct

SEQ ID NO: 310027 - DNA, 25 bp, Rattus norvegicus
gaatgacgagtttgattgctctcct

SEQ ID NO: 310028 - DNA, 25 bp, Rattus norvegicus
gaatgacggaacacctgttgcagcc

SEQ ID NO: 310029 - DNA, 25 bp, Rattus norvegicus
gaatgacggaactcctgttgcagcc

SEQ ID NO: 310030 - DNA, 25 bp, Rattus norvegicus
gaatgacgtcatagttactggaggg

SEQ ID NO: 310031 - DNA, 25 bp, Rattus norvegicus
gaatgacgtcattgttactggaggg

SEQ ID NO: 310032 - DNA, 25 bp, Rattus norvegicus
gaatgacgtggcaagtcgccgtacc

SEQ ID NO: 310033 - DNA, 25 bp, Rattus norvegicus
gaatgacgtggctagtcgccgtacc

SEQ ID NO: 310034 - DNA, 25 bp, Rattus norvegicus
gaatgacgttgaagaccttcccttc

SEQ ID NO: 310035 - DNA, 25 bp, Rattus norvegicus
gaatgacgttgatgaccttcccttc

SEQ ID NO: 310036 - DNA, 25 bp, Rattus norvegicus
gaatgactaaacctgtactttggga

SEQ ID NO: 310037 - DNA, 25 bp, Rattus norvegicus
gaatgactaaacgtgtactttggga

SEQ ID NO: 310038 - DNA, 25 bp, Rattus norvegicus
gaatgactacaaccctttagactct

SEQ ID NO: 310039 - DNA, 25 bp, Rattus norvegicus
gaatgactacaagcctttagactct

SEQ ID NO: 310040 - DNA, 25 bp, Rattus norvegicus
gaatgactactccatggtgttgaca

SEQ ID NO: 310041 - DNA, 25 bp, Rattus norvegicus
gaatgactactcgatggtgttgaca

SEQ ID NO: 310042 - DNA, 25 bp, Rattus norvegicus
gaatgactacttcacacttttgata

SEQ ID NO: 310043 - DNA, 25 bp, Rattus norvegicus
gaatgactacttgacacttttgata

SEQ ID NO: 310044 - DNA, 25 bp, Rattus norvegicus
gaatgactagcacaggccgatgccc

SEQ ID NO: 310045 - DNA, 25 bp, Rattus norvegicus
gaatgactagcagaggccgatgccc

SEQ ID NO: 310046 - DNA, 25 bp, Rattus norvegicus
gaatgactcagaactctttgggctg

SEQ ID NO: 310047 - DNA, 25 bp, Rattus norvegicus
gaatgactcagatctctttgggctg

SEQ ID NO: 310048 - DNA, 25 bp, Rattus norvegicus
gaatgactcataatagacacctggt

SEQ ID NO: 310049 - DNA, 25 bp, Rattus norvegicus
gaatgactcatattagacacctggt

SEQ ID NO: 310050 - DNA, 25 bp, Rattus norvegicus
gaatgactctaaagatatcgctgat

SEQ ID NO: 310051 - DNA, 25 bp, Rattus norvegicus
gaatgactctaatgatatcgctgat

SEQ ID NO: 310052 - DNA, 25 bp, Rattus norvegicus
gaatgactgcttctctggtaaatgt

SEQ ID NO: 310053 - DNA, 25 bp, Rattus norvegicus
gaatgactgcttgtctggtaaatgt

SEQ ID NO: 310054 - DNA, 25 bp, Rattus norvegicus
gaatgactggaaattcagccccacc

SEQ ID NO: 310055 - DNA, 25 bp, Rattus norvegicus
gaatgactggaactctccgctcata

SEQ ID NO: 310056 - DNA, 25 bp, Rattus norvegicus
gaatgactggaagtctccgctcata

SEQ ID NO: 310057 - DNA, 25 bp, Rattus norvegicus
gaatgactggaatttcagccccacc

SEQ ID NO: 310058 - DNA, 25 bp, Rattus norvegicus
gaatgactggcgcttcttgttcccc

SEQ ID NO: 310059 - DNA, 25 bp, Rattus norvegicus
gaatgactggcggttcttgttcccc

SEQ ID NO: 310060 - DNA, 25 bp, Rattus norvegicus
gaatgactgggaagctgccacaagt

SEQ ID NO: 310061 - DNA, 25 bp, Rattus norvegicus
gaatgactgggatgctgccacaagt

SEQ ID NO: 310062 - DNA, 25 bp, Rattus norvegicus
gaatgactgtctccagtgcatgcac

SEQ ID NO: 310063 - DNA, 25 bp, Rattus norvegicus
gaatgactgtctgcagtgcatgcac

SEQ ID NO: 310064 - DNA, 25 bp, Rattus norvegicus
gaatgactgtttaagcctgtgcctg

SEQ ID NO: 310065 - DNA, 25 bp, Rattus norvegicus
gaatgactgtttacctgatggctgt

SEQ ID NO: 310066 - DNA, 25 bp, Rattus norvegicus
gaatgactgttttagcctgtgcctg

SEQ ID NO: 310067 - DNA, 25 bp, Rattus norvegicus
gaatgactgttttcctgatggctgt

SEQ ID NO: 310068 - DNA, 25 bp, Rattus norvegicus
gaatgacttcaaagccagggcagcc

SEQ ID NO: 310069 - DNA, 25 bp, Rattus norvegicus
gaatgacttcaatgccagggcagcc

SEQ ID NO: 310070 - DNA, 25 bp, Rattus norvegicus
gaatgacttcagatttggaccagac

SEQ ID NO: 310071 - DNA, 25 bp, Rattus norvegicus
gaatgacttcagttttggaccagac

SEQ ID NO: 310072 - DNA, 25 bp, Rattus norvegicus
gaatgacttctcaacagactcatct

SEQ ID NO: 310073 - DNA, 25 bp, Rattus norvegicus
gaatgacttctctacagactcatct

SEQ ID NO: 310074 - DNA, 25 bp, Rattus norvegicus
gaatgacttctgaccaacagtgcca

SEQ ID NO: 310075 - DNA, 25 bp, Rattus norvegicus
gaatgacttctgactattcaagttt

SEQ ID NO: 310076 - DNA, 25 bp, Rattus norvegicus
gaatgacttctgtccaacagtgcca

SEQ ID NO: 310077 - DNA, 25 bp, Rattus norvegicus
gaatgacttctgtctattcaagttt

SEQ ID NO: 310078 - DNA, 25 bp, Rattus norvegicus
gaatgacttgcaacgccaagctaat

SEQ ID NO: 310079 - DNA, 25 bp, Rattus norvegicus
gaatgacttgcaacgtcttgactca

SEQ ID NO: 310080 - DNA, 25 bp, Rattus norvegicus
gaatgacttgcatcgccaagctaat

SEQ ID NO: 310081 - DNA, 25 bp, Rattus norvegicus
gaatgacttgcatcgtcttgactca

SEQ ID NO: 310082 - DNA, 25 bp, Rattus norvegicus
gaatgacttgccctttgaaaccact

SEQ ID NO: 310083 - DNA, 25 bp, Rattus norvegicus
gaatgacttgccgtttgaaaccact

SEQ ID NO: 310084 - DNA, 25 bp, Rattus norvegicus
gaatgacttgctccctccaagataa

SEQ ID NO: 310085 - DNA, 25 bp, Rattus norvegicus
gaatgacttgctgcctccaagataa

SEQ ID NO: 310086 - DNA, 25 bp, Rattus norvegicus
gaatgactttccatgatgagaagaa

SEQ ID NO: 310087 - DNA, 25 bp, Rattus norvegicus
gaatgactttccttgatgagaagaa

SEQ ID NO: 310088 - DNA, 25 bp, Rattus norvegicus
gaatgactttgacctggcacgagct

SEQ ID NO: 310089 - DNA, 25 bp, Rattus norvegicus
gaatgactttgagctggcacgagct

SEQ ID NO: 310090 - DNA, 25 bp, Rattus norvegicus
gaatgagaaacacagcaccctaggt

SEQ ID NO: 310091 - DNA, 25 bp, Rattus norvegicus
gaatgagaaacagagcaccctaggt

SEQ ID NO: 310092 - DNA, 25 bp, Rattus norvegicus
gaatgagaagccattgctatgctaa

SEQ ID NO: 310093 - DNA, 25 bp, Rattus norvegicus
gaatgagaagccctccgtgtgttac

SEQ ID NO: 310094 - DNA, 25 bp, Rattus norvegicus
gaatgagaagccgtccgtgtgttac

SEQ ID NO: 310095 - DNA, 25 bp, Rattus norvegicus
gaatgagaagcctttgctatgctaa

SEQ ID NO: 310096 - DNA, 25 bp, Rattus norvegicus
gaatgagaatctcgtcagatgtgat

SEQ ID NO: 310097 - DNA, 25 bp, Rattus norvegicus
gaatgagaatctggtcagatgtgat

SEQ ID NO: 310098 - DNA, 25 bp, Rattus norvegicus
gaatgagacaatcctcccacactga

SEQ ID NO: 310099 - DNA, 25 bp, Rattus norvegicus
gaatgagacaatgctcccacactga

SEQ ID NO: 310100 - DNA, 25 bp, Rattus norvegicus
gaatgagacatcagcatggcctcct

SEQ ID NO: 310101 - DNA, 25 bp, Rattus norvegicus
gaatgagacatctgcatggcctcct

SEQ ID NO: 310102 - DNA, 25 bp, Rattus norvegicus
gaatgagaccacagtcctgtaccgg

SEQ ID NO: 310103 - DNA, 25 bp, Rattus norvegicus
gaatgagaccactgtcctgtaccgg

SEQ ID NO: 310104 - DNA, 25 bp, Rattus norvegicus
gaatgagaccccacagtaggcactt

SEQ ID NO: 310105 - DNA, 25 bp, Rattus norvegicus
gaatgagacccctcagtaggcactt

SEQ ID NO: 310106 - DNA, 25 bp, Rattus norvegicus
gaatgagaccctacttgtggtgtaa

SEQ ID NO: 310107 - DNA, 25 bp, Rattus norvegicus
gaatgagacccttcttgtggtgtaa

SEQ ID NO: 310108 - DNA, 25 bp, Rattus norvegicus
gaatgagacctcagtttcctagctt

SEQ ID NO: 310109 - DNA, 25 bp, Rattus norvegicus
gaatgagacctctgtttcctagctt

SEQ ID NO: 310110 - DNA, 25 bp, Rattus norvegicus
gaatgagacctgattctagctacaa

SEQ ID NO: 310111 - DNA, 25 bp, Rattus norvegicus
gaatgagacctgtttctagctacaa

SEQ ID NO: 310112 - DNA, 25 bp, Rattus norvegicus
gaatgagactctccccaggagggct

SEQ ID NO: 310113 - DNA, 25 bp, Rattus norvegicus
gaatgagactctgcccaggagggct

SEQ ID NO: 310114 - DNA, 25 bp, Rattus norvegicus
gaatgagagaggaccccactgaccc

SEQ ID NO: 310115 - DNA, 25 bp, Rattus norvegicus
gaatgagagaggtccccactgaccc

SEQ ID NO: 310116 - DNA, 25 bp, Rattus norvegicus
gaatgagagcagcttcagaccgaac

SEQ ID NO: 310117 - DNA, 25 bp, Rattus norvegicus
gaatgagagcaggttcagaccgaac

SEQ ID NO: 310118 - DNA, 25 bp, Rattus norvegicus
gaatgagagcctcctgggcattgtt

SEQ ID NO: 310119 - DNA, 25 bp, Rattus norvegicus
gaatgagagcctgctgggcattgtt

SEQ ID NO: 310120 - DNA, 25 bp, Rattus norvegicus
gaatgagagcttagttttctgcctt

SEQ ID NO: 310121 - DNA, 25 bp, Rattus norvegicus
gaatgagagctttgttttctgcctt

SEQ ID NO: 310122 - DNA, 25 bp, Rattus norvegicus
gaatgagatctcagcgcgacacagt

SEQ ID NO: 310123 - DNA, 25 bp, Rattus norvegicus
gaatgagatctctgcgcgacacagt

SEQ ID NO: 310124 - DNA, 25 bp, Rattus norvegicus
gaatgagatgcgctgtgcctacgaa

SEQ ID NO: 310125 - DNA, 25 bp, Rattus norvegicus
gaatgagatgcggtgtgcctacgaa

SEQ ID NO: 310126 - DNA, 25 bp, Rattus norvegicus
gaatgagattccatcgcgtggtggt

SEQ ID NO: 310127 - DNA, 25 bp, Rattus norvegicus
gaatgagattccttcgcgtggtggt

SEQ ID NO: 310128 - DNA, 25 bp, Rattus norvegicus
gaatgagatttcctccaatcagcta

SEQ ID NO: 310129 - DNA, 25 bp, Rattus norvegicus
gaatgagatttcgtccaatcagcta

SEQ ID NO: 310130 - DNA, 25 bp, Rattus norvegicus
gaatgagcaccgagaagctacagga

SEQ ID NO: 310131 - DNA, 25 bp, Rattus norvegicus
gaatgagcaccgtgaagctacagga

SEQ ID NO: 310132 - DNA, 25 bp, Rattus norvegicus
gaatgagcacgacccaaccaatgaa

SEQ ID NO: 310133 - DNA, 25 bp, Rattus norvegicus
gaatgagcacgagccaaccaatgaa

SEQ ID NO: 310134 - DNA, 25 bp, Rattus norvegicus
gaatgagcacttcgcagctgtcctg

SEQ ID NO: 310135 - DNA, 25 bp, Rattus norvegicus
gaatgagcacttctaagacttcctg

SEQ ID NO: 310136 - DNA, 25 bp, Rattus norvegicus
gaatgagcacttggcagctgtcctg

SEQ ID NO: 310137 - DNA, 25 bp, Rattus norvegicus
gaatgagcacttgtaagacttcctg

SEQ ID NO: 310138 - DNA, 25 bp, Rattus norvegicus
gaatgagcagagatccctgggccaa

SEQ ID NO: 310139 - DNA, 25 bp, Rattus norvegicus
gaatgagcagagttccctgggccaa

SEQ ID NO: 310140 - DNA, 25 bp, Rattus norvegicus
gaatgagcagttagcttcctgttac

SEQ ID NO: 310141 - DNA, 25 bp, Rattus norvegicus
gaatgagcagtttgcttcctgttac

SEQ ID NO: 310142 - DNA, 25 bp, Rattus norvegicus
gaatgagccatcatgccgagcaaca

SEQ ID NO: 310143 - DNA, 25 bp, Rattus norvegicus
gaatgagccatcttgccgagcaaca

SEQ ID NO: 310144 - DNA, 25 bp, Rattus norvegicus
gaatgagcccaaagcatgccaagtt

SEQ ID NO: 310145 - DNA, 25 bp, Rattus norvegicus
gaatgagcccaatgcatgccaagtt

SEQ ID NO: 310146 - DNA, 25 bp, Rattus norvegicus
gaatgagcccagaaggacttttaca

SEQ ID NO: 310147 - DNA, 25 bp, Rattus norvegicus
gaatgagcccagtaggacttttaca

SEQ ID NO: 310148 - DNA, 25 bp, Rattus norvegicus
gaatgagccgccactcaaaggtggc

SEQ ID NO: 310149 - DNA, 25 bp, Rattus norvegicus
gaatgagccgcctctcaaaggtggc

SEQ ID NO: 310150 - DNA, 25 bp, Rattus norvegicus
gaatgagccggactactcccaagtt

SEQ ID NO: 310151 - DNA, 25 bp, Rattus norvegicus
gaatgagccggagtactcccaagtt

SEQ ID NO: 310152 - DNA, 25 bp, Rattus norvegicus
gaatgagccttgcagatccactaag

SEQ ID NO: 310153 - DNA, 25 bp, Rattus norvegicus
gaatgagccttggagatccactaag

SEQ ID NO: 310154 - DNA, 25 bp, Rattus norvegicus
gaatgagctattctttttctgtaaa

SEQ ID NO: 310155 - DNA, 25 bp, Rattus norvegicus
gaatgagctattgtttttctgtaaa

SEQ ID NO: 310156 - DNA, 25 bp, Rattus norvegicus
gaatgagctccaagtcctgatgttg

SEQ ID NO: 310157 - DNA, 25 bp, Rattus norvegicus
gaatgagctccatgtcctgatgttg

SEQ ID NO: 310158 - DNA, 25 bp, Rattus norvegicus
gaatgagctcttcaatgtctgccag

SEQ ID NO: 310159 - DNA, 25 bp, Rattus norvegicus
gaatgagctcttgaatgtctgccag

SEQ ID NO: 310160 - DNA, 25 bp, Rattus norvegicus
gaatgagcttctagaatttcttaag

SEQ ID NO: 310161 - DNA, 25 bp, Rattus norvegicus
gaatgagcttcttgaatttcttaag

SEQ ID NO: 310162 - DNA, 25 bp, Rattus norvegicus
gaatgaggatcgactaccatagtct

SEQ ID NO: 310163 - DNA, 25 bp, Rattus norvegicus
gaatgaggatcgtctaccatagtct

SEQ ID NO: 310164 - DNA, 25 bp, Rattus norvegicus
gaatgaggccagatttcccgagcac

SEQ ID NO: 310165 - DNA, 25 bp, Rattus norvegicus
gaatgaggccagttttcccgagcac

SEQ ID NO: 310166 - DNA, 25 bp, Rattus norvegicus
gaatgaggccctcaagacctgggat

SEQ ID NO: 310167 - DNA, 25 bp, Rattus norvegicus
gaatgaggccctgaagacctgggat

SEQ ID NO: 310168 - DNA, 25 bp, Rattus norvegicus
gaatgaggctttcccgtaaagtact

SEQ ID NO: 310169 - DNA, 25 bp, Rattus norvegicus
gaatgaggctttgccgtaaagtact

SEQ ID NO: 310170 - DNA, 25 bp, Rattus norvegicus
gaatgagggcaccatgttcccagtt

SEQ ID NO: 310171 - DNA, 25 bp, Rattus norvegicus
gaatgagggcacgatgttcccagtt

SEQ ID NO: 310172 - DNA, 25 bp, Rattus norvegicus
gaatgaggtcacaacctggtaacta

SEQ ID NO: 310173 - DNA, 25 bp, Rattus norvegicus
gaatgaggtcactacctggtaacta

SEQ ID NO: 310174 - DNA, 25 bp, Rattus norvegicus
gaatgagtaaccctgctatttttgt

SEQ ID NO: 310175 - DNA, 25 bp, Rattus norvegicus
gaatgagtaaccgtgctatttttgt

SEQ ID NO: 310176 - DNA, 25 bp, Rattus norvegicus
gaatgagtatctccacacgtggctg

SEQ ID NO: 310177 - DNA, 25 bp, Rattus norvegicus
gaatgagtatctgcacacgtggctg

SEQ ID NO: 310178 - DNA, 25 bp, Rattus norvegicus
gaatgagtcagaacccacagtagga

SEQ ID NO: 310179 - DNA, 25 bp, Rattus norvegicus
gaatgagtcagatcccacagtagga

SEQ ID NO: 310180 - DNA, 25 bp, Rattus norvegicus
gaatgagtcgctcctgcacgagttg

SEQ ID NO: 310181 - DNA, 25 bp, Rattus norvegicus
gaatgagtcgctgctgcacgagttg

SEQ ID NO: 310182 - DNA, 25 bp, Rattus norvegicus
gaatgagtgctcacgtttgtcatag

SEQ ID NO: 310183 - DNA, 25 bp, Rattus norvegicus
gaatgagtgctctcgtttgtcatag

SEQ ID NO: 310184 - DNA, 25 bp, Rattus norvegicus
gaatgagtggaaagcctccatccct

SEQ ID NO: 310185 - DNA, 25 bp, Rattus norvegicus
gaatgagtggaatgcctccatccct

SEQ ID NO: 310186 - DNA, 25 bp, Rattus norvegicus
gaatgagtgtctaggcaggacctgt

SEQ ID NO: 310187 - DNA, 25 bp, Rattus norvegicus
gaatgagtgtcttggcaggacctgt

SEQ ID NO: 310188 - DNA, 25 bp, Rattus norvegicus
gaatgagttcctcgcacaggtgctt

SEQ ID NO: 310189 - DNA, 25 bp, Rattus norvegicus
gaatgagttcctggcacaggtgctt

SEQ ID NO: 310190 - DNA, 25 bp, Rattus norvegicus
gaatgagttgccagcacgtgctata

SEQ ID NO: 310191 - DNA, 25 bp, Rattus norvegicus
gaatgagttgcctgcacgtgctata

SEQ ID NO: 310192 - DNA, 25 bp, Rattus norvegicus
gaatgagtttccctgtctactatct

SEQ ID NO: 310193 - DNA, 25 bp, Rattus norvegicus
gaatgagtttccgtgtctactatct

SEQ ID NO: 310194 - DNA, 25 bp, Rattus norvegicus
gaatgagtttctcttcttccacctc

SEQ ID NO: 310195 - DNA, 25 bp, Rattus norvegicus
gaatgagtttctgttcttccacctc

SEQ ID NO: 310196 - DNA, 25 bp, Rattus norvegicus
gaatgataaataactggcctgctga

SEQ ID NO: 310197 - DNA, 25 bp, Rattus norvegicus
gaatgataaatatctggcctgctga

SEQ ID NO: 310198 - DNA, 25 bp, Rattus norvegicus
gaatgataatcgagccactcctctt

SEQ ID NO: 310199 - DNA, 25 bp, Rattus norvegicus
gaatgataatcgtgccactcctctt

SEQ ID NO: 310200 - DNA, 25 bp, Rattus norvegicus
gaatgatactgcaccttcccagtag

SEQ ID NO: 310201 - DNA, 25 bp, Rattus norvegicus
gaatgatactgctccttcccagtag

SEQ ID NO: 310202 - DNA, 25 bp, Rattus norvegicus
gaatgatactgtccccagcatagcc

SEQ ID NO: 310203 - DNA, 25 bp, Rattus norvegicus
gaatgatactgtgcccagcatagcc

SEQ ID NO: 310204 - DNA, 25 bp, Rattus norvegicus
gaatgatacttcctaccacgtgttc

SEQ ID NO: 310205 - DNA, 25 bp, Rattus norvegicus
gaatgatacttcgtaccacgtgttc

SEQ ID NO: 310206 - DNA, 25 bp, Rattus norvegicus
gaatgatatcccatgcagtggtaaa

SEQ ID NO: 310207 - DNA, 25 bp, Rattus norvegicus
gaatgatatcccctactgaggagac

SEQ ID NO: 310208 - DNA, 25 bp, Rattus norvegicus
gaatgatatcccgtactgaggagac

SEQ ID NO: 310209 - DNA, 25 bp, Rattus norvegicus
gaatgatatcccttgcagtggtaaa

SEQ ID NO: 310210 - DNA, 25 bp, Rattus norvegicus
gaatgatcactcagtaaacacatac

SEQ ID NO: 310211 - DNA, 25 bp, Rattus norvegicus
gaatgatcactctgtaaacacatac

SEQ ID NO: 310212 - DNA, 25 bp, Rattus norvegicus
gaatgatcagaactgtcctcaccta

SEQ ID NO: 310213 - DNA, 25 bp, Rattus norvegicus
gaatgatcagaagtgtcctcaccta

SEQ ID NO: 310214 - DNA, 25 bp, Rattus norvegicus
gaatgatcagatactcagctacact

SEQ ID NO: 310215 - DNA, 25 bp, Rattus norvegicus
gaatgatcagattctcagctacact

SEQ ID NO: 310216 - DNA, 25 bp, Rattus norvegicus
gaatgatcagctatatcttagcagt

SEQ ID NO: 310217 - DNA, 25 bp, Rattus norvegicus
gaatgatcagctttatcttagcagt

SEQ ID NO: 310218 - DNA, 25 bp, Rattus norvegicus
gaatgatcagtcaccaatacccaga

SEQ ID NO: 310219 - DNA, 25 bp, Rattus norvegicus
gaatgatcagtctccaatacccaga

SEQ ID NO: 310220 - DNA, 25 bp, Rattus norvegicus
gaatgatcagttcaccacatagtag

SEQ ID NO: 310221 - DNA, 25 bp, Rattus norvegicus
gaatgatcagttgaccacatagtag

SEQ ID NO: 310222 - DNA, 25 bp, Rattus norvegicus
gaatgatcatcaccagaacaccctt

SEQ ID NO: 310223 - DNA, 25 bp, Rattus norvegicus
gaatgatcatcagcagaacaccctt

SEQ ID NO: 310224 - DNA, 25 bp, Rattus norvegicus
gaatgatcccaaaactcagtgagtg

SEQ ID NO: 310225 - DNA, 25 bp, Rattus norvegicus
gaatgatcccaatactcagtgagtg

SEQ ID NO: 310226 - DNA, 25 bp, Rattus norvegicus
gaatgatcccatcgactcatacatt

SEQ ID NO: 310227 - DNA, 25 bp, Rattus norvegicus
gaatgatcccatggactcatacatt

SEQ ID NO: 310228 - DNA, 25 bp, Rattus norvegicus
gaatgatctatcactttggcatttt

SEQ ID NO: 310229 - DNA, 25 bp, Rattus norvegicus
gaatgatctatctctttggcatttt

SEQ ID NO: 310230 - DNA, 25 bp, Rattus norvegicus
gaatgatctgttagcatcgttgccc

SEQ ID NO: 310231 - DNA, 25 bp, Rattus norvegicus
gaatgatctgttatgttactctttc

SEQ ID NO: 310232 - DNA, 25 bp, Rattus norvegicus
gaatgatctgtttgcatcgttgccc

SEQ ID NO: 310233 - DNA, 25 bp, Rattus norvegicus
gaatgatctgttttgttactctttc

SEQ ID NO: 310234 - DNA, 25 bp, Rattus norvegicus
gaatgatgacatccgcatcctcagg

SEQ ID NO: 310235 - DNA, 25 bp, Rattus norvegicus
gaatgatgacatgcgcatcctcagg

SEQ ID NO: 310236 - DNA, 25 bp, Rattus norvegicus
gaatgatgccgtcagagcttgcaaa

SEQ ID NO: 310237 - DNA, 25 bp, Rattus norvegicus
gaatgatgccgtgagagcttgcaaa

SEQ ID NO: 310238 - DNA, 25 bp, Rattus norvegicus
gaatgatgcctgctggtctcacagc

SEQ ID NO: 310239 - DNA, 25 bp, Rattus norvegicus
gaatgatgcctggtggtctcacagc

SEQ ID NO: 310240 - DNA, 25 bp, Rattus norvegicus
gaatgatgctgacccatgagcttgc

SEQ ID NO: 310241 - DNA, 25 bp, Rattus norvegicus
gaatgatgctgagccatgagcttgc

SEQ ID NO: 310242 - DNA, 25 bp, Rattus norvegicus
gaatgatggaacaccctgcaatgga

SEQ ID NO: 310243 - DNA, 25 bp, Rattus norvegicus
gaatgatggaactccctgcaatgga

SEQ ID NO: 310244 - DNA, 25 bp, Rattus norvegicus
gaatgatggcatagaactcttaaga

SEQ ID NO: 310245 - DNA, 25 bp, Rattus norvegicus
gaatgatggcatcttcctaaaccct

SEQ ID NO: 310246 - DNA, 25 bp, Rattus norvegicus
gaatgatggcatgttcctaaaccct

SEQ ID NO: 310247 - DNA, 25 bp, Rattus norvegicus
gaatgatggcattgaactcttaaga

SEQ ID NO: 310248 - DNA, 25 bp, Rattus norvegicus
gaatgatggcgtatctctctggtgc

SEQ ID NO: 310249 - DNA, 25 bp, Rattus norvegicus
gaatgatggcgtttctctctggtgc

SEQ ID NO: 310250 - DNA, 25 bp, Rattus norvegicus
gaatgatgtattagtggccttggac

SEQ ID NO: 310251 - DNA, 25 bp, Rattus norvegicus
gaatgatgtatttgtggccttggac

SEQ ID NO: 310252 - DNA, 25 bp, Rattus norvegicus
gaatgatgtcatccccgtgactgct

SEQ ID NO: 310253 - DNA, 25 bp, Rattus norvegicus
gaatgatgtcatgcccgtgactgct

SEQ ID NO: 310254 - DNA, 25 bp, Rattus norvegicus
gaatgatgtgctctatgctctcaaa

SEQ ID NO: 310255 - DNA, 25 bp, Rattus norvegicus
gaatgatgtgctgtatgctctcaaa

SEQ ID NO: 310256 - DNA, 25 bp, Rattus norvegicus
gaatgattaaacagaggcccggcct

SEQ ID NO: 310257 - DNA, 25 bp, Rattus norvegicus
gaatgattaaactgaggcccggcct

SEQ ID NO: 310258 - DNA, 25 bp, Rattus norvegicus
gaatgattaaatatcctgggcttaa

SEQ ID NO: 310259 - DNA, 25 bp, Rattus norvegicus
gaatgattaaatttcctgggcttaa

SEQ ID NO: 310260 - DNA, 25 bp, Rattus norvegicus
gaatgattaaccagagactgctccc

SEQ ID NO: 310261 - DNA, 25 bp, Rattus norvegicus
gaatgattaacctgagactgctccc

SEQ ID NO: 310262 - DNA, 25 bp, Rattus norvegicus
gaatgattaataattggcctgtgat

SEQ ID NO: 310263 - DNA, 25 bp, Rattus norvegicus
gaatgattaatatttggcctgtgat

SEQ ID NO: 310264 - DNA, 25 bp, Rattus norvegicus
gaatgattaatcagtgtaataaact

SEQ ID NO: 310265 - DNA, 25 bp, Rattus norvegicus
gaatgattaatctgtgtaataaact

SEQ ID NO: 310266 - DNA, 25 bp, Rattus norvegicus
gaatgattaccacggctctatctag

SEQ ID NO: 310267 - DNA, 25 bp, Rattus norvegicus
gaatgattaccagggctctatctag

SEQ ID NO: 310268 - DNA, 25 bp, Rattus norvegicus
gaatgattcacgctttatcgacaga

SEQ ID NO: 310269 - DNA, 25 bp, Rattus norvegicus
gaatgattcacggtttatcgacaga

SEQ ID NO: 310270 - DNA, 25 bp, Rattus norvegicus
gaatgattccccaagtgcctctgca

SEQ ID NO: 310271 - DNA, 25 bp, Rattus norvegicus
gaatgattcccctagtgcctctgca

SEQ ID NO: 310272 - DNA, 25 bp, Rattus norvegicus
gaatgattctggaacccatgtttct

SEQ ID NO: 310273 - DNA, 25 bp, Rattus norvegicus
gaatgattctggtacccatgtttct

SEQ ID NO: 310274 - DNA, 25 bp, Rattus norvegicus
gaatgattgagtcatttgtttctca

SEQ ID NO: 310275 - DNA, 25 bp, Rattus norvegicus
gaatgattgagtgatttgtttctca

SEQ ID NO: 310276 - DNA, 25 bp, Rattus norvegicus
gaatgatttcttactcaggcccaaa

SEQ ID NO: 310277 - DNA, 25 bp, Rattus norvegicus
gaatgatttctttctcaggcccaaa

SEQ ID NO: 310278 - DNA, 25 bp, Rattus norvegicus
gaatgatttgttcctgtcatacaca

SEQ ID NO: 310279 - DNA, 25 bp, Rattus norvegicus
gaatgatttgttgctgtcatacaca

SEQ ID NO: 310280 - DNA, 25 bp, Rattus norvegicus
gaatgattttctacagtggcctttc

SEQ ID NO: 310281 - DNA, 25 bp, Rattus norvegicus
gaatgattttcttcagtggcctttc

SEQ ID NO: 310282 - DNA, 25 bp, Rattus norvegicus
gaatgattttgtctgctcctaacta

SEQ ID NO: 310283 - DNA, 25 bp, Rattus norvegicus
gaatgattttgtgtgctcctaacta

SEQ ID NO: 310284 - DNA, 25 bp, Rattus norvegicus
gaatgcaaactgcaaaactgaaagg

SEQ ID NO: 310285 - DNA, 25 bp, Rattus norvegicus
gaatgcaaactggaaaactgaaagg

SEQ ID NO: 310286 - DNA, 25 bp, Rattus norvegicus
gaatgcaaagagcacccctgaccgc

SEQ ID NO: 310287 - DNA, 25 bp, Rattus norvegicus
gaatgcaaagaggacccctgaccgc

SEQ ID NO: 310288 - DNA, 25 bp, Rattus norvegicus
gaatgcaaatctatcttctcatatt

SEQ ID NO: 310289 - DNA, 25 bp, Rattus norvegicus
gaatgcaaatctttcttctcatatt

SEQ ID NO: 310290 - DNA, 25 bp, Rattus norvegicus
gaatgcaactgcagatttatcgatg

SEQ ID NO: 310291 - DNA, 25 bp, Rattus norvegicus
gaatgcaactgctgatttatcgatg

SEQ ID NO: 310292 - DNA, 25 bp, Rattus norvegicus
gaatgcaactgtacaaaccactctg

SEQ ID NO: 310293 - DNA, 25 bp, Rattus norvegicus
gaatgcaactgttcaaaccactctg

SEQ ID NO: 310294 - DNA, 25 bp, Rattus norvegicus
gaatgcaacttcagcaggaggccct

SEQ ID NO: 310295 - DNA, 25 bp, Rattus norvegicus
gaatgcaacttctgcaggaggccct

SEQ ID NO: 310296 - DNA, 25 bp, Rattus norvegicus
gaatgcaagacaccaacccgtctgc

SEQ ID NO: 310297 - DNA, 25 bp, Rattus norvegicus
gaatgcaagacagcaacccgtctgc

SEQ ID NO: 310298 - DNA, 25 bp, Rattus norvegicus
gaatgcaagccacatgacagcagat

SEQ ID NO: 310299 - DNA, 25 bp, Rattus norvegicus
gaatgcaagccaccccagaaggagg

SEQ ID NO: 310300 - DNA, 25 bp, Rattus norvegicus
gaatgcaagccagatgacagcagat

SEQ ID NO: 310301 - DNA, 25 bp, Rattus norvegicus
gaatgcaagccagcccagaaggagg

SEQ ID NO: 310302 - DNA, 25 bp, Rattus norvegicus
gaatgcaagctaacatcatccccgt

SEQ ID NO: 310303 - DNA, 25 bp, Rattus norvegicus
gaatgcaagctatcatcatccccgt

SEQ ID NO: 310304 - DNA, 25 bp, Rattus norvegicus
gaatgcaagctccaccaagaaagag

SEQ ID NO: 310305 - DNA, 25 bp, Rattus norvegicus
gaatgcaagctcgaccaagaaagag

SEQ ID NO: 310306 - DNA, 25 bp, Rattus norvegicus
gaatgcaaggctcaccacacttgta

SEQ ID NO: 310307 - DNA, 25 bp, Rattus norvegicus
gaatgcaaggctgaccacacttgta

SEQ ID NO: 310308 - DNA, 25 bp, Rattus norvegicus
gaatgcaagtctatcccatgcctat

SEQ ID NO: 310309 - DNA, 25 bp, Rattus norvegicus
gaatgcaagtctttcccatgcctat

SEQ ID NO: 310310 - DNA, 25 bp, Rattus norvegicus
gaatgcaagtgaatgtgagctctgt

SEQ ID NO: 310311 - DNA, 25 bp, Rattus norvegicus
gaatgcaagtgattgtgagctctgt

SEQ ID NO: 310312 - DNA, 25 bp, Rattus norvegicus
gaatgcaagttcatctctgggtatg

SEQ ID NO: 310313 - DNA, 25 bp, Rattus norvegicus
gaatgcaagttcttctctgggtatg

SEQ ID NO: 310314 - DNA, 25 bp, Rattus norvegicus
gaatgcaagtttcagcttagagagt

SEQ ID NO: 310315 - DNA, 25 bp, Rattus norvegicus
gaatgcaagtttgagcttagagagt

SEQ ID NO: 310316 - DNA, 25 bp, Rattus norvegicus
gaatgcaataccctctttttgtata

SEQ ID NO: 310317 - DNA, 25 bp, Rattus norvegicus
gaatgcaataccgtctttttgtata

SEQ ID NO: 310318 - DNA, 25 bp, Rattus norvegicus
gaatgcaatcctctagcctatatca

SEQ ID NO: 310319 - DNA, 25 bp, Rattus norvegicus
gaatgcaatcctgtagcctatatca

SEQ ID NO: 310320 - DNA, 25 bp, Rattus norvegicus
gaatgcaatctgctgccgagtcagg

SEQ ID NO: 310321 - DNA, 25 bp, Rattus norvegicus
gaatgcaatctggtgccgagtcagg

SEQ ID NO: 310322 - DNA, 25 bp, Rattus norvegicus
gaatgcaattcacctcataactcga

SEQ ID NO: 310323 - DNA, 25 bp, Rattus norvegicus
gaatgcaattcagctcataactcga

SEQ ID NO: 310324 - DNA, 25 bp, Rattus norvegicus
gaatgcacaacactcaaccaagatt

SEQ ID NO: 310325 - DNA, 25 bp, Rattus norvegicus
gaatgcacaacagtcaaccaagatt

SEQ ID NO: 310326 - DNA, 25 bp, Rattus norvegicus
gaatgcacaatgactgctctgtttt

SEQ ID NO: 310327 - DNA, 25 bp, Rattus norvegicus
gaatgcacaatgtctgctctgtttt

SEQ ID NO: 310328 - DNA, 25 bp, Rattus norvegicus
gaatgcacagaccatgggcctatca

SEQ ID NO: 310329 - DNA, 25 bp, Rattus norvegicus
gaatgcacagacgatgggcctatca

SEQ ID NO: 310330 - DNA, 25 bp, Rattus norvegicus
gaatgcacatctcttaagcactcgc

SEQ ID NO: 310331 - DNA, 25 bp, Rattus norvegicus
gaatgcacatctgttaagcactcgc

SEQ ID NO: 310332 - DNA, 25 bp, Rattus norvegicus
gaatgcaccataatcgctgtatgaa

SEQ ID NO: 310333 - DNA, 25 bp, Rattus norvegicus
gaatgcaccatattcgctgtatgaa

SEQ ID NO: 310334 - DNA, 25 bp, Rattus norvegicus
gaatgcacccatagaagggaaccag

SEQ ID NO: 310335 - DNA, 25 bp, Rattus norvegicus
gaatgcacccattgaagggaaccag

SEQ ID NO: 310336 - DNA, 25 bp, Rattus norvegicus
gaatgcacgctgaattaaatgacca

SEQ ID NO: 310337 - DNA, 25 bp, Rattus norvegicus
gaatgcacgctgtattaaatgacca

SEQ ID NO: 310338 - DNA, 25 bp, Rattus norvegicus
gaatgcacgtacctctgaactactt

SEQ ID NO: 310339 - DNA, 25 bp, Rattus norvegicus
gaatgcacgtacgtctgaactactt

SEQ ID NO: 310340 - DNA, 25 bp, Rattus norvegicus
gaatgcacgtgcactggtgtttctc

SEQ ID NO: 310341 - DNA, 25 bp, Rattus norvegicus
gaatgcacgtgctctggtgtttctc

SEQ ID NO: 310342 - DNA, 25 bp, Rattus norvegicus
gaatgcactactcttcacagagagg

SEQ ID NO: 310343 - DNA, 25 bp, Rattus norvegicus
gaatgcactactgttcacagagagg

SEQ ID NO: 310344 - DNA, 25 bp, Rattus norvegicus
gaatgcactattactgacacccggt

SEQ ID NO: 310345 - DNA, 25 bp, Rattus norvegicus
gaatgcactatttctgacacccggt

SEQ ID NO: 310346 - DNA, 25 bp, Rattus norvegicus
gaatgcactcagagatggctggaat

SEQ ID NO: 310347 - DNA, 25 bp, Rattus norvegicus
gaatgcactcagtgatggctggaat

SEQ ID NO: 310348 - DNA, 25 bp, Rattus norvegicus
gaatgcactctcattttgatctgct

SEQ ID NO: 310349 - DNA, 25 bp, Rattus norvegicus
gaatgcactctctttttgatctgct

SEQ ID NO: 310350 - DNA, 25 bp, Rattus norvegicus
gaatgcactcttcagagacccctat

SEQ ID NO: 310351 - DNA, 25 bp, Rattus norvegicus
gaatgcactcttcattttaacctaa

SEQ ID NO: 310352 - DNA, 25 bp, Rattus norvegicus
gaatgcactcttgagagacccctat

SEQ ID NO: 310353 - DNA, 25 bp, Rattus norvegicus
gaatgcactcttgattttaacctaa

SEQ ID NO: 310354 - DNA, 25 bp, Rattus norvegicus
gaatgcactgacagctagtttaagg

SEQ ID NO: 310355 - DNA, 25 bp, Rattus norvegicus
gaatgcactgactgctagtttaagg

SEQ ID NO: 310356 - DNA, 25 bp, Rattus norvegicus
gaatgcactgagacctctggtgtca

SEQ ID NO: 310357 - DNA, 25 bp, Rattus norvegicus
gaatgcactgagtcctctggtgtca

SEQ ID NO: 310358 - DNA, 25 bp, Rattus norvegicus
gaatgcactgggactcttgaggtaa

SEQ ID NO: 310359 - DNA, 25 bp, Rattus norvegicus
gaatgcactgggtctcttgaggtaa

SEQ ID NO: 310360 - DNA, 25 bp, Rattus norvegicus
gaatgcactgtacgtgaaatgcctt

SEQ ID NO: 310361 - DNA, 25 bp, Rattus norvegicus
gaatgcactgtaggtgaaatgcctt

SEQ ID NO: 310362 - DNA, 25 bp, Rattus norvegicus
gaatgcacttctcagggatccaatc

SEQ ID NO: 310363 - DNA, 25 bp, Rattus norvegicus
gaatgcacttctgagggatccaatc

SEQ ID NO: 310364 - DNA, 25 bp, Rattus norvegicus
gaatgcacttgcactggtcagatca

SEQ ID NO: 310365 - DNA, 25 bp, Rattus norvegicus
gaatgcacttgctctggtcagatca

SEQ ID NO: 310366 - DNA, 25 bp, Rattus norvegicus
gaatgcactttcagcttgcaatgcc

SEQ ID NO: 310367 - DNA, 25 bp, Rattus norvegicus
gaatgcactttctgcttgcaatgcc

SEQ ID NO: 310368 - DNA, 25 bp, Rattus norvegicus
gaatgcagaaaccacccgggacact

SEQ ID NO: 310369 - DNA, 25 bp, Rattus norvegicus
gaatgcagaaacgacccgggacact

SEQ ID NO: 310370 - DNA, 25 bp, Rattus norvegicus
gaatgcagaacaaccctgggagact

SEQ ID NO: 310371 - DNA, 25 bp, Rattus norvegicus
gaatgcagaacatccctgggagact

SEQ ID NO: 310372 - DNA, 25 bp, Rattus norvegicus
gaatgcagaagacccttcctggaaa

SEQ ID NO: 310373 - DNA, 25 bp, Rattus norvegicus
gaatgcagaagacttttgattgagt

SEQ ID NO: 310374 - DNA, 25 bp, Rattus norvegicus
gaatgcagaagagccttcctggaaa

SEQ ID NO: 310375 - DNA, 25 bp, Rattus norvegicus
gaatgcagaagagttttgattgagt

SEQ ID NO: 310376 - DNA, 25 bp, Rattus norvegicus
gaatgcagagacacatggctgctta

SEQ ID NO: 310377 - DNA, 25 bp, Rattus norvegicus
gaatgcagagactcatggctgctta

SEQ ID NO: 310378 - DNA, 25 bp, Rattus norvegicus
gaatgcagagcaaagccagcctcat

SEQ ID NO: 310379 - DNA, 25 bp, Rattus norvegicus
gaatgcagagcatagccagcctcat

SEQ ID NO: 310380 - DNA, 25 bp, Rattus norvegicus
gaatgcagagcgcttaccaaaccca

SEQ ID NO: 310381 - DNA, 25 bp, Rattus norvegicus
gaatgcagagcggttaccaaaccca

SEQ ID NO: 310382 - DNA, 25 bp, Rattus norvegicus
gaatgcagattccatcgctgagcct

SEQ ID NO: 310383 - DNA, 25 bp, Rattus norvegicus
gaatgcagattcgatcgctgagcct

SEQ ID NO: 310384 - DNA, 25 bp, Rattus norvegicus
gaatgcagatttaagcacagactga

SEQ ID NO: 310385 - DNA, 25 bp, Rattus norvegicus
gaatgcagattttagcacagactga

SEQ ID NO: 310386 - DNA, 25 bp, Rattus norvegicus
gaatgcagccaacagtctgcctcag

SEQ ID NO: 310387 - DNA, 25 bp, Rattus norvegicus
gaatgcagccaagagtctgcctcag

SEQ ID NO: 310388 - DNA, 25 bp, Rattus norvegicus
gaatgcagccatagtgtcttcccct

SEQ ID NO: 310389 - DNA, 25 bp, Rattus norvegicus
gaatgcagccatattgttccttggg

SEQ ID NO: 310390 - DNA, 25 bp, Rattus norvegicus
gaatgcagccattgtgtcttcccct

SEQ ID NO: 310391 - DNA, 25 bp, Rattus norvegicus
gaatgcagccattttgttccttggg

SEQ ID NO: 310392 - DNA, 25 bp, Rattus norvegicus
gaatgcagccttatctgaattctaa

SEQ ID NO: 310393 - DNA, 25 bp, Rattus norvegicus
gaatgcagccttttctgaattctaa

SEQ ID NO: 310394 - DNA, 25 bp, Rattus norvegicus
gaatgcagctctcaaactggccttg

SEQ ID NO: 310395 - DNA, 25 bp, Rattus norvegicus
gaatgcagctctgaaactggccttg

SEQ ID NO: 310396 - DNA, 25 bp, Rattus norvegicus
gaatgcagcttgaaactcatcccac

SEQ ID NO: 310397 - DNA, 25 bp, Rattus norvegicus
gaatgcagcttgtaactcatcccac

SEQ ID NO: 310398 - DNA, 25 bp, Rattus norvegicus
gaatgcaggccacaacatgatgact

SEQ ID NO: 310399 - DNA, 25 bp, Rattus norvegicus
gaatgcaggccagaacatgatgact

SEQ ID NO: 310400 - DNA, 25 bp, Rattus norvegicus
gaatgcaggtcccttcacaccgtgg

SEQ ID NO: 310401 - DNA, 25 bp, Rattus norvegicus
gaatgcaggtccgttcacaccgtgg

SEQ ID NO: 310402 - DNA, 25 bp, Rattus norvegicus
gaatgcagtacaaccgacgctttgt

SEQ ID NO: 310403 - DNA, 25 bp, Rattus norvegicus
gaatgcagtacatccgacgctttgt

SEQ ID NO: 310404 - DNA, 25 bp, Rattus norvegicus
gaatgcagtgcccagatcacaggtt

SEQ ID NO: 310405 - DNA, 25 bp, Rattus norvegicus
gaatgcagtgccgagatcacaggtt

SEQ ID NO: 310406 - DNA, 25 bp, Rattus norvegicus
gaatgcagttacaaacctgtctgga

SEQ ID NO: 310407 - DNA, 25 bp, Rattus norvegicus
gaatgcagttactaacctgtctgga

SEQ ID NO: 310408 - DNA, 25 bp, Rattus norvegicus
gaatgcagttcacttcactgctgta

SEQ ID NO: 310409 - DNA, 25 bp, Rattus norvegicus
gaatgcagttcagttcactgctgta

SEQ ID NO: 310410 - DNA, 25 bp, Rattus norvegicus
gaatgcagttctcatgataaaaatc

SEQ ID NO: 310411 - DNA, 25 bp, Rattus norvegicus
gaatgcagttctgatgataaaaatc

SEQ ID NO: 310412 - DNA, 25 bp, Rattus norvegicus
gaatgcagttgtaatccctgctcct

SEQ ID NO: 310413 - DNA, 25 bp, Rattus norvegicus
gaatgcagttgttatccctgctcct

SEQ ID NO: 310414 - DNA, 25 bp, Rattus norvegicus
gaatgcatagctcaactcagtccgg

SEQ ID NO: 310415 - DNA, 25 bp, Rattus norvegicus
gaatgcatagctgaactcagtccgg

SEQ ID NO: 310416 - DNA, 25 bp, Rattus norvegicus
gaatgcatccagcacttggtattat

SEQ ID NO: 310417 - DNA, 25 bp, Rattus norvegicus
gaatgcatccaggacttggtattat

SEQ ID NO: 310418 - DNA, 25 bp, Rattus norvegicus
gaatgcatctggcatggagacttaa

SEQ ID NO: 310419 - DNA, 25 bp, Rattus norvegicus
gaatgcatctgggatggagacttaa

SEQ ID NO: 310420 - DNA, 25 bp, Rattus norvegicus
gaatgcatcttcagggaacaatttg

SEQ ID NO: 310421 - DNA, 25 bp, Rattus norvegicus
gaatgcatcttcattaatccactct

SEQ ID NO: 310422 - DNA, 25 bp, Rattus norvegicus
gaatgcatcttctgggaacaatttg

SEQ ID NO: 310423 - DNA, 25 bp, Rattus norvegicus
gaatgcatcttctttaatccactct

SEQ ID NO: 310424 - DNA, 25 bp, Rattus norvegicus
gaatgcatgaagcacaatggctgtt

SEQ ID NO: 310425 - DNA, 25 bp, Rattus norvegicus
gaatgcatgaaggacaatggctgtt

SEQ ID NO: 310426 - DNA, 25 bp, Rattus norvegicus
gaatgcatgccgctataacagcagt

SEQ ID NO: 310427 - DNA, 25 bp, Rattus norvegicus
gaatgcatgccggtataacagcagt

SEQ ID NO: 310428 - DNA, 25 bp, Rattus norvegicus
gaatgcatgctgagtacatacaaac

SEQ ID NO: 310429 - DNA, 25 bp, Rattus norvegicus
gaatgcatgctgtgtacatacaaac

SEQ ID NO: 310430 - DNA, 25 bp, Rattus norvegicus
gaatgcatgcttacagttcctacag

SEQ ID NO: 310431 - DNA, 25 bp, Rattus norvegicus
gaatgcatgctttcagttcctacag

SEQ ID NO: 310432 - DNA, 25 bp, Rattus norvegicus
gaatgcatggtcctacagtaagtga

SEQ ID NO: 310433 - DNA, 25 bp, Rattus norvegicus
gaatgcatggtcgtacagtaagtga

SEQ ID NO: 310434 - DNA, 25 bp, Rattus norvegicus
gaatgcatggtgatgaccactcgta

SEQ ID NO: 310435 - DNA, 25 bp, Rattus norvegicus
gaatgcatggtgttgaccactcgta

SEQ ID NO: 310436 - DNA, 25 bp, Rattus norvegicus
gaatgcatgtgcctatatgcaccat

SEQ ID NO: 310437 - DNA, 25 bp, Rattus norvegicus
gaatgcatgtgcgtatatgcaccat

SEQ ID NO: 310438 - DNA, 25 bp, Rattus norvegicus
gaatgcatgttcatcatcttggtgg

SEQ ID NO: 310439 - DNA, 25 bp, Rattus norvegicus
gaatgcatgttcttcatcttggtgg

SEQ ID NO: 310440 - DNA, 25 bp, Rattus norvegicus
gaatgcattacacatcctttaaaat

SEQ ID NO: 310441 - DNA, 25 bp, Rattus norvegicus
gaatgcattacagatcctttaaaat

SEQ ID NO: 310442 - DNA, 25 bp, Rattus norvegicus
gaatgcatttctcctttggcttaaa

SEQ ID NO: 310443 - DNA, 25 bp, Rattus norvegicus
gaatgcatttctgctttggcttaaa

SEQ ID NO: 310444 - DNA, 25 bp, Rattus norvegicus
gaatgcattttcacttctggtaatg

SEQ ID NO: 310445 - DNA, 25 bp, Rattus norvegicus
gaatgcattttctcttctggtaatg

SEQ ID NO: 310446 - DNA, 25 bp, Rattus norvegicus
gaatgccaaaaaatcatccgcctga

SEQ ID NO: 310447 - DNA, 25 bp, Rattus norvegicus
gaatgccaaaaattcatccgcctga

SEQ ID NO: 310448 - DNA, 25 bp, Rattus norvegicus
gaatgccaacgcaacttcagagtta

SEQ ID NO: 310449 - DNA, 25 bp, Rattus norvegicus
gaatgccaacgctacttcagagtta

SEQ ID NO: 310450 - DNA, 25 bp, Rattus norvegicus
gaatgccaacttacagacggagccc

SEQ ID NO: 310451 - DNA, 25 bp, Rattus norvegicus
gaatgccaacttcctattttgcagc

SEQ ID NO: 310452 - DNA, 25 bp, Rattus norvegicus
gaatgccaacttgctattttgcagc

SEQ ID NO: 310453 - DNA, 25 bp, Rattus norvegicus
gaatgccaactttcagacggagccc

SEQ ID NO: 310454 - DNA, 25 bp, Rattus norvegicus
gaatgccacattatatcttcaagga

SEQ ID NO: 310455 - DNA, 25 bp, Rattus norvegicus
gaatgccacattttatcttcaagga

SEQ ID NO: 310456 - DNA, 25 bp, Rattus norvegicus
gaatgccaccttatattttcatgta

SEQ ID NO: 310457 - DNA, 25 bp, Rattus norvegicus
gaatgccaccttttattttcatgta

SEQ ID NO: 310458 - DNA, 25 bp, Rattus norvegicus
gaatgccacgcgctacaaaggaaaa

SEQ ID NO: 310459 - DNA, 25 bp, Rattus norvegicus
gaatgccacgcggtacaaaggaaaa

SEQ ID NO: 310460 - DNA, 25 bp, Rattus norvegicus
gaatgccacgtgagttgaacctcat

SEQ ID NO: 310461 - DNA, 25 bp, Rattus norvegicus
gaatgccacgtgtgttgaacctcat

SEQ ID NO: 310462 - DNA, 25 bp, Rattus norvegicus
gaatgccactccattgtagatcaac

SEQ ID NO: 310463 - DNA, 25 bp, Rattus norvegicus
gaatgccactcctttgtagatcaac

SEQ ID NO: 310464 - DNA, 25 bp, Rattus norvegicus
gaatgccagaagcagaacactattt

SEQ ID NO: 310465 - DNA, 25 bp, Rattus norvegicus
gaatgccagaaggagaacactattt

SEQ ID NO: 310466 - DNA, 25 bp, Rattus norvegicus
gaatgccagagcacagtgtgtcact

SEQ ID NO: 310467 - DNA, 25 bp, Rattus norvegicus
gaatgccagagctcagtgtgtcact

SEQ ID NO: 310468 - DNA, 25 bp, Rattus norvegicus
gaatgccagagtaccacaaatctat

SEQ ID NO: 310469 - DNA, 25 bp, Rattus norvegicus
gaatgccagagttccacaaatctat

SEQ ID NO: 310470 - DNA, 25 bp, Rattus norvegicus
gaatgccagcataacgaaaggtcta

SEQ ID NO: 310471 - DNA, 25 bp, Rattus norvegicus
gaatgccagcattacgaaaggtcta

SEQ ID NO: 310472 - DNA, 25 bp, Rattus norvegicus
gaatgccagtgtatgtcctcagtag

SEQ ID NO: 310473 - DNA, 25 bp, Rattus norvegicus
gaatgccagtgtttgtcctcagtag

SEQ ID NO: 310474 - DNA, 25 bp, Rattus norvegicus
gaatgccagttgctttctaagtcca

SEQ ID NO: 310475 - DNA, 25 bp, Rattus norvegicus
gaatgccagttggtttctaagtcca

SEQ ID NO: 310476 - DNA, 25 bp, Rattus norvegicus
gaatgccataacactgagttgtaca

SEQ ID NO: 310477 - DNA, 25 bp, Rattus norvegicus
gaatgccataactctgagttgtaca

SEQ ID NO: 310478 - DNA, 25 bp, Rattus norvegicus
gaatgccatagcacgtttattttca

SEQ ID NO: 310479 - DNA, 25 bp, Rattus norvegicus
gaatgccatagctcgtttattttca

SEQ ID NO: 310480 - DNA, 25 bp, Rattus norvegicus
gaatgccatcaaatcctttatagca

SEQ ID NO: 310481 - DNA, 25 bp, Rattus norvegicus
gaatgccatcaattcctttatagca

SEQ ID NO: 310482 - DNA, 25 bp, Rattus norvegicus
gaatgccatcttatatgaatgcaac

SEQ ID NO: 310483 - DNA, 25 bp, Rattus norvegicus
gaatgccatcttttatgaatgcaac

SEQ ID NO: 310484 - DNA, 25 bp, Rattus norvegicus
gaatgccatgcacatcgtgggcttt

SEQ ID NO: 310485 - DNA, 25 bp, Rattus norvegicus
gaatgccatgcagatcgtgggcttt

SEQ ID NO: 310486 - DNA, 25 bp, Rattus norvegicus
gaatgccattgtatgacacagggat

SEQ ID NO: 310487 - DNA, 25 bp, Rattus norvegicus
gaatgccattgtattaattactgtt

SEQ ID NO: 310488 - DNA, 25 bp, Rattus norvegicus
gaatgccattgtttgacacagggat

SEQ ID NO: 310489 - DNA, 25 bp, Rattus norvegicus
gaatgccattgttttaattactgtt

SEQ ID NO: 310490 - DNA, 25 bp, Rattus norvegicus
gaatgccatttgctaccaggccaga

SEQ ID NO: 310491 - DNA, 25 bp, Rattus norvegicus
gaatgccatttggtaccaggccaga

SEQ ID NO: 310492 - DNA, 25 bp, Rattus norvegicus
gaatgcccaaggaaatcaggccttt

SEQ ID NO: 310493 - DNA, 25 bp, Rattus norvegicus
gaatgcccaaggtaatcaggccttt

SEQ ID NO: 310494 - DNA, 25 bp, Rattus norvegicus
gaatgcccagaacctttccttcata

SEQ ID NO: 310495 - DNA, 25 bp, Rattus norvegicus
gaatgcccagaacgaggatcgtgtt

SEQ ID NO: 310496 - DNA, 25 bp, Rattus norvegicus
gaatgcccagaagctttccttcata

SEQ ID NO: 310497 - DNA, 25 bp, Rattus norvegicus
gaatgcccagaaggaggatcgtgtt

SEQ ID NO: 310498 - DNA, 25 bp, Rattus norvegicus
gaatgcccagtccaatggcagacat

SEQ ID NO: 310499 - DNA, 25 bp, Rattus norvegicus
gaatgcccagtcgaatggcagacat

SEQ ID NO: 310500 - DNA, 25 bp, Rattus norvegicus
gaatgccccagtagagtcatacact

SEQ ID NO: 310501 - DNA, 25 bp, Rattus norvegicus
gaatgccccagttgagtcatacact

SEQ ID NO: 310502 - DNA, 25 bp, Rattus norvegicus
gaatgcccgaatatgtgtccagacc

SEQ ID NO: 310503 - DNA, 25 bp, Rattus norvegicus
gaatgcccgaatcgtttgcacctag

SEQ ID NO: 310504 - DNA, 25 bp, Rattus norvegicus
gaatgcccgaatggtttgcacctag

SEQ ID NO: 310505 - DNA, 25 bp, Rattus norvegicus
gaatgcccgaatttgtgtccagacc

SEQ ID NO: 310506 - DNA, 25 bp, Rattus norvegicus
gaatgcccgatcatagcttattagc

SEQ ID NO: 310507 - DNA, 25 bp, Rattus norvegicus
gaatgcccgatcttagcttattagc

SEQ ID NO: 310508 - DNA, 25 bp, Rattus norvegicus
gaatgccctcaaacaggttgcccaa

SEQ ID NO: 310509 - DNA, 25 bp, Rattus norvegicus
gaatgccctcaatcaggttgcccaa

SEQ ID NO: 310510 - DNA, 25 bp, Rattus norvegicus
gaatgccctgtaatttgttaacatg

SEQ ID NO: 310511 - DNA, 25 bp, Rattus norvegicus
gaatgccctgtattttgttaacatg

SEQ ID NO: 310512 - DNA, 25 bp, Rattus norvegicus
gaatgccctgtgctgctcagcagct

SEQ ID NO: 310513 - DNA, 25 bp, Rattus norvegicus
gaatgccctgtggtgctcagcagct

SEQ ID NO: 310514 - DNA, 25 bp, Rattus norvegicus
gaatgccgaattaacgctgccaata

SEQ ID NO: 310515 - DNA, 25 bp, Rattus norvegicus
gaatgccgaatttacgctgccaata

SEQ ID NO: 310516 - DNA, 25 bp, Rattus norvegicus
gaatgccgcaggaagtattccactg

SEQ ID NO: 310517 - DNA, 25 bp, Rattus norvegicus
gaatgccgcaggtagtattccactg

SEQ ID NO: 310518 - DNA, 25 bp, Rattus norvegicus
gaatgccgcatcagatggaagccct

SEQ ID NO: 310519 - DNA, 25 bp, Rattus norvegicus
gaatgccgcatctgatggaagccct

SEQ ID NO: 310520 - DNA, 25 bp, Rattus norvegicus
gaatgccggactcttgttggctctg

SEQ ID NO: 310521 - DNA, 25 bp, Rattus norvegicus
gaatgccggactgttgttggctctg

SEQ ID NO: 310522 - DNA, 25 bp, Rattus norvegicus
gaatgcctaagacacctccatatgg

SEQ ID NO: 310523 - DNA, 25 bp, Rattus norvegicus
gaatgcctaagagacctccatatgg

SEQ ID NO: 310524 - DNA, 25 bp, Rattus norvegicus
gaatgcctacatacgcttaagcatc

SEQ ID NO: 310525 - DNA, 25 bp, Rattus norvegicus
gaatgcctacatcagtatcctatca

SEQ ID NO: 310526 - DNA, 25 bp, Rattus norvegicus
gaatgcctacatgagtatcctatca

SEQ ID NO: 310527 - DNA, 25 bp, Rattus norvegicus
gaatgcctacattcgcttaagcatc

SEQ ID NO: 310528 - DNA, 25 bp, Rattus norvegicus
gaatgcctactcatatcctgattat

SEQ ID NO: 310529 - DNA, 25 bp, Rattus norvegicus
gaatgcctactcttatcctgattat

SEQ ID NO: 310530 - DNA, 25 bp, Rattus norvegicus
gaatgcctactgcttacaatacctg

SEQ ID NO: 310531 - DNA, 25 bp, Rattus norvegicus
gaatgcctactggttacaatacctg

SEQ ID NO: 310532 - DNA, 25 bp, Rattus norvegicus
gaatgcctagaaacctaactctgag

SEQ ID NO: 310533 - DNA, 25 bp, Rattus norvegicus
gaatgcctagaatcctaactctgag

SEQ ID NO: 310534 - DNA, 25 bp, Rattus norvegicus
gaatgcctagccatgactgctggag

SEQ ID NO: 310535 - DNA, 25 bp, Rattus norvegicus
gaatgcctagccttgactgctggag

SEQ ID NO: 310536 - DNA, 25 bp, Rattus norvegicus
gaatgcctatctagcacattggaag

SEQ ID NO: 310537 - DNA, 25 bp, Rattus norvegicus
gaatgcctatcttgcacattggaag

SEQ ID NO: 310538 - DNA, 25 bp, Rattus norvegicus
gaatgcctatttctaatttcctgat

SEQ ID NO: 310539 - DNA, 25 bp, Rattus norvegicus
gaatgcctatttgtaatttcctgat

SEQ ID NO: 310540 - DNA, 25 bp, Rattus norvegicus
gaatgcctcactattatgctgacag

SEQ ID NO: 310541 - DNA, 25 bp, Rattus norvegicus
gaatgcctcacttttatgctgacag

SEQ ID NO: 310542 - DNA, 25 bp, Rattus norvegicus
gaatgcctcccaactaaggagctgg

SEQ ID NO: 310543 - DNA, 25 bp, Rattus norvegicus
gaatgcctcccatctaaggagctgg

SEQ ID NO: 310544 - DNA, 25 bp, Rattus norvegicus
gaatgcctcctgactgtggccttgg

SEQ ID NO: 310545 - DNA, 25 bp, Rattus norvegicus
gaatgcctcctgtctgtggccttgg

SEQ ID NO: 310546 - DNA, 25 bp, Rattus norvegicus
gaatgcctgcaactcatgtactatt

SEQ ID NO: 310547 - DNA, 25 bp, Rattus norvegicus
gaatgcctgcaagtcatgtactatt

SEQ ID NO: 310548 - DNA, 25 bp, Rattus norvegicus
gaatgcctgctaccaagactcagat

SEQ ID NO: 310549 - DNA, 25 bp, Rattus norvegicus
gaatgcctgctagcaagactcagat

SEQ ID NO: 310550 - DNA, 25 bp, Rattus norvegicus
gaatgcctgctcaaggacatgagaa

SEQ ID NO: 310551 - DNA, 25 bp, Rattus norvegicus
gaatgcctgctctaggacatgagaa

SEQ ID NO: 310552 - DNA, 25 bp, Rattus norvegicus
gaatgcctgggtagtggacttacgc

SEQ ID NO: 310553 - DNA, 25 bp, Rattus norvegicus
gaatgcctgggttgtggacttacgc

SEQ ID NO: 310554 - DNA, 25 bp, Rattus norvegicus
gaatgcctggttatatttacaatta

SEQ ID NO: 310555 - DNA, 25 bp, Rattus norvegicus
gaatgcctggttttatttacaatta

SEQ ID NO: 310556 - DNA, 25 bp, Rattus norvegicus
gaatgcctgtgaacccagtactcag

SEQ ID NO: 310557 - DNA, 25 bp, Rattus norvegicus
gaatgcctgtgatcccagtactcag

SEQ ID NO: 310558 - DNA, 25 bp, Rattus norvegicus
gaatgcctgttgaaatcatcttggg

SEQ ID NO: 310559 - DNA, 25 bp, Rattus norvegicus
gaatgcctgttgtaatcatcttggg

SEQ ID NO: 310560 - DNA, 25 bp, Rattus norvegicus
gaatgccttccaagacacaagagct

SEQ ID NO: 310561 - DNA, 25 bp, Rattus norvegicus
gaatgccttccatgacacaagagct

SEQ ID NO: 310562 - DNA, 25 bp, Rattus norvegicus
gaatgccttctgcaggtgataccca

SEQ ID NO: 310563 - DNA, 25 bp, Rattus norvegicus
gaatgccttctggaggtgataccca

SEQ ID NO: 310564 - DNA, 25 bp, Rattus norvegicus
gaatgccttcttccgtctgtgacag

SEQ ID NO: 310565 - DNA, 25 bp, Rattus norvegicus
gaatgccttcttgcgtctgtgacag

SEQ ID NO: 310566 - DNA, 25 bp, Rattus norvegicus
gaatgccttggcatgaactcttcat

SEQ ID NO: 310567 - DNA, 25 bp, Rattus norvegicus
gaatgccttggcttgaactcttcat

SEQ ID NO: 310568 - DNA, 25 bp, Rattus norvegicus
gaatgccttggtactcagtattatc

SEQ ID NO: 310569 - DNA, 25 bp, Rattus norvegicus
gaatgccttggttctcagtattatc

SEQ ID NO: 310570 - DNA, 25 bp, Rattus norvegicus
gaatgccttgttagagacttcagtt

SEQ ID NO: 310571 - DNA, 25 bp, Rattus norvegicus
gaatgccttgtttgagacttcagtt

SEQ ID NO: 310572 - DNA, 25 bp, Rattus norvegicus
gaatgcctttgcaagtgttatcctg

SEQ ID NO: 310573 - DNA, 25 bp, Rattus norvegicus
gaatgcctttgctagtgttatcctg

SEQ ID NO: 310574 - DNA, 25 bp, Rattus norvegicus
gaatgcctttgtaagcccacaggac

SEQ ID NO: 310575 - DNA, 25 bp, Rattus norvegicus
gaatgcctttgttagcccacaggac

SEQ ID NO: 310576 - DNA, 25 bp, Rattus norvegicus
gaatgcgaacaccatcaccaaatga

SEQ ID NO: 310577 - DNA, 25 bp, Rattus norvegicus
gaatgcgaacacgatcaccaaatga

SEQ ID NO: 310578 - DNA, 25 bp, Rattus norvegicus
gaatgcgaagttaacggctagaagt

SEQ ID NO: 310579 - DNA, 25 bp, Rattus norvegicus
gaatgcgaagtttacggctagaagt

SEQ ID NO: 310580 - DNA, 25 bp, Rattus norvegicus
gaatgcgagtgtcgtgtctcttaga

SEQ ID NO: 310581 - DNA, 25 bp, Rattus norvegicus
gaatgcgagtgtggtgtctcttaga

SEQ ID NO: 310582 - DNA, 25 bp, Rattus norvegicus
gaatgcgatgtgaaagtcccatgag

SEQ ID NO: 310583 - DNA, 25 bp, Rattus norvegicus
gaatgcgatgtgtaagtcccatgag

SEQ ID NO: 310584 - DNA, 25 bp, Rattus norvegicus
gaatgcgcaagcatgtgagtgtgtt

SEQ ID NO: 310585 - DNA, 25 bp, Rattus norvegicus
gaatgcgcaagcttgtgagtgtgtt

SEQ ID NO: 310586 - DNA, 25 bp, Rattus norvegicus
gaatgcgcccaccaggctgatgaag

SEQ ID NO: 310587 - DNA, 25 bp, Rattus norvegicus
gaatgcgcccacgaggctgatgaag

SEQ ID NO: 310588 - DNA, 25 bp, Rattus norvegicus
gaatgcgctaggcagtgcttctgat

SEQ ID NO: 310589 - DNA, 25 bp, Rattus norvegicus
gaatgcgctagggagtgcttctgat

SEQ ID NO: 310590 - DNA, 25 bp, Rattus norvegicus
gaatgcggaaaacacctatttgggt

SEQ ID NO: 310591 - DNA, 25 bp, Rattus norvegicus
gaatgcggaaaagacctatttgggt

SEQ ID NO: 310592 - DNA, 25 bp, Rattus norvegicus
gaatgcggaggtacctggccacgtt

SEQ ID NO: 310593 - DNA, 25 bp, Rattus norvegicus
gaatgcggaggttcctggccacgtt

SEQ ID NO: 310594 - DNA, 25 bp, Rattus norvegicus
gaatgcggccgaaatcacagacaag

SEQ ID NO: 310595 - DNA, 25 bp, Rattus norvegicus
gaatgcggccgatatcacagacaag

SEQ ID NO: 310596 - DNA, 25 bp, Rattus norvegicus
gaatgcgggcgtccatgttgccttc

SEQ ID NO: 310597 - DNA, 25 bp, Rattus norvegicus
gaatgcgggcgtgcatgttgccttc

SEQ ID NO: 310598 - DNA, 25 bp, Rattus norvegicus
gaatgcgggttgctaaatccctcga

SEQ ID NO: 310599 - DNA, 25 bp, Rattus norvegicus
gaatgcgggttggtaaatccctcga

SEQ ID NO: 310600 - DNA, 25 bp, Rattus norvegicus
gaatgcgtattccagtttaccttga

SEQ ID NO: 310601 - DNA, 25 bp, Rattus norvegicus
gaatgcgtattcgagtttaccttga

SEQ ID NO: 310602 - DNA, 25 bp, Rattus norvegicus
gaatgcgtctggagaactggtccca

SEQ ID NO: 310603 - DNA, 25 bp, Rattus norvegicus
gaatgcgtctggtgaactggtccca

SEQ ID NO: 310604 - DNA, 25 bp, Rattus norvegicus
gaatgcgtgtgtacatgtgtcagag

SEQ ID NO: 310605 - DNA, 25 bp, Rattus norvegicus
gaatgcgtgtgtatactacagcgaa

SEQ ID NO: 310606 - DNA, 25 bp, Rattus norvegicus
gaatgcgtgtgttcatgtgtcagag

SEQ ID NO: 310607 - DNA, 25 bp, Rattus norvegicus
gaatgcgtgtgtttactacagcgaa

SEQ ID NO: 310608 - DNA, 25 bp, Rattus norvegicus
gaatgcgttgtaacttttcactgta

SEQ ID NO: 310609 - DNA, 25 bp, Rattus norvegicus
gaatgcgttgtatcttttcactgta

SEQ ID NO: 310610 - DNA, 25 bp, Rattus norvegicus
gaatgctaacagatcacttgcagtg

SEQ ID NO: 310611 - DNA, 25 bp, Rattus norvegicus
gaatgctaacagttcacttgcagtg

SEQ ID NO: 310612 - DNA, 25 bp, Rattus norvegicus
gaatgctaactaatatttgtacata

SEQ ID NO: 310613 - DNA, 25 bp, Rattus norvegicus
gaatgctaactattatttgtacata

SEQ ID NO: 310614 - DNA, 25 bp, Rattus norvegicus
gaatgctaagcaaatgcatcagaac

SEQ ID NO: 310615 - DNA, 25 bp, Rattus norvegicus
gaatgctaagcatatgcatcagaac

SEQ ID NO: 310616 - DNA, 25 bp, Rattus norvegicus
gaatgctaagctattgtacgcccaa

SEQ ID NO: 310617 - DNA, 25 bp, Rattus norvegicus
gaatgctaagcttttgtacgcccaa

SEQ ID NO: 310618 - DNA, 25 bp, Rattus norvegicus
gaatgctaatatactgccttaaagt

SEQ ID NO: 310619 - DNA, 25 bp, Rattus norvegicus
gaatgctaatattctgccttaaagt

SEQ ID NO: 310620 - DNA, 25 bp, Rattus norvegicus
gaatgctaatcgatttggaacccgt

SEQ ID NO: 310621 - DNA, 25 bp, Rattus norvegicus
gaatgctaatcgttttggaacccgt

SEQ ID NO: 310622 - DNA, 25 bp, Rattus norvegicus
gaatgctaatggagctcctgccatc

SEQ ID NO: 310623 - DNA, 25 bp, Rattus norvegicus
gaatgctaatggtgctcctgccatc

SEQ ID NO: 310624 - DNA, 25 bp, Rattus norvegicus
gaatgctacagaacccgaatcgaaa

SEQ ID NO: 310625 - DNA, 25 bp, Rattus norvegicus
gaatgctacagatcccgaatcgaaa

SEQ ID NO: 310626 - DNA, 25 bp, Rattus norvegicus
gaatgctacatcatatcagatctat

SEQ ID NO: 310627 - DNA, 25 bp, Rattus norvegicus
gaatgctacatcttatcagatctat

SEQ ID NO: 310628 - DNA, 25 bp, Rattus norvegicus
gaatgctacctaacatcctgatcac

SEQ ID NO: 310629 - DNA, 25 bp, Rattus norvegicus
gaatgctacctatcatcctgatcac

SEQ ID NO: 310630 - DNA, 25 bp, Rattus norvegicus
gaatgctactttaaggtgtgtccta

SEQ ID NO: 310631 - DNA, 25 bp, Rattus norvegicus
gaatgctacttttaggtgtgtccta

SEQ ID NO: 310632 - DNA, 25 bp, Rattus norvegicus
gaatgctagaacacagcacacggga

SEQ ID NO: 310633 - DNA, 25 bp, Rattus norvegicus
gaatgctagaactcagcacacggga

SEQ ID NO: 310634 - DNA, 25 bp, Rattus norvegicus
gaatgctagatgatactccttatgc

SEQ ID NO: 310635 - DNA, 25 bp, Rattus norvegicus
gaatgctagatgttactccttatgc

SEQ ID NO: 310636 - DNA, 25 bp, Rattus norvegicus
gaatgctaggacatctactgggtga

SEQ ID NO: 310637 - DNA, 25 bp, Rattus norvegicus
gaatgctaggacttctactgggtga

SEQ ID NO: 310638 - DNA, 25 bp, Rattus norvegicus
gaatgctagtgcattcttctaaaca

SEQ ID NO: 310639 - DNA, 25 bp, Rattus norvegicus
gaatgctagtgctttcttctaaaca

SEQ ID NO: 310640 - DNA, 25 bp, Rattus norvegicus
gaatgctagtttaatgacttttcta

SEQ ID NO: 310641 - DNA, 25 bp, Rattus norvegicus
gaatgctagttttatgacttttcta

SEQ ID NO: 310642 - DNA, 25 bp, Rattus norvegicus
gaatgctatcatcaacagtggcccc

SEQ ID NO: 310643 - DNA, 25 bp, Rattus norvegicus
gaatgctatcatgaacagtggcccc

SEQ ID NO: 310644 - DNA, 25 bp, Rattus norvegicus
gaatgctatctcaagcacgacctgt

SEQ ID NO: 310645 - DNA, 25 bp, Rattus norvegicus
gaatgctatctctagcacgacctgt

SEQ ID NO: 310646 - DNA, 25 bp, Rattus norvegicus
gaatgctatgcgaattaaaccttgc

SEQ ID NO: 310647 - DNA, 25 bp, Rattus norvegicus
gaatgctatgcgtattaaaccttgc

SEQ ID NO: 310648 - DNA, 25 bp, Rattus norvegicus
gaatgctatggcaacgaggctcttc

SEQ ID NO: 310649 - DNA, 25 bp, Rattus norvegicus
gaatgctatggctacgaggctcttc

SEQ ID NO: 310650 - DNA, 25 bp, Rattus norvegicus
gaatgctatggtccctatgtcgagg

SEQ ID NO: 310651 - DNA, 25 bp, Rattus norvegicus
gaatgctatggtctgaggtacaata

SEQ ID NO: 310652 - DNA, 25 bp, Rattus norvegicus
gaatgctatggtgcctatgtcgagg

SEQ ID NO: 310653 - DNA, 25 bp, Rattus norvegicus
gaatgctatggtgtgaggtacaata

SEQ ID NO: 310654 - DNA, 25 bp, Rattus norvegicus
gaatgctattccacctgtttggtct

SEQ ID NO: 310655 - DNA, 25 bp, Rattus norvegicus
gaatgctattcctcctgtttggtct

SEQ ID NO: 310656 - DNA, 25 bp, Rattus norvegicus
gaatgctattttactaggctgagct

SEQ ID NO: 310657 - DNA, 25 bp, Rattus norvegicus
gaatgctatttttctaggctgagct

SEQ ID NO: 310658 - DNA, 25 bp, Rattus norvegicus
gaatgctcaagaacccagaggccaa

SEQ ID NO: 310659 - DNA, 25 bp, Rattus norvegicus
gaatgctcaagatcccagaggccaa

SEQ ID NO: 310660 - DNA, 25 bp, Rattus norvegicus
gaatgctcaaggctgcacagacaga

SEQ ID NO: 310661 - DNA, 25 bp, Rattus norvegicus
gaatgctcaagggtgcacagacaga

SEQ ID NO: 310662 - DNA, 25 bp, Rattus norvegicus
gaatgctcaagtaagcactagacag

SEQ ID NO: 310663 - DNA, 25 bp, Rattus norvegicus
gaatgctcaagttagcactagacag

SEQ ID NO: 310664 - DNA, 25 bp, Rattus norvegicus
gaatgctcagctatacagtcggaga

SEQ ID NO: 310665 - DNA, 25 bp, Rattus norvegicus
gaatgctcagctttacagtcggaga

SEQ ID NO: 310666 - DNA, 25 bp, Rattus norvegicus
gaatgctcaggcattgtaactcttg

SEQ ID NO: 310667 - DNA, 25 bp, Rattus norvegicus
gaatgctcaggctttgtaactcttg

SEQ ID NO: 310668 - DNA, 25 bp, Rattus norvegicus
gaatgctcagtgagcgaagttcatt

SEQ ID NO: 310669 - DNA, 25 bp, Rattus norvegicus
gaatgctcagtgtgcgaagttcatt

SEQ ID NO: 310670 - DNA, 25 bp, Rattus norvegicus
gaatgctcatttagacacgaatgta

SEQ ID NO: 310671 - DNA, 25 bp, Rattus norvegicus
gaatgctcattttgacacgaatgta

SEQ ID NO: 310672 - DNA, 25 bp, Rattus norvegicus
gaatgctccccaataaggttcacat

SEQ ID NO: 310673 - DNA, 25 bp, Rattus norvegicus
gaatgctccccattaaggttcacat

SEQ ID NO: 310674 - DNA, 25 bp, Rattus norvegicus
gaatgctccgggatttctgaggaca

SEQ ID NO: 310675 - DNA, 25 bp, Rattus norvegicus
gaatgctccgggttttctgaggaca

SEQ ID NO: 310676 - DNA, 25 bp, Rattus norvegicus
gaatgctccgtgacttgtaacaact

SEQ ID NO: 310677 - DNA, 25 bp, Rattus norvegicus
gaatgctccgtgatctggtaaataa

SEQ ID NO: 310678 - DNA, 25 bp, Rattus norvegicus
gaatgctccgtgtcttgtaacaact

SEQ ID NO: 310679 - DNA, 25 bp, Rattus norvegicus
gaatgctccgtgttctggtaaataa

SEQ ID NO: 310680 - DNA, 25 bp, Rattus norvegicus
gaatgctcctctcttcaagtactat

SEQ ID NO: 310681 - DNA, 25 bp, Rattus norvegicus
gaatgctcctctgttcaagtactat

SEQ ID NO: 310682 - DNA, 25 bp, Rattus norvegicus
gaatgctcgggaacgtaatcgctca

SEQ ID NO: 310683 - DNA, 25 bp, Rattus norvegicus
gaatgctcgggatcgtaatcgctca

SEQ ID NO: 310684 - DNA, 25 bp, Rattus norvegicus
gaatgctctagccatgtgccttgat

SEQ ID NO: 310685 - DNA, 25 bp, Rattus norvegicus
gaatgctctagcgatgtgccttgat

SEQ ID NO: 310686 - DNA, 25 bp, Rattus norvegicus
gaatgctctcagcttcactacaaag

SEQ ID NO: 310687 - DNA, 25 bp, Rattus norvegicus
gaatgctctcaggttcactacaaag

SEQ ID NO: 310688 - DNA, 25 bp, Rattus norvegicus
gaatgctctccacctgtgtgtatgg

SEQ ID NO: 310689 - DNA, 25 bp, Rattus norvegicus
gaatgctctccagctgtgtgtatgg

SEQ ID NO: 310690 - DNA, 25 bp, Rattus norvegicus
gaatgctctccgagctctggagaca

SEQ ID NO: 310691 - DNA, 25 bp, Rattus norvegicus
gaatgctctccgtgctctggagaca

SEQ ID NO: 310692 - DNA, 25 bp, Rattus norvegicus
gaatgctctgggacaggactccact

SEQ ID NO: 310693 - DNA, 25 bp, Rattus norvegicus
gaatgctctgggtcaggactccact

SEQ ID NO: 310694 - DNA, 25 bp, Rattus norvegicus
gaatgctctggtatatagctgccca

SEQ ID NO: 310695 - DNA, 25 bp, Rattus norvegicus
gaatgctctggtttatagctgccca

SEQ ID NO: 310696 - DNA, 25 bp, Rattus norvegicus
gaatgctctgtcaggattcagcttg

SEQ ID NO: 310697 - DNA, 25 bp, Rattus norvegicus
gaatgctctgtctggattcagcttg

SEQ ID NO: 310698 - DNA, 25 bp, Rattus norvegicus
gaatgctctgtgagaatgctcctcc

SEQ ID NO: 310699 - DNA, 25 bp, Rattus norvegicus
gaatgctctgtgtgaatgctcctcc

SEQ ID NO: 310700 - DNA, 25 bp, Rattus norvegicus
gaatgctgacagctgagcctgccag

SEQ ID NO: 310701 - DNA, 25 bp, Rattus norvegicus
gaatgctgacaggtgagcctgccag

SEQ ID NO: 310702 - DNA, 25 bp, Rattus norvegicus
gaatgctgagcaagctgtgccacaa

SEQ ID NO: 310703 - DNA, 25 bp, Rattus norvegicus
gaatgctgagcatgctgtgccacaa

SEQ ID NO: 310704 - DNA, 25 bp, Rattus norvegicus
gaatgctgataaagttggcgctgag

SEQ ID NO: 310705 - DNA, 25 bp, Rattus norvegicus
gaatgctgataatgttggcgctgag

SEQ ID NO: 310706 - DNA, 25 bp, Rattus norvegicus
gaatgctgatgcacaaactacaggt

SEQ ID NO: 310707 - DNA, 25 bp, Rattus norvegicus
gaatgctgatgctcaaactacaggt

SEQ ID NO: 310708 - DNA, 25 bp, Rattus norvegicus
gaatgctgcatgcaaaaccctggaa

SEQ ID NO: 310709 - DNA, 25 bp, Rattus norvegicus
gaatgctgcatggaaaaccctggaa

SEQ ID NO: 310710 - DNA, 25 bp, Rattus norvegicus
gaatgctgcgagatcaatcagactg

SEQ ID NO: 310711 - DNA, 25 bp, Rattus norvegicus
gaatgctgcgagttcaatcagactg

SEQ ID NO: 310712 - DNA, 25 bp, Rattus norvegicus
gaatgctgctgacactctaaacaat

SEQ ID NO: 310713 - DNA, 25 bp, Rattus norvegicus
gaatgctgctgacattggctaccct

SEQ ID NO: 310714 - DNA, 25 bp, Rattus norvegicus
gaatgctgctgagactctaaacaat

SEQ ID NO: 310715 - DNA, 25 bp, Rattus norvegicus
gaatgctgctgagattggctaccct

SEQ ID NO: 310716 - DNA, 25 bp, Rattus norvegicus
gaatgctgctgtaagctttatccgt

SEQ ID NO: 310717 - DNA, 25 bp, Rattus norvegicus
gaatgctgctgtattctgaaatgta

SEQ ID NO: 310718 - DNA, 25 bp, Rattus norvegicus
gaatgctgctgttagctttatccgt

SEQ ID NO: 310719 - DNA, 25 bp, Rattus norvegicus
gaatgctgctgttttctgaaatgta

SEQ ID NO: 310720 - DNA, 25 bp, Rattus norvegicus
gaatgctggagtcacacaatgctat

SEQ ID NO: 310721 - DNA, 25 bp, Rattus norvegicus
gaatgctggagtgacacaatgctat

SEQ ID NO: 310722 - DNA, 25 bp, Rattus norvegicus
gaatgctggctgacactggaattac

SEQ ID NO: 310723 - DNA, 25 bp, Rattus norvegicus
gaatgctggctgtcactggaattac

SEQ ID NO: 310724 - DNA, 25 bp, Rattus norvegicus
gaatgctggcttcatttagtgtcta

SEQ ID NO: 310725 - DNA, 25 bp, Rattus norvegicus
gaatgctggcttgatttagtgtcta

SEQ ID NO: 310726 - DNA, 25 bp, Rattus norvegicus
gaatgctgggacaaaggtatgtgcc

SEQ ID NO: 310727 - DNA, 25 bp, Rattus norvegicus
gaatgctgggacagcatcttggcag

SEQ ID NO: 310728 - DNA, 25 bp, Rattus norvegicus
gaatgctgggactaaggtatgtgcc

SEQ ID NO: 310729 - DNA, 25 bp, Rattus norvegicus
gaatgctgggactgcatcttggcag

SEQ ID NO: 310730 - DNA, 25 bp, Rattus norvegicus
gaatgctgggcacacactggacaag

SEQ ID NO: 310731 - DNA, 25 bp, Rattus norvegicus
gaatgctgggcagacactggacaag

SEQ ID NO: 310732 - DNA, 25 bp, Rattus norvegicus
gaatgctgggtaactcaatccctct

SEQ ID NO: 310733 - DNA, 25 bp, Rattus norvegicus
gaatgctgggtatctcaatccctct

SEQ ID NO: 310734 - DNA, 25 bp, Rattus norvegicus
gaatgctgggttcaccaaagcaggt

SEQ ID NO: 310735 - DNA, 25 bp, Rattus norvegicus
gaatgctgggttgaccaaagcaggt

SEQ ID NO: 310736 - DNA, 25 bp, Rattus norvegicus
gaatgctggtaaccactgtgcccac

SEQ ID NO: 310737 - DNA, 25 bp, Rattus norvegicus
gaatgctggtaagcactgtgcccac

SEQ ID NO: 310738 - DNA, 25 bp, Rattus norvegicus
gaatgctggtaccagaacccatccg

SEQ ID NO: 310739 - DNA, 25 bp, Rattus norvegicus
gaatgctggtacgagaacccatccg

SEQ ID NO: 310740 - DNA, 25 bp, Rattus norvegicus
gaatgctgtaaaagaccgaatggct

SEQ ID NO: 310741 - DNA, 25 bp, Rattus norvegicus
gaatgctgtaaatgaccgaatggct

SEQ ID NO: 310742 - DNA, 25 bp, Rattus norvegicus
gaatgctgtactccttctcacaaat

SEQ ID NO: 310743 - DNA, 25 bp, Rattus norvegicus
gaatgctgtactgcttctcacaaat

SEQ ID NO: 310744 - DNA, 25 bp, Rattus norvegicus
gaatgctgtctaacacatgtgtggt

SEQ ID NO: 310745 - DNA, 25 bp, Rattus norvegicus
gaatgctgtctatcacatgtgtggt

SEQ ID NO: 310746 - DNA, 25 bp, Rattus norvegicus
gaatgctgtgttagtcacactcaag

SEQ ID NO: 310747 - DNA, 25 bp, Rattus norvegicus
gaatgctgtgtttgtcacactcaag

SEQ ID NO: 310748 - DNA, 25 bp, Rattus norvegicus
gaatgctgttagatgcacactgttg

SEQ ID NO: 310749 - DNA, 25 bp, Rattus norvegicus
gaatgctgttagcaggaagccacaa

SEQ ID NO: 310750 - DNA, 25 bp, Rattus norvegicus
gaatgctgttaggaggaagccacaa

SEQ ID NO: 310751 - DNA, 25 bp, Rattus norvegicus
gaatgctgttagttgcacactgttg

SEQ ID NO: 310752 - DNA, 25 bp, Rattus norvegicus
gaatgctgttgccagtgtacaaaat

SEQ ID NO: 310753 - DNA, 25 bp, Rattus norvegicus
gaatgctgttgcgagtgtacaaaat

SEQ ID NO: 310754 - DNA, 25 bp, Rattus norvegicus
gaatgctgttgtccctcacttgagg

SEQ ID NO: 310755 - DNA, 25 bp, Rattus norvegicus
gaatgctgttgtctctttttctcaa

SEQ ID NO: 310756 - DNA, 25 bp, Rattus norvegicus
gaatgctgttgtgcctcacttgagg

SEQ ID NO: 310757 - DNA, 25 bp, Rattus norvegicus
gaatgctgttgtgtctttttctcaa

SEQ ID NO: 310758 - DNA, 25 bp, Rattus norvegicus
gaatgctgtttcattgttcatagag

SEQ ID NO: 310759 - DNA, 25 bp, Rattus norvegicus
gaatgctgtttctttgttcatagag

SEQ ID NO: 310760 - DNA, 25 bp, Rattus norvegicus
gaatgcttaagccttccatttcacc

SEQ ID NO: 310761 - DNA, 25 bp, Rattus norvegicus
gaatgcttaagcgttccatttcacc

SEQ ID NO: 310762 - DNA, 25 bp, Rattus norvegicus
gaatgcttaccactctgtattttgt

SEQ ID NO: 310763 - DNA, 25 bp, Rattus norvegicus
gaatgcttaccagtctgtattttgt

SEQ ID NO: 310764 - DNA, 25 bp, Rattus norvegicus
gaatgcttactcaggtgggatgcca

SEQ ID NO: 310765 - DNA, 25 bp, Rattus norvegicus
gaatgcttactctggtgggatgcca

SEQ ID NO: 310766 - DNA, 25 bp, Rattus norvegicus
gaatgcttacttcgctaacatgtac

SEQ ID NO: 310767 - DNA, 25 bp, Rattus norvegicus
gaatgcttacttggctaacatgtac

SEQ ID NO: 310768 - DNA, 25 bp, Rattus norvegicus
gaatgcttagttagttaacctgtga

SEQ ID NO: 310769 - DNA, 25 bp, Rattus norvegicus
gaatgcttagtttgttaacctgtga

SEQ ID NO: 310770 - DNA, 25 bp, Rattus norvegicus
gaatgcttcatcatccatacaagat

SEQ ID NO: 310771 - DNA, 25 bp, Rattus norvegicus
gaatgcttcatcttccatacaagat

SEQ ID NO: 310772 - DNA, 25 bp, Rattus norvegicus
gaatgcttcggtctttagcttcgcc

SEQ ID NO: 310773 - DNA, 25 bp, Rattus norvegicus
gaatgcttcggtgtttagcttcgcc

SEQ ID NO: 310774 - DNA, 25 bp, Rattus norvegicus
gaatgcttcgttctgaagcagccat

SEQ ID NO: 310775 - DNA, 25 bp, Rattus norvegicus
gaatgcttcgttgtgaagcagccat

SEQ ID NO: 310776 - DNA, 25 bp, Rattus norvegicus
gaatgcttctcacacattagttcct

SEQ ID NO: 310777 - DNA, 25 bp, Rattus norvegicus
gaatgcttctcagacattagttcct

SEQ ID NO: 310778 - DNA, 25 bp, Rattus norvegicus
gaatgcttgaagacaggcttttaga

SEQ ID NO: 310779 - DNA, 25 bp, Rattus norvegicus
gaatgcttgaagtcaggcttttaga

SEQ ID NO: 310780 - DNA, 25 bp, Rattus norvegicus
gaatgcttgacccaaggcctttgaa

SEQ ID NO: 310781 - DNA, 25 bp, Rattus norvegicus
gaatgcttgaccgaaggcctttgaa

SEQ ID NO: 310782 - DNA, 25 bp, Rattus norvegicus
gaatgcttgagtatcttagtgcagc

SEQ ID NO: 310783 - DNA, 25 bp, Rattus norvegicus
gaatgcttgagtttcttagtgcagc

SEQ ID NO: 310784 - DNA, 25 bp, Rattus norvegicus
gaatgcttgatcaccattgttacat

SEQ ID NO: 310785 - DNA, 25 bp, Rattus norvegicus
gaatgcttgatctccattgttacat

SEQ ID NO: 310786 - DNA, 25 bp, Rattus norvegicus
gaatgcttgccgcttggtagaccac

SEQ ID NO: 310787 - DNA, 25 bp, Rattus norvegicus
gaatgcttgccggttggtagaccac

SEQ ID NO: 310788 - DNA, 25 bp, Rattus norvegicus
gaatgcttgcttagaatgcctgaag

SEQ ID NO: 310789 - DNA, 25 bp, Rattus norvegicus
gaatgcttgctttgaatgcctgaag

SEQ ID NO: 310790 - DNA, 25 bp, Rattus norvegicus
gaatgcttggacatgatggatcact

SEQ ID NO: 310791 - DNA, 25 bp, Rattus norvegicus
gaatgcttggacttgatggatcact

SEQ ID NO: 310792 - DNA, 25 bp, Rattus norvegicus
gaatgcttgtggcttcacacccatg

SEQ ID NO: 310793 - DNA, 25 bp, Rattus norvegicus
gaatgcttgtgggttcacacccatg

SEQ ID NO: 310794 - DNA, 25 bp, Rattus norvegicus
gaatgctttcagagcctactgtaca

SEQ ID NO: 310795 - DNA, 25 bp, Rattus norvegicus
gaatgctttcagtgcctactgtaca

SEQ ID NO: 310796 - DNA, 25 bp, Rattus norvegicus
gaatgctttcccactggcatgtatg

SEQ ID NO: 310797 - DNA, 25 bp, Rattus norvegicus
gaatgctttccctctggcatgtatg

SEQ ID NO: 310798 - DNA, 25 bp, Rattus norvegicus
gaatgctttccgctttattatttgc

SEQ ID NO: 310799 - DNA, 25 bp, Rattus norvegicus
gaatgctttccggtttattatttgc

SEQ ID NO: 310800 - DNA, 25 bp, Rattus norvegicus
gaatgctttcttatcccagagactt

SEQ ID NO: 310801 - DNA, 25 bp, Rattus norvegicus
gaatgctttcttttcccagagactt

SEQ ID NO: 310802 - DNA, 25 bp, Rattus norvegicus
gaatgctttgaacggcatccgcttc

SEQ ID NO: 310803 - DNA, 25 bp, Rattus norvegicus
gaatgctttgaagggcatccgcttc

SEQ ID NO: 310804 - DNA, 25 bp, Rattus norvegicus
gaatgcttttagcagtgtttacact

SEQ ID NO: 310805 - DNA, 25 bp, Rattus norvegicus
gaatgcttttaggagtgtttacact

SEQ ID NO: 310806 - DNA, 25 bp, Rattus norvegicus
gaatgcttttctatggacatttaat

SEQ ID NO: 310807 - DNA, 25 bp, Rattus norvegicus
gaatgcttttctttggacatttaat

SEQ ID NO: 310808 - DNA, 25 bp, Rattus norvegicus
gaatgcttttgactccacatttcaa

SEQ ID NO: 310809 - DNA, 25 bp, Rattus norvegicus
gaatgcttttgagtccacatttcaa

SEQ ID NO: 310810 - DNA, 25 bp, Rattus norvegicus
gaatgcttttgtaggagttgggatt

SEQ ID NO: 310811 - DNA, 25 bp, Rattus norvegicus
gaatgcttttgttggagttgggatt

SEQ ID NO: 310812 - DNA, 25 bp, Rattus norvegicus
gaatgctttttaattggcccctctt

SEQ ID NO: 310813 - DNA, 25 bp, Rattus norvegicus
gaatgctttttatttggcccctctt

SEQ ID NO: 310814 - DNA, 25 bp, Rattus norvegicus
gaatggaaacgaaccccaaactgat

SEQ ID NO: 310815 - DNA, 25 bp, Rattus norvegicus
gaatggaaacgatccccaaactgat

SEQ ID NO: 310816 - DNA, 25 bp, Rattus norvegicus
gaatggaaaggcacctaaccgcctc

SEQ ID NO: 310817 - DNA, 25 bp, Rattus norvegicus
gaatggaaaggctcctaaccgcctc

SEQ ID NO: 310818 - DNA, 25 bp, Rattus norvegicus
gaatggaacagaactcccaggagtc

SEQ ID NO: 310819 - DNA, 25 bp, Rattus norvegicus
gaatggaacagatctcccaggagtc

SEQ ID NO: 310820 - DNA, 25 bp, Rattus norvegicus
gaatggaacctgaactacccaatgc

SEQ ID NO: 310821 - DNA, 25 bp, Rattus norvegicus
gaatggaacctgtactacccaatgc

SEQ ID NO: 310822 - DNA, 25 bp, Rattus norvegicus
gaatggaacgttctaaatgcttgtc

SEQ ID NO: 310823 - DNA, 25 bp, Rattus norvegicus
gaatggaacgttgtaaatgcttgtc

SEQ ID NO: 310824 - DNA, 25 bp, Rattus norvegicus
gaatggaactggaccgagtgtttat

SEQ ID NO: 310825 - DNA, 25 bp, Rattus norvegicus
gaatggaactggtccgagtgtttat

SEQ ID NO: 310826 - DNA, 25 bp, Rattus norvegicus
gaatggaagagacgcacctgccaat

SEQ ID NO: 310827 - DNA, 25 bp, Rattus norvegicus
gaatggaagagaggcacctgccaat

SEQ ID NO: 310828 - DNA, 25 bp, Rattus norvegicus
gaatggaagcctcaaagccctccgt

SEQ ID NO: 310829 - DNA, 25 bp, Rattus norvegicus
gaatggaagcctcatctttgcctct

SEQ ID NO: 310830 - DNA, 25 bp, Rattus norvegicus
gaatggaagcctgaaagccctccgt

SEQ ID NO: 310831 - DNA, 25 bp, Rattus norvegicus
gaatggaagcctgatctttgcctct

SEQ ID NO: 310832 - DNA, 25 bp, Rattus norvegicus
gaatggaagctcaacagttcaccag

SEQ ID NO: 310833 - DNA, 25 bp, Rattus norvegicus
gaatggaagctctacagttcaccag

SEQ ID NO: 310834 - DNA, 25 bp, Rattus norvegicus
gaatggaagtctatgaaccctcaaa

SEQ ID NO: 310835 - DNA, 25 bp, Rattus norvegicus
gaatggaagtctttgaaccctcaaa

SEQ ID NO: 310836 - DNA, 25 bp, Rattus norvegicus
gaatggaatgccctactgtgctatc

SEQ ID NO: 310837 - DNA, 25 bp, Rattus norvegicus
gaatggaatgccgtactgtgctatc

SEQ ID NO: 310838 - DNA, 25 bp, Rattus norvegicus
gaatggaatgctactgccacaaggc

SEQ ID NO: 310839 - DNA, 25 bp, Rattus norvegicus
gaatggaatgcttctgccacaaggc

SEQ ID NO: 310840 - DNA, 25 bp, Rattus norvegicus
gaatggacaacacgcttgctgaacg

SEQ ID NO: 310841 - DNA, 25 bp, Rattus norvegicus
gaatggacaacaggcttgctgaacg

SEQ ID NO: 310842 - DNA, 25 bp, Rattus norvegicus
gaatggacaaccctgctttaacaaa

SEQ ID NO: 310843 - DNA, 25 bp, Rattus norvegicus
gaatggacaaccgtgctttaacaaa

SEQ ID NO: 310844 - DNA, 25 bp, Rattus norvegicus
gaatggacacagaagcccttgcgct

SEQ ID NO: 310845 - DNA, 25 bp, Rattus norvegicus
gaatggacacagtagcccttgcgct

SEQ ID NO: 310846 - DNA, 25 bp, Rattus norvegicus
gaatggacactgcagttgccctaat

SEQ ID NO: 310847 - DNA, 25 bp, Rattus norvegicus
gaatggacactggagttgccctaat

SEQ ID NO: 310848 - DNA, 25 bp, Rattus norvegicus
gaatggacagacagacggcctgcac

SEQ ID NO: 310849 - DNA, 25 bp, Rattus norvegicus
gaatggacagactgacggcctgcac

SEQ ID NO: 310850 - DNA, 25 bp, Rattus norvegicus
gaatggacaggaagaccgccccgtg

SEQ ID NO: 310851 - DNA, 25 bp, Rattus norvegicus
gaatggacaggatgaccgccccgtg

SEQ ID NO: 310852 - DNA, 25 bp, Rattus norvegicus
gaatggacatttacctaagaacctt

SEQ ID NO: 310853 - DNA, 25 bp, Rattus norvegicus
gaatggacattttcctaagaacctt

SEQ ID NO: 310854 - DNA, 25 bp, Rattus norvegicus
gaatggaccaggactctagccacct

SEQ ID NO: 310855 - DNA, 25 bp, Rattus norvegicus
gaatggaccaggtctctagccacct

SEQ ID NO: 310856 - DNA, 25 bp, Rattus norvegicus
gaatggaccagtcccctgaggagat

SEQ ID NO: 310857 - DNA, 25 bp, Rattus norvegicus
gaatggaccagtgccctgaggagat

SEQ ID NO: 310858 - DNA, 25 bp, Rattus norvegicus
gaatggaccatgaagagattgccct

SEQ ID NO: 310859 - DNA, 25 bp, Rattus norvegicus
gaatggaccatgtagagattgccct

SEQ ID NO: 310860 - DNA, 25 bp, Rattus norvegicus
gaatggacccagatcttgtacatat

SEQ ID NO: 310861 - DNA, 25 bp, Rattus norvegicus
gaatggacccagttcttgtacatat

SEQ ID NO: 310862 - DNA, 25 bp, Rattus norvegicus
gaatggaccccgagcaacggaagtg

SEQ ID NO: 310863 - DNA, 25 bp, Rattus norvegicus
gaatggaccccgtgcaacggaagtg

SEQ ID NO: 310864 - DNA, 25 bp, Rattus norvegicus
gaatggacctgtaggcaccgcctga

SEQ ID NO: 310865 - DNA, 25 bp, Rattus norvegicus
gaatggacctgttggcaccgcctga

SEQ ID NO: 310866 - DNA, 25 bp, Rattus norvegicus
gaatggaccttgagagttttaggaa

SEQ ID NO: 310867 - DNA, 25 bp, Rattus norvegicus
gaatggaccttgatggatctggaca

SEQ ID NO: 310868 - DNA, 25 bp, Rattus norvegicus
gaatggaccttgtgagttttaggaa

SEQ ID NO: 310869 - DNA, 25 bp, Rattus norvegicus
gaatggaccttgttggatctggaca

SEQ ID NO: 310870 - DNA, 25 bp, Rattus norvegicus
gaatggacgagtactcccgcgggaa

SEQ ID NO: 310871 - DNA, 25 bp, Rattus norvegicus
gaatggacgagttctcccgcgggaa

SEQ ID NO: 310872 - DNA, 25 bp, Rattus norvegicus
gaatggactaccacgtctgcagatg

SEQ ID NO: 310873 - DNA, 25 bp, Rattus norvegicus
gaatggactacctcgtctgcagatg

SEQ ID NO: 310874 - DNA, 25 bp, Rattus norvegicus
gaatggactccacaggttgttctct

SEQ ID NO: 310875 - DNA, 25 bp, Rattus norvegicus
gaatggactccagaggttgttctct

SEQ ID NO: 310876 - DNA, 25 bp, Rattus norvegicus
gaatggactcgaattgagcaagcca

SEQ ID NO: 310877 - DNA, 25 bp, Rattus norvegicus
gaatggactcgatttgagcaagcca

SEQ ID NO: 310878 - DNA, 25 bp, Rattus norvegicus
gaatggactgtcaaacttctggaaa

SEQ ID NO: 310879 - DNA, 25 bp, Rattus norvegicus
gaatggactgtctaacttctggaaa

SEQ ID NO: 310880 - DNA, 25 bp, Rattus norvegicus
gaatggacttctcggtagctgttaa

SEQ ID NO: 310881 - DNA, 25 bp, Rattus norvegicus
gaatggacttctgggtagctgttaa

SEQ ID NO: 310882 - DNA, 25 bp, Rattus norvegicus
gaatggacttttatcttgcagtaca

SEQ ID NO: 310883 - DNA, 25 bp, Rattus norvegicus
gaatggacttttttcttgcagtaca

SEQ ID NO: 310884 - DNA, 25 bp, Rattus norvegicus
gaatggagacccctgaactcattga

SEQ ID NO: 310885 - DNA, 25 bp, Rattus norvegicus
gaatggagacccgtgaactcattga

SEQ ID NO: 310886 - DNA, 25 bp, Rattus norvegicus
gaatggagatgcatgcctcacagaa

SEQ ID NO: 310887 - DNA, 25 bp, Rattus norvegicus
gaatggagatgcttgcctcacagaa

SEQ ID NO: 310888 - DNA, 25 bp, Rattus norvegicus
gaatggagcagcacagcctcaagtt

SEQ ID NO: 310889 - DNA, 25 bp, Rattus norvegicus
gaatggagcagctcagcctcaagtt

SEQ ID NO: 310890 - DNA, 25 bp, Rattus norvegicus
gaatggagcctgcagcgcttctgaa

SEQ ID NO: 310891 - DNA, 25 bp, Rattus norvegicus
gaatggagcctggagcgcttctgaa

SEQ ID NO: 310892 - DNA, 25 bp, Rattus norvegicus
gaatggagccttaccccactggagg

SEQ ID NO: 310893 - DNA, 25 bp, Rattus norvegicus
gaatggagcctttccccactggagg

SEQ ID NO: 310894 - DNA, 25 bp, Rattus norvegicus
gaatggagtagtccaccacccaagt

SEQ ID NO: 310895 - DNA, 25 bp, Rattus norvegicus
gaatggagtagtgcaccacccaagt

SEQ ID NO: 310896 - DNA, 25 bp, Rattus norvegicus
gaatggagtcagattgcaagcatct

SEQ ID NO: 310897 - DNA, 25 bp, Rattus norvegicus
gaatggagtcagtttgcaagcatct

SEQ ID NO: 310898 - DNA, 25 bp, Rattus norvegicus
gaatggataatcaaggaggctacgg

SEQ ID NO: 310899 - DNA, 25 bp, Rattus norvegicus
gaatggataatctaggaggctacgg

SEQ ID NO: 310900 - DNA, 25 bp, Rattus norvegicus
gaatggatagacatgcttgcttaat

SEQ ID NO: 310901 - DNA, 25 bp, Rattus norvegicus
gaatggatagacttgcttgcttaat

SEQ ID NO: 310902 - DNA, 25 bp, Rattus norvegicus
gaatggatatataggtcggttcata

SEQ ID NO: 310903 - DNA, 25 bp, Rattus norvegicus
gaatggatatattggtcggttcata

SEQ ID NO: 310904 - DNA, 25 bp, Rattus norvegicus
gaatggatatcacttgtcccaagtc

SEQ ID NO: 310905 - DNA, 25 bp, Rattus norvegicus
gaatggatatcagttgtcccaagtc

SEQ ID NO: 310906 - DNA, 25 bp, Rattus norvegicus
gaatggatccctcaggactatcttc

SEQ ID NO: 310907 - DNA, 25 bp, Rattus norvegicus
gaatggatccctgaggactatcttc

SEQ ID NO: 310908 - DNA, 25 bp, Rattus norvegicus
gaatggatccttaaggagtcccact

SEQ ID NO: 310909 - DNA, 25 bp, Rattus norvegicus
gaatggatcctttaggagtcccact

SEQ ID NO: 310910 - DNA, 25 bp, Rattus norvegicus
gaatggatctacaattgcgggcacc

SEQ ID NO: 310911 - DNA, 25 bp, Rattus norvegicus
gaatggatctactattgcgggcacc

SEQ ID NO: 310912 - DNA, 25 bp, Rattus norvegicus
gaatggatgacaactctgccttcaa

SEQ ID NO: 310913 - DNA, 25 bp, Rattus norvegicus
gaatggatgacatctctgccttcaa

SEQ ID NO: 310914 - DNA, 25 bp, Rattus norvegicus
gaatggatgatcatggtgcacacat

SEQ ID NO: 310915 - DNA, 25 bp, Rattus norvegicus
gaatggatgatcttggtgcacacat

SEQ ID NO: 310916 - DNA, 25 bp, Rattus norvegicus
gaatggatgattcgactgtctaccc

SEQ ID NO: 310917 - DNA, 25 bp, Rattus norvegicus
gaatggatgattggactgtctaccc

SEQ ID NO: 310918 - DNA, 25 bp, Rattus norvegicus
gaatggatgcaaaaacaccttgtaa

SEQ ID NO: 310919 - DNA, 25 bp, Rattus norvegicus
gaatggatgcaataacaccttgtaa

SEQ ID NO: 310920 - DNA, 25 bp, Rattus norvegicus
gaatggatgcctagtctaaagatct

SEQ ID NO: 310921 - DNA, 25 bp, Rattus norvegicus
gaatggatgccttgtctaaagatct

SEQ ID NO: 310922 - DNA, 25 bp, Rattus norvegicus
gaatggattcatcttcctgctttaa

SEQ ID NO: 310923 - DNA, 25 bp, Rattus norvegicus
gaatggattcatgttcctgctttaa

SEQ ID NO: 310924 - DNA, 25 bp, Rattus norvegicus
gaatggattccacttctaatgttca

SEQ ID NO: 310925 - DNA, 25 bp, Rattus norvegicus
gaatggattccagttctaatgttca

SEQ ID NO: 310926 - DNA, 25 bp, Rattus norvegicus
gaatggattcctacctttaaggtct

SEQ ID NO: 310927 - DNA, 25 bp, Rattus norvegicus
gaatggattccttcctttaaggtct

SEQ ID NO: 310928 - DNA, 25 bp, Rattus norvegicus
gaatggattgtcaaccatgaatctt

SEQ ID NO: 310929 - DNA, 25 bp, Rattus norvegicus
gaatggattgtctaccatgaatctt

SEQ ID NO: 310930 - DNA, 25 bp, Rattus norvegicus
gaatggcaagatcccctgcgtttca

SEQ ID NO: 310931 - DNA, 25 bp, Rattus norvegicus
gaatggcaagatgccctgcgtttca

SEQ ID NO: 310932 - DNA, 25 bp, Rattus norvegicus
gaatggcaagttacccaacacagtg

SEQ ID NO: 310933 - DNA, 25 bp, Rattus norvegicus
gaatggcaagtttcccaacacagtg

SEQ ID NO: 310934 - DNA, 25 bp, Rattus norvegicus
gaatggcaccagcttgactgatgag

SEQ ID NO: 310935 - DNA, 25 bp, Rattus norvegicus
gaatggcaccaggttgactgatgag

SEQ ID NO: 310936 - DNA, 25 bp, Rattus norvegicus
gaatggcacgaaaccgttttcctca

SEQ ID NO: 310937 - DNA, 25 bp, Rattus norvegicus
gaatggcacgaatccgttttcctca

SEQ ID NO: 310938 - DNA, 25 bp, Rattus norvegicus
gaatggcagaaaaccgcctacctca

SEQ ID NO: 310939 - DNA, 25 bp, Rattus norvegicus
gaatggcagaaatccgcctacctca

SEQ ID NO: 310940 - DNA, 25 bp, Rattus norvegicus
gaatggcagagcatctgtcctgtgc

SEQ ID NO: 310941 - DNA, 25 bp, Rattus norvegicus
gaatggcagagcttctgtcctgtgc

SEQ ID NO: 310942 - DNA, 25 bp, Rattus norvegicus
gaatggcagatgaactcgatttaat

SEQ ID NO: 310943 - DNA, 25 bp, Rattus norvegicus
gaatggcagatgtactcgatttaat

SEQ ID NO: 310944 - DNA, 25 bp, Rattus norvegicus
gaatggcagcacaagacatcttctg

SEQ ID NO: 310945 - DNA, 25 bp, Rattus norvegicus
gaatggcagcaccaagttcacagct

SEQ ID NO: 310946 - DNA, 25 bp, Rattus norvegicus
gaatggcagcacgaagttcacagct

SEQ ID NO: 310947 - DNA, 25 bp, Rattus norvegicus
gaatggcagcactagacatcttctg

SEQ ID NO: 310948 - DNA, 25 bp, Rattus norvegicus
gaatggcagcatcaccctgtaacgt

SEQ ID NO: 310949 - DNA, 25 bp, Rattus norvegicus
gaatggcagcatgaccctgtaacgt

SEQ ID NO: 310950 - DNA, 25 bp, Rattus norvegicus
gaatggcagccgaaacacgtacctg

SEQ ID NO: 310951 - DNA, 25 bp, Rattus norvegicus
gaatggcagccgtaacacgtacctg

SEQ ID NO: 310952 - DNA, 25 bp, Rattus norvegicus
gaatggcagcctcactacagactta

SEQ ID NO: 310953 - DNA, 25 bp, Rattus norvegicus
gaatggcagcctgactacagactta

SEQ ID NO: 310954 - DNA, 25 bp, Rattus norvegicus
gaatggcagtacaccctgttaagaa

SEQ ID NO: 310955 - DNA, 25 bp, Rattus norvegicus
gaatggcagtactccctgttaagaa

SEQ ID NO: 310956 - DNA, 25 bp, Rattus norvegicus
gaatggcagtgtaacctctcatgaa

SEQ ID NO: 310957 - DNA, 25 bp, Rattus norvegicus
gaatggcagtgttacctctcatgaa

SEQ ID NO: 310958 - DNA, 25 bp, Rattus norvegicus
gaatggcatagcacaggttgagcgc

SEQ ID NO: 310959 - DNA, 25 bp, Rattus norvegicus
gaatggcatagctcaggttgagcgc

SEQ ID NO: 310960 - DNA, 25 bp, Rattus norvegicus
gaatggcatctaccaacgcattaga

SEQ ID NO: 310961 - DNA, 25 bp, Rattus norvegicus
gaatggcatctagcaacgcattaga

SEQ ID NO: 310962 - DNA, 25 bp, Rattus norvegicus
gaatggcatgtgaccttgaaagctc

SEQ ID NO: 310963 - DNA, 25 bp, Rattus norvegicus
gaatggcatgtgtccttgaaagctc

SEQ ID NO: 310964 - DNA, 25 bp, Rattus norvegicus
gaatggccaacaccctagcagtcaa

SEQ ID NO: 310965 - DNA, 25 bp, Rattus norvegicus
gaatggccaacagcctagcagtcaa

SEQ ID NO: 310966 - DNA, 25 bp, Rattus norvegicus
gaatggccacaactaatattatgct

SEQ ID NO: 310967 - DNA, 25 bp, Rattus norvegicus
gaatggccacaagtaatattatgct

SEQ ID NO: 310968 - DNA, 25 bp, Rattus norvegicus
gaatggccacataaatgtccccttc

SEQ ID NO: 310969 - DNA, 25 bp, Rattus norvegicus
gaatggccacattaatgtccccttc

SEQ ID NO: 310970 - DNA, 25 bp, Rattus norvegicus
gaatggccaccaagagccttgacta

SEQ ID NO: 310971 - DNA, 25 bp, Rattus norvegicus
gaatggccaccatgagccttgacta

SEQ ID NO: 310972 - DNA, 25 bp, Rattus norvegicus
gaatggccacgtaaaagtgaacggg

SEQ ID NO: 310973 - DNA, 25 bp, Rattus norvegicus
gaatggccacgttaaagtgaacggg

SEQ ID NO: 310974 - DNA, 25 bp, Rattus norvegicus
gaatggccattcaacccagatagat

SEQ ID NO: 310975 - DNA, 25 bp, Rattus norvegicus
gaatggccattctacccagatagat

SEQ ID NO: 310976 - DNA, 25 bp, Rattus norvegicus
gaatggcccaggaacaccaggcatc

SEQ ID NO: 310977 - DNA, 25 bp, Rattus norvegicus
gaatggcccaggacagcatgcacac

SEQ ID NO: 310978 - DNA, 25 bp, Rattus norvegicus
gaatggcccaggtacaccaggcatc

SEQ ID NO: 310979 - DNA, 25 bp, Rattus norvegicus
gaatggcccaggtcagcatgcacac

SEQ ID NO: 310980 - DNA, 25 bp, Rattus norvegicus
gaatggccggctacgcagcgattgt

SEQ ID NO: 310981 - DNA, 25 bp, Rattus norvegicus
gaatggccggcttcgcagcgattgt

SEQ ID NO: 310982 - DNA, 25 bp, Rattus norvegicus
gaatggccgggtaaccaaatctgct

SEQ ID NO: 310983 - DNA, 25 bp, Rattus norvegicus
gaatggccgggttaccaaatctgct

SEQ ID NO: 310984 - DNA, 25 bp, Rattus norvegicus
gaatggcctaggattccaggttact

SEQ ID NO: 310985 - DNA, 25 bp, Rattus norvegicus
gaatggcctaggtttccaggttact

SEQ ID NO: 310986 - DNA, 25 bp, Rattus norvegicus
gaatggcctatgactttcttctctc

SEQ ID NO: 310987 - DNA, 25 bp, Rattus norvegicus
gaatggcctatgtctttcttctctc

SEQ ID NO: 310988 - DNA, 25 bp, Rattus norvegicus
gaatggcctcatacctaggaaatat

SEQ ID NO: 310989 - DNA, 25 bp, Rattus norvegicus
gaatggcctcattcctaggaaatat

SEQ ID NO: 310990 - DNA, 25 bp, Rattus norvegicus
gaatggcctggtcttcaaggacgct

SEQ ID NO: 310991 - DNA, 25 bp, Rattus norvegicus
gaatggcctggtgttcaaggacgct

SEQ ID NO: 310992 - DNA, 25 bp, Rattus norvegicus
gaatggccttagcttcagtgtccac

SEQ ID NO: 310993 - DNA, 25 bp, Rattus norvegicus
gaatggccttaggttcagtgtccac

SEQ ID NO: 310994 - DNA, 25 bp, Rattus norvegicus
gaatggcgaaggaccaccggccggg

SEQ ID NO: 310995 - DNA, 25 bp, Rattus norvegicus
gaatggcgaaggtccaccggccggg

SEQ ID NO: 310996 - DNA, 25 bp, Rattus norvegicus
gaatggcgcctaataaatgctgtcc

SEQ ID NO: 310997 - DNA, 25 bp, Rattus norvegicus
gaatggcgcctattaaatgctgtcc

SEQ ID NO: 310998 - DNA, 25 bp, Rattus norvegicus
gaatggcggcgacgcgcggcccggg

SEQ ID NO: 310999 - DNA, 25 bp, Rattus norvegicus
gaatggcggcgaggcgcggcccggg

SEQ ID NO: 311000 - DNA, 25 bp, Rattus norvegicus
gaatggcggctacacattccacaaa

SEQ ID NO: 311001 - DNA, 25 bp, Rattus norvegicus
gaatggcggctagacattccacaaa

SEQ ID NO: 311002 - DNA, 25 bp, Rattus norvegicus
gaatggcgtcaaagttgtcagcggc

SEQ ID NO: 311003 - DNA, 25 bp, Rattus norvegicus
gaatggcgtcaatgttgtcagcggc

SEQ ID NO: 311004 - DNA, 25 bp, Rattus norvegicus
gaatggctaagtaattttctctaca

SEQ ID NO: 311005 - DNA, 25 bp, Rattus norvegicus
gaatggctaagttattttctctaca

SEQ ID NO: 311006 - DNA, 25 bp, Rattus norvegicus
gaatggctacagcttctgctcggtt

SEQ ID NO: 311007 - DNA, 25 bp, Rattus norvegicus
gaatggctacaggttctgctcggtt

SEQ ID NO: 311008 - DNA, 25 bp, Rattus norvegicus
gaatggctacgtatccttgaacaag

SEQ ID NO: 311009 - DNA, 25 bp, Rattus norvegicus
gaatggctacgtttccttgaacaag

SEQ ID NO: 311010 - DNA, 25 bp, Rattus norvegicus
gaatggctcacgaaggttttctttt

SEQ ID NO: 311011 - DNA, 25 bp, Rattus norvegicus
gaatggctcacgtaggttttctttt

SEQ ID NO: 311012 - DNA, 25 bp, Rattus norvegicus
gaatggctcactatcactgaggatg

SEQ ID NO: 311013 - DNA, 25 bp, Rattus norvegicus
gaatggctcactttcactgaggatg

SEQ ID NO: 311014 - DNA, 25 bp, Rattus norvegicus
gaatggctcagaagcttctaagaaa

SEQ ID NO: 311015 - DNA, 25 bp, Rattus norvegicus
gaatggctcagatgcttctaagaaa

SEQ ID NO: 311016 - DNA, 25 bp, Rattus norvegicus
gaatggctcatcatgaggttgctga

SEQ ID NO: 311017 - DNA, 25 bp, Rattus norvegicus
gaatggctcatcttgaggttgctga

SEQ ID NO: 311018 - DNA, 25 bp, Rattus norvegicus
gaatggctccggagtgatccttaca

SEQ ID NO: 311019 - DNA, 25 bp, Rattus norvegicus
gaatggctccggtgtgatccttaca

SEQ ID NO: 311020 - DNA, 25 bp, Rattus norvegicus
gaatggctccttagcttagtaccat

SEQ ID NO: 311021 - DNA, 25 bp, Rattus norvegicus
gaatggctcctttgcttagtaccat

SEQ ID NO: 311022 - DNA, 25 bp, Rattus norvegicus
gaatggctcgcgcaccaggtacctt

SEQ ID NO: 311023 - DNA, 25 bp, Rattus norvegicus
gaatggctcgcggaccaggtacctt

SEQ ID NO: 311024 - DNA, 25 bp, Rattus norvegicus
gaatggctctccattcgctgcttag

SEQ ID NO: 311025 - DNA, 25 bp, Rattus norvegicus
gaatggctctcctttcgctgcttag

SEQ ID NO: 311026 - DNA, 25 bp, Rattus norvegicus
gaatggctcttcaccgtggataaat

SEQ ID NO: 311027 - DNA, 25 bp, Rattus norvegicus
gaatggctcttctccgtggataaat

SEQ ID NO: 311028 - DNA, 25 bp, Rattus norvegicus
gaatggctgcacaggcctgttctgg

SEQ ID NO: 311029 - DNA, 25 bp, Rattus norvegicus
gaatggctgcactggcctgttctgg

SEQ ID NO: 311030 - DNA, 25 bp, Rattus norvegicus
gaatggctgcccagaagaagacagt

SEQ ID NO: 311031 - DNA, 25 bp, Rattus norvegicus
gaatggctgccctgaagaagacagt

SEQ ID NO: 311032 - DNA, 25 bp, Rattus norvegicus
gaatggctggagatatcctggcccg

SEQ ID NO: 311033 - DNA, 25 bp, Rattus norvegicus
gaatggctggagttatcctggcccg

SEQ ID NO: 311034 - DNA, 25 bp, Rattus norvegicus
gaatggctggctcctgctaggaacc

SEQ ID NO: 311035 - DNA, 25 bp, Rattus norvegicus
gaatggctggctgctgctaggaacc

SEQ ID NO: 311036 - DNA, 25 bp, Rattus norvegicus
gaatggctgtacagattgcactttg

SEQ ID NO: 311037 - DNA, 25 bp, Rattus norvegicus
gaatggctgtactgattgcactttg

SEQ ID NO: 311038 - DNA, 25 bp, Rattus norvegicus
gaatggctgtcgctcatcatatcca

SEQ ID NO: 311039 - DNA, 25 bp, Rattus norvegicus
gaatggctgtcggtcatcatatcca

SEQ ID NO: 311040 - DNA, 25 bp, Rattus norvegicus
gaatggctgtgcacttgaccactaa

SEQ ID NO: 311041 - DNA, 25 bp, Rattus norvegicus
gaatggctgtgctcttgaccactaa

SEQ ID NO: 311042 - DNA, 25 bp, Rattus norvegicus
gaatggcttacaacgaacgcatgaa

SEQ ID NO: 311043 - DNA, 25 bp, Rattus norvegicus
gaatggcttacatcgaacgcatgaa

SEQ ID NO: 311044 - DNA, 25 bp, Rattus norvegicus
gaatggcttactacatgttatcaat

SEQ ID NO: 311045 - DNA, 25 bp, Rattus norvegicus
gaatggcttacttcatgttatcaat

SEQ ID NO: 311046 - DNA, 25 bp, Rattus norvegicus
gaatggcttccaatgttacagctgt

SEQ ID NO: 311047 - DNA, 25 bp, Rattus norvegicus
gaatggcttccattgttacagctgt

SEQ ID NO: 311048 - DNA, 25 bp, Rattus norvegicus
gaatggctttatatactttggtgac

SEQ ID NO: 311049 - DNA, 25 bp, Rattus norvegicus
gaatggctttatttactttggtgac

SEQ ID NO: 311050 - DNA, 25 bp, Rattus norvegicus
gaatggctttctattggccttctct

SEQ ID NO: 311051 - DNA, 25 bp, Rattus norvegicus
gaatggctttcttttggccttctct

SEQ ID NO: 311052 - DNA, 25 bp, Rattus norvegicus
gaatggcttttcagctcagtggaat

SEQ ID NO: 311053 - DNA, 25 bp, Rattus norvegicus
gaatggcttttcatttggatcagga

SEQ ID NO: 311054 - DNA, 25 bp, Rattus norvegicus
gaatggcttttctgctcagtggaat

SEQ ID NO: 311055 - DNA, 25 bp, Rattus norvegicus
gaatggcttttcttttggatcagga

SEQ ID NO: 311056 - DNA, 25 bp, Rattus norvegicus
gaatgggaagatctggcctccactc

SEQ ID NO: 311057 - DNA, 25 bp, Rattus norvegicus
gaatgggaagatgtggcctccactc

SEQ ID NO: 311058 - DNA, 25 bp, Rattus norvegicus
gaatgggaattaacaacagcctttt

SEQ ID NO: 311059 - DNA, 25 bp, Rattus norvegicus
gaatgggaattatcaacagcctttt

SEQ ID NO: 311060 - DNA, 25 bp, Rattus norvegicus
gaatgggacctgagtctggttctca

SEQ ID NO: 311061 - DNA, 25 bp, Rattus norvegicus
gaatgggacctgtgtctggttctca

SEQ ID NO: 311062 - DNA, 25 bp, Rattus norvegicus
gaatgggactgtacacctttacctg

SEQ ID NO: 311063 - DNA, 25 bp, Rattus norvegicus
gaatgggactgttcacctttacctg

SEQ ID NO: 311064 - DNA, 25 bp, Rattus norvegicus
gaatgggagataattggttttcttt

SEQ ID NO: 311065 - DNA, 25 bp, Rattus norvegicus
gaatgggagatatttggttttcttt

SEQ ID NO: 311066 - DNA, 25 bp, Rattus norvegicus
gaatgggagcttccggattgccctc

SEQ ID NO: 311067 - DNA, 25 bp, Rattus norvegicus
gaatgggagcttgcggattgccctc

SEQ ID NO: 311068 - DNA, 25 bp, Rattus norvegicus
gaatgggaggcccatgtccttctct

SEQ ID NO: 311069 - DNA, 25 bp, Rattus norvegicus
gaatgggaggccctactcacccagt

SEQ ID NO: 311070 - DNA, 25 bp, Rattus norvegicus
gaatgggaggccgatgtccttctct

SEQ ID NO: 311071 - DNA, 25 bp, Rattus norvegicus
gaatgggaggccgtactcacccagt

SEQ ID NO: 311072 - DNA, 25 bp, Rattus norvegicus
gaatgggatctgcagaaccgccagc

SEQ ID NO: 311073 - DNA, 25 bp, Rattus norvegicus
gaatgggatctggagaaccgccagc

SEQ ID NO: 311074 - DNA, 25 bp, Rattus norvegicus
gaatgggatttgacatgtgtgtgca

SEQ ID NO: 311075 - DNA, 25 bp, Rattus norvegicus
gaatgggatttgtcatgtgtgtgca

SEQ ID NO: 311076 - DNA, 25 bp, Rattus norvegicus
gaatgggattttaatggcgcctacc

SEQ ID NO: 311077 - DNA, 25 bp, Rattus norvegicus
gaatgggatttttatggcgcctacc

SEQ ID NO: 311078 - DNA, 25 bp, Rattus norvegicus
gaatgggcattgaggccccagttct

SEQ ID NO: 311079 - DNA, 25 bp, Rattus norvegicus
gaatgggcattgtggccccagttct

SEQ ID NO: 311080 - DNA, 25 bp, Rattus norvegicus
gaatgggccaagctatgacaattaa

SEQ ID NO: 311081 - DNA, 25 bp, Rattus norvegicus
gaatgggccaaggtatgacaattaa

SEQ ID NO: 311082 - DNA, 25 bp, Rattus norvegicus
gaatgggcccatcactatgagctcc

SEQ ID NO: 311083 - DNA, 25 bp, Rattus norvegicus
gaatgggcccatgactatgagctcc

SEQ ID NO: 311084 - DNA, 25 bp, Rattus norvegicus
gaatgggccccaatgtatctctggg

SEQ ID NO: 311085 - DNA, 25 bp, Rattus norvegicus
gaatgggccccattgtatctctggg

SEQ ID NO: 311086 - DNA, 25 bp, Rattus norvegicus
gaatgggccccgagatgatcaattt

SEQ ID NO: 311087 - DNA, 25 bp, Rattus norvegicus
gaatgggccccgtgatgatcaattt

SEQ ID NO: 311088 - DNA, 25 bp, Rattus norvegicus
gaatgggcctcaattagtccagggt

SEQ ID NO: 311089 - DNA, 25 bp, Rattus norvegicus
gaatgggcctcatttagtccagggt

SEQ ID NO: 311090 - DNA, 25 bp, Rattus norvegicus
gaatgggcctgtaggaaccggacaa

SEQ ID NO: 311091 - DNA, 25 bp, Rattus norvegicus
gaatgggcctgtcgcttggcattaa

SEQ ID NO: 311092 - DNA, 25 bp, Rattus norvegicus
gaatgggcctgtggcttggcattaa

SEQ ID NO: 311093 - DNA, 25 bp, Rattus norvegicus
gaatgggcctgttggaaccggacaa

SEQ ID NO: 311094 - DNA, 25 bp, Rattus norvegicus
gaatgggctacacgtacaatggacc

SEQ ID NO: 311095 - DNA, 25 bp, Rattus norvegicus
gaatgggctacaggtacaatggacc

SEQ ID NO: 311096 - DNA, 25 bp, Rattus norvegicus
gaatgggctaccatccagtgcagac

SEQ ID NO: 311097 - DNA, 25 bp, Rattus norvegicus
gaatgggctaccttccagtgcagac

SEQ ID NO: 311098 - DNA, 25 bp, Rattus norvegicus
gaatgggctcatcgaccgtccagat

SEQ ID NO: 311099 - DNA, 25 bp, Rattus norvegicus
gaatgggctcatggaccgtccagat

SEQ ID NO: 311100 - DNA, 25 bp, Rattus norvegicus
gaatgggctccactcgttataaata

SEQ ID NO: 311101 - DNA, 25 bp, Rattus norvegicus
gaatgggctccagtcgttataaata

SEQ ID NO: 311102 - DNA, 25 bp, Rattus norvegicus
gaatgggctgaactcccagcacttg

SEQ ID NO: 311103 - DNA, 25 bp, Rattus norvegicus
gaatgggctgaagtcccagcacttg

SEQ ID NO: 311104 - DNA, 25 bp, Rattus norvegicus
gaatgggctgagaatcgacaagata

SEQ ID NO: 311105 - DNA, 25 bp, Rattus norvegicus
gaatgggctgagtatcgacaagata

SEQ ID NO: 311106 - DNA, 25 bp, Rattus norvegicus
gaatgggtaaatacacaccaagtaa

SEQ ID NO: 311107 - DNA, 25 bp, Rattus norvegicus
gaatgggtaaattcacaccaagtaa

SEQ ID NO: 311108 - DNA, 25 bp, Rattus norvegicus
gaatgggtcacacctgggactccgt

SEQ ID NO: 311109 - DNA, 25 bp, Rattus norvegicus
gaatgggtcacagctgggactccgt

SEQ ID NO: 311110 - DNA, 25 bp, Rattus norvegicus
gaatgggtcctgaacacttaccata

SEQ ID NO: 311111 - DNA, 25 bp, Rattus norvegicus
gaatgggtcctgtacacttaccata

SEQ ID NO: 311112 - DNA, 25 bp, Rattus norvegicus
gaatgggtctgcctacatgtactgt

SEQ ID NO: 311113 - DNA, 25 bp, Rattus norvegicus
gaatgggtctgcgtacatgtactgt

SEQ ID NO: 311114 - DNA, 25 bp, Rattus norvegicus
gaatgggtgctaacctgtctatgtc

SEQ ID NO: 311115 - DNA, 25 bp, Rattus norvegicus
gaatgggtgctatcctgtctatgtc

SEQ ID NO: 311116 - DNA, 25 bp, Rattus norvegicus
gaatgggtgctcacagggactttag

SEQ ID NO: 311117 - DNA, 25 bp, Rattus norvegicus
gaatgggtgctctcagggactttag

SEQ ID NO: 311118 - DNA, 25 bp, Rattus norvegicus
gaatgggtggaccagaactccccag

SEQ ID NO: 311119 - DNA, 25 bp, Rattus norvegicus
gaatgggtggacgagaactccccag

SEQ ID NO: 311120 - DNA, 25 bp, Rattus norvegicus
gaatgggttatcctgcatccaacta

SEQ ID NO: 311121 - DNA, 25 bp, Rattus norvegicus
gaatgggttatcgtgcatccaacta

SEQ ID NO: 311122 - DNA, 25 bp, Rattus norvegicus
gaatgggttattacctaggcaacaa

SEQ ID NO: 311123 - DNA, 25 bp, Rattus norvegicus
gaatgggttattatctttgcctaaa

SEQ ID NO: 311124 - DNA, 25 bp, Rattus norvegicus
gaatgggttatttcctaggcaacaa

SEQ ID NO: 311125 - DNA, 25 bp, Rattus norvegicus
gaatgggttattttctttgcctaaa

SEQ ID NO: 311126 - DNA, 25 bp, Rattus norvegicus
gaatgggttcccaggctgagccagt

SEQ ID NO: 311127 - DNA, 25 bp, Rattus norvegicus
gaatgggttccctggctgagccagt

SEQ ID NO: 311128 - DNA, 25 bp, Rattus norvegicus
gaatgggttcgtccctgtcaggaaa

SEQ ID NO: 311129 - DNA, 25 bp, Rattus norvegicus
gaatgggttcgtgcctgtcaggaaa

SEQ ID NO: 311130 - DNA, 25 bp, Rattus norvegicus
gaatgggttcttcatgctttgcagc

SEQ ID NO: 311131 - DNA, 25 bp, Rattus norvegicus
gaatgggttcttgatgctttgcagc

SEQ ID NO: 311132 - DNA, 25 bp, Rattus norvegicus
gaatgggttttcattgtgaattatc

SEQ ID NO: 311133 - DNA, 25 bp, Rattus norvegicus
gaatgggttttctttgtgaattatc

SEQ ID NO: 311134 - DNA, 25 bp, Rattus norvegicus
gaatggtaaccaatagccaggccca

SEQ ID NO: 311135 - DNA, 25 bp, Rattus norvegicus
gaatggtaaccattagccaggccca

SEQ ID NO: 311136 - DNA, 25 bp, Rattus norvegicus
gaatggtaatatcttttccccttgt

SEQ ID NO: 311137 - DNA, 25 bp, Rattus norvegicus
gaatggtaatatgttttccccttgt

SEQ ID NO: 311138 - DNA, 25 bp, Rattus norvegicus
gaatggtaccctatgcatccaaatg

SEQ ID NO: 311139 - DNA, 25 bp, Rattus norvegicus
gaatggtaccctttgcatccaaatg

SEQ ID NO: 311140 - DNA, 25 bp, Rattus norvegicus
gaatggtacttcctgatgccagcat

SEQ ID NO: 311141 - DNA, 25 bp, Rattus norvegicus
gaatggtacttcgtgatgccagcat

SEQ ID NO: 311142 - DNA, 25 bp, Rattus norvegicus
gaatggtagagcaggccttccgtac

SEQ ID NO: 311143 - DNA, 25 bp, Rattus norvegicus
gaatggtagagctggccttccgtac

SEQ ID NO: 311144 - DNA, 25 bp, Rattus norvegicus
gaatggtataccagggtcctcgggt

SEQ ID NO: 311145 - DNA, 25 bp, Rattus norvegicus
gaatggtatacctgggtcctcgggt

SEQ ID NO: 311146 - DNA, 25 bp, Rattus norvegicus
gaatggtatctgaatctgctctctt

SEQ ID NO: 311147 - DNA, 25 bp, Rattus norvegicus
gaatggtatctgtatctgctctctt

SEQ ID NO: 311148 - DNA, 25 bp, Rattus norvegicus
gaatggtcaactactggaccagata

SEQ ID NO: 311149 - DNA, 25 bp, Rattus norvegicus
gaatggtcaacttctggaccagata

SEQ ID NO: 311150 - DNA, 25 bp, Rattus norvegicus
gaatggtcaatcaagtctgtctgtc

SEQ ID NO: 311151 - DNA, 25 bp, Rattus norvegicus
gaatggtcaatctagtctgtctgtc

SEQ ID NO: 311152 - DNA, 25 bp, Rattus norvegicus
gaatggtcactgatagctggtctcc

SEQ ID NO: 311153 - DNA, 25 bp, Rattus norvegicus
gaatggtcactgttagctggtctcc

SEQ ID NO: 311154 - DNA, 25 bp, Rattus norvegicus
gaatggtcagaaacctcagtgagga

SEQ ID NO: 311155 - DNA, 25 bp, Rattus norvegicus
gaatggtcagaatcctcagtgagga

SEQ ID NO: 311156 - DNA, 25 bp, Rattus norvegicus
gaatggtcaggacgccacttccaca

SEQ ID NO: 311157 - DNA, 25 bp, Rattus norvegicus
gaatggtcaggaggccacttccaca

SEQ ID NO: 311158 - DNA, 25 bp, Rattus norvegicus
gaatggtcattcatgtttatcaaca

SEQ ID NO: 311159 - DNA, 25 bp, Rattus norvegicus
gaatggtcattcttgtttatcaaca

SEQ ID NO: 311160 - DNA, 25 bp, Rattus norvegicus
gaatggtcctgtaacgtatatgaac

SEQ ID NO: 311161 - DNA, 25 bp, Rattus norvegicus
gaatggtcctgttacgtatatgaac

SEQ ID NO: 311162 - DNA, 25 bp, Rattus norvegicus
gaatggtccttcatttggaatacca

SEQ ID NO: 311163 - DNA, 25 bp, Rattus norvegicus
gaatggtccttcttttggaatacca

SEQ ID NO: 311164 - DNA, 25 bp, Rattus norvegicus
gaatggtctaaactgcctccttgat

SEQ ID NO: 311165 - DNA, 25 bp, Rattus norvegicus
gaatggtctaaagtgcctccttgat

SEQ ID NO: 311166 - DNA, 25 bp, Rattus norvegicus
gaatggtctataaccctttctcagg

SEQ ID NO: 311167 - DNA, 25 bp, Rattus norvegicus
gaatggtctatatccctttctcagg

SEQ ID NO: 311168 - DNA, 25 bp, Rattus norvegicus
gaatggtctggaacctcttcaggct

SEQ ID NO: 311169 - DNA, 25 bp, Rattus norvegicus
gaatggtctggatcctcttcaggct

SEQ ID NO: 311170 - DNA, 25 bp, Rattus norvegicus
gaatggtcttgcaattttggcctga

SEQ ID NO: 311171 - DNA, 25 bp, Rattus norvegicus
gaatggtcttgctattttggcctga

SEQ ID NO: 311172 - DNA, 25 bp, Rattus norvegicus
gaatggtcttttacatctcttttat

SEQ ID NO: 311173 - DNA, 25 bp, Rattus norvegicus
gaatggtctttttcatctcttttat

SEQ ID NO: 311174 - DNA, 25 bp, Rattus norvegicus
gaatggtgaactaacagggccttta

SEQ ID NO: 311175 - DNA, 25 bp, Rattus norvegicus
gaatggtgaacttacagggccttta

SEQ ID NO: 311176 - DNA, 25 bp, Rattus norvegicus
gaatggtgactcaatgtcctggacc

SEQ ID NO: 311177 - DNA, 25 bp, Rattus norvegicus
gaatggtgactctatgtcctggacc

SEQ ID NO: 311178 - DNA, 25 bp, Rattus norvegicus
gaatggtgaggaccctgtgccttca

SEQ ID NO: 311179 - DNA, 25 bp, Rattus norvegicus
gaatggtgaggagcctgtgccttca

SEQ ID NO: 311180 - DNA, 25 bp, Rattus norvegicus
gaatggtgcacgagtgtcacagctc

SEQ ID NO: 311181 - DNA, 25 bp, Rattus norvegicus
gaatggtgcacgtgtgtcacagctc

SEQ ID NO: 311182 - DNA, 25 bp, Rattus norvegicus
gaatggtgccaaagtccatcagtgt

SEQ ID NO: 311183 - DNA, 25 bp, Rattus norvegicus
gaatggtgccaatgtccatcagtgt

SEQ ID NO: 311184 - DNA, 25 bp, Rattus norvegicus
gaatggtgcctcacacagtgggctt

SEQ ID NO: 311185 - DNA, 25 bp, Rattus norvegicus
gaatggtgcctctcacagtgggctt

SEQ ID NO: 311186 - DNA, 25 bp, Rattus norvegicus
gaatggtgctatagtacacatcaag

SEQ ID NO: 311187 - DNA, 25 bp, Rattus norvegicus
gaatggtgctattgtacacatcaag

SEQ ID NO: 311188 - DNA, 25 bp, Rattus norvegicus
gaatggtgctcgctgttcacttgac

SEQ ID NO: 311189 - DNA, 25 bp, Rattus norvegicus
gaatggtgctcggtgttcacttgac

SEQ ID NO: 311190 - DNA, 25 bp, Rattus norvegicus
gaatggtgctttaaaccccgagcag

SEQ ID NO: 311191 - DNA, 25 bp, Rattus norvegicus
gaatggtgcttttaaccccgagcag

SEQ ID NO: 311192 - DNA, 25 bp, Rattus norvegicus
gaatggtggaacacagtattccctt

SEQ ID NO: 311193 - DNA, 25 bp, Rattus norvegicus
gaatggtggaactcagtattccctt

SEQ ID NO: 311194 - DNA, 25 bp, Rattus norvegicus
gaatggtggccgcaattccttctgc

SEQ ID NO: 311195 - DNA, 25 bp, Rattus norvegicus
gaatggtggccggaattccttctgc

SEQ ID NO: 311196 - DNA, 25 bp, Rattus norvegicus
gaatggtggctaaccaaccccaaga

SEQ ID NO: 311197 - DNA, 25 bp, Rattus norvegicus
gaatggtggctatccaaccccaaga

SEQ ID NO: 311198 - DNA, 25 bp, Rattus norvegicus
gaatggtggctcactacgactatga

SEQ ID NO: 311199 - DNA, 25 bp, Rattus norvegicus
gaatggtggctctctacgactatga

SEQ ID NO: 311200 - DNA, 25 bp, Rattus norvegicus
gaatggtggcttacactgaaaatca

SEQ ID NO: 311201 - DNA, 25 bp, Rattus norvegicus
gaatggtggctttcactgaaaatca

SEQ ID NO: 311202 - DNA, 25 bp, Rattus norvegicus
gaatggtgggttccttcacatgaaa

SEQ ID NO: 311203 - DNA, 25 bp, Rattus norvegicus
gaatggtgggttgcttcacatgaaa

SEQ ID NO: 311204 - DNA, 25 bp, Rattus norvegicus
gaatggtgtcatcagaaggccccat

SEQ ID NO: 311205 - DNA, 25 bp, Rattus norvegicus
gaatggtgtcatgagaaggccccat

SEQ ID NO: 311206 - DNA, 25 bp, Rattus norvegicus
gaatggtgtccaccctggtgcccgc

SEQ ID NO: 311207 - DNA, 25 bp, Rattus norvegicus
gaatggtgtccagcctggtgcccgc

SEQ ID NO: 311208 - DNA, 25 bp, Rattus norvegicus
gaatggtgtctaatcgcaccctttt

SEQ ID NO: 311209 - DNA, 25 bp, Rattus norvegicus
gaatggtgtctattcgcaccctttt

SEQ ID NO: 311210 - DNA, 25 bp, Rattus norvegicus
gaatggtgtctccttctagagcttc

SEQ ID NO: 311211 - DNA, 25 bp, Rattus norvegicus
gaatggtgtctcgttctagagcttc

SEQ ID NO: 311212 - DNA, 25 bp, Rattus norvegicus
gaatggtgttgccagttggctcctc

SEQ ID NO: 311213 - DNA, 25 bp, Rattus norvegicus
gaatggtgttgcgagttggctcctc

SEQ ID NO: 311214 - DNA, 25 bp, Rattus norvegicus
gaatggttacaacctaggcctccgg

SEQ ID NO: 311215 - DNA, 25 bp, Rattus norvegicus
gaatggttacaagctaggcctccgg

SEQ ID NO: 311216 - DNA, 25 bp, Rattus norvegicus
gaatggttacatacacccagtcaac

SEQ ID NO: 311217 - DNA, 25 bp, Rattus norvegicus
gaatggttacattcacccagtcaac

SEQ ID NO: 311218 - DNA, 25 bp, Rattus norvegicus
gaatggttacgtcgcagatgctctg

SEQ ID NO: 311219 - DNA, 25 bp, Rattus norvegicus
gaatggttacgtggcagatgctctg

SEQ ID NO: 311220 - DNA, 25 bp, Rattus norvegicus
gaatggttatctctagctgtcgtta

SEQ ID NO: 311221 - DNA, 25 bp, Rattus norvegicus
gaatggttatctgtagctgtcgtta

SEQ ID NO: 311222 - DNA, 25 bp, Rattus norvegicus
gaatggttcacaccaaccctatttt

SEQ ID NO: 311223 - DNA, 25 bp, Rattus norvegicus
gaatggttcacagcaaccctatttt

SEQ ID NO: 311224 - DNA, 25 bp, Rattus norvegicus
gaatggttcactagtgcatttctca

SEQ ID NO: 311225 - DNA, 25 bp, Rattus norvegicus
gaatggttcacttgtgcatttctca

SEQ ID NO: 311226 - DNA, 25 bp, Rattus norvegicus
gaatggttccacacaactaaacact

SEQ ID NO: 311227 - DNA, 25 bp, Rattus norvegicus
gaatggttccactcaactaaacact

SEQ ID NO: 311228 - DNA, 25 bp, Rattus norvegicus
gaatggttcccaataggctgacaca

SEQ ID NO: 311229 - DNA, 25 bp, Rattus norvegicus
gaatggttcccattaggctgacaca

SEQ ID NO: 311230 - DNA, 25 bp, Rattus norvegicus
gaatggttccttcgtgtggtctaac

SEQ ID NO: 311231 - DNA, 25 bp, Rattus norvegicus
gaatggttccttggtgtggtctaac

SEQ ID NO: 311232 - DNA, 25 bp, Rattus norvegicus
gaatggttcgtaagccagggatcct

SEQ ID NO: 311233 - DNA, 25 bp, Rattus norvegicus
gaatggttcgtatgccagggatcct

SEQ ID NO: 311234 - DNA, 25 bp, Rattus norvegicus
gaatggttgattctcactctgaaag

SEQ ID NO: 311235 - DNA, 25 bp, Rattus norvegicus
gaatggttgattgtcactctgaaag

SEQ ID NO: 311236 - DNA, 25 bp, Rattus norvegicus
gaatggttggacagaccacgaccca

SEQ ID NO: 311237 - DNA, 25 bp, Rattus norvegicus
gaatggttggactgaccacgaccca

SEQ ID NO: 311238 - DNA, 25 bp, Rattus norvegicus
gaatggtttacaagctggcacctgt

SEQ ID NO: 311239 - DNA, 25 bp, Rattus norvegicus
gaatggtttacatgctggcacctgt

SEQ ID NO: 311240 - DNA, 25 bp, Rattus norvegicus
gaatggtttcctacctgacttaagt

SEQ ID NO: 311241 - DNA, 25 bp, Rattus norvegicus
gaatggtttccttcctgacttaagt

SEQ ID NO: 311242 - DNA, 25 bp, Rattus norvegicus
gaatggtttcttagtatctcaaaag

SEQ ID NO: 311243 - DNA, 25 bp, Rattus norvegicus
gaatggtttctttgtatctcaaaag

SEQ ID NO: 311244 - DNA, 25 bp, Rattus norvegicus
gaatggtttgggattgtgtagaata

SEQ ID NO: 311245 - DNA, 25 bp, Rattus norvegicus
gaatggtttgggtttgtgtagaata

SEQ ID NO: 311246 - DNA, 25 bp, Rattus norvegicus
gaatggtttgtcaacctagcttgtg

SEQ ID NO: 311247 - DNA, 25 bp, Rattus norvegicus
gaatggtttgtctacctagcttgtg

SEQ ID NO: 311248 - DNA, 25 bp, Rattus norvegicus
gaatggttttcaatgcacttcttgc

SEQ ID NO: 311249 - DNA, 25 bp, Rattus norvegicus
gaatggttttcattgcacttcttgc

SEQ ID NO: 311250 - DNA, 25 bp, Rattus norvegicus
gaatggtttttcagaacatctaaac

SEQ ID NO: 311251 - DNA, 25 bp, Rattus norvegicus
gaatggtttttctgaacatctaaac

SEQ ID NO: 311252 - DNA, 25 bp, Rattus norvegicus
gaatgtaaaacaccactcagttccc

SEQ ID NO: 311253 - DNA, 25 bp, Rattus norvegicus
gaatgtaaaacagcactcagttccc

SEQ ID NO: 311254 - DNA, 25 bp, Rattus norvegicus
gaatgtaaaccaaaggctctactgt

SEQ ID NO: 311255 - DNA, 25 bp, Rattus norvegicus
gaatgtaaaccataggctctactgt

SEQ ID NO: 311256 - DNA, 25 bp, Rattus norvegicus
gaatgtaaacctacttgtactcaga

SEQ ID NO: 311257 - DNA, 25 bp, Rattus norvegicus
gaatgtaaaccttcttgtactcaga

SEQ ID NO: 311258 - DNA, 25 bp, Rattus norvegicus
gaatgtaaagttaacctggcaatca

SEQ ID NO: 311259 - DNA, 25 bp, Rattus norvegicus
gaatgtaaagtttacctggcaatca

SEQ ID NO: 311260 - DNA, 25 bp, Rattus norvegicus
gaatgtaaatatatcagctccacat

SEQ ID NO: 311261 - DNA, 25 bp, Rattus norvegicus
gaatgtaaatatttcagctccacat

SEQ ID NO: 311262 - DNA, 25 bp, Rattus norvegicus
gaatgtaaatctctttctcctggaa

SEQ ID NO: 311263 - DNA, 25 bp, Rattus norvegicus
gaatgtaaatctgtttctcctggaa

SEQ ID NO: 311264 - DNA, 25 bp, Rattus norvegicus
gaatgtaacaagaagtttcaggcca

SEQ ID NO: 311265 - DNA, 25 bp, Rattus norvegicus
gaatgtaacaagtagtttcaggcca

SEQ ID NO: 311266 - DNA, 25 bp, Rattus norvegicus
gaatgtaacccaagtaccactgaag

SEQ ID NO: 311267 - DNA, 25 bp, Rattus norvegicus
gaatgtaacccatgtaccactgaag

SEQ ID NO: 311268 - DNA, 25 bp, Rattus norvegicus
gaatgtaaccctcaatccggatccc

SEQ ID NO: 311269 - DNA, 25 bp, Rattus norvegicus
gaatgtaaccctgaatccggatccc

SEQ ID NO: 311270 - DNA, 25 bp, Rattus norvegicus
gaatgtaactctaacgtgctttgag

SEQ ID NO: 311271 - DNA, 25 bp, Rattus norvegicus
gaatgtaactcttacgtgctttgag

SEQ ID NO: 311272 - DNA, 25 bp, Rattus norvegicus
gaatgtaacttgatactgcccgccc

SEQ ID NO: 311273 - DNA, 25 bp, Rattus norvegicus
gaatgtaacttgttactgcccgccc

SEQ ID NO: 311274 - DNA, 25 bp, Rattus norvegicus
gaatgtaactttagaggatgctggg

SEQ ID NO: 311275 - DNA, 25 bp, Rattus norvegicus
gaatgtaacttttgaggatgctggg

SEQ ID NO: 311276 - DNA, 25 bp, Rattus norvegicus
gaatgtaagccccttatatttcctt

SEQ ID NO: 311277 - DNA, 25 bp, Rattus norvegicus
gaatgtaagcccgttatatttcctt

SEQ ID NO: 311278 - DNA, 25 bp, Rattus norvegicus
gaatgtaatgctctccttcggtgta

SEQ ID NO: 311279 - DNA, 25 bp, Rattus norvegicus
gaatgtaatgctgtccttcggtgta

SEQ ID NO: 311280 - DNA, 25 bp, Rattus norvegicus
gaatgtaatgttaatcaccccagca

SEQ ID NO: 311281 - DNA, 25 bp, Rattus norvegicus
gaatgtaatgtttatcaccccagca

SEQ ID NO: 311282 - DNA, 25 bp, Rattus norvegicus
gaatgtacaagtactccctatctct

SEQ ID NO: 311283 - DNA, 25 bp, Rattus norvegicus
gaatgtacaagtcgtccttctacca

SEQ ID NO: 311284 - DNA, 25 bp, Rattus norvegicus
gaatgtacaagtggtccttctacca

SEQ ID NO: 311285 - DNA, 25 bp, Rattus norvegicus
gaatgtacaagttctccctatctct

SEQ ID NO: 311286 - DNA, 25 bp, Rattus norvegicus
gaatgtacagctattgtcccagttt

SEQ ID NO: 311287 - DNA, 25 bp, Rattus norvegicus
gaatgtacagcttttgtcccagttt

SEQ ID NO: 311288 - DNA, 25 bp, Rattus norvegicus
gaatgtacataacgcctgtgaaaaa

SEQ ID NO: 311289 - DNA, 25 bp, Rattus norvegicus
gaatgtacataaggcctgtgaaaaa

SEQ ID NO: 311290 - DNA, 25 bp, Rattus norvegicus
gaatgtacatctaccacatgcctct

SEQ ID NO: 311291 - DNA, 25 bp, Rattus norvegicus
gaatgtacatcttccacatgcctct

SEQ ID NO: 311292 - DNA, 25 bp, Rattus norvegicus
gaatgtaccagcctcttcagaggca

SEQ ID NO: 311293 - DNA, 25 bp, Rattus norvegicus
gaatgtaccagcgtcttcagaggca

SEQ ID NO: 311294 - DNA, 25 bp, Rattus norvegicus
gaatgtacccgacgtggcttctgca

SEQ ID NO: 311295 - DNA, 25 bp, Rattus norvegicus
gaatgtacccgaggtggcttctgca

SEQ ID NO: 311296 - DNA, 25 bp, Rattus norvegicus
gaatgtaccctgacacagtaggtgt

SEQ ID NO: 311297 - DNA, 25 bp, Rattus norvegicus
gaatgtaccctgtcacagtaggtgt

SEQ ID NO: 311298 - DNA, 25 bp, Rattus norvegicus
gaatgtacctgtatacgtttcaaaa

SEQ ID NO: 311299 - DNA, 25 bp, Rattus norvegicus
gaatgtacctgtttacgtttcaaaa

SEQ ID NO: 311300 - DNA, 25 bp, Rattus norvegicus
gaatgtacgtagcaacccacgtgtg

SEQ ID NO: 311301 - DNA, 25 bp, Rattus norvegicus
gaatgtacgtaggaacccacgtgtg

SEQ ID NO: 311302 - DNA, 25 bp, Rattus norvegicus
gaatgtactaaaagcccctaggcgt

SEQ ID NO: 311303 - DNA, 25 bp, Rattus norvegicus
gaatgtactaaatgcccctaggcgt

SEQ ID NO: 311304 - DNA, 25 bp, Rattus norvegicus
gaatgtactccgcaagctgctgaag

SEQ ID NO: 311305 - DNA, 25 bp, Rattus norvegicus
gaatgtactccggaagctgctgaag

SEQ ID NO: 311306 - DNA, 25 bp, Rattus norvegicus
gaatgtactgctctgttcgtgctgc

SEQ ID NO: 311307 - DNA, 25 bp, Rattus norvegicus
gaatgtactgctgtgttcgtgctgc

SEQ ID NO: 311308 - DNA, 25 bp, Rattus norvegicus
gaatgtacttctatctcctggaggt

SEQ ID NO: 311309 - DNA, 25 bp, Rattus norvegicus
gaatgtacttctcgtaaggcgaaca

SEQ ID NO: 311310 - DNA, 25 bp, Rattus norvegicus
gaatgtacttctggtaaggcgaaca

SEQ ID NO: 311311 - DNA, 25 bp, Rattus norvegicus
gaatgtacttctttctcctggaggt

SEQ ID NO: 311312 - DNA, 25 bp, Rattus norvegicus
gaatgtagattcaggcgctcatgcc

SEQ ID NO: 311313 - DNA, 25 bp, Rattus norvegicus
gaatgtagattctggcgctcatgcc

SEQ ID NO: 311314 - DNA, 25 bp, Rattus norvegicus
gaatgtagccagacactgctgctgc

SEQ ID NO: 311315 - DNA, 25 bp, Rattus norvegicus
gaatgtagccagtcactgctgctgc

SEQ ID NO: 311316 - DNA, 25 bp, Rattus norvegicus
gaatgtagctcaccgtgtgtgcctg

SEQ ID NO: 311317 - DNA, 25 bp, Rattus norvegicus
gaatgtagctcactgctctgttgac

SEQ ID NO: 311318 - DNA, 25 bp, Rattus norvegicus
gaatgtagctcagcgtgtgtgcctg

SEQ ID NO: 311319 - DNA, 25 bp, Rattus norvegicus
gaatgtagctcagtgctctgttgac

SEQ ID NO: 311320 - DNA, 25 bp, Rattus norvegicus
gaatgtagctttctagcccaggaaa

SEQ ID NO: 311321 - DNA, 25 bp, Rattus norvegicus
gaatgtagctttgtagcccaggaaa

SEQ ID NO: 311322 - DNA, 25 bp, Rattus norvegicus
gaatgtagtgagcttttacgagagt

SEQ ID NO: 311323 - DNA, 25 bp, Rattus norvegicus
gaatgtagtgaggttttacgagagt

SEQ ID NO: 311324 - DNA, 25 bp, Rattus norvegicus
gaatgtatacttaatgctctctgaa

SEQ ID NO: 311325 - DNA, 25 bp, Rattus norvegicus
gaatgtatactttatgctctctgaa

SEQ ID NO: 311326 - DNA, 25 bp, Rattus norvegicus
gaatgtatagaaactccctctccac

SEQ ID NO: 311327 - DNA, 25 bp, Rattus norvegicus
gaatgtatagaatctccctctccac

SEQ ID NO: 311328 - DNA, 25 bp, Rattus norvegicus
gaatgtatatagagcaaaccctttt

SEQ ID NO: 311329 - DNA, 25 bp, Rattus norvegicus
gaatgtatatagtgcaaaccctttt

SEQ ID NO: 311330 - DNA, 25 bp, Rattus norvegicus
gaatgtatatatctccatcatgtgt

SEQ ID NO: 311331 - DNA, 25 bp, Rattus norvegicus
gaatgtatatatgtccatcatgtgt

SEQ ID NO: 311332 - DNA, 25 bp, Rattus norvegicus
gaatgtatcaacatgtatgcatgac

SEQ ID NO: 311333 - DNA, 25 bp, Rattus norvegicus
gaatgtatcaacttgtatgcatgac

SEQ ID NO: 311334 - DNA, 25 bp, Rattus norvegicus
gaatgtatccacatcagcaggactg

SEQ ID NO: 311335 - DNA, 25 bp, Rattus norvegicus
gaatgtatccacttcagcaggactg

SEQ ID NO: 311336 - DNA, 25 bp, Rattus norvegicus
gaatgtatccagattcagttacaaa

SEQ ID NO: 311337 - DNA, 25 bp, Rattus norvegicus
gaatgtatccagtttcagttacaaa

SEQ ID NO: 311338 - DNA, 25 bp, Rattus norvegicus
gaatgtatccgaccgtatgtattta

SEQ ID NO: 311339 - DNA, 25 bp, Rattus norvegicus
gaatgtatccgagcgtatgtattta

SEQ ID NO: 311340 - DNA, 25 bp, Rattus norvegicus
gaatgtatcggactttgtaagcctg

SEQ ID NO: 311341 - DNA, 25 bp, Rattus norvegicus
gaatgtatcggagtttgtaagcctg

SEQ ID NO: 311342 - DNA, 25 bp, Rattus norvegicus
gaatgtatctccatgtttactgcta

SEQ ID NO: 311343 - DNA, 25 bp, Rattus norvegicus
gaatgtatctccctgtggtactaaa

SEQ ID NO: 311344 - DNA, 25 bp, Rattus norvegicus
gaatgtatctccgtgtggtactaaa

SEQ ID NO: 311345 - DNA, 25 bp, Rattus norvegicus
gaatgtatctccttgtttactgcta

SEQ ID NO: 311346 - DNA, 25 bp, Rattus norvegicus
gaatgtatctgtcaagcctgcacaa

SEQ ID NO: 311347 - DNA, 25 bp, Rattus norvegicus
gaatgtatctgtgaagcctgcacaa

SEQ ID NO: 311348 - DNA, 25 bp, Rattus norvegicus
gaatgtatgagaccctgtgttcaat

SEQ ID NO: 311349 - DNA, 25 bp, Rattus norvegicus
gaatgtatgagagcctgtgttcaat

SEQ ID NO: 311350 - DNA, 25 bp, Rattus norvegicus
gaatgtatggttaccctgatctcag

SEQ ID NO: 311351 - DNA, 25 bp, Rattus norvegicus
gaatgtatggtttccctgatctcag

SEQ ID NO: 311352 - DNA, 25 bp, Rattus norvegicus
gaatgtatgtagatcgaggctagcc

SEQ ID NO: 311353 - DNA, 25 bp, Rattus norvegicus
gaatgtatgtagttcgaggctagcc

SEQ ID NO: 311354 - DNA, 25 bp, Rattus norvegicus
gaatgtatgttgctaaattacttgg

SEQ ID NO: 311355 - DNA, 25 bp, Rattus norvegicus
gaatgtatgttggtaaattacttgg

SEQ ID NO: 311356 - DNA, 25 bp, Rattus norvegicus
gaatgtattattcccgggcatgacc

SEQ ID NO: 311357 - DNA, 25 bp, Rattus norvegicus
gaatgtattattgccgggcatgacc

SEQ ID NO: 311358 - DNA, 25 bp, Rattus norvegicus
gaatgtattcaaaggttccctcctc

SEQ ID NO: 311359 - DNA, 25 bp, Rattus norvegicus
gaatgtattcaatggttccctcctc

SEQ ID NO: 311360 - DNA, 25 bp, Rattus norvegicus
gaatgtattccaatctctcctggtt

SEQ ID NO: 311361 - DNA, 25 bp, Rattus norvegicus
gaatgtattccattctctcctggtt

SEQ ID NO: 311362 - DNA, 25 bp, Rattus norvegicus
gaatgtattcctagatggactggag

SEQ ID NO: 311363 - DNA, 25 bp, Rattus norvegicus
gaatgtattcctcctttgggttttg

SEQ ID NO: 311364 - DNA, 25 bp, Rattus norvegicus
gaatgtattcctgctttgggttttg

SEQ ID NO: 311365 - DNA, 25 bp, Rattus norvegicus
gaatgtattccttgatggactggag

SEQ ID NO: 311366 - DNA, 25 bp, Rattus norvegicus
gaatgtattgtaccgtgtctgtgaa

SEQ ID NO: 311367 - DNA, 25 bp, Rattus norvegicus
gaatgtattgtagcgtgtctgtgaa

SEQ ID NO: 311368 - DNA, 25 bp, Rattus norvegicus
gaatgtatttatatggaaggccggg

SEQ ID NO: 311369 - DNA, 25 bp, Rattus norvegicus
gaatgtatttatttggaaggccggg

SEQ ID NO: 311370 - DNA, 25 bp, Rattus norvegicus
gaatgtatttccactgacagtctaa

SEQ ID NO: 311371 - DNA, 25 bp, Rattus norvegicus
gaatgtatttcctctgacagtctaa

SEQ ID NO: 311372 - DNA, 25 bp, Rattus norvegicus
gaatgtatttctatcgagactgaca

SEQ ID NO: 311373 - DNA, 25 bp, Rattus norvegicus
gaatgtatttctttcgagactgaca

SEQ ID NO: 311374 - DNA, 25 bp, Rattus norvegicus
gaatgtatttgtcatataactagag

SEQ ID NO: 311375 - DNA, 25 bp, Rattus norvegicus
gaatgtatttgtgatataactagag

SEQ ID NO: 311376 - DNA, 25 bp, Rattus norvegicus
gaatgtatttttcttacctcggcat

SEQ ID NO: 311377 - DNA, 25 bp, Rattus norvegicus
gaatgtatttttgttacctcggcat

SEQ ID NO: 311378 - DNA, 25 bp, Rattus norvegicus
gaatgtcaaattctctaggcccttc

SEQ ID NO: 311379 - DNA, 25 bp, Rattus norvegicus
gaatgtcaaattgtctaggcccttc

SEQ ID NO: 311380 - DNA, 25 bp, Rattus norvegicus
gaatgtcaactgctttatattaaaa

SEQ ID NO: 311381 - DNA, 25 bp, Rattus norvegicus
gaatgtcaactggtttatattaaaa

SEQ ID NO: 311382 - DNA, 25 bp, Rattus norvegicus
gaatgtcaacttagtacctcctgat

SEQ ID NO: 311383 - DNA, 25 bp, Rattus norvegicus
gaatgtcaactttgtacctcctgat

SEQ ID NO: 311384 - DNA, 25 bp, Rattus norvegicus
gaatgtcaagctcagaacttcatgc

SEQ ID NO: 311385 - DNA, 25 bp, Rattus norvegicus
gaatgtcaagctgagaacttcatgc

SEQ ID NO: 311386 - DNA, 25 bp, Rattus norvegicus
gaatgtcaatagcaaatgttcactt

SEQ ID NO: 311387 - DNA, 25 bp, Rattus norvegicus
gaatgtcaataggaaatgttcactt

SEQ ID NO: 311388 - DNA, 25 bp, Rattus norvegicus
gaatgtcacagaacagcagcctgga

SEQ ID NO: 311389 - DNA, 25 bp, Rattus norvegicus
gaatgtcacagatcagcagcctgga

SEQ ID NO: 311390 - DNA, 25 bp, Rattus norvegicus
gaatgtcaccatagcagttgtagct

SEQ ID NO: 311391 - DNA, 25 bp, Rattus norvegicus
gaatgtcaccataggctcggtgtct

SEQ ID NO: 311392 - DNA, 25 bp, Rattus norvegicus
gaatgtcaccatatttcttcgttgt

SEQ ID NO: 311393 - DNA, 25 bp, Rattus norvegicus
gaatgtcaccattgcagttgtagct

SEQ ID NO: 311394 - DNA, 25 bp, Rattus norvegicus
gaatgtcaccattggctcggtgtct

SEQ ID NO: 311395 - DNA, 25 bp, Rattus norvegicus
gaatgtcaccatttttcttcgttgt

SEQ ID NO: 311396 - DNA, 25 bp, Rattus norvegicus
gaatgtcacgctacacaggtgcaac

SEQ ID NO: 311397 - DNA, 25 bp, Rattus norvegicus
gaatgtcacgcttcacaggtgcaac

SEQ ID NO: 311398 - DNA, 25 bp, Rattus norvegicus
gaatgtcactgaacatttctgccca

SEQ ID NO: 311399 - DNA, 25 bp, Rattus norvegicus
gaatgtcactgatcatttctgccca

SEQ ID NO: 311400 - DNA, 25 bp, Rattus norvegicus
gaatgtcactgtagtgaacacaggc

SEQ ID NO: 311401 - DNA, 25 bp, Rattus norvegicus
gaatgtcactgttgtgaacacaggc

SEQ ID NO: 311402 - DNA, 25 bp, Rattus norvegicus
gaatgtcagatcctctgcaactgga

SEQ ID NO: 311403 - DNA, 25 bp, Rattus norvegicus
gaatgtcagatcgtctgcaactgga

SEQ ID NO: 311404 - DNA, 25 bp, Rattus norvegicus
gaatgtcagcacctgcaggtttggt

SEQ ID NO: 311405 - DNA, 25 bp, Rattus norvegicus
gaatgtcagcacgtgcaggtttggt

SEQ ID NO: 311406 - DNA, 25 bp, Rattus norvegicus
gaatgtcagctacagctctggtggt

SEQ ID NO: 311407 - DNA, 25 bp, Rattus norvegicus
gaatgtcagctagagctctggtggt

SEQ ID NO: 311408 - DNA, 25 bp, Rattus norvegicus
gaatgtcagggtattcagttagaaa

SEQ ID NO: 311409 - DNA, 25 bp, Rattus norvegicus
gaatgtcagggttttcagttagaaa

SEQ ID NO: 311410 - DNA, 25 bp, Rattus norvegicus
gaatgtcagtttcagcgtcagcaga

SEQ ID NO: 311411 - DNA, 25 bp, Rattus norvegicus
gaatgtcagtttgagcgtcagcaga

SEQ ID NO: 311412 - DNA, 25 bp, Rattus norvegicus
gaatgtcatcaacctaagtatctgt

SEQ ID NO: 311413 - DNA, 25 bp, Rattus norvegicus
gaatgtcatcaagctaagtatctgt

SEQ ID NO: 311414 - DNA, 25 bp, Rattus norvegicus
gaatgtcatccaaatgctacacgct

SEQ ID NO: 311415 - DNA, 25 bp, Rattus norvegicus
gaatgtcatccatatgctacacgct

SEQ ID NO: 311416 - DNA, 25 bp, Rattus norvegicus
gaatgtcatccccagtgaataggca

SEQ ID NO: 311417 - DNA, 25 bp, Rattus norvegicus
gaatgtcatcccgagtgaataggca

SEQ ID NO: 311418 - DNA, 25 bp, Rattus norvegicus
gaatgtcatcttaattgctacatca

SEQ ID NO: 311419 - DNA, 25 bp, Rattus norvegicus
gaatgtcatcttccacaaagggctc

SEQ ID NO: 311420 - DNA, 25 bp, Rattus norvegicus
gaatgtcatcttctgacacaccctt

SEQ ID NO: 311421 - DNA, 25 bp, Rattus norvegicus
gaatgtcatcttgcacaaagggctc

SEQ ID NO: 311422 - DNA, 25 bp, Rattus norvegicus
gaatgtcatcttgtgacacaccctt

SEQ ID NO: 311423 - DNA, 25 bp, Rattus norvegicus
gaatgtcatctttattgctacatca

SEQ ID NO: 311424 - DNA, 25 bp, Rattus norvegicus
gaatgtcatgcacacggtggaccat

SEQ ID NO: 311425 - DNA, 25 bp, Rattus norvegicus
gaatgtcatgcagacggtggaccat

SEQ ID NO: 311426 - DNA, 25 bp, Rattus norvegicus
gaatgtcatgtaatccttggaggaa

SEQ ID NO: 311427 - DNA, 25 bp, Rattus norvegicus
gaatgtcatgtattccttggaggaa

SEQ ID NO: 311428 - DNA, 25 bp, Rattus norvegicus
gaatgtcatgttagagtttccccac

SEQ ID NO: 311429 - DNA, 25 bp, Rattus norvegicus
gaatgtcatgtttgagtttccccac

SEQ ID NO: 311430 - DNA, 25 bp, Rattus norvegicus
gaatgtcatttactgctgcagacca

SEQ ID NO: 311431 - DNA, 25 bp, Rattus norvegicus
gaatgtcatttagtgctgcagacca

SEQ ID NO: 311432 - DNA, 25 bp, Rattus norvegicus
gaatgtccaaacctccagccaatat

SEQ ID NO: 311433 - DNA, 25 bp, Rattus norvegicus
gaatgtccaaacgtccagccaatat

SEQ ID NO: 311434 - DNA, 25 bp, Rattus norvegicus
gaatgtccaacacttcacttgtgta

SEQ ID NO: 311435 - DNA, 25 bp, Rattus norvegicus
gaatgtccaacagttcacttgtgta

SEQ ID NO: 311436 - DNA, 25 bp, Rattus norvegicus
gaatgtccacatccaggttattttc

SEQ ID NO: 311437 - DNA, 25 bp, Rattus norvegicus
gaatgtccacatgcaggttattttc

SEQ ID NO: 311438 - DNA, 25 bp, Rattus norvegicus
gaatgtccagacacatcacagattg

SEQ ID NO: 311439 - DNA, 25 bp, Rattus norvegicus
gaatgtccagactcatcacagattg

SEQ ID NO: 311440 - DNA, 25 bp, Rattus norvegicus
gaatgtccagagctgctgtgtatca

SEQ ID NO: 311441 - DNA, 25 bp, Rattus norvegicus
gaatgtccagaggtgctgtgtatca

SEQ ID NO: 311442 - DNA, 25 bp, Rattus norvegicus
gaatgtccaggcaagttctctacca

SEQ ID NO: 311443 - DNA, 25 bp, Rattus norvegicus
gaatgtccaggctagttctctacca

SEQ ID NO: 311444 - DNA, 25 bp, Rattus norvegicus
gaatgtcccaagctggtaccggtgt

SEQ ID NO: 311445 - DNA, 25 bp, Rattus norvegicus
gaatgtcccaaggtggtaccggtgt

SEQ ID NO: 311446 - DNA, 25 bp, Rattus norvegicus
gaatgtcccagaaccagacagcatt

SEQ ID NO: 311447 - DNA, 25 bp, Rattus norvegicus
gaatgtcccagatccagacagcatt

SEQ ID NO: 311448 - DNA, 25 bp, Rattus norvegicus
gaatgtcccagtctcaaaccttaga

SEQ ID NO: 311449 - DNA, 25 bp, Rattus norvegicus
gaatgtcccagtgtcaaaccttaga

SEQ ID NO: 311450 - DNA, 25 bp, Rattus norvegicus
gaatgtcccctaagtatttgtacgc

SEQ ID NO: 311451 - DNA, 25 bp, Rattus norvegicus
gaatgtcccctatgtatttgtacgc

SEQ ID NO: 311452 - DNA, 25 bp, Rattus norvegicus
gaatgtcccggacccatagtaacca

SEQ ID NO: 311453 - DNA, 25 bp, Rattus norvegicus
gaatgtcccggagccatagtaacca

SEQ ID NO: 311454 - DNA, 25 bp, Rattus norvegicus
gaatgtccctccatagtaaataaat

SEQ ID NO: 311455 - DNA, 25 bp, Rattus norvegicus
gaatgtccctccttagtaaataaat

SEQ ID NO: 311456 - DNA, 25 bp, Rattus norvegicus
gaatgtccctgaactttcagatagt

SEQ ID NO: 311457 - DNA, 25 bp, Rattus norvegicus
gaatgtccctgatctttcagatagt

SEQ ID NO: 311458 - DNA, 25 bp, Rattus norvegicus
gaatgtccctgtagaaaatcctggt

SEQ ID NO: 311459 - DNA, 25 bp, Rattus norvegicus
gaatgtccctgttgaaaatcctggt

SEQ ID NO: 311460 - DNA, 25 bp, Rattus norvegicus
gaatgtcccttccaacttttatatt

SEQ ID NO: 311461 - DNA, 25 bp, Rattus norvegicus
gaatgtcccttcgaacttttatatt

SEQ ID NO: 311462 - DNA, 25 bp, Rattus norvegicus
gaatgtccgacgacttcttctgaaa

SEQ ID NO: 311463 - DNA, 25 bp, Rattus norvegicus
gaatgtccgacgtcttcttctgaaa

SEQ ID NO: 311464 - DNA, 25 bp, Rattus norvegicus
gaatgtccgtagcttagccagtttt

SEQ ID NO: 311465 - DNA, 25 bp, Rattus norvegicus
gaatgtccgtaggttagccagtttt

SEQ ID NO: 311466 - DNA, 25 bp, Rattus norvegicus
gaatgtcctattacctgtgtctgct

SEQ ID NO: 311467 - DNA, 25 bp, Rattus norvegicus
gaatgtcctatttcctgtgtctgct

SEQ ID NO: 311468 - DNA, 25 bp, Rattus norvegicus
gaatgtcctgcgaatccagtgtctt

SEQ ID NO: 311469 - DNA, 25 bp, Rattus norvegicus
gaatgtcctgcgtatccagtgtctt

SEQ ID NO: 311470 - DNA, 25 bp, Rattus norvegicus
gaatgtcctgtgagttctcgggttg

SEQ ID NO: 311471 - DNA, 25 bp, Rattus norvegicus
gaatgtcctgtgtgttctcgggttg

SEQ ID NO: 311472 - DNA, 25 bp, Rattus norvegicus
gaatgtccttttctgtaggcactac

SEQ ID NO: 311473 - DNA, 25 bp, Rattus norvegicus
gaatgtccttttgtgtaggcactac

SEQ ID NO: 311474 - DNA, 25 bp, Rattus norvegicus
gaatgtcgagagacgttacctctgt

SEQ ID NO: 311475 - DNA, 25 bp, Rattus norvegicus
gaatgtcgagagtcgttacctctgt

SEQ ID NO: 311476 - DNA, 25 bp, Rattus norvegicus
gaatgtcgattcactttagatgata

SEQ ID NO: 311477 - DNA, 25 bp, Rattus norvegicus
gaatgtcgattctctttagatgata

SEQ ID NO: 311478 - DNA, 25 bp, Rattus norvegicus
gaatgtcgcattacagtctgatcag

SEQ ID NO: 311479 - DNA, 25 bp, Rattus norvegicus
gaatgtcgcatttcagtctgatcag

SEQ ID NO: 311480 - DNA, 25 bp, Rattus norvegicus
gaatgtcggcctcagtcggacccta

SEQ ID NO: 311481 - DNA, 25 bp, Rattus norvegicus
gaatgtcggcctgagtcggacccta

SEQ ID NO: 311482 - DNA, 25 bp, Rattus norvegicus
gaatgtcgtattcaagtcgcactag

SEQ ID NO: 311483 - DNA, 25 bp, Rattus norvegicus
gaatgtcgtattgaagtcgcactag

SEQ ID NO: 311484 - DNA, 25 bp, Rattus norvegicus
gaatgtcgtgacacagagcaaagac

SEQ ID NO: 311485 - DNA, 25 bp, Rattus norvegicus
gaatgtcgtgactcagagcaaagac

SEQ ID NO: 311486 - DNA, 25 bp, Rattus norvegicus
gaatgtctaaccatgtttaaaatct

SEQ ID NO: 311487 - DNA, 25 bp, Rattus norvegicus
gaatgtctaaccttgtttaaaatct

SEQ ID NO: 311488 - DNA, 25 bp, Rattus norvegicus
gaatgtctaattaccagtggtgttg

SEQ ID NO: 311489 - DNA, 25 bp, Rattus norvegicus
gaatgtctaatttccagtggtgttg

SEQ ID NO: 311490 - DNA, 25 bp, Rattus norvegicus
gaatgtctacaccagatcggttccg

SEQ ID NO: 311491 - DNA, 25 bp, Rattus norvegicus
gaatgtctacacgagatcggttccg

SEQ ID NO: 311492 - DNA, 25 bp, Rattus norvegicus
gaatgtctacatcaggctgctgtct

SEQ ID NO: 311493 - DNA, 25 bp, Rattus norvegicus
gaatgtctacatgaggctgctgtct

SEQ ID NO: 311494 - DNA, 25 bp, Rattus norvegicus
gaatgtctactacgtgccaggttgt

SEQ ID NO: 311495 - DNA, 25 bp, Rattus norvegicus
gaatgtctactaggtgccaggttgt

SEQ ID NO: 311496 - DNA, 25 bp, Rattus norvegicus
gaatgtctatcgaacgacctgtctt

SEQ ID NO: 311497 - DNA, 25 bp, Rattus norvegicus
gaatgtctatcgtacgacctgtctt

SEQ ID NO: 311498 - DNA, 25 bp, Rattus norvegicus
gaatgtctcaacaattcccagaaga

SEQ ID NO: 311499 - DNA, 25 bp, Rattus norvegicus
gaatgtctcaactattcccagaaga

SEQ ID NO: 311500 - DNA, 25 bp, Rattus norvegicus
gaatgtctcagaaggccagcttctt

SEQ ID NO: 311501 - DNA, 25 bp, Rattus norvegicus
gaatgtctcagatggccagcttctt

SEQ ID NO: 311502 - DNA, 25 bp, Rattus norvegicus
gaatgtctcattagtatctctgctt

SEQ ID NO: 311503 - DNA, 25 bp, Rattus norvegicus
gaatgtctcatttgtatctctgctt

SEQ ID NO: 311504 - DNA, 25 bp, Rattus norvegicus
gaatgtctccgactctctgaattca

SEQ ID NO: 311505 - DNA, 25 bp, Rattus norvegicus
gaatgtctccgagtctctgaattca

SEQ ID NO: 311506 - DNA, 25 bp, Rattus norvegicus
gaatgtctcggtcctagtccaggta

SEQ ID NO: 311507 - DNA, 25 bp, Rattus norvegicus
gaatgtctcggtgctagtccaggta

SEQ ID NO: 311508 - DNA, 25 bp, Rattus norvegicus
gaatgtctctaacaactcagtaatt

SEQ ID NO: 311509 - DNA, 25 bp, Rattus norvegicus
gaatgtctctaagaactcagtaatt

SEQ ID NO: 311510 - DNA, 25 bp, Rattus norvegicus
gaatgtctctgaccgtaaggctgaa

SEQ ID NO: 311511 - DNA, 25 bp, Rattus norvegicus
gaatgtctctgagcgtaaggctgaa

SEQ ID NO: 311512 - DNA, 25 bp, Rattus norvegicus
gaatgtctctggcaatttttgtagc

SEQ ID NO: 311513 - DNA, 25 bp, Rattus norvegicus
gaatgtctctgggaatttttgtagc

SEQ ID NO: 311514 - DNA, 25 bp, Rattus norvegicus
gaatgtctcttccatctctagaaag

SEQ ID NO: 311515 - DNA, 25 bp, Rattus norvegicus
gaatgtctcttcgatctctagaaag

SEQ ID NO: 311516 - DNA, 25 bp, Rattus norvegicus
gaatgtctgcaaatcactgccaatg

SEQ ID NO: 311517 - DNA, 25 bp, Rattus norvegicus
gaatgtctgcaattcactgccaatg

SEQ ID NO: 311518 - DNA, 25 bp, Rattus norvegicus
gaatgtctgcctcccaccatgagtg

SEQ ID NO: 311519 - DNA, 25 bp, Rattus norvegicus
gaatgtctgcctgccaccatgagtg

SEQ ID NO: 311520 - DNA, 25 bp, Rattus norvegicus
gaatgtctgcgactcaccgacaata

SEQ ID NO: 311521 - DNA, 25 bp, Rattus norvegicus
gaatgtctgcgagtcaccgacaata

SEQ ID NO: 311522 - DNA, 25 bp, Rattus norvegicus
gaatgtctgctcatgtgaccagctg

SEQ ID NO: 311523 - DNA, 25 bp, Rattus norvegicus
gaatgtctgctcttgtgaccagctg

SEQ ID NO: 311524 - DNA, 25 bp, Rattus norvegicus
gaatgtctgtagagatgggccccac

SEQ ID NO: 311525 - DNA, 25 bp, Rattus norvegicus
gaatgtctgtagtgatgggccccac

SEQ ID NO: 311526 - DNA, 25 bp, Rattus norvegicus
gaatgtctgtccacgtcctgaatga

SEQ ID NO: 311527 - DNA, 25 bp, Rattus norvegicus
gaatgtctgtccatctggctaaaga

SEQ ID NO: 311528 - DNA, 25 bp, Rattus norvegicus
gaatgtctgtcctcgtcctgaatga

SEQ ID NO: 311529 - DNA, 25 bp, Rattus norvegicus
gaatgtctgtccttctggctaaaga

SEQ ID NO: 311530 - DNA, 25 bp, Rattus norvegicus
gaatgtctgttgagtgacttcctga

SEQ ID NO: 311531 - DNA, 25 bp, Rattus norvegicus
gaatgtctgttgtgtgacttcctga

SEQ ID NO: 311532 - DNA, 25 bp, Rattus norvegicus
gaatgtcttaaaaatagtcctgtgt

SEQ ID NO: 311533 - DNA, 25 bp, Rattus norvegicus
gaatgtcttaaatatagtcctgtgt

SEQ ID NO: 311534 - DNA, 25 bp, Rattus norvegicus
gaatgtcttaatatgtgactttctt

SEQ ID NO: 311535 - DNA, 25 bp, Rattus norvegicus
gaatgtcttaatttgtgactttctt

SEQ ID NO: 311536 - DNA, 25 bp, Rattus norvegicus
gaatgtcttcacaacagctgctgga

SEQ ID NO: 311537 - DNA, 25 bp, Rattus norvegicus
gaatgtcttcactacagctgctgga

SEQ ID NO: 311538 - DNA, 25 bp, Rattus norvegicus
gaatgtcttcttaaaaaaccaggca

SEQ ID NO: 311539 - DNA, 25 bp, Rattus norvegicus
gaatgtcttcttcgcctgatggtta

SEQ ID NO: 311540 - DNA, 25 bp, Rattus norvegicus
gaatgtcttcttggcctgatggtta

SEQ ID NO: 311541 - DNA, 25 bp, Rattus norvegicus
gaatgtcttctttaaaaaccaggca

SEQ ID NO: 311542 - DNA, 25 bp, Rattus norvegicus
gaatgtcttgtaacgctttcaacag

SEQ ID NO: 311543 - DNA, 25 bp, Rattus norvegicus
gaatgtcttgtatcgctttcaacag

SEQ ID NO: 311544 - DNA, 25 bp, Rattus norvegicus
gaatgtcttgttcctgcgtctgaga

SEQ ID NO: 311545 - DNA, 25 bp, Rattus norvegicus
gaatgtcttgttgctgcgtctgaga

SEQ ID NO: 311546 - DNA, 25 bp, Rattus norvegicus
gaatgtctttcaacacctgaacctc

SEQ ID NO: 311547 - DNA, 25 bp, Rattus norvegicus
gaatgtctttcatcacctgaacctc

SEQ ID NO: 311548 - DNA, 25 bp, Rattus norvegicus
gaatgtctttctagtcttcagaagc

SEQ ID NO: 311549 - DNA, 25 bp, Rattus norvegicus
gaatgtctttcttgtcttcagaagc

SEQ ID NO: 311550 - DNA, 25 bp, Rattus norvegicus
gaatgtcttttcacttgcaaagggc

SEQ ID NO: 311551 - DNA, 25 bp, Rattus norvegicus
gaatgtcttttctcttgcaaagggc

SEQ ID NO: 311552 - DNA, 25 bp, Rattus norvegicus
gaatgtcttttgacagacggttaga

SEQ ID NO: 311553 - DNA, 25 bp, Rattus norvegicus
gaatgtcttttgtcagacggttaga

SEQ ID NO: 311554 - DNA, 25 bp, Rattus norvegicus
gaatgtgaaggcagaacaccccaga

SEQ ID NO: 311555 - DNA, 25 bp, Rattus norvegicus
gaatgtgaaggctgaacaccccaga

SEQ ID NO: 311556 - DNA, 25 bp, Rattus norvegicus
gaatgtgaatttcggacatcccctt

SEQ ID NO: 311557 - DNA, 25 bp, Rattus norvegicus
gaatgtgaatttgggacatcccctt

SEQ ID NO: 311558 - DNA, 25 bp, Rattus norvegicus
gaatgtgacactcaaagtttacctg

SEQ ID NO: 311559 - DNA, 25 bp, Rattus norvegicus
gaatgtgacactgaaagtttacctg

SEQ ID NO: 311560 - DNA, 25 bp, Rattus norvegicus
gaatgtgaccagagagcccagccct

SEQ ID NO: 311561 - DNA, 25 bp, Rattus norvegicus
gaatgtgaccagtgagcccagccct

SEQ ID NO: 311562 - DNA, 25 bp, Rattus norvegicus
gaatgtgaccctacgcttaagagtc

SEQ ID NO: 311563 - DNA, 25 bp, Rattus norvegicus
gaatgtgacccttcgcttaagagtc

SEQ ID NO: 311564 - DNA, 25 bp, Rattus norvegicus
gaatgtgactaaatacttggtccta

SEQ ID NO: 311565 - DNA, 25 bp, Rattus norvegicus
gaatgtgactaattacttggtccta

SEQ ID NO: 311566 - DNA, 25 bp, Rattus norvegicus
gaatgtgactctctggccagtttat

SEQ ID NO: 311567 - DNA, 25 bp, Rattus norvegicus
gaatgtgactctgtggccagtttat

SEQ ID NO: 311568 - DNA, 25 bp, Rattus norvegicus
gaatgtgacttaacgccacggtgga

SEQ ID NO: 311569 - DNA, 25 bp, Rattus norvegicus
gaatgtgacttatcgccacggtgga

SEQ ID NO: 311570 - DNA, 25 bp, Rattus norvegicus
gaatgtgagcagagccgttacccaa

SEQ ID NO: 311571 - DNA, 25 bp, Rattus norvegicus
gaatgtgagcagtgccgttacccaa

SEQ ID NO: 311572 - DNA, 25 bp, Rattus norvegicus
gaatgtgagctccaacttaagtgtt

SEQ ID NO: 311573 - DNA, 25 bp, Rattus norvegicus
gaatgtgagctcgaacttaagtgtt

SEQ ID NO: 311574 - DNA, 25 bp, Rattus norvegicus
gaatgtgagggcatcaccctgttcc

SEQ ID NO: 311575 - DNA, 25 bp, Rattus norvegicus
gaatgtgagggcttcaccctgttcc

SEQ ID NO: 311576 - DNA, 25 bp, Rattus norvegicus
gaatgtgatggcagaatccttcccg

SEQ ID NO: 311577 - DNA, 25 bp, Rattus norvegicus
gaatgtgatggctgaatccttcccg

SEQ ID NO: 311578 - DNA, 25 bp, Rattus norvegicus
gaatgtgattccaatgccctctttc

SEQ ID NO: 311579 - DNA, 25 bp, Rattus norvegicus
gaatgtgattcctatgccctctttc

SEQ ID NO: 311580 - DNA, 25 bp, Rattus norvegicus
gaatgtgattctattggacttactc

SEQ ID NO: 311581 - DNA, 25 bp, Rattus norvegicus
gaatgtgattctcctgtgctttctc

SEQ ID NO: 311582 - DNA, 25 bp, Rattus norvegicus
gaatgtgattctgctgtgctttctc

SEQ ID NO: 311583 - DNA, 25 bp, Rattus norvegicus
gaatgtgattcttttggacttactc

SEQ ID NO: 311584 - DNA, 25 bp, Rattus norvegicus
gaatgtgcacatccacgcatgctct

SEQ ID NO: 311585 - DNA, 25 bp, Rattus norvegicus
gaatgtgcacatcttcagcattaat

SEQ ID NO: 311586 - DNA, 25 bp, Rattus norvegicus
gaatgtgcacatgcacgcatgctct

SEQ ID NO: 311587 - DNA, 25 bp, Rattus norvegicus
gaatgtgcacatgttcagcattaat

SEQ ID NO: 311588 - DNA, 25 bp, Rattus norvegicus
gaatgtgcagctatgtgcatccgag

SEQ ID NO: 311589 - DNA, 25 bp, Rattus norvegicus
gaatgtgcagctttgtgcatccgag

SEQ ID NO: 311590 - DNA, 25 bp, Rattus norvegicus
gaatgtgcaggaaacccacaccata

SEQ ID NO: 311591 - DNA, 25 bp, Rattus norvegicus
gaatgtgcaggatacccacaccata

SEQ ID NO: 311592 - DNA, 25 bp, Rattus norvegicus
gaatgtgcagttcctgttcagtctg

SEQ ID NO: 311593 - DNA, 25 bp, Rattus norvegicus
gaatgtgcagttgctgttcagtctg

SEQ ID NO: 311594 - DNA, 25 bp, Rattus norvegicus
gaatgtgcatgtcatttatcagcat

SEQ ID NO: 311595 - DNA, 25 bp, Rattus norvegicus
gaatgtgcatgtgatttatcagcat

SEQ ID NO: 311596 - DNA, 25 bp, Rattus norvegicus
gaatgtgccagtaaaagtgctcaac

SEQ ID NO: 311597 - DNA, 25 bp, Rattus norvegicus
gaatgtgccagttaaagtgctcaac

SEQ ID NO: 311598 - DNA, 25 bp, Rattus norvegicus
gaatgtgccattccagtaccacttg

SEQ ID NO: 311599 - DNA, 25 bp, Rattus norvegicus
gaatgtgccattgcagtaccacttg

SEQ ID NO: 311600 - DNA, 25 bp, Rattus norvegicus
gaatgtgccctaacgtctaagaaat

SEQ ID NO: 311601 - DNA, 25 bp, Rattus norvegicus
gaatgtgccctaatttgttggatga

SEQ ID NO: 311602 - DNA, 25 bp, Rattus norvegicus
gaatgtgccctatcgtctaagaaat

SEQ ID NO: 311603 - DNA, 25 bp, Rattus norvegicus
gaatgtgccctattttgttggatga

SEQ ID NO: 311604 - DNA, 25 bp, Rattus norvegicus
gaatgtgccctcagtcttagaagtc

SEQ ID NO: 311605 - DNA, 25 bp, Rattus norvegicus
gaatgtgccctctgtcttagaagtc

SEQ ID NO: 311606 - DNA, 25 bp, Rattus norvegicus
gaatgtgcccttaatttacgttaag

SEQ ID NO: 311607 - DNA, 25 bp, Rattus norvegicus
gaatgtgccctttatttacgttaag

SEQ ID NO: 311608 - DNA, 25 bp, Rattus norvegicus
gaatgtgccgcgatttgttttcaat

SEQ ID NO: 311609 - DNA, 25 bp, Rattus norvegicus
gaatgtgccgcgttttgttttcaat

SEQ ID NO: 311610 - DNA, 25 bp, Rattus norvegicus
gaatgtgcctatcttttcacttggt

SEQ ID NO: 311611 - DNA, 25 bp, Rattus norvegicus
gaatgtgcctatgttttcacttggt

SEQ ID NO: 311612 - DNA, 25 bp, Rattus norvegicus
gaatgtgccttcaacaccagtcgag

SEQ ID NO: 311613 - DNA, 25 bp, Rattus norvegicus
gaatgtgccttctacaccagtcgag

SEQ ID NO: 311614 - DNA, 25 bp, Rattus norvegicus
gaatgtgcgccacaggaacgccacc

SEQ ID NO: 311615 - DNA, 25 bp, Rattus norvegicus
gaatgtgcgccagaggaacgccacc

SEQ ID NO: 311616 - DNA, 25 bp, Rattus norvegicus
gaatgtgctactcaatgacttagac

SEQ ID NO: 311617 - DNA, 25 bp, Rattus norvegicus
gaatgtgctactgaatgacttagac

SEQ ID NO: 311618 - DNA, 25 bp, Rattus norvegicus
gaatgtgctgctaccaatgtcaaaa

SEQ ID NO: 311619 - DNA, 25 bp, Rattus norvegicus
gaatgtgctgcttccaatgtcaaaa

SEQ ID NO: 311620 - DNA, 25 bp, Rattus norvegicus
gaatgtgctgtcctacagtgggcct

SEQ ID NO: 311621 - DNA, 25 bp, Rattus norvegicus
gaatgtgctgtcgtacagtgggcct

SEQ ID NO: 311622 - DNA, 25 bp, Rattus norvegicus
gaatgtggaagcctgccatgtagac

SEQ ID NO: 311623 - DNA, 25 bp, Rattus norvegicus
gaatgtggaagcgtgccatgtagac

SEQ ID NO: 311624 - DNA, 25 bp, Rattus norvegicus
gaatgtggacatcacccgtgaagct

SEQ ID NO: 311625 - DNA, 25 bp, Rattus norvegicus
gaatgtggacatgacccgtgaagct

SEQ ID NO: 311626 - DNA, 25 bp, Rattus norvegicus
gaatgtggacccaaaggcaaacctt

SEQ ID NO: 311627 - DNA, 25 bp, Rattus norvegicus
gaatgtggaccctaaggcaaacctt

SEQ ID NO: 311628 - DNA, 25 bp, Rattus norvegicus
gaatgtggagcccaggtcttcctcg

SEQ ID NO: 311629 - DNA, 25 bp, Rattus norvegicus
gaatgtggagccgaggtcttcctcg

SEQ ID NO: 311630 - DNA, 25 bp, Rattus norvegicus
gaatgtggagttcaatagtcctcaa

SEQ ID NO: 311631 - DNA, 25 bp, Rattus norvegicus
gaatgtggagttgaatagtcctcaa

SEQ ID NO: 311632 - DNA, 25 bp, Rattus norvegicus
gaatgtggcaaaacctttacgcaaa

SEQ ID NO: 311633 - DNA, 25 bp, Rattus norvegicus
gaatgtggcaaacacttcaacaaca

SEQ ID NO: 311634 - DNA, 25 bp, Rattus norvegicus
gaatgtggcaaagacttcaacaaca

SEQ ID NO: 311635 - DNA, 25 bp, Rattus norvegicus
gaatgtggcaaatcctttacgcaaa

SEQ ID NO: 311636 - DNA, 25 bp, Rattus norvegicus
gaatgtggcaacatgcttgtgccta

SEQ ID NO: 311637 - DNA, 25 bp, Rattus norvegicus
gaatgtggcaacttgcttgtgccta

SEQ ID NO: 311638 - DNA, 25 bp, Rattus norvegicus
gaatgtggcaatctccgtgtaaggt

SEQ ID NO: 311639 - DNA, 25 bp, Rattus norvegicus
gaatgtggcaatgtccgtgtaaggt

SEQ ID NO: 311640 - DNA, 25 bp, Rattus norvegicus
gaatgtggccagcattatccagcaa

SEQ ID NO: 311641 - DNA, 25 bp, Rattus norvegicus
gaatgtggccaggattatccagcaa

SEQ ID NO: 311642 - DNA, 25 bp, Rattus norvegicus
gaatgtggccgtccctttagaaaga

SEQ ID NO: 311643 - DNA, 25 bp, Rattus norvegicus
gaatgtggccgtgcctttagaaaga

SEQ ID NO: 311644 - DNA, 25 bp, Rattus norvegicus
gaatgtggcctaaggacctacccag

SEQ ID NO: 311645 - DNA, 25 bp, Rattus norvegicus
gaatgtggcctatggacctacccag

SEQ ID NO: 311646 - DNA, 25 bp, Rattus norvegicus
gaatgtggccttcctaatgatgtcc

SEQ ID NO: 311647 - DNA, 25 bp, Rattus norvegicus
gaatgtggccttgctaatgatgtcc

SEQ ID NO: 311648 - DNA, 25 bp, Rattus norvegicus
gaatgtggctggcaacagttcttta

SEQ ID NO: 311649 - DNA, 25 bp, Rattus norvegicus
gaatgtggctgggaacagttcttta

SEQ ID NO: 311650 - DNA, 25 bp, Rattus norvegicus
gaatgtggcttcaccagtcagacag

SEQ ID NO: 311651 - DNA, 25 bp, Rattus norvegicus
gaatgtggcttcagaaccctgacct

SEQ ID NO: 311652 - DNA, 25 bp, Rattus norvegicus
gaatgtggcttccacccaacaagtt

SEQ ID NO: 311653 - DNA, 25 bp, Rattus norvegicus
gaatgtggcttcgacccaacaagtt

SEQ ID NO: 311654 - DNA, 25 bp, Rattus norvegicus
gaatgtggcttctccagtcagacag

SEQ ID NO: 311655 - DNA, 25 bp, Rattus norvegicus
gaatgtggcttctgaaccctgacct

SEQ ID NO: 311656 - DNA, 25 bp, Rattus norvegicus
gaatgtggctttccctgtcattcat

SEQ ID NO: 311657 - DNA, 25 bp, Rattus norvegicus
gaatgtggctttcgtttacccacct

SEQ ID NO: 311658 - DNA, 25 bp, Rattus norvegicus
gaatgtggctttgcctgtcattcat

SEQ ID NO: 311659 - DNA, 25 bp, Rattus norvegicus
gaatgtggctttggtttacccacct

SEQ ID NO: 311660 - DNA, 25 bp, Rattus norvegicus
gaatgtgggaaaatcctctgccctt

SEQ ID NO: 311661 - DNA, 25 bp, Rattus norvegicus
gaatgtgggaaattcctctgccctt

SEQ ID NO: 311662 - DNA, 25 bp, Rattus norvegicus
gaatgtgggcctcggcaagccattc

SEQ ID NO: 311663 - DNA, 25 bp, Rattus norvegicus
gaatgtgggcctgggcaagccattc

SEQ ID NO: 311664 - DNA, 25 bp, Rattus norvegicus
gaatgtgggtagacagtattttgga

SEQ ID NO: 311665 - DNA, 25 bp, Rattus norvegicus
gaatgtgggtagtcagtattttgga

SEQ ID NO: 311666 - DNA, 25 bp, Rattus norvegicus
gaatgtgggtccctctgggcatatc

SEQ ID NO: 311667 - DNA, 25 bp, Rattus norvegicus
gaatgtgggtccgtctgggcatatc

SEQ ID NO: 311668 - DNA, 25 bp, Rattus norvegicus
gaatgtgggttaagttcttctatcc

SEQ ID NO: 311669 - DNA, 25 bp, Rattus norvegicus
gaatgtgggttatgttcttctatcc

SEQ ID NO: 311670 - DNA, 25 bp, Rattus norvegicus
gaatgtggtcgaccttccagagacc

SEQ ID NO: 311671 - DNA, 25 bp, Rattus norvegicus
gaatgtggtcgagcttccagagacc

SEQ ID NO: 311672 - DNA, 25 bp, Rattus norvegicus
gaatgtggtgacatggacccctcga

SEQ ID NO: 311673 - DNA, 25 bp, Rattus norvegicus
gaatgtggtgacttggacccctcga

SEQ ID NO: 311674 - DNA, 25 bp, Rattus norvegicus
gaatgtggtgggagcatgcccttct

SEQ ID NO: 311675 - DNA, 25 bp, Rattus norvegicus
gaatgtggtgggtgcatgcccttct

SEQ ID NO: 311676 - DNA, 25 bp, Rattus norvegicus
gaatgtggttctctgatctttttaa

SEQ ID NO: 311677 - DNA, 25 bp, Rattus norvegicus
gaatgtggttctgtgatctttttaa

SEQ ID NO: 311678 - DNA, 25 bp, Rattus norvegicus
gaatgtgtacaacagccccatgacg

SEQ ID NO: 311679 - DNA, 25 bp, Rattus norvegicus
gaatgtgtacaagagccccatgacg

SEQ ID NO: 311680 - DNA, 25 bp, Rattus norvegicus
gaatgtgtagtgagctgctgttctg

SEQ ID NO: 311681 - DNA, 25 bp, Rattus norvegicus
gaatgtgtagtgtgctgctgttctg

SEQ ID NO: 311682 - DNA, 25 bp, Rattus norvegicus
gaatgtgtattcaacaaccccttag

SEQ ID NO: 311683 - DNA, 25 bp, Rattus norvegicus
gaatgtgtattctacaaccccttag

SEQ ID NO: 311684 - DNA, 25 bp, Rattus norvegicus
gaatgtgtcaaccatagcgtctaga

SEQ ID NO: 311685 - DNA, 25 bp, Rattus norvegicus
gaatgtgtcaacgatagcgtctaga

SEQ ID NO: 311686 - DNA, 25 bp, Rattus norvegicus
gaatgtgtcagtcagttttccaaat

SEQ ID NO: 311687 - DNA, 25 bp, Rattus norvegicus
gaatgtgtcagtgagttttccaaat

SEQ ID NO: 311688 - DNA, 25 bp, Rattus norvegicus
gaatgtgtcatccacgagctacaga

SEQ ID NO: 311689 - DNA, 25 bp, Rattus norvegicus
gaatgtgtcatcgacgagctacaga

SEQ ID NO: 311690 - DNA, 25 bp, Rattus norvegicus
gaatgtgtccacctttaagtcaccc

SEQ ID NO: 311691 - DNA, 25 bp, Rattus norvegicus
gaatgtgtccacgtttaagtcaccc

SEQ ID NO: 311692 - DNA, 25 bp, Rattus norvegicus
gaatgtgtccttaagatgctgtgaa

SEQ ID NO: 311693 - DNA, 25 bp, Rattus norvegicus
gaatgtgtcctttagatgctgtgaa

SEQ ID NO: 311694 - DNA, 25 bp, Rattus norvegicus
gaatgtgtctgaagtaccacgccaa

SEQ ID NO: 311695 - DNA, 25 bp, Rattus norvegicus
gaatgtgtctgatgtaccacgccaa

SEQ ID NO: 311696 - DNA, 25 bp, Rattus norvegicus
gaatgtgtctgcagtgctggctact

SEQ ID NO: 311697 - DNA, 25 bp, Rattus norvegicus
gaatgtgtctgctgtgctggctact

SEQ ID NO: 311698 - DNA, 25 bp, Rattus norvegicus
gaatgtgtctggctttggcactaaa

SEQ ID NO: 311699 - DNA, 25 bp, Rattus norvegicus
gaatgtgtctgggtttggcactaaa

SEQ ID NO: 311700 - DNA, 25 bp, Rattus norvegicus
gaatgtgtctgtatccgaggtagca

SEQ ID NO: 311701 - DNA, 25 bp, Rattus norvegicus
gaatgtgtctgtccacaacctttga

SEQ ID NO: 311702 - DNA, 25 bp, Rattus norvegicus
gaatgtgtctgtgcacaacctttga

SEQ ID NO: 311703 - DNA, 25 bp, Rattus norvegicus
gaatgtgtctgtttccgaggtagca

SEQ ID NO: 311704 - DNA, 25 bp, Rattus norvegicus
gaatgtgtcttccagaatctcagat

SEQ ID NO: 311705 - DNA, 25 bp, Rattus norvegicus
gaatgtgtcttcgagaatctcagat

SEQ ID NO: 311706 - DNA, 25 bp, Rattus norvegicus
gaatgtgtgaagaatcctattgggt

SEQ ID NO: 311707 - DNA, 25 bp, Rattus norvegicus
gaatgtgtgaagtatcctattgggt

SEQ ID NO: 311708 - DNA, 25 bp, Rattus norvegicus
gaatgtgtgcacatgcccatgcatg

SEQ ID NO: 311709 - DNA, 25 bp, Rattus norvegicus
gaatgtgtgcacttgcccatgcatg

SEQ ID NO: 311710 - DNA, 25 bp, Rattus norvegicus
gaatgtgtgcttacacgggtgtcct

SEQ ID NO: 311711 - DNA, 25 bp, Rattus norvegicus
gaatgtgtgctttcacgggtgtcct

SEQ ID NO: 311712 - DNA, 25 bp, Rattus norvegicus
gaatgtgtggcacctatcagatgct

SEQ ID NO: 311713 - DNA, 25 bp, Rattus norvegicus
gaatgtgtggcagctatcagatgct

SEQ ID NO: 311714 - DNA, 25 bp, Rattus norvegicus
gaatgtgtgtaaaccccttctgagg

SEQ ID NO: 311715 - DNA, 25 bp, Rattus norvegicus
gaatgtgtgtaatccccttctgagg

SEQ ID NO: 311716 - DNA, 25 bp, Rattus norvegicus
gaatgtgtgtagacacgctcttcct

SEQ ID NO: 311717 - DNA, 25 bp, Rattus norvegicus
gaatgtgtgtagtcacgctcttcct

SEQ ID NO: 311718 - DNA, 25 bp, Rattus norvegicus
gaatgtgtgtatcaacctgtgtctt

SEQ ID NO: 311719 - DNA, 25 bp, Rattus norvegicus
gaatgtgtgtatcctgctggtgact

SEQ ID NO: 311720 - DNA, 25 bp, Rattus norvegicus
gaatgtgtgtatgaacctgtgtctt

SEQ ID NO: 311721 - DNA, 25 bp, Rattus norvegicus
gaatgtgtgtatgctgctggtgact

SEQ ID NO: 311722 - DNA, 25 bp, Rattus norvegicus
gaatgtgtgttcaccaggaaggaag

SEQ ID NO: 311723 - DNA, 25 bp, Rattus norvegicus
gaatgtgtgttcatagttcctctga

SEQ ID NO: 311724 - DNA, 25 bp, Rattus norvegicus
gaatgtgtgttctccaggaaggaag

SEQ ID NO: 311725 - DNA, 25 bp, Rattus norvegicus
gaatgtgtgttcttagttcctctga

SEQ ID NO: 311726 - DNA, 25 bp, Rattus norvegicus
gaatgtgttcaactttctgatgaat

SEQ ID NO: 311727 - DNA, 25 bp, Rattus norvegicus
gaatgtgttcaagtttctgatgaat

SEQ ID NO: 311728 - DNA, 25 bp, Rattus norvegicus
gaatgtgttcatcaaatggccccaa

SEQ ID NO: 311729 - DNA, 25 bp, Rattus norvegicus
gaatgtgttcatgaaatggccccaa

SEQ ID NO: 311730 - DNA, 25 bp, Rattus norvegicus
gaatgtgttccgacactcagctttg

SEQ ID NO: 311731 - DNA, 25 bp, Rattus norvegicus
gaatgtgttccgtcactcagctttg

SEQ ID NO: 311732 - DNA, 25 bp, Rattus norvegicus
gaatgtgttctgactttgaggttta

SEQ ID NO: 311733 - DNA, 25 bp, Rattus norvegicus
gaatgtgttctgtctttgaggttta

SEQ ID NO: 311734 - DNA, 25 bp, Rattus norvegicus
gaatgtgttcttcggcatccacggg

SEQ ID NO: 311735 - DNA, 25 bp, Rattus norvegicus
gaatgtgttcttgggcatccacggg

SEQ ID NO: 311736 - DNA, 25 bp, Rattus norvegicus
gaatgtgttgcactcagccaggcta

SEQ ID NO: 311737 - DNA, 25 bp, Rattus norvegicus
gaatgtgttgcagtcagccaggcta

SEQ ID NO: 311738 - DNA, 25 bp, Rattus norvegicus
gaatgtgttgccatcctgctaaaca

SEQ ID NO: 311739 - DNA, 25 bp, Rattus norvegicus
gaatgtgttgccttcctgctaaaca

SEQ ID NO: 311740 - DNA, 25 bp, Rattus norvegicus
gaatgtgttggcaagatctctgcct

SEQ ID NO: 311741 - DNA, 25 bp, Rattus norvegicus
gaatgtgttggctagatctctgcct

SEQ ID NO: 311742 - DNA, 25 bp, Rattus norvegicus
gaatgtgttgtcaaaaatgcctgtt

SEQ ID NO: 311743 - DNA, 25 bp, Rattus norvegicus
gaatgtgttgtctaaaatgcctgtt

SEQ ID NO: 311744 - DNA, 25 bp, Rattus norvegicus
gaatgtgtttacatctcgctgtata

SEQ ID NO: 311745 - DNA, 25 bp, Rattus norvegicus
gaatgtgtttacttctcgctgtata

SEQ ID NO: 311746 - DNA, 25 bp, Rattus norvegicus
gaatgtgtttctcatcatttgcagt

SEQ ID NO: 311747 - DNA, 25 bp, Rattus norvegicus
gaatgtgtttctgatcatttgcagt

SEQ ID NO: 311748 - DNA, 25 bp, Rattus norvegicus
gaatgttaaatcaccagctatacta

SEQ ID NO: 311749 - DNA, 25 bp, Rattus norvegicus
gaatgttaaatctccagctatacta

SEQ ID NO: 311750 - DNA, 25 bp, Rattus norvegicus
gaatgttaatcactgcttgactatg

SEQ ID NO: 311751 - DNA, 25 bp, Rattus norvegicus
gaatgttaatcagtgcttgactatg

SEQ ID NO: 311752 - DNA, 25 bp, Rattus norvegicus
gaatgttaccaacgccacacagaac

SEQ ID NO: 311753 - DNA, 25 bp, Rattus norvegicus
gaatgttaccaaggccacacagaac

SEQ ID NO: 311754 - DNA, 25 bp, Rattus norvegicus
gaatgttaccatcaactctcagccc

SEQ ID NO: 311755 - DNA, 25 bp, Rattus norvegicus
gaatgttaccatgaactctcagccc

SEQ ID NO: 311756 - DNA, 25 bp, Rattus norvegicus
gaatgttacctgcatagtgaccatg

SEQ ID NO: 311757 - DNA, 25 bp, Rattus norvegicus
gaatgttacctggatagtgaccatg

SEQ ID NO: 311758 - DNA, 25 bp, Rattus norvegicus
gaatgttacgaccttttgtccacta

SEQ ID NO: 311759 - DNA, 25 bp, Rattus norvegicus
gaatgttacgacgttttgtccacta

SEQ ID NO: 311760 - DNA, 25 bp, Rattus norvegicus
gaatgttactaaatgctgatgccca

SEQ ID NO: 311761 - DNA, 25 bp, Rattus norvegicus
gaatgttactaattgctgatgccca

SEQ ID NO: 311762 - DNA, 25 bp, Rattus norvegicus
gaatgttacttcaggaatcctatgc

SEQ ID NO: 311763 - DNA, 25 bp, Rattus norvegicus
gaatgttacttctggaatcctatgc

SEQ ID NO: 311764 - DNA, 25 bp, Rattus norvegicus
gaatgttactttcttccgatcccac

SEQ ID NO: 311765 - DNA, 25 bp, Rattus norvegicus
gaatgttactttgttccgatcccac

SEQ ID NO: 311766 - DNA, 25 bp, Rattus norvegicus
gaatgttagcacagagcttgccaca

SEQ ID NO: 311767 - DNA, 25 bp, Rattus norvegicus
gaatgttagcactgagcttgccaca

SEQ ID NO: 311768 - DNA, 25 bp, Rattus norvegicus
gaatgttatcctcatggcccacgat

SEQ ID NO: 311769 - DNA, 25 bp, Rattus norvegicus
gaatgttatcctgatggcccacgat

SEQ ID NO: 311770 - DNA, 25 bp, Rattus norvegicus
gaatgttcaacactcaggtctgcct

SEQ ID NO: 311771 - DNA, 25 bp, Rattus norvegicus
gaatgttcaacagtcaggtctgcct

SEQ ID NO: 311772 - DNA, 25 bp, Rattus norvegicus
gaatgttcacagattctctcagaaa

SEQ ID NO: 311773 - DNA, 25 bp, Rattus norvegicus
gaatgttcacagtttctctcagaaa

SEQ ID NO: 311774 - DNA, 25 bp, Rattus norvegicus
gaatgttcacataacctttctggtt

SEQ ID NO: 311775 - DNA, 25 bp, Rattus norvegicus
gaatgttcacattacctttctggtt

SEQ ID NO: 311776 - DNA, 25 bp, Rattus norvegicus
gaatgttcacggaataagcccctaa

SEQ ID NO: 311777 - DNA, 25 bp, Rattus norvegicus
gaatgttcacggcaccaaccatgag

SEQ ID NO: 311778 - DNA, 25 bp, Rattus norvegicus
gaatgttcacgggaccaaccatgag

SEQ ID NO: 311779 - DNA, 25 bp, Rattus norvegicus
gaatgttcacggtataagcccctaa

SEQ ID NO: 311780 - DNA, 25 bp, Rattus norvegicus
gaatgttcactaattgacccacata

SEQ ID NO: 311781 - DNA, 25 bp, Rattus norvegicus
gaatgttcactatttgacccacata

SEQ ID NO: 311782 - DNA, 25 bp, Rattus norvegicus
gaatgttcatctctatgtctgcctc

SEQ ID NO: 311783 - DNA, 25 bp, Rattus norvegicus
gaatgttcatctgtatgtctgcctc

SEQ ID NO: 311784 - DNA, 25 bp, Rattus norvegicus
gaatgttccaagagtggctatgatg

SEQ ID NO: 311785 - DNA, 25 bp, Rattus norvegicus
gaatgttccaagtgtggctatgatg

SEQ ID NO: 311786 - DNA, 25 bp, Rattus norvegicus
gaatgttccacacgttgatcgtaca

SEQ ID NO: 311787 - DNA, 25 bp, Rattus norvegicus
gaatgttccacaggttgatcgtaca

SEQ ID NO: 311788 - DNA, 25 bp, Rattus norvegicus
gaatgttccaccactcgatagtaga

SEQ ID NO: 311789 - DNA, 25 bp, Rattus norvegicus
gaatgttccacctctcgatagtaga

SEQ ID NO: 311790 - DNA, 25 bp, Rattus norvegicus
gaatgttccagaagttgcacctgtt

SEQ ID NO: 311791 - DNA, 25 bp, Rattus norvegicus
gaatgttccagatgttgcacctgtt

SEQ ID NO: 311792 - DNA, 25 bp, Rattus norvegicus
gaatgttccaggaataggctttttt

SEQ ID NO: 311793 - DNA, 25 bp, Rattus norvegicus
gaatgttccaggtataggctttttt

SEQ ID NO: 311794 - DNA, 25 bp, Rattus norvegicus
gaatgttccatactccgctgcttcg

SEQ ID NO: 311795 - DNA, 25 bp, Rattus norvegicus
gaatgttccatagtccgctgcttcg

SEQ ID NO: 311796 - DNA, 25 bp, Rattus norvegicus
gaatgttcccgcaatggtgaccgga

SEQ ID NO: 311797 - DNA, 25 bp, Rattus norvegicus
gaatgttcccgctatggtgaccgga

SEQ ID NO: 311798 - DNA, 25 bp, Rattus norvegicus
gaatgttccctaaagcactgttaat

SEQ ID NO: 311799 - DNA, 25 bp, Rattus norvegicus
gaatgttccctacttacaactgtgg

SEQ ID NO: 311800 - DNA, 25 bp, Rattus norvegicus
gaatgttccctagttacaactgtgg

SEQ ID NO: 311801 - DNA, 25 bp, Rattus norvegicus
gaatgttccctatagcactgttaat

SEQ ID NO: 311802 - DNA, 25 bp, Rattus norvegicus
gaatgttccctgaagtatttgtatg

SEQ ID NO: 311803 - DNA, 25 bp, Rattus norvegicus
gaatgttccctgtagtatttgtatg

SEQ ID NO: 311804 - DNA, 25 bp, Rattus norvegicus
gaatgttccgttagcctgagtagat

SEQ ID NO: 311805 - DNA, 25 bp, Rattus norvegicus
gaatgttccgtttgcctgagtagat

SEQ ID NO: 311806 - DNA, 25 bp, Rattus norvegicus
gaatgttcctcaaaggctcaagttt

SEQ ID NO: 311807 - DNA, 25 bp, Rattus norvegicus
gaatgttcctcataggctcaagttt

SEQ ID NO: 311808 - DNA, 25 bp, Rattus norvegicus
gaatgttccttccattggagccaga

SEQ ID NO: 311809 - DNA, 25 bp, Rattus norvegicus
gaatgttccttcgattggagccaga

SEQ ID NO: 311810 - DNA, 25 bp, Rattus norvegicus
gaatgttcgtctcaaattgcctcaa

SEQ ID NO: 311811 - DNA, 25 bp, Rattus norvegicus
gaatgttcgtctgaaattgcctcaa

SEQ ID NO: 311812 - DNA, 25 bp, Rattus norvegicus
gaatgttctacacaagctgtccaat

SEQ ID NO: 311813 - DNA, 25 bp, Rattus norvegicus
gaatgttctacagaagctgtccaat

SEQ ID NO: 311814 - DNA, 25 bp, Rattus norvegicus
gaatgttctagacttctacaggcag

SEQ ID NO: 311815 - DNA, 25 bp, Rattus norvegicus
gaatgttctagagttctacaggcag

SEQ ID NO: 311816 - DNA, 25 bp, Rattus norvegicus
gaatgttctattaccatgtgaactg

SEQ ID NO: 311817 - DNA, 25 bp, Rattus norvegicus
gaatgttctatttccatgtgaactg

SEQ ID NO: 311818 - DNA, 25 bp, Rattus norvegicus
gaatgttctcatattcataaggtga

SEQ ID NO: 311819 - DNA, 25 bp, Rattus norvegicus
gaatgttctcattttcataaggtga

SEQ ID NO: 311820 - DNA, 25 bp, Rattus norvegicus
gaatgttctctgcttccctgaccat

SEQ ID NO: 311821 - DNA, 25 bp, Rattus norvegicus
gaatgttctctggttccctgaccat

SEQ ID NO: 311822 - DNA, 25 bp, Rattus norvegicus
gaatgttcttatcaccgaacgttgg

SEQ ID NO: 311823 - DNA, 25 bp, Rattus norvegicus
gaatgttcttatgaccgaacgttgg

SEQ ID NO: 311824 - DNA, 25 bp, Rattus norvegicus
gaatgttcttccaccaattttatgc

SEQ ID NO: 311825 - DNA, 25 bp, Rattus norvegicus
gaatgttcttcctccaattttatgc

SEQ ID NO: 311826 - DNA, 25 bp, Rattus norvegicus
gaatgttcttcgagtagcttacagc

SEQ ID NO: 311827 - DNA, 25 bp, Rattus norvegicus
gaatgttcttcgtgtagcttacagc

SEQ ID NO: 311828 - DNA, 25 bp, Rattus norvegicus
gaatgttcttctctcatctcaggaa

SEQ ID NO: 311829 - DNA, 25 bp, Rattus norvegicus
gaatgttcttctgtcatctcaggaa

SEQ ID NO: 311830 - DNA, 25 bp, Rattus norvegicus
gaatgttcttggaagctgtttcgta

SEQ ID NO: 311831 - DNA, 25 bp, Rattus norvegicus
gaatgttcttggtagctgtttcgta

SEQ ID NO: 311832 - DNA, 25 bp, Rattus norvegicus
gaatgttgaatgacaccgtatgcgt

SEQ ID NO: 311833 - DNA, 25 bp, Rattus norvegicus
gaatgttgaatgtcaccgtatgcgt

SEQ ID NO: 311834 - DNA, 25 bp, Rattus norvegicus
gaatgttgaattccctgaaactgtt

SEQ ID NO: 311835 - DNA, 25 bp, Rattus norvegicus
gaatgttgaattcttatccgcccac

SEQ ID NO: 311836 - DNA, 25 bp, Rattus norvegicus
gaatgttgaattgcctgaaactgtt

SEQ ID NO: 311837 - DNA, 25 bp, Rattus norvegicus
gaatgttgaattgttatccgcccac

SEQ ID NO: 311838 - DNA, 25 bp, Rattus norvegicus
gaatgttgacggagccaactgtcac

SEQ ID NO: 311839 - DNA, 25 bp, Rattus norvegicus
gaatgttgacggtgccaactgtcac

SEQ ID NO: 311840 - DNA, 25 bp, Rattus norvegicus
gaatgttgagtcactctctgagttt

SEQ ID NO: 311841 - DNA, 25 bp, Rattus norvegicus
gaatgttgagtctctctctgagttt

SEQ ID NO: 311842 - DNA, 25 bp, Rattus norvegicus
gaatgttgatttactgcacccaaga

SEQ ID NO: 311843 - DNA, 25 bp, Rattus norvegicus
gaatgttgattttctgcacccaaga

SEQ ID NO: 311844 - DNA, 25 bp, Rattus norvegicus
gaatgttgcagccaagtggaccatt

SEQ ID NO: 311845 - DNA, 25 bp, Rattus norvegicus
gaatgttgcagcgaagtggaccatt

SEQ ID NO: 311846 - DNA, 25 bp, Rattus norvegicus
gaatgttgcatcaagagctccgaat

SEQ ID NO: 311847 - DNA, 25 bp, Rattus norvegicus
gaatgttgcatctagagctccgaat

SEQ ID NO: 311848 - DNA, 25 bp, Rattus norvegicus
gaatgttgccgtcgatgacctagaa

SEQ ID NO: 311849 - DNA, 25 bp, Rattus norvegicus
gaatgttgccgtggatgacctagaa

SEQ ID NO: 311850 - DNA, 25 bp, Rattus norvegicus
gaatgttgcctaaacttctggccaa

SEQ ID NO: 311851 - DNA, 25 bp, Rattus norvegicus
gaatgttgcctatacttctggccaa

SEQ ID NO: 311852 - DNA, 25 bp, Rattus norvegicus
gaatgttgcggtcttcagtccagta

SEQ ID NO: 311853 - DNA, 25 bp, Rattus norvegicus
gaatgttgcggtgttcagtccagta

SEQ ID NO: 311854 - DNA, 25 bp, Rattus norvegicus
gaatgttgctttcatgcctatttta

SEQ ID NO: 311855 - DNA, 25 bp, Rattus norvegicus
gaatgttgctttgatgcctatttta

SEQ ID NO: 311856 - DNA, 25 bp, Rattus norvegicus
gaatgttgtacaactggtgggctcg

SEQ ID NO: 311857 - DNA, 25 bp, Rattus norvegicus
gaatgttgtacatctggtgggctcg

SEQ ID NO: 311858 - DNA, 25 bp, Rattus norvegicus
gaatgttgtcatccgatgctgtagt

SEQ ID NO: 311859 - DNA, 25 bp, Rattus norvegicus
gaatgttgtcatgcgatgctgtagt

SEQ ID NO: 311860 - DNA, 25 bp, Rattus norvegicus
gaatgttgtgctagtatgaccatga

SEQ ID NO: 311861 - DNA, 25 bp, Rattus norvegicus
gaatgttgtgcttgtatgaccatga

SEQ ID NO: 311862 - DNA, 25 bp, Rattus norvegicus
gaatgttgttacaagactgatacct

SEQ ID NO: 311863 - DNA, 25 bp, Rattus norvegicus
gaatgttgttactagactgatacct

SEQ ID NO: 311864 - DNA, 25 bp, Rattus norvegicus
gaatgttgttctatccttgggacat

SEQ ID NO: 311865 - DNA, 25 bp, Rattus norvegicus
gaatgttgttctttccttgggacat

SEQ ID NO: 311866 - DNA, 25 bp, Rattus norvegicus
gaatgttgttttagactgtaaggct

SEQ ID NO: 311867 - DNA, 25 bp, Rattus norvegicus
gaatgttgtttttgactgtaaggct

SEQ ID NO: 311868 - DNA, 25 bp, Rattus norvegicus
gaatgtttaattcggcgcttgctta

SEQ ID NO: 311869 - DNA, 25 bp, Rattus norvegicus
gaatgtttaattgggcgcttgctta

SEQ ID NO: 311870 - DNA, 25 bp, Rattus norvegicus
gaatgtttacagacctacgtgtacg

SEQ ID NO: 311871 - DNA, 25 bp, Rattus norvegicus
gaatgtttacagtcctacgtgtacg

SEQ ID NO: 311872 - DNA, 25 bp, Rattus norvegicus
gaatgtttacgtatgcttacgcaag

SEQ ID NO: 311873 - DNA, 25 bp, Rattus norvegicus
gaatgtttacgtttgcttacgcaag

SEQ ID NO: 311874 - DNA, 25 bp, Rattus norvegicus
gaatgtttactacggcattgctcaa

SEQ ID NO: 311875 - DNA, 25 bp, Rattus norvegicus
gaatgtttactagggcattgctcaa

SEQ ID NO: 311876 - DNA, 25 bp, Rattus norvegicus
gaatgtttagagcttcatcaccatg

SEQ ID NO: 311877 - DNA, 25 bp, Rattus norvegicus
gaatgtttagaggttcatcaccatg

SEQ ID NO: 311878 - DNA, 25 bp, Rattus norvegicus
gaatgtttagttatctgagccagat

SEQ ID NO: 311879 - DNA, 25 bp, Rattus norvegicus
gaatgtttagttttctgagccagat

SEQ ID NO: 311880 - DNA, 25 bp, Rattus norvegicus
gaatgtttatctcagcaggcagatg

SEQ ID NO: 311881 - DNA, 25 bp, Rattus norvegicus
gaatgtttatctgagcaggcagatg

SEQ ID NO: 311882 - DNA, 25 bp, Rattus norvegicus
gaatgtttattacctctctctctct

SEQ ID NO: 311883 - DNA, 25 bp, Rattus norvegicus
gaatgtttattagctctctctctct

SEQ ID NO: 311884 - DNA, 25 bp, Rattus norvegicus
gaatgtttattcaacagtccaagga

SEQ ID NO: 311885 - DNA, 25 bp, Rattus norvegicus
gaatgtttattctacagtccaagga

SEQ ID NO: 311886 - DNA, 25 bp, Rattus norvegicus
gaatgtttcaagcagtgcctcttct

SEQ ID NO: 311887 - DNA, 25 bp, Rattus norvegicus
gaatgtttcaaggagtgcctcttct

SEQ ID NO: 311888 - DNA, 25 bp, Rattus norvegicus
gaatgtttcactacagacagctgga

SEQ ID NO: 311889 - DNA, 25 bp, Rattus norvegicus
gaatgtttcacttcagacagctgga

SEQ ID NO: 311890 - DNA, 25 bp, Rattus norvegicus
gaatgtttcatactccttccattga

SEQ ID NO: 311891 - DNA, 25 bp, Rattus norvegicus
gaatgtttcatagtccttccattga

SEQ ID NO: 311892 - DNA, 25 bp, Rattus norvegicus
gaatgtttcattcaccttcaagggt

SEQ ID NO: 311893 - DNA, 25 bp, Rattus norvegicus
gaatgtttcattgaccttcaagggt

SEQ ID NO: 311894 - DNA, 25 bp, Rattus norvegicus
gaatgtttcctgaaaatgacaatca

SEQ ID NO: 311895 - DNA, 25 bp, Rattus norvegicus
gaatgtttcctgtaaatgacaatca

SEQ ID NO: 311896 - DNA, 25 bp, Rattus norvegicus
gaatgtttcgctctaatgtacacac

SEQ ID NO: 311897 - DNA, 25 bp, Rattus norvegicus
gaatgtttcgctgtaatgtacacac

SEQ ID NO: 311898 - DNA, 25 bp, Rattus norvegicus
gaatgtttcttgctagtttctcata

SEQ ID NO: 311899 - DNA, 25 bp, Rattus norvegicus
gaatgtttcttggtagtttctcata

SEQ ID NO: 311900 - DNA, 25 bp, Rattus norvegicus
gaatgtttgatcacgttttctcaga

SEQ ID NO: 311901 - DNA, 25 bp, Rattus norvegicus
gaatgtttgatcatcactgctgaaa

SEQ ID NO: 311902 - DNA, 25 bp, Rattus norvegicus
gaatgtttgatctcgttttctcaga

SEQ ID NO: 311903 - DNA, 25 bp, Rattus norvegicus
gaatgtttgatcttcactgctgaaa

SEQ ID NO: 311904 - DNA, 25 bp, Rattus norvegicus
gaatgtttgcagaccttggaataaa

SEQ ID NO: 311905 - DNA, 25 bp, Rattus norvegicus
gaatgtttgcagtccttggaataaa

SEQ ID NO: 311906 - DNA, 25 bp, Rattus norvegicus
gaatgtttgcttacagtgttggcta

SEQ ID NO: 311907 - DNA, 25 bp, Rattus norvegicus
gaatgtttgcttacctgtagtagcc

SEQ ID NO: 311908 - DNA, 25 bp, Rattus norvegicus
gaatgtttgctttcagtgttggcta

SEQ ID NO: 311909 - DNA, 25 bp, Rattus norvegicus
gaatgtttgctttcctgtagtagcc

SEQ ID NO: 311910 - DNA, 25 bp, Rattus norvegicus
gaatgtttgttcagtggtgcttaga

SEQ ID NO: 311911 - DNA, 25 bp, Rattus norvegicus
gaatgtttgttctgtggtgcttaga

SEQ ID NO: 311912 - DNA, 25 bp, Rattus norvegicus
gaatgttttcatcaacttgccaaag

SEQ ID NO: 311913 - DNA, 25 bp, Rattus norvegicus
gaatgttttcatcactgtagtgcct

SEQ ID NO: 311914 - DNA, 25 bp, Rattus norvegicus
gaatgttttcatgaacttgccaaag

SEQ ID NO: 311915 - DNA, 25 bp, Rattus norvegicus
gaatgttttcatgactgtagtgcct

SEQ ID NO: 311916 - DNA, 25 bp, Rattus norvegicus
gaatgttttccaccagatgcctctt

SEQ ID NO: 311917 - DNA, 25 bp, Rattus norvegicus
gaatgttttccagcagatgcctctt

SEQ ID NO: 311918 - DNA, 25 bp, Rattus norvegicus
gaatgttttcctatgttatacttca

SEQ ID NO: 311919 - DNA, 25 bp, Rattus norvegicus
gaatgttttcctttgttatacttca

SEQ ID NO: 311920 - DNA, 25 bp, Rattus norvegicus
gaatgttttgacacgtggtctcact

SEQ ID NO: 311921 - DNA, 25 bp, Rattus norvegicus
gaatgttttgactcgtggtctcact

SEQ ID NO: 311922 - DNA, 25 bp, Rattus norvegicus
gaatgttttggtaacatgcctattt

SEQ ID NO: 311923 - DNA, 25 bp, Rattus norvegicus
gaatgttttggttacatgcctattt

SEQ ID NO: 311924 - DNA, 25 bp, Rattus norvegicus
gaatgttttgtccaagctcttcact

SEQ ID NO: 311925 - DNA, 25 bp, Rattus norvegicus
gaatgttttgtccttctgaccacaa

SEQ ID NO: 311926 - DNA, 25 bp, Rattus norvegicus
gaatgttttgtcgaagctcttcact

SEQ ID NO: 311927 - DNA, 25 bp, Rattus norvegicus
gaatgttttgtcgttctgaccacaa

SEQ ID NO: 311928 - DNA, 25 bp, Rattus norvegicus
gaatgttttgttatacgtgagagta

SEQ ID NO: 311929 - DNA, 25 bp, Rattus norvegicus
gaatgttttgttttacgtgagagta

SEQ ID NO: 311930 - DNA, 25 bp, Rattus norvegicus
gaatgtttttacaaccctcagaaga

SEQ ID NO: 311931 - DNA, 25 bp, Rattus norvegicus
gaatgtttttacctgtgtttcagca

SEQ ID NO: 311932 - DNA, 25 bp, Rattus norvegicus
gaatgtttttacgtgtgtttcagca

SEQ ID NO: 311933 - DNA, 25 bp, Rattus norvegicus
gaatgtttttactaccctcagaaga

SEQ ID NO: 311934 - DNA, 25 bp, Rattus norvegicus
gaatgtttttctattgatctcacaa

SEQ ID NO: 311935 - DNA, 25 bp, Rattus norvegicus
gaatgtttttcttttgatctcacaa

SEQ ID NO: 311936 - DNA, 25 bp, Rattus norvegicus
gaatgtttttgcaagtatcagatct

SEQ ID NO: 311937 - DNA, 25 bp, Rattus norvegicus
gaatgtttttgctagtatcagatct

SEQ ID NO: 311938 - DNA, 25 bp, Rattus norvegicus
gaattaaaccctcagaacacgtctc

SEQ ID NO: 311939 - DNA, 25 bp, Rattus norvegicus
gaattaaaccctgagaacacgtctc

SEQ ID NO: 311940 - DNA, 25 bp, Rattus norvegicus
gaattaaactctaacctggctcttc

SEQ ID NO: 311941 - DNA, 25 bp, Rattus norvegicus
gaattaaactcttacctggctcttc

SEQ ID NO: 311942 - DNA, 25 bp, Rattus norvegicus
gaattaaactgtcgctctctcacgt

SEQ ID NO: 311943 - DNA, 25 bp, Rattus norvegicus
gaattaaactgtggctctctcacgt

SEQ ID NO: 311944 - DNA, 25 bp, Rattus norvegicus
gaattaaagcccagtttgaagttgt

SEQ ID NO: 311945 - DNA, 25 bp, Rattus norvegicus
gaattaaagccctgtttgaagttgt

SEQ ID NO: 311946 - DNA, 25 bp, Rattus norvegicus
gaattaaaggatccccgtgctgccg

SEQ ID NO: 311947 - DNA, 25 bp, Rattus norvegicus
gaattaaaggatgcccgtgctgccg

SEQ ID NO: 311948 - DNA, 25 bp, Rattus norvegicus
gaattaaaggccacggcttttctgt

SEQ ID NO: 311949 - DNA, 25 bp, Rattus norvegicus
gaattaaaggcctcggcttttctgt

SEQ ID NO: 311950 - DNA, 25 bp, Rattus norvegicus
gaattaaatgcacgcttctgtcatg

SEQ ID NO: 311951 - DNA, 25 bp, Rattus norvegicus
gaattaaatgcaggcttctgtcatg

SEQ ID NO: 311952 - DNA, 25 bp, Rattus norvegicus
gaattaaatgctatctggttccaat

SEQ ID NO: 311953 - DNA, 25 bp, Rattus norvegicus
gaattaaatgctttctggttccaat

SEQ ID NO: 311954 - DNA, 25 bp, Rattus norvegicus
gaattaaattcaaacttgcagcatt

SEQ ID NO: 311955 - DNA, 25 bp, Rattus norvegicus
gaattaaattcatacttgcagcatt

SEQ ID NO: 311956 - DNA, 25 bp, Rattus norvegicus
gaattaacagcgactttcctttggt

SEQ ID NO: 311957 - DNA, 25 bp, Rattus norvegicus
gaattaacagcgtctttcctttggt

SEQ ID NO: 311958 - DNA, 25 bp, Rattus norvegicus
gaattaaccaacctagaagctctca

SEQ ID NO: 311959 - DNA, 25 bp, Rattus norvegicus
gaattaaccaacgtagaagctctca

SEQ ID NO: 311960 - DNA, 25 bp, Rattus norvegicus
gaattaaccccaaaatgatcgctaa

SEQ ID NO: 311961 - DNA, 25 bp, Rattus norvegicus
gaattaaccccataatgatcgctaa

SEQ ID NO: 311962 - DNA, 25 bp, Rattus norvegicus
gaattaacctgtaactcaatcgctg

SEQ ID NO: 311963 - DNA, 25 bp, Rattus norvegicus
gaattaacctgttactcaatcgctg

SEQ ID NO: 311964 - DNA, 25 bp, Rattus norvegicus
gaattaacttatcatgcactcgctt

SEQ ID NO: 311965 - DNA, 25 bp, Rattus norvegicus
gaattaacttatgatgcactcgctt

SEQ ID NO: 311966 - DNA, 25 bp, Rattus norvegicus
gaattaacttcccagttctttctga

SEQ ID NO: 311967 - DNA, 25 bp, Rattus norvegicus
gaattaacttccgagttctttctga

SEQ ID NO: 311968 - DNA, 25 bp, Rattus norvegicus
gaattaagtcagaacagtagcctcc

SEQ ID NO: 311969 - DNA, 25 bp, Rattus norvegicus
gaattaagtcagtacagtagcctcc

SEQ ID NO: 311970 - DNA, 25 bp, Rattus norvegicus
gaattaagtgccagtgagagactga

SEQ ID NO: 311971 - DNA, 25 bp, Rattus norvegicus
gaattaagtgcctgtgagagactga

SEQ ID NO: 311972 - DNA, 25 bp, Rattus norvegicus
gaattaagtggaacctgtggtcctt

SEQ ID NO: 311973 - DNA, 25 bp, Rattus norvegicus
gaattaagtggatcctgtggtcctt

SEQ ID NO: 311974 - DNA, 25 bp, Rattus norvegicus
gaattaatagcccttagcaacgact

SEQ ID NO: 311975 - DNA, 25 bp, Rattus norvegicus
gaattaatagccgttagcaacgact

SEQ ID NO: 311976 - DNA, 25 bp, Rattus norvegicus
gaattaatatccctgtactcccaaa

SEQ ID NO: 311977 - DNA, 25 bp, Rattus norvegicus
gaattaatatccgtgtactcccaaa

SEQ ID NO: 311978 - DNA, 25 bp, Rattus norvegicus
gaattaatcttacaacatttggcta

SEQ ID NO: 311979 - DNA, 25 bp, Rattus norvegicus
gaattaatcttagaacatttggcta

SEQ ID NO: 311980 - DNA, 25 bp, Rattus norvegicus
gaattaatgagccttgtcctttaca

SEQ ID NO: 311981 - DNA, 25 bp, Rattus norvegicus
gaattaatgagcgttgtcctttaca

SEQ ID NO: 311982 - DNA, 25 bp, Rattus norvegicus
gaattaattgtaacagcaaactgaa

SEQ ID NO: 311983 - DNA, 25 bp, Rattus norvegicus
gaattaattgtatcagcaaactgaa

SEQ ID NO: 311984 - DNA, 25 bp, Rattus norvegicus
gaattaatttctacctggctttggt

SEQ ID NO: 311985 - DNA, 25 bp, Rattus norvegicus
gaattaatttcttcctggctttggt

SEQ ID NO: 311986 - DNA, 25 bp, Rattus norvegicus
gaattacaactactatcctcccgta

SEQ ID NO: 311987 - DNA, 25 bp, Rattus norvegicus
gaattacaactagtatcctcccgta

SEQ ID NO: 311988 - DNA, 25 bp, Rattus norvegicus
gaattacaacttaccaatcctgcgc

SEQ ID NO: 311989 - DNA, 25 bp, Rattus norvegicus
gaattacaactttccaatcctgcgc

SEQ ID NO: 311990 - DNA, 25 bp, Rattus norvegicus
gaattacaagcgcaggctctctgca

SEQ ID NO: 311991 - DNA, 25 bp, Rattus norvegicus
gaattacaagcggaggctctctgca

SEQ ID NO: 311992 - DNA, 25 bp, Rattus norvegicus
gaattacactacattcagaatccca

SEQ ID NO: 311993 - DNA, 25 bp, Rattus norvegicus
gaattacactactttcagaatccca

SEQ ID NO: 311994 - DNA, 25 bp, Rattus norvegicus
gaattacactcacattggcccctga

SEQ ID NO: 311995 - DNA, 25 bp, Rattus norvegicus
gaattacactcagattggcccctga

SEQ ID NO: 311996 - DNA, 25 bp, Rattus norvegicus
gaattacactgcactgttgaccggt

SEQ ID NO: 311997 - DNA, 25 bp, Rattus norvegicus
gaattacactgctctgttgaccggt

SEQ ID NO: 311998 - DNA, 25 bp, Rattus norvegicus
gaattacagaaaactcatcgaggac

SEQ ID NO: 311999 - DNA, 25 bp, Rattus norvegicus
gaattacagaaatctcatcgaggac

SEQ ID NO: 312000 - DNA, 25 bp, Rattus norvegicus
gaattacagcttaagtccagccagg

SEQ ID NO: 312001 - DNA, 25 bp, Rattus norvegicus
gaattacagctttagtccagccagg

SEQ ID NO: 312002 - DNA, 25 bp, Rattus norvegicus
gaattacagtctagcgtgtccaaaa

SEQ ID NO: 312003 - DNA, 25 bp, Rattus norvegicus
gaattacagtcttgcgtgtccaaaa

SEQ ID NO: 312004 - DNA, 25 bp, Rattus norvegicus
gaattacagttcctgggagcctcag

SEQ ID NO: 312005 - DNA, 25 bp, Rattus norvegicus
gaattacagttcgtgggagcctcag

SEQ ID NO: 312006 - DNA, 25 bp, Rattus norvegicus
gaattacatctcacttttattttcg

SEQ ID NO: 312007 - DNA, 25 bp, Rattus norvegicus
gaattacatctctcttttattttcg

SEQ ID NO: 312008 - DNA, 25 bp, Rattus norvegicus
gaattacatctgctcagctattaat

SEQ ID NO: 312009 - DNA, 25 bp, Rattus norvegicus
gaattacatctggtcagctattaat

SEQ ID NO: 312010 - DNA, 25 bp, Rattus norvegicus
gaattaccacataccaacacagtcc

SEQ ID NO: 312011 - DNA, 25 bp, Rattus norvegicus
gaattaccacattccaacacagtcc

SEQ ID NO: 312012 - DNA, 25 bp, Rattus norvegicus
gaattaccactccattgccaatgaa

SEQ ID NO: 312013 - DNA, 25 bp, Rattus norvegicus
gaattaccactcgattgccaatgaa

SEQ ID NO: 312014 - DNA, 25 bp, Rattus norvegicus
gaattaccaggtcaagatgaagatc

SEQ ID NO: 312015 - DNA, 25 bp, Rattus norvegicus
gaattaccaggtgaagatgaagatc

SEQ ID NO: 312016 - DNA, 25 bp, Rattus norvegicus
gaattaccatagaaacacgtccctg

SEQ ID NO: 312017 - DNA, 25 bp, Rattus norvegicus
gaattaccatagcagaataccagaa

SEQ ID NO: 312018 - DNA, 25 bp, Rattus norvegicus
gaattaccataggagaataccagaa

SEQ ID NO: 312019 - DNA, 25 bp, Rattus norvegicus
gaattaccatagtaacacgtccctg

SEQ ID NO: 312020 - DNA, 25 bp, Rattus norvegicus
gaattaccatctattgagtacggca

SEQ ID NO: 312021 - DNA, 25 bp, Rattus norvegicus
gaattaccatcttttgagtacggca

SEQ ID NO: 312022 - DNA, 25 bp, Rattus norvegicus
gaattaccatggaactgcttctgat

SEQ ID NO: 312023 - DNA, 25 bp, Rattus norvegicus
gaattaccatggtactgcttctgat

SEQ ID NO: 312024 - DNA, 25 bp, Rattus norvegicus
gaattaccattgatacaacgtccat

SEQ ID NO: 312025 - DNA, 25 bp, Rattus norvegicus
gaattaccattgttacaacgtccat

SEQ ID NO: 312026 - DNA, 25 bp, Rattus norvegicus
gaattacccgtgaccaagtcttgaa

SEQ ID NO: 312027 - DNA, 25 bp, Rattus norvegicus
gaattacccgtgtccaagtcttgaa

SEQ ID NO: 312028 - DNA, 25 bp, Rattus norvegicus
gaattaccctgcaaagccggtgctt

SEQ ID NO: 312029 - DNA, 25 bp, Rattus norvegicus
gaattaccctgctaagccggtgctt

SEQ ID NO: 312030 - DNA, 25 bp, Rattus norvegicus
gaattaccggcacattgctagtggt

SEQ ID NO: 312031 - DNA, 25 bp, Rattus norvegicus
gaattaccggcagattgctagtggt

SEQ ID NO: 312032 - DNA, 25 bp, Rattus norvegicus
gaattaccgtctatggttgactgta

SEQ ID NO: 312033 - DNA, 25 bp, Rattus norvegicus
gaattaccgtctttggttgactgta

SEQ ID NO: 312034 - DNA, 25 bp, Rattus norvegicus
gaattacctaagcaaaccctcaata

SEQ ID NO: 312035 - DNA, 25 bp, Rattus norvegicus
gaattacctaaggaaaccctcaata

SEQ ID NO: 312036 - DNA, 25 bp, Rattus norvegicus
gaattacctattatcctccaagtag

SEQ ID NO: 312037 - DNA, 25 bp, Rattus norvegicus
gaattacctattttcctccaagtag

SEQ ID NO: 312038 - DNA, 25 bp, Rattus norvegicus
gaattacctgttattatgttccagc

SEQ ID NO: 312039 - DNA, 25 bp, Rattus norvegicus
gaattacctgtttttatgttccagc

SEQ ID NO: 312040 - DNA, 25 bp, Rattus norvegicus
gaattacgaagcacactgaccgggt

SEQ ID NO: 312041 - DNA, 25 bp, Rattus norvegicus
gaattacgaagctcactgaccgggt

SEQ ID NO: 312042 - DNA, 25 bp, Rattus norvegicus
gaattacgacgacttcatgaagcgc

SEQ ID NO: 312043 - DNA, 25 bp, Rattus norvegicus
gaattacgacgagttcatgaagcgc

SEQ ID NO: 312044 - DNA, 25 bp, Rattus norvegicus
gaattacgatttagtaaatcccgtg

SEQ ID NO: 312045 - DNA, 25 bp, Rattus norvegicus
gaattacgattttgtaaatcccgtg

SEQ ID NO: 312046 - DNA, 25 bp, Rattus norvegicus
gaattacgtttcatcctgtgatttg

SEQ ID NO: 312047 - DNA, 25 bp, Rattus norvegicus
gaattacgtttcttcctgtgatttg

SEQ ID NO: 312048 - DNA, 25 bp, Rattus norvegicus
gaattactaggtccatctcactcag

SEQ ID NO: 312049 - DNA, 25 bp, Rattus norvegicus
gaattactaggtgcatctcactcag

SEQ ID NO: 312050 - DNA, 25 bp, Rattus norvegicus
gaattactcagcatggcatttacca

SEQ ID NO: 312051 - DNA, 25 bp, Rattus norvegicus
gaattactcagcttggcatttacca

SEQ ID NO: 312052 - DNA, 25 bp, Rattus norvegicus
gaattactccgtctactgttgctgt

SEQ ID NO: 312053 - DNA, 25 bp, Rattus norvegicus
gaattactccgtgtactgttgctgt

SEQ ID NO: 312054 - DNA, 25 bp, Rattus norvegicus
gaattactcgccatcttgtggacag

SEQ ID NO: 312055 - DNA, 25 bp, Rattus norvegicus
gaattactcgccttcttgtggacag

SEQ ID NO: 312056 - DNA, 25 bp, Rattus norvegicus
gaattactctataacttccgtgcgc

SEQ ID NO: 312057 - DNA, 25 bp, Rattus norvegicus
gaattactctattacttccgtgcgc

SEQ ID NO: 312058 - DNA, 25 bp, Rattus norvegicus
gaattactcttacactcttatcaga

SEQ ID NO: 312059 - DNA, 25 bp, Rattus norvegicus
gaattactcttagactcttatcaga

SEQ ID NO: 312060 - DNA, 25 bp, Rattus norvegicus
gaattactgataattgcgctccaaa

SEQ ID NO: 312061 - DNA, 25 bp, Rattus norvegicus
gaattactgatatttgcgctccaaa

SEQ ID NO: 312062 - DNA, 25 bp, Rattus norvegicus
gaattactgtaaaccaatgcctata

SEQ ID NO: 312063 - DNA, 25 bp, Rattus norvegicus
gaattactgtaatccaatgcctata

SEQ ID NO: 312064 - DNA, 25 bp, Rattus norvegicus
gaattactgtcaacatcctctcaga

SEQ ID NO: 312065 - DNA, 25 bp, Rattus norvegicus
gaattactgtcatcatcctctcaga

SEQ ID NO: 312066 - DNA, 25 bp, Rattus norvegicus
gaattactgtgcaaagggttacctt

SEQ ID NO: 312067 - DNA, 25 bp, Rattus norvegicus
gaattactgtgctaagggttacctt

SEQ ID NO: 312068 - DNA, 25 bp, Rattus norvegicus
gaattacttcctctttctcctttag

SEQ ID NO: 312069 - DNA, 25 bp, Rattus norvegicus
gaattacttcctgtttctcctttag

SEQ ID NO: 312070 - DNA, 25 bp, Rattus norvegicus
gaattactttcaatcgctttgctcc

SEQ ID NO: 312071 - DNA, 25 bp, Rattus norvegicus
gaattactttcattcgctttgctcc

SEQ ID NO: 312072 - DNA, 25 bp, Rattus norvegicus
gaattactttgcctattgcactgta

SEQ ID NO: 312073 - DNA, 25 bp, Rattus norvegicus
gaattactttgcgtattgcactgta

SEQ ID NO: 312074 - DNA, 25 bp, Rattus norvegicus
gaattagaaagaccgctccccactt

SEQ ID NO: 312075 - DNA, 25 bp, Rattus norvegicus
gaattagaaagagcgctccccactt

SEQ ID NO: 312076 - DNA, 25 bp, Rattus norvegicus
gaattagaagtaccctcgtccactt

SEQ ID NO: 312077 - DNA, 25 bp, Rattus norvegicus
gaattagaagtagcctcgtccactt

SEQ ID NO: 312078 - DNA, 25 bp, Rattus norvegicus
gaattagaatcgaacctgcccttgg

SEQ ID NO: 312079 - DNA, 25 bp, Rattus norvegicus
gaattagaatcgtacctgcccttgg

SEQ ID NO: 312080 - DNA, 25 bp, Rattus norvegicus
gaattagaatttagtggcctggata

SEQ ID NO: 312081 - DNA, 25 bp, Rattus norvegicus
gaattagaattttgtggcctggata

SEQ ID NO: 312082 - DNA, 25 bp, Rattus norvegicus
gaattagaccgccagccaggaaaag

SEQ ID NO: 312083 - DNA, 25 bp, Rattus norvegicus
gaattagaccgcgagccaggaaaag

SEQ ID NO: 312084 - DNA, 25 bp, Rattus norvegicus
gaattagactgactcactgtcccat

SEQ ID NO: 312085 - DNA, 25 bp, Rattus norvegicus
gaattagactgagtcactgtcccat

SEQ ID NO: 312086 - DNA, 25 bp, Rattus norvegicus
gaattagactgtattccctgggctt

SEQ ID NO: 312087 - DNA, 25 bp, Rattus norvegicus
gaattagactgttttccctgggctt

SEQ ID NO: 312088 - DNA, 25 bp, Rattus norvegicus
gaattagacttcaccctgaccattg

SEQ ID NO: 312089 - DNA, 25 bp, Rattus norvegicus
gaattagacttccatcatgaacaag

SEQ ID NO: 312090 - DNA, 25 bp, Rattus norvegicus
gaattagacttcgatcatgaacaag

SEQ ID NO: 312091 - DNA, 25 bp, Rattus norvegicus
gaattagacttctccctgaccattg

SEQ ID NO: 312092 - DNA, 25 bp, Rattus norvegicus
gaattagaggacatagctgggtttt

SEQ ID NO: 312093 - DNA, 25 bp, Rattus norvegicus
gaattagaggacttagctgggtttt

SEQ ID NO: 312094 - DNA, 25 bp, Rattus norvegicus
gaattagatcaacggcttcctccat

SEQ ID NO: 312095 - DNA, 25 bp, Rattus norvegicus
gaattagatcaagggcttcctccat

SEQ ID NO: 312096 - DNA, 25 bp, Rattus norvegicus
gaattagattgcctgtacccaagcg

SEQ ID NO: 312097 - DNA, 25 bp, Rattus norvegicus
gaattagattgcgtgtacccaagcg

SEQ ID NO: 312098 - DNA, 25 bp, Rattus norvegicus
gaattagcaaaccaataccaggact

SEQ ID NO: 312099 - DNA, 25 bp, Rattus norvegicus
gaattagcaaacgaataccaggact

SEQ ID NO: 312100 - DNA, 25 bp, Rattus norvegicus
gaattagcaaccatgcagcagcctg

SEQ ID NO: 312101 - DNA, 25 bp, Rattus norvegicus
gaattagcaaccttgcagcagcctg

SEQ ID NO: 312102 - DNA, 25 bp, Rattus norvegicus
gaattagcacctcaccaacaacatt

SEQ ID NO: 312103 - DNA, 25 bp, Rattus norvegicus
gaattagcacctgaccaacaacatt

SEQ ID NO: 312104 - DNA, 25 bp, Rattus norvegicus
gaattagcatccaacaactgtaccg

SEQ ID NO: 312105 - DNA, 25 bp, Rattus norvegicus
gaattagcatcctacaactgtaccg

SEQ ID NO: 312106 - DNA, 25 bp, Rattus norvegicus
gaattagccatcacgaggatctcca

SEQ ID NO: 312107 - DNA, 25 bp, Rattus norvegicus
gaattagccatctcgaggatctcca

SEQ ID NO: 312108 - DNA, 25 bp, Rattus norvegicus
gaattagctgttaccctatgaatct

SEQ ID NO: 312109 - DNA, 25 bp, Rattus norvegicus
gaattagctgtttccctatgaatct

SEQ ID NO: 312110 - DNA, 25 bp, Rattus norvegicus
gaattagcttcgattgttcttcggt

SEQ ID NO: 312111 - DNA, 25 bp, Rattus norvegicus
gaattagcttcgtttgttcttcggt

SEQ ID NO: 312112 - DNA, 25 bp, Rattus norvegicus
gaattagcttgccttgtgtatacaa

SEQ ID NO: 312113 - DNA, 25 bp, Rattus norvegicus
gaattagcttgcgttgtgtatacaa

SEQ ID NO: 312114 - DNA, 25 bp, Rattus norvegicus
gaattaggccggagagtaagtagct

SEQ ID NO: 312115 - DNA, 25 bp, Rattus norvegicus
gaattaggccggtgagtaagtagct

SEQ ID NO: 312116 - DNA, 25 bp, Rattus norvegicus
gaattaggcctgatgactttccttt

SEQ ID NO: 312117 - DNA, 25 bp, Rattus norvegicus
gaattaggcctgttgactttccttt

SEQ ID NO: 312118 - DNA, 25 bp, Rattus norvegicus
gaattaggctctccaacactcccag

SEQ ID NO: 312119 - DNA, 25 bp, Rattus norvegicus
gaattaggctctgcaacactcccag

SEQ ID NO: 312120 - DNA, 25 bp, Rattus norvegicus
gaattaggctggcattctctgcaga

SEQ ID NO: 312121 - DNA, 25 bp, Rattus norvegicus
gaattaggctgggattctctgcaga

SEQ ID NO: 312122 - DNA, 25 bp, Rattus norvegicus
gaattaggtagtcaccttctcacct

SEQ ID NO: 312123 - DNA, 25 bp, Rattus norvegicus
gaattaggtagtgaccttctcacct

SEQ ID NO: 312124 - DNA, 25 bp, Rattus norvegicus
gaattaggtgaactacccccacgtg

SEQ ID NO: 312125 - DNA, 25 bp, Rattus norvegicus
gaattaggtgaagtacccccacgtg

SEQ ID NO: 312126 - DNA, 25 bp, Rattus norvegicus
gaattagtaagaaagcagacccaat

SEQ ID NO: 312127 - DNA, 25 bp, Rattus norvegicus
gaattagtaagatagcagacccaat

SEQ ID NO: 312128 - DNA, 25 bp, Rattus norvegicus
gaattagtcctcatgctctagtgtc

SEQ ID NO: 312129 - DNA, 25 bp, Rattus norvegicus
gaattagtcctcttgctctagtgtc

SEQ ID NO: 312130 - DNA, 25 bp, Rattus norvegicus
gaattagtcggtatctgagttctct

SEQ ID NO: 312131 - DNA, 25 bp, Rattus norvegicus
gaattagtcggtttctgagttctct

SEQ ID NO: 312132 - DNA, 25 bp, Rattus norvegicus
gaattagtcgtcattccagtccttt

SEQ ID NO: 312133 - DNA, 25 bp, Rattus norvegicus
gaattagtcgtctttccagtccttt

SEQ ID NO: 312134 - DNA, 25 bp, Rattus norvegicus
gaattagtctcacgctttaacgttg

SEQ ID NO: 312135 - DNA, 25 bp, Rattus norvegicus
gaattagtctcaggctttaacgttg

SEQ ID NO: 312136 - DNA, 25 bp, Rattus norvegicus
gaattagtctttctcacacagacct

SEQ ID NO: 312137 - DNA, 25 bp, Rattus norvegicus
gaattagtctttgtcacacagacct

SEQ ID NO: 312138 - DNA, 25 bp, Rattus norvegicus
gaattagtgatcacgggcatcggcc

SEQ ID NO: 312139 - DNA, 25 bp, Rattus norvegicus
gaattagtgatctcgggcatcggcc

SEQ ID NO: 312140 - DNA, 25 bp, Rattus norvegicus
gaattagtgctcattacttcttcag

SEQ ID NO: 312141 - DNA, 25 bp, Rattus norvegicus
gaattagtgctctttacttcttcag

SEQ ID NO: 312142 - DNA, 25 bp, Rattus norvegicus
gaattagttcacacagtggaacttg

SEQ ID NO: 312143 - DNA, 25 bp, Rattus norvegicus
gaattagttcactcagtggaacttg

SEQ ID NO: 312144 - DNA, 25 bp, Rattus norvegicus
gaattagttgatctcgctgtagaaa

SEQ ID NO: 312145 - DNA, 25 bp, Rattus norvegicus
gaattagttgatgtcgctgtagaaa

SEQ ID NO: 312146 - DNA, 25 bp, Rattus norvegicus
gaattagttgtcagcttttgtatct

SEQ ID NO: 312147 - DNA, 25 bp, Rattus norvegicus
gaattagttgtctgcttttgtatct

SEQ ID NO: 312148 - DNA, 25 bp, Rattus norvegicus
gaattatacatacttatggcatgga

SEQ ID NO: 312149 - DNA, 25 bp, Rattus norvegicus
gaattatacatagttatggcatgga

SEQ ID NO: 312150 - DNA, 25 bp, Rattus norvegicus
gaattataccatctgtgccaactat

SEQ ID NO: 312151 - DNA, 25 bp, Rattus norvegicus
gaattataccatgtgtgccaactat

SEQ ID NO: 312152 - DNA, 25 bp, Rattus norvegicus
gaattatactccagagccatgtccc

SEQ ID NO: 312153 - DNA, 25 bp, Rattus norvegicus
gaattatactcctgagccatgtccc

SEQ ID NO: 312154 - DNA, 25 bp, Rattus norvegicus
gaattatagcttactctctgcttgt

SEQ ID NO: 312155 - DNA, 25 bp, Rattus norvegicus
gaattatagctttctctctgcttgt

SEQ ID NO: 312156 - DNA, 25 bp, Rattus norvegicus
gaattataggctccaccacacactg

SEQ ID NO: 312157 - DNA, 25 bp, Rattus norvegicus
gaattataggctgcaccacacactg

SEQ ID NO: 312158 - DNA, 25 bp, Rattus norvegicus
gaattatatatacacctgccctggg

SEQ ID NO: 312159 - DNA, 25 bp, Rattus norvegicus
gaattatatatagacctgccctggg

SEQ ID NO: 312160 - DNA, 25 bp, Rattus norvegicus
gaattatatctgactccctgatgaa

SEQ ID NO: 312161 - DNA, 25 bp, Rattus norvegicus
gaattatatctgtctccctgatgaa

SEQ ID NO: 312162 - DNA, 25 bp, Rattus norvegicus
gaattatcactgattttcctaggac

SEQ ID NO: 312163 - DNA, 25 bp, Rattus norvegicus
gaattatcactgtttttcctaggac

SEQ ID NO: 312164 - DNA, 25 bp, Rattus norvegicus
gaattatcagatccatgttacatta

SEQ ID NO: 312165 - DNA, 25 bp, Rattus norvegicus
gaattatcagatgcatgttacatta

SEQ ID NO: 312166 - DNA, 25 bp, Rattus norvegicus
gaattatcaggaatgttgccaagga

SEQ ID NO: 312167 - DNA, 25 bp, Rattus norvegicus
gaattatcaggattgttgccaagga

SEQ ID NO: 312168 - DNA, 25 bp, Rattus norvegicus
gaattatccccaacggttgtgaaga

SEQ ID NO: 312169 - DNA, 25 bp, Rattus norvegicus
gaattatccccatcggttgtgaaga

SEQ ID NO: 312170 - DNA, 25 bp, Rattus norvegicus
gaattatcctcaatcccaattgctc

SEQ ID NO: 312171 - DNA, 25 bp, Rattus norvegicus
gaattatcctcattcccaattgctc

SEQ ID NO: 312172 - DNA, 25 bp, Rattus norvegicus
gaattatcgtttaatctcaacttga

SEQ ID NO: 312173 - DNA, 25 bp, Rattus norvegicus
gaattatcgttttatctcaacttga

SEQ ID NO: 312174 - DNA, 25 bp, Rattus norvegicus
gaattatctcccaacgatggatttg

SEQ ID NO: 312175 - DNA, 25 bp, Rattus norvegicus
gaattatctccctacgatggatttg

SEQ ID NO: 312176 - DNA, 25 bp, Rattus norvegicus
gaattatctgtacgcttttccagac

SEQ ID NO: 312177 - DNA, 25 bp, Rattus norvegicus
gaattatctgtaggcttttccagac

SEQ ID NO: 312178 - DNA, 25 bp, Rattus norvegicus
gaattatgagcaacctttgggctgc

SEQ ID NO: 312179 - DNA, 25 bp, Rattus norvegicus
gaattatgagcatcctttgggctgc

SEQ ID NO: 312180 - DNA, 25 bp, Rattus norvegicus
gaattatgctttctaggtgctgcca

SEQ ID NO: 312181 - DNA, 25 bp, Rattus norvegicus
gaattatgctttgtaggtgctgcca

SEQ ID NO: 312182 - DNA, 25 bp, Rattus norvegicus
gaattattcagtcctcttcttgaga

SEQ ID NO: 312183 - DNA, 25 bp, Rattus norvegicus
gaattattcagtgctcttcttgaga

SEQ ID NO: 312184 - DNA, 25 bp, Rattus norvegicus
gaattattcctaagaaccattgaag

SEQ ID NO: 312185 - DNA, 25 bp, Rattus norvegicus
gaattattcctatgaaccattgaag

SEQ ID NO: 312186 - DNA, 25 bp, Rattus norvegicus
gaattattccttcttcattgttgtt

SEQ ID NO: 312187 - DNA, 25 bp, Rattus norvegicus
gaattattccttgttcattgttgtt

SEQ ID NO: 312188 - DNA, 25 bp, Rattus norvegicus
gaattattcttccatggcagcactg

SEQ ID NO: 312189 - DNA, 25 bp, Rattus norvegicus
gaattattcttcgatggcagcactg

SEQ ID NO: 312190 - DNA, 25 bp, Rattus norvegicus
gaattattgaaacactgagcagctg

SEQ ID NO: 312191 - DNA, 25 bp, Rattus norvegicus
gaattattgaaagactgagcagctg

SEQ ID NO: 312192 - DNA, 25 bp, Rattus norvegicus
gaattattgtgcaacaacttcacct

SEQ ID NO: 312193 - DNA, 25 bp, Rattus norvegicus
gaattattgtgctacaacttcacct

SEQ ID NO: 312194 - DNA, 25 bp, Rattus norvegicus
gaattattgttccttacagttacgt

SEQ ID NO: 312195 - DNA, 25 bp, Rattus norvegicus
gaattattgttcgttacagttacgt

SEQ ID NO: 312196 - DNA, 25 bp, Rattus norvegicus
gaattattgtttagccctgtctggt

SEQ ID NO: 312197 - DNA, 25 bp, Rattus norvegicus
gaattattgttttgccctgtctggt

SEQ ID NO: 312198 - DNA, 25 bp, Rattus norvegicus
gaattatttaggacccagtattggt

SEQ ID NO: 312199 - DNA, 25 bp, Rattus norvegicus
gaattatttaggtcccagtattggt

SEQ ID NO: 312200 - DNA, 25 bp, Rattus norvegicus
gaattatttctaaacacacacctga

SEQ ID NO: 312201 - DNA, 25 bp, Rattus norvegicus
gaattatttctatacacacacctga

SEQ ID NO: 312202 - DNA, 25 bp, Rattus norvegicus
gaattatttcttaggctacctctct

SEQ ID NO: 312203 - DNA, 25 bp, Rattus norvegicus
gaattatttctttggctacctctct

SEQ ID NO: 312204 - DNA, 25 bp, Rattus norvegicus
gaattattttccctgctgcatcata

SEQ ID NO: 312205 - DNA, 25 bp, Rattus norvegicus
gaattattttccgtgctgcatcata

SEQ ID NO: 312206 - DNA, 25 bp, Rattus norvegicus
gaattatttttcatgtgacttatga

SEQ ID NO: 312207 - DNA, 25 bp, Rattus norvegicus
gaattatttttcttgtgacttatga

SEQ ID NO: 312208 - DNA, 25 bp, Rattus norvegicus
gaattcaaaattcagctctaggccc

SEQ ID NO: 312209 - DNA, 25 bp, Rattus norvegicus
gaattcaaaattgagctctaggccc

SEQ ID NO: 312210 - DNA, 25 bp, Rattus norvegicus
gaattcaaactcacctgatgatgtg

SEQ ID NO: 312211 - DNA, 25 bp, Rattus norvegicus
gaattcaaactctcctgatgatgtg

SEQ ID NO: 312212 - DNA, 25 bp, Rattus norvegicus
gaattcaacattcaccattctatgg

SEQ ID NO: 312213 - DNA, 25 bp, Rattus norvegicus
gaattcaacattgaccattctatgg

SEQ ID NO: 312214 - DNA, 25 bp, Rattus norvegicus
gaattcaacgaacaccaggctgctt

SEQ ID NO: 312215 - DNA, 25 bp, Rattus norvegicus
gaattcaacgaagaccaggctgctt

SEQ ID NO: 312216 - DNA, 25 bp, Rattus norvegicus
gaattcaactgtatcccttccctca

SEQ ID NO: 312217 - DNA, 25 bp, Rattus norvegicus
gaattcaactgtccctatgggtatt

SEQ ID NO: 312218 - DNA, 25 bp, Rattus norvegicus
gaattcaactgtgcctatgggtatt

SEQ ID NO: 312219 - DNA, 25 bp, Rattus norvegicus
gaattcaactgtttcccttccctca

SEQ ID NO: 312220 - DNA, 25 bp, Rattus norvegicus
gaattcaagaatcactttccatgat

SEQ ID NO: 312221 - DNA, 25 bp, Rattus norvegicus
gaattcaagaatgactttccatgat

SEQ ID NO: 312222 - DNA, 25 bp, Rattus norvegicus
gaattcaagcagatgttcctttctg

SEQ ID NO: 312223 - DNA, 25 bp, Rattus norvegicus
gaattcaagcagttgttcctttctg

SEQ ID NO: 312224 - DNA, 25 bp, Rattus norvegicus
gaattcaagcccaacaatgctgtga

SEQ ID NO: 312225 - DNA, 25 bp, Rattus norvegicus
gaattcaagccctacaatgctgtga

SEQ ID NO: 312226 - DNA, 25 bp, Rattus norvegicus
gaattcaaggaccagttgcctgctg

SEQ ID NO: 312227 - DNA, 25 bp, Rattus norvegicus
gaattcaaggacgagttgcctgctg

SEQ ID NO: 312228 - DNA, 25 bp, Rattus norvegicus
gaattcaaggtcattagctacacag

SEQ ID NO: 312229 - DNA, 25 bp, Rattus norvegicus
gaattcaaggtctttagctacacag

SEQ ID NO: 312230 - DNA, 25 bp, Rattus norvegicus
gaattcaagtgcctccttgtttacc

SEQ ID NO: 312231 - DNA, 25 bp, Rattus norvegicus
gaattcaagtgcgtccttgtttacc

SEQ ID NO: 312232 - DNA, 25 bp, Rattus norvegicus
gaattcaatcaactggccaaagcat

SEQ ID NO: 312233 - DNA, 25 bp, Rattus norvegicus
gaattcaatcaagtggccaaagcat

SEQ ID NO: 312234 - DNA, 25 bp, Rattus norvegicus
gaattcaatcttacatcgagtgttt

SEQ ID NO: 312235 - DNA, 25 bp, Rattus norvegicus
gaattcaatctttcatcgagtgttt

SEQ ID NO: 312236 - DNA, 25 bp, Rattus norvegicus
gaattcaatgtgactctgatagcaa

SEQ ID NO: 312237 - DNA, 25 bp, Rattus norvegicus
gaattcaatgtgtctctgatagcaa

SEQ ID NO: 312238 - DNA, 25 bp, Rattus norvegicus
gaattcaattctaacacctacggtg

SEQ ID NO: 312239 - DNA, 25 bp, Rattus norvegicus
gaattcaattcttacacctacggtg

SEQ ID NO: 312240 - DNA, 25 bp, Rattus norvegicus
gaattcacagataccgtgtttgcca

SEQ ID NO: 312241 - DNA, 25 bp, Rattus norvegicus
gaattcacagattccgtgtttgcca

SEQ ID NO: 312242 - DNA, 25 bp, Rattus norvegicus
gaattcacagctcaaggccttgact

SEQ ID NO: 312243 - DNA, 25 bp, Rattus norvegicus
gaattcacagctgaaggccttgact

SEQ ID NO: 312244 - DNA, 25 bp, Rattus norvegicus
gaattcacattcaagcacgtgcttc

SEQ ID NO: 312245 - DNA, 25 bp, Rattus norvegicus
gaattcacattctagcacgtgcttc

SEQ ID NO: 312246 - DNA, 25 bp, Rattus norvegicus
gaattcacatttcctacttggtcta

SEQ ID NO: 312247 - DNA, 25 bp, Rattus norvegicus
gaattcacatttgctacttggtcta

SEQ ID NO: 312248 - DNA, 25 bp, Rattus norvegicus
gaattcaccttaatcacgaccttag

SEQ ID NO: 312249 - DNA, 25 bp, Rattus norvegicus
gaattcaccttattcacgaccttag

SEQ ID NO: 312250 - DNA, 25 bp, Rattus norvegicus
gaattcacgggaactctgtggtcgt

SEQ ID NO: 312251 - DNA, 25 bp, Rattus norvegicus
gaattcacgggatctctgtggtcgt

SEQ ID NO: 312252 - DNA, 25 bp, Rattus norvegicus
gaattcacgtgactagggccatttt

SEQ ID NO: 312253 - DNA, 25 bp, Rattus norvegicus
gaattcacgtgagtagggccatttt

SEQ ID NO: 312254 - DNA, 25 bp, Rattus norvegicus
gaattcactgtgatagttttcccaa

SEQ ID NO: 312255 - DNA, 25 bp, Rattus norvegicus
gaattcactgtgttagttttcccaa

SEQ ID NO: 312256 - DNA, 25 bp, Rattus norvegicus
gaattcacttccctacgatggtaag

SEQ ID NO: 312257 - DNA, 25 bp, Rattus norvegicus
gaattcacttccgtacgatggtaag

SEQ ID NO: 312258 - DNA, 25 bp, Rattus norvegicus
gaattcagaactcagcagccgtatc

SEQ ID NO: 312259 - DNA, 25 bp, Rattus norvegicus
gaattcagaactgagcagccgtatc

SEQ ID NO: 312260 - DNA, 25 bp, Rattus norvegicus
gaattcagacctctccactggagta

SEQ ID NO: 312261 - DNA, 25 bp, Rattus norvegicus
gaattcagacctgtccactggagta

SEQ ID NO: 312262 - DNA, 25 bp, Rattus norvegicus
gaattcagagacaacctagactaca

SEQ ID NO: 312263 - DNA, 25 bp, Rattus norvegicus
gaattcagagactacctagactaca

SEQ ID NO: 312264 - DNA, 25 bp, Rattus norvegicus
gaattcagagccatgtgccaaaaca

SEQ ID NO: 312265 - DNA, 25 bp, Rattus norvegicus
gaattcagagccttgtgccaaaaca

SEQ ID NO: 312266 - DNA, 25 bp, Rattus norvegicus
gaattcagagcgaggacagacatca

SEQ ID NO: 312267 - DNA, 25 bp, Rattus norvegicus
gaattcagagcgtggacagacatca

SEQ ID NO: 312268 - DNA, 25 bp, Rattus norvegicus
gaattcagagctacggtcactttaa

SEQ ID NO: 312269 - DNA, 25 bp, Rattus norvegicus
gaattcagagcttcggtcactttaa

SEQ ID NO: 312270 - DNA, 25 bp, Rattus norvegicus
gaattcagataaccctaaccctcag

SEQ ID NO: 312271 - DNA, 25 bp, Rattus norvegicus
gaattcagataagcctaaccctcag

SEQ ID NO: 312272 - DNA, 25 bp, Rattus norvegicus
gaattcagatcactcgttgatgttt

SEQ ID NO: 312273 - DNA, 25 bp, Rattus norvegicus
gaattcagatcagtcgttgatgttt

SEQ ID NO: 312274 - DNA, 25 bp, Rattus norvegicus
gaattcagatgtactctccataaat

SEQ ID NO: 312275 - DNA, 25 bp, Rattus norvegicus
gaattcagatgttctctccataaat

SEQ ID NO: 312276 - DNA, 25 bp, Rattus norvegicus
gaattcagccatcagttttaaaaag

SEQ ID NO: 312277 - DNA, 25 bp, Rattus norvegicus
gaattcagccatgagttttaaaaag

SEQ ID NO: 312278 - DNA, 25 bp, Rattus norvegicus
gaattcagctaacatttgtgaccta

SEQ ID NO: 312279 - DNA, 25 bp, Rattus norvegicus
gaattcagctaagatttgtgaccta

SEQ ID NO: 312280 - DNA, 25 bp, Rattus norvegicus
gaattcagctctagacatcgatggt

SEQ ID NO: 312281 - DNA, 25 bp, Rattus norvegicus
gaattcagctcttgacatcgatggt

SEQ ID NO: 312282 - DNA, 25 bp, Rattus norvegicus
gaattcagctgacaacggctttcaa

SEQ ID NO: 312283 - DNA, 25 bp, Rattus norvegicus
gaattcagctgagaacggctttcaa

SEQ ID NO: 312284 - DNA, 25 bp, Rattus norvegicus
gaattcaggctgcacacagctttaa

SEQ ID NO: 312285 - DNA, 25 bp, Rattus norvegicus
gaattcaggctggacacagctttaa

SEQ ID NO: 312286 - DNA, 25 bp, Rattus norvegicus
gaattcaggtccacttcaagaagaa

SEQ ID NO: 312287 - DNA, 25 bp, Rattus norvegicus
gaattcaggtcctcttcaagaagaa

SEQ ID NO: 312288 - DNA, 25 bp, Rattus norvegicus
gaattcaggtgcacacgcttcaatt

SEQ ID NO: 312289 - DNA, 25 bp, Rattus norvegicus
gaattcaggtgcattagccgtttgt

SEQ ID NO: 312290 - DNA, 25 bp, Rattus norvegicus
gaattcaggtgctcacgcttcaatt

SEQ ID NO: 312291 - DNA, 25 bp, Rattus norvegicus
gaattcaggtgctttagccgtttgt

SEQ ID NO: 312292 - DNA, 25 bp, Rattus norvegicus
gaattcagtcagatttcagggaaga

SEQ ID NO: 312293 - DNA, 25 bp, Rattus norvegicus
gaattcagtcagttttcagggaaga

SEQ ID NO: 312294 - DNA, 25 bp, Rattus norvegicus
gaattcagtcatctacaccaatcaa

SEQ ID NO: 312295 - DNA, 25 bp, Rattus norvegicus
gaattcagtcatgtacaccaatcaa

SEQ ID NO: 312296 - DNA, 25 bp, Rattus norvegicus
gaattcagtcctatcttactgaggt

SEQ ID NO: 312297 - DNA, 25 bp, Rattus norvegicus
gaattcagtcctttcttactgaggt

SEQ ID NO: 312298 - DNA, 25 bp, Rattus norvegicus
gaattcagtctcatgcaatacaagt

SEQ ID NO: 312299 - DNA, 25 bp, Rattus norvegicus
gaattcagtctcttgcaatacaagt

SEQ ID NO: 312300 - DNA, 25 bp, Rattus norvegicus
gaattcagtgaacccaagcctaatg

SEQ ID NO: 312301 - DNA, 25 bp, Rattus norvegicus
gaattcagtgaagccaagcctaatg

SEQ ID NO: 312302 - DNA, 25 bp, Rattus norvegicus
gaattcagtgcaagtccatctgcct

SEQ ID NO: 312303 - DNA, 25 bp, Rattus norvegicus
gaattcagtgcatgtccatctgcct

SEQ ID NO: 312304 - DNA, 25 bp, Rattus norvegicus
gaattcagttccctgcacctacatg

SEQ ID NO: 312305 - DNA, 25 bp, Rattus norvegicus
gaattcagttccgtgcacctacatg

SEQ ID NO: 312306 - DNA, 25 bp, Rattus norvegicus
gaattcagttctactctgtacagaa

SEQ ID NO: 312307 - DNA, 25 bp, Rattus norvegicus
gaattcagttctcttctgtctggct

SEQ ID NO: 312308 - DNA, 25 bp, Rattus norvegicus
gaattcagttctgttctgtctggct

SEQ ID NO: 312309 - DNA, 25 bp, Rattus norvegicus
gaattcagttcttctctgtacagaa

SEQ ID NO: 312310 - DNA, 25 bp, Rattus norvegicus
gaattcagttttcatgttccaaatt

SEQ ID NO: 312311 - DNA, 25 bp, Rattus norvegicus
gaattcagttttgatgttccaaatt

SEQ ID NO: 312312 - DNA, 25 bp, Rattus norvegicus
gaattcatactccacctgcaaaggc

SEQ ID NO: 312313 - DNA, 25 bp, Rattus norvegicus
gaattcatactcgacctgcaaaggc

SEQ ID NO: 312314 - DNA, 25 bp, Rattus norvegicus
gaattcatatccatttaccacttga

SEQ ID NO: 312315 - DNA, 25 bp, Rattus norvegicus
gaattcatatccttttaccacttga

SEQ ID NO: 312316 - DNA, 25 bp, Rattus norvegicus
gaattcatcaaccttccagtgacag

SEQ ID NO: 312317 - DNA, 25 bp, Rattus norvegicus
gaattcatcaacgttccagtgacag

SEQ ID NO: 312318 - DNA, 25 bp, Rattus norvegicus
gaattcatcagcaacagacctaaag

SEQ ID NO: 312319 - DNA, 25 bp, Rattus norvegicus
gaattcatcagctacagacctaaag

SEQ ID NO: 312320 - DNA, 25 bp, Rattus norvegicus
gaattcatccagacagaggccccta

SEQ ID NO: 312321 - DNA, 25 bp, Rattus norvegicus
gaattcatccagtcagaggccccta

SEQ ID NO: 312322 - DNA, 25 bp, Rattus norvegicus
gaattcatcgctattgttaccattt

SEQ ID NO: 312323 - DNA, 25 bp, Rattus norvegicus
gaattcatcgcttttgttaccattt

SEQ ID NO: 312324 - DNA, 25 bp, Rattus norvegicus
gaattcatcggcaaaaatcacagga

SEQ ID NO: 312325 - DNA, 25 bp, Rattus norvegicus
gaattcatcggctaaaatcacagga

SEQ ID NO: 312326 - DNA, 25 bp, Rattus norvegicus
gaattcatgacaccttggactcttc

SEQ ID NO: 312327 - DNA, 25 bp, Rattus norvegicus
gaattcatgacagcttggactcttc

SEQ ID NO: 312328 - DNA, 25 bp, Rattus norvegicus
gaattcatggccaaatgtatacaaa

SEQ ID NO: 312329 - DNA, 25 bp, Rattus norvegicus
gaattcatggcctaatgtatacaaa

SEQ ID NO: 312330 - DNA, 25 bp, Rattus norvegicus
gaattcatggctcaacaccggcggg

SEQ ID NO: 312331 - DNA, 25 bp, Rattus norvegicus
gaattcatggctgaacaccggcggg

SEQ ID NO: 312332 - DNA, 25 bp, Rattus norvegicus
gaattcatgtttactctctgccagg

SEQ ID NO: 312333 - DNA, 25 bp, Rattus norvegicus
gaattcatgttttctctctgccagg

SEQ ID NO: 312334 - DNA, 25 bp, Rattus norvegicus
gaattcattattccctcagtcaact

SEQ ID NO: 312335 - DNA, 25 bp, Rattus norvegicus
gaattcattattgcctcagtcaact

SEQ ID NO: 312336 - DNA, 25 bp, Rattus norvegicus
gaattcatttccactttgggcatgg

SEQ ID NO: 312337 - DNA, 25 bp, Rattus norvegicus
gaattcatttccctgtagtcacaac

SEQ ID NO: 312338 - DNA, 25 bp, Rattus norvegicus
gaattcatttccgtgtagtcacaac

SEQ ID NO: 312339 - DNA, 25 bp, Rattus norvegicus
gaattcatttcctctttgggcatgg

SEQ ID NO: 312340 - DNA, 25 bp, Rattus norvegicus
gaattcatttgaatcctgcatcaat

SEQ ID NO: 312341 - DNA, 25 bp, Rattus norvegicus
gaattcatttgattcctgcatcaat

SEQ ID NO: 312342 - DNA, 25 bp, Rattus norvegicus
gaattcatttgcacctaaaccttgc

SEQ ID NO: 312343 - DNA, 25 bp, Rattus norvegicus
gaattcatttgctcctaaaccttgc

SEQ ID NO: 312344 - DNA, 25 bp, Rattus norvegicus
gaattccaaacaacacgcaatcaaa

SEQ ID NO: 312345 - DNA, 25 bp, Rattus norvegicus
gaattccaaacatcacgcaatcaaa

SEQ ID NO: 312346 - DNA, 25 bp, Rattus norvegicus
gaattccaaccacgtttctcaggag

SEQ ID NO: 312347 - DNA, 25 bp, Rattus norvegicus
gaattccaaccaggtttctcaggag

SEQ ID NO: 312348 - DNA, 25 bp, Rattus norvegicus
gaattccaacggagcgcgatacctt

SEQ ID NO: 312349 - DNA, 25 bp, Rattus norvegicus
gaattccaacggtgcgcgatacctt

SEQ ID NO: 312350 - DNA, 25 bp, Rattus norvegicus
gaattccaagcaagacacctcgctt

SEQ ID NO: 312351 - DNA, 25 bp, Rattus norvegicus
gaattccaagcatgacacctcgctt

SEQ ID NO: 312352 - DNA, 25 bp, Rattus norvegicus
gaattccaaggaagtgtcagttaca

SEQ ID NO: 312353 - DNA, 25 bp, Rattus norvegicus
gaattccaaggatgtgtcagttaca

SEQ ID NO: 312354 - DNA, 25 bp, Rattus norvegicus
gaattccacatgagcagatgctaga

SEQ ID NO: 312355 - DNA, 25 bp, Rattus norvegicus
gaattccacatgtgcagatgctaga

SEQ ID NO: 312356 - DNA, 25 bp, Rattus norvegicus
gaattccacattcacagtctcttgt

SEQ ID NO: 312357 - DNA, 25 bp, Rattus norvegicus
gaattccacattgacagtctcttgt

SEQ ID NO: 312358 - DNA, 25 bp, Rattus norvegicus
gaattccaccaaccaggcatcataa

SEQ ID NO: 312359 - DNA, 25 bp, Rattus norvegicus
gaattccaccaagcaggcatcataa

SEQ ID NO: 312360 - DNA, 25 bp, Rattus norvegicus
gaattccaccttcatacttcaaatg

SEQ ID NO: 312361 - DNA, 25 bp, Rattus norvegicus
gaattccaccttgatacttcaaatg

SEQ ID NO: 312362 - DNA, 25 bp, Rattus norvegicus
gaattccactaacaaacaccaaggt

SEQ ID NO: 312363 - DNA, 25 bp, Rattus norvegicus
gaattccactaagaaacaccaaggt

SEQ ID NO: 312364 - DNA, 25 bp, Rattus norvegicus
gaattccacttcagagatgcaccaa

SEQ ID NO: 312365 - DNA, 25 bp, Rattus norvegicus
gaattccacttctgagatgcaccaa

SEQ ID NO: 312366 - DNA, 25 bp, Rattus norvegicus
gaattccagacaatgccacgaagcc

SEQ ID NO: 312367 - DNA, 25 bp, Rattus norvegicus
gaattccagacattgccacgaagcc

SEQ ID NO: 312368 - DNA, 25 bp, Rattus norvegicus
gaattccagcaccattagcatttgt

SEQ ID NO: 312369 - DNA, 25 bp, Rattus norvegicus
gaattccagcacgattagcatttgt

SEQ ID NO: 312370 - DNA, 25 bp, Rattus norvegicus
gaattccagcttcctctgaagcact

SEQ ID NO: 312371 - DNA, 25 bp, Rattus norvegicus
gaattccagcttgctctgaagcact

SEQ ID NO: 312372 - DNA, 25 bp, Rattus norvegicus
gaattccaggacagtaaaagctata

SEQ ID NO: 312373 - DNA, 25 bp, Rattus norvegicus
gaattccaggactgtaaaagctata

SEQ ID NO: 312374 - DNA, 25 bp, Rattus norvegicus
gaattccaggctcatttaccgtaaa

SEQ ID NO: 312375 - DNA, 25 bp, Rattus norvegicus
gaattccaggctgatttaccgtaaa

SEQ ID NO: 312376 - DNA, 25 bp, Rattus norvegicus
gaattccaggtgcttgtggctgcat

SEQ ID NO: 312377 - DNA, 25 bp, Rattus norvegicus
gaattccaggtggttgtggctgcat

SEQ ID NO: 312378 - DNA, 25 bp, Rattus norvegicus
gaattccaggttagcttggcctaca

SEQ ID NO: 312379 - DNA, 25 bp, Rattus norvegicus
gaattccaggtttgcttggcctaca

SEQ ID NO: 312380 - DNA, 25 bp, Rattus norvegicus
gaattccagtcaacagatatgtaac

SEQ ID NO: 312381 - DNA, 25 bp, Rattus norvegicus
gaattccagtcatcagatatgtaac

SEQ ID NO: 312382 - DNA, 25 bp, Rattus norvegicus
gaattccagtctactaatgtccacg

SEQ ID NO: 312383 - DNA, 25 bp, Rattus norvegicus
gaattccagtcttctaatgtccacg

SEQ ID NO: 312384 - DNA, 25 bp, Rattus norvegicus
gaattccagtttattcctcctgaag

SEQ ID NO: 312385 - DNA, 25 bp, Rattus norvegicus
gaattccagttttttcctcctgaag

SEQ ID NO: 312386 - DNA, 25 bp, Rattus norvegicus
gaattccatatgatcctgagttatt

SEQ ID NO: 312387 - DNA, 25 bp, Rattus norvegicus
gaattccatatgttcctgagttatt

SEQ ID NO: 312388 - DNA, 25 bp, Rattus norvegicus
gaattccatctcagggctacactaa

SEQ ID NO: 312389 - DNA, 25 bp, Rattus norvegicus
gaattccatctctgggctacactaa

SEQ ID NO: 312390 - DNA, 25 bp, Rattus norvegicus
gaattccattgtcatggccactggg

SEQ ID NO: 312391 - DNA, 25 bp, Rattus norvegicus
gaattccattgtgatggccactggg

SEQ ID NO: 312392 - DNA, 25 bp, Rattus norvegicus
gaattcccaacacgtgcagcgtaca

SEQ ID NO: 312393 - DNA, 25 bp, Rattus norvegicus
gaattcccaacaggtgcagcgtaca

SEQ ID NO: 312394 - DNA, 25 bp, Rattus norvegicus
gaattcccaagacgttctcatttct

SEQ ID NO: 312395 - DNA, 25 bp, Rattus norvegicus
gaattcccaagaggttctcatttct

SEQ ID NO: 312396 - DNA, 25 bp, Rattus norvegicus
gaattcccaaggacaaatgcggtta

SEQ ID NO: 312397 - DNA, 25 bp, Rattus norvegicus
gaattcccaaggtcaaatgcggtta

SEQ ID NO: 312398 - DNA, 25 bp, Rattus norvegicus
gaattcccaatactagccaggctag

SEQ ID NO: 312399 - DNA, 25 bp, Rattus norvegicus
gaattcccaatagtagccaggctag

SEQ ID NO: 312400 - DNA, 25 bp, Rattus norvegicus
gaattccccatacaggctggtgaca

SEQ ID NO: 312401 - DNA, 25 bp, Rattus norvegicus
gaattccccatagaggctggtgaca

SEQ ID NO: 312402 - DNA, 25 bp, Rattus norvegicus
gaattccccgtaatctgctgaatga

SEQ ID NO: 312403 - DNA, 25 bp, Rattus norvegicus
gaattccccgtattctgctgaatga

SEQ ID NO: 312404 - DNA, 25 bp, Rattus norvegicus
gaattcccctgtactttggctagga

SEQ ID NO: 312405 - DNA, 25 bp, Rattus norvegicus
gaattcccctgttctttggctagga

SEQ ID NO: 312406 - DNA, 25 bp, Rattus norvegicus
gaattccccttacaaaccatatgtg

SEQ ID NO: 312407 - DNA, 25 bp, Rattus norvegicus
gaattccccttagaaaccatatgtg

SEQ ID NO: 312408 - DNA, 25 bp, Rattus norvegicus
gaattcccttctcagcttatgtcga

SEQ ID NO: 312409 - DNA, 25 bp, Rattus norvegicus
gaattcccttctgagcttatgtcga

SEQ ID NO: 312410 - DNA, 25 bp, Rattus norvegicus
gaattcccttttaatcaactgtagg

SEQ ID NO: 312411 - DNA, 25 bp, Rattus norvegicus
gaattcccttttcgtgtggtactag

SEQ ID NO: 312412 - DNA, 25 bp, Rattus norvegicus
gaattcccttttggtgtggtactag

SEQ ID NO: 312413 - DNA, 25 bp, Rattus norvegicus
gaattccctttttatcaactgtagg

SEQ ID NO: 312414 - DNA, 25 bp, Rattus norvegicus
gaattccgagagaaatctaacacac

SEQ ID NO: 312415 - DNA, 25 bp, Rattus norvegicus
gaattccgagagtaatctaacacac

SEQ ID NO: 312416 - DNA, 25 bp, Rattus norvegicus
gaattccggaagagggctgcaaact

SEQ ID NO: 312417 - DNA, 25 bp, Rattus norvegicus
gaattccggaagtgggctgcaaact

SEQ ID NO: 312418 - DNA, 25 bp, Rattus norvegicus
gaattccgggacaagttagctgcct

SEQ ID NO: 312419 - DNA, 25 bp, Rattus norvegicus
gaattccgggactagttagctgcct

SEQ ID NO: 312420 - DNA, 25 bp, Rattus norvegicus
gaattccgtgacctcactggactgt

SEQ ID NO: 312421 - DNA, 25 bp, Rattus norvegicus
gaattccgtgacgtcactggactgt

SEQ ID NO: 312422 - DNA, 25 bp, Rattus norvegicus
gaattccgtgcgagggccacagcaa

SEQ ID NO: 312423 - DNA, 25 bp, Rattus norvegicus
gaattccgtgcgtgggccacagcaa

SEQ ID NO: 312424 - DNA, 25 bp, Rattus norvegicus
gaattccgtgtcaagtataactcaa

SEQ ID NO: 312425 - DNA, 25 bp, Rattus norvegicus
gaattccgtgtctagtataactcaa

SEQ ID NO: 312426 - DNA, 25 bp, Rattus norvegicus
gaattcctagatctcaacactcaca

SEQ ID NO: 312427 - DNA, 25 bp, Rattus norvegicus
gaattcctagatgtcaacactcaca

SEQ ID NO: 312428 - DNA, 25 bp, Rattus norvegicus
gaattcctagctcttgacattactc

SEQ ID NO: 312429 - DNA, 25 bp, Rattus norvegicus
gaattcctagctgttgacattactc

SEQ ID NO: 312430 - DNA, 25 bp, Rattus norvegicus
gaattcctaggtccagctaccacag

SEQ ID NO: 312431 - DNA, 25 bp, Rattus norvegicus
gaattcctaggtgcagctaccacag

SEQ ID NO: 312432 - DNA, 25 bp, Rattus norvegicus
gaattcctcaatcgtttctacgtta

SEQ ID NO: 312433 - DNA, 25 bp, Rattus norvegicus
gaattcctcaatggtttctacgtta

SEQ ID NO: 312434 - DNA, 25 bp, Rattus norvegicus
gaattcctcactcgtgagcgtcagc

SEQ ID NO: 312435 - DNA, 25 bp, Rattus norvegicus
gaattcctcactggtgagcgtcagc

SEQ ID NO: 312436 - DNA, 25 bp, Rattus norvegicus
gaattcctcagccactgtgaataca

SEQ ID NO: 312437 - DNA, 25 bp, Rattus norvegicus
gaattcctcagcgactgtgaataca

SEQ ID NO: 312438 - DNA, 25 bp, Rattus norvegicus
gaattcctcagtattgtgtgtctcc

SEQ ID NO: 312439 - DNA, 25 bp, Rattus norvegicus
gaattcctcagttttgtgtgtctcc

SEQ ID NO: 312440 - DNA, 25 bp, Rattus norvegicus
gaattcctcccaaagaacatcatcc

SEQ ID NO: 312441 - DNA, 25 bp, Rattus norvegicus
gaattcctcccatagaacatcatcc

SEQ ID NO: 312442 - DNA, 25 bp, Rattus norvegicus
gaattcctcctcagagaagaaatta

SEQ ID NO: 312443 - DNA, 25 bp, Rattus norvegicus
gaattcctcctctgagaagaaatta

SEQ ID NO: 312444 - DNA, 25 bp, Rattus norvegicus
gaattcctctcaccagattccagta

SEQ ID NO: 312445 - DNA, 25 bp, Rattus norvegicus
gaattcctctcagcagattccagta

SEQ ID NO: 312446 - DNA, 25 bp, Rattus norvegicus
gaattcctgccaagcaccttgaacg

SEQ ID NO: 312447 - DNA, 25 bp, Rattus norvegicus
gaattcctgccatgcaccttgaacg

SEQ ID NO: 312448 - DNA, 25 bp, Rattus norvegicus
gaattcctgctacttttctgccatt

SEQ ID NO: 312449 - DNA, 25 bp, Rattus norvegicus
gaattcctgctagttttctgccatt

SEQ ID NO: 312450 - DNA, 25 bp, Rattus norvegicus
gaattcctggcgaagctctttgtgg

SEQ ID NO: 312451 - DNA, 25 bp, Rattus norvegicus
gaattcctggcgtagctctttgtgg

SEQ ID NO: 312452 - DNA, 25 bp, Rattus norvegicus
gaattcctggtcctggtctaagata

SEQ ID NO: 312453 - DNA, 25 bp, Rattus norvegicus
gaattcctggtcgtggtctaagata

SEQ ID NO: 312454 - DNA, 25 bp, Rattus norvegicus
gaattcctggttatatgcatctatt

SEQ ID NO: 312455 - DNA, 25 bp, Rattus norvegicus
gaattcctggttttatgcatctatt

SEQ ID NO: 312456 - DNA, 25 bp, Rattus norvegicus
gaattcctgtataggctttcctttt

SEQ ID NO: 312457 - DNA, 25 bp, Rattus norvegicus
gaattcctgtattggctttcctttt

SEQ ID NO: 312458 - DNA, 25 bp, Rattus norvegicus
gaattcctgtcactcaggagcacac

SEQ ID NO: 312459 - DNA, 25 bp, Rattus norvegicus
gaattcctgtcagtcaggagcacac

SEQ ID NO: 312460 - DNA, 25 bp, Rattus norvegicus
gaattcctgtccacagcttcagaat

SEQ ID NO: 312461 - DNA, 25 bp, Rattus norvegicus
gaattcctgtcctcagcttcagaat

SEQ ID NO: 312462 - DNA, 25 bp, Rattus norvegicus
gaattcctgttaaaggcacacacta

SEQ ID NO: 312463 - DNA, 25 bp, Rattus norvegicus
gaattcctgttataggcacacacta

SEQ ID NO: 312464 - DNA, 25 bp, Rattus norvegicus
gaattccttaaacccattttgaact

SEQ ID NO: 312465 - DNA, 25 bp, Rattus norvegicus
gaattccttaaagccattttgaact

SEQ ID NO: 312466 - DNA, 25 bp, Rattus norvegicus
gaattccttctcaatcatctgtagt

SEQ ID NO: 312467 - DNA, 25 bp, Rattus norvegicus
gaattccttctctatcatctgtagt

SEQ ID NO: 312468 - DNA, 25 bp, Rattus norvegicus
gaattccttgagagtcagtggtcta

SEQ ID NO: 312469 - DNA, 25 bp, Rattus norvegicus
gaattccttgagtgtcagtggtcta

SEQ ID NO: 312470 - DNA, 25 bp, Rattus norvegicus
gaattccttgcaactggagctcaga

SEQ ID NO: 312471 - DNA, 25 bp, Rattus norvegicus
gaattccttgcatctggagctcaga

SEQ ID NO: 312472 - DNA, 25 bp, Rattus norvegicus
gaattccttgctaatccttatgttg

SEQ ID NO: 312473 - DNA, 25 bp, Rattus norvegicus
gaattccttgcttatccttatgttg

SEQ ID NO: 312474 - DNA, 25 bp, Rattus norvegicus
gaattcctttgcacatctgtgtaat

SEQ ID NO: 312475 - DNA, 25 bp, Rattus norvegicus
gaattcctttgctcatctgtgtaat

SEQ ID NO: 312476 - DNA, 25 bp, Rattus norvegicus
gaattccttttgaaaaccatgctgg

SEQ ID NO: 312477 - DNA, 25 bp, Rattus norvegicus
gaattccttttgattctctgtgcta

SEQ ID NO: 312478 - DNA, 25 bp, Rattus norvegicus
gaattccttttgtaaaccatgctgg

SEQ ID NO: 312479 - DNA, 25 bp, Rattus norvegicus
gaattccttttgtttctctgtgcta

SEQ ID NO: 312480 - DNA, 25 bp, Rattus norvegicus
gaattcgaagaacccgagcaagtga

SEQ ID NO: 312481 - DNA, 25 bp, Rattus norvegicus
gaattcgaagaagccgagcaagtga

SEQ ID NO: 312482 - DNA, 25 bp, Rattus norvegicus
gaattcgactctcctgggtcatctg

SEQ ID NO: 312483 - DNA, 25 bp, Rattus norvegicus
gaattcgactctgctgggtcatctg

SEQ ID NO: 312484 - DNA, 25 bp, Rattus norvegicus
gaattcgagaggacggatcaggccc

SEQ ID NO: 312485 - DNA, 25 bp, Rattus norvegicus
gaattcgagaggtcggatcaggccc

SEQ ID NO: 312486 - DNA, 25 bp, Rattus norvegicus
gaattcgaggagatccggttactaa

SEQ ID NO: 312487 - DNA, 25 bp, Rattus norvegicus
gaattcgaggagttccggttactaa

SEQ ID NO: 312488 - DNA, 25 bp, Rattus norvegicus
gaattcgataccaactatgccacag

SEQ ID NO: 312489 - DNA, 25 bp, Rattus norvegicus
gaattcgatacctactatgccacag

SEQ ID NO: 312490 - DNA, 25 bp, Rattus norvegicus
gaattcgatgccagcttcatgatta

SEQ ID NO: 312491 - DNA, 25 bp, Rattus norvegicus
gaattcgatgcctgcttcatgatta

SEQ ID NO: 312492 - DNA, 25 bp, Rattus norvegicus
gaattcgatgtcactcttctagtaa

SEQ ID NO: 312493 - DNA, 25 bp, Rattus norvegicus
gaattcgatgtctctcttctagtaa

SEQ ID NO: 312494 - DNA, 25 bp, Rattus norvegicus
gaattcgattttatgcagactggat

SEQ ID NO: 312495 - DNA, 25 bp, Rattus norvegicus
gaattcgattttttgcagactggat

SEQ ID NO: 312496 - DNA, 25 bp, Rattus norvegicus
gaattcgcaatcagaacccaagtga

SEQ ID NO: 312497 - DNA, 25 bp, Rattus norvegicus
gaattcgcaatctgaacccaagtga

SEQ ID NO: 312498 - DNA, 25 bp, Rattus norvegicus
gaattcgcatgacctttactgtgtt

SEQ ID NO: 312499 - DNA, 25 bp, Rattus norvegicus
gaattcgcatgagctttactgtgtt

SEQ ID NO: 312500 - DNA, 25 bp, Rattus norvegicus
gaattcgctagtacctaacgcttga

SEQ ID NO: 312501 - DNA, 25 bp, Rattus norvegicus
gaattcgctagttcctaacgcttga

SEQ ID NO: 312502 - DNA, 25 bp, Rattus norvegicus
gaattcgctctcctgaatgtccaga

SEQ ID NO: 312503 - DNA, 25 bp, Rattus norvegicus
gaattcgctctcgtgaatgtccaga

SEQ ID NO: 312504 - DNA, 25 bp, Rattus norvegicus
gaattcggcttgctggtgatgttcc

SEQ ID NO: 312505 - DNA, 25 bp, Rattus norvegicus
gaattcggcttggtggtgatgttcc

SEQ ID NO: 312506 - DNA, 25 bp, Rattus norvegicus
gaattcggtgagctgactcctgatt

SEQ ID NO: 312507 - DNA, 25 bp, Rattus norvegicus
gaattcggtgaggtgactcctgatt

SEQ ID NO: 312508 - DNA, 25 bp, Rattus norvegicus
gaattcgtcaggaaccaagcccaaa

SEQ ID NO: 312509 - DNA, 25 bp, Rattus norvegicus
gaattcgtcaggtaccaagcccaaa

SEQ ID NO: 312510 - DNA, 25 bp, Rattus norvegicus
gaattcgtctttatagtgactcact

SEQ ID NO: 312511 - DNA, 25 bp, Rattus norvegicus
gaattcgtctttttagtgactcact

SEQ ID NO: 312512 - DNA, 25 bp, Rattus norvegicus
gaattcgtgcttattagcccgactg

SEQ ID NO: 312513 - DNA, 25 bp, Rattus norvegicus
gaattcgtgctttttagcccgactg

SEQ ID NO: 312514 - DNA, 25 bp, Rattus norvegicus
gaattctaagtcaacccagcatctg

SEQ ID NO: 312515 - DNA, 25 bp, Rattus norvegicus
gaattctaagtctacccagcatctg

SEQ ID NO: 312516 - DNA, 25 bp, Rattus norvegicus
gaattctaatgcaaggcttcctcca

SEQ ID NO: 312517 - DNA, 25 bp, Rattus norvegicus
gaattctaatgctaggcttcctcca

SEQ ID NO: 312518 - DNA, 25 bp, Rattus norvegicus
gaattctaattcagttcgcctggga

SEQ ID NO: 312519 - DNA, 25 bp, Rattus norvegicus
gaattctaattctgttcgcctggga

SEQ ID NO: 312520 - DNA, 25 bp, Rattus norvegicus
gaattctacctcatagatacagcta

SEQ ID NO: 312521 - DNA, 25 bp, Rattus norvegicus
gaattctacctcttagatacagcta

SEQ ID NO: 312522 - DNA, 25 bp, Rattus norvegicus
gaattctaccttctatgaactcagg

SEQ ID NO: 312523 - DNA, 25 bp, Rattus norvegicus
gaattctaccttgtatgaactcagg

SEQ ID NO: 312524 - DNA, 25 bp, Rattus norvegicus
gaattctacggactgacatctgaca

SEQ ID NO: 312525 - DNA, 25 bp, Rattus norvegicus
gaattctacggagtgacatctgaca

SEQ ID NO: 312526 - DNA, 25 bp, Rattus norvegicus
gaattctactaaagaatccgatgtg

SEQ ID NO: 312527 - DNA, 25 bp, Rattus norvegicus
gaattctactaatgaatccgatgtg

SEQ ID NO: 312528 - DNA, 25 bp, Rattus norvegicus
gaattctacttccattcaacatttt

SEQ ID NO: 312529 - DNA, 25 bp, Rattus norvegicus
gaattctacttcgattcaacatttt

SEQ ID NO: 312530 - DNA, 25 bp, Rattus norvegicus
gaattctagcccacgtgttatgtat

SEQ ID NO: 312531 - DNA, 25 bp, Rattus norvegicus
gaattctagccctcgtgttatgtat

SEQ ID NO: 312532 - DNA, 25 bp, Rattus norvegicus
gaattctaggacaccagaggcgaac

SEQ ID NO: 312533 - DNA, 25 bp, Rattus norvegicus
gaattctaggactccagaggcgaac

SEQ ID NO: 312534 - DNA, 25 bp, Rattus norvegicus
gaattctaggccaggcaggactata

SEQ ID NO: 312535 - DNA, 25 bp, Rattus norvegicus
gaattctaggcctggcaggactata

SEQ ID NO: 312536 - DNA, 25 bp, Rattus norvegicus
gaattctagggccagcaagacagct

SEQ ID NO: 312537 - DNA, 25 bp, Rattus norvegicus
gaattctagggcgagcaagacagct

SEQ ID NO: 312538 - DNA, 25 bp, Rattus norvegicus
gaattctagtgtattctccaatgca

SEQ ID NO: 312539 - DNA, 25 bp, Rattus norvegicus
gaattctagtgttttctccaatgca

SEQ ID NO: 312540 - DNA, 25 bp, Rattus norvegicus
gaattctataccctgttcttggata

SEQ ID NO: 312541 - DNA, 25 bp, Rattus norvegicus
gaattctataccgtgttcttggata

SEQ ID NO: 312542 - DNA, 25 bp, Rattus norvegicus
gaattctatagtactcgtcaactgg

SEQ ID NO: 312543 - DNA, 25 bp, Rattus norvegicus
gaattctatagttctcgtcaactgg

SEQ ID NO: 312544 - DNA, 25 bp, Rattus norvegicus
gaattctatcatattgttttagcat

SEQ ID NO: 312545 - DNA, 25 bp, Rattus norvegicus
gaattctatcattttgttttagcat

SEQ ID NO: 312546 - DNA, 25 bp, Rattus norvegicus
gaattctatgtcaacaggtttgcct

SEQ ID NO: 312547 - DNA, 25 bp, Rattus norvegicus
gaattctatgtctacaggtttgcct

SEQ ID NO: 312548 - DNA, 25 bp, Rattus norvegicus
gaattctattctaccaaaattacat

SEQ ID NO: 312549 - DNA, 25 bp, Rattus norvegicus
gaattctattcttccaaaattacat

SEQ ID NO: 312550 - DNA, 25 bp, Rattus norvegicus
gaattctcacgtataccagcttatg

SEQ ID NO: 312551 - DNA, 25 bp, Rattus norvegicus
gaattctcacgtttaccagcttatg

SEQ ID NO: 312552 - DNA, 25 bp, Rattus norvegicus
gaattctcagatctggagacccctc

SEQ ID NO: 312553 - DNA, 25 bp, Rattus norvegicus
gaattctcagatgtggagacccctc

SEQ ID NO: 312554 - DNA, 25 bp, Rattus norvegicus
gaattctcagccatttcaagcttgg

SEQ ID NO: 312555 - DNA, 25 bp, Rattus norvegicus
gaattctcagccttttcaagcttgg

SEQ ID NO: 312556 - DNA, 25 bp, Rattus norvegicus
gaattctcagcgcattttttagcac

SEQ ID NO: 312557 - DNA, 25 bp, Rattus norvegicus
gaattctcagcggattttttagcac

SEQ ID NO: 312558 - DNA, 25 bp, Rattus norvegicus
gaattctcagctactggatctagat

SEQ ID NO: 312559 - DNA, 25 bp, Rattus norvegicus
gaattctcagcttctggatctagat

SEQ ID NO: 312560 - DNA, 25 bp, Rattus norvegicus
gaattctcagtgaaataagccaggc

SEQ ID NO: 312561 - DNA, 25 bp, Rattus norvegicus
gaattctcagtgtaataagccaggc

SEQ ID NO: 312562 - DNA, 25 bp, Rattus norvegicus
gaattctcataacctacttgtcact

SEQ ID NO: 312563 - DNA, 25 bp, Rattus norvegicus
gaattctcataagctacttgtcact

SEQ ID NO: 312564 - DNA, 25 bp, Rattus norvegicus
gaattctcatttaacagcagtcgtg

SEQ ID NO: 312565 - DNA, 25 bp, Rattus norvegicus
gaattctcattttacagcagtcgtg

SEQ ID NO: 312566 - DNA, 25 bp, Rattus norvegicus
gaattctccagaacttaacccaaga

SEQ ID NO: 312567 - DNA, 25 bp, Rattus norvegicus
gaattctccagatcttaacccaaga

SEQ ID NO: 312568 - DNA, 25 bp, Rattus norvegicus
gaattctccattcccgagcggtctg

SEQ ID NO: 312569 - DNA, 25 bp, Rattus norvegicus
gaattctccattgccgagcggtctg

SEQ ID NO: 312570 - DNA, 25 bp, Rattus norvegicus
gaattctcctaactccatcctgaaa

SEQ ID NO: 312571 - DNA, 25 bp, Rattus norvegicus
gaattctcctaagtccatcctgaaa

SEQ ID NO: 312572 - DNA, 25 bp, Rattus norvegicus
gaattctcctggagctacgtacatt

SEQ ID NO: 312573 - DNA, 25 bp, Rattus norvegicus
gaattctcctggtgctacgtacatt

SEQ ID NO: 312574 - DNA, 25 bp, Rattus norvegicus
gaattctcctttactattggtcttg

SEQ ID NO: 312575 - DNA, 25 bp, Rattus norvegicus
gaattctcctttctttcttcagggt

SEQ ID NO: 312576 - DNA, 25 bp, Rattus norvegicus
gaattctcctttgtttcttcagggt

SEQ ID NO: 312577 - DNA, 25 bp, Rattus norvegicus
gaattctccttttctattggtcttg

SEQ ID NO: 312578 - DNA, 25 bp, Rattus norvegicus
gaattctcgaaacaatgcacacaca

SEQ ID NO: 312579 - DNA, 25 bp, Rattus norvegicus
gaattctcgaaagaatgcacacaca

SEQ ID NO: 312580 - DNA, 25 bp, Rattus norvegicus
gaattctcgatcagggaccgcgatt

SEQ ID NO: 312581 - DNA, 25 bp, Rattus norvegicus
gaattctcgatctgggaccgcgatt

SEQ ID NO: 312582 - DNA, 25 bp, Rattus norvegicus
gaattctcgtcacgcaagcatgcta

SEQ ID NO: 312583 - DNA, 25 bp, Rattus norvegicus
gaattctcgtcaggcaagcatgcta

SEQ ID NO: 312584 - DNA, 25 bp, Rattus norvegicus
gaattctctatcagggctaaacgtc

SEQ ID NO: 312585 - DNA, 25 bp, Rattus norvegicus
gaattctctatctgggctaaacgtc

SEQ ID NO: 312586 - DNA, 25 bp, Rattus norvegicus
gaattctctctgacatatatgtcat

SEQ ID NO: 312587 - DNA, 25 bp, Rattus norvegicus
gaattctctctgtcatatatgtcat

SEQ ID NO: 312588 - DNA, 25 bp, Rattus norvegicus
gaattctctgcaatccttacttgca

SEQ ID NO: 312589 - DNA, 25 bp, Rattus norvegicus
gaattctctgcattccttacttgca

SEQ ID NO: 312590 - DNA, 25 bp, Rattus norvegicus
gaattctctgttatgtgaagactta

SEQ ID NO: 312591 - DNA, 25 bp, Rattus norvegicus
gaattctctgttttgtgaagactta

SEQ ID NO: 312592 - DNA, 25 bp, Rattus norvegicus
gaattctcttaactcacctgattat

SEQ ID NO: 312593 - DNA, 25 bp, Rattus norvegicus
gaattctcttaagtcacctgattat

SEQ ID NO: 312594 - DNA, 25 bp, Rattus norvegicus
gaattctcttcaagaacctctatgc

SEQ ID NO: 312595 - DNA, 25 bp, Rattus norvegicus
gaattctcttcaatctactgtagac

SEQ ID NO: 312596 - DNA, 25 bp, Rattus norvegicus
gaattctcttcatgaacctctatgc

SEQ ID NO: 312597 - DNA, 25 bp, Rattus norvegicus
gaattctcttcattctactgtagac

SEQ ID NO: 312598 - DNA, 25 bp, Rattus norvegicus
gaattctcttgcagtttggatcgtt

SEQ ID NO: 312599 - DNA, 25 bp, Rattus norvegicus
gaattctcttgctgtttggatcgtt

SEQ ID NO: 312600 - DNA, 25 bp, Rattus norvegicus
gaattctctttaccatctgtcagcc

SEQ ID NO: 312601 - DNA, 25 bp, Rattus norvegicus
gaattctctttagcatctgtcagcc

SEQ ID NO: 312602 - DNA, 25 bp, Rattus norvegicus
gaattctctttcaatttggagccta

SEQ ID NO: 312603 - DNA, 25 bp, Rattus norvegicus
gaattctctttctatttggagccta

SEQ ID NO: 312604 - DNA, 25 bp, Rattus norvegicus
gaattctctttgcacatttgtactg

SEQ ID NO: 312605 - DNA, 25 bp, Rattus norvegicus
gaattctctttgctgtttgcaagcc

SEQ ID NO: 312606 - DNA, 25 bp, Rattus norvegicus
gaattctctttggacatttgtactg

SEQ ID NO: 312607 - DNA, 25 bp, Rattus norvegicus
gaattctctttggtgtttgcaagcc

SEQ ID NO: 312608 - DNA, 25 bp, Rattus norvegicus
gaattctgaaatccatctgtccctg

SEQ ID NO: 312609 - DNA, 25 bp, Rattus norvegicus
gaattctgaaatgcatctgtccctg

SEQ ID NO: 312610 - DNA, 25 bp, Rattus norvegicus
gaattctgaagactgcaactcgtaa

SEQ ID NO: 312611 - DNA, 25 bp, Rattus norvegicus
gaattctgaagagtgcaactcgtaa

SEQ ID NO: 312612 - DNA, 25 bp, Rattus norvegicus
gaattctgaagcctccgtgttttcc

SEQ ID NO: 312613 - DNA, 25 bp, Rattus norvegicus
gaattctgaagcgtccgtgttttcc

SEQ ID NO: 312614 - DNA, 25 bp, Rattus norvegicus
gaattctgacacatttcctacacac

SEQ ID NO: 312615 - DNA, 25 bp, Rattus norvegicus
gaattctgacacttttcctacacac

SEQ ID NO: 312616 - DNA, 25 bp, Rattus norvegicus
gaattctgacttcgcatgtactgtg

SEQ ID NO: 312617 - DNA, 25 bp, Rattus norvegicus
gaattctgacttggcatgtactgtg

SEQ ID NO: 312618 - DNA, 25 bp, Rattus norvegicus
gaattctgagacaccgacaatgcaa

SEQ ID NO: 312619 - DNA, 25 bp, Rattus norvegicus
gaattctgagactccgacaatgcaa

SEQ ID NO: 312620 - DNA, 25 bp, Rattus norvegicus
gaattctgagctatgtgtttggact

SEQ ID NO: 312621 - DNA, 25 bp, Rattus norvegicus
gaattctgagctttgtgtttggact

SEQ ID NO: 312622 - DNA, 25 bp, Rattus norvegicus
gaattctgcaaactcatggttccca

SEQ ID NO: 312623 - DNA, 25 bp, Rattus norvegicus
gaattctgcaaagtcatggttccca

SEQ ID NO: 312624 - DNA, 25 bp, Rattus norvegicus
gaattctgccagacctatacagttg

SEQ ID NO: 312625 - DNA, 25 bp, Rattus norvegicus
gaattctgccagtcctatacagttg

SEQ ID NO: 312626 - DNA, 25 bp, Rattus norvegicus
gaattctgcctaagcacttgtgctc

SEQ ID NO: 312627 - DNA, 25 bp, Rattus norvegicus
gaattctgcctatgcacttgtgctc

SEQ ID NO: 312628 - DNA, 25 bp, Rattus norvegicus
gaattctgccttatgccttgacttc

SEQ ID NO: 312629 - DNA, 25 bp, Rattus norvegicus
gaattctgccttttgccttgacttc

SEQ ID NO: 312630 - DNA, 25 bp, Rattus norvegicus
gaattctgctccctgcggtggcatt

SEQ ID NO: 312631 - DNA, 25 bp, Rattus norvegicus
gaattctgctccgtgcggtggcatt

SEQ ID NO: 312632 - DNA, 25 bp, Rattus norvegicus
gaattctgctttactctactaatct

SEQ ID NO: 312633 - DNA, 25 bp, Rattus norvegicus
gaattctgctttctttgtccaacta

SEQ ID NO: 312634 - DNA, 25 bp, Rattus norvegicus
gaattctgctttgtttgtccaacta

SEQ ID NO: 312635 - DNA, 25 bp, Rattus norvegicus
gaattctgcttttctctactaatct

SEQ ID NO: 312636 - DNA, 25 bp, Rattus norvegicus
gaattctggccaaatcttcaatcat

SEQ ID NO: 312637 - DNA, 25 bp, Rattus norvegicus
gaattctggccatatcttcaatcat

SEQ ID NO: 312638 - DNA, 25 bp, Rattus norvegicus
gaattctggcggagggcacaagcct

SEQ ID NO: 312639 - DNA, 25 bp, Rattus norvegicus
gaattctggcggtgggcacaagcct

SEQ ID NO: 312640 - DNA, 25 bp, Rattus norvegicus
gaattctgggacaatctgactggat

SEQ ID NO: 312641 - DNA, 25 bp, Rattus norvegicus
gaattctgggacacctgagagggta

SEQ ID NO: 312642 - DNA, 25 bp, Rattus norvegicus
gaattctgggactatctgactggat

SEQ ID NO: 312643 - DNA, 25 bp, Rattus norvegicus
gaattctgggactcctgagagggta

SEQ ID NO: 312644 - DNA, 25 bp, Rattus norvegicus
gaattctgggctaaggccctaatct

SEQ ID NO: 312645 - DNA, 25 bp, Rattus norvegicus
gaattctgggcttaggccctaatct

SEQ ID NO: 312646 - DNA, 25 bp, Rattus norvegicus
gaattctgggtcacctcaggacaag

SEQ ID NO: 312647 - DNA, 25 bp, Rattus norvegicus
gaattctgggtctcctcaggacaag

SEQ ID NO: 312648 - DNA, 25 bp, Rattus norvegicus
gaattctggtatacttggcgtcacc

SEQ ID NO: 312649 - DNA, 25 bp, Rattus norvegicus
gaattctggtattcttggcgtcacc

SEQ ID NO: 312650 - DNA, 25 bp, Rattus norvegicus
gaattctggtttcgcgtgatcctgc

SEQ ID NO: 312651 - DNA, 25 bp, Rattus norvegicus
gaattctggtttggcgtgatcctgc

SEQ ID NO: 312652 - DNA, 25 bp, Rattus norvegicus
gaattctgtaatcttgggaggccat

SEQ ID NO: 312653 - DNA, 25 bp, Rattus norvegicus
gaattctgtaatgttgggaggccat

SEQ ID NO: 312654 - DNA, 25 bp, Rattus norvegicus
gaattctgtagcatcttcttagagg

SEQ ID NO: 312655 - DNA, 25 bp, Rattus norvegicus
gaattctgtagcttcttcttagagg

SEQ ID NO: 312656 - DNA, 25 bp, Rattus norvegicus
gaattctgtatcattcaagtactgt

SEQ ID NO: 312657 - DNA, 25 bp, Rattus norvegicus
gaattctgtatctttcaagtactgt

SEQ ID NO: 312658 - DNA, 25 bp, Rattus norvegicus
gaattctgtccaattctgatggctc

SEQ ID NO: 312659 - DNA, 25 bp, Rattus norvegicus
gaattctgtccatttctgatggctc

SEQ ID NO: 312660 - DNA, 25 bp, Rattus norvegicus
gaattctgtcctatctggccgaaaa

SEQ ID NO: 312661 - DNA, 25 bp, Rattus norvegicus
gaattctgtcctttctggccgaaaa

SEQ ID NO: 312662 - DNA, 25 bp, Rattus norvegicus
gaattctgtctaagaccatgtattt

SEQ ID NO: 312663 - DNA, 25 bp, Rattus norvegicus
gaattctgtctatgaccatgtattt

SEQ ID NO: 312664 - DNA, 25 bp, Rattus norvegicus
gaattctgtctgagatgctcaattg

SEQ ID NO: 312665 - DNA, 25 bp, Rattus norvegicus
gaattctgtctgtgatgctcaattg

SEQ ID NO: 312666 - DNA, 25 bp, Rattus norvegicus
gaattctgtgagagtaaactgattt

SEQ ID NO: 312667 - DNA, 25 bp, Rattus norvegicus
gaattctgtgagtgtaaactgattt

SEQ ID NO: 312668 - DNA, 25 bp, Rattus norvegicus
gaattctgtggccttataatcctat

SEQ ID NO: 312669 - DNA, 25 bp, Rattus norvegicus
gaattctgtggcgttataatcctat

SEQ ID NO: 312670 - DNA, 25 bp, Rattus norvegicus
gaattctgtgttctactttacgtaa

SEQ ID NO: 312671 - DNA, 25 bp, Rattus norvegicus
gaattctgtgttctagactccgctt

SEQ ID NO: 312672 - DNA, 25 bp, Rattus norvegicus
gaattctgtgttgtactttacgtaa

SEQ ID NO: 312673 - DNA, 25 bp, Rattus norvegicus
gaattctgtgttgtagactccgctt

SEQ ID NO: 312674 - DNA, 25 bp, Rattus norvegicus
gaattctgttccaggcatgtgacat

SEQ ID NO: 312675 - DNA, 25 bp, Rattus norvegicus
gaattctgttcctggcatgtgacat

SEQ ID NO: 312676 - DNA, 25 bp, Rattus norvegicus
gaattcttaaaaaatctagagctaa

SEQ ID NO: 312677 - DNA, 25 bp, Rattus norvegicus
gaattcttaaaatatctagagctaa

SEQ ID NO: 312678 - DNA, 25 bp, Rattus norvegicus
gaattcttaatactcactcaagttg

SEQ ID NO: 312679 - DNA, 25 bp, Rattus norvegicus
gaattcttaatagtcactcaagttg

SEQ ID NO: 312680 - DNA, 25 bp, Rattus norvegicus
gaattcttacatatacaagcttttg

SEQ ID NO: 312681 - DNA, 25 bp, Rattus norvegicus
gaattcttacatttacaagcttttg

SEQ ID NO: 312682 - DNA, 25 bp, Rattus norvegicus
gaattcttacctacaagtgatcttg

SEQ ID NO: 312683 - DNA, 25 bp, Rattus norvegicus
gaattcttaccttcaagtgatcttg

SEQ ID NO: 312684 - DNA, 25 bp, Rattus norvegicus
gaattcttagagctgtctcttagta

SEQ ID NO: 312685 - DNA, 25 bp, Rattus norvegicus
gaattcttagaggtgtctcttagta

SEQ ID NO: 312686 - DNA, 25 bp, Rattus norvegicus
gaattcttagcacctcggtgagctt

SEQ ID NO: 312687 - DNA, 25 bp, Rattus norvegicus
gaattcttagcagctcggtgagctt

SEQ ID NO: 312688 - DNA, 25 bp, Rattus norvegicus
gaattcttatgcattctggttgctt

SEQ ID NO: 312689 - DNA, 25 bp, Rattus norvegicus
gaattcttatgctttctggttgctt

SEQ ID NO: 312690 - DNA, 25 bp, Rattus norvegicus
gaattcttcagaaggtaagtccttc

SEQ ID NO: 312691 - DNA, 25 bp, Rattus norvegicus
gaattcttcagatggtaagtccttc

SEQ ID NO: 312692 - DNA, 25 bp, Rattus norvegicus
gaattcttcaggatgtcccctaaag

SEQ ID NO: 312693 - DNA, 25 bp, Rattus norvegicus
gaattcttcaggttgtcccctaaag

SEQ ID NO: 312694 - DNA, 25 bp, Rattus norvegicus
gaattcttcctgatacacattaatg

SEQ ID NO: 312695 - DNA, 25 bp, Rattus norvegicus
gaattcttcctgttacacattaatg

SEQ ID NO: 312696 - DNA, 25 bp, Rattus norvegicus
gaattcttcgaaagtctgaccctga

SEQ ID NO: 312697 - DNA, 25 bp, Rattus norvegicus
gaattcttcgaatgtctgaccctga

SEQ ID NO: 312698 - DNA, 25 bp, Rattus norvegicus
gaattcttctagatgtctgactttg

SEQ ID NO: 312699 - DNA, 25 bp, Rattus norvegicus
gaattcttctagttgtctgactttg

SEQ ID NO: 312700 - DNA, 25 bp, Rattus norvegicus
gaattcttctatatttctaggtgca

SEQ ID NO: 312701 - DNA, 25 bp, Rattus norvegicus
gaattcttctatttttctaggtgca

SEQ ID NO: 312702 - DNA, 25 bp, Rattus norvegicus
gaattcttctcaccctttatcacat

SEQ ID NO: 312703 - DNA, 25 bp, Rattus norvegicus
gaattcttctcagcctttatcacat

SEQ ID NO: 312704 - DNA, 25 bp, Rattus norvegicus
gaattcttctgaatgctttcacttg

SEQ ID NO: 312705 - DNA, 25 bp, Rattus norvegicus
gaattcttctgattgctttcacttg

SEQ ID NO: 312706 - DNA, 25 bp, Rattus norvegicus
gaattcttctgtcgaggctgagtct

SEQ ID NO: 312707 - DNA, 25 bp, Rattus norvegicus
gaattcttctgtggaggctgagtct

SEQ ID NO: 312708 - DNA, 25 bp, Rattus norvegicus
gaattcttcttcacacatgacaata

SEQ ID NO: 312709 - DNA, 25 bp, Rattus norvegicus
gaattcttcttctcacatgacaata

SEQ ID NO: 312710 - DNA, 25 bp, Rattus norvegicus
gaattcttgacaaccatccagttgt

SEQ ID NO: 312711 - DNA, 25 bp, Rattus norvegicus
gaattcttgacatccatccagttgt

SEQ ID NO: 312712 - DNA, 25 bp, Rattus norvegicus
gaattcttgagaaccgagtcccttc

SEQ ID NO: 312713 - DNA, 25 bp, Rattus norvegicus
gaattcttgagatccgagtcccttc

SEQ ID NO: 312714 - DNA, 25 bp, Rattus norvegicus
gaattcttgatgacgcaaaccccgt

SEQ ID NO: 312715 - DNA, 25 bp, Rattus norvegicus
gaattcttgatgtcgcaaaccccgt

SEQ ID NO: 312716 - DNA, 25 bp, Rattus norvegicus
gaattcttgcagcaccagtgtacca

SEQ ID NO: 312717 - DNA, 25 bp, Rattus norvegicus
gaattcttgcaggaccagtgtacca

SEQ ID NO: 312718 - DNA, 25 bp, Rattus norvegicus
gaattcttgcctatctttccaggaa

SEQ ID NO: 312719 - DNA, 25 bp, Rattus norvegicus
gaattcttgcctttctttccaggaa

SEQ ID NO: 312720 - DNA, 25 bp, Rattus norvegicus
gaattcttggagctttcacgtattt

SEQ ID NO: 312721 - DNA, 25 bp, Rattus norvegicus
gaattcttggaggtttcacgtattt

SEQ ID NO: 312722 - DNA, 25 bp, Rattus norvegicus
gaattcttggcactgcaaggccatg

SEQ ID NO: 312723 - DNA, 25 bp, Rattus norvegicus
gaattcttggcagtgcaaggccatg

SEQ ID NO: 312724 - DNA, 25 bp, Rattus norvegicus
gaattcttgggcaacctcagtgatt

SEQ ID NO: 312725 - DNA, 25 bp, Rattus norvegicus
gaattcttgggctacctcagtgatt

SEQ ID NO: 312726 - DNA, 25 bp, Rattus norvegicus
gaattcttgtctaatttaaatactt

SEQ ID NO: 312727 - DNA, 25 bp, Rattus norvegicus
gaattcttgtcttatttaaatactt

SEQ ID NO: 312728 - DNA, 25 bp, Rattus norvegicus
gaattctttattcatggtagccata

SEQ ID NO: 312729 - DNA, 25 bp, Rattus norvegicus
gaattctttattgatggtagccata

SEQ ID NO: 312730 - DNA, 25 bp, Rattus norvegicus
gaattctttcagctcatgactggca

SEQ ID NO: 312731 - DNA, 25 bp, Rattus norvegicus
gaattctttcaggtcatgactggca

SEQ ID NO: 312732 - DNA, 25 bp, Rattus norvegicus
gaattctttcccagagaaccttttg

SEQ ID NO: 312733 - DNA, 25 bp, Rattus norvegicus
gaattctttccctgagaaccttttg

SEQ ID NO: 312734 - DNA, 25 bp, Rattus norvegicus
gaattctttcttccaactctcagtg

SEQ ID NO: 312735 - DNA, 25 bp, Rattus norvegicus
gaattctttcttgcaactctcagtg

SEQ ID NO: 312736 - DNA, 25 bp, Rattus norvegicus
gaattctttgcaacacttgaggctg

SEQ ID NO: 312737 - DNA, 25 bp, Rattus norvegicus
gaattctttgcacaattgtcccatt

SEQ ID NO: 312738 - DNA, 25 bp, Rattus norvegicus
gaattctttgcagaattgtcccatt

SEQ ID NO: 312739 - DNA, 25 bp, Rattus norvegicus
gaattctttgcatcacttgaggctg

SEQ ID NO: 312740 - DNA, 25 bp, Rattus norvegicus
gaattctttgctaccggaatccggg

SEQ ID NO: 312741 - DNA, 25 bp, Rattus norvegicus
gaattctttgcttccggaatccggg

SEQ ID NO: 312742 - DNA, 25 bp, Rattus norvegicus
gaattctttgtgaatattcctcgga

SEQ ID NO: 312743 - DNA, 25 bp, Rattus norvegicus
gaattctttgtgtatattcctcgga

SEQ ID NO: 312744 - DNA, 25 bp, Rattus norvegicus
gaattctttgttcttgccagtgctc

SEQ ID NO: 312745 - DNA, 25 bp, Rattus norvegicus
gaattctttgttgttgccagtgctc

SEQ ID NO: 312746 - DNA, 25 bp, Rattus norvegicus
gaattcttttctatatccatgagca

SEQ ID NO: 312747 - DNA, 25 bp, Rattus norvegicus
gaattcttttctcctgatttatcac

SEQ ID NO: 312748 - DNA, 25 bp, Rattus norvegicus
gaattcttttctgctgatttatcac

SEQ ID NO: 312749 - DNA, 25 bp, Rattus norvegicus
gaattcttttctttatccatgagca

SEQ ID NO: 312750 - DNA, 25 bp, Rattus norvegicus
gaattgaaagagaagcccttgacta

SEQ ID NO: 312751 - DNA, 25 bp, Rattus norvegicus
gaattgaaagagtagcccttgacta

SEQ ID NO: 312752 - DNA, 25 bp, Rattus norvegicus
gaattgaaagctaccttactggttc

SEQ ID NO: 312753 - DNA, 25 bp, Rattus norvegicus
gaattgaaagcttccttactggttc

SEQ ID NO: 312754 - DNA, 25 bp, Rattus norvegicus
gaattgaaatttactctcctcgttg

SEQ ID NO: 312755 - DNA, 25 bp, Rattus norvegicus
gaattgaaattttctctcctcgttg

SEQ ID NO: 312756 - DNA, 25 bp, Rattus norvegicus
gaattgaaccaaaactccccacatg

SEQ ID NO: 312757 - DNA, 25 bp, Rattus norvegicus
gaattgaaccaatactccccacatg

SEQ ID NO: 312758 - DNA, 25 bp, Rattus norvegicus
gaattgaaccctcgccctctcaaga

SEQ ID NO: 312759 - DNA, 25 bp, Rattus norvegicus
gaattgaaccctggccctctcaaga

SEQ ID NO: 312760 - DNA, 25 bp, Rattus norvegicus
gaattgaagccaacacgagctcagg

SEQ ID NO: 312761 - DNA, 25 bp, Rattus norvegicus
gaattgaagccatcacgagctcagg

SEQ ID NO: 312762 - DNA, 25 bp, Rattus norvegicus
gaattgaagtgcctggcccactgtc

SEQ ID NO: 312763 - DNA, 25 bp, Rattus norvegicus
gaattgaagtgcgtggcccactgtc

SEQ ID NO: 312764 - DNA, 25 bp, Rattus norvegicus
gaattgaatgctactccttgctgag

SEQ ID NO: 312765 - DNA, 25 bp, Rattus norvegicus
gaattgaatgcttctccttgctgag

SEQ ID NO: 312766 - DNA, 25 bp, Rattus norvegicus
gaattgaatttaaagcgccccagcg

SEQ ID NO: 312767 - DNA, 25 bp, Rattus norvegicus
gaattgaatttatagcgccccagcg

SEQ ID NO: 312768 - DNA, 25 bp, Rattus norvegicus
gaattgacaccacgcttttctttga

SEQ ID NO: 312769 - DNA, 25 bp, Rattus norvegicus
gaattgacaccaggcttttctttga

SEQ ID NO: 312770 - DNA, 25 bp, Rattus norvegicus
gaattgacacggacactgtgtacca

SEQ ID NO: 312771 - DNA, 25 bp, Rattus norvegicus
gaattgacacggtcactgtgtacca

SEQ ID NO: 312772 - DNA, 25 bp, Rattus norvegicus
gaattgaccgctatcccagaaaagt

SEQ ID NO: 312773 - DNA, 25 bp, Rattus norvegicus
gaattgaccgctttcccagaaaagt

SEQ ID NO: 312774 - DNA, 25 bp, Rattus norvegicus
gaattgacgcttaagtggcccaact

SEQ ID NO: 312775 - DNA, 25 bp, Rattus norvegicus
gaattgacgctttagtggcccaact

SEQ ID NO: 312776 - DNA, 25 bp, Rattus norvegicus
gaattgactacacactgttttccaa

SEQ ID NO: 312777 - DNA, 25 bp, Rattus norvegicus
gaattgactacagactgttttccaa

SEQ ID NO: 312778 - DNA, 25 bp, Rattus norvegicus
gaattgactattatggaccaggtta

SEQ ID NO: 312779 - DNA, 25 bp, Rattus norvegicus
gaattgactattttggaccaggtta

SEQ ID NO: 312780 - DNA, 25 bp, Rattus norvegicus
gaattgactgcgaagaagccttgta

SEQ ID NO: 312781 - DNA, 25 bp, Rattus norvegicus
gaattgactgcgtagaagccttgta

SEQ ID NO: 312782 - DNA, 25 bp, Rattus norvegicus
gaattgacttaaatttgcatctgta

SEQ ID NO: 312783 - DNA, 25 bp, Rattus norvegicus
gaattgacttaattttgcatctgta

SEQ ID NO: 312784 - DNA, 25 bp, Rattus norvegicus
gaattgactttcacttttgaccctt

SEQ ID NO: 312785 - DNA, 25 bp, Rattus norvegicus
gaattgactttctcttttgaccctt

SEQ ID NO: 312786 - DNA, 25 bp, Rattus norvegicus
gaattgagccccaaacatcagcagc

SEQ ID NO: 312787 - DNA, 25 bp, Rattus norvegicus
gaattgagcccctaacatcagcagc

SEQ ID NO: 312788 - DNA, 25 bp, Rattus norvegicus
gaattgagctgtatttcttagccta

SEQ ID NO: 312789 - DNA, 25 bp, Rattus norvegicus
gaattgagctgtttttcttagccta

SEQ ID NO: 312790 - DNA, 25 bp, Rattus norvegicus
gaattgagcttcatgtcaaaacgga

SEQ ID NO: 312791 - DNA, 25 bp, Rattus norvegicus
gaattgagcttcttgtcaaaacgga

SEQ ID NO: 312792 - DNA, 25 bp, Rattus norvegicus
gaattgaggagcagctacgcctgcc

SEQ ID NO: 312793 - DNA, 25 bp, Rattus norvegicus
gaattgaggagctgctacgcctgcc

SEQ ID NO: 312794 - DNA, 25 bp, Rattus norvegicus
gaattgaggtcaccattcccttaat

SEQ ID NO: 312795 - DNA, 25 bp, Rattus norvegicus
gaattgaggtcagcattcccttaat

SEQ ID NO: 312796 - DNA, 25 bp, Rattus norvegicus
gaattgagtgtcaacagctccctct

SEQ ID NO: 312797 - DNA, 25 bp, Rattus norvegicus
gaattgagtgtcatgtctccgttac

SEQ ID NO: 312798 - DNA, 25 bp, Rattus norvegicus
gaattgagtgtctacagctccctct

SEQ ID NO: 312799 - DNA, 25 bp, Rattus norvegicus
gaattgagtgtcttgtctccgttac

SEQ ID NO: 312800 - DNA, 25 bp, Rattus norvegicus
gaattgagttctcgccaacatcgga

SEQ ID NO: 312801 - DNA, 25 bp, Rattus norvegicus
gaattgagttctggccaacatcgga

SEQ ID NO: 312802 - DNA, 25 bp, Rattus norvegicus
gaattgagtttacttccctaaagag

SEQ ID NO: 312803 - DNA, 25 bp, Rattus norvegicus
gaattgagtttagttccctaaagag

SEQ ID NO: 312804 - DNA, 25 bp, Rattus norvegicus
gaattgatattcctgtattaacctt

SEQ ID NO: 312805 - DNA, 25 bp, Rattus norvegicus
gaattgatattcgtgtattaacctt

SEQ ID NO: 312806 - DNA, 25 bp, Rattus norvegicus
gaattgatcaatcctcttggcttcc

SEQ ID NO: 312807 - DNA, 25 bp, Rattus norvegicus
gaattgatcaatgctcttggcttcc

SEQ ID NO: 312808 - DNA, 25 bp, Rattus norvegicus
gaattgatcacacatcccctcattc

SEQ ID NO: 312809 - DNA, 25 bp, Rattus norvegicus
gaattgatcacagatcccctcattc

SEQ ID NO: 312810 - DNA, 25 bp, Rattus norvegicus
gaattgatccgaagccgctcatctg

SEQ ID NO: 312811 - DNA, 25 bp, Rattus norvegicus
gaattgatccgatgccgctcatctg

SEQ ID NO: 312812 - DNA, 25 bp, Rattus norvegicus
gaattgattagtattcctagttatt

SEQ ID NO: 312813 - DNA, 25 bp, Rattus norvegicus
gaattgattagttttcctagttatt

SEQ ID NO: 312814 - DNA, 25 bp, Rattus norvegicus
gaattgattcttactgtggtacaag

SEQ ID NO: 312815 - DNA, 25 bp, Rattus norvegicus
gaattgattctttctgtggtacaag

SEQ ID NO: 312816 - DNA, 25 bp, Rattus norvegicus
gaattgattttaagtaacctttatg

SEQ ID NO: 312817 - DNA, 25 bp, Rattus norvegicus
gaattgattttatgtaacctttatg

SEQ ID NO: 312818 - DNA, 25 bp, Rattus norvegicus
gaattgcaaagtcctcgtctgttag

SEQ ID NO: 312819 - DNA, 25 bp, Rattus norvegicus
gaattgcaaagtgctcgtctgttag

SEQ ID NO: 312820 - DNA, 25 bp, Rattus norvegicus
gaattgcaaccgaagccttatggga

SEQ ID NO: 312821 - DNA, 25 bp, Rattus norvegicus
gaattgcaaccgtagccttatggga

SEQ ID NO: 312822 - DNA, 25 bp, Rattus norvegicus
gaattgcaactcatttcagtccttg

SEQ ID NO: 312823 - DNA, 25 bp, Rattus norvegicus
gaattgcaactcttttcagtccttg

SEQ ID NO: 312824 - DNA, 25 bp, Rattus norvegicus
gaattgcaatatcctaatttcattt

SEQ ID NO: 312825 - DNA, 25 bp, Rattus norvegicus
gaattgcaatatgctaatttcattt

SEQ ID NO: 312826 - DNA, 25 bp, Rattus norvegicus
gaattgcacacaattcagtatgttc

SEQ ID NO: 312827 - DNA, 25 bp, Rattus norvegicus
gaattgcacacatttcagtatgttc

SEQ ID NO: 312828 - DNA, 25 bp, Rattus norvegicus
gaattgcacattactcttaaccatg

SEQ ID NO: 312829 - DNA, 25 bp, Rattus norvegicus
gaattgcacatttctcttaaccatg

SEQ ID NO: 312830 - DNA, 25 bp, Rattus norvegicus
gaattgcacctgaaattattcctcc

SEQ ID NO: 312831 - DNA, 25 bp, Rattus norvegicus
gaattgcacctgtaattattcctcc

SEQ ID NO: 312832 - DNA, 25 bp, Rattus norvegicus
gaattgcagactcctgcctgcaaca

SEQ ID NO: 312833 - DNA, 25 bp, Rattus norvegicus
gaattgcagactgctgcctgcaaca

SEQ ID NO: 312834 - DNA, 25 bp, Rattus norvegicus
gaattgcagctgcaaccatgttttt

SEQ ID NO: 312835 - DNA, 25 bp, Rattus norvegicus
gaattgcagctggaaccatgttttt

SEQ ID NO: 312836 - DNA, 25 bp, Rattus norvegicus
gaattgcaggacacaagccagcagc

SEQ ID NO: 312837 - DNA, 25 bp, Rattus norvegicus
gaattgcaggactcaagccagcagc

SEQ ID NO: 312838 - DNA, 25 bp, Rattus norvegicus
gaattgcaggctcttggcccatgga

SEQ ID NO: 312839 - DNA, 25 bp, Rattus norvegicus
gaattgcaggctgttggcccatgga

SEQ ID NO: 312840 - DNA, 25 bp, Rattus norvegicus
gaattgcagtctcagctcagcatga

SEQ ID NO: 312841 - DNA, 25 bp, Rattus norvegicus
gaattgcagtctgagctcagcatga

SEQ ID NO: 312842 - DNA, 25 bp, Rattus norvegicus
gaattgcagttcagctcgtcatcat

SEQ ID NO: 312843 - DNA, 25 bp, Rattus norvegicus
gaattgcagttctgctcgtcatcat

SEQ ID NO: 312844 - DNA, 25 bp, Rattus norvegicus
gaattgcatctcatctctcttgaaa

SEQ ID NO: 312845 - DNA, 25 bp, Rattus norvegicus
gaattgcatctcttctctcttgaaa

SEQ ID NO: 312846 - DNA, 25 bp, Rattus norvegicus
gaattgcatggtaccttcattttaa

SEQ ID NO: 312847 - DNA, 25 bp, Rattus norvegicus
gaattgcatggttccttcattttaa

SEQ ID NO: 312848 - DNA, 25 bp, Rattus norvegicus
gaattgcatgtgcttttcacgttat

SEQ ID NO: 312849 - DNA, 25 bp, Rattus norvegicus
gaattgcatgtggttttcacgttat

SEQ ID NO: 312850 - DNA, 25 bp, Rattus norvegicus
gaattgcattttacagaaggtccca

SEQ ID NO: 312851 - DNA, 25 bp, Rattus norvegicus
gaattgcatttttcagaaggtccca

SEQ ID NO: 312852 - DNA, 25 bp, Rattus norvegicus
gaattgccacacctgggactgaagg

SEQ ID NO: 312853 - DNA, 25 bp, Rattus norvegicus
gaattgccacacgtgggactgaagg

SEQ ID NO: 312854 - DNA, 25 bp, Rattus norvegicus
gaattgccagtcaagaccgccagga

SEQ ID NO: 312855 - DNA, 25 bp, Rattus norvegicus
gaattgccagtctagaccgccagga

SEQ ID NO: 312856 - DNA, 25 bp, Rattus norvegicus
gaattgcccaagaagctgtctacct

SEQ ID NO: 312857 - DNA, 25 bp, Rattus norvegicus
gaattgcccaagtagctgtctacct

SEQ ID NO: 312858 - DNA, 25 bp, Rattus norvegicus
gaattgcctaggaataaaacaacat

SEQ ID NO: 312859 - DNA, 25 bp, Rattus norvegicus
gaattgcctaggtataaaacaacat

SEQ ID NO: 312860 - DNA, 25 bp, Rattus norvegicus
gaattgccttgtcattgtccaaact

SEQ ID NO: 312861 - DNA, 25 bp, Rattus norvegicus
gaattgccttgtgattgtccaaact

SEQ ID NO: 312862 - DNA, 25 bp, Rattus norvegicus
gaattgcgagagacacctcaggact

SEQ ID NO: 312863 - DNA, 25 bp, Rattus norvegicus
gaattgcgagagtcacctcaggact

SEQ ID NO: 312864 - DNA, 25 bp, Rattus norvegicus
gaattgcggctcactcactgcaagt

SEQ ID NO: 312865 - DNA, 25 bp, Rattus norvegicus
gaattgcggctctctcactgcaagt

SEQ ID NO: 312866 - DNA, 25 bp, Rattus norvegicus
gaattgctaacactgctcagggcag

SEQ ID NO: 312867 - DNA, 25 bp, Rattus norvegicus
gaattgctaacagtgctcagggcag

SEQ ID NO: 312868 - DNA, 25 bp, Rattus norvegicus
gaattgctaagaactacaacctcga

SEQ ID NO: 312869 - DNA, 25 bp, Rattus norvegicus
gaattgctaagatctacaacctcga

SEQ ID NO: 312870 - DNA, 25 bp, Rattus norvegicus
gaattgctaagcatactaacaccta

SEQ ID NO: 312871 - DNA, 25 bp, Rattus norvegicus
gaattgctaagcttactaacaccta

SEQ ID NO: 312872 - DNA, 25 bp, Rattus norvegicus
gaattgctacacaccattcagcttc

SEQ ID NO: 312873 - DNA, 25 bp, Rattus norvegicus
gaattgctacactccattcagcttc

SEQ ID NO: 312874 - DNA, 25 bp, Rattus norvegicus
gaattgctacatatgccctttatcc

SEQ ID NO: 312875 - DNA, 25 bp, Rattus norvegicus
gaattgctacatttgccctttatcc

SEQ ID NO: 312876 - DNA, 25 bp, Rattus norvegicus
gaattgctagaacccgaggcccctg

SEQ ID NO: 312877 - DNA, 25 bp, Rattus norvegicus
gaattgctagaagccgaggcccctg

SEQ ID NO: 312878 - DNA, 25 bp, Rattus norvegicus
gaattgctccagacattggcttaaa

SEQ ID NO: 312879 - DNA, 25 bp, Rattus norvegicus
gaattgctccagtcattggcttaaa

SEQ ID NO: 312880 - DNA, 25 bp, Rattus norvegicus
gaattgctcccaacttaagactcac

SEQ ID NO: 312881 - DNA, 25 bp, Rattus norvegicus
gaattgctcccatcttaagactcac

SEQ ID NO: 312882 - DNA, 25 bp, Rattus norvegicus
gaattgctcctacttaacagttggc

SEQ ID NO: 312883 - DNA, 25 bp, Rattus norvegicus
gaattgctcctagttaacagttggc

SEQ ID NO: 312884 - DNA, 25 bp, Rattus norvegicus
gaattgctctacaaatggtgtctct

SEQ ID NO: 312885 - DNA, 25 bp, Rattus norvegicus
gaattgctctactaatggtgtctct

SEQ ID NO: 312886 - DNA, 25 bp, Rattus norvegicus
gaattgctctgcagccccaaagatg

SEQ ID NO: 312887 - DNA, 25 bp, Rattus norvegicus
gaattgctctgctgccccaaagatg

SEQ ID NO: 312888 - DNA, 25 bp, Rattus norvegicus
gaattgctctgtatttgcttggaac

SEQ ID NO: 312889 - DNA, 25 bp, Rattus norvegicus
gaattgctctgtttttgcttggaac

SEQ ID NO: 312890 - DNA, 25 bp, Rattus norvegicus
gaattgctgccacactgtagctttt

SEQ ID NO: 312891 - DNA, 25 bp, Rattus norvegicus
gaattgctgccagactgtagctttt

SEQ ID NO: 312892 - DNA, 25 bp, Rattus norvegicus
gaattgctgtcaaaacctgtgtttt

SEQ ID NO: 312893 - DNA, 25 bp, Rattus norvegicus
gaattgctgtcataacctgtgtttt

SEQ ID NO: 312894 - DNA, 25 bp, Rattus norvegicus
gaattgctgtgtccatgacagcctt

SEQ ID NO: 312895 - DNA, 25 bp, Rattus norvegicus
gaattgctgtgtgcatgacagcctt

SEQ ID NO: 312896 - DNA, 25 bp, Rattus norvegicus
gaattgcttatgaaattgctctcag

SEQ ID NO: 312897 - DNA, 25 bp, Rattus norvegicus
gaattgcttatgtaattgctctcag

SEQ ID NO: 312898 - DNA, 25 bp, Rattus norvegicus
gaattgcttcaactatctgtacttt

SEQ ID NO: 312899 - DNA, 25 bp, Rattus norvegicus
gaattgcttcaagtatctgtacttt

SEQ ID NO: 312900 - DNA, 25 bp, Rattus norvegicus
gaattgcttcttcaagtgccaaaag

SEQ ID NO: 312901 - DNA, 25 bp, Rattus norvegicus
gaattgcttcttgaagtgccaaaag

SEQ ID NO: 312902 - DNA, 25 bp, Rattus norvegicus
gaattgcttgccatctggcgaaatg

SEQ ID NO: 312903 - DNA, 25 bp, Rattus norvegicus
gaattgcttgccttctggcgaaatg

SEQ ID NO: 312904 - DNA, 25 bp, Rattus norvegicus
gaattgcttgttactgctttatcta

SEQ ID NO: 312905 - DNA, 25 bp, Rattus norvegicus
gaattgcttgtttctgctttatcta

SEQ ID NO: 312906 - DNA, 25 bp, Rattus norvegicus
gaattgctttctaagcaaccgttgt

SEQ ID NO: 312907 - DNA, 25 bp, Rattus norvegicus
gaattgctttctcctctataatctg

SEQ ID NO: 312908 - DNA, 25 bp, Rattus norvegicus
gaattgctttctgctctataatctg

SEQ ID NO: 312909 - DNA, 25 bp, Rattus norvegicus
gaattgctttcttagcaaccgttgt

SEQ ID NO: 312910 - DNA, 25 bp, Rattus norvegicus
gaattggacggaagtggcacctgtt

SEQ ID NO: 312911 - DNA, 25 bp, Rattus norvegicus
gaattggacggatgtggcacctgtt

SEQ ID NO: 312912 - DNA, 25 bp, Rattus norvegicus
gaattggagaagcaacttagcagag

SEQ ID NO: 312913 - DNA, 25 bp, Rattus norvegicus
gaattggagaaggaacttagcagag

SEQ ID NO: 312914 - DNA, 25 bp, Rattus norvegicus
gaattggaggctactcttggtacct

SEQ ID NO: 312915 - DNA, 25 bp, Rattus norvegicus
gaattggaggcttctcttggtacct

SEQ ID NO: 312916 - DNA, 25 bp, Rattus norvegicus
gaattggatccccttgaactgaggt

SEQ ID NO: 312917 - DNA, 25 bp, Rattus norvegicus
gaattggatcccgttgaactgaggt

SEQ ID NO: 312918 - DNA, 25 bp, Rattus norvegicus
gaattggatggcagttctctgctaa

SEQ ID NO: 312919 - DNA, 25 bp, Rattus norvegicus
gaattggatggctgttctctgctaa

SEQ ID NO: 312920 - DNA, 25 bp, Rattus norvegicus
gaattggcacagacagtcctttgtt

SEQ ID NO: 312921 - DNA, 25 bp, Rattus norvegicus
gaattggcacagtcagtcctttgtt

SEQ ID NO: 312922 - DNA, 25 bp, Rattus norvegicus
gaattggcacctctggcagttttct

SEQ ID NO: 312923 - DNA, 25 bp, Rattus norvegicus
gaattggcacctgtggcagttttct

SEQ ID NO: 312924 - DNA, 25 bp, Rattus norvegicus
gaattggcaggcaccttcttattga

SEQ ID NO: 312925 - DNA, 25 bp, Rattus norvegicus
gaattggcaggcatcggcctacaaa

SEQ ID NO: 312926 - DNA, 25 bp, Rattus norvegicus
gaattggcaggctccttcttattga

SEQ ID NO: 312927 - DNA, 25 bp, Rattus norvegicus
gaattggcaggcttcggcctacaaa

SEQ ID NO: 312928 - DNA, 25 bp, Rattus norvegicus
gaattggccccacaaaaggctagtt

SEQ ID NO: 312929 - DNA, 25 bp, Rattus norvegicus
gaattggccccagaaaaggctagtt

SEQ ID NO: 312930 - DNA, 25 bp, Rattus norvegicus
gaattggctagacttttccctgctg

SEQ ID NO: 312931 - DNA, 25 bp, Rattus norvegicus
gaattggctagagttttccctgctg

SEQ ID NO: 312932 - DNA, 25 bp, Rattus norvegicus
gaattgggcattaacagtagtcaaa

SEQ ID NO: 312933 - DNA, 25 bp, Rattus norvegicus
gaattgggcattcgccttttccaaa

SEQ ID NO: 312934 - DNA, 25 bp, Rattus norvegicus
gaattgggcattggccttttccaaa

SEQ ID NO: 312935 - DNA, 25 bp, Rattus norvegicus
gaattgggcatttacagtagtcaaa

SEQ ID NO: 312936 - DNA, 25 bp, Rattus norvegicus
gaattgggctttatcccagccgaaa

SEQ ID NO: 312937 - DNA, 25 bp, Rattus norvegicus
gaattgggctttcactcagccagat

SEQ ID NO: 312938 - DNA, 25 bp, Rattus norvegicus
gaattgggctttcctgttcattgat

SEQ ID NO: 312939 - DNA, 25 bp, Rattus norvegicus
gaattgggctttgactcagccagat

SEQ ID NO: 312940 - DNA, 25 bp, Rattus norvegicus
gaattgggctttgctgttcattgat

SEQ ID NO: 312941 - DNA, 25 bp, Rattus norvegicus
gaattgggctttttcccagccgaaa

SEQ ID NO: 312942 - DNA, 25 bp, Rattus norvegicus
gaattggtaaacatctcactttaga

SEQ ID NO: 312943 - DNA, 25 bp, Rattus norvegicus
gaattggtaaacttctcactttaga

SEQ ID NO: 312944 - DNA, 25 bp, Rattus norvegicus
gaattggtaccaaccttttgttgga

SEQ ID NO: 312945 - DNA, 25 bp, Rattus norvegicus
gaattggtaccatccttttgttgga

SEQ ID NO: 312946 - DNA, 25 bp, Rattus norvegicus
gaattggtcactccatcctttatgg

SEQ ID NO: 312947 - DNA, 25 bp, Rattus norvegicus
gaattggtcactgcatcctttatgg

SEQ ID NO: 312948 - DNA, 25 bp, Rattus norvegicus
gaattggtccctcttattatagtat

SEQ ID NO: 312949 - DNA, 25 bp, Rattus norvegicus
gaattggtccctgttattatagtat

SEQ ID NO: 312950 - DNA, 25 bp, Rattus norvegicus
gaattggtcctgcacctacatgagt

SEQ ID NO: 312951 - DNA, 25 bp, Rattus norvegicus
gaattggtcctggacctacatgagt

SEQ ID NO: 312952 - DNA, 25 bp, Rattus norvegicus
gaattggtggcaccggcctgtaatc

SEQ ID NO: 312953 - DNA, 25 bp, Rattus norvegicus
gaattggtggcagcggcctgtaatc

SEQ ID NO: 312954 - DNA, 25 bp, Rattus norvegicus
gaattggtggtgcttctcaatgcca

SEQ ID NO: 312955 - DNA, 25 bp, Rattus norvegicus
gaattggtggtggttctcaatgcca

SEQ ID NO: 312956 - DNA, 25 bp, Rattus norvegicus
gaattggtgtagacttcggataaca

SEQ ID NO: 312957 - DNA, 25 bp, Rattus norvegicus
gaattggtgtagtcttcggataaca

SEQ ID NO: 312958 - DNA, 25 bp, Rattus norvegicus
gaattggttcatatcaccagcgaag

SEQ ID NO: 312959 - DNA, 25 bp, Rattus norvegicus
gaattggttcatttcaccagcgaag

SEQ ID NO: 312960 - DNA, 25 bp, Rattus norvegicus
gaattggttgtcaccttgatgtaaa

SEQ ID NO: 312961 - DNA, 25 bp, Rattus norvegicus
gaattggttgtctccttgatgtaaa

SEQ ID NO: 312962 - DNA, 25 bp, Rattus norvegicus
gaattgtacataaacctcttctgac

SEQ ID NO: 312963 - DNA, 25 bp, Rattus norvegicus
gaattgtacatatacctcttctgac

SEQ ID NO: 312964 - DNA, 25 bp, Rattus norvegicus
gaattgtaccaaagtgtcggccact

SEQ ID NO: 312965 - DNA, 25 bp, Rattus norvegicus
gaattgtaccaatgtgtcggccact

SEQ ID NO: 312966 - DNA, 25 bp, Rattus norvegicus
gaattgtacgagcaccaacttggta

SEQ ID NO: 312967 - DNA, 25 bp, Rattus norvegicus
gaattgtacgaggaccaacttggta

SEQ ID NO: 312968 - DNA, 25 bp, Rattus norvegicus
gaattgtactggctgttgaccacca

SEQ ID NO: 312969 - DNA, 25 bp, Rattus norvegicus
gaattgtactgggtgttgaccacca

SEQ ID NO: 312970 - DNA, 25 bp, Rattus norvegicus
gaattgtactgtacttcttaaagaa

SEQ ID NO: 312971 - DNA, 25 bp, Rattus norvegicus
gaattgtactgtatagccatcctcc

SEQ ID NO: 312972 - DNA, 25 bp, Rattus norvegicus
gaattgtactgttcttcttaaagaa

SEQ ID NO: 312973 - DNA, 25 bp, Rattus norvegicus
gaattgtactgtttagccatcctcc

SEQ ID NO: 312974 - DNA, 25 bp, Rattus norvegicus
gaattgtagtctcatgctgctctgt

SEQ ID NO: 312975 - DNA, 25 bp, Rattus norvegicus
gaattgtagtctgatgctgctctgt

SEQ ID NO: 312976 - DNA, 25 bp, Rattus norvegicus
gaattgtattctaggcgatgtctga

SEQ ID NO: 312977 - DNA, 25 bp, Rattus norvegicus
gaattgtattcttggcgatgtctga

SEQ ID NO: 312978 - DNA, 25 bp, Rattus norvegicus
gaattgtatttcaacttcatttccc

SEQ ID NO: 312979 - DNA, 25 bp, Rattus norvegicus
gaattgtatttctacttcatttccc

SEQ ID NO: 312980 - DNA, 25 bp, Rattus norvegicus
gaattgtcaatcactctacttccaa

SEQ ID NO: 312981 - DNA, 25 bp, Rattus norvegicus
gaattgtcaatctctctacttccaa

SEQ ID NO: 312982 - DNA, 25 bp, Rattus norvegicus
gaattgtcacttccctgtatgtgga

SEQ ID NO: 312983 - DNA, 25 bp, Rattus norvegicus
gaattgtcacttgcctgtatgtgga

SEQ ID NO: 312984 - DNA, 25 bp, Rattus norvegicus
gaattgtcagtgcagcctgcagtct

SEQ ID NO: 312985 - DNA, 25 bp, Rattus norvegicus
gaattgtcagtggagcctgcagtct

SEQ ID NO: 312986 - DNA, 25 bp, Rattus norvegicus
gaattgtcatcaagtcatagccaga

SEQ ID NO: 312987 - DNA, 25 bp, Rattus norvegicus
gaattgtcatcatgtcatagccaga

SEQ ID NO: 312988 - DNA, 25 bp, Rattus norvegicus
gaattgtccacccagagttgagtcg

SEQ ID NO: 312989 - DNA, 25 bp, Rattus norvegicus
gaattgtccaccgagagttgagtcg

SEQ ID NO: 312990 - DNA, 25 bp, Rattus norvegicus
gaattgtccggacccataagagcca

SEQ ID NO: 312991 - DNA, 25 bp, Rattus norvegicus
gaattgtccggagccataagagcca

SEQ ID NO: 312992 - DNA, 25 bp, Rattus norvegicus
gaattgtccttaaatgcccattcgg

SEQ ID NO: 312993 - DNA, 25 bp, Rattus norvegicus
gaattgtccttatatgcccattcgg

SEQ ID NO: 312994 - DNA, 25 bp, Rattus norvegicus
gaattgtcgccactgtgtgatccgg

SEQ ID NO: 312995 - DNA, 25 bp, Rattus norvegicus
gaattgtcgccagtgtgtgatccgg

SEQ ID NO: 312996 - DNA, 25 bp, Rattus norvegicus
gaattgtctgcacactgtaaaccat

SEQ ID NO: 312997 - DNA, 25 bp, Rattus norvegicus
gaattgtctgcagactgtaaaccat

SEQ ID NO: 312998 - DNA, 25 bp, Rattus norvegicus
gaattgtctggtactgtggctaatt

SEQ ID NO: 312999 - DNA, 25 bp, Rattus norvegicus
gaattgtctggttctgtggctaatt

SEQ ID NO: 313000 - DNA, 25 bp, Rattus norvegicus
gaattgtctgtcattgaggctaaac

SEQ ID NO: 313001 - DNA, 25 bp, Rattus norvegicus
gaattgtctgtctttgaggctaaac

SEQ ID NO: 313002 - DNA, 25 bp, Rattus norvegicus
gaattgtcttctccagttctctaac

SEQ ID NO: 313003 - DNA, 25 bp, Rattus norvegicus
gaattgtcttctgcagttctctaac

SEQ ID NO: 313004 - DNA, 25 bp, Rattus norvegicus
gaattgtgacaacttcagctggaac

SEQ ID NO: 313005 - DNA, 25 bp, Rattus norvegicus
gaattgtgacaagttcagctggaac

SEQ ID NO: 313006 - DNA, 25 bp, Rattus norvegicus
gaattgtgcctacgacagccataag

SEQ ID NO: 313007 - DNA, 25 bp, Rattus norvegicus
gaattgtgcctaggacagccataag

SEQ ID NO: 313008 - DNA, 25 bp, Rattus norvegicus
gaattgtgcctgagtatataactct

SEQ ID NO: 313009 - DNA, 25 bp, Rattus norvegicus
gaattgtgcctgtgtatataactct

SEQ ID NO: 313010 - DNA, 25 bp, Rattus norvegicus
gaattgtgcgtaactgaaatactga

SEQ ID NO: 313011 - DNA, 25 bp, Rattus norvegicus
gaattgtgcgtatctgaaatactga

SEQ ID NO: 313012 - DNA, 25 bp, Rattus norvegicus
gaattgtgctcgattcaggatggaa

SEQ ID NO: 313013 - DNA, 25 bp, Rattus norvegicus
gaattgtgctcgtttcaggatggaa

SEQ ID NO: 313014 - DNA, 25 bp, Rattus norvegicus
gaattgtgctctctgccatgctggc

SEQ ID NO: 313015 - DNA, 25 bp, Rattus norvegicus
gaattgtgctctgtgccatgctggc

SEQ ID NO: 313016 - DNA, 25 bp, Rattus norvegicus
gaattgtgctggattaactgtcaac

SEQ ID NO: 313017 - DNA, 25 bp, Rattus norvegicus
gaattgtgctggtttaactgtcaac

SEQ ID NO: 313018 - DNA, 25 bp, Rattus norvegicus
gaattgtgctttaccttccaacata

SEQ ID NO: 313019 - DNA, 25 bp, Rattus norvegicus
gaattgtgctttccaggttctacta

SEQ ID NO: 313020 - DNA, 25 bp, Rattus norvegicus
gaattgtgctttgcaggttctacta

SEQ ID NO: 313021 - DNA, 25 bp, Rattus norvegicus
gaattgtgcttttccttccaacata

SEQ ID NO: 313022 - DNA, 25 bp, Rattus norvegicus
gaattgtggaacacctgccaatgga

SEQ ID NO: 313023 - DNA, 25 bp, Rattus norvegicus
gaattgtggaaccatcccagaacaa

SEQ ID NO: 313024 - DNA, 25 bp, Rattus norvegicus
gaattgtggaacgatcccagaacaa

SEQ ID NO: 313025 - DNA, 25 bp, Rattus norvegicus
gaattgtggaactcctgccaatgga

SEQ ID NO: 313026 - DNA, 25 bp, Rattus norvegicus
gaattgtggctgaaagttgtggctt

SEQ ID NO: 313027 - DNA, 25 bp, Rattus norvegicus
gaattgtggctgtaagttgtggctt

SEQ ID NO: 313028 - DNA, 25 bp, Rattus norvegicus
gaattgtgtattccctggtagtaat

SEQ ID NO: 313029 - DNA, 25 bp, Rattus norvegicus
gaattgtgtattgcctggtagtaat

SEQ ID NO: 313030 - DNA, 25 bp, Rattus norvegicus
gaattgtgtcctctgctatatgtat

SEQ ID NO: 313031 - DNA, 25 bp, Rattus norvegicus
gaattgtgtcctgtgctatatgtat

SEQ ID NO: 313032 - DNA, 25 bp, Rattus norvegicus
gaattgtgtggcacttctatcatta

SEQ ID NO: 313033 - DNA, 25 bp, Rattus norvegicus
gaattgtgtggctcttctatcatta

SEQ ID NO: 313034 - DNA, 25 bp, Rattus norvegicus
gaattgtgtgtccaaaattaaacat

SEQ ID NO: 313035 - DNA, 25 bp, Rattus norvegicus
gaattgtgtgtcgaaaattaaacat

SEQ ID NO: 313036 - DNA, 25 bp, Rattus norvegicus
gaattgttacaaatcctggttagaa

SEQ ID NO: 313037 - DNA, 25 bp, Rattus norvegicus
gaattgttacaaccgctctggtcag

SEQ ID NO: 313038 - DNA, 25 bp, Rattus norvegicus
gaattgttacaagcgctctggtcag

SEQ ID NO: 313039 - DNA, 25 bp, Rattus norvegicus
gaattgttacaattcctggttagaa

SEQ ID NO: 313040 - DNA, 25 bp, Rattus norvegicus
gaattgttaccaacactgcagacct

SEQ ID NO: 313041 - DNA, 25 bp, Rattus norvegicus
gaattgttaccatcactgcagacct

SEQ ID NO: 313042 - DNA, 25 bp, Rattus norvegicus
gaattgttattcatgcccatgaaac

SEQ ID NO: 313043 - DNA, 25 bp, Rattus norvegicus
gaattgttattcttgcccatgaaac

SEQ ID NO: 313044 - DNA, 25 bp, Rattus norvegicus
gaattgttattgatccctttcgtca

SEQ ID NO: 313045 - DNA, 25 bp, Rattus norvegicus
gaattgttattgttccctttcgtca

SEQ ID NO: 313046 - DNA, 25 bp, Rattus norvegicus
gaattgttcataagctgcctttgga

SEQ ID NO: 313047 - DNA, 25 bp, Rattus norvegicus
gaattgttcatatgctgcctttgga

SEQ ID NO: 313048 - DNA, 25 bp, Rattus norvegicus
gaattgttgactctgtcttcatcaa

SEQ ID NO: 313049 - DNA, 25 bp, Rattus norvegicus
gaattgttgactgtgtcttcatcaa

SEQ ID NO: 313050 - DNA, 25 bp, Rattus norvegicus
gaattgttgctcaatggcttgcaca

SEQ ID NO: 313051 - DNA, 25 bp, Rattus norvegicus
gaattgttgctctatggcttgcaca

SEQ ID NO: 313052 - DNA, 25 bp, Rattus norvegicus
gaattgttggttctgagcttccttt

SEQ ID NO: 313053 - DNA, 25 bp, Rattus norvegicus
gaattgttggttgtgagcttccttt

SEQ ID NO: 313054 - DNA, 25 bp, Rattus norvegicus
gaattgtttcccactactgtcaaaa

SEQ ID NO: 313055 - DNA, 25 bp, Rattus norvegicus
gaattgtttccctctactgtcaaaa

SEQ ID NO: 313056 - DNA, 25 bp, Rattus norvegicus
gaattgttttatacttgcccttgaa

SEQ ID NO: 313057 - DNA, 25 bp, Rattus norvegicus
gaattgttttattcttgcccttgaa

SEQ ID NO: 313058 - DNA, 25 bp, Rattus norvegicus
gaattgttttctccccaaggttaat

SEQ ID NO: 313059 - DNA, 25 bp, Rattus norvegicus
gaattgttttctgcccaaggttaat

SEQ ID NO: 313060 - DNA, 25 bp, Rattus norvegicus
gaatttaaaaccagaatgcctaaga

SEQ ID NO: 313061 - DNA, 25 bp, Rattus norvegicus
gaatttaaaacctgaatgcctaaga

SEQ ID NO: 313062 - DNA, 25 bp, Rattus norvegicus
gaatttaaacgtcgtcaccttcgag

SEQ ID NO: 313063 - DNA, 25 bp, Rattus norvegicus
gaatttaaacgtggtcaccttcgag

SEQ ID NO: 313064 - DNA, 25 bp, Rattus norvegicus
gaatttaaccatcctgagtcatgta

SEQ ID NO: 313065 - DNA, 25 bp, Rattus norvegicus
gaatttaaccatgctgagtcatgta

SEQ ID NO: 313066 - DNA, 25 bp, Rattus norvegicus
gaatttaagtttccttttgtgtcat

SEQ ID NO: 313067 - DNA, 25 bp, Rattus norvegicus
gaatttaagtttgcttttgtgtcat

SEQ ID NO: 313068 - DNA, 25 bp, Rattus norvegicus
gaatttacaagtcgtccttaaggag

SEQ ID NO: 313069 - DNA, 25 bp, Rattus norvegicus
gaatttacaagtggtccttaaggag

SEQ ID NO: 313070 - DNA, 25 bp, Rattus norvegicus
gaatttacactcatttgcagtcatt

SEQ ID NO: 313071 - DNA, 25 bp, Rattus norvegicus
gaatttacactcttttgcagtcatt

SEQ ID NO: 313072 - DNA, 25 bp, Rattus norvegicus
gaatttacatcaataactgctcatg

SEQ ID NO: 313073 - DNA, 25 bp, Rattus norvegicus
gaatttacatcattaactgctcatg

SEQ ID NO: 313074 - DNA, 25 bp, Rattus norvegicus
gaatttaccaatattcaggactttg

SEQ ID NO: 313075 - DNA, 25 bp, Rattus norvegicus
gaatttaccaattttcaggactttg

SEQ ID NO: 313076 - DNA, 25 bp, Rattus norvegicus
gaatttaccacaatctgtatagatc

SEQ ID NO: 313077 - DNA, 25 bp, Rattus norvegicus
gaatttaccacattctgtatagatc

SEQ ID NO: 313078 - DNA, 25 bp, Rattus norvegicus
gaatttaccaccacagttttctgga

SEQ ID NO: 313079 - DNA, 25 bp, Rattus norvegicus
gaatttaccacctcagttttctgga

SEQ ID NO: 313080 - DNA, 25 bp, Rattus norvegicus
gaatttacctccaattcgaaatggg

SEQ ID NO: 313081 - DNA, 25 bp, Rattus norvegicus
gaatttacctcctattcgaaatggg

SEQ ID NO: 313082 - DNA, 25 bp, Rattus norvegicus
gaatttacctctcagctacgccaaa

SEQ ID NO: 313083 - DNA, 25 bp, Rattus norvegicus
gaatttacctctgagctacgccaaa

SEQ ID NO: 313084 - DNA, 25 bp, Rattus norvegicus
gaatttacgagcatgctgtccccaa

SEQ ID NO: 313085 - DNA, 25 bp, Rattus norvegicus
gaatttacgagcttgctgtccccaa

SEQ ID NO: 313086 - DNA, 25 bp, Rattus norvegicus
gaatttacgcctaaatgtgtcatta

SEQ ID NO: 313087 - DNA, 25 bp, Rattus norvegicus
gaatttacgccttaatgtgtcatta

SEQ ID NO: 313088 - DNA, 25 bp, Rattus norvegicus
gaatttactacaaggcccaatctga

SEQ ID NO: 313089 - DNA, 25 bp, Rattus norvegicus
gaatttactacatggcccaatctga

SEQ ID NO: 313090 - DNA, 25 bp, Rattus norvegicus
gaatttactgtgctgctggagtcca

SEQ ID NO: 313091 - DNA, 25 bp, Rattus norvegicus
gaatttactgtggtgctggagtcca

SEQ ID NO: 313092 - DNA, 25 bp, Rattus norvegicus
gaatttacttccacccaagaatttg

SEQ ID NO: 313093 - DNA, 25 bp, Rattus norvegicus
gaatttacttccatcttttgctggt

SEQ ID NO: 313094 - DNA, 25 bp, Rattus norvegicus
gaatttacttcctcccaagaatttg

SEQ ID NO: 313095 - DNA, 25 bp, Rattus norvegicus
gaatttacttccttcttttgctggt

SEQ ID NO: 313096 - DNA, 25 bp, Rattus norvegicus
gaatttactttcaccttgtatgcta

SEQ ID NO: 313097 - DNA, 25 bp, Rattus norvegicus
gaatttactttctccttgtatgcta

SEQ ID NO: 313098 - DNA, 25 bp, Rattus norvegicus
gaatttagatttagggcttccctga

SEQ ID NO: 313099 - DNA, 25 bp, Rattus norvegicus
gaatttagattttgggcttccctga

SEQ ID NO: 313100 - DNA, 25 bp, Rattus norvegicus
gaatttagccctaagaatgcagagc

SEQ ID NO: 313101 - DNA, 25 bp, Rattus norvegicus
gaatttagcccttagaatgcagagc

SEQ ID NO: 313102 - DNA, 25 bp, Rattus norvegicus
gaatttagctgtatctttttaaccg

SEQ ID NO: 313103 - DNA, 25 bp, Rattus norvegicus
gaatttagctgtttctttttaaccg

SEQ ID NO: 313104 - DNA, 25 bp, Rattus norvegicus
gaatttaggtcactggttgtccata

SEQ ID NO: 313105 - DNA, 25 bp, Rattus norvegicus
gaatttaggtcagtggttgtccata

SEQ ID NO: 313106 - DNA, 25 bp, Rattus norvegicus
gaatttagtgatcccagtgagcttc

SEQ ID NO: 313107 - DNA, 25 bp, Rattus norvegicus
gaatttagtgatgccagtgagcttc

SEQ ID NO: 313108 - DNA, 25 bp, Rattus norvegicus
gaatttagttttctcccagcagtgt

SEQ ID NO: 313109 - DNA, 25 bp, Rattus norvegicus
gaatttagttttgtcccagcagtgt

SEQ ID NO: 313110 - DNA, 25 bp, Rattus norvegicus
gaatttatacccagtccagcagatc

SEQ ID NO: 313111 - DNA, 25 bp, Rattus norvegicus
gaatttataccctgtccagcagatc

SEQ ID NO: 313112 - DNA, 25 bp, Rattus norvegicus
gaatttatactactcggcctagatt

SEQ ID NO: 313113 - DNA, 25 bp, Rattus norvegicus
gaatttatactagtcggcctagatt

SEQ ID NO: 313114 - DNA, 25 bp, Rattus norvegicus
gaatttatatttcttgcagctgcta

SEQ ID NO: 313115 - DNA, 25 bp, Rattus norvegicus
gaatttatatttgttgcagctgcta

SEQ ID NO: 313116 - DNA, 25 bp, Rattus norvegicus
gaatttatccgaaacctagtcacat

SEQ ID NO: 313117 - DNA, 25 bp, Rattus norvegicus
gaatttatccgatacctagtcacat

SEQ ID NO: 313118 - DNA, 25 bp, Rattus norvegicus
gaatttatcttccatgagtcccaag

SEQ ID NO: 313119 - DNA, 25 bp, Rattus norvegicus
gaatttatcttcgatgagtcccaag

SEQ ID NO: 313120 - DNA, 25 bp, Rattus norvegicus
gaatttatgatacagccttggctct

SEQ ID NO: 313121 - DNA, 25 bp, Rattus norvegicus
gaatttatgatagagccttggctct

SEQ ID NO: 313122 - DNA, 25 bp, Rattus norvegicus
gaatttatgattcttgctgattgtc

SEQ ID NO: 313123 - DNA, 25 bp, Rattus norvegicus
gaatttatgattgttgctgattgtc

SEQ ID NO: 313124 - DNA, 25 bp, Rattus norvegicus
gaatttatggacacctggcccagga

SEQ ID NO: 313125 - DNA, 25 bp, Rattus norvegicus
gaatttatggactcctggcccagga

SEQ ID NO: 313126 - DNA, 25 bp, Rattus norvegicus
gaatttatgttgaacttttcctgtt

SEQ ID NO: 313127 - DNA, 25 bp, Rattus norvegicus
gaatttatgttgtacttttcctgtt

SEQ ID NO: 313128 - DNA, 25 bp, Rattus norvegicus
gaatttattattagttgagtcctga

SEQ ID NO: 313129 - DNA, 25 bp, Rattus norvegicus
gaatttattatttgttgagtcctga

SEQ ID NO: 313130 - DNA, 25 bp, Rattus norvegicus
gaatttattcctctggtttccagaa

SEQ ID NO: 313131 - DNA, 25 bp, Rattus norvegicus
gaatttattcctgtggtttccagaa

SEQ ID NO: 313132 - DNA, 25 bp, Rattus norvegicus
gaatttattggcatttctgatccag

SEQ ID NO: 313133 - DNA, 25 bp, Rattus norvegicus
gaatttattggcttttctgatccag

SEQ ID NO: 313134 - DNA, 25 bp, Rattus norvegicus
gaatttatttgcagggacaacttgt

SEQ ID NO: 313135 - DNA, 25 bp, Rattus norvegicus
gaatttatttgctgggacaacttgt

SEQ ID NO: 313136 - DNA, 25 bp, Rattus norvegicus
gaatttcaacctaactgacccttca

SEQ ID NO: 313137 - DNA, 25 bp, Rattus norvegicus
gaatttcaaccttactgacccttca

SEQ ID NO: 313138 - DNA, 25 bp, Rattus norvegicus
gaatttcaagctcgtacttcatatg

SEQ ID NO: 313139 - DNA, 25 bp, Rattus norvegicus
gaatttcaagctggtacttcatatg

SEQ ID NO: 313140 - DNA, 25 bp, Rattus norvegicus
gaatttcaaggtagccatccctgag

SEQ ID NO: 313141 - DNA, 25 bp, Rattus norvegicus
gaatttcaaggttgccatccctgag

SEQ ID NO: 313142 - DNA, 25 bp, Rattus norvegicus
gaatttcactcacccattatttctc

SEQ ID NO: 313143 - DNA, 25 bp, Rattus norvegicus
gaatttcactcagccattatttctc

SEQ ID NO: 313144 - DNA, 25 bp, Rattus norvegicus
gaatttcactgtacttcagaccaag

SEQ ID NO: 313145 - DNA, 25 bp, Rattus norvegicus
gaatttcactgttcttcagaccaag

SEQ ID NO: 313146 - DNA, 25 bp, Rattus norvegicus
gaatttcacttcatgcacccaagtc

SEQ ID NO: 313147 - DNA, 25 bp, Rattus norvegicus
gaatttcacttcttgcacccaagtc

SEQ ID NO: 313148 - DNA, 25 bp, Rattus norvegicus
gaatttcagagacctcagactcctc

SEQ ID NO: 313149 - DNA, 25 bp, Rattus norvegicus
gaatttcagagagctcagactcctc

SEQ ID NO: 313150 - DNA, 25 bp, Rattus norvegicus
gaatttcagcccctactggcaaaca

SEQ ID NO: 313151 - DNA, 25 bp, Rattus norvegicus
gaatttcagcccgtactggcaaaca

SEQ ID NO: 313152 - DNA, 25 bp, Rattus norvegicus
gaatttcaggagaggatccaaccca

SEQ ID NO: 313153 - DNA, 25 bp, Rattus norvegicus
gaatttcaggagtggatccaaccca

SEQ ID NO: 313154 - DNA, 25 bp, Rattus norvegicus
gaatttcagggaacccaggcttgaa

SEQ ID NO: 313155 - DNA, 25 bp, Rattus norvegicus
gaatttcagggatcccaggcttgaa

SEQ ID NO: 313156 - DNA, 25 bp, Rattus norvegicus
gaatttcagggcacaccccaggatt

SEQ ID NO: 313157 - DNA, 25 bp, Rattus norvegicus
gaatttcagggctcaccccaggatt

SEQ ID NO: 313158 - DNA, 25 bp, Rattus norvegicus
gaatttcagttgcacgtacccgata

SEQ ID NO: 313159 - DNA, 25 bp, Rattus norvegicus
gaatttcagttggacgtacccgata

SEQ ID NO: 313160 - DNA, 25 bp, Rattus norvegicus
gaatttcatactaccaatcttggtt

SEQ ID NO: 313161 - DNA, 25 bp, Rattus norvegicus
gaatttcatacttccaatcttggtt

SEQ ID NO: 313162 - DNA, 25 bp, Rattus norvegicus
gaatttcatcacaaggatcctcctc

SEQ ID NO: 313163 - DNA, 25 bp, Rattus norvegicus
gaatttcatcactaggatcctcctc

SEQ ID NO: 313164 - DNA, 25 bp, Rattus norvegicus
gaatttcatcatatccagaacgttg

SEQ ID NO: 313165 - DNA, 25 bp, Rattus norvegicus
gaatttcatcatttccagaacgttg

SEQ ID NO: 313166 - DNA, 25 bp, Rattus norvegicus
gaatttcatcgtctgcaaatctccc

SEQ ID NO: 313167 - DNA, 25 bp, Rattus norvegicus
gaatttcatcgtgtgcaaatctccc

SEQ ID NO: 313168 - DNA, 25 bp, Rattus norvegicus
gaatttcatgtcaaggatcagcagt

SEQ ID NO: 313169 - DNA, 25 bp, Rattus norvegicus
gaatttcatgtctaggatcagcagt

SEQ ID NO: 313170 - DNA, 25 bp, Rattus norvegicus
gaatttcattcaaagcttacaaaca

SEQ ID NO: 313171 - DNA, 25 bp, Rattus norvegicus
gaatttcattcatagcttacaaaca

SEQ ID NO: 313172 - DNA, 25 bp, Rattus norvegicus
gaatttcattgtaccatgcatggag

SEQ ID NO: 313173 - DNA, 25 bp, Rattus norvegicus
gaatttcattgttccatgcatggag

SEQ ID NO: 313174 - DNA, 25 bp, Rattus norvegicus
gaatttccaaaaacccatgaactga

SEQ ID NO: 313175 - DNA, 25 bp, Rattus norvegicus
gaatttccaaaatcccatgaactga

SEQ ID NO: 313176 - DNA, 25 bp, Rattus norvegicus
gaatttccaagtagtggagcacaca

SEQ ID NO: 313177 - DNA, 25 bp, Rattus norvegicus
gaatttccaagttgtggagcacaca

SEQ ID NO: 313178 - DNA, 25 bp, Rattus norvegicus
gaatttccacagcaagaatcagctt

SEQ ID NO: 313179 - DNA, 25 bp, Rattus norvegicus
gaatttccacaggaagaatcagctt

SEQ ID NO: 313180 - DNA, 25 bp, Rattus norvegicus
gaatttccatagagctacatccaga

SEQ ID NO: 313181 - DNA, 25 bp, Rattus norvegicus
gaatttccatagtgctacatccaga

SEQ ID NO: 313182 - DNA, 25 bp, Rattus norvegicus
gaatttccatccatgtcttggtaga

SEQ ID NO: 313183 - DNA, 25 bp, Rattus norvegicus
gaatttccatccttgtcttggtaga

SEQ ID NO: 313184 - DNA, 25 bp, Rattus norvegicus
gaatttccatcgactacaccagagt

SEQ ID NO: 313185 - DNA, 25 bp, Rattus norvegicus
gaatttccatcgtctacaccagagt

SEQ ID NO: 313186 - DNA, 25 bp, Rattus norvegicus
gaatttccatctatctgagcatgca

SEQ ID NO: 313187 - DNA, 25 bp, Rattus norvegicus
gaatttccatctttctgagcatgca

SEQ ID NO: 313188 - DNA, 25 bp, Rattus norvegicus
gaatttccatgacggtttcattcaa

SEQ ID NO: 313189 - DNA, 25 bp, Rattus norvegicus
gaatttccatgagggtttcattcaa

SEQ ID NO: 313190 - DNA, 25 bp, Rattus norvegicus
gaatttccatgcatccaggcacttg

SEQ ID NO: 313191 - DNA, 25 bp, Rattus norvegicus
gaatttccatgcttccaggcacttg

SEQ ID NO: 313192 - DNA, 25 bp, Rattus norvegicus
gaatttccatttaatcctgttcaat

SEQ ID NO: 313193 - DNA, 25 bp, Rattus norvegicus
gaatttccattttatcctgttcaat

SEQ ID NO: 313194 - DNA, 25 bp, Rattus norvegicus
gaatttcccactagagaaccatgcc

SEQ ID NO: 313195 - DNA, 25 bp, Rattus norvegicus
gaatttcccacttgagaaccatgcc

SEQ ID NO: 313196 - DNA, 25 bp, Rattus norvegicus
gaatttcccatgactgacctggaca

SEQ ID NO: 313197 - DNA, 25 bp, Rattus norvegicus
gaatttcccatgtctgacctggaca

SEQ ID NO: 313198 - DNA, 25 bp, Rattus norvegicus
gaatttcccattcctgagcagttca

SEQ ID NO: 313199 - DNA, 25 bp, Rattus norvegicus
gaatttcccattgctgagcagttca

SEQ ID NO: 313200 - DNA, 25 bp, Rattus norvegicus
gaatttccccacaagtgggcaccca

SEQ ID NO: 313201 - DNA, 25 bp, Rattus norvegicus
gaatttccccactagtgggcaccca

SEQ ID NO: 313202 - DNA, 25 bp, Rattus norvegicus
gaatttccccataagtgatttccca

SEQ ID NO: 313203 - DNA, 25 bp, Rattus norvegicus
gaatttccccattagtgatttccca

SEQ ID NO: 313204 - DNA, 25 bp, Rattus norvegicus
gaatttcccctaactttggacacat

SEQ ID NO: 313205 - DNA, 25 bp, Rattus norvegicus
gaatttcccctatctttggacacat

SEQ ID NO: 313206 - DNA, 25 bp, Rattus norvegicus
gaatttcccgaactgtggacttctg

SEQ ID NO: 313207 - DNA, 25 bp, Rattus norvegicus
gaatttcccgaagtgtggacttctg

SEQ ID NO: 313208 - DNA, 25 bp, Rattus norvegicus
gaatttccctggaagttcaactgga

SEQ ID NO: 313209 - DNA, 25 bp, Rattus norvegicus
gaatttccctggtagttcaactgga

SEQ ID NO: 313210 - DNA, 25 bp, Rattus norvegicus
gaatttccctttaagagtgtggctc

SEQ ID NO: 313211 - DNA, 25 bp, Rattus norvegicus
gaatttcccttttagagtgtggctc

SEQ ID NO: 313212 - DNA, 25 bp, Rattus norvegicus
gaatttccggctatgatctcctttg

SEQ ID NO: 313213 - DNA, 25 bp, Rattus norvegicus
gaatttccggctttgatctcctttg

SEQ ID NO: 313214 - DNA, 25 bp, Rattus norvegicus
gaatttccgggtactgctggtaaag

SEQ ID NO: 313215 - DNA, 25 bp, Rattus norvegicus
gaatttccgggttctgctggtaaag

SEQ ID NO: 313216 - DNA, 25 bp, Rattus norvegicus
gaatttcctatcagggatatgccaa

SEQ ID NO: 313217 - DNA, 25 bp, Rattus norvegicus
gaatttcctatctgggatatgccaa

SEQ ID NO: 313218 - DNA, 25 bp, Rattus norvegicus
gaatttcctcagatgtgacaagcat

SEQ ID NO: 313219 - DNA, 25 bp, Rattus norvegicus
gaatttcctcagttgtgacaagcat

SEQ ID NO: 313220 - DNA, 25 bp, Rattus norvegicus
gaatttcctctgactttacctgtag

SEQ ID NO: 313221 - DNA, 25 bp, Rattus norvegicus
gaatttcctctgtctttacctgtag

SEQ ID NO: 313222 - DNA, 25 bp, Rattus norvegicus
gaatttcctgatctgatttcagagt

SEQ ID NO: 313223 - DNA, 25 bp, Rattus norvegicus
gaatttcctgatgtgatttcagagt

SEQ ID NO: 313224 - DNA, 25 bp, Rattus norvegicus
gaatttcctgtacagcagtcagttg

SEQ ID NO: 313225 - DNA, 25 bp, Rattus norvegicus
gaatttcctgtagagcagtcagttg

SEQ ID NO: 313226 - DNA, 25 bp, Rattus norvegicus
gaatttcctgttattcctctttaat

SEQ ID NO: 313227 - DNA, 25 bp, Rattus norvegicus
gaatttcctgtttttcctctttaat

SEQ ID NO: 313228 - DNA, 25 bp, Rattus norvegicus
gaatttccttgaactgcacagttga

SEQ ID NO: 313229 - DNA, 25 bp, Rattus norvegicus
gaatttccttgatctgcacagttga

SEQ ID NO: 313230 - DNA, 25 bp, Rattus norvegicus
gaatttcctttaaggctttcctcac

SEQ ID NO: 313231 - DNA, 25 bp, Rattus norvegicus
gaatttcctttaattcttaaatcat

SEQ ID NO: 313232 - DNA, 25 bp, Rattus norvegicus
gaatttcctttatggctttcctcac

SEQ ID NO: 313233 - DNA, 25 bp, Rattus norvegicus
gaatttcctttatttcttaaatcat

SEQ ID NO: 313234 - DNA, 25 bp, Rattus norvegicus
gaatttcctttgacacgtagttttg

SEQ ID NO: 313235 - DNA, 25 bp, Rattus norvegicus
gaatttcctttgtcacgtagttttg

SEQ ID NO: 313236 - DNA, 25 bp, Rattus norvegicus
gaatttccttttctcagcaatggcc

SEQ ID NO: 313237 - DNA, 25 bp, Rattus norvegicus
gaatttccttttgtcagcaatggcc

SEQ ID NO: 313238 - DNA, 25 bp, Rattus norvegicus
gaatttcgaaaaaccgcacagtctg

SEQ ID NO: 313239 - DNA, 25 bp, Rattus norvegicus
gaatttcgaaaatccgcacagtctg

SEQ ID NO: 313240 - DNA, 25 bp, Rattus norvegicus
gaatttcgagtaaactgctgatttt

SEQ ID NO: 313241 - DNA, 25 bp, Rattus norvegicus
gaatttcgagtatactgctgatttt

SEQ ID NO: 313242 - DNA, 25 bp, Rattus norvegicus
gaatttcggttcaacgctggaggca

SEQ ID NO: 313243 - DNA, 25 bp, Rattus norvegicus
gaatttcggttctacgctggaggca

SEQ ID NO: 313244 - DNA, 25 bp, Rattus norvegicus
gaatttcgtttcagataacttgtac

SEQ ID NO: 313245 - DNA, 25 bp, Rattus norvegicus
gaatttcgtttctgataacttgtac

SEQ ID NO: 313246 - DNA, 25 bp, Rattus norvegicus
gaatttctaccacctctgattgcca

SEQ ID NO: 313247 - DNA, 25 bp, Rattus norvegicus
gaatttctaccagctctgattgcca

SEQ ID NO: 313248 - DNA, 25 bp, Rattus norvegicus
gaatttctacctcttttatctcatt

SEQ ID NO: 313249 - DNA, 25 bp, Rattus norvegicus
gaatttctacctgttttatctcatt

SEQ ID NO: 313250 - DNA, 25 bp, Rattus norvegicus
gaatttctactgcaggtgccgcaca

SEQ ID NO: 313251 - DNA, 25 bp, Rattus norvegicus
gaatttctactggaggtgccgcaca

SEQ ID NO: 313252 - DNA, 25 bp, Rattus norvegicus
gaatttctattcatgtattaacaaa

SEQ ID NO: 313253 - DNA, 25 bp, Rattus norvegicus
gaatttctattccagcatcagacaa

SEQ ID NO: 313254 - DNA, 25 bp, Rattus norvegicus
gaatttctattcgagcatcagacaa

SEQ ID NO: 313255 - DNA, 25 bp, Rattus norvegicus
gaatttctattcttgtattaacaaa

SEQ ID NO: 313256 - DNA, 25 bp, Rattus norvegicus
gaatttctcaagattgtgtggcgct

SEQ ID NO: 313257 - DNA, 25 bp, Rattus norvegicus
gaatttctcaagtttgtgtggcgct

SEQ ID NO: 313258 - DNA, 25 bp, Rattus norvegicus
gaatttctccatatccttatctggt

SEQ ID NO: 313259 - DNA, 25 bp, Rattus norvegicus
gaatttctccatttccttatctggt

SEQ ID NO: 313260 - DNA, 25 bp, Rattus norvegicus
gaatttctccgtatactagcatgcc

SEQ ID NO: 313261 - DNA, 25 bp, Rattus norvegicus
gaatttctccgtccttaaagtgtag

SEQ ID NO: 313262 - DNA, 25 bp, Rattus norvegicus
gaatttctccgtgcttaaagtgtag

SEQ ID NO: 313263 - DNA, 25 bp, Rattus norvegicus
gaatttctccgtttactagcatgcc

SEQ ID NO: 313264 - DNA, 25 bp, Rattus norvegicus
gaatttctctgcagtatccaaagga

SEQ ID NO: 313265 - DNA, 25 bp, Rattus norvegicus
gaatttctctgctgtatccaaagga

SEQ ID NO: 313266 - DNA, 25 bp, Rattus norvegicus
gaatttctctggatcaacactttat

SEQ ID NO: 313267 - DNA, 25 bp, Rattus norvegicus
gaatttctctggttcaacactttat

SEQ ID NO: 313268 - DNA, 25 bp, Rattus norvegicus
gaatttctgatcacgacattttgtt

SEQ ID NO: 313269 - DNA, 25 bp, Rattus norvegicus
gaatttctgatctcgacattttgtt

SEQ ID NO: 313270 - DNA, 25 bp, Rattus norvegicus
gaatttctgattaaatgactggact

SEQ ID NO: 313271 - DNA, 25 bp, Rattus norvegicus
gaatttctgatttaatgactggact

SEQ ID NO: 313272 - DNA, 25 bp, Rattus norvegicus
gaatttctgcatatgcctccaagta

SEQ ID NO: 313273 - DNA, 25 bp, Rattus norvegicus
gaatttctgcatttgcctccaagta

SEQ ID NO: 313274 - DNA, 25 bp, Rattus norvegicus
gaatttctggaacctaaacactact

SEQ ID NO: 313275 - DNA, 25 bp, Rattus norvegicus
gaatttctggaagctaaacactact

SEQ ID NO: 313276 - DNA, 25 bp, Rattus norvegicus
gaatttctggcacagtagccggtgc

SEQ ID NO: 313277 - DNA, 25 bp, Rattus norvegicus
gaatttctggcagagtagccggtgc

SEQ ID NO: 313278 - DNA, 25 bp, Rattus norvegicus
gaatttctgtctctcttgttacatg

SEQ ID NO: 313279 - DNA, 25 bp, Rattus norvegicus
gaatttctgtctgtcttgttacatg

SEQ ID NO: 313280 - DNA, 25 bp, Rattus norvegicus
gaatttcttaccaggcaataaactg

SEQ ID NO: 313281 - DNA, 25 bp, Rattus norvegicus
gaatttcttacctggcaataaactg

SEQ ID NO: 313282 - DNA, 25 bp, Rattus norvegicus
gaatttcttcatacactttctgctt

SEQ ID NO: 313283 - DNA, 25 bp, Rattus norvegicus
gaatttcttcattcactttctgctt

SEQ ID NO: 313284 - DNA, 25 bp, Rattus norvegicus
gaatttcttcccctggcaagcacag

SEQ ID NO: 313285 - DNA, 25 bp, Rattus norvegicus
gaatttcttcccgtggcaagcacag

SEQ ID NO: 313286 - DNA, 25 bp, Rattus norvegicus
gaatttctttctacatttacagcca

SEQ ID NO: 313287 - DNA, 25 bp, Rattus norvegicus
gaatttctttctcatggtaacctta

SEQ ID NO: 313288 - DNA, 25 bp, Rattus norvegicus
gaatttctttctgatggtaacctta

SEQ ID NO: 313289 - DNA, 25 bp, Rattus norvegicus
gaatttctttcttcatttacagcca

SEQ ID NO: 313290 - DNA, 25 bp, Rattus norvegicus
gaatttctttgtcatatatacccag

SEQ ID NO: 313291 - DNA, 25 bp, Rattus norvegicus
gaatttctttgtgatatatacccag

SEQ ID NO: 313292 - DNA, 25 bp, Rattus norvegicus
gaatttgaacatatggtctccagtt

SEQ ID NO: 313293 - DNA, 25 bp, Rattus norvegicus
gaatttgaacatcggttccgcgtta

SEQ ID NO: 313294 - DNA, 25 bp, Rattus norvegicus
gaatttgaacatgggttccgcgtta

SEQ ID NO: 313295 - DNA, 25 bp, Rattus norvegicus
gaatttgaacatttggtctccagtt

SEQ ID NO: 313296 - DNA, 25 bp, Rattus norvegicus
gaatttgaacctagacataactgag

SEQ ID NO: 313297 - DNA, 25 bp, Rattus norvegicus
gaatttgaaccttgacataactgag

SEQ ID NO: 313298 - DNA, 25 bp, Rattus norvegicus
gaatttgaactgaccactgtgtgtc

SEQ ID NO: 313299 - DNA, 25 bp, Rattus norvegicus
gaatttgaactgtccactgtgtgtc

SEQ ID NO: 313300 - DNA, 25 bp, Rattus norvegicus
gaatttgaatgcatgaccccaggaa

SEQ ID NO: 313301 - DNA, 25 bp, Rattus norvegicus
gaatttgaatgcttgaccccaggaa

SEQ ID NO: 313302 - DNA, 25 bp, Rattus norvegicus
gaatttgaattcatgcagccattgt

SEQ ID NO: 313303 - DNA, 25 bp, Rattus norvegicus
gaatttgaattcttgcagccattgt

SEQ ID NO: 313304 - DNA, 25 bp, Rattus norvegicus
gaatttgacccaaggactctatatg

SEQ ID NO: 313305 - DNA, 25 bp, Rattus norvegicus
gaatttgacccatggactctatatg

SEQ ID NO: 313306 - DNA, 25 bp, Rattus norvegicus
gaatttgaccttacttgatttgctt

SEQ ID NO: 313307 - DNA, 25 bp, Rattus norvegicus
gaatttgacctttcttgatttgctt

SEQ ID NO: 313308 - DNA, 25 bp, Rattus norvegicus
gaatttgactatcacctagccatgt

SEQ ID NO: 313309 - DNA, 25 bp, Rattus norvegicus
gaatttgactatgacctagccatgt

SEQ ID NO: 313310 - DNA, 25 bp, Rattus norvegicus
gaatttgacttccaccttagagttc

SEQ ID NO: 313311 - DNA, 25 bp, Rattus norvegicus
gaatttgacttcgaccttagagttc

SEQ ID NO: 313312 - DNA, 25 bp, Rattus norvegicus
gaatttgagagccatcagccacatg

SEQ ID NO: 313313 - DNA, 25 bp, Rattus norvegicus
gaatttgagagcgatcagccacatg

SEQ ID NO: 313314 - DNA, 25 bp, Rattus norvegicus
gaatttgagcttattctccttaccc

SEQ ID NO: 313315 - DNA, 25 bp, Rattus norvegicus
gaatttgagctttttctccttaccc

SEQ ID NO: 313316 - DNA, 25 bp, Rattus norvegicus
gaatttgaggagaacctccggcaga

SEQ ID NO: 313317 - DNA, 25 bp, Rattus norvegicus
gaatttgaggagtacctccggcaga

SEQ ID NO: 313318 - DNA, 25 bp, Rattus norvegicus
gaatttgagtacagcaccgaataga

SEQ ID NO: 313319 - DNA, 25 bp, Rattus norvegicus
gaatttgagtactgcaccgaataga

SEQ ID NO: 313320 - DNA, 25 bp, Rattus norvegicus
gaatttgatccaaacctttttgctg

SEQ ID NO: 313321 - DNA, 25 bp, Rattus norvegicus
gaatttgatccatacctttttgctg

SEQ ID NO: 313322 - DNA, 25 bp, Rattus norvegicus
gaatttgatcttcccttagtctttt

SEQ ID NO: 313323 - DNA, 25 bp, Rattus norvegicus
gaatttgatcttcctcttcactgtt

SEQ ID NO: 313324 - DNA, 25 bp, Rattus norvegicus
gaatttgatcttgccttagtctttt

SEQ ID NO: 313325 - DNA, 25 bp, Rattus norvegicus
gaatttgatcttgctcttcactgtt

SEQ ID NO: 313326 - DNA, 25 bp, Rattus norvegicus
gaatttgatgccaatagccttctat

SEQ ID NO: 313327 - DNA, 25 bp, Rattus norvegicus
gaatttgatgcctatagccttctat

SEQ ID NO: 313328 - DNA, 25 bp, Rattus norvegicus
gaatttgattatcgctgcccttcag

SEQ ID NO: 313329 - DNA, 25 bp, Rattus norvegicus
gaatttgattatggctgcccttcag

SEQ ID NO: 313330 - DNA, 25 bp, Rattus norvegicus
gaatttgcaaacctgactccgttaa

SEQ ID NO: 313331 - DNA, 25 bp, Rattus norvegicus
gaatttgcaaacgtgactccgttaa

SEQ ID NO: 313332 - DNA, 25 bp, Rattus norvegicus
gaatttgcaaccagtaatccggacc

SEQ ID NO: 313333 - DNA, 25 bp, Rattus norvegicus
gaatttgcaacctgtaatccggacc

SEQ ID NO: 313334 - DNA, 25 bp, Rattus norvegicus
gaatttgcaagaactctcagcccgt

SEQ ID NO: 313335 - DNA, 25 bp, Rattus norvegicus
gaatttgcaagatctctcagcccgt

SEQ ID NO: 313336 - DNA, 25 bp, Rattus norvegicus
gaatttgcacagacgtttgttgcta

SEQ ID NO: 313337 - DNA, 25 bp, Rattus norvegicus
gaatttgcacagtcgtttgttgcta

SEQ ID NO: 313338 - DNA, 25 bp, Rattus norvegicus
gaatttgcacccaggtagcagctgt

SEQ ID NO: 313339 - DNA, 25 bp, Rattus norvegicus
gaatttgcaccctggtagcagctgt

SEQ ID NO: 313340 - DNA, 25 bp, Rattus norvegicus
gaatttgcagacactctgggtgtcc

SEQ ID NO: 313341 - DNA, 25 bp, Rattus norvegicus
gaatttgcagactctctgggtgtcc

SEQ ID NO: 313342 - DNA, 25 bp, Rattus norvegicus
gaatttgcagtactctctcctaaag

SEQ ID NO: 313343 - DNA, 25 bp, Rattus norvegicus
gaatttgcagtagtctctcctaaag

SEQ ID NO: 313344 - DNA, 25 bp, Rattus norvegicus
gaatttgcatcacgtccagagtgtt

SEQ ID NO: 313345 - DNA, 25 bp, Rattus norvegicus
gaatttgcatcaggtccagagtgtt

SEQ ID NO: 313346 - DNA, 25 bp, Rattus norvegicus
gaatttgcattcatgtactgtttct

SEQ ID NO: 313347 - DNA, 25 bp, Rattus norvegicus
gaatttgcattcttgtactgtttct

SEQ ID NO: 313348 - DNA, 25 bp, Rattus norvegicus
gaatttgccaatagatccctggctt

SEQ ID NO: 313349 - DNA, 25 bp, Rattus norvegicus
gaatttgccaattgatccctggctt

SEQ ID NO: 313350 - DNA, 25 bp, Rattus norvegicus
gaatttgccacacaagacttctcgt

SEQ ID NO: 313351 - DNA, 25 bp, Rattus norvegicus
gaatttgccacagaagacttctcgt

SEQ ID NO: 313352 - DNA, 25 bp, Rattus norvegicus
gaatttgccaccacttttatgacag

SEQ ID NO: 313353 - DNA, 25 bp, Rattus norvegicus
gaatttgccacctcttttatgacag

SEQ ID NO: 313354 - DNA, 25 bp, Rattus norvegicus
gaatttgccagtatcctaagctgtt

SEQ ID NO: 313355 - DNA, 25 bp, Rattus norvegicus
gaatttgccagtttcctaagctgtt

SEQ ID NO: 313356 - DNA, 25 bp, Rattus norvegicus
gaatttgcccggatcatgagcattg

SEQ ID NO: 313357 - DNA, 25 bp, Rattus norvegicus
gaatttgcccggttcatgagcattg

SEQ ID NO: 313358 - DNA, 25 bp, Rattus norvegicus
gaatttgccggtaacaagccagatt

SEQ ID NO: 313359 - DNA, 25 bp, Rattus norvegicus
gaatttgccggttacaagccagatt

SEQ ID NO: 313360 - DNA, 25 bp, Rattus norvegicus
gaatttgcctctcttttgcatattt

SEQ ID NO: 313361 - DNA, 25 bp, Rattus norvegicus
gaatttgcctctgttttgcatattt

SEQ ID NO: 313362 - DNA, 25 bp, Rattus norvegicus
gaatttgcctgcctgtccaaaggag

SEQ ID NO: 313363 - DNA, 25 bp, Rattus norvegicus
gaatttgcctgcgtgtccaaaggag

SEQ ID NO: 313364 - DNA, 25 bp, Rattus norvegicus
gaatttgccttcagtgtatatatgt

SEQ ID NO: 313365 - DNA, 25 bp, Rattus norvegicus
gaatttgccttctgtgtatatatgt

SEQ ID NO: 313366 - DNA, 25 bp, Rattus norvegicus
gaatttgctatcatccctaatggac

SEQ ID NO: 313367 - DNA, 25 bp, Rattus norvegicus
gaatttgctatcttccctaatggac

SEQ ID NO: 313368 - DNA, 25 bp, Rattus norvegicus
gaatttgctcttaaaagtccactca

SEQ ID NO: 313369 - DNA, 25 bp, Rattus norvegicus
gaatttgctctttaaagtccactca

SEQ ID NO: 313370 - DNA, 25 bp, Rattus norvegicus
gaatttgctgagaagtccccattat

SEQ ID NO: 313371 - DNA, 25 bp, Rattus norvegicus
gaatttgctgagtagtccccattat

SEQ ID NO: 313372 - DNA, 25 bp, Rattus norvegicus
gaatttgctgcaaactatttcacag

SEQ ID NO: 313373 - DNA, 25 bp, Rattus norvegicus
gaatttgctgcatactatttcacag

SEQ ID NO: 313374 - DNA, 25 bp, Rattus norvegicus
gaatttgctgtaactggatccttta

SEQ ID NO: 313375 - DNA, 25 bp, Rattus norvegicus
gaatttgctgtatctggatccttta

SEQ ID NO: 313376 - DNA, 25 bp, Rattus norvegicus
gaatttgcttctcttagtttgttac

SEQ ID NO: 313377 - DNA, 25 bp, Rattus norvegicus
gaatttgcttctgttagtttgttac

SEQ ID NO: 313378 - DNA, 25 bp, Rattus norvegicus
gaatttggaaacagaccctcaccca

SEQ ID NO: 313379 - DNA, 25 bp, Rattus norvegicus
gaatttggaaactgaccctcaccca

SEQ ID NO: 313380 - DNA, 25 bp, Rattus norvegicus
gaatttggactcacaaaccatgtga

SEQ ID NO: 313381 - DNA, 25 bp, Rattus norvegicus
gaatttggactctcaaaccatgtga

SEQ ID NO: 313382 - DNA, 25 bp, Rattus norvegicus
gaatttggagttaacgccttcaata

SEQ ID NO: 313383 - DNA, 25 bp, Rattus norvegicus
gaatttggagtttacgccttcaata

SEQ ID NO: 313384 - DNA, 25 bp, Rattus norvegicus
gaatttggatatcaagtaccgcccc

SEQ ID NO: 313385 - DNA, 25 bp, Rattus norvegicus
gaatttggatatgaagtaccgcccc

SEQ ID NO: 313386 - DNA, 25 bp, Rattus norvegicus
gaatttggcattaatctgtgggcat

SEQ ID NO: 313387 - DNA, 25 bp, Rattus norvegicus
gaatttggcatttatctgtgggcat

SEQ ID NO: 313388 - DNA, 25 bp, Rattus norvegicus
gaatttggcctccttcacagagagg

SEQ ID NO: 313389 - DNA, 25 bp, Rattus norvegicus
gaatttggcctcgttcacagagagg

SEQ ID NO: 313390 - DNA, 25 bp, Rattus norvegicus
gaatttggctagaattctcctatat

SEQ ID NO: 313391 - DNA, 25 bp, Rattus norvegicus
gaatttggctagtattctcctatat

SEQ ID NO: 313392 - DNA, 25 bp, Rattus norvegicus
gaatttggctgcattcttgatttat

SEQ ID NO: 313393 - DNA, 25 bp, Rattus norvegicus
gaatttggctgctttcttgatttat

SEQ ID NO: 313394 - DNA, 25 bp, Rattus norvegicus
gaatttggctttaccatcgaaacta

SEQ ID NO: 313395 - DNA, 25 bp, Rattus norvegicus
gaatttggcttttccatcgaaacta

SEQ ID NO: 313396 - DNA, 25 bp, Rattus norvegicus
gaatttgggctcagaaccagccgtt

SEQ ID NO: 313397 - DNA, 25 bp, Rattus norvegicus
gaatttgggctctgaaccagccgtt

SEQ ID NO: 313398 - DNA, 25 bp, Rattus norvegicus
gaatttgggttcagagggcctctcc

SEQ ID NO: 313399 - DNA, 25 bp, Rattus norvegicus
gaatttgggttctgagggcctctcc

SEQ ID NO: 313400 - DNA, 25 bp, Rattus norvegicus
gaatttggtccacagagcaggctga

SEQ ID NO: 313401 - DNA, 25 bp, Rattus norvegicus
gaatttggtccagagagcaggctga

SEQ ID NO: 313402 - DNA, 25 bp, Rattus norvegicus
gaatttggtgaaagcgtacgcgccg

SEQ ID NO: 313403 - DNA, 25 bp, Rattus norvegicus
gaatttggtgaatgcgtacgcgccg

SEQ ID NO: 313404 - DNA, 25 bp, Rattus norvegicus
gaatttggtgtcacatgcgcttaag

SEQ ID NO: 313405 - DNA, 25 bp, Rattus norvegicus
gaatttggtgtctcatgcgcttaag

SEQ ID NO: 313406 - DNA, 25 bp, Rattus norvegicus
gaatttggttttactctactttgag

SEQ ID NO: 313407 - DNA, 25 bp, Rattus norvegicus
gaatttggtttttctctactttgag

SEQ ID NO: 313408 - DNA, 25 bp, Rattus norvegicus
gaatttgtaaagatcatcctgctct

SEQ ID NO: 313409 - DNA, 25 bp, Rattus norvegicus
gaatttgtaaagttcatcctgctct

SEQ ID NO: 313410 - DNA, 25 bp, Rattus norvegicus
gaatttgtacgcaagaccctggcca

SEQ ID NO: 313411 - DNA, 25 bp, Rattus norvegicus
gaatttgtacgctagaccctggcca

SEQ ID NO: 313412 - DNA, 25 bp, Rattus norvegicus
gaatttgtagccacttgttttgaat

SEQ ID NO: 313413 - DNA, 25 bp, Rattus norvegicus
gaatttgtagcctcttgttttgaat

SEQ ID NO: 313414 - DNA, 25 bp, Rattus norvegicus
gaatttgtagtgagcgttagtgcgc

SEQ ID NO: 313415 - DNA, 25 bp, Rattus norvegicus
gaatttgtagtgtgcgttagtgcgc

SEQ ID NO: 313416 - DNA, 25 bp, Rattus norvegicus
gaatttgtcaagactctaaccccat

SEQ ID NO: 313417 - DNA, 25 bp, Rattus norvegicus
gaatttgtcaagtctctaaccccat

SEQ ID NO: 313418 - DNA, 25 bp, Rattus norvegicus
gaatttgtcacgacaagggaaccta

SEQ ID NO: 313419 - DNA, 25 bp, Rattus norvegicus
gaatttgtcacgtcaagggaaccta

SEQ ID NO: 313420 - DNA, 25 bp, Rattus norvegicus
gaatttgtcactcaatgtcctttga

SEQ ID NO: 313421 - DNA, 25 bp, Rattus norvegicus
gaatttgtcactcaggcacaacctg

SEQ ID NO: 313422 - DNA, 25 bp, Rattus norvegicus
gaatttgtcactgaatgtcctttga

SEQ ID NO: 313423 - DNA, 25 bp, Rattus norvegicus
gaatttgtcactgaggcacaacctg

SEQ ID NO: 313424 - DNA, 25 bp, Rattus norvegicus
gaatttgtcatactgttataatact

SEQ ID NO: 313425 - DNA, 25 bp, Rattus norvegicus
gaatttgtcatagtgttataatact

SEQ ID NO: 313426 - DNA, 25 bp, Rattus norvegicus
gaatttgtctggcagtcggtcttct

SEQ ID NO: 313427 - DNA, 25 bp, Rattus norvegicus
gaatttgtctgggagtcggtcttct

SEQ ID NO: 313428 - DNA, 25 bp, Rattus norvegicus
gaatttgtcttaatggcgcttctcc

SEQ ID NO: 313429 - DNA, 25 bp, Rattus norvegicus
gaatttgtcttattggcgcttctcc

SEQ ID NO: 313430 - DNA, 25 bp, Rattus norvegicus
gaatttgtctttaactctgcgggtg

SEQ ID NO: 313431 - DNA, 25 bp, Rattus norvegicus
gaatttgtcttttactctgcgggtg

SEQ ID NO: 313432 - DNA, 25 bp, Rattus norvegicus
gaatttgtgaatatactgcgcccca

SEQ ID NO: 313433 - DNA, 25 bp, Rattus norvegicus
gaatttgtgaatttactgcgcccca

SEQ ID NO: 313434 - DNA, 25 bp, Rattus norvegicus
gaatttgtgcaaagtatctacatta

SEQ ID NO: 313435 - DNA, 25 bp, Rattus norvegicus
gaatttgtgcaatgtatctacatta

SEQ ID NO: 313436 - DNA, 25 bp, Rattus norvegicus
gaatttgtggttcagtttggcatca

SEQ ID NO: 313437 - DNA, 25 bp, Rattus norvegicus
gaatttgtggttgagtttggcatca

SEQ ID NO: 313438 - DNA, 25 bp, Rattus norvegicus
gaatttgtgttcaaatttgcgtaat

SEQ ID NO: 313439 - DNA, 25 bp, Rattus norvegicus
gaatttgtgttctaatttgcgtaat

SEQ ID NO: 313440 - DNA, 25 bp, Rattus norvegicus
gaatttgttcagagttttaacctgt

SEQ ID NO: 313441 - DNA, 25 bp, Rattus norvegicus
gaatttgttcagtgttttaacctgt

SEQ ID NO: 313442 - DNA, 25 bp, Rattus norvegicus
gaatttgttgtaaaccttgccagta

SEQ ID NO: 313443 - DNA, 25 bp, Rattus norvegicus
gaatttgttgtataccttgccagta

SEQ ID NO: 313444 - DNA, 25 bp, Rattus norvegicus
gaatttgttgtgacgctctgcttca

SEQ ID NO: 313445 - DNA, 25 bp, Rattus norvegicus
gaatttgttgtgtcgctctgcttca

SEQ ID NO: 313446 - DNA, 25 bp, Rattus norvegicus
gaatttgtttgccaggccccgtgct

SEQ ID NO: 313447 - DNA, 25 bp, Rattus norvegicus
gaatttgtttgcgaggccccgtgct

SEQ ID NO: 313448 - DNA, 25 bp, Rattus norvegicus
gaatttgttttcaaactagtctgtc

SEQ ID NO: 313449 - DNA, 25 bp, Rattus norvegicus
gaatttgttttcctgcttgtgtaat

SEQ ID NO: 313450 - DNA, 25 bp, Rattus norvegicus
gaatttgttttcgtgcttgtgtaat

SEQ ID NO: 313451 - DNA, 25 bp, Rattus norvegicus
gaatttgttttctaactagtctgtc

SEQ ID NO: 313452 - DNA, 25 bp, Rattus norvegicus
gaattttaaatcactccaagcgaag

SEQ ID NO: 313453 - DNA, 25 bp, Rattus norvegicus
gaattttaaatcactccactggact

SEQ ID NO: 313454 - DNA, 25 bp, Rattus norvegicus
gaattttaaatctctccaagcgaag

SEQ ID NO: 313455 - DNA, 25 bp, Rattus norvegicus
gaattttaaatctctccactggact

SEQ ID NO: 313456 - DNA, 25 bp, Rattus norvegicus
gaattttaacagatctccgtcattg

SEQ ID NO: 313457 - DNA, 25 bp, Rattus norvegicus
gaattttaacagttctccgtcattg

SEQ ID NO: 313458 - DNA, 25 bp, Rattus norvegicus
gaattttaactcagtaatgcttaat

SEQ ID NO: 313459 - DNA, 25 bp, Rattus norvegicus
gaattttaactctgtaatgcttaat

SEQ ID NO: 313460 - DNA, 25 bp, Rattus norvegicus
gaattttaatcaccggcattgcccg

SEQ ID NO: 313461 - DNA, 25 bp, Rattus norvegicus
gaattttaatcagcggcattgcccg

SEQ ID NO: 313462 - DNA, 25 bp, Rattus norvegicus
gaattttaatgcagggccttccaaa

SEQ ID NO: 313463 - DNA, 25 bp, Rattus norvegicus
gaattttaatgctgggccttccaaa

SEQ ID NO: 313464 - DNA, 25 bp, Rattus norvegicus
gaattttacagactctagctctata

SEQ ID NO: 313465 - DNA, 25 bp, Rattus norvegicus
gaattttacagagtctagctctata

SEQ ID NO: 313466 - DNA, 25 bp, Rattus norvegicus
gaattttacagcctaatccatttgg

SEQ ID NO: 313467 - DNA, 25 bp, Rattus norvegicus
gaattttacagcgtaatccatttgg

SEQ ID NO: 313468 - DNA, 25 bp, Rattus norvegicus
gaattttacagtatatcccatgttt

SEQ ID NO: 313469 - DNA, 25 bp, Rattus norvegicus
gaattttacagtttatcccatgttt

SEQ ID NO: 313470 - DNA, 25 bp, Rattus norvegicus
gaattttacattatcccataacaat

SEQ ID NO: 313471 - DNA, 25 bp, Rattus norvegicus
gaattttacattttcccataacaat

SEQ ID NO: 313472 - DNA, 25 bp, Rattus norvegicus
gaattttaccacctcttagaagcag

SEQ ID NO: 313473 - DNA, 25 bp, Rattus norvegicus
gaattttaccacgtcttagaagcag

SEQ ID NO: 313474 - DNA, 25 bp, Rattus norvegicus
gaattttaccctcgagactctgcaa

SEQ ID NO: 313475 - DNA, 25 bp, Rattus norvegicus
gaattttaccctggagactctgcaa

SEQ ID NO: 313476 - DNA, 25 bp, Rattus norvegicus
gaattttacctcctttacatacaca

SEQ ID NO: 313477 - DNA, 25 bp, Rattus norvegicus
gaattttacctcgtttacatacaca

SEQ ID NO: 313478 - DNA, 25 bp, Rattus norvegicus
gaattttactcactactgacaagtc

SEQ ID NO: 313479 - DNA, 25 bp, Rattus norvegicus
gaattttactcagtactgacaagtc

SEQ ID NO: 313480 - DNA, 25 bp, Rattus norvegicus
gaattttagcgtctgtgcaaactct

SEQ ID NO: 313481 - DNA, 25 bp, Rattus norvegicus
gaattttagcgtgtgtgcaaactct

SEQ ID NO: 313482 - DNA, 25 bp, Rattus norvegicus
gaattttagcttcagccttcgggat

SEQ ID NO: 313483 - DNA, 25 bp, Rattus norvegicus
gaattttagcttgagccttcgggat

SEQ ID NO: 313484 - DNA, 25 bp, Rattus norvegicus
gaattttagtacacagcagtatctg

SEQ ID NO: 313485 - DNA, 25 bp, Rattus norvegicus
gaattttagtactcagcagtatctg

SEQ ID NO: 313486 - DNA, 25 bp, Rattus norvegicus
gaattttagttaactgctggacatt

SEQ ID NO: 313487 - DNA, 25 bp, Rattus norvegicus
gaattttagttatctgctggacatt

SEQ ID NO: 313488 - DNA, 25 bp, Rattus norvegicus
gaattttatatccatttatccatgc

SEQ ID NO: 313489 - DNA, 25 bp, Rattus norvegicus
gaattttatatcgatttatccatgc

SEQ ID NO: 313490 - DNA, 25 bp, Rattus norvegicus
gaattttatccgcaaaccccacatg

SEQ ID NO: 313491 - DNA, 25 bp, Rattus norvegicus
gaattttatccggaaaccccacatg

SEQ ID NO: 313492 - DNA, 25 bp, Rattus norvegicus
gaattttatggccagaatccaacaa

SEQ ID NO: 313493 - DNA, 25 bp, Rattus norvegicus
gaattttatggcgagaatccaacaa

SEQ ID NO: 313494 - DNA, 25 bp, Rattus norvegicus
gaattttattctctgccttgagctc

SEQ ID NO: 313495 - DNA, 25 bp, Rattus norvegicus
gaattttattctgtgccttgagctc

SEQ ID NO: 313496 - DNA, 25 bp, Rattus norvegicus
gaattttcaacaaaaccgcctgtgt

SEQ ID NO: 313497 - DNA, 25 bp, Rattus norvegicus
gaattttcaacataaccgcctgtgt

SEQ ID NO: 313498 - DNA, 25 bp, Rattus norvegicus
gaattttcaaccacctataactcca

SEQ ID NO: 313499 - DNA, 25 bp, Rattus norvegicus
gaattttcaacctcctataactcca

SEQ ID NO: 313500 - DNA, 25 bp, Rattus norvegicus
gaattttcaactcagtcttccaacc

SEQ ID NO: 313501 - DNA, 25 bp, Rattus norvegicus
gaattttcaactgagtcttccaacc

SEQ ID NO: 313502 - DNA, 25 bp, Rattus norvegicus
gaattttcaagcaaatggtccctta

SEQ ID NO: 313503 - DNA, 25 bp, Rattus norvegicus
gaattttcaagctaatggtccctta

SEQ ID NO: 313504 - DNA, 25 bp, Rattus norvegicus
gaattttcaatgagagcctgtagta

SEQ ID NO: 313505 - DNA, 25 bp, Rattus norvegicus
gaattttcaatgtgagcctgtagta

SEQ ID NO: 313506 - DNA, 25 bp, Rattus norvegicus
gaattttcacagagaacttccccaa

SEQ ID NO: 313507 - DNA, 25 bp, Rattus norvegicus
gaattttcacagtgaacttccccaa

SEQ ID NO: 313508 - DNA, 25 bp, Rattus norvegicus
gaattttcaccaactatcactcgac

SEQ ID NO: 313509 - DNA, 25 bp, Rattus norvegicus
gaattttcaccatctatcactcgac

SEQ ID NO: 313510 - DNA, 25 bp, Rattus norvegicus
gaattttcactgactaagcaccctc

SEQ ID NO: 313511 - DNA, 25 bp, Rattus norvegicus
gaattttcactgcaacattactcag

SEQ ID NO: 313512 - DNA, 25 bp, Rattus norvegicus
gaattttcactggaacattactcag

SEQ ID NO: 313513 - DNA, 25 bp, Rattus norvegicus
gaattttcactgtctaagcaccctc

SEQ ID NO: 313514 - DNA, 25 bp, Rattus norvegicus
gaattttcagaaatccccttggtga

SEQ ID NO: 313515 - DNA, 25 bp, Rattus norvegicus
gaattttcagaattccccttggtga

SEQ ID NO: 313516 - DNA, 25 bp, Rattus norvegicus
gaattttcagcccttgaggaacccg

SEQ ID NO: 313517 - DNA, 25 bp, Rattus norvegicus
gaattttcagccgttgaggaacccg

SEQ ID NO: 313518 - DNA, 25 bp, Rattus norvegicus
gaattttcattccatctgcaggcct

SEQ ID NO: 313519 - DNA, 25 bp, Rattus norvegicus
gaattttcattcgatctgcaggcct

SEQ ID NO: 313520 - DNA, 25 bp, Rattus norvegicus
gaattttccactatattcttcctgg

SEQ ID NO: 313521 - DNA, 25 bp, Rattus norvegicus
gaattttccactttattcttcctgg

SEQ ID NO: 313522 - DNA, 25 bp, Rattus norvegicus
gaattttccagaacagctttggcct

SEQ ID NO: 313523 - DNA, 25 bp, Rattus norvegicus
gaattttccagatcagctttggcct

SEQ ID NO: 313524 - DNA, 25 bp, Rattus norvegicus
gaattttccccactggcaaacgcag

SEQ ID NO: 313525 - DNA, 25 bp, Rattus norvegicus
gaattttccccagtggcaaacgcag

SEQ ID NO: 313526 - DNA, 25 bp, Rattus norvegicus
gaattttcgatgacaatggccggga

SEQ ID NO: 313527 - DNA, 25 bp, Rattus norvegicus
gaattttcgatgtcaatggccggga

SEQ ID NO: 313528 - DNA, 25 bp, Rattus norvegicus
gaattttctaatcgagtgactctgc

SEQ ID NO: 313529 - DNA, 25 bp, Rattus norvegicus
gaattttctaatggagtgactctgc

SEQ ID NO: 313530 - DNA, 25 bp, Rattus norvegicus
gaattttctacaagaccataactgg

SEQ ID NO: 313531 - DNA, 25 bp, Rattus norvegicus
gaattttctacatgaccataactgg

SEQ ID NO: 313532 - DNA, 25 bp, Rattus norvegicus
gaattttctagtactccaaataact

SEQ ID NO: 313533 - DNA, 25 bp, Rattus norvegicus
gaattttctagttctccaaataact

SEQ ID NO: 313534 - DNA, 25 bp, Rattus norvegicus
gaattttctcgtattatggccatga

SEQ ID NO: 313535 - DNA, 25 bp, Rattus norvegicus
gaattttctcgttttatggccatga

SEQ ID NO: 313536 - DNA, 25 bp, Rattus norvegicus
gaattttctctgctccttaacagaa

SEQ ID NO: 313537 - DNA, 25 bp, Rattus norvegicus
gaattttctctggtccttaacagaa

SEQ ID NO: 313538 - DNA, 25 bp, Rattus norvegicus
gaattttctggcctagaatcctagg

SEQ ID NO: 313539 - DNA, 25 bp, Rattus norvegicus
gaattttctggcgtagaatcctagg

SEQ ID NO: 313540 - DNA, 25 bp, Rattus norvegicus
gaattttctggtactgtgactcagt

SEQ ID NO: 313541 - DNA, 25 bp, Rattus norvegicus
gaattttctggttctgtgactcagt

SEQ ID NO: 313542 - DNA, 25 bp, Rattus norvegicus
gaattttctgtaaactggcaagctt

SEQ ID NO: 313543 - DNA, 25 bp, Rattus norvegicus
gaattttctgtatactggcaagctt

SEQ ID NO: 313544 - DNA, 25 bp, Rattus norvegicus
gaattttcttatcccttgtgaggca

SEQ ID NO: 313545 - DNA, 25 bp, Rattus norvegicus
gaattttcttatgccttgtgaggca

SEQ ID NO: 313546 - DNA, 25 bp, Rattus norvegicus
gaattttcttcacttctacccaaat

SEQ ID NO: 313547 - DNA, 25 bp, Rattus norvegicus
gaattttcttcagttctacccaaat

SEQ ID NO: 313548 - DNA, 25 bp, Rattus norvegicus
gaattttgaaagactgcttccaaga

SEQ ID NO: 313549 - DNA, 25 bp, Rattus norvegicus
gaattttgaaagtctgcttccaaga

SEQ ID NO: 313550 - DNA, 25 bp, Rattus norvegicus
gaattttgaaatctgcttgttatgc

SEQ ID NO: 313551 - DNA, 25 bp, Rattus norvegicus
gaattttgaaatgtgcttgttatgc

SEQ ID NO: 313552 - DNA, 25 bp, Rattus norvegicus
gaattttgactgacttacccctatg

SEQ ID NO: 313553 - DNA, 25 bp, Rattus norvegicus
gaattttgactgtcttacccctatg

SEQ ID NO: 313554 - DNA, 25 bp, Rattus norvegicus
gaattttgacttagcattctgtcag

SEQ ID NO: 313555 - DNA, 25 bp, Rattus norvegicus
gaattttgactttgcattctgtcag

SEQ ID NO: 313556 - DNA, 25 bp, Rattus norvegicus
gaattttgagaaagtacccgacttt

SEQ ID NO: 313557 - DNA, 25 bp, Rattus norvegicus
gaattttgagaatgtacccgacttt

SEQ ID NO: 313558 - DNA, 25 bp, Rattus norvegicus
gaattttgagacctcgaagtcccga

SEQ ID NO: 313559 - DNA, 25 bp, Rattus norvegicus
gaattttgagacgtcgaagtcccga

SEQ ID NO: 313560 - DNA, 25 bp, Rattus norvegicus
gaattttgagccaactgtcctgaaa

SEQ ID NO: 313561 - DNA, 25 bp, Rattus norvegicus
gaattttgagcctactgtcctgaaa

SEQ ID NO: 313562 - DNA, 25 bp, Rattus norvegicus
gaattttgagtgacctctccatgtt

SEQ ID NO: 313563 - DNA, 25 bp, Rattus norvegicus
gaattttgagtgtcctctccatgtt

SEQ ID NO: 313564 - DNA, 25 bp, Rattus norvegicus
gaattttgagttagagccactttct

SEQ ID NO: 313565 - DNA, 25 bp, Rattus norvegicus
gaattttgagtttgagccactttct

SEQ ID NO: 313566 - DNA, 25 bp, Rattus norvegicus
gaattttgcagtacagttgttaaac

SEQ ID NO: 313567 - DNA, 25 bp, Rattus norvegicus
gaattttgcagttcagttgttaaac

SEQ ID NO: 313568 - DNA, 25 bp, Rattus norvegicus
gaattttgcattatagcacttgcac

SEQ ID NO: 313569 - DNA, 25 bp, Rattus norvegicus
gaattttgcattcagattgttttat

SEQ ID NO: 313570 - DNA, 25 bp, Rattus norvegicus
gaattttgcattgagattgttttat

SEQ ID NO: 313571 - DNA, 25 bp, Rattus norvegicus
gaattttgcattttagcacttgcac

SEQ ID NO: 313572 - DNA, 25 bp, Rattus norvegicus
gaattttgccctaaatatgtggtca

SEQ ID NO: 313573 - DNA, 25 bp, Rattus norvegicus
gaattttgcccttaatatgtggtca

SEQ ID NO: 313574 - DNA, 25 bp, Rattus norvegicus
gaattttgcgctcaaagactgtcta

SEQ ID NO: 313575 - DNA, 25 bp, Rattus norvegicus
gaattttgcgctgaaagactgtcta

SEQ ID NO: 313576 - DNA, 25 bp, Rattus norvegicus
gaattttgctaaatgccgcaggctg

SEQ ID NO: 313577 - DNA, 25 bp, Rattus norvegicus
gaattttgctaattgccgcaggctg

SEQ ID NO: 313578 - DNA, 25 bp, Rattus norvegicus
gaattttgctacactctcacggata

SEQ ID NO: 313579 - DNA, 25 bp, Rattus norvegicus
gaattttgctactctctcacggata

SEQ ID NO: 313580 - DNA, 25 bp, Rattus norvegicus
gaattttgctctattgaggtccatt

SEQ ID NO: 313581 - DNA, 25 bp, Rattus norvegicus
gaattttgctcttttgaggtccatt

SEQ ID NO: 313582 - DNA, 25 bp, Rattus norvegicus
gaattttggacactaccatgtgttt

SEQ ID NO: 313583 - DNA, 25 bp, Rattus norvegicus
gaattttggacagtaccatgtgttt

SEQ ID NO: 313584 - DNA, 25 bp, Rattus norvegicus
gaattttggataaccagtcggtgga

SEQ ID NO: 313585 - DNA, 25 bp, Rattus norvegicus
gaattttggatatccagtcggtgga

SEQ ID NO: 313586 - DNA, 25 bp, Rattus norvegicus
gaattttgggttcatttcctgatat

SEQ ID NO: 313587 - DNA, 25 bp, Rattus norvegicus
gaattttgggttgatttcctgatat

SEQ ID NO: 313588 - DNA, 25 bp, Rattus norvegicus
gaattttgtacaactggcttatttt

SEQ ID NO: 313589 - DNA, 25 bp, Rattus norvegicus
gaattttgtacatctggcttatttt

SEQ ID NO: 313590 - DNA, 25 bp, Rattus norvegicus
gaattttgtactaccaaagcagaat

SEQ ID NO: 313591 - DNA, 25 bp, Rattus norvegicus
gaattttgtactatagctgctctct

SEQ ID NO: 313592 - DNA, 25 bp, Rattus norvegicus
gaattttgtacttccaaagcagaat

SEQ ID NO: 313593 - DNA, 25 bp, Rattus norvegicus
gaattttgtactttagctgctctct

SEQ ID NO: 313594 - DNA, 25 bp, Rattus norvegicus
gaattttgtcagagttctattgctg

SEQ ID NO: 313595 - DNA, 25 bp, Rattus norvegicus
gaattttgtcagtgttctattgctg

SEQ ID NO: 313596 - DNA, 25 bp, Rattus norvegicus
gaattttgtgctatgtttgctccca

SEQ ID NO: 313597 - DNA, 25 bp, Rattus norvegicus
gaattttgtgctttgtttgctccca

SEQ ID NO: 313598 - DNA, 25 bp, Rattus norvegicus
gaatttttacaactggccaggcaac

SEQ ID NO: 313599 - DNA, 25 bp, Rattus norvegicus
gaatttttacaagtggccaggcaac

SEQ ID NO: 313600 - DNA, 25 bp, Rattus norvegicus
gaatttttaccaatctctgctgggt

SEQ ID NO: 313601 - DNA, 25 bp, Rattus norvegicus
gaatttttaccattctctgctgggt

SEQ ID NO: 313602 - DNA, 25 bp, Rattus norvegicus
gaatttttaggcaatcactgtacag

SEQ ID NO: 313603 - DNA, 25 bp, Rattus norvegicus
gaatttttaggcagtaagccactac

SEQ ID NO: 313604 - DNA, 25 bp, Rattus norvegicus
gaatttttaggctatcactgtacag

SEQ ID NO: 313605 - DNA, 25 bp, Rattus norvegicus
gaatttttaggctgtaagccactac

SEQ ID NO: 313606 - DNA, 25 bp, Rattus norvegicus
gaatttttatgcacctgtatagtta

SEQ ID NO: 313607 - DNA, 25 bp, Rattus norvegicus
gaatttttatgctcctgtatagtta

SEQ ID NO: 313608 - DNA, 25 bp, Rattus norvegicus
gaatttttcccccttgaacatgctt

SEQ ID NO: 313609 - DNA, 25 bp, Rattus norvegicus
gaatttttccccgttgaacatgctt

SEQ ID NO: 313610 - DNA, 25 bp, Rattus norvegicus
gaatttttcctcatcaatgtgcctg

SEQ ID NO: 313611 - DNA, 25 bp, Rattus norvegicus
gaatttttcctcttcaatgtgcctg

SEQ ID NO: 313612 - DNA, 25 bp, Rattus norvegicus
gaatttttctaacagggtttctgat

SEQ ID NO: 313613 - DNA, 25 bp, Rattus norvegicus
gaatttttctaagagggtttctgat

SEQ ID NO: 313614 - DNA, 25 bp, Rattus norvegicus
gaatttttctctaatggcacattgg

SEQ ID NO: 313615 - DNA, 25 bp, Rattus norvegicus
gaatttttctcttatggcacattgg

SEQ ID NO: 313616 - DNA, 25 bp, Rattus norvegicus
gaatttttctgcattctgattttga

SEQ ID NO: 313617 - DNA, 25 bp, Rattus norvegicus
gaatttttctgctttctgattttga

SEQ ID NO: 313618 - DNA, 25 bp, Rattus norvegicus
gaatttttctgtagccttcattttc

SEQ ID NO: 313619 - DNA, 25 bp, Rattus norvegicus
gaatttttctgttgccttcattttc

SEQ ID NO: 313620 - DNA, 25 bp, Rattus norvegicus
gaatttttggttactctgttgccaa

SEQ ID NO: 313621 - DNA, 25 bp, Rattus norvegicus
gaatttttggtttctctgttgccaa

SEQ ID NO: 313622 - DNA, 25 bp, Rattus norvegicus
gaattttttcacatggaccaaggtc

SEQ ID NO: 313623 - DNA, 25 bp, Rattus norvegicus
gaattttttcacttggaccaaggtc

SEQ ID NO: 313624 - DNA, 25 bp, Rattus norvegicus
gaattttttgctatcagtctctatg

SEQ ID NO: 313625 - DNA, 25 bp, Rattus norvegicus
gaattttttgctttcagtctctatg

SEQ ID NO: 313626 - DNA, 25 bp, Rattus norvegicus
gacaaaaacaaactgaaggatgtat

SEQ ID NO: 313627 - DNA, 25 bp, Rattus norvegicus
gacaaaaacaaagtgaaggatgtat

SEQ ID NO: 313628 - DNA, 25 bp, Rattus norvegicus
gacaaaaaccaacagcacgttccgc

SEQ ID NO: 313629 - DNA, 25 bp, Rattus norvegicus
gacaaaaaccaagagcacgttccgc

SEQ ID NO: 313630 - DNA, 25 bp, Rattus norvegicus
gacaaaaaccttacacagccctgtg

SEQ ID NO: 313631 - DNA, 25 bp, Rattus norvegicus
gacaaaaacctttcacagccctgtg

SEQ ID NO: 313632 - DNA, 25 bp, Rattus norvegicus
gacaaaaagcctcctgttcgacaga

SEQ ID NO: 313633 - DNA, 25 bp, Rattus norvegicus
gacaaaaagcctgctgttcgacaga

SEQ ID NO: 313634 - DNA, 25 bp, Rattus norvegicus
gacaaaaaggccagcagcgccagcg

SEQ ID NO: 313635 - DNA, 25 bp, Rattus norvegicus
gacaaaaaggcctgcagcgccagcg

SEQ ID NO: 313636 - DNA, 25 bp, Rattus norvegicus
gacaaaacaaatcccttcacaagtt

SEQ ID NO: 313637 - DNA, 25 bp, Rattus norvegicus
gacaaaacaaatgccttcacaagtt

SEQ ID NO: 313638 - DNA, 25 bp, Rattus norvegicus
gacaaaacaatgcacactagaagag

SEQ ID NO: 313639 - DNA, 25 bp, Rattus norvegicus
gacaaaacaatggacactagaagag

SEQ ID NO: 313640 - DNA, 25 bp, Rattus norvegicus
gacaaaacaggaagtacacagcaag

SEQ ID NO: 313641 - DNA, 25 bp, Rattus norvegicus
gacaaaacaggatgtacacagcaag

SEQ ID NO: 313642 - DNA, 25 bp, Rattus norvegicus
gacaaaacagttcacctgccgagtg

SEQ ID NO: 313643 - DNA, 25 bp, Rattus norvegicus
gacaaaacagttgacctgccgagtg

SEQ ID NO: 313644 - DNA, 25 bp, Rattus norvegicus
gacaaaagacatctcaccctctatg

SEQ ID NO: 313645 - DNA, 25 bp, Rattus norvegicus
gacaaaagacatgtcaccctctatg

SEQ ID NO: 313646 - DNA, 25 bp, Rattus norvegicus
gacaaaagcatcatggtcctggata

SEQ ID NO: 313647 - DNA, 25 bp, Rattus norvegicus
gacaaaagcatcttggtcctggata

SEQ ID NO: 313648 - DNA, 25 bp, Rattus norvegicus
gacaaaagccataacccatgagtgt

SEQ ID NO: 313649 - DNA, 25 bp, Rattus norvegicus
gacaaaagccattacccatgagtgt

SEQ ID NO: 313650 - DNA, 25 bp, Rattus norvegicus
gacaaaagcccacaggccctggaag

SEQ ID NO: 313651 - DNA, 25 bp, Rattus norvegicus
gacaaaagcccagaggccctggaag

SEQ ID NO: 313652 - DNA, 25 bp, Rattus norvegicus
gacaaaagcctcagagattcttttt

SEQ ID NO: 313653 - DNA, 25 bp, Rattus norvegicus
gacaaaagcctctgagattcttttt

SEQ ID NO: 313654 - DNA, 25 bp, Rattus norvegicus
gacaaaagcctgcaggctccgactt

SEQ ID NO: 313655 - DNA, 25 bp, Rattus norvegicus
gacaaaagcctgctggttctgactt

SEQ ID NO: 313656 - DNA, 25 bp, Rattus norvegicus
gacaaaagcctggaggctccgactt

SEQ ID NO: 313657 - DNA, 25 bp, Rattus norvegicus
gacaaaagcctggtggttctgactt

SEQ ID NO: 313658 - DNA, 25 bp, Rattus norvegicus
gacaaaaggcttctaatcccctaga

SEQ ID NO: 313659 - DNA, 25 bp, Rattus norvegicus
gacaaaaggcttgtaatcccctaga

SEQ ID NO: 313660 - DNA, 25 bp, Rattus norvegicus
gacaaaagtggcatcattgaggagg

SEQ ID NO: 313661 - DNA, 25 bp, Rattus norvegicus
gacaaaagtggcttcattgaggagg

SEQ ID NO: 313662 - DNA, 25 bp, Rattus norvegicus
gacaaaagtgtacttcatttacaat

SEQ ID NO: 313663 - DNA, 25 bp, Rattus norvegicus
gacaaaagtgtagttcatttacaat

SEQ ID NO: 313664 - DNA, 25 bp, Rattus norvegicus
gacaaaatactcaataagtccttaa

SEQ ID NO: 313665 - DNA, 25 bp, Rattus norvegicus
gacaaaatactctataagtccttaa

SEQ ID NO: 313666 - DNA, 25 bp, Rattus norvegicus
gacaaaatcatcatcatggccagca

SEQ ID NO: 313667 - DNA, 25 bp, Rattus norvegicus
gacaaaatcatcttcatggccagca

SEQ ID NO: 313668 - DNA, 25 bp, Rattus norvegicus
gacaaaatctataaggcccgtacga

SEQ ID NO: 313669 - DNA, 25 bp, Rattus norvegicus
gacaaaatctattaggcccgtacga

SEQ ID NO: 313670 - DNA, 25 bp, Rattus norvegicus
gacaaaatcttcagggcggcaaact

SEQ ID NO: 313671 - DNA, 25 bp, Rattus norvegicus
gacaaaatcttctgggcggcaaact

SEQ ID NO: 313672 - DNA, 25 bp, Rattus norvegicus
gacaaaatgatcatcccacctgagg

SEQ ID NO: 313673 - DNA, 25 bp, Rattus norvegicus
gacaaaatgatcttcccacctgagg

SEQ ID NO: 313674 - DNA, 25 bp, Rattus norvegicus
gacaaaatgcagacgtgaagtcatt

SEQ ID NO: 313675 - DNA, 25 bp, Rattus norvegicus
gacaaaatgcagtcgtgaagtcatt

SEQ ID NO: 313676 - DNA, 25 bp, Rattus norvegicus
gacaaaatgcctcttgttcctctat

SEQ ID NO: 313677 - DNA, 25 bp, Rattus norvegicus
gacaaaatgcctgttgttcctctat

SEQ ID NO: 313678 - DNA, 25 bp, Rattus norvegicus
gacaaaatgctgcaacctgacaccc

SEQ ID NO: 313679 - DNA, 25 bp, Rattus norvegicus
gacaaaatgctggaacctgacaccc

SEQ ID NO: 313680 - DNA, 25 bp, Rattus norvegicus
gacaaaatgtgaaactactcaaaat

SEQ ID NO: 313681 - DNA, 25 bp, Rattus norvegicus
gacaaaatgtgatactactcaaaat

SEQ ID NO: 313682 - DNA, 25 bp, Rattus norvegicus
gacaaaattcctcccttggtgtttg

SEQ ID NO: 313683 - DNA, 25 bp, Rattus norvegicus
gacaaaattcctgccttggtgtttg

SEQ ID NO: 313684 - DNA, 25 bp, Rattus norvegicus
gacaaaattgttcctgacccctggg

SEQ ID NO: 313685 - DNA, 25 bp, Rattus norvegicus
gacaaaattgttgctgacccctggg

SEQ ID NO: 313686 - DNA, 25 bp, Rattus norvegicus
gacaaacaaacacagaacgctcagg

SEQ ID NO: 313687 - DNA, 25 bp, Rattus norvegicus
gacaaacaaacagagaacgctcagg

SEQ ID NO: 313688 - DNA, 25 bp, Rattus norvegicus
gacaaacaccatcttcagacatgca

SEQ ID NO: 313689 - DNA, 25 bp, Rattus norvegicus
gacaaacaccatgttcagacatgca

SEQ ID NO: 313690 - DNA, 25 bp, Rattus norvegicus
gacaaacaccctcttgaactgagag

SEQ ID NO: 313691 - DNA, 25 bp, Rattus norvegicus
gacaaacaccctgttgaactgagag

SEQ ID NO: 313692 - DNA, 25 bp, Rattus norvegicus
gacaaacaccgtcatctggtagttt

SEQ ID NO: 313693 - DNA, 25 bp, Rattus norvegicus
gacaaacaccgtgatctggtagttt

SEQ ID NO: 313694 - DNA, 25 bp, Rattus norvegicus
gacaaacacgttcttagcagctagt

SEQ ID NO: 313695 - DNA, 25 bp, Rattus norvegicus
gacaaacacgttgttagcagctagt

SEQ ID NO: 313696 - DNA, 25 bp, Rattus norvegicus
gacaaacactttctacaacttctat

SEQ ID NO: 313697 - DNA, 25 bp, Rattus norvegicus
gacaaacactttgtacaacttctat

SEQ ID NO: 313698 - DNA, 25 bp, Rattus norvegicus
gacaaacagacacagggccacacaa

SEQ ID NO: 313699 - DNA, 25 bp, Rattus norvegicus
gacaaacagacagagggccacacaa

SEQ ID NO: 313700 - DNA, 25 bp, Rattus norvegicus
gacaaacaggccaatctgcgtgcag

SEQ ID NO: 313701 - DNA, 25 bp, Rattus norvegicus
gacaaacaggcctatctgcgtgcag

SEQ ID NO: 313702 - DNA, 25 bp, Rattus norvegicus
gacaaacagtctctaagctccaaat

SEQ ID NO: 313703 - DNA, 25 bp, Rattus norvegicus
gacaaacagtctgtaagctccaaat

SEQ ID NO: 313704 - DNA, 25 bp, Rattus norvegicus
gacaaacatcgtcggctgctactgg

SEQ ID NO: 313705 - DNA, 25 bp, Rattus norvegicus
gacaaacatcgtgggctgctactgg

SEQ ID NO: 313706 - DNA, 25 bp, Rattus norvegicus
gacaaacattctcttcgccatgaag

SEQ ID NO: 313707 - DNA, 25 bp, Rattus norvegicus
gacaaacattctgttcgccatgaag

SEQ ID NO: 313708 - DNA, 25 bp, Rattus norvegicus
gacaaaccaacgcttattccactgc

SEQ ID NO: 313709 - DNA, 25 bp, Rattus norvegicus
gacaaaccaacggttattccactgc

SEQ ID NO: 313710 - DNA, 25 bp, Rattus norvegicus
gacaaaccagcaagggtaccagcat

SEQ ID NO: 313711 - DNA, 25 bp, Rattus norvegicus
gacaaaccagcacgtcaagggccca

SEQ ID NO: 313712 - DNA, 25 bp, Rattus norvegicus
gacaaaccagcaggtcaagggccca

SEQ ID NO: 313713 - DNA, 25 bp, Rattus norvegicus
gacaaaccagcatgggtaccagcat

SEQ ID NO: 313714 - DNA, 25 bp, Rattus norvegicus
gacaaaccctggaccaaacaactca

SEQ ID NO: 313715 - DNA, 25 bp, Rattus norvegicus
gacaaaccctggtccaaacaactca

SEQ ID NO: 313716 - DNA, 25 bp, Rattus norvegicus
gacaaaccgggtatgactacagcaa

SEQ ID NO: 313717 - DNA, 25 bp, Rattus norvegicus
gacaaaccgggtttgactacagcaa

SEQ ID NO: 313718 - DNA, 25 bp, Rattus norvegicus
gacaaacgccagcaccgaggtcagt

SEQ ID NO: 313719 - DNA, 25 bp, Rattus norvegicus
gacaaacgccaggaccgaggtcagt

SEQ ID NO: 313720 - DNA, 25 bp, Rattus norvegicus
gacaaacgccatacacagggcacat

SEQ ID NO: 313721 - DNA, 25 bp, Rattus norvegicus
gacaaacgccattcacagggcacat

SEQ ID NO: 313722 - DNA, 25 bp, Rattus norvegicus
gacaaacggtggattctgcccaggc

SEQ ID NO: 313723 - DNA, 25 bp, Rattus norvegicus
gacaaacggtggtttctgcccaggc

SEQ ID NO: 313724 - DNA, 25 bp, Rattus norvegicus
gacaaacgtgctagctgatatactg

SEQ ID NO: 313725 - DNA, 25 bp, Rattus norvegicus
gacaaacgtgcttgctgatatactg

SEQ ID NO: 313726 - DNA, 25 bp, Rattus norvegicus
gacaaactaaaccagcttacagccc

SEQ ID NO: 313727 - DNA, 25 bp, Rattus norvegicus
gacaaactaaacgagcttacagccc

SEQ ID NO: 313728 - DNA, 25 bp, Rattus norvegicus
gacaaactaactattggcttcttag

SEQ ID NO: 313729 - DNA, 25 bp, Rattus norvegicus
gacaaactaacttttggcttcttag

SEQ ID NO: 313730 - DNA, 25 bp, Rattus norvegicus
gacaaactatagacaactctcttga

SEQ ID NO: 313731 - DNA, 25 bp, Rattus norvegicus
gacaaactatagtcaactctcttga

SEQ ID NO: 313732 - DNA, 25 bp, Rattus norvegicus
gacaaactcactagtgtacagaaag

SEQ ID NO: 313733 - DNA, 25 bp, Rattus norvegicus
gacaaactcacttgtgtacagaaag

SEQ ID NO: 313734 - DNA, 25 bp, Rattus norvegicus
gacaaactcagtaagacgaagtcgg

SEQ ID NO: 313735 - DNA, 25 bp, Rattus norvegicus
gacaaactcagttagacgaagtcgg

SEQ ID NO: 313736 - DNA, 25 bp, Rattus norvegicus
gacaaactcatccaagtacttccca

SEQ ID NO: 313737 - DNA, 25 bp, Rattus norvegicus
gacaaactcatcgaagtacttccca

SEQ ID NO: 313738 - DNA, 25 bp, Rattus norvegicus
gacaaactgcataatttccgtaaga

SEQ ID NO: 313739 - DNA, 25 bp, Rattus norvegicus
gacaaactgcattatttccgtaaga

SEQ ID NO: 313740 - DNA, 25 bp, Rattus norvegicus
gacaaactgctgagtgtgcgagtgt

SEQ ID NO: 313741 - DNA, 25 bp, Rattus norvegicus
gacaaactgctgtgtgtgcgagtgt

SEQ ID NO: 313742 - DNA, 25 bp, Rattus norvegicus
gacaaactggccagggcttttacaa

SEQ ID NO: 313743 - DNA, 25 bp, Rattus norvegicus
gacaaactggcctgggcttttacaa

SEQ ID NO: 313744 - DNA, 25 bp, Rattus norvegicus
gacaaacttcacaatttccctgaga

SEQ ID NO: 313745 - DNA, 25 bp, Rattus norvegicus
gacaaacttcacatattcacatttc

SEQ ID NO: 313746 - DNA, 25 bp, Rattus norvegicus
gacaaacttcactatttccctgaga

SEQ ID NO: 313747 - DNA, 25 bp, Rattus norvegicus
gacaaacttcacttattcacatttc

SEQ ID NO: 313748 - DNA, 25 bp, Rattus norvegicus
gacaaacttgagactgcctactttt

SEQ ID NO: 313749 - DNA, 25 bp, Rattus norvegicus
gacaaacttgagtctgcctactttt

SEQ ID NO: 313750 - DNA, 25 bp, Rattus norvegicus
gacaaacttgatctactgcactgag

SEQ ID NO: 313751 - DNA, 25 bp, Rattus norvegicus
gacaaacttgatgtactgcactgag

SEQ ID NO: 313752 - DNA, 25 bp, Rattus norvegicus
gacaaacttgcaaaactgtgctttt

SEQ ID NO: 313753 - DNA, 25 bp, Rattus norvegicus
gacaaacttgcataactgtgctttt

SEQ ID NO: 313754 - DNA, 25 bp, Rattus norvegicus
gacaaacttgtcattttagcctttg

SEQ ID NO: 313755 - DNA, 25 bp, Rattus norvegicus
gacaaacttgtctttttagcctttg

SEQ ID NO: 313756 - DNA, 25 bp, Rattus norvegicus
gacaaactttcaaattctgcagcat

SEQ ID NO: 313757 - DNA, 25 bp, Rattus norvegicus
gacaaactttcatattctgcagcat

SEQ ID NO: 313758 - DNA, 25 bp, Rattus norvegicus
gacaaagaaattcaggttctctata

SEQ ID NO: 313759 - DNA, 25 bp, Rattus norvegicus
gacaaagaaattgaggttctctata

SEQ ID NO: 313760 - DNA, 25 bp, Rattus norvegicus
gacaaagaacaaacctaaaccctgc

SEQ ID NO: 313761 - DNA, 25 bp, Rattus norvegicus
gacaaagaacaatcctaaaccctgc

SEQ ID NO: 313762 - DNA, 25 bp, Rattus norvegicus
gacaaagaacttcgctctccgagat

SEQ ID NO: 313763 - DNA, 25 bp, Rattus norvegicus
gacaaagaacttggctctccgagat

SEQ ID NO: 313764 - DNA, 25 bp, Rattus norvegicus
gacaaagacagcctgatccagatga

SEQ ID NO: 313765 - DNA, 25 bp, Rattus norvegicus
gacaaagacagcgtgatccagatga

SEQ ID NO: 313766 - DNA, 25 bp, Rattus norvegicus
gacaaagacaggaatgggacaataa

SEQ ID NO: 313767 - DNA, 25 bp, Rattus norvegicus
gacaaagacaggtatgggacaataa

SEQ ID NO: 313768 - DNA, 25 bp, Rattus norvegicus
gacaaagaccatcccttcgggaagt

SEQ ID NO: 313769 - DNA, 25 bp, Rattus norvegicus
gacaaagaccatgccttcgggaagt

SEQ ID NO: 313770 - DNA, 25 bp, Rattus norvegicus
gacaaagactttatctagttcctat

SEQ ID NO: 313771 - DNA, 25 bp, Rattus norvegicus
gacaaagactttttctagttcctat

SEQ ID NO: 313772 - DNA, 25 bp, Rattus norvegicus
gacaaagaggcaacagtcttccggg

SEQ ID NO: 313773 - DNA, 25 bp, Rattus norvegicus
gacaaagaggcatcagtcttccggg

SEQ ID NO: 313774 - DNA, 25 bp, Rattus norvegicus
gacaaagaggtaaaagccatgcaat

SEQ ID NO: 313775 - DNA, 25 bp, Rattus norvegicus
gacaaagaggtataagccatgcaat

SEQ ID NO: 313776 - DNA, 25 bp, Rattus norvegicus
gacaaagatagcaggagacaggatt

SEQ ID NO: 313777 - DNA, 25 bp, Rattus norvegicus
gacaaagatagctggagacaggatt

SEQ ID NO: 313778 - DNA, 25 bp, Rattus norvegicus
gacaaagatcccatgctaatcgtga

SEQ ID NO: 313779 - DNA, 25 bp, Rattus norvegicus
gacaaagatcccttgctaatcgtga

SEQ ID NO: 313780 - DNA, 25 bp, Rattus norvegicus
gacaaagatgagatacccacgattt

SEQ ID NO: 313781 - DNA, 25 bp, Rattus norvegicus
gacaaagatgagttacccacgattt

SEQ ID NO: 313782 - DNA, 25 bp, Rattus norvegicus
gacaaagcaaccataacaacaacaa

SEQ ID NO: 313783 - DNA, 25 bp, Rattus norvegicus
gacaaagcaaccttaacaacaacaa

SEQ ID NO: 313784 - DNA, 25 bp, Rattus norvegicus
gacaaagcacctccctagcatttag

SEQ ID NO: 313785 - DNA, 25 bp, Rattus norvegicus
gacaaagcacctgcctagcatttag

SEQ ID NO: 313786 - DNA, 25 bp, Rattus norvegicus
gacaaagcactaacctttaggcctc

SEQ ID NO: 313787 - DNA, 25 bp, Rattus norvegicus
gacaaagcactatcctttaggcctc

SEQ ID NO: 313788 - DNA, 25 bp, Rattus norvegicus
gacaaagccttgacaaacagtgcag

SEQ ID NO: 313789 - DNA, 25 bp, Rattus norvegicus
gacaaagccttgtcaaacagtgcag

SEQ ID NO: 313790 - DNA, 25 bp, Rattus norvegicus
gacaaagctacactgcccattataa

SEQ ID NO: 313791 - DNA, 25 bp, Rattus norvegicus
gacaaagctacagtgcccattataa

SEQ ID NO: 313792 - DNA, 25 bp, Rattus norvegicus
gacaaagctactaacgacaaacttt

SEQ ID NO: 313793 - DNA, 25 bp, Rattus norvegicus
gacaaagctacttacgacaaacttt

SEQ ID NO: 313794 - DNA, 25 bp, Rattus norvegicus
gacaaagctcgaaagactattttat

SEQ ID NO: 313795 - DNA, 25 bp, Rattus norvegicus
gacaaagctcgatagactattttat

SEQ ID NO: 313796 - DNA, 25 bp, Rattus norvegicus
gacaaagctgcactgaccgtccgag

SEQ ID NO: 313797 - DNA, 25 bp, Rattus norvegicus
gacaaagctgcagtgaccgtccgag

SEQ ID NO: 313798 - DNA, 25 bp, Rattus norvegicus
gacaaagctgtaagtgccacctcaa

SEQ ID NO: 313799 - DNA, 25 bp, Rattus norvegicus
gacaaagctgtatgtgccacctcaa

SEQ ID NO: 313800 - DNA, 25 bp, Rattus norvegicus
gacaaagctgtgatccttacgcaac

SEQ ID NO: 313801 - DNA, 25 bp, Rattus norvegicus
gacaaagctgtgttccttacgcaac

SEQ ID NO: 313802 - DNA, 25 bp, Rattus norvegicus
gacaaagctgttcctgcacagacga

SEQ ID NO: 313803 - DNA, 25 bp, Rattus norvegicus
gacaaagctgttgctgcacagacga

SEQ ID NO: 313804 - DNA, 25 bp, Rattus norvegicus
gacaaagcttcaatctgtacctcac

SEQ ID NO: 313805 - DNA, 25 bp, Rattus norvegicus
gacaaagcttcattctgtacctcac

SEQ ID NO: 313806 - DNA, 25 bp, Rattus norvegicus
gacaaagcttctcatgggacagtta

SEQ ID NO: 313807 - DNA, 25 bp, Rattus norvegicus
gacaaagcttctgatgggacagtta

SEQ ID NO: 313808 - DNA, 25 bp, Rattus norvegicus
gacaaaggacatccatccaccaaga

SEQ ID NO: 313809 - DNA, 25 bp, Rattus norvegicus
gacaaaggacatgcatccaccaaga

SEQ ID NO: 313810 - DNA, 25 bp, Rattus norvegicus
gacaaaggcactaggaacttcgaca

SEQ ID NO: 313811 - DNA, 25 bp, Rattus norvegicus
gacaaaggcacttggaacttcgaca

SEQ ID NO: 313812 - DNA, 25 bp, Rattus norvegicus
gacaaaggcatccaaggtttcagca

SEQ ID NO: 313813 - DNA, 25 bp, Rattus norvegicus
gacaaaggcatcctacgactccact

SEQ ID NO: 313814 - DNA, 25 bp, Rattus norvegicus
gacaaaggcatcgaaggtttcagca

SEQ ID NO: 313815 - DNA, 25 bp, Rattus norvegicus
gacaaaggcatcgtacgactccact

SEQ ID NO: 313816 - DNA, 25 bp, Rattus norvegicus
gacaaaggccctctgcgtgaagaat

SEQ ID NO: 313817 - DNA, 25 bp, Rattus norvegicus
gacaaaggccctgtgcgtgaagaat

SEQ ID NO: 313818 - DNA, 25 bp, Rattus norvegicus
gacaaaggcgacatccttggaagag

SEQ ID NO: 313819 - DNA, 25 bp, Rattus norvegicus
gacaaaggcgacttccttggaagag

SEQ ID NO: 313820 - DNA, 25 bp, Rattus norvegicus
gacaaaggctgacttctgtgagttt

SEQ ID NO: 313821 - DNA, 25 bp, Rattus norvegicus
gacaaaggctgagttctgtgagttt

SEQ ID NO: 313822 - DNA, 25 bp, Rattus norvegicus
gacaaaggctggctcatgcactttt

SEQ ID NO: 313823 - DNA, 25 bp, Rattus norvegicus
gacaaaggctgggtcatgcactttt

SEQ ID NO: 313824 - DNA, 25 bp, Rattus norvegicus
gacaaagggcatcagccttcaggaa

SEQ ID NO: 313825 - DNA, 25 bp, Rattus norvegicus
gacaaagggcatgagccttcaggaa

SEQ ID NO: 313826 - DNA, 25 bp, Rattus norvegicus
gacaaaggtcgtataagtaccatcg

SEQ ID NO: 313827 - DNA, 25 bp, Rattus norvegicus
gacaaaggtcgtttaagtaccatcg

SEQ ID NO: 313828 - DNA, 25 bp, Rattus norvegicus
gacaaaggttgcacttggcttcttc

SEQ ID NO: 313829 - DNA, 25 bp, Rattus norvegicus
gacaaaggttgctcttggcttcttc

SEQ ID NO: 313830 - DNA, 25 bp, Rattus norvegicus
gacaaaggtttcctcagggttgata

SEQ ID NO: 313831 - DNA, 25 bp, Rattus norvegicus
gacaaaggtttcgtcagggttgata

SEQ ID NO: 313832 - DNA, 25 bp, Rattus norvegicus
gacaaagtagctcagtgggccccat

SEQ ID NO: 313833 - DNA, 25 bp, Rattus norvegicus
gacaaagtagctgagtgggccccat

SEQ ID NO: 313834 - DNA, 25 bp, Rattus norvegicus
gacaaagtaggtctctccagcgcac

SEQ ID NO: 313835 - DNA, 25 bp, Rattus norvegicus
gacaaagtaggtgtctccagcgcac

SEQ ID NO: 313836 - DNA, 25 bp, Rattus norvegicus
gacaaagtcatcatggaatccccag

SEQ ID NO: 313837 - DNA, 25 bp, Rattus norvegicus
gacaaagtcatcttggaatccccag

SEQ ID NO: 313838 - DNA, 25 bp, Rattus norvegicus
gacaaagtctctctttatactctta

SEQ ID NO: 313839 - DNA, 25 bp, Rattus norvegicus
gacaaagtctctgtttatactctta

SEQ ID NO: 313840 - DNA, 25 bp, Rattus norvegicus
gacaaagtcttcagtgcccaggagg

SEQ ID NO: 313841 - DNA, 25 bp, Rattus norvegicus
gacaaagtcttctgtgcccaggagg

SEQ ID NO: 313842 - DNA, 25 bp, Rattus norvegicus
gacaaagtgagcatccggaaacatg

SEQ ID NO: 313843 - DNA, 25 bp, Rattus norvegicus
gacaaagtgagcttccggaaacatg

SEQ ID NO: 313844 - DNA, 25 bp, Rattus norvegicus
gacaaagttgccacttaccttgagg

SEQ ID NO: 313845 - DNA, 25 bp, Rattus norvegicus
gacaaagttgcctcttaccttgagg

SEQ ID NO: 313846 - DNA, 25 bp, Rattus norvegicus
gacaaagttgtcaccatcaaagtgt

SEQ ID NO: 313847 - DNA, 25 bp, Rattus norvegicus
gacaaagttgtctccatcaaagtgt

SEQ ID NO: 313848 - DNA, 25 bp, Rattus norvegicus
gacaaagttttgctgatcaagatat

SEQ ID NO: 313849 - DNA, 25 bp, Rattus norvegicus
gacaaagttttggtgatcaagatat

SEQ ID NO: 313850 - DNA, 25 bp, Rattus norvegicus
gacaaataataacctatctctcctg

SEQ ID NO: 313851 - DNA, 25 bp, Rattus norvegicus
gacaaataataagctatctctcctg

SEQ ID NO: 313852 - DNA, 25 bp, Rattus norvegicus
gacaaatacatccacaagcgctggg

SEQ ID NO: 313853 - DNA, 25 bp, Rattus norvegicus
gacaaatacatcgacaagcgctggg

SEQ ID NO: 313854 - DNA, 25 bp, Rattus norvegicus
gacaaatactgcatgtttgtttcat

SEQ ID NO: 313855 - DNA, 25 bp, Rattus norvegicus
gacaaatactgcttgtttgtttcat

SEQ ID NO: 313856 - DNA, 25 bp, Rattus norvegicus
gacaaatatagtaggataccctgga

SEQ ID NO: 313857 - DNA, 25 bp, Rattus norvegicus
gacaaatatagttggataccctgga

SEQ ID NO: 313858 - DNA, 25 bp, Rattus norvegicus
gacaaatattctcaactgggacgga

SEQ ID NO: 313859 - DNA, 25 bp, Rattus norvegicus
gacaaatattctgaactgggacgga

SEQ ID NO: 313860 - DNA, 25 bp, Rattus norvegicus
gacaaatatttcatcaccctgctta

SEQ ID NO: 313861 - DNA, 25 bp, Rattus norvegicus
gacaaatatttcttcaccctgctta

SEQ ID NO: 313862 - DNA, 25 bp, Rattus norvegicus
gacaaatcacacagcctcagaagga

SEQ ID NO: 313863 - DNA, 25 bp, Rattus norvegicus
gacaaatcacactgcctcagaagga

SEQ ID NO: 313864 - DNA, 25 bp, Rattus norvegicus
gacaaatcagtccaggttcatccag

SEQ ID NO: 313865 - DNA, 25 bp, Rattus norvegicus
gacaaatcagtcgaggttcatccag

SEQ ID NO: 313866 - DNA, 25 bp, Rattus norvegicus
gacaaatcatgactgcacctgagct

SEQ ID NO: 313867 - DNA, 25 bp, Rattus norvegicus
gacaaatcatgagtgcacctgagct

SEQ ID NO: 313868 - DNA, 25 bp, Rattus norvegicus
gacaaatcatgtactctgaagacag

SEQ ID NO: 313869 - DNA, 25 bp, Rattus norvegicus
gacaaatcatgttctctgaagacag

SEQ ID NO: 313870 - DNA, 25 bp, Rattus norvegicus
gacaaatccaccagcgagttggcgc

SEQ ID NO: 313871 - DNA, 25 bp, Rattus norvegicus
gacaaatccacctgcgagttggcgc

SEQ ID NO: 313872 - DNA, 25 bp, Rattus norvegicus
gacaaatcctccctagactcttgaa

SEQ ID NO: 313873 - DNA, 25 bp, Rattus norvegicus
gacaaatcctccgtagactcttgaa

SEQ ID NO: 313874 - DNA, 25 bp, Rattus norvegicus
gacaaatctctgctttcatcttaaa

SEQ ID NO: 313875 - DNA, 25 bp, Rattus norvegicus
gacaaatctctggtttcatcttaaa

SEQ ID NO: 313876 - DNA, 25 bp, Rattus norvegicus
gacaaatctgacaccatctcgttca

SEQ ID NO: 313877 - DNA, 25 bp, Rattus norvegicus
gacaaatctgactccatctcgttca

SEQ ID NO: 313878 - DNA, 25 bp, Rattus norvegicus
gacaaatctttccacatctctgaag

SEQ ID NO: 313879 - DNA, 25 bp, Rattus norvegicus
gacaaatctttcgacatctctgaag

SEQ ID NO: 313880 - DNA, 25 bp, Rattus norvegicus
gacaaatcttttactaggtgctcct

SEQ ID NO: 313881 - DNA, 25 bp, Rattus norvegicus
gacaaatctttttctaggtgctcct

SEQ ID NO: 313882 - DNA, 25 bp, Rattus norvegicus
gacaaatgaatgatcagccgcttag

SEQ ID NO: 313883 - DNA, 25 bp, Rattus norvegicus
gacaaatgaatgttcagccgcttag

SEQ ID NO: 313884 - DNA, 25 bp, Rattus norvegicus
gacaaatgacttccagaacctgctg

SEQ ID NO: 313885 - DNA, 25 bp, Rattus norvegicus
gacaaatgacttgcagaacctgctg

SEQ ID NO: 313886 - DNA, 25 bp, Rattus norvegicus
gacaaatgagcgatcctacaacctt

SEQ ID NO: 313887 - DNA, 25 bp, Rattus norvegicus
gacaaatgagcgttcctacaacctt

SEQ ID NO: 313888 - DNA, 25 bp, Rattus norvegicus
gacaaatgcccactggtgggttcct

SEQ ID NO: 313889 - DNA, 25 bp, Rattus norvegicus
gacaaatgcccagtggtgggttcct

SEQ ID NO: 313890 - DNA, 25 bp, Rattus norvegicus
gacaaatgctatcagctgctctaga

SEQ ID NO: 313891 - DNA, 25 bp, Rattus norvegicus
gacaaatgctatgagctgctctaga

SEQ ID NO: 313892 - DNA, 25 bp, Rattus norvegicus
gacaaatgctcccagtcttattagg

SEQ ID NO: 313893 - DNA, 25 bp, Rattus norvegicus
gacaaatgctccgagtcttattagg

SEQ ID NO: 313894 - DNA, 25 bp, Rattus norvegicus
gacaaatgggtcagacgacgcttga

SEQ ID NO: 313895 - DNA, 25 bp, Rattus norvegicus
gacaaatgggtctgacgacgcttga

SEQ ID NO: 313896 - DNA, 25 bp, Rattus norvegicus
gacaaatggtttctctgggccactg

SEQ ID NO: 313897 - DNA, 25 bp, Rattus norvegicus
gacaaatggtttgtctgggccactg

SEQ ID NO: 313898 - DNA, 25 bp, Rattus norvegicus
gacaaatgtccacgtctctacgaaa

SEQ ID NO: 313899 - DNA, 25 bp, Rattus norvegicus
gacaaatgtccaggtctctacgaaa

SEQ ID NO: 313900 - DNA, 25 bp, Rattus norvegicus
gacaaatgtctgaccacattctacc

SEQ ID NO: 313901 - DNA, 25 bp, Rattus norvegicus
gacaaatgtctgtccacattctacc

SEQ ID NO: 313902 - DNA, 25 bp, Rattus norvegicus
gacaaatgtggcacagattcgcatg

SEQ ID NO: 313903 - DNA, 25 bp, Rattus norvegicus
gacaaatgtggctcagattcgcatg

SEQ ID NO: 313904 - DNA, 25 bp, Rattus norvegicus
gacaaatgtgtacagttctaaccaa

SEQ ID NO: 313905 - DNA, 25 bp, Rattus norvegicus
gacaaatgtgtagagttctaaccaa

SEQ ID NO: 313906 - DNA, 25 bp, Rattus norvegicus
gacaaatgtgttcagcttgcactat

SEQ ID NO: 313907 - DNA, 25 bp, Rattus norvegicus
gacaaatgtgttgagcttgcactat

SEQ ID NO: 313908 - DNA, 25 bp, Rattus norvegicus
gacaaatgttgtcttcagccataaa

SEQ ID NO: 313909 - DNA, 25 bp, Rattus norvegicus
gacaaatgttgtgttcagccataaa

SEQ ID NO: 313910 - DNA, 25 bp, Rattus norvegicus
gacaaatgtttgatgtgccctcctc

SEQ ID NO: 313911 - DNA, 25 bp, Rattus norvegicus
gacaaatgtttgttgtgccctcctc

SEQ ID NO: 313912 - DNA, 25 bp, Rattus norvegicus
gacaaattatatactcttccaccaa

SEQ ID NO: 313913 - DNA, 25 bp, Rattus norvegicus
gacaaattatattctcttccaccaa

SEQ ID NO: 313914 - DNA, 25 bp, Rattus norvegicus
gacaaattatgtaatccattacttt

SEQ ID NO: 313915 - DNA, 25 bp, Rattus norvegicus
gacaaattatgttatccattacttt

SEQ ID NO: 313916 - DNA, 25 bp, Rattus norvegicus
gacaaattcctaagctgtggagact

SEQ ID NO: 313917 - DNA, 25 bp, Rattus norvegicus
gacaaattcctatgctgtggagact

SEQ ID NO: 313918 - DNA, 25 bp, Rattus norvegicus
gacaaattctctcttgcccaaatgc

SEQ ID NO: 313919 - DNA, 25 bp, Rattus norvegicus
gacaaattctctgttgcccaaatgc

SEQ ID NO: 313920 - DNA, 25 bp, Rattus norvegicus
gacaaatttcaacccctcacaggag

SEQ ID NO: 313921 - DNA, 25 bp, Rattus norvegicus
gacaaatttcaagccctcacaggag

SEQ ID NO: 313922 - DNA, 25 bp, Rattus norvegicus
gacaaatttcgccacatgttaggag

SEQ ID NO: 313923 - DNA, 25 bp, Rattus norvegicus
gacaaatttcgcgacatgttaggag

SEQ ID NO: 313924 - DNA, 25 bp, Rattus norvegicus
gacaaatttcttaaagtgctcacag

SEQ ID NO: 313925 - DNA, 25 bp, Rattus norvegicus
gacaaatttctttaagtgctcacag

SEQ ID NO: 313926 - DNA, 25 bp, Rattus norvegicus
gacaaatttgctcacttcatggtga

SEQ ID NO: 313927 - DNA, 25 bp, Rattus norvegicus
gacaaatttgctgacttcatggtga

SEQ ID NO: 313928 - DNA, 25 bp, Rattus norvegicus
gacaaattttcaacttactgcacaa

SEQ ID NO: 313929 - DNA, 25 bp, Rattus norvegicus
gacaaattttcatcttactgcacaa

SEQ ID NO: 313930 - DNA, 25 bp, Rattus norvegicus
gacaaatttttcaacccatcaatgg

SEQ ID NO: 313931 - DNA, 25 bp, Rattus norvegicus
gacaaatttttctacccatcaatgg

SEQ ID NO: 313932 - DNA, 25 bp, Rattus norvegicus
gacaacaaaactccctttctgggcg

SEQ ID NO: 313933 - DNA, 25 bp, Rattus norvegicus
gacaacaaaactgcctttctgggcg

SEQ ID NO: 313934 - DNA, 25 bp, Rattus norvegicus
gacaacaaaattctactcagcaata

SEQ ID NO: 313935 - DNA, 25 bp, Rattus norvegicus
gacaacaaaattgtactcagcaata

SEQ ID NO: 313936 - DNA, 25 bp, Rattus norvegicus
gacaacaaagctcgatgacctcaca

SEQ ID NO: 313937 - DNA, 25 bp, Rattus norvegicus
gacaacaaagctggatgacctcaca

SEQ ID NO: 313938 - DNA, 25 bp, Rattus norvegicus
gacaacaaagggagggcagactgct

SEQ ID NO: 313939 - DNA, 25 bp, Rattus norvegicus
gacaacaaagggtgggcagactgct

SEQ ID NO: 313940 - DNA, 25 bp, Rattus norvegicus
gacaacaaccccattatgatgcagt

SEQ ID NO: 313941 - DNA, 25 bp, Rattus norvegicus
gacaacaacccctttatgatgcagt

SEQ ID NO: 313942 - DNA, 25 bp, Rattus norvegicus
gacaacaacgtccagcaagaaggtg

SEQ ID NO: 313943 - DNA, 25 bp, Rattus norvegicus
gacaacaacgtcgagcaagaaggtg

SEQ ID NO: 313944 - DNA, 25 bp, Rattus norvegicus
gacaacaaggtcctggatcgcagaa

SEQ ID NO: 313945 - DNA, 25 bp, Rattus norvegicus
gacaacaaggtcgtggatcgcagaa

SEQ ID NO: 313946 - DNA, 25 bp, Rattus norvegicus
gacaacaatgcacctaactatctaa

SEQ ID NO: 313947 - DNA, 25 bp, Rattus norvegicus
gacaacaatgcagctaactatctaa

SEQ ID NO: 313948 - DNA, 25 bp, Rattus norvegicus
gacaacaattcacaccccagatgga

SEQ ID NO: 313949 - DNA, 25 bp, Rattus norvegicus
gacaacaattcagaccccagatgga

SEQ ID NO: 313950 - DNA, 25 bp, Rattus norvegicus
gacaacacagttaattttatggtaa

SEQ ID NO: 313951 - DNA, 25 bp, Rattus norvegicus
gacaacacagtttattttatggtaa

SEQ ID NO: 313952 - DNA, 25 bp, Rattus norvegicus
gacaacacatgaactacgttccaga

SEQ ID NO: 313953 - DNA, 25 bp, Rattus norvegicus
gacaacacatgatctacgttccaga

SEQ ID NO: 313954 - DNA, 25 bp, Rattus norvegicus
gacaacacatttaaactcctgcaga

SEQ ID NO: 313955 - DNA, 25 bp, Rattus norvegicus
gacaacacattttaactcctgcaga

SEQ ID NO: 313956 - DNA, 25 bp, Rattus norvegicus
gacaacaccaatcaccaatccggag

SEQ ID NO: 313957 - DNA, 25 bp, Rattus norvegicus
gacaacaccaatgaccaatccggag

SEQ ID NO: 313958 - DNA, 25 bp, Rattus norvegicus
gacaacaccctgcatggcattcttt

SEQ ID NO: 313959 - DNA, 25 bp, Rattus norvegicus
gacaacaccctggatggcattcttt

SEQ ID NO: 313960 - DNA, 25 bp, Rattus norvegicus
gacaacaccgtaaccgtttgtatgg

SEQ ID NO: 313961 - DNA, 25 bp, Rattus norvegicus
gacaacaccgtatccgtttgtatgg

SEQ ID NO: 313962 - DNA, 25 bp, Rattus norvegicus
gacaacacctacatcgtggcactaa

SEQ ID NO: 313963 - DNA, 25 bp, Rattus norvegicus
gacaacacctacttcgtggcactaa

SEQ ID NO: 313964 - DNA, 25 bp, Rattus norvegicus
gacaacactggtacctgggaggtga

SEQ ID NO: 313965 - DNA, 25 bp, Rattus norvegicus
gacaacactggttcctgggaggtga

SEQ ID NO: 313966 - DNA, 25 bp, Rattus norvegicus
gacaacactgttacgatgtgccacc

SEQ ID NO: 313967 - DNA, 25 bp, Rattus norvegicus
gacaacactgtttcgatgtgccacc

SEQ ID NO: 313968 - DNA, 25 bp, Rattus norvegicus
gacaacacttacctctagctcagcg

SEQ ID NO: 313969 - DNA, 25 bp, Rattus norvegicus
gacaacacttacgtctagctcagcg

SEQ ID NO: 313970 - DNA, 25 bp, Rattus norvegicus
gacaacacttggagctcttgagcga

SEQ ID NO: 313971 - DNA, 25 bp, Rattus norvegicus
gacaacacttggtgctcttgagcga

SEQ ID NO: 313972 - DNA, 25 bp, Rattus norvegicus
gacaacagaaccatgcttggtctcc

SEQ ID NO: 313973 - DNA, 25 bp, Rattus norvegicus
gacaacagaaccttgcttggtctcc

SEQ ID NO: 313974 - DNA, 25 bp, Rattus norvegicus
gacaacagcccaaaggctcatgtgt

SEQ ID NO: 313975 - DNA, 25 bp, Rattus norvegicus
gacaacagcccataggctcatgtgt

SEQ ID NO: 313976 - DNA, 25 bp, Rattus norvegicus
gacaacagcctcagacagtattata

SEQ ID NO: 313977 - DNA, 25 bp, Rattus norvegicus
gacaacagcctctgacagtattata

SEQ ID NO: 313978 - DNA, 25 bp, Rattus norvegicus
gacaacaggcatatatttaaccaga

SEQ ID NO: 313979 - DNA, 25 bp, Rattus norvegicus
gacaacaggcatttatttaaccaga

SEQ ID NO: 313980 - DNA, 25 bp, Rattus norvegicus
gacaacaggccacagctgcaggaga

SEQ ID NO: 313981 - DNA, 25 bp, Rattus norvegicus
gacaacaggccagagctgcaggaga

SEQ ID NO: 313982 - DNA, 25 bp, Rattus norvegicus
gacaacaggtggagcccatacgctg

SEQ ID NO: 313983 - DNA, 25 bp, Rattus norvegicus
gacaacaggtggtgcccatacgctg

SEQ ID NO: 313984 - DNA, 25 bp, Rattus norvegicus
gacaacaggtttcgtccttgatttt

SEQ ID NO: 313985 - DNA, 25 bp, Rattus norvegicus
gacaacaggtttggtccttgatttt

SEQ ID NO: 313986 - DNA, 25 bp, Rattus norvegicus
gacaacagtcttacacaagtttgct

SEQ ID NO: 313987 - DNA, 25 bp, Rattus norvegicus
gacaacagtctttcacaagtttgct

SEQ ID NO: 313988 - DNA, 25 bp, Rattus norvegicus
gacaacagtgtaatcccactacata

SEQ ID NO: 313989 - DNA, 25 bp, Rattus norvegicus
gacaacagtgtattcccactacata

SEQ ID NO: 313990 - DNA, 25 bp, Rattus norvegicus
gacaacatcctcatgggcagaaata

SEQ ID NO: 313991 - DNA, 25 bp, Rattus norvegicus
gacaacatcctcttgggcagaaata

SEQ ID NO: 313992 - DNA, 25 bp, Rattus norvegicus
gacaacatcctgaacagactgacca

SEQ ID NO: 313993 - DNA, 25 bp, Rattus norvegicus
gacaacatcctgtacagactgacca

SEQ ID NO: 313994 - DNA, 25 bp, Rattus norvegicus
gacaacatcgtgcttgtgttttgaa

SEQ ID NO: 313995 - DNA, 25 bp, Rattus norvegicus
gacaacatcgtggttgtgttttgaa

SEQ ID NO: 313996 - DNA, 25 bp, Rattus norvegicus
gacaacatctaccttattggccatg

SEQ ID NO: 313997 - DNA, 25 bp, Rattus norvegicus
gacaacatctacgttattggccatg

SEQ ID NO: 313998 - DNA, 25 bp, Rattus norvegicus
gacaacatgcaaatgtgctccagac

SEQ ID NO: 313999 - DNA, 25 bp, Rattus norvegicus
gacaacatgcaattgtgctccagac

SEQ ID NO: 314000 - DNA, 25 bp, Rattus norvegicus
gacaacatggagatcggtaaccatt

SEQ ID NO: 314001 - DNA, 25 bp, Rattus norvegicus
gacaacatggagttcggtaaccatt

SEQ ID NO: 314002 - DNA, 25 bp, Rattus norvegicus
gacaacatggccacctaaggtgcaa

SEQ ID NO: 314003 - DNA, 25 bp, Rattus norvegicus
gacaacatggcctcctaaggtgcaa

SEQ ID NO: 314004 - DNA, 25 bp, Rattus norvegicus
gacaacatgggcacctaaggcacgg

SEQ ID NO: 314005 - DNA, 25 bp, Rattus norvegicus
gacaacatgggctcctaaggcacgg

SEQ ID NO: 314006 - DNA, 25 bp, Rattus norvegicus
gacaacatggttcctgttggccatt

SEQ ID NO: 314007 - DNA, 25 bp, Rattus norvegicus
gacaacatggttgctgttggccatt

SEQ ID NO: 314008 - DNA, 25 bp, Rattus norvegicus
gacaacatgtcacttgtagagacct

SEQ ID NO: 314009 - DNA, 25 bp, Rattus norvegicus
gacaacatgtcagttgtagagacct

SEQ ID NO: 314010 - DNA, 25 bp, Rattus norvegicus
gacaacatgttactaggacttccac

SEQ ID NO: 314011 - DNA, 25 bp, Rattus norvegicus
gacaacatgttagtaggacttccac

SEQ ID NO: 314012 - DNA, 25 bp, Rattus norvegicus
gacaacattgccaaagctaccatcc

SEQ ID NO: 314013 - DNA, 25 bp, Rattus norvegicus
gacaacattgcctaagctaccatcc

SEQ ID NO: 314014 - DNA, 25 bp, Rattus norvegicus
gacaacatttctatggttcctctgg

SEQ ID NO: 314015 - DNA, 25 bp, Rattus norvegicus
gacaacatttctttggttcctctgg

SEQ ID NO: 314016 - DNA, 25 bp, Rattus norvegicus
gacaaccaagacattagcccagcag

SEQ ID NO: 314017 - DNA, 25 bp, Rattus norvegicus
gacaaccaagactttagcccagcag

SEQ ID NO: 314018 - DNA, 25 bp, Rattus norvegicus
gacaaccaagataaaccatcacagg

SEQ ID NO: 314019 - DNA, 25 bp, Rattus norvegicus
gacaaccaagattaaccatcacagg

SEQ ID NO: 314020 - DNA, 25 bp, Rattus norvegicus
gacaaccacagaacatttagcgaca

SEQ ID NO: 314021 - DNA, 25 bp, Rattus norvegicus
gacaaccacagatcatttagcgaca

SEQ ID NO: 314022 - DNA, 25 bp, Rattus norvegicus
gacaaccacgagcaagactattttc

SEQ ID NO: 314023 - DNA, 25 bp, Rattus norvegicus
gacaaccacgaggaagactattttc

SEQ ID NO: 314024 - DNA, 25 bp, Rattus norvegicus
gacaaccacttcagctctgttagag

SEQ ID NO: 314025 - DNA, 25 bp, Rattus norvegicus
gacaaccacttctgctctgttagag

SEQ ID NO: 314026 - DNA, 25 bp, Rattus norvegicus
gacaaccagaaaacggcagccccat

SEQ ID NO: 314027 - DNA, 25 bp, Rattus norvegicus
gacaaccagaaatcggcagccccat

SEQ ID NO: 314028 - DNA, 25 bp, Rattus norvegicus
gacaaccagaacctgcaacagatgg

SEQ ID NO: 314029 - DNA, 25 bp, Rattus norvegicus
gacaaccagaacgtgcaacagatgg

SEQ ID NO: 314030 - DNA, 25 bp, Rattus norvegicus
gacaaccagcctcaggtctgtagaa

SEQ ID NO: 314031 - DNA, 25 bp, Rattus norvegicus
gacaaccagcctgaggtctgtagaa

SEQ ID NO: 314032 - DNA, 25 bp, Rattus norvegicus
gacaaccaggcgactatgcagcagg

SEQ ID NO: 314033 - DNA, 25 bp, Rattus norvegicus
gacaaccaggcgtctatgcagcagg

SEQ ID NO: 314034 - DNA, 25 bp, Rattus norvegicus
gacaaccatttcaaatcttgcacat

SEQ ID NO: 314035 - DNA, 25 bp, Rattus norvegicus
gacaaccatttctaatcttgcacat

SEQ ID NO: 314036 - DNA, 25 bp, Rattus norvegicus
gacaacccacgtcgcttattttgaa

SEQ ID NO: 314037 - DNA, 25 bp, Rattus norvegicus
gacaacccacgtggcttattttgaa

SEQ ID NO: 314038 - DNA, 25 bp, Rattus norvegicus
gacaacccatggaacgcttagagtg

SEQ ID NO: 314039 - DNA, 25 bp, Rattus norvegicus
gacaacccatggtacgcttagagtg

SEQ ID NO: 314040 - DNA, 25 bp, Rattus norvegicus
gacaacccatttagcagatgcagca

SEQ ID NO: 314041 - DNA, 25 bp, Rattus norvegicus
gacaacccattttgcagatgcagca

SEQ ID NO: 314042 - DNA, 25 bp, Rattus norvegicus
gacaaccccaaccagagtgacttga

SEQ ID NO: 314043 - DNA, 25 bp, Rattus norvegicus
gacaaccccaacgagagtgacttga

SEQ ID NO: 314044 - DNA, 25 bp, Rattus norvegicus
gacaaccccaatagagaaaatgctc

SEQ ID NO: 314045 - DNA, 25 bp, Rattus norvegicus
gacaaccccaattgagaaaatgctc

SEQ ID NO: 314046 - DNA, 25 bp, Rattus norvegicus
gacaaccccagtactcagtggaaaa

SEQ ID NO: 314047 - DNA, 25 bp, Rattus norvegicus
gacaaccccagttctcagtggaaaa

SEQ ID NO: 314048 - DNA, 25 bp, Rattus norvegicus
gacaaccccgagacaggcttctgga

SEQ ID NO: 314049 - DNA, 25 bp, Rattus norvegicus
gacaaccccgagagaatccagcaga

SEQ ID NO: 314050 - DNA, 25 bp, Rattus norvegicus
gacaaccccgagtcaggcttctgga

SEQ ID NO: 314051 - DNA, 25 bp, Rattus norvegicus
gacaaccccgagtgaatccagcaga

SEQ ID NO: 314052 - DNA, 25 bp, Rattus norvegicus
gacaacccctttcggagctgggctg

SEQ ID NO: 314053 - DNA, 25 bp, Rattus norvegicus
gacaacccctttgggagctgggctg

SEQ ID NO: 314054 - DNA, 25 bp, Rattus norvegicus
gacaacccgagtacactcactagaa

SEQ ID NO: 314055 - DNA, 25 bp, Rattus norvegicus
gacaacccgagttcactcactagaa

SEQ ID NO: 314056 - DNA, 25 bp, Rattus norvegicus
gacaaccctttaccacattcagaag

SEQ ID NO: 314057 - DNA, 25 bp, Rattus norvegicus
gacaaccctttagcacattcagaag

SEQ ID NO: 314058 - DNA, 25 bp, Rattus norvegicus
gacaaccgatgcagcgcagaaagca

SEQ ID NO: 314059 - DNA, 25 bp, Rattus norvegicus
gacaaccgatgctgcgcagaaagca

SEQ ID NO: 314060 - DNA, 25 bp, Rattus norvegicus
gacaaccgattgcttggtgtactct

SEQ ID NO: 314061 - DNA, 25 bp, Rattus norvegicus
gacaaccgattggttggtgtactct

SEQ ID NO: 314062 - DNA, 25 bp, Rattus norvegicus
gacaaccgcttaacaagactgtgag

SEQ ID NO: 314063 - DNA, 25 bp, Rattus norvegicus
gacaaccgcttatcaagactgtgag

SEQ ID NO: 314064 - DNA, 25 bp, Rattus norvegicus
gacaaccgtcaccagagttggtcat

SEQ ID NO: 314065 - DNA, 25 bp, Rattus norvegicus
gacaaccgtcacgagagttggtcat

SEQ ID NO: 314066 - DNA, 25 bp, Rattus norvegicus
gacaaccgttacatcagttccaatg

SEQ ID NO: 314067 - DNA, 25 bp, Rattus norvegicus
gacaaccgttacttcagttccaatg

SEQ ID NO: 314068 - DNA, 25 bp, Rattus norvegicus
gacaacctcaatattgttcctcagg

SEQ ID NO: 314069 - DNA, 25 bp, Rattus norvegicus
gacaacctcaatcctgaactgtact

SEQ ID NO: 314070 - DNA, 25 bp, Rattus norvegicus
gacaacctcaatgctgaactgtact

SEQ ID NO: 314071 - DNA, 25 bp, Rattus norvegicus
gacaacctcaattttgttcctcagg

SEQ ID NO: 314072 - DNA, 25 bp, Rattus norvegicus
gacaacctcattatctctgacttag

SEQ ID NO: 314073 - DNA, 25 bp, Rattus norvegicus
gacaacctcattttctctgacttag

SEQ ID NO: 314074 - DNA, 25 bp, Rattus norvegicus
gacaacctctgaaaggcttctacac

SEQ ID NO: 314075 - DNA, 25 bp, Rattus norvegicus
gacaacctctgataggcttctacac

SEQ ID NO: 314076 - DNA, 25 bp, Rattus norvegicus
gacaacctgaggcaggtggctctct

SEQ ID NO: 314077 - DNA, 25 bp, Rattus norvegicus
gacaacctgagggaggtggctctct

SEQ ID NO: 314078 - DNA, 25 bp, Rattus norvegicus
gacaacctggctcttgtgatctaaa

SEQ ID NO: 314079 - DNA, 25 bp, Rattus norvegicus
gacaacctggctgttgtgatctaaa

SEQ ID NO: 314080 - DNA, 25 bp, Rattus norvegicus
gacaacctgggcatcatgagacccc

SEQ ID NO: 314081 - DNA, 25 bp, Rattus norvegicus
gacaacctgggcttcatgagacccc

SEQ ID NO: 314082 - DNA, 25 bp, Rattus norvegicus
gacaacctggtgctggacgacttca

SEQ ID NO: 314083 - DNA, 25 bp, Rattus norvegicus
gacaacctggtggtggacgacttca

SEQ ID NO: 314084 - DNA, 25 bp, Rattus norvegicus
gacaacctggttccctggaccgatg

SEQ ID NO: 314085 - DNA, 25 bp, Rattus norvegicus
gacaacctggttgcctggaccgatg

SEQ ID NO: 314086 - DNA, 25 bp, Rattus norvegicus
gacaacctgtacagcaaggccttgg

SEQ ID NO: 314087 - DNA, 25 bp, Rattus norvegicus
gacaacctgtactgcaaggccttgg

SEQ ID NO: 314088 - DNA, 25 bp, Rattus norvegicus
gacaacctgtttcagacgtcctttc

SEQ ID NO: 314089 - DNA, 25 bp, Rattus norvegicus
gacaacctgtttgagacgtcctttc

SEQ ID NO: 314090 - DNA, 25 bp, Rattus norvegicus
gacaaccttgagacagggtgttcgt

SEQ ID NO: 314091 - DNA, 25 bp, Rattus norvegicus
gacaaccttgagtcagggtgttcgt

SEQ ID NO: 314092 - DNA, 25 bp, Rattus norvegicus
gacaaccttgtacgtggtagcctta

SEQ ID NO: 314093 - DNA, 25 bp, Rattus norvegicus
gacaaccttgtaggtggtagcctta

SEQ ID NO: 314094 - DNA, 25 bp, Rattus norvegicus
gacaaccttgtgctgaatctgcagg

SEQ ID NO: 314095 - DNA, 25 bp, Rattus norvegicus
gacaaccttgtggtgaatctgcagg

SEQ ID NO: 314096 - DNA, 25 bp, Rattus norvegicus
gacaacgacactaactgtttccatg

SEQ ID NO: 314097 - DNA, 25 bp, Rattus norvegicus
gacaacgacacttactgtttccatg

SEQ ID NO: 314098 - DNA, 25 bp, Rattus norvegicus
gacaacgacaggcaaatctctcagt

SEQ ID NO: 314099 - DNA, 25 bp, Rattus norvegicus
gacaacgacagggaaatctctcagt

SEQ ID NO: 314100 - DNA, 25 bp, Rattus norvegicus
gacaacgacgatcatgctgaaacct

SEQ ID NO: 314101 - DNA, 25 bp, Rattus norvegicus
gacaacgacgatgatgctgaaacct

SEQ ID NO: 314102 - DNA, 25 bp, Rattus norvegicus
gacaacgatcatcatgatgaccatg

SEQ ID NO: 314103 - DNA, 25 bp, Rattus norvegicus
gacaacgatcatgatgatgaccatg

SEQ ID NO: 314104 - DNA, 25 bp, Rattus norvegicus
gacaacgccctacagatgaacattt

SEQ ID NO: 314105 - DNA, 25 bp, Rattus norvegicus
gacaacgccctagagatgaacattt

SEQ ID NO: 314106 - DNA, 25 bp, Rattus norvegicus
gacaacgccttacttactgtttcta

SEQ ID NO: 314107 - DNA, 25 bp, Rattus norvegicus
gacaacgccttagttactgtttcta

SEQ ID NO: 314108 - DNA, 25 bp, Rattus norvegicus
gacaacgctgctaatgttcacattt

SEQ ID NO: 314109 - DNA, 25 bp, Rattus norvegicus
gacaacgctgcttatgttcacattt

SEQ ID NO: 314110 - DNA, 25 bp, Rattus norvegicus
gacaacggacccatcagatatttca

SEQ ID NO: 314111 - DNA, 25 bp, Rattus norvegicus
gacaacggacccttcagatatttca

SEQ ID NO: 314112 - DNA, 25 bp, Rattus norvegicus
gacaacggagctacgaaaagtacag

SEQ ID NO: 314113 - DNA, 25 bp, Rattus norvegicus
gacaacggagcttcgaaaagtacag

SEQ ID NO: 314114 - DNA, 25 bp, Rattus norvegicus
gacaacggcattcttgggcaagtag

SEQ ID NO: 314115 - DNA, 25 bp, Rattus norvegicus
gacaacggcattgttgggcaagtag

SEQ ID NO: 314116 - DNA, 25 bp, Rattus norvegicus
gacaacggcgttaagaatgggaaag

SEQ ID NO: 314117 - DNA, 25 bp, Rattus norvegicus
gacaacggcgtttagaatgggaaag

SEQ ID NO: 314118 - DNA, 25 bp, Rattus norvegicus
gacaacggtacgacatccaacgaga

SEQ ID NO: 314119 - DNA, 25 bp, Rattus norvegicus
gacaacggtacgtcatccaacgaga

SEQ ID NO: 314120 - DNA, 25 bp, Rattus norvegicus
gacaacggtggtcttcaataaacta

SEQ ID NO: 314121 - DNA, 25 bp, Rattus norvegicus
gacaacggtggtgttcaataaacta

SEQ ID NO: 314122 - DNA, 25 bp, Rattus norvegicus
gacaacggtgtcatttctagcatgt

SEQ ID NO: 314123 - DNA, 25 bp, Rattus norvegicus
gacaacggtgtcttttctagcatgt

SEQ ID NO: 314124 - DNA, 25 bp, Rattus norvegicus
gacaacgtacaaatctctatggtat

SEQ ID NO: 314125 - DNA, 25 bp, Rattus norvegicus
gacaacgtacaattctctatggtat

SEQ ID NO: 314126 - DNA, 25 bp, Rattus norvegicus
gacaacgtacccaggttacatttgt

SEQ ID NO: 314127 - DNA, 25 bp, Rattus norvegicus
gacaacgtaccctggttacatttgt

SEQ ID NO: 314128 - DNA, 25 bp, Rattus norvegicus
gacaacgtccagaactgtggctact

SEQ ID NO: 314129 - DNA, 25 bp, Rattus norvegicus
gacaacgtccagtactgtggctact

SEQ ID NO: 314130 - DNA, 25 bp, Rattus norvegicus
gacaacgtgctaagtaatcattatt

SEQ ID NO: 314131 - DNA, 25 bp, Rattus norvegicus
gacaacgtgctatgtaatcattatt

SEQ ID NO: 314132 - DNA, 25 bp, Rattus norvegicus
gacaactaacacacaaggacttcac

SEQ ID NO: 314133 - DNA, 25 bp, Rattus norvegicus
gacaactaacactcaaggacttcac

SEQ ID NO: 314134 - DNA, 25 bp, Rattus norvegicus
gacaactaacttcttgctgctgtat

SEQ ID NO: 314135 - DNA, 25 bp, Rattus norvegicus
gacaactaacttgttgctgctgtat

SEQ ID NO: 314136 - DNA, 25 bp, Rattus norvegicus
gacaactacactaactttatgcatt

SEQ ID NO: 314137 - DNA, 25 bp, Rattus norvegicus
gacaactacacttactttatgcatt

SEQ ID NO: 314138 - DNA, 25 bp, Rattus norvegicus
gacaactacagtatcacattgaagc

SEQ ID NO: 314139 - DNA, 25 bp, Rattus norvegicus
gacaactacagtttcacattgaagc

SEQ ID NO: 314140 - DNA, 25 bp, Rattus norvegicus
gacaactacatcaaactccttacag

SEQ ID NO: 314141 - DNA, 25 bp, Rattus norvegicus
gacaactacatctaactccttacag

SEQ ID NO: 314142 - DNA, 25 bp, Rattus norvegicus
gacaactagacaactgctcttcatc

SEQ ID NO: 314143 - DNA, 25 bp, Rattus norvegicus
gacaactagacatctgctcttcatc

SEQ ID NO: 314144 - DNA, 25 bp, Rattus norvegicus
gacaactagctaactgtgagacttc

SEQ ID NO: 314145 - DNA, 25 bp, Rattus norvegicus
gacaactagctatctgtgagacttc

SEQ ID NO: 314146 - DNA, 25 bp, Rattus norvegicus
gacaactatcagatgcctcagtctt

SEQ ID NO: 314147 - DNA, 25 bp, Rattus norvegicus
gacaactatcagttgcctcagtctt

SEQ ID NO: 314148 - DNA, 25 bp, Rattus norvegicus
gacaactatggtactcactctgaat

SEQ ID NO: 314149 - DNA, 25 bp, Rattus norvegicus
gacaactatggttctcactctgaat

SEQ ID NO: 314150 - DNA, 25 bp, Rattus norvegicus
gacaactcaactatgcttctgtttt

SEQ ID NO: 314151 - DNA, 25 bp, Rattus norvegicus
gacaactcaactttgcttctgtttt

SEQ ID NO: 314152 - DNA, 25 bp, Rattus norvegicus
gacaactcacagatcagtgcagtgc

SEQ ID NO: 314153 - DNA, 25 bp, Rattus norvegicus
gacaactcacagttcagtgcagtgc

SEQ ID NO: 314154 - DNA, 25 bp, Rattus norvegicus
gacaactcagcccttcggaccattt

SEQ ID NO: 314155 - DNA, 25 bp, Rattus norvegicus
gacaactcagccgttcggaccattt

SEQ ID NO: 314156 - DNA, 25 bp, Rattus norvegicus
gacaactcaggaatctatgacagct

SEQ ID NO: 314157 - DNA, 25 bp, Rattus norvegicus
gacaactcaggattctatgacagct

SEQ ID NO: 314158 - DNA, 25 bp, Rattus norvegicus
gacaactcattccaagctaagcctg

SEQ ID NO: 314159 - DNA, 25 bp, Rattus norvegicus
gacaactcattcgaagctaagcctg

SEQ ID NO: 314160 - DNA, 25 bp, Rattus norvegicus
gacaactccgctacctttttatacg

SEQ ID NO: 314161 - DNA, 25 bp, Rattus norvegicus
gacaactccgcttcctttttatacg

SEQ ID NO: 314162 - DNA, 25 bp, Rattus norvegicus
gacaactccttgagactctactgta

SEQ ID NO: 314163 - DNA, 25 bp, Rattus norvegicus
gacaactccttgtgactctactgta

SEQ ID NO: 314164 - DNA, 25 bp, Rattus norvegicus
gacaactctctcctttacctggttt

SEQ ID NO: 314165 - DNA, 25 bp, Rattus norvegicus
gacaactctctcgtttacctggttt

SEQ ID NO: 314166 - DNA, 25 bp, Rattus norvegicus
gacaactctgagctgtgttactatt

SEQ ID NO: 314167 - DNA, 25 bp, Rattus norvegicus
gacaactctgaggtgtgttactatt

SEQ ID NO: 314168 - DNA, 25 bp, Rattus norvegicus
gacaactctgggaacaagtgcttga

SEQ ID NO: 314169 - DNA, 25 bp, Rattus norvegicus
gacaactctgggtacaagtgcttga

SEQ ID NO: 314170 - DNA, 25 bp, Rattus norvegicus
gacaactctttcatatcttccagtt

SEQ ID NO: 314171 - DNA, 25 bp, Rattus norvegicus
gacaactctttcttatcttccagtt

SEQ ID NO: 314172 - DNA, 25 bp, Rattus norvegicus
gacaactgaatgagctgcctaggat

SEQ ID NO: 314173 - DNA, 25 bp, Rattus norvegicus
gacaactgaatgtgctgcctaggat

SEQ ID NO: 314174 - DNA, 25 bp, Rattus norvegicus
gacaactgaccacattccttagtat

SEQ ID NO: 314175 - DNA, 25 bp, Rattus norvegicus
gacaactgaccactcttcttcagaa

SEQ ID NO: 314176 - DNA, 25 bp, Rattus norvegicus
gacaactgaccagattccttagtat

SEQ ID NO: 314177 - DNA, 25 bp, Rattus norvegicus
gacaactgaccagtcttcttcagaa

SEQ ID NO: 314178 - DNA, 25 bp, Rattus norvegicus
gacaactgagttatagcccctgtta

SEQ ID NO: 314179 - DNA, 25 bp, Rattus norvegicus
gacaactgagttttagcccctgtta

SEQ ID NO: 314180 - DNA, 25 bp, Rattus norvegicus
gacaactgatgaatcgtctgttcct

SEQ ID NO: 314181 - DNA, 25 bp, Rattus norvegicus
gacaactgatgattcgtctgttcct

SEQ ID NO: 314182 - DNA, 25 bp, Rattus norvegicus
gacaactgatgtcaatattctagtt

SEQ ID NO: 314183 - DNA, 25 bp, Rattus norvegicus
gacaactgatgtgaatattctagtt

SEQ ID NO: 314184 - DNA, 25 bp, Rattus norvegicus
gacaactgatttcaaaaacttgttt

SEQ ID NO: 314185 - DNA, 25 bp, Rattus norvegicus
gacaactgatttgaaaaacttgttt

SEQ ID NO: 314186 - DNA, 25 bp, Rattus norvegicus
gacaactggcggcttgttgagctta

SEQ ID NO: 314187 - DNA, 25 bp, Rattus norvegicus
gacaactggcgggttgttgagctta

SEQ ID NO: 314188 - DNA, 25 bp, Rattus norvegicus
gacaactgtccaatgcagactgagt

SEQ ID NO: 314189 - DNA, 25 bp, Rattus norvegicus
gacaactgtccattgcagactgagt

SEQ ID NO: 314190 - DNA, 25 bp, Rattus norvegicus
gacaactgtctgaactctacttcta

SEQ ID NO: 314191 - DNA, 25 bp, Rattus norvegicus
gacaactgtctgctgtggtgcgaac

SEQ ID NO: 314192 - DNA, 25 bp, Rattus norvegicus
gacaactgtctggtgtggtgcgaac

SEQ ID NO: 314193 - DNA, 25 bp, Rattus norvegicus
gacaactgtctgtactctacttcta

SEQ ID NO: 314194 - DNA, 25 bp, Rattus norvegicus
gacaactgtgggatcaagtgcttta

SEQ ID NO: 314195 - DNA, 25 bp, Rattus norvegicus
gacaactgtgggttcaagtgcttta

SEQ ID NO: 314196 - DNA, 25 bp, Rattus norvegicus
gacaactgtggtcaatccgaagtat

SEQ ID NO: 314197 - DNA, 25 bp, Rattus norvegicus
gacaactgtggtgaatccgaagtat

SEQ ID NO: 314198 - DNA, 25 bp, Rattus norvegicus
gacaactgttcaaatctccatcttc

SEQ ID NO: 314199 - DNA, 25 bp, Rattus norvegicus
gacaactgttcatatctccatcttc

SEQ ID NO: 314200 - DNA, 25 bp, Rattus norvegicus
gacaactgtttcattctatgcacat

SEQ ID NO: 314201 - DNA, 25 bp, Rattus norvegicus
gacaactgtttctttctatgcacat

SEQ ID NO: 314202 - DNA, 25 bp, Rattus norvegicus
gacaacttactacctgatatgcaac

SEQ ID NO: 314203 - DNA, 25 bp, Rattus norvegicus
gacaacttactagctgatatgcaac

SEQ ID NO: 314204 - DNA, 25 bp, Rattus norvegicus
gacaacttagaaaatccttggagcc

SEQ ID NO: 314205 - DNA, 25 bp, Rattus norvegicus
gacaacttagaatatccttggagcc

SEQ ID NO: 314206 - DNA, 25 bp, Rattus norvegicus
gacaacttccgcaccagcaataaat

SEQ ID NO: 314207 - DNA, 25 bp, Rattus norvegicus
gacaacttccgctccagcaataaat

SEQ ID NO: 314208 - DNA, 25 bp, Rattus norvegicus
gacaacttccttactttggaagact

SEQ ID NO: 314209 - DNA, 25 bp, Rattus norvegicus
gacaacttcctttctttggaagact

SEQ ID NO: 314210 - DNA, 25 bp, Rattus norvegicus
gacaacttcgtgagacaagaactag

SEQ ID NO: 314211 - DNA, 25 bp, Rattus norvegicus
gacaacttcgtgtgacaagaactag

SEQ ID NO: 314212 - DNA, 25 bp, Rattus norvegicus
gacaacttctgcatggtgggtcttg

SEQ ID NO: 314213 - DNA, 25 bp, Rattus norvegicus
gacaacttctgcttggtgggtcttg

SEQ ID NO: 314214 - DNA, 25 bp, Rattus norvegicus
gacaacttgcatacttttctgtttg

SEQ ID NO: 314215 - DNA, 25 bp, Rattus norvegicus
gacaacttgcattcttttctgtttg

SEQ ID NO: 314216 - DNA, 25 bp, Rattus norvegicus
gacaacttgggtatattctctagct

SEQ ID NO: 314217 - DNA, 25 bp, Rattus norvegicus
gacaacttgggtttattctctagct

SEQ ID NO: 314218 - DNA, 25 bp, Rattus norvegicus
gacaacttgtctattcatgctgaaa

SEQ ID NO: 314219 - DNA, 25 bp, Rattus norvegicus
gacaacttgtcttttcatgctgaaa

SEQ ID NO: 314220 - DNA, 25 bp, Rattus norvegicus
gacaactttaaaacttctgaccacg

SEQ ID NO: 314221 - DNA, 25 bp, Rattus norvegicus
gacaactttaaatcttctgaccacg

SEQ ID NO: 314222 - DNA, 25 bp, Rattus norvegicus
gacaactttatgcaggctttcctga

SEQ ID NO: 314223 - DNA, 25 bp, Rattus norvegicus
gacaactttatggaggctttcctga

SEQ ID NO: 314224 - DNA, 25 bp, Rattus norvegicus
gacaactttattaccccttgatcca

SEQ ID NO: 314225 - DNA, 25 bp, Rattus norvegicus
gacaactttatttccccttgatcca

SEQ ID NO: 314226 - DNA, 25 bp, Rattus norvegicus
gacaactttgctcatgtccaggtct

SEQ ID NO: 314227 - DNA, 25 bp, Rattus norvegicus
gacaactttgctgatgtccaggtct

SEQ ID NO: 314228 - DNA, 25 bp, Rattus norvegicus
gacaactttgtacggtcggttctga

SEQ ID NO: 314229 - DNA, 25 bp, Rattus norvegicus
gacaactttgtagggtcggttctga

SEQ ID NO: 314230 - DNA, 25 bp, Rattus norvegicus
gacaactttgttccctactgagcag

SEQ ID NO: 314231 - DNA, 25 bp, Rattus norvegicus
gacaactttgttgcctactgagcag

SEQ ID NO: 314232 - DNA, 25 bp, Rattus norvegicus
gacaacttttggcaaccgattctct

SEQ ID NO: 314233 - DNA, 25 bp, Rattus norvegicus
gacaacttttgggaaccgattctct

SEQ ID NO: 314234 - DNA, 25 bp, Rattus norvegicus
gacaacttttgtacatgaaggtgga

SEQ ID NO: 314235 - DNA, 25 bp, Rattus norvegicus
gacaacttttgttcatgaaggtgga

SEQ ID NO: 314236 - DNA, 25 bp, Rattus norvegicus
gacaacttttttcatattcattaga

SEQ ID NO: 314237 - DNA, 25 bp, Rattus norvegicus
gacaacttttttgatattcattaga

SEQ ID NO: 314238 - DNA, 25 bp, Rattus norvegicus
gacaagaaatcccagatcctgcttc

SEQ ID NO: 314239 - DNA, 25 bp, Rattus norvegicus
gacaagaaatccgagatcctgcttc

SEQ ID NO: 314240 - DNA, 25 bp, Rattus norvegicus
gacaagaacaaccaactgcacgcag

SEQ ID NO: 314241 - DNA, 25 bp, Rattus norvegicus
gacaagaacaacgaactgcacgcag

SEQ ID NO: 314242 - DNA, 25 bp, Rattus norvegicus
gacaagaacagcctactcgtgctaa

SEQ ID NO: 314243 - DNA, 25 bp, Rattus norvegicus
gacaagaacagcgtactcgtgctaa

SEQ ID NO: 314244 - DNA, 25 bp, Rattus norvegicus
gacaagaacatcacccagttgatat

SEQ ID NO: 314245 - DNA, 25 bp, Rattus norvegicus
gacaagaacatctcccagttgatat

SEQ ID NO: 314246 - DNA, 25 bp, Rattus norvegicus
gacaagaagccaacctgaagcgcta

SEQ ID NO: 314247 - DNA, 25 bp, Rattus norvegicus
gacaagaagccatcctgaagcgcta

SEQ ID NO: 314248 - DNA, 25 bp, Rattus norvegicus
gacaagaaggagagcaccccgtcca

SEQ ID NO: 314249 - DNA, 25 bp, Rattus norvegicus
gacaagaaggagtgcaccccgtcca

SEQ ID NO: 314250 - DNA, 25 bp, Rattus norvegicus
gacaagaagtaaactggtgagccat

SEQ ID NO: 314251 - DNA, 25 bp, Rattus norvegicus
gacaagaagtaatctggtgagccat

SEQ ID NO: 314252 - DNA, 25 bp, Rattus norvegicus
gacaagaagtcgctgctgtgcatcc

SEQ ID NO: 314253 - DNA, 25 bp, Rattus norvegicus
gacaagaagtcggtgctgtgcatcc

SEQ ID NO: 314254 - DNA, 25 bp, Rattus norvegicus
gacaagaatccgcatttgtatttca

SEQ ID NO: 314255 - DNA, 25 bp, Rattus norvegicus
gacaagaatccggatttgtatttca

SEQ ID NO: 314256 - DNA, 25 bp, Rattus norvegicus
gacaagaatgctattatcctcccca

SEQ ID NO: 314257 - DNA, 25 bp, Rattus norvegicus
gacaagaatgcttttatcctcccca

SEQ ID NO: 314258 - DNA, 25 bp, Rattus norvegicus
gacaagaatttgataggtcagcatt

SEQ ID NO: 314259 - DNA, 25 bp, Rattus norvegicus
gacaagaatttgttaggtcagcatt

SEQ ID NO: 314260 - DNA, 25 bp, Rattus norvegicus
gacaagacacccatgtttctggtgg

SEQ ID NO: 314261 - DNA, 25 bp, Rattus norvegicus
gacaagacacccttgtttctggtgg

SEQ ID NO: 314262 - DNA, 25 bp, Rattus norvegicus
gacaagacagtcagtgccagcttcg

SEQ ID NO: 314263 - DNA, 25 bp, Rattus norvegicus
gacaagacagtctgtgccagcttcg

SEQ ID NO: 314264 - DNA, 25 bp, Rattus norvegicus
gacaagaccctgatttaatggacat

SEQ ID NO: 314265 - DNA, 25 bp, Rattus norvegicus
gacaagaccctgttttaatggacat

SEQ ID NO: 314266 - DNA, 25 bp, Rattus norvegicus
gacaagacgtgacggtcctattttt

SEQ ID NO: 314267 - DNA, 25 bp, Rattus norvegicus
gacaagacgtgagggtcctattttt

SEQ ID NO: 314268 - DNA, 25 bp, Rattus norvegicus
gacaagactactctgtttcttctca

SEQ ID NO: 314269 - DNA, 25 bp, Rattus norvegicus
gacaagactactgtgtttcttctca

SEQ ID NO: 314270 - DNA, 25 bp, Rattus norvegicus
gacaagactgttactttgtagccat

SEQ ID NO: 314271 - DNA, 25 bp, Rattus norvegicus
gacaagactgtttctttgtagccat

SEQ ID NO: 314272 - DNA, 25 bp, Rattus norvegicus
gacaagacttctcctttgaggtcac

SEQ ID NO: 314273 - DNA, 25 bp, Rattus norvegicus
gacaagacttctgctttgaggtcac

SEQ ID NO: 314274 - DNA, 25 bp, Rattus norvegicus
gacaagacttttatccatcaggaga

SEQ ID NO: 314275 - DNA, 25 bp, Rattus norvegicus
gacaagacttttttccatcaggaga

SEQ ID NO: 314276 - DNA, 25 bp, Rattus norvegicus
gacaagagacaactggcccaaggct

SEQ ID NO: 314277 - DNA, 25 bp, Rattus norvegicus
gacaagagacaagtggcccaaggct

SEQ ID NO: 314278 - DNA, 25 bp, Rattus norvegicus
gacaagagactgaagtttcaaaaca

SEQ ID NO: 314279 - DNA, 25 bp, Rattus norvegicus
gacaagagactgtagtttcaaaaca

SEQ ID NO: 314280 - DNA, 25 bp, Rattus norvegicus
gacaagagcaggacattaggagaaa

SEQ ID NO: 314281 - DNA, 25 bp, Rattus norvegicus
gacaagagcaggtcattaggagaaa

SEQ ID NO: 314282 - DNA, 25 bp, Rattus norvegicus
gacaagagccagattgctccttgcc

SEQ ID NO: 314283 - DNA, 25 bp, Rattus norvegicus
gacaagagccagtttgctccttgcc

SEQ ID NO: 314284 - DNA, 25 bp, Rattus norvegicus
gacaagaggataagcagatggtttt

SEQ ID NO: 314285 - DNA, 25 bp, Rattus norvegicus
gacaagaggatatgcagatggtttt

SEQ ID NO: 314286 - DNA, 25 bp, Rattus norvegicus
gacaagatacctctcgcatgtccac

SEQ ID NO: 314287 - DNA, 25 bp, Rattus norvegicus
gacaagatacctgtcgcatgtccac

SEQ ID NO: 314288 - DNA, 25 bp, Rattus norvegicus
gacaagatacttataccatggccga

SEQ ID NO: 314289 - DNA, 25 bp, Rattus norvegicus
gacaagatacttttaccatggccga

SEQ ID NO: 314290 - DNA, 25 bp, Rattus norvegicus
gacaagatagatactgttactcagc

SEQ ID NO: 314291 - DNA, 25 bp, Rattus norvegicus
gacaagatagattctgttactcagc

SEQ ID NO: 314292 - DNA, 25 bp, Rattus norvegicus
gacaagatcaaaagtgccacaccag

SEQ ID NO: 314293 - DNA, 25 bp, Rattus norvegicus
gacaagatcaaatgtgccacaccag

SEQ ID NO: 314294 - DNA, 25 bp, Rattus norvegicus
gacaagatccctcttgatacttaga

SEQ ID NO: 314295 - DNA, 25 bp, Rattus norvegicus
gacaagatccctgttgatacttaga

SEQ ID NO: 314296 - DNA, 25 bp, Rattus norvegicus
gacaagatccgccaacaagactttg

SEQ ID NO: 314297 - DNA, 25 bp, Rattus norvegicus
gacaagatccgcgaacaagactttg

SEQ ID NO: 314298 - DNA, 25 bp, Rattus norvegicus
gacaagatgcctcgactgtgtgtgt

SEQ ID NO: 314299 - DNA, 25 bp, Rattus norvegicus
gacaagatgcctggactgtgtgtgt

SEQ ID NO: 314300 - DNA, 25 bp, Rattus norvegicus
gacaagattgtaataacacagacag

SEQ ID NO: 314301 - DNA, 25 bp, Rattus norvegicus
gacaagattgtattaacacagacag

SEQ ID NO: 314302 - DNA, 25 bp, Rattus norvegicus
gacaagatttccagagcacccaaaa

SEQ ID NO: 314303 - DNA, 25 bp, Rattus norvegicus
gacaagatttcctgagcacccaaaa

SEQ ID NO: 314304 - DNA, 25 bp, Rattus norvegicus
gacaagcaaccacttcagaggccct

SEQ ID NO: 314305 - DNA, 25 bp, Rattus norvegicus
gacaagcaaccagttcagaggccct

SEQ ID NO: 314306 - DNA, 25 bp, Rattus norvegicus
gacaagcacaccctgagcaagaagg

SEQ ID NO: 314307 - DNA, 25 bp, Rattus norvegicus
gacaagcacaccgtgagcaagaagg

SEQ ID NO: 314308 - DNA, 25 bp, Rattus norvegicus
gacaagcacagccatttggctacct

SEQ ID NO: 314309 - DNA, 25 bp, Rattus norvegicus
gacaagcacagcgatttggctacct

SEQ ID NO: 314310 - DNA, 25 bp, Rattus norvegicus
gacaagcacccacatcagcgaagtg

SEQ ID NO: 314311 - DNA, 25 bp, Rattus norvegicus
gacaagcacccagatcagcgaagtg

SEQ ID NO: 314312 - DNA, 25 bp, Rattus norvegicus
gacaagcaccgacagtttgccatgg

SEQ ID NO: 314313 - DNA, 25 bp, Rattus norvegicus
gacaagcaccgagagtttgccatgg

SEQ ID NO: 314314 - DNA, 25 bp, Rattus norvegicus
gacaagcactccaagctctttgaag

SEQ ID NO: 314315 - DNA, 25 bp, Rattus norvegicus
gacaagcactcctagctctttgaag

SEQ ID NO: 314316 - DNA, 25 bp, Rattus norvegicus
gacaagcactgccaggtcgctgaaa

SEQ ID NO: 314317 - DNA, 25 bp, Rattus norvegicus
gacaagcactgcgaggtcgctgaaa

SEQ ID NO: 314318 - DNA, 25 bp, Rattus norvegicus
gacaagcacttcaacttcaaccaga

SEQ ID NO: 314319 - DNA, 25 bp, Rattus norvegicus
gacaagcacttctacttcaaccaga

SEQ ID NO: 314320 - DNA, 25 bp, Rattus norvegicus
gacaagcagccccacctgggtttac

SEQ ID NO: 314321 - DNA, 25 bp, Rattus norvegicus
gacaagcagcccgacctgggtttac

SEQ ID NO: 314322 - DNA, 25 bp, Rattus norvegicus
gacaagcaggacactggatccagta

SEQ ID NO: 314323 - DNA, 25 bp, Rattus norvegicus
gacaagcaggactctggatccagta

SEQ ID NO: 314324 - DNA, 25 bp, Rattus norvegicus
gacaagcagttacatctggcagcgt

SEQ ID NO: 314325 - DNA, 25 bp, Rattus norvegicus
gacaagcagttagatctggcagcgt

SEQ ID NO: 314326 - DNA, 25 bp, Rattus norvegicus
gacaagcatcacctagctagctcta

SEQ ID NO: 314327 - DNA, 25 bp, Rattus norvegicus
gacaagcatcacgtagctagctcta

SEQ ID NO: 314328 - DNA, 25 bp, Rattus norvegicus
gacaagcatgccaaagaccctgggc

SEQ ID NO: 314329 - DNA, 25 bp, Rattus norvegicus
gacaagcatgcctaagaccctgggc

SEQ ID NO: 314330 - DNA, 25 bp, Rattus norvegicus
gacaagccaacaccctgcgtaggtg

SEQ ID NO: 314331 - DNA, 25 bp, Rattus norvegicus
gacaagccaacagcctgcgtaggtg

SEQ ID NO: 314332 - DNA, 25 bp, Rattus norvegicus
gacaagccaccaattgtttgactat

SEQ ID NO: 314333 - DNA, 25 bp, Rattus norvegicus
gacaagccaccatttgtttgactat

SEQ ID NO: 314334 - DNA, 25 bp, Rattus norvegicus
gacaagccagtacatcgtcagtttg

SEQ ID NO: 314335 - DNA, 25 bp, Rattus norvegicus
gacaagccagtacatgctgcaggtg

SEQ ID NO: 314336 - DNA, 25 bp, Rattus norvegicus
gacaagccagtagatcgtcagtttg

SEQ ID NO: 314337 - DNA, 25 bp, Rattus norvegicus
gacaagccagtagatgctgcaggtg

SEQ ID NO: 314338 - DNA, 25 bp, Rattus norvegicus
gacaagccatgccatcactaacagt

SEQ ID NO: 314339 - DNA, 25 bp, Rattus norvegicus
gacaagccatgcgatcactaacagt

SEQ ID NO: 314340 - DNA, 25 bp, Rattus norvegicus
gacaagcccctgaatgtttttatag

SEQ ID NO: 314341 - DNA, 25 bp, Rattus norvegicus
gacaagcccctgtatgtttttatag

SEQ ID NO: 314342 - DNA, 25 bp, Rattus norvegicus
gacaagcccggaaagattagactat

SEQ ID NO: 314343 - DNA, 25 bp, Rattus norvegicus
gacaagcccggatagattagactat

SEQ ID NO: 314344 - DNA, 25 bp, Rattus norvegicus
gacaagccctacatcaggttgtcta

SEQ ID NO: 314345 - DNA, 25 bp, Rattus norvegicus
gacaagccctacttcaggttgtcta

SEQ ID NO: 314346 - DNA, 25 bp, Rattus norvegicus
gacaagccctcaaggtttgagacgg

SEQ ID NO: 314347 - DNA, 25 bp, Rattus norvegicus
gacaagccctcatggtttgagacgg

SEQ ID NO: 314348 - DNA, 25 bp, Rattus norvegicus
gacaagcctcagcaaacccaaagat

SEQ ID NO: 314349 - DNA, 25 bp, Rattus norvegicus
gacaagcctcaggaaacccaaagat

SEQ ID NO: 314350 - DNA, 25 bp, Rattus norvegicus
gacaagccttcccactaagaagtga

SEQ ID NO: 314351 - DNA, 25 bp, Rattus norvegicus
gacaagccttccgactaagaagtga

SEQ ID NO: 314352 - DNA, 25 bp, Rattus norvegicus
gacaagctacacaatctaagggacc

SEQ ID NO: 314353 - DNA, 25 bp, Rattus norvegicus
gacaagctacactatctaagggacc

SEQ ID NO: 314354 - DNA, 25 bp, Rattus norvegicus
gacaagctatcacctgatgtttagt

SEQ ID NO: 314355 - DNA, 25 bp, Rattus norvegicus
gacaagctatcagctgatgtttagt

SEQ ID NO: 314356 - DNA, 25 bp, Rattus norvegicus
gacaagctattcatgcggagacagg

SEQ ID NO: 314357 - DNA, 25 bp, Rattus norvegicus
gacaagctattcttgcggagacagg

SEQ ID NO: 314358 - DNA, 25 bp, Rattus norvegicus
gacaagctctttactgtgcactgtg

SEQ ID NO: 314359 - DNA, 25 bp, Rattus norvegicus
gacaagctcttttctgtgcactgtg

SEQ ID NO: 314360 - DNA, 25 bp, Rattus norvegicus
gacaagctgactaccacttaaattc

SEQ ID NO: 314361 - DNA, 25 bp, Rattus norvegicus
gacaagctgacttccacttaaattc

SEQ ID NO: 314362 - DNA, 25 bp, Rattus norvegicus
gacaagctgatcaactggcctcatg

SEQ ID NO: 314363 - DNA, 25 bp, Rattus norvegicus
gacaagctgatctactggcctcatg

SEQ ID NO: 314364 - DNA, 25 bp, Rattus norvegicus
gacaagctgcacataggaggccttt

SEQ ID NO: 314365 - DNA, 25 bp, Rattus norvegicus
gacaagctgcacttaggaggccttt

SEQ ID NO: 314366 - DNA, 25 bp, Rattus norvegicus
gacaagctgcccattgaagagaccc

SEQ ID NO: 314367 - DNA, 25 bp, Rattus norvegicus
gacaagctgccctttgaagagaccc

SEQ ID NO: 314368 - DNA, 25 bp, Rattus norvegicus
gacaagctggagctgagcttctata

SEQ ID NO: 314369 - DNA, 25 bp, Rattus norvegicus
gacaagctggaggtgagcttctata

SEQ ID NO: 314370 - DNA, 25 bp, Rattus norvegicus
gacaagctgggcattggcctagaag

SEQ ID NO: 314371 - DNA, 25 bp, Rattus norvegicus
gacaagctgggctttggcctagaag

SEQ ID NO: 314372 - DNA, 25 bp, Rattus norvegicus
gacaagctgggtagacctctgagaa

SEQ ID NO: 314373 - DNA, 25 bp, Rattus norvegicus
gacaagctgggttgacctctgagaa

SEQ ID NO: 314374 - DNA, 25 bp, Rattus norvegicus
gacaagctgtggaatattttacact

SEQ ID NO: 314375 - DNA, 25 bp, Rattus norvegicus
gacaagctgtggtatattttacact

SEQ ID NO: 314376 - DNA, 25 bp, Rattus norvegicus
gacaagctgtttaggagtccctctg

SEQ ID NO: 314377 - DNA, 25 bp, Rattus norvegicus
gacaagctgtttcccaagtttgggt

SEQ ID NO: 314378 - DNA, 25 bp, Rattus norvegicus
gacaagctgtttctcttggaccagt

SEQ ID NO: 314379 - DNA, 25 bp, Rattus norvegicus
gacaagctgtttgccaagtttgggt

SEQ ID NO: 314380 - DNA, 25 bp, Rattus norvegicus
gacaagctgtttgtcttggaccagt

SEQ ID NO: 314381 - DNA, 25 bp, Rattus norvegicus
gacaagctgttttggagtccctctg

SEQ ID NO: 314382 - DNA, 25 bp, Rattus norvegicus
gacaagcttcacctggatcccgaga

SEQ ID NO: 314383 - DNA, 25 bp, Rattus norvegicus
gacaagcttcacgtggatcccgaga

SEQ ID NO: 314384 - DNA, 25 bp, Rattus norvegicus
gacaagcttcttacttgctacgatt

SEQ ID NO: 314385 - DNA, 25 bp, Rattus norvegicus
gacaagcttctttcttgctacgatt

SEQ ID NO: 314386 - DNA, 25 bp, Rattus norvegicus
gacaagcttgacagtctgatccaaa

SEQ ID NO: 314387 - DNA, 25 bp, Rattus norvegicus
gacaagcttgactgtctgatccaaa

SEQ ID NO: 314388 - DNA, 25 bp, Rattus norvegicus
gacaagcttgagagtagatttccca

SEQ ID NO: 314389 - DNA, 25 bp, Rattus norvegicus
gacaagcttgagtgtagatttccca

SEQ ID NO: 314390 - DNA, 25 bp, Rattus norvegicus
gacaagctttcaactgtgactcact

SEQ ID NO: 314391 - DNA, 25 bp, Rattus norvegicus
gacaagctttcatctgtgactcact

SEQ ID NO: 314392 - DNA, 25 bp, Rattus norvegicus
gacaaggaagcaccgaatccagact

SEQ ID NO: 314393 - DNA, 25 bp, Rattus norvegicus
gacaaggaagcagcgaatccagact

SEQ ID NO: 314394 - DNA, 25 bp, Rattus norvegicus
gacaaggacaaacagacagatagac

SEQ ID NO: 314395 - DNA, 25 bp, Rattus norvegicus
gacaaggacaaagagacagatagac

SEQ ID NO: 314396 - DNA, 25 bp, Rattus norvegicus
gacaaggacagtcctccgggttgca

SEQ ID NO: 314397 - DNA, 25 bp, Rattus norvegicus
gacaaggacagtgctccgggttgca

SEQ ID NO: 314398 - DNA, 25 bp, Rattus norvegicus
gacaaggactgcactggcaatttct

SEQ ID NO: 314399 - DNA, 25 bp, Rattus norvegicus
gacaaggactgctctggcaatttct

SEQ ID NO: 314400 - DNA, 25 bp, Rattus norvegicus
gacaaggacttcatcgaccagagca

SEQ ID NO: 314401 - DNA, 25 bp, Rattus norvegicus
gacaaggacttcttcgaccagagca

SEQ ID NO: 314402 - DNA, 25 bp, Rattus norvegicus
gacaaggagactaacgaacttcgtt

SEQ ID NO: 314403 - DNA, 25 bp, Rattus norvegicus
gacaaggagacttacgaacttcgtt

SEQ ID NO: 314404 - DNA, 25 bp, Rattus norvegicus
gacaaggagccaaagatacaagcat

SEQ ID NO: 314405 - DNA, 25 bp, Rattus norvegicus
gacaaggagccatagatacaagcat

SEQ ID NO: 314406 - DNA, 25 bp, Rattus norvegicus
gacaaggagcccatattcctgactg

SEQ ID NO: 314407 - DNA, 25 bp, Rattus norvegicus
gacaaggagcccttattcctgactg

SEQ ID NO: 314408 - DNA, 25 bp, Rattus norvegicus
gacaaggaggagatgctcttcttct

SEQ ID NO: 314409 - DNA, 25 bp, Rattus norvegicus
gacaaggaggagttgctcttcttct

SEQ ID NO: 314410 - DNA, 25 bp, Rattus norvegicus
gacaaggataacagcttcgccactg

SEQ ID NO: 314411 - DNA, 25 bp, Rattus norvegicus
gacaaggataactgcttcgccactg

SEQ ID NO: 314412 - DNA, 25 bp, Rattus norvegicus
gacaaggatgtcaaacccaaatgaa

SEQ ID NO: 314413 - DNA, 25 bp, Rattus norvegicus
gacaaggatgtctaacccaaatgaa

SEQ ID NO: 314414 - DNA, 25 bp, Rattus norvegicus
gacaaggatgtgactctcagctaca

SEQ ID NO: 314415 - DNA, 25 bp, Rattus norvegicus
gacaaggatgtgtctctcagctaca

SEQ ID NO: 314416 - DNA, 25 bp, Rattus norvegicus
gacaaggattctctagggttctaaa

SEQ ID NO: 314417 - DNA, 25 bp, Rattus norvegicus
gacaaggattctgtagggttctaaa

SEQ ID NO: 314418 - DNA, 25 bp, Rattus norvegicus
gacaaggcacgcacggtcattcaga

SEQ ID NO: 314419 - DNA, 25 bp, Rattus norvegicus
gacaaggcacgctcggtcattcaga

SEQ ID NO: 314420 - DNA, 25 bp, Rattus norvegicus
gacaaggcacttaggcttcctgagc

SEQ ID NO: 314421 - DNA, 25 bp, Rattus norvegicus
gacaaggcactttggcttcctgagc

SEQ ID NO: 314422 - DNA, 25 bp, Rattus norvegicus
gacaaggcagcaattggatctttac

SEQ ID NO: 314423 - DNA, 25 bp, Rattus norvegicus
gacaaggcagcatttggatctttac

SEQ ID NO: 314424 - DNA, 25 bp, Rattus norvegicus
gacaaggcaggtcggagctacccac

SEQ ID NO: 314425 - DNA, 25 bp, Rattus norvegicus
gacaaggcaggtgggagctacccac

SEQ ID NO: 314426 - DNA, 25 bp, Rattus norvegicus
gacaaggccaagaaacccaaagtga

SEQ ID NO: 314427 - DNA, 25 bp, Rattus norvegicus
gacaaggccaagtaacccaaagtga

SEQ ID NO: 314428 - DNA, 25 bp, Rattus norvegicus
gacaaggccaataacctgtcccaag

SEQ ID NO: 314429 - DNA, 25 bp, Rattus norvegicus
gacaaggccaattacctgtcccaag

SEQ ID NO: 314430 - DNA, 25 bp, Rattus norvegicus
gacaaggccacccagtaggaggaat

SEQ ID NO: 314431 - DNA, 25 bp, Rattus norvegicus
gacaaggccaccgagtaggaggaat

SEQ ID NO: 314432 - DNA, 25 bp, Rattus norvegicus
gacaaggccatcaaggtcctcgaaa

SEQ ID NO: 314433 - DNA, 25 bp, Rattus norvegicus
gacaaggccatcctggacattgaga

SEQ ID NO: 314434 - DNA, 25 bp, Rattus norvegicus
gacaaggccatcgtggacattgaga

SEQ ID NO: 314435 - DNA, 25 bp, Rattus norvegicus
gacaaggccatctaggtcctcgaaa

SEQ ID NO: 314436 - DNA, 25 bp, Rattus norvegicus
gacaaggcccgcaagaagctactgg

SEQ ID NO: 314437 - DNA, 25 bp, Rattus norvegicus
gacaaggcccgctagaagctactgg

SEQ ID NO: 314438 - DNA, 25 bp, Rattus norvegicus
gacaaggcccttccaatatgtttac

SEQ ID NO: 314439 - DNA, 25 bp, Rattus norvegicus
gacaaggcccttgcaatatgtttac

SEQ ID NO: 314440 - DNA, 25 bp, Rattus norvegicus
gacaaggcctggacctgagacaaaa

SEQ ID NO: 314441 - DNA, 25 bp, Rattus norvegicus
gacaaggcctggctctaatatgcct

SEQ ID NO: 314442 - DNA, 25 bp, Rattus norvegicus
gacaaggcctgggtctaatatgcct

SEQ ID NO: 314443 - DNA, 25 bp, Rattus norvegicus
gacaaggcctggtcctgagacaaaa

SEQ ID NO: 314444 - DNA, 25 bp, Rattus norvegicus
gacaaggcctttagcagatcacaca

SEQ ID NO: 314445 - DNA, 25 bp, Rattus norvegicus
gacaaggccttttgcagatcacaca

SEQ ID NO: 314446 - DNA, 25 bp, Rattus norvegicus
gacaaggcgagtctccagggactaa

SEQ ID NO: 314447 - DNA, 25 bp, Rattus norvegicus
gacaaggcgagtgtccagggactaa

SEQ ID NO: 314448 - DNA, 25 bp, Rattus norvegicus
gacaaggctgtacttgcttcacagt

SEQ ID NO: 314449 - DNA, 25 bp, Rattus norvegicus
gacaaggctgtagttgcttcacagt

SEQ ID NO: 314450 - DNA, 25 bp, Rattus norvegicus
gacaaggctgtcagtattcttcctg

SEQ ID NO: 314451 - DNA, 25 bp, Rattus norvegicus
gacaaggctgtcattgctcttacag

SEQ ID NO: 314452 - DNA, 25 bp, Rattus norvegicus
gacaaggctgtctgtattcttcctg

SEQ ID NO: 314453 - DNA, 25 bp, Rattus norvegicus
gacaaggctgtctttgctcttacag

SEQ ID NO: 314454 - DNA, 25 bp, Rattus norvegicus
gacaaggctttacgcagacacagga

SEQ ID NO: 314455 - DNA, 25 bp, Rattus norvegicus
gacaaggctttaggcagacacagga

SEQ ID NO: 314456 - DNA, 25 bp, Rattus norvegicus
gacaaggctttcagatactcgggtt

SEQ ID NO: 314457 - DNA, 25 bp, Rattus norvegicus
gacaaggctttctgatactcgggtt

SEQ ID NO: 314458 - DNA, 25 bp, Rattus norvegicus
gacaagggcagacggcttttataca

SEQ ID NO: 314459 - DNA, 25 bp, Rattus norvegicus
gacaagggcagagggcttttataca

SEQ ID NO: 314460 - DNA, 25 bp, Rattus norvegicus
gacaagggccctcagtgtgtccctg

SEQ ID NO: 314461 - DNA, 25 bp, Rattus norvegicus
gacaagggccctgagtgtgtccctg

SEQ ID NO: 314462 - DNA, 25 bp, Rattus norvegicus
gacaagggccttcctgatgatacag

SEQ ID NO: 314463 - DNA, 25 bp, Rattus norvegicus
gacaagggccttgctgatgatacag

SEQ ID NO: 314464 - DNA, 25 bp, Rattus norvegicus
gacaagggcggcatccaaggagcaa

SEQ ID NO: 314465 - DNA, 25 bp, Rattus norvegicus
gacaagggcggcttccaaggagcaa

SEQ ID NO: 314466 - DNA, 25 bp, Rattus norvegicus
gacaagggctatatccgaaggctga

SEQ ID NO: 314467 - DNA, 25 bp, Rattus norvegicus
gacaagggctatttccgaaggctga

SEQ ID NO: 314468 - DNA, 25 bp, Rattus norvegicus
gacaagggctttcccatggagtcat

SEQ ID NO: 314469 - DNA, 25 bp, Rattus norvegicus
gacaagggctttgccatggagtcat

SEQ ID NO: 314470 - DNA, 25 bp, Rattus norvegicus
gacaagggtcttccattggatgaga

SEQ ID NO: 314471 - DNA, 25 bp, Rattus norvegicus
gacaagggtcttgcattggatgaga

SEQ ID NO: 314472 - DNA, 25 bp, Rattus norvegicus
gacaagggtgtcaatttgcagcata

SEQ ID NO: 314473 - DNA, 25 bp, Rattus norvegicus
gacaagggtgtctatttgcagcata

SEQ ID NO: 314474 - DNA, 25 bp, Rattus norvegicus
gacaaggtaacaatacatgggtaaa

SEQ ID NO: 314475 - DNA, 25 bp, Rattus norvegicus
gacaaggtaacattacatgggtaaa

SEQ ID NO: 314476 - DNA, 25 bp, Rattus norvegicus
gacaaggtaggccagtccttcaaaa

SEQ ID NO: 314477 - DNA, 25 bp, Rattus norvegicus
gacaaggtaggcgagtccttcaaaa

SEQ ID NO: 314478 - DNA, 25 bp, Rattus norvegicus
gacaaggtatctcggtcagtagcca

SEQ ID NO: 314479 - DNA, 25 bp, Rattus norvegicus
gacaaggtatctgggtcagtagcca

SEQ ID NO: 314480 - DNA, 25 bp, Rattus norvegicus
gacaaggtcattattctgcagcatg

SEQ ID NO: 314481 - DNA, 25 bp, Rattus norvegicus
gacaaggtcatttttctgcagcatg

SEQ ID NO: 314482 - DNA, 25 bp, Rattus norvegicus
gacaaggtccgactctgtaacccac

SEQ ID NO: 314483 - DNA, 25 bp, Rattus norvegicus
gacaaggtccgagtctgtaacccac

SEQ ID NO: 314484 - DNA, 25 bp, Rattus norvegicus
gacaaggtcttcatttagtcacttt

SEQ ID NO: 314485 - DNA, 25 bp, Rattus norvegicus
gacaaggtcttcttttagtcacttt

SEQ ID NO: 314486 - DNA, 25 bp, Rattus norvegicus
gacaaggtctttcctatgaagaaca

SEQ ID NO: 314487 - DNA, 25 bp, Rattus norvegicus
gacaaggtctttgctatgaagaaca

SEQ ID NO: 314488 - DNA, 25 bp, Rattus norvegicus
gacaaggtgattacttcccgcttaa

SEQ ID NO: 314489 - DNA, 25 bp, Rattus norvegicus
gacaaggtgatttcttcccgcttaa

SEQ ID NO: 314490 - DNA, 25 bp, Rattus norvegicus
gacaaggtgcaaagtttcccattaa

SEQ ID NO: 314491 - DNA, 25 bp, Rattus norvegicus
gacaaggtgcaatgtttcccattaa

SEQ ID NO: 314492 - DNA, 25 bp, Rattus norvegicus
gacaaggtggatcggctcatcatct

SEQ ID NO: 314493 - DNA, 25 bp, Rattus norvegicus
gacaaggtggatgggctcatcatct

SEQ ID NO: 314494 - DNA, 25 bp, Rattus norvegicus
gacaaggtggtcatatctacagaaa

SEQ ID NO: 314495 - DNA, 25 bp, Rattus norvegicus
gacaaggtggtcttatctacagaaa

SEQ ID NO: 314496 - DNA, 25 bp, Rattus norvegicus
gacaaggttaggaaccactgacgac

SEQ ID NO: 314497 - DNA, 25 bp, Rattus norvegicus
gacaaggttaggtaccactgacgac

SEQ ID NO: 314498 - DNA, 25 bp, Rattus norvegicus
gacaaggttgttaccaccagttccg

SEQ ID NO: 314499 - DNA, 25 bp, Rattus norvegicus
gacaaggttgtttccaccagttccg

SEQ ID NO: 314500 - DNA, 25 bp, Rattus norvegicus
gacaaggtttccaaggcacgtggca

SEQ ID NO: 314501 - DNA, 25 bp, Rattus norvegicus
gacaaggtttcctaggcacgtggca

SEQ ID NO: 314502 - DNA, 25 bp, Rattus norvegicus
gacaaggtttgcatttccagcctgt

SEQ ID NO: 314503 - DNA, 25 bp, Rattus norvegicus
gacaaggtttgcttttccagcctgt

SEQ ID NO: 314504 - DNA, 25 bp, Rattus norvegicus
gacaagtaagagagtgatatattca

SEQ ID NO: 314505 - DNA, 25 bp, Rattus norvegicus
gacaagtaagagtgtgatatattca

SEQ ID NO: 314506 - DNA, 25 bp, Rattus norvegicus
gacaagtaagggacagtctattctg

SEQ ID NO: 314507 - DNA, 25 bp, Rattus norvegicus
gacaagtaagggtcagtctattctg

SEQ ID NO: 314508 - DNA, 25 bp, Rattus norvegicus
gacaagtacatcctgattacacact

SEQ ID NO: 314509 - DNA, 25 bp, Rattus norvegicus
gacaagtacatcgtgattacacact

SEQ ID NO: 314510 - DNA, 25 bp, Rattus norvegicus
gacaagtaccctacctgtatgagcc

SEQ ID NO: 314511 - DNA, 25 bp, Rattus norvegicus
gacaagtacccttcctgtatgagcc

SEQ ID NO: 314512 - DNA, 25 bp, Rattus norvegicus
gacaagtacgatccgttcaccgtga

SEQ ID NO: 314513 - DNA, 25 bp, Rattus norvegicus
gacaagtacgatgcgttcaccgtga

SEQ ID NO: 314514 - DNA, 25 bp, Rattus norvegicus
gacaagtatactacatctatcccct

SEQ ID NO: 314515 - DNA, 25 bp, Rattus norvegicus
gacaagtatacttcatctatcccct

SEQ ID NO: 314516 - DNA, 25 bp, Rattus norvegicus
gacaagtatatgacctggccttgag

SEQ ID NO: 314517 - DNA, 25 bp, Rattus norvegicus
gacaagtatatgtcctggccttgag

SEQ ID NO: 314518 - DNA, 25 bp, Rattus norvegicus
gacaagtatcgaaaccagctccagc

SEQ ID NO: 314519 - DNA, 25 bp, Rattus norvegicus
gacaagtatcgataccagctccagc

SEQ ID NO: 314520 - DNA, 25 bp, Rattus norvegicus
gacaagtatgtgaccagtgccccaa

SEQ ID NO: 314521 - DNA, 25 bp, Rattus norvegicus
gacaagtatgtgtccagtgccccaa

SEQ ID NO: 314522 - DNA, 25 bp, Rattus norvegicus
gacaagtattcgctgcttttgccca

SEQ ID NO: 314523 - DNA, 25 bp, Rattus norvegicus
gacaagtattcggtgcttttgccca

SEQ ID NO: 314524 - DNA, 25 bp, Rattus norvegicus
gacaagtcaaatcttggctccctgt

SEQ ID NO: 314525 - DNA, 25 bp, Rattus norvegicus
gacaagtcaaatgttggctccctgt

SEQ ID NO: 314526 - DNA, 25 bp, Rattus norvegicus
gacaagtcaaggagatcatctccaa

SEQ ID NO: 314527 - DNA, 25 bp, Rattus norvegicus
gacaagtcaaggtgatcatctccaa

SEQ ID NO: 314528 - DNA, 25 bp, Rattus norvegicus
gacaagtcaatcaagtcctgcccag

SEQ ID NO: 314529 - DNA, 25 bp, Rattus norvegicus
gacaagtcaatctagtcctgcccag

SEQ ID NO: 314530 - DNA, 25 bp, Rattus norvegicus
gacaagtcaatgagaacctcactga

SEQ ID NO: 314531 - DNA, 25 bp, Rattus norvegicus
gacaagtcaatgtgaacctcactga

SEQ ID NO: 314532 - DNA, 25 bp, Rattus norvegicus
gacaagtcacagattcatcaatttg

SEQ ID NO: 314533 - DNA, 25 bp, Rattus norvegicus
gacaagtcacagtttcatcaatttg

SEQ ID NO: 314534 - DNA, 25 bp, Rattus norvegicus
gacaagtcacatctgcattcatgct

SEQ ID NO: 314535 - DNA, 25 bp, Rattus norvegicus
gacaagtcacatgtgcattcatgct

SEQ ID NO: 314536 - DNA, 25 bp, Rattus norvegicus
gacaagtcacttcaagtctcttaag

SEQ ID NO: 314537 - DNA, 25 bp, Rattus norvegicus
gacaagtcacttgaagtctcttaag

SEQ ID NO: 314538 - DNA, 25 bp, Rattus norvegicus
gacaagtcaggacctgcagtcaagt

SEQ ID NO: 314539 - DNA, 25 bp, Rattus norvegicus
gacaagtcaggagctgcagtcaagt

SEQ ID NO: 314540 - DNA, 25 bp, Rattus norvegicus
gacaagtcatctcttccagtgtata

SEQ ID NO: 314541 - DNA, 25 bp, Rattus norvegicus
gacaagtcatctgttccagtgtata

SEQ ID NO: 314542 - DNA, 25 bp, Rattus norvegicus
gacaagtcattcagccggcgaatca

SEQ ID NO: 314543 - DNA, 25 bp, Rattus norvegicus
gacaagtcattctgccggcgaatca

SEQ ID NO: 314544 - DNA, 25 bp, Rattus norvegicus
gacaagtccacaccctcagaagagt

SEQ ID NO: 314545 - DNA, 25 bp, Rattus norvegicus
gacaagtccacagcctcagaagagt

SEQ ID NO: 314546 - DNA, 25 bp, Rattus norvegicus
gacaagtccctcactgagctggaaa

SEQ ID NO: 314547 - DNA, 25 bp, Rattus norvegicus
gacaagtccctctctgagctggaaa

SEQ ID NO: 314548 - DNA, 25 bp, Rattus norvegicus
gacaagtctagccatatctgcttac

SEQ ID NO: 314549 - DNA, 25 bp, Rattus norvegicus
gacaagtctagcgatatctgcttac

SEQ ID NO: 314550 - DNA, 25 bp, Rattus norvegicus
gacaagtctagtatgttcgtttggg

SEQ ID NO: 314551 - DNA, 25 bp, Rattus norvegicus
gacaagtctagtttgttcgtttggg

SEQ ID NO: 314552 - DNA, 25 bp, Rattus norvegicus
gacaagtctttactatttcaccaga

SEQ ID NO: 314553 - DNA, 25 bp, Rattus norvegicus
gacaagtctttagtatttcaccaga

SEQ ID NO: 314554 - DNA, 25 bp, Rattus norvegicus
gacaagtctttgcttttaatcttac

SEQ ID NO: 314555 - DNA, 25 bp, Rattus norvegicus
gacaagtctttggttttaatcttac

SEQ ID NO: 314556 - DNA, 25 bp, Rattus norvegicus
gacaagtgaaagaggttcatgccga

SEQ ID NO: 314557 - DNA, 25 bp, Rattus norvegicus
gacaagtgaaagtggttcatgccga

SEQ ID NO: 314558 - DNA, 25 bp, Rattus norvegicus
gacaagtgaagaattggttccagaa

SEQ ID NO: 314559 - DNA, 25 bp, Rattus norvegicus
gacaagtgaagatttggttccagaa

SEQ ID NO: 314560 - DNA, 25 bp, Rattus norvegicus
gacaagtgaagtccacctctccaca

SEQ ID NO: 314561 - DNA, 25 bp, Rattus norvegicus
gacaagtgaagtgcacctctccaca

SEQ ID NO: 314562 - DNA, 25 bp, Rattus norvegicus
gacaagtgacatcttggcaccttaa

SEQ ID NO: 314563 - DNA, 25 bp, Rattus norvegicus
gacaagtgacatgttggcaccttaa

SEQ ID NO: 314564 - DNA, 25 bp, Rattus norvegicus
gacaagtgaccgatcttctgggact

SEQ ID NO: 314565 - DNA, 25 bp, Rattus norvegicus
gacaagtgaccgttcttctgggact

SEQ ID NO: 314566 - DNA, 25 bp, Rattus norvegicus
gacaagtgaggcatgatcaggaact

SEQ ID NO: 314567 - DNA, 25 bp, Rattus norvegicus
gacaagtgaggcttgatcaggaact

SEQ ID NO: 314568 - DNA, 25 bp, Rattus norvegicus
gacaagtgcaccaggcatttttcag

SEQ ID NO: 314569 - DNA, 25 bp, Rattus norvegicus
gacaagtgcacctggcatttttcag

SEQ ID NO: 314570 - DNA, 25 bp, Rattus norvegicus
gacaagtgccaaatccagtgtgaat

SEQ ID NO: 314571 - DNA, 25 bp, Rattus norvegicus
gacaagtgccaacaatgccaccaat

SEQ ID NO: 314572 - DNA, 25 bp, Rattus norvegicus
gacaagtgccaagaatgccaccaat

SEQ ID NO: 314573 - DNA, 25 bp, Rattus norvegicus
gacaagtgccaattccagtgtgaat

SEQ ID NO: 314574 - DNA, 25 bp, Rattus norvegicus
gacaagtgcgtgatttattttcatc

SEQ ID NO: 314575 - DNA, 25 bp, Rattus norvegicus
gacaagtgcgtgttttattttcatc

SEQ ID NO: 314576 - DNA, 25 bp, Rattus norvegicus
gacaagtggcgaacagagtcccctg

SEQ ID NO: 314577 - DNA, 25 bp, Rattus norvegicus
gacaagtggcgatcagagtcccctg

SEQ ID NO: 314578 - DNA, 25 bp, Rattus norvegicus
gacaagtggctaacctccaggacag

SEQ ID NO: 314579 - DNA, 25 bp, Rattus norvegicus
gacaagtggctatcctccaggacag

SEQ ID NO: 314580 - DNA, 25 bp, Rattus norvegicus
gacaagtgtgcaatgacccgaaatt

SEQ ID NO: 314581 - DNA, 25 bp, Rattus norvegicus
gacaagtgtgcattgacccgaaatt

SEQ ID NO: 314582 - DNA, 25 bp, Rattus norvegicus
gacaagtgttggactcctgagctta

SEQ ID NO: 314583 - DNA, 25 bp, Rattus norvegicus
gacaagtgttggtctcctgagctta

SEQ ID NO: 314584 - DNA, 25 bp, Rattus norvegicus
gacaagttcaatcgccagcactgga

SEQ ID NO: 314585 - DNA, 25 bp, Rattus norvegicus
gacaagttcaatggccagcactgga

SEQ ID NO: 314586 - DNA, 25 bp, Rattus norvegicus
gacaagttcagaagatccatagcta

SEQ ID NO: 314587 - DNA, 25 bp, Rattus norvegicus
gacaagttcagatgatccatagcta

SEQ ID NO: 314588 - DNA, 25 bp, Rattus norvegicus
gacaagttcccacgagagctcactg

SEQ ID NO: 314589 - DNA, 25 bp, Rattus norvegicus
gacaagttcccaggagagctcactg

SEQ ID NO: 314590 - DNA, 25 bp, Rattus norvegicus
gacaagttcgagacagcactctctt

SEQ ID NO: 314591 - DNA, 25 bp, Rattus norvegicus
gacaagttcgagtcagcactctctt

SEQ ID NO: 314592 - DNA, 25 bp, Rattus norvegicus
gacaagttcgtaacttttcctgatg

SEQ ID NO: 314593 - DNA, 25 bp, Rattus norvegicus
gacaagttcgtatcttttcctgatg

SEQ ID NO: 314594 - DNA, 25 bp, Rattus norvegicus
gacaagttctcacctagtgtgcatg

SEQ ID NO: 314595 - DNA, 25 bp, Rattus norvegicus
gacaagttctcacctgggacaaaca

SEQ ID NO: 314596 - DNA, 25 bp, Rattus norvegicus
gacaagttctcagctagtgtgcatg

SEQ ID NO: 314597 - DNA, 25 bp, Rattus norvegicus
gacaagttctcagctgggacaaaca

SEQ ID NO: 314598 - DNA, 25 bp, Rattus norvegicus
gacaagttctccaagtgtggtgtga

SEQ ID NO: 314599 - DNA, 25 bp, Rattus norvegicus
gacaagttctcctagtgtggtgtga

SEQ ID NO: 314600 - DNA, 25 bp, Rattus norvegicus
gacaagttctgactggcggactcta

SEQ ID NO: 314601 - DNA, 25 bp, Rattus norvegicus
gacaagttctgagtggcggactcta

SEQ ID NO: 314602 - DNA, 25 bp, Rattus norvegicus
gacaagttctgtccaagtcttttct

SEQ ID NO: 314603 - DNA, 25 bp, Rattus norvegicus
gacaagttctgtgcaagtcttttct

SEQ ID NO: 314604 - DNA, 25 bp, Rattus norvegicus
gacaagttctttagatccagctgtg

SEQ ID NO: 314605 - DNA, 25 bp, Rattus norvegicus
gacaagttcttttgatccagctgtg

SEQ ID NO: 314606 - DNA, 25 bp, Rattus norvegicus
gacaagttgaaaagctggtaaccaa

SEQ ID NO: 314607 - DNA, 25 bp, Rattus norvegicus
gacaagttgaaatgctggtaaccaa

SEQ ID NO: 314608 - DNA, 25 bp, Rattus norvegicus
gacaagttgagaatgaggccctgaa

SEQ ID NO: 314609 - DNA, 25 bp, Rattus norvegicus
gacaagttgagattgaggccctgaa

SEQ ID NO: 314610 - DNA, 25 bp, Rattus norvegicus
gacaagttgatgcatagccccacgg

SEQ ID NO: 314611 - DNA, 25 bp, Rattus norvegicus
gacaagttgatggatagccccacgg

SEQ ID NO: 314612 - DNA, 25 bp, Rattus norvegicus
gacaagttgcctagaatacctgtaa

SEQ ID NO: 314613 - DNA, 25 bp, Rattus norvegicus
gacaagttgccttgaatacctgtaa

SEQ ID NO: 314614 - DNA, 25 bp, Rattus norvegicus
gacaagttgctcaagtaacccaaag

SEQ ID NO: 314615 - DNA, 25 bp, Rattus norvegicus
gacaagttgctctagtaacccaaag

SEQ ID NO: 314616 - DNA, 25 bp, Rattus norvegicus
gacaagttggagctttgtaaccgaa

SEQ ID NO: 314617 - DNA, 25 bp, Rattus norvegicus
gacaagttggaggtttgtaaccgaa

SEQ ID NO: 314618 - DNA, 25 bp, Rattus norvegicus
gacaagttgtagactcctttaccca

SEQ ID NO: 314619 - DNA, 25 bp, Rattus norvegicus
gacaagttgtagtctcctttaccca

SEQ ID NO: 314620 - DNA, 25 bp, Rattus norvegicus
gacaagttgtcccaaagagcattta

SEQ ID NO: 314621 - DNA, 25 bp, Rattus norvegicus
gacaagttgtccgaaagagcattta

SEQ ID NO: 314622 - DNA, 25 bp, Rattus norvegicus
gacaagtttctgactgacgcctaat

SEQ ID NO: 314623 - DNA, 25 bp, Rattus norvegicus
gacaagtttctgtctgacgcctaat

SEQ ID NO: 314624 - DNA, 25 bp, Rattus norvegicus
gacaagtttgagatttgtagtaaca

SEQ ID NO: 314625 - DNA, 25 bp, Rattus norvegicus
gacaagtttgagttttgtagtaaca

SEQ ID NO: 314626 - DNA, 25 bp, Rattus norvegicus
gacaataaaaataccatctactctt

SEQ ID NO: 314627 - DNA, 25 bp, Rattus norvegicus
gacaataaaaattccatctactctt

SEQ ID NO: 314628 - DNA, 25 bp, Rattus norvegicus
gacaataaatacacacctacctcgc

SEQ ID NO: 314629 - DNA, 25 bp, Rattus norvegicus
gacaataaatactcacctacctcgc

SEQ ID NO: 314630 - DNA, 25 bp, Rattus norvegicus
gacaataactttatactcctagcca

SEQ ID NO: 314631 - DNA, 25 bp, Rattus norvegicus
gacaataactttttactcctagcca

SEQ ID NO: 314632 - DNA, 25 bp, Rattus norvegicus
gacaatacgtgtaacctcccttcct

SEQ ID NO: 314633 - DNA, 25 bp, Rattus norvegicus
gacaatacgtgttacctcccttcct

SEQ ID NO: 314634 - DNA, 25 bp, Rattus norvegicus
gacaatataccaccttttgccgcag

SEQ ID NO: 314635 - DNA, 25 bp, Rattus norvegicus
gacaatataccagcttttgccgcag

SEQ ID NO: 314636 - DNA, 25 bp, Rattus norvegicus
gacaatatcaccatcacgagcgtaa

SEQ ID NO: 314637 - DNA, 25 bp, Rattus norvegicus
gacaatatcaccttcacgagcgtaa

SEQ ID NO: 314638 - DNA, 25 bp, Rattus norvegicus
gacaatatggcaaccagccctaaag

SEQ ID NO: 314639 - DNA, 25 bp, Rattus norvegicus
gacaatatggcatccagccctaaag

SEQ ID NO: 314640 - DNA, 25 bp, Rattus norvegicus
gacaatattaccaacatgacttcaa

SEQ ID NO: 314641 - DNA, 25 bp, Rattus norvegicus
gacaatattacctacatgacttcaa

SEQ ID NO: 314642 - DNA, 25 bp, Rattus norvegicus
gacaatatttctaacccaaaccagg

SEQ ID NO: 314643 - DNA, 25 bp, Rattus norvegicus
gacaatatttcttacccaaaccagg

SEQ ID NO: 314644 - DNA, 25 bp, Rattus norvegicus
gacaatatttgcatggtcttctccc

SEQ ID NO: 314645 - DNA, 25 bp, Rattus norvegicus
gacaatatttgcttggtcttctccc

SEQ ID NO: 314646 - DNA, 25 bp, Rattus norvegicus
gacaatattttacttagccaccatg

SEQ ID NO: 314647 - DNA, 25 bp, Rattus norvegicus
gacaatattttagttagccaccatg

SEQ ID NO: 314648 - DNA, 25 bp, Rattus norvegicus
gacaatcaactgacctttgaggagt

SEQ ID NO: 314649 - DNA, 25 bp, Rattus norvegicus
gacaatcaactgtcctttgaggagt

SEQ ID NO: 314650 - DNA, 25 bp, Rattus norvegicus
gacaatcaagtgaggcccaatgctg

SEQ ID NO: 314651 - DNA, 25 bp, Rattus norvegicus
gacaatcaagtgtggcccaatgctg

SEQ ID NO: 314652 - DNA, 25 bp, Rattus norvegicus
gacaatcactgtatgccttttagaa

SEQ ID NO: 314653 - DNA, 25 bp, Rattus norvegicus
gacaatcactgtttgccttttagaa

SEQ ID NO: 314654 - DNA, 25 bp, Rattus norvegicus
gacaatcagatgcaggagcgcaaac

SEQ ID NO: 314655 - DNA, 25 bp, Rattus norvegicus
gacaatcagatggaggagcgcaaac

SEQ ID NO: 314656 - DNA, 25 bp, Rattus norvegicus
gacaatcagccgcaaatctgtggac

SEQ ID NO: 314657 - DNA, 25 bp, Rattus norvegicus
gacaatcagccggaaatctgtggac

SEQ ID NO: 314658 - DNA, 25 bp, Rattus norvegicus
gacaatcataggagcagagacaact

SEQ ID NO: 314659 - DNA, 25 bp, Rattus norvegicus
gacaatcataggtgcagagacaact

SEQ ID NO: 314660 - DNA, 25 bp, Rattus norvegicus
gacaatcattttaactcagcccaag

SEQ ID NO: 314661 - DNA, 25 bp, Rattus norvegicus
gacaatcatttttactcagcccaag

SEQ ID NO: 314662 - DNA, 25 bp, Rattus norvegicus
gacaatccaagtacagtgtcccctt

SEQ ID NO: 314663 - DNA, 25 bp, Rattus norvegicus
gacaatccaagttcagtgtcccctt

SEQ ID NO: 314664 - DNA, 25 bp, Rattus norvegicus
gacaatccattcaattctaagaacc

SEQ ID NO: 314665 - DNA, 25 bp, Rattus norvegicus
gacaatccattctattctaagaacc

SEQ ID NO: 314666 - DNA, 25 bp, Rattus norvegicus
gacaatcctaaaaatgcttcagctc

SEQ ID NO: 314667 - DNA, 25 bp, Rattus norvegicus
gacaatcctaaatatgcttcagctc

SEQ ID NO: 314668 - DNA, 25 bp, Rattus norvegicus
gacaatcctcttattattcagggct

SEQ ID NO: 314669 - DNA, 25 bp, Rattus norvegicus
gacaatcctctttttattcagggct

SEQ ID NO: 314670 - DNA, 25 bp, Rattus norvegicus
gacaatcgcctgaggccaatcggaa

SEQ ID NO: 314671 - DNA, 25 bp, Rattus norvegicus
gacaatcgcctgtggccaatcggaa

SEQ ID NO: 314672 - DNA, 25 bp, Rattus norvegicus
gacaatcgctttcactggtgttctt

SEQ ID NO: 314673 - DNA, 25 bp, Rattus norvegicus
gacaatcgctttgactggtgttctt

SEQ ID NO: 314674 - DNA, 25 bp, Rattus norvegicus
gacaatctcagccacatgttcggaa

SEQ ID NO: 314675 - DNA, 25 bp, Rattus norvegicus
gacaatctcagcgacatgttcggaa

SEQ ID NO: 314676 - DNA, 25 bp, Rattus norvegicus
gacaatctctagcacaatgacttca

SEQ ID NO: 314677 - DNA, 25 bp, Rattus norvegicus
gacaatctctaggacaatgacttca

SEQ ID NO: 314678 - DNA, 25 bp, Rattus norvegicus
gacaatctcttgagcattctgtgga

SEQ ID NO: 314679 - DNA, 25 bp, Rattus norvegicus
gacaatctcttgtgcattctgtgga

SEQ ID NO: 314680 - DNA, 25 bp, Rattus norvegicus
gacaatctgagtatggtctcccgga

SEQ ID NO: 314681 - DNA, 25 bp, Rattus norvegicus
gacaatctgagtctagttattaaca

SEQ ID NO: 314682 - DNA, 25 bp, Rattus norvegicus
gacaatctgagtgtagttattaaca

SEQ ID NO: 314683 - DNA, 25 bp, Rattus norvegicus
gacaatctgagtttggtctcccgga

SEQ ID NO: 314684 - DNA, 25 bp, Rattus norvegicus
gacaatctggaaatcctgccagcac

SEQ ID NO: 314685 - DNA, 25 bp, Rattus norvegicus
gacaatctggaattcctgccagcac

SEQ ID NO: 314686 - DNA, 25 bp, Rattus norvegicus
gacaatctgtctctgccttatggaa

SEQ ID NO: 314687 - DNA, 25 bp, Rattus norvegicus
gacaatctgtctgtgccttatggaa

SEQ ID NO: 314688 - DNA, 25 bp, Rattus norvegicus
gacaatgacaggcagctctccaagg

SEQ ID NO: 314689 - DNA, 25 bp, Rattus norvegicus
gacaatgacagggagctctccaagg

SEQ ID NO: 314690 - DNA, 25 bp, Rattus norvegicus
gacaatgacagtccacagtgtactt

SEQ ID NO: 314691 - DNA, 25 bp, Rattus norvegicus
gacaatgacagtgcacagtgtactt

SEQ ID NO: 314692 - DNA, 25 bp, Rattus norvegicus
gacaatgaccccactcatggttagt

SEQ ID NO: 314693 - DNA, 25 bp, Rattus norvegicus
gacaatgacccctctcatggttagt

SEQ ID NO: 314694 - DNA, 25 bp, Rattus norvegicus
gacaatgacgatcacctctatggct

SEQ ID NO: 314695 - DNA, 25 bp, Rattus norvegicus
gacaatgacgatgacctctatggct

SEQ ID NO: 314696 - DNA, 25 bp, Rattus norvegicus
gacaatgagatcattcttttggcct

SEQ ID NO: 314697 - DNA, 25 bp, Rattus norvegicus
gacaatgagatctttcttttggcct

SEQ ID NO: 314698 - DNA, 25 bp, Rattus norvegicus
gacaatgaggaacaccatggtgata

SEQ ID NO: 314699 - DNA, 25 bp, Rattus norvegicus
gacaatgaggaagaccatggtgata

SEQ ID NO: 314700 - DNA, 25 bp, Rattus norvegicus
gacaatgaggcactgcatcgctgga

SEQ ID NO: 314701 - DNA, 25 bp, Rattus norvegicus
gacaatgaggcagtgcatcgctgga

SEQ ID NO: 314702 - DNA, 25 bp, Rattus norvegicus
gacaatgatcagctgaactctgagg

SEQ ID NO: 314703 - DNA, 25 bp, Rattus norvegicus
gacaatgatcaggtgaactctgagg

SEQ ID NO: 314704 - DNA, 25 bp, Rattus norvegicus
gacaatgatggcaattctaaacgct

SEQ ID NO: 314705 - DNA, 25 bp, Rattus norvegicus
gacaatgatggctattctaaacgct

SEQ ID NO: 314706 - DNA, 25 bp, Rattus norvegicus
gacaatgattccagctggaacgcca

SEQ ID NO: 314707 - DNA, 25 bp, Rattus norvegicus
gacaatgattcctgctggaacgcca

SEQ ID NO: 314708 - DNA, 25 bp, Rattus norvegicus
gacaatgcacttaccttccaggaaa

SEQ ID NO: 314709 - DNA, 25 bp, Rattus norvegicus
gacaatgcactttccttccaggaaa

SEQ ID NO: 314710 - DNA, 25 bp, Rattus norvegicus
gacaatgcagagaccttggccgagg

SEQ ID NO: 314711 - DNA, 25 bp, Rattus norvegicus
gacaatgcagagtccttggccgagg

SEQ ID NO: 314712 - DNA, 25 bp, Rattus norvegicus
gacaatgccaacagtgtacatccct

SEQ ID NO: 314713 - DNA, 25 bp, Rattus norvegicus
gacaatgccaactgtgtacatccct

SEQ ID NO: 314714 - DNA, 25 bp, Rattus norvegicus
gacaatgccacgaaagtgttgccca

SEQ ID NO: 314715 - DNA, 25 bp, Rattus norvegicus
gacaatgccacgtaagtgttgccca

SEQ ID NO: 314716 - DNA, 25 bp, Rattus norvegicus
gacaatgccatgaacccaactgatt

SEQ ID NO: 314717 - DNA, 25 bp, Rattus norvegicus
gacaatgccatgtacccaactgatt

SEQ ID NO: 314718 - DNA, 25 bp, Rattus norvegicus
gacaatgccgtaacacttcctttaa

SEQ ID NO: 314719 - DNA, 25 bp, Rattus norvegicus
gacaatgccgtatcacttcctttaa

SEQ ID NO: 314720 - DNA, 25 bp, Rattus norvegicus
gacaatgcctctatggttatgctga

SEQ ID NO: 314721 - DNA, 25 bp, Rattus norvegicus
gacaatgcctctttggttatgctga

SEQ ID NO: 314722 - DNA, 25 bp, Rattus norvegicus
gacaatgctgaacaccctacagaac

SEQ ID NO: 314723 - DNA, 25 bp, Rattus norvegicus
gacaatgctgaagaccctacagaac

SEQ ID NO: 314724 - DNA, 25 bp, Rattus norvegicus
gacaatgctgacatcccatgaagtg

SEQ ID NO: 314725 - DNA, 25 bp, Rattus norvegicus
gacaatgctgacttcccatgaagtg

SEQ ID NO: 314726 - DNA, 25 bp, Rattus norvegicus
gacaatgctgagcaagccccgtaag

SEQ ID NO: 314727 - DNA, 25 bp, Rattus norvegicus
gacaatgctgaggaagccccgtaag

SEQ ID NO: 314728 - DNA, 25 bp, Rattus norvegicus
gacaatgcttctcgatcactacaaa

SEQ ID NO: 314729 - DNA, 25 bp, Rattus norvegicus
gacaatgcttctggatcactacaaa

SEQ ID NO: 314730 - DNA, 25 bp, Rattus norvegicus
gacaatgctttgacagggctctggg

SEQ ID NO: 314731 - DNA, 25 bp, Rattus norvegicus
gacaatgctttgtcagggctctggg

SEQ ID NO: 314732 - DNA, 25 bp, Rattus norvegicus
gacaatggagtcatcgtagatctgg

SEQ ID NO: 314733 - DNA, 25 bp, Rattus norvegicus
gacaatggagtcttcgtagatctgg

SEQ ID NO: 314734 - DNA, 25 bp, Rattus norvegicus
gacaatggagttaagccctcccaga

SEQ ID NO: 314735 - DNA, 25 bp, Rattus norvegicus
gacaatggagtttagccctcccaga

SEQ ID NO: 314736 - DNA, 25 bp, Rattus norvegicus
gacaatggatctatctatgttttga

SEQ ID NO: 314737 - DNA, 25 bp, Rattus norvegicus
gacaatggatctttctatgttttga

SEQ ID NO: 314738 - DNA, 25 bp, Rattus norvegicus
gacaatggatggatgctcaaagcat

SEQ ID NO: 314739 - DNA, 25 bp, Rattus norvegicus
gacaatggatggttgctcaaagcat

SEQ ID NO: 314740 - DNA, 25 bp, Rattus norvegicus
gacaatggcaagactcctcacaaga

SEQ ID NO: 314741 - DNA, 25 bp, Rattus norvegicus
gacaatggcaagtctcctcacaaga

SEQ ID NO: 314742 - DNA, 25 bp, Rattus norvegicus
gacaatggcaatcggtttctcagac

SEQ ID NO: 314743 - DNA, 25 bp, Rattus norvegicus
gacaatggcaatgggtttctcagac

SEQ ID NO: 314744 - DNA, 25 bp, Rattus norvegicus
gacaatggcgacatcactggaacat

SEQ ID NO: 314745 - DNA, 25 bp, Rattus norvegicus
gacaatggcgacttcactggaacat

SEQ ID NO: 314746 - DNA, 25 bp, Rattus norvegicus
gacaatggcgtcaaccctcagaagg

SEQ ID NO: 314747 - DNA, 25 bp, Rattus norvegicus
gacaatggcgtctaccctcagaagg

SEQ ID NO: 314748 - DNA, 25 bp, Rattus norvegicus
gacaatggctgaccgcaacctggac

SEQ ID NO: 314749 - DNA, 25 bp, Rattus norvegicus
gacaatggctgagcgcaacctggac

SEQ ID NO: 314750 - DNA, 25 bp, Rattus norvegicus
gacaatgggtgtctggatgacatca

SEQ ID NO: 314751 - DNA, 25 bp, Rattus norvegicus
gacaatgggtgtgtggatgacatca

SEQ ID NO: 314752 - DNA, 25 bp, Rattus norvegicus
gacaatggtcacatacattcaaatg

SEQ ID NO: 314753 - DNA, 25 bp, Rattus norvegicus
gacaatggtcacttacattcaaatg

SEQ ID NO: 314754 - DNA, 25 bp, Rattus norvegicus
gacaatggtgacacatgctgactgc

SEQ ID NO: 314755 - DNA, 25 bp, Rattus norvegicus
gacaatggtgactcatgctgactgc

SEQ ID NO: 314756 - DNA, 25 bp, Rattus norvegicus
gacaatggtgatacttcctataaac

SEQ ID NO: 314757 - DNA, 25 bp, Rattus norvegicus
gacaatggtgattcttcctataaac

SEQ ID NO: 314758 - DNA, 25 bp, Rattus norvegicus
gacaatggtggccatgtcctcctga

SEQ ID NO: 314759 - DNA, 25 bp, Rattus norvegicus
gacaatggtggcgatgtcctcctga

SEQ ID NO: 314760 - DNA, 25 bp, Rattus norvegicus
gacaatggtggtagacatcccgaaa

SEQ ID NO: 314761 - DNA, 25 bp, Rattus norvegicus
gacaatggtggttgacatcccgaaa

SEQ ID NO: 314762 - DNA, 25 bp, Rattus norvegicus
gacaatggttttaggacttgcatcc

SEQ ID NO: 314763 - DNA, 25 bp, Rattus norvegicus
gacaatggtttttggacttgcatcc

SEQ ID NO: 314764 - DNA, 25 bp, Rattus norvegicus
gacaatgtaaaaacccctctgctcc

SEQ ID NO: 314765 - DNA, 25 bp, Rattus norvegicus
gacaatgtaaaatcccctctgctcc

SEQ ID NO: 314766 - DNA, 25 bp, Rattus norvegicus
gacaatgtagaacacgacttctcca

SEQ ID NO: 314767 - DNA, 25 bp, Rattus norvegicus
gacaatgtagaagacgacttctcca

SEQ ID NO: 314768 - DNA, 25 bp, Rattus norvegicus
gacaatgtatagatcctcctggcat

SEQ ID NO: 314769 - DNA, 25 bp, Rattus norvegicus
gacaatgtatagttcctcctggcat

SEQ ID NO: 314770 - DNA, 25 bp, Rattus norvegicus
gacaatgtcaacaacagcgacctga

SEQ ID NO: 314771 - DNA, 25 bp, Rattus norvegicus
gacaatgtcaactacagcgacctga

SEQ ID NO: 314772 - DNA, 25 bp, Rattus norvegicus
gacaatgtcataatctactctgttc

SEQ ID NO: 314773 - DNA, 25 bp, Rattus norvegicus
gacaatgtcatattctactctgttc

SEQ ID NO: 314774 - DNA, 25 bp, Rattus norvegicus
gacaatgtcgcacctttgatggaga

SEQ ID NO: 314775 - DNA, 25 bp, Rattus norvegicus
gacaatgtcgcagctttgatggaga

SEQ ID NO: 314776 - DNA, 25 bp, Rattus norvegicus
gacaatgtctacataacctctatcc

SEQ ID NO: 314777 - DNA, 25 bp, Rattus norvegicus
gacaatgtctacttaacctctatcc

SEQ ID NO: 314778 - DNA, 25 bp, Rattus norvegicus
gacaatgtgaggacttagccaggca

SEQ ID NO: 314779 - DNA, 25 bp, Rattus norvegicus
gacaatgtgaggtcttagccaggca

SEQ ID NO: 314780 - DNA, 25 bp, Rattus norvegicus
gacaatgtgtaaaactcccagggta

SEQ ID NO: 314781 - DNA, 25 bp, Rattus norvegicus
gacaatgtgtaatactcccagggta

SEQ ID NO: 314782 - DNA, 25 bp, Rattus norvegicus
gacaatgtgtggctgctaacttagg

SEQ ID NO: 314783 - DNA, 25 bp, Rattus norvegicus
gacaatgtgtgggtgctaacttagg

SEQ ID NO: 314784 - DNA, 25 bp, Rattus norvegicus
gacaatgttacaaatgctcaatcgc

SEQ ID NO: 314785 - DNA, 25 bp, Rattus norvegicus
gacaatgttacatatgctcaatcgc

SEQ ID NO: 314786 - DNA, 25 bp, Rattus norvegicus
gacaatgttcaaccagacacccatt

SEQ ID NO: 314787 - DNA, 25 bp, Rattus norvegicus
gacaatgttcaagcagacacccatt

SEQ ID NO: 314788 - DNA, 25 bp, Rattus norvegicus
gacaatgtttaaactaccatctggg

SEQ ID NO: 314789 - DNA, 25 bp, Rattus norvegicus
gacaatgtttaatctaccatctggg

SEQ ID NO: 314790 - DNA, 25 bp, Rattus norvegicus
gacaatgttttgaccagcaggcctc

SEQ ID NO: 314791 - DNA, 25 bp, Rattus norvegicus
gacaatgttttgtccagcaggcctc

SEQ ID NO: 314792 - DNA, 25 bp, Rattus norvegicus
gacaattatcacagttcctcagaag

SEQ ID NO: 314793 - DNA, 25 bp, Rattus norvegicus
gacaattatcactgttcctcagaag

SEQ ID NO: 314794 - DNA, 25 bp, Rattus norvegicus
gacaattatgtacaccacgcctgca

SEQ ID NO: 314795 - DNA, 25 bp, Rattus norvegicus
gacaattatgtagaccacgcctgca

SEQ ID NO: 314796 - DNA, 25 bp, Rattus norvegicus
gacaattcaattaaagtatcccttc

SEQ ID NO: 314797 - DNA, 25 bp, Rattus norvegicus
gacaattcaatttaagtatcccttc

SEQ ID NO: 314798 - DNA, 25 bp, Rattus norvegicus
gacaattcacatccttgtgtgcgca

SEQ ID NO: 314799 - DNA, 25 bp, Rattus norvegicus
gacaattcacatgcttgtgtgcgca

SEQ ID NO: 314800 - DNA, 25 bp, Rattus norvegicus
gacaattcatatatcttagcaaagg

SEQ ID NO: 314801 - DNA, 25 bp, Rattus norvegicus
gacaattcatatttcttagcaaagg

SEQ ID NO: 314802 - DNA, 25 bp, Rattus norvegicus
gacaattcattgcagcattagcctg

SEQ ID NO: 314803 - DNA, 25 bp, Rattus norvegicus
gacaattcattggagcattagcctg

SEQ ID NO: 314804 - DNA, 25 bp, Rattus norvegicus
gacaattcccttcagttgtatgaat

SEQ ID NO: 314805 - DNA, 25 bp, Rattus norvegicus
gacaattcccttgagttgtatgaat

SEQ ID NO: 314806 - DNA, 25 bp, Rattus norvegicus
gacaattccttccatgccaagcgag

SEQ ID NO: 314807 - DNA, 25 bp, Rattus norvegicus
gacaattccttcgatgccaagcgag

SEQ ID NO: 314808 - DNA, 25 bp, Rattus norvegicus
gacaattcgcttaattttctatgct

SEQ ID NO: 314809 - DNA, 25 bp, Rattus norvegicus
gacaattcgctttattttctatgct

SEQ ID NO: 314810 - DNA, 25 bp, Rattus norvegicus
gacaattgcccactggataccaaca

SEQ ID NO: 314811 - DNA, 25 bp, Rattus norvegicus
gacaattgcccagtggataccaaca

SEQ ID NO: 314812 - DNA, 25 bp, Rattus norvegicus
gacaattggccgctgcaactgcatc

SEQ ID NO: 314813 - DNA, 25 bp, Rattus norvegicus
gacaattggccggtgcaactgcatc

SEQ ID NO: 314814 - DNA, 25 bp, Rattus norvegicus
gacaattgtcagaggtggccgtttt

SEQ ID NO: 314815 - DNA, 25 bp, Rattus norvegicus
gacaattgtcagtggtggccgtttt

SEQ ID NO: 314816 - DNA, 25 bp, Rattus norvegicus
gacaattgtccaccaccacttagag

SEQ ID NO: 314817 - DNA, 25 bp, Rattus norvegicus
gacaattgtccagcaccacttagag

SEQ ID NO: 314818 - DNA, 25 bp, Rattus norvegicus
gacaattgttttctgacctcacatg

SEQ ID NO: 314819 - DNA, 25 bp, Rattus norvegicus
gacaattgttttgtgacctcacatg

SEQ ID NO: 314820 - DNA, 25 bp, Rattus norvegicus
gacaatttccttctaacaaatgatg

SEQ ID NO: 314821 - DNA, 25 bp, Rattus norvegicus
gacaatttccttgtaacaaatgatg

SEQ ID NO: 314822 - DNA, 25 bp, Rattus norvegicus
gacaatttctcaaaacactgggcac

SEQ ID NO: 314823 - DNA, 25 bp, Rattus norvegicus
gacaatttctcataacactgggcac

SEQ ID NO: 314824 - DNA, 25 bp, Rattus norvegicus
gacaatttcttgctgttggtacttg

SEQ ID NO: 314825 - DNA, 25 bp, Rattus norvegicus
gacaatttcttggtgttggtacttg

SEQ ID NO: 314826 - DNA, 25 bp, Rattus norvegicus
gacaatttgagtaccatccctgtaa

SEQ ID NO: 314827 - DNA, 25 bp, Rattus norvegicus
gacaatttgagttccatccctgtaa

SEQ ID NO: 314828 - DNA, 25 bp, Rattus norvegicus
gacaatttgccaagggccccggagc

SEQ ID NO: 314829 - DNA, 25 bp, Rattus norvegicus
gacaatttgccatgggccccggagc

SEQ ID NO: 314830 - DNA, 25 bp, Rattus norvegicus
gacaatttgctgacctaaaatacca

SEQ ID NO: 314831 - DNA, 25 bp, Rattus norvegicus
gacaatttgctgtcctaaaatacca

SEQ ID NO: 314832 - DNA, 25 bp, Rattus norvegicus
gacaatttgtcacccagagcctgga

SEQ ID NO: 314833 - DNA, 25 bp, Rattus norvegicus
gacaatttgtcagccagagcctgga

SEQ ID NO: 314834 - DNA, 25 bp, Rattus norvegicus
gacaatttgttcaaggtcatgcaac

SEQ ID NO: 314835 - DNA, 25 bp, Rattus norvegicus
gacaatttgttctaggtcatgcaac

SEQ ID NO: 314836 - DNA, 25 bp, Rattus norvegicus
gacaatttgtttcggagtctgcaat

SEQ ID NO: 314837 - DNA, 25 bp, Rattus norvegicus
gacaatttgtttgggagtctgcaat

SEQ ID NO: 314838 - DNA, 25 bp, Rattus norvegicus
gacaattttataagcctcactggtg

SEQ ID NO: 314839 - DNA, 25 bp, Rattus norvegicus
gacaattttatatgcctcactggtg

SEQ ID NO: 314840 - DNA, 25 bp, Rattus norvegicus
gacaattttccactctatttcgtga

SEQ ID NO: 314841 - DNA, 25 bp, Rattus norvegicus
gacaattttccagtctatttcgtga

SEQ ID NO: 314842 - DNA, 25 bp, Rattus norvegicus
gacacaaaagagcacgtacagcatg

SEQ ID NO: 314843 - DNA, 25 bp, Rattus norvegicus
gacacaaaagaggacgtacagcatg

SEQ ID NO: 314844 - DNA, 25 bp, Rattus norvegicus
gacacaaaagcccaattccttgaga

SEQ ID NO: 314845 - DNA, 25 bp, Rattus norvegicus
gacacaaaagccgaattccttgaga

SEQ ID NO: 314846 - DNA, 25 bp, Rattus norvegicus
gacacaaaatttcacactctttacc

SEQ ID NO: 314847 - DNA, 25 bp, Rattus norvegicus
gacacaaaatttgacactctttacc

SEQ ID NO: 314848 - DNA, 25 bp, Rattus norvegicus
gacacaaacaacacttttggcttta

SEQ ID NO: 314849 - DNA, 25 bp, Rattus norvegicus
gacacaaacaactcttttggcttta

SEQ ID NO: 314850 - DNA, 25 bp, Rattus norvegicus
gacacaaacactatcccaggttcca

SEQ ID NO: 314851 - DNA, 25 bp, Rattus norvegicus
gacacaaacactttcccaggttcca

SEQ ID NO: 314852 - DNA, 25 bp, Rattus norvegicus
gacacaaacggacgagttgcctcct

SEQ ID NO: 314853 - DNA, 25 bp, Rattus norvegicus
gacacaaacggaggagttgcctcct

SEQ ID NO: 314854 - DNA, 25 bp, Rattus norvegicus
gacacaaacgtcatccagaaccatg

SEQ ID NO: 314855 - DNA, 25 bp, Rattus norvegicus
gacacaaacgtcttccagaaccatg

SEQ ID NO: 314856 - DNA, 25 bp, Rattus norvegicus
gacacaaactgtagggtgttcccag

SEQ ID NO: 314857 - DNA, 25 bp, Rattus norvegicus
gacacaaactgttgggtgttcccag

SEQ ID NO: 314858 - DNA, 25 bp, Rattus norvegicus
gacacaaaggcacgctctcagaggt

SEQ ID NO: 314859 - DNA, 25 bp, Rattus norvegicus
gacacaaaggcaggctctcagaggt

SEQ ID NO: 314860 - DNA, 25 bp, Rattus norvegicus
gacacaacactacctactgcagatg

SEQ ID NO: 314861 - DNA, 25 bp, Rattus norvegicus
gacacaacactagctactgcagatg

SEQ ID NO: 314862 - DNA, 25 bp, Rattus norvegicus
gacacaaccccgagaggagcagtac

SEQ ID NO: 314863 - DNA, 25 bp, Rattus norvegicus
gacacaaccccgtgaggagcagtac

SEQ ID NO: 314864 - DNA, 25 bp, Rattus norvegicus
gacacaacccttaggagttgctctg

SEQ ID NO: 314865 - DNA, 25 bp, Rattus norvegicus
gacacaaccctttggagttgctctg

SEQ ID NO: 314866 - DNA, 25 bp, Rattus norvegicus
gacacaacctttcagtcatttcatt

SEQ ID NO: 314867 - DNA, 25 bp, Rattus norvegicus
gacacaacctttgagtcatttcatt

SEQ ID NO: 314868 - DNA, 25 bp, Rattus norvegicus
gacacaactagaattccctgacttt

SEQ ID NO: 314869 - DNA, 25 bp, Rattus norvegicus
gacacaactagatttccctgacttt

SEQ ID NO: 314870 - DNA, 25 bp, Rattus norvegicus
gacacaactgggacagggacctgaa

SEQ ID NO: 314871 - DNA, 25 bp, Rattus norvegicus
gacacaactgggtcagggacctgaa

SEQ ID NO: 314872 - DNA, 25 bp, Rattus norvegicus
gacacaactgtcattggcttcgtat

SEQ ID NO: 314873 - DNA, 25 bp, Rattus norvegicus
gacacaactgtctttggcttcgtat

SEQ ID NO: 314874 - DNA, 25 bp, Rattus norvegicus
gacacaacttccatattatacccat

SEQ ID NO: 314875 - DNA, 25 bp, Rattus norvegicus
gacacaacttccttattatacccat

SEQ ID NO: 314876 - DNA, 25 bp, Rattus norvegicus
gacacaagatgacaagtctgcatgg

SEQ ID NO: 314877 - DNA, 25 bp, Rattus norvegicus
gacacaagatgagaagtctgcatgg

SEQ ID NO: 314878 - DNA, 25 bp, Rattus norvegicus
gacacaagcaagcaccctcattagt

SEQ ID NO: 314879 - DNA, 25 bp, Rattus norvegicus
gacacaagcaaggaccctcattagt

SEQ ID NO: 314880 - DNA, 25 bp, Rattus norvegicus
gacacaagcgctcagtgtgttccac

SEQ ID NO: 314881 - DNA, 25 bp, Rattus norvegicus
gacacaagcgctgagtgtgttccac

SEQ ID NO: 314882 - DNA, 25 bp, Rattus norvegicus
gacacaagctccctgagagttccag

SEQ ID NO: 314883 - DNA, 25 bp, Rattus norvegicus
gacacaagctccgtgagagttccag

SEQ ID NO: 314884 - DNA, 25 bp, Rattus norvegicus
gacacaagctctattgacaaccctg

SEQ ID NO: 314885 - DNA, 25 bp, Rattus norvegicus
gacacaagctcttttgacaaccctg

SEQ ID NO: 314886 - DNA, 25 bp, Rattus norvegicus
gacacaaggacacgtttgatcccac

SEQ ID NO: 314887 - DNA, 25 bp, Rattus norvegicus
gacacaaggacaggtttgatcccac

SEQ ID NO: 314888 - DNA, 25 bp, Rattus norvegicus
gacacaaggagtcggcttcatgcat

SEQ ID NO: 314889 - DNA, 25 bp, Rattus norvegicus
gacacaaggagtgggcttcatgcat

SEQ ID NO: 314890 - DNA, 25 bp, Rattus norvegicus
gacacaaggttacaaattcacctct

SEQ ID NO: 314891 - DNA, 25 bp, Rattus norvegicus
gacacaaggttagaaattcacctct

SEQ ID NO: 314892 - DNA, 25 bp, Rattus norvegicus
gacacaaggtttcagttaacgttcg

SEQ ID NO: 314893 - DNA, 25 bp, Rattus norvegicus
gacacaaggtttgagttaacgttcg

SEQ ID NO: 314894 - DNA, 25 bp, Rattus norvegicus
gacacaagttcacttctcagtgccc

SEQ ID NO: 314895 - DNA, 25 bp, Rattus norvegicus
gacacaagttcagttctcagtgccc

SEQ ID NO: 314896 - DNA, 25 bp, Rattus norvegicus
gacacaatacccatggcagtttgcc

SEQ ID NO: 314897 - DNA, 25 bp, Rattus norvegicus
gacacaatacccttggcagtttgcc

SEQ ID NO: 314898 - DNA, 25 bp, Rattus norvegicus
gacacaatccagcagtctaaccact

SEQ ID NO: 314899 - DNA, 25 bp, Rattus norvegicus
gacacaatccaggagtctaaccact

SEQ ID NO: 314900 - DNA, 25 bp, Rattus norvegicus
gacacaatctccatagtgacaatgt

SEQ ID NO: 314901 - DNA, 25 bp, Rattus norvegicus
gacacaatctccttagtgacaatgt

SEQ ID NO: 314902 - DNA, 25 bp, Rattus norvegicus
gacacaatgcagaccaaggtcccag

SEQ ID NO: 314903 - DNA, 25 bp, Rattus norvegicus
gacacaatgcagtccaaggtcccag

SEQ ID NO: 314904 - DNA, 25 bp, Rattus norvegicus
gacacaattctccatgtaagatgtt

SEQ ID NO: 314905 - DNA, 25 bp, Rattus norvegicus
gacacaattctcgatgtaagatgtt

SEQ ID NO: 314906 - DNA, 25 bp, Rattus norvegicus
gacacaattcttcagatggctttga

SEQ ID NO: 314907 - DNA, 25 bp, Rattus norvegicus
gacacaattcttgagatggctttga

SEQ ID NO: 314908 - DNA, 25 bp, Rattus norvegicus
gacacaatttgtagagaccccggca

SEQ ID NO: 314909 - DNA, 25 bp, Rattus norvegicus
gacacaatttgttgagaccccggca

SEQ ID NO: 314910 - DNA, 25 bp, Rattus norvegicus
gacacacaaaggcagccattatttt

SEQ ID NO: 314911 - DNA, 25 bp, Rattus norvegicus
gacacacaaagggagccattatttt

SEQ ID NO: 314912 - DNA, 25 bp, Rattus norvegicus
gacacacaaggtacatgctctgagt

SEQ ID NO: 314913 - DNA, 25 bp, Rattus norvegicus
gacacacaaggttcatgctctgagt

SEQ ID NO: 314914 - DNA, 25 bp, Rattus norvegicus
gacacacaatctctgtagctccaca

SEQ ID NO: 314915 - DNA, 25 bp, Rattus norvegicus
gacacacaatctgtgtagctccaca

SEQ ID NO: 314916 - DNA, 25 bp, Rattus norvegicus
gacacacacagtagaaaccccatca

SEQ ID NO: 314917 - DNA, 25 bp, Rattus norvegicus
gacacacacagttgaaaccccatca

SEQ ID NO: 314918 - DNA, 25 bp, Rattus norvegicus
gacacacacgtaaaagcagcaccct

SEQ ID NO: 314919 - DNA, 25 bp, Rattus norvegicus
gacacacacgtataagcagcaccct

SEQ ID NO: 314920 - DNA, 25 bp, Rattus norvegicus
gacacacacttacatctccaatgag

SEQ ID NO: 314921 - DNA, 25 bp, Rattus norvegicus
gacacacacttagatctccaatgag

SEQ ID NO: 314922 - DNA, 25 bp, Rattus norvegicus
gacacacacttgctcgctgtcagca

SEQ ID NO: 314923 - DNA, 25 bp, Rattus norvegicus
gacacacacttggtcgctgtcagca

SEQ ID NO: 314924 - DNA, 25 bp, Rattus norvegicus
gacacacaggagcatagcccaggcg

SEQ ID NO: 314925 - DNA, 25 bp, Rattus norvegicus
gacacacaggaggatagcccaggcg

SEQ ID NO: 314926 - DNA, 25 bp, Rattus norvegicus
gacacacaggccactcgatgtttaa

SEQ ID NO: 314927 - DNA, 25 bp, Rattus norvegicus
gacacacaggcctctcgatgtttaa

SEQ ID NO: 314928 - DNA, 25 bp, Rattus norvegicus
gacacacaggcgcaagaggccatac

SEQ ID NO: 314929 - DNA, 25 bp, Rattus norvegicus
gacacacaggcggaagaggccatac

SEQ ID NO: 314930 - DNA, 25 bp, Rattus norvegicus
gacacacaggttaccgacagggagt

SEQ ID NO: 314931 - DNA, 25 bp, Rattus norvegicus
gacacacaggtttccgacagggagt

SEQ ID NO: 314932 - DNA, 25 bp, Rattus norvegicus
gacacacagtttcgttgagtttttc

SEQ ID NO: 314933 - DNA, 25 bp, Rattus norvegicus
gacacacagtttggttgagtttttc

SEQ ID NO: 314934 - DNA, 25 bp, Rattus norvegicus
gacacacatccacaagttgtatttg

SEQ ID NO: 314935 - DNA, 25 bp, Rattus norvegicus
gacacacatccagaagttgtatttg

SEQ ID NO: 314936 - DNA, 25 bp, Rattus norvegicus
gacacacatgctatgggatctgggc

SEQ ID NO: 314937 - DNA, 25 bp, Rattus norvegicus
gacacacatgctttgggatctgggc

SEQ ID NO: 314938 - DNA, 25 bp, Rattus norvegicus
gacacacatgttaagcttcagctct

SEQ ID NO: 314939 - DNA, 25 bp, Rattus norvegicus
gacacacatgtttagcttcagctct

SEQ ID NO: 314940 - DNA, 25 bp, Rattus norvegicus
gacacacattcacaacagttaaagt

SEQ ID NO: 314941 - DNA, 25 bp, Rattus norvegicus
gacacacattcagaacagttaaagt

SEQ ID NO: 314942 - DNA, 25 bp, Rattus norvegicus
gacacacattctacagggctgtagg

SEQ ID NO: 314943 - DNA, 25 bp, Rattus norvegicus
gacacacattcttcagggctgtagg

SEQ ID NO: 314944 - DNA, 25 bp, Rattus norvegicus
gacacaccaagtatattctttaatc

SEQ ID NO: 314945 - DNA, 25 bp, Rattus norvegicus
gacacaccaagtttattctttaatc

SEQ ID NO: 314946 - DNA, 25 bp, Rattus norvegicus
gacacaccaatcactgagatggctg

SEQ ID NO: 314947 - DNA, 25 bp, Rattus norvegicus
gacacaccaatctctgagatggctg

SEQ ID NO: 314948 - DNA, 25 bp, Rattus norvegicus
gacacaccactgaaagcttttctgt

SEQ ID NO: 314949 - DNA, 25 bp, Rattus norvegicus
gacacaccactgtaagcttttctgt

SEQ ID NO: 314950 - DNA, 25 bp, Rattus norvegicus
gacacaccaggtacactcagtgcta

SEQ ID NO: 314951 - DNA, 25 bp, Rattus norvegicus
gacacaccaggttcactcagtgcta

SEQ ID NO: 314952 - DNA, 25 bp, Rattus norvegicus
gacacacccagtcagcaaacgtgga

SEQ ID NO: 314953 - DNA, 25 bp, Rattus norvegicus
gacacacccagtgagcaaacgtgga

SEQ ID NO: 314954 - DNA, 25 bp, Rattus norvegicus
gacacacccataaaccaaatctgat

SEQ ID NO: 314955 - DNA, 25 bp, Rattus norvegicus
gacacacccatataccaaatctgat

SEQ ID NO: 314956 - DNA, 25 bp, Rattus norvegicus
gacacaccctttacaatcttcctta

SEQ ID NO: 314957 - DNA, 25 bp, Rattus norvegicus
gacacacccttttcaatcttcctta

SEQ ID NO: 314958 - DNA, 25 bp, Rattus norvegicus
gacacaccgagaaaaggctccctga

SEQ ID NO: 314959 - DNA, 25 bp, Rattus norvegicus
gacacaccgagataaggctccctga

SEQ ID NO: 314960 - DNA, 25 bp, Rattus norvegicus
gacacaccggccagggtgcagactg

SEQ ID NO: 314961 - DNA, 25 bp, Rattus norvegicus
gacacaccggcctgggtgcagactg

SEQ ID NO: 314962 - DNA, 25 bp, Rattus norvegicus
gacacacctatgaagtcaggagcat

SEQ ID NO: 314963 - DNA, 25 bp, Rattus norvegicus
gacacacctatgtagtcaggagcat

SEQ ID NO: 314964 - DNA, 25 bp, Rattus norvegicus
gacacacctggtcacctataggata

SEQ ID NO: 314965 - DNA, 25 bp, Rattus norvegicus
gacacacctggtgacctataggata

SEQ ID NO: 314966 - DNA, 25 bp, Rattus norvegicus
gacacacctgtgactctgtgcgaac

SEQ ID NO: 314967 - DNA, 25 bp, Rattus norvegicus
gacacacctgtgtctctgtgcgaac

SEQ ID NO: 314968 - DNA, 25 bp, Rattus norvegicus
gacacaccttctactggagacttag

SEQ ID NO: 314969 - DNA, 25 bp, Rattus norvegicus
gacacaccttcttctggagacttag

SEQ ID NO: 314970 - DNA, 25 bp, Rattus norvegicus
gacacaccttgaagacactgcggag

SEQ ID NO: 314971 - DNA, 25 bp, Rattus norvegicus
gacacaccttgatgacactgcggag

SEQ ID NO: 314972 - DNA, 25 bp, Rattus norvegicus
gacacacgttgtatgggcatatgag

SEQ ID NO: 314973 - DNA, 25 bp, Rattus norvegicus
gacacacgttgtttgggcatatgag

SEQ ID NO: 314974 - DNA, 25 bp, Rattus norvegicus
gacacactacacattggctatcttt

SEQ ID NO: 314975 - DNA, 25 bp, Rattus norvegicus
gacacactacactttggctatcttt

SEQ ID NO: 314976 - DNA, 25 bp, Rattus norvegicus
gacacactagtaacatccacagaat

SEQ ID NO: 314977 - DNA, 25 bp, Rattus norvegicus
gacacactagtatcatccacagaat

SEQ ID NO: 314978 - DNA, 25 bp, Rattus norvegicus
gacacactccacatacgtattgaac

SEQ ID NO: 314979 - DNA, 25 bp, Rattus norvegicus
gacacactccacttacgtattgaac

SEQ ID NO: 314980 - DNA, 25 bp, Rattus norvegicus
gacacactccagcatgttcctgtgt

SEQ ID NO: 314981 - DNA, 25 bp, Rattus norvegicus
gacacactccaggatgttcctgtgt

SEQ ID NO: 314982 - DNA, 25 bp, Rattus norvegicus
gacacactcctcaataccttgaatt

SEQ ID NO: 314983 - DNA, 25 bp, Rattus norvegicus
gacacactcctctataccttgaatt

SEQ ID NO: 314984 - DNA, 25 bp, Rattus norvegicus
gacacactgaagcactccaggacct

SEQ ID NO: 314985 - DNA, 25 bp, Rattus norvegicus
gacacactgaaggactccaggacct

SEQ ID NO: 314986 - DNA, 25 bp, Rattus norvegicus
gacacactgcccctcaaaaagagac

SEQ ID NO: 314987 - DNA, 25 bp, Rattus norvegicus
gacacactgcccgtcaaaaagagac

SEQ ID NO: 314988 - DNA, 25 bp, Rattus norvegicus
gacacactgcctaaagtctggcttg

SEQ ID NO: 314989 - DNA, 25 bp, Rattus norvegicus
gacacactgcctcaaggtcatgctt

SEQ ID NO: 314990 - DNA, 25 bp, Rattus norvegicus
gacacactgcctgaaggtcatgctt

SEQ ID NO: 314991 - DNA, 25 bp, Rattus norvegicus
gacacactgccttaagtctggcttg

SEQ ID NO: 314992 - DNA, 25 bp, Rattus norvegicus
gacacactggaccttggataagtat

SEQ ID NO: 314993 - DNA, 25 bp, Rattus norvegicus
gacacactggacgttggataagtat

SEQ ID NO: 314994 - DNA, 25 bp, Rattus norvegicus
gacacactggatccactgtagtcct

SEQ ID NO: 314995 - DNA, 25 bp, Rattus norvegicus
gacacactggatgcactgtagtcct

SEQ ID NO: 314996 - DNA, 25 bp, Rattus norvegicus
gacacactggccagctagagaaaca

SEQ ID NO: 314997 - DNA, 25 bp, Rattus norvegicus
gacacactggcctgctagagaaaca

SEQ ID NO: 314998 - DNA, 25 bp, Rattus norvegicus
gacacactgggcacactttggaaag

SEQ ID NO: 314999 - DNA, 25 bp, Rattus norvegicus
gacacactgggctcactttggaaag

SEQ ID NO: 315000 - DNA, 25 bp, Rattus norvegicus
gacacactggttagtgctatagcta

SEQ ID NO: 315001 - DNA, 25 bp, Rattus norvegicus
gacacactggtttgtgctatagcta

SEQ ID NO: 315002 - DNA, 25 bp, Rattus norvegicus
gacacactgtacaaagccaggcttt

SEQ ID NO: 315003 - DNA, 25 bp, Rattus norvegicus
gacacactgtactaagccaggcttt

SEQ ID NO: 315004 - DNA, 25 bp, Rattus norvegicus
gacacactgtctcggcctggcgatg

SEQ ID NO: 315005 - DNA, 25 bp, Rattus norvegicus
gacacactgtctgggcctggcgatg

SEQ ID NO: 315006 - DNA, 25 bp, Rattus norvegicus
gacacacttactcatttggttgcac

SEQ ID NO: 315007 - DNA, 25 bp, Rattus norvegicus
gacacacttactgatttggttgcac

SEQ ID NO: 315008 - DNA, 25 bp, Rattus norvegicus
gacacacttagcatcagacgacctt

SEQ ID NO: 315009 - DNA, 25 bp, Rattus norvegicus
gacacacttagcttcagacgacctt

SEQ ID NO: 315010 - DNA, 25 bp, Rattus norvegicus
gacacacttcagagttcttctcatt

SEQ ID NO: 315011 - DNA, 25 bp, Rattus norvegicus
gacacacttcagtgttcttctcatt

SEQ ID NO: 315012 - DNA, 25 bp, Rattus norvegicus
gacacacttgctagaccaaacttat

SEQ ID NO: 315013 - DNA, 25 bp, Rattus norvegicus
gacacacttgcttgaccaaacttat

SEQ ID NO: 315014 - DNA, 25 bp, Rattus norvegicus
gacacactttgacaggttgcgcaac

SEQ ID NO: 315015 - DNA, 25 bp, Rattus norvegicus
gacacactttgagaggttgcgcaac

SEQ ID NO: 315016 - DNA, 25 bp, Rattus norvegicus
gacacacttttgagtaccttccaga

SEQ ID NO: 315017 - DNA, 25 bp, Rattus norvegicus
gacacacttttgtgtaccttccaga

SEQ ID NO: 315018 - DNA, 25 bp, Rattus norvegicus
gacacagaagagaccacgagaccct

SEQ ID NO: 315019 - DNA, 25 bp, Rattus norvegicus
gacacagaagagatgattccccact

SEQ ID NO: 315020 - DNA, 25 bp, Rattus norvegicus
gacacagaagagtccacgagaccct

SEQ ID NO: 315021 - DNA, 25 bp, Rattus norvegicus
gacacagaagagttgattccccact

SEQ ID NO: 315022 - DNA, 25 bp, Rattus norvegicus
gacacagaagatcctgccaagttca

SEQ ID NO: 315023 - DNA, 25 bp, Rattus norvegicus
gacacagaagatgctgccaagttca

SEQ ID NO: 315024 - DNA, 25 bp, Rattus norvegicus
gacacagaagctattacatctcgga

SEQ ID NO: 315025 - DNA, 25 bp, Rattus norvegicus
gacacagaagcttttacatctcgga

SEQ ID NO: 315026 - DNA, 25 bp, Rattus norvegicus
gacacagaatagatccatcaccttt

SEQ ID NO: 315027 - DNA, 25 bp, Rattus norvegicus
gacacagaatagttccatcaccttt

SEQ ID NO: 315028 - DNA, 25 bp, Rattus norvegicus
gacacagaatatcttgcctgcacca

SEQ ID NO: 315029 - DNA, 25 bp, Rattus norvegicus
gacacagaatatgttgcctgcacca

SEQ ID NO: 315030 - DNA, 25 bp, Rattus norvegicus
gacacagacaacacaggtcccagtg

SEQ ID NO: 315031 - DNA, 25 bp, Rattus norvegicus
gacacagacaactcaggtcccagtg

SEQ ID NO: 315032 - DNA, 25 bp, Rattus norvegicus
gacacagacacgagtcctggcagag

SEQ ID NO: 315033 - DNA, 25 bp, Rattus norvegicus
gacacagacacgtgtcctggcagag

SEQ ID NO: 315034 - DNA, 25 bp, Rattus norvegicus
gacacagacatcaggctgaatgcca

SEQ ID NO: 315035 - DNA, 25 bp, Rattus norvegicus
gacacagacatctggctgaatgcca

SEQ ID NO: 315036 - DNA, 25 bp, Rattus norvegicus
gacacagacctcaacttgctgcgat

SEQ ID NO: 315037 - DNA, 25 bp, Rattus norvegicus
gacacagacctcatgacaacattgt

SEQ ID NO: 315038 - DNA, 25 bp, Rattus norvegicus
gacacagacctctacttgctgcgat

SEQ ID NO: 315039 - DNA, 25 bp, Rattus norvegicus
gacacagacctcttgacaacattgt

SEQ ID NO: 315040 - DNA, 25 bp, Rattus norvegicus
gacacagacgaacaaggaatggcct

SEQ ID NO: 315041 - DNA, 25 bp, Rattus norvegicus
gacacagacgaagaaggaatggcct

SEQ ID NO: 315042 - DNA, 25 bp, Rattus norvegicus
gacacagacgccatatacatctcta

SEQ ID NO: 315043 - DNA, 25 bp, Rattus norvegicus
gacacagacgccttatacatctcta

SEQ ID NO: 315044 - DNA, 25 bp, Rattus norvegicus
gacacagacggcactttggtttggt

SEQ ID NO: 315045 - DNA, 25 bp, Rattus norvegicus
gacacagacggctctttggtttggt

SEQ ID NO: 315046 - DNA, 25 bp, Rattus norvegicus
gacacagactctcgcgtcctgggaa

SEQ ID NO: 315047 - DNA, 25 bp, Rattus norvegicus
gacacagactctggcgtcctgggaa

SEQ ID NO: 315048 - DNA, 25 bp, Rattus norvegicus
gacacagactggagcagatgcagat

SEQ ID NO: 315049 - DNA, 25 bp, Rattus norvegicus
gacacagactggtgcagatgcagat

SEQ ID NO: 315050 - DNA, 25 bp, Rattus norvegicus
gacacagactgtataacctacatta

SEQ ID NO: 315051 - DNA, 25 bp, Rattus norvegicus
gacacagactgtttaacctacatta

SEQ ID NO: 315052 - DNA, 25 bp, Rattus norvegicus
gacacagacttacggcttcagggac

SEQ ID NO: 315053 - DNA, 25 bp, Rattus norvegicus
gacacagacttagggcttcagggac

SEQ ID NO: 315054 - DNA, 25 bp, Rattus norvegicus
gacacagagacaaggctgctctcca

SEQ ID NO: 315055 - DNA, 25 bp, Rattus norvegicus
gacacagagacatggctgctctcca

SEQ ID NO: 315056 - DNA, 25 bp, Rattus norvegicus
gacacagagacgaatttctacccct

SEQ ID NO: 315057 - DNA, 25 bp, Rattus norvegicus
gacacagagacgtatttctacccct

SEQ ID NO: 315058 - DNA, 25 bp, Rattus norvegicus
gacacagaggacacggagggcgccc

SEQ ID NO: 315059 - DNA, 25 bp, Rattus norvegicus
gacacagaggactcggagggcgccc

SEQ ID NO: 315060 - DNA, 25 bp, Rattus norvegicus
gacacagatcatccgagtttcctaa

SEQ ID NO: 315061 - DNA, 25 bp, Rattus norvegicus
gacacagatcatgcgagtttcctaa

SEQ ID NO: 315062 - DNA, 25 bp, Rattus norvegicus
gacacagatgatcaaggagcccctc

SEQ ID NO: 315063 - DNA, 25 bp, Rattus norvegicus
gacacagatgatgaaggagcccctc

SEQ ID NO: 315064 - DNA, 25 bp, Rattus norvegicus
gacacagatgttcgtttttctttcc

SEQ ID NO: 315065 - DNA, 25 bp, Rattus norvegicus
gacacagatgttggtttttctttcc

SEQ ID NO: 315066 - DNA, 25 bp, Rattus norvegicus
gacacagattcacagaattcctcct

SEQ ID NO: 315067 - DNA, 25 bp, Rattus norvegicus
gacacagattcagagaattcctcct

SEQ ID NO: 315068 - DNA, 25 bp, Rattus norvegicus
gacacagattcccatacattaactt

SEQ ID NO: 315069 - DNA, 25 bp, Rattus norvegicus
gacacagattccgatacattaactt

SEQ ID NO: 315070 - DNA, 25 bp, Rattus norvegicus
gacacagatttacgctgggtagcat

SEQ ID NO: 315071 - DNA, 25 bp, Rattus norvegicus
gacacagatttaggctgggtagcat

SEQ ID NO: 315072 - DNA, 25 bp, Rattus norvegicus
gacacagcaaccaacaccttatttg

SEQ ID NO: 315073 - DNA, 25 bp, Rattus norvegicus
gacacagcaacctacaccttatttg

SEQ ID NO: 315074 - DNA, 25 bp, Rattus norvegicus
gacacagccaagatcgctgctagtg

SEQ ID NO: 315075 - DNA, 25 bp, Rattus norvegicus
gacacagccaagttcgctgctagtg

SEQ ID NO: 315076 - DNA, 25 bp, Rattus norvegicus
gacacagccacaagatcaaccagta

SEQ ID NO: 315077 - DNA, 25 bp, Rattus norvegicus
gacacagccacatgatcaaccagta

SEQ ID NO: 315078 - DNA, 25 bp, Rattus norvegicus
gacacagccataaattctctggatg

SEQ ID NO: 315079 - DNA, 25 bp, Rattus norvegicus
gacacagccatatattctctggatg

SEQ ID NO: 315080 - DNA, 25 bp, Rattus norvegicus
gacacagcccatcatgatctcaagt

SEQ ID NO: 315081 - DNA, 25 bp, Rattus norvegicus
gacacagcccatgatgatctcaagt

SEQ ID NO: 315082 - DNA, 25 bp, Rattus norvegicus
gacacagcctgtaagactgttttgg

SEQ ID NO: 315083 - DNA, 25 bp, Rattus norvegicus
gacacagcctgtccctgagggagat

SEQ ID NO: 315084 - DNA, 25 bp, Rattus norvegicus
gacacagcctgtgcctgagggagat

SEQ ID NO: 315085 - DNA, 25 bp, Rattus norvegicus
gacacagcctgttagactgttttgg

SEQ ID NO: 315086 - DNA, 25 bp, Rattus norvegicus
gacacagcgtacctgacgatggtta

SEQ ID NO: 315087 - DNA, 25 bp, Rattus norvegicus
gacacagcgtacgtgacgatggtta

SEQ ID NO: 315088 - DNA, 25 bp, Rattus norvegicus
gacacagctaccagcctaggaacaa

SEQ ID NO: 315089 - DNA, 25 bp, Rattus norvegicus
gacacagctacctgcctaggaacaa

SEQ ID NO: 315090 - DNA, 25 bp, Rattus norvegicus
gacacagctagcacaggaaactcca

SEQ ID NO: 315091 - DNA, 25 bp, Rattus norvegicus
gacacagctagctcaggaaactcca

SEQ ID NO: 315092 - DNA, 25 bp, Rattus norvegicus
gacacagctcaccagtgctttatag

SEQ ID NO: 315093 - DNA, 25 bp, Rattus norvegicus
gacacagctcacgagtgctttatag

SEQ ID NO: 315094 - DNA, 25 bp, Rattus norvegicus
gacacagctgctacgagccatagaa

SEQ ID NO: 315095 - DNA, 25 bp, Rattus norvegicus
gacacagctgctcgtgaaatcgcca

SEQ ID NO: 315096 - DNA, 25 bp, Rattus norvegicus
gacacagctgctggtgaaatcgcca

SEQ ID NO: 315097 - DNA, 25 bp, Rattus norvegicus
gacacagctgcttcgagccatagaa

SEQ ID NO: 315098 - DNA, 25 bp, Rattus norvegicus
gacacagctgtaatcctcagcacag

SEQ ID NO: 315099 - DNA, 25 bp, Rattus norvegicus
gacacagctgtaatttaacctttga

SEQ ID NO: 315100 - DNA, 25 bp, Rattus norvegicus
gacacagctgtattcctcagcacag

SEQ ID NO: 315101 - DNA, 25 bp, Rattus norvegicus
gacacagctgtattttaacctttga

SEQ ID NO: 315102 - DNA, 25 bp, Rattus norvegicus
gacacagctgtcattgggtagactt

SEQ ID NO: 315103 - DNA, 25 bp, Rattus norvegicus
gacacagctgtctttgggtagactt

SEQ ID NO: 315104 - DNA, 25 bp, Rattus norvegicus
gacacagcttggagggtaaccccag

SEQ ID NO: 315105 - DNA, 25 bp, Rattus norvegicus
gacacagcttggtgggtaaccccag

SEQ ID NO: 315106 - DNA, 25 bp, Rattus norvegicus
gacacaggaaccacatgggtctcat

SEQ ID NO: 315107 - DNA, 25 bp, Rattus norvegicus
gacacaggaacctcatgggtctcat

SEQ ID NO: 315108 - DNA, 25 bp, Rattus norvegicus
gacacaggaagtctctgctctgaga

SEQ ID NO: 315109 - DNA, 25 bp, Rattus norvegicus
gacacaggaagtgtctgctctgaga

SEQ ID NO: 315110 - DNA, 25 bp, Rattus norvegicus
gacacaggacacatttcaggagcca

SEQ ID NO: 315111 - DNA, 25 bp, Rattus norvegicus
gacacaggacacttttcaggagcca

SEQ ID NO: 315112 - DNA, 25 bp, Rattus norvegicus
gacacaggacgtaaccatacttggc

SEQ ID NO: 315113 - DNA, 25 bp, Rattus norvegicus
gacacaggacgttaccatacttggc

SEQ ID NO: 315114 - DNA, 25 bp, Rattus norvegicus
gacacaggccccagggactggtgaa

SEQ ID NO: 315115 - DNA, 25 bp, Rattus norvegicus
gacacaggcccctgggactggtgaa

SEQ ID NO: 315116 - DNA, 25 bp, Rattus norvegicus
gacacaggcgctccaagaggcttca

SEQ ID NO: 315117 - DNA, 25 bp, Rattus norvegicus
gacacaggcgctgcaagaggcttca

SEQ ID NO: 315118 - DNA, 25 bp, Rattus norvegicus
gacacaggctccatgcttatttgaa

SEQ ID NO: 315119 - DNA, 25 bp, Rattus norvegicus
gacacaggctccttgcttatttgaa

SEQ ID NO: 315120 - DNA, 25 bp, Rattus norvegicus
gacacagggaacatctcaatttaat

SEQ ID NO: 315121 - DNA, 25 bp, Rattus norvegicus
gacacagggaacttctcaatttaat

SEQ ID NO: 315122 - DNA, 25 bp, Rattus norvegicus
gacacagggcacaactggcaacagt

SEQ ID NO: 315123 - DNA, 25 bp, Rattus norvegicus
gacacagggcactactggcaacagt

SEQ ID NO: 315124 - DNA, 25 bp, Rattus norvegicus
gacacagggcccattagcctttgag

SEQ ID NO: 315125 - DNA, 25 bp, Rattus norvegicus
gacacagggccctttagcctttgag

SEQ ID NO: 315126 - DNA, 25 bp, Rattus norvegicus
gacacagggctgatgcagtattcct

SEQ ID NO: 315127 - DNA, 25 bp, Rattus norvegicus
gacacagggctgttgcagtattcct

SEQ ID NO: 315128 - DNA, 25 bp, Rattus norvegicus
gacacagggtccattacagtgggaa

SEQ ID NO: 315129 - DNA, 25 bp, Rattus norvegicus
gacacagggtcctttacagtgggaa

SEQ ID NO: 315130 - DNA, 25 bp, Rattus norvegicus
gacacagggtctctttttatatata

SEQ ID NO: 315131 - DNA, 25 bp, Rattus norvegicus
gacacagggtctgtttttatatata

SEQ ID NO: 315132 - DNA, 25 bp, Rattus norvegicus
gacacaggtacacaggtggtgcaca

SEQ ID NO: 315133 - DNA, 25 bp, Rattus norvegicus
gacacaggtacagaggtggtgcaca

SEQ ID NO: 315134 - DNA, 25 bp, Rattus norvegicus
gacacaggtattaagggctttctct

SEQ ID NO: 315135 - DNA, 25 bp, Rattus norvegicus
gacacaggtatttagggctttctct

SEQ ID NO: 315136 - DNA, 25 bp, Rattus norvegicus
gacacaggtcagcatcagggccctt

SEQ ID NO: 315137 - DNA, 25 bp, Rattus norvegicus
gacacaggtcaggatcagggccctt

SEQ ID NO: 315138 - DNA, 25 bp, Rattus norvegicus
gacacaggtgaaaggcctgctgggc

SEQ ID NO: 315139 - DNA, 25 bp, Rattus norvegicus
gacacaggtgaatggcctgctgggc

SEQ ID NO: 315140 - DNA, 25 bp, Rattus norvegicus
gacacaggtggtcttcttgtaagca

SEQ ID NO: 315141 - DNA, 25 bp, Rattus norvegicus
gacacaggtggtgttcttgtaagca

SEQ ID NO: 315142 - DNA, 25 bp, Rattus norvegicus
gacacaggtgtcactgcaaattgtt

SEQ ID NO: 315143 - DNA, 25 bp, Rattus norvegicus
gacacaggtgtctctgcaaattgtt

SEQ ID NO: 315144 - DNA, 25 bp, Rattus norvegicus
gacacaggtgttaaaggctcgccta

SEQ ID NO: 315145 - DNA, 25 bp, Rattus norvegicus
gacacaggtgtttaaggctcgccta

SEQ ID NO: 315146 - DNA, 25 bp, Rattus norvegicus
gacacaggttgtcgatttcatcgta

SEQ ID NO: 315147 - DNA, 25 bp, Rattus norvegicus
gacacaggttgtggatttcatcgta

SEQ ID NO: 315148 - DNA, 25 bp, Rattus norvegicus
gacacagtactcaccttaattgcac

SEQ ID NO: 315149 - DNA, 25 bp, Rattus norvegicus
gacacagtactctccttaattgcac

SEQ ID NO: 315150 - DNA, 25 bp, Rattus norvegicus
gacacagtatgaccgatccagggat

SEQ ID NO: 315151 - DNA, 25 bp, Rattus norvegicus
gacacagtatgagcgatccagggat

SEQ ID NO: 315152 - DNA, 25 bp, Rattus norvegicus
gacacagtatttccgttctaaaaca

SEQ ID NO: 315153 - DNA, 25 bp, Rattus norvegicus
gacacagtatttgcgttctaaaaca

SEQ ID NO: 315154 - DNA, 25 bp, Rattus norvegicus
gacacagtcatcacctatgttagaa

SEQ ID NO: 315155 - DNA, 25 bp, Rattus norvegicus
gacacagtcatctcctatgttagaa

SEQ ID NO: 315156 - DNA, 25 bp, Rattus norvegicus
gacacagtcctacacatacctggga

SEQ ID NO: 315157 - DNA, 25 bp, Rattus norvegicus
gacacagtcctagacatacctggga

SEQ ID NO: 315158 - DNA, 25 bp, Rattus norvegicus
gacacagtctccacagggtcagaga

SEQ ID NO: 315159 - DNA, 25 bp, Rattus norvegicus
gacacagtctcctcagggtcagaga

SEQ ID NO: 315160 - DNA, 25 bp, Rattus norvegicus
gacacagtctgtcagccacttataa

SEQ ID NO: 315161 - DNA, 25 bp, Rattus norvegicus
gacacagtctgtgagccacttataa

SEQ ID NO: 315162 - DNA, 25 bp, Rattus norvegicus
gacacagtcttaatgctcagtaaat

SEQ ID NO: 315163 - DNA, 25 bp, Rattus norvegicus
gacacagtcttacagcaagttccct

SEQ ID NO: 315164 - DNA, 25 bp, Rattus norvegicus
gacacagtcttagagcaagttccct

SEQ ID NO: 315165 - DNA, 25 bp, Rattus norvegicus
gacacagtcttattgctcagtaaat

SEQ ID NO: 315166 - DNA, 25 bp, Rattus norvegicus
gacacagtgattaaacgcatgcggg

SEQ ID NO: 315167 - DNA, 25 bp, Rattus norvegicus
gacacagtgatttaacgcatgcggg

SEQ ID NO: 315168 - DNA, 25 bp, Rattus norvegicus
gacacagtgcagcttgggtgacacc

SEQ ID NO: 315169 - DNA, 25 bp, Rattus norvegicus
gacacagtgcaggttgggtgacacc

SEQ ID NO: 315170 - DNA, 25 bp, Rattus norvegicus
gacacagtgcctatcagcattatga

SEQ ID NO: 315171 - DNA, 25 bp, Rattus norvegicus
gacacagtgcctttcagcattatga

SEQ ID NO: 315172 - DNA, 25 bp, Rattus norvegicus
gacacagtggctatcatcttctgct

SEQ ID NO: 315173 - DNA, 25 bp, Rattus norvegicus
gacacagtggctcgaaaaccctttt

SEQ ID NO: 315174 - DNA, 25 bp, Rattus norvegicus
gacacagtggctggaaaaccctttt

SEQ ID NO: 315175 - DNA, 25 bp, Rattus norvegicus
gacacagtggctttcatcttctgct

SEQ ID NO: 315176 - DNA, 25 bp, Rattus norvegicus
gacacagtggtaagtccctgttgtt

SEQ ID NO: 315177 - DNA, 25 bp, Rattus norvegicus
gacacagtggtatgtccctgttgtt

SEQ ID NO: 315178 - DNA, 25 bp, Rattus norvegicus
gacacagtgtcaacaggagtgccaa

SEQ ID NO: 315179 - DNA, 25 bp, Rattus norvegicus
gacacagtgtcatcaggagtgccaa

SEQ ID NO: 315180 - DNA, 25 bp, Rattus norvegicus
gacacagtgtgacctaactttggca

SEQ ID NO: 315181 - DNA, 25 bp, Rattus norvegicus
gacacagtgtgagctaactttggca

SEQ ID NO: 315182 - DNA, 25 bp, Rattus norvegicus
gacacagtgtggatagctttttaaa

SEQ ID NO: 315183 - DNA, 25 bp, Rattus norvegicus
gacacagtgtggttagctttttaaa

SEQ ID NO: 315184 - DNA, 25 bp, Rattus norvegicus
gacacagtgtgtatgcttctggtat

SEQ ID NO: 315185 - DNA, 25 bp, Rattus norvegicus
gacacagtgtgtttgcttctggtat

SEQ ID NO: 315186 - DNA, 25 bp, Rattus norvegicus
gacacagtgttcatcaaaggagcat

SEQ ID NO: 315187 - DNA, 25 bp, Rattus norvegicus
gacacagtgttcttcaaaggagcat

SEQ ID NO: 315188 - DNA, 25 bp, Rattus norvegicus
gacacagttagaaaggttcccgact

SEQ ID NO: 315189 - DNA, 25 bp, Rattus norvegicus
gacacagttagataggttcccgact

SEQ ID NO: 315190 - DNA, 25 bp, Rattus norvegicus
gacacagttcccacagaagagctga

SEQ ID NO: 315191 - DNA, 25 bp, Rattus norvegicus
gacacagttccctcagaagagctga

SEQ ID NO: 315192 - DNA, 25 bp, Rattus norvegicus
gacacagttcctattatagtcaaga

SEQ ID NO: 315193 - DNA, 25 bp, Rattus norvegicus
gacacagttccttttatagtcaaga

SEQ ID NO: 315194 - DNA, 25 bp, Rattus norvegicus
gacacagttcttcataaagcattat

SEQ ID NO: 315195 - DNA, 25 bp, Rattus norvegicus
gacacagttcttgataaagcattat

SEQ ID NO: 315196 - DNA, 25 bp, Rattus norvegicus
gacacagttgagaagcctgggcagt

SEQ ID NO: 315197 - DNA, 25 bp, Rattus norvegicus
gacacagttgagtagcctgggcagt

SEQ ID NO: 315198 - DNA, 25 bp, Rattus norvegicus
gacacagttgccacctttaaagttt

SEQ ID NO: 315199 - DNA, 25 bp, Rattus norvegicus
gacacagttgcctcctttaaagttt

SEQ ID NO: 315200 - DNA, 25 bp, Rattus norvegicus
gacacagtttttcatgcttgagcca

SEQ ID NO: 315201 - DNA, 25 bp, Rattus norvegicus
gacacagtttttgatgcttgagcca

SEQ ID NO: 315202 - DNA, 25 bp, Rattus norvegicus
gacacataaatgctttctgaggcac

SEQ ID NO: 315203 - DNA, 25 bp, Rattus norvegicus
gacacataaatggtttctgaggcac

SEQ ID NO: 315204 - DNA, 25 bp, Rattus norvegicus
gacacataacgcctgttccagcttc

SEQ ID NO: 315205 - DNA, 25 bp, Rattus norvegicus
gacacataacgcgtgttccagcttc

SEQ ID NO: 315206 - DNA, 25 bp, Rattus norvegicus
gacacataatctccctctgtgtgga

SEQ ID NO: 315207 - DNA, 25 bp, Rattus norvegicus
gacacataatctgcctctgtgtgga

SEQ ID NO: 315208 - DNA, 25 bp, Rattus norvegicus
gacacatacatacactggagaaact

SEQ ID NO: 315209 - DNA, 25 bp, Rattus norvegicus
gacacatacatagactggagaaact

SEQ ID NO: 315210 - DNA, 25 bp, Rattus norvegicus
gacacatacatgcttcacaggcata

SEQ ID NO: 315211 - DNA, 25 bp, Rattus norvegicus
gacacatacatggttcacaggcata

SEQ ID NO: 315212 - DNA, 25 bp, Rattus norvegicus
gacacatacgtcaacatgcgactta

SEQ ID NO: 315213 - DNA, 25 bp, Rattus norvegicus
gacacatacgtctacatgcgactta

SEQ ID NO: 315214 - DNA, 25 bp, Rattus norvegicus
gacacatacttgcattgcgacactg

SEQ ID NO: 315215 - DNA, 25 bp, Rattus norvegicus
gacacatacttggattgcgacactg

SEQ ID NO: 315216 - DNA, 25 bp, Rattus norvegicus
gacacataggaaagagggactctct

SEQ ID NO: 315217 - DNA, 25 bp, Rattus norvegicus
gacacataggaatgagggactctct

SEQ ID NO: 315218 - DNA, 25 bp, Rattus norvegicus
gacacatagtggctcgcttatcatg

SEQ ID NO: 315219 - DNA, 25 bp, Rattus norvegicus
gacacatagtgggtcgcttatcatg

SEQ ID NO: 315220 - DNA, 25 bp, Rattus norvegicus
gacacatatactcacttcaaaccat

SEQ ID NO: 315221 - DNA, 25 bp, Rattus norvegicus
gacacatatactgacttcaaaccat

SEQ ID NO: 315222 - DNA, 25 bp, Rattus norvegicus
gacacatatgtcagctttctagtag

SEQ ID NO: 315223 - DNA, 25 bp, Rattus norvegicus
gacacatatgtctgctttctagtag

SEQ ID NO: 315224 - DNA, 25 bp, Rattus norvegicus
gacacatattaacctttccctgaag

SEQ ID NO: 315225 - DNA, 25 bp, Rattus norvegicus
gacacatattaagctttccctgaag

SEQ ID NO: 315226 - DNA, 25 bp, Rattus norvegicus
gacacatcatccatcattccaggga

SEQ ID NO: 315227 - DNA, 25 bp, Rattus norvegicus
gacacatcatccttcattccaggga

SEQ ID NO: 315228 - DNA, 25 bp, Rattus norvegicus
gacacatcatgtcagcacttggaag

SEQ ID NO: 315229 - DNA, 25 bp, Rattus norvegicus
gacacatcatgtgagcacttggaag

SEQ ID NO: 315230 - DNA, 25 bp, Rattus norvegicus
gacacatccagcctcacagttttga

SEQ ID NO: 315231 - DNA, 25 bp, Rattus norvegicus
gacacatccagcgtcacagttttga

SEQ ID NO: 315232 - DNA, 25 bp, Rattus norvegicus
gacacatccattagtttgacctctt

SEQ ID NO: 315233 - DNA, 25 bp, Rattus norvegicus
gacacatccatttgtttgacctctt

SEQ ID NO: 315234 - DNA, 25 bp, Rattus norvegicus
gacacatccgagcttgtcttcaaca

SEQ ID NO: 315235 - DNA, 25 bp, Rattus norvegicus
gacacatccgaggttgtcttcaaca

SEQ ID NO: 315236 - DNA, 25 bp, Rattus norvegicus
gacacatcctaacccactttagagt

SEQ ID NO: 315237 - DNA, 25 bp, Rattus norvegicus
gacacatcctaagccactttagagt

SEQ ID NO: 315238 - DNA, 25 bp, Rattus norvegicus
gacacatcctgtcaaatatgccact

SEQ ID NO: 315239 - DNA, 25 bp, Rattus norvegicus
gacacatcctgtgaaatatgccact

SEQ ID NO: 315240 - DNA, 25 bp, Rattus norvegicus
gacacatcggatctatttttggaag

SEQ ID NO: 315241 - DNA, 25 bp, Rattus norvegicus
gacacatcggatgtatttttggaag

SEQ ID NO: 315242 - DNA, 25 bp, Rattus norvegicus
gacacatctctgactgaaaagctga

SEQ ID NO: 315243 - DNA, 25 bp, Rattus norvegicus
gacacatctctgtctgaaaagctga

SEQ ID NO: 315244 - DNA, 25 bp, Rattus norvegicus
gacacatctgtacagtgcactccga

SEQ ID NO: 315245 - DNA, 25 bp, Rattus norvegicus
gacacatctgtagagtgcactccga

SEQ ID NO: 315246 - DNA, 25 bp, Rattus norvegicus
gacacatctgtcacacacattttgt

SEQ ID NO: 315247 - DNA, 25 bp, Rattus norvegicus
gacacatctgtcaccataatatatt

SEQ ID NO: 315248 - DNA, 25 bp, Rattus norvegicus
gacacatctgtctcacacattttgt

SEQ ID NO: 315249 - DNA, 25 bp, Rattus norvegicus
gacacatctgtctccataatatatt

SEQ ID NO: 315250 - DNA, 25 bp, Rattus norvegicus
gacacatctttcatttactaactgg

SEQ ID NO: 315251 - DNA, 25 bp, Rattus norvegicus
gacacatctttcttttactaactgg

SEQ ID NO: 315252 - DNA, 25 bp, Rattus norvegicus
gacacatgaactagtcctttcttta

SEQ ID NO: 315253 - DNA, 25 bp, Rattus norvegicus
gacacatgaacttgtcctttcttta

SEQ ID NO: 315254 - DNA, 25 bp, Rattus norvegicus
gacacatgacagaaatcccaatagt

SEQ ID NO: 315255 - DNA, 25 bp, Rattus norvegicus
gacacatgacagtaatcccaatagt

SEQ ID NO: 315256 - DNA, 25 bp, Rattus norvegicus
gacacatgaggaatcaagccataac

SEQ ID NO: 315257 - DNA, 25 bp, Rattus norvegicus
gacacatgaggaccgatgcccgttt

SEQ ID NO: 315258 - DNA, 25 bp, Rattus norvegicus
gacacatgaggagcgatgcccgttt

SEQ ID NO: 315259 - DNA, 25 bp, Rattus norvegicus
gacacatgaggattcaagccataac

SEQ ID NO: 315260 - DNA, 25 bp, Rattus norvegicus
gacacatgatgactcctgtcttggg

SEQ ID NO: 315261 - DNA, 25 bp, Rattus norvegicus
gacacatgatgagtcctgtcttggg

SEQ ID NO: 315262 - DNA, 25 bp, Rattus norvegicus
gacacatgcagtaggacatcacttt

SEQ ID NO: 315263 - DNA, 25 bp, Rattus norvegicus
gacacatgcagttggacatcacttt

SEQ ID NO: 315264 - DNA, 25 bp, Rattus norvegicus
gacacatggctacagagacatctat

SEQ ID NO: 315265 - DNA, 25 bp, Rattus norvegicus
gacacatggctagagagacatctat

SEQ ID NO: 315266 - DNA, 25 bp, Rattus norvegicus
gacacatgtaggaatggccgcccca

SEQ ID NO: 315267 - DNA, 25 bp, Rattus norvegicus
gacacatgtaggtatggccgcccca

SEQ ID NO: 315268 - DNA, 25 bp, Rattus norvegicus
gacacatgtgcgaccgttcaagtat

SEQ ID NO: 315269 - DNA, 25 bp, Rattus norvegicus
gacacatgtgcgtccgttcaagtat

SEQ ID NO: 315270 - DNA, 25 bp, Rattus norvegicus
gacacatgtggcactgatccagttc

SEQ ID NO: 315271 - DNA, 25 bp, Rattus norvegicus
gacacatgtggctctgatccagttc

SEQ ID NO: 315272 - DNA, 25 bp, Rattus norvegicus
gacacatgtggtacccaatgtttat

SEQ ID NO: 315273 - DNA, 25 bp, Rattus norvegicus
gacacatgtggttcccaatgtttat

SEQ ID NO: 315274 - DNA, 25 bp, Rattus norvegicus
gacacatgttgaaccggagatctct

SEQ ID NO: 315275 - DNA, 25 bp, Rattus norvegicus
gacacatgttgatccggagatctct

SEQ ID NO: 315276 - DNA, 25 bp, Rattus norvegicus
gacacattcgctatgcatttttgtt

SEQ ID NO: 315277 - DNA, 25 bp, Rattus norvegicus
gacacattcgctttgcatttttgtt

SEQ ID NO: 315278 - DNA, 25 bp, Rattus norvegicus
gacacattctccattgatatcagcc

SEQ ID NO: 315279 - DNA, 25 bp, Rattus norvegicus
gacacattctcctttgatatcagcc

SEQ ID NO: 315280 - DNA, 25 bp, Rattus norvegicus
gacacattcttgattgcggcttgag

SEQ ID NO: 315281 - DNA, 25 bp, Rattus norvegicus
gacacattcttgtttgcggcttgag

SEQ ID NO: 315282 - DNA, 25 bp, Rattus norvegicus
gacacattgaaaacgcggcagtagt

SEQ ID NO: 315283 - DNA, 25 bp, Rattus norvegicus
gacacattgaaatcgcggcagtagt

SEQ ID NO: 315284 - DNA, 25 bp, Rattus norvegicus
gacacattgggaagcttgctgttta

SEQ ID NO: 315285 - DNA, 25 bp, Rattus norvegicus
gacacattgggatgcttgctgttta

SEQ ID NO: 315286 - DNA, 25 bp, Rattus norvegicus
gacacattggtcagccatgttttgt

SEQ ID NO: 315287 - DNA, 25 bp, Rattus norvegicus
gacacattggtctgccatgttttgt

SEQ ID NO: 315288 - DNA, 25 bp, Rattus norvegicus
gacacattgtgtccatcttttcaga

SEQ ID NO: 315289 - DNA, 25 bp, Rattus norvegicus
gacacattgtgtgcatcttttcaga

SEQ ID NO: 315290 - DNA, 25 bp, Rattus norvegicus
gacacattgttactggaatcccgcc

SEQ ID NO: 315291 - DNA, 25 bp, Rattus norvegicus
gacacattgttagtggaatcccgcc

SEQ ID NO: 315292 - DNA, 25 bp, Rattus norvegicus
gacacatttaacaagttcccctcaa

SEQ ID NO: 315293 - DNA, 25 bp, Rattus norvegicus
gacacatttaactagttcccctcaa

SEQ ID NO: 315294 - DNA, 25 bp, Rattus norvegicus
gacacatttacactagaggccaggg

SEQ ID NO: 315295 - DNA, 25 bp, Rattus norvegicus
gacacatttacagtagaggccaggg

SEQ ID NO: 315296 - DNA, 25 bp, Rattus norvegicus
gacacatttatacaggtctctccta

SEQ ID NO: 315297 - DNA, 25 bp, Rattus norvegicus
gacacatttatagaggtctctccta

SEQ ID NO: 315298 - DNA, 25 bp, Rattus norvegicus
gacacatttgacacagggctgacct

SEQ ID NO: 315299 - DNA, 25 bp, Rattus norvegicus
gacacatttgactcagggctgacct

SEQ ID NO: 315300 - DNA, 25 bp, Rattus norvegicus
gacacatttgtacgtctctgcatat

SEQ ID NO: 315301 - DNA, 25 bp, Rattus norvegicus
gacacatttgtaggtctctgcatat

SEQ ID NO: 315302 - DNA, 25 bp, Rattus norvegicus
gacacattttggaccctttgttttg

SEQ ID NO: 315303 - DNA, 25 bp, Rattus norvegicus
gacacattttggacttaatccatgt

SEQ ID NO: 315304 - DNA, 25 bp, Rattus norvegicus
gacacattttggtccctttgttttg

SEQ ID NO: 315305 - DNA, 25 bp, Rattus norvegicus
gacacattttggtcttaatccatgt

SEQ ID NO: 315306 - DNA, 25 bp, Rattus norvegicus
gacaccaaataactgtttcccactc

SEQ ID NO: 315307 - DNA, 25 bp, Rattus norvegicus
gacaccaaataagtgtttcccactc

SEQ ID NO: 315308 - DNA, 25 bp, Rattus norvegicus
gacaccaaattccatggctgccatc

SEQ ID NO: 315309 - DNA, 25 bp, Rattus norvegicus
gacaccaaattcgatggctgccatc

SEQ ID NO: 315310 - DNA, 25 bp, Rattus norvegicus
gacaccaacgtgaaatcagcttata

SEQ ID NO: 315311 - DNA, 25 bp, Rattus norvegicus
gacaccaacgtgtaatcagcttata

SEQ ID NO: 315312 - DNA, 25 bp, Rattus norvegicus
gacaccaactttaaggtcacataaa

SEQ ID NO: 315313 - DNA, 25 bp, Rattus norvegicus
gacaccaacttttaggtcacataaa

SEQ ID NO: 315314 - DNA, 25 bp, Rattus norvegicus
gacaccaagacgaggaagccgccca

SEQ ID NO: 315315 - DNA, 25 bp, Rattus norvegicus
gacaccaagacgtggaagccgccca

SEQ ID NO: 315316 - DNA, 25 bp, Rattus norvegicus
gacaccaagtccaacagacctcttt

SEQ ID NO: 315317 - DNA, 25 bp, Rattus norvegicus
gacaccaagtcctacagacctcttt

SEQ ID NO: 315318 - DNA, 25 bp, Rattus norvegicus
gacaccaagtttactgctgtgctgg

SEQ ID NO: 315319 - DNA, 25 bp, Rattus norvegicus
gacaccaagtttcgagagttcctcc

SEQ ID NO: 315320 - DNA, 25 bp, Rattus norvegicus
gacaccaagtttggagagttcctcc

SEQ ID NO: 315321 - DNA, 25 bp, Rattus norvegicus
gacaccaagttttctgctgtgctgg

SEQ ID NO: 315322 - DNA, 25 bp, Rattus norvegicus
gacaccaatgcaactttgtgcagct

SEQ ID NO: 315323 - DNA, 25 bp, Rattus norvegicus
gacaccaatgcatctttgtgcagct

SEQ ID NO: 315324 - DNA, 25 bp, Rattus norvegicus
gacaccaatggactgctggccctaa

SEQ ID NO: 315325 - DNA, 25 bp, Rattus norvegicus
gacaccaatggagtgctggccctaa

SEQ ID NO: 315326 - DNA, 25 bp, Rattus norvegicus
gacaccaatgtgacataatattctt

SEQ ID NO: 315327 - DNA, 25 bp, Rattus norvegicus
gacaccaatgtgtcataatattctt

SEQ ID NO: 315328 - DNA, 25 bp, Rattus norvegicus
gacaccaatgttcaggctacctagt

SEQ ID NO: 315329 - DNA, 25 bp, Rattus norvegicus
gacaccaatgttgaggctacctagt

SEQ ID NO: 315330 - DNA, 25 bp, Rattus norvegicus
gacaccacaatgcagttttctcttt

SEQ ID NO: 315331 - DNA, 25 bp, Rattus norvegicus
gacaccacaatggagttttctcttt

SEQ ID NO: 315332 - DNA, 25 bp, Rattus norvegicus
gacaccacacctcatgagctgagtt

SEQ ID NO: 315333 - DNA, 25 bp, Rattus norvegicus
gacaccacacctgatgagctgagtt

SEQ ID NO: 315334 - DNA, 25 bp, Rattus norvegicus
gacaccacagatcaaggccctgtgt

SEQ ID NO: 315335 - DNA, 25 bp, Rattus norvegicus
gacaccacagatgaaggccctgtgt

SEQ ID NO: 315336 - DNA, 25 bp, Rattus norvegicus
gacaccacatacctagttcctttta

SEQ ID NO: 315337 - DNA, 25 bp, Rattus norvegicus
gacaccacatacgtagttcctttta

SEQ ID NO: 315338 - DNA, 25 bp, Rattus norvegicus
gacaccaccagtatttagtgttcta

SEQ ID NO: 315339 - DNA, 25 bp, Rattus norvegicus
gacaccaccagtttttagtgttcta

SEQ ID NO: 315340 - DNA, 25 bp, Rattus norvegicus
gacaccaccattcctggagacaaag

SEQ ID NO: 315341 - DNA, 25 bp, Rattus norvegicus
gacaccaccattgctggagacaaag

SEQ ID NO: 315342 - DNA, 25 bp, Rattus norvegicus
gacaccaccgcaagctaaacagaag

SEQ ID NO: 315343 - DNA, 25 bp, Rattus norvegicus
gacaccaccgcatgctaaacagaag

SEQ ID NO: 315344 - DNA, 25 bp, Rattus norvegicus
gacaccacctacagattgaatccta

SEQ ID NO: 315345 - DNA, 25 bp, Rattus norvegicus
gacaccacctactgattgaatccta

SEQ ID NO: 315346 - DNA, 25 bp, Rattus norvegicus
gacaccacgggcaaaaaacttctgc

SEQ ID NO: 315347 - DNA, 25 bp, Rattus norvegicus
gacaccacgggctaaaaacttctgc

SEQ ID NO: 315348 - DNA, 25 bp, Rattus norvegicus
gacaccactgacaaggtctacactc

SEQ ID NO: 315349 - DNA, 25 bp, Rattus norvegicus
gacaccactgactaggtctacactc

SEQ ID NO: 315350 - DNA, 25 bp, Rattus norvegicus
gacaccacttggacccgggatacaa

SEQ ID NO: 315351 - DNA, 25 bp, Rattus norvegicus
gacaccacttggtcccgggatacaa

SEQ ID NO: 315352 - DNA, 25 bp, Rattus norvegicus
gacaccactttacaagagtgctcga

SEQ ID NO: 315353 - DNA, 25 bp, Rattus norvegicus
gacaccactttagaagagtgctcga

SEQ ID NO: 315354 - DNA, 25 bp, Rattus norvegicus
gacaccagaagtattttccacagcc

SEQ ID NO: 315355 - DNA, 25 bp, Rattus norvegicus
gacaccagaagttttttccacagcc

SEQ ID NO: 315356 - DNA, 25 bp, Rattus norvegicus
gacaccagatatccaagaccctcat

SEQ ID NO: 315357 - DNA, 25 bp, Rattus norvegicus
gacaccagatatgcaagaccctcat

SEQ ID NO: 315358 - DNA, 25 bp, Rattus norvegicus
gacaccagattcctgagcgtgatct

SEQ ID NO: 315359 - DNA, 25 bp, Rattus norvegicus
gacaccagattcgtgagcgtgatct

SEQ ID NO: 315360 - DNA, 25 bp, Rattus norvegicus
gacaccagcaccagattggaacctt

SEQ ID NO: 315361 - DNA, 25 bp, Rattus norvegicus
gacaccagcacctgattggaacctt

SEQ ID NO: 315362 - DNA, 25 bp, Rattus norvegicus
gacaccagcctgcatattcgtggac

SEQ ID NO: 315363 - DNA, 25 bp, Rattus norvegicus
gacaccagcctggatattcgtggac

SEQ ID NO: 315364 - DNA, 25 bp, Rattus norvegicus
gacaccagcgagcaatgggcagcta

SEQ ID NO: 315365 - DNA, 25 bp, Rattus norvegicus
gacaccagcgaggaatgggcagcta

SEQ ID NO: 315366 - DNA, 25 bp, Rattus norvegicus
gacaccaggatcactgtagccacat

SEQ ID NO: 315367 - DNA, 25 bp, Rattus norvegicus
gacaccaggatctctgtagccacat

SEQ ID NO: 315368 - DNA, 25 bp, Rattus norvegicus
gacaccaggcgcacattcaaagaat

SEQ ID NO: 315369 - DNA, 25 bp, Rattus norvegicus
gacaccaggcgctcattcaaagaat

SEQ ID NO: 315370 - DNA, 25 bp, Rattus norvegicus
gacaccaggctaccacaaaactatg

SEQ ID NO: 315371 - DNA, 25 bp, Rattus norvegicus
gacaccaggctagcacaaaactatg

SEQ ID NO: 315372 - DNA, 25 bp, Rattus norvegicus
gacaccagtagaacatttcctatca

SEQ ID NO: 315373 - DNA, 25 bp, Rattus norvegicus
gacaccagtagacagacatcacaat

SEQ ID NO: 315374 - DNA, 25 bp, Rattus norvegicus
gacaccagtagagagacatcacaat

SEQ ID NO: 315375 - DNA, 25 bp, Rattus norvegicus
gacaccagtagatcatttcctatca

SEQ ID NO: 315376 - DNA, 25 bp, Rattus norvegicus
gacaccagtagtaccattgtaagct

SEQ ID NO: 315377 - DNA, 25 bp, Rattus norvegicus
gacaccagtagttccattgtaagct

SEQ ID NO: 315378 - DNA, 25 bp, Rattus norvegicus
gacaccagtccgcaccaagaagaag

SEQ ID NO: 315379 - DNA, 25 bp, Rattus norvegicus
gacaccagtccggaccaagaagaag

SEQ ID NO: 315380 - DNA, 25 bp, Rattus norvegicus
gacaccagtgccacctagggagcaa

SEQ ID NO: 315381 - DNA, 25 bp, Rattus norvegicus
gacaccagtgcctcctagggagcaa

SEQ ID NO: 315382 - DNA, 25 bp, Rattus norvegicus
gacaccagtggacctaccctttgtg

SEQ ID NO: 315383 - DNA, 25 bp, Rattus norvegicus
gacaccagtggagctaccctttgtg

SEQ ID NO: 315384 - DNA, 25 bp, Rattus norvegicus
gacaccagtgtcaatattcttaata

SEQ ID NO: 315385 - DNA, 25 bp, Rattus norvegicus
gacaccagtgtctatattcttaata

SEQ ID NO: 315386 - DNA, 25 bp, Rattus norvegicus
gacaccataccacaggacttccagg

SEQ ID NO: 315387 - DNA, 25 bp, Rattus norvegicus
gacaccataccagaggacttccagg

SEQ ID NO: 315388 - DNA, 25 bp, Rattus norvegicus
gacaccatagatcttcgacaactga

SEQ ID NO: 315389 - DNA, 25 bp, Rattus norvegicus
gacaccatagatgttcgacaactga

SEQ ID NO: 315390 - DNA, 25 bp, Rattus norvegicus
gacaccatcacgagccaagtggaga

SEQ ID NO: 315391 - DNA, 25 bp, Rattus norvegicus
gacaccatcacgtgccaagtggaga

SEQ ID NO: 315392 - DNA, 25 bp, Rattus norvegicus
gacaccatccatcaatgactgctta

SEQ ID NO: 315393 - DNA, 25 bp, Rattus norvegicus
gacaccatccatgaatgactgctta

SEQ ID NO: 315394 - DNA, 25 bp, Rattus norvegicus
gacaccatcggccacctgaagaaac

SEQ ID NO: 315395 - DNA, 25 bp, Rattus norvegicus
gacaccatcggcgacctgaagaaac

SEQ ID NO: 315396 - DNA, 25 bp, Rattus norvegicus
gacaccatctgcacctgtaaataaa

SEQ ID NO: 315397 - DNA, 25 bp, Rattus norvegicus
gacaccatctgcagttttgaatttc

SEQ ID NO: 315398 - DNA, 25 bp, Rattus norvegicus
gacaccatctgctcctgtaaataaa

SEQ ID NO: 315399 - DNA, 25 bp, Rattus norvegicus
gacaccatctgctgttttgaatttc

SEQ ID NO: 315400 - DNA, 25 bp, Rattus norvegicus
gacaccatctggcaaggatccgtgg

SEQ ID NO: 315401 - DNA, 25 bp, Rattus norvegicus
gacaccatctgggaaggatccgtgg

SEQ ID NO: 315402 - DNA, 25 bp, Rattus norvegicus
gacaccatctgtaatgaaggtcaca

SEQ ID NO: 315403 - DNA, 25 bp, Rattus norvegicus
gacaccatctgttatgaaggtcaca

SEQ ID NO: 315404 - DNA, 25 bp, Rattus norvegicus
gacaccatgacacctacaagtcctt

SEQ ID NO: 315405 - DNA, 25 bp, Rattus norvegicus
gacaccatgacagctacaagtcctt

SEQ ID NO: 315406 - DNA, 25 bp, Rattus norvegicus
gacaccatgctgatcatgcagcgac

SEQ ID NO: 315407 - DNA, 25 bp, Rattus norvegicus
gacaccatgctgttcatgcagcgac

SEQ ID NO: 315408 - DNA, 25 bp, Rattus norvegicus
gacaccatggccactgtgtaactga

SEQ ID NO: 315409 - DNA, 25 bp, Rattus norvegicus
gacaccatggcctctgtgtaactga

SEQ ID NO: 315410 - DNA, 25 bp, Rattus norvegicus
gacaccatggtgcacctgactgatg

SEQ ID NO: 315411 - DNA, 25 bp, Rattus norvegicus
gacaccatggtggacctgactgatg

SEQ ID NO: 315412 - DNA, 25 bp, Rattus norvegicus
gacaccatggttacattactcagta

SEQ ID NO: 315413 - DNA, 25 bp, Rattus norvegicus
gacaccatggtttcattactcagta

SEQ ID NO: 315414 - DNA, 25 bp, Rattus norvegicus
gacaccatgtagcaaaccactagtt

SEQ ID NO: 315415 - DNA, 25 bp, Rattus norvegicus
gacaccatgtaggaaaccactagtt

SEQ ID NO: 315416 - DNA, 25 bp, Rattus norvegicus
gacaccattaccaggacaatgtgct

SEQ ID NO: 315417 - DNA, 25 bp, Rattus norvegicus
gacaccattacctggacaatgtgct

SEQ ID NO: 315418 - DNA, 25 bp, Rattus norvegicus
gacaccattatgcatactggatcaa

SEQ ID NO: 315419 - DNA, 25 bp, Rattus norvegicus
gacaccattatggatactggatcaa

SEQ ID NO: 315420 - DNA, 25 bp, Rattus norvegicus
gacaccattgaaaagcttccccaaa

SEQ ID NO: 315421 - DNA, 25 bp, Rattus norvegicus
gacaccattgaatagcttccccaaa

SEQ ID NO: 315422 - DNA, 25 bp, Rattus norvegicus
gacaccattgatattgatcctcgtt

SEQ ID NO: 315423 - DNA, 25 bp, Rattus norvegicus
gacaccattgattttgatcctcgtt

SEQ ID NO: 315424 - DNA, 25 bp, Rattus norvegicus
gacaccatttgaactctttagggaa

SEQ ID NO: 315425 - DNA, 25 bp, Rattus norvegicus
gacaccatttgatctctttagggaa

SEQ ID NO: 315426 - DNA, 25 bp, Rattus norvegicus
gacacccaaagactcctcaaggtca

SEQ ID NO: 315427 - DNA, 25 bp, Rattus norvegicus
gacacccaaagagtcctcaaggtca

SEQ ID NO: 315428 - DNA, 25 bp, Rattus norvegicus
gacacccaagaactgttacaccttt

SEQ ID NO: 315429 - DNA, 25 bp, Rattus norvegicus
gacacccaagaagtgttacaccttt

SEQ ID NO: 315430 - DNA, 25 bp, Rattus norvegicus
gacacccaagagagtcttctgctag

SEQ ID NO: 315431 - DNA, 25 bp, Rattus norvegicus
gacacccaagagtgtcttctgctag

SEQ ID NO: 315432 - DNA, 25 bp, Rattus norvegicus
gacacccacaagctttcttgtacct

SEQ ID NO: 315433 - DNA, 25 bp, Rattus norvegicus
gacacccacaaggtttcttgtacct

SEQ ID NO: 315434 - DNA, 25 bp, Rattus norvegicus
gacacccaccagatgaatccagaat

SEQ ID NO: 315435 - DNA, 25 bp, Rattus norvegicus
gacacccaccagttgaatccagaat

SEQ ID NO: 315436 - DNA, 25 bp, Rattus norvegicus
gacacccacgtcacaaactaattat

SEQ ID NO: 315437 - DNA, 25 bp, Rattus norvegicus
gacacccacgtctcaaactaattat

SEQ ID NO: 315438 - DNA, 25 bp, Rattus norvegicus
gacacccagatgaagcagtggcttt

SEQ ID NO: 315439 - DNA, 25 bp, Rattus norvegicus
gacacccagatgtagcagtggcttt

SEQ ID NO: 315440 - DNA, 25 bp, Rattus norvegicus
gacacccagcagcagatttcaagtt

SEQ ID NO: 315441 - DNA, 25 bp, Rattus norvegicus
gacacccagcaggagatttcaagtt

SEQ ID NO: 315442 - DNA, 25 bp, Rattus norvegicus
gacacccagggtattatgaggcaaa

SEQ ID NO: 315443 - DNA, 25 bp, Rattus norvegicus
gacacccagggttttatgaggcaaa

SEQ ID NO: 315444 - DNA, 25 bp, Rattus norvegicus
gacacccaggttattatatattagc

SEQ ID NO: 315445 - DNA, 25 bp, Rattus norvegicus
gacacccaggtttttatatattagc

SEQ ID NO: 315446 - DNA, 25 bp, Rattus norvegicus
gacacccagttcagtgtcttcacaa

SEQ ID NO: 315447 - DNA, 25 bp, Rattus norvegicus
gacacccagttctgtgtcttcacaa

SEQ ID NO: 315448 - DNA, 25 bp, Rattus norvegicus
gacacccataacagaatagacacag

SEQ ID NO: 315449 - DNA, 25 bp, Rattus norvegicus
gacacccataactgaatagacacag

SEQ ID NO: 315450 - DNA, 25 bp, Rattus norvegicus
gacacccatccacctgcatgtgata

SEQ ID NO: 315451 - DNA, 25 bp, Rattus norvegicus
gacacccatccagctgcatgtgata

SEQ ID NO: 315452 - DNA, 25 bp, Rattus norvegicus
gacacccatgtaagtgctatgatct

SEQ ID NO: 315453 - DNA, 25 bp, Rattus norvegicus
gacacccatgtatgtgctatgatct

SEQ ID NO: 315454 - DNA, 25 bp, Rattus norvegicus
gacaccccaaagcagttcatagtag

SEQ ID NO: 315455 - DNA, 25 bp, Rattus norvegicus
gacaccccaaaggagttcatagtag

SEQ ID NO: 315456 - DNA, 25 bp, Rattus norvegicus
gacaccccactgctaaatggctgaa

SEQ ID NO: 315457 - DNA, 25 bp, Rattus norvegicus
gacaccccactggtaaatggctgaa

SEQ ID NO: 315458 - DNA, 25 bp, Rattus norvegicus
gacaccccacttatggagcatggag

SEQ ID NO: 315459 - DNA, 25 bp, Rattus norvegicus
gacaccccacttttggagcatggag

SEQ ID NO: 315460 - DNA, 25 bp, Rattus norvegicus
gacaccccaggaacctcagaaatat

SEQ ID NO: 315461 - DNA, 25 bp, Rattus norvegicus
gacaccccaggatcctcagaaatat

SEQ ID NO: 315462 - DNA, 25 bp, Rattus norvegicus
gacaccccgatcaacagccaggtgg

SEQ ID NO: 315463 - DNA, 25 bp, Rattus norvegicus
gacaccccgatctacagccaggtgg

SEQ ID NO: 315464 - DNA, 25 bp, Rattus norvegicus
gacacccctcatagtgacagacgta

SEQ ID NO: 315465 - DNA, 25 bp, Rattus norvegicus
gacacccctcattgtgacagacgta

SEQ ID NO: 315466 - DNA, 25 bp, Rattus norvegicus
gacacccctggtcgttgatgtggaa

SEQ ID NO: 315467 - DNA, 25 bp, Rattus norvegicus
gacacccctggtggttgatgtggaa

SEQ ID NO: 315468 - DNA, 25 bp, Rattus norvegicus
gacacccgctatcagagcctgggaa

SEQ ID NO: 315469 - DNA, 25 bp, Rattus norvegicus
gacacccgctatgagagcctgggaa

SEQ ID NO: 315470 - DNA, 25 bp, Rattus norvegicus
gacaccctaaaacgtttgctgtttg

SEQ ID NO: 315471 - DNA, 25 bp, Rattus norvegicus
gacaccctaaaaggtttgctgtttg

SEQ ID NO: 315472 - DNA, 25 bp, Rattus norvegicus
gacaccctagtgatgcgatacagcc

SEQ ID NO: 315473 - DNA, 25 bp, Rattus norvegicus
gacaccctagtgttgcgatacagcc

SEQ ID NO: 315474 - DNA, 25 bp, Rattus norvegicus
gacaccctatttcgcattttcactg

SEQ ID NO: 315475 - DNA, 25 bp, Rattus norvegicus
gacaccctatttggcattttcactg

SEQ ID NO: 315476 - DNA, 25 bp, Rattus norvegicus
gacaccctcagtctcagaaactgga

SEQ ID NO: 315477 - DNA, 25 bp, Rattus norvegicus
gacaccctcagtgtcagaaactgga

SEQ ID NO: 315478 - DNA, 25 bp, Rattus norvegicus
gacaccctgattcagagtggccctg

SEQ ID NO: 315479 - DNA, 25 bp, Rattus norvegicus
gacaccctgattgagagtggccctg

SEQ ID NO: 315480 - DNA, 25 bp, Rattus norvegicus
gacacccttcacattagttacaaat

SEQ ID NO: 315481 - DNA, 25 bp, Rattus norvegicus
gacacccttcactttagttacaaat

SEQ ID NO: 315482 - DNA, 25 bp, Rattus norvegicus
gacacccttctgctttctttcttgt

SEQ ID NO: 315483 - DNA, 25 bp, Rattus norvegicus
gacacccttctggtttctttcttgt

SEQ ID NO: 315484 - DNA, 25 bp, Rattus norvegicus
gacacccttgtgcagcatttgcata

SEQ ID NO: 315485 - DNA, 25 bp, Rattus norvegicus
gacacccttgtgcataacatctctg

SEQ ID NO: 315486 - DNA, 25 bp, Rattus norvegicus
gacacccttgtggagcatttgcata

SEQ ID NO: 315487 - DNA, 25 bp, Rattus norvegicus
gacacccttgtggataacatctctg

SEQ ID NO: 315488 - DNA, 25 bp, Rattus norvegicus
gacaccgaaacacagcgcttcctag

SEQ ID NO: 315489 - DNA, 25 bp, Rattus norvegicus
gacaccgaaacagagcgcttcctag

SEQ ID NO: 315490 - DNA, 25 bp, Rattus norvegicus
gacaccgacacccacttataagggc

SEQ ID NO: 315491 - DNA, 25 bp, Rattus norvegicus
gacaccgacaccgacttataagggc

SEQ ID NO: 315492 - DNA, 25 bp, Rattus norvegicus
gacaccgacatcaagtggtcgtttg

SEQ ID NO: 315493 - DNA, 25 bp, Rattus norvegicus
gacaccgacatctagtggtcgtttg

SEQ ID NO: 315494 - DNA, 25 bp, Rattus norvegicus
gacaccgaccatccagtaggactgg

SEQ ID NO: 315495 - DNA, 25 bp, Rattus norvegicus
gacaccgaccatgcagtaggactgg

SEQ ID NO: 315496 - DNA, 25 bp, Rattus norvegicus
gacaccgacgtgctaggccagagtt

SEQ ID NO: 315497 - DNA, 25 bp, Rattus norvegicus
gacaccgacgtggtaggccagagtt

SEQ ID NO: 315498 - DNA, 25 bp, Rattus norvegicus
gacaccgacgttccaaaaaaggcca

SEQ ID NO: 315499 - DNA, 25 bp, Rattus norvegicus
gacaccgacgttgcaaaaaaggcca

SEQ ID NO: 315500 - DNA, 25 bp, Rattus norvegicus
gacaccgagtcacactgcatagagt

SEQ ID NO: 315501 - DNA, 25 bp, Rattus norvegicus
gacaccgagtcagactgcatagagt

SEQ ID NO: 315502 - DNA, 25 bp, Rattus norvegicus
gacaccgagtgacaatatctggcct

SEQ ID NO: 315503 - DNA, 25 bp, Rattus norvegicus
gacaccgagtgagaatatctggcct

SEQ ID NO: 315504 - DNA, 25 bp, Rattus norvegicus
gacaccgagttgagttctcagcaca

SEQ ID NO: 315505 - DNA, 25 bp, Rattus norvegicus
gacaccgagttgtgttctcagcaca

SEQ ID NO: 315506 - DNA, 25 bp, Rattus norvegicus
gacaccgcccttaggagtggtcaga

SEQ ID NO: 315507 - DNA, 25 bp, Rattus norvegicus
gacaccgccctttggagtggtcaga

SEQ ID NO: 315508 - DNA, 25 bp, Rattus norvegicus
gacaccgcggccactggtgtcctag

SEQ ID NO: 315509 - DNA, 25 bp, Rattus norvegicus
gacaccgcggcctctggtgtcctag

SEQ ID NO: 315510 - DNA, 25 bp, Rattus norvegicus
gacaccgcgtgccaactgatgttac

SEQ ID NO: 315511 - DNA, 25 bp, Rattus norvegicus
gacaccgcgtgcgaactgatgttac

SEQ ID NO: 315512 - DNA, 25 bp, Rattus norvegicus
gacaccgctggaaagcaaggctctg

SEQ ID NO: 315513 - DNA, 25 bp, Rattus norvegicus
gacaccgctggatagcaaggctctg

SEQ ID NO: 315514 - DNA, 25 bp, Rattus norvegicus
gacaccggaagccaaactgctgttt

SEQ ID NO: 315515 - DNA, 25 bp, Rattus norvegicus
gacaccggaagcgaaactgctgttt

SEQ ID NO: 315516 - DNA, 25 bp, Rattus norvegicus
gacaccggactgaacttctgcaagg

SEQ ID NO: 315517 - DNA, 25 bp, Rattus norvegicus
gacaccggactgtacttctgcaagg

SEQ ID NO: 315518 - DNA, 25 bp, Rattus norvegicus
gacaccggccggatgcgcagcagct

SEQ ID NO: 315519 - DNA, 25 bp, Rattus norvegicus
gacaccggccggttgcgcagcagct

SEQ ID NO: 315520 - DNA, 25 bp, Rattus norvegicus
gacaccggcgcacacgcaacgggat

SEQ ID NO: 315521 - DNA, 25 bp, Rattus norvegicus
gacaccggcgcagacgcaacgggat

SEQ ID NO: 315522 - DNA, 25 bp, Rattus norvegicus
gacaccgggagacggatgcttaacc

SEQ ID NO: 315523 - DNA, 25 bp, Rattus norvegicus
gacaccgggagagggatgcttaacc

SEQ ID NO: 315524 - DNA, 25 bp, Rattus norvegicus
gacaccgggatacagaacgggaccg

SEQ ID NO: 315525 - DNA, 25 bp, Rattus norvegicus
gacaccgggatagagaacgggaccg

SEQ ID NO: 315526 - DNA, 25 bp, Rattus norvegicus
gacaccgggcggactttgctggtac

SEQ ID NO: 315527 - DNA, 25 bp, Rattus norvegicus
gacaccgggcggtctttgctggtac

SEQ ID NO: 315528 - DNA, 25 bp, Rattus norvegicus
gacaccgggcttcatgttgttactt

SEQ ID NO: 315529 - DNA, 25 bp, Rattus norvegicus
gacaccgggcttgatgttgttactt

SEQ ID NO: 315530 - DNA, 25 bp, Rattus norvegicus
gacaccggtgagagttcctaaccca

SEQ ID NO: 315531 - DNA, 25 bp, Rattus norvegicus
gacaccggtgagtgttcctaaccca

SEQ ID NO: 315532 - DNA, 25 bp, Rattus norvegicus
gacaccgtagcgagcattaggatat

SEQ ID NO: 315533 - DNA, 25 bp, Rattus norvegicus
gacaccgtagcgtgcattaggatat

SEQ ID NO: 315534 - DNA, 25 bp, Rattus norvegicus
gacaccgtgcagatctcgctagaca

SEQ ID NO: 315535 - DNA, 25 bp, Rattus norvegicus
gacaccgtgcagttctcgctagaca

SEQ ID NO: 315536 - DNA, 25 bp, Rattus norvegicus
gacaccgtggtgattgccttcactg

SEQ ID NO: 315537 - DNA, 25 bp, Rattus norvegicus
gacaccgtggtgtttgccttcactg

SEQ ID NO: 315538 - DNA, 25 bp, Rattus norvegicus
gacaccgttgataatggagacatga

SEQ ID NO: 315539 - DNA, 25 bp, Rattus norvegicus
gacaccgttgattatggagacatga

SEQ ID NO: 315540 - DNA, 25 bp, Rattus norvegicus
gacaccgtttgtccccattggaatg

SEQ ID NO: 315541 - DNA, 25 bp, Rattus norvegicus
gacaccgtttgtgcccattggaatg

SEQ ID NO: 315542 - DNA, 25 bp, Rattus norvegicus
gacacctagatgaacgcgagcggct

SEQ ID NO: 315543 - DNA, 25 bp, Rattus norvegicus
gacacctagatgaggttcagctcct

SEQ ID NO: 315544 - DNA, 25 bp, Rattus norvegicus
gacacctagatgtacgcgagcggct

SEQ ID NO: 315545 - DNA, 25 bp, Rattus norvegicus
gacacctagatgtggttcagctcct

SEQ ID NO: 315546 - DNA, 25 bp, Rattus norvegicus
gacacctatctgcagagatttgcct

SEQ ID NO: 315547 - DNA, 25 bp, Rattus norvegicus
gacacctatctggagagatttgcct

SEQ ID NO: 315548 - DNA, 25 bp, Rattus norvegicus
gacacctatgatagtagccagcatt

SEQ ID NO: 315549 - DNA, 25 bp, Rattus norvegicus
gacacctatgattgtagccagcatt

SEQ ID NO: 315550 - DNA, 25 bp, Rattus norvegicus
gacacctattaaaatccccagactc

SEQ ID NO: 315551 - DNA, 25 bp, Rattus norvegicus
gacacctattaatatccccagactc

SEQ ID NO: 315552 - DNA, 25 bp, Rattus norvegicus
gacacctcacacctgacaagaacgt

SEQ ID NO: 315553 - DNA, 25 bp, Rattus norvegicus
gacacctcacacgtgacaagaacgt

SEQ ID NO: 315554 - DNA, 25 bp, Rattus norvegicus
gacacctcacatactgcgggtctaa

SEQ ID NO: 315555 - DNA, 25 bp, Rattus norvegicus
gacacctcacattctgcgggtctaa

SEQ ID NO: 315556 - DNA, 25 bp, Rattus norvegicus
gacacctcctatccagatggctatt

SEQ ID NO: 315557 - DNA, 25 bp, Rattus norvegicus
gacacctcctatgcagatggctatt

SEQ ID NO: 315558 - DNA, 25 bp, Rattus norvegicus
gacacctctcttaaatccctttagt

SEQ ID NO: 315559 - DNA, 25 bp, Rattus norvegicus
gacacctctctttaatccctttagt

SEQ ID NO: 315560 - DNA, 25 bp, Rattus norvegicus
gacacctctgtgattatccttttga

SEQ ID NO: 315561 - DNA, 25 bp, Rattus norvegicus
gacacctctgtgcattcaatgggac

SEQ ID NO: 315562 - DNA, 25 bp, Rattus norvegicus
gacacctctgtggattcaatgggac

SEQ ID NO: 315563 - DNA, 25 bp, Rattus norvegicus
gacacctctgtgtttatccttttga

SEQ ID NO: 315564 - DNA, 25 bp, Rattus norvegicus
gacacctcttcacagcagaaccgga

SEQ ID NO: 315565 - DNA, 25 bp, Rattus norvegicus
gacacctcttcagagcagaaccgga

SEQ ID NO: 315566 - DNA, 25 bp, Rattus norvegicus
gacacctgaatcatttacctggaga

SEQ ID NO: 315567 - DNA, 25 bp, Rattus norvegicus
gacacctgaatccattccagtttgg

SEQ ID NO: 315568 - DNA, 25 bp, Rattus norvegicus
gacacctgaatcgattccagtttgg

SEQ ID NO: 315569 - DNA, 25 bp, Rattus norvegicus
gacacctgaatcttttacctggaga

SEQ ID NO: 315570 - DNA, 25 bp, Rattus norvegicus
gacacctgaatgagatttctaacta

SEQ ID NO: 315571 - DNA, 25 bp, Rattus norvegicus
gacacctgaatgtgatttctaacta

SEQ ID NO: 315572 - DNA, 25 bp, Rattus norvegicus
gacacctgaggaaccttcattttgg

SEQ ID NO: 315573 - DNA, 25 bp, Rattus norvegicus
gacacctgaggatccttcattttgg

SEQ ID NO: 315574 - DNA, 25 bp, Rattus norvegicus
gacacctgatgtcatactctggcca

SEQ ID NO: 315575 - DNA, 25 bp, Rattus norvegicus
gacacctgatgtgatactctggcca

SEQ ID NO: 315576 - DNA, 25 bp, Rattus norvegicus
gacacctgcctgctgtataacgagt

SEQ ID NO: 315577 - DNA, 25 bp, Rattus norvegicus
gacacctgcctggtgtataacgagt

SEQ ID NO: 315578 - DNA, 25 bp, Rattus norvegicus
gacacctgctggctacgtggtttta

SEQ ID NO: 315579 - DNA, 25 bp, Rattus norvegicus
gacacctgctgggtacgtggtttta

SEQ ID NO: 315580 - DNA, 25 bp, Rattus norvegicus
gacacctgctttaatatctgaattg

SEQ ID NO: 315581 - DNA, 25 bp, Rattus norvegicus
gacacctgcttttatatctgaattg

SEQ ID NO: 315582 - DNA, 25 bp, Rattus norvegicus
gacacctggaaaccaggcttctgct

SEQ ID NO: 315583 - DNA, 25 bp, Rattus norvegicus
gacacctggaaagcaggcttctgct

SEQ ID NO: 315584 - DNA, 25 bp, Rattus norvegicus
gacacctggagaactatgacgctat

SEQ ID NO: 315585 - DNA, 25 bp, Rattus norvegicus
gacacctggagatctatgacgctat

SEQ ID NO: 315586 - DNA, 25 bp, Rattus norvegicus
gacacctggcagatagcttgttttc

SEQ ID NO: 315587 - DNA, 25 bp, Rattus norvegicus
gacacctggcagttagcttgttttc

SEQ ID NO: 315588 - DNA, 25 bp, Rattus norvegicus
gacacctgggagcaatgctttgcct

SEQ ID NO: 315589 - DNA, 25 bp, Rattus norvegicus
gacacctgggaggaatgctttgcct

SEQ ID NO: 315590 - DNA, 25 bp, Rattus norvegicus
gacacctggtagacctaagaacagt

SEQ ID NO: 315591 - DNA, 25 bp, Rattus norvegicus
gacacctggtagtcctaagaacagt

SEQ ID NO: 315592 - DNA, 25 bp, Rattus norvegicus
gacacctgtggtatgcagaggccgc

SEQ ID NO: 315593 - DNA, 25 bp, Rattus norvegicus
gacacctgtggtcaccaaagcgaca

SEQ ID NO: 315594 - DNA, 25 bp, Rattus norvegicus
gacacctgtggtgaccaaagcgaca

SEQ ID NO: 315595 - DNA, 25 bp, Rattus norvegicus
gacacctgtggtttgcagaggccgc

SEQ ID NO: 315596 - DNA, 25 bp, Rattus norvegicus
gacacctgtgtaccagcagcaattt

SEQ ID NO: 315597 - DNA, 25 bp, Rattus norvegicus
gacacctgtgtagcagcagcaattt

SEQ ID NO: 315598 - DNA, 25 bp, Rattus norvegicus
gacacctgtgttatcaccagcagaa

SEQ ID NO: 315599 - DNA, 25 bp, Rattus norvegicus
gacacctgtgttttcaccagcagaa

SEQ ID NO: 315600 - DNA, 25 bp, Rattus norvegicus
gacaccttaggtctggatatttttt

SEQ ID NO: 315601 - DNA, 25 bp, Rattus norvegicus
gacaccttaggtgtggatatttttt

SEQ ID NO: 315602 - DNA, 25 bp, Rattus norvegicus
gacaccttcaagagcaaagtccagg

SEQ ID NO: 315603 - DNA, 25 bp, Rattus norvegicus
gacaccttcaagtgcaaagtccagg

SEQ ID NO: 315604 - DNA, 25 bp, Rattus norvegicus
gacaccttcagaatgtaagctttga

SEQ ID NO: 315605 - DNA, 25 bp, Rattus norvegicus
gacaccttcagattgtaagctttga

SEQ ID NO: 315606 - DNA, 25 bp, Rattus norvegicus
gacaccttcctacattgcagatgct

SEQ ID NO: 315607 - DNA, 25 bp, Rattus norvegicus
gacaccttcctagattgcagatgct

SEQ ID NO: 315608 - DNA, 25 bp, Rattus norvegicus
gacaccttctgtatcttcattctaa

SEQ ID NO: 315609 - DNA, 25 bp, Rattus norvegicus
gacaccttctgtttcttcattctaa

SEQ ID NO: 315610 - DNA, 25 bp, Rattus norvegicus
gacaccttggcgcatttgttatctc

SEQ ID NO: 315611 - DNA, 25 bp, Rattus norvegicus
gacaccttggcggatttgttatctc

SEQ ID NO: 315612 - DNA, 25 bp, Rattus norvegicus
gacaccttgggtacatagacaacgt

SEQ ID NO: 315613 - DNA, 25 bp, Rattus norvegicus
gacaccttgggttcatagacaacgt

SEQ ID NO: 315614 - DNA, 25 bp, Rattus norvegicus
gacaccttggtcactagtgcattct

SEQ ID NO: 315615 - DNA, 25 bp, Rattus norvegicus
gacaccttggtctctagtgcattct

SEQ ID NO: 315616 - DNA, 25 bp, Rattus norvegicus
gacaccttgtggcacatgggtctct

SEQ ID NO: 315617 - DNA, 25 bp, Rattus norvegicus
gacaccttgtgggacatgggtctct

SEQ ID NO: 315618 - DNA, 25 bp, Rattus norvegicus
gacaccttgtgtctattcttagtgg

SEQ ID NO: 315619 - DNA, 25 bp, Rattus norvegicus
gacaccttgtgtgtattcttagtgg

SEQ ID NO: 315620 - DNA, 25 bp, Rattus norvegicus
gacacctttagcaggctactgagtt

SEQ ID NO: 315621 - DNA, 25 bp, Rattus norvegicus
gacacctttagctggctactgagtt

SEQ ID NO: 315622 - DNA, 25 bp, Rattus norvegicus
gacacctttccacccagggtgataa

SEQ ID NO: 315623 - DNA, 25 bp, Rattus norvegicus
gacacctttccagccagggtgataa

SEQ ID NO: 315624 - DNA, 25 bp, Rattus norvegicus
gacacctttgaaccgctgcgtattg

SEQ ID NO: 315625 - DNA, 25 bp, Rattus norvegicus
gacacctttgaagcgctgcgtattg

SEQ ID NO: 315626 - DNA, 25 bp, Rattus norvegicus
gacacctttgacaacactgagtatc

SEQ ID NO: 315627 - DNA, 25 bp, Rattus norvegicus
gacacctttgactacactgagtatc

SEQ ID NO: 315628 - DNA, 25 bp, Rattus norvegicus
gacacctttgtgctggagagcccca

SEQ ID NO: 315629 - DNA, 25 bp, Rattus norvegicus
gacacctttgtggtggagagcccca

SEQ ID NO: 315630 - DNA, 25 bp, Rattus norvegicus
gacaccttttgtctgtggaatcgct

SEQ ID NO: 315631 - DNA, 25 bp, Rattus norvegicus
gacaccttttgtgtgtggaatcgct

SEQ ID NO: 315632 - DNA, 25 bp, Rattus norvegicus
gacacgaccccaagcactaggaata

SEQ ID NO: 315633 - DNA, 25 bp, Rattus norvegicus
gacacgaccccacatgggtttgaga

SEQ ID NO: 315634 - DNA, 25 bp, Rattus norvegicus
gacacgaccccagatgggtttgaga

SEQ ID NO: 315635 - DNA, 25 bp, Rattus norvegicus
gacacgaccccatgcactaggaata

SEQ ID NO: 315636 - DNA, 25 bp, Rattus norvegicus
gacacgacctctacgggcaagatag

SEQ ID NO: 315637 - DNA, 25 bp, Rattus norvegicus
gacacgacctcttcgggcaagatag

SEQ ID NO: 315638 - DNA, 25 bp, Rattus norvegicus
gacacgagaacacaggccatccaag

SEQ ID NO: 315639 - DNA, 25 bp, Rattus norvegicus
gacacgagaacagaggccatccaag

SEQ ID NO: 315640 - DNA, 25 bp, Rattus norvegicus
gacacgagactgagacatagctttt

SEQ ID NO: 315641 - DNA, 25 bp, Rattus norvegicus
gacacgagactgtgacatagctttt

SEQ ID NO: 315642 - DNA, 25 bp, Rattus norvegicus
gacacgagcagtatatgcccatacc

SEQ ID NO: 315643 - DNA, 25 bp, Rattus norvegicus
gacacgagcagtttatgcccatacc

SEQ ID NO: 315644 - DNA, 25 bp, Rattus norvegicus
gacacgagctacagagcctcctaaa

SEQ ID NO: 315645 - DNA, 25 bp, Rattus norvegicus
gacacgagctactgagcctcctaaa

SEQ ID NO: 315646 - DNA, 25 bp, Rattus norvegicus
gacacgaggcagctggcaactgtta

SEQ ID NO: 315647 - DNA, 25 bp, Rattus norvegicus
gacacgaggcaggtggcaactgtta

SEQ ID NO: 315648 - DNA, 25 bp, Rattus norvegicus
gacacgaggcccagatgcgagtcac

SEQ ID NO: 315649 - DNA, 25 bp, Rattus norvegicus
gacacgaggccctgatgcgagtcac

SEQ ID NO: 315650 - DNA, 25 bp, Rattus norvegicus
gacacgagtcctcccaatggaacta

SEQ ID NO: 315651 - DNA, 25 bp, Rattus norvegicus
gacacgagtcctgccaatggaacta

SEQ ID NO: 315652 - DNA, 25 bp, Rattus norvegicus
gacacgatacttcctttcccagagt

SEQ ID NO: 315653 - DNA, 25 bp, Rattus norvegicus
gacacgatacttgctttcccagagt

SEQ ID NO: 315654 - DNA, 25 bp, Rattus norvegicus
gacacgatccctctaatatattgag

SEQ ID NO: 315655 - DNA, 25 bp, Rattus norvegicus
gacacgatccctgtaatatattgag

SEQ ID NO: 315656 - DNA, 25 bp, Rattus norvegicus
gacacgatttagcaccagcgggtta

SEQ ID NO: 315657 - DNA, 25 bp, Rattus norvegicus
gacacgatttaggaccagcgggtta

SEQ ID NO: 315658 - DNA, 25 bp, Rattus norvegicus
gacacgcaaacaccagactgaagca

SEQ ID NO: 315659 - DNA, 25 bp, Rattus norvegicus
gacacgcaaacagcagactgaagca

SEQ ID NO: 315660 - DNA, 25 bp, Rattus norvegicus
gacacgcaaagcaacctgactgaag

SEQ ID NO: 315661 - DNA, 25 bp, Rattus norvegicus
gacacgcaaagctacctgactgaag

SEQ ID NO: 315662 - DNA, 25 bp, Rattus norvegicus
gacacgcaagttctctacgggtagc

SEQ ID NO: 315663 - DNA, 25 bp, Rattus norvegicus
gacacgcaagttgtctacgggtagc

SEQ ID NO: 315664 - DNA, 25 bp, Rattus norvegicus
gacacgcaggagctgcccttagaaa

SEQ ID NO: 315665 - DNA, 25 bp, Rattus norvegicus
gacacgcaggaggtgcccttagaaa

SEQ ID NO: 315666 - DNA, 25 bp, Rattus norvegicus
gacacgcagtggaatctcattattg

SEQ ID NO: 315667 - DNA, 25 bp, Rattus norvegicus
gacacgcagtggtatctcattattg

SEQ ID NO: 315668 - DNA, 25 bp, Rattus norvegicus
gacacgcatcacatcctaatattta

SEQ ID NO: 315669 - DNA, 25 bp, Rattus norvegicus
gacacgcatcacttcctaatattta

SEQ ID NO: 315670 - DNA, 25 bp, Rattus norvegicus
gacacgcatcgtatttggaatccat

SEQ ID NO: 315671 - DNA, 25 bp, Rattus norvegicus
gacacgcatcgtttttggaatccat

SEQ ID NO: 315672 - DNA, 25 bp, Rattus norvegicus
gacacgcatgagctgctgtctcagt

SEQ ID NO: 315673 - DNA, 25 bp, Rattus norvegicus
gacacgcatgaggtgctgtctcagt

SEQ ID NO: 315674 - DNA, 25 bp, Rattus norvegicus
gacacgcattcactagtttatgcta

SEQ ID NO: 315675 - DNA, 25 bp, Rattus norvegicus
gacacgcattcagtagtttatgcta

SEQ ID NO: 315676 - DNA, 25 bp, Rattus norvegicus
gacacgccattaatttctccttttt

SEQ ID NO: 315677 - DNA, 25 bp, Rattus norvegicus
gacacgccattattttctccttttt

SEQ ID NO: 315678 - DNA, 25 bp, Rattus norvegicus
gacacgcccgagcaaaggagcctgt

SEQ ID NO: 315679 - DNA, 25 bp, Rattus norvegicus
gacacgcccgaggaaaggagcctgt

SEQ ID NO: 315680 - DNA, 25 bp, Rattus norvegicus
gacacgcctctgctgagtcttacag

SEQ ID NO: 315681 - DNA, 25 bp, Rattus norvegicus
gacacgcctctggtgagtcttacag

SEQ ID NO: 315682 - DNA, 25 bp, Rattus norvegicus
gacacgcgagaaactatccccggaa

SEQ ID NO: 315683 - DNA, 25 bp, Rattus norvegicus
gacacgcgagaatctatccccggaa

SEQ ID NO: 315684 - DNA, 25 bp, Rattus norvegicus
gacacgcggtacactcgtggtagtc

SEQ ID NO: 315685 - DNA, 25 bp, Rattus norvegicus
gacacgcggtactctcgtggtagtc

SEQ ID NO: 315686 - DNA, 25 bp, Rattus norvegicus
gacacgcgtgtgagtccacattgta

SEQ ID NO: 315687 - DNA, 25 bp, Rattus norvegicus
gacacgcgtgtgtgtccacattgta

SEQ ID NO: 315688 - DNA, 25 bp, Rattus norvegicus
gacacgctcaacacattggaaggca

SEQ ID NO: 315689 - DNA, 25 bp, Rattus norvegicus
gacacgctcaactcattggaaggca

SEQ ID NO: 315690 - DNA, 25 bp, Rattus norvegicus
gacacgctggagcacatttacaatc

SEQ ID NO: 315691 - DNA, 25 bp, Rattus norvegicus
gacacgctggaggacatttacaatc

SEQ ID NO: 315692 - DNA, 25 bp, Rattus norvegicus
gacacgcttttacatttttgatcag

SEQ ID NO: 315693 - DNA, 25 bp, Rattus norvegicus
gacacgcttttagatttttgatcag

SEQ ID NO: 315694 - DNA, 25 bp, Rattus norvegicus
gacacggaacgaaccctgcaacatt

SEQ ID NO: 315695 - DNA, 25 bp, Rattus norvegicus
gacacggaacgatccctgcaacatt

SEQ ID NO: 315696 - DNA, 25 bp, Rattus norvegicus
gacacggacatgaagcgactttcca

SEQ ID NO: 315697 - DNA, 25 bp, Rattus norvegicus
gacacggacatgtagcgactttcca

SEQ ID NO: 315698 - DNA, 25 bp, Rattus norvegicus
gacacggactggactttggaagaca

SEQ ID NO: 315699 - DNA, 25 bp, Rattus norvegicus
gacacggactggtctttggaagaca

SEQ ID NO: 315700 - DNA, 25 bp, Rattus norvegicus
gacacggagactctgacgtcagctg

SEQ ID NO: 315701 - DNA, 25 bp, Rattus norvegicus
gacacggagactgtgacgtcagctg

SEQ ID NO: 315702 - DNA, 25 bp, Rattus norvegicus
gacacggagctgattctgtataccc

SEQ ID NO: 315703 - DNA, 25 bp, Rattus norvegicus
gacacggagctgtttctgtataccc

SEQ ID NO: 315704 - DNA, 25 bp, Rattus norvegicus
gacacggaggcccaggcaagattta

SEQ ID NO: 315705 - DNA, 25 bp, Rattus norvegicus
gacacggaggccgaggcaagattta

SEQ ID NO: 315706 - DNA, 25 bp, Rattus norvegicus
gacacggaggttcacagaggcccca

SEQ ID NO: 315707 - DNA, 25 bp, Rattus norvegicus
gacacggaggttgacagaggcccca

SEQ ID NO: 315708 - DNA, 25 bp, Rattus norvegicus
gacacggcacaccagtgattgctct

SEQ ID NO: 315709 - DNA, 25 bp, Rattus norvegicus
gacacggcacacgagtgattgctct

SEQ ID NO: 315710 - DNA, 25 bp, Rattus norvegicus
gacacggcactgaccacagctaaag

SEQ ID NO: 315711 - DNA, 25 bp, Rattus norvegicus
gacacggcactgtccacagctaaag

SEQ ID NO: 315712 - DNA, 25 bp, Rattus norvegicus
gacacggcatctatctgagtcgatt

SEQ ID NO: 315713 - DNA, 25 bp, Rattus norvegicus
gacacggcatctttctgagtcgatt

SEQ ID NO: 315714 - DNA, 25 bp, Rattus norvegicus
gacacggcattcctcaatgggctga

SEQ ID NO: 315715 - DNA, 25 bp, Rattus norvegicus
gacacggcattcgtcaatgggctga

SEQ ID NO: 315716 - DNA, 25 bp, Rattus norvegicus
gacacggccgaaataactgactcct

SEQ ID NO: 315717 - DNA, 25 bp, Rattus norvegicus
gacacggccgaattaactgactcct

SEQ ID NO: 315718 - DNA, 25 bp, Rattus norvegicus
gacacggcctcaactggaagcacag

SEQ ID NO: 315719 - DNA, 25 bp, Rattus norvegicus
gacacggcctcatctggaagcacag

SEQ ID NO: 315720 - DNA, 25 bp, Rattus norvegicus
gacacggcctgcacgcaggttcgtg

SEQ ID NO: 315721 - DNA, 25 bp, Rattus norvegicus
gacacggcctgctcgcaggttcgtg

SEQ ID NO: 315722 - DNA, 25 bp, Rattus norvegicus
gacacggcgtatcttctgttgatgc

SEQ ID NO: 315723 - DNA, 25 bp, Rattus norvegicus
gacacggcgtatgttctgttgatgc

SEQ ID NO: 315724 - DNA, 25 bp, Rattus norvegicus
gacacggctaagacacactgggttc

SEQ ID NO: 315725 - DNA, 25 bp, Rattus norvegicus
gacacggctaagtcacactgggttc

SEQ ID NO: 315726 - DNA, 25 bp, Rattus norvegicus
gacacggctagtctcatacagcttt

SEQ ID NO: 315727 - DNA, 25 bp, Rattus norvegicus
gacacggctagtgtcatacagcttt

SEQ ID NO: 315728 - DNA, 25 bp, Rattus norvegicus
gacacgggatgcagagaaggctcta

SEQ ID NO: 315729 - DNA, 25 bp, Rattus norvegicus
gacacgggatgctgagaaggctcta

SEQ ID NO: 315730 - DNA, 25 bp, Rattus norvegicus
gacacgggccatcaaaactactggt

SEQ ID NO: 315731 - DNA, 25 bp, Rattus norvegicus
gacacgggccatgaaaactactggt

SEQ ID NO: 315732 - DNA, 25 bp, Rattus norvegicus
gacacgggtatcataaggacctcaa

SEQ ID NO: 315733 - DNA, 25 bp, Rattus norvegicus
gacacgggtatcttaaggacctcaa

SEQ ID NO: 315734 - DNA, 25 bp, Rattus norvegicus
gacacgggtcacactgtatttggct

SEQ ID NO: 315735 - DNA, 25 bp, Rattus norvegicus
gacacgggtcactctgtatttggct

SEQ ID NO: 315736 - DNA, 25 bp, Rattus norvegicus
gacacgggttccctcaagtgttagg

SEQ ID NO: 315737 - DNA, 25 bp, Rattus norvegicus
gacacgggttccgtcaagtgttagg

SEQ ID NO: 315738 - DNA, 25 bp, Rattus norvegicus
gacacggtatagctgctggaatcca

SEQ ID NO: 315739 - DNA, 25 bp, Rattus norvegicus
gacacggtataggtgctggaatcca

SEQ ID NO: 315740 - DNA, 25 bp, Rattus norvegicus
gacacggtattgcatttctatcttt

SEQ ID NO: 315741 - DNA, 25 bp, Rattus norvegicus
gacacggtattggatttctatcttt

SEQ ID NO: 315742 - DNA, 25 bp, Rattus norvegicus
gacacggtggatacttcggttaaag

SEQ ID NO: 315743 - DNA, 25 bp, Rattus norvegicus
gacacggtggattcttcggttaaag

SEQ ID NO: 315744 - DNA, 25 bp, Rattus norvegicus
gacacggttgggattctcataagta

SEQ ID NO: 315745 - DNA, 25 bp, Rattus norvegicus
gacacggttgggtttctcataagta

SEQ ID NO: 315746 - DNA, 25 bp, Rattus norvegicus
gacacggttttgctgacacttggag

SEQ ID NO: 315747 - DNA, 25 bp, Rattus norvegicus
gacacggttttggtgacacttggag

SEQ ID NO: 315748 - DNA, 25 bp, Rattus norvegicus
gacacgtaacacaattgctccaaat

SEQ ID NO: 315749 - DNA, 25 bp, Rattus norvegicus
gacacgtaacactattgctccaaat

SEQ ID NO: 315750 - DNA, 25 bp, Rattus norvegicus
gacacgtagggtactgggacttgta

SEQ ID NO: 315751 - DNA, 25 bp, Rattus norvegicus
gacacgtagggttctgggacttgta

SEQ ID NO: 315752 - DNA, 25 bp, Rattus norvegicus
gacacgtagtagacacaagttgcat

SEQ ID NO: 315753 - DNA, 25 bp, Rattus norvegicus
gacacgtagtagtcacaagttgcat

SEQ ID NO: 315754 - DNA, 25 bp, Rattus norvegicus
gacacgtccaccagagtggccaaag

SEQ ID NO: 315755 - DNA, 25 bp, Rattus norvegicus
gacacgtccacctgagtggccaaag

SEQ ID NO: 315756 - DNA, 25 bp, Rattus norvegicus
gacacgtctctgcatgttaattctg

SEQ ID NO: 315757 - DNA, 25 bp, Rattus norvegicus
gacacgtctctggatgttaattctg

SEQ ID NO: 315758 - DNA, 25 bp, Rattus norvegicus
gacacgtgagatcgagagaccagaa

SEQ ID NO: 315759 - DNA, 25 bp, Rattus norvegicus
gacacgtgagatggagagaccagaa

SEQ ID NO: 315760 - DNA, 25 bp, Rattus norvegicus
gacacgtgctgaaatatatgacaaa

SEQ ID NO: 315761 - DNA, 25 bp, Rattus norvegicus
gacacgtgctgatatatatgacaaa

SEQ ID NO: 315762 - DNA, 25 bp, Rattus norvegicus
gacacgtgggacagagagacctctc

SEQ ID NO: 315763 - DNA, 25 bp, Rattus norvegicus
gacacgtgggactgagagacctctc

SEQ ID NO: 315764 - DNA, 25 bp, Rattus norvegicus
gacacgtgtgacaatcactaggtat

SEQ ID NO: 315765 - DNA, 25 bp, Rattus norvegicus
gacacgtgtgactatcactaggtat

SEQ ID NO: 315766 - DNA, 25 bp, Rattus norvegicus
gacacgtgttttcgctcagcttagt

SEQ ID NO: 315767 - DNA, 25 bp, Rattus norvegicus
gacacgtgttttggctcagcttagt

SEQ ID NO: 315768 - DNA, 25 bp, Rattus norvegicus
gacacgttattcagtggatgtaatt

SEQ ID NO: 315769 - DNA, 25 bp, Rattus norvegicus
gacacgttattctgtggatgtaatt

SEQ ID NO: 315770 - DNA, 25 bp, Rattus norvegicus
gacacgtttttgacactaatgacta

SEQ ID NO: 315771 - DNA, 25 bp, Rattus norvegicus
gacacgtttttgtcactaatgacta

SEQ ID NO: 315772 - DNA, 25 bp, Rattus norvegicus
gacactaaattcaacatgccttcgt

SEQ ID NO: 315773 - DNA, 25 bp, Rattus norvegicus
gacactaaattctacatgccttcgt

SEQ ID NO: 315774 - DNA, 25 bp, Rattus norvegicus
gacactaaccagatttttatctact

SEQ ID NO: 315775 - DNA, 25 bp, Rattus norvegicus
gacactaaccagttttttatctact

SEQ ID NO: 315776 - DNA, 25 bp, Rattus norvegicus
gacactaaggaaacaagcatggcag

SEQ ID NO: 315777 - DNA, 25 bp, Rattus norvegicus
gacactaaggaatcaagcatggcag

SEQ ID NO: 315778 - DNA, 25 bp, Rattus norvegicus
gacactaatgtgattctggacactg

SEQ ID NO: 315779 - DNA, 25 bp, Rattus norvegicus
gacactaatgtgtttctggacactg

SEQ ID NO: 315780 - DNA, 25 bp, Rattus norvegicus
gacactacactacattcactgtggt

SEQ ID NO: 315781 - DNA, 25 bp, Rattus norvegicus
gacactacactagattcactgtggt

SEQ ID NO: 315782 - DNA, 25 bp, Rattus norvegicus
gacactacagtcctgatgcgggaaa

SEQ ID NO: 315783 - DNA, 25 bp, Rattus norvegicus
gacactacagtcgtgatgcgggaaa

SEQ ID NO: 315784 - DNA, 25 bp, Rattus norvegicus
gacactacattgatttggcctcaga

SEQ ID NO: 315785 - DNA, 25 bp, Rattus norvegicus
gacactacattgttttggcctcaga

SEQ ID NO: 315786 - DNA, 25 bp, Rattus norvegicus
gacactaccgtgatctcagatgtat

SEQ ID NO: 315787 - DNA, 25 bp, Rattus norvegicus
gacactaccgtgttctcagatgtat

SEQ ID NO: 315788 - DNA, 25 bp, Rattus norvegicus
gacactactaaacctgttggtctag

SEQ ID NO: 315789 - DNA, 25 bp, Rattus norvegicus
gacactactaaagctgttggtctag

SEQ ID NO: 315790 - DNA, 25 bp, Rattus norvegicus
gacactactagaaaggcacgcccaa

SEQ ID NO: 315791 - DNA, 25 bp, Rattus norvegicus
gacactactagataggcacgcccaa

SEQ ID NO: 315792 - DNA, 25 bp, Rattus norvegicus
gacactacttttaatatgtgctcta

SEQ ID NO: 315793 - DNA, 25 bp, Rattus norvegicus
gacactactttttatatgtgctcta

SEQ ID NO: 315794 - DNA, 25 bp, Rattus norvegicus
gacactagcatcagcttgaaccaga

SEQ ID NO: 315795 - DNA, 25 bp, Rattus norvegicus
gacactagcatctgcttgaaccaga

SEQ ID NO: 315796 - DNA, 25 bp, Rattus norvegicus
gacactagcattcccagtgaattgc

SEQ ID NO: 315797 - DNA, 25 bp, Rattus norvegicus
gacactagcattgccagtgaattgc

SEQ ID NO: 315798 - DNA, 25 bp, Rattus norvegicus
gacactagcctcagcgcccggagga

SEQ ID NO: 315799 - DNA, 25 bp, Rattus norvegicus
gacactagcctctgcgcccggagga

SEQ ID NO: 315800 - DNA, 25 bp, Rattus norvegicus
gacactagctatcgattttcatccc

SEQ ID NO: 315801 - DNA, 25 bp, Rattus norvegicus
gacactagctatggattttcatccc

SEQ ID NO: 315802 - DNA, 25 bp, Rattus norvegicus
gacactaggtttccactgaatcttc

SEQ ID NO: 315803 - DNA, 25 bp, Rattus norvegicus
gacactaggtttgcactgaatcttc

SEQ ID NO: 315804 - DNA, 25 bp, Rattus norvegicus
gacactagtctgatacactctgtgc

SEQ ID NO: 315805 - DNA, 25 bp, Rattus norvegicus
gacactagtctgttacactctgtgc

SEQ ID NO: 315806 - DNA, 25 bp, Rattus norvegicus
gacactatacatcagccatggtaga

SEQ ID NO: 315807 - DNA, 25 bp, Rattus norvegicus
gacactatacatgagccatggtaga

SEQ ID NO: 315808 - DNA, 25 bp, Rattus norvegicus
gacactatagtgattgcttctactg

SEQ ID NO: 315809 - DNA, 25 bp, Rattus norvegicus
gacactatagtgcatcggagtagga

SEQ ID NO: 315810 - DNA, 25 bp, Rattus norvegicus
gacactatagtggatcggagtagga

SEQ ID NO: 315811 - DNA, 25 bp, Rattus norvegicus
gacactatagtgtttgcttctactg

SEQ ID NO: 315812 - DNA, 25 bp, Rattus norvegicus
gacactatccatctctatttgtagt

SEQ ID NO: 315813 - DNA, 25 bp, Rattus norvegicus
gacactatccatgtctatttgtagt

SEQ ID NO: 315814 - DNA, 25 bp, Rattus norvegicus
gacactatcggtcgagatgctggaa

SEQ ID NO: 315815 - DNA, 25 bp, Rattus norvegicus
gacactatcggtggagatgctggaa

SEQ ID NO: 315816 - DNA, 25 bp, Rattus norvegicus
gacactatctatcgtgaccctctaa

SEQ ID NO: 315817 - DNA, 25 bp, Rattus norvegicus
gacactatctatggtgaccctctaa

SEQ ID NO: 315818 - DNA, 25 bp, Rattus norvegicus
gacactatgacaacacagctgtacc

SEQ ID NO: 315819 - DNA, 25 bp, Rattus norvegicus
gacactatgacatcacagctgtacc

SEQ ID NO: 315820 - DNA, 25 bp, Rattus norvegicus
gacactatggccacagatactggtg

SEQ ID NO: 315821 - DNA, 25 bp, Rattus norvegicus
gacactatggcctcagatactggtg

SEQ ID NO: 315822 - DNA, 25 bp, Rattus norvegicus
gacactatgtgcctggtgctcacca

SEQ ID NO: 315823 - DNA, 25 bp, Rattus norvegicus
gacactatgtgcgtggtgctcacca

SEQ ID NO: 315824 - DNA, 25 bp, Rattus norvegicus
gacactattgcaaccaaattggctt

SEQ ID NO: 315825 - DNA, 25 bp, Rattus norvegicus
gacactattgcatccaaattggctt

SEQ ID NO: 315826 - DNA, 25 bp, Rattus norvegicus
gacactattgtcatcaacaaggagt

SEQ ID NO: 315827 - DNA, 25 bp, Rattus norvegicus
gacactattgtcttcaacaaggagt

SEQ ID NO: 315828 - DNA, 25 bp, Rattus norvegicus
gacactatttaccagtcactaatca

SEQ ID NO: 315829 - DNA, 25 bp, Rattus norvegicus
gacactatttacgagtcactaatca

SEQ ID NO: 315830 - DNA, 25 bp, Rattus norvegicus
gacactcaacacacagttttctcag

SEQ ID NO: 315831 - DNA, 25 bp, Rattus norvegicus
gacactcaacactcagttttctcag

SEQ ID NO: 315832 - DNA, 25 bp, Rattus norvegicus
gacactcaacctctctcaggaggag

SEQ ID NO: 315833 - DNA, 25 bp, Rattus norvegicus
gacactcaacctgtctcaggaggag

SEQ ID NO: 315834 - DNA, 25 bp, Rattus norvegicus
gacactcacaggcttcacaaagaag

SEQ ID NO: 315835 - DNA, 25 bp, Rattus norvegicus
gacactcacagggttcacaaagaag

SEQ ID NO: 315836 - DNA, 25 bp, Rattus norvegicus
gacactcacagtaagcagaaccact

SEQ ID NO: 315837 - DNA, 25 bp, Rattus norvegicus
gacactcacagttagcagaaccact

SEQ ID NO: 315838 - DNA, 25 bp, Rattus norvegicus
gacactcacctgactaactttggac

SEQ ID NO: 315839 - DNA, 25 bp, Rattus norvegicus
gacactcacctgtctaactttggac

SEQ ID NO: 315840 - DNA, 25 bp, Rattus norvegicus
gacactcagagtaggcagcctttga

SEQ ID NO: 315841 - DNA, 25 bp, Rattus norvegicus
gacactcagagttggcagcctttga

SEQ ID NO: 315842 - DNA, 25 bp, Rattus norvegicus
gacactcaggaactgcctctggaaa

SEQ ID NO: 315843 - DNA, 25 bp, Rattus norvegicus
gacactcaggaagtgcctctggaaa

SEQ ID NO: 315844 - DNA, 25 bp, Rattus norvegicus
gacactcaggacctttgacacgggt

SEQ ID NO: 315845 - DNA, 25 bp, Rattus norvegicus
gacactcaggacgtttgacacgggt

SEQ ID NO: 315846 - DNA, 25 bp, Rattus norvegicus
gacactcaggcacttaaatgacact

SEQ ID NO: 315847 - DNA, 25 bp, Rattus norvegicus
gacactcaggcagttaaatgacact

SEQ ID NO: 315848 - DNA, 25 bp, Rattus norvegicus
gacactcagtagacttgatgatggt

SEQ ID NO: 315849 - DNA, 25 bp, Rattus norvegicus
gacactcagtagtcttgatgatggt

SEQ ID NO: 315850 - DNA, 25 bp, Rattus norvegicus
gacactcatcctccactgaggtgaa

SEQ ID NO: 315851 - DNA, 25 bp, Rattus norvegicus
gacactcatcctgcactgaggtgaa

SEQ ID NO: 315852 - DNA, 25 bp, Rattus norvegicus
gacactcatctgagaatatcgctgg

SEQ ID NO: 315853 - DNA, 25 bp, Rattus norvegicus
gacactcatctgtgaatatcgctgg

SEQ ID NO: 315854 - DNA, 25 bp, Rattus norvegicus
gacactccaaatcgcatgtgactcc

SEQ ID NO: 315855 - DNA, 25 bp, Rattus norvegicus
gacactccaaatggcatgtgactcc

SEQ ID NO: 315856 - DNA, 25 bp, Rattus norvegicus
gacactccaagaatgactgctcctt

SEQ ID NO: 315857 - DNA, 25 bp, Rattus norvegicus
gacactccaagattgactgctcctt

SEQ ID NO: 315858 - DNA, 25 bp, Rattus norvegicus
gacactccaagtctagcagtgacag

SEQ ID NO: 315859 - DNA, 25 bp, Rattus norvegicus
gacactccaagtgtagcagtgacag

SEQ ID NO: 315860 - DNA, 25 bp, Rattus norvegicus
gacactccagaacaagttgctccaa

SEQ ID NO: 315861 - DNA, 25 bp, Rattus norvegicus
gacactccagaagaagttgctccaa

SEQ ID NO: 315862 - DNA, 25 bp, Rattus norvegicus
gacactccagagagctaacgtctgt

SEQ ID NO: 315863 - DNA, 25 bp, Rattus norvegicus
gacactccagagtgctaacgtctgt

SEQ ID NO: 315864 - DNA, 25 bp, Rattus norvegicus
gacactccagggattcaccttcaga

SEQ ID NO: 315865 - DNA, 25 bp, Rattus norvegicus
gacactccagggtttcaccttcaga

SEQ ID NO: 315866 - DNA, 25 bp, Rattus norvegicus
gacactcccatcactagggtttcag

SEQ ID NO: 315867 - DNA, 25 bp, Rattus norvegicus
gacactcccatctctagggtttcag

SEQ ID NO: 315868 - DNA, 25 bp, Rattus norvegicus
gacactccctgtaaaaattccatct

SEQ ID NO: 315869 - DNA, 25 bp, Rattus norvegicus
gacactccctgttaaaattccatct

SEQ ID NO: 315870 - DNA, 25 bp, Rattus norvegicus
gacactccgttcacagatttctaga

SEQ ID NO: 315871 - DNA, 25 bp, Rattus norvegicus
gacactccgttctcagatttctaga

SEQ ID NO: 315872 - DNA, 25 bp, Rattus norvegicus
gacactcctcagactattgagtagg

SEQ ID NO: 315873 - DNA, 25 bp, Rattus norvegicus
gacactcctcagtctattgagtagg

SEQ ID NO: 315874 - DNA, 25 bp, Rattus norvegicus
gacactcctcatcggagggatggct

SEQ ID NO: 315875 - DNA, 25 bp, Rattus norvegicus
gacactcctcatgggagggatggct

SEQ ID NO: 315876 - DNA, 25 bp, Rattus norvegicus
gacactcctgaacgacagtggacta

SEQ ID NO: 315877 - DNA, 25 bp, Rattus norvegicus
gacactcctgaaggacagtggacta

SEQ ID NO: 315878 - DNA, 25 bp, Rattus norvegicus
gacactccttggatggtgatctgga

SEQ ID NO: 315879 - DNA, 25 bp, Rattus norvegicus
gacactccttggttggtgatctgga

SEQ ID NO: 315880 - DNA, 25 bp, Rattus norvegicus
gacactcgaacacttatcattcact

SEQ ID NO: 315881 - DNA, 25 bp, Rattus norvegicus
gacactcgaacagttatcattcact

SEQ ID NO: 315882 - DNA, 25 bp, Rattus norvegicus
gacactcgactgatgaggttgccgt

SEQ ID NO: 315883 - DNA, 25 bp, Rattus norvegicus
gacactcgactgttgaggttgccgt

SEQ ID NO: 315884 - DNA, 25 bp, Rattus norvegicus
gacactcgaggcatgaggctgacaa

SEQ ID NO: 315885 - DNA, 25 bp, Rattus norvegicus
gacactcgaggcttgaggctgacaa

SEQ ID NO: 315886 - DNA, 25 bp, Rattus norvegicus
gacactcgccaaagtcactagaacg

SEQ ID NO: 315887 - DNA, 25 bp, Rattus norvegicus
gacactcgccaatgtcactagaacg

SEQ ID NO: 315888 - DNA, 25 bp, Rattus norvegicus
gacactcgctgactcctgaggagta

SEQ ID NO: 315889 - DNA, 25 bp, Rattus norvegicus
gacactcgctgagtcctgaggagta

SEQ ID NO: 315890 - DNA, 25 bp, Rattus norvegicus
gacactcgtgagactgacttacagg

SEQ ID NO: 315891 - DNA, 25 bp, Rattus norvegicus
gacactcgtgagtctgacttacagg

SEQ ID NO: 315892 - DNA, 25 bp, Rattus norvegicus
gacactcgtttcaaaaattaccaca

SEQ ID NO: 315893 - DNA, 25 bp, Rattus norvegicus
gacactcgtttctaaaattaccaca

SEQ ID NO: 315894 - DNA, 25 bp, Rattus norvegicus
gacactctacagacgctcaaactga

SEQ ID NO: 315895 - DNA, 25 bp, Rattus norvegicus
gacactctacagtcgctcaaactga

SEQ ID NO: 315896 - DNA, 25 bp, Rattus norvegicus
gacactctccgacatgaaggcctag

SEQ ID NO: 315897 - DNA, 25 bp, Rattus norvegicus
gacactctccgagatgaaggcctag

SEQ ID NO: 315898 - DNA, 25 bp, Rattus norvegicus
gacactctcgatattcctgtgtaga

SEQ ID NO: 315899 - DNA, 25 bp, Rattus norvegicus
gacactctcgattttcctgtgtaga

SEQ ID NO: 315900 - DNA, 25 bp, Rattus norvegicus
gacactctggagcaagtacgtagca

SEQ ID NO: 315901 - DNA, 25 bp, Rattus norvegicus
gacactctggaggaagtacgtagca

SEQ ID NO: 315902 - DNA, 25 bp, Rattus norvegicus
gacactctgtttatgaactgtgcta

SEQ ID NO: 315903 - DNA, 25 bp, Rattus norvegicus
gacactctgtttttgaactgtgcta

SEQ ID NO: 315904 - DNA, 25 bp, Rattus norvegicus
gacactcttacgctgacttttgttt

SEQ ID NO: 315905 - DNA, 25 bp, Rattus norvegicus
gacactcttacggtgacttttgttt

SEQ ID NO: 315906 - DNA, 25 bp, Rattus norvegicus
gacactctttaccaactcattgaaa

SEQ ID NO: 315907 - DNA, 25 bp, Rattus norvegicus
gacactctttacgaactcattgaaa

SEQ ID NO: 315908 - DNA, 25 bp, Rattus norvegicus
gacactctttgcattttgtctaagt

SEQ ID NO: 315909 - DNA, 25 bp, Rattus norvegicus
gacactctttgctttttgtctaagt

SEQ ID NO: 315910 - DNA, 25 bp, Rattus norvegicus
gacactgaaagcatgcctctggagc

SEQ ID NO: 315911 - DNA, 25 bp, Rattus norvegicus
gacactgaaagcttgcctctggagc

SEQ ID NO: 315912 - DNA, 25 bp, Rattus norvegicus
gacactgaaaggataccgtggcatc

SEQ ID NO: 315913 - DNA, 25 bp, Rattus norvegicus
gacactgaaaggttaccgtggcatc

SEQ ID NO: 315914 - DNA, 25 bp, Rattus norvegicus
gacactgaactcatggaggtcgctt

SEQ ID NO: 315915 - DNA, 25 bp, Rattus norvegicus
gacactgaactcttggaggtcgctt

SEQ ID NO: 315916 - DNA, 25 bp, Rattus norvegicus
gacactgaactgcagcaaggccttg

SEQ ID NO: 315917 - DNA, 25 bp, Rattus norvegicus
gacactgaactggagcaaggccttg

SEQ ID NO: 315918 - DNA, 25 bp, Rattus norvegicus
gacactgaagatcttggttctctca

SEQ ID NO: 315919 - DNA, 25 bp, Rattus norvegicus
gacactgaagatgttggttctctca

SEQ ID NO: 315920 - DNA, 25 bp, Rattus norvegicus
gacactgacaatcgcctttttgttc

SEQ ID NO: 315921 - DNA, 25 bp, Rattus norvegicus
gacactgacaatggcctttttgttc

SEQ ID NO: 315922 - DNA, 25 bp, Rattus norvegicus
gacactgacacaaccacacacatgg

SEQ ID NO: 315923 - DNA, 25 bp, Rattus norvegicus
gacactgacacatccacacacatgg

SEQ ID NO: 315924 - DNA, 25 bp, Rattus norvegicus
gacactgacaccaggattcatgact

SEQ ID NO: 315925 - DNA, 25 bp, Rattus norvegicus
gacactgacacctggattcatgact

SEQ ID NO: 315926 - DNA, 25 bp, Rattus norvegicus
gacactgacagcagcctggaagcct

SEQ ID NO: 315927 - DNA, 25 bp, Rattus norvegicus
gacactgacagccaaaagtgatgct

SEQ ID NO: 315928 - DNA, 25 bp, Rattus norvegicus
gacactgacagcgaaaagtgatgct

SEQ ID NO: 315929 - DNA, 25 bp, Rattus norvegicus
gacactgacagctgcctggaagcct

SEQ ID NO: 315930 - DNA, 25 bp, Rattus norvegicus
gacactgacaggactcttcagagct

SEQ ID NO: 315931 - DNA, 25 bp, Rattus norvegicus
gacactgacaggtctcttcagagct

SEQ ID NO: 315932 - DNA, 25 bp, Rattus norvegicus
gacactgacagtcgaactcccttta

SEQ ID NO: 315933 - DNA, 25 bp, Rattus norvegicus
gacactgacagtggaactcccttta

SEQ ID NO: 315934 - DNA, 25 bp, Rattus norvegicus
gacactgacatgcaactctgggcta

SEQ ID NO: 315935 - DNA, 25 bp, Rattus norvegicus
gacactgacatggaactctgggcta

SEQ ID NO: 315936 - DNA, 25 bp, Rattus norvegicus
gacactgacgccacttagaactgtg

SEQ ID NO: 315937 - DNA, 25 bp, Rattus norvegicus
gacactgacgcctcttagaactgtg

SEQ ID NO: 315938 - DNA, 25 bp, Rattus norvegicus
gacactgactgaagggctacttagc

SEQ ID NO: 315939 - DNA, 25 bp, Rattus norvegicus
gacactgactgatgggctacttagc

SEQ ID NO: 315940 - DNA, 25 bp, Rattus norvegicus
gacactgactgcacttgttatccat

SEQ ID NO: 315941 - DNA, 25 bp, Rattus norvegicus
gacactgactgctcttgttatccat

SEQ ID NO: 315942 - DNA, 25 bp, Rattus norvegicus
gacactgacttcaaggtgacgactg

SEQ ID NO: 315943 - DNA, 25 bp, Rattus norvegicus
gacactgacttctaggtgacgactg

SEQ ID NO: 315944 - DNA, 25 bp, Rattus norvegicus
gacactgagctgagaagccggacac

SEQ ID NO: 315945 - DNA, 25 bp, Rattus norvegicus
gacactgagctgtgaagccggacac

SEQ ID NO: 315946 - DNA, 25 bp, Rattus norvegicus
gacactgaggaccagcttcaaggct

SEQ ID NO: 315947 - DNA, 25 bp, Rattus norvegicus
gacactgaggacgagcttcaaggct

SEQ ID NO: 315948 - DNA, 25 bp, Rattus norvegicus
gacactgaggtcattaagaggccct

SEQ ID NO: 315949 - DNA, 25 bp, Rattus norvegicus
gacactgaggtctttaagaggccct

SEQ ID NO: 315950 - DNA, 25 bp, Rattus norvegicus
gacactgaggttacttcagcttgcc

SEQ ID NO: 315951 - DNA, 25 bp, Rattus norvegicus
gacactgaggtttcttcagcttgcc

SEQ ID NO: 315952 - DNA, 25 bp, Rattus norvegicus
gacactgagtgcaaaaggtattgga

SEQ ID NO: 315953 - DNA, 25 bp, Rattus norvegicus
gacactgagtgcattgtgctttctg

SEQ ID NO: 315954 - DNA, 25 bp, Rattus norvegicus
gacactgagtgctaaaggtattgga

SEQ ID NO: 315955 - DNA, 25 bp, Rattus norvegicus
gacactgagtgctttgtgctttctg

SEQ ID NO: 315956 - DNA, 25 bp, Rattus norvegicus
gacactgattctccgtcaactgatg

SEQ ID NO: 315957 - DNA, 25 bp, Rattus norvegicus
gacactgattctgcgtcaactgatg

SEQ ID NO: 315958 - DNA, 25 bp, Rattus norvegicus
gacactgatttgagggagtcttctt

SEQ ID NO: 315959 - DNA, 25 bp, Rattus norvegicus
gacactgatttgtgggagtcttctt

SEQ ID NO: 315960 - DNA, 25 bp, Rattus norvegicus
gacactgcaatgaagttaccatagt

SEQ ID NO: 315961 - DNA, 25 bp, Rattus norvegicus
gacactgcaatgtagttaccatagt

SEQ ID NO: 315962 - DNA, 25 bp, Rattus norvegicus
gacactgcacagatgggtccttagc

SEQ ID NO: 315963 - DNA, 25 bp, Rattus norvegicus
gacactgcacagttgggtccttagc

SEQ ID NO: 315964 - DNA, 25 bp, Rattus norvegicus
gacactgcactgatagagtcaactc

SEQ ID NO: 315965 - DNA, 25 bp, Rattus norvegicus
gacactgcactgttagagtcaactc

SEQ ID NO: 315966 - DNA, 25 bp, Rattus norvegicus
gacactgcagaacaggtcatcgcct

SEQ ID NO: 315967 - DNA, 25 bp, Rattus norvegicus
gacactgcagaagaggtcatcgcct

SEQ ID NO: 315968 - DNA, 25 bp, Rattus norvegicus
gacactgcagatcctaaagccgagt

SEQ ID NO: 315969 - DNA, 25 bp, Rattus norvegicus
gacactgcagatgctaaagccgagt

SEQ ID NO: 315970 - DNA, 25 bp, Rattus norvegicus
gacactgcagcaaggaacactttac

SEQ ID NO: 315971 - DNA, 25 bp, Rattus norvegicus
gacactgcagcatggaacactttac

SEQ ID NO: 315972 - DNA, 25 bp, Rattus norvegicus
gacactgcagtcattggaaggccag

SEQ ID NO: 315973 - DNA, 25 bp, Rattus norvegicus
gacactgcagtctttggaaggccag

SEQ ID NO: 315974 - DNA, 25 bp, Rattus norvegicus
gacactgcatcaatggcattgcctg

SEQ ID NO: 315975 - DNA, 25 bp, Rattus norvegicus
gacactgcatcattggcattgcctg

SEQ ID NO: 315976 - DNA, 25 bp, Rattus norvegicus
gacactgcatggaagccagagcctt

SEQ ID NO: 315977 - DNA, 25 bp, Rattus norvegicus
gacactgcatggtagccagagcctt

SEQ ID NO: 315978 - DNA, 25 bp, Rattus norvegicus
gacactgcccatcagtacagagcca

SEQ ID NO: 315979 - DNA, 25 bp, Rattus norvegicus
gacactgcccatgagtacagagcca

SEQ ID NO: 315980 - DNA, 25 bp, Rattus norvegicus
gacactgcccttacatacaaaatgg

SEQ ID NO: 315981 - DNA, 25 bp, Rattus norvegicus
gacactgccctttcatacaaaatgg

SEQ ID NO: 315982 - DNA, 25 bp, Rattus norvegicus
gacactgcctcaagagttctgagaa

SEQ ID NO: 315983 - DNA, 25 bp, Rattus norvegicus
gacactgcctcatgagttctgagaa

SEQ ID NO: 315984 - DNA, 25 bp, Rattus norvegicus
gacactgcctctagtctcagacaag

SEQ ID NO: 315985 - DNA, 25 bp, Rattus norvegicus
gacactgcctcttgtctcagacaag

SEQ ID NO: 315986 - DNA, 25 bp, Rattus norvegicus
gacactgccttcaagctgggattta

SEQ ID NO: 315987 - DNA, 25 bp, Rattus norvegicus
gacactgccttctagctgggattta

SEQ ID NO: 315988 - DNA, 25 bp, Rattus norvegicus
gacactgccttgaatttttgtgcaa

SEQ ID NO: 315989 - DNA, 25 bp, Rattus norvegicus
gacactgccttgtatttttgtgcaa

SEQ ID NO: 315990 - DNA, 25 bp, Rattus norvegicus
gacactgctagtatttgctacctgt

SEQ ID NO: 315991 - DNA, 25 bp, Rattus norvegicus
gacactgctagtttttgctacctgt

SEQ ID NO: 315992 - DNA, 25 bp, Rattus norvegicus
gacactgctctgactgacactgaag

SEQ ID NO: 315993 - DNA, 25 bp, Rattus norvegicus
gacactgctctgtctgacactgaag

SEQ ID NO: 315994 - DNA, 25 bp, Rattus norvegicus
gacactgctgctacattatcaaaaa

SEQ ID NO: 315995 - DNA, 25 bp, Rattus norvegicus
gacactgctgcttcattatcaaaaa

SEQ ID NO: 315996 - DNA, 25 bp, Rattus norvegicus
gacactgcttcaagatttactttta

SEQ ID NO: 315997 - DNA, 25 bp, Rattus norvegicus
gacactgcttcatgatttactttta

SEQ ID NO: 315998 - DNA, 25 bp, Rattus norvegicus
gacactggaaagaatctccggcaga

SEQ ID NO: 315999 - DNA, 25 bp, Rattus norvegicus
gacactggaaagtatctccggcaga

SEQ ID NO: 316000 - DNA, 25 bp, Rattus norvegicus
gacactggacatcctggacctcggg

SEQ ID NO: 316001 - DNA, 25 bp, Rattus norvegicus
gacactggacatgctggacctcggg

SEQ ID NO: 316002 - DNA, 25 bp, Rattus norvegicus
gacactggactgagtctcacagacc

SEQ ID NO: 316003 - DNA, 25 bp, Rattus norvegicus
gacactggactgtgtctcacagacc

SEQ ID NO: 316004 - DNA, 25 bp, Rattus norvegicus
gacactggagatcaggatgcacaca

SEQ ID NO: 316005 - DNA, 25 bp, Rattus norvegicus
gacactggagatgaggatgcacaca

SEQ ID NO: 316006 - DNA, 25 bp, Rattus norvegicus
gacactggagtgagccttgatggca

SEQ ID NO: 316007 - DNA, 25 bp, Rattus norvegicus
gacactggagtgtgccttgatggca

SEQ ID NO: 316008 - DNA, 25 bp, Rattus norvegicus
gacactggatgtccttatctgtact

SEQ ID NO: 316009 - DNA, 25 bp, Rattus norvegicus
gacactggatgtgcttatctgtact

SEQ ID NO: 316010 - DNA, 25 bp, Rattus norvegicus
gacactggcatgcaatttttggtat

SEQ ID NO: 316011 - DNA, 25 bp, Rattus norvegicus
gacactggcatggaatttttggtat

SEQ ID NO: 316012 - DNA, 25 bp, Rattus norvegicus
gacactggctctaacaacatacatc

SEQ ID NO: 316013 - DNA, 25 bp, Rattus norvegicus
gacactggctcttacaacatacatc

SEQ ID NO: 316014 - DNA, 25 bp, Rattus norvegicus
gacactgggcctcttgagcacttgt

SEQ ID NO: 316015 - DNA, 25 bp, Rattus norvegicus
gacactgggcctgttgagcacttgt

SEQ ID NO: 316016 - DNA, 25 bp, Rattus norvegicus
gacactgggctcacagagatgcgta

SEQ ID NO: 316017 - DNA, 25 bp, Rattus norvegicus
gacactgggctctcagagatgcgta

SEQ ID NO: 316018 - DNA, 25 bp, Rattus norvegicus
gacactgggcttccgttacaagatg

SEQ ID NO: 316019 - DNA, 25 bp, Rattus norvegicus
gacactgggcttgcgttacaagatg

SEQ ID NO: 316020 - DNA, 25 bp, Rattus norvegicus
gacactgggtgtactaatgctgact

SEQ ID NO: 316021 - DNA, 25 bp, Rattus norvegicus
gacactgggtgttctaatgctgact

SEQ ID NO: 316022 - DNA, 25 bp, Rattus norvegicus
gacactggtactatctgagcttgac

SEQ ID NO: 316023 - DNA, 25 bp, Rattus norvegicus
gacactggtactttctgagcttgac

SEQ ID NO: 316024 - DNA, 25 bp, Rattus norvegicus
gacactggtatacatggtcattttt

SEQ ID NO: 316025 - DNA, 25 bp, Rattus norvegicus
gacactggtatagatggtcattttt

SEQ ID NO: 316026 - DNA, 25 bp, Rattus norvegicus
gacactggtcacagaacagcggctg

SEQ ID NO: 316027 - DNA, 25 bp, Rattus norvegicus
gacactggtcactgaacagcggctg

SEQ ID NO: 316028 - DNA, 25 bp, Rattus norvegicus
gacactggtcggcagtcagaacctt

SEQ ID NO: 316029 - DNA, 25 bp, Rattus norvegicus
gacactggtcgggagtcagaacctt

SEQ ID NO: 316030 - DNA, 25 bp, Rattus norvegicus
gacactggtctgagtccaaagaact

SEQ ID NO: 316031 - DNA, 25 bp, Rattus norvegicus
gacactggtctgtgtccaaagaact

SEQ ID NO: 316032 - DNA, 25 bp, Rattus norvegicus
gacactggtgggaagcaatgccttg

SEQ ID NO: 316033 - DNA, 25 bp, Rattus norvegicus
gacactggtgggtagcaatgccttg

SEQ ID NO: 316034 - DNA, 25 bp, Rattus norvegicus
gacactggtgtccttggcaaaaatt

SEQ ID NO: 316035 - DNA, 25 bp, Rattus norvegicus
gacactggtgtcgttggcaaaaatt

SEQ ID NO: 316036 - DNA, 25 bp, Rattus norvegicus
gacactggtgtgatgttcatttcta

SEQ ID NO: 316037 - DNA, 25 bp, Rattus norvegicus
gacactggtgtgttgttcatttcta

SEQ ID NO: 316038 - DNA, 25 bp, Rattus norvegicus
gacactggttctaaccatgtgaccc

SEQ ID NO: 316039 - DNA, 25 bp, Rattus norvegicus
gacactggttcttaccatgtgaccc

SEQ ID NO: 316040 - DNA, 25 bp, Rattus norvegicus
gacactggttgtcatctaatcagca

SEQ ID NO: 316041 - DNA, 25 bp, Rattus norvegicus
gacactggttgtgatctaatcagca

SEQ ID NO: 316042 - DNA, 25 bp, Rattus norvegicus
gacactgtaaggactgtgggctcca

SEQ ID NO: 316043 - DNA, 25 bp, Rattus norvegicus
gacactgtaaggtctgtgggctcca

SEQ ID NO: 316044 - DNA, 25 bp, Rattus norvegicus
gacactgtaatgagctaccgcgtgc

SEQ ID NO: 316045 - DNA, 25 bp, Rattus norvegicus
gacactgtaatgtgctaccgcgtgc

SEQ ID NO: 316046 - DNA, 25 bp, Rattus norvegicus
gacactgtacagatttccatggtag

SEQ ID NO: 316047 - DNA, 25 bp, Rattus norvegicus
gacactgtacagcaggcctatccca

SEQ ID NO: 316048 - DNA, 25 bp, Rattus norvegicus
gacactgtacaggaggcctatccca

SEQ ID NO: 316049 - DNA, 25 bp, Rattus norvegicus
gacactgtacagttttccatggtag

SEQ ID NO: 316050 - DNA, 25 bp, Rattus norvegicus
gacactgtagacataaagcctggta

SEQ ID NO: 316051 - DNA, 25 bp, Rattus norvegicus
gacactgtagacttaaagcctggta

SEQ ID NO: 316052 - DNA, 25 bp, Rattus norvegicus
gacactgtagagagtgctcgttaca

SEQ ID NO: 316053 - DNA, 25 bp, Rattus norvegicus
gacactgtagagtgtgctcgttaca

SEQ ID NO: 316054 - DNA, 25 bp, Rattus norvegicus
gacactgtagcccatggcccttggt

SEQ ID NO: 316055 - DNA, 25 bp, Rattus norvegicus
gacactgtagccgatggcccttggt

SEQ ID NO: 316056 - DNA, 25 bp, Rattus norvegicus
gacactgtagctcacggcatctggc

SEQ ID NO: 316057 - DNA, 25 bp, Rattus norvegicus
gacactgtagctgacggcatctggc

SEQ ID NO: 316058 - DNA, 25 bp, Rattus norvegicus
gacactgtaggtaggctcacatctt

SEQ ID NO: 316059 - DNA, 25 bp, Rattus norvegicus
gacactgtaggttggctcacatctt

SEQ ID NO: 316060 - DNA, 25 bp, Rattus norvegicus
gacactgtagttccattcctatgaa

SEQ ID NO: 316061 - DNA, 25 bp, Rattus norvegicus
gacactgtagttgcattcctatgaa

SEQ ID NO: 316062 - DNA, 25 bp, Rattus norvegicus
gacactgtatataattcttgccgta

SEQ ID NO: 316063 - DNA, 25 bp, Rattus norvegicus
gacactgtatattattcttgccgta

SEQ ID NO: 316064 - DNA, 25 bp, Rattus norvegicus
gacactgtatttagaggcattgctc

SEQ ID NO: 316065 - DNA, 25 bp, Rattus norvegicus
gacactgtattttgaggcattgctc

SEQ ID NO: 316066 - DNA, 25 bp, Rattus norvegicus
gacactgtcaccagaaatgcgggca

SEQ ID NO: 316067 - DNA, 25 bp, Rattus norvegicus
gacactgtcacctgaaatgcgggca

SEQ ID NO: 316068 - DNA, 25 bp, Rattus norvegicus
gacactgtcagtcagaagtttcttt

SEQ ID NO: 316069 - DNA, 25 bp, Rattus norvegicus
gacactgtcagtgagaagtttcttt

SEQ ID NO: 316070 - DNA, 25 bp, Rattus norvegicus
gacactgtccatcactggtctgaca

SEQ ID NO: 316071 - DNA, 25 bp, Rattus norvegicus
gacactgtccatgactggtctgaca

SEQ ID NO: 316072 - DNA, 25 bp, Rattus norvegicus
gacactgtcccaatctgtacataga

SEQ ID NO: 316073 - DNA, 25 bp, Rattus norvegicus
gacactgtcccacataaccatcgga

SEQ ID NO: 316074 - DNA, 25 bp, Rattus norvegicus
gacactgtcccagataaccatcgga

SEQ ID NO: 316075 - DNA, 25 bp, Rattus norvegicus
gacactgtcccattctgtacataga

SEQ ID NO: 316076 - DNA, 25 bp, Rattus norvegicus
gacactgtcctcagagtatgctaag

SEQ ID NO: 316077 - DNA, 25 bp, Rattus norvegicus
gacactgtcctctgagtatgctaag

SEQ ID NO: 316078 - DNA, 25 bp, Rattus norvegicus
gacactgtcctgaggtagaccttcc

SEQ ID NO: 316079 - DNA, 25 bp, Rattus norvegicus
gacactgtcctgtggtagaccttcc

SEQ ID NO: 316080 - DNA, 25 bp, Rattus norvegicus
gacactgtcgggagcagagtccttc

SEQ ID NO: 316081 - DNA, 25 bp, Rattus norvegicus
gacactgtcgggtgcagagtccttc

SEQ ID NO: 316082 - DNA, 25 bp, Rattus norvegicus
gacactgtcgttaacctctctgtag

SEQ ID NO: 316083 - DNA, 25 bp, Rattus norvegicus
gacactgtcgtttacctctctgtag

SEQ ID NO: 316084 - DNA, 25 bp, Rattus norvegicus
gacactgtctcaactgtggttagca

SEQ ID NO: 316085 - DNA, 25 bp, Rattus norvegicus
gacactgtctcacgatgtagttctg

SEQ ID NO: 316086 - DNA, 25 bp, Rattus norvegicus
gacactgtctcaggatgtagttctg

SEQ ID NO: 316087 - DNA, 25 bp, Rattus norvegicus
gacactgtctcatctgtggttagca

SEQ ID NO: 316088 - DNA, 25 bp, Rattus norvegicus
gacactgtctcgacactgtgtttga

SEQ ID NO: 316089 - DNA, 25 bp, Rattus norvegicus
gacactgtctcgtcactgtgtttga

SEQ ID NO: 316090 - DNA, 25 bp, Rattus norvegicus
gacactgtctgacgtcccatgggat

SEQ ID NO: 316091 - DNA, 25 bp, Rattus norvegicus
gacactgtctgaggtcccatgggat

SEQ ID NO: 316092 - DNA, 25 bp, Rattus norvegicus
gacactgtctgtagttaatcaagta

SEQ ID NO: 316093 - DNA, 25 bp, Rattus norvegicus
gacactgtctgttgttaatcaagta

SEQ ID NO: 316094 - DNA, 25 bp, Rattus norvegicus
gacactgtgaacatggcctccagaa

SEQ ID NO: 316095 - DNA, 25 bp, Rattus norvegicus
gacactgtgaacttggcctccagaa

SEQ ID NO: 316096 - DNA, 25 bp, Rattus norvegicus
gacactgtgcaaagctgttgtgacc

SEQ ID NO: 316097 - DNA, 25 bp, Rattus norvegicus
gacactgtgcaatgctgttgtgacc

SEQ ID NO: 316098 - DNA, 25 bp, Rattus norvegicus
gacactgtgccacttcttgagaatg

SEQ ID NO: 316099 - DNA, 25 bp, Rattus norvegicus
gacactgtgccagttcttgagaatg

SEQ ID NO: 316100 - DNA, 25 bp, Rattus norvegicus
gacactgtgctactcgttcttaatt

SEQ ID NO: 316101 - DNA, 25 bp, Rattus norvegicus
gacactgtgctagtcgttcttaatt

SEQ ID NO: 316102 - DNA, 25 bp, Rattus norvegicus
gacactgtggccatgtgggtgatta

SEQ ID NO: 316103 - DNA, 25 bp, Rattus norvegicus
gacactgtggccttgtgggtgatta

SEQ ID NO: 316104 - DNA, 25 bp, Rattus norvegicus
gacactgtggtacagatcaagctaa

SEQ ID NO: 316105 - DNA, 25 bp, Rattus norvegicus
gacactgtggtagagatcaagctaa

SEQ ID NO: 316106 - DNA, 25 bp, Rattus norvegicus
gacactgtgtacatcaactatcaag

SEQ ID NO: 316107 - DNA, 25 bp, Rattus norvegicus
gacactgtgtacttcaactatcaag

SEQ ID NO: 316108 - DNA, 25 bp, Rattus norvegicus
gacactgtgtcaagaagtctgagcg

SEQ ID NO: 316109 - DNA, 25 bp, Rattus norvegicus
gacactgtgtcatgaagtctgagcg

SEQ ID NO: 316110 - DNA, 25 bp, Rattus norvegicus
gacactgtgtctcatgctgtatact

SEQ ID NO: 316111 - DNA, 25 bp, Rattus norvegicus
gacactgtgtctcctgaagatctga

SEQ ID NO: 316112 - DNA, 25 bp, Rattus norvegicus
gacactgtgtctgatgctgtatact

SEQ ID NO: 316113 - DNA, 25 bp, Rattus norvegicus
gacactgtgtctgctgaagatctga

SEQ ID NO: 316114 - DNA, 25 bp, Rattus norvegicus
gacactgtgtggctaacctactggg

SEQ ID NO: 316115 - DNA, 25 bp, Rattus norvegicus
gacactgtgtgggtaacctactggg

SEQ ID NO: 316116 - DNA, 25 bp, Rattus norvegicus
gacactgtgtgtcctactgcaggat

SEQ ID NO: 316117 - DNA, 25 bp, Rattus norvegicus
gacactgtgtgtgctactgcaggat

SEQ ID NO: 316118 - DNA, 25 bp, Rattus norvegicus
gacactgttactcttctgtgaaccc

SEQ ID NO: 316119 - DNA, 25 bp, Rattus norvegicus
gacactgttactgttctgtgaaccc

SEQ ID NO: 316120 - DNA, 25 bp, Rattus norvegicus
gacactgttatacacacttggttaa

SEQ ID NO: 316121 - DNA, 25 bp, Rattus norvegicus
gacactgttatagacacttggttaa

SEQ ID NO: 316122 - DNA, 25 bp, Rattus norvegicus
gacactgtttacagggcaggcgagt

SEQ ID NO: 316123 - DNA, 25 bp, Rattus norvegicus
gacactgtttactgggcaggcgagt

SEQ ID NO: 316124 - DNA, 25 bp, Rattus norvegicus
gacactgtttgaactcttactaaag

SEQ ID NO: 316125 - DNA, 25 bp, Rattus norvegicus
gacactgtttgatctcttactaaag

SEQ ID NO: 316126 - DNA, 25 bp, Rattus norvegicus
gacacttaacaacccttggtttaca

SEQ ID NO: 316127 - DNA, 25 bp, Rattus norvegicus
gacacttaacaagccttggtttaca

SEQ ID NO: 316128 - DNA, 25 bp, Rattus norvegicus
gacacttaacacctgcagagatcgg

SEQ ID NO: 316129 - DNA, 25 bp, Rattus norvegicus
gacacttaacacgtgcagagatcgg

SEQ ID NO: 316130 - DNA, 25 bp, Rattus norvegicus
gacacttaatggatggaaaatagct

SEQ ID NO: 316131 - DNA, 25 bp, Rattus norvegicus
gacacttaatggttggaaaatagct

SEQ ID NO: 316132 - DNA, 25 bp, Rattus norvegicus
gacacttaccacatgggtcccaaat

SEQ ID NO: 316133 - DNA, 25 bp, Rattus norvegicus
gacacttaccacttgggtcccaaat

SEQ ID NO: 316134 - DNA, 25 bp, Rattus norvegicus
gacacttacgggactcgttctcagt

SEQ ID NO: 316135 - DNA, 25 bp, Rattus norvegicus
gacacttacgggtctcgttctcagt

SEQ ID NO: 316136 - DNA, 25 bp, Rattus norvegicus
gacacttagtaacctgcattgccag

SEQ ID NO: 316137 - DNA, 25 bp, Rattus norvegicus
gacacttagtaagctgcattgccag

SEQ ID NO: 316138 - DNA, 25 bp, Rattus norvegicus
gacacttagtatacaacttgaccac

SEQ ID NO: 316139 - DNA, 25 bp, Rattus norvegicus
gacacttagtattcaacttgaccac

SEQ ID NO: 316140 - DNA, 25 bp, Rattus norvegicus
gacacttcaagcaagatgtgccttt

SEQ ID NO: 316141 - DNA, 25 bp, Rattus norvegicus
gacacttcaagctagatgtgccttt

SEQ ID NO: 316142 - DNA, 25 bp, Rattus norvegicus
gacacttcaaggcacagcagaggca

SEQ ID NO: 316143 - DNA, 25 bp, Rattus norvegicus
gacacttcaagggacagcagaggca

SEQ ID NO: 316144 - DNA, 25 bp, Rattus norvegicus
gacacttcaatgaaacctagtactt

SEQ ID NO: 316145 - DNA, 25 bp, Rattus norvegicus
gacacttcaatgtaacctagtactt

SEQ ID NO: 316146 - DNA, 25 bp, Rattus norvegicus
gacacttcagtaaaccttgcttgga

SEQ ID NO: 316147 - DNA, 25 bp, Rattus norvegicus
gacacttcagtataccttgcttgga

SEQ ID NO: 316148 - DNA, 25 bp, Rattus norvegicus
gacacttccagaattaagaacccca

SEQ ID NO: 316149 - DNA, 25 bp, Rattus norvegicus
gacacttccagatttaagaacccca

SEQ ID NO: 316150 - DNA, 25 bp, Rattus norvegicus
gacacttccgagaagcccttgtgga

SEQ ID NO: 316151 - DNA, 25 bp, Rattus norvegicus
gacacttccgagtagcccttgtgga

SEQ ID NO: 316152 - DNA, 25 bp, Rattus norvegicus
gacacttccgatatggaggcagtat

SEQ ID NO: 316153 - DNA, 25 bp, Rattus norvegicus
gacacttccgatttggaggcagtat

SEQ ID NO: 316154 - DNA, 25 bp, Rattus norvegicus
gacacttccgtgctcctgaaagaga

SEQ ID NO: 316155 - DNA, 25 bp, Rattus norvegicus
gacacttccgtggtcctgaaagaga

SEQ ID NO: 316156 - DNA, 25 bp, Rattus norvegicus
gacacttcctccactaaaacacaaa

SEQ ID NO: 316157 - DNA, 25 bp, Rattus norvegicus
gacacttcctcctctaaaacacaaa

SEQ ID NO: 316158 - DNA, 25 bp, Rattus norvegicus
gacacttcctgtctggtgctaacag

SEQ ID NO: 316159 - DNA, 25 bp, Rattus norvegicus
gacacttcctgtgtggtgctaacag

SEQ ID NO: 316160 - DNA, 25 bp, Rattus norvegicus
gacacttccttaatctcataggcta

SEQ ID NO: 316161 - DNA, 25 bp, Rattus norvegicus
gacacttccttattctcataggcta

SEQ ID NO: 316162 - DNA, 25 bp, Rattus norvegicus
gacacttcgaggacaagctcagcct

SEQ ID NO: 316163 - DNA, 25 bp, Rattus norvegicus
gacacttcgaggtcaagctcagcct

SEQ ID NO: 316164 - DNA, 25 bp, Rattus norvegicus
gacacttcgagtcccagtctgatga

SEQ ID NO: 316165 - DNA, 25 bp, Rattus norvegicus
gacacttcgagtgccagtctgatga

SEQ ID NO: 316166 - DNA, 25 bp, Rattus norvegicus
gacacttcgtgtccctttaacaaat

SEQ ID NO: 316167 - DNA, 25 bp, Rattus norvegicus
gacacttcgtgtgcctttaacaaat

SEQ ID NO: 316168 - DNA, 25 bp, Rattus norvegicus
gacacttctactcaccagtgctgag

SEQ ID NO: 316169 - DNA, 25 bp, Rattus norvegicus
gacacttctactgaccagtgctgag

SEQ ID NO: 316170 - DNA, 25 bp, Rattus norvegicus
gacacttctcaaaaatcataagctt

SEQ ID NO: 316171 - DNA, 25 bp, Rattus norvegicus
gacacttctcaacagtagcctgctg

SEQ ID NO: 316172 - DNA, 25 bp, Rattus norvegicus
gacacttctcaagagtagcctgctg

SEQ ID NO: 316173 - DNA, 25 bp, Rattus norvegicus
gacacttctcaataatcataagctt

SEQ ID NO: 316174 - DNA, 25 bp, Rattus norvegicus
gacacttctccgagagatatttcct

SEQ ID NO: 316175 - DNA, 25 bp, Rattus norvegicus
gacacttctccgtgagatatttcct

SEQ ID NO: 316176 - DNA, 25 bp, Rattus norvegicus
gacacttctcggagtgacccaaatg

SEQ ID NO: 316177 - DNA, 25 bp, Rattus norvegicus
gacacttctcggtgtgacccaaatg

SEQ ID NO: 316178 - DNA, 25 bp, Rattus norvegicus
gacacttctgctccaaagatggtca

SEQ ID NO: 316179 - DNA, 25 bp, Rattus norvegicus
gacacttctgctgcaaagatggtca

SEQ ID NO: 316180 - DNA, 25 bp, Rattus norvegicus
gacacttctggactttttcaagcgt

SEQ ID NO: 316181 - DNA, 25 bp, Rattus norvegicus
gacacttctggagtttttcaagcgt

SEQ ID NO: 316182 - DNA, 25 bp, Rattus norvegicus
gacacttctggtcggaatcttcaca

SEQ ID NO: 316183 - DNA, 25 bp, Rattus norvegicus
gacacttctggtgggaatcttcaca

SEQ ID NO: 316184 - DNA, 25 bp, Rattus norvegicus
gacacttgaactcaggcagagggat

SEQ ID NO: 316185 - DNA, 25 bp, Rattus norvegicus
gacacttgaactgaggcagagggat

SEQ ID NO: 316186 - DNA, 25 bp, Rattus norvegicus
gacacttgaattaccctttttagca

SEQ ID NO: 316187 - DNA, 25 bp, Rattus norvegicus
gacacttgaatttccctttttagca

SEQ ID NO: 316188 - DNA, 25 bp, Rattus norvegicus
gacacttgacatctggaaactcact

SEQ ID NO: 316189 - DNA, 25 bp, Rattus norvegicus
gacacttgacatgtggaaactcact

SEQ ID NO: 316190 - DNA, 25 bp, Rattus norvegicus
gacacttgagaaactgagggcgatc

SEQ ID NO: 316191 - DNA, 25 bp, Rattus norvegicus
gacacttgagaatctgagggcgatc

SEQ ID NO: 316192 - DNA, 25 bp, Rattus norvegicus
gacacttgatgtagcctcttgggaa

SEQ ID NO: 316193 - DNA, 25 bp, Rattus norvegicus
gacacttgatgttgcctcttgggaa

SEQ ID NO: 316194 - DNA, 25 bp, Rattus norvegicus
gacacttgcatacaggagccttacc

SEQ ID NO: 316195 - DNA, 25 bp, Rattus norvegicus
gacacttgcatagaggagccttacc

SEQ ID NO: 316196 - DNA, 25 bp, Rattus norvegicus
gacacttgctatcgtgacgctggca

SEQ ID NO: 316197 - DNA, 25 bp, Rattus norvegicus
gacacttgctatggtgacgctggca

SEQ ID NO: 316198 - DNA, 25 bp, Rattus norvegicus
gacacttgctgccacatcagcatta

SEQ ID NO: 316199 - DNA, 25 bp, Rattus norvegicus
gacacttgctgcgacatcagcatta

SEQ ID NO: 316200 - DNA, 25 bp, Rattus norvegicus
gacacttggaagattcgatgccgac

SEQ ID NO: 316201 - DNA, 25 bp, Rattus norvegicus
gacacttggaagtttcgatgccgac

SEQ ID NO: 316202 - DNA, 25 bp, Rattus norvegicus
gacacttggattaagagccctttct

SEQ ID NO: 316203 - DNA, 25 bp, Rattus norvegicus
gacacttggatttagagccctttct

SEQ ID NO: 316204 - DNA, 25 bp, Rattus norvegicus
gacacttgggttatagcattttcca

SEQ ID NO: 316205 - DNA, 25 bp, Rattus norvegicus
gacacttgggttttagcattttcca

SEQ ID NO: 316206 - DNA, 25 bp, Rattus norvegicus
gacacttgtaccacttctgttttag

SEQ ID NO: 316207 - DNA, 25 bp, Rattus norvegicus
gacacttgtacctcttctgttttag

SEQ ID NO: 316208 - DNA, 25 bp, Rattus norvegicus
gacacttgtactcgtgtggctgtac

SEQ ID NO: 316209 - DNA, 25 bp, Rattus norvegicus
gacacttgtactggtgtggctgtac

SEQ ID NO: 316210 - DNA, 25 bp, Rattus norvegicus
gacacttgtcagaatctcatgtggg

SEQ ID NO: 316211 - DNA, 25 bp, Rattus norvegicus
gacacttgtcagtatctcatgtggg

SEQ ID NO: 316212 - DNA, 25 bp, Rattus norvegicus
gacacttgtccgaacatgcacagtt

SEQ ID NO: 316213 - DNA, 25 bp, Rattus norvegicus
gacacttgtccgtacatgcacagtt

SEQ ID NO: 316214 - DNA, 25 bp, Rattus norvegicus
gacacttgtgaaaaagattggcgaa

SEQ ID NO: 316215 - DNA, 25 bp, Rattus norvegicus
gacacttgtgaataagattggcgaa

SEQ ID NO: 316216 - DNA, 25 bp, Rattus norvegicus
gacacttgtgtgagttctactctaa

SEQ ID NO: 316217 - DNA, 25 bp, Rattus norvegicus
gacacttgtgtgtgttctactctaa

SEQ ID NO: 316218 - DNA, 25 bp, Rattus norvegicus
gacactttacttacatcagcaccaa

SEQ ID NO: 316219 - DNA, 25 bp, Rattus norvegicus
gacactttactttcatcagcaccaa

SEQ ID NO: 316220 - DNA, 25 bp, Rattus norvegicus
gacactttagacattgatgaaggcc

SEQ ID NO: 316221 - DNA, 25 bp, Rattus norvegicus
gacactttagactttgatgaaggcc

SEQ ID NO: 316222 - DNA, 25 bp, Rattus norvegicus
gacactttaggactgaggctttctg

SEQ ID NO: 316223 - DNA, 25 bp, Rattus norvegicus
gacactttaggagtgaggctttctg

SEQ ID NO: 316224 - DNA, 25 bp, Rattus norvegicus
gacactttcactcaggatttggcca

SEQ ID NO: 316225 - DNA, 25 bp, Rattus norvegicus
gacactttcactgaggatttggcca

SEQ ID NO: 316226 - DNA, 25 bp, Rattus norvegicus
gacactttcaggcagtttctaaaca

SEQ ID NO: 316227 - DNA, 25 bp, Rattus norvegicus
gacactttcagggagtttctaaaca

SEQ ID NO: 316228 - DNA, 25 bp, Rattus norvegicus
gacactttccagagttggcttatgt

SEQ ID NO: 316229 - DNA, 25 bp, Rattus norvegicus
gacactttccagtgttggcttatgt

SEQ ID NO: 316230 - DNA, 25 bp, Rattus norvegicus
gacactttccctcagaatcttaaac

SEQ ID NO: 316231 - DNA, 25 bp, Rattus norvegicus
gacactttccctcaggtgggctgaa

SEQ ID NO: 316232 - DNA, 25 bp, Rattus norvegicus
gacactttccctgagaatcttaaac

SEQ ID NO: 316233 - DNA, 25 bp, Rattus norvegicus
gacactttccctgaggtgggctgaa

SEQ ID NO: 316234 - DNA, 25 bp, Rattus norvegicus
gacactttccttatcctacaaagtg

SEQ ID NO: 316235 - DNA, 25 bp, Rattus norvegicus
gacactttccttttcctacaaagtg

SEQ ID NO: 316236 - DNA, 25 bp, Rattus norvegicus
gacactttctggacagaactcctga

SEQ ID NO: 316237 - DNA, 25 bp, Rattus norvegicus
gacactttctggtcagaactcctga

SEQ ID NO: 316238 - DNA, 25 bp, Rattus norvegicus
gacactttcttcctggaactgattg

SEQ ID NO: 316239 - DNA, 25 bp, Rattus norvegicus
gacactttcttcgtggaactgattg

SEQ ID NO: 316240 - DNA, 25 bp, Rattus norvegicus
gacactttgaaacatctaacactag

SEQ ID NO: 316241 - DNA, 25 bp, Rattus norvegicus
gacactttgaaagatctaacactag

SEQ ID NO: 316242 - DNA, 25 bp, Rattus norvegicus
gacactttgataatgcattccacca

SEQ ID NO: 316243 - DNA, 25 bp, Rattus norvegicus
gacactttgatacagtctttgttca

SEQ ID NO: 316244 - DNA, 25 bp, Rattus norvegicus
gacactttgatagagtctttgttca

SEQ ID NO: 316245 - DNA, 25 bp, Rattus norvegicus
gacactttgatattgcattccacca

SEQ ID NO: 316246 - DNA, 25 bp, Rattus norvegicus
gacactttggctacagttctaaacc

SEQ ID NO: 316247 - DNA, 25 bp, Rattus norvegicus
gacactttggcttcagttctaaacc

SEQ ID NO: 316248 - DNA, 25 bp, Rattus norvegicus
gacactttggtgcaatggcttggta

SEQ ID NO: 316249 - DNA, 25 bp, Rattus norvegicus
gacactttggtggaatggcttggta

SEQ ID NO: 316250 - DNA, 25 bp, Rattus norvegicus
gacactttgtggaggcctatgccaa

SEQ ID NO: 316251 - DNA, 25 bp, Rattus norvegicus
gacactttgtggtggcctatgccaa

SEQ ID NO: 316252 - DNA, 25 bp, Rattus norvegicus
gacactttgttcatcgaagatctta

SEQ ID NO: 316253 - DNA, 25 bp, Rattus norvegicus
gacactttgttcttcgaagatctta

SEQ ID NO: 316254 - DNA, 25 bp, Rattus norvegicus
gacactttgttgcacgtttcaggat

SEQ ID NO: 316255 - DNA, 25 bp, Rattus norvegicus
gacactttgttggacgtttcaggat

SEQ ID NO: 316256 - DNA, 25 bp, Rattus norvegicus
gacacttttatgaattccattgttt

SEQ ID NO: 316257 - DNA, 25 bp, Rattus norvegicus
gacacttttatgtattccattgttt

SEQ ID NO: 316258 - DNA, 25 bp, Rattus norvegicus
gacacttttcatatcagggctgaca

SEQ ID NO: 316259 - DNA, 25 bp, Rattus norvegicus
gacacttttcatttcagggctgaca

SEQ ID NO: 316260 - DNA, 25 bp, Rattus norvegicus
gacacttttctaccattcttgaact

SEQ ID NO: 316261 - DNA, 25 bp, Rattus norvegicus
gacacttttctagcattcttgaact

SEQ ID NO: 316262 - DNA, 25 bp, Rattus norvegicus
gacacttttgacacacaacctgaag

SEQ ID NO: 316263 - DNA, 25 bp, Rattus norvegicus
gacacttttgactcacaacctgaag

SEQ ID NO: 316264 - DNA, 25 bp, Rattus norvegicus
gacacttttgatatatccttgctaa

SEQ ID NO: 316265 - DNA, 25 bp, Rattus norvegicus
gacacttttgatttatccttgctaa

SEQ ID NO: 316266 - DNA, 25 bp, Rattus norvegicus
gacacttttgcaataccttgcttta

SEQ ID NO: 316267 - DNA, 25 bp, Rattus norvegicus
gacacttttgcattaccttgcttta

SEQ ID NO: 316268 - DNA, 25 bp, Rattus norvegicus
gacacttttggacaccgtaacaaca

SEQ ID NO: 316269 - DNA, 25 bp, Rattus norvegicus
gacacttttggacatgtaacgcttt

SEQ ID NO: 316270 - DNA, 25 bp, Rattus norvegicus
gacacttttggagaccgtaacaaca

SEQ ID NO: 316271 - DNA, 25 bp, Rattus norvegicus
gacacttttggagatgtaacgcttt

SEQ ID NO: 316272 - DNA, 25 bp, Rattus norvegicus
gacacttttgtgaacatagtccctg

SEQ ID NO: 316273 - DNA, 25 bp, Rattus norvegicus
gacacttttgtgtacatagtccctg

SEQ ID NO: 316274 - DNA, 25 bp, Rattus norvegicus
gacagaaaaccactagtcctcttta

SEQ ID NO: 316275 - DNA, 25 bp, Rattus norvegicus
gacagaaaaccagtagtcctcttta

SEQ ID NO: 316276 - DNA, 25 bp, Rattus norvegicus
gacagaaaaggcatggatccagatg

SEQ ID NO: 316277 - DNA, 25 bp, Rattus norvegicus
gacagaaaaggcttggatccagatg

SEQ ID NO: 316278 - DNA, 25 bp, Rattus norvegicus
gacagaaacagtccttttgtgttaa

SEQ ID NO: 316279 - DNA, 25 bp, Rattus norvegicus
gacagaaacagtgcttttgtgttaa

SEQ ID NO: 316280 - DNA, 25 bp, Rattus norvegicus
gacagaaacattaccatgcgcatgg

SEQ ID NO: 316281 - DNA, 25 bp, Rattus norvegicus
gacagaaacatttccatgcgcatgg

SEQ ID NO: 316282 - DNA, 25 bp, Rattus norvegicus
gacagaaaccatatgccaggcttag

SEQ ID NO: 316283 - DNA, 25 bp, Rattus norvegicus
gacagaaaccatttgccaggcttag

SEQ ID NO: 316284 - DNA, 25 bp, Rattus norvegicus
gacagaaacctgcaactttatcaaa

SEQ ID NO: 316285 - DNA, 25 bp, Rattus norvegicus
gacagaaacctggaactttatcaaa

SEQ ID NO: 316286 - DNA, 25 bp, Rattus norvegicus
gacagaaacgtcatctgcgtgtctc

SEQ ID NO: 316287 - DNA, 25 bp, Rattus norvegicus
gacagaaacgtcttctgcgtgtctc

SEQ ID NO: 316288 - DNA, 25 bp, Rattus norvegicus
gacagaaactcgagatacctcacaa

SEQ ID NO: 316289 - DNA, 25 bp, Rattus norvegicus
gacagaaactcgtgatacctcacaa

SEQ ID NO: 316290 - DNA, 25 bp, Rattus norvegicus
gacagaaaggcacttccggtttggt

SEQ ID NO: 316291 - DNA, 25 bp, Rattus norvegicus
gacagaaaggcagttccggtttggt

SEQ ID NO: 316292 - DNA, 25 bp, Rattus norvegicus
gacagaaataacatgctctggagct

SEQ ID NO: 316293 - DNA, 25 bp, Rattus norvegicus
gacagaaataacttgctctggagct

SEQ ID NO: 316294 - DNA, 25 bp, Rattus norvegicus
gacagaaatttccacccagatttgt

SEQ ID NO: 316295 - DNA, 25 bp, Rattus norvegicus
gacagaaatttcgacccagatttgt

SEQ ID NO: 316296 - DNA, 25 bp, Rattus norvegicus
gacagaacaattactcaagccaccc

SEQ ID NO: 316297 - DNA, 25 bp, Rattus norvegicus
gacagaacaatttctcaagccaccc

SEQ ID NO: 316298 - DNA, 25 bp, Rattus norvegicus
gacagaacaccccaacatgagcttg

SEQ ID NO: 316299 - DNA, 25 bp, Rattus norvegicus
gacagaacacccgaacatgagcttg

SEQ ID NO: 316300 - DNA, 25 bp, Rattus norvegicus
gacagaacaggcagatgatctcttg

SEQ ID NO: 316301 - DNA, 25 bp, Rattus norvegicus
gacagaacaggctgatgatctcttg

SEQ ID NO: 316302 - DNA, 25 bp, Rattus norvegicus
gacagaaccaataacagatcaactt

SEQ ID NO: 316303 - DNA, 25 bp, Rattus norvegicus
gacagaaccaattacagatcaactt

SEQ ID NO: 316304 - DNA, 25 bp, Rattus norvegicus
gacagaaccaggagaccagcgccca

SEQ ID NO: 316305 - DNA, 25 bp, Rattus norvegicus
gacagaaccaggtgaccagcgccca

SEQ ID NO: 316306 - DNA, 25 bp, Rattus norvegicus
gacagaaccatcagaggctcacagt

SEQ ID NO: 316307 - DNA, 25 bp, Rattus norvegicus
gacagaaccatcctaggagtcccgg

SEQ ID NO: 316308 - DNA, 25 bp, Rattus norvegicus
gacagaaccatcgtaggagtcccgg

SEQ ID NO: 316309 - DNA, 25 bp, Rattus norvegicus
gacagaaccatctgaggctcacagt

SEQ ID NO: 316310 - DNA, 25 bp, Rattus norvegicus
gacagaacccacactctggaaaaga

SEQ ID NO: 316311 - DNA, 25 bp, Rattus norvegicus
gacagaacccactctctggaaaaga

SEQ ID NO: 316312 - DNA, 25 bp, Rattus norvegicus
gacagaaccccacaagcacatttga

SEQ ID NO: 316313 - DNA, 25 bp, Rattus norvegicus
gacagaaccccagaagcacatttga

SEQ ID NO: 316314 - DNA, 25 bp, Rattus norvegicus
gacagaaccgacctcagatacactg

SEQ ID NO: 316315 - DNA, 25 bp, Rattus norvegicus
gacagaaccgacgtcagatacactg

SEQ ID NO: 316316 - DNA, 25 bp, Rattus norvegicus
gacagaaccttcatacatattaata

SEQ ID NO: 316317 - DNA, 25 bp, Rattus norvegicus
gacagaaccttcttacatattaata

SEQ ID NO: 316318 - DNA, 25 bp, Rattus norvegicus
gacagaacgctcagctagtgaagag

SEQ ID NO: 316319 - DNA, 25 bp, Rattus norvegicus
gacagaacgctctgctagtgaagag

SEQ ID NO: 316320 - DNA, 25 bp, Rattus norvegicus
gacagaacgggtcagccttatggct

SEQ ID NO: 316321 - DNA, 25 bp, Rattus norvegicus
gacagaacgggtgagccttatggct

SEQ ID NO: 316322 - DNA, 25 bp, Rattus norvegicus
gacagaacggtgaagccaaagctct

SEQ ID NO: 316323 - DNA, 25 bp, Rattus norvegicus
gacagaacggtgtagccaaagctct

SEQ ID NO: 316324 - DNA, 25 bp, Rattus norvegicus
gacagaactcagctgcctgatggca

SEQ ID NO: 316325 - DNA, 25 bp, Rattus norvegicus
gacagaactcaggtgcctgatggca

SEQ ID NO: 316326 - DNA, 25 bp, Rattus norvegicus
gacagaactccgcacattcaaccat

SEQ ID NO: 316327 - DNA, 25 bp, Rattus norvegicus
gacagaactccggacattcaaccat

SEQ ID NO: 316328 - DNA, 25 bp, Rattus norvegicus
gacagaactgacaccagactcttgg

SEQ ID NO: 316329 - DNA, 25 bp, Rattus norvegicus
gacagaactgactccagactcttgg

SEQ ID NO: 316330 - DNA, 25 bp, Rattus norvegicus
gacagaactgagagaccgctttgaa

SEQ ID NO: 316331 - DNA, 25 bp, Rattus norvegicus
gacagaactgagtgaccgctttgaa

SEQ ID NO: 316332 - DNA, 25 bp, Rattus norvegicus
gacagaactgccatttcagtacagg

SEQ ID NO: 316333 - DNA, 25 bp, Rattus norvegicus
gacagaactgccttttcagtacagg

SEQ ID NO: 316334 - DNA, 25 bp, Rattus norvegicus
gacagaactgcgattgaccaatggt

SEQ ID NO: 316335 - DNA, 25 bp, Rattus norvegicus
gacagaactgcgtttgaccaatggt

SEQ ID NO: 316336 - DNA, 25 bp, Rattus norvegicus
gacagaactggtcgctccattcaac

SEQ ID NO: 316337 - DNA, 25 bp, Rattus norvegicus
gacagaactggtggctccattcaac

SEQ ID NO: 316338 - DNA, 25 bp, Rattus norvegicus
gacagaactgtcctccggagctgac

SEQ ID NO: 316339 - DNA, 25 bp, Rattus norvegicus
gacagaactgtcgtccggagctgac

SEQ ID NO: 316340 - DNA, 25 bp, Rattus norvegicus
gacagaactgttaccttttattagt

SEQ ID NO: 316341 - DNA, 25 bp, Rattus norvegicus
gacagaactgttcagggcgactttt

SEQ ID NO: 316342 - DNA, 25 bp, Rattus norvegicus
gacagaactgttgagggcgactttt

SEQ ID NO: 316343 - DNA, 25 bp, Rattus norvegicus
gacagaactgtttccttttattagt

SEQ ID NO: 316344 - DNA, 25 bp, Rattus norvegicus
gacagaactttcaccaattactggg

SEQ ID NO: 316345 - DNA, 25 bp, Rattus norvegicus
gacagaactttctccaattactggg

SEQ ID NO: 316346 - DNA, 25 bp, Rattus norvegicus
gacagaagaacaaggcattttataa

SEQ ID NO: 316347 - DNA, 25 bp, Rattus norvegicus
gacagaagaacatggcattttataa

SEQ ID NO: 316348 - DNA, 25 bp, Rattus norvegicus
gacagaagacaacttccggattcct

SEQ ID NO: 316349 - DNA, 25 bp, Rattus norvegicus
gacagaagacaagttccggattcct

SEQ ID NO: 316350 - DNA, 25 bp, Rattus norvegicus
gacagaagacctccgcattgtgtca

SEQ ID NO: 316351 - DNA, 25 bp, Rattus norvegicus
gacagaagacctgcgcattgtgtca

SEQ ID NO: 316352 - DNA, 25 bp, Rattus norvegicus
gacagaagactcctggaaccagttt

SEQ ID NO: 316353 - DNA, 25 bp, Rattus norvegicus
gacagaagactcgtggaaccagttt

SEQ ID NO: 316354 - DNA, 25 bp, Rattus norvegicus
gacagaagcaggaaacgagagttaa

SEQ ID NO: 316355 - DNA, 25 bp, Rattus norvegicus
gacagaagcaggtaacgagagttaa

SEQ ID NO: 316356 - DNA, 25 bp, Rattus norvegicus
gacagaagcattctccagccattct

SEQ ID NO: 316357 - DNA, 25 bp, Rattus norvegicus
gacagaagcattgtccagccattct

SEQ ID NO: 316358 - DNA, 25 bp, Rattus norvegicus
gacagaagccgaccctacttatctt

SEQ ID NO: 316359 - DNA, 25 bp, Rattus norvegicus
gacagaagccgagcctacttatctt

SEQ ID NO: 316360 - DNA, 25 bp, Rattus norvegicus
gacagaagcgatatggctctcggct

SEQ ID NO: 316361 - DNA, 25 bp, Rattus norvegicus
gacagaagcgatttggctctcggct

SEQ ID NO: 316362 - DNA, 25 bp, Rattus norvegicus
gacagaagctgcaagcgcccgtcga

SEQ ID NO: 316363 - DNA, 25 bp, Rattus norvegicus
gacagaagctgctagcgcccgtcga

SEQ ID NO: 316364 - DNA, 25 bp, Rattus norvegicus
gacagaagctggacgcggcctatgt

SEQ ID NO: 316365 - DNA, 25 bp, Rattus norvegicus
gacagaagctggactgtgcacccag

SEQ ID NO: 316366 - DNA, 25 bp, Rattus norvegicus
gacagaagctggtcgcggcctatgt

SEQ ID NO: 316367 - DNA, 25 bp, Rattus norvegicus
gacagaagctggtctgtgcacccag

SEQ ID NO: 316368 - DNA, 25 bp, Rattus norvegicus
gacagaaggaacactctttagctta

SEQ ID NO: 316369 - DNA, 25 bp, Rattus norvegicus
gacagaaggaactctctttagctta

SEQ ID NO: 316370 - DNA, 25 bp, Rattus norvegicus
gacagaagggttccagccttgttgt

SEQ ID NO: 316371 - DNA, 25 bp, Rattus norvegicus
gacagaagggttgcagccttgttgt

SEQ ID NO: 316372 - DNA, 25 bp, Rattus norvegicus
gacagaagtctcattgcttcccaac

SEQ ID NO: 316373 - DNA, 25 bp, Rattus norvegicus
gacagaagtctctttgcttcccaac

SEQ ID NO: 316374 - DNA, 25 bp, Rattus norvegicus
gacagaagtctgcaccaggctgaaa

SEQ ID NO: 316375 - DNA, 25 bp, Rattus norvegicus
gacagaagtctggaccaggctgaaa

SEQ ID NO: 316376 - DNA, 25 bp, Rattus norvegicus
gacagaataaacatgttcttccgtt

SEQ ID NO: 316377 - DNA, 25 bp, Rattus norvegicus
gacagaataaacttgttcttccgtt

SEQ ID NO: 316378 - DNA, 25 bp, Rattus norvegicus
gacagaatacaacctcgaatggcag

SEQ ID NO: 316379 - DNA, 25 bp, Rattus norvegicus
gacagaatacaagctcgaatggcag

SEQ ID NO: 316380 - DNA, 25 bp, Rattus norvegicus
gacagaatacttccgggctgaggct

SEQ ID NO: 316381 - DNA, 25 bp, Rattus norvegicus
gacagaatacttgcgggctgaggct

SEQ ID NO: 316382 - DNA, 25 bp, Rattus norvegicus
gacagaatcctacccaggcagaggt

SEQ ID NO: 316383 - DNA, 25 bp, Rattus norvegicus
gacagaatcctagccaggcagaggt

SEQ ID NO: 316384 - DNA, 25 bp, Rattus norvegicus
gacagaatcgcaaggtaatcccgac

SEQ ID NO: 316385 - DNA, 25 bp, Rattus norvegicus
gacagaatcgcatggtaatcccgac

SEQ ID NO: 316386 - DNA, 25 bp, Rattus norvegicus
gacagaatcgttccaaggtacggtt

SEQ ID NO: 316387 - DNA, 25 bp, Rattus norvegicus
gacagaatcgttgcaaggtacggtt

SEQ ID NO: 316388 - DNA, 25 bp, Rattus norvegicus
gacagaatctcaatgtgtggtccat

SEQ ID NO: 316389 - DNA, 25 bp, Rattus norvegicus
gacagaatctcattgtgtggtccat

SEQ ID NO: 316390 - DNA, 25 bp, Rattus norvegicus
gacagaatctttacgggctctgaaa

SEQ ID NO: 316391 - DNA, 25 bp, Rattus norvegicus
gacagaatcttttcgggctctgaaa

SEQ ID NO: 316392 - DNA, 25 bp, Rattus norvegicus
gacagaatgaccagacctgccatcg

SEQ ID NO: 316393 - DNA, 25 bp, Rattus norvegicus
gacagaatgacctgacctgccatcg

SEQ ID NO: 316394 - DNA, 25 bp, Rattus norvegicus
gacagaatgctgctccacttgtggg

SEQ ID NO: 316395 - DNA, 25 bp, Rattus norvegicus
gacagaatgctggtccacttgtggg

SEQ ID NO: 316396 - DNA, 25 bp, Rattus norvegicus
gacagaatgtcaaaggcctgcagat

SEQ ID NO: 316397 - DNA, 25 bp, Rattus norvegicus
gacagaatgtcataggcctgcagat

SEQ ID NO: 316398 - DNA, 25 bp, Rattus norvegicus
gacagaatgttcaggtacgcagagt

SEQ ID NO: 316399 - DNA, 25 bp, Rattus norvegicus
gacagaatgttctggtacgcagagt

SEQ ID NO: 316400 - DNA, 25 bp, Rattus norvegicus
gacagaatgtttacagagatcatct

SEQ ID NO: 316401 - DNA, 25 bp, Rattus norvegicus
gacagaatgttttcagagatcatct

SEQ ID NO: 316402 - DNA, 25 bp, Rattus norvegicus
gacagaattctaacttccattgcat

SEQ ID NO: 316403 - DNA, 25 bp, Rattus norvegicus
gacagaattctatcttccattgcat

SEQ ID NO: 316404 - DNA, 25 bp, Rattus norvegicus
gacagaattctcctccttggacctt

SEQ ID NO: 316405 - DNA, 25 bp, Rattus norvegicus
gacagaattctcgtccttggacctt

SEQ ID NO: 316406 - DNA, 25 bp, Rattus norvegicus
gacagaatttggctctaatctcact

SEQ ID NO: 316407 - DNA, 25 bp, Rattus norvegicus
gacagaatttgggtctaatctcact

SEQ ID NO: 316408 - DNA, 25 bp, Rattus norvegicus
gacagacaaatgacaaccacccttc

SEQ ID NO: 316409 - DNA, 25 bp, Rattus norvegicus
gacagacaaatgtcaaccacccttc

SEQ ID NO: 316410 - DNA, 25 bp, Rattus norvegicus
gacagacaaattattccagcaaaga

SEQ ID NO: 316411 - DNA, 25 bp, Rattus norvegicus
gacagacaaatttttccagcaaaga

SEQ ID NO: 316412 - DNA, 25 bp, Rattus norvegicus
gacagacaccagatatttcgatgaa

SEQ ID NO: 316413 - DNA, 25 bp, Rattus norvegicus
gacagacaccagttatttcgatgaa

SEQ ID NO: 316414 - DNA, 25 bp, Rattus norvegicus
gacagacacctcaggaaaagcccca

SEQ ID NO: 316415 - DNA, 25 bp, Rattus norvegicus
gacagacacctctggaaaagcccca

SEQ ID NO: 316416 - DNA, 25 bp, Rattus norvegicus
gacagacactatctcctagcacagg

SEQ ID NO: 316417 - DNA, 25 bp, Rattus norvegicus
gacagacactatgtcctagcacagg

SEQ ID NO: 316418 - DNA, 25 bp, Rattus norvegicus
gacagacagctccacggtagagcac

SEQ ID NO: 316419 - DNA, 25 bp, Rattus norvegicus
gacagacagctcgacggtagagcac

SEQ ID NO: 316420 - DNA, 25 bp, Rattus norvegicus
gacagacagcttctccttccggtag

SEQ ID NO: 316421 - DNA, 25 bp, Rattus norvegicus
gacagacagcttgtccttccggtag

SEQ ID NO: 316422 - DNA, 25 bp, Rattus norvegicus
gacagacagtccctcatcagaacag

SEQ ID NO: 316423 - DNA, 25 bp, Rattus norvegicus
gacagacagtccgtcatcagaacag

SEQ ID NO: 316424 - DNA, 25 bp, Rattus norvegicus
gacagacagtgcctgttttcctcat

SEQ ID NO: 316425 - DNA, 25 bp, Rattus norvegicus
gacagacagtgcgtgttttcctcat

SEQ ID NO: 316426 - DNA, 25 bp, Rattus norvegicus
gacagacagttcctgagcctgtttg

SEQ ID NO: 316427 - DNA, 25 bp, Rattus norvegicus
gacagacagttcgtgagcctgtttg

SEQ ID NO: 316428 - DNA, 25 bp, Rattus norvegicus
gacagacagttgaaactcaagataa

SEQ ID NO: 316429 - DNA, 25 bp, Rattus norvegicus
gacagacagttgtaactcaagataa

SEQ ID NO: 316430 - DNA, 25 bp, Rattus norvegicus
gacagacagtttcacactcctggta

SEQ ID NO: 316431 - DNA, 25 bp, Rattus norvegicus
gacagacagtttgacactcctggta

SEQ ID NO: 316432 - DNA, 25 bp, Rattus norvegicus
gacagacatatgcttttgccttccc

SEQ ID NO: 316433 - DNA, 25 bp, Rattus norvegicus
gacagacatatggttttgccttccc

SEQ ID NO: 316434 - DNA, 25 bp, Rattus norvegicus
gacagacatcatactggacccacaa

SEQ ID NO: 316435 - DNA, 25 bp, Rattus norvegicus
gacagacatcattctggacccacaa

SEQ ID NO: 316436 - DNA, 25 bp, Rattus norvegicus
gacagacatgacaagccaggtgatt

SEQ ID NO: 316437 - DNA, 25 bp, Rattus norvegicus
gacagacatgactagccaggtgatt

SEQ ID NO: 316438 - DNA, 25 bp, Rattus norvegicus
gacagacatgagctgcacatggctg

SEQ ID NO: 316439 - DNA, 25 bp, Rattus norvegicus
gacagacatgaggtgcacatggctg

SEQ ID NO: 316440 - DNA, 25 bp, Rattus norvegicus
gacagacatgttccctgaaatccct

SEQ ID NO: 316441 - DNA, 25 bp, Rattus norvegicus
gacagacatgttgcctgaaatccct

SEQ ID NO: 316442 - DNA, 25 bp, Rattus norvegicus
gacagacattctaggagagtgaccc

SEQ ID NO: 316443 - DNA, 25 bp, Rattus norvegicus
gacagacattcttggagagtgaccc

SEQ ID NO: 316444 - DNA, 25 bp, Rattus norvegicus
gacagaccaaatcgacatttcctca

SEQ ID NO: 316445 - DNA, 25 bp, Rattus norvegicus
gacagaccaaatggacatttcctca

SEQ ID NO: 316446 - DNA, 25 bp, Rattus norvegicus
gacagaccaactcaagtcaagtgga

SEQ ID NO: 316447 - DNA, 25 bp, Rattus norvegicus
gacagaccaactgaagtcaagtgga

SEQ ID NO: 316448 - DNA, 25 bp, Rattus norvegicus
gacagaccagaacattcgcttgact

SEQ ID NO: 316449 - DNA, 25 bp, Rattus norvegicus
gacagaccagaagattcgcttgact

SEQ ID NO: 316450 - DNA, 25 bp, Rattus norvegicus
gacagaccagcacaagcatcagctt

SEQ ID NO: 316451 - DNA, 25 bp, Rattus norvegicus
gacagaccagcagaagcatcagctt

SEQ ID NO: 316452 - DNA, 25 bp, Rattus norvegicus
gacagaccagccactgtagattaat

SEQ ID NO: 316453 - DNA, 25 bp, Rattus norvegicus
gacagaccagccagtagcacggaac

SEQ ID NO: 316454 - DNA, 25 bp, Rattus norvegicus
gacagaccagcctctgtagattaat

SEQ ID NO: 316455 - DNA, 25 bp, Rattus norvegicus
gacagaccagcctgtagcacggaac

SEQ ID NO: 316456 - DNA, 25 bp, Rattus norvegicus
gacagacccgtgacaccattcagta

SEQ ID NO: 316457 - DNA, 25 bp, Rattus norvegicus
gacagacccgtgtcaccattcagta

SEQ ID NO: 316458 - DNA, 25 bp, Rattus norvegicus
gacagaccctccatgtaatgttacc

SEQ ID NO: 316459 - DNA, 25 bp, Rattus norvegicus
gacagaccctccttgtaatgttacc

SEQ ID NO: 316460 - DNA, 25 bp, Rattus norvegicus
gacagaccctgtcaataagcccata

SEQ ID NO: 316461 - DNA, 25 bp, Rattus norvegicus
gacagaccctgtgaataagcccata

SEQ ID NO: 316462 - DNA, 25 bp, Rattus norvegicus
gacagacccttgcaagagctcattt

SEQ ID NO: 316463 - DNA, 25 bp, Rattus norvegicus
gacagacccttggaagagctcattt

SEQ ID NO: 316464 - DNA, 25 bp, Rattus norvegicus
gacagaccgaaacaagatgaattcc

SEQ ID NO: 316465 - DNA, 25 bp, Rattus norvegicus
gacagaccgaaagaagatgaattcc

SEQ ID NO: 316466 - DNA, 25 bp, Rattus norvegicus
gacagaccgaatagagtgtttacaa

SEQ ID NO: 316467 - DNA, 25 bp, Rattus norvegicus
gacagaccgaattgagtgtttacaa

SEQ ID NO: 316468 - DNA, 25 bp, Rattus norvegicus
gacagaccgcaactctgagcgtgaa

SEQ ID NO: 316469 - DNA, 25 bp, Rattus norvegicus
gacagaccgcaagtctgagcgtgaa

SEQ ID NO: 316470 - DNA, 25 bp, Rattus norvegicus
gacagaccggtgatattgcttcaaa

SEQ ID NO: 316471 - DNA, 25 bp, Rattus norvegicus
gacagaccggtgttattgcttcaaa

SEQ ID NO: 316472 - DNA, 25 bp, Rattus norvegicus
gacagaccgtctagaacacctcgag

SEQ ID NO: 316473 - DNA, 25 bp, Rattus norvegicus
gacagaccgtcttgaacacctcgag

SEQ ID NO: 316474 - DNA, 25 bp, Rattus norvegicus
gacagacctacactggctgcttcat

SEQ ID NO: 316475 - DNA, 25 bp, Rattus norvegicus
gacagacctacagtggctgcttcat

SEQ ID NO: 316476 - DNA, 25 bp, Rattus norvegicus
gacagacctatgacagggttacttt

SEQ ID NO: 316477 - DNA, 25 bp, Rattus norvegicus
gacagacctatgtcagggttacttt

SEQ ID NO: 316478 - DNA, 25 bp, Rattus norvegicus
gacagacctattactggcagcctta

SEQ ID NO: 316479 - DNA, 25 bp, Rattus norvegicus
gacagacctatttctggcagcctta

SEQ ID NO: 316480 - DNA, 25 bp, Rattus norvegicus
gacagacctccgctggtctgcaacg

SEQ ID NO: 316481 - DNA, 25 bp, Rattus norvegicus
gacagacctccggtggtctgcaacg

SEQ ID NO: 316482 - DNA, 25 bp, Rattus norvegicus
gacagacctcctataaagagccaga

SEQ ID NO: 316483 - DNA, 25 bp, Rattus norvegicus
gacagacctcctttaaagagccaga

SEQ ID NO: 316484 - DNA, 25 bp, Rattus norvegicus
gacagacctctacaaatgttcctat

SEQ ID NO: 316485 - DNA, 25 bp, Rattus norvegicus
gacagacctctacacacatgctgtt

SEQ ID NO: 316486 - DNA, 25 bp, Rattus norvegicus
gacagacctctagaaatgttcctat

SEQ ID NO: 316487 - DNA, 25 bp, Rattus norvegicus
gacagacctctagacacatgctgtt

SEQ ID NO: 316488 - DNA, 25 bp, Rattus norvegicus
gacagacctgttctatgagcgcaaa

SEQ ID NO: 316489 - DNA, 25 bp, Rattus norvegicus
gacagacctgttgtatgagcgcaaa

SEQ ID NO: 316490 - DNA, 25 bp, Rattus norvegicus
gacagaccttctattgtagttcttg

SEQ ID NO: 316491 - DNA, 25 bp, Rattus norvegicus
gacagaccttcttttgtagttcttg

SEQ ID NO: 316492 - DNA, 25 bp, Rattus norvegicus
gacagaccttgtcactttttgcaac

SEQ ID NO: 316493 - DNA, 25 bp, Rattus norvegicus
gacagaccttgtgactttttgcaac

SEQ ID NO: 316494 - DNA, 25 bp, Rattus norvegicus
gacagacgaacactttggaacttac

SEQ ID NO: 316495 - DNA, 25 bp, Rattus norvegicus
gacagacgaacagtttggaacttac

SEQ ID NO: 316496 - DNA, 25 bp, Rattus norvegicus
gacagacgcagtcggtgagctcctt

SEQ ID NO: 316497 - DNA, 25 bp, Rattus norvegicus
gacagacgcagtgggtgagctcctt

SEQ ID NO: 316498 - DNA, 25 bp, Rattus norvegicus
gacagacggaatagattgtttacat

SEQ ID NO: 316499 - DNA, 25 bp, Rattus norvegicus
gacagacggaattgattgtttacat

SEQ ID NO: 316500 - DNA, 25 bp, Rattus norvegicus
gacagacggcccagtatgtggctgt

SEQ ID NO: 316501 - DNA, 25 bp, Rattus norvegicus
gacagacggccctgtatgtggctgt

SEQ ID NO: 316502 - DNA, 25 bp, Rattus norvegicus
gacagacgggttaattctagcttta

SEQ ID NO: 316503 - DNA, 25 bp, Rattus norvegicus
gacagacgggtttattctagcttta

SEQ ID NO: 316504 - DNA, 25 bp, Rattus norvegicus
gacagacgtagaccacaccaccggg

SEQ ID NO: 316505 - DNA, 25 bp, Rattus norvegicus
gacagacgtagagcacaccaccggg

SEQ ID NO: 316506 - DNA, 25 bp, Rattus norvegicus
gacagacgtcgtcaacacttgccat

SEQ ID NO: 316507 - DNA, 25 bp, Rattus norvegicus
gacagacgtcgtgaacacttgccat

SEQ ID NO: 316508 - DNA, 25 bp, Rattus norvegicus
gacagacgtggtacatcttccacat

SEQ ID NO: 316509 - DNA, 25 bp, Rattus norvegicus
gacagacgtggttcatcttccacat

SEQ ID NO: 316510 - DNA, 25 bp, Rattus norvegicus
gacagacgttaaatccagttacttt

SEQ ID NO: 316511 - DNA, 25 bp, Rattus norvegicus
gacagacgttaattccagttacttt

SEQ ID NO: 316512 - DNA, 25 bp, Rattus norvegicus
gacagactaattaccagtttctctt

SEQ ID NO: 316513 - DNA, 25 bp, Rattus norvegicus
gacagactaatttccagtttctctt

SEQ ID NO: 316514 - DNA, 25 bp, Rattus norvegicus
gacagactacccacaggttgcttaa

SEQ ID NO: 316515 - DNA, 25 bp, Rattus norvegicus
gacagactaccctcaggttgcttaa

SEQ ID NO: 316516 - DNA, 25 bp, Rattus norvegicus
gacagactacggctctgcagccttg

SEQ ID NO: 316517 - DNA, 25 bp, Rattus norvegicus
gacagactacgggtctgcagccttg

SEQ ID NO: 316518 - DNA, 25 bp, Rattus norvegicus
gacagactacttagaggaagcagct

SEQ ID NO: 316519 - DNA, 25 bp, Rattus norvegicus
gacagactactttgaggaagcagct

SEQ ID NO: 316520 - DNA, 25 bp, Rattus norvegicus
gacagactatatcagggccccacag

SEQ ID NO: 316521 - DNA, 25 bp, Rattus norvegicus
gacagactatatctacgacccggaa

SEQ ID NO: 316522 - DNA, 25 bp, Rattus norvegicus
gacagactatatgagggccccacag

SEQ ID NO: 316523 - DNA, 25 bp, Rattus norvegicus
gacagactatatgtacgacccggaa

SEQ ID NO: 316524 - DNA, 25 bp, Rattus norvegicus
gacagactcacaccgctttgggaag

SEQ ID NO: 316525 - DNA, 25 bp, Rattus norvegicus
gacagactcacagcgctttgggaag

SEQ ID NO: 316526 - DNA, 25 bp, Rattus norvegicus
gacagactcactcagagacctttag

SEQ ID NO: 316527 - DNA, 25 bp, Rattus norvegicus
gacagactcactgagagacctttag

SEQ ID NO: 316528 - DNA, 25 bp, Rattus norvegicus
gacagactcctaagggctatccatg

SEQ ID NO: 316529 - DNA, 25 bp, Rattus norvegicus
gacagactcctatgggctatccatg

SEQ ID NO: 316530 - DNA, 25 bp, Rattus norvegicus
gacagactcctgaatgctcatgtag

SEQ ID NO: 316531 - DNA, 25 bp, Rattus norvegicus
gacagactcctgtatgctcatgtag

SEQ ID NO: 316532 - DNA, 25 bp, Rattus norvegicus
gacagactccttccgtttcaaaact

SEQ ID NO: 316533 - DNA, 25 bp, Rattus norvegicus
gacagactccttcgaacttttattt

SEQ ID NO: 316534 - DNA, 25 bp, Rattus norvegicus
gacagactccttgcgtttcaaaact

SEQ ID NO: 316535 - DNA, 25 bp, Rattus norvegicus
gacagactccttggaacttttattt

SEQ ID NO: 316536 - DNA, 25 bp, Rattus norvegicus
gacagactcgtcattacatttgtaa

SEQ ID NO: 316537 - DNA, 25 bp, Rattus norvegicus
gacagactcgtctttacatttgtaa

SEQ ID NO: 316538 - DNA, 25 bp, Rattus norvegicus
gacagactctaaaaggaacacttcc

SEQ ID NO: 316539 - DNA, 25 bp, Rattus norvegicus
gacagactctaataggaacacttcc

SEQ ID NO: 316540 - DNA, 25 bp, Rattus norvegicus
gacagactctccatgtttgcagatt

SEQ ID NO: 316541 - DNA, 25 bp, Rattus norvegicus
gacagactctccttgtttgcagatt

SEQ ID NO: 316542 - DNA, 25 bp, Rattus norvegicus
gacagactctctcggtgatctttag

SEQ ID NO: 316543 - DNA, 25 bp, Rattus norvegicus
gacagactctctcgttgagcatccc

SEQ ID NO: 316544 - DNA, 25 bp, Rattus norvegicus
gacagactctctgggtgatctttag

SEQ ID NO: 316545 - DNA, 25 bp, Rattus norvegicus
gacagactctctggttgagcatccc

SEQ ID NO: 316546 - DNA, 25 bp, Rattus norvegicus
gacagactctggacaactgcacagc

SEQ ID NO: 316547 - DNA, 25 bp, Rattus norvegicus
gacagactctggactgacctggtaa

SEQ ID NO: 316548 - DNA, 25 bp, Rattus norvegicus
gacagactctggtcaactgcacagc

SEQ ID NO: 316549 - DNA, 25 bp, Rattus norvegicus
gacagactctggtctgacctggtaa

SEQ ID NO: 316550 - DNA, 25 bp, Rattus norvegicus
gacagactcttgatggctgctggtg

SEQ ID NO: 316551 - DNA, 25 bp, Rattus norvegicus
gacagactcttgttggctgctggtg

SEQ ID NO: 316552 - DNA, 25 bp, Rattus norvegicus
gacagactgaaccttgctgcagtaa

SEQ ID NO: 316553 - DNA, 25 bp, Rattus norvegicus
gacagactgaacgttgctgcagtaa

SEQ ID NO: 316554 - DNA, 25 bp, Rattus norvegicus
gacagactgggtacaagtgtggact

SEQ ID NO: 316555 - DNA, 25 bp, Rattus norvegicus
gacagactgggttcaagtgtggact

SEQ ID NO: 316556 - DNA, 25 bp, Rattus norvegicus
gacagactggttacttttccacata

SEQ ID NO: 316557 - DNA, 25 bp, Rattus norvegicus
gacagactggtttcttttccacata

SEQ ID NO: 316558 - DNA, 25 bp, Rattus norvegicus
gacagacttgaacttcttcctggac

SEQ ID NO: 316559 - DNA, 25 bp, Rattus norvegicus
gacagacttgaagttcttcctggac

SEQ ID NO: 316560 - DNA, 25 bp, Rattus norvegicus
gacagacttggcactcgataaactt

SEQ ID NO: 316561 - DNA, 25 bp, Rattus norvegicus
gacagacttggctctcgataaactt

SEQ ID NO: 316562 - DNA, 25 bp, Rattus norvegicus
gacagacttgtcatagcaacctagt

SEQ ID NO: 316563 - DNA, 25 bp, Rattus norvegicus
gacagacttgtcttagcaacctagt

SEQ ID NO: 316564 - DNA, 25 bp, Rattus norvegicus
gacagacttgttagtctagcaggga

SEQ ID NO: 316565 - DNA, 25 bp, Rattus norvegicus
gacagacttgtttgtctagcaggga

SEQ ID NO: 316566 - DNA, 25 bp, Rattus norvegicus
gacagagaaaccaccttgggcagag

SEQ ID NO: 316567 - DNA, 25 bp, Rattus norvegicus
gacagagaaacctccttgggcagag

SEQ ID NO: 316568 - DNA, 25 bp, Rattus norvegicus
gacagagaaggcagtctccccacca

SEQ ID NO: 316569 - DNA, 25 bp, Rattus norvegicus
gacagagaaggctgtctccccacca

SEQ ID NO: 316570 - DNA, 25 bp, Rattus norvegicus
gacagagacacaaaccggccaaaag

SEQ ID NO: 316571 - DNA, 25 bp, Rattus norvegicus
gacagagacacataccggccaaaag

SEQ ID NO: 316572 - DNA, 25 bp, Rattus norvegicus
gacagagacacgcattcctgggatg

SEQ ID NO: 316573 - DNA, 25 bp, Rattus norvegicus
gacagagacacggattcctgggatg

SEQ ID NO: 316574 - DNA, 25 bp, Rattus norvegicus
gacagagacagactgttctacagag

SEQ ID NO: 316575 - DNA, 25 bp, Rattus norvegicus
gacagagacagagtgttctacagag

SEQ ID NO: 316576 - DNA, 25 bp, Rattus norvegicus
gacagagaccacagattttccttgt

SEQ ID NO: 316577 - DNA, 25 bp, Rattus norvegicus
gacagagaccactgattttccttgt

SEQ ID NO: 316578 - DNA, 25 bp, Rattus norvegicus
gacagagaccatacccacagtggaa

SEQ ID NO: 316579 - DNA, 25 bp, Rattus norvegicus
gacagagaccatcttcaacgcctgc

SEQ ID NO: 316580 - DNA, 25 bp, Rattus norvegicus
gacagagaccatgttcaacgcctgc

SEQ ID NO: 316581 - DNA, 25 bp, Rattus norvegicus
gacagagaccattcccacagtggaa

SEQ ID NO: 316582 - DNA, 25 bp, Rattus norvegicus
gacagagacctgcagataccaaccc

SEQ ID NO: 316583 - DNA, 25 bp, Rattus norvegicus
gacagagacctggagataccaaccc

SEQ ID NO: 316584 - DNA, 25 bp, Rattus norvegicus
gacagagacgtgaaccgggaatatt

SEQ ID NO: 316585 - DNA, 25 bp, Rattus norvegicus
gacagagacgtgtaccgggaatatt

SEQ ID NO: 316586 - DNA, 25 bp, Rattus norvegicus
gacagagactacactgctggctgca

SEQ ID NO: 316587 - DNA, 25 bp, Rattus norvegicus
gacagagactactctgctggctgca

SEQ ID NO: 316588 - DNA, 25 bp, Rattus norvegicus
gacagagactttagagccaaggcct

SEQ ID NO: 316589 - DNA, 25 bp, Rattus norvegicus
gacagagactttaggaataacaatg

SEQ ID NO: 316590 - DNA, 25 bp, Rattus norvegicus
gacagagacttttgagccaaggcct

SEQ ID NO: 316591 - DNA, 25 bp, Rattus norvegicus
gacagagacttttggaataacaatg

SEQ ID NO: 316592 - DNA, 25 bp, Rattus norvegicus
gacagagagaacatccaacctcaaa

SEQ ID NO: 316593 - DNA, 25 bp, Rattus norvegicus
gacagagagaacttccaacctcaaa

SEQ ID NO: 316594 - DNA, 25 bp, Rattus norvegicus
gacagagagaagcagattacaccaa

SEQ ID NO: 316595 - DNA, 25 bp, Rattus norvegicus
gacagagagaaggagattacaccaa

SEQ ID NO: 316596 - DNA, 25 bp, Rattus norvegicus
gacagagagcacaggctgccgttca

SEQ ID NO: 316597 - DNA, 25 bp, Rattus norvegicus
gacagagagcactggctgccgttca

SEQ ID NO: 316598 - DNA, 25 bp, Rattus norvegicus
gacagagagcccaaaacagccctta

SEQ ID NO: 316599 - DNA, 25 bp, Rattus norvegicus
gacagagagccctaaacagccctta

SEQ ID NO: 316600 - DNA, 25 bp, Rattus norvegicus
gacagagagctcagtggcagaacac

SEQ ID NO: 316601 - DNA, 25 bp, Rattus norvegicus
gacagagagctctgtggcagaacac

SEQ ID NO: 316602 - DNA, 25 bp, Rattus norvegicus
gacagagagtcacagcccaaggatg

SEQ ID NO: 316603 - DNA, 25 bp, Rattus norvegicus
gacagagagtcagagcccaaggatg

SEQ ID NO: 316604 - DNA, 25 bp, Rattus norvegicus
gacagagagtctccatggaagctct

SEQ ID NO: 316605 - DNA, 25 bp, Rattus norvegicus
gacagagagtctgcatggaagctct

SEQ ID NO: 316606 - DNA, 25 bp, Rattus norvegicus
gacagagagtgacccatgcttccag

SEQ ID NO: 316607 - DNA, 25 bp, Rattus norvegicus
gacagagagtgagccatgcttccag

SEQ ID NO: 316608 - DNA, 25 bp, Rattus norvegicus
gacagagatgaacccagccacatgg

SEQ ID NO: 316609 - DNA, 25 bp, Rattus norvegicus
gacagagatgaagccagccacatgg

SEQ ID NO: 316610 - DNA, 25 bp, Rattus norvegicus
gacagagattcacattttaatgaca

SEQ ID NO: 316611 - DNA, 25 bp, Rattus norvegicus
gacagagattcagattttaatgaca

SEQ ID NO: 316612 - DNA, 25 bp, Rattus norvegicus
gacagagattggactccactacctg

SEQ ID NO: 316613 - DNA, 25 bp, Rattus norvegicus
gacagagattggtctccactacctg

SEQ ID NO: 316614 - DNA, 25 bp, Rattus norvegicus
gacagagcaaaaccctagtccacgt

SEQ ID NO: 316615 - DNA, 25 bp, Rattus norvegicus
gacagagcaaaagcctagtccacgt

SEQ ID NO: 316616 - DNA, 25 bp, Rattus norvegicus
gacagagcaacaaagagtacttcat

SEQ ID NO: 316617 - DNA, 25 bp, Rattus norvegicus
gacagagcaacaagtatggatccta

SEQ ID NO: 316618 - DNA, 25 bp, Rattus norvegicus
gacagagcaacatagagtacttcat

SEQ ID NO: 316619 - DNA, 25 bp, Rattus norvegicus
gacagagcaacatgtatggatccta

SEQ ID NO: 316620 - DNA, 25 bp, Rattus norvegicus
gacagagcacttacagaacatggga

SEQ ID NO: 316621 - DNA, 25 bp, Rattus norvegicus
gacagagcactttcagaacatggga

SEQ ID NO: 316622 - DNA, 25 bp, Rattus norvegicus
gacagagcagcaccagtactggctt

SEQ ID NO: 316623 - DNA, 25 bp, Rattus norvegicus
gacagagcagcagcagtactggctt

SEQ ID NO: 316624 - DNA, 25 bp, Rattus norvegicus
gacagagcagctcaacagtcctgaa

SEQ ID NO: 316625 - DNA, 25 bp, Rattus norvegicus
gacagagcagctcatcgaagccata

SEQ ID NO: 316626 - DNA, 25 bp, Rattus norvegicus
gacagagcagctgaacagtcctgaa

SEQ ID NO: 316627 - DNA, 25 bp, Rattus norvegicus
gacagagcagctgatcgaagccata

SEQ ID NO: 316628 - DNA, 25 bp, Rattus norvegicus
gacagagcaggtctcctagctggac

SEQ ID NO: 316629 - DNA, 25 bp, Rattus norvegicus
gacagagcaggtgtcctagctggac

SEQ ID NO: 316630 - DNA, 25 bp, Rattus norvegicus
gacagagcattgaatgcctcctttt

SEQ ID NO: 316631 - DNA, 25 bp, Rattus norvegicus
gacagagcattgtatgcctcctttt

SEQ ID NO: 316632 - DNA, 25 bp, Rattus norvegicus
gacagagccaacatgccagacgggt

SEQ ID NO: 316633 - DNA, 25 bp, Rattus norvegicus
gacagagccaacttgccagacgggt

SEQ ID NO: 316634 - DNA, 25 bp, Rattus norvegicus
gacagagccactcctgctggtttga

SEQ ID NO: 316635 - DNA, 25 bp, Rattus norvegicus
gacagagccactgctgctggtttga

SEQ ID NO: 316636 - DNA, 25 bp, Rattus norvegicus
gacagagccagacagtacagatcac

SEQ ID NO: 316637 - DNA, 25 bp, Rattus norvegicus
gacagagccagagagtacagatcac

SEQ ID NO: 316638 - DNA, 25 bp, Rattus norvegicus
gacagagccatcctgtcttactctt

SEQ ID NO: 316639 - DNA, 25 bp, Rattus norvegicus
gacagagccatcgtgtcttactctt

SEQ ID NO: 316640 - DNA, 25 bp, Rattus norvegicus
gacagagcccgacaagggtcctgta

SEQ ID NO: 316641 - DNA, 25 bp, Rattus norvegicus
gacagagcccgagaagggtcctgta

SEQ ID NO: 316642 - DNA, 25 bp, Rattus norvegicus
gacagagccggcctttaccagtctc

SEQ ID NO: 316643 - DNA, 25 bp, Rattus norvegicus
gacagagccggcgtttaccagtctc

SEQ ID NO: 316644 - DNA, 25 bp, Rattus norvegicus
gacagagcctcaatttcgatgatgt

SEQ ID NO: 316645 - DNA, 25 bp, Rattus norvegicus
gacagagcctcattttcgatgatgt

SEQ ID NO: 316646 - DNA, 25 bp, Rattus norvegicus
gacagagcctgcctttgagccagct

SEQ ID NO: 316647 - DNA, 25 bp, Rattus norvegicus
gacagagcctgcgtttgagccagct

SEQ ID NO: 316648 - DNA, 25 bp, Rattus norvegicus
gacagagcctggaacttgccgagac

SEQ ID NO: 316649 - DNA, 25 bp, Rattus norvegicus
gacagagcctggtacttgccgagac

SEQ ID NO: 316650 - DNA, 25 bp, Rattus norvegicus
gacagagcggcaacctcaggtgcaa

SEQ ID NO: 316651 - DNA, 25 bp, Rattus norvegicus
gacagagcggcatcctcaggtgcaa

SEQ ID NO: 316652 - DNA, 25 bp, Rattus norvegicus
gacagagctaaccacatcgttcttt

SEQ ID NO: 316653 - DNA, 25 bp, Rattus norvegicus
gacagagctaacgacatcgttcttt

SEQ ID NO: 316654 - DNA, 25 bp, Rattus norvegicus
gacagagctagacccagccagtcac

SEQ ID NO: 316655 - DNA, 25 bp, Rattus norvegicus
gacagagctagagccagccagtcac

SEQ ID NO: 316656 - DNA, 25 bp, Rattus norvegicus
gacagagctcaactcctgcattgat

SEQ ID NO: 316657 - DNA, 25 bp, Rattus norvegicus
gacagagctcaagtcctgcattgat

SEQ ID NO: 316658 - DNA, 25 bp, Rattus norvegicus
gacagagctcacacactttgtatct

SEQ ID NO: 316659 - DNA, 25 bp, Rattus norvegicus
gacagagctcactcactttgtatct

SEQ ID NO: 316660 - DNA, 25 bp, Rattus norvegicus
gacagagctctgaccatgtacagtg

SEQ ID NO: 316661 - DNA, 25 bp, Rattus norvegicus
gacagagctctgtccatgtacagtg

SEQ ID NO: 316662 - DNA, 25 bp, Rattus norvegicus
gacagagctgccaaccagattctta

SEQ ID NO: 316663 - DNA, 25 bp, Rattus norvegicus
gacagagctgcctaccagattctta

SEQ ID NO: 316664 - DNA, 25 bp, Rattus norvegicus
gacagagctggaagcttagacctgg

SEQ ID NO: 316665 - DNA, 25 bp, Rattus norvegicus
gacagagctggatgcttagacctgg

SEQ ID NO: 316666 - DNA, 25 bp, Rattus norvegicus
gacagagctggcatctgagttcacc

SEQ ID NO: 316667 - DNA, 25 bp, Rattus norvegicus
gacagagctggcttctgagttcacc

SEQ ID NO: 316668 - DNA, 25 bp, Rattus norvegicus
gacagagcttacatgcgtgtttccc

SEQ ID NO: 316669 - DNA, 25 bp, Rattus norvegicus
gacagagcttacttgcgtgtttccc

SEQ ID NO: 316670 - DNA, 25 bp, Rattus norvegicus
gacagaggaactacactgcctgctt

SEQ ID NO: 316671 - DNA, 25 bp, Rattus norvegicus
gacagaggaactagcactttcccgt

SEQ ID NO: 316672 - DNA, 25 bp, Rattus norvegicus
gacagaggaacttcactgcctgctt

SEQ ID NO: 316673 - DNA, 25 bp, Rattus norvegicus
gacagaggaacttgcactttcccgt

SEQ ID NO: 316674 - DNA, 25 bp, Rattus norvegicus
gacagaggaagtccccaagccaaag

SEQ ID NO: 316675 - DNA, 25 bp, Rattus norvegicus
gacagaggaagtgcccaagccaaag

SEQ ID NO: 316676 - DNA, 25 bp, Rattus norvegicus
gacagaggaatccaattcttctcag

SEQ ID NO: 316677 - DNA, 25 bp, Rattus norvegicus
gacagaggaatcgaattcttctcag

SEQ ID NO: 316678 - DNA, 25 bp, Rattus norvegicus
gacagaggaattcttttcttttcgg

SEQ ID NO: 316679 - DNA, 25 bp, Rattus norvegicus
gacagaggaattgttttcttttcgg

SEQ ID NO: 316680 - DNA, 25 bp, Rattus norvegicus
gacagaggactccttacactcctta

SEQ ID NO: 316681 - DNA, 25 bp, Rattus norvegicus
gacagaggactcgttacactcctta

SEQ ID NO: 316682 - DNA, 25 bp, Rattus norvegicus
gacagaggactgattcccagggccc

SEQ ID NO: 316683 - DNA, 25 bp, Rattus norvegicus
gacagaggactgtttcccagggccc

SEQ ID NO: 316684 - DNA, 25 bp, Rattus norvegicus
gacagaggagacacggcagcttccg

SEQ ID NO: 316685 - DNA, 25 bp, Rattus norvegicus
gacagaggagactcggcagcttccg

SEQ ID NO: 316686 - DNA, 25 bp, Rattus norvegicus
gacagaggagctatcgagttttata

SEQ ID NO: 316687 - DNA, 25 bp, Rattus norvegicus
gacagaggagctttcgagttttata

SEQ ID NO: 316688 - DNA, 25 bp, Rattus norvegicus
gacagaggatctcgccctgtggact

SEQ ID NO: 316689 - DNA, 25 bp, Rattus norvegicus
gacagaggatctggccctgtggact

SEQ ID NO: 316690 - DNA, 25 bp, Rattus norvegicus
gacagaggatgaccgtctcacccct

SEQ ID NO: 316691 - DNA, 25 bp, Rattus norvegicus
gacagaggatgagcgtctcacccct

SEQ ID NO: 316692 - DNA, 25 bp, Rattus norvegicus
gacagaggcctcacccatgtgttta

SEQ ID NO: 316693 - DNA, 25 bp, Rattus norvegicus
gacagaggcctctcccatgtgttta

SEQ ID NO: 316694 - DNA, 25 bp, Rattus norvegicus
gacagaggcgccatcaggtggacac

SEQ ID NO: 316695 - DNA, 25 bp, Rattus norvegicus
gacagaggcgccttcaggtggacac

SEQ ID NO: 316696 - DNA, 25 bp, Rattus norvegicus
gacagaggctcaccaagatgctgct

SEQ ID NO: 316697 - DNA, 25 bp, Rattus norvegicus
gacagaggctcagcaagatgctgct

SEQ ID NO: 316698 - DNA, 25 bp, Rattus norvegicus
gacagaggctgcacttccagctgat

SEQ ID NO: 316699 - DNA, 25 bp, Rattus norvegicus
gacagaggctgctcttccagctgat

SEQ ID NO: 316700 - DNA, 25 bp, Rattus norvegicus
gacagagggacacatttctcccctt

SEQ ID NO: 316701 - DNA, 25 bp, Rattus norvegicus
gacagagggacagatttctcccctt

SEQ ID NO: 316702 - DNA, 25 bp, Rattus norvegicus
gacagaggtaatcacctttgccaaa

SEQ ID NO: 316703 - DNA, 25 bp, Rattus norvegicus
gacagaggtaatgacctttgccaaa

SEQ ID NO: 316704 - DNA, 25 bp, Rattus norvegicus
gacagaggtcacctagccccaggta

SEQ ID NO: 316705 - DNA, 25 bp, Rattus norvegicus
gacagaggtcacgtagccccaggta

SEQ ID NO: 316706 - DNA, 25 bp, Rattus norvegicus
gacagaggtcctctgggtttagccc

SEQ ID NO: 316707 - DNA, 25 bp, Rattus norvegicus
gacagaggtcctgtgggtttagccc

SEQ ID NO: 316708 - DNA, 25 bp, Rattus norvegicus
gacagaggtctcactttgaattttc

SEQ ID NO: 316709 - DNA, 25 bp, Rattus norvegicus
gacagaggtctctctttgaattttc

SEQ ID NO: 316710 - DNA, 25 bp, Rattus norvegicus
gacagaggtctgagccacgacattc

SEQ ID NO: 316711 - DNA, 25 bp, Rattus norvegicus
gacagaggtctgtgccacgacattc

SEQ ID NO: 316712 - DNA, 25 bp, Rattus norvegicus
gacagaggttccagcccttgagggc

SEQ ID NO: 316713 - DNA, 25 bp, Rattus norvegicus
gacagaggttcctgcccttgagggc

SEQ ID NO: 316714 - DNA, 25 bp, Rattus norvegicus
gacagaggtttcaacagcattcctg

SEQ ID NO: 316715 - DNA, 25 bp, Rattus norvegicus
gacagaggtttctacagcattcctg

SEQ ID NO: 316716 - DNA, 25 bp, Rattus norvegicus
gacagagtagatctcctggcttctg

SEQ ID NO: 316717 - DNA, 25 bp, Rattus norvegicus
gacagagtagatgtcctggcttctg

SEQ ID NO: 316718 - DNA, 25 bp, Rattus norvegicus
gacagagtccacaccagctggaagt

SEQ ID NO: 316719 - DNA, 25 bp, Rattus norvegicus
gacagagtccactccagctggaagt

SEQ ID NO: 316720 - DNA, 25 bp, Rattus norvegicus
gacagagtcccgcaaatcactatta

SEQ ID NO: 316721 - DNA, 25 bp, Rattus norvegicus
gacagagtcccggaaatcactatta

SEQ ID NO: 316722 - DNA, 25 bp, Rattus norvegicus
gacagagtcctgacagtcattaaag

SEQ ID NO: 316723 - DNA, 25 bp, Rattus norvegicus
gacagagtcctgtcagtcattaaag

SEQ ID NO: 316724 - DNA, 25 bp, Rattus norvegicus
gacagagtctcacctttcagtggat

SEQ ID NO: 316725 - DNA, 25 bp, Rattus norvegicus
gacagagtctcagctttcagtggat

SEQ ID NO: 316726 - DNA, 25 bp, Rattus norvegicus
gacagagtctccacgcagtttcatt

SEQ ID NO: 316727 - DNA, 25 bp, Rattus norvegicus
gacagagtctcctcgcagtttcatt

SEQ ID NO: 316728 - DNA, 25 bp, Rattus norvegicus
gacagagtctttaataggcccagga

SEQ ID NO: 316729 - DNA, 25 bp, Rattus norvegicus
gacagagtctttcactgaacttgga

SEQ ID NO: 316730 - DNA, 25 bp, Rattus norvegicus
gacagagtctttcgaggtccatctt

SEQ ID NO: 316731 - DNA, 25 bp, Rattus norvegicus
gacagagtctttgactgaacttgga

SEQ ID NO: 316732 - DNA, 25 bp, Rattus norvegicus
gacagagtctttggaggtccatctt

SEQ ID NO: 316733 - DNA, 25 bp, Rattus norvegicus
gacagagtcttttataggcccagga

SEQ ID NO: 316734 - DNA, 25 bp, Rattus norvegicus
gacagagtgagccactgcaccccag

SEQ ID NO: 316735 - DNA, 25 bp, Rattus norvegicus
gacagagtgagcgactgcaccccag

SEQ ID NO: 316736 - DNA, 25 bp, Rattus norvegicus
gacagagtgagtacccacaagccag

SEQ ID NO: 316737 - DNA, 25 bp, Rattus norvegicus
gacagagtgagttcccacaagccag

SEQ ID NO: 316738 - DNA, 25 bp, Rattus norvegicus
gacagagtgccactagtgtgagact

SEQ ID NO: 316739 - DNA, 25 bp, Rattus norvegicus
gacagagtgccagtagtgtgagact

SEQ ID NO: 316740 - DNA, 25 bp, Rattus norvegicus
gacagagtggctccaaccactgtga

SEQ ID NO: 316741 - DNA, 25 bp, Rattus norvegicus
gacagagtggctgcaaccactgtga

SEQ ID NO: 316742 - DNA, 25 bp, Rattus norvegicus
gacagagtgggacgtgtcattcact

SEQ ID NO: 316743 - DNA, 25 bp, Rattus norvegicus
gacagagtgggaggtgtcattcact

SEQ ID NO: 316744 - DNA, 25 bp, Rattus norvegicus
gacagagtgttgcaagtttccttta

SEQ ID NO: 316745 - DNA, 25 bp, Rattus norvegicus
gacagagtgttggaagtttccttta

SEQ ID NO: 316746 - DNA, 25 bp, Rattus norvegicus
gacagagttcagaggctcagccttc

SEQ ID NO: 316747 - DNA, 25 bp, Rattus norvegicus
gacagagttcagtggctcagccttc

SEQ ID NO: 316748 - DNA, 25 bp, Rattus norvegicus
gacagagtttcgaaaaagtatccat

SEQ ID NO: 316749 - DNA, 25 bp, Rattus norvegicus
gacagagtttcgtaaaagtatccat

SEQ ID NO: 316750 - DNA, 25 bp, Rattus norvegicus
gacagagttttcagtggcttggccc

SEQ ID NO: 316751 - DNA, 25 bp, Rattus norvegicus
gacagagttttctgtggcttggccc

SEQ ID NO: 316752 - DNA, 25 bp, Rattus norvegicus
gacagataaaaccacgtgctctcag

SEQ ID NO: 316753 - DNA, 25 bp, Rattus norvegicus
gacagataaaacgacgtgctctcag

SEQ ID NO: 316754 - DNA, 25 bp, Rattus norvegicus
gacagataaccacaatcagccgagt

SEQ ID NO: 316755 - DNA, 25 bp, Rattus norvegicus
gacagataaccagaatcagccgagt

SEQ ID NO: 316756 - DNA, 25 bp, Rattus norvegicus
gacagatacagaaccacgtgtttta

SEQ ID NO: 316757 - DNA, 25 bp, Rattus norvegicus
gacagatacagatccacgtgtttta

SEQ ID NO: 316758 - DNA, 25 bp, Rattus norvegicus
gacagataccagctgtggttctctg

SEQ ID NO: 316759 - DNA, 25 bp, Rattus norvegicus
gacagataccaggtgtggttctctg

SEQ ID NO: 316760 - DNA, 25 bp, Rattus norvegicus
gacagatactggaagctctacgcta

SEQ ID NO: 316761 - DNA, 25 bp, Rattus norvegicus
gacagatactggtagctctacgcta

SEQ ID NO: 316762 - DNA, 25 bp, Rattus norvegicus
gacagatacttcagaggcacgggac

SEQ ID NO: 316763 - DNA, 25 bp, Rattus norvegicus
gacagatacttctgaggcacgggac

SEQ ID NO: 316764 - DNA, 25 bp, Rattus norvegicus
gacagatatgaccagatccgccgcc

SEQ ID NO: 316765 - DNA, 25 bp, Rattus norvegicus
gacagatatgacgagatccgccgcc

SEQ ID NO: 316766 - DNA, 25 bp, Rattus norvegicus
gacagatcactaaggtgctgacacg

SEQ ID NO: 316767 - DNA, 25 bp, Rattus norvegicus
gacagatcactatggtgctgacacg

SEQ ID NO: 316768 - DNA, 25 bp, Rattus norvegicus
gacagatcacttcaatccaattcat

SEQ ID NO: 316769 - DNA, 25 bp, Rattus norvegicus
gacagatcacttgaatccaattcat

SEQ ID NO: 316770 - DNA, 25 bp, Rattus norvegicus
gacagatcagatcctcatgggctct

SEQ ID NO: 316771 - DNA, 25 bp, Rattus norvegicus
gacagatcagatgctcatgggctct

SEQ ID NO: 316772 - DNA, 25 bp, Rattus norvegicus
gacagatcaggcacattagtgagga

SEQ ID NO: 316773 - DNA, 25 bp, Rattus norvegicus
gacagatcaggctcattagtgagga

SEQ ID NO: 316774 - DNA, 25 bp, Rattus norvegicus
gacagatcatctcgaaccttgacaa

SEQ ID NO: 316775 - DNA, 25 bp, Rattus norvegicus
gacagatcatctggaaccttgacaa

SEQ ID NO: 316776 - DNA, 25 bp, Rattus norvegicus
gacagatcatgaattcagggtcttt

SEQ ID NO: 316777 - DNA, 25 bp, Rattus norvegicus
gacagatcatgatttcagggtcttt

SEQ ID NO: 316778 - DNA, 25 bp, Rattus norvegicus
gacagatcccatcagtaactaccca

SEQ ID NO: 316779 - DNA, 25 bp, Rattus norvegicus
gacagatcccatgagtaactaccca

SEQ ID NO: 316780 - DNA, 25 bp, Rattus norvegicus
gacagatcgcttatgcatgcagtct

SEQ ID NO: 316781 - DNA, 25 bp, Rattus norvegicus
gacagatcgcttccatattttttaa

SEQ ID NO: 316782 - DNA, 25 bp, Rattus norvegicus
gacagatcgcttgcatattttttaa

SEQ ID NO: 316783 - DNA, 25 bp, Rattus norvegicus
gacagatcgcttttgcatgcagtct

SEQ ID NO: 316784 - DNA, 25 bp, Rattus norvegicus
gacagatcgttcaggtgtcagtccc

SEQ ID NO: 316785 - DNA, 25 bp, Rattus norvegicus
gacagatcgttctggtgtcagtccc

SEQ ID NO: 316786 - DNA, 25 bp, Rattus norvegicus
gacagatctcctagataatgtactt

SEQ ID NO: 316787 - DNA, 25 bp, Rattus norvegicus
gacagatctccttgataatgtactt

SEQ ID NO: 316788 - DNA, 25 bp, Rattus norvegicus
gacagatgaaagctactcccagcat

SEQ ID NO: 316789 - DNA, 25 bp, Rattus norvegicus
gacagatgaaaggtactcccagcat

SEQ ID NO: 316790 - DNA, 25 bp, Rattus norvegicus
gacagatgaccacggatgttgcctt

SEQ ID NO: 316791 - DNA, 25 bp, Rattus norvegicus
gacagatgaccagggatgttgcctt

SEQ ID NO: 316792 - DNA, 25 bp, Rattus norvegicus
gacagatgactgactcttgcggaca

SEQ ID NO: 316793 - DNA, 25 bp, Rattus norvegicus
gacagatgactgtctcttgcggaca

SEQ ID NO: 316794 - DNA, 25 bp, Rattus norvegicus
gacagatgacttatctgcctctgag

SEQ ID NO: 316795 - DNA, 25 bp, Rattus norvegicus
gacagatgacttttctgcctctgag

SEQ ID NO: 316796 - DNA, 25 bp, Rattus norvegicus
gacagatgccgtaacagctattcat

SEQ ID NO: 316797 - DNA, 25 bp, Rattus norvegicus
gacagatgccgttacagctattcat

SEQ ID NO: 316798 - DNA, 25 bp, Rattus norvegicus
gacagatgccttcaatatcattcct

SEQ ID NO: 316799 - DNA, 25 bp, Rattus norvegicus
gacagatgccttctgccaacagtga

SEQ ID NO: 316800 - DNA, 25 bp, Rattus norvegicus
gacagatgccttgaatatcattcct

SEQ ID NO: 316801 - DNA, 25 bp, Rattus norvegicus
gacagatgccttgtgccaacagtga

SEQ ID NO: 316802 - DNA, 25 bp, Rattus norvegicus
gacagatgctataaagacaccaaat

SEQ ID NO: 316803 - DNA, 25 bp, Rattus norvegicus
gacagatgctattaagacaccaaat

SEQ ID NO: 316804 - DNA, 25 bp, Rattus norvegicus
gacagatgctcgctcatagggacac

SEQ ID NO: 316805 - DNA, 25 bp, Rattus norvegicus
gacagatgctcggtcatagggacac

SEQ ID NO: 316806 - DNA, 25 bp, Rattus norvegicus
gacagatgctgacaactgccacctg

SEQ ID NO: 316807 - DNA, 25 bp, Rattus norvegicus
gacagatgctgagaactgccacctg

SEQ ID NO: 316808 - DNA, 25 bp, Rattus norvegicus
gacagatgctgcaatcatagactta

SEQ ID NO: 316809 - DNA, 25 bp, Rattus norvegicus
gacagatgctgctatcatagactta

SEQ ID NO: 316810 - DNA, 25 bp, Rattus norvegicus
gacagatgcttcatcccgggtcagc

SEQ ID NO: 316811 - DNA, 25 bp, Rattus norvegicus
gacagatgcttcttcccgggtcagc

SEQ ID NO: 316812 - DNA, 25 bp, Rattus norvegicus
gacagatggactcagtgccctgctg

SEQ ID NO: 316813 - DNA, 25 bp, Rattus norvegicus
gacagatggactgagtgccctgctg

SEQ ID NO: 316814 - DNA, 25 bp, Rattus norvegicus
gacagatggattacaccgttggtga

SEQ ID NO: 316815 - DNA, 25 bp, Rattus norvegicus
gacagatggatttcaccgttggtga

SEQ ID NO: 316816 - DNA, 25 bp, Rattus norvegicus
gacagatggcccagcatgcaaatat

SEQ ID NO: 316817 - DNA, 25 bp, Rattus norvegicus
gacagatggccctgcatgcaaatat

SEQ ID NO: 316818 - DNA, 25 bp, Rattus norvegicus
gacagatgtcagaactaagtttgct

SEQ ID NO: 316819 - DNA, 25 bp, Rattus norvegicus
gacagatgtcagagtgtccttctga

SEQ ID NO: 316820 - DNA, 25 bp, Rattus norvegicus
gacagatgtcagtactaagtttgct

SEQ ID NO: 316821 - DNA, 25 bp, Rattus norvegicus
gacagatgtcagtgtgtccttctga

SEQ ID NO: 316822 - DNA, 25 bp, Rattus norvegicus
gacagatgtcccagtgtagttctcg

SEQ ID NO: 316823 - DNA, 25 bp, Rattus norvegicus
gacagatgtccctgtgtagttctcg

SEQ ID NO: 316824 - DNA, 25 bp, Rattus norvegicus
gacagatgtgaccaagaccttcgca

SEQ ID NO: 316825 - DNA, 25 bp, Rattus norvegicus
gacagatgtgacgaagaccttcgca

SEQ ID NO: 316826 - DNA, 25 bp, Rattus norvegicus
gacagatgtggccttaacgttgcaa

SEQ ID NO: 316827 - DNA, 25 bp, Rattus norvegicus
gacagatgtggcgttaacgttgcaa

SEQ ID NO: 316828 - DNA, 25 bp, Rattus norvegicus
gacagatgtgtgagcctatcagcat

SEQ ID NO: 316829 - DNA, 25 bp, Rattus norvegicus
gacagatgtgtgtgcctatcagcat

SEQ ID NO: 316830 - DNA, 25 bp, Rattus norvegicus
gacagattagccatcttggtagcaa

SEQ ID NO: 316831 - DNA, 25 bp, Rattus norvegicus
gacagattagccttcttggtagcaa

SEQ ID NO: 316832 - DNA, 25 bp, Rattus norvegicus
gacagattcacgatatcaaagcaga

SEQ ID NO: 316833 - DNA, 25 bp, Rattus norvegicus
gacagattcacgttatcaaagcaga

SEQ ID NO: 316834 - DNA, 25 bp, Rattus norvegicus
gacagattcctacggttgctgccac

SEQ ID NO: 316835 - DNA, 25 bp, Rattus norvegicus
gacagattcctagggttgctgccac

SEQ ID NO: 316836 - DNA, 25 bp, Rattus norvegicus
gacagattcttgatgctccttgttt

SEQ ID NO: 316837 - DNA, 25 bp, Rattus norvegicus
gacagattcttgttgctccttgttt

SEQ ID NO: 316838 - DNA, 25 bp, Rattus norvegicus
gacagattgacacacagttgtcctc

SEQ ID NO: 316839 - DNA, 25 bp, Rattus norvegicus
gacagattgacagacagttgtcctc

SEQ ID NO: 316840 - DNA, 25 bp, Rattus norvegicus
gacagattgaccacagtgagctgta

SEQ ID NO: 316841 - DNA, 25 bp, Rattus norvegicus
gacagattgacctcagtgagctgta

SEQ ID NO: 316842 - DNA, 25 bp, Rattus norvegicus
gacagattgatcatcctcagtgggc

SEQ ID NO: 316843 - DNA, 25 bp, Rattus norvegicus
gacagattgatcttcctcagtgggc

SEQ ID NO: 316844 - DNA, 25 bp, Rattus norvegicus
gacagattgctgacgcatttctcag

SEQ ID NO: 316845 - DNA, 25 bp, Rattus norvegicus
gacagattgctgtcgcatttctcag

SEQ ID NO: 316846 - DNA, 25 bp, Rattus norvegicus
gacagattgcttcttgtttaacaaa

SEQ ID NO: 316847 - DNA, 25 bp, Rattus norvegicus
gacagattgcttgttgtttaacaaa

SEQ ID NO: 316848 - DNA, 25 bp, Rattus norvegicus
gacagattgtctcagttacttccta

SEQ ID NO: 316849 - DNA, 25 bp, Rattus norvegicus
gacagattgtctgagttacttccta

SEQ ID NO: 316850 - DNA, 25 bp, Rattus norvegicus
gacagattgtgaatttcaggcggcc

SEQ ID NO: 316851 - DNA, 25 bp, Rattus norvegicus
gacagattgtgattttcaggcggcc

SEQ ID NO: 316852 - DNA, 25 bp, Rattus norvegicus
gacagattgtttacccttcacattc

SEQ ID NO: 316853 - DNA, 25 bp, Rattus norvegicus
gacagattgttttcccttcacattc

SEQ ID NO: 316854 - DNA, 25 bp, Rattus norvegicus
gacagatttcagcttacaccatgtt

SEQ ID NO: 316855 - DNA, 25 bp, Rattus norvegicus
gacagatttcaggttacaccatgtt

SEQ ID NO: 316856 - DNA, 25 bp, Rattus norvegicus
gacagatttctaccctggtgttatg

SEQ ID NO: 316857 - DNA, 25 bp, Rattus norvegicus
gacagatttctagcctggtgttatg

SEQ ID NO: 316858 - DNA, 25 bp, Rattus norvegicus
gacagattttcacatcgctccttgc

SEQ ID NO: 316859 - DNA, 25 bp, Rattus norvegicus
gacagattttcagatcgctccttgc

SEQ ID NO: 316860 - DNA, 25 bp, Rattus norvegicus
gacagattttgcagactagctttta

SEQ ID NO: 316861 - DNA, 25 bp, Rattus norvegicus
gacagattttgctgactagctttta

SEQ ID NO: 316862 - DNA, 25 bp, Rattus norvegicus
gacagcaaacacctgcctatttact

SEQ ID NO: 316863 - DNA, 25 bp, Rattus norvegicus
gacagcaaacacgtgcctatttact

SEQ ID NO: 316864 - DNA, 25 bp, Rattus norvegicus
gacagcaaacccagcttttgactca

SEQ ID NO: 316865 - DNA, 25 bp, Rattus norvegicus
gacagcaaaccctgcttttgactca

SEQ ID NO: 316866 - DNA, 25 bp, Rattus norvegicus
gacagcaacatcctcaggtggttct

SEQ ID NO: 316867 - DNA, 25 bp, Rattus norvegicus
gacagcaacatcgtcaggtggttct

SEQ ID NO: 316868 - DNA, 25 bp, Rattus norvegicus
gacagcaacttcattccaagttctt

SEQ ID NO: 316869 - DNA, 25 bp, Rattus norvegicus
gacagcaacttctttccaagttctt

SEQ ID NO: 316870 - DNA, 25 bp, Rattus norvegicus
gacagcaactttaccctgaggtcac

SEQ ID NO: 316871 - DNA, 25 bp, Rattus norvegicus
gacagcaacttttccctgaggtcac

SEQ ID NO: 316872 - DNA, 25 bp, Rattus norvegicus
gacagcaagaggagacagctcatgt

SEQ ID NO: 316873 - DNA, 25 bp, Rattus norvegicus
gacagcaagaggtgacagctcatgt

SEQ ID NO: 316874 - DNA, 25 bp, Rattus norvegicus
gacagcaagatcacctaaggtatgg

SEQ ID NO: 316875 - DNA, 25 bp, Rattus norvegicus
gacagcaagatctcctaaggtatgg

SEQ ID NO: 316876 - DNA, 25 bp, Rattus norvegicus
gacagcaagctcacttgccttggga

SEQ ID NO: 316877 - DNA, 25 bp, Rattus norvegicus
gacagcaagctctcttgccttggga

SEQ ID NO: 316878 - DNA, 25 bp, Rattus norvegicus
gacagcaagctgcaggctctctata

SEQ ID NO: 316879 - DNA, 25 bp, Rattus norvegicus
gacagcaagctggaggctctctata

SEQ ID NO: 316880 - DNA, 25 bp, Rattus norvegicus
gacagcaaggacattttacagagac

SEQ ID NO: 316881 - DNA, 25 bp, Rattus norvegicus
gacagcaaggactttttacagagac

SEQ ID NO: 316882 - DNA, 25 bp, Rattus norvegicus
gacagcaaggcccacctatgtggat

SEQ ID NO: 316883 - DNA, 25 bp, Rattus norvegicus
gacagcaaggccgacctatgtggat

SEQ ID NO: 316884 - DNA, 25 bp, Rattus norvegicus
gacagcaaggctcaaactctatagt

SEQ ID NO: 316885 - DNA, 25 bp, Rattus norvegicus
gacagcaaggctgaaactctatagt

SEQ ID NO: 316886 - DNA, 25 bp, Rattus norvegicus
gacagcaagtccacagtgacgcaaa

SEQ ID NO: 316887 - DNA, 25 bp, Rattus norvegicus
gacagcaagtcctcagtgacgcaaa

SEQ ID NO: 316888 - DNA, 25 bp, Rattus norvegicus
gacagcaagttcaagttaacagaga

SEQ ID NO: 316889 - DNA, 25 bp, Rattus norvegicus
gacagcaagttctagttaacagaga

SEQ ID NO: 316890 - DNA, 25 bp, Rattus norvegicus
gacagcaagttgacatatccaaata

SEQ ID NO: 316891 - DNA, 25 bp, Rattus norvegicus
gacagcaagttgtcatatccaaata

SEQ ID NO: 316892 - DNA, 25 bp, Rattus norvegicus
gacagcaagtttcttatctcatttg

SEQ ID NO: 316893 - DNA, 25 bp, Rattus norvegicus
gacagcaagtttgttatctcatttg

SEQ ID NO: 316894 - DNA, 25 bp, Rattus norvegicus
gacagcaatattcacagcacattat

SEQ ID NO: 316895 - DNA, 25 bp, Rattus norvegicus
gacagcaatattgacagcacattat

SEQ ID NO: 316896 - DNA, 25 bp, Rattus norvegicus
gacagcaatcaaccacgcactacag

SEQ ID NO: 316897 - DNA, 25 bp, Rattus norvegicus
gacagcaatcaagcacgcactacag

SEQ ID NO: 316898 - DNA, 25 bp, Rattus norvegicus
gacagcaatgcacttccttcagggc

SEQ ID NO: 316899 - DNA, 25 bp, Rattus norvegicus
gacagcaatgcagttccttcagggc

SEQ ID NO: 316900 - DNA, 25 bp, Rattus norvegicus
gacagcaatgcccactgggcttgat

SEQ ID NO: 316901 - DNA, 25 bp, Rattus norvegicus
gacagcaatgccgactgggcttgat

SEQ ID NO: 316902 - DNA, 25 bp, Rattus norvegicus
gacagcacaaggcaagctctgacct

SEQ ID NO: 316903 - DNA, 25 bp, Rattus norvegicus
gacagcacaagggaagctctgacct

SEQ ID NO: 316904 - DNA, 25 bp, Rattus norvegicus
gacagcacaccactgttcagagcag

SEQ ID NO: 316905 - DNA, 25 bp, Rattus norvegicus
gacagcacaccagtgttcagagcag

SEQ ID NO: 316906 - DNA, 25 bp, Rattus norvegicus
gacagcacactcagtccctggaagt

SEQ ID NO: 316907 - DNA, 25 bp, Rattus norvegicus
gacagcacactctgtccctggaagt

SEQ ID NO: 316908 - DNA, 25 bp, Rattus norvegicus
gacagcacaggacatttgagcccaa

SEQ ID NO: 316909 - DNA, 25 bp, Rattus norvegicus
gacagcacaggagatttgagcccaa

SEQ ID NO: 316910 - DNA, 25 bp, Rattus norvegicus
gacagcacagttcacctacagactt

SEQ ID NO: 316911 - DNA, 25 bp, Rattus norvegicus
gacagcacagttgacctacagactt

SEQ ID NO: 316912 - DNA, 25 bp, Rattus norvegicus
gacagcacatgaagtctgccaatgt

SEQ ID NO: 316913 - DNA, 25 bp, Rattus norvegicus
gacagcacatgatgtctgccaatgt

SEQ ID NO: 316914 - DNA, 25 bp, Rattus norvegicus
gacagcaccatcctggctgtgcaga

SEQ ID NO: 316915 - DNA, 25 bp, Rattus norvegicus
gacagcaccatcgtggctgtgcaga

SEQ ID NO: 316916 - DNA, 25 bp, Rattus norvegicus
gacagcacccctccagcaagagtgg

SEQ ID NO: 316917 - DNA, 25 bp, Rattus norvegicus
gacagcacccctgcagcaagagtgg

SEQ ID NO: 316918 - DNA, 25 bp, Rattus norvegicus
gacagcaccgagcaacgtacacttt

SEQ ID NO: 316919 - DNA, 25 bp, Rattus norvegicus
gacagcaccgaggaacgtacacttt

SEQ ID NO: 316920 - DNA, 25 bp, Rattus norvegicus
gacagcacctacagtctcagcagca

SEQ ID NO: 316921 - DNA, 25 bp, Rattus norvegicus
gacagcacctactgtctcagcagca

SEQ ID NO: 316922 - DNA, 25 bp, Rattus norvegicus
gacagcacctctaacaccagaaaag

SEQ ID NO: 316923 - DNA, 25 bp, Rattus norvegicus
gacagcacctcttacaccagaaaag

SEQ ID NO: 316924 - DNA, 25 bp, Rattus norvegicus
gacagcacctgacaaccccaaaaat

SEQ ID NO: 316925 - DNA, 25 bp, Rattus norvegicus
gacagcacctgagaaccccaaaaat

SEQ ID NO: 316926 - DNA, 25 bp, Rattus norvegicus
gacagcaccttcattagacactcgc

SEQ ID NO: 316927 - DNA, 25 bp, Rattus norvegicus
gacagcaccttcattctgtgcagag

SEQ ID NO: 316928 - DNA, 25 bp, Rattus norvegicus
gacagcaccttctttagacactcgc

SEQ ID NO: 316929 - DNA, 25 bp, Rattus norvegicus
gacagcaccttctttctgtgcagag

SEQ ID NO: 316930 - DNA, 25 bp, Rattus norvegicus
gacagcacgccgctggatatgcaga

SEQ ID NO: 316931 - DNA, 25 bp, Rattus norvegicus
gacagcacgccggtggatatgcaga

SEQ ID NO: 316932 - DNA, 25 bp, Rattus norvegicus
gacagcactagtctcggtggagtta

SEQ ID NO: 316933 - DNA, 25 bp, Rattus norvegicus
gacagcactagtgtcggtggagtta

SEQ ID NO: 316934 - DNA, 25 bp, Rattus norvegicus
gacagcactcctcttgtaacagaag

SEQ ID NO: 316935 - DNA, 25 bp, Rattus norvegicus
gacagcactcctgttgtaacagaag

SEQ ID NO: 316936 - DNA, 25 bp, Rattus norvegicus
gacagcactgacacagtgggtcact

SEQ ID NO: 316937 - DNA, 25 bp, Rattus norvegicus
gacagcactgactcagtgggtcact

SEQ ID NO: 316938 - DNA, 25 bp, Rattus norvegicus
gacagcactgcacgtgaggcactct

SEQ ID NO: 316939 - DNA, 25 bp, Rattus norvegicus
gacagcactgcaggtgaggcactct

SEQ ID NO: 316940 - DNA, 25 bp, Rattus norvegicus
gacagcactgctccaaggacttatg

SEQ ID NO: 316941 - DNA, 25 bp, Rattus norvegicus
gacagcactgctgcaaggacttatg

SEQ ID NO: 316942 - DNA, 25 bp, Rattus norvegicus
gacagcagaagaatcagtctcagca

SEQ ID NO: 316943 - DNA, 25 bp, Rattus norvegicus
gacagcagaagattcagtctcagca

SEQ ID NO: 316944 - DNA, 25 bp, Rattus norvegicus
gacagcagacacactttcagagagg

SEQ ID NO: 316945 - DNA, 25 bp, Rattus norvegicus
gacagcagacactctttcagagagg

SEQ ID NO: 316946 - DNA, 25 bp, Rattus norvegicus
gacagcagaccaacaaatcaataat

SEQ ID NO: 316947 - DNA, 25 bp, Rattus norvegicus
gacagcagaccatcaaatcaataat

SEQ ID NO: 316948 - DNA, 25 bp, Rattus norvegicus
gacagcagaccccaatgtcaatgtg

SEQ ID NO: 316949 - DNA, 25 bp, Rattus norvegicus
gacagcagacccgaatgtcaatgtg

SEQ ID NO: 316950 - DNA, 25 bp, Rattus norvegicus
gacagcagactgagtctcatcggca

SEQ ID NO: 316951 - DNA, 25 bp, Rattus norvegicus
gacagcagactgtgtctcatcggca

SEQ ID NO: 316952 - DNA, 25 bp, Rattus norvegicus
gacagcagacttacatttatttatg

SEQ ID NO: 316953 - DNA, 25 bp, Rattus norvegicus
gacagcagactttcatttatttatg

SEQ ID NO: 316954 - DNA, 25 bp, Rattus norvegicus
gacagcagagctatatggagaaacc

SEQ ID NO: 316955 - DNA, 25 bp, Rattus norvegicus
gacagcagagctttatggagaaacc

SEQ ID NO: 316956 - DNA, 25 bp, Rattus norvegicus
gacagcagattcaagtgcccagcaa

SEQ ID NO: 316957 - DNA, 25 bp, Rattus norvegicus
gacagcagattctagtgcccagcaa

SEQ ID NO: 316958 - DNA, 25 bp, Rattus norvegicus
gacagcagcactaggttacctgact

SEQ ID NO: 316959 - DNA, 25 bp, Rattus norvegicus
gacagcagcacttggttacctgact

SEQ ID NO: 316960 - DNA, 25 bp, Rattus norvegicus
gacagcagcagcctagaagacgcta

SEQ ID NO: 316961 - DNA, 25 bp, Rattus norvegicus
gacagcagcagcgtagaagacgcta

SEQ ID NO: 316962 - DNA, 25 bp, Rattus norvegicus
gacagcagcagtaggatctctgtaa

SEQ ID NO: 316963 - DNA, 25 bp, Rattus norvegicus
gacagcagcagttggatctctgtaa

SEQ ID NO: 316964 - DNA, 25 bp, Rattus norvegicus
gacagcagcatgatattcagcgtct

SEQ ID NO: 316965 - DNA, 25 bp, Rattus norvegicus
gacagcagcatgttattcagcgtct

SEQ ID NO: 316966 - DNA, 25 bp, Rattus norvegicus
gacagcagcctaacctttggagatt

SEQ ID NO: 316967 - DNA, 25 bp, Rattus norvegicus
gacagcagcctatcctttggagatt

SEQ ID NO: 316968 - DNA, 25 bp, Rattus norvegicus
gacagcagcgaacgccatttgggta

SEQ ID NO: 316969 - DNA, 25 bp, Rattus norvegicus
gacagcagcgaaggccatttgggta

SEQ ID NO: 316970 - DNA, 25 bp, Rattus norvegicus
gacagcagcggacgcaggctctctt

SEQ ID NO: 316971 - DNA, 25 bp, Rattus norvegicus
gacagcagcggaggcaggctctctt

SEQ ID NO: 316972 - DNA, 25 bp, Rattus norvegicus
gacagcagctatcggcatccttgca

SEQ ID NO: 316973 - DNA, 25 bp, Rattus norvegicus
gacagcagctatgggcatccttgca

SEQ ID NO: 316974 - DNA, 25 bp, Rattus norvegicus
gacagcagctccactcataatgaaa

SEQ ID NO: 316975 - DNA, 25 bp, Rattus norvegicus
gacagcagctcctctcataatgaaa

SEQ ID NO: 316976 - DNA, 25 bp, Rattus norvegicus
gacagcagctgaatacaagattcta

SEQ ID NO: 316977 - DNA, 25 bp, Rattus norvegicus
gacagcagctgattacaagattcta

SEQ ID NO: 316978 - DNA, 25 bp, Rattus norvegicus
gacagcagctgcactactgacgctt

SEQ ID NO: 316979 - DNA, 25 bp, Rattus norvegicus
gacagcagctgcacttacagaaaga

SEQ ID NO: 316980 - DNA, 25 bp, Rattus norvegicus
gacagcagctgctctactgacgctt

SEQ ID NO: 316981 - DNA, 25 bp, Rattus norvegicus
gacagcagctgctcttacagaaaga

SEQ ID NO: 316982 - DNA, 25 bp, Rattus norvegicus
gacagcagctggactccataaacac

SEQ ID NO: 316983 - DNA, 25 bp, Rattus norvegicus
gacagcagctggtctccataaacac

SEQ ID NO: 316984 - DNA, 25 bp, Rattus norvegicus
gacagcagctttctcaatgaccatg

SEQ ID NO: 316985 - DNA, 25 bp, Rattus norvegicus
gacagcagctttgtcaatgaccatg

SEQ ID NO: 316986 - DNA, 25 bp, Rattus norvegicus
gacagcagggacatcgacaacaaca

SEQ ID NO: 316987 - DNA, 25 bp, Rattus norvegicus
gacagcagggacttcgacaacaaca

SEQ ID NO: 316988 - DNA, 25 bp, Rattus norvegicus
gacagcaggtgaactacctcagtga

SEQ ID NO: 316989 - DNA, 25 bp, Rattus norvegicus
gacagcaggtgatctacctcagtga

SEQ ID NO: 316990 - DNA, 25 bp, Rattus norvegicus
gacagcaggttactgggagccctta

SEQ ID NO: 316991 - DNA, 25 bp, Rattus norvegicus
gacagcaggttagtgggagccctta

SEQ ID NO: 316992 - DNA, 25 bp, Rattus norvegicus
gacagcagtccaatgacaaatactg

SEQ ID NO: 316993 - DNA, 25 bp, Rattus norvegicus
gacagcagtccattgacaaatactg

SEQ ID NO: 316994 - DNA, 25 bp, Rattus norvegicus
gacagcagtgtcacacaggcctggg

SEQ ID NO: 316995 - DNA, 25 bp, Rattus norvegicus
gacagcagtgtcatcgtggattctc

SEQ ID NO: 316996 - DNA, 25 bp, Rattus norvegicus
gacagcagtgtcattgagttctact

SEQ ID NO: 316997 - DNA, 25 bp, Rattus norvegicus
gacagcagtgtctcacaggcctggg

SEQ ID NO: 316998 - DNA, 25 bp, Rattus norvegicus
gacagcagtgtcttcgtggattctc

SEQ ID NO: 316999 - DNA, 25 bp, Rattus norvegicus
gacagcagtgtctttgagttctact

SEQ ID NO: 317000 - DNA, 25 bp, Rattus norvegicus
gacagcagtgtgaacttccgaagtg

SEQ ID NO: 317001 - DNA, 25 bp, Rattus norvegicus
gacagcagtgtgtacttccgaagtg

SEQ ID NO: 317002 - DNA, 25 bp, Rattus norvegicus
gacagcataactagggtatccccag

SEQ ID NO: 317003 - DNA, 25 bp, Rattus norvegicus
gacagcataacttgggtatccccag

SEQ ID NO: 317004 - DNA, 25 bp, Rattus norvegicus
gacagcataagaagtccctatgact

SEQ ID NO: 317005 - DNA, 25 bp, Rattus norvegicus
gacagcataagatgtccctatgact

SEQ ID NO: 317006 - DNA, 25 bp, Rattus norvegicus
gacagcataattactttcctatagc

SEQ ID NO: 317007 - DNA, 25 bp, Rattus norvegicus
gacagcataatttctttcctatagc

SEQ ID NO: 317008 - DNA, 25 bp, Rattus norvegicus
gacagcatacataactctgcctagg

SEQ ID NO: 317009 - DNA, 25 bp, Rattus norvegicus
gacagcatacattactctgcctagg

SEQ ID NO: 317010 - DNA, 25 bp, Rattus norvegicus
gacagcatattacagattttcagaa

SEQ ID NO: 317011 - DNA, 25 bp, Rattus norvegicus
gacagcatattagagattttcagaa

SEQ ID NO: 317012 - DNA, 25 bp, Rattus norvegicus
gacagcatattgagtgcccttcctg

SEQ ID NO: 317013 - DNA, 25 bp, Rattus norvegicus
gacagcatattgtgtgcccttcctg

SEQ ID NO: 317014 - DNA, 25 bp, Rattus norvegicus
gacagcatcacaacctagtagaaat

SEQ ID NO: 317015 - DNA, 25 bp, Rattus norvegicus
gacagcatcacatcctagtagaaat

SEQ ID NO: 317016 - DNA, 25 bp, Rattus norvegicus
gacagcatccttcaatatgtaaaag

SEQ ID NO: 317017 - DNA, 25 bp, Rattus norvegicus
gacagcatccttgaatatgtaaaag

SEQ ID NO: 317018 - DNA, 25 bp, Rattus norvegicus
gacagcatctatccatgtaaccaga

SEQ ID NO: 317019 - DNA, 25 bp, Rattus norvegicus
gacagcatctatgcatgtaaccaga

SEQ ID NO: 317020 - DNA, 25 bp, Rattus norvegicus
gacagcatctgacttggcttagctc

SEQ ID NO: 317021 - DNA, 25 bp, Rattus norvegicus
gacagcatctgagttggcttagctc

SEQ ID NO: 317022 - DNA, 25 bp, Rattus norvegicus
gacagcatcttcagtggattcctca

SEQ ID NO: 317023 - DNA, 25 bp, Rattus norvegicus
gacagcatcttctgtggattcctca

SEQ ID NO: 317024 - DNA, 25 bp, Rattus norvegicus
gacagcatgagtagttcaccgttct

SEQ ID NO: 317025 - DNA, 25 bp, Rattus norvegicus
gacagcatgagttgttcaccgttct

SEQ ID NO: 317026 - DNA, 25 bp, Rattus norvegicus
gacagcatgctgaaagtgtacctta

SEQ ID NO: 317027 - DNA, 25 bp, Rattus norvegicus
gacagcatgctgtaagtgtacctta

SEQ ID NO: 317028 - DNA, 25 bp, Rattus norvegicus
gacagcatggtcactacgcaggatg

SEQ ID NO: 317029 - DNA, 25 bp, Rattus norvegicus
gacagcatggtctctacgcaggatg

SEQ ID NO: 317030 - DNA, 25 bp, Rattus norvegicus
gacagcattaaacctccaggccttc

SEQ ID NO: 317031 - DNA, 25 bp, Rattus norvegicus
gacagcattaaagctccaggccttc

SEQ ID NO: 317032 - DNA, 25 bp, Rattus norvegicus
gacagcattaagagccagtaacagc

SEQ ID NO: 317033 - DNA, 25 bp, Rattus norvegicus
gacagcattaagtgccagtaacagc

SEQ ID NO: 317034 - DNA, 25 bp, Rattus norvegicus
gacagcattcagatatagacgggat

SEQ ID NO: 317035 - DNA, 25 bp, Rattus norvegicus
gacagcattcagttatagacgggat

SEQ ID NO: 317036 - DNA, 25 bp, Rattus norvegicus
gacagcattctcagcgacgatggac

SEQ ID NO: 317037 - DNA, 25 bp, Rattus norvegicus
gacagcattctctgcgacgatggac

SEQ ID NO: 317038 - DNA, 25 bp, Rattus norvegicus
gacagcattgagatatcatccgtta

SEQ ID NO: 317039 - DNA, 25 bp, Rattus norvegicus
gacagcattgagttatcatccgtta

SEQ ID NO: 317040 - DNA, 25 bp, Rattus norvegicus
gacagcattggtattctacagtgag

SEQ ID NO: 317041 - DNA, 25 bp, Rattus norvegicus
gacagcattggttttctacagtgag

SEQ ID NO: 317042 - DNA, 25 bp, Rattus norvegicus
gacagcatttgtatggattcacata

SEQ ID NO: 317043 - DNA, 25 bp, Rattus norvegicus
gacagcatttgtttggattcacata

SEQ ID NO: 317044 - DNA, 25 bp, Rattus norvegicus
gacagcattttaaagtcttgccctt

SEQ ID NO: 317045 - DNA, 25 bp, Rattus norvegicus
gacagcattttatagtcttgccctt

SEQ ID NO: 317046 - DNA, 25 bp, Rattus norvegicus
gacagcattttgaatttggcccact

SEQ ID NO: 317047 - DNA, 25 bp, Rattus norvegicus
gacagcattttgtatttggcccact

SEQ ID NO: 317048 - DNA, 25 bp, Rattus norvegicus
gacagccaaagtaaagccatttcaa

SEQ ID NO: 317049 - DNA, 25 bp, Rattus norvegicus
gacagccaaagttaagccatttcaa

SEQ ID NO: 317050 - DNA, 25 bp, Rattus norvegicus
gacagccaagatagcccaccacatg

SEQ ID NO: 317051 - DNA, 25 bp, Rattus norvegicus
gacagccaagattgcccaccacatg

SEQ ID NO: 317052 - DNA, 25 bp, Rattus norvegicus
gacagccaaggccacctagaagcaa

SEQ ID NO: 317053 - DNA, 25 bp, Rattus norvegicus
gacagccaaggcgacctagaagcaa

SEQ ID NO: 317054 - DNA, 25 bp, Rattus norvegicus
gacagccaatgtcttcagcagctct

SEQ ID NO: 317055 - DNA, 25 bp, Rattus norvegicus
gacagccaatgtgttcagcagctct

SEQ ID NO: 317056 - DNA, 25 bp, Rattus norvegicus
gacagccaattccagattccagaaa

SEQ ID NO: 317057 - DNA, 25 bp, Rattus norvegicus
gacagccaattcgagattccagaaa

SEQ ID NO: 317058 - DNA, 25 bp, Rattus norvegicus
gacagccacattactttctggcaga

SEQ ID NO: 317059 - DNA, 25 bp, Rattus norvegicus
gacagccacatttctttctggcaga

SEQ ID NO: 317060 - DNA, 25 bp, Rattus norvegicus
gacagccaccttcttttaaagtgac

SEQ ID NO: 317061 - DNA, 25 bp, Rattus norvegicus
gacagccaccttgttttaaagtgac

SEQ ID NO: 317062 - DNA, 25 bp, Rattus norvegicus
gacagccacgatcaactgtgcagat

SEQ ID NO: 317063 - DNA, 25 bp, Rattus norvegicus
gacagccacgatgaactgtgcagat

SEQ ID NO: 317064 - DNA, 25 bp, Rattus norvegicus
gacagccactctcatgcttatgtga

SEQ ID NO: 317065 - DNA, 25 bp, Rattus norvegicus
gacagccactctgatgcttatgtga

SEQ ID NO: 317066 - DNA, 25 bp, Rattus norvegicus
gacagccactgcaagccctgaagaa

SEQ ID NO: 317067 - DNA, 25 bp, Rattus norvegicus
gacagccactgctagccctgaagaa

SEQ ID NO: 317068 - DNA, 25 bp, Rattus norvegicus
gacagccactgtaatcagtgctcta

SEQ ID NO: 317069 - DNA, 25 bp, Rattus norvegicus
gacagccactgttatcagtgctcta

SEQ ID NO: 317070 - DNA, 25 bp, Rattus norvegicus
gacagccacttcctgttttatacag

SEQ ID NO: 317071 - DNA, 25 bp, Rattus norvegicus
gacagccacttcgtgttttatacag

SEQ ID NO: 317072 - DNA, 25 bp, Rattus norvegicus
gacagccagaccaacattagcttga

SEQ ID NO: 317073 - DNA, 25 bp, Rattus norvegicus
gacagccagaccaggctttgaggca

SEQ ID NO: 317074 - DNA, 25 bp, Rattus norvegicus
gacagccagacctacattagcttga

SEQ ID NO: 317075 - DNA, 25 bp, Rattus norvegicus
gacagccagacctggctttgaggca

SEQ ID NO: 317076 - DNA, 25 bp, Rattus norvegicus
gacagccagagaagaatcgtacatg

SEQ ID NO: 317077 - DNA, 25 bp, Rattus norvegicus
gacagccagagatgaatcgtacatg

SEQ ID NO: 317078 - DNA, 25 bp, Rattus norvegicus
gacagccagatcagctgagtcggca

SEQ ID NO: 317079 - DNA, 25 bp, Rattus norvegicus
gacagccagatctgctgagtcggca

SEQ ID NO: 317080 - DNA, 25 bp, Rattus norvegicus
gacagccagcatccgagggtcacca

SEQ ID NO: 317081 - DNA, 25 bp, Rattus norvegicus
gacagccagcatgcgagggtcacca

SEQ ID NO: 317082 - DNA, 25 bp, Rattus norvegicus
gacagccagcgaccatcagtgtgaa

SEQ ID NO: 317083 - DNA, 25 bp, Rattus norvegicus
gacagccagcgagcatcagtgtgaa

SEQ ID NO: 317084 - DNA, 25 bp, Rattus norvegicus
gacagccagctacagggagacttta

SEQ ID NO: 317085 - DNA, 25 bp, Rattus norvegicus
gacagccagctagagggagacttta

SEQ ID NO: 317086 - DNA, 25 bp, Rattus norvegicus
gacagccagggaacagtttctagtt

SEQ ID NO: 317087 - DNA, 25 bp, Rattus norvegicus
gacagccagggatcagtttctagtt

SEQ ID NO: 317088 - DNA, 25 bp, Rattus norvegicus
gacagccagtatctcctgtgagccg

SEQ ID NO: 317089 - DNA, 25 bp, Rattus norvegicus
gacagccagtatgtcctgtgagccg

SEQ ID NO: 317090 - DNA, 25 bp, Rattus norvegicus
gacagccagtgaccagccatggtct

SEQ ID NO: 317091 - DNA, 25 bp, Rattus norvegicus
gacagccagtgaccattcgtggtct

SEQ ID NO: 317092 - DNA, 25 bp, Rattus norvegicus
gacagccagtgagcagccatggtct

SEQ ID NO: 317093 - DNA, 25 bp, Rattus norvegicus
gacagccagtgagcattcgtggtct

SEQ ID NO: 317094 - DNA, 25 bp, Rattus norvegicus
gacagccagtgtcctgttttgagcc

SEQ ID NO: 317095 - DNA, 25 bp, Rattus norvegicus
gacagccagtgtgctgttttgagcc

SEQ ID NO: 317096 - DNA, 25 bp, Rattus norvegicus
gacagccatactaagatgccagagt

SEQ ID NO: 317097 - DNA, 25 bp, Rattus norvegicus
gacagccatacttagatgccagagt

SEQ ID NO: 317098 - DNA, 25 bp, Rattus norvegicus
gacagccatcagactgggattagct

SEQ ID NO: 317099 - DNA, 25 bp, Rattus norvegicus
gacagccatcagtctgggattagct

SEQ ID NO: 317100 - DNA, 25 bp, Rattus norvegicus
gacagccatgctagcagttgtgcta

SEQ ID NO: 317101 - DNA, 25 bp, Rattus norvegicus
gacagccatgcttgcagttgtgcta

SEQ ID NO: 317102 - DNA, 25 bp, Rattus norvegicus
gacagccatggacctgtaccagctg

SEQ ID NO: 317103 - DNA, 25 bp, Rattus norvegicus
gacagccatggagctgtaccagctg

SEQ ID NO: 317104 - DNA, 25 bp, Rattus norvegicus
gacagccatggtaaccagtgcggtt

SEQ ID NO: 317105 - DNA, 25 bp, Rattus norvegicus
gacagccatggtcgagctcatcaac

SEQ ID NO: 317106 - DNA, 25 bp, Rattus norvegicus
gacagccatggtggagctcatcaac

SEQ ID NO: 317107 - DNA, 25 bp, Rattus norvegicus
gacagccatggttaccagtgcggtt

SEQ ID NO: 317108 - DNA, 25 bp, Rattus norvegicus
gacagccattgtacaggtgctcagc

SEQ ID NO: 317109 - DNA, 25 bp, Rattus norvegicus
gacagccattgttcaggtgctcagc

SEQ ID NO: 317110 - DNA, 25 bp, Rattus norvegicus
gacagcccaaatcgccacagatttt

SEQ ID NO: 317111 - DNA, 25 bp, Rattus norvegicus
gacagcccaaatggccacagatttt

SEQ ID NO: 317112 - DNA, 25 bp, Rattus norvegicus
gacagcccaagtcttcttctttatt

SEQ ID NO: 317113 - DNA, 25 bp, Rattus norvegicus
gacagcccaagtgttcttctttatt

SEQ ID NO: 317114 - DNA, 25 bp, Rattus norvegicus
gacagcccactgattgtgtacacaa

SEQ ID NO: 317115 - DNA, 25 bp, Rattus norvegicus
gacagcccactgtttgtgtacacaa

SEQ ID NO: 317116 - DNA, 25 bp, Rattus norvegicus
gacagcccagacagtctgtttggtt

SEQ ID NO: 317117 - DNA, 25 bp, Rattus norvegicus
gacagcccagactgtctgtttggtt

SEQ ID NO: 317118 - DNA, 25 bp, Rattus norvegicus
gacagcccaggcaggtattgctgga

SEQ ID NO: 317119 - DNA, 25 bp, Rattus norvegicus
gacagcccaggctggtattgctgga

SEQ ID NO: 317120 - DNA, 25 bp, Rattus norvegicus
gacagcccagtaaaatgctttttta

SEQ ID NO: 317121 - DNA, 25 bp, Rattus norvegicus
gacagcccagtataatgctttttta

SEQ ID NO: 317122 - DNA, 25 bp, Rattus norvegicus
gacagcccagtcaacatgaagttca

SEQ ID NO: 317123 - DNA, 25 bp, Rattus norvegicus
gacagcccagtctacatgaagttca

SEQ ID NO: 317124 - DNA, 25 bp, Rattus norvegicus
gacagcccatccagttttacgatcg

SEQ ID NO: 317125 - DNA, 25 bp, Rattus norvegicus
gacagcccatcctgttttacgatcg

SEQ ID NO: 317126 - DNA, 25 bp, Rattus norvegicus
gacagcccatgccacctgtggagaa

SEQ ID NO: 317127 - DNA, 25 bp, Rattus norvegicus
gacagcccatgcgacctgtggagaa

SEQ ID NO: 317128 - DNA, 25 bp, Rattus norvegicus
gacagcccatggactttttaccaat

SEQ ID NO: 317129 - DNA, 25 bp, Rattus norvegicus
gacagcccatggtctttttaccaat

SEQ ID NO: 317130 - DNA, 25 bp, Rattus norvegicus
gacagccccagaactaagcggtgtg

SEQ ID NO: 317131 - DNA, 25 bp, Rattus norvegicus
gacagccccagaactggttttgtaa

SEQ ID NO: 317132 - DNA, 25 bp, Rattus norvegicus
gacagccccagatctaagcggtgtg

SEQ ID NO: 317133 - DNA, 25 bp, Rattus norvegicus
gacagccccagatctggttttgtaa

SEQ ID NO: 317134 - DNA, 25 bp, Rattus norvegicus
gacagccccatcattttgtggtgga

SEQ ID NO: 317135 - DNA, 25 bp, Rattus norvegicus
gacagccccatctttttgtggtgga

SEQ ID NO: 317136 - DNA, 25 bp, Rattus norvegicus
gacagcccgcccagaaaggcaggaa

SEQ ID NO: 317137 - DNA, 25 bp, Rattus norvegicus
gacagcccgccctgaaaggcaggaa

SEQ ID NO: 317138 - DNA, 25 bp, Rattus norvegicus
gacagcccgtgtcttcatggtatac

SEQ ID NO: 317139 - DNA, 25 bp, Rattus norvegicus
gacagcccgtgtgttcatggtatac

SEQ ID NO: 317140 - DNA, 25 bp, Rattus norvegicus
gacagccctaagctgaggtggcttt

SEQ ID NO: 317141 - DNA, 25 bp, Rattus norvegicus
gacagccctaaggtgaggtggcttt

SEQ ID NO: 317142 - DNA, 25 bp, Rattus norvegicus
gacagccctagaagcctgaggcagt

SEQ ID NO: 317143 - DNA, 25 bp, Rattus norvegicus
gacagccctagatgcctgaggcagt

SEQ ID NO: 317144 - DNA, 25 bp, Rattus norvegicus
gacagccctccgaaatcttcaaata

SEQ ID NO: 317145 - DNA, 25 bp, Rattus norvegicus
gacagccctccgtaatcttcaaata

SEQ ID NO: 317146 - DNA, 25 bp, Rattus norvegicus
gacagccgacagactacatgttgtg

SEQ ID NO: 317147 - DNA, 25 bp, Rattus norvegicus
gacagccgacagtctacatgttgtg

SEQ ID NO: 317148 - DNA, 25 bp, Rattus norvegicus
gacagccgactgacttctcaagaaa

SEQ ID NO: 317149 - DNA, 25 bp, Rattus norvegicus
gacagccgactgtcttctcaagaaa

SEQ ID NO: 317150 - DNA, 25 bp, Rattus norvegicus
gacagccggaacagaaactgtttca

SEQ ID NO: 317151 - DNA, 25 bp, Rattus norvegicus
gacagccggaactgaaactgtttca

SEQ ID NO: 317152 - DNA, 25 bp, Rattus norvegicus
gacagccggcagaatgtatcctgta

SEQ ID NO: 317153 - DNA, 25 bp, Rattus norvegicus
gacagccggcagtatgtatcctgta

SEQ ID NO: 317154 - DNA, 25 bp, Rattus norvegicus
gacagccgggaaagactgagtcacc

SEQ ID NO: 317155 - DNA, 25 bp, Rattus norvegicus
gacagccgggaatgactgagtcacc

SEQ ID NO: 317156 - DNA, 25 bp, Rattus norvegicus
gacagccgggtcatatggctcagat

SEQ ID NO: 317157 - DNA, 25 bp, Rattus norvegicus
gacagccgggtcttatggctcagat

SEQ ID NO: 317158 - DNA, 25 bp, Rattus norvegicus
gacagccgtgtgaccctgtttgagg

SEQ ID NO: 317159 - DNA, 25 bp, Rattus norvegicus
gacagccgtgtgtccctgtttgagg

SEQ ID NO: 317160 - DNA, 25 bp, Rattus norvegicus
gacagccgtttgattattttcatag

SEQ ID NO: 317161 - DNA, 25 bp, Rattus norvegicus
gacagccgtttgtttattttcatag

SEQ ID NO: 317162 - DNA, 25 bp, Rattus norvegicus
gacagcctaaccagcaaagtcttag

SEQ ID NO: 317163 - DNA, 25 bp, Rattus norvegicus
gacagcctaacctgcaaagtcttag

SEQ ID NO: 317164 - DNA, 25 bp, Rattus norvegicus
gacagcctaggcaatcaagagagat

SEQ ID NO: 317165 - DNA, 25 bp, Rattus norvegicus
gacagcctaggctatcaagagagat

SEQ ID NO: 317166 - DNA, 25 bp, Rattus norvegicus
gacagcctcacaaccaaacgagaag

SEQ ID NO: 317167 - DNA, 25 bp, Rattus norvegicus
gacagcctcacatccaaacgagaag

SEQ ID NO: 317168 - DNA, 25 bp, Rattus norvegicus
gacagcctcagtcccggagccagag

SEQ ID NO: 317169 - DNA, 25 bp, Rattus norvegicus
gacagcctcagtgccggagccagag

SEQ ID NO: 317170 - DNA, 25 bp, Rattus norvegicus
gacagcctcctgaaccacagaaaga

SEQ ID NO: 317171 - DNA, 25 bp, Rattus norvegicus
gacagcctcctgtaccacagaaaga

SEQ ID NO: 317172 - DNA, 25 bp, Rattus norvegicus
gacagcctctgtaaaccttgaagga

SEQ ID NO: 317173 - DNA, 25 bp, Rattus norvegicus
gacagcctctgttaaccttgaagga

SEQ ID NO: 317174 - DNA, 25 bp, Rattus norvegicus
gacagcctgagcacagtcctggatc

SEQ ID NO: 317175 - DNA, 25 bp, Rattus norvegicus
gacagcctgagctcagtcctggatc

SEQ ID NO: 317176 - DNA, 25 bp, Rattus norvegicus
gacagcctgcggagtgctcaagtag

SEQ ID NO: 317177 - DNA, 25 bp, Rattus norvegicus
gacagcctgcggtgtgctcaagtag

SEQ ID NO: 317178 - DNA, 25 bp, Rattus norvegicus
gacagcctgctgaacttacgggatg

SEQ ID NO: 317179 - DNA, 25 bp, Rattus norvegicus
gacagcctgctgtacttacgggatg

SEQ ID NO: 317180 - DNA, 25 bp, Rattus norvegicus
gacagcctggaaaatatcactctaa

SEQ ID NO: 317181 - DNA, 25 bp, Rattus norvegicus
gacagcctggaaatcaaggacccta

SEQ ID NO: 317182 - DNA, 25 bp, Rattus norvegicus
gacagcctggaatatatcactctaa

SEQ ID NO: 317183 - DNA, 25 bp, Rattus norvegicus
gacagcctggaattcaaggacccta

SEQ ID NO: 317184 - DNA, 25 bp, Rattus norvegicus
gacagcctggctcagtgattctgga

SEQ ID NO: 317185 - DNA, 25 bp, Rattus norvegicus
gacagcctggctgagtgattctgga

SEQ ID NO: 317186 - DNA, 25 bp, Rattus norvegicus
gacagcctgggaaacttcataaaat

SEQ ID NO: 317187 - DNA, 25 bp, Rattus norvegicus
gacagcctgggatacttcataaaat

SEQ ID NO: 317188 - DNA, 25 bp, Rattus norvegicus
gacagcctggttaaccatatcctaa

SEQ ID NO: 317189 - DNA, 25 bp, Rattus norvegicus
gacagcctggtttaccatatcctaa

SEQ ID NO: 317190 - DNA, 25 bp, Rattus norvegicus
gacagcctgtcccagaagttcctaa

SEQ ID NO: 317191 - DNA, 25 bp, Rattus norvegicus
gacagcctgtccgagaagttcctaa

SEQ ID NO: 317192 - DNA, 25 bp, Rattus norvegicus
gacagcctgtcgcacatttagaagt

SEQ ID NO: 317193 - DNA, 25 bp, Rattus norvegicus
gacagcctgtcggacatttagaagt

SEQ ID NO: 317194 - DNA, 25 bp, Rattus norvegicus
gacagcctgttcctctgctgaggag

SEQ ID NO: 317195 - DNA, 25 bp, Rattus norvegicus
gacagcctgttcgtctgctgaggag

SEQ ID NO: 317196 - DNA, 25 bp, Rattus norvegicus
gacagccttaaaagttcataccagt

SEQ ID NO: 317197 - DNA, 25 bp, Rattus norvegicus
gacagccttaaatgttcataccagt

SEQ ID NO: 317198 - DNA, 25 bp, Rattus norvegicus
gacagccttcttctaggagaccaat

SEQ ID NO: 317199 - DNA, 25 bp, Rattus norvegicus
gacagccttcttgtaggagaccaat

SEQ ID NO: 317200 - DNA, 25 bp, Rattus norvegicus
gacagccttgcgagaggatgactct

SEQ ID NO: 317201 - DNA, 25 bp, Rattus norvegicus
gacagccttgcgtgaggatgactct

SEQ ID NO: 317202 - DNA, 25 bp, Rattus norvegicus
gacagccttggaccatttcatggga

SEQ ID NO: 317203 - DNA, 25 bp, Rattus norvegicus
gacagccttggagcatttcatggga

SEQ ID NO: 317204 - DNA, 25 bp, Rattus norvegicus
gacagccttggcatctcttgtattc

SEQ ID NO: 317205 - DNA, 25 bp, Rattus norvegicus
gacagccttggcttctcttgtattc

SEQ ID NO: 317206 - DNA, 25 bp, Rattus norvegicus
gacagccttggtacagtttatagtt

SEQ ID NO: 317207 - DNA, 25 bp, Rattus norvegicus
gacagccttggtattcattccttta

SEQ ID NO: 317208 - DNA, 25 bp, Rattus norvegicus
gacagccttggttcagtttatagtt

SEQ ID NO: 317209 - DNA, 25 bp, Rattus norvegicus
gacagccttggttttcattccttta

SEQ ID NO: 317210 - DNA, 25 bp, Rattus norvegicus
gacagccttgtcagggagagggcgt

SEQ ID NO: 317211 - DNA, 25 bp, Rattus norvegicus
gacagccttgtctgggagagggcgt

SEQ ID NO: 317212 - DNA, 25 bp, Rattus norvegicus
gacagcctttatcatagcggacaat

SEQ ID NO: 317213 - DNA, 25 bp, Rattus norvegicus
gacagcctttatgatagcggacaat

SEQ ID NO: 317214 - DNA, 25 bp, Rattus norvegicus
gacagcgactagagggtcttcagct

SEQ ID NO: 317215 - DNA, 25 bp, Rattus norvegicus
gacagcgactagtgggtcttcagct

SEQ ID NO: 317216 - DNA, 25 bp, Rattus norvegicus
gacagcgactcgcagcgtctgaaac

SEQ ID NO: 317217 - DNA, 25 bp, Rattus norvegicus
gacagcgactcggagcgtctgaaac

SEQ ID NO: 317218 - DNA, 25 bp, Rattus norvegicus
gacagcgagatcaaagcccttgaac

SEQ ID NO: 317219 - DNA, 25 bp, Rattus norvegicus
gacagcgagatctaagcccttgaac

SEQ ID NO: 317220 - DNA, 25 bp, Rattus norvegicus
gacagcgagtgacctgtgtcatctt

SEQ ID NO: 317221 - DNA, 25 bp, Rattus norvegicus
gacagcgagtgagctgtgtcatctt

SEQ ID NO: 317222 - DNA, 25 bp, Rattus norvegicus
gacagcgagtgtctccatctggaag

SEQ ID NO: 317223 - DNA, 25 bp, Rattus norvegicus
gacagcgagtgtgtccatctggaag

SEQ ID NO: 317224 - DNA, 25 bp, Rattus norvegicus
gacagcgatcacagcagccatagcg

SEQ ID NO: 317225 - DNA, 25 bp, Rattus norvegicus
gacagcgatcactgcagccatagcg

SEQ ID NO: 317226 - DNA, 25 bp, Rattus norvegicus
gacagcgattcgagcctggacgagc

SEQ ID NO: 317227 - DNA, 25 bp, Rattus norvegicus
gacagcgattcgtgcctggacgagc

SEQ ID NO: 317228 - DNA, 25 bp, Rattus norvegicus
gacagcgcagctcactacagacgca

SEQ ID NO: 317229 - DNA, 25 bp, Rattus norvegicus
gacagcgcagctgactacagacgca

SEQ ID NO: 317230 - DNA, 25 bp, Rattus norvegicus
gacagcgcaggtagaagtcgccgcc

SEQ ID NO: 317231 - DNA, 25 bp, Rattus norvegicus
gacagcgcaggttgaagtcgccgcc

SEQ ID NO: 317232 - DNA, 25 bp, Rattus norvegicus
gacagcgcccgcagttttcggagcc

SEQ ID NO: 317233 - DNA, 25 bp, Rattus norvegicus
gacagcgcccgctgttttcggagcc

SEQ ID NO: 317234 - DNA, 25 bp, Rattus norvegicus
gacagcgcggagatgaagccaagtc

SEQ ID NO: 317235 - DNA, 25 bp, Rattus norvegicus
gacagcgcggagttgaagccaagtc

SEQ ID NO: 317236 - DNA, 25 bp, Rattus norvegicus
gacagcgcggtgatccagtgagcgt

SEQ ID NO: 317237 - DNA, 25 bp, Rattus norvegicus
gacagcgcggtgttccagtgagcgt

SEQ ID NO: 317238 - DNA, 25 bp, Rattus norvegicus
gacagcgctatgaagatgggccatt

SEQ ID NO: 317239 - DNA, 25 bp, Rattus norvegicus
gacagcgctatgtagatgggccatt

SEQ ID NO: 317240 - DNA, 25 bp, Rattus norvegicus
gacagcgctcctcagttgcagagaa

SEQ ID NO: 317241 - DNA, 25 bp, Rattus norvegicus
gacagcgctcctgagttgcagagaa

SEQ ID NO: 317242 - DNA, 25 bp, Rattus norvegicus
gacagcggaatcacctgtgtgacct

SEQ ID NO: 317243 - DNA, 25 bp, Rattus norvegicus
gacagcggaatctcctgtgtgacct

SEQ ID NO: 317244 - DNA, 25 bp, Rattus norvegicus
gacagcggacctatttatgacacat

SEQ ID NO: 317245 - DNA, 25 bp, Rattus norvegicus
gacagcggacctttttatgacacat

SEQ ID NO: 317246 - DNA, 25 bp, Rattus norvegicus
gacagcgggactatcaggttttgtt

SEQ ID NO: 317247 - DNA, 25 bp, Rattus norvegicus
gacagcgggactttcaggttttgtt

SEQ ID NO: 317248 - DNA, 25 bp, Rattus norvegicus
gacagcgggcaaaccattccaaagg

SEQ ID NO: 317249 - DNA, 25 bp, Rattus norvegicus
gacagcgggcaacgcgtccggcgcg

SEQ ID NO: 317250 - DNA, 25 bp, Rattus norvegicus
gacagcgggcaaggcgtccggcgcg

SEQ ID NO: 317251 - DNA, 25 bp, Rattus norvegicus
gacagcgggcaatccattccaaagg

SEQ ID NO: 317252 - DNA, 25 bp, Rattus norvegicus
gacagcggtaggagcctgcagaact

SEQ ID NO: 317253 - DNA, 25 bp, Rattus norvegicus
gacagcggtaggtgcctgcagaact

SEQ ID NO: 317254 - DNA, 25 bp, Rattus norvegicus
gacagcggtgctctatggaagcaaa

SEQ ID NO: 317255 - DNA, 25 bp, Rattus norvegicus
gacagcggtgctgtatggaagcaaa

SEQ ID NO: 317256 - DNA, 25 bp, Rattus norvegicus
gacagcggtggccacatcaccgaat

SEQ ID NO: 317257 - DNA, 25 bp, Rattus norvegicus
gacagcggtggcgacatcaccgaat

SEQ ID NO: 317258 - DNA, 25 bp, Rattus norvegicus
gacagcggtgtaactgggaaccctt

SEQ ID NO: 317259 - DNA, 25 bp, Rattus norvegicus
gacagcggtgtatctgggaaccctt

SEQ ID NO: 317260 - DNA, 25 bp, Rattus norvegicus
gacagcgtcttgcatctatttatga

SEQ ID NO: 317261 - DNA, 25 bp, Rattus norvegicus
gacagcgtcttggatctatttatga

SEQ ID NO: 317262 - DNA, 25 bp, Rattus norvegicus
gacagcgtgcagagtgagctatgta

SEQ ID NO: 317263 - DNA, 25 bp, Rattus norvegicus
gacagcgtgcagtgtgagctatgta

SEQ ID NO: 317264 - DNA, 25 bp, Rattus norvegicus
gacagcgtggttcatctgattgact

SEQ ID NO: 317265 - DNA, 25 bp, Rattus norvegicus
gacagcgtggttgatctgattgact

SEQ ID NO: 317266 - DNA, 25 bp, Rattus norvegicus
gacagcgttactatctgaagtccag

SEQ ID NO: 317267 - DNA, 25 bp, Rattus norvegicus
gacagcgttactttctgaagtccag

SEQ ID NO: 317268 - DNA, 25 bp, Rattus norvegicus
gacagcgttcacataggtgtcccag

SEQ ID NO: 317269 - DNA, 25 bp, Rattus norvegicus
gacagcgttcacttaggtgtcccag

SEQ ID NO: 317270 - DNA, 25 bp, Rattus norvegicus
gacagcgtttgcaggatcattgcaa

SEQ ID NO: 317271 - DNA, 25 bp, Rattus norvegicus
gacagcgtttgctggatcattgcaa

SEQ ID NO: 317272 - DNA, 25 bp, Rattus norvegicus
gacagctaaaatcttacctagaggg

SEQ ID NO: 317273 - DNA, 25 bp, Rattus norvegicus
gacagctaaaatgttacctagaggg

SEQ ID NO: 317274 - DNA, 25 bp, Rattus norvegicus
gacagctaatgaaccctgcacagca

SEQ ID NO: 317275 - DNA, 25 bp, Rattus norvegicus
gacagctaatgatccctgcacagca

SEQ ID NO: 317276 - DNA, 25 bp, Rattus norvegicus
gacagctacaacattattcaccgag

SEQ ID NO: 317277 - DNA, 25 bp, Rattus norvegicus
gacagctacaactttattcaccgag

SEQ ID NO: 317278 - DNA, 25 bp, Rattus norvegicus
gacagctacaccagcaaagtcggtt

SEQ ID NO: 317279 - DNA, 25 bp, Rattus norvegicus
gacagctacacctgcaaagtcggtt

SEQ ID NO: 317280 - DNA, 25 bp, Rattus norvegicus
gacagctacttcctggcatcaagaa

SEQ ID NO: 317281 - DNA, 25 bp, Rattus norvegicus
gacagctacttcgtggcatcaagaa

SEQ ID NO: 317282 - DNA, 25 bp, Rattus norvegicus
gacagctagatcataattttcacct

SEQ ID NO: 317283 - DNA, 25 bp, Rattus norvegicus
gacagctagatcttaattttcacct

SEQ ID NO: 317284 - DNA, 25 bp, Rattus norvegicus
gacagctagctgatttctctaaaat

SEQ ID NO: 317285 - DNA, 25 bp, Rattus norvegicus
gacagctagctgttttctctaaaat

SEQ ID NO: 317286 - DNA, 25 bp, Rattus norvegicus
gacagctatagtctattcaacatgt

SEQ ID NO: 317287 - DNA, 25 bp, Rattus norvegicus
gacagctatagtgtattcaacatgt

SEQ ID NO: 317288 - DNA, 25 bp, Rattus norvegicus
gacagctatgacacgtggatcccag

SEQ ID NO: 317289 - DNA, 25 bp, Rattus norvegicus
gacagctatgactcgtggatcccag

SEQ ID NO: 317290 - DNA, 25 bp, Rattus norvegicus
gacagctatgctacatttgttttgt

SEQ ID NO: 317291 - DNA, 25 bp, Rattus norvegicus
gacagctatgcttcatttgttttgt

SEQ ID NO: 317292 - DNA, 25 bp, Rattus norvegicus
gacagctattggatttgtggccact

SEQ ID NO: 317293 - DNA, 25 bp, Rattus norvegicus
gacagctattggttttgtggccact

SEQ ID NO: 317294 - DNA, 25 bp, Rattus norvegicus
gacagctcaactcgaccctgaagtt

SEQ ID NO: 317295 - DNA, 25 bp, Rattus norvegicus
gacagctcaactggaccctgaagtt

SEQ ID NO: 317296 - DNA, 25 bp, Rattus norvegicus
gacagctcacacctgaaatcttggg

SEQ ID NO: 317297 - DNA, 25 bp, Rattus norvegicus
gacagctcacacgtgaaatcttggg

SEQ ID NO: 317298 - DNA, 25 bp, Rattus norvegicus
gacagctcactaagttctccttgga

SEQ ID NO: 317299 - DNA, 25 bp, Rattus norvegicus
gacagctcactatgttctccttgga

SEQ ID NO: 317300 - DNA, 25 bp, Rattus norvegicus
gacagctcagcaaggaaacgttatt

SEQ ID NO: 317301 - DNA, 25 bp, Rattus norvegicus
gacagctcagcatggaaacgttatt

SEQ ID NO: 317302 - DNA, 25 bp, Rattus norvegicus
gacagctcagccagttttggatttc

SEQ ID NO: 317303 - DNA, 25 bp, Rattus norvegicus
gacagctcagcctgttttggatttc

SEQ ID NO: 317304 - DNA, 25 bp, Rattus norvegicus
gacagctcaggaatacagtccgttg

SEQ ID NO: 317305 - DNA, 25 bp, Rattus norvegicus
gacagctcaggattacagtccgttg

SEQ ID NO: 317306 - DNA, 25 bp, Rattus norvegicus
gacagctcaggcctagatcttcaga

SEQ ID NO: 317307 - DNA, 25 bp, Rattus norvegicus
gacagctcaggcgtagatcttcaga

SEQ ID NO: 317308 - DNA, 25 bp, Rattus norvegicus
gacagctcagggatgtttggagcct

SEQ ID NO: 317309 - DNA, 25 bp, Rattus norvegicus
gacagctcagggttgtttggagcct

SEQ ID NO: 317310 - DNA, 25 bp, Rattus norvegicus
gacagctcagtgctcactaggtgaa

SEQ ID NO: 317311 - DNA, 25 bp, Rattus norvegicus
gacagctcagtggtcactaggtgaa

SEQ ID NO: 317312 - DNA, 25 bp, Rattus norvegicus
gacagctcatggagaaattgtggga

SEQ ID NO: 317313 - DNA, 25 bp, Rattus norvegicus
gacagctcatggtgaaattgtggga

SEQ ID NO: 317314 - DNA, 25 bp, Rattus norvegicus
gacagctcatgtcgaaagattcaaa

SEQ ID NO: 317315 - DNA, 25 bp, Rattus norvegicus
gacagctcatgtggaaagattcaaa

SEQ ID NO: 317316 - DNA, 25 bp, Rattus norvegicus
gacagctcattcaagttcgctaact

SEQ ID NO: 317317 - DNA, 25 bp, Rattus norvegicus
gacagctcattctagttcgctaact

SEQ ID NO: 317318 - DNA, 25 bp, Rattus norvegicus
gacagctccaaaatcactgtgctaa

SEQ ID NO: 317319 - DNA, 25 bp, Rattus norvegicus
gacagctccaaattcactgtgctaa

SEQ ID NO: 317320 - DNA, 25 bp, Rattus norvegicus
gacagctccaagacctgggttccaa

SEQ ID NO: 317321 - DNA, 25 bp, Rattus norvegicus
gacagctccaagtcctgggttccaa

SEQ ID NO: 317322 - DNA, 25 bp, Rattus norvegicus
gacagctccaatagatgggctacca

SEQ ID NO: 317323 - DNA, 25 bp, Rattus norvegicus
gacagctccaattgatgggctacca

SEQ ID NO: 317324 - DNA, 25 bp, Rattus norvegicus
gacagctccactcgcttttatagga

SEQ ID NO: 317325 - DNA, 25 bp, Rattus norvegicus
gacagctccactggcttttatagga

SEQ ID NO: 317326 - DNA, 25 bp, Rattus norvegicus
gacagctccagtaagagccgagtga

SEQ ID NO: 317327 - DNA, 25 bp, Rattus norvegicus
gacagctccagtctgggtatgcacc

SEQ ID NO: 317328 - DNA, 25 bp, Rattus norvegicus
gacagctccagtgtgggtatgcacc

SEQ ID NO: 317329 - DNA, 25 bp, Rattus norvegicus
gacagctccagttagagccgagtga

SEQ ID NO: 317330 - DNA, 25 bp, Rattus norvegicus
gacagctccttactctgtactttgt

SEQ ID NO: 317331 - DNA, 25 bp, Rattus norvegicus
gacagctccttagtctgtactttgt

SEQ ID NO: 317332 - DNA, 25 bp, Rattus norvegicus
gacagctccttgaagggacagggat

SEQ ID NO: 317333 - DNA, 25 bp, Rattus norvegicus
gacagctccttgacttgtttatggt

SEQ ID NO: 317334 - DNA, 25 bp, Rattus norvegicus
gacagctccttgtagggacagggat

SEQ ID NO: 317335 - DNA, 25 bp, Rattus norvegicus
gacagctccttgtcttgtttatggt

SEQ ID NO: 317336 - DNA, 25 bp, Rattus norvegicus
gacagctcggtgcttcagggttctt

SEQ ID NO: 317337 - DNA, 25 bp, Rattus norvegicus
gacagctcggtggttcagggttctt

SEQ ID NO: 317338 - DNA, 25 bp, Rattus norvegicus
gacagctctccaccacagaatacag

SEQ ID NO: 317339 - DNA, 25 bp, Rattus norvegicus
gacagctctccagcacagaatacag

SEQ ID NO: 317340 - DNA, 25 bp, Rattus norvegicus
gacagctctcttaactgatttcagc

SEQ ID NO: 317341 - DNA, 25 bp, Rattus norvegicus
gacagctctctttactgatttcagc

SEQ ID NO: 317342 - DNA, 25 bp, Rattus norvegicus
gacagctctgctccttggaaaggga

SEQ ID NO: 317343 - DNA, 25 bp, Rattus norvegicus
gacagctctgctgcttggaaaggga

SEQ ID NO: 317344 - DNA, 25 bp, Rattus norvegicus
gacagctctggcctcttgggaaaca

SEQ ID NO: 317345 - DNA, 25 bp, Rattus norvegicus
gacagctctggcgtcttgggaaaca

SEQ ID NO: 317346 - DNA, 25 bp, Rattus norvegicus
gacagctctggtatttatcatccta

SEQ ID NO: 317347 - DNA, 25 bp, Rattus norvegicus
gacagctctggtttttatcatccta

SEQ ID NO: 317348 - DNA, 25 bp, Rattus norvegicus
gacagctctgtgcttgtatgtaagt

SEQ ID NO: 317349 - DNA, 25 bp, Rattus norvegicus
gacagctctgtggttgtatgtaagt

SEQ ID NO: 317350 - DNA, 25 bp, Rattus norvegicus
gacagctgaaataaccccagatcca

SEQ ID NO: 317351 - DNA, 25 bp, Rattus norvegicus
gacagctgaaattaccccagatcca

SEQ ID NO: 317352 - DNA, 25 bp, Rattus norvegicus
gacagctgacaacttttttgagaag

SEQ ID NO: 317353 - DNA, 25 bp, Rattus norvegicus
gacagctgacaagttttttgagaag

SEQ ID NO: 317354 - DNA, 25 bp, Rattus norvegicus
gacagctgacacaggcaggcgattt

SEQ ID NO: 317355 - DNA, 25 bp, Rattus norvegicus
gacagctgacaccatatgagaacct

SEQ ID NO: 317356 - DNA, 25 bp, Rattus norvegicus
gacagctgacacgatatgagaacct

SEQ ID NO: 317357 - DNA, 25 bp, Rattus norvegicus
gacagctgacactggcaggcgattt

SEQ ID NO: 317358 - DNA, 25 bp, Rattus norvegicus
gacagctgaccgcagggtaacctga

SEQ ID NO: 317359 - DNA, 25 bp, Rattus norvegicus
gacagctgaccggagggtaacctga

SEQ ID NO: 317360 - DNA, 25 bp, Rattus norvegicus
gacagctgacctcacttagtgcaaa

SEQ ID NO: 317361 - DNA, 25 bp, Rattus norvegicus
gacagctgacctgacttagtgcaaa

SEQ ID NO: 317362 - DNA, 25 bp, Rattus norvegicus
gacagctgacgtatgtgctctgacc

SEQ ID NO: 317363 - DNA, 25 bp, Rattus norvegicus
gacagctgacgtttgtgctctgacc

SEQ ID NO: 317364 - DNA, 25 bp, Rattus norvegicus
gacagctgatctctcagagcacgtt

SEQ ID NO: 317365 - DNA, 25 bp, Rattus norvegicus
gacagctgatctgtcagagcacgtt

SEQ ID NO: 317366 - DNA, 25 bp, Rattus norvegicus
gacagctgcatccggtgcggttctt

SEQ ID NO: 317367 - DNA, 25 bp, Rattus norvegicus
gacagctgcatcgggtgcggttctt

SEQ ID NO: 317368 - DNA, 25 bp, Rattus norvegicus
gacagctgcattacataccaacatc

SEQ ID NO: 317369 - DNA, 25 bp, Rattus norvegicus
gacagctgcatttcataccaacatc

SEQ ID NO: 317370 - DNA, 25 bp, Rattus norvegicus
gacagctgccaaagtcacgaactct

SEQ ID NO: 317371 - DNA, 25 bp, Rattus norvegicus
gacagctgccaatgtcacgaactct

SEQ ID NO: 317372 - DNA, 25 bp, Rattus norvegicus
gacagctgccacaaagtctttttat

SEQ ID NO: 317373 - DNA, 25 bp, Rattus norvegicus
gacagctgccactaagtctttttat

SEQ ID NO: 317374 - DNA, 25 bp, Rattus norvegicus
gacagctgcccgatcaacgtggatg

SEQ ID NO: 317375 - DNA, 25 bp, Rattus norvegicus
gacagctgcccgttcaacgtggatg

SEQ ID NO: 317376 - DNA, 25 bp, Rattus norvegicus
gacagctgctagactggcttcggta

SEQ ID NO: 317377 - DNA, 25 bp, Rattus norvegicus
gacagctgctagatacctctgacat

SEQ ID NO: 317378 - DNA, 25 bp, Rattus norvegicus
gacagctgctagtctggcttcggta

SEQ ID NO: 317379 - DNA, 25 bp, Rattus norvegicus
gacagctgctagttacctctgacat

SEQ ID NO: 317380 - DNA, 25 bp, Rattus norvegicus
gacagctggcatcaagtgaatgtac

SEQ ID NO: 317381 - DNA, 25 bp, Rattus norvegicus
gacagctggcatgaagtgaatgtac

SEQ ID NO: 317382 - DNA, 25 bp, Rattus norvegicus
gacagctggccactgtggaaacaca

SEQ ID NO: 317383 - DNA, 25 bp, Rattus norvegicus
gacagctggccagtgtggaaacaca

SEQ ID NO: 317384 - DNA, 25 bp, Rattus norvegicus
gacagctggcgtatggtgcaagact

SEQ ID NO: 317385 - DNA, 25 bp, Rattus norvegicus
gacagctggcgtttggtgcaagact

SEQ ID NO: 317386 - DNA, 25 bp, Rattus norvegicus
gacagctgtagaacatcatatgcta

SEQ ID NO: 317387 - DNA, 25 bp, Rattus norvegicus
gacagctgtagatcatcatatgcta

SEQ ID NO: 317388 - DNA, 25 bp, Rattus norvegicus
gacagctgtatgaggacaaccacga

SEQ ID NO: 317389 - DNA, 25 bp, Rattus norvegicus
gacagctgtatgtggacaaccacga

SEQ ID NO: 317390 - DNA, 25 bp, Rattus norvegicus
gacagctgtcacacggctcagaagg

SEQ ID NO: 317391 - DNA, 25 bp, Rattus norvegicus
gacagctgtcactcggctcagaagg

SEQ ID NO: 317392 - DNA, 25 bp, Rattus norvegicus
gacagctgtcatctctgtaactcca

SEQ ID NO: 317393 - DNA, 25 bp, Rattus norvegicus
gacagctgtcatgtctgtaactcca

SEQ ID NO: 317394 - DNA, 25 bp, Rattus norvegicus
gacagctgtcgcacagagagttctg

SEQ ID NO: 317395 - DNA, 25 bp, Rattus norvegicus
gacagctgtcgctcagagagttctg

SEQ ID NO: 317396 - DNA, 25 bp, Rattus norvegicus
gacagctgtctaagcatccattgca

SEQ ID NO: 317397 - DNA, 25 bp, Rattus norvegicus
gacagctgtctatgcatccattgca

SEQ ID NO: 317398 - DNA, 25 bp, Rattus norvegicus
gacagctgtgagacggccaggttct

SEQ ID NO: 317399 - DNA, 25 bp, Rattus norvegicus
gacagctgtgagtcggccaggttct

SEQ ID NO: 317400 - DNA, 25 bp, Rattus norvegicus
gacagctgtggacttcagcaaccag

SEQ ID NO: 317401 - DNA, 25 bp, Rattus norvegicus
gacagctgtggagttcagcaaccag

SEQ ID NO: 317402 - DNA, 25 bp, Rattus norvegicus
gacagctgttgcaagagccgcactt

SEQ ID NO: 317403 - DNA, 25 bp, Rattus norvegicus
gacagctgttgctagagccgcactt

SEQ ID NO: 317404 - DNA, 25 bp, Rattus norvegicus
gacagctgttgtacgaggacacctc

SEQ ID NO: 317405 - DNA, 25 bp, Rattus norvegicus
gacagctgttgttcgaggacacctc

SEQ ID NO: 317406 - DNA, 25 bp, Rattus norvegicus
gacagcttcagtatgcagtagcaga

SEQ ID NO: 317407 - DNA, 25 bp, Rattus norvegicus
gacagcttcagtttgcagtagcaga

SEQ ID NO: 317408 - DNA, 25 bp, Rattus norvegicus
gacagcttcctccaagcatcatgtt

SEQ ID NO: 317409 - DNA, 25 bp, Rattus norvegicus
gacagcttcctcgaagcatcatgtt

SEQ ID NO: 317410 - DNA, 25 bp, Rattus norvegicus
gacagcttcctgcttactagacttg

SEQ ID NO: 317411 - DNA, 25 bp, Rattus norvegicus
gacagcttcctggttactagacttg

SEQ ID NO: 317412 - DNA, 25 bp, Rattus norvegicus
gacagcttcgatcataaaatatgcc

SEQ ID NO: 317413 - DNA, 25 bp, Rattus norvegicus
gacagcttcgatgataaaatatgcc

SEQ ID NO: 317414 - DNA, 25 bp, Rattus norvegicus
gacagcttctacatcgtggatgatc

SEQ ID NO: 317415 - DNA, 25 bp, Rattus norvegicus
gacagcttctacttcgtggatgatc

SEQ ID NO: 317416 - DNA, 25 bp, Rattus norvegicus
gacagcttctataaatcacaggact

SEQ ID NO: 317417 - DNA, 25 bp, Rattus norvegicus
gacagcttctatctggagatgatcc

SEQ ID NO: 317418 - DNA, 25 bp, Rattus norvegicus
gacagcttctatgtggagatgatcc

SEQ ID NO: 317419 - DNA, 25 bp, Rattus norvegicus
gacagcttctattaatcacaggact

SEQ ID NO: 317420 - DNA, 25 bp, Rattus norvegicus
gacagcttctttaactccaaggtag

SEQ ID NO: 317421 - DNA, 25 bp, Rattus norvegicus
gacagcttctttagctttacaatgt

SEQ ID NO: 317422 - DNA, 25 bp, Rattus norvegicus
gacagcttcttttactccaaggtag

SEQ ID NO: 317423 - DNA, 25 bp, Rattus norvegicus
gacagcttcttttgctttacaatgt

SEQ ID NO: 317424 - DNA, 25 bp, Rattus norvegicus
gacagcttgccaaatgctgccatgt

SEQ ID NO: 317425 - DNA, 25 bp, Rattus norvegicus
gacagcttgccatatgctgccatgt

SEQ ID NO: 317426 - DNA, 25 bp, Rattus norvegicus
gacagcttggctccagcgtgaccga

SEQ ID NO: 317427 - DNA, 25 bp, Rattus norvegicus
gacagcttggctgcagcgtgaccga

SEQ ID NO: 317428 - DNA, 25 bp, Rattus norvegicus
gacagctttaacaacgacaactaca

SEQ ID NO: 317429 - DNA, 25 bp, Rattus norvegicus
gacagctttaactacgacaactaca

SEQ ID NO: 317430 - DNA, 25 bp, Rattus norvegicus
gacagctttattcatgtgaaaacgc

SEQ ID NO: 317431 - DNA, 25 bp, Rattus norvegicus
gacagctttattgatgtgaaaacgc

SEQ ID NO: 317432 - DNA, 25 bp, Rattus norvegicus
gacagctttcagaattgttattgtt

SEQ ID NO: 317433 - DNA, 25 bp, Rattus norvegicus
gacagctttcagtattgttattgtt

SEQ ID NO: 317434 - DNA, 25 bp, Rattus norvegicus
gacagctttccacatgatttgacaa

SEQ ID NO: 317435 - DNA, 25 bp, Rattus norvegicus
gacagctttccagatgatttgacaa

SEQ ID NO: 317436 - DNA, 25 bp, Rattus norvegicus
gacagctttcctattggtgtttcta

SEQ ID NO: 317437 - DNA, 25 bp, Rattus norvegicus
gacagctttcctatttgtaactaat

SEQ ID NO: 317438 - DNA, 25 bp, Rattus norvegicus
gacagctttccttttggtgtttcta

SEQ ID NO: 317439 - DNA, 25 bp, Rattus norvegicus
gacagctttcctttttgtaactaat

SEQ ID NO: 317440 - DNA, 25 bp, Rattus norvegicus
gacagctttctacgacatggtaagt

SEQ ID NO: 317441 - DNA, 25 bp, Rattus norvegicus
gacagctttctaggacatggtaagt

SEQ ID NO: 317442 - DNA, 25 bp, Rattus norvegicus
gacagctttggccaggacatcttca

SEQ ID NO: 317443 - DNA, 25 bp, Rattus norvegicus
gacagctttggcgaggacatcttca

SEQ ID NO: 317444 - DNA, 25 bp, Rattus norvegicus
gacagctttgtcacaaggcctttgg

SEQ ID NO: 317445 - DNA, 25 bp, Rattus norvegicus
gacagctttgtctcaaggcctttgg

SEQ ID NO: 317446 - DNA, 25 bp, Rattus norvegicus
gacagcttttggaatgacctctttc

SEQ ID NO: 317447 - DNA, 25 bp, Rattus norvegicus
gacagcttttggtatgacctctttc

SEQ ID NO: 317448 - DNA, 25 bp, Rattus norvegicus
gacagcttttgtctcctgtaggtga

SEQ ID NO: 317449 - DNA, 25 bp, Rattus norvegicus
gacagcttttgtgtcctgtaggtga

SEQ ID NO: 317450 - DNA, 25 bp, Rattus norvegicus
gacaggaaaagcactccccgcagga

SEQ ID NO: 317451 - DNA, 25 bp, Rattus norvegicus
gacaggaaaagctctccccgcagga

SEQ ID NO: 317452 - DNA, 25 bp, Rattus norvegicus
gacaggaaacctcggctcgctgaaa

SEQ ID NO: 317453 - DNA, 25 bp, Rattus norvegicus
gacaggaaacctgggctcgctgaaa

SEQ ID NO: 317454 - DNA, 25 bp, Rattus norvegicus
gacaggaaatataccacagagcttg

SEQ ID NO: 317455 - DNA, 25 bp, Rattus norvegicus
gacaggaaatattccacagagcttg

SEQ ID NO: 317456 - DNA, 25 bp, Rattus norvegicus
gacaggaagattatggctctgctta

SEQ ID NO: 317457 - DNA, 25 bp, Rattus norvegicus
gacaggaagattttggctctgctta

SEQ ID NO: 317458 - DNA, 25 bp, Rattus norvegicus
gacaggaaggacacagcttttctct

SEQ ID NO: 317459 - DNA, 25 bp, Rattus norvegicus
gacaggaaggactcagcttttctct

SEQ ID NO: 317460 - DNA, 25 bp, Rattus norvegicus
gacaggaagtccatggtcacacaga

SEQ ID NO: 317461 - DNA, 25 bp, Rattus norvegicus
gacaggaagtccattttccacaaat

SEQ ID NO: 317462 - DNA, 25 bp, Rattus norvegicus
gacaggaagtccttggtcacacaga

SEQ ID NO: 317463 - DNA, 25 bp, Rattus norvegicus
gacaggaagtcctttttccacaaat

SEQ ID NO: 317464 - DNA, 25 bp, Rattus norvegicus
gacaggaagttcactcactcggagt

SEQ ID NO: 317465 - DNA, 25 bp, Rattus norvegicus
gacaggaagttctctcactcggagt

SEQ ID NO: 317466 - DNA, 25 bp, Rattus norvegicus
gacaggaatctcagccggaacgaaa

SEQ ID NO: 317467 - DNA, 25 bp, Rattus norvegicus
gacaggaatctctgccggaacgaaa

SEQ ID NO: 317468 - DNA, 25 bp, Rattus norvegicus
gacaggaatgaactcagctcccacc

SEQ ID NO: 317469 - DNA, 25 bp, Rattus norvegicus
gacaggaatgaagtcagctcccacc

SEQ ID NO: 317470 - DNA, 25 bp, Rattus norvegicus
gacaggaattaaccttccttctcct

SEQ ID NO: 317471 - DNA, 25 bp, Rattus norvegicus
gacaggaattaagcttccttctcct

SEQ ID NO: 317472 - DNA, 25 bp, Rattus norvegicus
gacaggacacatattctctggtgca

SEQ ID NO: 317473 - DNA, 25 bp, Rattus norvegicus
gacaggacacattttctctggtgca

SEQ ID NO: 317474 - DNA, 25 bp, Rattus norvegicus
gacaggacaggaactccaggcagga

SEQ ID NO: 317475 - DNA, 25 bp, Rattus norvegicus
gacaggacaggatctccaggcagga

SEQ ID NO: 317476 - DNA, 25 bp, Rattus norvegicus
gacaggacctcactttttgcatcag

SEQ ID NO: 317477 - DNA, 25 bp, Rattus norvegicus
gacaggacctcagtttttgcatcag

SEQ ID NO: 317478 - DNA, 25 bp, Rattus norvegicus
gacaggacgctccaggcttttgcag

SEQ ID NO: 317479 - DNA, 25 bp, Rattus norvegicus
gacaggacgctcgaggcttttgcag

SEQ ID NO: 317480 - DNA, 25 bp, Rattus norvegicus
gacaggactagcctttatcccagca

SEQ ID NO: 317481 - DNA, 25 bp, Rattus norvegicus
gacaggactagcgtttatcccagca

SEQ ID NO: 317482 - DNA, 25 bp, Rattus norvegicus
gacaggactcgcagtcaaacatggg

SEQ ID NO: 317483 - DNA, 25 bp, Rattus norvegicus
gacaggactcgctgtcaaacatggg

SEQ ID NO: 317484 - DNA, 25 bp, Rattus norvegicus
gacaggacttataaccaggaactat

SEQ ID NO: 317485 - DNA, 25 bp, Rattus norvegicus
gacaggacttattaccaggaactat

SEQ ID NO: 317486 - DNA, 25 bp, Rattus norvegicus
gacaggagaacccaagccagaagtt

SEQ ID NO: 317487 - DNA, 25 bp, Rattus norvegicus
gacaggagaaccgaagccagaagtt

SEQ ID NO: 317488 - DNA, 25 bp, Rattus norvegicus
gacaggagacaccactttggacaaa

SEQ ID NO: 317489 - DNA, 25 bp, Rattus norvegicus
gacaggagacacgactttggacaaa

SEQ ID NO: 317490 - DNA, 25 bp, Rattus norvegicus
gacaggagaccacatttagtgttta

SEQ ID NO: 317491 - DNA, 25 bp, Rattus norvegicus
gacaggagaccagatttagtgttta

SEQ ID NO: 317492 - DNA, 25 bp, Rattus norvegicus
gacaggagacccacctgacaggaat

SEQ ID NO: 317493 - DNA, 25 bp, Rattus norvegicus
gacaggagaccctcctgacaggaat

SEQ ID NO: 317494 - DNA, 25 bp, Rattus norvegicus
gacaggagacgccagaactgccaaa

SEQ ID NO: 317495 - DNA, 25 bp, Rattus norvegicus
gacaggagacgcgagaactgccaaa

SEQ ID NO: 317496 - DNA, 25 bp, Rattus norvegicus
gacaggagaggacagaccttcccca

SEQ ID NO: 317497 - DNA, 25 bp, Rattus norvegicus
gacaggagaggagagaccttcccca

SEQ ID NO: 317498 - DNA, 25 bp, Rattus norvegicus
gacaggagatctctattctactgaa

SEQ ID NO: 317499 - DNA, 25 bp, Rattus norvegicus
gacaggagatctgtattctactgaa

SEQ ID NO: 317500 - DNA, 25 bp, Rattus norvegicus
gacaggagcaaacccagctatcacg

SEQ ID NO: 317501 - DNA, 25 bp, Rattus norvegicus
gacaggagcaaagccagctatcacg

SEQ ID NO: 317502 - DNA, 25 bp, Rattus norvegicus
gacaggagcagtcacccaggaactt

SEQ ID NO: 317503 - DNA, 25 bp, Rattus norvegicus
gacaggagcagtgacccaggaactt

SEQ ID NO: 317504 - DNA, 25 bp, Rattus norvegicus
gacaggagcatcatgcatgtgctta

SEQ ID NO: 317505 - DNA, 25 bp, Rattus norvegicus
gacaggagcatcattggcgccatca

SEQ ID NO: 317506 - DNA, 25 bp, Rattus norvegicus
gacaggagcatcttgcatgtgctta

SEQ ID NO: 317507 - DNA, 25 bp, Rattus norvegicus
gacaggagcatctttggcgccatca

SEQ ID NO: 317508 - DNA, 25 bp, Rattus norvegicus
gacaggagccgtaacaaactctcaa

SEQ ID NO: 317509 - DNA, 25 bp, Rattus norvegicus
gacaggagccgttacaaactctcaa

SEQ ID NO: 317510 - DNA, 25 bp, Rattus norvegicus
gacaggagctggacaccatgtggac

SEQ ID NO: 317511 - DNA, 25 bp, Rattus norvegicus
gacaggagctggctatacccaagaa

SEQ ID NO: 317512 - DNA, 25 bp, Rattus norvegicus
gacaggagctgggtatacccaagaa

SEQ ID NO: 317513 - DNA, 25 bp, Rattus norvegicus
gacaggagctggtcaccatgtggac

SEQ ID NO: 317514 - DNA, 25 bp, Rattus norvegicus
gacaggagctgtagttaacttttgg

SEQ ID NO: 317515 - DNA, 25 bp, Rattus norvegicus
gacaggagctgttgttaacttttgg

SEQ ID NO: 317516 - DNA, 25 bp, Rattus norvegicus
gacaggaggattcagacacccctac

SEQ ID NO: 317517 - DNA, 25 bp, Rattus norvegicus
gacaggaggattgagacacccctac

SEQ ID NO: 317518 - DNA, 25 bp, Rattus norvegicus
gacaggaggctcagctgaccggctt

SEQ ID NO: 317519 - DNA, 25 bp, Rattus norvegicus
gacaggaggctctgctgaccggctt

SEQ ID NO: 317520 - DNA, 25 bp, Rattus norvegicus
gacaggagggtgacctttgtcacca

SEQ ID NO: 317521 - DNA, 25 bp, Rattus norvegicus
gacaggagggtgtcctttgtcacca

SEQ ID NO: 317522 - DNA, 25 bp, Rattus norvegicus
gacaggagtaccatgtccttccagt

SEQ ID NO: 317523 - DNA, 25 bp, Rattus norvegicus
gacaggagtaccttgtccttccagt

SEQ ID NO: 317524 - DNA, 25 bp, Rattus norvegicus
gacaggagtctgattgcacagctca

SEQ ID NO: 317525 - DNA, 25 bp, Rattus norvegicus
gacaggagtctgtttgcacagctca

SEQ ID NO: 317526 - DNA, 25 bp, Rattus norvegicus
gacaggagtggcctctggcttaaaa

SEQ ID NO: 317527 - DNA, 25 bp, Rattus norvegicus
gacaggagtggcgtctggcttaaaa

SEQ ID NO: 317528 - DNA, 25 bp, Rattus norvegicus
gacaggagttcacttccacggcagc

SEQ ID NO: 317529 - DNA, 25 bp, Rattus norvegicus
gacaggagttcagttccacggcagc

SEQ ID NO: 317530 - DNA, 25 bp, Rattus norvegicus
gacaggagttccctatctggttacc

SEQ ID NO: 317531 - DNA, 25 bp, Rattus norvegicus
gacaggagttccgtatctggttacc

SEQ ID NO: 317532 - DNA, 25 bp, Rattus norvegicus
gacaggagttgtcggcacaccgaca

SEQ ID NO: 317533 - DNA, 25 bp, Rattus norvegicus
gacaggagttgtgggcacaccgaca

SEQ ID NO: 317534 - DNA, 25 bp, Rattus norvegicus
gacaggagtttcatcttcgctacaa

SEQ ID NO: 317535 - DNA, 25 bp, Rattus norvegicus
gacaggagtttcttcttcgctacaa

SEQ ID NO: 317536 - DNA, 25 bp, Rattus norvegicus
gacaggatcacaaagattcattggt

SEQ ID NO: 317537 - DNA, 25 bp, Rattus norvegicus
gacaggatcacatagattcattggt

SEQ ID NO: 317538 - DNA, 25 bp, Rattus norvegicus
gacaggatccctctgttaatttgag

SEQ ID NO: 317539 - DNA, 25 bp, Rattus norvegicus
gacaggatccctgtgttaatttgag

SEQ ID NO: 317540 - DNA, 25 bp, Rattus norvegicus
gacaggatcctacacgaacttgaga

SEQ ID NO: 317541 - DNA, 25 bp, Rattus norvegicus
gacaggatcctagacgaacttgaga

SEQ ID NO: 317542 - DNA, 25 bp, Rattus norvegicus
gacaggatcctgctgggcatagcac

SEQ ID NO: 317543 - DNA, 25 bp, Rattus norvegicus
gacaggatcctggtgggcatagcac

SEQ ID NO: 317544 - DNA, 25 bp, Rattus norvegicus
gacaggatctagctaacccctaatt

SEQ ID NO: 317545 - DNA, 25 bp, Rattus norvegicus
gacaggatctaggtaacccctaatt

SEQ ID NO: 317546 - DNA, 25 bp, Rattus norvegicus
gacaggatctccatttttagccctt

SEQ ID NO: 317547 - DNA, 25 bp, Rattus norvegicus
gacaggatctccttttttagccctt

SEQ ID NO: 317548 - DNA, 25 bp, Rattus norvegicus
gacaggatctgtcttacccaaagaa

SEQ ID NO: 317549 - DNA, 25 bp, Rattus norvegicus
gacaggatctgtgttacccaaagaa

SEQ ID NO: 317550 - DNA, 25 bp, Rattus norvegicus
gacaggatggttagtggcttgctct

SEQ ID NO: 317551 - DNA, 25 bp, Rattus norvegicus
gacaggatggtttgtggcttgctct

SEQ ID NO: 317552 - DNA, 25 bp, Rattus norvegicus
gacaggattattctgcaaggccctt

SEQ ID NO: 317553 - DNA, 25 bp, Rattus norvegicus
gacaggattattgtgcaaggccctt

SEQ ID NO: 317554 - DNA, 25 bp, Rattus norvegicus
gacaggattcacaatttacatcaga

SEQ ID NO: 317555 - DNA, 25 bp, Rattus norvegicus
gacaggattcactatttacatcaga

SEQ ID NO: 317556 - DNA, 25 bp, Rattus norvegicus
gacaggattctgaactaactcatga

SEQ ID NO: 317557 - DNA, 25 bp, Rattus norvegicus
gacaggattctgtactaactcatga

SEQ ID NO: 317558 - DNA, 25 bp, Rattus norvegicus
gacaggatttctatagctttggcta

SEQ ID NO: 317559 - DNA, 25 bp, Rattus norvegicus
gacaggatttctctggcctggaact

SEQ ID NO: 317560 - DNA, 25 bp, Rattus norvegicus
gacaggatttctgtggcctggaact

SEQ ID NO: 317561 - DNA, 25 bp, Rattus norvegicus
gacaggatttctttagctttggcta

SEQ ID NO: 317562 - DNA, 25 bp, Rattus norvegicus
gacaggcaaaacatccacatgcata

SEQ ID NO: 317563 - DNA, 25 bp, Rattus norvegicus
gacaggcaaaacttccacatgcata

SEQ ID NO: 317564 - DNA, 25 bp, Rattus norvegicus
gacaggcaaccacttacctatttat

SEQ ID NO: 317565 - DNA, 25 bp, Rattus norvegicus
gacaggcaaccagttacctatttat

SEQ ID NO: 317566 - DNA, 25 bp, Rattus norvegicus
gacaggcaacctaaatggctgggta

SEQ ID NO: 317567 - DNA, 25 bp, Rattus norvegicus
gacaggcaaccttaatggctgggta

SEQ ID NO: 317568 - DNA, 25 bp, Rattus norvegicus
gacaggcaactacacggcttctttt

SEQ ID NO: 317569 - DNA, 25 bp, Rattus norvegicus
gacaggcaactagacggcttctttt

SEQ ID NO: 317570 - DNA, 25 bp, Rattus norvegicus
gacaggcaagttcccagatacttta

SEQ ID NO: 317571 - DNA, 25 bp, Rattus norvegicus
gacaggcaagttgccagatacttta

SEQ ID NO: 317572 - DNA, 25 bp, Rattus norvegicus
gacaggcaatcgactcatacacatg

SEQ ID NO: 317573 - DNA, 25 bp, Rattus norvegicus
gacaggcaatcgtctcatacacatg

SEQ ID NO: 317574 - DNA, 25 bp, Rattus norvegicus
gacaggcacatccagcagaccaatg

SEQ ID NO: 317575 - DNA, 25 bp, Rattus norvegicus
gacaggcacatcgagcagaccaatg

SEQ ID NO: 317576 - DNA, 25 bp, Rattus norvegicus
gacaggcactgtacagtcggtagct

SEQ ID NO: 317577 - DNA, 25 bp, Rattus norvegicus
gacaggcactgttcagtcggtagct

SEQ ID NO: 317578 - DNA, 25 bp, Rattus norvegicus
gacaggcagaataatccccagattg

SEQ ID NO: 317579 - DNA, 25 bp, Rattus norvegicus
gacaggcagaattatccccagattg

SEQ ID NO: 317580 - DNA, 25 bp, Rattus norvegicus
gacaggcagacaccattcaaggtta

SEQ ID NO: 317581 - DNA, 25 bp, Rattus norvegicus
gacaggcagacagcattcaaggtta

SEQ ID NO: 317582 - DNA, 25 bp, Rattus norvegicus
gacaggcagcaaagatggcaccatc

SEQ ID NO: 317583 - DNA, 25 bp, Rattus norvegicus
gacaggcagcaatgatggcaccatc

SEQ ID NO: 317584 - DNA, 25 bp, Rattus norvegicus
gacaggcagccaatttaagagagaa

SEQ ID NO: 317585 - DNA, 25 bp, Rattus norvegicus
gacaggcagccattttaagagagaa

SEQ ID NO: 317586 - DNA, 25 bp, Rattus norvegicus
gacaggcatatactccaaggactaa

SEQ ID NO: 317587 - DNA, 25 bp, Rattus norvegicus
gacaggcatatagtccaaggactaa

SEQ ID NO: 317588 - DNA, 25 bp, Rattus norvegicus
gacaggcatcggcttctgcagttag

SEQ ID NO: 317589 - DNA, 25 bp, Rattus norvegicus
gacaggcatcgggttctgcagttag

SEQ ID NO: 317590 - DNA, 25 bp, Rattus norvegicus
gacaggcattatccggatgcttgag

SEQ ID NO: 317591 - DNA, 25 bp, Rattus norvegicus
gacaggcattatgcggatgcttgag

SEQ ID NO: 317592 - DNA, 25 bp, Rattus norvegicus
gacaggcattcaacacattatttta

SEQ ID NO: 317593 - DNA, 25 bp, Rattus norvegicus
gacaggcattcatcacattatttta

SEQ ID NO: 317594 - DNA, 25 bp, Rattus norvegicus
gacaggcattccctttgtaacttag

SEQ ID NO: 317595 - DNA, 25 bp, Rattus norvegicus
gacaggcattccgtttgtaacttag

SEQ ID NO: 317596 - DNA, 25 bp, Rattus norvegicus
gacaggcattgtcactttgcaggtt

SEQ ID NO: 317597 - DNA, 25 bp, Rattus norvegicus
gacaggcattgtgactttgcaggtt

SEQ ID NO: 317598 - DNA, 25 bp, Rattus norvegicus
gacaggcattttcaactattttcca

SEQ ID NO: 317599 - DNA, 25 bp, Rattus norvegicus
gacaggcattttgaactattttcca

SEQ ID NO: 317600 - DNA, 25 bp, Rattus norvegicus
gacaggccaaccagattgggtcctg

SEQ ID NO: 317601 - DNA, 25 bp, Rattus norvegicus
gacaggccaacctgattgggtcctg

SEQ ID NO: 317602 - DNA, 25 bp, Rattus norvegicus
gacaggccaaggactgtatcaagga

SEQ ID NO: 317603 - DNA, 25 bp, Rattus norvegicus
gacaggccaaggtctgtatcaagga

SEQ ID NO: 317604 - DNA, 25 bp, Rattus norvegicus
gacaggccaattatcatgggctctc

SEQ ID NO: 317605 - DNA, 25 bp, Rattus norvegicus
gacaggccaattttcatgggctctc

SEQ ID NO: 317606 - DNA, 25 bp, Rattus norvegicus
gacaggccatccatttttgtagcac

SEQ ID NO: 317607 - DNA, 25 bp, Rattus norvegicus
gacaggccatccttttttgtagcac

SEQ ID NO: 317608 - DNA, 25 bp, Rattus norvegicus
gacaggccatgtctctgtgtcgtgt

SEQ ID NO: 317609 - DNA, 25 bp, Rattus norvegicus
gacaggccatgtgtctgtgtcgtgt

SEQ ID NO: 317610 - DNA, 25 bp, Rattus norvegicus
gacaggcccgagactcctgagtatt

SEQ ID NO: 317611 - DNA, 25 bp, Rattus norvegicus
gacaggcccgagtctcctgagtatt

SEQ ID NO: 317612 - DNA, 25 bp, Rattus norvegicus
gacaggccctacagggaatggactt

SEQ ID NO: 317613 - DNA, 25 bp, Rattus norvegicus
gacaggccctactgggaatggactt

SEQ ID NO: 317614 - DNA, 25 bp, Rattus norvegicus
gacaggccgatcaacacccgagcgg

SEQ ID NO: 317615 - DNA, 25 bp, Rattus norvegicus
gacaggccgatctacacccgagcgg

SEQ ID NO: 317616 - DNA, 25 bp, Rattus norvegicus
gacaggccgcatatgtgcatcagga

SEQ ID NO: 317617 - DNA, 25 bp, Rattus norvegicus
gacaggccgcatttgtgcatcagga

SEQ ID NO: 317618 - DNA, 25 bp, Rattus norvegicus
gacaggcctgccaaacagctaggtt

SEQ ID NO: 317619 - DNA, 25 bp, Rattus norvegicus
gacaggcctgccatcgtaggaagtc

SEQ ID NO: 317620 - DNA, 25 bp, Rattus norvegicus
gacaggcctgcctaacagctaggtt

SEQ ID NO: 317621 - DNA, 25 bp, Rattus norvegicus
gacaggcctgccttcgtaggaagtc

SEQ ID NO: 317622 - DNA, 25 bp, Rattus norvegicus
gacaggcctggcagccagtcggctt

SEQ ID NO: 317623 - DNA, 25 bp, Rattus norvegicus
gacaggcctggctgccagtcggctt

SEQ ID NO: 317624 - DNA, 25 bp, Rattus norvegicus
gacaggcgacataccagagtagcta

SEQ ID NO: 317625 - DNA, 25 bp, Rattus norvegicus
gacaggcgacattccagagtagcta

SEQ ID NO: 317626 - DNA, 25 bp, Rattus norvegicus
gacaggcgagatctacaaccatgat

SEQ ID NO: 317627 - DNA, 25 bp, Rattus norvegicus
gacaggcgagatgtacaaccatgat

SEQ ID NO: 317628 - DNA, 25 bp, Rattus norvegicus
gacaggcgatcccaaagagccgtat

SEQ ID NO: 317629 - DNA, 25 bp, Rattus norvegicus
gacaggcgatccgaaagagccgtat

SEQ ID NO: 317630 - DNA, 25 bp, Rattus norvegicus
gacaggcgcagaccaacgacgacct

SEQ ID NO: 317631 - DNA, 25 bp, Rattus norvegicus
gacaggcgcagagcaacgacgacct

SEQ ID NO: 317632 - DNA, 25 bp, Rattus norvegicus
gacaggcgtctgactgtttcagtca

SEQ ID NO: 317633 - DNA, 25 bp, Rattus norvegicus
gacaggcgtctgtctgtttcagtca

SEQ ID NO: 317634 - DNA, 25 bp, Rattus norvegicus
gacaggcgtcttcctttagcccaag

SEQ ID NO: 317635 - DNA, 25 bp, Rattus norvegicus
gacaggcgtcttgctttagcccaag

SEQ ID NO: 317636 - DNA, 25 bp, Rattus norvegicus
gacaggctacatatgtccctcgtgc

SEQ ID NO: 317637 - DNA, 25 bp, Rattus norvegicus
gacaggctacatttgtccctcgtgc

SEQ ID NO: 317638 - DNA, 25 bp, Rattus norvegicus
gacaggctacctatgtgtatatagt

SEQ ID NO: 317639 - DNA, 25 bp, Rattus norvegicus
gacaggctacctttgtgtatatagt

SEQ ID NO: 317640 - DNA, 25 bp, Rattus norvegicus
gacaggctagccactgttaggattg

SEQ ID NO: 317641 - DNA, 25 bp, Rattus norvegicus
gacaggctagcctctgttaggattg

SEQ ID NO: 317642 - DNA, 25 bp, Rattus norvegicus
gacaggctcccacagtgatgcagac

SEQ ID NO: 317643 - DNA, 25 bp, Rattus norvegicus
gacaggctcccagagtgatgcagac

SEQ ID NO: 317644 - DNA, 25 bp, Rattus norvegicus
gacaggctccttcagcttacaaata

SEQ ID NO: 317645 - DNA, 25 bp, Rattus norvegicus
gacaggctccttgagcttacaaata

SEQ ID NO: 317646 - DNA, 25 bp, Rattus norvegicus
gacaggctcgccctaatactgcatt

SEQ ID NO: 317647 - DNA, 25 bp, Rattus norvegicus
gacaggctcgccgtaatactgcatt

SEQ ID NO: 317648 - DNA, 25 bp, Rattus norvegicus
gacaggctcttgaggtgcagttaaa

SEQ ID NO: 317649 - DNA, 25 bp, Rattus norvegicus
gacaggctcttgtggtgcagttaaa

SEQ ID NO: 317650 - DNA, 25 bp, Rattus norvegicus
gacaggctgcaacttggcactttgg

SEQ ID NO: 317651 - DNA, 25 bp, Rattus norvegicus
gacaggctgcaagttggcactttgg

SEQ ID NO: 317652 - DNA, 25 bp, Rattus norvegicus
gacaggctgcagcattcaggctcct

SEQ ID NO: 317653 - DNA, 25 bp, Rattus norvegicus
gacaggctgcaggattcaggctcct

SEQ ID NO: 317654 - DNA, 25 bp, Rattus norvegicus
gacaggctggccattcggagactct

SEQ ID NO: 317655 - DNA, 25 bp, Rattus norvegicus
gacaggctggcctttcggagactct

SEQ ID NO: 317656 - DNA, 25 bp, Rattus norvegicus
gacaggctgtagatcgcagagccaa

SEQ ID NO: 317657 - DNA, 25 bp, Rattus norvegicus
gacaggctgtagttcgcagagccaa

SEQ ID NO: 317658 - DNA, 25 bp, Rattus norvegicus
gacaggctgtcaagtcagctatttt

SEQ ID NO: 317659 - DNA, 25 bp, Rattus norvegicus
gacaggctgtcactggatatgccag

SEQ ID NO: 317660 - DNA, 25 bp, Rattus norvegicus
gacaggctgtcagtggatatgccag

SEQ ID NO: 317661 - DNA, 25 bp, Rattus norvegicus
gacaggctgtcatgtcagctatttt

SEQ ID NO: 317662 - DNA, 25 bp, Rattus norvegicus
gacaggcttagaacccctggaggga

SEQ ID NO: 317663 - DNA, 25 bp, Rattus norvegicus
gacaggcttagatcccctggaggga

SEQ ID NO: 317664 - DNA, 25 bp, Rattus norvegicus
gacaggctttgtctgatttctttac

SEQ ID NO: 317665 - DNA, 25 bp, Rattus norvegicus
gacaggctttgtgtgatttctttac

SEQ ID NO: 317666 - DNA, 25 bp, Rattus norvegicus
gacaggctttttacatcagaggact

SEQ ID NO: 317667 - DNA, 25 bp, Rattus norvegicus
gacaggcttttttcatcagaggact

SEQ ID NO: 317668 - DNA, 25 bp, Rattus norvegicus
gacagggaaaatcttaagtccataa

SEQ ID NO: 317669 - DNA, 25 bp, Rattus norvegicus
gacagggaaaatgttaagtccataa

SEQ ID NO: 317670 - DNA, 25 bp, Rattus norvegicus
gacagggaaatcagctagttataca

SEQ ID NO: 317671 - DNA, 25 bp, Rattus norvegicus
gacagggaaatctgctagttataca

SEQ ID NO: 317672 - DNA, 25 bp, Rattus norvegicus
gacagggaaatgactcacccaaccc

SEQ ID NO: 317673 - DNA, 25 bp, Rattus norvegicus
gacagggaaatgtctcacccaaccc

SEQ ID NO: 317674 - DNA, 25 bp, Rattus norvegicus
gacagggaagctacaggttacaaca

SEQ ID NO: 317675 - DNA, 25 bp, Rattus norvegicus
gacagggaagcttcaggttacaaca

SEQ ID NO: 317676 - DNA, 25 bp, Rattus norvegicus
gacagggaattgcattcacacgcta

SEQ ID NO: 317677 - DNA, 25 bp, Rattus norvegicus
gacagggaattggattcacacgcta

SEQ ID NO: 317678 - DNA, 25 bp, Rattus norvegicus
gacagggacatgactatggacattt

SEQ ID NO: 317679 - DNA, 25 bp, Rattus norvegicus
gacagggacatgtctatggacattt

SEQ ID NO: 317680 - DNA, 25 bp, Rattus norvegicus
gacagggaccaactacagaagcaga

SEQ ID NO: 317681 - DNA, 25 bp, Rattus norvegicus
gacagggaccaagtacagaagcaga

SEQ ID NO: 317682 - DNA, 25 bp, Rattus norvegicus
gacagggaccatcctcaaggcataa

SEQ ID NO: 317683 - DNA, 25 bp, Rattus norvegicus
gacagggaccatcttggtctctgtt

SEQ ID NO: 317684 - DNA, 25 bp, Rattus norvegicus
gacagggaccatgctcaaggcataa

SEQ ID NO: 317685 - DNA, 25 bp, Rattus norvegicus
gacagggaccatgttggtctctgtt

SEQ ID NO: 317686 - DNA, 25 bp, Rattus norvegicus
gacagggacccaagcacagtgatta

SEQ ID NO: 317687 - DNA, 25 bp, Rattus norvegicus
gacagggacccatgcacagtgatta

SEQ ID NO: 317688 - DNA, 25 bp, Rattus norvegicus
gacagggactcacaggaagatcaat

SEQ ID NO: 317689 - DNA, 25 bp, Rattus norvegicus
gacagggactcagaggaagatcaat

SEQ ID NO: 317690 - DNA, 25 bp, Rattus norvegicus
gacagggactgtcctggtgaccact

SEQ ID NO: 317691 - DNA, 25 bp, Rattus norvegicus
gacagggactgtgctggtgaccact

SEQ ID NO: 317692 - DNA, 25 bp, Rattus norvegicus
gacagggaggcaaggccagcatcct

SEQ ID NO: 317693 - DNA, 25 bp, Rattus norvegicus
gacagggaggcatggccagcatcct

SEQ ID NO: 317694 - DNA, 25 bp, Rattus norvegicus
gacagggagggaagccatcaaccaa

SEQ ID NO: 317695 - DNA, 25 bp, Rattus norvegicus
gacagggagggatgccatcaaccaa

SEQ ID NO: 317696 - DNA, 25 bp, Rattus norvegicus
gacagggatgaacgaaaatacttta

SEQ ID NO: 317697 - DNA, 25 bp, Rattus norvegicus
gacagggatgaaggaaaatacttta

SEQ ID NO: 317698 - DNA, 25 bp, Rattus norvegicus
gacagggattctctaatgcagctct

SEQ ID NO: 317699 - DNA, 25 bp, Rattus norvegicus
gacagggattctgtaatgcagctct

SEQ ID NO: 317700 - DNA, 25 bp, Rattus norvegicus
gacagggcaactactgggtaggcat

SEQ ID NO: 317701 - DNA, 25 bp, Rattus norvegicus
gacagggcaacttctgggtaggcat

SEQ ID NO: 317702 - DNA, 25 bp, Rattus norvegicus
gacagggccaacatgcagcacagat

SEQ ID NO: 317703 - DNA, 25 bp, Rattus norvegicus
gacagggccaacttgcagcacagat

SEQ ID NO: 317704 - DNA, 25 bp, Rattus norvegicus
gacagggccaccatctcgagaaggg

SEQ ID NO: 317705 - DNA, 25 bp, Rattus norvegicus
gacagggccaccttctcgagaaggg

SEQ ID NO: 317706 - DNA, 25 bp, Rattus norvegicus
gacagggccagtcaatctcagctga

SEQ ID NO: 317707 - DNA, 25 bp, Rattus norvegicus
gacagggccagtgaatctcagctga

SEQ ID NO: 317708 - DNA, 25 bp, Rattus norvegicus
gacagggcccatcgttctgacaaga

SEQ ID NO: 317709 - DNA, 25 bp, Rattus norvegicus
gacagggcccatggttctgacaaga

SEQ ID NO: 317710 - DNA, 25 bp, Rattus norvegicus
gacagggcccttaaagaccccactg

SEQ ID NO: 317711 - DNA, 25 bp, Rattus norvegicus
gacagggccctttaagaccccactg

SEQ ID NO: 317712 - DNA, 25 bp, Rattus norvegicus
gacagggcctctctacttaaatgtg

SEQ ID NO: 317713 - DNA, 25 bp, Rattus norvegicus
gacagggcctctgtacttaaatgtg

SEQ ID NO: 317714 - DNA, 25 bp, Rattus norvegicus
gacagggccttacaatatagccttg

SEQ ID NO: 317715 - DNA, 25 bp, Rattus norvegicus
gacagggccttagaatatagccttg

SEQ ID NO: 317716 - DNA, 25 bp, Rattus norvegicus
gacagggcgacaaatgaacttgcta

SEQ ID NO: 317717 - DNA, 25 bp, Rattus norvegicus
gacagggcgacatatgaacttgcta

SEQ ID NO: 317718 - DNA, 25 bp, Rattus norvegicus
gacagggcggttcgcaggtctgaga

SEQ ID NO: 317719 - DNA, 25 bp, Rattus norvegicus
gacagggcggttggcaggtctgaga

SEQ ID NO: 317720 - DNA, 25 bp, Rattus norvegicus
gacagggctactatcaggactagat

SEQ ID NO: 317721 - DNA, 25 bp, Rattus norvegicus
gacagggctactttcaggactagat

SEQ ID NO: 317722 - DNA, 25 bp, Rattus norvegicus
gacagggctgccagtagccatacag

SEQ ID NO: 317723 - DNA, 25 bp, Rattus norvegicus
gacagggctgcctgtagccatacag

SEQ ID NO: 317724 - DNA, 25 bp, Rattus norvegicus
gacagggctgtcagtaccactggag

SEQ ID NO: 317725 - DNA, 25 bp, Rattus norvegicus
gacagggctgtctgtaccactggag

SEQ ID NO: 317726 - DNA, 25 bp, Rattus norvegicus
gacagggcttctccgacgagtgctc

SEQ ID NO: 317727 - DNA, 25 bp, Rattus norvegicus
gacagggcttctgcgacgagtgctc

SEQ ID NO: 317728 - DNA, 25 bp, Rattus norvegicus
gacagggcttttctagctctgatgt

SEQ ID NO: 317729 - DNA, 25 bp, Rattus norvegicus
gacagggcttttgtagctctgatgt

SEQ ID NO: 317730 - DNA, 25 bp, Rattus norvegicus
gacagggggtcacagccctttctca

SEQ ID NO: 317731 - DNA, 25 bp, Rattus norvegicus
gacagggggtcagagccctttctca

SEQ ID NO: 317732 - DNA, 25 bp, Rattus norvegicus
gacagggtacctcagccagagcacc

SEQ ID NO: 317733 - DNA, 25 bp, Rattus norvegicus
gacagggtacctcgaagcagagcct

SEQ ID NO: 317734 - DNA, 25 bp, Rattus norvegicus
gacagggtacctgagccagagcacc

SEQ ID NO: 317735 - DNA, 25 bp, Rattus norvegicus
gacagggtacctggaagcagagcct

SEQ ID NO: 317736 - DNA, 25 bp, Rattus norvegicus
gacagggtcacaagtagtccaggct

SEQ ID NO: 317737 - DNA, 25 bp, Rattus norvegicus
gacagggtcacatgtagtccaggct

SEQ ID NO: 317738 - DNA, 25 bp, Rattus norvegicus
gacagggtcaccaaattccatggaa

SEQ ID NO: 317739 - DNA, 25 bp, Rattus norvegicus
gacagggtcacctaattccatggaa

SEQ ID NO: 317740 - DNA, 25 bp, Rattus norvegicus
gacagggtcagaaacaggtgtccca

SEQ ID NO: 317741 - DNA, 25 bp, Rattus norvegicus
gacagggtcagatacaggtgtccca

SEQ ID NO: 317742 - DNA, 25 bp, Rattus norvegicus
gacagggtccgtaaactgcaggaaa

SEQ ID NO: 317743 - DNA, 25 bp, Rattus norvegicus
gacagggtccgttaactgcaggaaa

SEQ ID NO: 317744 - DNA, 25 bp, Rattus norvegicus
gacagggtctccagttagcctaggt

SEQ ID NO: 317745 - DNA, 25 bp, Rattus norvegicus
gacagggtctcctgttagcctaggt

SEQ ID NO: 317746 - DNA, 25 bp, Rattus norvegicus
gacagggtctctagttgaatctgga

SEQ ID NO: 317747 - DNA, 25 bp, Rattus norvegicus
gacagggtctctatagtgaccagaa

SEQ ID NO: 317748 - DNA, 25 bp, Rattus norvegicus
gacagggtctcttgttgaatctgga

SEQ ID NO: 317749 - DNA, 25 bp, Rattus norvegicus
gacagggtctctttagtgaccagaa

SEQ ID NO: 317750 - DNA, 25 bp, Rattus norvegicus
gacagggtgccaattctgtaccaag

SEQ ID NO: 317751 - DNA, 25 bp, Rattus norvegicus
gacagggtgccatttctgtaccaag

SEQ ID NO: 317752 - DNA, 25 bp, Rattus norvegicus
gacagggtgcttaagtccccagaaa

SEQ ID NO: 317753 - DNA, 25 bp, Rattus norvegicus
gacagggtgctttagtccccagaaa

SEQ ID NO: 317754 - DNA, 25 bp, Rattus norvegicus
gacagggttcctctatcaggagaaa

SEQ ID NO: 317755 - DNA, 25 bp, Rattus norvegicus
gacagggttcctgtatcaggagaaa

SEQ ID NO: 317756 - DNA, 25 bp, Rattus norvegicus
gacagggttctcagagtaacagccc

SEQ ID NO: 317757 - DNA, 25 bp, Rattus norvegicus
gacagggttctctgagtaacagccc

SEQ ID NO: 317758 - DNA, 25 bp, Rattus norvegicus
gacagggttctgagcatttctttga

SEQ ID NO: 317759 - DNA, 25 bp, Rattus norvegicus
gacagggttctgtgcatttctttga

SEQ ID NO: 317760 - DNA, 25 bp, Rattus norvegicus
gacagggttgaaactctgggttcca

SEQ ID NO: 317761 - DNA, 25 bp, Rattus norvegicus
gacagggttgaatctctgggttcca

SEQ ID NO: 317762 - DNA, 25 bp, Rattus norvegicus
gacagggttgtcattagcatgctca

SEQ ID NO: 317763 - DNA, 25 bp, Rattus norvegicus
gacagggttgtctttagcatgctca

SEQ ID NO: 317764 - DNA, 25 bp, Rattus norvegicus
gacagggtttaacctgtaccagaca

SEQ ID NO: 317765 - DNA, 25 bp, Rattus norvegicus
gacagggtttaagctgtaccagaca

SEQ ID NO: 317766 - DNA, 25 bp, Rattus norvegicus
gacagggttttcactctgaagccct

SEQ ID NO: 317767 - DNA, 25 bp, Rattus norvegicus
gacagggttttctctctgaagccct

SEQ ID NO: 317768 - DNA, 25 bp, Rattus norvegicus
gacaggtaacttctcccagaagcag

SEQ ID NO: 317769 - DNA, 25 bp, Rattus norvegicus
gacaggtaacttgtcccagaagcag

SEQ ID NO: 317770 - DNA, 25 bp, Rattus norvegicus
gacaggtactatcacctctgtggtc

SEQ ID NO: 317771 - DNA, 25 bp, Rattus norvegicus
gacaggtactatgacctctgtggtc

SEQ ID NO: 317772 - DNA, 25 bp, Rattus norvegicus
gacaggtactcgctcattgttacat

SEQ ID NO: 317773 - DNA, 25 bp, Rattus norvegicus
gacaggtactcggtcattgttacat

SEQ ID NO: 317774 - DNA, 25 bp, Rattus norvegicus
gacaggtactctacgaatcaagggc

SEQ ID NO: 317775 - DNA, 25 bp, Rattus norvegicus
gacaggtactcttcgaatcaagggc

SEQ ID NO: 317776 - DNA, 25 bp, Rattus norvegicus
gacaggtactggatcagctccttgt

SEQ ID NO: 317777 - DNA, 25 bp, Rattus norvegicus
gacaggtactggctctgcgcataga

SEQ ID NO: 317778 - DNA, 25 bp, Rattus norvegicus
gacaggtactgggtctgcgcataga

SEQ ID NO: 317779 - DNA, 25 bp, Rattus norvegicus
gacaggtactggttcagctccttgt

SEQ ID NO: 317780 - DNA, 25 bp, Rattus norvegicus
gacaggtagaagatccagcccagac

SEQ ID NO: 317781 - DNA, 25 bp, Rattus norvegicus
gacaggtagaagttccagcccagac

SEQ ID NO: 317782 - DNA, 25 bp, Rattus norvegicus
gacaggtagacacgctcaaacagct

SEQ ID NO: 317783 - DNA, 25 bp, Rattus norvegicus
gacaggtagacaggctcaaacagct

SEQ ID NO: 317784 - DNA, 25 bp, Rattus norvegicus
gacaggtagatgccagaagtaccat

SEQ ID NO: 317785 - DNA, 25 bp, Rattus norvegicus
gacaggtagatggcagaagtaccat

SEQ ID NO: 317786 - DNA, 25 bp, Rattus norvegicus
gacaggtagcttatgcattactgac

SEQ ID NO: 317787 - DNA, 25 bp, Rattus norvegicus
gacaggtagcttttgcattactgac

SEQ ID NO: 317788 - DNA, 25 bp, Rattus norvegicus
gacaggtcagagaatgtcactgttg

SEQ ID NO: 317789 - DNA, 25 bp, Rattus norvegicus
gacaggtcagagtatgtcactgttg

SEQ ID NO: 317790 - DNA, 25 bp, Rattus norvegicus
gacaggtccttcagggcttagacta

SEQ ID NO: 317791 - DNA, 25 bp, Rattus norvegicus
gacaggtccttctgggcttagacta

SEQ ID NO: 317792 - DNA, 25 bp, Rattus norvegicus
gacaggtcggttactctccgccggg

SEQ ID NO: 317793 - DNA, 25 bp, Rattus norvegicus
gacaggtcggtttctctccgccggg

SEQ ID NO: 317794 - DNA, 25 bp, Rattus norvegicus
gacaggtctgagattcactcacaga

SEQ ID NO: 317795 - DNA, 25 bp, Rattus norvegicus
gacaggtctgagtttcactcacaga

SEQ ID NO: 317796 - DNA, 25 bp, Rattus norvegicus
gacaggtctgtactcactgctgaga

SEQ ID NO: 317797 - DNA, 25 bp, Rattus norvegicus
gacaggtctgtagtcactgctgaga

SEQ ID NO: 317798 - DNA, 25 bp, Rattus norvegicus
gacaggtcttccaaggctcatgcac

SEQ ID NO: 317799 - DNA, 25 bp, Rattus norvegicus
gacaggtcttcctaggctcatgcac

SEQ ID NO: 317800 - DNA, 25 bp, Rattus norvegicus
gacaggtcttgaactagccatgcag

SEQ ID NO: 317801 - DNA, 25 bp, Rattus norvegicus
gacaggtcttgatctagccatgcag

SEQ ID NO: 317802 - DNA, 25 bp, Rattus norvegicus
gacaggtctttcaatttggttggtt

SEQ ID NO: 317803 - DNA, 25 bp, Rattus norvegicus
gacaggtctttctatttggttggtt

SEQ ID NO: 317804 - DNA, 25 bp, Rattus norvegicus
gacaggtgaaccatttacctcccag

SEQ ID NO: 317805 - DNA, 25 bp, Rattus norvegicus
gacaggtgaaccttttacctcccag

SEQ ID NO: 317806 - DNA, 25 bp, Rattus norvegicus
gacaggtgaagacccgtgtgtattt

SEQ ID NO: 317807 - DNA, 25 bp, Rattus norvegicus
gacaggtgaagagccgtgtgtattt

SEQ ID NO: 317808 - DNA, 25 bp, Rattus norvegicus
gacaggtgacaaacctcagcttgta

SEQ ID NO: 317809 - DNA, 25 bp, Rattus norvegicus
gacaggtgacaatcctcagcttgta

SEQ ID NO: 317810 - DNA, 25 bp, Rattus norvegicus
gacaggtgacctcaggtaccagcag

SEQ ID NO: 317811 - DNA, 25 bp, Rattus norvegicus
gacaggtgacctgaggtaccagcag

SEQ ID NO: 317812 - DNA, 25 bp, Rattus norvegicus
gacaggtgagcaaccaacattgaga

SEQ ID NO: 317813 - DNA, 25 bp, Rattus norvegicus
gacaggtgagcaactcttgaacctc

SEQ ID NO: 317814 - DNA, 25 bp, Rattus norvegicus
gacaggtgagcatccaacattgaga

SEQ ID NO: 317815 - DNA, 25 bp, Rattus norvegicus
gacaggtgagcatctcttgaacctc

SEQ ID NO: 317816 - DNA, 25 bp, Rattus norvegicus
gacaggtgagccagaagtttaaatt

SEQ ID NO: 317817 - DNA, 25 bp, Rattus norvegicus
gacaggtgagcctgaagtttaaatt

SEQ ID NO: 317818 - DNA, 25 bp, Rattus norvegicus
gacaggtgcccgagtcacaggacac

SEQ ID NO: 317819 - DNA, 25 bp, Rattus norvegicus
gacaggtgcccgtgtcacaggacac

SEQ ID NO: 317820 - DNA, 25 bp, Rattus norvegicus
gacaggtgctacatctgtacaggca

SEQ ID NO: 317821 - DNA, 25 bp, Rattus norvegicus
gacaggtgctacttctgtacaggca

SEQ ID NO: 317822 - DNA, 25 bp, Rattus norvegicus
gacaggtggctcattagaggtcctt

SEQ ID NO: 317823 - DNA, 25 bp, Rattus norvegicus
gacaggtggctctttagaggtcctt

SEQ ID NO: 317824 - DNA, 25 bp, Rattus norvegicus
gacaggtggctgagcacatttgcta

SEQ ID NO: 317825 - DNA, 25 bp, Rattus norvegicus
gacaggtggctgtgcacatttgcta

SEQ ID NO: 317826 - DNA, 25 bp, Rattus norvegicus
gacaggtgtcatactgaccaccgat

SEQ ID NO: 317827 - DNA, 25 bp, Rattus norvegicus
gacaggtgtcattctgaccaccgat

SEQ ID NO: 317828 - DNA, 25 bp, Rattus norvegicus
gacaggtgtcggcagcacttgctct

SEQ ID NO: 317829 - DNA, 25 bp, Rattus norvegicus
gacaggtgtcgggagcacttgctct

SEQ ID NO: 317830 - DNA, 25 bp, Rattus norvegicus
gacaggtgtcttagctgctgttcta

SEQ ID NO: 317831 - DNA, 25 bp, Rattus norvegicus
gacaggtgtctttgctgctgttcta

SEQ ID NO: 317832 - DNA, 25 bp, Rattus norvegicus
gacaggttaagtaatccttgactac

SEQ ID NO: 317833 - DNA, 25 bp, Rattus norvegicus
gacaggttaagttatccttgactac

SEQ ID NO: 317834 - DNA, 25 bp, Rattus norvegicus
gacaggttactcacagacgatcctc

SEQ ID NO: 317835 - DNA, 25 bp, Rattus norvegicus
gacaggttactctcagacgatcctc

SEQ ID NO: 317836 - DNA, 25 bp, Rattus norvegicus
gacaggttacttactgcaggagcga

SEQ ID NO: 317837 - DNA, 25 bp, Rattus norvegicus
gacaggttactttctgcaggagcga

SEQ ID NO: 317838 - DNA, 25 bp, Rattus norvegicus
gacaggttaggcacatgggttcaga

SEQ ID NO: 317839 - DNA, 25 bp, Rattus norvegicus
gacaggttaggctcatgggttcaga

SEQ ID NO: 317840 - DNA, 25 bp, Rattus norvegicus
gacaggttatggctttcttctggat

SEQ ID NO: 317841 - DNA, 25 bp, Rattus norvegicus
gacaggttatgggtttcttctggat

SEQ ID NO: 317842 - DNA, 25 bp, Rattus norvegicus
gacaggttcaaaccacactggcaat

SEQ ID NO: 317843 - DNA, 25 bp, Rattus norvegicus
gacaggttcaaagcacactggcaat

SEQ ID NO: 317844 - DNA, 25 bp, Rattus norvegicus
gacaggttcacactatctgcctaaa

SEQ ID NO: 317845 - DNA, 25 bp, Rattus norvegicus
gacaggttcacagtatctgcctaaa

SEQ ID NO: 317846 - DNA, 25 bp, Rattus norvegicus
gacaggttcagtctcccaaggctga

SEQ ID NO: 317847 - DNA, 25 bp, Rattus norvegicus
gacaggttcagtgtcccaaggctga

SEQ ID NO: 317848 - DNA, 25 bp, Rattus norvegicus
gacaggttctggacttgtgtgaatc

SEQ ID NO: 317849 - DNA, 25 bp, Rattus norvegicus
gacaggttctggtcttgtgtgaatc

SEQ ID NO: 317850 - DNA, 25 bp, Rattus norvegicus
gacaggttgaagcagatgccttgct

SEQ ID NO: 317851 - DNA, 25 bp, Rattus norvegicus
gacaggttgaaggagatgccttgct

SEQ ID NO: 317852 - DNA, 25 bp, Rattus norvegicus
gacaggttgcctcaggaagtccagt

SEQ ID NO: 317853 - DNA, 25 bp, Rattus norvegicus
gacaggttgcctgaggaagtccagt

SEQ ID NO: 317854 - DNA, 25 bp, Rattus norvegicus
gacaggttggtgcattgaacacaga

SEQ ID NO: 317855 - DNA, 25 bp, Rattus norvegicus
gacaggttggtggattgaacacaga

SEQ ID NO: 317856 - DNA, 25 bp, Rattus norvegicus
gacaggtttcagaactcccaaagat

SEQ ID NO: 317857 - DNA, 25 bp, Rattus norvegicus
gacaggtttcagtactcccaaagat

SEQ ID NO: 317858 - DNA, 25 bp, Rattus norvegicus
gacaggtttcccacagtccgaggat

SEQ ID NO: 317859 - DNA, 25 bp, Rattus norvegicus
gacaggtttccctcagtccgaggat

SEQ ID NO: 317860 - DNA, 25 bp, Rattus norvegicus
gacaggttttctcatgggcactttt

SEQ ID NO: 317861 - DNA, 25 bp, Rattus norvegicus
gacaggttttctgatgggcactttt

SEQ ID NO: 317862 - DNA, 25 bp, Rattus norvegicus
gacaggttttgtcctttgggctact

SEQ ID NO: 317863 - DNA, 25 bp, Rattus norvegicus
gacaggttttgtgctttgggctact

SEQ ID NO: 317864 - DNA, 25 bp, Rattus norvegicus
gacagtaaagtaatgctccagctct

SEQ ID NO: 317865 - DNA, 25 bp, Rattus norvegicus
gacagtaaagtattgctccagctct

SEQ ID NO: 317866 - DNA, 25 bp, Rattus norvegicus
gacagtaaccagattgctccaggct

SEQ ID NO: 317867 - DNA, 25 bp, Rattus norvegicus
gacagtaaccagtttgctccaggct

SEQ ID NO: 317868 - DNA, 25 bp, Rattus norvegicus
gacagtaaccttccaaatccttgat

SEQ ID NO: 317869 - DNA, 25 bp, Rattus norvegicus
gacagtaaccttgcaaatccttgat

SEQ ID NO: 317870 - DNA, 25 bp, Rattus norvegicus
gacagtaacgcactcgcagttggag

SEQ ID NO: 317871 - DNA, 25 bp, Rattus norvegicus
gacagtaacgcagtcgcagttggag

SEQ ID NO: 317872 - DNA, 25 bp, Rattus norvegicus
gacagtaactgtatacttcaggcag

SEQ ID NO: 317873 - DNA, 25 bp, Rattus norvegicus
gacagtaactgtttacttcaggcag

SEQ ID NO: 317874 - DNA, 25 bp, Rattus norvegicus
gacagtaagcacatcacagatctct

SEQ ID NO: 317875 - DNA, 25 bp, Rattus norvegicus
gacagtaagcacttcacagatctct

SEQ ID NO: 317876 - DNA, 25 bp, Rattus norvegicus
gacagtaagtgaaagagaccgtgga

SEQ ID NO: 317877 - DNA, 25 bp, Rattus norvegicus
gacagtaagtgatagagaccgtgga

SEQ ID NO: 317878 - DNA, 25 bp, Rattus norvegicus
gacagtacaataatctcagttgtta

SEQ ID NO: 317879 - DNA, 25 bp, Rattus norvegicus
gacagtacaatattctcagttgtta

SEQ ID NO: 317880 - DNA, 25 bp, Rattus norvegicus
gacagtacagtcacttctggatatg

SEQ ID NO: 317881 - DNA, 25 bp, Rattus norvegicus
gacagtacagtctcttctggatatg

SEQ ID NO: 317882 - DNA, 25 bp, Rattus norvegicus
gacagtaccgtccagtgccagacat

SEQ ID NO: 317883 - DNA, 25 bp, Rattus norvegicus
gacagtaccgtcgagtgccagacat

SEQ ID NO: 317884 - DNA, 25 bp, Rattus norvegicus
gacagtacctgcaatcatttttatc

SEQ ID NO: 317885 - DNA, 25 bp, Rattus norvegicus
gacagtacctgctatcatttttatc

SEQ ID NO: 317886 - DNA, 25 bp, Rattus norvegicus
gacagtactacccattcatctattg

SEQ ID NO: 317887 - DNA, 25 bp, Rattus norvegicus
gacagtactaccgattcatctattg

SEQ ID NO: 317888 - DNA, 25 bp, Rattus norvegicus
gacagtactagacgtgatgcacact

SEQ ID NO: 317889 - DNA, 25 bp, Rattus norvegicus
gacagtactagaggtgatgcacact

SEQ ID NO: 317890 - DNA, 25 bp, Rattus norvegicus
gacagtactatgatccctatttaat

SEQ ID NO: 317891 - DNA, 25 bp, Rattus norvegicus
gacagtactatgttccctatttaat

SEQ ID NO: 317892 - DNA, 25 bp, Rattus norvegicus
gacagtactggtcactctcgttaac

SEQ ID NO: 317893 - DNA, 25 bp, Rattus norvegicus
gacagtactggtgactctcgttaac

SEQ ID NO: 317894 - DNA, 25 bp, Rattus norvegicus
gacagtactgtccatttgcctgagt

SEQ ID NO: 317895 - DNA, 25 bp, Rattus norvegicus
gacagtactgtcgatttgcctgagt

SEQ ID NO: 317896 - DNA, 25 bp, Rattus norvegicus
gacagtactgtgagctgtgtgccta

SEQ ID NO: 317897 - DNA, 25 bp, Rattus norvegicus
gacagtactgtgtgctgtgtgccta

SEQ ID NO: 317898 - DNA, 25 bp, Rattus norvegicus
gacagtacttatcccttgatagcat

SEQ ID NO: 317899 - DNA, 25 bp, Rattus norvegicus
gacagtacttatgccttgatagcat

SEQ ID NO: 317900 - DNA, 25 bp, Rattus norvegicus
gacagtagactcatgtgcttgtaga

SEQ ID NO: 317901 - DNA, 25 bp, Rattus norvegicus
gacagtagactcttgtgcttgtaga

SEQ ID NO: 317902 - DNA, 25 bp, Rattus norvegicus
gacagtagcaaacctctgaccatat

SEQ ID NO: 317903 - DNA, 25 bp, Rattus norvegicus
gacagtagcaaagctctgaccatat

SEQ ID NO: 317904 - DNA, 25 bp, Rattus norvegicus
gacagtagcactcaaaatgttgtgt

SEQ ID NO: 317905 - DNA, 25 bp, Rattus norvegicus
gacagtagcactgaaaatgttgtgt

SEQ ID NO: 317906 - DNA, 25 bp, Rattus norvegicus
gacagtagcccacctggtagagcgt

SEQ ID NO: 317907 - DNA, 25 bp, Rattus norvegicus
gacagtagcccagctggtagagcgt

SEQ ID NO: 317908 - DNA, 25 bp, Rattus norvegicus
gacagtagctctaagtcttgcctat

SEQ ID NO: 317909 - DNA, 25 bp, Rattus norvegicus
gacagtagctcttagtcttgcctat

SEQ ID NO: 317910 - DNA, 25 bp, Rattus norvegicus
gacagtaggactaagcactccgtgt

SEQ ID NO: 317911 - DNA, 25 bp, Rattus norvegicus
gacagtaggacttagcactccgtgt

SEQ ID NO: 317912 - DNA, 25 bp, Rattus norvegicus
gacagtaggcaacgaaactggatta

SEQ ID NO: 317913 - DNA, 25 bp, Rattus norvegicus
gacagtaggcaaggaaactggatta

SEQ ID NO: 317914 - DNA, 25 bp, Rattus norvegicus
gacagtaggttcatattcagacttt

SEQ ID NO: 317915 - DNA, 25 bp, Rattus norvegicus
gacagtaggttcttattcagacttt

SEQ ID NO: 317916 - DNA, 25 bp, Rattus norvegicus
gacagtagtaccaagctgggctcct

SEQ ID NO: 317917 - DNA, 25 bp, Rattus norvegicus
gacagtagtacctagctgggctcct

SEQ ID NO: 317918 - DNA, 25 bp, Rattus norvegicus
gacagtagttcacttattgcataga

SEQ ID NO: 317919 - DNA, 25 bp, Rattus norvegicus
gacagtagttcagttattgcataga

SEQ ID NO: 317920 - DNA, 25 bp, Rattus norvegicus
gacagtataccacttgccttttccc

SEQ ID NO: 317921 - DNA, 25 bp, Rattus norvegicus
gacagtataccagttgccttttccc

SEQ ID NO: 317922 - DNA, 25 bp, Rattus norvegicus
gacagtatatcacagggtggccagt

SEQ ID NO: 317923 - DNA, 25 bp, Rattus norvegicus
gacagtatatcagagggtggccagt

SEQ ID NO: 317924 - DNA, 25 bp, Rattus norvegicus
gacagtatgagcctcagtcttactg

SEQ ID NO: 317925 - DNA, 25 bp, Rattus norvegicus
gacagtatgagcgtcagtcttactg

SEQ ID NO: 317926 - DNA, 25 bp, Rattus norvegicus
gacagtatgtatcgcttctcttatg

SEQ ID NO: 317927 - DNA, 25 bp, Rattus norvegicus
gacagtatgtatggcttctcttatg

SEQ ID NO: 317928 - DNA, 25 bp, Rattus norvegicus
gacagtattatgaggccctgaataa

SEQ ID NO: 317929 - DNA, 25 bp, Rattus norvegicus
gacagtattatgtggccctgaataa

SEQ ID NO: 317930 - DNA, 25 bp, Rattus norvegicus
gacagtattctactgtactttcatg

SEQ ID NO: 317931 - DNA, 25 bp, Rattus norvegicus
gacagtattctagtgtactttcatg

SEQ ID NO: 317932 - DNA, 25 bp, Rattus norvegicus
gacagtattctgattagccaataaa

SEQ ID NO: 317933 - DNA, 25 bp, Rattus norvegicus
gacagtattctgtttagccaataaa

SEQ ID NO: 317934 - DNA, 25 bp, Rattus norvegicus
gacagtatttatagttttcccagaa

SEQ ID NO: 317935 - DNA, 25 bp, Rattus norvegicus
gacagtatttattgttttcccagaa

SEQ ID NO: 317936 - DNA, 25 bp, Rattus norvegicus
gacagtcaaaatccacatgcctata

SEQ ID NO: 317937 - DNA, 25 bp, Rattus norvegicus
gacagtcaaaatgcacatgcctata

SEQ ID NO: 317938 - DNA, 25 bp, Rattus norvegicus
gacagtcaaggaacctgttcttctc

SEQ ID NO: 317939 - DNA, 25 bp, Rattus norvegicus
gacagtcaaggatcctgttcttctc

SEQ ID NO: 317940 - DNA, 25 bp, Rattus norvegicus
gacagtcaataaataaaccgaggcg

SEQ ID NO: 317941 - DNA, 25 bp, Rattus norvegicus
gacagtcaataattaaaccgaggcg

SEQ ID NO: 317942 - DNA, 25 bp, Rattus norvegicus
gacagtcacaccataattcgattct

SEQ ID NO: 317943 - DNA, 25 bp, Rattus norvegicus
gacagtcacaccttaattcgattct

SEQ ID NO: 317944 - DNA, 25 bp, Rattus norvegicus
gacagtcaccttaggcatcaagcat

SEQ ID NO: 317945 - DNA, 25 bp, Rattus norvegicus
gacagtcacctttggcatcaagcat

SEQ ID NO: 317946 - DNA, 25 bp, Rattus norvegicus
gacagtcactgtattccgttactaa

SEQ ID NO: 317947 - DNA, 25 bp, Rattus norvegicus
gacagtcactgttttccgttactaa

SEQ ID NO: 317948 - DNA, 25 bp, Rattus norvegicus
gacagtcagaccagagcctttgcga

SEQ ID NO: 317949 - DNA, 25 bp, Rattus norvegicus
gacagtcagacctgagcctttgcga

SEQ ID NO: 317950 - DNA, 25 bp, Rattus norvegicus
gacagtcagcacactactcattggg

SEQ ID NO: 317951 - DNA, 25 bp, Rattus norvegicus
gacagtcagcactctactcattggg

SEQ ID NO: 317952 - DNA, 25 bp, Rattus norvegicus
gacagtcaggaccacactcttgagg

SEQ ID NO: 317953 - DNA, 25 bp, Rattus norvegicus
gacagtcaggacgacactcttgagg

SEQ ID NO: 317954 - DNA, 25 bp, Rattus norvegicus
gacagtcaggcaatgggaagccaga

SEQ ID NO: 317955 - DNA, 25 bp, Rattus norvegicus
gacagtcaggcattgggaagccaga

SEQ ID NO: 317956 - DNA, 25 bp, Rattus norvegicus
gacagtcaggttacattagttgagc

SEQ ID NO: 317957 - DNA, 25 bp, Rattus norvegicus
gacagtcaggtttcattagttgagc

SEQ ID NO: 317958 - DNA, 25 bp, Rattus norvegicus
gacagtcatcccaaaattctatctt

SEQ ID NO: 317959 - DNA, 25 bp, Rattus norvegicus
gacagtcatccctaaattctatctt

SEQ ID NO: 317960 - DNA, 25 bp, Rattus norvegicus
gacagtcatcgtccagacagccaca

SEQ ID NO: 317961 - DNA, 25 bp, Rattus norvegicus
gacagtcatcgtgcagacagccaca

SEQ ID NO: 317962 - DNA, 25 bp, Rattus norvegicus
gacagtcatcttacttaattctcct

SEQ ID NO: 317963 - DNA, 25 bp, Rattus norvegicus
gacagtcatctttcttaattctcct

SEQ ID NO: 317964 - DNA, 25 bp, Rattus norvegicus
gacagtcatgtcctggaaggtgccc

SEQ ID NO: 317965 - DNA, 25 bp, Rattus norvegicus
gacagtcatgtcgtggaaggtgccc

SEQ ID NO: 317966 - DNA, 25 bp, Rattus norvegicus
gacagtcatttactctctcggatga

SEQ ID NO: 317967 - DNA, 25 bp, Rattus norvegicus
gacagtcatttagtctctcggatga

SEQ ID NO: 317968 - DNA, 25 bp, Rattus norvegicus
gacagtccacagaactaggctttcc

SEQ ID NO: 317969 - DNA, 25 bp, Rattus norvegicus
gacagtccacagtactaggctttcc

SEQ ID NO: 317970 - DNA, 25 bp, Rattus norvegicus
gacagtccagaacttgtactattat

SEQ ID NO: 317971 - DNA, 25 bp, Rattus norvegicus
gacagtccagaagttgtactattat

SEQ ID NO: 317972 - DNA, 25 bp, Rattus norvegicus
gacagtccagcaccaaccagtagat

SEQ ID NO: 317973 - DNA, 25 bp, Rattus norvegicus
gacagtccagcagcaaccagtagat

SEQ ID NO: 317974 - DNA, 25 bp, Rattus norvegicus
gacagtccaggtcatttgtggaatc

SEQ ID NO: 317975 - DNA, 25 bp, Rattus norvegicus
gacagtccaggtgatttgtggaatc

SEQ ID NO: 317976 - DNA, 25 bp, Rattus norvegicus
gacagtccagttaggcgagctgacc

SEQ ID NO: 317977 - DNA, 25 bp, Rattus norvegicus
gacagtccagtttggcgagctgacc

SEQ ID NO: 317978 - DNA, 25 bp, Rattus norvegicus
gacagtccattcacagccaggagat

SEQ ID NO: 317979 - DNA, 25 bp, Rattus norvegicus
gacagtccattctcagccaggagat

SEQ ID NO: 317980 - DNA, 25 bp, Rattus norvegicus
gacagtcccaggaaaataacctctg

SEQ ID NO: 317981 - DNA, 25 bp, Rattus norvegicus
gacagtcccaggtaaataacctctg

SEQ ID NO: 317982 - DNA, 25 bp, Rattus norvegicus
gacagtccccacaaaggcgcacagg

SEQ ID NO: 317983 - DNA, 25 bp, Rattus norvegicus
gacagtccccactaaggcgcacagg

SEQ ID NO: 317984 - DNA, 25 bp, Rattus norvegicus
gacagtcccctcaacggagatgttt

SEQ ID NO: 317985 - DNA, 25 bp, Rattus norvegicus
gacagtcccctctacggagatgttt

SEQ ID NO: 317986 - DNA, 25 bp, Rattus norvegicus
gacagtcctaatcgctcagctaatt

SEQ ID NO: 317987 - DNA, 25 bp, Rattus norvegicus
gacagtcctaatggctcagctaatt

SEQ ID NO: 317988 - DNA, 25 bp, Rattus norvegicus
gacagtcctgtccagaatctatgcc

SEQ ID NO: 317989 - DNA, 25 bp, Rattus norvegicus
gacagtcctgtcgagaatctatgcc

SEQ ID NO: 317990 - DNA, 25 bp, Rattus norvegicus
gacagtcgactgctgtgagtgctct

SEQ ID NO: 317991 - DNA, 25 bp, Rattus norvegicus
gacagtcgactggtgtgagtgctct

SEQ ID NO: 317992 - DNA, 25 bp, Rattus norvegicus
gacagtcgcatgcacctacaggaag

SEQ ID NO: 317993 - DNA, 25 bp, Rattus norvegicus
gacagtcgcatggacctacaggaag

SEQ ID NO: 317994 - DNA, 25 bp, Rattus norvegicus
gacagtcggcgcaccggtcttcgcg

SEQ ID NO: 317995 - DNA, 25 bp, Rattus norvegicus
gacagtcggcgctccggtcttcgcg

SEQ ID NO: 317996 - DNA, 25 bp, Rattus norvegicus
gacagtcggctaagtgacggtttca

SEQ ID NO: 317997 - DNA, 25 bp, Rattus norvegicus
gacagtcggctatgtgacggtttca

SEQ ID NO: 317998 - DNA, 25 bp, Rattus norvegicus
gacagtcggtgacctattcctgtga

SEQ ID NO: 317999 - DNA, 25 bp, Rattus norvegicus
gacagtcggtgagctattcctgtga

SEQ ID NO: 318000 - DNA, 25 bp, Rattus norvegicus
gacagtcgtgagcatatgaccacca

SEQ ID NO: 318001 - DNA, 25 bp, Rattus norvegicus
gacagtcgtgaggatatgaccacca

SEQ ID NO: 318002 - DNA, 25 bp, Rattus norvegicus
gacagtcgttccctagggcaggact

SEQ ID NO: 318003 - DNA, 25 bp, Rattus norvegicus
gacagtcgttccgtagggcaggact

SEQ ID NO: 318004 - DNA, 25 bp, Rattus norvegicus
gacagtctactaccaaaacagagtg

SEQ ID NO: 318005 - DNA, 25 bp, Rattus norvegicus
gacagtctactagcaaaacagagtg

SEQ ID NO: 318006 - DNA, 25 bp, Rattus norvegicus
gacagtctagccagcaacatttagt

SEQ ID NO: 318007 - DNA, 25 bp, Rattus norvegicus
gacagtctagcctgcaacatttagt

SEQ ID NO: 318008 - DNA, 25 bp, Rattus norvegicus
gacagtctatttcagcagtgagcac

SEQ ID NO: 318009 - DNA, 25 bp, Rattus norvegicus
gacagtctatttgagcagtgagcac

SEQ ID NO: 318010 - DNA, 25 bp, Rattus norvegicus
gacagtctcaagacttccttagtga

SEQ ID NO: 318011 - DNA, 25 bp, Rattus norvegicus
gacagtctcaagtcttccttagtga

SEQ ID NO: 318012 - DNA, 25 bp, Rattus norvegicus
gacagtctcaataagctggctctcc

SEQ ID NO: 318013 - DNA, 25 bp, Rattus norvegicus
gacagtctcaattagctggctctcc

SEQ ID NO: 318014 - DNA, 25 bp, Rattus norvegicus
gacagtctcagaagatttgctttct

SEQ ID NO: 318015 - DNA, 25 bp, Rattus norvegicus
gacagtctcagatgatttgctttct

SEQ ID NO: 318016 - DNA, 25 bp, Rattus norvegicus
gacagtctcaggaatagtggctatt

SEQ ID NO: 318017 - DNA, 25 bp, Rattus norvegicus
gacagtctcaggtatagtggctatt

SEQ ID NO: 318018 - DNA, 25 bp, Rattus norvegicus
gacagtctccatcatgcttcttaga

SEQ ID NO: 318019 - DNA, 25 bp, Rattus norvegicus
gacagtctccatgatgcttcttaga

SEQ ID NO: 318020 - DNA, 25 bp, Rattus norvegicus
gacagtctctgtaagttcattacct

SEQ ID NO: 318021 - DNA, 25 bp, Rattus norvegicus
gacagtctctgttagttcattacct

SEQ ID NO: 318022 - DNA, 25 bp, Rattus norvegicus
gacagtctgatcattatatccatgt

SEQ ID NO: 318023 - DNA, 25 bp, Rattus norvegicus
gacagtctgatctttatatccatgt

SEQ ID NO: 318024 - DNA, 25 bp, Rattus norvegicus
gacagtctgcaaagccaaaagggtc

SEQ ID NO: 318025 - DNA, 25 bp, Rattus norvegicus
gacagtctgcaatgccaaaagggtc

SEQ ID NO: 318026 - DNA, 25 bp, Rattus norvegicus
gacagtctgctaccaaacacatttt

SEQ ID NO: 318027 - DNA, 25 bp, Rattus norvegicus
gacagtctgctagcaaacacatttt

SEQ ID NO: 318028 - DNA, 25 bp, Rattus norvegicus
gacagtctgctccaagattagcccc

SEQ ID NO: 318029 - DNA, 25 bp, Rattus norvegicus
gacagtctgctcgaagattagcccc

SEQ ID NO: 318030 - DNA, 25 bp, Rattus norvegicus
gacagtctggaactttacctcccca

SEQ ID NO: 318031 - DNA, 25 bp, Rattus norvegicus
gacagtctggaagtttacctcccca

SEQ ID NO: 318032 - DNA, 25 bp, Rattus norvegicus
gacagtctggacatcagccaacagg

SEQ ID NO: 318033 - DNA, 25 bp, Rattus norvegicus
gacagtctggacttcagccaacagg

SEQ ID NO: 318034 - DNA, 25 bp, Rattus norvegicus
gacagtctggatcactcaggctgta

SEQ ID NO: 318035 - DNA, 25 bp, Rattus norvegicus
gacagtctggatgactcaggctgta

SEQ ID NO: 318036 - DNA, 25 bp, Rattus norvegicus
gacagtctggttaccggaagacatc

SEQ ID NO: 318037 - DNA, 25 bp, Rattus norvegicus
gacagtctggtttccggaagacatc

SEQ ID NO: 318038 - DNA, 25 bp, Rattus norvegicus
gacagtctgtgaagagccgaagcca

SEQ ID NO: 318039 - DNA, 25 bp, Rattus norvegicus
gacagtctgtgatgagccgaagcca

SEQ ID NO: 318040 - DNA, 25 bp, Rattus norvegicus
gacagtcttaaccttcatagttagc

SEQ ID NO: 318041 - DNA, 25 bp, Rattus norvegicus
gacagtcttaacgttcatagttagc

SEQ ID NO: 318042 - DNA, 25 bp, Rattus norvegicus
gacagtcttaccaaggacacttcac

SEQ ID NO: 318043 - DNA, 25 bp, Rattus norvegicus
gacagtcttacctaggacacttcac

SEQ ID NO: 318044 - DNA, 25 bp, Rattus norvegicus
gacagtcttcctaccatgttagggt

SEQ ID NO: 318045 - DNA, 25 bp, Rattus norvegicus
gacagtcttccttccatgttagggt

SEQ ID NO: 318046 - DNA, 25 bp, Rattus norvegicus
gacagtcttgcaatggaatcctcga

SEQ ID NO: 318047 - DNA, 25 bp, Rattus norvegicus
gacagtcttgcattggaatcctcga

SEQ ID NO: 318048 - DNA, 25 bp, Rattus norvegicus
gacagtcttgcgaataatatcccca

SEQ ID NO: 318049 - DNA, 25 bp, Rattus norvegicus
gacagtcttgcgtataatatcccca

SEQ ID NO: 318050 - DNA, 25 bp, Rattus norvegicus
gacagtcttgctacataacctggaa

SEQ ID NO: 318051 - DNA, 25 bp, Rattus norvegicus
gacagtcttgctacttgataaataa

SEQ ID NO: 318052 - DNA, 25 bp, Rattus norvegicus
gacagtcttgcttcataacctggaa

SEQ ID NO: 318053 - DNA, 25 bp, Rattus norvegicus
gacagtcttgcttcttgataaataa

SEQ ID NO: 318054 - DNA, 25 bp, Rattus norvegicus
gacagtcttggactttcggtttctt

SEQ ID NO: 318055 - DNA, 25 bp, Rattus norvegicus
gacagtcttggagtttcggtttctt

SEQ ID NO: 318056 - DNA, 25 bp, Rattus norvegicus
gacagtcttgttcatccaaagctgc

SEQ ID NO: 318057 - DNA, 25 bp, Rattus norvegicus
gacagtcttgttgatccaaagctgc

SEQ ID NO: 318058 - DNA, 25 bp, Rattus norvegicus
gacagtctttcaatgtgacatccaa

SEQ ID NO: 318059 - DNA, 25 bp, Rattus norvegicus
gacagtctttcattgtgacatccaa

SEQ ID NO: 318060 - DNA, 25 bp, Rattus norvegicus
gacagtgaaagcagctctgcctctt

SEQ ID NO: 318061 - DNA, 25 bp, Rattus norvegicus
gacagtgaaagctgctctgcctctt

SEQ ID NO: 318062 - DNA, 25 bp, Rattus norvegicus
gacagtgaacctaactcttggtcca

SEQ ID NO: 318063 - DNA, 25 bp, Rattus norvegicus
gacagtgaaccttactcttggtcca

SEQ ID NO: 318064 - DNA, 25 bp, Rattus norvegicus
gacagtgaacggaggccgcactttc

SEQ ID NO: 318065 - DNA, 25 bp, Rattus norvegicus
gacagtgaacggtggccgcactttc

SEQ ID NO: 318066 - DNA, 25 bp, Rattus norvegicus
gacagtgaagaacatcgcagaccta

SEQ ID NO: 318067 - DNA, 25 bp, Rattus norvegicus
gacagtgaagaagatcgcagaccta

SEQ ID NO: 318068 - DNA, 25 bp, Rattus norvegicus
gacagtgaagacctgtgcctacacc

SEQ ID NO: 318069 - DNA, 25 bp, Rattus norvegicus
gacagtgaagacgtgtgcctacacc

SEQ ID NO: 318070 - DNA, 25 bp, Rattus norvegicus
gacagtgaagctctggtcttctaca

SEQ ID NO: 318071 - DNA, 25 bp, Rattus norvegicus
gacagtgaagctgtggtcttctaca

SEQ ID NO: 318072 - DNA, 25 bp, Rattus norvegicus
gacagtgaagtaaagcagactctga

SEQ ID NO: 318073 - DNA, 25 bp, Rattus norvegicus
gacagtgaagtatagcagactctga

SEQ ID NO: 318074 - DNA, 25 bp, Rattus norvegicus
gacagtgaatgtcctggcgcagatt

SEQ ID NO: 318075 - DNA, 25 bp, Rattus norvegicus
gacagtgaatgtgctggcgcagatt

SEQ ID NO: 318076 - DNA, 25 bp, Rattus norvegicus
gacagtgacaaaacccttctaaccg

SEQ ID NO: 318077 - DNA, 25 bp, Rattus norvegicus
gacagtgacaaatcccttctaaccg

SEQ ID NO: 318078 - DNA, 25 bp, Rattus norvegicus
gacagtgacaccaagtcttatagta

SEQ ID NO: 318079 - DNA, 25 bp, Rattus norvegicus
gacagtgacaccacaagtctcaggg

SEQ ID NO: 318080 - DNA, 25 bp, Rattus norvegicus
gacagtgacacctagtcttatagta

SEQ ID NO: 318081 - DNA, 25 bp, Rattus norvegicus
gacagtgacacctcaagtctcaggg

SEQ ID NO: 318082 - DNA, 25 bp, Rattus norvegicus
gacagtgacagcattgttgggacag

SEQ ID NO: 318083 - DNA, 25 bp, Rattus norvegicus
gacagtgacagctttgttgggacag

SEQ ID NO: 318084 - DNA, 25 bp, Rattus norvegicus
gacagtgacaggaaccacccaaagc

SEQ ID NO: 318085 - DNA, 25 bp, Rattus norvegicus
gacagtgacaggtaccacccaaagc

SEQ ID NO: 318086 - DNA, 25 bp, Rattus norvegicus
gacagtgacattactatagtcccaa

SEQ ID NO: 318087 - DNA, 25 bp, Rattus norvegicus
gacagtgacatttctatagtcccaa

SEQ ID NO: 318088 - DNA, 25 bp, Rattus norvegicus
gacagtgaccacatctacttgtgat

SEQ ID NO: 318089 - DNA, 25 bp, Rattus norvegicus
gacagtgaccacttctacttgtgat

SEQ ID NO: 318090 - DNA, 25 bp, Rattus norvegicus
gacagtgaccttagaagctcattaa

SEQ ID NO: 318091 - DNA, 25 bp, Rattus norvegicus
gacagtgacctttgaagctcattaa

SEQ ID NO: 318092 - DNA, 25 bp, Rattus norvegicus
gacagtgactgaactctctaggttg

SEQ ID NO: 318093 - DNA, 25 bp, Rattus norvegicus
gacagtgactgatctctctaggttg

SEQ ID NO: 318094 - DNA, 25 bp, Rattus norvegicus
gacagtgactgtagacgtaggccca

SEQ ID NO: 318095 - DNA, 25 bp, Rattus norvegicus
gacagtgactgttgacgtaggccca

SEQ ID NO: 318096 - DNA, 25 bp, Rattus norvegicus
gacagtgagattccccgcctgagaa

SEQ ID NO: 318097 - DNA, 25 bp, Rattus norvegicus
gacagtgagattgcccgcctgagaa

SEQ ID NO: 318098 - DNA, 25 bp, Rattus norvegicus
gacagtgagcccagtggtcctttca

SEQ ID NO: 318099 - DNA, 25 bp, Rattus norvegicus
gacagtgagccctgtggtcctttca

SEQ ID NO: 318100 - DNA, 25 bp, Rattus norvegicus
gacagtgaggtgctctagccttcca

SEQ ID NO: 318101 - DNA, 25 bp, Rattus norvegicus
gacagtgaggtggtctagccttcca

SEQ ID NO: 318102 - DNA, 25 bp, Rattus norvegicus
gacagtgagtctcgttttcaccagg

SEQ ID NO: 318103 - DNA, 25 bp, Rattus norvegicus
gacagtgagtctggttttcaccagg

SEQ ID NO: 318104 - DNA, 25 bp, Rattus norvegicus
gacagtgagtgcacgcagcttccaa

SEQ ID NO: 318105 - DNA, 25 bp, Rattus norvegicus
gacagtgagtgctcgcagcttccaa

SEQ ID NO: 318106 - DNA, 25 bp, Rattus norvegicus
gacagtgagtgtcctaggaaacccc

SEQ ID NO: 318107 - DNA, 25 bp, Rattus norvegicus
gacagtgagtgtgctaggaaacccc

SEQ ID NO: 318108 - DNA, 25 bp, Rattus norvegicus
gacagtgagttgagatcctttcttg

SEQ ID NO: 318109 - DNA, 25 bp, Rattus norvegicus
gacagtgagttgtgatcctttcttg

SEQ ID NO: 318110 - DNA, 25 bp, Rattus norvegicus
gacagtgatcgaaaccctgttgata

SEQ ID NO: 318111 - DNA, 25 bp, Rattus norvegicus
gacagtgatcgataccctgttgata

SEQ ID NO: 318112 - DNA, 25 bp, Rattus norvegicus
gacagtgatctgaggctgcagcaga

SEQ ID NO: 318113 - DNA, 25 bp, Rattus norvegicus
gacagtgatctgtggctgcagcaga

SEQ ID NO: 318114 - DNA, 25 bp, Rattus norvegicus
gacagtgatgctctgagttttcata

SEQ ID NO: 318115 - DNA, 25 bp, Rattus norvegicus
gacagtgatgctgtgagttttcata

SEQ ID NO: 318116 - DNA, 25 bp, Rattus norvegicus
gacagtgattgtactggcaccatga

SEQ ID NO: 318117 - DNA, 25 bp, Rattus norvegicus
gacagtgattgttctggcaccatga

SEQ ID NO: 318118 - DNA, 25 bp, Rattus norvegicus
gacagtgcaaacctgaggcctacaa

SEQ ID NO: 318119 - DNA, 25 bp, Rattus norvegicus
gacagtgcaaacgtgaggcctacaa

SEQ ID NO: 318120 - DNA, 25 bp, Rattus norvegicus
gacagtgcaagactcccatttggct

SEQ ID NO: 318121 - DNA, 25 bp, Rattus norvegicus
gacagtgcaagagtcccatttggct

SEQ ID NO: 318122 - DNA, 25 bp, Rattus norvegicus
gacagtgcacatcctttaaatctaa

SEQ ID NO: 318123 - DNA, 25 bp, Rattus norvegicus
gacagtgcacatgctttaaatctaa

SEQ ID NO: 318124 - DNA, 25 bp, Rattus norvegicus
gacagtgcagtaagccccaggtcag

SEQ ID NO: 318125 - DNA, 25 bp, Rattus norvegicus
gacagtgcagtatgccccaggtcag

SEQ ID NO: 318126 - DNA, 25 bp, Rattus norvegicus
gacagtgcatcacaacccagacaga

SEQ ID NO: 318127 - DNA, 25 bp, Rattus norvegicus
gacagtgcatcagaacccagacaga

SEQ ID NO: 318128 - DNA, 25 bp, Rattus norvegicus
gacagtgcatgcatattacatcaac

SEQ ID NO: 318129 - DNA, 25 bp, Rattus norvegicus
gacagtgcatgcttattacatcaac

SEQ ID NO: 318130 - DNA, 25 bp, Rattus norvegicus
gacagtgcatttatctacccattgt

SEQ ID NO: 318131 - DNA, 25 bp, Rattus norvegicus
gacagtgcatttttctacccattgt

SEQ ID NO: 318132 - DNA, 25 bp, Rattus norvegicus
gacagtgccaataatgatatcctta

SEQ ID NO: 318133 - DNA, 25 bp, Rattus norvegicus
gacagtgccaatcaccgggtgccat

SEQ ID NO: 318134 - DNA, 25 bp, Rattus norvegicus
gacagtgccaatgaccgggtgccat

SEQ ID NO: 318135 - DNA, 25 bp, Rattus norvegicus
gacagtgccaattatgatatcctta

SEQ ID NO: 318136 - DNA, 25 bp, Rattus norvegicus
gacagtgccactcacacagctgtgt

SEQ ID NO: 318137 - DNA, 25 bp, Rattus norvegicus
gacagtgccactgacacagctgtgt

SEQ ID NO: 318138 - DNA, 25 bp, Rattus norvegicus
gacagtgccaggaccgcatccgcta

SEQ ID NO: 318139 - DNA, 25 bp, Rattus norvegicus
gacagtgccaggtccgcatccgcta

SEQ ID NO: 318140 - DNA, 25 bp, Rattus norvegicus
gacagtgcccagattgagatctaca

SEQ ID NO: 318141 - DNA, 25 bp, Rattus norvegicus
gacagtgcccagtttgagatctaca

SEQ ID NO: 318142 - DNA, 25 bp, Rattus norvegicus
gacagtgcctcgctacagcagagaa

SEQ ID NO: 318143 - DNA, 25 bp, Rattus norvegicus
gacagtgcctcggtacagcagagaa

SEQ ID NO: 318144 - DNA, 25 bp, Rattus norvegicus
gacagtgcctgtaaacatctctact

SEQ ID NO: 318145 - DNA, 25 bp, Rattus norvegicus
gacagtgcctgtacttcaaggtttg

SEQ ID NO: 318146 - DNA, 25 bp, Rattus norvegicus
gacagtgcctgttaacatctctact

SEQ ID NO: 318147 - DNA, 25 bp, Rattus norvegicus
gacagtgcctgttcttcaaggtttg

SEQ ID NO: 318148 - DNA, 25 bp, Rattus norvegicus
gacagtgccttcactatggagtcat

SEQ ID NO: 318149 - DNA, 25 bp, Rattus norvegicus
gacagtgccttctctatggagtcat

SEQ ID NO: 318150 - DNA, 25 bp, Rattus norvegicus
gacagtgcgtacctgcttgttcctt

SEQ ID NO: 318151 - DNA, 25 bp, Rattus norvegicus
gacagtgcgtacgtgcttgttcctt

SEQ ID NO: 318152 - DNA, 25 bp, Rattus norvegicus
gacagtgcgtcaatgtaacccacat

SEQ ID NO: 318153 - DNA, 25 bp, Rattus norvegicus
gacagtgcgtcacatccatggaact

SEQ ID NO: 318154 - DNA, 25 bp, Rattus norvegicus
gacagtgcgtcagatccatggaact

SEQ ID NO: 318155 - DNA, 25 bp, Rattus norvegicus
gacagtgcgtcattgtaacccacat

SEQ ID NO: 318156 - DNA, 25 bp, Rattus norvegicus
gacagtgcgtccactgtactgagca

SEQ ID NO: 318157 - DNA, 25 bp, Rattus norvegicus
gacagtgcgtcctctgtactgagca

SEQ ID NO: 318158 - DNA, 25 bp, Rattus norvegicus
gacagtgctaaaccagttgcgctac

SEQ ID NO: 318159 - DNA, 25 bp, Rattus norvegicus
gacagtgctaaagcagttgcgctac

SEQ ID NO: 318160 - DNA, 25 bp, Rattus norvegicus
gacagtgctaatctgagaccctgat

SEQ ID NO: 318161 - DNA, 25 bp, Rattus norvegicus
gacagtgctaatgtgagaccctgat

SEQ ID NO: 318162 - DNA, 25 bp, Rattus norvegicus
gacagtgctattaaaccctctcata

SEQ ID NO: 318163 - DNA, 25 bp, Rattus norvegicus
gacagtgctatttaaccctctcata

SEQ ID NO: 318164 - DNA, 25 bp, Rattus norvegicus
gacagtgctctgaaatggaccttac

SEQ ID NO: 318165 - DNA, 25 bp, Rattus norvegicus
gacagtgctctgtaatggaccttac

SEQ ID NO: 318166 - DNA, 25 bp, Rattus norvegicus
gacagtgctgatcacctgttcttct

SEQ ID NO: 318167 - DNA, 25 bp, Rattus norvegicus
gacagtgctgatgacctgttcttct

SEQ ID NO: 318168 - DNA, 25 bp, Rattus norvegicus
gacagtgctgtgaggctcgtccata

SEQ ID NO: 318169 - DNA, 25 bp, Rattus norvegicus
gacagtgctgtgtggctcgtccata

SEQ ID NO: 318170 - DNA, 25 bp, Rattus norvegicus
gacagtgctgttagtgtctgatttc

SEQ ID NO: 318171 - DNA, 25 bp, Rattus norvegicus
gacagtgctgttattcctttaaaat

SEQ ID NO: 318172 - DNA, 25 bp, Rattus norvegicus
gacagtgctgttcggatagttcatc

SEQ ID NO: 318173 - DNA, 25 bp, Rattus norvegicus
gacagtgctgttgggatagttcatc

SEQ ID NO: 318174 - DNA, 25 bp, Rattus norvegicus
gacagtgctgtttgtgtctgatttc

SEQ ID NO: 318175 - DNA, 25 bp, Rattus norvegicus
gacagtgctgtttttcctttaaaat

SEQ ID NO: 318176 - DNA, 25 bp, Rattus norvegicus
gacagtgcttaaaacacccgccaat

SEQ ID NO: 318177 - DNA, 25 bp, Rattus norvegicus
gacagtgcttaatacacccgccaat

SEQ ID NO: 318178 - DNA, 25 bp, Rattus norvegicus
gacagtggacaccaaagctgcagta

SEQ ID NO: 318179 - DNA, 25 bp, Rattus norvegicus
gacagtggacacgaaagctgcagta

SEQ ID NO: 318180 - DNA, 25 bp, Rattus norvegicus
gacagtggaccaagcggtacgccac

SEQ ID NO: 318181 - DNA, 25 bp, Rattus norvegicus
gacagtggaccatgcggtacgccac

SEQ ID NO: 318182 - DNA, 25 bp, Rattus norvegicus
gacagtggacttatcttacaaatgc

SEQ ID NO: 318183 - DNA, 25 bp, Rattus norvegicus
gacagtggacttttcttacaaatgc

SEQ ID NO: 318184 - DNA, 25 bp, Rattus norvegicus
gacagtggatttactgtggcgccac

SEQ ID NO: 318185 - DNA, 25 bp, Rattus norvegicus
gacagtggattttctgtggcgccac

SEQ ID NO: 318186 - DNA, 25 bp, Rattus norvegicus
gacagtggcagaagcagtattagca

SEQ ID NO: 318187 - DNA, 25 bp, Rattus norvegicus
gacagtggcagatgcagtattagca

SEQ ID NO: 318188 - DNA, 25 bp, Rattus norvegicus
gacagtggctcacggtgactttctt

SEQ ID NO: 318189 - DNA, 25 bp, Rattus norvegicus
gacagtggctcagggtgactttctt

SEQ ID NO: 318190 - DNA, 25 bp, Rattus norvegicus
gacagtggctcccagacaagctcag

SEQ ID NO: 318191 - DNA, 25 bp, Rattus norvegicus
gacagtggctccgagacaagctcag

SEQ ID NO: 318192 - DNA, 25 bp, Rattus norvegicus
gacagtggctgcaatcagactggaa

SEQ ID NO: 318193 - DNA, 25 bp, Rattus norvegicus
gacagtggctgctatcagactggaa

SEQ ID NO: 318194 - DNA, 25 bp, Rattus norvegicus
gacagtggctggaaatcggttccta

SEQ ID NO: 318195 - DNA, 25 bp, Rattus norvegicus
gacagtggctggtaatcggttccta

SEQ ID NO: 318196 - DNA, 25 bp, Rattus norvegicus
gacagtgggaagaccttcctttcct

SEQ ID NO: 318197 - DNA, 25 bp, Rattus norvegicus
gacagtgggaagtccttcctttcct

SEQ ID NO: 318198 - DNA, 25 bp, Rattus norvegicus
gacagtgggaatcctgacttccttc

SEQ ID NO: 318199 - DNA, 25 bp, Rattus norvegicus
gacagtgggaatgctgacttccttc

SEQ ID NO: 318200 - DNA, 25 bp, Rattus norvegicus
gacagtgggcagcacatctttcttg

SEQ ID NO: 318201 - DNA, 25 bp, Rattus norvegicus
gacagtgggcaggacatctttcttg

SEQ ID NO: 318202 - DNA, 25 bp, Rattus norvegicus
gacagtgggtagagctcgcctcgca

SEQ ID NO: 318203 - DNA, 25 bp, Rattus norvegicus
gacagtgggtagcacttccttttac

SEQ ID NO: 318204 - DNA, 25 bp, Rattus norvegicus
gacagtgggtaggacttccttttac

SEQ ID NO: 318205 - DNA, 25 bp, Rattus norvegicus
gacagtgggtagtgctcgcctcgca

SEQ ID NO: 318206 - DNA, 25 bp, Rattus norvegicus
gacagtggtacccaggacggtaact

SEQ ID NO: 318207 - DNA, 25 bp, Rattus norvegicus
gacagtggtaccgaggacggtaact

SEQ ID NO: 318208 - DNA, 25 bp, Rattus norvegicus
gacagtggtcttatttcggtggtat

SEQ ID NO: 318209 - DNA, 25 bp, Rattus norvegicus
gacagtggtcttttttcggtggtat

SEQ ID NO: 318210 - DNA, 25 bp, Rattus norvegicus
gacagtggtgggaagagccctcccc

SEQ ID NO: 318211 - DNA, 25 bp, Rattus norvegicus
gacagtggtgggtagagccctcccc

SEQ ID NO: 318212 - DNA, 25 bp, Rattus norvegicus
gacagtggttctcaagcctttgggc

SEQ ID NO: 318213 - DNA, 25 bp, Rattus norvegicus
gacagtggttctgaagcctttgggc

SEQ ID NO: 318214 - DNA, 25 bp, Rattus norvegicus
gacagtggttggctgccaccaacta

SEQ ID NO: 318215 - DNA, 25 bp, Rattus norvegicus
gacagtggttgggtgccaccaacta

SEQ ID NO: 318216 - DNA, 25 bp, Rattus norvegicus
gacagtgtacagcaatggttcccag

SEQ ID NO: 318217 - DNA, 25 bp, Rattus norvegicus
gacagtgtacaggaatggttcccag

SEQ ID NO: 318218 - DNA, 25 bp, Rattus norvegicus
gacagtgtactgatgttcttgcatt

SEQ ID NO: 318219 - DNA, 25 bp, Rattus norvegicus
gacagtgtactgttgttcttgcatt

SEQ ID NO: 318220 - DNA, 25 bp, Rattus norvegicus
gacagtgtagctcttctctgtgtcc

SEQ ID NO: 318221 - DNA, 25 bp, Rattus norvegicus
gacagtgtagctgttctctgtgtcc

SEQ ID NO: 318222 - DNA, 25 bp, Rattus norvegicus
gacagtgtaggcactgaggatcttt

SEQ ID NO: 318223 - DNA, 25 bp, Rattus norvegicus
gacagtgtaggctctgaggatcttt

SEQ ID NO: 318224 - DNA, 25 bp, Rattus norvegicus
gacagtgtatgtctgagcctctgcc

SEQ ID NO: 318225 - DNA, 25 bp, Rattus norvegicus
gacagtgtatgtgtgagcctctgcc

SEQ ID NO: 318226 - DNA, 25 bp, Rattus norvegicus
gacagtgtcactagtgggctggcaa

SEQ ID NO: 318227 - DNA, 25 bp, Rattus norvegicus
gacagtgtcacttgtgggctggcaa

SEQ ID NO: 318228 - DNA, 25 bp, Rattus norvegicus
gacagtgtcatacaaaagtcagtat

SEQ ID NO: 318229 - DNA, 25 bp, Rattus norvegicus
gacagtgtcatagaaaagtcagtat

SEQ ID NO: 318230 - DNA, 25 bp, Rattus norvegicus
gacagtgtcatgcaatcttacttga

SEQ ID NO: 318231 - DNA, 25 bp, Rattus norvegicus
gacagtgtcatggaatcttacttga

SEQ ID NO: 318232 - DNA, 25 bp, Rattus norvegicus
gacagtgtcattcttcaatagtact

SEQ ID NO: 318233 - DNA, 25 bp, Rattus norvegicus
gacagtgtcattgttcaatagtact

SEQ ID NO: 318234 - DNA, 25 bp, Rattus norvegicus
gacagtgtccaactctcaggctggg

SEQ ID NO: 318235 - DNA, 25 bp, Rattus norvegicus
gacagtgtccaagtctcaggctggg

SEQ ID NO: 318236 - DNA, 25 bp, Rattus norvegicus
gacagtgtccagagtaccttgtgaa

SEQ ID NO: 318237 - DNA, 25 bp, Rattus norvegicus
gacagtgtccagtgtaccttgtgaa

SEQ ID NO: 318238 - DNA, 25 bp, Rattus norvegicus
gacagtgtccgtatgttcagtgtga

SEQ ID NO: 318239 - DNA, 25 bp, Rattus norvegicus
gacagtgtccgtttgttcagtgtga

SEQ ID NO: 318240 - DNA, 25 bp, Rattus norvegicus
gacagtgtcctccacattattagat

SEQ ID NO: 318241 - DNA, 25 bp, Rattus norvegicus
gacagtgtcctcgacattattagat

SEQ ID NO: 318242 - DNA, 25 bp, Rattus norvegicus
gacagtgtcctgaaagaggcaatca

SEQ ID NO: 318243 - DNA, 25 bp, Rattus norvegicus
gacagtgtcctgtaagaggcaatca

SEQ ID NO: 318244 - DNA, 25 bp, Rattus norvegicus
gacagtgtcgtaagcacacgggaat

SEQ ID NO: 318245 - DNA, 25 bp, Rattus norvegicus
gacagtgtcgtatgcacacgggaat

SEQ ID NO: 318246 - DNA, 25 bp, Rattus norvegicus
gacagtgtctctattggcagcttct

SEQ ID NO: 318247 - DNA, 25 bp, Rattus norvegicus
gacagtgtctcttttggcagcttct

SEQ ID NO: 318248 - DNA, 25 bp, Rattus norvegicus
gacagtgtctgtataagtggaatga

SEQ ID NO: 318249 - DNA, 25 bp, Rattus norvegicus
gacagtgtctgtttaagtggaatga

SEQ ID NO: 318250 - DNA, 25 bp, Rattus norvegicus
gacagtgtcttcaagtgactgcagt

SEQ ID NO: 318251 - DNA, 25 bp, Rattus norvegicus
gacagtgtcttcctccagtgtagaa

SEQ ID NO: 318252 - DNA, 25 bp, Rattus norvegicus
gacagtgtcttcgtccagtgtagaa

SEQ ID NO: 318253 - DNA, 25 bp, Rattus norvegicus
gacagtgtcttctagtgactgcagt

SEQ ID NO: 318254 - DNA, 25 bp, Rattus norvegicus
gacagtgtgaccatctccttataga

SEQ ID NO: 318255 - DNA, 25 bp, Rattus norvegicus
gacagtgtgaccttctccttataga

SEQ ID NO: 318256 - DNA, 25 bp, Rattus norvegicus
gacagtgtgcagactctaccatggt

SEQ ID NO: 318257 - DNA, 25 bp, Rattus norvegicus
gacagtgtgcagtctctaccatggt

SEQ ID NO: 318258 - DNA, 25 bp, Rattus norvegicus
gacagtgtgccaaagcgactcgctg

SEQ ID NO: 318259 - DNA, 25 bp, Rattus norvegicus
gacagtgtgccatagcgactcgctg

SEQ ID NO: 318260 - DNA, 25 bp, Rattus norvegicus
gacagtgtgccccaagagtgactcg

SEQ ID NO: 318261 - DNA, 25 bp, Rattus norvegicus
gacagtgtgcccgaagagtgactcg

SEQ ID NO: 318262 - DNA, 25 bp, Rattus norvegicus
gacagtgtgcctactttgatttgca

SEQ ID NO: 318263 - DNA, 25 bp, Rattus norvegicus
gacagtgtgccttctttgatttgca

SEQ ID NO: 318264 - DNA, 25 bp, Rattus norvegicus
gacagtgtgctgatcatgggctcag

SEQ ID NO: 318265 - DNA, 25 bp, Rattus norvegicus
gacagtgtgctgttcatgggctcag

SEQ ID NO: 318266 - DNA, 25 bp, Rattus norvegicus
gacagtgtgttgatgcaagcagttt

SEQ ID NO: 318267 - DNA, 25 bp, Rattus norvegicus
gacagtgtgttgttgcaagcagttt

SEQ ID NO: 318268 - DNA, 25 bp, Rattus norvegicus
gacagtgttcagagcttcgtgtaca

SEQ ID NO: 318269 - DNA, 25 bp, Rattus norvegicus
gacagtgttcagtgcttcgtgtaca

SEQ ID NO: 318270 - DNA, 25 bp, Rattus norvegicus
gacagtgttctcatctcaaagcaaa

SEQ ID NO: 318271 - DNA, 25 bp, Rattus norvegicus
gacagtgttctcttctcaaagcaaa

SEQ ID NO: 318272 - DNA, 25 bp, Rattus norvegicus
gacagtgttgacagcacagcctagt

SEQ ID NO: 318273 - DNA, 25 bp, Rattus norvegicus
gacagtgttgactgcacagcctagt

SEQ ID NO: 318274 - DNA, 25 bp, Rattus norvegicus
gacagtgttgccagtggtgcagcca

SEQ ID NO: 318275 - DNA, 25 bp, Rattus norvegicus
gacagtgttgcctgtggtgcagcca

SEQ ID NO: 318276 - DNA, 25 bp, Rattus norvegicus
gacagtgtttggcactaccacgggt

SEQ ID NO: 318277 - DNA, 25 bp, Rattus norvegicus
gacagtgtttgggactaccacgggt

SEQ ID NO: 318278 - DNA, 25 bp, Rattus norvegicus
gacagtgtttgtagacctttgttat

SEQ ID NO: 318279 - DNA, 25 bp, Rattus norvegicus
gacagtgtttgtcattggtagctca

SEQ ID NO: 318280 - DNA, 25 bp, Rattus norvegicus
gacagtgtttgtgattggtagctca

SEQ ID NO: 318281 - DNA, 25 bp, Rattus norvegicus
gacagtgtttgttgacctttgttat

SEQ ID NO: 318282 - DNA, 25 bp, Rattus norvegicus
gacagtgttttgaagtccaagcaga

SEQ ID NO: 318283 - DNA, 25 bp, Rattus norvegicus
gacagtgttttgtagtccaagcaga

SEQ ID NO: 318284 - DNA, 25 bp, Rattus norvegicus
gacagttaaaccagcacaattcatt

SEQ ID NO: 318285 - DNA, 25 bp, Rattus norvegicus
gacagttaaacctgcacaattcatt

SEQ ID NO: 318286 - DNA, 25 bp, Rattus norvegicus
gacagttaacacatgcaccggtatt

SEQ ID NO: 318287 - DNA, 25 bp, Rattus norvegicus
gacagttaacacttgcaccggtatt

SEQ ID NO: 318288 - DNA, 25 bp, Rattus norvegicus
gacagttaactgatcccttaaatag

SEQ ID NO: 318289 - DNA, 25 bp, Rattus norvegicus
gacagttaactgttcccttaaatag

SEQ ID NO: 318290 - DNA, 25 bp, Rattus norvegicus
gacagttacaatctgcagccagaca

SEQ ID NO: 318291 - DNA, 25 bp, Rattus norvegicus
gacagttacaatgtgcagccagaca

SEQ ID NO: 318292 - DNA, 25 bp, Rattus norvegicus
gacagttacagcatcatctcagtgg

SEQ ID NO: 318293 - DNA, 25 bp, Rattus norvegicus
gacagttacagcttcatctcagtgg

SEQ ID NO: 318294 - DNA, 25 bp, Rattus norvegicus
gacagttaccaaaatgcacactttg

SEQ ID NO: 318295 - DNA, 25 bp, Rattus norvegicus
gacagttaccaatatgcacactttg

SEQ ID NO: 318296 - DNA, 25 bp, Rattus norvegicus
gacagttaccacctgtaaatgttta

SEQ ID NO: 318297 - DNA, 25 bp, Rattus norvegicus
gacagttaccacgtgtaaatgttta

SEQ ID NO: 318298 - DNA, 25 bp, Rattus norvegicus
gacagttaccttatcaaatttgcac

SEQ ID NO: 318299 - DNA, 25 bp, Rattus norvegicus
gacagttaccttttcaaatttgcac

SEQ ID NO: 318300 - DNA, 25 bp, Rattus norvegicus
gacagttagcatataccaacatgga

SEQ ID NO: 318301 - DNA, 25 bp, Rattus norvegicus
gacagttagcatttaccaacatgga

SEQ ID NO: 318302 - DNA, 25 bp, Rattus norvegicus
gacagttataatctaaccaatttta

SEQ ID NO: 318303 - DNA, 25 bp, Rattus norvegicus
gacagttataatgtaaccaatttta

SEQ ID NO: 318304 - DNA, 25 bp, Rattus norvegicus
gacagttatattatccagtcatgaa

SEQ ID NO: 318305 - DNA, 25 bp, Rattus norvegicus
gacagttatattttccagtcatgaa

SEQ ID NO: 318306 - DNA, 25 bp, Rattus norvegicus
gacagttattctaagtcttctcccc

SEQ ID NO: 318307 - DNA, 25 bp, Rattus norvegicus
gacagttattctacatctaagtctg

SEQ ID NO: 318308 - DNA, 25 bp, Rattus norvegicus
gacagttattctatttctaagcaga

SEQ ID NO: 318309 - DNA, 25 bp, Rattus norvegicus
gacagttattcttagtcttctcccc

SEQ ID NO: 318310 - DNA, 25 bp, Rattus norvegicus
gacagttattcttcatctaagtctg

SEQ ID NO: 318311 - DNA, 25 bp, Rattus norvegicus
gacagttattctttttctaagcaga

SEQ ID NO: 318312 - DNA, 25 bp, Rattus norvegicus
gacagttattgacttgactacttaa

SEQ ID NO: 318313 - DNA, 25 bp, Rattus norvegicus
gacagttattgagttgactacttaa

SEQ ID NO: 318314 - DNA, 25 bp, Rattus norvegicus
gacagttcaaatcttgaatcacaag

SEQ ID NO: 318315 - DNA, 25 bp, Rattus norvegicus
gacagttcaaatgttgaatcacaag

SEQ ID NO: 318316 - DNA, 25 bp, Rattus norvegicus
gacagttcagataacatgagaccct

SEQ ID NO: 318317 - DNA, 25 bp, Rattus norvegicus
gacagttcagattacatgagaccct

SEQ ID NO: 318318 - DNA, 25 bp, Rattus norvegicus
gacagttcagggagaccatggtgat

SEQ ID NO: 318319 - DNA, 25 bp, Rattus norvegicus
gacagttcagggtgaccatggtgat

SEQ ID NO: 318320 - DNA, 25 bp, Rattus norvegicus
gacagttcatcccaattgcattatg

SEQ ID NO: 318321 - DNA, 25 bp, Rattus norvegicus
gacagttcatccgaattgcattatg

SEQ ID NO: 318322 - DNA, 25 bp, Rattus norvegicus
gacagttcatgtctggatggtgact

SEQ ID NO: 318323 - DNA, 25 bp, Rattus norvegicus
gacagttcatgtgtggatggtgact

SEQ ID NO: 318324 - DNA, 25 bp, Rattus norvegicus
gacagttcattcagggattgctcac

SEQ ID NO: 318325 - DNA, 25 bp, Rattus norvegicus
gacagttcattctgggattgctcac

SEQ ID NO: 318326 - DNA, 25 bp, Rattus norvegicus
gacagttcccaaaacccaggtcagg

SEQ ID NO: 318327 - DNA, 25 bp, Rattus norvegicus
gacagttcccaatacccaggtcagg

SEQ ID NO: 318328 - DNA, 25 bp, Rattus norvegicus
gacagttccccaatgggtgcataaa

SEQ ID NO: 318329 - DNA, 25 bp, Rattus norvegicus
gacagttccccattgggtgcataaa

SEQ ID NO: 318330 - DNA, 25 bp, Rattus norvegicus
gacagttcccttctgtgtctaaatt

SEQ ID NO: 318331 - DNA, 25 bp, Rattus norvegicus
gacagttcccttgtgtgtctaaatt

SEQ ID NO: 318332 - DNA, 25 bp, Rattus norvegicus
gacagttcctggattatgcgggcgc

SEQ ID NO: 318333 - DNA, 25 bp, Rattus norvegicus
gacagttcctggtttatgcgggcgc

SEQ ID NO: 318334 - DNA, 25 bp, Rattus norvegicus
gacagttcctttattcagtttcaag

SEQ ID NO: 318335 - DNA, 25 bp, Rattus norvegicus
gacagttccttttttcagtttcaag

SEQ ID NO: 318336 - DNA, 25 bp, Rattus norvegicus
gacagttcggaacactactcagtgt

SEQ ID NO: 318337 - DNA, 25 bp, Rattus norvegicus
gacagttcggaagactactcagtgt

SEQ ID NO: 318338 - DNA, 25 bp, Rattus norvegicus
gacagttcgggaccatcagtgagca

SEQ ID NO: 318339 - DNA, 25 bp, Rattus norvegicus
gacagttcgggagcatcagtgagca

SEQ ID NO: 318340 - DNA, 25 bp, Rattus norvegicus
gacagttctattaagtgacggcagt

SEQ ID NO: 318341 - DNA, 25 bp, Rattus norvegicus
gacagttctatttagtgacggcagt

SEQ ID NO: 318342 - DNA, 25 bp, Rattus norvegicus
gacagttctcctatggcggtaacct

SEQ ID NO: 318343 - DNA, 25 bp, Rattus norvegicus
gacagttctcctttggcggtaacct

SEQ ID NO: 318344 - DNA, 25 bp, Rattus norvegicus
gacagttctgacacggctttgtatc

SEQ ID NO: 318345 - DNA, 25 bp, Rattus norvegicus
gacagttctgactcggctttgtatc

SEQ ID NO: 318346 - DNA, 25 bp, Rattus norvegicus
gacagttctggaaatcactctgata

SEQ ID NO: 318347 - DNA, 25 bp, Rattus norvegicus
gacagttctggatatcactctgata

SEQ ID NO: 318348 - DNA, 25 bp, Rattus norvegicus
gacagttctggcaagcaggcatgaa

SEQ ID NO: 318349 - DNA, 25 bp, Rattus norvegicus
gacagttctggctagcaggcatgaa

SEQ ID NO: 318350 - DNA, 25 bp, Rattus norvegicus
gacagttctgtgactcgggcatgta

SEQ ID NO: 318351 - DNA, 25 bp, Rattus norvegicus
gacagttctgtgtctcgggcatgta

SEQ ID NO: 318352 - DNA, 25 bp, Rattus norvegicus
gacagttcttagatcatacactcag

SEQ ID NO: 318353 - DNA, 25 bp, Rattus norvegicus
gacagttcttagttcatacactcag

SEQ ID NO: 318354 - DNA, 25 bp, Rattus norvegicus
gacagttgagaaacatgctccccat

SEQ ID NO: 318355 - DNA, 25 bp, Rattus norvegicus
gacagttgagaatcatgctccccat

SEQ ID NO: 318356 - DNA, 25 bp, Rattus norvegicus
gacagttgcccaaacagaggtcaag

SEQ ID NO: 318357 - DNA, 25 bp, Rattus norvegicus
gacagttgcccatacagaggtcaag

SEQ ID NO: 318358 - DNA, 25 bp, Rattus norvegicus
gacagttgctgtatcctggacacta

SEQ ID NO: 318359 - DNA, 25 bp, Rattus norvegicus
gacagttgctgtttcctggacacta

SEQ ID NO: 318360 - DNA, 25 bp, Rattus norvegicus
gacagttgggagattcttccgtggc

SEQ ID NO: 318361 - DNA, 25 bp, Rattus norvegicus
gacagttgggagtttcttccgtggc

SEQ ID NO: 318362 - DNA, 25 bp, Rattus norvegicus
gacagttggtcacatgggtaccatt

SEQ ID NO: 318363 - DNA, 25 bp, Rattus norvegicus
gacagttggtcagatgggtaccatt

SEQ ID NO: 318364 - DNA, 25 bp, Rattus norvegicus
gacagttggttcaagcagctctgca

SEQ ID NO: 318365 - DNA, 25 bp, Rattus norvegicus
gacagttggttctagcagctctgca

SEQ ID NO: 318366 - DNA, 25 bp, Rattus norvegicus
gacagttgtaaacgtctctctctga

SEQ ID NO: 318367 - DNA, 25 bp, Rattus norvegicus
gacagttgtaaaggtctctctctga

SEQ ID NO: 318368 - DNA, 25 bp, Rattus norvegicus
gacagttgtctcattctcagatact

SEQ ID NO: 318369 - DNA, 25 bp, Rattus norvegicus
gacagttgtctctttctcagatact

SEQ ID NO: 318370 - DNA, 25 bp, Rattus norvegicus
gacagttgttcaactagtcagtcct

SEQ ID NO: 318371 - DNA, 25 bp, Rattus norvegicus
gacagttgttcatctagtcagtcct

SEQ ID NO: 318372 - DNA, 25 bp, Rattus norvegicus
gacagttgttttccatgattttgac

SEQ ID NO: 318373 - DNA, 25 bp, Rattus norvegicus
gacagttgttttgcatgattttgac

SEQ ID NO: 318374 - DNA, 25 bp, Rattus norvegicus
gacagtttaaatatcccctgactct

SEQ ID NO: 318375 - DNA, 25 bp, Rattus norvegicus
gacagtttaaatttcccctgactct

SEQ ID NO: 318376 - DNA, 25 bp, Rattus norvegicus
gacagtttaactcgaatcatgcttc

SEQ ID NO: 318377 - DNA, 25 bp, Rattus norvegicus
gacagtttaactggaatcatgcttc

SEQ ID NO: 318378 - DNA, 25 bp, Rattus norvegicus
gacagtttatcaaccagactgggag

SEQ ID NO: 318379 - DNA, 25 bp, Rattus norvegicus
gacagtttatcatccagactgggag

SEQ ID NO: 318380 - DNA, 25 bp, Rattus norvegicus
gacagtttattacagacacacaagg

SEQ ID NO: 318381 - DNA, 25 bp, Rattus norvegicus
gacagtttattagagacacacaagg

SEQ ID NO: 318382 - DNA, 25 bp, Rattus norvegicus
gacagtttcaagctgatttcttcaa

SEQ ID NO: 318383 - DNA, 25 bp, Rattus norvegicus
gacagtttcaaggtgatttcttcaa

SEQ ID NO: 318384 - DNA, 25 bp, Rattus norvegicus
gacagtttcacccatagaacgcaca

SEQ ID NO: 318385 - DNA, 25 bp, Rattus norvegicus
gacagtttcaccgatagaacgcaca

SEQ ID NO: 318386 - DNA, 25 bp, Rattus norvegicus
gacagtttcagtactaatggctctt

SEQ ID NO: 318387 - DNA, 25 bp, Rattus norvegicus
gacagtttcagttctaatggctctt

SEQ ID NO: 318388 - DNA, 25 bp, Rattus norvegicus
gacagtttcctcattatctggtagg

SEQ ID NO: 318389 - DNA, 25 bp, Rattus norvegicus
gacagtttcctctttatctggtagg

SEQ ID NO: 318390 - DNA, 25 bp, Rattus norvegicus
gacagtttcgtgaaactcccagtaa

SEQ ID NO: 318391 - DNA, 25 bp, Rattus norvegicus
gacagtttcgtgtaactcccagtaa

SEQ ID NO: 318392 - DNA, 25 bp, Rattus norvegicus
gacagtttcttcaactcagcaagtg

SEQ ID NO: 318393 - DNA, 25 bp, Rattus norvegicus
gacagtttcttctactcagcaagtg

SEQ ID NO: 318394 - DNA, 25 bp, Rattus norvegicus
gacagtttctttcatatcccatccc

SEQ ID NO: 318395 - DNA, 25 bp, Rattus norvegicus
gacagtttctttgatatcccatccc

SEQ ID NO: 318396 - DNA, 25 bp, Rattus norvegicus
gacagtttggctagtgtttcaaaat

SEQ ID NO: 318397 - DNA, 25 bp, Rattus norvegicus
gacagtttggcttgtgtttcaaaat

SEQ ID NO: 318398 - DNA, 25 bp, Rattus norvegicus
gacagtttgtaaaagcttcctagca

SEQ ID NO: 318399 - DNA, 25 bp, Rattus norvegicus
gacagtttgtaatagcttcctagca

SEQ ID NO: 318400 - DNA, 25 bp, Rattus norvegicus
gacagtttgtcacctcactggtggc

SEQ ID NO: 318401 - DNA, 25 bp, Rattus norvegicus
gacagtttgtcagctcactggtggc

SEQ ID NO: 318402 - DNA, 25 bp, Rattus norvegicus
gacagtttgtccagtgtttctacag

SEQ ID NO: 318403 - DNA, 25 bp, Rattus norvegicus
gacagtttgtcctgtgtttctacag

SEQ ID NO: 318404 - DNA, 25 bp, Rattus norvegicus
gacagtttgtgtactgcggcaagaa

SEQ ID NO: 318405 - DNA, 25 bp, Rattus norvegicus
gacagtttgtgtctctgctattaaa

SEQ ID NO: 318406 - DNA, 25 bp, Rattus norvegicus
gacagtttgtgtgtctgctattaaa

SEQ ID NO: 318407 - DNA, 25 bp, Rattus norvegicus
gacagtttgtgttctgcggcaagaa

SEQ ID NO: 318408 - DNA, 25 bp, Rattus norvegicus
gacagtttgttacaccttcaggatt

SEQ ID NO: 318409 - DNA, 25 bp, Rattus norvegicus
gacagtttgttagaccttcaggatt

SEQ ID NO: 318410 - DNA, 25 bp, Rattus norvegicus
gacagttttaaaatggccttccaca

SEQ ID NO: 318411 - DNA, 25 bp, Rattus norvegicus
gacagttttaaattggccttccaca

SEQ ID NO: 318412 - DNA, 25 bp, Rattus norvegicus
gacagttttacaccttgcattgaac

SEQ ID NO: 318413 - DNA, 25 bp, Rattus norvegicus
gacagttttacagcttgcattgaac

SEQ ID NO: 318414 - DNA, 25 bp, Rattus norvegicus
gacagttttatacaccaggagacct

SEQ ID NO: 318415 - DNA, 25 bp, Rattus norvegicus
gacagttttatagaccaggagacct

SEQ ID NO: 318416 - DNA, 25 bp, Rattus norvegicus
gacagttttccactttctgactatt

SEQ ID NO: 318417 - DNA, 25 bp, Rattus norvegicus
gacagttttccagtttctgactatt

SEQ ID NO: 318418 - DNA, 25 bp, Rattus norvegicus
gacagttttctgaagctgttaatca

SEQ ID NO: 318419 - DNA, 25 bp, Rattus norvegicus
gacagttttctgtagctgttaatca

SEQ ID NO: 318420 - DNA, 25 bp, Rattus norvegicus
gacagttttgcacaggttcttgaaa

SEQ ID NO: 318421 - DNA, 25 bp, Rattus norvegicus
gacagttttgcagaggttcttgaaa

SEQ ID NO: 318422 - DNA, 25 bp, Rattus norvegicus
gacagttttgtaacaactcaggttt

SEQ ID NO: 318423 - DNA, 25 bp, Rattus norvegicus
gacagttttgtaacattttgctaaa

SEQ ID NO: 318424 - DNA, 25 bp, Rattus norvegicus
gacagttttgtatcaactcaggttt

SEQ ID NO: 318425 - DNA, 25 bp, Rattus norvegicus
gacagttttgtatcattttgctaaa

SEQ ID NO: 318426 - DNA, 25 bp, Rattus norvegicus
gacagttttttcagtgcttttctat

SEQ ID NO: 318427 - DNA, 25 bp, Rattus norvegicus
gacagttttttctgtgcttttctat

SEQ ID NO: 318428 - DNA, 25 bp, Rattus norvegicus
gacataaaatataaggctcgggtta

SEQ ID NO: 318429 - DNA, 25 bp, Rattus norvegicus
gacataaaatattaggctcgggtta

SEQ ID NO: 318430 - DNA, 25 bp, Rattus norvegicus
gacataaacaacagtacggtggcat

SEQ ID NO: 318431 - DNA, 25 bp, Rattus norvegicus
gacataaacaactgtacggtggcat

SEQ ID NO: 318432 - DNA, 25 bp, Rattus norvegicus
gacataaacatcatcaccggagccc

SEQ ID NO: 318433 - DNA, 25 bp, Rattus norvegicus
gacataaacatcttcaccggagccc

SEQ ID NO: 318434 - DNA, 25 bp, Rattus norvegicus
gacataaacccaaccagagaccaga

SEQ ID NO: 318435 - DNA, 25 bp, Rattus norvegicus
gacataaacccatccagagaccaga

SEQ ID NO: 318436 - DNA, 25 bp, Rattus norvegicus
gacataaatgtaacctgactctctt

SEQ ID NO: 318437 - DNA, 25 bp, Rattus norvegicus
gacataaatgtatcctgactctctt

SEQ ID NO: 318438 - DNA, 25 bp, Rattus norvegicus
gacataacattccttcgatgcgtga

SEQ ID NO: 318439 - DNA, 25 bp, Rattus norvegicus
gacataacattcgttcgatgcgtga

SEQ ID NO: 318440 - DNA, 25 bp, Rattus norvegicus
gacataaccaaaccccaaactcatt

SEQ ID NO: 318441 - DNA, 25 bp, Rattus norvegicus
gacataaccaaagcccaaactcatt

SEQ ID NO: 318442 - DNA, 25 bp, Rattus norvegicus
gacataactgaaatctgaattccga

SEQ ID NO: 318443 - DNA, 25 bp, Rattus norvegicus
gacataactgaattctgaattccga

SEQ ID NO: 318444 - DNA, 25 bp, Rattus norvegicus
gacataagctttagagtgcccgtat

SEQ ID NO: 318445 - DNA, 25 bp, Rattus norvegicus
gacataagcttttgagtgcccgtat

SEQ ID NO: 318446 - DNA, 25 bp, Rattus norvegicus
gacataaggtgtcagccatggctca

SEQ ID NO: 318447 - DNA, 25 bp, Rattus norvegicus
gacataaggtgtgagccatggctca

SEQ ID NO: 318448 - DNA, 25 bp, Rattus norvegicus
gacataagtctaaagcacaggaggg

SEQ ID NO: 318449 - DNA, 25 bp, Rattus norvegicus
gacataagtctatagcacaggaggg

SEQ ID NO: 318450 - DNA, 25 bp, Rattus norvegicus
gacataagtgtgattcttcctggga

SEQ ID NO: 318451 - DNA, 25 bp, Rattus norvegicus
gacataagtgtgtttcttcctggga

SEQ ID NO: 318452 - DNA, 25 bp, Rattus norvegicus
gacataatctgtctgattgcctctt

SEQ ID NO: 318453 - DNA, 25 bp, Rattus norvegicus
gacataatctgtgtgattgcctctt

SEQ ID NO: 318454 - DNA, 25 bp, Rattus norvegicus
gacataatggctatggagggaccaa

SEQ ID NO: 318455 - DNA, 25 bp, Rattus norvegicus
gacataatggctttggagggaccaa

SEQ ID NO: 318456 - DNA, 25 bp, Rattus norvegicus
gacataatgtctcatcagccgtgat

SEQ ID NO: 318457 - DNA, 25 bp, Rattus norvegicus
gacataatgtctgatcagccgtgat

SEQ ID NO: 318458 - DNA, 25 bp, Rattus norvegicus
gacataattgctcttggaggaacta

SEQ ID NO: 318459 - DNA, 25 bp, Rattus norvegicus
gacataattgctgttggaggaacta

SEQ ID NO: 318460 - DNA, 25 bp, Rattus norvegicus
gacataatttccaattccttcaagc

SEQ ID NO: 318461 - DNA, 25 bp, Rattus norvegicus
gacataatttcctattccttcaagc

SEQ ID NO: 318462 - DNA, 25 bp, Rattus norvegicus
gacataatttgtctgcttcctgtga

SEQ ID NO: 318463 - DNA, 25 bp, Rattus norvegicus
gacataatttgtgtgcttcctgtga

SEQ ID NO: 318464 - DNA, 25 bp, Rattus norvegicus
gacatacacataaataggccatctt

SEQ ID NO: 318465 - DNA, 25 bp, Rattus norvegicus
gacatacacatactggtcagcctct

SEQ ID NO: 318466 - DNA, 25 bp, Rattus norvegicus
gacatacacatagtggtcagcctct

SEQ ID NO: 318467 - DNA, 25 bp, Rattus norvegicus
gacatacacatatataggccatctt

SEQ ID NO: 318468 - DNA, 25 bp, Rattus norvegicus
gacatacaccgcagcatgctaatgg

SEQ ID NO: 318469 - DNA, 25 bp, Rattus norvegicus
gacatacaccgctgcatgctaatgg

SEQ ID NO: 318470 - DNA, 25 bp, Rattus norvegicus
gacatacacctacatctccagataa

SEQ ID NO: 318471 - DNA, 25 bp, Rattus norvegicus
gacatacacctagatctccagataa

SEQ ID NO: 318472 - DNA, 25 bp, Rattus norvegicus
gacatacactttatgatcccagcac

SEQ ID NO: 318473 - DNA, 25 bp, Rattus norvegicus
gacatacactttttgatcccagcac

SEQ ID NO: 318474 - DNA, 25 bp, Rattus norvegicus
gacatacagttccttagcatttagt

SEQ ID NO: 318475 - DNA, 25 bp, Rattus norvegicus
gacatacagttcgttagcatttagt

SEQ ID NO: 318476 - DNA, 25 bp, Rattus norvegicus
gacatacattccaagcttttcaact

SEQ ID NO: 318477 - DNA, 25 bp, Rattus norvegicus
gacatacattcctagcttttcaact

SEQ ID NO: 318478 - DNA, 25 bp, Rattus norvegicus
gacataccaccaccttttgttttat

SEQ ID NO: 318479 - DNA, 25 bp, Rattus norvegicus
gacataccaccagcttttgttttat

SEQ ID NO: 318480 - DNA, 25 bp, Rattus norvegicus
gacataccagaactcttcgaccctg

SEQ ID NO: 318481 - DNA, 25 bp, Rattus norvegicus
gacataccagaagtcttcgaccctg

SEQ ID NO: 318482 - DNA, 25 bp, Rattus norvegicus
gacatacctatgaccttcaaaacat

SEQ ID NO: 318483 - DNA, 25 bp, Rattus norvegicus
gacatacctatgtccttcaaaacat

SEQ ID NO: 318484 - DNA, 25 bp, Rattus norvegicus
gacatacctgtcatatacctatggg

SEQ ID NO: 318485 - DNA, 25 bp, Rattus norvegicus
gacatacctgtcttatacctatggg

SEQ ID NO: 318486 - DNA, 25 bp, Rattus norvegicus
gacatacctttgatcctgggatagt

SEQ ID NO: 318487 - DNA, 25 bp, Rattus norvegicus
gacatacctttgttcctgggatagt

SEQ ID NO: 318488 - DNA, 25 bp, Rattus norvegicus
gacatacgtgagattggaattcctt

SEQ ID NO: 318489 - DNA, 25 bp, Rattus norvegicus
gacatacgtgagtttggaattcctt

SEQ ID NO: 318490 - DNA, 25 bp, Rattus norvegicus
gacatacgtgttatgaccatgtgct

SEQ ID NO: 318491 - DNA, 25 bp, Rattus norvegicus
gacatacgtgttatgtttaactgcg

SEQ ID NO: 318492 - DNA, 25 bp, Rattus norvegicus
gacatacgtgttttgaccatgtgct

SEQ ID NO: 318493 - DNA, 25 bp, Rattus norvegicus
gacatacgtgttttgtttaactgcg

SEQ ID NO: 318494 - DNA, 25 bp, Rattus norvegicus
gacatacgttgtatactggagctaa

SEQ ID NO: 318495 - DNA, 25 bp, Rattus norvegicus
gacatacgttgtttactggagctaa

SEQ ID NO: 318496 - DNA, 25 bp, Rattus norvegicus
gacatactaataatcactcaagcag

SEQ ID NO: 318497 - DNA, 25 bp, Rattus norvegicus
gacatactaatattcactcaagcag

SEQ ID NO: 318498 - DNA, 25 bp, Rattus norvegicus
gacatactacagcttccatgttttc

SEQ ID NO: 318499 - DNA, 25 bp, Rattus norvegicus
gacatactacaggttccatgttttc

SEQ ID NO: 318500 - DNA, 25 bp, Rattus norvegicus
gacatactagttctttggccatcac

SEQ ID NO: 318501 - DNA, 25 bp, Rattus norvegicus
gacatactagttgtttggccatcac

SEQ ID NO: 318502 - DNA, 25 bp, Rattus norvegicus
gacatactccccacgcaaagagaaa

SEQ ID NO: 318503 - DNA, 25 bp, Rattus norvegicus
gacatactcccctcgcaaagagaaa

SEQ ID NO: 318504 - DNA, 25 bp, Rattus norvegicus
gacatactctgtactgctcatcagt

SEQ ID NO: 318505 - DNA, 25 bp, Rattus norvegicus
gacatactctgttctgctcatcagt

SEQ ID NO: 318506 - DNA, 25 bp, Rattus norvegicus
gacatactgaaaagctccctggagg

SEQ ID NO: 318507 - DNA, 25 bp, Rattus norvegicus
gacatactgaaatgctccctggagg

SEQ ID NO: 318508 - DNA, 25 bp, Rattus norvegicus
gacatacttcctatcgtgagctatt

SEQ ID NO: 318509 - DNA, 25 bp, Rattus norvegicus
gacatacttcctttcgtgagctatt

SEQ ID NO: 318510 - DNA, 25 bp, Rattus norvegicus
gacatacttgtcagttgagagtcca

SEQ ID NO: 318511 - DNA, 25 bp, Rattus norvegicus
gacatacttgtctgttgagagtcca

SEQ ID NO: 318512 - DNA, 25 bp, Rattus norvegicus
gacatactttcgagaggaccctgac

SEQ ID NO: 318513 - DNA, 25 bp, Rattus norvegicus
gacatactttcgtgaggaccctgac

SEQ ID NO: 318514 - DNA, 25 bp, Rattus norvegicus
gacatactttggcagttcacagata

SEQ ID NO: 318515 - DNA, 25 bp, Rattus norvegicus
gacatactttgggagttcacagata

SEQ ID NO: 318516 - DNA, 25 bp, Rattus norvegicus
gacatagaaggcatttcaccatgaa

SEQ ID NO: 318517 - DNA, 25 bp, Rattus norvegicus
gacatagaaggcttttcaccatgaa

SEQ ID NO: 318518 - DNA, 25 bp, Rattus norvegicus
gacatagatagaagaccctcactcc

SEQ ID NO: 318519 - DNA, 25 bp, Rattus norvegicus
gacatagatagatgaccctcactcc

SEQ ID NO: 318520 - DNA, 25 bp, Rattus norvegicus
gacatagatccccagaaacccataa

SEQ ID NO: 318521 - DNA, 25 bp, Rattus norvegicus
gacatagatcccgagaaacccataa

SEQ ID NO: 318522 - DNA, 25 bp, Rattus norvegicus
gacatagatttaacctagttcctta

SEQ ID NO: 318523 - DNA, 25 bp, Rattus norvegicus
gacatagatttatcctagttcctta

SEQ ID NO: 318524 - DNA, 25 bp, Rattus norvegicus
gacatagcactcactagtcttctgg

SEQ ID NO: 318525 - DNA, 25 bp, Rattus norvegicus
gacatagcactctctagtcttctgg

SEQ ID NO: 318526 - DNA, 25 bp, Rattus norvegicus
gacatagctcagcatgacctgaatt

SEQ ID NO: 318527 - DNA, 25 bp, Rattus norvegicus
gacatagctcaggatgacctgaatt

SEQ ID NO: 318528 - DNA, 25 bp, Rattus norvegicus
gacatagcttgtcggccaggacctt

SEQ ID NO: 318529 - DNA, 25 bp, Rattus norvegicus
gacatagcttgtgggccaggacctt

SEQ ID NO: 318530 - DNA, 25 bp, Rattus norvegicus
gacatagctttcatggcttcctcaa

SEQ ID NO: 318531 - DNA, 25 bp, Rattus norvegicus
gacatagctttcttggcttcctcaa

SEQ ID NO: 318532 - DNA, 25 bp, Rattus norvegicus
gacataggaagaaaccagctttttt

SEQ ID NO: 318533 - DNA, 25 bp, Rattus norvegicus
gacataggaagataccagctttttt

SEQ ID NO: 318534 - DNA, 25 bp, Rattus norvegicus
gacataggaccaatctttctaagac

SEQ ID NO: 318535 - DNA, 25 bp, Rattus norvegicus
gacataggaccattctttctaagac

SEQ ID NO: 318536 - DNA, 25 bp, Rattus norvegicus
gacataggctacaagacacgcataa

SEQ ID NO: 318537 - DNA, 25 bp, Rattus norvegicus
gacataggctactagacacgcataa

SEQ ID NO: 318538 - DNA, 25 bp, Rattus norvegicus
gacataggtcctactgtcctagaga

SEQ ID NO: 318539 - DNA, 25 bp, Rattus norvegicus
gacataggtccttctgtcctagaga

SEQ ID NO: 318540 - DNA, 25 bp, Rattus norvegicus
gacatagtacaaacctctcaccaga

SEQ ID NO: 318541 - DNA, 25 bp, Rattus norvegicus
gacatagtacaatcctctcaccaga

SEQ ID NO: 318542 - DNA, 25 bp, Rattus norvegicus
gacatagtcacaactgctcatttaa

SEQ ID NO: 318543 - DNA, 25 bp, Rattus norvegicus
gacatagtcacaatccgaacaaagc

SEQ ID NO: 318544 - DNA, 25 bp, Rattus norvegicus
gacatagtcacatctgctcatttaa

SEQ ID NO: 318545 - DNA, 25 bp, Rattus norvegicus
gacatagtcacattccgaacaaagc

SEQ ID NO: 318546 - DNA, 25 bp, Rattus norvegicus
gacatagtcattatcagagccagct

SEQ ID NO: 318547 - DNA, 25 bp, Rattus norvegicus
gacatagtcattttcagagccagct

SEQ ID NO: 318548 - DNA, 25 bp, Rattus norvegicus
gacatagtccgtcaaggcagacgca

SEQ ID NO: 318549 - DNA, 25 bp, Rattus norvegicus
gacatagtccgtgaaggcagacgca

SEQ ID NO: 318550 - DNA, 25 bp, Rattus norvegicus
gacatagtgcatagccaggctggac

SEQ ID NO: 318551 - DNA, 25 bp, Rattus norvegicus
gacatagtgcattgccaggctggac

SEQ ID NO: 318552 - DNA, 25 bp, Rattus norvegicus
gacatagtgcttagtcttcagcaga

SEQ ID NO: 318553 - DNA, 25 bp, Rattus norvegicus
gacatagtgctttgtcttcagcaga

SEQ ID NO: 318554 - DNA, 25 bp, Rattus norvegicus
gacatagttaccctgtgggccagaa

SEQ ID NO: 318555 - DNA, 25 bp, Rattus norvegicus
gacatagttaccgtgtgggccagaa

SEQ ID NO: 318556 - DNA, 25 bp, Rattus norvegicus
gacatagttcatcatctccagggaa

SEQ ID NO: 318557 - DNA, 25 bp, Rattus norvegicus
gacatagttcatgatctccagggaa

SEQ ID NO: 318558 - DNA, 25 bp, Rattus norvegicus
gacatagttgtccagagctcttcct

SEQ ID NO: 318559 - DNA, 25 bp, Rattus norvegicus
gacatagttgtcgagagctcttcct

SEQ ID NO: 318560 - DNA, 25 bp, Rattus norvegicus
gacatagtttgtacctgcattttta

SEQ ID NO: 318561 - DNA, 25 bp, Rattus norvegicus
gacatagtttgttcctgcattttta

SEQ ID NO: 318562 - DNA, 25 bp, Rattus norvegicus
gacatataacctctggtccaccctt

SEQ ID NO: 318563 - DNA, 25 bp, Rattus norvegicus
gacatataacctgtggtccaccctt

SEQ ID NO: 318564 - DNA, 25 bp, Rattus norvegicus
gacatataagtgagccttagacgca

SEQ ID NO: 318565 - DNA, 25 bp, Rattus norvegicus
gacatataagtgtgccttagacgca

SEQ ID NO: 318566 - DNA, 25 bp, Rattus norvegicus
gacatataattcagaggcttctgat

SEQ ID NO: 318567 - DNA, 25 bp, Rattus norvegicus
gacatataattctgaggcttctgat

SEQ ID NO: 318568 - DNA, 25 bp, Rattus norvegicus
gacatataggtgattctaagactct

SEQ ID NO: 318569 - DNA, 25 bp, Rattus norvegicus
gacatataggtgtttctaagactct

SEQ ID NO: 318570 - DNA, 25 bp, Rattus norvegicus
gacatatagttcaaagccctgcctt

SEQ ID NO: 318571 - DNA, 25 bp, Rattus norvegicus
gacatatagttctaagccctgcctt

SEQ ID NO: 318572 - DNA, 25 bp, Rattus norvegicus
gacatatattccatttcacacccta

SEQ ID NO: 318573 - DNA, 25 bp, Rattus norvegicus
gacatatattccttttcacacccta

SEQ ID NO: 318574 - DNA, 25 bp, Rattus norvegicus
gacatatcacagcttcaagccattg

SEQ ID NO: 318575 - DNA, 25 bp, Rattus norvegicus
gacatatcacaggttcaagccattg

SEQ ID NO: 318576 - DNA, 25 bp, Rattus norvegicus
gacatatcactaccttcaatcaata

SEQ ID NO: 318577 - DNA, 25 bp, Rattus norvegicus
gacatatcactagcttcaatcaata

SEQ ID NO: 318578 - DNA, 25 bp, Rattus norvegicus
gacatatcacttaccttccagtggt

SEQ ID NO: 318579 - DNA, 25 bp, Rattus norvegicus
gacatatcactttccttccagtggt

SEQ ID NO: 318580 - DNA, 25 bp, Rattus norvegicus
gacatatcatcaccaaaacaatttt

SEQ ID NO: 318581 - DNA, 25 bp, Rattus norvegicus
gacatatcatcagcaaaacaatttt

SEQ ID NO: 318582 - DNA, 25 bp, Rattus norvegicus
gacatatccagacacgagcttgagt

SEQ ID NO: 318583 - DNA, 25 bp, Rattus norvegicus
gacatatccagagacgagcttgagt

SEQ ID NO: 318584 - DNA, 25 bp, Rattus norvegicus
gacatatccatcatctttgtacata

SEQ ID NO: 318585 - DNA, 25 bp, Rattus norvegicus
gacatatccatcttctttgtacata

SEQ ID NO: 318586 - DNA, 25 bp, Rattus norvegicus
gacatatccatgagctgaactcgtg

SEQ ID NO: 318587 - DNA, 25 bp, Rattus norvegicus
gacatatccatgtgctgaactcgtg

SEQ ID NO: 318588 - DNA, 25 bp, Rattus norvegicus
gacatatccgccagatgagaccata

SEQ ID NO: 318589 - DNA, 25 bp, Rattus norvegicus
gacatatccgcctgatgagaccata

SEQ ID NO: 318590 - DNA, 25 bp, Rattus norvegicus
gacatatctgatcgcttcttggcat

SEQ ID NO: 318591 - DNA, 25 bp, Rattus norvegicus
gacatatctgatggcttcttggcat

SEQ ID NO: 318592 - DNA, 25 bp, Rattus norvegicus
gacatatctgccattgaacacggtg

SEQ ID NO: 318593 - DNA, 25 bp, Rattus norvegicus
gacatatctgcctttgaacacggtg

SEQ ID NO: 318594 - DNA, 25 bp, Rattus norvegicus
gacatatgaagtcctctagtcaagt

SEQ ID NO: 318595 - DNA, 25 bp, Rattus norvegicus
gacatatgaagtgctctagtcaagt

SEQ ID NO: 318596 - DNA, 25 bp, Rattus norvegicus
gacatatgactgaagcagcctcact

SEQ ID NO: 318597 - DNA, 25 bp, Rattus norvegicus
gacatatgactgtagcagcctcact

SEQ ID NO: 318598 - DNA, 25 bp, Rattus norvegicus
gacatatgatgcatgaggagcacat

SEQ ID NO: 318599 - DNA, 25 bp, Rattus norvegicus
gacatatgatgcttgaggagcacat

SEQ ID NO: 318600 - DNA, 25 bp, Rattus norvegicus
gacatatgtccccaaagagtttaaa

SEQ ID NO: 318601 - DNA, 25 bp, Rattus norvegicus
gacatatgtcccgaaagagtttaaa

SEQ ID NO: 318602 - DNA, 25 bp, Rattus norvegicus
gacatatgtgaccttttcgtctcta

SEQ ID NO: 318603 - DNA, 25 bp, Rattus norvegicus
gacatatgtgacgttttcgtctcta

SEQ ID NO: 318604 - DNA, 25 bp, Rattus norvegicus
gacatattaaacatttcttgccctt

SEQ ID NO: 318605 - DNA, 25 bp, Rattus norvegicus
gacatattaaacttttcttgccctt

SEQ ID NO: 318606 - DNA, 25 bp, Rattus norvegicus
gacatattcaatcttgacagccagt

SEQ ID NO: 318607 - DNA, 25 bp, Rattus norvegicus
gacatattcaatgttgacagccagt

SEQ ID NO: 318608 - DNA, 25 bp, Rattus norvegicus
gacatattcacccatgagagcgagg

SEQ ID NO: 318609 - DNA, 25 bp, Rattus norvegicus
gacatattcaccgatgagagcgagg

SEQ ID NO: 318610 - DNA, 25 bp, Rattus norvegicus
gacatattcccgatcttctgtaacc

SEQ ID NO: 318611 - DNA, 25 bp, Rattus norvegicus
gacatattcccgttcttctgtaacc

SEQ ID NO: 318612 - DNA, 25 bp, Rattus norvegicus
gacatattctctattcagtgcgcgg

SEQ ID NO: 318613 - DNA, 25 bp, Rattus norvegicus
gacatattctcttttcagtgcgcgg

SEQ ID NO: 318614 - DNA, 25 bp, Rattus norvegicus
gacatattctgtcaatcactgccgg

SEQ ID NO: 318615 - DNA, 25 bp, Rattus norvegicus
gacatattctgtgaatcactgccgg

SEQ ID NO: 318616 - DNA, 25 bp, Rattus norvegicus
gacatattgactcttttctgtagaa

SEQ ID NO: 318617 - DNA, 25 bp, Rattus norvegicus
gacatattgactgttttctgtagaa

SEQ ID NO: 318618 - DNA, 25 bp, Rattus norvegicus
gacatattgagcatcctaggactgg

SEQ ID NO: 318619 - DNA, 25 bp, Rattus norvegicus
gacatattgagcttcctaggactgg

SEQ ID NO: 318620 - DNA, 25 bp, Rattus norvegicus
gacatatttagaaagcatacacttg

SEQ ID NO: 318621 - DNA, 25 bp, Rattus norvegicus
gacatatttagatagcatacacttg

SEQ ID NO: 318622 - DNA, 25 bp, Rattus norvegicus
gacatatttattcccccctgatgtt

SEQ ID NO: 318623 - DNA, 25 bp, Rattus norvegicus
gacatatttattgccccctgatgtt

SEQ ID NO: 318624 - DNA, 25 bp, Rattus norvegicus
gacatattttatattcagaccacaa

SEQ ID NO: 318625 - DNA, 25 bp, Rattus norvegicus
gacatattttattttcagaccacaa

SEQ ID NO: 318626 - DNA, 25 bp, Rattus norvegicus
gacatattttctatactcatacccc

SEQ ID NO: 318627 - DNA, 25 bp, Rattus norvegicus
gacatattttctttactcatacccc

SEQ ID NO: 318628 - DNA, 25 bp, Rattus norvegicus
gacatcaaaccccaacctttactgg

SEQ ID NO: 318629 - DNA, 25 bp, Rattus norvegicus
gacatcaaacccgaacctttactgg

SEQ ID NO: 318630 - DNA, 25 bp, Rattus norvegicus
gacatcaaacgtctcctcaaagttg

SEQ ID NO: 318631 - DNA, 25 bp, Rattus norvegicus
gacatcaaacgtgtcctcaaagttg

SEQ ID NO: 318632 - DNA, 25 bp, Rattus norvegicus
gacatcaacaccatccaaactagat

SEQ ID NO: 318633 - DNA, 25 bp, Rattus norvegicus
gacatcaacaccttccaaactagat

SEQ ID NO: 318634 - DNA, 25 bp, Rattus norvegicus
gacatcaacacgctcactgtgtcca

SEQ ID NO: 318635 - DNA, 25 bp, Rattus norvegicus
gacatcaacacggtcactgtgtcca

SEQ ID NO: 318636 - DNA, 25 bp, Rattus norvegicus
gacatcaacagcatcgaccagtggg

SEQ ID NO: 318637 - DNA, 25 bp, Rattus norvegicus
gacatcaacagcttcgaccagtggg

SEQ ID NO: 318638 - DNA, 25 bp, Rattus norvegicus
gacatcaaccgcaaggtcctcggag

SEQ ID NO: 318639 - DNA, 25 bp, Rattus norvegicus
gacatcaaccgctaggtcctcggag

SEQ ID NO: 318640 - DNA, 25 bp, Rattus norvegicus
gacatcaactctccagtaactgatc

SEQ ID NO: 318641 - DNA, 25 bp, Rattus norvegicus
gacatcaactctgcagtaactgatc

SEQ ID NO: 318642 - DNA, 25 bp, Rattus norvegicus
gacatcaagcccaggcagcactcag

SEQ ID NO: 318643 - DNA, 25 bp, Rattus norvegicus
gacatcaagccctggcagcactcag

SEQ ID NO: 318644 - DNA, 25 bp, Rattus norvegicus
gacatcaaggccctcctttttctgc

SEQ ID NO: 318645 - DNA, 25 bp, Rattus norvegicus
gacatcaaggccgtcctttttctgc

SEQ ID NO: 318646 - DNA, 25 bp, Rattus norvegicus
gacatcaagggaaccataggtcttc

SEQ ID NO: 318647 - DNA, 25 bp, Rattus norvegicus
gacatcaagggatccataggtcttc

SEQ ID NO: 318648 - DNA, 25 bp, Rattus norvegicus
gacatcaagttcaacccctttgaaa

SEQ ID NO: 318649 - DNA, 25 bp, Rattus norvegicus
gacatcaagttcactgagctcacct

SEQ ID NO: 318650 - DNA, 25 bp, Rattus norvegicus
gacatcaagttctacccctttgaaa

SEQ ID NO: 318651 - DNA, 25 bp, Rattus norvegicus
gacatcaagttctctgagctcacct

SEQ ID NO: 318652 - DNA, 25 bp, Rattus norvegicus
gacatcaatacaaagtgggccgcca

SEQ ID NO: 318653 - DNA, 25 bp, Rattus norvegicus
gacatcaatacatagtgggccgcca

SEQ ID NO: 318654 - DNA, 25 bp, Rattus norvegicus
gacatcaatcaaagcgtcggtctcc

SEQ ID NO: 318655 - DNA, 25 bp, Rattus norvegicus
gacatcaatcaatgcgtcggtctcc

SEQ ID NO: 318656 - DNA, 25 bp, Rattus norvegicus
gacatcaatcgtctgtcctgatttg

SEQ ID NO: 318657 - DNA, 25 bp, Rattus norvegicus
gacatcaatcgtgtgtcctgatttg

SEQ ID NO: 318658 - DNA, 25 bp, Rattus norvegicus
gacatcaatgtccttaggaaagaga

SEQ ID NO: 318659 - DNA, 25 bp, Rattus norvegicus
gacatcaatgtcgttaggaaagaga

SEQ ID NO: 318660 - DNA, 25 bp, Rattus norvegicus
gacatcaattgtcttaacggttcaa

SEQ ID NO: 318661 - DNA, 25 bp, Rattus norvegicus
gacatcaattgtgttaacggttcaa

SEQ ID NO: 318662 - DNA, 25 bp, Rattus norvegicus
gacatcacaatacctttcttcaagg

SEQ ID NO: 318663 - DNA, 25 bp, Rattus norvegicus
gacatcacaatacgacatatgcaat

SEQ ID NO: 318664 - DNA, 25 bp, Rattus norvegicus
gacatcacaatagctttcttcaagg

SEQ ID NO: 318665 - DNA, 25 bp, Rattus norvegicus
gacatcacaataggacatatgcaat

SEQ ID NO: 318666 - DNA, 25 bp, Rattus norvegicus
gacatcacacagaagttactccact

SEQ ID NO: 318667 - DNA, 25 bp, Rattus norvegicus
gacatcacacagtagttactccact

SEQ ID NO: 318668 - DNA, 25 bp, Rattus norvegicus
gacatcacacccaaaaaccagaact

SEQ ID NO: 318669 - DNA, 25 bp, Rattus norvegicus
gacatcacaccctaaaaccagaact

SEQ ID NO: 318670 - DNA, 25 bp, Rattus norvegicus
gacatcacactcatcattgcagtgg

SEQ ID NO: 318671 - DNA, 25 bp, Rattus norvegicus
gacatcacactcttcattgcagtgg

SEQ ID NO: 318672 - DNA, 25 bp, Rattus norvegicus
gacatcacagctctcagcaacagag

SEQ ID NO: 318673 - DNA, 25 bp, Rattus norvegicus
gacatcacagctgtcagcaacagag

SEQ ID NO: 318674 - DNA, 25 bp, Rattus norvegicus
gacatcacagtccagggtggctcat

SEQ ID NO: 318675 - DNA, 25 bp, Rattus norvegicus
gacatcacagtcgagggtggctcat

SEQ ID NO: 318676 - DNA, 25 bp, Rattus norvegicus
gacatcaccaaccaccgatacaagg

SEQ ID NO: 318677 - DNA, 25 bp, Rattus norvegicus
gacatcaccaacgaccgatacaagg

SEQ ID NO: 318678 - DNA, 25 bp, Rattus norvegicus
gacatcaccatcaatcagaatgtaa

SEQ ID NO: 318679 - DNA, 25 bp, Rattus norvegicus
gacatcaccatctatcagaatgtaa

SEQ ID NO: 318680 - DNA, 25 bp, Rattus norvegicus
gacatcaccgatcggtgttacatcc

SEQ ID NO: 318681 - DNA, 25 bp, Rattus norvegicus
gacatcaccgatgggtgttacatcc

SEQ ID NO: 318682 - DNA, 25 bp, Rattus norvegicus
gacatcaccgtccttcaggcttatt

SEQ ID NO: 318683 - DNA, 25 bp, Rattus norvegicus
gacatcaccgtcgttcaggcttatt

SEQ ID NO: 318684 - DNA, 25 bp, Rattus norvegicus
gacatcaccttccatactgtagttt

SEQ ID NO: 318685 - DNA, 25 bp, Rattus norvegicus
gacatcaccttcgatactgtagttt

SEQ ID NO: 318686 - DNA, 25 bp, Rattus norvegicus
gacatcacgacgcaccgggtcacat

SEQ ID NO: 318687 - DNA, 25 bp, Rattus norvegicus
gacatcacgacggaccgggtcacat

SEQ ID NO: 318688 - DNA, 25 bp, Rattus norvegicus
gacatcacggagcagccttcaagca

SEQ ID NO: 318689 - DNA, 25 bp, Rattus norvegicus
gacatcacggaggagccttcaagca

SEQ ID NO: 318690 - DNA, 25 bp, Rattus norvegicus
gacatcacggttcaggtcggtgaca

SEQ ID NO: 318691 - DNA, 25 bp, Rattus norvegicus
gacatcacggttgaggtcggtgaca

SEQ ID NO: 318692 - DNA, 25 bp, Rattus norvegicus
gacatcactctgaacaaagctaaac

SEQ ID NO: 318693 - DNA, 25 bp, Rattus norvegicus
gacatcactctgtacaaagctaaac

SEQ ID NO: 318694 - DNA, 25 bp, Rattus norvegicus
gacatcactgatccagggacaacta

SEQ ID NO: 318695 - DNA, 25 bp, Rattus norvegicus
gacatcactgatgcagggacaacta

SEQ ID NO: 318696 - DNA, 25 bp, Rattus norvegicus
gacatcactggactatctgtgtaga

SEQ ID NO: 318697 - DNA, 25 bp, Rattus norvegicus
gacatcactggagtatctgtgtaga

SEQ ID NO: 318698 - DNA, 25 bp, Rattus norvegicus
gacatcactgtgaccatgtgcctac

SEQ ID NO: 318699 - DNA, 25 bp, Rattus norvegicus
gacatcactgtgactccaggactgg

SEQ ID NO: 318700 - DNA, 25 bp, Rattus norvegicus
gacatcactgtgtccatgtgcctac

SEQ ID NO: 318701 - DNA, 25 bp, Rattus norvegicus
gacatcactgtgtctccaggactgg

SEQ ID NO: 318702 - DNA, 25 bp, Rattus norvegicus
gacatcacttctcggttgcagacat

SEQ ID NO: 318703 - DNA, 25 bp, Rattus norvegicus
gacatcacttctgggttgcagacat

SEQ ID NO: 318704 - DNA, 25 bp, Rattus norvegicus
gacatcagacatatagcttacttcg

SEQ ID NO: 318705 - DNA, 25 bp, Rattus norvegicus
gacatcagacatcgaggtgcagact

SEQ ID NO: 318706 - DNA, 25 bp, Rattus norvegicus
gacatcagacatggaggtgcagact

SEQ ID NO: 318707 - DNA, 25 bp, Rattus norvegicus
gacatcagacatttagcttacttcg

SEQ ID NO: 318708 - DNA, 25 bp, Rattus norvegicus
gacatcagactcatgagtagccaga

SEQ ID NO: 318709 - DNA, 25 bp, Rattus norvegicus
gacatcagactcctcaaaccaactg

SEQ ID NO: 318710 - DNA, 25 bp, Rattus norvegicus
gacatcagactcgtcaaaccaactg

SEQ ID NO: 318711 - DNA, 25 bp, Rattus norvegicus
gacatcagactcttgagtagccaga

SEQ ID NO: 318712 - DNA, 25 bp, Rattus norvegicus
gacatcagaggaaccagccagccca

SEQ ID NO: 318713 - DNA, 25 bp, Rattus norvegicus
gacatcagaggatccagccagccca

SEQ ID NO: 318714 - DNA, 25 bp, Rattus norvegicus
gacatcagatttacacttccactag

SEQ ID NO: 318715 - DNA, 25 bp, Rattus norvegicus
gacatcagattttcacttccactag

SEQ ID NO: 318716 - DNA, 25 bp, Rattus norvegicus
gacatcagcattacacgcagtgact

SEQ ID NO: 318717 - DNA, 25 bp, Rattus norvegicus
gacatcagcatttcacgcagtgact

SEQ ID NO: 318718 - DNA, 25 bp, Rattus norvegicus
gacatcaggagcactgcttgcaagt

SEQ ID NO: 318719 - DNA, 25 bp, Rattus norvegicus
gacatcaggagctctgcttgcaagt

SEQ ID NO: 318720 - DNA, 25 bp, Rattus norvegicus
gacatcaggattaggttcttccgga

SEQ ID NO: 318721 - DNA, 25 bp, Rattus norvegicus
gacatcaggatttggttcttccgga

SEQ ID NO: 318722 - DNA, 25 bp, Rattus norvegicus
gacatcaggcagcatctgtctagtg

SEQ ID NO: 318723 - DNA, 25 bp, Rattus norvegicus
gacatcaggcaggatctgtctagtg

SEQ ID NO: 318724 - DNA, 25 bp, Rattus norvegicus
gacatcaggcccagccgcgaggtgt

SEQ ID NO: 318725 - DNA, 25 bp, Rattus norvegicus
gacatcaggccctgccgcgaggtgt

SEQ ID NO: 318726 - DNA, 25 bp, Rattus norvegicus
gacatcaggctgcaagaatttattt

SEQ ID NO: 318727 - DNA, 25 bp, Rattus norvegicus
gacatcaggctggaagaatttattt

SEQ ID NO: 318728 - DNA, 25 bp, Rattus norvegicus
gacatcaggttcattttcgttttgt

SEQ ID NO: 318729 - DNA, 25 bp, Rattus norvegicus
gacatcaggttctttttcgttttgt

SEQ ID NO: 318730 - DNA, 25 bp, Rattus norvegicus
gacatcagtcacctttatcattgta

SEQ ID NO: 318731 - DNA, 25 bp, Rattus norvegicus
gacatcagtcacgtttatcattgta

SEQ ID NO: 318732 - DNA, 25 bp, Rattus norvegicus
gacatcagtggaccgttcagtgact

SEQ ID NO: 318733 - DNA, 25 bp, Rattus norvegicus
gacatcagtggagcgttcagtgact

SEQ ID NO: 318734 - DNA, 25 bp, Rattus norvegicus
gacatcagtgtccatgaccaaggca

SEQ ID NO: 318735 - DNA, 25 bp, Rattus norvegicus
gacatcagtgtcgatgaccaaggca

SEQ ID NO: 318736 - DNA, 25 bp, Rattus norvegicus
gacatcataaagaaccacacccgaa

SEQ ID NO: 318737 - DNA, 25 bp, Rattus norvegicus
gacatcataaagtaccacacccgaa

SEQ ID NO: 318738 - DNA, 25 bp, Rattus norvegicus
gacatcatactacaatttcccagtt

SEQ ID NO: 318739 - DNA, 25 bp, Rattus norvegicus
gacatcatactagaatttcccagtt

SEQ ID NO: 318740 - DNA, 25 bp, Rattus norvegicus
gacatcatactgaggtttcctgaaa

SEQ ID NO: 318741 - DNA, 25 bp, Rattus norvegicus
gacatcatactgtggtttcctgaaa

SEQ ID NO: 318742 - DNA, 25 bp, Rattus norvegicus
gacatcataggtcacttatctgaag

SEQ ID NO: 318743 - DNA, 25 bp, Rattus norvegicus
gacatcataggtgacttatctgaag

SEQ ID NO: 318744 - DNA, 25 bp, Rattus norvegicus
gacatcatagtcaagggcctgggct

SEQ ID NO: 318745 - DNA, 25 bp, Rattus norvegicus
gacatcatagtctagggcctgggct

SEQ ID NO: 318746 - DNA, 25 bp, Rattus norvegicus
gacatcatcacccagcgagaggact

SEQ ID NO: 318747 - DNA, 25 bp, Rattus norvegicus
gacatcatcaccgagcgagaggact

SEQ ID NO: 318748 - DNA, 25 bp, Rattus norvegicus
gacatcatcacgatcatttctcaga

SEQ ID NO: 318749 - DNA, 25 bp, Rattus norvegicus
gacatcatcacgttcatttctcaga

SEQ ID NO: 318750 - DNA, 25 bp, Rattus norvegicus
gacatcatcagtcgcatttcatcca

SEQ ID NO: 318751 - DNA, 25 bp, Rattus norvegicus
gacatcatcagtctaaggcatccgt

SEQ ID NO: 318752 - DNA, 25 bp, Rattus norvegicus
gacatcatcagtggcatttcatcca

SEQ ID NO: 318753 - DNA, 25 bp, Rattus norvegicus
gacatcatcagtgtaaggcatccgt

SEQ ID NO: 318754 - DNA, 25 bp, Rattus norvegicus
gacatcatcatccagaccttcgagg

SEQ ID NO: 318755 - DNA, 25 bp, Rattus norvegicus
gacatcatcatcgagaccttcgagg

SEQ ID NO: 318756 - DNA, 25 bp, Rattus norvegicus
gacatcatcattagtgtggcttttg

SEQ ID NO: 318757 - DNA, 25 bp, Rattus norvegicus
gacatcatcatttgtgtggcttttg

SEQ ID NO: 318758 - DNA, 25 bp, Rattus norvegicus
gacatcatccaaaaagccatgtggg

SEQ ID NO: 318759 - DNA, 25 bp, Rattus norvegicus
gacatcatccaataagccatgtggg

SEQ ID NO: 318760 - DNA, 25 bp, Rattus norvegicus
gacatcatccctactatgactacta

SEQ ID NO: 318761 - DNA, 25 bp, Rattus norvegicus
gacatcatcccttctatgactacta

SEQ ID NO: 318762 - DNA, 25 bp, Rattus norvegicus
gacatcatccggaagcaggtcctgg

SEQ ID NO: 318763 - DNA, 25 bp, Rattus norvegicus
gacatcatccggtagcaggtcctgg

SEQ ID NO: 318764 - DNA, 25 bp, Rattus norvegicus
gacatcatcctcacattgcaagcaa

SEQ ID NO: 318765 - DNA, 25 bp, Rattus norvegicus
gacatcatcctctcattgcaagcaa

SEQ ID NO: 318766 - DNA, 25 bp, Rattus norvegicus
gacatcatcctgcactagagtgata

SEQ ID NO: 318767 - DNA, 25 bp, Rattus norvegicus
gacatcatcctggactagagtgata

SEQ ID NO: 318768 - DNA, 25 bp, Rattus norvegicus
gacatcatccttcctggtggataca

SEQ ID NO: 318769 - DNA, 25 bp, Rattus norvegicus
gacatcatccttgctggtggataca

SEQ ID NO: 318770 - DNA, 25 bp, Rattus norvegicus
gacatcatcttcaagtgacccgaga

SEQ ID NO: 318771 - DNA, 25 bp, Rattus norvegicus
gacatcatcttctagtgacccgaga

SEQ ID NO: 318772 - DNA, 25 bp, Rattus norvegicus
gacatcatgactctggcccagactt

SEQ ID NO: 318773 - DNA, 25 bp, Rattus norvegicus
gacatcatgactgtggcccagactt

SEQ ID NO: 318774 - DNA, 25 bp, Rattus norvegicus
gacatcatgatactaagcagtgact

SEQ ID NO: 318775 - DNA, 25 bp, Rattus norvegicus
gacatcatgatagtaagcagtgact

SEQ ID NO: 318776 - DNA, 25 bp, Rattus norvegicus
gacatcatgatcagcatcctgggcc

SEQ ID NO: 318777 - DNA, 25 bp, Rattus norvegicus
gacatcatgatctgcatcctgggcc

SEQ ID NO: 318778 - DNA, 25 bp, Rattus norvegicus
gacatcatggagaccatttctcctt

SEQ ID NO: 318779 - DNA, 25 bp, Rattus norvegicus
gacatcatggagcacctggacacaa

SEQ ID NO: 318780 - DNA, 25 bp, Rattus norvegicus
gacatcatggaggacctggacacaa

SEQ ID NO: 318781 - DNA, 25 bp, Rattus norvegicus
gacatcatggagtccatttctcctt

SEQ ID NO: 318782 - DNA, 25 bp, Rattus norvegicus
gacatcatgtcaatggtcgaccaac

SEQ ID NO: 318783 - DNA, 25 bp, Rattus norvegicus
gacatcatgtcattggtcgaccaac

SEQ ID NO: 318784 - DNA, 25 bp, Rattus norvegicus
gacatcattaccaacctgactgcta

SEQ ID NO: 318785 - DNA, 25 bp, Rattus norvegicus
gacatcattacctacctgactgcta

SEQ ID NO: 318786 - DNA, 25 bp, Rattus norvegicus
gacatcattataattactgacttca

SEQ ID NO: 318787 - DNA, 25 bp, Rattus norvegicus
gacatcattatatttactgacttca

SEQ ID NO: 318788 - DNA, 25 bp, Rattus norvegicus
gacatcattatcaacttcctttgga

SEQ ID NO: 318789 - DNA, 25 bp, Rattus norvegicus
gacatcattatctacttcctttgga

SEQ ID NO: 318790 - DNA, 25 bp, Rattus norvegicus
gacatcatttatccatagggcaggg

SEQ ID NO: 318791 - DNA, 25 bp, Rattus norvegicus
gacatcatttatgcatagggcaggg

SEQ ID NO: 318792 - DNA, 25 bp, Rattus norvegicus
gacatccaatatataaagttttcct

SEQ ID NO: 318793 - DNA, 25 bp, Rattus norvegicus
gacatccaatatttaaagttttcct

SEQ ID NO: 318794 - DNA, 25 bp, Rattus norvegicus
gacatccacaacatgtccgtcaagg

SEQ ID NO: 318795 - DNA, 25 bp, Rattus norvegicus
gacatccacaacttgtccgtcaagg

SEQ ID NO: 318796 - DNA, 25 bp, Rattus norvegicus
gacatccaccttctgggtatttgag

SEQ ID NO: 318797 - DNA, 25 bp, Rattus norvegicus
gacatccaccttgtgggtatttgag

SEQ ID NO: 318798 - DNA, 25 bp, Rattus norvegicus
gacatccacgtcagttggaagactt

SEQ ID NO: 318799 - DNA, 25 bp, Rattus norvegicus
gacatccacgtctgttggaagactt

SEQ ID NO: 318800 - DNA, 25 bp, Rattus norvegicus
gacatccacttaaaagacgctgtga

SEQ ID NO: 318801 - DNA, 25 bp, Rattus norvegicus
gacatccacttaattgtgtttacta

SEQ ID NO: 318802 - DNA, 25 bp, Rattus norvegicus
gacatccacttataagacgctgtga

SEQ ID NO: 318803 - DNA, 25 bp, Rattus norvegicus
gacatccacttatttgtgtttacta

SEQ ID NO: 318804 - DNA, 25 bp, Rattus norvegicus
gacatccagcccaagtaacacttaa

SEQ ID NO: 318805 - DNA, 25 bp, Rattus norvegicus
gacatccagccctagtaacacttaa

SEQ ID NO: 318806 - DNA, 25 bp, Rattus norvegicus
gacatccagcctaatttcattaata

SEQ ID NO: 318807 - DNA, 25 bp, Rattus norvegicus
gacatccagccttatttcattaata

SEQ ID NO: 318808 - DNA, 25 bp, Rattus norvegicus
gacatccaggacatcttttaccgag

SEQ ID NO: 318809 - DNA, 25 bp, Rattus norvegicus
gacatccaggacttcttttaccgag

SEQ ID NO: 318810 - DNA, 25 bp, Rattus norvegicus
gacatccaggagacacttagcttcg

SEQ ID NO: 318811 - DNA, 25 bp, Rattus norvegicus
gacatccaggagtcacttagcttcg

SEQ ID NO: 318812 - DNA, 25 bp, Rattus norvegicus
gacatccagtatctcaaggcaagtg

SEQ ID NO: 318813 - DNA, 25 bp, Rattus norvegicus
gacatccagtatgtcaaggcaagtg

SEQ ID NO: 318814 - DNA, 25 bp, Rattus norvegicus
gacatccagtgtctcatgatctcca

SEQ ID NO: 318815 - DNA, 25 bp, Rattus norvegicus
gacatccagtgtgtcatgatctcca

SEQ ID NO: 318816 - DNA, 25 bp, Rattus norvegicus
gacatccatagtatctctgagagct

SEQ ID NO: 318817 - DNA, 25 bp, Rattus norvegicus
gacatccatagtttctctgagagct

SEQ ID NO: 318818 - DNA, 25 bp, Rattus norvegicus
gacatccatctaacagaagtgggaa

SEQ ID NO: 318819 - DNA, 25 bp, Rattus norvegicus
gacatccatctatcagaagtgggaa

SEQ ID NO: 318820 - DNA, 25 bp, Rattus norvegicus
gacatccatgaacagcttttctgtg

SEQ ID NO: 318821 - DNA, 25 bp, Rattus norvegicus
gacatccatgaagagcttttctgtg

SEQ ID NO: 318822 - DNA, 25 bp, Rattus norvegicus
gacatccattctagaaggcctctga

SEQ ID NO: 318823 - DNA, 25 bp, Rattus norvegicus
gacatccattcttgaaggcctctga

SEQ ID NO: 318824 - DNA, 25 bp, Rattus norvegicus
gacatccatttgagcacttgtacct

SEQ ID NO: 318825 - DNA, 25 bp, Rattus norvegicus
gacatccatttgtgcacttgtacct

SEQ ID NO: 318826 - DNA, 25 bp, Rattus norvegicus
gacatcccatctctttggagacaaa

SEQ ID NO: 318827 - DNA, 25 bp, Rattus norvegicus
gacatcccatctgtttggagacaaa

SEQ ID NO: 318828 - DNA, 25 bp, Rattus norvegicus
gacatccccatacgcaaatctgttt

SEQ ID NO: 318829 - DNA, 25 bp, Rattus norvegicus
gacatccccataggcaaatctgttt

SEQ ID NO: 318830 - DNA, 25 bp, Rattus norvegicus
gacatccccttgctgaaatcttact

SEQ ID NO: 318831 - DNA, 25 bp, Rattus norvegicus
gacatccccttggtgaaatcttact

SEQ ID NO: 318832 - DNA, 25 bp, Rattus norvegicus
gacatcccgaaacaattaagctctt

SEQ ID NO: 318833 - DNA, 25 bp, Rattus norvegicus
gacatcccgaaagaattaagctctt

SEQ ID NO: 318834 - DNA, 25 bp, Rattus norvegicus
gacatcccgagacattaaattccaa

SEQ ID NO: 318835 - DNA, 25 bp, Rattus norvegicus
gacatcccgagagattaaattccaa

SEQ ID NO: 318836 - DNA, 25 bp, Rattus norvegicus
gacatccgacatcttttttgacaac

SEQ ID NO: 318837 - DNA, 25 bp, Rattus norvegicus
gacatccgacatgttttttgacaac

SEQ ID NO: 318838 - DNA, 25 bp, Rattus norvegicus
gacatccgactcaaactggagctgg

SEQ ID NO: 318839 - DNA, 25 bp, Rattus norvegicus
gacatccgactctaactggagctgg

SEQ ID NO: 318840 - DNA, 25 bp, Rattus norvegicus
gacatccgatttcagctactagccc

SEQ ID NO: 318841 - DNA, 25 bp, Rattus norvegicus
gacatccgatttgagctactagccc

SEQ ID NO: 318842 - DNA, 25 bp, Rattus norvegicus
gacatccggtggagtcttccaacgt

SEQ ID NO: 318843 - DNA, 25 bp, Rattus norvegicus
gacatccggtggtgtcttccaacgt

SEQ ID NO: 318844 - DNA, 25 bp, Rattus norvegicus
gacatccgtagacgcatcgtgctgc

SEQ ID NO: 318845 - DNA, 25 bp, Rattus norvegicus
gacatccgtagaggcatcgtgctgc

SEQ ID NO: 318846 - DNA, 25 bp, Rattus norvegicus
gacatcctacttaatccttagtcct

SEQ ID NO: 318847 - DNA, 25 bp, Rattus norvegicus
gacatcctactttatccttagtcct

SEQ ID NO: 318848 - DNA, 25 bp, Rattus norvegicus
gacatcctaggtctttcgtgttgaa

SEQ ID NO: 318849 - DNA, 25 bp, Rattus norvegicus
gacatcctaggtgtttcgtgttgaa

SEQ ID NO: 318850 - DNA, 25 bp, Rattus norvegicus
gacatcctatagatggcggctgctc

SEQ ID NO: 318851 - DNA, 25 bp, Rattus norvegicus
gacatcctatagttggcggctgctc

SEQ ID NO: 318852 - DNA, 25 bp, Rattus norvegicus
gacatcctatcgatcatgactggaa

SEQ ID NO: 318853 - DNA, 25 bp, Rattus norvegicus
gacatcctatcgttcatgactggaa

SEQ ID NO: 318854 - DNA, 25 bp, Rattus norvegicus
gacatcctcaaacaagattggcctt

SEQ ID NO: 318855 - DNA, 25 bp, Rattus norvegicus
gacatcctcaaagaagattggcctt

SEQ ID NO: 318856 - DNA, 25 bp, Rattus norvegicus
gacatcctcagaactatctcattct

SEQ ID NO: 318857 - DNA, 25 bp, Rattus norvegicus
gacatcctcagatctatctcattct

SEQ ID NO: 318858 - DNA, 25 bp, Rattus norvegicus
gacatcctcatccacaatgcaggga

SEQ ID NO: 318859 - DNA, 25 bp, Rattus norvegicus
gacatcctcatcgacaatgcaggga

SEQ ID NO: 318860 - DNA, 25 bp, Rattus norvegicus
gacatcctcatgattaagttggtgt

SEQ ID NO: 318861 - DNA, 25 bp, Rattus norvegicus
gacatcctcatgcacctcatctgaa

SEQ ID NO: 318862 - DNA, 25 bp, Rattus norvegicus
gacatcctcatggacctcatctgaa

SEQ ID NO: 318863 - DNA, 25 bp, Rattus norvegicus
gacatcctcatgtttaagttggtgt

SEQ ID NO: 318864 - DNA, 25 bp, Rattus norvegicus
gacatcctctaccttatgtaacttg

SEQ ID NO: 318865 - DNA, 25 bp, Rattus norvegicus
gacatcctctacgttatgtaacttg

SEQ ID NO: 318866 - DNA, 25 bp, Rattus norvegicus
gacatcctctggagcactgaaatgg

SEQ ID NO: 318867 - DNA, 25 bp, Rattus norvegicus
gacatcctctggtgcactgaaatgg

SEQ ID NO: 318868 - DNA, 25 bp, Rattus norvegicus
gacatcctcttcagtcaggtcggaa

SEQ ID NO: 318869 - DNA, 25 bp, Rattus norvegicus
gacatcctcttctgtcaggtcggaa

SEQ ID NO: 318870 - DNA, 25 bp, Rattus norvegicus
gacatcctctttacttgtgacgtgt

SEQ ID NO: 318871 - DNA, 25 bp, Rattus norvegicus
gacatcctcttttcttgtgacgtgt

SEQ ID NO: 318872 - DNA, 25 bp, Rattus norvegicus
gacatcctgaggaaggctgtccaca

SEQ ID NO: 318873 - DNA, 25 bp, Rattus norvegicus
gacatcctgaggtaggctgtccaca

SEQ ID NO: 318874 - DNA, 25 bp, Rattus norvegicus
gacatcctggacacatccctagagt

SEQ ID NO: 318875 - DNA, 25 bp, Rattus norvegicus
gacatcctggactcatccctagagt

SEQ ID NO: 318876 - DNA, 25 bp, Rattus norvegicus
gacatcctggatcctcaatgtgtca

SEQ ID NO: 318877 - DNA, 25 bp, Rattus norvegicus
gacatcctggatgctcaatgtgtca

SEQ ID NO: 318878 - DNA, 25 bp, Rattus norvegicus
gacatccttggactgtggaatgttc

SEQ ID NO: 318879 - DNA, 25 bp, Rattus norvegicus
gacatccttggagtgtggaatgttc

SEQ ID NO: 318880 - DNA, 25 bp, Rattus norvegicus
gacatccttttcaagcatgggttaa

SEQ ID NO: 318881 - DNA, 25 bp, Rattus norvegicus
gacatccttttcaagggctgccaaa

SEQ ID NO: 318882 - DNA, 25 bp, Rattus norvegicus
gacatccttttctagcatgggttaa

SEQ ID NO: 318883 - DNA, 25 bp, Rattus norvegicus
gacatccttttctagggctgccaaa

SEQ ID NO: 318884 - DNA, 25 bp, Rattus norvegicus
gacatcgaccacacagcgggaagaa

SEQ ID NO: 318885 - DNA, 25 bp, Rattus norvegicus
gacatcgaccactcagcgggaagaa

SEQ ID NO: 318886 - DNA, 25 bp, Rattus norvegicus
gacatcgaggatcttcaggaacagt

SEQ ID NO: 318887 - DNA, 25 bp, Rattus norvegicus
gacatcgaggatgttcaggaacagt

SEQ ID NO: 318888 - DNA, 25 bp, Rattus norvegicus
gacatcgccctgcaagacagtgcca

SEQ ID NO: 318889 - DNA, 25 bp, Rattus norvegicus
gacatcgccctggaagacagtgcca

SEQ ID NO: 318890 - DNA, 25 bp, Rattus norvegicus
gacatcgctgcaagatgcatctcag

SEQ ID NO: 318891 - DNA, 25 bp, Rattus norvegicus
gacatcgctgcatgatgcatctcag

SEQ ID NO: 318892 - DNA, 25 bp, Rattus norvegicus
gacatcggaacacacctcaagaact

SEQ ID NO: 318893 - DNA, 25 bp, Rattus norvegicus
gacatcggaacagacctcaagaact

SEQ ID NO: 318894 - DNA, 25 bp, Rattus norvegicus
gacatcggagcactctttgggcttg

SEQ ID NO: 318895 - DNA, 25 bp, Rattus norvegicus
gacatcggagcagtctttgggcttg

SEQ ID NO: 318896 - DNA, 25 bp, Rattus norvegicus
gacatcggcgagatgatcatgctca

SEQ ID NO: 318897 - DNA, 25 bp, Rattus norvegicus
gacatcggcgagttgatcatgctca

SEQ ID NO: 318898 - DNA, 25 bp, Rattus norvegicus
gacatcgggcacatttcagagtttg

SEQ ID NO: 318899 - DNA, 25 bp, Rattus norvegicus
gacatcgggcacttttcagagtttg

SEQ ID NO: 318900 - DNA, 25 bp, Rattus norvegicus
gacatcggggacattttacagcaaa

SEQ ID NO: 318901 - DNA, 25 bp, Rattus norvegicus
gacatcggggactttttacagcaaa

SEQ ID NO: 318902 - DNA, 25 bp, Rattus norvegicus
gacatcggtgctccccagaacagaa

SEQ ID NO: 318903 - DNA, 25 bp, Rattus norvegicus
gacatcggtgctgcccagaacagaa

SEQ ID NO: 318904 - DNA, 25 bp, Rattus norvegicus
gacatcggttatactggagcacttt

SEQ ID NO: 318905 - DNA, 25 bp, Rattus norvegicus
gacatcggttattctggagcacttt

SEQ ID NO: 318906 - DNA, 25 bp, Rattus norvegicus
gacatcgtcactaggcggaggctaa

SEQ ID NO: 318907 - DNA, 25 bp, Rattus norvegicus
gacatcgtcacttggcggaggctaa

SEQ ID NO: 318908 - DNA, 25 bp, Rattus norvegicus
gacatcgttgtcatgcagtccacgg

SEQ ID NO: 318909 - DNA, 25 bp, Rattus norvegicus
gacatcgttgtcttgcagtccacgg

SEQ ID NO: 318910 - DNA, 25 bp, Rattus norvegicus
gacatcgtttgaaaatccggtaatc

SEQ ID NO: 318911 - DNA, 25 bp, Rattus norvegicus
gacatcgtttgataatccggtaatc

SEQ ID NO: 318912 - DNA, 25 bp, Rattus norvegicus
gacatcgtttggctggctgtctatt

SEQ ID NO: 318913 - DNA, 25 bp, Rattus norvegicus
gacatcgtttgggtggctgtctatt

SEQ ID NO: 318914 - DNA, 25 bp, Rattus norvegicus
gacatcgtttgtagaccattcctta

SEQ ID NO: 318915 - DNA, 25 bp, Rattus norvegicus
gacatcgtttgttgaccattcctta

SEQ ID NO: 318916 - DNA, 25 bp, Rattus norvegicus
gacatctacataagagtcggcccct

SEQ ID NO: 318917 - DNA, 25 bp, Rattus norvegicus
gacatctacatatgagtcggcccct

SEQ ID NO: 318918 - DNA, 25 bp, Rattus norvegicus
gacatctaccagcagccccgagtga

SEQ ID NO: 318919 - DNA, 25 bp, Rattus norvegicus
gacatctaccaggagccccgagtga

SEQ ID NO: 318920 - DNA, 25 bp, Rattus norvegicus
gacatctacgtcagcgctgattcaa

SEQ ID NO: 318921 - DNA, 25 bp, Rattus norvegicus
gacatctacgtctgcgctgattcaa

SEQ ID NO: 318922 - DNA, 25 bp, Rattus norvegicus
gacatctacttgcattatggcacct

SEQ ID NO: 318923 - DNA, 25 bp, Rattus norvegicus
gacatctacttggattatggcacct

SEQ ID NO: 318924 - DNA, 25 bp, Rattus norvegicus
gacatctagatgcactttgaacctg

SEQ ID NO: 318925 - DNA, 25 bp, Rattus norvegicus
gacatctagatggactttgaacctg

SEQ ID NO: 318926 - DNA, 25 bp, Rattus norvegicus
gacatctagggcaccagactccaag

SEQ ID NO: 318927 - DNA, 25 bp, Rattus norvegicus
gacatctagggcactgttacaaaat

SEQ ID NO: 318928 - DNA, 25 bp, Rattus norvegicus
gacatctagggctccagactccaag

SEQ ID NO: 318929 - DNA, 25 bp, Rattus norvegicus
gacatctagggctctgttacaaaat

SEQ ID NO: 318930 - DNA, 25 bp, Rattus norvegicus
gacatctatctaacatctccaactg

SEQ ID NO: 318931 - DNA, 25 bp, Rattus norvegicus
gacatctatctatcatctccaactg

SEQ ID NO: 318932 - DNA, 25 bp, Rattus norvegicus
gacatctatttacttctcacaggcc

SEQ ID NO: 318933 - DNA, 25 bp, Rattus norvegicus
gacatctatttagttctcacaggcc

SEQ ID NO: 318934 - DNA, 25 bp, Rattus norvegicus
gacatctattttctaggttaaccca

SEQ ID NO: 318935 - DNA, 25 bp, Rattus norvegicus
gacatctattttgtaggttaaccca

SEQ ID NO: 318936 - DNA, 25 bp, Rattus norvegicus
gacatctcaaggacaaattctccat

SEQ ID NO: 318937 - DNA, 25 bp, Rattus norvegicus
gacatctcaaggtcaaattctccat

SEQ ID NO: 318938 - DNA, 25 bp, Rattus norvegicus
gacatctcacctctaagccgtgcat

SEQ ID NO: 318939 - DNA, 25 bp, Rattus norvegicus
gacatctcacctgtaagccgtgcat

SEQ ID NO: 318940 - DNA, 25 bp, Rattus norvegicus
gacatctcagcacctcctggtggcg

SEQ ID NO: 318941 - DNA, 25 bp, Rattus norvegicus
gacatctcagcagctcctggtggcg

SEQ ID NO: 318942 - DNA, 25 bp, Rattus norvegicus
gacatctcatgtcggaccggagcct

SEQ ID NO: 318943 - DNA, 25 bp, Rattus norvegicus
gacatctcatgtgggaccggagcct

SEQ ID NO: 318944 - DNA, 25 bp, Rattus norvegicus
gacatctccagcaaagatctgcagg

SEQ ID NO: 318945 - DNA, 25 bp, Rattus norvegicus
gacatctccagctaagatctgcagg

SEQ ID NO: 318946 - DNA, 25 bp, Rattus norvegicus
gacatctccatgaacacgctcagtc

SEQ ID NO: 318947 - DNA, 25 bp, Rattus norvegicus
gacatctccatgaatactctctgtg

SEQ ID NO: 318948 - DNA, 25 bp, Rattus norvegicus
gacatctccatgtacacgctcagtc

SEQ ID NO: 318949 - DNA, 25 bp, Rattus norvegicus
gacatctccatgtatactctctgtg

SEQ ID NO: 318950 - DNA, 25 bp, Rattus norvegicus
gacatctccattaaacagctctgct

SEQ ID NO: 318951 - DNA, 25 bp, Rattus norvegicus
gacatctccatttaacagctctgct

SEQ ID NO: 318952 - DNA, 25 bp, Rattus norvegicus
gacatctccgcgcacaggattgaag

SEQ ID NO: 318953 - DNA, 25 bp, Rattus norvegicus
gacatctccgcggacaggattgaag

SEQ ID NO: 318954 - DNA, 25 bp, Rattus norvegicus
gacatctcctttctgctagtgtgta

SEQ ID NO: 318955 - DNA, 25 bp, Rattus norvegicus
gacatctcctttgtgctagtgtgta

SEQ ID NO: 318956 - DNA, 25 bp, Rattus norvegicus
gacatctctcccacggaagacaaag

SEQ ID NO: 318957 - DNA, 25 bp, Rattus norvegicus
gacatctctccctcggaagacaaag

SEQ ID NO: 318958 - DNA, 25 bp, Rattus norvegicus
gacatctctcctatatttctacatt

SEQ ID NO: 318959 - DNA, 25 bp, Rattus norvegicus
gacatctctcctttatttctacatt

SEQ ID NO: 318960 - DNA, 25 bp, Rattus norvegicus
gacatctctctgcaaaaggctttta

SEQ ID NO: 318961 - DNA, 25 bp, Rattus norvegicus
gacatctctctggaaaaggctttta

SEQ ID NO: 318962 - DNA, 25 bp, Rattus norvegicus
gacatctctgacactgccaaagatt

SEQ ID NO: 318963 - DNA, 25 bp, Rattus norvegicus
gacatctctgactctgccaaagatt

SEQ ID NO: 318964 - DNA, 25 bp, Rattus norvegicus
gacatctcttgtatttatggcctca

SEQ ID NO: 318965 - DNA, 25 bp, Rattus norvegicus
gacatctcttgtttttatggcctca

SEQ ID NO: 318966 - DNA, 25 bp, Rattus norvegicus
gacatctgagccattcaaggtcact

SEQ ID NO: 318967 - DNA, 25 bp, Rattus norvegicus
gacatctgagcctttcaaggtcact

SEQ ID NO: 318968 - DNA, 25 bp, Rattus norvegicus
gacatctgcaacagggtgttccatc

SEQ ID NO: 318969 - DNA, 25 bp, Rattus norvegicus
gacatctgcaactgggtgttccatc

SEQ ID NO: 318970 - DNA, 25 bp, Rattus norvegicus
gacatctgcaggctgaaggctgaat

SEQ ID NO: 318971 - DNA, 25 bp, Rattus norvegicus
gacatctgcagggtgaaggctgaat

SEQ ID NO: 318972 - DNA, 25 bp, Rattus norvegicus
gacatctgcatcctgaacctttgtg

SEQ ID NO: 318973 - DNA, 25 bp, Rattus norvegicus
gacatctgcatcgtgaacctttgtg

SEQ ID NO: 318974 - DNA, 25 bp, Rattus norvegicus
gacatctgccagcttgtagaagtga

SEQ ID NO: 318975 - DNA, 25 bp, Rattus norvegicus
gacatctgccaggttgtagaagtga

SEQ ID NO: 318976 - DNA, 25 bp, Rattus norvegicus
gacatctggcatcctttactgtcat

SEQ ID NO: 318977 - DNA, 25 bp, Rattus norvegicus
gacatctggcatgctttactgtcat

SEQ ID NO: 318978 - DNA, 25 bp, Rattus norvegicus
gacatctgggagaacaaccgccgtg

SEQ ID NO: 318979 - DNA, 25 bp, Rattus norvegicus
gacatctgggagtacaaccgccgtg

SEQ ID NO: 318980 - DNA, 25 bp, Rattus norvegicus
gacatctgtattattgcctttgaaa

SEQ ID NO: 318981 - DNA, 25 bp, Rattus norvegicus
gacatctgtatttttgcctttgaaa

SEQ ID NO: 318982 - DNA, 25 bp, Rattus norvegicus
gacatctgtcaccatgaaggtcgag

SEQ ID NO: 318983 - DNA, 25 bp, Rattus norvegicus
gacatctgtcacgatgaaggtcgag

SEQ ID NO: 318984 - DNA, 25 bp, Rattus norvegicus
gacatctgtgaacactgtctctgct

SEQ ID NO: 318985 - DNA, 25 bp, Rattus norvegicus
gacatctgtgaagactgtctctgct

SEQ ID NO: 318986 - DNA, 25 bp, Rattus norvegicus
gacatctgttggaccaggaagcatc

SEQ ID NO: 318987 - DNA, 25 bp, Rattus norvegicus
gacatctgttggtccaggaagcatc

SEQ ID NO: 318988 - DNA, 25 bp, Rattus norvegicus
gacatcttaaaaattccaatccttt

SEQ ID NO: 318989 - DNA, 25 bp, Rattus norvegicus
gacatcttaaaatttccaatccttt

SEQ ID NO: 318990 - DNA, 25 bp, Rattus norvegicus
gacatcttcattccttattttgaga

SEQ ID NO: 318991 - DNA, 25 bp, Rattus norvegicus
gacatcttcattgcttattttgaga

SEQ ID NO: 318992 - DNA, 25 bp, Rattus norvegicus
gacatcttccgcagggccaaagagg

SEQ ID NO: 318993 - DNA, 25 bp, Rattus norvegicus
gacatcttccgctgggccaaagagg

SEQ ID NO: 318994 - DNA, 25 bp, Rattus norvegicus
gacatcttccggagccagcagagaa

SEQ ID NO: 318995 - DNA, 25 bp, Rattus norvegicus
gacatcttccggtgccagcagagaa

SEQ ID NO: 318996 - DNA, 25 bp, Rattus norvegicus
gacatcttcgaacgcattgctacgg

SEQ ID NO: 318997 - DNA, 25 bp, Rattus norvegicus
gacatcttcgaaggcattgctacgg

SEQ ID NO: 318998 - DNA, 25 bp, Rattus norvegicus
gacatcttctggattctttgggcat

SEQ ID NO: 318999 - DNA, 25 bp, Rattus norvegicus
gacatcttctggtttctttgggcat

SEQ ID NO: 319000 - DNA, 25 bp, Rattus norvegicus
gacatcttgaaacctcccaagcctg

SEQ ID NO: 319001 - DNA, 25 bp, Rattus norvegicus
gacatcttgaaagctcccaagcctg

SEQ ID NO: 319002 - DNA, 25 bp, Rattus norvegicus
gacatcttgatccagccagggagta

SEQ ID NO: 319003 - DNA, 25 bp, Rattus norvegicus
gacatcttgatcgagccagggagta

SEQ ID NO: 319004 - DNA, 25 bp, Rattus norvegicus
gacatcttgattcggcttggccttc

SEQ ID NO: 319005 - DNA, 25 bp, Rattus norvegicus
gacatcttgattgggcttggccttc

SEQ ID NO: 319006 - DNA, 25 bp, Rattus norvegicus
gacatcttgccgcaagtaagacaca

SEQ ID NO: 319007 - DNA, 25 bp, Rattus norvegicus
gacatcttgccggaagtaagacaca

SEQ ID NO: 319008 - DNA, 25 bp, Rattus norvegicus
gacatcttgtaaaggatattttcac

SEQ ID NO: 319009 - DNA, 25 bp, Rattus norvegicus
gacatcttgtaatggatattttcac

SEQ ID NO: 319010 - DNA, 25 bp, Rattus norvegicus
gacatctttctcaaaacgtttcacc

SEQ ID NO: 319011 - DNA, 25 bp, Rattus norvegicus
gacatctttctctaaacgtttcacc

SEQ ID NO: 319012 - DNA, 25 bp, Rattus norvegicus
gacatctttcttatcagagacagag

SEQ ID NO: 319013 - DNA, 25 bp, Rattus norvegicus
gacatctttcttttcagagacagag

SEQ ID NO: 319014 - DNA, 25 bp, Rattus norvegicus
gacatctttgacagcaacttgagga

SEQ ID NO: 319015 - DNA, 25 bp, Rattus norvegicus
gacatctttgactgcaacttgagga

SEQ ID NO: 319016 - DNA, 25 bp, Rattus norvegicus
gacatctttgagaacagccagagct

SEQ ID NO: 319017 - DNA, 25 bp, Rattus norvegicus
gacatctttgagtacagccagagct

SEQ ID NO: 319018 - DNA, 25 bp, Rattus norvegicus
gacatctttgcaatactgtctagat

SEQ ID NO: 319019 - DNA, 25 bp, Rattus norvegicus
gacatctttgcattactgtctagat

SEQ ID NO: 319020 - DNA, 25 bp, Rattus norvegicus
gacatcttttctctaaacctctgct

SEQ ID NO: 319021 - DNA, 25 bp, Rattus norvegicus
gacatcttttctgtaaacctctgct

SEQ ID NO: 319022 - DNA, 25 bp, Rattus norvegicus
gacatctttttccaattggtcaagg

SEQ ID NO: 319023 - DNA, 25 bp, Rattus norvegicus
gacatctttttcgaattggtcaagg

SEQ ID NO: 319024 - DNA, 25 bp, Rattus norvegicus
gacatgaaaattaatgccccgcaaa

SEQ ID NO: 319025 - DNA, 25 bp, Rattus norvegicus
gacatgaaaatttatgccccgcaaa

SEQ ID NO: 319026 - DNA, 25 bp, Rattus norvegicus
gacatgaaacttactgccatctgct

SEQ ID NO: 319027 - DNA, 25 bp, Rattus norvegicus
gacatgaaactttctgccatctgct

SEQ ID NO: 319028 - DNA, 25 bp, Rattus norvegicus
gacatgaaagccattgtctcctcaa

SEQ ID NO: 319029 - DNA, 25 bp, Rattus norvegicus
gacatgaaagcctttgtctcctcaa

SEQ ID NO: 319030 - DNA, 25 bp, Rattus norvegicus
gacatgaaagtccttgatggcctaa

SEQ ID NO: 319031 - DNA, 25 bp, Rattus norvegicus
gacatgaaagtcgttgatggcctaa

SEQ ID NO: 319032 - DNA, 25 bp, Rattus norvegicus
gacatgaaattcacgcactcaaaat

SEQ ID NO: 319033 - DNA, 25 bp, Rattus norvegicus
gacatgaaattctcgcactcaaaat

SEQ ID NO: 319034 - DNA, 25 bp, Rattus norvegicus
gacatgaacactcaaattgctggat

SEQ ID NO: 319035 - DNA, 25 bp, Rattus norvegicus
gacatgaacactgaaattgctggat

SEQ ID NO: 319036 - DNA, 25 bp, Rattus norvegicus
gacatgaacattcatcctgactcca

SEQ ID NO: 319037 - DNA, 25 bp, Rattus norvegicus
gacatgaacattgatcctgactcca

SEQ ID NO: 319038 - DNA, 25 bp, Rattus norvegicus
gacatgaactagagctggagcagca

SEQ ID NO: 319039 - DNA, 25 bp, Rattus norvegicus
gacatgaactagtgctggagcagca

SEQ ID NO: 319040 - DNA, 25 bp, Rattus norvegicus
gacatgaacttcagccttgcatcac

SEQ ID NO: 319041 - DNA, 25 bp, Rattus norvegicus
gacatgaacttctgccttgcatcac

SEQ ID NO: 319042 - DNA, 25 bp, Rattus norvegicus
gacatgaagattacctgttgcaata

SEQ ID NO: 319043 - DNA, 25 bp, Rattus norvegicus
gacatgaagatttcctgttgcaata

SEQ ID NO: 319044 - DNA, 25 bp, Rattus norvegicus
gacatgaagcggcactgcttgcaca

SEQ ID NO: 319045 - DNA, 25 bp, Rattus norvegicus
gacatgaagcgggactgcttgcaca

SEQ ID NO: 319046 - DNA, 25 bp, Rattus norvegicus
gacatgaagtctcttcacctcaaga

SEQ ID NO: 319047 - DNA, 25 bp, Rattus norvegicus
gacatgaagtctgttcacctcaaga

SEQ ID NO: 319048 - DNA, 25 bp, Rattus norvegicus
gacatgaagtgtcaattctagtcat

SEQ ID NO: 319049 - DNA, 25 bp, Rattus norvegicus
gacatgaagtgtgaattctagtcat

SEQ ID NO: 319050 - DNA, 25 bp, Rattus norvegicus
gacatgaatattaaaagaccgcgtt

SEQ ID NO: 319051 - DNA, 25 bp, Rattus norvegicus
gacatgaatatttaaagaccgcgtt

SEQ ID NO: 319052 - DNA, 25 bp, Rattus norvegicus
gacatgacactgaaacttttgcttt

SEQ ID NO: 319053 - DNA, 25 bp, Rattus norvegicus
gacatgacactgtaacttttgcttt

SEQ ID NO: 319054 - DNA, 25 bp, Rattus norvegicus
gacatgacagaccttacacactcag

SEQ ID NO: 319055 - DNA, 25 bp, Rattus norvegicus
gacatgacagacgttacacactcag

SEQ ID NO: 319056 - DNA, 25 bp, Rattus norvegicus
gacatgacagcaacttcttgactgt

SEQ ID NO: 319057 - DNA, 25 bp, Rattus norvegicus
gacatgacagcatcttcttgactgt

SEQ ID NO: 319058 - DNA, 25 bp, Rattus norvegicus
gacatgacatgcaggcttggatcaa

SEQ ID NO: 319059 - DNA, 25 bp, Rattus norvegicus
gacatgacatgctggcttggatcaa

SEQ ID NO: 319060 - DNA, 25 bp, Rattus norvegicus
gacatgaccaaaaggctgctgccaa

SEQ ID NO: 319061 - DNA, 25 bp, Rattus norvegicus
gacatgaccaaatggctgctgccaa

SEQ ID NO: 319062 - DNA, 25 bp, Rattus norvegicus
gacatgaccatgattgtcaccgcat

SEQ ID NO: 319063 - DNA, 25 bp, Rattus norvegicus
gacatgaccatgctgtgcaacccag

SEQ ID NO: 319064 - DNA, 25 bp, Rattus norvegicus
gacatgaccatggtgtgcaacccag

SEQ ID NO: 319065 - DNA, 25 bp, Rattus norvegicus
gacatgaccatgtttgtcaccgcat

SEQ ID NO: 319066 - DNA, 25 bp, Rattus norvegicus
gacatgactcttaacttactaccag

SEQ ID NO: 319067 - DNA, 25 bp, Rattus norvegicus
gacatgactctttacttactaccag

SEQ ID NO: 319068 - DNA, 25 bp, Rattus norvegicus
gacatgactttaagagtcaagccag

SEQ ID NO: 319069 - DNA, 25 bp, Rattus norvegicus
gacatgactttatgagtcaagccag

SEQ ID NO: 319070 - DNA, 25 bp, Rattus norvegicus
gacatgactttcctttcctaatttt

SEQ ID NO: 319071 - DNA, 25 bp, Rattus norvegicus
gacatgactttcgtttcctaatttt

SEQ ID NO: 319072 - DNA, 25 bp, Rattus norvegicus
gacatgagagtcaccagttctttct

SEQ ID NO: 319073 - DNA, 25 bp, Rattus norvegicus
gacatgagagtctccagttctttct

SEQ ID NO: 319074 - DNA, 25 bp, Rattus norvegicus
gacatgagcaatatcccacagtgtg

SEQ ID NO: 319075 - DNA, 25 bp, Rattus norvegicus
gacatgagcaatttcccacagtgtg

SEQ ID NO: 319076 - DNA, 25 bp, Rattus norvegicus
gacatgaggcagataccacgttcca

SEQ ID NO: 319077 - DNA, 25 bp, Rattus norvegicus
gacatgaggcagttaccacgttcca

SEQ ID NO: 319078 - DNA, 25 bp, Rattus norvegicus
gacatgagtcctattacagtgacag

SEQ ID NO: 319079 - DNA, 25 bp, Rattus norvegicus
gacatgagtccttttacagtgacag

SEQ ID NO: 319080 - DNA, 25 bp, Rattus norvegicus
gacatgagtcgtcccctgggtgtaa

SEQ ID NO: 319081 - DNA, 25 bp, Rattus norvegicus
gacatgagtcgtgccctgggtgtaa

SEQ ID NO: 319082 - DNA, 25 bp, Rattus norvegicus
gacatgatcagcatgtacctccccg

SEQ ID NO: 319083 - DNA, 25 bp, Rattus norvegicus
gacatgatcagcttgtacctccccg

SEQ ID NO: 319084 - DNA, 25 bp, Rattus norvegicus
gacatgatcccaactgaggtgccat

SEQ ID NO: 319085 - DNA, 25 bp, Rattus norvegicus
gacatgatcccatctgaggtgccat

SEQ ID NO: 319086 - DNA, 25 bp, Rattus norvegicus
gacatgatccgtctggctgatgcag

SEQ ID NO: 319087 - DNA, 25 bp, Rattus norvegicus
gacatgatccgtgtggctgatgcag

SEQ ID NO: 319088 - DNA, 25 bp, Rattus norvegicus
gacatgatgagtcctgtcctcagtg

SEQ ID NO: 319089 - DNA, 25 bp, Rattus norvegicus
gacatgatgagtgctgtcctcagtg

SEQ ID NO: 319090 - DNA, 25 bp, Rattus norvegicus
gacatgatgcacaccattctggatg

SEQ ID NO: 319091 - DNA, 25 bp, Rattus norvegicus
gacatgatgcactccattctggatg

SEQ ID NO: 319092 - DNA, 25 bp, Rattus norvegicus
gacatgatgccgatcctgtattgga

SEQ ID NO: 319093 - DNA, 25 bp, Rattus norvegicus
gacatgatgccgttcctgtattgga

SEQ ID NO: 319094 - DNA, 25 bp, Rattus norvegicus
gacatgatggcccacacctataatc

SEQ ID NO: 319095 - DNA, 25 bp, Rattus norvegicus
gacatgatggccgacacctataatc

SEQ ID NO: 319096 - DNA, 25 bp, Rattus norvegicus
gacatgatgttaacgggccttgtaa

SEQ ID NO: 319097 - DNA, 25 bp, Rattus norvegicus
gacatgatgttatcgggccttgtaa

SEQ ID NO: 319098 - DNA, 25 bp, Rattus norvegicus
gacatgattacaactttctggaaaa

SEQ ID NO: 319099 - DNA, 25 bp, Rattus norvegicus
gacatgattacatctttctggaaaa

SEQ ID NO: 319100 - DNA, 25 bp, Rattus norvegicus
gacatgattggaaaccggccactgt

SEQ ID NO: 319101 - DNA, 25 bp, Rattus norvegicus
gacatgattggataccggccactgt

SEQ ID NO: 319102 - DNA, 25 bp, Rattus norvegicus
gacatgattgtacctatcttggaga

SEQ ID NO: 319103 - DNA, 25 bp, Rattus norvegicus
gacatgattgtagctatcttggaga

SEQ ID NO: 319104 - DNA, 25 bp, Rattus norvegicus
gacatgatttcgattttagtgctat

SEQ ID NO: 319105 - DNA, 25 bp, Rattus norvegicus
gacatgatttcgtttttagtgctat

SEQ ID NO: 319106 - DNA, 25 bp, Rattus norvegicus
gacatgatttctccgtttcttaaag

SEQ ID NO: 319107 - DNA, 25 bp, Rattus norvegicus
gacatgatttctgcgtttcttaaag

SEQ ID NO: 319108 - DNA, 25 bp, Rattus norvegicus
gacatgcaagcactttcaactccat

SEQ ID NO: 319109 - DNA, 25 bp, Rattus norvegicus
gacatgcaagcagtttcaactccat

SEQ ID NO: 319110 - DNA, 25 bp, Rattus norvegicus
gacatgcacagtctttctgtcacca

SEQ ID NO: 319111 - DNA, 25 bp, Rattus norvegicus
gacatgcacagtgtttctgtcacca

SEQ ID NO: 319112 - DNA, 25 bp, Rattus norvegicus
gacatgcaccttaagtggagtttga

SEQ ID NO: 319113 - DNA, 25 bp, Rattus norvegicus
gacatgcacctttagtggagtttga

SEQ ID NO: 319114 - DNA, 25 bp, Rattus norvegicus
gacatgcacgacatctttgtgggac

SEQ ID NO: 319115 - DNA, 25 bp, Rattus norvegicus
gacatgcacgacttctttgtgggac

SEQ ID NO: 319116 - DNA, 25 bp, Rattus norvegicus
gacatgcagaccagtacaaactgta

SEQ ID NO: 319117 - DNA, 25 bp, Rattus norvegicus
gacatgcagacctgtacaaactgta

SEQ ID NO: 319118 - DNA, 25 bp, Rattus norvegicus
gacatgcagactctgttgttccaga

SEQ ID NO: 319119 - DNA, 25 bp, Rattus norvegicus
gacatgcagactgtgttgttccaga

SEQ ID NO: 319120 - DNA, 25 bp, Rattus norvegicus
gacatgcagcagatggttcgagagc

SEQ ID NO: 319121 - DNA, 25 bp, Rattus norvegicus
gacatgcagcagttggttcgagagc

SEQ ID NO: 319122 - DNA, 25 bp, Rattus norvegicus
gacatgcagtcgcatcgctttagtt

SEQ ID NO: 319123 - DNA, 25 bp, Rattus norvegicus
gacatgcagtcggatcgctttagtt

SEQ ID NO: 319124 - DNA, 25 bp, Rattus norvegicus
gacatgcagtgtccgttagcacaga

SEQ ID NO: 319125 - DNA, 25 bp, Rattus norvegicus
gacatgcagtgtgcgttagcacaga

SEQ ID NO: 319126 - DNA, 25 bp, Rattus norvegicus
gacatgcagttcatgacctgtctct

SEQ ID NO: 319127 - DNA, 25 bp, Rattus norvegicus
gacatgcagttcttgacctgtctct

SEQ ID NO: 319128 - DNA, 25 bp, Rattus norvegicus
gacatgcatacgattacttttacca

SEQ ID NO: 319129 - DNA, 25 bp, Rattus norvegicus
gacatgcatacgtttacttttacca

SEQ ID NO: 319130 - DNA, 25 bp, Rattus norvegicus
gacatgcatcggatcactgtgaagg

SEQ ID NO: 319131 - DNA, 25 bp, Rattus norvegicus
gacatgcatcggttcactgtgaagg

SEQ ID NO: 319132 - DNA, 25 bp, Rattus norvegicus
gacatgcatctgagggtctcagcga

SEQ ID NO: 319133 - DNA, 25 bp, Rattus norvegicus
gacatgcatctgtgggtctcagcga

SEQ ID NO: 319134 - DNA, 25 bp, Rattus norvegicus
gacatgcatgcaccggttggagaca

SEQ ID NO: 319135 - DNA, 25 bp, Rattus norvegicus
gacatgcatgcagcggttggagaca

SEQ ID NO: 319136 - DNA, 25 bp, Rattus norvegicus
gacatgcatggcatctaacgaactg

SEQ ID NO: 319137 - DNA, 25 bp, Rattus norvegicus
gacatgcatggcttctaacgaactg

SEQ ID NO: 319138 - DNA, 25 bp, Rattus norvegicus
gacatgcatggtatttcagccctaa

SEQ ID NO: 319139 - DNA, 25 bp, Rattus norvegicus
gacatgcatggtttttcagccctaa

SEQ ID NO: 319140 - DNA, 25 bp, Rattus norvegicus
gacatgcatgttacaagtggtattg

SEQ ID NO: 319141 - DNA, 25 bp, Rattus norvegicus
gacatgcatgtttcaagtggtattg

SEQ ID NO: 319142 - DNA, 25 bp, Rattus norvegicus
gacatgcattgtaggctatttgaaa

SEQ ID NO: 319143 - DNA, 25 bp, Rattus norvegicus
gacatgcattgttggctatttgaaa

SEQ ID NO: 319144 - DNA, 25 bp, Rattus norvegicus
gacatgccaacccagatgatctttt

SEQ ID NO: 319145 - DNA, 25 bp, Rattus norvegicus
gacatgccaaccgagatgatctttt

SEQ ID NO: 319146 - DNA, 25 bp, Rattus norvegicus
gacatgccacttcatgaccctagag

SEQ ID NO: 319147 - DNA, 25 bp, Rattus norvegicus
gacatgccacttgatgaccctagag

SEQ ID NO: 319148 - DNA, 25 bp, Rattus norvegicus
gacatgccagctcccattgtaagca

SEQ ID NO: 319149 - DNA, 25 bp, Rattus norvegicus
gacatgccagctgccattgtaagca

SEQ ID NO: 319150 - DNA, 25 bp, Rattus norvegicus
gacatgccagtacaatttccctatt

SEQ ID NO: 319151 - DNA, 25 bp, Rattus norvegicus
gacatgccagtagaatttccctatt

SEQ ID NO: 319152 - DNA, 25 bp, Rattus norvegicus
gacatgccatggactgtgactttat

SEQ ID NO: 319153 - DNA, 25 bp, Rattus norvegicus
gacatgccatggtctgtgactttat

SEQ ID NO: 319154 - DNA, 25 bp, Rattus norvegicus
gacatgccatgtcctttggttttta

SEQ ID NO: 319155 - DNA, 25 bp, Rattus norvegicus
gacatgccatgtgctttggttttta

SEQ ID NO: 319156 - DNA, 25 bp, Rattus norvegicus
gacatgcccgcgaacagacacactt

SEQ ID NO: 319157 - DNA, 25 bp, Rattus norvegicus
gacatgcccgcgtacagacacactt

SEQ ID NO: 319158 - DNA, 25 bp, Rattus norvegicus
gacatgccggctatatggactgtga

SEQ ID NO: 319159 - DNA, 25 bp, Rattus norvegicus
gacatgccggctttatggactgtga

SEQ ID NO: 319160 - DNA, 25 bp, Rattus norvegicus
gacatgccgggtctcattttgtgct

SEQ ID NO: 319161 - DNA, 25 bp, Rattus norvegicus
gacatgccgggtgtcattttgtgct

SEQ ID NO: 319162 - DNA, 25 bp, Rattus norvegicus
gacatgcctgtcaggagtctgtcca

SEQ ID NO: 319163 - DNA, 25 bp, Rattus norvegicus
gacatgcctgtctggagtctgtcca

SEQ ID NO: 319164 - DNA, 25 bp, Rattus norvegicus
gacatgcctgttctgagatgaacct

SEQ ID NO: 319165 - DNA, 25 bp, Rattus norvegicus
gacatgcctgttgtgagatgaacct

SEQ ID NO: 319166 - DNA, 25 bp, Rattus norvegicus
gacatgcggctccacaataattgat

SEQ ID NO: 319167 - DNA, 25 bp, Rattus norvegicus
gacatgcggctcgacaataattgat

SEQ ID NO: 319168 - DNA, 25 bp, Rattus norvegicus
gacatgcgtttaattacacaggcgt

SEQ ID NO: 319169 - DNA, 25 bp, Rattus norvegicus
gacatgcgtttatttacacaggcgt

SEQ ID NO: 319170 - DNA, 25 bp, Rattus norvegicus
gacatgctacagaatgggttatcca

SEQ ID NO: 319171 - DNA, 25 bp, Rattus norvegicus
gacatgctacagtatgggttatcca

SEQ ID NO: 319172 - DNA, 25 bp, Rattus norvegicus
gacatgctcaatccagtctttaaca

SEQ ID NO: 319173 - DNA, 25 bp, Rattus norvegicus
gacatgctcaatgcagtctttaaca

SEQ ID NO: 319174 - DNA, 25 bp, Rattus norvegicus
gacatgctcattactgctctaaagg

SEQ ID NO: 319175 - DNA, 25 bp, Rattus norvegicus
gacatgctcatttctgctctaaagg

SEQ ID NO: 319176 - DNA, 25 bp, Rattus norvegicus
gacatgctccagacaagcagcggct

SEQ ID NO: 319177 - DNA, 25 bp, Rattus norvegicus
gacatgctccagtcaagcagcggct

SEQ ID NO: 319178 - DNA, 25 bp, Rattus norvegicus
gacatgctccatcgcttttgagtgg

SEQ ID NO: 319179 - DNA, 25 bp, Rattus norvegicus
gacatgctccatggcttttgagtgg

SEQ ID NO: 319180 - DNA, 25 bp, Rattus norvegicus
gacatgctcgttaagatctgaacaa

SEQ ID NO: 319181 - DNA, 25 bp, Rattus norvegicus
gacatgctcgtttagatctgaacaa

SEQ ID NO: 319182 - DNA, 25 bp, Rattus norvegicus
gacatgctctccaatttcgggtacc

SEQ ID NO: 319183 - DNA, 25 bp, Rattus norvegicus
gacatgctctcctatttcgggtacc

SEQ ID NO: 319184 - DNA, 25 bp, Rattus norvegicus
gacatgctctgcatcaccgaggaga

SEQ ID NO: 319185 - DNA, 25 bp, Rattus norvegicus
gacatgctctgcttcaccgaggaga

SEQ ID NO: 319186 - DNA, 25 bp, Rattus norvegicus
gacatgctgctgaggcacgaggcca

SEQ ID NO: 319187 - DNA, 25 bp, Rattus norvegicus
gacatgctgctgtggcacgaggcca

SEQ ID NO: 319188 - DNA, 25 bp, Rattus norvegicus
gacatgctgggtctgtcagcctgct

SEQ ID NO: 319189 - DNA, 25 bp, Rattus norvegicus
gacatgctgggtgtgtcagcctgct

SEQ ID NO: 319190 - DNA, 25 bp, Rattus norvegicus
gacatgctggtgaaccaaccgctga

SEQ ID NO: 319191 - DNA, 25 bp, Rattus norvegicus
gacatgctggtgtaccaaccgctga

SEQ ID NO: 319192 - DNA, 25 bp, Rattus norvegicus
gacatgctgtaaagttggcctccct

SEQ ID NO: 319193 - DNA, 25 bp, Rattus norvegicus
gacatgctgtaatgttggcctccct

SEQ ID NO: 319194 - DNA, 25 bp, Rattus norvegicus
gacatgctgtggctgtaaactataa

SEQ ID NO: 319195 - DNA, 25 bp, Rattus norvegicus
gacatgctgtgggtgtaaactataa

SEQ ID NO: 319196 - DNA, 25 bp, Rattus norvegicus
gacatgctgttcacagcctttgaga

SEQ ID NO: 319197 - DNA, 25 bp, Rattus norvegicus
gacatgctgttcagagcaagcccaa

SEQ ID NO: 319198 - DNA, 25 bp, Rattus norvegicus
gacatgctgttctcagcctttgaga

SEQ ID NO: 319199 - DNA, 25 bp, Rattus norvegicus
gacatgctgttctgagcaagcccaa

SEQ ID NO: 319200 - DNA, 25 bp, Rattus norvegicus
gacatgcttatcattcctggtttaa

SEQ ID NO: 319201 - DNA, 25 bp, Rattus norvegicus
gacatgcttatctttcctggtttaa

SEQ ID NO: 319202 - DNA, 25 bp, Rattus norvegicus
gacatgcttcatcaacagcgcggcg

SEQ ID NO: 319203 - DNA, 25 bp, Rattus norvegicus
gacatgcttcatcttcggtatcctc

SEQ ID NO: 319204 - DNA, 25 bp, Rattus norvegicus
gacatgcttcatgaacagcgcggcg

SEQ ID NO: 319205 - DNA, 25 bp, Rattus norvegicus
gacatgcttcatgttcggtatcctc

SEQ ID NO: 319206 - DNA, 25 bp, Rattus norvegicus
gacatgcttctgacagggagcacct

SEQ ID NO: 319207 - DNA, 25 bp, Rattus norvegicus
gacatgcttctgtcagggagcacct

SEQ ID NO: 319208 - DNA, 25 bp, Rattus norvegicus
gacatgcttgctctgtggtccctgg

SEQ ID NO: 319209 - DNA, 25 bp, Rattus norvegicus
gacatgcttgctgtgtggtccctgg

SEQ ID NO: 319210 - DNA, 25 bp, Rattus norvegicus
gacatgcttgtgctttggaaatcca

SEQ ID NO: 319211 - DNA, 25 bp, Rattus norvegicus
gacatgcttgtggtttggaaatcca

SEQ ID NO: 319212 - DNA, 25 bp, Rattus norvegicus
gacatgctttagatagttttcggtg

SEQ ID NO: 319213 - DNA, 25 bp, Rattus norvegicus
gacatgctttagttagttttcggtg

SEQ ID NO: 319214 - DNA, 25 bp, Rattus norvegicus
gacatggaaagaccgtggcaccccg

SEQ ID NO: 319215 - DNA, 25 bp, Rattus norvegicus
gacatggaaagagcgtggcaccccg

SEQ ID NO: 319216 - DNA, 25 bp, Rattus norvegicus
gacatggaagtgattcctttctcct

SEQ ID NO: 319217 - DNA, 25 bp, Rattus norvegicus
gacatggaagtgtttcctttctcct

SEQ ID NO: 319218 - DNA, 25 bp, Rattus norvegicus
gacatggacacacacctactatgct

SEQ ID NO: 319219 - DNA, 25 bp, Rattus norvegicus
gacatggacacagacctactatgct

SEQ ID NO: 319220 - DNA, 25 bp, Rattus norvegicus
gacatggacacgcaggaacgcatca

SEQ ID NO: 319221 - DNA, 25 bp, Rattus norvegicus
gacatggacacggaggaacgcatca

SEQ ID NO: 319222 - DNA, 25 bp, Rattus norvegicus
gacatggactagatgtagcaagcaa

SEQ ID NO: 319223 - DNA, 25 bp, Rattus norvegicus
gacatggactagttgtagcaagcaa

SEQ ID NO: 319224 - DNA, 25 bp, Rattus norvegicus
gacatggactctaagttgagctcaa

SEQ ID NO: 319225 - DNA, 25 bp, Rattus norvegicus
gacatggactcttagttgagctcaa

SEQ ID NO: 319226 - DNA, 25 bp, Rattus norvegicus
gacatggacttcaatgactgagttc

SEQ ID NO: 319227 - DNA, 25 bp, Rattus norvegicus
gacatggacttctatgactgagttc

SEQ ID NO: 319228 - DNA, 25 bp, Rattus norvegicus
gacatggaggccaagccagcctcaa

SEQ ID NO: 319229 - DNA, 25 bp, Rattus norvegicus
gacatggaggcctagccagcctcaa

SEQ ID NO: 319230 - DNA, 25 bp, Rattus norvegicus
gacatggagtcccatctggatggct

SEQ ID NO: 319231 - DNA, 25 bp, Rattus norvegicus
gacatggagtccgatctggatggct

SEQ ID NO: 319232 - DNA, 25 bp, Rattus norvegicus
gacatggatcaacggatgggacttt

SEQ ID NO: 319233 - DNA, 25 bp, Rattus norvegicus
gacatggatcaagggatgggacttt

SEQ ID NO: 319234 - DNA, 25 bp, Rattus norvegicus
gacatggatcccagcacaccttgat

SEQ ID NO: 319235 - DNA, 25 bp, Rattus norvegicus
gacatggatccctgcacaccttgat

SEQ ID NO: 319236 - DNA, 25 bp, Rattus norvegicus
gacatggatcctacagacaactctg

SEQ ID NO: 319237 - DNA, 25 bp, Rattus norvegicus
gacatggatccttcagacaactctg

SEQ ID NO: 319238 - DNA, 25 bp, Rattus norvegicus
gacatggatgtcactggcacagatg

SEQ ID NO: 319239 - DNA, 25 bp, Rattus norvegicus
gacatggatgtctctggcacagatg

SEQ ID NO: 319240 - DNA, 25 bp, Rattus norvegicus
gacatggattttcgaactctggctt

SEQ ID NO: 319241 - DNA, 25 bp, Rattus norvegicus
gacatggattttggaactctggctt

SEQ ID NO: 319242 - DNA, 25 bp, Rattus norvegicus
gacatggcagcacacctgacagaaa

SEQ ID NO: 319243 - DNA, 25 bp, Rattus norvegicus
gacatggcagcacaggtttaacact

SEQ ID NO: 319244 - DNA, 25 bp, Rattus norvegicus
gacatggcagcagacctgacagaaa

SEQ ID NO: 319245 - DNA, 25 bp, Rattus norvegicus
gacatggcagcagaggtttaacact

SEQ ID NO: 319246 - DNA, 25 bp, Rattus norvegicus
gacatggcatggcacagcagccatc

SEQ ID NO: 319247 - DNA, 25 bp, Rattus norvegicus
gacatggcatgggacagcagccatc

SEQ ID NO: 319248 - DNA, 25 bp, Rattus norvegicus
gacatggccaagaatcggagcattc

SEQ ID NO: 319249 - DNA, 25 bp, Rattus norvegicus
gacatggccaagtatcggagcattc

SEQ ID NO: 319250 - DNA, 25 bp, Rattus norvegicus
gacatggcggcgcacaactttgatc

SEQ ID NO: 319251 - DNA, 25 bp, Rattus norvegicus
gacatggcggcggacaactttgatc

SEQ ID NO: 319252 - DNA, 25 bp, Rattus norvegicus
gacatggctactacggtgccaactg

SEQ ID NO: 319253 - DNA, 25 bp, Rattus norvegicus
gacatggctacttcggtgccaactg

SEQ ID NO: 319254 - DNA, 25 bp, Rattus norvegicus
gacatggctcacaggtaaaggctaa

SEQ ID NO: 319255 - DNA, 25 bp, Rattus norvegicus
gacatggctcactggtaaaggctaa

SEQ ID NO: 319256 - DNA, 25 bp, Rattus norvegicus
gacatggctcagatccaggcagtta

SEQ ID NO: 319257 - DNA, 25 bp, Rattus norvegicus
gacatggctcagttccaggcagtta

SEQ ID NO: 319258 - DNA, 25 bp, Rattus norvegicus
gacatggctctactactgaactcgg

SEQ ID NO: 319259 - DNA, 25 bp, Rattus norvegicus
gacatggctctagtactgaactcgg

SEQ ID NO: 319260 - DNA, 25 bp, Rattus norvegicus
gacatggctctgatatgttagggcc

SEQ ID NO: 319261 - DNA, 25 bp, Rattus norvegicus
gacatggctctgttatgttagggcc

SEQ ID NO: 319262 - DNA, 25 bp, Rattus norvegicus
gacatggctgagactctgagaatac

SEQ ID NO: 319263 - DNA, 25 bp, Rattus norvegicus
gacatggctgagtctctgagaatac

SEQ ID NO: 319264 - DNA, 25 bp, Rattus norvegicus
gacatggctggcaattacgctttat

SEQ ID NO: 319265 - DNA, 25 bp, Rattus norvegicus
gacatggctggctattacgctttat

SEQ ID NO: 319266 - DNA, 25 bp, Rattus norvegicus
gacatggcttaacttgaaccttctg

SEQ ID NO: 319267 - DNA, 25 bp, Rattus norvegicus
gacatggcttaagttgaaccttctg

SEQ ID NO: 319268 - DNA, 25 bp, Rattus norvegicus
gacatggcttataagcttgggccta

SEQ ID NO: 319269 - DNA, 25 bp, Rattus norvegicus
gacatggcttatactaccctgtgta

SEQ ID NO: 319270 - DNA, 25 bp, Rattus norvegicus
gacatggcttattagcttgggccta

SEQ ID NO: 319271 - DNA, 25 bp, Rattus norvegicus
gacatggcttattctaccctgtgta

SEQ ID NO: 319272 - DNA, 25 bp, Rattus norvegicus
gacatggcttccctcctggagatgt

SEQ ID NO: 319273 - DNA, 25 bp, Rattus norvegicus
gacatggcttccctttctaattggt

SEQ ID NO: 319274 - DNA, 25 bp, Rattus norvegicus
gacatggcttccgtcctggagatgt

SEQ ID NO: 319275 - DNA, 25 bp, Rattus norvegicus
gacatggcttccgtttctaattggt

SEQ ID NO: 319276 - DNA, 25 bp, Rattus norvegicus
gacatgggaatgcagaccactgtga

SEQ ID NO: 319277 - DNA, 25 bp, Rattus norvegicus
gacatgggaatggagaccactgtga

SEQ ID NO: 319278 - DNA, 25 bp, Rattus norvegicus
gacatgggatgtcctgttgccctta

SEQ ID NO: 319279 - DNA, 25 bp, Rattus norvegicus
gacatgggatgtcctttgccactta

SEQ ID NO: 319280 - DNA, 25 bp, Rattus norvegicus
gacatgggatgtgctgttgccctta

SEQ ID NO: 319281 - DNA, 25 bp, Rattus norvegicus
gacatgggatgtgctttgccactta

SEQ ID NO: 319282 - DNA, 25 bp, Rattus norvegicus
gacatgggccaacaagacgtgttgc

SEQ ID NO: 319283 - DNA, 25 bp, Rattus norvegicus
gacatgggccaagaagacgtgttgc

SEQ ID NO: 319284 - DNA, 25 bp, Rattus norvegicus
gacatgggcccacttttaagataca

SEQ ID NO: 319285 - DNA, 25 bp, Rattus norvegicus
gacatgggcccagttttaagataca

SEQ ID NO: 319286 - DNA, 25 bp, Rattus norvegicus
gacatgggcctgcaaccccagcaat

SEQ ID NO: 319287 - DNA, 25 bp, Rattus norvegicus
gacatgggcctggaaccccagcaat

SEQ ID NO: 319288 - DNA, 25 bp, Rattus norvegicus
gacatgggctctcaatgcagcggca

SEQ ID NO: 319289 - DNA, 25 bp, Rattus norvegicus
gacatgggctctgaatgcagcggca

SEQ ID NO: 319290 - DNA, 25 bp, Rattus norvegicus
gacatgggctgtatgcatcatctga

SEQ ID NO: 319291 - DNA, 25 bp, Rattus norvegicus
gacatgggctgtttgcatcatctga

SEQ ID NO: 319292 - DNA, 25 bp, Rattus norvegicus
gacatgggtcctcaaaactgtgtac

SEQ ID NO: 319293 - DNA, 25 bp, Rattus norvegicus
gacatgggtcctgaaaactgtgtac

SEQ ID NO: 319294 - DNA, 25 bp, Rattus norvegicus
gacatgggttcacgaccagctggat

SEQ ID NO: 319295 - DNA, 25 bp, Rattus norvegicus
gacatgggttcaggaccagctggat

SEQ ID NO: 319296 - DNA, 25 bp, Rattus norvegicus
gacatgggttcccactcaaaatgtg

SEQ ID NO: 319297 - DNA, 25 bp, Rattus norvegicus
gacatgggttccgactcaaaatgtg

SEQ ID NO: 319298 - DNA, 25 bp, Rattus norvegicus
gacatggtacatcgtaacaactgcg

SEQ ID NO: 319299 - DNA, 25 bp, Rattus norvegicus
gacatggtacatggtaacaactgcg

SEQ ID NO: 319300 - DNA, 25 bp, Rattus norvegicus
gacatggtaccaatgatatgcatct

SEQ ID NO: 319301 - DNA, 25 bp, Rattus norvegicus
gacatggtaccattgatatgcatct

SEQ ID NO: 319302 - DNA, 25 bp, Rattus norvegicus
gacatggtcaaacgagttctcgccg

SEQ ID NO: 319303 - DNA, 25 bp, Rattus norvegicus
gacatggtcaaaggagttctcgccg

SEQ ID NO: 319304 - DNA, 25 bp, Rattus norvegicus
gacatggtcagaatacatcctctcc

SEQ ID NO: 319305 - DNA, 25 bp, Rattus norvegicus
gacatggtcagattacatcctctcc

SEQ ID NO: 319306 - DNA, 25 bp, Rattus norvegicus
gacatggtggatcgctcttgttgtc

SEQ ID NO: 319307 - DNA, 25 bp, Rattus norvegicus
gacatggtggatggctcttgttgtc

SEQ ID NO: 319308 - DNA, 25 bp, Rattus norvegicus
gacatggtgggcaaggtcccttctt

SEQ ID NO: 319309 - DNA, 25 bp, Rattus norvegicus
gacatggtgggcactttcacagaca

SEQ ID NO: 319310 - DNA, 25 bp, Rattus norvegicus
gacatggtgggccaaacctagataa

SEQ ID NO: 319311 - DNA, 25 bp, Rattus norvegicus
gacatggtgggcgaaacctagataa

SEQ ID NO: 319312 - DNA, 25 bp, Rattus norvegicus
gacatggtgggctaggtcccttctt

SEQ ID NO: 319313 - DNA, 25 bp, Rattus norvegicus
gacatggtgggctctttcacagaca

SEQ ID NO: 319314 - DNA, 25 bp, Rattus norvegicus
gacatggtgtcaccggaggctacca

SEQ ID NO: 319315 - DNA, 25 bp, Rattus norvegicus
gacatggtgtcagcggaggctacca

SEQ ID NO: 319316 - DNA, 25 bp, Rattus norvegicus
gacatggttctgagtttgtagcacc

SEQ ID NO: 319317 - DNA, 25 bp, Rattus norvegicus
gacatggttctgtgtttgtagcacc

SEQ ID NO: 319318 - DNA, 25 bp, Rattus norvegicus
gacatggttgccaatgattgcaggt

SEQ ID NO: 319319 - DNA, 25 bp, Rattus norvegicus
gacatggttgcctatgattgcaggt

SEQ ID NO: 319320 - DNA, 25 bp, Rattus norvegicus
gacatggttgtacggatattctttt

SEQ ID NO: 319321 - DNA, 25 bp, Rattus norvegicus
gacatggttgtagggatattctttt

SEQ ID NO: 319322 - DNA, 25 bp, Rattus norvegicus
gacatgtaaatccagtctcttcctc

SEQ ID NO: 319323 - DNA, 25 bp, Rattus norvegicus
gacatgtaaatcgagtctcttcctc

SEQ ID NO: 319324 - DNA, 25 bp, Rattus norvegicus
gacatgtaagtgacacgctaagcaa

SEQ ID NO: 319325 - DNA, 25 bp, Rattus norvegicus
gacatgtaagtgtcacgctaagcaa

SEQ ID NO: 319326 - DNA, 25 bp, Rattus norvegicus
gacatgtaatgtctgctctctttca

SEQ ID NO: 319327 - DNA, 25 bp, Rattus norvegicus
gacatgtaatgtgtgctctctttca

SEQ ID NO: 319328 - DNA, 25 bp, Rattus norvegicus
gacatgtaattaaagttccagcact

SEQ ID NO: 319329 - DNA, 25 bp, Rattus norvegicus
gacatgtaattatagttccagcact

SEQ ID NO: 319330 - DNA, 25 bp, Rattus norvegicus
gacatgtacacaaagatcgagtaag

SEQ ID NO: 319331 - DNA, 25 bp, Rattus norvegicus
gacatgtacacatagatcgagtaag

SEQ ID NO: 319332 - DNA, 25 bp, Rattus norvegicus
gacatgtacaccatagctgtgcttt

SEQ ID NO: 319333 - DNA, 25 bp, Rattus norvegicus
gacatgtacaccttagctgtgcttt

SEQ ID NO: 319334 - DNA, 25 bp, Rattus norvegicus
gacatgtacatccagggactccagc

SEQ ID NO: 319335 - DNA, 25 bp, Rattus norvegicus
gacatgtacatcgagggactccagc

SEQ ID NO: 319336 - DNA, 25 bp, Rattus norvegicus
gacatgtacctcaagttttggctac

SEQ ID NO: 319337 - DNA, 25 bp, Rattus norvegicus
gacatgtacctctagttttggctac

SEQ ID NO: 319338 - DNA, 25 bp, Rattus norvegicus
gacatgtagactctggactttccaa

SEQ ID NO: 319339 - DNA, 25 bp, Rattus norvegicus
gacatgtagactgtggactttccaa

SEQ ID NO: 319340 - DNA, 25 bp, Rattus norvegicus
gacatgtagggtctcttctcacaca

SEQ ID NO: 319341 - DNA, 25 bp, Rattus norvegicus
gacatgtagggtgtcttctcacaca

SEQ ID NO: 319342 - DNA, 25 bp, Rattus norvegicus
gacatgtatgccaactcatcgggag

SEQ ID NO: 319343 - DNA, 25 bp, Rattus norvegicus
gacatgtatgcctactcatcgggag

SEQ ID NO: 319344 - DNA, 25 bp, Rattus norvegicus
gacatgtatttgattgctgggtaac

SEQ ID NO: 319345 - DNA, 25 bp, Rattus norvegicus
gacatgtatttgtttgctgggtaac

SEQ ID NO: 319346 - DNA, 25 bp, Rattus norvegicus
gacatgtattttaatctgaccttaa

SEQ ID NO: 319347 - DNA, 25 bp, Rattus norvegicus
gacatgtatttttatctgaccttaa

SEQ ID NO: 319348 - DNA, 25 bp, Rattus norvegicus
gacatgtcataaacggctggttaga

SEQ ID NO: 319349 - DNA, 25 bp, Rattus norvegicus
gacatgtcataatcggctggttaga

SEQ ID NO: 319350 - DNA, 25 bp, Rattus norvegicus
gacatgtccacgcttatgagccgga

SEQ ID NO: 319351 - DNA, 25 bp, Rattus norvegicus
gacatgtccacggttatgagccgga

SEQ ID NO: 319352 - DNA, 25 bp, Rattus norvegicus
gacatgtccgaaaatgtaagaccat

SEQ ID NO: 319353 - DNA, 25 bp, Rattus norvegicus
gacatgtccgaatatgtaagaccat

SEQ ID NO: 319354 - DNA, 25 bp, Rattus norvegicus
gacatgtccggcatgcgacggttgt

SEQ ID NO: 319355 - DNA, 25 bp, Rattus norvegicus
gacatgtccggcttgcgacggttgt

SEQ ID NO: 319356 - DNA, 25 bp, Rattus norvegicus
gacatgtcctatatccaagggcttg

SEQ ID NO: 319357 - DNA, 25 bp, Rattus norvegicus
gacatgtcctatcagcagctgatgc

SEQ ID NO: 319358 - DNA, 25 bp, Rattus norvegicus
gacatgtcctatgagcagctgatgc

SEQ ID NO: 319359 - DNA, 25 bp, Rattus norvegicus
gacatgtcctatttccaagggcttg

SEQ ID NO: 319360 - DNA, 25 bp, Rattus norvegicus
gacatgtcgagtctgcaggcagcac

SEQ ID NO: 319361 - DNA, 25 bp, Rattus norvegicus
gacatgtcgagtgtgcaggcagcac

SEQ ID NO: 319362 - DNA, 25 bp, Rattus norvegicus
gacatgtctagtactgatagtcact

SEQ ID NO: 319363 - DNA, 25 bp, Rattus norvegicus
gacatgtctagttctgatagtcact

SEQ ID NO: 319364 - DNA, 25 bp, Rattus norvegicus
gacatgtctgatcaaggtcccatct

SEQ ID NO: 319365 - DNA, 25 bp, Rattus norvegicus
gacatgtctgatgaaggtcccatct

SEQ ID NO: 319366 - DNA, 25 bp, Rattus norvegicus
gacatgtcttgcagcatttctctta

SEQ ID NO: 319367 - DNA, 25 bp, Rattus norvegicus
gacatgtcttgctgcatttctctta

SEQ ID NO: 319368 - DNA, 25 bp, Rattus norvegicus
gacatgtgaatccacacctctgtac

SEQ ID NO: 319369 - DNA, 25 bp, Rattus norvegicus
gacatgtgaatcgacacctctgtac

SEQ ID NO: 319370 - DNA, 25 bp, Rattus norvegicus
gacatgtgacacatttctgacctct

SEQ ID NO: 319371 - DNA, 25 bp, Rattus norvegicus
gacatgtgacacttttctgacctct

SEQ ID NO: 319372 - DNA, 25 bp, Rattus norvegicus
gacatgtgatctcagcaccagggaa

SEQ ID NO: 319373 - DNA, 25 bp, Rattus norvegicus
gacatgtgatctgagcaccagggaa

SEQ ID NO: 319374 - DNA, 25 bp, Rattus norvegicus
gacatgtgcctcataaggactcagg

SEQ ID NO: 319375 - DNA, 25 bp, Rattus norvegicus
gacatgtgcctcttaaggactcagg

SEQ ID NO: 319376 - DNA, 25 bp, Rattus norvegicus
gacatgtgctctctaagtccactta

SEQ ID NO: 319377 - DNA, 25 bp, Rattus norvegicus
gacatgtgctctgtaagtccactta

SEQ ID NO: 319378 - DNA, 25 bp, Rattus norvegicus
gacatgtgctggctcatttggtagt

SEQ ID NO: 319379 - DNA, 25 bp, Rattus norvegicus
gacatgtgctgggtcatttggtagt

SEQ ID NO: 319380 - DNA, 25 bp, Rattus norvegicus
gacatgtgctgtagttcggcaggaa

SEQ ID NO: 319381 - DNA, 25 bp, Rattus norvegicus
gacatgtgctgttgttcggcaggaa

SEQ ID NO: 319382 - DNA, 25 bp, Rattus norvegicus
gacatgtggagtatccttctggata

SEQ ID NO: 319383 - DNA, 25 bp, Rattus norvegicus
gacatgtggagtttccttctggata

SEQ ID NO: 319384 - DNA, 25 bp, Rattus norvegicus
gacatgtggccacggactctggatt

SEQ ID NO: 319385 - DNA, 25 bp, Rattus norvegicus
gacatgtggccagggactctggatt

SEQ ID NO: 319386 - DNA, 25 bp, Rattus norvegicus
gacatgtggtcgctaggctgcatat

SEQ ID NO: 319387 - DNA, 25 bp, Rattus norvegicus
gacatgtggtcggtaggctgcatat

SEQ ID NO: 319388 - DNA, 25 bp, Rattus norvegicus
gacatgtgtaataccagagcttctg

SEQ ID NO: 319389 - DNA, 25 bp, Rattus norvegicus
gacatgtgtaattccagagcttctg

SEQ ID NO: 319390 - DNA, 25 bp, Rattus norvegicus
gacatgtgtattccactggccttgg

SEQ ID NO: 319391 - DNA, 25 bp, Rattus norvegicus
gacatgtgtattgcactggccttgg

SEQ ID NO: 319392 - DNA, 25 bp, Rattus norvegicus
gacatgtgtctcaagctgcatttag

SEQ ID NO: 319393 - DNA, 25 bp, Rattus norvegicus
gacatgtgtctctagctgcatttag

SEQ ID NO: 319394 - DNA, 25 bp, Rattus norvegicus
gacatgtgtgacagggaccactaca

SEQ ID NO: 319395 - DNA, 25 bp, Rattus norvegicus
gacatgtgtgactgggaccactaca

SEQ ID NO: 319396 - DNA, 25 bp, Rattus norvegicus
gacatgtgtggcatgcatagtacga

SEQ ID NO: 319397 - DNA, 25 bp, Rattus norvegicus
gacatgtgtggcttgcatagtacga

SEQ ID NO: 319398 - DNA, 25 bp, Rattus norvegicus
gacatgtgtgtcaagttcctctcaa

SEQ ID NO: 319399 - DNA, 25 bp, Rattus norvegicus
gacatgtgtgtctagttcctctcaa

SEQ ID NO: 319400 - DNA, 25 bp, Rattus norvegicus
gacatgttcaggcatcgccaggcgt

SEQ ID NO: 319401 - DNA, 25 bp, Rattus norvegicus
gacatgttcagggatcgccaggcgt

SEQ ID NO: 319402 - DNA, 25 bp, Rattus norvegicus
gacatgttccgtctgactggcagat

SEQ ID NO: 319403 - DNA, 25 bp, Rattus norvegicus
gacatgttccgtgtgactggcagat

SEQ ID NO: 319404 - DNA, 25 bp, Rattus norvegicus
gacatgttcgtcatttctgttttaa

SEQ ID NO: 319405 - DNA, 25 bp, Rattus norvegicus
gacatgttcgtcttttctgttttaa

SEQ ID NO: 319406 - DNA, 25 bp, Rattus norvegicus
gacatgttctcacttatccaaagac

SEQ ID NO: 319407 - DNA, 25 bp, Rattus norvegicus
gacatgttctcagttatccaaagac

SEQ ID NO: 319408 - DNA, 25 bp, Rattus norvegicus
gacatgttctgcaaatagttctgtg

SEQ ID NO: 319409 - DNA, 25 bp, Rattus norvegicus
gacatgttctgctaatagttctgtg

SEQ ID NO: 319410 - DNA, 25 bp, Rattus norvegicus
gacatgttctggattgtttctgatg

SEQ ID NO: 319411 - DNA, 25 bp, Rattus norvegicus
gacatgttctggtttgtttctgatg

SEQ ID NO: 319412 - DNA, 25 bp, Rattus norvegicus
gacatgttgccacagtttaatgcca

SEQ ID NO: 319413 - DNA, 25 bp, Rattus norvegicus
gacatgttgccagagtttaatgcca

SEQ ID NO: 319414 - DNA, 25 bp, Rattus norvegicus
gacatgttgtgcacagcagtcactc

SEQ ID NO: 319415 - DNA, 25 bp, Rattus norvegicus
gacatgttgtgctcagcagtcactc

SEQ ID NO: 319416 - DNA, 25 bp, Rattus norvegicus
gacatgttgtgtccctgtcagagca

SEQ ID NO: 319417 - DNA, 25 bp, Rattus norvegicus
gacatgttgtgtgcctgtcagagca

SEQ ID NO: 319418 - DNA, 25 bp, Rattus norvegicus
gacatgtttcttattcccatctagt

SEQ ID NO: 319419 - DNA, 25 bp, Rattus norvegicus
gacatgtttctttttcccatctagt

SEQ ID NO: 319420 - DNA, 25 bp, Rattus norvegicus
gacatgtttggacttttcttcttca

SEQ ID NO: 319421 - DNA, 25 bp, Rattus norvegicus
gacatgtttggagttttcttcttca

SEQ ID NO: 319422 - DNA, 25 bp, Rattus norvegicus
gacattaacttccatagttttcagc

SEQ ID NO: 319423 - DNA, 25 bp, Rattus norvegicus
gacattaacttcgatagttttcagc

SEQ ID NO: 319424 - DNA, 25 bp, Rattus norvegicus
gacattaagacgaacccctttctgg

SEQ ID NO: 319425 - DNA, 25 bp, Rattus norvegicus
gacattaagacgtacccctttctgg

SEQ ID NO: 319426 - DNA, 25 bp, Rattus norvegicus
gacattaagattctgttctgtgtat

SEQ ID NO: 319427 - DNA, 25 bp, Rattus norvegicus
gacattaagattgtgttctgtgtat

SEQ ID NO: 319428 - DNA, 25 bp, Rattus norvegicus
gacattaagctactctgttccattt

SEQ ID NO: 319429 - DNA, 25 bp, Rattus norvegicus
gacattaagctagtctgttccattt

SEQ ID NO: 319430 - DNA, 25 bp, Rattus norvegicus
gacattaagtcaaaaagtgtcgtca

SEQ ID NO: 319431 - DNA, 25 bp, Rattus norvegicus
gacattaagtcataaagtgtcgtca

SEQ ID NO: 319432 - DNA, 25 bp, Rattus norvegicus
gacattaattagattggcaagtgac

SEQ ID NO: 319433 - DNA, 25 bp, Rattus norvegicus
gacattaattagtttggcaagtgac

SEQ ID NO: 319434 - DNA, 25 bp, Rattus norvegicus
gacattacacttctctgggaaccat

SEQ ID NO: 319435 - DNA, 25 bp, Rattus norvegicus
gacattacacttgtctgggaaccat

SEQ ID NO: 319436 - DNA, 25 bp, Rattus norvegicus
gacattacatgtccttgatcccagc

SEQ ID NO: 319437 - DNA, 25 bp, Rattus norvegicus
gacattacatgtgcttgatcccagc

SEQ ID NO: 319438 - DNA, 25 bp, Rattus norvegicus
gacattaccaagagtcgatcactga

SEQ ID NO: 319439 - DNA, 25 bp, Rattus norvegicus
gacattaccaagtgtcgatcactga

SEQ ID NO: 319440 - DNA, 25 bp, Rattus norvegicus
gacattaccctaaagcgtggctgac

SEQ ID NO: 319441 - DNA, 25 bp, Rattus norvegicus
gacattaccctatagcgtggctgac

SEQ ID NO: 319442 - DNA, 25 bp, Rattus norvegicus
gacattagaaatactgtgactgcac

SEQ ID NO: 319443 - DNA, 25 bp, Rattus norvegicus
gacattagaaattctgtgactgcac

SEQ ID NO: 319444 - DNA, 25 bp, Rattus norvegicus
gacattagaccacacaccacgacag

SEQ ID NO: 319445 - DNA, 25 bp, Rattus norvegicus
gacattagaccagacaccacgacag

SEQ ID NO: 319446 - DNA, 25 bp, Rattus norvegicus
gacattagccgtattacattaccga

SEQ ID NO: 319447 - DNA, 25 bp, Rattus norvegicus
gacattagccgttttacattaccga

SEQ ID NO: 319448 - DNA, 25 bp, Rattus norvegicus
gacattagtccaacattcttcttga

SEQ ID NO: 319449 - DNA, 25 bp, Rattus norvegicus
gacattagtccatcattcttcttga

SEQ ID NO: 319450 - DNA, 25 bp, Rattus norvegicus
gacattagtgaccaattggcaccaa

SEQ ID NO: 319451 - DNA, 25 bp, Rattus norvegicus
gacattagtgacgaattggcaccaa

SEQ ID NO: 319452 - DNA, 25 bp, Rattus norvegicus
gacattatcaccaccttagcagtgt

SEQ ID NO: 319453 - DNA, 25 bp, Rattus norvegicus
gacattatcacctccttagcagtgt

SEQ ID NO: 319454 - DNA, 25 bp, Rattus norvegicus
gacattatctcgatggactgacgcc

SEQ ID NO: 319455 - DNA, 25 bp, Rattus norvegicus
gacattatctcgttggactgacgcc

SEQ ID NO: 319456 - DNA, 25 bp, Rattus norvegicus
gacattatgacaacaacttccaggt

SEQ ID NO: 319457 - DNA, 25 bp, Rattus norvegicus
gacattatgacatcaacttccaggt

SEQ ID NO: 319458 - DNA, 25 bp, Rattus norvegicus
gacattattcatatgtgttgctctt

SEQ ID NO: 319459 - DNA, 25 bp, Rattus norvegicus
gacattattcatttgtgttgctctt

SEQ ID NO: 319460 - DNA, 25 bp, Rattus norvegicus
gacattattttcattcacaacgtta

SEQ ID NO: 319461 - DNA, 25 bp, Rattus norvegicus
gacattattttctttcacaacgtta

SEQ ID NO: 319462 - DNA, 25 bp, Rattus norvegicus
gacattcaacaactaggtggctaaa

SEQ ID NO: 319463 - DNA, 25 bp, Rattus norvegicus
gacattcaacaagtaggtggctaaa

SEQ ID NO: 319464 - DNA, 25 bp, Rattus norvegicus
gacattcacaatactcctgggcaaa

SEQ ID NO: 319465 - DNA, 25 bp, Rattus norvegicus
gacattcacaattctcctgggcaaa

SEQ ID NO: 319466 - DNA, 25 bp, Rattus norvegicus
gacattcacactccagtaggctggg

SEQ ID NO: 319467 - DNA, 25 bp, Rattus norvegicus
gacattcacactgcagtaggctggg

SEQ ID NO: 319468 - DNA, 25 bp, Rattus norvegicus
gacattcacggtataatgacatcat

SEQ ID NO: 319469 - DNA, 25 bp, Rattus norvegicus
gacattcacggtttaatgacatcat

SEQ ID NO: 319470 - DNA, 25 bp, Rattus norvegicus
gacattcagatcatcccttaagggc

SEQ ID NO: 319471 - DNA, 25 bp, Rattus norvegicus
gacattcagatcttcccttaagggc

SEQ ID NO: 319472 - DNA, 25 bp, Rattus norvegicus
gacattcagctgattgtgctatgca

SEQ ID NO: 319473 - DNA, 25 bp, Rattus norvegicus
gacattcagctgcatctcatcacaa

SEQ ID NO: 319474 - DNA, 25 bp, Rattus norvegicus
gacattcagctggatctcatcacaa

SEQ ID NO: 319475 - DNA, 25 bp, Rattus norvegicus
gacattcagctgtttgtgctatgca

SEQ ID NO: 319476 - DNA, 25 bp, Rattus norvegicus
gacattcagggtaaacagcttccgc

SEQ ID NO: 319477 - DNA, 25 bp, Rattus norvegicus
gacattcagggttaacagcttccgc

SEQ ID NO: 319478 - DNA, 25 bp, Rattus norvegicus
gacattcagtctcaagtgaccaact

SEQ ID NO: 319479 - DNA, 25 bp, Rattus norvegicus
gacattcagtctgaagtgaccaact

SEQ ID NO: 319480 - DNA, 25 bp, Rattus norvegicus
gacattcatcgaacactcatggttg

SEQ ID NO: 319481 - DNA, 25 bp, Rattus norvegicus
gacattcatcgatcactcatggttg

SEQ ID NO: 319482 - DNA, 25 bp, Rattus norvegicus
gacattcatgaacttaattcttatt

SEQ ID NO: 319483 - DNA, 25 bp, Rattus norvegicus
gacattcatgaagttaattcttatt

SEQ ID NO: 319484 - DNA, 25 bp, Rattus norvegicus
gacattcatggaccctttcttcata

SEQ ID NO: 319485 - DNA, 25 bp, Rattus norvegicus
gacattcatggagcctttcttcata

SEQ ID NO: 319486 - DNA, 25 bp, Rattus norvegicus
gacattcatgttcctgtttcttata

SEQ ID NO: 319487 - DNA, 25 bp, Rattus norvegicus
gacattcatgttgctgtttcttata

SEQ ID NO: 319488 - DNA, 25 bp, Rattus norvegicus
gacattcattcaccttagcctggga

SEQ ID NO: 319489 - DNA, 25 bp, Rattus norvegicus
gacattcattcagcttagcctggga

SEQ ID NO: 319490 - DNA, 25 bp, Rattus norvegicus
gacattccacacaaacataacactg

SEQ ID NO: 319491 - DNA, 25 bp, Rattus norvegicus
gacattccacactaacataacactg

SEQ ID NO: 319492 - DNA, 25 bp, Rattus norvegicus
gacattccactgaccggatgtaaga

SEQ ID NO: 319493 - DNA, 25 bp, Rattus norvegicus
gacattccactgtccggatgtaaga

SEQ ID NO: 319494 - DNA, 25 bp, Rattus norvegicus
gacattccaggacctagccatttta

SEQ ID NO: 319495 - DNA, 25 bp, Rattus norvegicus
gacattccaggagctagccatttta

SEQ ID NO: 319496 - DNA, 25 bp, Rattus norvegicus
gacattccaggcagcttgattacca

SEQ ID NO: 319497 - DNA, 25 bp, Rattus norvegicus
gacattccaggctgcttgattacca

SEQ ID NO: 319498 - DNA, 25 bp, Rattus norvegicus
gacattccagttcccagtgacaccg

SEQ ID NO: 319499 - DNA, 25 bp, Rattus norvegicus
gacattccagttgccagtgacaccg

SEQ ID NO: 319500 - DNA, 25 bp, Rattus norvegicus
gacattccatgacgcaggagccatt

SEQ ID NO: 319501 - DNA, 25 bp, Rattus norvegicus
gacattccatgaggcaggagccatt

SEQ ID NO: 319502 - DNA, 25 bp, Rattus norvegicus
gacattcccttaagctgtagagcgc

SEQ ID NO: 319503 - DNA, 25 bp, Rattus norvegicus
gacattcccttatgctgtagagcgc

SEQ ID NO: 319504 - DNA, 25 bp, Rattus norvegicus
gacattccgatcagtttctttttta

SEQ ID NO: 319505 - DNA, 25 bp, Rattus norvegicus
gacattccgatctgtttctttttta

SEQ ID NO: 319506 - DNA, 25 bp, Rattus norvegicus
gacattcctgttcagtttccttatt

SEQ ID NO: 319507 - DNA, 25 bp, Rattus norvegicus
gacattcctgttgagtttccttatt

SEQ ID NO: 319508 - DNA, 25 bp, Rattus norvegicus
gacattcctttgctgatcttgttaa

SEQ ID NO: 319509 - DNA, 25 bp, Rattus norvegicus
gacattcctttggtgatcttgttaa

SEQ ID NO: 319510 - DNA, 25 bp, Rattus norvegicus
gacattcgacctaagaggccagctt

SEQ ID NO: 319511 - DNA, 25 bp, Rattus norvegicus
gacattcgaccttagaggccagctt

SEQ ID NO: 319512 - DNA, 25 bp, Rattus norvegicus
gacattctcacacacacttcaagca

SEQ ID NO: 319513 - DNA, 25 bp, Rattus norvegicus
gacattctcacagacacttcaagca

SEQ ID NO: 319514 - DNA, 25 bp, Rattus norvegicus
gacattctcaggagtacagtgactg

SEQ ID NO: 319515 - DNA, 25 bp, Rattus norvegicus
gacattctcaggtgtacagtgactg

SEQ ID NO: 319516 - DNA, 25 bp, Rattus norvegicus
gacattctcccaatgtaattcagtg

SEQ ID NO: 319517 - DNA, 25 bp, Rattus norvegicus
gacattctcccattgtaattcagtg

SEQ ID NO: 319518 - DNA, 25 bp, Rattus norvegicus
gacattctcgatataaagctctcag

SEQ ID NO: 319519 - DNA, 25 bp, Rattus norvegicus
gacattctcgatttaaagctctcag

SEQ ID NO: 319520 - DNA, 25 bp, Rattus norvegicus
gacattctcgccctgggactttgat

SEQ ID NO: 319521 - DNA, 25 bp, Rattus norvegicus
gacattctcgccgtgggactttgat

SEQ ID NO: 319522 - DNA, 25 bp, Rattus norvegicus
gacattctctgccaggtcctgcaga

SEQ ID NO: 319523 - DNA, 25 bp, Rattus norvegicus
gacattctctgcgaggtcctgcaga

SEQ ID NO: 319524 - DNA, 25 bp, Rattus norvegicus
gacattctctggattatagtacaat

SEQ ID NO: 319525 - DNA, 25 bp, Rattus norvegicus
gacattctctggtttatagtacaat

SEQ ID NO: 319526 - DNA, 25 bp, Rattus norvegicus
gacattctgaggatgctagcatgcc

SEQ ID NO: 319527 - DNA, 25 bp, Rattus norvegicus
gacattctgaggttgctagcatgcc

SEQ ID NO: 319528 - DNA, 25 bp, Rattus norvegicus
gacattctgattccagtgacactgg

SEQ ID NO: 319529 - DNA, 25 bp, Rattus norvegicus
gacattctgattgcagtgacactgg

SEQ ID NO: 319530 - DNA, 25 bp, Rattus norvegicus
gacattctgcagatgttcatgccct

SEQ ID NO: 319531 - DNA, 25 bp, Rattus norvegicus
gacattctgcagttgttcatgccct

SEQ ID NO: 319532 - DNA, 25 bp, Rattus norvegicus
gacattctgctacaaagcttctgaa

SEQ ID NO: 319533 - DNA, 25 bp, Rattus norvegicus
gacattctgctagaaagcttctgaa

SEQ ID NO: 319534 - DNA, 25 bp, Rattus norvegicus
gacattctggtgaccttgaacactc

SEQ ID NO: 319535 - DNA, 25 bp, Rattus norvegicus
gacattctggtgtccttgaacactc

SEQ ID NO: 319536 - DNA, 25 bp, Rattus norvegicus
gacattctgtgaatatcagctgtgt

SEQ ID NO: 319537 - DNA, 25 bp, Rattus norvegicus
gacattctgtgattatcagctgtgt

SEQ ID NO: 319538 - DNA, 25 bp, Rattus norvegicus
gacattcttaacaccagatgcaggc

SEQ ID NO: 319539 - DNA, 25 bp, Rattus norvegicus
gacattcttaactccagatgcaggc

SEQ ID NO: 319540 - DNA, 25 bp, Rattus norvegicus
gacattcttcccacttgttggattt

SEQ ID NO: 319541 - DNA, 25 bp, Rattus norvegicus
gacattcttccctcttgttggattt

SEQ ID NO: 319542 - DNA, 25 bp, Rattus norvegicus
gacattcttcgaagcttcatcaaag

SEQ ID NO: 319543 - DNA, 25 bp, Rattus norvegicus
gacattcttcgatgcttcatcaaag

SEQ ID NO: 319544 - DNA, 25 bp, Rattus norvegicus
gacattcttggacagtgaccctgag

SEQ ID NO: 319545 - DNA, 25 bp, Rattus norvegicus
gacattcttggagagtgaccctgag

SEQ ID NO: 319546 - DNA, 25 bp, Rattus norvegicus
gacattcttgtgaagcaactctccc

SEQ ID NO: 319547 - DNA, 25 bp, Rattus norvegicus
gacattcttgtgtagcaactctccc

SEQ ID NO: 319548 - DNA, 25 bp, Rattus norvegicus
gacattcttttgatgttaagttctt

SEQ ID NO: 319549 - DNA, 25 bp, Rattus norvegicus
gacattcttttgttgttaagttctt

SEQ ID NO: 319550 - DNA, 25 bp, Rattus norvegicus
gacattgaaagcactagcctcagcc

SEQ ID NO: 319551 - DNA, 25 bp, Rattus norvegicus
gacattgaaagctctagcctcagcc

SEQ ID NO: 319552 - DNA, 25 bp, Rattus norvegicus
gacattgaacccagcagcaacccag

SEQ ID NO: 319553 - DNA, 25 bp, Rattus norvegicus
gacattgaaccctgcagcaacccag

SEQ ID NO: 319554 - DNA, 25 bp, Rattus norvegicus
gacattgaactcatggaagcgtccc

SEQ ID NO: 319555 - DNA, 25 bp, Rattus norvegicus
gacattgaactcttggaagcgtccc

SEQ ID NO: 319556 - DNA, 25 bp, Rattus norvegicus
gacattgaatacatgttaagtggct

SEQ ID NO: 319557 - DNA, 25 bp, Rattus norvegicus
gacattgaatacttgttaagtggct

SEQ ID NO: 319558 - DNA, 25 bp, Rattus norvegicus
gacattgacaccaaactagacgcaa

SEQ ID NO: 319559 - DNA, 25 bp, Rattus norvegicus
gacattgacacctaactagacgcaa

SEQ ID NO: 319560 - DNA, 25 bp, Rattus norvegicus
gacattgacattcaccatggcgatg

SEQ ID NO: 319561 - DNA, 25 bp, Rattus norvegicus
gacattgacattgaccatggcgatg

SEQ ID NO: 319562 - DNA, 25 bp, Rattus norvegicus
gacattgaccaacacattcctcact

SEQ ID NO: 319563 - DNA, 25 bp, Rattus norvegicus
gacattgaccaagacattcctcact

SEQ ID NO: 319564 - DNA, 25 bp, Rattus norvegicus
gacattgaccttagcaatggcccct

SEQ ID NO: 319565 - DNA, 25 bp, Rattus norvegicus
gacattgacctttgcaatggcccct

SEQ ID NO: 319566 - DNA, 25 bp, Rattus norvegicus
gacattgacgttctttgaatccatg

SEQ ID NO: 319567 - DNA, 25 bp, Rattus norvegicus
gacattgacgttgtttgaatccatg

SEQ ID NO: 319568 - DNA, 25 bp, Rattus norvegicus
gacattgactctacctgtgaacttg

SEQ ID NO: 319569 - DNA, 25 bp, Rattus norvegicus
gacattgactcttcctgtgaacttg

SEQ ID NO: 319570 - DNA, 25 bp, Rattus norvegicus
gacattgactggagatgaccctgag

SEQ ID NO: 319571 - DNA, 25 bp, Rattus norvegicus
gacattgactggtgatgaccctgag

SEQ ID NO: 319572 - DNA, 25 bp, Rattus norvegicus
gacattgagacacgccagcagacag

SEQ ID NO: 319573 - DNA, 25 bp, Rattus norvegicus
gacattgagacaggccagcagacag

SEQ ID NO: 319574 - DNA, 25 bp, Rattus norvegicus
gacattgaggcgctcattggcccgc

SEQ ID NO: 319575 - DNA, 25 bp, Rattus norvegicus
gacattgaggcggtcattggcccgc

SEQ ID NO: 319576 - DNA, 25 bp, Rattus norvegicus
gacattgagtatacttgcctctcac

SEQ ID NO: 319577 - DNA, 25 bp, Rattus norvegicus
gacattgagtattcttgcctctcac

SEQ ID NO: 319578 - DNA, 25 bp, Rattus norvegicus
gacattgagtttcagctgctgacct

SEQ ID NO: 319579 - DNA, 25 bp, Rattus norvegicus
gacattgagtttgagctgctgacct

SEQ ID NO: 319580 - DNA, 25 bp, Rattus norvegicus
gacattgataccaacttcggctgct

SEQ ID NO: 319581 - DNA, 25 bp, Rattus norvegicus
gacattgatacctacttcggctgct

SEQ ID NO: 319582 - DNA, 25 bp, Rattus norvegicus
gacattgatacgactgcggtggaaa

SEQ ID NO: 319583 - DNA, 25 bp, Rattus norvegicus
gacattgatacgatgccagttctga

SEQ ID NO: 319584 - DNA, 25 bp, Rattus norvegicus
gacattgatacgtctgcggtggaaa

SEQ ID NO: 319585 - DNA, 25 bp, Rattus norvegicus
gacattgatacgttgccagttctga

SEQ ID NO: 319586 - DNA, 25 bp, Rattus norvegicus
gacattgatgacctcaagcggcaga

SEQ ID NO: 319587 - DNA, 25 bp, Rattus norvegicus
gacattgatgacgtcaagcggcaga

SEQ ID NO: 319588 - DNA, 25 bp, Rattus norvegicus
gacattgatgccagggagttgcgta

SEQ ID NO: 319589 - DNA, 25 bp, Rattus norvegicus
gacattgatgcctgggagttgcgta

SEQ ID NO: 319590 - DNA, 25 bp, Rattus norvegicus
gacattgatgcgaaagtgcgattga

SEQ ID NO: 319591 - DNA, 25 bp, Rattus norvegicus
gacattgatgcgtaagtgcgattga

SEQ ID NO: 319592 - DNA, 25 bp, Rattus norvegicus
gacattgatttaatacagggcataa

SEQ ID NO: 319593 - DNA, 25 bp, Rattus norvegicus
gacattgatttattacagggcataa

SEQ ID NO: 319594 - DNA, 25 bp, Rattus norvegicus
gacattgcacagacacagctgaaga

SEQ ID NO: 319595 - DNA, 25 bp, Rattus norvegicus
gacattgcacagtcacagctgaaga

SEQ ID NO: 319596 - DNA, 25 bp, Rattus norvegicus
gacattgcatatcctgattttcaag

SEQ ID NO: 319597 - DNA, 25 bp, Rattus norvegicus
gacattgcatatgctgattttcaag

SEQ ID NO: 319598 - DNA, 25 bp, Rattus norvegicus
gacattgcatgcagttagtgctcat

SEQ ID NO: 319599 - DNA, 25 bp, Rattus norvegicus
gacattgcatgctgttagtgctcat

SEQ ID NO: 319600 - DNA, 25 bp, Rattus norvegicus
gacattgccttcctggagtttgaca

SEQ ID NO: 319601 - DNA, 25 bp, Rattus norvegicus
gacattgccttcgtggagtttgaca

SEQ ID NO: 319602 - DNA, 25 bp, Rattus norvegicus
gacattgcggacatcgacaacctgg

SEQ ID NO: 319603 - DNA, 25 bp, Rattus norvegicus
gacattgcggacttcgacaacctgg

SEQ ID NO: 319604 - DNA, 25 bp, Rattus norvegicus
gacattgctattcctttattatata

SEQ ID NO: 319605 - DNA, 25 bp, Rattus norvegicus
gacattgctattgctttattatata

SEQ ID NO: 319606 - DNA, 25 bp, Rattus norvegicus
gacattgctgacaacttccaggcat

SEQ ID NO: 319607 - DNA, 25 bp, Rattus norvegicus
gacattgctgactacttccaggcat

SEQ ID NO: 319608 - DNA, 25 bp, Rattus norvegicus
gacattgctggcaagcgtatgcaga

SEQ ID NO: 319609 - DNA, 25 bp, Rattus norvegicus
gacattgctggctagcgtatgcaga

SEQ ID NO: 319610 - DNA, 25 bp, Rattus norvegicus
gacattgctgtacccatagatcagt

SEQ ID NO: 319611 - DNA, 25 bp, Rattus norvegicus
gacattgctgtagccatagatcagt

SEQ ID NO: 319612 - DNA, 25 bp, Rattus norvegicus
gacattgctgtcaccatgaagaaga

SEQ ID NO: 319613 - DNA, 25 bp, Rattus norvegicus
gacattgctgtccagcaggcggatc

SEQ ID NO: 319614 - DNA, 25 bp, Rattus norvegicus
gacattgctgtcgagcaggcggatc

SEQ ID NO: 319615 - DNA, 25 bp, Rattus norvegicus
gacattgctgtctccatgaagaaga

SEQ ID NO: 319616 - DNA, 25 bp, Rattus norvegicus
gacattgcttttaccacatggaccc

SEQ ID NO: 319617 - DNA, 25 bp, Rattus norvegicus
gacattgctttttccacatggaccc

SEQ ID NO: 319618 - DNA, 25 bp, Rattus norvegicus
gacattggaaggcacgctcgagaat

SEQ ID NO: 319619 - DNA, 25 bp, Rattus norvegicus
gacattggaagggacgctcgagaat

SEQ ID NO: 319620 - DNA, 25 bp, Rattus norvegicus
gacattggaagtccactgtcccttg

SEQ ID NO: 319621 - DNA, 25 bp, Rattus norvegicus
gacattggaagtgcactgtcccttg

SEQ ID NO: 319622 - DNA, 25 bp, Rattus norvegicus
gacattggagctatcttctttcact

SEQ ID NO: 319623 - DNA, 25 bp, Rattus norvegicus
gacattggagctttcttctttcact

SEQ ID NO: 319624 - DNA, 25 bp, Rattus norvegicus
gacattggaggtcagaaggctaaac

SEQ ID NO: 319625 - DNA, 25 bp, Rattus norvegicus
gacattggaggtgagaaggctaaac

SEQ ID NO: 319626 - DNA, 25 bp, Rattus norvegicus
gacattggagttcagtgcttttgac

SEQ ID NO: 319627 - DNA, 25 bp, Rattus norvegicus
gacattggagttgagtgcttttgac

SEQ ID NO: 319628 - DNA, 25 bp, Rattus norvegicus
gacattggatttagatgccctgagt

SEQ ID NO: 319629 - DNA, 25 bp, Rattus norvegicus
gacattggattttgatgccctgagt

SEQ ID NO: 319630 - DNA, 25 bp, Rattus norvegicus
gacattggcaaactcaacgcggttg

SEQ ID NO: 319631 - DNA, 25 bp, Rattus norvegicus
gacattggcaaagtcaacgcggttg

SEQ ID NO: 319632 - DNA, 25 bp, Rattus norvegicus
gacattggcacaagaataaggcccc

SEQ ID NO: 319633 - DNA, 25 bp, Rattus norvegicus
gacattggcacatgaataaggcccc

SEQ ID NO: 319634 - DNA, 25 bp, Rattus norvegicus
gacattggcatcagtaatactctcg

SEQ ID NO: 319635 - DNA, 25 bp, Rattus norvegicus
gacattggcatctgtaatactctcg

SEQ ID NO: 319636 - DNA, 25 bp, Rattus norvegicus
gacattggcgcaagagttcccagga

SEQ ID NO: 319637 - DNA, 25 bp, Rattus norvegicus
gacattggcgcatgagttcccagga

SEQ ID NO: 319638 - DNA, 25 bp, Rattus norvegicus
gacattggcgccaagcagaaaatgc

SEQ ID NO: 319639 - DNA, 25 bp, Rattus norvegicus
gacattggcgcctagcagaaaatgc

SEQ ID NO: 319640 - DNA, 25 bp, Rattus norvegicus
gacattggctagcaagtgcatctat

SEQ ID NO: 319641 - DNA, 25 bp, Rattus norvegicus
gacattggctaggaagtgcatctat

SEQ ID NO: 319642 - DNA, 25 bp, Rattus norvegicus
gacattggctggcagttgcttcgaa

SEQ ID NO: 319643 - DNA, 25 bp, Rattus norvegicus
gacattggctgggagttgcttcgaa

SEQ ID NO: 319644 - DNA, 25 bp, Rattus norvegicus
gacattggctttaagaagttacagt

SEQ ID NO: 319645 - DNA, 25 bp, Rattus norvegicus
gacattggcttttagaagttacagt

SEQ ID NO: 319646 - DNA, 25 bp, Rattus norvegicus
gacattgggacacatctactacctg

SEQ ID NO: 319647 - DNA, 25 bp, Rattus norvegicus
gacattgggacagatctactacctg

SEQ ID NO: 319648 - DNA, 25 bp, Rattus norvegicus
gacattgggaggacctttgatacat

SEQ ID NO: 319649 - DNA, 25 bp, Rattus norvegicus
gacattgggaggtcctttgatacat

SEQ ID NO: 319650 - DNA, 25 bp, Rattus norvegicus
gacattgggatcattctgagcatac

SEQ ID NO: 319651 - DNA, 25 bp, Rattus norvegicus
gacattgggatctttctgagcatac

SEQ ID NO: 319652 - DNA, 25 bp, Rattus norvegicus
gacattgggcaaacgagataaatct

SEQ ID NO: 319653 - DNA, 25 bp, Rattus norvegicus
gacattgggcaatcgagataaatct

SEQ ID NO: 319654 - DNA, 25 bp, Rattus norvegicus
gacattgggcttacagagttgtttg

SEQ ID NO: 319655 - DNA, 25 bp, Rattus norvegicus
gacattgggctttcagagttgtttg

SEQ ID NO: 319656 - DNA, 25 bp, Rattus norvegicus
gacattgggttcaactgacctggca

SEQ ID NO: 319657 - DNA, 25 bp, Rattus norvegicus
gacattgggttctactgacctggca

SEQ ID NO: 319658 - DNA, 25 bp, Rattus norvegicus
gacattggtaaaacactgcagtggg

SEQ ID NO: 319659 - DNA, 25 bp, Rattus norvegicus
gacattggtaaatcactgcagtggg

SEQ ID NO: 319660 - DNA, 25 bp, Rattus norvegicus
gacattggtctcaatttgagattgg

SEQ ID NO: 319661 - DNA, 25 bp, Rattus norvegicus
gacattggtctctatttgagattgg

SEQ ID NO: 319662 - DNA, 25 bp, Rattus norvegicus
gacattggtgctcaactgtggttag

SEQ ID NO: 319663 - DNA, 25 bp, Rattus norvegicus
gacattggtgctgaactgtggttag

SEQ ID NO: 319664 - DNA, 25 bp, Rattus norvegicus
gacattggtggtcctgatcaagaat

SEQ ID NO: 319665 - DNA, 25 bp, Rattus norvegicus
gacattggtggtgctgatcaagaat

SEQ ID NO: 319666 - DNA, 25 bp, Rattus norvegicus
gacattggttgtagtttctgctcag

SEQ ID NO: 319667 - DNA, 25 bp, Rattus norvegicus
gacattggttgttgtttctgctcag

SEQ ID NO: 319668 - DNA, 25 bp, Rattus norvegicus
gacattgtagatcgtactggagttt

SEQ ID NO: 319669 - DNA, 25 bp, Rattus norvegicus
gacattgtagatggtactggagttt

SEQ ID NO: 319670 - DNA, 25 bp, Rattus norvegicus
gacattgtataactgcccgtgtgtt

SEQ ID NO: 319671 - DNA, 25 bp, Rattus norvegicus
gacattgtataagtgcccgtgtgtt

SEQ ID NO: 319672 - DNA, 25 bp, Rattus norvegicus
gacattgtatcacgtataagccatc

SEQ ID NO: 319673 - DNA, 25 bp, Rattus norvegicus
gacattgtatcaggtataagccatc

SEQ ID NO: 319674 - DNA, 25 bp, Rattus norvegicus
gacattgtatgtatctggtttccca

SEQ ID NO: 319675 - DNA, 25 bp, Rattus norvegicus
gacattgtatgtttctggtttccca

SEQ ID NO: 319676 - DNA, 25 bp, Rattus norvegicus
gacattgtccagaactcttcaattt

SEQ ID NO: 319677 - DNA, 25 bp, Rattus norvegicus
gacattgtccagtactcttcaattt

SEQ ID NO: 319678 - DNA, 25 bp, Rattus norvegicus
gacattgtcccaacagacagttcct

SEQ ID NO: 319679 - DNA, 25 bp, Rattus norvegicus
gacattgtcccatcagacagttcct

SEQ ID NO: 319680 - DNA, 25 bp, Rattus norvegicus
gacattgtcgcaagtcacagaatta

SEQ ID NO: 319681 - DNA, 25 bp, Rattus norvegicus
gacattgtcgcatgtcacagaatta

SEQ ID NO: 319682 - DNA, 25 bp, Rattus norvegicus
gacattgtctaaaccattggcactt

SEQ ID NO: 319683 - DNA, 25 bp, Rattus norvegicus
gacattgtctaatccattggcactt

SEQ ID NO: 319684 - DNA, 25 bp, Rattus norvegicus
gacattgtctgaatgcaggccaact

SEQ ID NO: 319685 - DNA, 25 bp, Rattus norvegicus
gacattgtctgattgcaggccaact

SEQ ID NO: 319686 - DNA, 25 bp, Rattus norvegicus
gacattgtcttcaccatcgacagtg

SEQ ID NO: 319687 - DNA, 25 bp, Rattus norvegicus
gacattgtcttctccatcgacagtg

SEQ ID NO: 319688 - DNA, 25 bp, Rattus norvegicus
gacattgtctttaggttgtgaccac

SEQ ID NO: 319689 - DNA, 25 bp, Rattus norvegicus
gacattgtcttttggttgtgaccac

SEQ ID NO: 319690 - DNA, 25 bp, Rattus norvegicus
gacattgtgaaacccatcgctcgtc

SEQ ID NO: 319691 - DNA, 25 bp, Rattus norvegicus
gacattgtgaaagccatcgctcgtc

SEQ ID NO: 319692 - DNA, 25 bp, Rattus norvegicus
gacattgtgattacggtggttcctg

SEQ ID NO: 319693 - DNA, 25 bp, Rattus norvegicus
gacattgtgatttcggtggttcctg

SEQ ID NO: 319694 - DNA, 25 bp, Rattus norvegicus
gacattgtgccaaataattcctttt

SEQ ID NO: 319695 - DNA, 25 bp, Rattus norvegicus
gacattgtgccatataattcctttt

SEQ ID NO: 319696 - DNA, 25 bp, Rattus norvegicus
gacattgtggctcagttcgggccca

SEQ ID NO: 319697 - DNA, 25 bp, Rattus norvegicus
gacattgtggctgagttcgggccca

SEQ ID NO: 319698 - DNA, 25 bp, Rattus norvegicus
gacattgtgtgcatgaaacaaggct

SEQ ID NO: 319699 - DNA, 25 bp, Rattus norvegicus
gacattgtgtgcttgaaacaaggct

SEQ ID NO: 319700 - DNA, 25 bp, Rattus norvegicus
gacattgtgtgtagtgtgacctgga

SEQ ID NO: 319701 - DNA, 25 bp, Rattus norvegicus
gacattgtgtgttgtgtgacctgga

SEQ ID NO: 319702 - DNA, 25 bp, Rattus norvegicus
gacattgtgttgatgttcctgccca

SEQ ID NO: 319703 - DNA, 25 bp, Rattus norvegicus
gacattgtgttgcacgtcagcagca

SEQ ID NO: 319704 - DNA, 25 bp, Rattus norvegicus
gacattgtgttggacgtcagcagca

SEQ ID NO: 319705 - DNA, 25 bp, Rattus norvegicus
gacattgtgttgttgttcctgccca

SEQ ID NO: 319706 - DNA, 25 bp, Rattus norvegicus
gacattgtgtttacgtcactggcat

SEQ ID NO: 319707 - DNA, 25 bp, Rattus norvegicus
gacattgtgttttcgtcactggcat

SEQ ID NO: 319708 - DNA, 25 bp, Rattus norvegicus
gacattgttaacagtttccatgaat

SEQ ID NO: 319709 - DNA, 25 bp, Rattus norvegicus
gacattgttaactgtttccatgaat

SEQ ID NO: 319710 - DNA, 25 bp, Rattus norvegicus
gacattgttaccacttctgtgtatg

SEQ ID NO: 319711 - DNA, 25 bp, Rattus norvegicus
gacattgttaccctactcttgaata

SEQ ID NO: 319712 - DNA, 25 bp, Rattus norvegicus
gacattgttaccgtactcttgaata

SEQ ID NO: 319713 - DNA, 25 bp, Rattus norvegicus
gacattgttacctcttctgtgtatg

SEQ ID NO: 319714 - DNA, 25 bp, Rattus norvegicus
gacattgttatgctaaagtcttcca

SEQ ID NO: 319715 - DNA, 25 bp, Rattus norvegicus
gacattgttatggtaaagtcttcca

SEQ ID NO: 319716 - DNA, 25 bp, Rattus norvegicus
gacattgttcacagactagtacaca

SEQ ID NO: 319717 - DNA, 25 bp, Rattus norvegicus
gacattgttcactgactagtacaca

SEQ ID NO: 319718 - DNA, 25 bp, Rattus norvegicus
gacattgttctgcattacgctttgt

SEQ ID NO: 319719 - DNA, 25 bp, Rattus norvegicus
gacattgttctggattacgctttgt

SEQ ID NO: 319720 - DNA, 25 bp, Rattus norvegicus
gacattgttcttcaagactcccggg

SEQ ID NO: 319721 - DNA, 25 bp, Rattus norvegicus
gacattgttcttgaagactcccggg

SEQ ID NO: 319722 - DNA, 25 bp, Rattus norvegicus
gacattgttggccaaagtaccctaa

SEQ ID NO: 319723 - DNA, 25 bp, Rattus norvegicus
gacattgttggcgaaagtaccctaa

SEQ ID NO: 319724 - DNA, 25 bp, Rattus norvegicus
gacattgtttcaacctgaatcacaa

SEQ ID NO: 319725 - DNA, 25 bp, Rattus norvegicus
gacattgtttcatcctgaatcacaa

SEQ ID NO: 319726 - DNA, 25 bp, Rattus norvegicus
gacattgtttgtccctactttatct

SEQ ID NO: 319727 - DNA, 25 bp, Rattus norvegicus
gacattgtttgtgcctactttatct

SEQ ID NO: 319728 - DNA, 25 bp, Rattus norvegicus
gacatttaacatcaccggccttagc

SEQ ID NO: 319729 - DNA, 25 bp, Rattus norvegicus
gacatttaacatgaccggccttagc

SEQ ID NO: 319730 - DNA, 25 bp, Rattus norvegicus
gacatttaactcaggtgcggtaacc

SEQ ID NO: 319731 - DNA, 25 bp, Rattus norvegicus
gacatttaactctggtgcggtaacc

SEQ ID NO: 319732 - DNA, 25 bp, Rattus norvegicus
gacatttaactgatttctctcctcg

SEQ ID NO: 319733 - DNA, 25 bp, Rattus norvegicus
gacatttaactgttttctctcctcg

SEQ ID NO: 319734 - DNA, 25 bp, Rattus norvegicus
gacatttaattcaagttacctgaga

SEQ ID NO: 319735 - DNA, 25 bp, Rattus norvegicus
gacatttaattctagttacctgaga

SEQ ID NO: 319736 - DNA, 25 bp, Rattus norvegicus
gacatttacagtcttggtattgatc

SEQ ID NO: 319737 - DNA, 25 bp, Rattus norvegicus
gacatttacagtgttggtattgatc

SEQ ID NO: 319738 - DNA, 25 bp, Rattus norvegicus
gacatttactcaaggactggtttaa

SEQ ID NO: 319739 - DNA, 25 bp, Rattus norvegicus
gacatttactcatggactggtttaa

SEQ ID NO: 319740 - DNA, 25 bp, Rattus norvegicus
gacatttagggcagcctccagagtt

SEQ ID NO: 319741 - DNA, 25 bp, Rattus norvegicus
gacatttagggctgcctccagagtt

SEQ ID NO: 319742 - DNA, 25 bp, Rattus norvegicus
gacatttagtatctcttgtaggttc

SEQ ID NO: 319743 - DNA, 25 bp, Rattus norvegicus
gacatttagtatgtcttgtaggttc

SEQ ID NO: 319744 - DNA, 25 bp, Rattus norvegicus
gacatttatacacatcctgtttctg

SEQ ID NO: 319745 - DNA, 25 bp, Rattus norvegicus
gacatttatacagatcctgtttctg

SEQ ID NO: 319746 - DNA, 25 bp, Rattus norvegicus
gacatttatactacgtgactgcata

SEQ ID NO: 319747 - DNA, 25 bp, Rattus norvegicus
gacatttatacttcgtgactgcata

SEQ ID NO: 319748 - DNA, 25 bp, Rattus norvegicus
gacatttatcttagcaggttcttaa

SEQ ID NO: 319749 - DNA, 25 bp, Rattus norvegicus
gacatttatctttgcaggttcttaa

SEQ ID NO: 319750 - DNA, 25 bp, Rattus norvegicus
gacatttatgaaccacctggcgaca

SEQ ID NO: 319751 - DNA, 25 bp, Rattus norvegicus
gacatttatgaagcacctggcgaca

SEQ ID NO: 319752 - DNA, 25 bp, Rattus norvegicus
gacatttatgttcggcctttaaggc

SEQ ID NO: 319753 - DNA, 25 bp, Rattus norvegicus
gacatttatgttgggcctttaaggc

SEQ ID NO: 319754 - DNA, 25 bp, Rattus norvegicus
gacatttattctcagttatactgag

SEQ ID NO: 319755 - DNA, 25 bp, Rattus norvegicus
gacatttattctgagttatactgag

SEQ ID NO: 319756 - DNA, 25 bp, Rattus norvegicus
gacatttattgtcccatctcttcct

SEQ ID NO: 319757 - DNA, 25 bp, Rattus norvegicus
gacatttattgtgccatctcttcct

SEQ ID NO: 319758 - DNA, 25 bp, Rattus norvegicus
gacatttattttaactattgcccta

SEQ ID NO: 319759 - DNA, 25 bp, Rattus norvegicus
gacatttatttttactattgcccta

SEQ ID NO: 319760 - DNA, 25 bp, Rattus norvegicus
gacatttcaaatactataaccccga

SEQ ID NO: 319761 - DNA, 25 bp, Rattus norvegicus
gacatttcaaattctataaccccga

SEQ ID NO: 319762 - DNA, 25 bp, Rattus norvegicus
gacatttcaaggatagcccaagctg

SEQ ID NO: 319763 - DNA, 25 bp, Rattus norvegicus
gacatttcaaggcagctctcaggac

SEQ ID NO: 319764 - DNA, 25 bp, Rattus norvegicus
gacatttcaagggagctctcaggac

SEQ ID NO: 319765 - DNA, 25 bp, Rattus norvegicus
gacatttcaaggttagcccaagctg

SEQ ID NO: 319766 - DNA, 25 bp, Rattus norvegicus
gacatttcagatccaaggcacggca

SEQ ID NO: 319767 - DNA, 25 bp, Rattus norvegicus
gacatttcagatgcaaggcacggca

SEQ ID NO: 319768 - DNA, 25 bp, Rattus norvegicus
gacatttcagcaattttcctcctgg

SEQ ID NO: 319769 - DNA, 25 bp, Rattus norvegicus
gacatttcagcatttttcctcctgg

SEQ ID NO: 319770 - DNA, 25 bp, Rattus norvegicus
gacatttcagggacaagctagacag

SEQ ID NO: 319771 - DNA, 25 bp, Rattus norvegicus
gacatttcagggtcaagctagacag

SEQ ID NO: 319772 - DNA, 25 bp, Rattus norvegicus
gacatttcaggtactagggcactca

SEQ ID NO: 319773 - DNA, 25 bp, Rattus norvegicus
gacatttcaggttctagggcactca

SEQ ID NO: 319774 - DNA, 25 bp, Rattus norvegicus
gacatttcagttacaaggagttaaa

SEQ ID NO: 319775 - DNA, 25 bp, Rattus norvegicus
gacatttcagtttcaaggagttaaa

SEQ ID NO: 319776 - DNA, 25 bp, Rattus norvegicus
gacatttcatgtcgtgagtgattat

SEQ ID NO: 319777 - DNA, 25 bp, Rattus norvegicus
gacatttcatgtggtgagtgattat

SEQ ID NO: 319778 - DNA, 25 bp, Rattus norvegicus
gacatttccagtcgtgtctttactg

SEQ ID NO: 319779 - DNA, 25 bp, Rattus norvegicus
gacatttccagtggtgtctttactg

SEQ ID NO: 319780 - DNA, 25 bp, Rattus norvegicus
gacatttcccaacttcctggaccgg

SEQ ID NO: 319781 - DNA, 25 bp, Rattus norvegicus
gacatttcccaagttcctggaccgg

SEQ ID NO: 319782 - DNA, 25 bp, Rattus norvegicus
gacatttcctacactttggatatag

SEQ ID NO: 319783 - DNA, 25 bp, Rattus norvegicus
gacatttcctactctttggatatag

SEQ ID NO: 319784 - DNA, 25 bp, Rattus norvegicus
gacatttcctgacgctacacagaga

SEQ ID NO: 319785 - DNA, 25 bp, Rattus norvegicus
gacatttcctgaggctacacagaga

SEQ ID NO: 319786 - DNA, 25 bp, Rattus norvegicus
gacatttcgggcaaactctctttgc

SEQ ID NO: 319787 - DNA, 25 bp, Rattus norvegicus
gacatttcgggctaactctctttgc

SEQ ID NO: 319788 - DNA, 25 bp, Rattus norvegicus
gacatttctaaccatggcaccaagc

SEQ ID NO: 319789 - DNA, 25 bp, Rattus norvegicus
gacatttctaacgatggcaccaagc

SEQ ID NO: 319790 - DNA, 25 bp, Rattus norvegicus
gacatttctaagctcaaggctttta

SEQ ID NO: 319791 - DNA, 25 bp, Rattus norvegicus
gacatttctaaggtcaaggctttta

SEQ ID NO: 319792 - DNA, 25 bp, Rattus norvegicus
gacatttctacaatgcagcagcaca

SEQ ID NO: 319793 - DNA, 25 bp, Rattus norvegicus
gacatttctacattgcagcagcaca

SEQ ID NO: 319794 - DNA, 25 bp, Rattus norvegicus
gacatttctaccatttgacatctgg

SEQ ID NO: 319795 - DNA, 25 bp, Rattus norvegicus
gacatttctaccttttgacatctgg

SEQ ID NO: 319796 - DNA, 25 bp, Rattus norvegicus
gacatttctagtattagcgaccaag

SEQ ID NO: 319797 - DNA, 25 bp, Rattus norvegicus
gacatttctagttttagcgaccaag

SEQ ID NO: 319798 - DNA, 25 bp, Rattus norvegicus
gacatttctcaacaagttttctgga

SEQ ID NO: 319799 - DNA, 25 bp, Rattus norvegicus
gacatttctcaagaagttttctgga

SEQ ID NO: 319800 - DNA, 25 bp, Rattus norvegicus
gacatttctcacaaagtgctatggg

SEQ ID NO: 319801 - DNA, 25 bp, Rattus norvegicus
gacatttctcactaagtgctatggg

SEQ ID NO: 319802 - DNA, 25 bp, Rattus norvegicus
gacatttctcatagtgtgtacttaa

SEQ ID NO: 319803 - DNA, 25 bp, Rattus norvegicus
gacatttctcattgtgtgtacttaa

SEQ ID NO: 319804 - DNA, 25 bp, Rattus norvegicus
gacatttctcccaccaggtggagca

SEQ ID NO: 319805 - DNA, 25 bp, Rattus norvegicus
gacatttctccctccaggtggagca

SEQ ID NO: 319806 - DNA, 25 bp, Rattus norvegicus
gacatttctgagacagccaaggact

SEQ ID NO: 319807 - DNA, 25 bp, Rattus norvegicus
gacatttctgagtcagccaaggact

SEQ ID NO: 319808 - DNA, 25 bp, Rattus norvegicus
gacatttctggcattaagcctgtgt

SEQ ID NO: 319809 - DNA, 25 bp, Rattus norvegicus
gacatttctggctttaagcctgtgt

SEQ ID NO: 319810 - DNA, 25 bp, Rattus norvegicus
gacatttctgttactcgtagttggt

SEQ ID NO: 319811 - DNA, 25 bp, Rattus norvegicus
gacatttctgttagtgaggcgagca

SEQ ID NO: 319812 - DNA, 25 bp, Rattus norvegicus
gacatttctgtttctcgtagttggt

SEQ ID NO: 319813 - DNA, 25 bp, Rattus norvegicus
gacatttctgtttgtgaggcgagca

SEQ ID NO: 319814 - DNA, 25 bp, Rattus norvegicus
gacatttctttaagccaggttgaca

SEQ ID NO: 319815 - DNA, 25 bp, Rattus norvegicus
gacatttctttatgccaggttgaca

SEQ ID NO: 319816 - DNA, 25 bp, Rattus norvegicus
gacatttgataacagaggcgggcct

SEQ ID NO: 319817 - DNA, 25 bp, Rattus norvegicus
gacatttgataagagaggcgggcct

SEQ ID NO: 319818 - DNA, 25 bp, Rattus norvegicus
gacatttgatctcattttgcctttc

SEQ ID NO: 319819 - DNA, 25 bp, Rattus norvegicus
gacatttgatctgattttgcctttc

SEQ ID NO: 319820 - DNA, 25 bp, Rattus norvegicus
gacatttgatttaccacttgtagca

SEQ ID NO: 319821 - DNA, 25 bp, Rattus norvegicus
gacatttgattttccacttgtagca

SEQ ID NO: 319822 - DNA, 25 bp, Rattus norvegicus
gacatttgcaggattgccttggtct

SEQ ID NO: 319823 - DNA, 25 bp, Rattus norvegicus
gacatttgcaggtttgccttggtct

SEQ ID NO: 319824 - DNA, 25 bp, Rattus norvegicus
gacatttgcataatctcttccatag

SEQ ID NO: 319825 - DNA, 25 bp, Rattus norvegicus
gacatttgcatacacttgatttcct

SEQ ID NO: 319826 - DNA, 25 bp, Rattus norvegicus
gacatttgcatagacttgatttcct

SEQ ID NO: 319827 - DNA, 25 bp, Rattus norvegicus
gacatttgcatattctcttccatag

SEQ ID NO: 319828 - DNA, 25 bp, Rattus norvegicus
gacatttggaagacctcacatccga

SEQ ID NO: 319829 - DNA, 25 bp, Rattus norvegicus
gacatttggaagtcctcacatccga

SEQ ID NO: 319830 - DNA, 25 bp, Rattus norvegicus
gacatttggacgatcatggagtttc

SEQ ID NO: 319831 - DNA, 25 bp, Rattus norvegicus
gacatttggacgctgatggacttag

SEQ ID NO: 319832 - DNA, 25 bp, Rattus norvegicus
gacatttggacggtgatggacttag

SEQ ID NO: 319833 - DNA, 25 bp, Rattus norvegicus
gacatttggacgttcatggagtttc

SEQ ID NO: 319834 - DNA, 25 bp, Rattus norvegicus
gacatttgggctagtggcctttcaa

SEQ ID NO: 319835 - DNA, 25 bp, Rattus norvegicus
gacatttgggcttgtggcctttcaa

SEQ ID NO: 319836 - DNA, 25 bp, Rattus norvegicus
gacatttggtataaacagctgtgct

SEQ ID NO: 319837 - DNA, 25 bp, Rattus norvegicus
gacatttggtattaacagctgtgct

SEQ ID NO: 319838 - DNA, 25 bp, Rattus norvegicus
gacatttggtcacgtggtttctcat

SEQ ID NO: 319839 - DNA, 25 bp, Rattus norvegicus
gacatttggtcaggtggtttctcat

SEQ ID NO: 319840 - DNA, 25 bp, Rattus norvegicus
gacatttgtagcagctgactttcct

SEQ ID NO: 319841 - DNA, 25 bp, Rattus norvegicus
gacatttgtagctgctgactttcct

SEQ ID NO: 319842 - DNA, 25 bp, Rattus norvegicus
gacatttgtcctctgggagactcta

SEQ ID NO: 319843 - DNA, 25 bp, Rattus norvegicus
gacatttgtcctgtgggagactcta

SEQ ID NO: 319844 - DNA, 25 bp, Rattus norvegicus
gacatttgtgtcagctatcttcata

SEQ ID NO: 319845 - DNA, 25 bp, Rattus norvegicus
gacatttgtgtctgctatcttcata

SEQ ID NO: 319846 - DNA, 25 bp, Rattus norvegicus
gacatttgttgtagatctccctttg

SEQ ID NO: 319847 - DNA, 25 bp, Rattus norvegicus
gacatttgttgtagccctatcttct

SEQ ID NO: 319848 - DNA, 25 bp, Rattus norvegicus
gacatttgttgttgatctccctttg

SEQ ID NO: 319849 - DNA, 25 bp, Rattus norvegicus
gacatttgttgttgccctatcttct

SEQ ID NO: 319850 - DNA, 25 bp, Rattus norvegicus
gacattttaaccacagtgtgactaa

SEQ ID NO: 319851 - DNA, 25 bp, Rattus norvegicus
gacattttaacctcagtgtgactaa

SEQ ID NO: 319852 - DNA, 25 bp, Rattus norvegicus
gacattttaagaatcagttcctgat

SEQ ID NO: 319853 - DNA, 25 bp, Rattus norvegicus
gacattttaagattcagttcctgat

SEQ ID NO: 319854 - DNA, 25 bp, Rattus norvegicus
gacattttaagcacagttctgatga

SEQ ID NO: 319855 - DNA, 25 bp, Rattus norvegicus
gacattttaagctcagttctgatga

SEQ ID NO: 319856 - DNA, 25 bp, Rattus norvegicus
gacattttaattcaccacatggatt

SEQ ID NO: 319857 - DNA, 25 bp, Rattus norvegicus
gacattttaattgaccacatggatt

SEQ ID NO: 319858 - DNA, 25 bp, Rattus norvegicus
gacattttacctattcagatcactt

SEQ ID NO: 319859 - DNA, 25 bp, Rattus norvegicus
gacattttaccttttcagatcactt

SEQ ID NO: 319860 - DNA, 25 bp, Rattus norvegicus
gacattttagtcagggtatttacat

SEQ ID NO: 319861 - DNA, 25 bp, Rattus norvegicus
gacattttagtctgggtatttacat

SEQ ID NO: 319862 - DNA, 25 bp, Rattus norvegicus
gacattttatacagtcccctggtgc

SEQ ID NO: 319863 - DNA, 25 bp, Rattus norvegicus
gacattttatactgtcccctggtgc

SEQ ID NO: 319864 - DNA, 25 bp, Rattus norvegicus
gacattttatctagtccgtgaagat

SEQ ID NO: 319865 - DNA, 25 bp, Rattus norvegicus
gacattttatcttgtccgtgaagat

SEQ ID NO: 319866 - DNA, 25 bp, Rattus norvegicus
gacattttatgtcacttactaaccc

SEQ ID NO: 319867 - DNA, 25 bp, Rattus norvegicus
gacattttatgtgacttactaaccc

SEQ ID NO: 319868 - DNA, 25 bp, Rattus norvegicus
gacattttattcaaccacacacgga

SEQ ID NO: 319869 - DNA, 25 bp, Rattus norvegicus
gacattttattctaccacacacgga

SEQ ID NO: 319870 - DNA, 25 bp, Rattus norvegicus
gacattttattgcagcccgtttaac

SEQ ID NO: 319871 - DNA, 25 bp, Rattus norvegicus
gacattttattggagcccgtttaac

SEQ ID NO: 319872 - DNA, 25 bp, Rattus norvegicus
gacattttcacacccactgtctgtc

SEQ ID NO: 319873 - DNA, 25 bp, Rattus norvegicus
gacattttcacacttatgacagctt

SEQ ID NO: 319874 - DNA, 25 bp, Rattus norvegicus
gacattttcacagccactgtctgtc

SEQ ID NO: 319875 - DNA, 25 bp, Rattus norvegicus
gacattttcacagttatgacagctt

SEQ ID NO: 319876 - DNA, 25 bp, Rattus norvegicus
gacattttcagtccgtgaatactca

SEQ ID NO: 319877 - DNA, 25 bp, Rattus norvegicus
gacattttcagtgcgtgaatactca

SEQ ID NO: 319878 - DNA, 25 bp, Rattus norvegicus
gacattttcattacattaccattca

SEQ ID NO: 319879 - DNA, 25 bp, Rattus norvegicus
gacattttcatttcattaccattca

SEQ ID NO: 319880 - DNA, 25 bp, Rattus norvegicus
gacattttccagctacagtgttttg

SEQ ID NO: 319881 - DNA, 25 bp, Rattus norvegicus
gacattttccaggtacagtgttttg

SEQ ID NO: 319882 - DNA, 25 bp, Rattus norvegicus
gacattttccctacaagagccgagt

SEQ ID NO: 319883 - DNA, 25 bp, Rattus norvegicus
gacattttcccttcaagagccgagt

SEQ ID NO: 319884 - DNA, 25 bp, Rattus norvegicus
gacattttcggactcacattgcgca

SEQ ID NO: 319885 - DNA, 25 bp, Rattus norvegicus
gacattttcggagtcacattgcgca

SEQ ID NO: 319886 - DNA, 25 bp, Rattus norvegicus
gacattttcttaccatctccttaga

SEQ ID NO: 319887 - DNA, 25 bp, Rattus norvegicus
gacattttcttagcatctccttaga

SEQ ID NO: 319888 - DNA, 25 bp, Rattus norvegicus
gacattttcttgaattcccagcact

SEQ ID NO: 319889 - DNA, 25 bp, Rattus norvegicus
gacattttcttgtattcccagcact

SEQ ID NO: 319890 - DNA, 25 bp, Rattus norvegicus
gacattttgaatctcccactggact

SEQ ID NO: 319891 - DNA, 25 bp, Rattus norvegicus
gacattttgaatgtcccactggact

SEQ ID NO: 319892 - DNA, 25 bp, Rattus norvegicus
gacattttgacacacacagcctgaa

SEQ ID NO: 319893 - DNA, 25 bp, Rattus norvegicus
gacattttgacagacacagcctgaa

SEQ ID NO: 319894 - DNA, 25 bp, Rattus norvegicus
gacattttgagcatcctggagtcgc

SEQ ID NO: 319895 - DNA, 25 bp, Rattus norvegicus
gacattttgagcttcctggagtcgc

SEQ ID NO: 319896 - DNA, 25 bp, Rattus norvegicus
gacattttgcctcattcatttgcca

SEQ ID NO: 319897 - DNA, 25 bp, Rattus norvegicus
gacattttgcctgattcatttgcca

SEQ ID NO: 319898 - DNA, 25 bp, Rattus norvegicus
gacattttgctaatgtgtgctttga

SEQ ID NO: 319899 - DNA, 25 bp, Rattus norvegicus
gacattttgctattgtgtgctttga

SEQ ID NO: 319900 - DNA, 25 bp, Rattus norvegicus
gacattttgttcataaccagtgtga

SEQ ID NO: 319901 - DNA, 25 bp, Rattus norvegicus
gacattttgttcttaaccagtgtga

SEQ ID NO: 319902 - DNA, 25 bp, Rattus norvegicus
gacattttgttgaacctatgactgt

SEQ ID NO: 319903 - DNA, 25 bp, Rattus norvegicus
gacattttgttgtacctatgactgt

SEQ ID NO: 319904 - DNA, 25 bp, Rattus norvegicus
gacattttgtttcattggtgcgctg

SEQ ID NO: 319905 - DNA, 25 bp, Rattus norvegicus
gacattttgtttcctatcagctttg

SEQ ID NO: 319906 - DNA, 25 bp, Rattus norvegicus
gacattttgtttgattggtgcgctg

SEQ ID NO: 319907 - DNA, 25 bp, Rattus norvegicus
gacattttgtttgctatcagctttg

SEQ ID NO: 319908 - DNA, 25 bp, Rattus norvegicus
gacatttttacaccttgcacttctg

SEQ ID NO: 319909 - DNA, 25 bp, Rattus norvegicus
gacatttttacagcttgcacttctg

SEQ ID NO: 319910 - DNA, 25 bp, Rattus norvegicus
gacatttttaccactcctgtgtatg

SEQ ID NO: 319911 - DNA, 25 bp, Rattus norvegicus
gacatttttacctctcctgtgtatg

SEQ ID NO: 319912 - DNA, 25 bp, Rattus norvegicus
gacatttttctcaacaggaatccat

SEQ ID NO: 319913 - DNA, 25 bp, Rattus norvegicus
gacatttttctctacaggaatccat

SEQ ID NO: 319914 - DNA, 25 bp, Rattus norvegicus
gacatttttgatcctttatcccagg

SEQ ID NO: 319915 - DNA, 25 bp, Rattus norvegicus
gacatttttgatgctttatcccagg

SEQ ID NO: 319916 - DNA, 25 bp, Rattus norvegicus
gacatttttgctattggctctctga

SEQ ID NO: 319917 - DNA, 25 bp, Rattus norvegicus
gacatttttgcttttggctctctga

SEQ ID NO: 319918 - DNA, 25 bp, Rattus norvegicus
gacattttttcccatgcggttgcca

SEQ ID NO: 319919 - DNA, 25 bp, Rattus norvegicus
gacattttttccctcggtagtctgc

SEQ ID NO: 319920 - DNA, 25 bp, Rattus norvegicus
gacattttttccgatgcggttgcca

SEQ ID NO: 319921 - DNA, 25 bp, Rattus norvegicus
gacattttttccgtcggtagtctgc

SEQ ID NO: 319922 - DNA, 25 bp, Rattus norvegicus
gaccaaaaatcgatctctgtttgag

SEQ ID NO: 319923 - DNA, 25 bp, Rattus norvegicus
gaccaaaaatcgttctctgtttgag

SEQ ID NO: 319924 - DNA, 25 bp, Rattus norvegicus
gaccaaaaattcagatgaccgcatc

SEQ ID NO: 319925 - DNA, 25 bp, Rattus norvegicus
gaccaaaaattctgatgaccgcatc

SEQ ID NO: 319926 - DNA, 25 bp, Rattus norvegicus
gaccaaaacatgagccacttccagt

SEQ ID NO: 319927 - DNA, 25 bp, Rattus norvegicus
gaccaaaacatgtgccacttccagt

SEQ ID NO: 319928 - DNA, 25 bp, Rattus norvegicus
gaccaaaagccaataagttcagata

SEQ ID NO: 319929 - DNA, 25 bp, Rattus norvegicus
gaccaaaagccattaagttcagata

SEQ ID NO: 319930 - DNA, 25 bp, Rattus norvegicus
gaccaaaataagctcccgtgttcct

SEQ ID NO: 319931 - DNA, 25 bp, Rattus norvegicus
gaccaaaataaggtcccgtgttcct

SEQ ID NO: 319932 - DNA, 25 bp, Rattus norvegicus
gaccaaaatggtccaaacggccctg

SEQ ID NO: 319933 - DNA, 25 bp, Rattus norvegicus
gaccaaaatggtgcaaacggccctg

SEQ ID NO: 319934 - DNA, 25 bp, Rattus norvegicus
gaccaaacaaatactaggactgcag

SEQ ID NO: 319935 - DNA, 25 bp, Rattus norvegicus
gaccaaacaaattctaggactgcag

SEQ ID NO: 319936 - DNA, 25 bp, Rattus norvegicus
gaccaaacagtaatccaacacctac

SEQ ID NO: 319937 - DNA, 25 bp, Rattus norvegicus
gaccaaacagtattccaacacctac

SEQ ID NO: 319938 - DNA, 25 bp, Rattus norvegicus
gaccaaacatccaagcacctgttga

SEQ ID NO: 319939 - DNA, 25 bp, Rattus norvegicus
gaccaaacatcctagcacctgttga

SEQ ID NO: 319940 - DNA, 25 bp, Rattus norvegicus
gaccaaaccagcctttgtactcaaa

SEQ ID NO: 319941 - DNA, 25 bp, Rattus norvegicus
gaccaaaccagcgtttgtactcaaa

SEQ ID NO: 319942 - DNA, 25 bp, Rattus norvegicus
gaccaaacgctgacaagaacttaat

SEQ ID NO: 319943 - DNA, 25 bp, Rattus norvegicus
gaccaaacgctgtcaagaacttaat

SEQ ID NO: 319944 - DNA, 25 bp, Rattus norvegicus
gaccaaactcaacgaaacctctgat

SEQ ID NO: 319945 - DNA, 25 bp, Rattus norvegicus
gaccaaactcaaggaaacctctgat

SEQ ID NO: 319946 - DNA, 25 bp, Rattus norvegicus
gaccaaactgttacaaggccagaat

SEQ ID NO: 319947 - DNA, 25 bp, Rattus norvegicus
gaccaaactgtttcaaggccagaat

SEQ ID NO: 319948 - DNA, 25 bp, Rattus norvegicus
gaccaaacttggatgctctcctgga

SEQ ID NO: 319949 - DNA, 25 bp, Rattus norvegicus
gaccaaacttggttgctctcctgga

SEQ ID NO: 319950 - DNA, 25 bp, Rattus norvegicus
gaccaaagacatataatctgcactt

SEQ ID NO: 319951 - DNA, 25 bp, Rattus norvegicus
gaccaaagacatttaatctgcactt

SEQ ID NO: 319952 - DNA, 25 bp, Rattus norvegicus
gaccaaagagatcgcccacctggaa

SEQ ID NO: 319953 - DNA, 25 bp, Rattus norvegicus
gaccaaagagatggcccacctggaa

SEQ ID NO: 319954 - DNA, 25 bp, Rattus norvegicus
gaccaaagatagactctttctaagt

SEQ ID NO: 319955 - DNA, 25 bp, Rattus norvegicus
gaccaaagatagtctctttctaagt

SEQ ID NO: 319956 - DNA, 25 bp, Rattus norvegicus
gaccaaagccatatccattggacag

SEQ ID NO: 319957 - DNA, 25 bp, Rattus norvegicus
gaccaaagccatttccattggacag

SEQ ID NO: 319958 - DNA, 25 bp, Rattus norvegicus
gaccaaagcccaatgtattcttgga

SEQ ID NO: 319959 - DNA, 25 bp, Rattus norvegicus
gaccaaagcccattgtattcttgga

SEQ ID NO: 319960 - DNA, 25 bp, Rattus norvegicus
gaccaaaggccacctctgaatttta

SEQ ID NO: 319961 - DNA, 25 bp, Rattus norvegicus
gaccaaaggccagctctgaatttta

SEQ ID NO: 319962 - DNA, 25 bp, Rattus norvegicus
gaccaaaggttcatcgaggcactag

SEQ ID NO: 319963 - DNA, 25 bp, Rattus norvegicus
gaccaaaggttcttcgaggcactag

SEQ ID NO: 319964 - DNA, 25 bp, Rattus norvegicus
gaccaaagtctgaccttgagataga

SEQ ID NO: 319965 - DNA, 25 bp, Rattus norvegicus
gaccaaagtctgtccttgagataga

SEQ ID NO: 319966 - DNA, 25 bp, Rattus norvegicus
gaccaaataccccagtcttttccat

SEQ ID NO: 319967 - DNA, 25 bp, Rattus norvegicus
gaccaaatacccgagtcttttccat

SEQ ID NO: 319968 - DNA, 25 bp, Rattus norvegicus
gaccaaatactacaagaggaccaga

SEQ ID NO: 319969 - DNA, 25 bp, Rattus norvegicus
gaccaaatactagaagaggaccaga

SEQ ID NO: 319970 - DNA, 25 bp, Rattus norvegicus
gaccaaatgcacatctgttttctgt

SEQ ID NO: 319971 - DNA, 25 bp, Rattus norvegicus
gaccaaatgcacttctgttttctgt

SEQ ID NO: 319972 - DNA, 25 bp, Rattus norvegicus
gaccaaatggctcccccggtgtcgg

SEQ ID NO: 319973 - DNA, 25 bp, Rattus norvegicus
gaccaaatggctgccccggtgtcgg

SEQ ID NO: 319974 - DNA, 25 bp, Rattus norvegicus
gaccaaatgtgcctctaggttctgt

SEQ ID NO: 319975 - DNA, 25 bp, Rattus norvegicus
gaccaaatgtgcgtctaggttctgt

SEQ ID NO: 319976 - DNA, 25 bp, Rattus norvegicus
gaccaaattttgaacctcctcagta

SEQ ID NO: 319977 - DNA, 25 bp, Rattus norvegicus
gaccaaattttgtacctcctcagta

SEQ ID NO: 319978 - DNA, 25 bp, Rattus norvegicus
gaccaacaagaacctggagcatgat

SEQ ID NO: 319979 - DNA, 25 bp, Rattus norvegicus
gaccaacaagaagctggagcatgat

SEQ ID NO: 319980 - DNA, 25 bp, Rattus norvegicus
gaccaacaccctctcttataaaaag

SEQ ID NO: 319981 - DNA, 25 bp, Rattus norvegicus
gaccaacaccctgtcttataaaaag

SEQ ID NO: 319982 - DNA, 25 bp, Rattus norvegicus
gaccaacagcgtcaagacattacat

SEQ ID NO: 319983 - DNA, 25 bp, Rattus norvegicus
gaccaacagcgtgaagacattacat

SEQ ID NO: 319984 - DNA, 25 bp, Rattus norvegicus
gaccaacatctaaatctctccaaga

SEQ ID NO: 319985 - DNA, 25 bp, Rattus norvegicus
gaccaacatctatatctctccaaga

SEQ ID NO: 319986 - DNA, 25 bp, Rattus norvegicus
gaccaacattaaacgctaccacata

SEQ ID NO: 319987 - DNA, 25 bp, Rattus norvegicus
gaccaacattaatcgctaccacata

SEQ ID NO: 319988 - DNA, 25 bp, Rattus norvegicus
gaccaacccataatgttgggtgcat

SEQ ID NO: 319989 - DNA, 25 bp, Rattus norvegicus
gaccaacccatattgttgggtgcat

SEQ ID NO: 319990 - DNA, 25 bp, Rattus norvegicus
gaccaaccccatatggatcaagcct

SEQ ID NO: 319991 - DNA, 25 bp, Rattus norvegicus
gaccaaccccatttggatcaagcct

SEQ ID NO: 319992 - DNA, 25 bp, Rattus norvegicus
gaccaacccttgacagagcttcttg

SEQ ID NO: 319993 - DNA, 25 bp, Rattus norvegicus
gaccaacccttgtcagagcttcttg

SEQ ID NO: 319994 - DNA, 25 bp, Rattus norvegicus
gaccaacctgagagcaccgtttaag

SEQ ID NO: 319995 - DNA, 25 bp, Rattus norvegicus
gaccaacctgagtgcaccgtttaag

SEQ ID NO: 319996 - DNA, 25 bp, Rattus norvegicus
gaccaacgaagacttccggttcaat

SEQ ID NO: 319997 - DNA, 25 bp, Rattus norvegicus
gaccaacgaagagttccggttcaat

SEQ ID NO: 319998 - DNA, 25 bp, Rattus norvegicus
gaccaacgcagcaggcaaacgagat

SEQ ID NO: 319999 - DNA, 25 bp, Rattus norvegicus
gaccaacgcagctggcaaacgagat

SEQ ID NO: 320000 - DNA, 25 bp, Rattus norvegicus
gaccaacgcctaaaccatctgaggt

SEQ ID NO: 320001 - DNA, 25 bp, Rattus norvegicus
gaccaacgcctataccatctgaggt

SEQ ID NO: 320002 - DNA, 25 bp, Rattus norvegicus
gaccaactactgagcttactaaaga

SEQ ID NO: 320003 - DNA, 25 bp, Rattus norvegicus
gaccaactactgtgcttactaaaga

SEQ ID NO: 320004 - DNA, 25 bp, Rattus norvegicus
gaccaactcaataagtgatgccatg

SEQ ID NO: 320005 - DNA, 25 bp, Rattus norvegicus
gaccaactcaattagtgatgccatg

SEQ ID NO: 320006 - DNA, 25 bp, Rattus norvegicus
gaccaactccttaactaatgattct

SEQ ID NO: 320007 - DNA, 25 bp, Rattus norvegicus
gaccaactcctttactaatgattct

SEQ ID NO: 320008 - DNA, 25 bp, Rattus norvegicus
gaccaactgcggaggaaaatattat

SEQ ID NO: 320009 - DNA, 25 bp, Rattus norvegicus
gaccaactgcggtggaaaatattat

SEQ ID NO: 320010 - DNA, 25 bp, Rattus norvegicus
gaccaactgggacattgctcacatg

SEQ ID NO: 320011 - DNA, 25 bp, Rattus norvegicus
gaccaactgggagattgctcacatg

SEQ ID NO: 320012 - DNA, 25 bp, Rattus norvegicus
gaccaacttattctgttccttacca

SEQ ID NO: 320013 - DNA, 25 bp, Rattus norvegicus
gaccaacttattgtgttccttacca

SEQ ID NO: 320014 - DNA, 25 bp, Rattus norvegicus
gaccaacttcaccaagagggagcta

SEQ ID NO: 320015 - DNA, 25 bp, Rattus norvegicus
gaccaacttcacgaagagggagcta

SEQ ID NO: 320016 - DNA, 25 bp, Rattus norvegicus
gaccaactttgtcattgcaatgcta

SEQ ID NO: 320017 - DNA, 25 bp, Rattus norvegicus
gaccaactttgtgattgcaatgcta

SEQ ID NO: 320018 - DNA, 25 bp, Rattus norvegicus
gaccaagaaaggctccatgccggaa

SEQ ID NO: 320019 - DNA, 25 bp, Rattus norvegicus
gaccaagaaagggtccatgccggaa

SEQ ID NO: 320020 - DNA, 25 bp, Rattus norvegicus
gaccaagaacacacacgtaggcctt

SEQ ID NO: 320021 - DNA, 25 bp, Rattus norvegicus
gaccaagaacactcacgtaggcctt

SEQ ID NO: 320022 - DNA, 25 bp, Rattus norvegicus
gaccaagacaaccaccagggatcct

SEQ ID NO: 320023 - DNA, 25 bp, Rattus norvegicus
gaccaagacaacgaccagggatcct

SEQ ID NO: 320024 - DNA, 25 bp, Rattus norvegicus
gaccaagacagtaagccatccagtg

SEQ ID NO: 320025 - DNA, 25 bp, Rattus norvegicus
gaccaagacagttagccatccagtg

SEQ ID NO: 320026 - DNA, 25 bp, Rattus norvegicus
gaccaagaccatctgggtacgagga

SEQ ID NO: 320027 - DNA, 25 bp, Rattus norvegicus
gaccaagaccatgtgggtacgagga

SEQ ID NO: 320028 - DNA, 25 bp, Rattus norvegicus
gaccaagactggcacatagccttga

SEQ ID NO: 320029 - DNA, 25 bp, Rattus norvegicus
gaccaagactgggacatagccttga

SEQ ID NO: 320030 - DNA, 25 bp, Rattus norvegicus
gaccaagagaccattcaggcttcaa

SEQ ID NO: 320031 - DNA, 25 bp, Rattus norvegicus
gaccaagagacctttcaggcttcaa

SEQ ID NO: 320032 - DNA, 25 bp, Rattus norvegicus
gaccaagagcaaagacggcttccta

SEQ ID NO: 320033 - DNA, 25 bp, Rattus norvegicus
gaccaagagcaatgacggcttccta

SEQ ID NO: 320034 - DNA, 25 bp, Rattus norvegicus
gaccaagagcagcacaggccagcga

SEQ ID NO: 320035 - DNA, 25 bp, Rattus norvegicus
gaccaagagcaggacaggccagcga

SEQ ID NO: 320036 - DNA, 25 bp, Rattus norvegicus
gaccaagagttgcatcccaacccta

SEQ ID NO: 320037 - DNA, 25 bp, Rattus norvegicus
gaccaagagttggatcccaacccta

SEQ ID NO: 320038 - DNA, 25 bp, Rattus norvegicus
gaccaagatcctaactcgcatatta

SEQ ID NO: 320039 - DNA, 25 bp, Rattus norvegicus
gaccaagatccttactcgcatatta

SEQ ID NO: 320040 - DNA, 25 bp, Rattus norvegicus
gaccaagatgaacagacgagccgtt

SEQ ID NO: 320041 - DNA, 25 bp, Rattus norvegicus
gaccaagatgaagagacgagccgtt

SEQ ID NO: 320042 - DNA, 25 bp, Rattus norvegicus
gaccaagatgatagcattccccaca

SEQ ID NO: 320043 - DNA, 25 bp, Rattus norvegicus
gaccaagatgattgcattccccaca

SEQ ID NO: 320044 - DNA, 25 bp, Rattus norvegicus
gaccaagatgctctcaggcccaatt

SEQ ID NO: 320045 - DNA, 25 bp, Rattus norvegicus
gaccaagatgctgtcaggcccaatt

SEQ ID NO: 320046 - DNA, 25 bp, Rattus norvegicus
gaccaagattcgaggtggcctgcca

SEQ ID NO: 320047 - DNA, 25 bp, Rattus norvegicus
gaccaagattcgtggtggcctgcca

SEQ ID NO: 320048 - DNA, 25 bp, Rattus norvegicus
gaccaagatttgcacccagaaacga

SEQ ID NO: 320049 - DNA, 25 bp, Rattus norvegicus
gaccaagatttggacccagaaacga

SEQ ID NO: 320050 - DNA, 25 bp, Rattus norvegicus
gaccaagcaggcatcagggctgtga

SEQ ID NO: 320051 - DNA, 25 bp, Rattus norvegicus
gaccaagcaggcttcagggctgtga

SEQ ID NO: 320052 - DNA, 25 bp, Rattus norvegicus
gaccaagcaggtacatcccagagaa

SEQ ID NO: 320053 - DNA, 25 bp, Rattus norvegicus
gaccaagcaggttcatcccagagaa

SEQ ID NO: 320054 - DNA, 25 bp, Rattus norvegicus
gaccaagcagtcagacaaggagtct

SEQ ID NO: 320055 - DNA, 25 bp, Rattus norvegicus
gaccaagcagtctgacaaggagtct

SEQ ID NO: 320056 - DNA, 25 bp, Rattus norvegicus
gaccaagcagttaagtgttcctggg

SEQ ID NO: 320057 - DNA, 25 bp, Rattus norvegicus
gaccaagcagtttagtgttcctggg

SEQ ID NO: 320058 - DNA, 25 bp, Rattus norvegicus
gaccaagcattcacatatgcgagcc

SEQ ID NO: 320059 - DNA, 25 bp, Rattus norvegicus
gaccaagcattctcatatgcgagcc

SEQ ID NO: 320060 - DNA, 25 bp, Rattus norvegicus
gaccaagcatttctgaacctcatga

SEQ ID NO: 320061 - DNA, 25 bp, Rattus norvegicus
gaccaagcatttgtgaacctcatga

SEQ ID NO: 320062 - DNA, 25 bp, Rattus norvegicus
gaccaagccctacactaaagggagt

SEQ ID NO: 320063 - DNA, 25 bp, Rattus norvegicus
gaccaagccctagactaaagggagt

SEQ ID NO: 320064 - DNA, 25 bp, Rattus norvegicus
gaccaagccgaccacaatcattgag

SEQ ID NO: 320065 - DNA, 25 bp, Rattus norvegicus
gaccaagccgacgacaatcattgag

SEQ ID NO: 320066 - DNA, 25 bp, Rattus norvegicus
gaccaagccgtgaagcactttgtgc

SEQ ID NO: 320067 - DNA, 25 bp, Rattus norvegicus
gaccaagccgtgtagcactttgtgc

SEQ ID NO: 320068 - DNA, 25 bp, Rattus norvegicus
gaccaagccttgaactttgtagccc

SEQ ID NO: 320069 - DNA, 25 bp, Rattus norvegicus
gaccaagccttgtactttgtagccc

SEQ ID NO: 320070 - DNA, 25 bp, Rattus norvegicus
gaccaagctctcagtctggtttgag

SEQ ID NO: 320071 - DNA, 25 bp, Rattus norvegicus
gaccaagctctctgtctggtttgag

SEQ ID NO: 320072 - DNA, 25 bp, Rattus norvegicus
gaccaagctgacacttctcagggaa

SEQ ID NO: 320073 - DNA, 25 bp, Rattus norvegicus
gaccaagctgactcttctcagggaa

SEQ ID NO: 320074 - DNA, 25 bp, Rattus norvegicus
gaccaagctgccaaatgacacctga

SEQ ID NO: 320075 - DNA, 25 bp, Rattus norvegicus
gaccaagctgcctaatgacacctga

SEQ ID NO: 320076 - DNA, 25 bp, Rattus norvegicus
gaccaagcttgtcaccggatttacc

SEQ ID NO: 320077 - DNA, 25 bp, Rattus norvegicus
gaccaagcttgtgaccggatttacc

SEQ ID NO: 320078 - DNA, 25 bp, Rattus norvegicus
gaccaagctttgcatgctcagcaca

SEQ ID NO: 320079 - DNA, 25 bp, Rattus norvegicus
gaccaagctttggatgctcagcaca

SEQ ID NO: 320080 - DNA, 25 bp, Rattus norvegicus
gaccaaggacagacagagctgaaca

SEQ ID NO: 320081 - DNA, 25 bp, Rattus norvegicus
gaccaaggacagtcagagctgaaca

SEQ ID NO: 320082 - DNA, 25 bp, Rattus norvegicus
gaccaaggaccacaaacagcttcgt

SEQ ID NO: 320083 - DNA, 25 bp, Rattus norvegicus
gaccaaggaccagaaacagcttcgt

SEQ ID NO: 320084 - DNA, 25 bp, Rattus norvegicus
gaccaaggacggaccaattgccata

SEQ ID NO: 320085 - DNA, 25 bp, Rattus norvegicus
gaccaaggacggtccaattgccata

SEQ ID NO: 320086 - DNA, 25 bp, Rattus norvegicus
gaccaaggatggagtttcaggcaca

SEQ ID NO: 320087 - DNA, 25 bp, Rattus norvegicus
gaccaaggatggtgtttcaggcaca

SEQ ID NO: 320088 - DNA, 25 bp, Rattus norvegicus
gaccaaggcacaataaacatcagaa

SEQ ID NO: 320089 - DNA, 25 bp, Rattus norvegicus
gaccaaggcacattaaacatcagaa

SEQ ID NO: 320090 - DNA, 25 bp, Rattus norvegicus
gaccaaggcccaacaatgacggtga

SEQ ID NO: 320091 - DNA, 25 bp, Rattus norvegicus
gaccaaggcccatcaatgacggtga

SEQ ID NO: 320092 - DNA, 25 bp, Rattus norvegicus
gaccaaggcgtgcttcagaagaact

SEQ ID NO: 320093 - DNA, 25 bp, Rattus norvegicus
gaccaaggcgtggttcagaagaact

SEQ ID NO: 320094 - DNA, 25 bp, Rattus norvegicus
gaccaaggctgtatctgcttcagac

SEQ ID NO: 320095 - DNA, 25 bp, Rattus norvegicus
gaccaaggctgtttctgcttcagac

SEQ ID NO: 320096 - DNA, 25 bp, Rattus norvegicus
gaccaagggagcatcctttgaggaa

SEQ ID NO: 320097 - DNA, 25 bp, Rattus norvegicus
gaccaagggagcttcctttgaggaa

SEQ ID NO: 320098 - DNA, 25 bp, Rattus norvegicus
gaccaagggcaacatgcgcatccac

SEQ ID NO: 320099 - DNA, 25 bp, Rattus norvegicus
gaccaagggcaagatgcgcatccac

SEQ ID NO: 320100 - DNA, 25 bp, Rattus norvegicus
gaccaaggtgaacacttcccggcct

SEQ ID NO: 320101 - DNA, 25 bp, Rattus norvegicus
gaccaaggtgaagacttcccggcct

SEQ ID NO: 320102 - DNA, 25 bp, Rattus norvegicus
gaccaaggtggacaacaggcaatta

SEQ ID NO: 320103 - DNA, 25 bp, Rattus norvegicus
gaccaaggtggagaacaggcaatta

SEQ ID NO: 320104 - DNA, 25 bp, Rattus norvegicus
gaccaagtcttcaatttaaggcact

SEQ ID NO: 320105 - DNA, 25 bp, Rattus norvegicus
gaccaagtcttctatttaaggcact

SEQ ID NO: 320106 - DNA, 25 bp, Rattus norvegicus
gaccaagtgaagctggtgacttctg

SEQ ID NO: 320107 - DNA, 25 bp, Rattus norvegicus
gaccaagtgaaggtggtgacttctg

SEQ ID NO: 320108 - DNA, 25 bp, Rattus norvegicus
gaccaagtgacaccaatgctgtttc

SEQ ID NO: 320109 - DNA, 25 bp, Rattus norvegicus
gaccaagtgacagcaatgctgtttc

SEQ ID NO: 320110 - DNA, 25 bp, Rattus norvegicus
gaccaagtggcaatcctctgtggaa

SEQ ID NO: 320111 - DNA, 25 bp, Rattus norvegicus
gaccaagtggcattcctctgtggaa

SEQ ID NO: 320112 - DNA, 25 bp, Rattus norvegicus
gaccaagtggttacccaagtcgcca

SEQ ID NO: 320113 - DNA, 25 bp, Rattus norvegicus
gaccaagtggtttcccaagtcgcca

SEQ ID NO: 320114 - DNA, 25 bp, Rattus norvegicus
gaccaagtgttgcacagccctatta

SEQ ID NO: 320115 - DNA, 25 bp, Rattus norvegicus
gaccaagtgttggacagccctatta

SEQ ID NO: 320116 - DNA, 25 bp, Rattus norvegicus
gaccaagttcgcatctgtatttgct

SEQ ID NO: 320117 - DNA, 25 bp, Rattus norvegicus
gaccaagttcgcttctgtatttgct

SEQ ID NO: 320118 - DNA, 25 bp, Rattus norvegicus
gaccaagtttggaagcgtgcacagt

SEQ ID NO: 320119 - DNA, 25 bp, Rattus norvegicus
gaccaagtttggtagcgtgcacagt

SEQ ID NO: 320120 - DNA, 25 bp, Rattus norvegicus
gaccaatagctgctgctttcatatt

SEQ ID NO: 320121 - DNA, 25 bp, Rattus norvegicus
gaccaatagctggtgctttcatatt

SEQ ID NO: 320122 - DNA, 25 bp, Rattus norvegicus
gaccaatcactgagttcgtctctgt

SEQ ID NO: 320123 - DNA, 25 bp, Rattus norvegicus
gaccaatcactgtgttcgtctctgt

SEQ ID NO: 320124 - DNA, 25 bp, Rattus norvegicus
gaccaatcagtgcttatgacgcaaa

SEQ ID NO: 320125 - DNA, 25 bp, Rattus norvegicus
gaccaatcagtggttatgacgcaaa

SEQ ID NO: 320126 - DNA, 25 bp, Rattus norvegicus
gaccaatcatggagccacgtgagct

SEQ ID NO: 320127 - DNA, 25 bp, Rattus norvegicus
gaccaatcatggtgccacgtgagct

SEQ ID NO: 320128 - DNA, 25 bp, Rattus norvegicus
gaccaatccaggaccagggcgcctg

SEQ ID NO: 320129 - DNA, 25 bp, Rattus norvegicus
gaccaatccaggtccagggcgcctg

SEQ ID NO: 320130 - DNA, 25 bp, Rattus norvegicus
gaccaatgaaatcaagtgggcttct

SEQ ID NO: 320131 - DNA, 25 bp, Rattus norvegicus
gaccaatgaaatgaagtgggcttct

SEQ ID NO: 320132 - DNA, 25 bp, Rattus norvegicus
gaccaatgacatattaccacttgaa

SEQ ID NO: 320133 - DNA, 25 bp, Rattus norvegicus
gaccaatgacattttaccacttgaa

SEQ ID NO: 320134 - DNA, 25 bp, Rattus norvegicus
gaccaatgaggcagtgtccagtcca

SEQ ID NO: 320135 - DNA, 25 bp, Rattus norvegicus
gaccaatgaggctgtgtccagtcca

SEQ ID NO: 320136 - DNA, 25 bp, Rattus norvegicus
gaccaatgagtgcacgtgtggacat

SEQ ID NO: 320137 - DNA, 25 bp, Rattus norvegicus
gaccaatgagtggacgtgtggacat

SEQ ID NO: 320138 - DNA, 25 bp, Rattus norvegicus
gaccaatgcaaaagaggacgtgatt

SEQ ID NO: 320139 - DNA, 25 bp, Rattus norvegicus
gaccaatgcaaatgaggacgtgatt

SEQ ID NO: 320140 - DNA, 25 bp, Rattus norvegicus
gaccaatgggatatgctcttttttc

SEQ ID NO: 320141 - DNA, 25 bp, Rattus norvegicus
gaccaatgggatttgctcttttttc

SEQ ID NO: 320142 - DNA, 25 bp, Rattus norvegicus
gaccaatgtaagctgccatgtgtct

SEQ ID NO: 320143 - DNA, 25 bp, Rattus norvegicus
gaccaatgtaaggtgccatgtgtct

SEQ ID NO: 320144 - DNA, 25 bp, Rattus norvegicus
gaccaatgtgttacctttaaaccat

SEQ ID NO: 320145 - DNA, 25 bp, Rattus norvegicus
gaccaatgtgttactcatgtgaaaa

SEQ ID NO: 320146 - DNA, 25 bp, Rattus norvegicus
gaccaatgtgtttcctttaaaccat

SEQ ID NO: 320147 - DNA, 25 bp, Rattus norvegicus
gaccaatgtgtttctcatgtgaaaa

SEQ ID NO: 320148 - DNA, 25 bp, Rattus norvegicus
gaccaattagacaaggcccacccaa

SEQ ID NO: 320149 - DNA, 25 bp, Rattus norvegicus
gaccaattagactaggcccacccaa

SEQ ID NO: 320150 - DNA, 25 bp, Rattus norvegicus
gaccaattggctcgcattgcctaga

SEQ ID NO: 320151 - DNA, 25 bp, Rattus norvegicus
gaccaattggctggcattgcctaga

SEQ ID NO: 320152 - DNA, 25 bp, Rattus norvegicus
gaccacaaacagagttcatcttggg

SEQ ID NO: 320153 - DNA, 25 bp, Rattus norvegicus
gaccacaaacagtgttcatcttggg

SEQ ID NO: 320154 - DNA, 25 bp, Rattus norvegicus
gaccacaaagtgatctcagcagttg

SEQ ID NO: 320155 - DNA, 25 bp, Rattus norvegicus
gaccacaaagtgttctcagcagttg

SEQ ID NO: 320156 - DNA, 25 bp, Rattus norvegicus
gaccacaaatagaccatcgtgtcat

SEQ ID NO: 320157 - DNA, 25 bp, Rattus norvegicus
gaccacaaatagtccatcgtgtcat

SEQ ID NO: 320158 - DNA, 25 bp, Rattus norvegicus
gaccacaagccaacacaattttctg

SEQ ID NO: 320159 - DNA, 25 bp, Rattus norvegicus
gaccacaagccatcacaattttctg

SEQ ID NO: 320160 - DNA, 25 bp, Rattus norvegicus
gaccacaaggtgcacttcatcctgc

SEQ ID NO: 320161 - DNA, 25 bp, Rattus norvegicus
gaccacaaggtggacttcatcctgc

SEQ ID NO: 320162 - DNA, 25 bp, Rattus norvegicus
gaccacaagtggcacatcgtcactt

SEQ ID NO: 320163 - DNA, 25 bp, Rattus norvegicus
gaccacaagtgggacatcgtcactt

SEQ ID NO: 320164 - DNA, 25 bp, Rattus norvegicus
gaccacaatgctaggacaggctgaa

SEQ ID NO: 320165 - DNA, 25 bp, Rattus norvegicus
gaccacaatgcttggacaggctgaa

SEQ ID NO: 320166 - DNA, 25 bp, Rattus norvegicus
gaccacacaaaactcacactgatgc

SEQ ID NO: 320167 - DNA, 25 bp, Rattus norvegicus
gaccacacaaaagtcacactgatgc

SEQ ID NO: 320168 - DNA, 25 bp, Rattus norvegicus
gaccacacaagcagtaaggactttt

SEQ ID NO: 320169 - DNA, 25 bp, Rattus norvegicus
gaccacacaagctgtaaggactttt

SEQ ID NO: 320170 - DNA, 25 bp, Rattus norvegicus
gaccacacatggagcaaaccctgga

SEQ ID NO: 320171 - DNA, 25 bp, Rattus norvegicus
gaccacacatggtgcaaaccctgga

SEQ ID NO: 320172 - DNA, 25 bp, Rattus norvegicus
gaccacacattactacctttgtttg

SEQ ID NO: 320173 - DNA, 25 bp, Rattus norvegicus
gaccacacattagtacctttgtttg

SEQ ID NO: 320174 - DNA, 25 bp, Rattus norvegicus
gaccacaccatgaagaagctcatca

SEQ ID NO: 320175 - DNA, 25 bp, Rattus norvegicus
gaccacaccatgtagaagctcatca

SEQ ID NO: 320176 - DNA, 25 bp, Rattus norvegicus
gaccacaccctacgattgagtatct

SEQ ID NO: 320177 - DNA, 25 bp, Rattus norvegicus
gaccacaccctaggattgagtatct

SEQ ID NO: 320178 - DNA, 25 bp, Rattus norvegicus
gaccacacggttcggaaaccatttg

SEQ ID NO: 320179 - DNA, 25 bp, Rattus norvegicus
gaccacacggttgggaaaccatttg

SEQ ID NO: 320180 - DNA, 25 bp, Rattus norvegicus
gaccacactcctattttagaagtat

SEQ ID NO: 320181 - DNA, 25 bp, Rattus norvegicus
gaccacactccttttttagaagtat

SEQ ID NO: 320182 - DNA, 25 bp, Rattus norvegicus
gaccacactgcacagttaagctctg

SEQ ID NO: 320183 - DNA, 25 bp, Rattus norvegicus
gaccacactgcagagttaagctctg

SEQ ID NO: 320184 - DNA, 25 bp, Rattus norvegicus
gaccacactggcctaagattcagag

SEQ ID NO: 320185 - DNA, 25 bp, Rattus norvegicus
gaccacactggcgtaagattcagag

SEQ ID NO: 320186 - DNA, 25 bp, Rattus norvegicus
gaccacactgtcctccaaaaataaa

SEQ ID NO: 320187 - DNA, 25 bp, Rattus norvegicus
gaccacactgtcgtccaaaaataaa

SEQ ID NO: 320188 - DNA, 25 bp, Rattus norvegicus
gaccacagaagactcctggacttgt

SEQ ID NO: 320189 - DNA, 25 bp, Rattus norvegicus
gaccacagaagagtcctggacttgt

SEQ ID NO: 320190 - DNA, 25 bp, Rattus norvegicus
gaccacagaccacttgtaatggtaa

SEQ ID NO: 320191 - DNA, 25 bp, Rattus norvegicus
gaccacagaccagttgtaatggtaa

SEQ ID NO: 320192 - DNA, 25 bp, Rattus norvegicus
gaccacagacgaccagtgtgtctat

SEQ ID NO: 320193 - DNA, 25 bp, Rattus norvegicus
gaccacagacgagcagtgtgtctat

SEQ ID NO: 320194 - DNA, 25 bp, Rattus norvegicus
gaccacagagaccaactcagtgatt

SEQ ID NO: 320195 - DNA, 25 bp, Rattus norvegicus
gaccacagagacgaactcagtgatt

SEQ ID NO: 320196 - DNA, 25 bp, Rattus norvegicus
gaccacagagccagggagcactgac

SEQ ID NO: 320197 - DNA, 25 bp, Rattus norvegicus
gaccacagagcctgggagcactgac

SEQ ID NO: 320198 - DNA, 25 bp, Rattus norvegicus
gaccacagccagcatttggctcctt

SEQ ID NO: 320199 - DNA, 25 bp, Rattus norvegicus
gaccacagccaggatttggctcctt

SEQ ID NO: 320200 - DNA, 25 bp, Rattus norvegicus
gaccacaggagcagggtgacaatcc

SEQ ID NO: 320201 - DNA, 25 bp, Rattus norvegicus
gaccacaggagccttgtcttcagaa

SEQ ID NO: 320202 - DNA, 25 bp, Rattus norvegicus
gaccacaggagcgttgtcttcagaa

SEQ ID NO: 320203 - DNA, 25 bp, Rattus norvegicus
gaccacaggagctgggtgacaatcc

SEQ ID NO: 320204 - DNA, 25 bp, Rattus norvegicus
gaccacaggatacgcatctttgcta

SEQ ID NO: 320205 - DNA, 25 bp, Rattus norvegicus
gaccacaggataggcatctttgcta

SEQ ID NO: 320206 - DNA, 25 bp, Rattus norvegicus
gaccacaggcagaagaatccaagat

SEQ ID NO: 320207 - DNA, 25 bp, Rattus norvegicus
gaccacaggcagtagaatccaagat

SEQ ID NO: 320208 - DNA, 25 bp, Rattus norvegicus
gaccacagggatctttccagagttt

SEQ ID NO: 320209 - DNA, 25 bp, Rattus norvegicus
gaccacagggatgtttccagagttt

SEQ ID NO: 320210 - DNA, 25 bp, Rattus norvegicus
gaccacagggtgcaacttttctaga

SEQ ID NO: 320211 - DNA, 25 bp, Rattus norvegicus
gaccacagggtggaacttttctaga

SEQ ID NO: 320212 - DNA, 25 bp, Rattus norvegicus
gaccacaggtaacacaaaccttcct

SEQ ID NO: 320213 - DNA, 25 bp, Rattus norvegicus
gaccacaggtaagacaaaccttcct

SEQ ID NO: 320214 - DNA, 25 bp, Rattus norvegicus
gaccacaggtctatattcttagctt

SEQ ID NO: 320215 - DNA, 25 bp, Rattus norvegicus
gaccacaggtctttattcttagctt

SEQ ID NO: 320216 - DNA, 25 bp, Rattus norvegicus
gaccacaggtgccttttactactga

SEQ ID NO: 320217 - DNA, 25 bp, Rattus norvegicus
gaccacaggtgcgttttactactga

SEQ ID NO: 320218 - DNA, 25 bp, Rattus norvegicus
gaccacagtattcacctggttttat

SEQ ID NO: 320219 - DNA, 25 bp, Rattus norvegicus
gaccacagtattgacctggttttat

SEQ ID NO: 320220 - DNA, 25 bp, Rattus norvegicus
gaccacagttcaatgactccatagc

SEQ ID NO: 320221 - DNA, 25 bp, Rattus norvegicus
gaccacagttcattgactccatagc

SEQ ID NO: 320222 - DNA, 25 bp, Rattus norvegicus
gaccacatagttcctgtgaacccag

SEQ ID NO: 320223 - DNA, 25 bp, Rattus norvegicus
gaccacatagttgctgtgaacccag

SEQ ID NO: 320224 - DNA, 25 bp, Rattus norvegicus
gaccacatcatccagatcaaacaag

SEQ ID NO: 320225 - DNA, 25 bp, Rattus norvegicus
gaccacatcatccagtatgcaaacc

SEQ ID NO: 320226 - DNA, 25 bp, Rattus norvegicus
gaccacatcatcgagatcaaacaag

SEQ ID NO: 320227 - DNA, 25 bp, Rattus norvegicus
gaccacatcatcgagtatgcaaacc

SEQ ID NO: 320228 - DNA, 25 bp, Rattus norvegicus
gaccacatggataccacacttttgg

SEQ ID NO: 320229 - DNA, 25 bp, Rattus norvegicus
gaccacatggattccacacttttgg

SEQ ID NO: 320230 - DNA, 25 bp, Rattus norvegicus
gaccacatggtgatcagtctatacc

SEQ ID NO: 320231 - DNA, 25 bp, Rattus norvegicus
gaccacatggtgttcagtctatacc

SEQ ID NO: 320232 - DNA, 25 bp, Rattus norvegicus
gaccacatgtagctggctgtatgct

SEQ ID NO: 320233 - DNA, 25 bp, Rattus norvegicus
gaccacatgtaggtggctgtatgct

SEQ ID NO: 320234 - DNA, 25 bp, Rattus norvegicus
gaccacatgtcacagaagcagctaa

SEQ ID NO: 320235 - DNA, 25 bp, Rattus norvegicus
gaccacatgtcagagaagcagctaa

SEQ ID NO: 320236 - DNA, 25 bp, Rattus norvegicus
gaccacatgtccaacagcaagcagg

SEQ ID NO: 320237 - DNA, 25 bp, Rattus norvegicus
gaccacatgtcctacagcaagcagg

SEQ ID NO: 320238 - DNA, 25 bp, Rattus norvegicus
gaccacatgtgcattctcatgagat

SEQ ID NO: 320239 - DNA, 25 bp, Rattus norvegicus
gaccacatgtgctttctcatgagat

SEQ ID NO: 320240 - DNA, 25 bp, Rattus norvegicus
gaccacatgtttcatttcccaagag

SEQ ID NO: 320241 - DNA, 25 bp, Rattus norvegicus
gaccacatgtttgatttcccaagag

SEQ ID NO: 320242 - DNA, 25 bp, Rattus norvegicus
gaccacatttggcttctacattctg

SEQ ID NO: 320243 - DNA, 25 bp, Rattus norvegicus
gaccacatttgggttctacattctg

SEQ ID NO: 320244 - DNA, 25 bp, Rattus norvegicus
gaccacattttaacctggcacttga

SEQ ID NO: 320245 - DNA, 25 bp, Rattus norvegicus
gaccacattttatcctggcacttga

SEQ ID NO: 320246 - DNA, 25 bp, Rattus norvegicus
gaccaccaaactctcactgtgtatc

SEQ ID NO: 320247 - DNA, 25 bp, Rattus norvegicus
gaccaccaaactgtcactgtgtatc

SEQ ID NO: 320248 - DNA, 25 bp, Rattus norvegicus
gaccaccaacgtctagagctggaaa

SEQ ID NO: 320249 - DNA, 25 bp, Rattus norvegicus
gaccaccaacgtgtagagctggaaa

SEQ ID NO: 320250 - DNA, 25 bp, Rattus norvegicus
gaccaccaaggaagccctggatgag

SEQ ID NO: 320251 - DNA, 25 bp, Rattus norvegicus
gaccaccaaggatgccctggatgag

SEQ ID NO: 320252 - DNA, 25 bp, Rattus norvegicus
gaccaccactgtagactatctcgaa

SEQ ID NO: 320253 - DNA, 25 bp, Rattus norvegicus
gaccaccactgttgactatctcgaa

SEQ ID NO: 320254 - DNA, 25 bp, Rattus norvegicus
gaccaccagctcagtagtgacacaa

SEQ ID NO: 320255 - DNA, 25 bp, Rattus norvegicus
gaccaccagctctgtagtgacacaa

SEQ ID NO: 320256 - DNA, 25 bp, Rattus norvegicus
gaccaccaggtgagcggagatttta

SEQ ID NO: 320257 - DNA, 25 bp, Rattus norvegicus
gaccaccaggtgtgcggagatttta

SEQ ID NO: 320258 - DNA, 25 bp, Rattus norvegicus
gaccaccagtgacatgggccttcta

SEQ ID NO: 320259 - DNA, 25 bp, Rattus norvegicus
gaccaccagtgagatgggccttcta

SEQ ID NO: 320260 - DNA, 25 bp, Rattus norvegicus
gaccaccagttaagtattagttgcc

SEQ ID NO: 320261 - DNA, 25 bp, Rattus norvegicus
gaccaccagttatgtattagttgcc

SEQ ID NO: 320262 - DNA, 25 bp, Rattus norvegicus
gaccaccatgttaacagttctgtat

SEQ ID NO: 320263 - DNA, 25 bp, Rattus norvegicus
gaccaccatgtttacagttctgtat

SEQ ID NO: 320264 - DNA, 25 bp, Rattus norvegicus
gaccaccattgcatgatgactggcc

SEQ ID NO: 320265 - DNA, 25 bp, Rattus norvegicus
gaccaccattgcttgatgactggcc

SEQ ID NO: 320266 - DNA, 25 bp, Rattus norvegicus
gaccaccattggatgtacaaggtac

SEQ ID NO: 320267 - DNA, 25 bp, Rattus norvegicus
gaccaccattggttgtacaaggtac

SEQ ID NO: 320268 - DNA, 25 bp, Rattus norvegicus
gaccaccattgtatttggctctttg

SEQ ID NO: 320269 - DNA, 25 bp, Rattus norvegicus
gaccaccattgtttttggctctttg

SEQ ID NO: 320270 - DNA, 25 bp, Rattus norvegicus
gaccacccaatccagatagaccaag

SEQ ID NO: 320271 - DNA, 25 bp, Rattus norvegicus
gaccacccaatcgagatagaccaag

SEQ ID NO: 320272 - DNA, 25 bp, Rattus norvegicus
gaccaccccgggaagagtctgagat

SEQ ID NO: 320273 - DNA, 25 bp, Rattus norvegicus
gaccaccccgggtagagtctgagat

SEQ ID NO: 320274 - DNA, 25 bp, Rattus norvegicus
gaccaccccttgactatgtaatgag

SEQ ID NO: 320275 - DNA, 25 bp, Rattus norvegicus
gaccaccccttgtctatgtaatgag

SEQ ID NO: 320276 - DNA, 25 bp, Rattus norvegicus
gaccacccgaacaccgagatatggt

SEQ ID NO: 320277 - DNA, 25 bp, Rattus norvegicus
gaccacccgaactccgagatatggt

SEQ ID NO: 320278 - DNA, 25 bp, Rattus norvegicus
gaccacccgtaccttgtatgtgaag

SEQ ID NO: 320279 - DNA, 25 bp, Rattus norvegicus
gaccacccgtacgttgtatgtgaag

SEQ ID NO: 320280 - DNA, 25 bp, Rattus norvegicus
gaccaccctcagcatttggacatct

SEQ ID NO: 320281 - DNA, 25 bp, Rattus norvegicus
gaccaccctcaggatttggacatct

SEQ ID NO: 320282 - DNA, 25 bp, Rattus norvegicus
gaccaccctggcatgactatgttaa

SEQ ID NO: 320283 - DNA, 25 bp, Rattus norvegicus
gaccaccctggcttgactatgttaa

SEQ ID NO: 320284 - DNA, 25 bp, Rattus norvegicus
gaccaccgagagagatgaccagcca

SEQ ID NO: 320285 - DNA, 25 bp, Rattus norvegicus
gaccaccgagagtgatgaccagcca

SEQ ID NO: 320286 - DNA, 25 bp, Rattus norvegicus
gaccaccgagtcagctatgaagaaa

SEQ ID NO: 320287 - DNA, 25 bp, Rattus norvegicus
gaccaccgagtctgctatgaagaaa

SEQ ID NO: 320288 - DNA, 25 bp, Rattus norvegicus
gaccaccgcaatcaagagcttctag

SEQ ID NO: 320289 - DNA, 25 bp, Rattus norvegicus
gaccaccgcaatgaagagcttctag

SEQ ID NO: 320290 - DNA, 25 bp, Rattus norvegicus
gaccaccgtcagaaagcattgcact

SEQ ID NO: 320291 - DNA, 25 bp, Rattus norvegicus
gaccaccgtcagtaagcattgcact

SEQ ID NO: 320292 - DNA, 25 bp, Rattus norvegicus
gaccacctaaggaagcgtcagctga

SEQ ID NO: 320293 - DNA, 25 bp, Rattus norvegicus
gaccacctaaggtagcgtcagctga

SEQ ID NO: 320294 - DNA, 25 bp, Rattus norvegicus
gaccacctaggaaccagttttagca

SEQ ID NO: 320295 - DNA, 25 bp, Rattus norvegicus
gaccacctaggatccagttttagca

SEQ ID NO: 320296 - DNA, 25 bp, Rattus norvegicus
gaccacctcacaccttgaaggctaa

SEQ ID NO: 320297 - DNA, 25 bp, Rattus norvegicus
gaccacctcacagcttgaaggctaa

SEQ ID NO: 320298 - DNA, 25 bp, Rattus norvegicus
gaccacctccatagtgctttagaat

SEQ ID NO: 320299 - DNA, 25 bp, Rattus norvegicus
gaccacctccattgtgctttagaat

SEQ ID NO: 320300 - DNA, 25 bp, Rattus norvegicus
gaccacctgcacatcaatcagattg

SEQ ID NO: 320301 - DNA, 25 bp, Rattus norvegicus
gaccacctgcacttcaatcagattg

SEQ ID NO: 320302 - DNA, 25 bp, Rattus norvegicus
gaccaccttataccagcgttatgag

SEQ ID NO: 320303 - DNA, 25 bp, Rattus norvegicus
gaccaccttatagcagcgttatgag

SEQ ID NO: 320304 - DNA, 25 bp, Rattus norvegicus
gaccaccttcaaatacactctaata

SEQ ID NO: 320305 - DNA, 25 bp, Rattus norvegicus
gaccaccttcaattacactctaata

SEQ ID NO: 320306 - DNA, 25 bp, Rattus norvegicus
gaccaccttcatacacttctgaata

SEQ ID NO: 320307 - DNA, 25 bp, Rattus norvegicus
gaccaccttcattcacttctgaata

SEQ ID NO: 320308 - DNA, 25 bp, Rattus norvegicus
gaccaccttgagaatcagtgccaga

SEQ ID NO: 320309 - DNA, 25 bp, Rattus norvegicus
gaccaccttgagtatcagtgccaga

SEQ ID NO: 320310 - DNA, 25 bp, Rattus norvegicus
gaccacctttgcattagttcactgt

SEQ ID NO: 320311 - DNA, 25 bp, Rattus norvegicus
gaccacctttgctttagttcactgt

SEQ ID NO: 320312 - DNA, 25 bp, Rattus norvegicus
gaccacgactttcagccgctgaggc

SEQ ID NO: 320313 - DNA, 25 bp, Rattus norvegicus
gaccacgactttgagccgctgaggc

SEQ ID NO: 320314 - DNA, 25 bp, Rattus norvegicus
gaccacgaggcccaaggtatgcaga

SEQ ID NO: 320315 - DNA, 25 bp, Rattus norvegicus
gaccacgaggccgaaggtatgcaga

SEQ ID NO: 320316 - DNA, 25 bp, Rattus norvegicus
gaccacgcatttaccgggaggaaat

SEQ ID NO: 320317 - DNA, 25 bp, Rattus norvegicus
gaccacgcattttccgggaggaaat

SEQ ID NO: 320318 - DNA, 25 bp, Rattus norvegicus
gaccacgccattctcctttatgagt

SEQ ID NO: 320319 - DNA, 25 bp, Rattus norvegicus
gaccacgccattgtcctttatgagt

SEQ ID NO: 320320 - DNA, 25 bp, Rattus norvegicus
gaccacgcgttcctactgccagtat

SEQ ID NO: 320321 - DNA, 25 bp, Rattus norvegicus
gaccacgcgttcgtactgccagtat

SEQ ID NO: 320322 - DNA, 25 bp, Rattus norvegicus
gaccacgctacactaagttacctaa

SEQ ID NO: 320323 - DNA, 25 bp, Rattus norvegicus
gaccacgctacagtaagttacctaa

SEQ ID NO: 320324 - DNA, 25 bp, Rattus norvegicus
gaccacgctctcaacgatatgactt

SEQ ID NO: 320325 - DNA, 25 bp, Rattus norvegicus
gaccacgctctctacgatatgactt

SEQ ID NO: 320326 - DNA, 25 bp, Rattus norvegicus
gaccacggagtgcttactcgcagaa

SEQ ID NO: 320327 - DNA, 25 bp, Rattus norvegicus
gaccacggagtggttactcgcagaa

SEQ ID NO: 320328 - DNA, 25 bp, Rattus norvegicus
gaccacggatctaacaaggcttctg

SEQ ID NO: 320329 - DNA, 25 bp, Rattus norvegicus
gaccacggatcttacaaggcttctg

SEQ ID NO: 320330 - DNA, 25 bp, Rattus norvegicus
gaccacggcgatctaatcctagcat

SEQ ID NO: 320331 - DNA, 25 bp, Rattus norvegicus
gaccacggcgatgtaatcctagcat

SEQ ID NO: 320332 - DNA, 25 bp, Rattus norvegicus
gaccacggctctagggtacttgtga

SEQ ID NO: 320333 - DNA, 25 bp, Rattus norvegicus
gaccacggctcttgggtacttgtga

SEQ ID NO: 320334 - DNA, 25 bp, Rattus norvegicus
gaccacgggcttaaccagaagtagt

SEQ ID NO: 320335 - DNA, 25 bp, Rattus norvegicus
gaccacgggctttaccagaagtagt

SEQ ID NO: 320336 - DNA, 25 bp, Rattus norvegicus
gaccacggtgtacattcttttgtta

SEQ ID NO: 320337 - DNA, 25 bp, Rattus norvegicus
gaccacggtgtagattcttttgtta

SEQ ID NO: 320338 - DNA, 25 bp, Rattus norvegicus
gaccacgtacgcaggcatttttaca

SEQ ID NO: 320339 - DNA, 25 bp, Rattus norvegicus
gaccacgtacgctggcatttttaca

SEQ ID NO: 320340 - DNA, 25 bp, Rattus norvegicus
gaccacgtacttatctgtgcaggaa

SEQ ID NO: 320341 - DNA, 25 bp, Rattus norvegicus
gaccacgtacttttctgtgcaggaa

SEQ ID NO: 320342 - DNA, 25 bp, Rattus norvegicus
gaccacgtcactcatcgagagccag

SEQ ID NO: 320343 - DNA, 25 bp, Rattus norvegicus
gaccacgtcactgatcgagagccag

SEQ ID NO: 320344 - DNA, 25 bp, Rattus norvegicus
gaccacgtcgaacacctgcctggtg

SEQ ID NO: 320345 - DNA, 25 bp, Rattus norvegicus
gaccacgtcgaagacctgcctggtg

SEQ ID NO: 320346 - DNA, 25 bp, Rattus norvegicus
gaccacgttgccaggcaaggattat

SEQ ID NO: 320347 - DNA, 25 bp, Rattus norvegicus
gaccacgttgcctggcaaggattat

SEQ ID NO: 320348 - DNA, 25 bp, Rattus norvegicus
gaccacgtttatatgggcactccaa

SEQ ID NO: 320349 - DNA, 25 bp, Rattus norvegicus
gaccacgtttatttgggcactccaa

SEQ ID NO: 320350 - DNA, 25 bp, Rattus norvegicus
gaccactaagctagctctttctata

SEQ ID NO: 320351 - DNA, 25 bp, Rattus norvegicus
gaccactaagcttgctctttctata

SEQ ID NO: 320352 - DNA, 25 bp, Rattus norvegicus
gaccactacaacagaagccgcctag

SEQ ID NO: 320353 - DNA, 25 bp, Rattus norvegicus
gaccactacaactgaagccgcctag

SEQ ID NO: 320354 - DNA, 25 bp, Rattus norvegicus
gaccactagggcagaggagctcttg

SEQ ID NO: 320355 - DNA, 25 bp, Rattus norvegicus
gaccactagggctgaggagctcttg

SEQ ID NO: 320356 - DNA, 25 bp, Rattus norvegicus
gaccactatagtatgacgccatctc

SEQ ID NO: 320357 - DNA, 25 bp, Rattus norvegicus
gaccactatagtttgacgccatctc

SEQ ID NO: 320358 - DNA, 25 bp, Rattus norvegicus
gaccactatgatccgtccagtcaaa

SEQ ID NO: 320359 - DNA, 25 bp, Rattus norvegicus
gaccactatgatgcgtccagtcaaa

SEQ ID NO: 320360 - DNA, 25 bp, Rattus norvegicus
gaccactcacatctcaagtttaagg

SEQ ID NO: 320361 - DNA, 25 bp, Rattus norvegicus
gaccactcacatgtcaagtttaagg

SEQ ID NO: 320362 - DNA, 25 bp, Rattus norvegicus
gaccactcagacacatacatacgta

SEQ ID NO: 320363 - DNA, 25 bp, Rattus norvegicus
gaccactcagactcatacatacgta

SEQ ID NO: 320364 - DNA, 25 bp, Rattus norvegicus
gaccactcattcatacatgttttga

SEQ ID NO: 320365 - DNA, 25 bp, Rattus norvegicus
gaccactcattcttacatgttttga

SEQ ID NO: 320366 - DNA, 25 bp, Rattus norvegicus
gaccactcctatcgttatagtgttt

SEQ ID NO: 320367 - DNA, 25 bp, Rattus norvegicus
gaccactcctatggttatagtgttt

SEQ ID NO: 320368 - DNA, 25 bp, Rattus norvegicus
gaccactcgatgcaattaggtgagg

SEQ ID NO: 320369 - DNA, 25 bp, Rattus norvegicus
gaccactcgatggaattaggtgagg

SEQ ID NO: 320370 - DNA, 25 bp, Rattus norvegicus
gaccactcggttcgacatcttggag

SEQ ID NO: 320371 - DNA, 25 bp, Rattus norvegicus
gaccactcggttggacatcttggag

SEQ ID NO: 320372 - DNA, 25 bp, Rattus norvegicus
gaccactctggccttaaactcaaag

SEQ ID NO: 320373 - DNA, 25 bp, Rattus norvegicus
gaccactctggcgttaaactcaaag

SEQ ID NO: 320374 - DNA, 25 bp, Rattus norvegicus
gaccactcttgtctccagatgggaa

SEQ ID NO: 320375 - DNA, 25 bp, Rattus norvegicus
gaccactcttgtgtccagatgggaa

SEQ ID NO: 320376 - DNA, 25 bp, Rattus norvegicus
gaccactgaatgaaattttagccct

SEQ ID NO: 320377 - DNA, 25 bp, Rattus norvegicus
gaccactgaatgtaattttagccct

SEQ ID NO: 320378 - DNA, 25 bp, Rattus norvegicus
gaccactgctgcctcaataaatctg

SEQ ID NO: 320379 - DNA, 25 bp, Rattus norvegicus
gaccactgctgcgtcaataaatctg

SEQ ID NO: 320380 - DNA, 25 bp, Rattus norvegicus
gaccactggatcatcgatacggact

SEQ ID NO: 320381 - DNA, 25 bp, Rattus norvegicus
gaccactggatcttcgatacggact

SEQ ID NO: 320382 - DNA, 25 bp, Rattus norvegicus
gaccactgggcgcttaattagccaa

SEQ ID NO: 320383 - DNA, 25 bp, Rattus norvegicus
gaccactgggcggttaattagccaa

SEQ ID NO: 320384 - DNA, 25 bp, Rattus norvegicus
gaccactggtttagtttcaggcatg

SEQ ID NO: 320385 - DNA, 25 bp, Rattus norvegicus
gaccactggttttgtttcaggcatg

SEQ ID NO: 320386 - DNA, 25 bp, Rattus norvegicus
gaccactgtggtaggcatttaccgt

SEQ ID NO: 320387 - DNA, 25 bp, Rattus norvegicus
gaccactgtggttggcatttaccgt

SEQ ID NO: 320388 - DNA, 25 bp, Rattus norvegicus
gaccactgttggcagagcaagtcca

SEQ ID NO: 320389 - DNA, 25 bp, Rattus norvegicus
gaccactgttgggagagcaagtcca

SEQ ID NO: 320390 - DNA, 25 bp, Rattus norvegicus
gaccacttaagtcccgtgttttcag

SEQ ID NO: 320391 - DNA, 25 bp, Rattus norvegicus
gaccacttaagtgccgtgttttcag

SEQ ID NO: 320392 - DNA, 25 bp, Rattus norvegicus
gaccacttagagcacgactagactg

SEQ ID NO: 320393 - DNA, 25 bp, Rattus norvegicus
gaccacttagaggacgactagactg

SEQ ID NO: 320394 - DNA, 25 bp, Rattus norvegicus
gaccacttatgtaggctcatcttgg

SEQ ID NO: 320395 - DNA, 25 bp, Rattus norvegicus
gaccacttatgttggctcatcttgg

SEQ ID NO: 320396 - DNA, 25 bp, Rattus norvegicus
gaccacttcagcctgtagacttatt

SEQ ID NO: 320397 - DNA, 25 bp, Rattus norvegicus
gaccacttcagcgtgtagacttatt

SEQ ID NO: 320398 - DNA, 25 bp, Rattus norvegicus
gaccacttcatccattgtttcattg

SEQ ID NO: 320399 - DNA, 25 bp, Rattus norvegicus
gaccacttcatcgattgtttcattg

SEQ ID NO: 320400 - DNA, 25 bp, Rattus norvegicus
gaccacttccttaacagctgtatta

SEQ ID NO: 320401 - DNA, 25 bp, Rattus norvegicus
gaccacttcctttacagctgtatta

SEQ ID NO: 320402 - DNA, 25 bp, Rattus norvegicus
gaccacttcggacgcaaattacact

SEQ ID NO: 320403 - DNA, 25 bp, Rattus norvegicus
gaccacttcggaggcaaattacact

SEQ ID NO: 320404 - DNA, 25 bp, Rattus norvegicus
gaccacttctgtctctttattatta

SEQ ID NO: 320405 - DNA, 25 bp, Rattus norvegicus
gaccacttctgtgtctttattatta

SEQ ID NO: 320406 - DNA, 25 bp, Rattus norvegicus
gaccacttgaagaaagactgggact

SEQ ID NO: 320407 - DNA, 25 bp, Rattus norvegicus
gaccacttgaagtaagactgggact

SEQ ID NO: 320408 - DNA, 25 bp, Rattus norvegicus
gaccacttgcccagtgtttccagga

SEQ ID NO: 320409 - DNA, 25 bp, Rattus norvegicus
gaccacttgccctgtgtttccagga

SEQ ID NO: 320410 - DNA, 25 bp, Rattus norvegicus
gaccacttggttaaactgtagactc

SEQ ID NO: 320411 - DNA, 25 bp, Rattus norvegicus
gaccacttggttatcctgagaggcc

SEQ ID NO: 320412 - DNA, 25 bp, Rattus norvegicus
gaccacttggtttaactgtagactc

SEQ ID NO: 320413 - DNA, 25 bp, Rattus norvegicus
gaccacttggttttcctgagaggcc

SEQ ID NO: 320414 - DNA, 25 bp, Rattus norvegicus
gaccactttagaaaacatttgattc

SEQ ID NO: 320415 - DNA, 25 bp, Rattus norvegicus
gaccactttagataacatttgattc

SEQ ID NO: 320416 - DNA, 25 bp, Rattus norvegicus
gaccactttgagctaaatttcacag

SEQ ID NO: 320417 - DNA, 25 bp, Rattus norvegicus
gaccactttgaggtaaatttcacag

SEQ ID NO: 320418 - DNA, 25 bp, Rattus norvegicus
gaccactttgcaccgggcgggtact

SEQ ID NO: 320419 - DNA, 25 bp, Rattus norvegicus
gaccactttgcagcgggcgggtact

SEQ ID NO: 320420 - DNA, 25 bp, Rattus norvegicus
gaccagaaacttctccagggagctg

SEQ ID NO: 320421 - DNA, 25 bp, Rattus norvegicus
gaccagaaacttgtccagggagctg

SEQ ID NO: 320422 - DNA, 25 bp, Rattus norvegicus
gaccagaaatatcctgtccttttta

SEQ ID NO: 320423 - DNA, 25 bp, Rattus norvegicus
gaccagaaatatgctgtccttttta

SEQ ID NO: 320424 - DNA, 25 bp, Rattus norvegicus
gaccagaaatttactgttttgctaa

SEQ ID NO: 320425 - DNA, 25 bp, Rattus norvegicus
gaccagaaattttctgttttgctaa

SEQ ID NO: 320426 - DNA, 25 bp, Rattus norvegicus
gaccagaacagcagtcgtgcttata

SEQ ID NO: 320427 - DNA, 25 bp, Rattus norvegicus
gaccagaacagctgtcgtgcttata

SEQ ID NO: 320428 - DNA, 25 bp, Rattus norvegicus
gaccagaacctgcagaagctgaagc

SEQ ID NO: 320429 - DNA, 25 bp, Rattus norvegicus
gaccagaacctggagaagctgaagc

SEQ ID NO: 320430 - DNA, 25 bp, Rattus norvegicus
gaccagaagtccaaagccagtgtta

SEQ ID NO: 320431 - DNA, 25 bp, Rattus norvegicus
gaccagaagtcctaagccagtgtta

SEQ ID NO: 320432 - DNA, 25 bp, Rattus norvegicus
gaccagacaagtcttcacctactaa

SEQ ID NO: 320433 - DNA, 25 bp, Rattus norvegicus
gaccagacaagtgttcacctactaa

SEQ ID NO: 320434 - DNA, 25 bp, Rattus norvegicus
gaccagacacctcatgagaatgatc

SEQ ID NO: 320435 - DNA, 25 bp, Rattus norvegicus
gaccagacacctgatgagaatgatc

SEQ ID NO: 320436 - DNA, 25 bp, Rattus norvegicus
gaccagacagacaggagccagaaac

SEQ ID NO: 320437 - DNA, 25 bp, Rattus norvegicus
gaccagacagactggagccagaaac

SEQ ID NO: 320438 - DNA, 25 bp, Rattus norvegicus
gaccagacagctcaggtttttctct

SEQ ID NO: 320439 - DNA, 25 bp, Rattus norvegicus
gaccagacagctgaggtttttctct

SEQ ID NO: 320440 - DNA, 25 bp, Rattus norvegicus
gaccagacagtcctcgtgtaaaaca

SEQ ID NO: 320441 - DNA, 25 bp, Rattus norvegicus
gaccagacagtcgtcgtgtaaaaca

SEQ ID NO: 320442 - DNA, 25 bp, Rattus norvegicus
gaccagacatttctgggcagcttgt

SEQ ID NO: 320443 - DNA, 25 bp, Rattus norvegicus
gaccagacatttgtgggcagcttgt

SEQ ID NO: 320444 - DNA, 25 bp, Rattus norvegicus
gaccagaccctgcacgaggatgatc

SEQ ID NO: 320445 - DNA, 25 bp, Rattus norvegicus
gaccagaccctggacgaggatgatc

SEQ ID NO: 320446 - DNA, 25 bp, Rattus norvegicus
gaccagacctggcacaccatggtat

SEQ ID NO: 320447 - DNA, 25 bp, Rattus norvegicus
gaccagacctgggacaccatggtat

SEQ ID NO: 320448 - DNA, 25 bp, Rattus norvegicus
gaccagactcaccaaaaagtgcttt

SEQ ID NO: 320449 - DNA, 25 bp, Rattus norvegicus
gaccagactcacgaaaaagtgcttt

SEQ ID NO: 320450 - DNA, 25 bp, Rattus norvegicus
gaccagactgagcactgctacactt

SEQ ID NO: 320451 - DNA, 25 bp, Rattus norvegicus
gaccagactgaggactgctacactt

SEQ ID NO: 320452 - DNA, 25 bp, Rattus norvegicus
gaccagactggaattagtctcacag

SEQ ID NO: 320453 - DNA, 25 bp, Rattus norvegicus
gaccagactggatttagtctcacag

SEQ ID NO: 320454 - DNA, 25 bp, Rattus norvegicus
gaccagactgtaattctcaattctt

SEQ ID NO: 320455 - DNA, 25 bp, Rattus norvegicus
gaccagactgtacgttttatcaccc

SEQ ID NO: 320456 - DNA, 25 bp, Rattus norvegicus
gaccagactgtaggttttatcaccc

SEQ ID NO: 320457 - DNA, 25 bp, Rattus norvegicus
gaccagactgtatttctcaattctt

SEQ ID NO: 320458 - DNA, 25 bp, Rattus norvegicus
gaccagacttggatgaggcagctga

SEQ ID NO: 320459 - DNA, 25 bp, Rattus norvegicus
gaccagacttggttgaggcagctga

SEQ ID NO: 320460 - DNA, 25 bp, Rattus norvegicus
gaccagagacagacgatagcttcca

SEQ ID NO: 320461 - DNA, 25 bp, Rattus norvegicus
gaccagagacagtcgatagcttcca

SEQ ID NO: 320462 - DNA, 25 bp, Rattus norvegicus
gaccagagatatcaccctgacgctc

SEQ ID NO: 320463 - DNA, 25 bp, Rattus norvegicus
gaccagagatatgaccctgacgctc

SEQ ID NO: 320464 - DNA, 25 bp, Rattus norvegicus
gaccagagatggcaacgtgttcctt

SEQ ID NO: 320465 - DNA, 25 bp, Rattus norvegicus
gaccagagatgggaacgtgttcctt

SEQ ID NO: 320466 - DNA, 25 bp, Rattus norvegicus
gaccagagccggcatttacagttaa

SEQ ID NO: 320467 - DNA, 25 bp, Rattus norvegicus
gaccagagccgggatttacagttaa

SEQ ID NO: 320468 - DNA, 25 bp, Rattus norvegicus
gaccagagctggaagggatgaccat

SEQ ID NO: 320469 - DNA, 25 bp, Rattus norvegicus
gaccagagctggtagggatgaccat

SEQ ID NO: 320470 - DNA, 25 bp, Rattus norvegicus
gaccagaggaggaccttgaccacat

SEQ ID NO: 320471 - DNA, 25 bp, Rattus norvegicus
gaccagaggaggtccttgaccacat

SEQ ID NO: 320472 - DNA, 25 bp, Rattus norvegicus
gaccagagtaaaattgcaggagcac

SEQ ID NO: 320473 - DNA, 25 bp, Rattus norvegicus
gaccagagtaaatttgcaggagcac

SEQ ID NO: 320474 - DNA, 25 bp, Rattus norvegicus
gaccagagtcagctttcacagcatc

SEQ ID NO: 320475 - DNA, 25 bp, Rattus norvegicus
gaccagagtcaggtttcacagcatc

SEQ ID NO: 320476 - DNA, 25 bp, Rattus norvegicus
gaccagagttccattgtttctgtga

SEQ ID NO: 320477 - DNA, 25 bp, Rattus norvegicus
gaccagagttcctttgtttctgtga

SEQ ID NO: 320478 - DNA, 25 bp, Rattus norvegicus
gaccagagtttgaccgtggctataa

SEQ ID NO: 320479 - DNA, 25 bp, Rattus norvegicus
gaccagagtttgtccgtggctataa

SEQ ID NO: 320480 - DNA, 25 bp, Rattus norvegicus
gaccagagttttcactatggcagaa

SEQ ID NO: 320481 - DNA, 25 bp, Rattus norvegicus
gaccagagttttgactatggcagaa

SEQ ID NO: 320482 - DNA, 25 bp, Rattus norvegicus
gaccagatcaacactgacacctatg

SEQ ID NO: 320483 - DNA, 25 bp, Rattus norvegicus
gaccagatcaactctgacacctatg

SEQ ID NO: 320484 - DNA, 25 bp, Rattus norvegicus
gaccagatcagaccgtttccatatg

SEQ ID NO: 320485 - DNA, 25 bp, Rattus norvegicus
gaccagatcagagcgtttccatatg

SEQ ID NO: 320486 - DNA, 25 bp, Rattus norvegicus
gaccagatcctgactgtatctagaa

SEQ ID NO: 320487 - DNA, 25 bp, Rattus norvegicus
gaccagatcctgagtaacctaagca

SEQ ID NO: 320488 - DNA, 25 bp, Rattus norvegicus
gaccagatcctgcagtccgtggact

SEQ ID NO: 320489 - DNA, 25 bp, Rattus norvegicus
gaccagatcctggagtccgtggact

SEQ ID NO: 320490 - DNA, 25 bp, Rattus norvegicus
gaccagatcctgtctgtatctagaa

SEQ ID NO: 320491 - DNA, 25 bp, Rattus norvegicus
gaccagatcctgtgtaacctaagca

SEQ ID NO: 320492 - DNA, 25 bp, Rattus norvegicus
gaccagatctacatatgcaggccag

SEQ ID NO: 320493 - DNA, 25 bp, Rattus norvegicus
gaccagatctacttatgcaggccag

SEQ ID NO: 320494 - DNA, 25 bp, Rattus norvegicus
gaccagatctataacagtgggattt

SEQ ID NO: 320495 - DNA, 25 bp, Rattus norvegicus
gaccagatctataggcaggcatagt

SEQ ID NO: 320496 - DNA, 25 bp, Rattus norvegicus
gaccagatctattacagtgggattt

SEQ ID NO: 320497 - DNA, 25 bp, Rattus norvegicus
gaccagatctattggcaggcatagt

SEQ ID NO: 320498 - DNA, 25 bp, Rattus norvegicus
gaccagatgggcctcgaatttacag

SEQ ID NO: 320499 - DNA, 25 bp, Rattus norvegicus
gaccagatgggcgtcgaatttacag

SEQ ID NO: 320500 - DNA, 25 bp, Rattus norvegicus
gaccagattcagcaagcattggaag

SEQ ID NO: 320501 - DNA, 25 bp, Rattus norvegicus
gaccagattcaggaagcattggaag

SEQ ID NO: 320502 - DNA, 25 bp, Rattus norvegicus
gaccagatttacagcaccaggcaca

SEQ ID NO: 320503 - DNA, 25 bp, Rattus norvegicus
gaccagatttactgcaccaggcaca

SEQ ID NO: 320504 - DNA, 25 bp, Rattus norvegicus
gaccagatttgtacttgcactgtca

SEQ ID NO: 320505 - DNA, 25 bp, Rattus norvegicus
gaccagatttgttcttgcactgtca

SEQ ID NO: 320506 - DNA, 25 bp, Rattus norvegicus
gaccagattttgctgttagctgatg

SEQ ID NO: 320507 - DNA, 25 bp, Rattus norvegicus
gaccagattttggtgttagctgatg

SEQ ID NO: 320508 - DNA, 25 bp, Rattus norvegicus
gaccagcaagtaccagggcccagtg

SEQ ID NO: 320509 - DNA, 25 bp, Rattus norvegicus
gaccagcaagtagcagggcccagtg

SEQ ID NO: 320510 - DNA, 25 bp, Rattus norvegicus
gaccagcaatggagggtccactcat

SEQ ID NO: 320511 - DNA, 25 bp, Rattus norvegicus
gaccagcaatggtgggtccactcat

SEQ ID NO: 320512 - DNA, 25 bp, Rattus norvegicus
gaccagcagacccaggaacaaactg

SEQ ID NO: 320513 - DNA, 25 bp, Rattus norvegicus
gaccagcagaccgaggaacaaactg

SEQ ID NO: 320514 - DNA, 25 bp, Rattus norvegicus
gaccagcagattcttggcacaacca

SEQ ID NO: 320515 - DNA, 25 bp, Rattus norvegicus
gaccagcagattgttggcacaacca

SEQ ID NO: 320516 - DNA, 25 bp, Rattus norvegicus
gaccagcaggctaacctgtttcaaa

SEQ ID NO: 320517 - DNA, 25 bp, Rattus norvegicus
gaccagcaggcttacctgtttcaaa

SEQ ID NO: 320518 - DNA, 25 bp, Rattus norvegicus
gaccagcaggtgcagtgcaggccct

SEQ ID NO: 320519 - DNA, 25 bp, Rattus norvegicus
gaccagcaggtggagtgcaggccct

SEQ ID NO: 320520 - DNA, 25 bp, Rattus norvegicus
gaccagcagtctcacctaacaagga

SEQ ID NO: 320521 - DNA, 25 bp, Rattus norvegicus
gaccagcagtctgacctaacaagga

SEQ ID NO: 320522 - DNA, 25 bp, Rattus norvegicus
gaccagcatcggcatctgcaatgga

SEQ ID NO: 320523 - DNA, 25 bp, Rattus norvegicus
gaccagcatcgggatctgcaatgga

SEQ ID NO: 320524 - DNA, 25 bp, Rattus norvegicus
gaccagcatctccaggttaatctcc

SEQ ID NO: 320525 - DNA, 25 bp, Rattus norvegicus
gaccagcatctcgaggttaatctcc

SEQ ID NO: 320526 - DNA, 25 bp, Rattus norvegicus
gaccagcatgaacggtgtctcacat

SEQ ID NO: 320527 - DNA, 25 bp, Rattus norvegicus
gaccagcatgaagggtgtctcacat

SEQ ID NO: 320528 - DNA, 25 bp, Rattus norvegicus
gaccagcatggccagtacccagtat

SEQ ID NO: 320529 - DNA, 25 bp, Rattus norvegicus
gaccagcatggcgagtacccagtat

SEQ ID NO: 320530 - DNA, 25 bp, Rattus norvegicus
gaccagccaggaaagcggttttctt

SEQ ID NO: 320531 - DNA, 25 bp, Rattus norvegicus
gaccagccaggaagggcacaattct

SEQ ID NO: 320532 - DNA, 25 bp, Rattus norvegicus
gaccagccaggatagcggttttctt

SEQ ID NO: 320533 - DNA, 25 bp, Rattus norvegicus
gaccagccaggatgggcacaattct

SEQ ID NO: 320534 - DNA, 25 bp, Rattus norvegicus
gaccagccatccaatctataattat

SEQ ID NO: 320535 - DNA, 25 bp, Rattus norvegicus
gaccagccatcctatctataattat

SEQ ID NO: 320536 - DNA, 25 bp, Rattus norvegicus
gaccagccattgactacgtgggcag

SEQ ID NO: 320537 - DNA, 25 bp, Rattus norvegicus
gaccagccattgtctacgtgggcag

SEQ ID NO: 320538 - DNA, 25 bp, Rattus norvegicus
gaccagcccatcagagctattatta

SEQ ID NO: 320539 - DNA, 25 bp, Rattus norvegicus
gaccagcccatctgagctattatta

SEQ ID NO: 320540 - DNA, 25 bp, Rattus norvegicus
gaccagccctttatgtcttgtaata

SEQ ID NO: 320541 - DNA, 25 bp, Rattus norvegicus
gaccagccctttttgtcttgtaata

SEQ ID NO: 320542 - DNA, 25 bp, Rattus norvegicus
gaccagcctagcaccatacgtgaaa

SEQ ID NO: 320543 - DNA, 25 bp, Rattus norvegicus
gaccagcctagctccatacgtgaaa

SEQ ID NO: 320544 - DNA, 25 bp, Rattus norvegicus
gaccagcctcagcaatactgtggga

SEQ ID NO: 320545 - DNA, 25 bp, Rattus norvegicus
gaccagcctcaggaatactgtggga

SEQ ID NO: 320546 - DNA, 25 bp, Rattus norvegicus
gaccagcctccccaataaaactaat

SEQ ID NO: 320547 - DNA, 25 bp, Rattus norvegicus
gaccagcctcccgaataaaactaat

SEQ ID NO: 320548 - DNA, 25 bp, Rattus norvegicus
gaccagcctctgaagagtccagatg

SEQ ID NO: 320549 - DNA, 25 bp, Rattus norvegicus
gaccagcctctgtagagtccagatg

SEQ ID NO: 320550 - DNA, 25 bp, Rattus norvegicus
gaccagcctggactgcatagtgcaa

SEQ ID NO: 320551 - DNA, 25 bp, Rattus norvegicus
gaccagcctggagtgcatagtgcaa

SEQ ID NO: 320552 - DNA, 25 bp, Rattus norvegicus
gaccagcgtgatcttatatgtctgt

SEQ ID NO: 320553 - DNA, 25 bp, Rattus norvegicus
gaccagcgtgatgttatatgtctgt

SEQ ID NO: 320554 - DNA, 25 bp, Rattus norvegicus
gaccagctagaaagcttttcatcag

SEQ ID NO: 320555 - DNA, 25 bp, Rattus norvegicus
gaccagctagaatgcttttcatcag

SEQ ID NO: 320556 - DNA, 25 bp, Rattus norvegicus
gaccagctaggtcgtgtactgagta

SEQ ID NO: 320557 - DNA, 25 bp, Rattus norvegicus
gaccagctaggtggtgtactgagta

SEQ ID NO: 320558 - DNA, 25 bp, Rattus norvegicus
gaccagctcacaacaacgctgtcta

SEQ ID NO: 320559 - DNA, 25 bp, Rattus norvegicus
gaccagctcacatcaacgctgtcta

SEQ ID NO: 320560 - DNA, 25 bp, Rattus norvegicus
gaccagctccttcactacaggaaga

SEQ ID NO: 320561 - DNA, 25 bp, Rattus norvegicus
gaccagctccttgactacaggaaga

SEQ ID NO: 320562 - DNA, 25 bp, Rattus norvegicus
gaccagctctataggattctctctc

SEQ ID NO: 320563 - DNA, 25 bp, Rattus norvegicus
gaccagctctattggattctctctc

SEQ ID NO: 320564 - DNA, 25 bp, Rattus norvegicus
gaccagctctctcctgtagctaata

SEQ ID NO: 320565 - DNA, 25 bp, Rattus norvegicus
gaccagctctctgctgtagctaata

SEQ ID NO: 320566 - DNA, 25 bp, Rattus norvegicus
gaccagctgcaaactgtggttggca

SEQ ID NO: 320567 - DNA, 25 bp, Rattus norvegicus
gaccagctgcaatctgtggttggca

SEQ ID NO: 320568 - DNA, 25 bp, Rattus norvegicus
gaccagctgctgaggaactggcagt

SEQ ID NO: 320569 - DNA, 25 bp, Rattus norvegicus
gaccagctgctgtggaactggcagt

SEQ ID NO: 320570 - DNA, 25 bp, Rattus norvegicus
gaccagctggagctcatcatgtgaa

SEQ ID NO: 320571 - DNA, 25 bp, Rattus norvegicus
gaccagctggaggtcatcatgtgaa

SEQ ID NO: 320572 - DNA, 25 bp, Rattus norvegicus
gaccagctgtcacaagagggctctt

SEQ ID NO: 320573 - DNA, 25 bp, Rattus norvegicus
gaccagctgtcagaagagggctctt

SEQ ID NO: 320574 - DNA, 25 bp, Rattus norvegicus
gaccagcttcgcatgctcttggaga

SEQ ID NO: 320575 - DNA, 25 bp, Rattus norvegicus
gaccagcttcgcttgctcttggaga

SEQ ID NO: 320576 - DNA, 25 bp, Rattus norvegicus
gaccagcttcggcaatacggtgaga

SEQ ID NO: 320577 - DNA, 25 bp, Rattus norvegicus
gaccagcttcgggaatacggtgaga

SEQ ID NO: 320578 - DNA, 25 bp, Rattus norvegicus
gaccagcttgaacttgaggcctcgc

SEQ ID NO: 320579 - DNA, 25 bp, Rattus norvegicus
gaccagcttgaagttgaggcctcgc

SEQ ID NO: 320580 - DNA, 25 bp, Rattus norvegicus
gaccagcttggcagaggtctgcagc

SEQ ID NO: 320581 - DNA, 25 bp, Rattus norvegicus
gaccagcttggctgaggtctgcagc

SEQ ID NO: 320582 - DNA, 25 bp, Rattus norvegicus
gaccagcttgtgattgtaacctcta

SEQ ID NO: 320583 - DNA, 25 bp, Rattus norvegicus
gaccagcttgtgtttgtaacctcta

SEQ ID NO: 320584 - DNA, 25 bp, Rattus norvegicus
gaccagctttctctcatcaattaat

SEQ ID NO: 320585 - DNA, 25 bp, Rattus norvegicus
gaccagctttctgtcatcaattaat

SEQ ID NO: 320586 - DNA, 25 bp, Rattus norvegicus
gaccaggaacccctggagttctcct

SEQ ID NO: 320587 - DNA, 25 bp, Rattus norvegicus
gaccaggaacccgtggagttctcct

SEQ ID NO: 320588 - DNA, 25 bp, Rattus norvegicus
gaccaggaacctcttttctgacatt

SEQ ID NO: 320589 - DNA, 25 bp, Rattus norvegicus
gaccaggaacctgttttctgacatt

SEQ ID NO: 320590 - DNA, 25 bp, Rattus norvegicus
gaccaggaacttcgtgtcttgttct

SEQ ID NO: 320591 - DNA, 25 bp, Rattus norvegicus
gaccaggaacttggtgtcttgttct

SEQ ID NO: 320592 - DNA, 25 bp, Rattus norvegicus
gaccaggaagccacgctgtgcgcag

SEQ ID NO: 320593 - DNA, 25 bp, Rattus norvegicus
gaccaggaagcctcgctgtgcgcag

SEQ ID NO: 320594 - DNA, 25 bp, Rattus norvegicus
gaccaggaatgtattcctcttctat

SEQ ID NO: 320595 - DNA, 25 bp, Rattus norvegicus
gaccaggaatgttttcctcttctat

SEQ ID NO: 320596 - DNA, 25 bp, Rattus norvegicus
gaccaggaggcacaaccccttttct

SEQ ID NO: 320597 - DNA, 25 bp, Rattus norvegicus
gaccaggaggcagaaccccttttct

SEQ ID NO: 320598 - DNA, 25 bp, Rattus norvegicus
gaccaggatggcaccccagagatgg

SEQ ID NO: 320599 - DNA, 25 bp, Rattus norvegicus
gaccaggatggctccccagagatgg

SEQ ID NO: 320600 - DNA, 25 bp, Rattus norvegicus
gaccaggattataagccatcctagt

SEQ ID NO: 320601 - DNA, 25 bp, Rattus norvegicus
gaccaggattattagccatcctagt

SEQ ID NO: 320602 - DNA, 25 bp, Rattus norvegicus
gaccaggattcaattgctagaacac

SEQ ID NO: 320603 - DNA, 25 bp, Rattus norvegicus
gaccaggattcatttgctagaacac

SEQ ID NO: 320604 - DNA, 25 bp, Rattus norvegicus
gaccaggcagccctactagcagtgg

SEQ ID NO: 320605 - DNA, 25 bp, Rattus norvegicus
gaccaggcagccgtactagcagtgg

SEQ ID NO: 320606 - DNA, 25 bp, Rattus norvegicus
gaccaggcagggactgtcctattgc

SEQ ID NO: 320607 - DNA, 25 bp, Rattus norvegicus
gaccaggcagggattcgtcttgtcc

SEQ ID NO: 320608 - DNA, 25 bp, Rattus norvegicus
gaccaggcagggtctgtcctattgc

SEQ ID NO: 320609 - DNA, 25 bp, Rattus norvegicus
gaccaggcagggtttcgtcttgtcc

SEQ ID NO: 320610 - DNA, 25 bp, Rattus norvegicus
gaccaggcagtcagctttctcaaga

SEQ ID NO: 320611 - DNA, 25 bp, Rattus norvegicus
gaccaggcagtctgctttctcaaga

SEQ ID NO: 320612 - DNA, 25 bp, Rattus norvegicus
gaccaggcccaactgtgtggagctt

SEQ ID NO: 320613 - DNA, 25 bp, Rattus norvegicus
gaccaggcccaagtgtgtggagctt

SEQ ID NO: 320614 - DNA, 25 bp, Rattus norvegicus
gaccaggccgcaatgacagaaagat

SEQ ID NO: 320615 - DNA, 25 bp, Rattus norvegicus
gaccaggccgcattgacagaaagat

SEQ ID NO: 320616 - DNA, 25 bp, Rattus norvegicus
gaccaggccttgaatattaccgaga

SEQ ID NO: 320617 - DNA, 25 bp, Rattus norvegicus
gaccaggccttgtatattaccgaga

SEQ ID NO: 320618 - DNA, 25 bp, Rattus norvegicus
gaccaggctaacactaattccacaa

SEQ ID NO: 320619 - DNA, 25 bp, Rattus norvegicus
gaccaggctaactctaattccacaa

SEQ ID NO: 320620 - DNA, 25 bp, Rattus norvegicus
gaccaggctattctgactgagctaa

SEQ ID NO: 320621 - DNA, 25 bp, Rattus norvegicus
gaccaggctattgtgactgagctaa

SEQ ID NO: 320622 - DNA, 25 bp, Rattus norvegicus
gaccaggctctcaagtcgctgatag

SEQ ID NO: 320623 - DNA, 25 bp, Rattus norvegicus
gaccaggctctctagtcgctgatag

SEQ ID NO: 320624 - DNA, 25 bp, Rattus norvegicus
gaccaggctctgacttctcagagga

SEQ ID NO: 320625 - DNA, 25 bp, Rattus norvegicus
gaccaggctctgtcttctcagagga

SEQ ID NO: 320626 - DNA, 25 bp, Rattus norvegicus
gaccaggctgaaaacatatgcgaag

SEQ ID NO: 320627 - DNA, 25 bp, Rattus norvegicus
gaccaggctgaatacatatgcgaag

SEQ ID NO: 320628 - DNA, 25 bp, Rattus norvegicus
gaccaggctggaaatgacacaccga

SEQ ID NO: 320629 - DNA, 25 bp, Rattus norvegicus
gaccaggctggatatgacacaccga

SEQ ID NO: 320630 - DNA, 25 bp, Rattus norvegicus
gaccaggctggcaggttccatgtaa

SEQ ID NO: 320631 - DNA, 25 bp, Rattus norvegicus
gaccaggctggctggttccatgtaa

SEQ ID NO: 320632 - DNA, 25 bp, Rattus norvegicus
gaccaggcttccacctgagtttata

SEQ ID NO: 320633 - DNA, 25 bp, Rattus norvegicus
gaccaggcttcctcctgagtttata

SEQ ID NO: 320634 - DNA, 25 bp, Rattus norvegicus
gaccaggcttttaattatgtattcc

SEQ ID NO: 320635 - DNA, 25 bp, Rattus norvegicus
gaccaggctttttattatgtattcc

SEQ ID NO: 320636 - DNA, 25 bp, Rattus norvegicus
gaccagggaggaccgttcacttttg

SEQ ID NO: 320637 - DNA, 25 bp, Rattus norvegicus
gaccagggaggagcgttcacttttg

SEQ ID NO: 320638 - DNA, 25 bp, Rattus norvegicus
gaccagggcaggaattcttgaccag

SEQ ID NO: 320639 - DNA, 25 bp, Rattus norvegicus
gaccagggcaggtattcttgaccag

SEQ ID NO: 320640 - DNA, 25 bp, Rattus norvegicus
gaccagggtcctaacagagtgcaat

SEQ ID NO: 320641 - DNA, 25 bp, Rattus norvegicus
gaccagggtccttacagagtgcaat

SEQ ID NO: 320642 - DNA, 25 bp, Rattus norvegicus
gaccaggtaatgagcactttttctt

SEQ ID NO: 320643 - DNA, 25 bp, Rattus norvegicus
gaccaggtaatgtgcactttttctt

SEQ ID NO: 320644 - DNA, 25 bp, Rattus norvegicus
gaccaggtacacaccatcatggaaa

SEQ ID NO: 320645 - DNA, 25 bp, Rattus norvegicus
gaccaggtacactccatcatggaaa

SEQ ID NO: 320646 - DNA, 25 bp, Rattus norvegicus
gaccaggtatgaaggccactttgcc

SEQ ID NO: 320647 - DNA, 25 bp, Rattus norvegicus
gaccaggtatgatggccactttgcc

SEQ ID NO: 320648 - DNA, 25 bp, Rattus norvegicus
gaccaggtcataagttgtttgactt

SEQ ID NO: 320649 - DNA, 25 bp, Rattus norvegicus
gaccaggtcatatgttgtttgactt

SEQ ID NO: 320650 - DNA, 25 bp, Rattus norvegicus
gaccaggtcgccagtatgctgtctg

SEQ ID NO: 320651 - DNA, 25 bp, Rattus norvegicus
gaccaggtcgcctgtatgctgtctg

SEQ ID NO: 320652 - DNA, 25 bp, Rattus norvegicus
gaccaggtgagtcatctatggaagt

SEQ ID NO: 320653 - DNA, 25 bp, Rattus norvegicus
gaccaggtgagtgatctatggaagt

SEQ ID NO: 320654 - DNA, 25 bp, Rattus norvegicus
gaccaggtgcaaacccatcagagtt

SEQ ID NO: 320655 - DNA, 25 bp, Rattus norvegicus
gaccaggtgcaatcccatcagagtt

SEQ ID NO: 320656 - DNA, 25 bp, Rattus norvegicus
gaccaggtggagctactcgcacaga

SEQ ID NO: 320657 - DNA, 25 bp, Rattus norvegicus
gaccaggtggaggtactcgcacaga

SEQ ID NO: 320658 - DNA, 25 bp, Rattus norvegicus
gaccaggtggtaaagagttcagatc

SEQ ID NO: 320659 - DNA, 25 bp, Rattus norvegicus
gaccaggtggtatagagttcagatc

SEQ ID NO: 320660 - DNA, 25 bp, Rattus norvegicus
gaccaggtgtggaataggcctgtaa

SEQ ID NO: 320661 - DNA, 25 bp, Rattus norvegicus
gaccaggtgtggtataggcctgtaa

SEQ ID NO: 320662 - DNA, 25 bp, Rattus norvegicus
gaccaggttaccagtggcacagtta

SEQ ID NO: 320663 - DNA, 25 bp, Rattus norvegicus
gaccaggttacctgtggcacagtta

SEQ ID NO: 320664 - DNA, 25 bp, Rattus norvegicus
gaccaggttaggatgtactcccaag

SEQ ID NO: 320665 - DNA, 25 bp, Rattus norvegicus
gaccaggttaggttgtactcccaag

SEQ ID NO: 320666 - DNA, 25 bp, Rattus norvegicus
gaccaggttgtcacctgtgacttca

SEQ ID NO: 320667 - DNA, 25 bp, Rattus norvegicus
gaccaggttgtctcctgtgacttca

SEQ ID NO: 320668 - DNA, 25 bp, Rattus norvegicus
gaccagtaaccaatgcttgattctt

SEQ ID NO: 320669 - DNA, 25 bp, Rattus norvegicus
gaccagtaaccattgcttgattctt

SEQ ID NO: 320670 - DNA, 25 bp, Rattus norvegicus
gaccagtaatccacatagcttgact

SEQ ID NO: 320671 - DNA, 25 bp, Rattus norvegicus
gaccagtaatcctcatagcttgact

SEQ ID NO: 320672 - DNA, 25 bp, Rattus norvegicus
gaccagtaccgtctgcttaatacta

SEQ ID NO: 320673 - DNA, 25 bp, Rattus norvegicus
gaccagtaccgtgtgcttaatacta

SEQ ID NO: 320674 - DNA, 25 bp, Rattus norvegicus
gaccagtaggccattatgatccctg

SEQ ID NO: 320675 - DNA, 25 bp, Rattus norvegicus
gaccagtaggcctttatgatccctg

SEQ ID NO: 320676 - DNA, 25 bp, Rattus norvegicus
gaccagtagggtcacgcgcaatcct

SEQ ID NO: 320677 - DNA, 25 bp, Rattus norvegicus
gaccagtagggtgacgcgcaatcct

SEQ ID NO: 320678 - DNA, 25 bp, Rattus norvegicus
gaccagtagttgacaggcgctgctc

SEQ ID NO: 320679 - DNA, 25 bp, Rattus norvegicus
gaccagtagttgtcaggcgctgctc

SEQ ID NO: 320680 - DNA, 25 bp, Rattus norvegicus
gaccagtatggaaatttgcttttgt

SEQ ID NO: 320681 - DNA, 25 bp, Rattus norvegicus
gaccagtatggatatttgcttttgt

SEQ ID NO: 320682 - DNA, 25 bp, Rattus norvegicus
gaccagtcagagaaactgcaggagt

SEQ ID NO: 320683 - DNA, 25 bp, Rattus norvegicus
gaccagtcagagtaactgcaggagt

SEQ ID NO: 320684 - DNA, 25 bp, Rattus norvegicus
gaccagtccatgatttgtcactgag

SEQ ID NO: 320685 - DNA, 25 bp, Rattus norvegicus
gaccagtccatgttttgtcactgag

SEQ ID NO: 320686 - DNA, 25 bp, Rattus norvegicus
gaccagtccccgctgttagaaagag

SEQ ID NO: 320687 - DNA, 25 bp, Rattus norvegicus
gaccagtccccggtgttagaaagag

SEQ ID NO: 320688 - DNA, 25 bp, Rattus norvegicus
gaccagtccctgcaaagaagcattg

SEQ ID NO: 320689 - DNA, 25 bp, Rattus norvegicus
gaccagtccctggaaagaagcattg

SEQ ID NO: 320690 - DNA, 25 bp, Rattus norvegicus
gaccagtcctagcagctgagtgcca

SEQ ID NO: 320691 - DNA, 25 bp, Rattus norvegicus
gaccagtcctaggagctgagtgcca

SEQ ID NO: 320692 - DNA, 25 bp, Rattus norvegicus
gaccagtctagcagtggctcagata

SEQ ID NO: 320693 - DNA, 25 bp, Rattus norvegicus
gaccagtctagccaaggagtcaact

SEQ ID NO: 320694 - DNA, 25 bp, Rattus norvegicus
gaccagtctagcgaaggagtcaact

SEQ ID NO: 320695 - DNA, 25 bp, Rattus norvegicus
gaccagtctagctgtggctcagata

SEQ ID NO: 320696 - DNA, 25 bp, Rattus norvegicus
gaccagtctgaacatgaggcacttg

SEQ ID NO: 320697 - DNA, 25 bp, Rattus norvegicus
gaccagtctgaagatgaggcacttg

SEQ ID NO: 320698 - DNA, 25 bp, Rattus norvegicus
gaccagtctgtccttgacacaatag

SEQ ID NO: 320699 - DNA, 25 bp, Rattus norvegicus
gaccagtctgtcgttgacacaatag

SEQ ID NO: 320700 - DNA, 25 bp, Rattus norvegicus
gaccagtgaactagctgaagccata

SEQ ID NO: 320701 - DNA, 25 bp, Rattus norvegicus
gaccagtgaacttgctgaagccata

SEQ ID NO: 320702 - DNA, 25 bp, Rattus norvegicus
gaccagtgaagccagattgccgaat

SEQ ID NO: 320703 - DNA, 25 bp, Rattus norvegicus
gaccagtgaagcgagattgccgaat

SEQ ID NO: 320704 - DNA, 25 bp, Rattus norvegicus
gaccagtgacatcaagagcttcccg

SEQ ID NO: 320705 - DNA, 25 bp, Rattus norvegicus
gaccagtgacatgaagagcttcccg

SEQ ID NO: 320706 - DNA, 25 bp, Rattus norvegicus
gaccagtgaccactcatgtcttggt

SEQ ID NO: 320707 - DNA, 25 bp, Rattus norvegicus
gaccagtgaccagtcatgtcttggt

SEQ ID NO: 320708 - DNA, 25 bp, Rattus norvegicus
gaccagtgagataccatcttgccac

SEQ ID NO: 320709 - DNA, 25 bp, Rattus norvegicus
gaccagtgagattccatcttgccac

SEQ ID NO: 320710 - DNA, 25 bp, Rattus norvegicus
gaccagtgcagtcgttccagaacct

SEQ ID NO: 320711 - DNA, 25 bp, Rattus norvegicus
gaccagtgcagtggttccagaacct

SEQ ID NO: 320712 - DNA, 25 bp, Rattus norvegicus
gaccagtgcctgacctgggtaagga

SEQ ID NO: 320713 - DNA, 25 bp, Rattus norvegicus
gaccagtgcctgtcctgggtaagga

SEQ ID NO: 320714 - DNA, 25 bp, Rattus norvegicus
gaccagtgctctaagcctgagcaat

SEQ ID NO: 320715 - DNA, 25 bp, Rattus norvegicus
gaccagtgctcttagcctgagcaat

SEQ ID NO: 320716 - DNA, 25 bp, Rattus norvegicus
gaccagtgtactatgtgtttctttt

SEQ ID NO: 320717 - DNA, 25 bp, Rattus norvegicus
gaccagtgtactttgtgtttctttt

SEQ ID NO: 320718 - DNA, 25 bp, Rattus norvegicus
gaccagtgtaggagatcgtggccat

SEQ ID NO: 320719 - DNA, 25 bp, Rattus norvegicus
gaccagtgtaggtgatcgtggccat

SEQ ID NO: 320720 - DNA, 25 bp, Rattus norvegicus
gaccagtgtcctaagaagagtatca

SEQ ID NO: 320721 - DNA, 25 bp, Rattus norvegicus
gaccagtgtccttagaagagtatca

SEQ ID NO: 320722 - DNA, 25 bp, Rattus norvegicus
gaccagtgtgacatcattagatacg

SEQ ID NO: 320723 - DNA, 25 bp, Rattus norvegicus
gaccagtgtgacttcattagatacg

SEQ ID NO: 320724 - DNA, 25 bp, Rattus norvegicus
gaccagtgtgcaataatccttccag

SEQ ID NO: 320725 - DNA, 25 bp, Rattus norvegicus
gaccagtgtgcattaatccttccag

SEQ ID NO: 320726 - DNA, 25 bp, Rattus norvegicus
gaccagtgttctctctgtcaatatt

SEQ ID NO: 320727 - DNA, 25 bp, Rattus norvegicus
gaccagtgttctgtctgtcaatatt

SEQ ID NO: 320728 - DNA, 25 bp, Rattus norvegicus
gaccagtgtttgaccaagggacccg

SEQ ID NO: 320729 - DNA, 25 bp, Rattus norvegicus
gaccagtgtttgtccaagggacccg

SEQ ID NO: 320730 - DNA, 25 bp, Rattus norvegicus
gaccagttacatatctaagctacta

SEQ ID NO: 320731 - DNA, 25 bp, Rattus norvegicus
gaccagttacatttctaagctacta

SEQ ID NO: 320732 - DNA, 25 bp, Rattus norvegicus
gaccagttattcagacttaatgatg

SEQ ID NO: 320733 - DNA, 25 bp, Rattus norvegicus
gaccagttattctgacttaatgatg

SEQ ID NO: 320734 - DNA, 25 bp, Rattus norvegicus
gaccagttggcaaggagagtctact

SEQ ID NO: 320735 - DNA, 25 bp, Rattus norvegicus
gaccagttggcatggagagtctact

SEQ ID NO: 320736 - DNA, 25 bp, Rattus norvegicus
gaccagttgtgcagcagggaacact

SEQ ID NO: 320737 - DNA, 25 bp, Rattus norvegicus
gaccagttgtgctgcagggaacact

SEQ ID NO: 320738 - DNA, 25 bp, Rattus norvegicus
gaccagtttaacaccagatccggtt

SEQ ID NO: 320739 - DNA, 25 bp, Rattus norvegicus
gaccagtttaactccagatccggtt

SEQ ID NO: 320740 - DNA, 25 bp, Rattus norvegicus
gaccagtttaagctgcctcgggact

SEQ ID NO: 320741 - DNA, 25 bp, Rattus norvegicus
gaccagtttaaggtgcctcgggact

SEQ ID NO: 320742 - DNA, 25 bp, Rattus norvegicus
gaccagtttcagcaagccgaaggag

SEQ ID NO: 320743 - DNA, 25 bp, Rattus norvegicus
gaccagtttcaggaagccgaaggag

SEQ ID NO: 320744 - DNA, 25 bp, Rattus norvegicus
gaccagtttcctagcagactctgaa

SEQ ID NO: 320745 - DNA, 25 bp, Rattus norvegicus
gaccagtttccttgcagactctgaa

SEQ ID NO: 320746 - DNA, 25 bp, Rattus norvegicus
gaccataaaagtctacgccagcagc

SEQ ID NO: 320747 - DNA, 25 bp, Rattus norvegicus
gaccataaaagtgtacgccagcagc

SEQ ID NO: 320748 - DNA, 25 bp, Rattus norvegicus
gaccataaatgtaattgctccgcag

SEQ ID NO: 320749 - DNA, 25 bp, Rattus norvegicus
gaccataaatgttattgctccgcag

SEQ ID NO: 320750 - DNA, 25 bp, Rattus norvegicus
gaccataagattccctggctgtgcc

SEQ ID NO: 320751 - DNA, 25 bp, Rattus norvegicus
gaccataagattgcctggctgtgcc

SEQ ID NO: 320752 - DNA, 25 bp, Rattus norvegicus
gaccataagtcacgccacgttggct

SEQ ID NO: 320753 - DNA, 25 bp, Rattus norvegicus
gaccataagtcaggccacgttggct

SEQ ID NO: 320754 - DNA, 25 bp, Rattus norvegicus
gaccataagtccatctgacagggca

SEQ ID NO: 320755 - DNA, 25 bp, Rattus norvegicus
gaccataagtccttctgacagggca

SEQ ID NO: 320756 - DNA, 25 bp, Rattus norvegicus
gaccatacacggcttgatatacaac

SEQ ID NO: 320757 - DNA, 25 bp, Rattus norvegicus
gaccatacacgggttgatatacaac

SEQ ID NO: 320758 - DNA, 25 bp, Rattus norvegicus
gaccatacactgaccttaagcattc

SEQ ID NO: 320759 - DNA, 25 bp, Rattus norvegicus
gaccatacactgtccttaagcattc

SEQ ID NO: 320760 - DNA, 25 bp, Rattus norvegicus
gaccatacaggccttacatcattcg

SEQ ID NO: 320761 - DNA, 25 bp, Rattus norvegicus
gaccatacaggcgttacatcattcg

SEQ ID NO: 320762 - DNA, 25 bp, Rattus norvegicus
gaccatactgtaatgcaaatttttt

SEQ ID NO: 320763 - DNA, 25 bp, Rattus norvegicus
gaccatactgtactgaccagtgtca

SEQ ID NO: 320764 - DNA, 25 bp, Rattus norvegicus
gaccatactgtagtgaccagtgtca

SEQ ID NO: 320765 - DNA, 25 bp, Rattus norvegicus
gaccatactgtattgcaaatttttt

SEQ ID NO: 320766 - DNA, 25 bp, Rattus norvegicus
gaccatacttcactttgacacttcc

SEQ ID NO: 320767 - DNA, 25 bp, Rattus norvegicus
gaccatacttcagtttgacacttcc

SEQ ID NO: 320768 - DNA, 25 bp, Rattus norvegicus
gaccatagcccgctttagtttttca

SEQ ID NO: 320769 - DNA, 25 bp, Rattus norvegicus
gaccatagcccggtttagtttttca

SEQ ID NO: 320770 - DNA, 25 bp, Rattus norvegicus
gaccatagcctaacagtgctagctt

SEQ ID NO: 320771 - DNA, 25 bp, Rattus norvegicus
gaccatagcctatcagtgctagctt

SEQ ID NO: 320772 - DNA, 25 bp, Rattus norvegicus
gaccatagctgtatgtctgactggg

SEQ ID NO: 320773 - DNA, 25 bp, Rattus norvegicus
gaccatagctgtttgtctgactggg

SEQ ID NO: 320774 - DNA, 25 bp, Rattus norvegicus
gaccatataattctctattctagga

SEQ ID NO: 320775 - DNA, 25 bp, Rattus norvegicus
gaccatataattgtctattctagga

SEQ ID NO: 320776 - DNA, 25 bp, Rattus norvegicus
gaccatatacggcgtattaaggttg

SEQ ID NO: 320777 - DNA, 25 bp, Rattus norvegicus
gaccatatacggggtattaaggttg

SEQ ID NO: 320778 - DNA, 25 bp, Rattus norvegicus
gaccatatactgcatggctctgtaa

SEQ ID NO: 320779 - DNA, 25 bp, Rattus norvegicus
gaccatatactggatggctctgtaa

SEQ ID NO: 320780 - DNA, 25 bp, Rattus norvegicus
gaccatatctgtcaggtgtcttgac

SEQ ID NO: 320781 - DNA, 25 bp, Rattus norvegicus
gaccatatctgtgaggtgtcttgac

SEQ ID NO: 320782 - DNA, 25 bp, Rattus norvegicus
gaccatattgctctcatagaccttc

SEQ ID NO: 320783 - DNA, 25 bp, Rattus norvegicus
gaccatattgctgtcatagaccttc

SEQ ID NO: 320784 - DNA, 25 bp, Rattus norvegicus
gaccatattttcaggcagtctggaa

SEQ ID NO: 320785 - DNA, 25 bp, Rattus norvegicus
gaccatattttctggcagtctggaa

SEQ ID NO: 320786 - DNA, 25 bp, Rattus norvegicus
gaccatattttgctgaatgcgtttc

SEQ ID NO: 320787 - DNA, 25 bp, Rattus norvegicus
gaccatattttggtgaatgcgtttc

SEQ ID NO: 320788 - DNA, 25 bp, Rattus norvegicus
gaccatcaagtccaatttgtgctgt

SEQ ID NO: 320789 - DNA, 25 bp, Rattus norvegicus
gaccatcaagtcgaatttgtgctgt

SEQ ID NO: 320790 - DNA, 25 bp, Rattus norvegicus
gaccatcaatttccagatagaatgc

SEQ ID NO: 320791 - DNA, 25 bp, Rattus norvegicus
gaccatcaatttgcagatagaatgc

SEQ ID NO: 320792 - DNA, 25 bp, Rattus norvegicus
gaccatcacagaccagagtttggat

SEQ ID NO: 320793 - DNA, 25 bp, Rattus norvegicus
gaccatcacagagcagagtttggat

SEQ ID NO: 320794 - DNA, 25 bp, Rattus norvegicus
gaccatcacagcctccatgagagga

SEQ ID NO: 320795 - DNA, 25 bp, Rattus norvegicus
gaccatcacagcgtccatgagagga

SEQ ID NO: 320796 - DNA, 25 bp, Rattus norvegicus
gaccatcaccgaatactagagctat

SEQ ID NO: 320797 - DNA, 25 bp, Rattus norvegicus
gaccatcaccgattactagagctat

SEQ ID NO: 320798 - DNA, 25 bp, Rattus norvegicus
gaccatcactccagatttgttattg

SEQ ID NO: 320799 - DNA, 25 bp, Rattus norvegicus
gaccatcactcctgatttgttattg

SEQ ID NO: 320800 - DNA, 25 bp, Rattus norvegicus
gaccatcacttacgcagtctctaga

SEQ ID NO: 320801 - DNA, 25 bp, Rattus norvegicus
gaccatcacttaggcagtctctaga

SEQ ID NO: 320802 - DNA, 25 bp, Rattus norvegicus
gaccatcagcaaccacagctaagaa

SEQ ID NO: 320803 - DNA, 25 bp, Rattus norvegicus
gaccatcagcaagcacagctaagaa

SEQ ID NO: 320804 - DNA, 25 bp, Rattus norvegicus
gaccatcagcttatcttctggagat

SEQ ID NO: 320805 - DNA, 25 bp, Rattus norvegicus
gaccatcagcttttcttctggagat

SEQ ID NO: 320806 - DNA, 25 bp, Rattus norvegicus
gaccatcatgctacctacagacctg

SEQ ID NO: 320807 - DNA, 25 bp, Rattus norvegicus
gaccatcatgcttcctacagacctg

SEQ ID NO: 320808 - DNA, 25 bp, Rattus norvegicus
gaccatcatggaccacgtacgagac

SEQ ID NO: 320809 - DNA, 25 bp, Rattus norvegicus
gaccatcatggagcacgtacgagac

SEQ ID NO: 320810 - DNA, 25 bp, Rattus norvegicus
gaccatcatggtagctggcagagcc

SEQ ID NO: 320811 - DNA, 25 bp, Rattus norvegicus
gaccatcatggttgctggcagagcc

SEQ ID NO: 320812 - DNA, 25 bp, Rattus norvegicus
gaccatcatgttctagacttcttca

SEQ ID NO: 320813 - DNA, 25 bp, Rattus norvegicus
gaccatcatgttgtagacttcttca

SEQ ID NO: 320814 - DNA, 25 bp, Rattus norvegicus
gaccatcattggagaatccctgaac

SEQ ID NO: 320815 - DNA, 25 bp, Rattus norvegicus
gaccatcattggtgaatccctgaac

SEQ ID NO: 320816 - DNA, 25 bp, Rattus norvegicus
gaccatccaactcatcttgaaagca

SEQ ID NO: 320817 - DNA, 25 bp, Rattus norvegicus
gaccatccaactgatcttgaaagca

SEQ ID NO: 320818 - DNA, 25 bp, Rattus norvegicus
gaccatccactgagctgtggtatac

SEQ ID NO: 320819 - DNA, 25 bp, Rattus norvegicus
gaccatccactgtgctgtggtatac

SEQ ID NO: 320820 - DNA, 25 bp, Rattus norvegicus
gaccatccagatctgtggctgttca

SEQ ID NO: 320821 - DNA, 25 bp, Rattus norvegicus
gaccatccagatgtgtggctgttca

SEQ ID NO: 320822 - DNA, 25 bp, Rattus norvegicus
gaccatccatggcaggctgacactg

SEQ ID NO: 320823 - DNA, 25 bp, Rattus norvegicus
gaccatccatgggaggctgacactg

SEQ ID NO: 320824 - DNA, 25 bp, Rattus norvegicus
gaccatcccaacctacagagtcatt

SEQ ID NO: 320825 - DNA, 25 bp, Rattus norvegicus
gaccatcccaacgtacagagtcatt

SEQ ID NO: 320826 - DNA, 25 bp, Rattus norvegicus
gaccatcccgagctgaatatcgggg

SEQ ID NO: 320827 - DNA, 25 bp, Rattus norvegicus
gaccatcccgaggtgaatatcgggg

SEQ ID NO: 320828 - DNA, 25 bp, Rattus norvegicus
gaccatccctcacattaacttattg

SEQ ID NO: 320829 - DNA, 25 bp, Rattus norvegicus
gaccatccctcagattaacttattg

SEQ ID NO: 320830 - DNA, 25 bp, Rattus norvegicus
gaccatccctgtactccatttttat

SEQ ID NO: 320831 - DNA, 25 bp, Rattus norvegicus
gaccatccctgttctccatttttat

SEQ ID NO: 320832 - DNA, 25 bp, Rattus norvegicus
gaccatccgctcctttaagagcttg

SEQ ID NO: 320833 - DNA, 25 bp, Rattus norvegicus
gaccatccgctcgtttaagagcttg

SEQ ID NO: 320834 - DNA, 25 bp, Rattus norvegicus
gaccatcctggaagttacggaccaa

SEQ ID NO: 320835 - DNA, 25 bp, Rattus norvegicus
gaccatcctggatgttacggaccaa

SEQ ID NO: 320836 - DNA, 25 bp, Rattus norvegicus
gaccatccttgtctacatagggagt

SEQ ID NO: 320837 - DNA, 25 bp, Rattus norvegicus
gaccatccttgtgtacatagggagt

SEQ ID NO: 320838 - DNA, 25 bp, Rattus norvegicus
gaccatcgagtcaaccagtaagaca

SEQ ID NO: 320839 - DNA, 25 bp, Rattus norvegicus
gaccatcgagtctaccagtaagaca

SEQ ID NO: 320840 - DNA, 25 bp, Rattus norvegicus
gaccatcgctttcattcctgtgtat

SEQ ID NO: 320841 - DNA, 25 bp, Rattus norvegicus
gaccatcgctttgattcctgtgtat

SEQ ID NO: 320842 - DNA, 25 bp, Rattus norvegicus
gaccatctaggcacacaggcttaat

SEQ ID NO: 320843 - DNA, 25 bp, Rattus norvegicus
gaccatctaggctcacaggcttaat

SEQ ID NO: 320844 - DNA, 25 bp, Rattus norvegicus
gaccatctcatcagttatgtctgtc

SEQ ID NO: 320845 - DNA, 25 bp, Rattus norvegicus
gaccatctcatctgttatgtctgtc

SEQ ID NO: 320846 - DNA, 25 bp, Rattus norvegicus
gaccatctccccagaggaggtggat

SEQ ID NO: 320847 - DNA, 25 bp, Rattus norvegicus
gaccatctcccctgaggaggtggat

SEQ ID NO: 320848 - DNA, 25 bp, Rattus norvegicus
gaccatctgaagacatgtactgact

SEQ ID NO: 320849 - DNA, 25 bp, Rattus norvegicus
gaccatctgaagtcatgtactgact

SEQ ID NO: 320850 - DNA, 25 bp, Rattus norvegicus
gaccatctgagcacacacactatgt

SEQ ID NO: 320851 - DNA, 25 bp, Rattus norvegicus
gaccatctgagctcacacactatgt

SEQ ID NO: 320852 - DNA, 25 bp, Rattus norvegicus
gaccatctgcacatattcatgctgt

SEQ ID NO: 320853 - DNA, 25 bp, Rattus norvegicus
gaccatctgcacttattcatgctgt

SEQ ID NO: 320854 - DNA, 25 bp, Rattus norvegicus
gaccatctgtaaattgagtgccggg

SEQ ID NO: 320855 - DNA, 25 bp, Rattus norvegicus
gaccatctgtaatttgagtgccggg

SEQ ID NO: 320856 - DNA, 25 bp, Rattus norvegicus
gaccatctgtttagggtgttccaac

SEQ ID NO: 320857 - DNA, 25 bp, Rattus norvegicus
gaccatctgttttgggtgttccaac

SEQ ID NO: 320858 - DNA, 25 bp, Rattus norvegicus
gaccatcttatcctcaatgtcgagt

SEQ ID NO: 320859 - DNA, 25 bp, Rattus norvegicus
gaccatcttatcgtcaatgtcgagt

SEQ ID NO: 320860 - DNA, 25 bp, Rattus norvegicus
gaccatcttgataatttccccttaa

SEQ ID NO: 320861 - DNA, 25 bp, Rattus norvegicus
gaccatcttgattatttccccttaa

SEQ ID NO: 320862 - DNA, 25 bp, Rattus norvegicus
gaccatcttgctactgcctttggat

SEQ ID NO: 320863 - DNA, 25 bp, Rattus norvegicus
gaccatcttgcttctgcctttggat

SEQ ID NO: 320864 - DNA, 25 bp, Rattus norvegicus
gaccatctttgtcgctggagtcctc

SEQ ID NO: 320865 - DNA, 25 bp, Rattus norvegicus
gaccatctttgtggctggagtcctc

SEQ ID NO: 320866 - DNA, 25 bp, Rattus norvegicus
gaccatctttttcttacatttataa

SEQ ID NO: 320867 - DNA, 25 bp, Rattus norvegicus
gaccatctttttgttacatttataa

SEQ ID NO: 320868 - DNA, 25 bp, Rattus norvegicus
gaccatgaacatcgcttgcagccag

SEQ ID NO: 320869 - DNA, 25 bp, Rattus norvegicus
gaccatgaacatggcttgcagccag

SEQ ID NO: 320870 - DNA, 25 bp, Rattus norvegicus
gaccatgaagaaatacaccacctat

SEQ ID NO: 320871 - DNA, 25 bp, Rattus norvegicus
gaccatgaagaattacaccacctat

SEQ ID NO: 320872 - DNA, 25 bp, Rattus norvegicus
gaccatgaagccagaccaatagaat

SEQ ID NO: 320873 - DNA, 25 bp, Rattus norvegicus
gaccatgaagcctgaccaatagaat

SEQ ID NO: 320874 - DNA, 25 bp, Rattus norvegicus
gaccatgaaggtaacccacttcctt

SEQ ID NO: 320875 - DNA, 25 bp, Rattus norvegicus
gaccatgaaggttacccacttcctt

SEQ ID NO: 320876 - DNA, 25 bp, Rattus norvegicus
gaccatgacatactgtttgggccag

SEQ ID NO: 320877 - DNA, 25 bp, Rattus norvegicus
gaccatgacatagtgtttgggccag

SEQ ID NO: 320878 - DNA, 25 bp, Rattus norvegicus
gaccatgaccaccttcaaacaattg

SEQ ID NO: 320879 - DNA, 25 bp, Rattus norvegicus
gaccatgaccacgttcaaacaattg

SEQ ID NO: 320880 - DNA, 25 bp, Rattus norvegicus
gaccatgacgaccttcgcagagatc

SEQ ID NO: 320881 - DNA, 25 bp, Rattus norvegicus
gaccatgacgacgttcgcagagatc

SEQ ID NO: 320882 - DNA, 25 bp, Rattus norvegicus
gaccatgagcacaggaacttttctt

SEQ ID NO: 320883 - DNA, 25 bp, Rattus norvegicus
gaccatgagcactggaacttttctt

SEQ ID NO: 320884 - DNA, 25 bp, Rattus norvegicus
gaccatgaggagagtccctgaatga

SEQ ID NO: 320885 - DNA, 25 bp, Rattus norvegicus
gaccatgaggagtgtccctgaatga

SEQ ID NO: 320886 - DNA, 25 bp, Rattus norvegicus
gaccatgagtctatgcctgagtgat

SEQ ID NO: 320887 - DNA, 25 bp, Rattus norvegicus
gaccatgagtctttgcctgagtgat

SEQ ID NO: 320888 - DNA, 25 bp, Rattus norvegicus
gaccatgatacaactctcagggctg

SEQ ID NO: 320889 - DNA, 25 bp, Rattus norvegicus
gaccatgatacatctctcagggctg

SEQ ID NO: 320890 - DNA, 25 bp, Rattus norvegicus
gaccatgatcagaatggagctggct

SEQ ID NO: 320891 - DNA, 25 bp, Rattus norvegicus
gaccatgatcagtatggagctggct

SEQ ID NO: 320892 - DNA, 25 bp, Rattus norvegicus
gaccatgatcgtaagagtgtgtcaa

SEQ ID NO: 320893 - DNA, 25 bp, Rattus norvegicus
gaccatgatcgttagagtgtgtcaa

SEQ ID NO: 320894 - DNA, 25 bp, Rattus norvegicus
gaccatgatggccttgacattatat

SEQ ID NO: 320895 - DNA, 25 bp, Rattus norvegicus
gaccatgatggcgttgacattatat

SEQ ID NO: 320896 - DNA, 25 bp, Rattus norvegicus
gaccatgcaaaactacttcacctga

SEQ ID NO: 320897 - DNA, 25 bp, Rattus norvegicus
gaccatgcaaaagtacttcacctga

SEQ ID NO: 320898 - DNA, 25 bp, Rattus norvegicus
gaccatgcaaatcactttacctctg

SEQ ID NO: 320899 - DNA, 25 bp, Rattus norvegicus
gaccatgcaaatgactttacctctg

SEQ ID NO: 320900 - DNA, 25 bp, Rattus norvegicus
gaccatgcagggagatggccttaaa

SEQ ID NO: 320901 - DNA, 25 bp, Rattus norvegicus
gaccatgcagggtgatggccttaaa

SEQ ID NO: 320902 - DNA, 25 bp, Rattus norvegicus
gaccatgcatcacatggctgctatg

SEQ ID NO: 320903 - DNA, 25 bp, Rattus norvegicus
gaccatgcatcagatggctgctatg

SEQ ID NO: 320904 - DNA, 25 bp, Rattus norvegicus
gaccatgcatccatatactgtgact

SEQ ID NO: 320905 - DNA, 25 bp, Rattus norvegicus
gaccatgcatccttatactgtgact

SEQ ID NO: 320906 - DNA, 25 bp, Rattus norvegicus
gaccatgccaaaataatattctggg

SEQ ID NO: 320907 - DNA, 25 bp, Rattus norvegicus
gaccatgccaaattaatattctggg

SEQ ID NO: 320908 - DNA, 25 bp, Rattus norvegicus
gaccatgccaagagtagtagcctgt

SEQ ID NO: 320909 - DNA, 25 bp, Rattus norvegicus
gaccatgccaagtgtagtagcctgt

SEQ ID NO: 320910 - DNA, 25 bp, Rattus norvegicus
gaccatgccatgcagttttctagtt

SEQ ID NO: 320911 - DNA, 25 bp, Rattus norvegicus
gaccatgccatggagttttctagtt

SEQ ID NO: 320912 - DNA, 25 bp, Rattus norvegicus
gaccatgcccttcgctggaggaatg

SEQ ID NO: 320913 - DNA, 25 bp, Rattus norvegicus
gaccatgcccttggctggaggaatg

SEQ ID NO: 320914 - DNA, 25 bp, Rattus norvegicus
gaccatgccggacgacgttcgtgaa

SEQ ID NO: 320915 - DNA, 25 bp, Rattus norvegicus
gaccatgccggaggacgttcgtgaa

SEQ ID NO: 320916 - DNA, 25 bp, Rattus norvegicus
gaccatgctaggacttgacattttt

SEQ ID NO: 320917 - DNA, 25 bp, Rattus norvegicus
gaccatgctaggtcttgacattttt

SEQ ID NO: 320918 - DNA, 25 bp, Rattus norvegicus
gaccatgctctcagaataaagctga

SEQ ID NO: 320919 - DNA, 25 bp, Rattus norvegicus
gaccatgctctctgaataaagctga

SEQ ID NO: 320920 - DNA, 25 bp, Rattus norvegicus
gaccatgctgaccttgtattgttac

SEQ ID NO: 320921 - DNA, 25 bp, Rattus norvegicus
gaccatgctgacgttgtattgttac

SEQ ID NO: 320922 - DNA, 25 bp, Rattus norvegicus
gaccatgcttggatgcagtgcctag

SEQ ID NO: 320923 - DNA, 25 bp, Rattus norvegicus
gaccatgcttggttgcagtgcctag

SEQ ID NO: 320924 - DNA, 25 bp, Rattus norvegicus
gaccatggaatgctaccgggtaccg

SEQ ID NO: 320925 - DNA, 25 bp, Rattus norvegicus
gaccatggaatggtaccgggtaccg

SEQ ID NO: 320926 - DNA, 25 bp, Rattus norvegicus
gaccatggagctccctaggttgtta

SEQ ID NO: 320927 - DNA, 25 bp, Rattus norvegicus
gaccatggagctgcctaggttgtta

SEQ ID NO: 320928 - DNA, 25 bp, Rattus norvegicus
gaccatggagggagctacttattcc

SEQ ID NO: 320929 - DNA, 25 bp, Rattus norvegicus
gaccatggagggtgctacttattcc

SEQ ID NO: 320930 - DNA, 25 bp, Rattus norvegicus
gaccatggatcaacgagggacacta

SEQ ID NO: 320931 - DNA, 25 bp, Rattus norvegicus
gaccatggatcatcgagggacacta

SEQ ID NO: 320932 - DNA, 25 bp, Rattus norvegicus
gaccatggatggcaaacgctctgat

SEQ ID NO: 320933 - DNA, 25 bp, Rattus norvegicus
gaccatggatgggaaacgctctgat

SEQ ID NO: 320934 - DNA, 25 bp, Rattus norvegicus
gaccatggccaactcatctgtaact

SEQ ID NO: 320935 - DNA, 25 bp, Rattus norvegicus
gaccatggccaacttcatccgtaac

SEQ ID NO: 320936 - DNA, 25 bp, Rattus norvegicus
gaccatggccaagtcatctgtaact

SEQ ID NO: 320937 - DNA, 25 bp, Rattus norvegicus
gaccatggccaagttcatccgtaac

SEQ ID NO: 320938 - DNA, 25 bp, Rattus norvegicus
gaccatggccttctgaccacaggat

SEQ ID NO: 320939 - DNA, 25 bp, Rattus norvegicus
gaccatggccttgtgaccacaggat

SEQ ID NO: 320940 - DNA, 25 bp, Rattus norvegicus
gaccatggcgctaagcagcattgtt

SEQ ID NO: 320941 - DNA, 25 bp, Rattus norvegicus
gaccatggcgcttagcagcattgtt

SEQ ID NO: 320942 - DNA, 25 bp, Rattus norvegicus
gaccatgggacaaaggcagcgcgtt

SEQ ID NO: 320943 - DNA, 25 bp, Rattus norvegicus
gaccatgggacataggcagcgcgtt

SEQ ID NO: 320944 - DNA, 25 bp, Rattus norvegicus
gaccatgggaccctatgctacttga

SEQ ID NO: 320945 - DNA, 25 bp, Rattus norvegicus
gaccatgggaccgtatgctacttga

SEQ ID NO: 320946 - DNA, 25 bp, Rattus norvegicus
gaccatgggattagaagtgcccgga

SEQ ID NO: 320947 - DNA, 25 bp, Rattus norvegicus
gaccatgggatttgaagtgcccgga

SEQ ID NO: 320948 - DNA, 25 bp, Rattus norvegicus
gaccatgggtaactcatcttctaaa

SEQ ID NO: 320949 - DNA, 25 bp, Rattus norvegicus
gaccatgggtaagtcatcttctaaa

SEQ ID NO: 320950 - DNA, 25 bp, Rattus norvegicus
gaccatggtcatacagtttttcaaa

SEQ ID NO: 320951 - DNA, 25 bp, Rattus norvegicus
gaccatggtcattcagtttttcaaa

SEQ ID NO: 320952 - DNA, 25 bp, Rattus norvegicus
gaccatggtgtcatatctcactgga

SEQ ID NO: 320953 - DNA, 25 bp, Rattus norvegicus
gaccatggtgtcttatctcactgga

SEQ ID NO: 320954 - DNA, 25 bp, Rattus norvegicus
gaccatgtaagtctcccatagcact

SEQ ID NO: 320955 - DNA, 25 bp, Rattus norvegicus
gaccatgtaagtgtcccatagcact

SEQ ID NO: 320956 - DNA, 25 bp, Rattus norvegicus
gaccatgtacctattacatcttcta

SEQ ID NO: 320957 - DNA, 25 bp, Rattus norvegicus
gaccatgtaccttttacatcttcta

SEQ ID NO: 320958 - DNA, 25 bp, Rattus norvegicus
gaccatgtactgctcttgaagactt

SEQ ID NO: 320959 - DNA, 25 bp, Rattus norvegicus
gaccatgtactggtcttgaagactt

SEQ ID NO: 320960 - DNA, 25 bp, Rattus norvegicus
gaccatgtcattaactaaacttccc

SEQ ID NO: 320961 - DNA, 25 bp, Rattus norvegicus
gaccatgtcatttactaaacttccc

SEQ ID NO: 320962 - DNA, 25 bp, Rattus norvegicus
gaccatgtctgaagttgctaggaga

SEQ ID NO: 320963 - DNA, 25 bp, Rattus norvegicus
gaccatgtctgatgttgctaggaga

SEQ ID NO: 320964 - DNA, 25 bp, Rattus norvegicus
gaccatgtctggacaactcactatg

SEQ ID NO: 320965 - DNA, 25 bp, Rattus norvegicus
gaccatgtctggtcaactcactatg

SEQ ID NO: 320966 - DNA, 25 bp, Rattus norvegicus
gaccatgtctttcccttgatttact

SEQ ID NO: 320967 - DNA, 25 bp, Rattus norvegicus
gaccatgtctttgccttgatttact

SEQ ID NO: 320968 - DNA, 25 bp, Rattus norvegicus
gaccatgtgcttatggagtcagcca

SEQ ID NO: 320969 - DNA, 25 bp, Rattus norvegicus
gaccatgtgcttttggagtcagcca

SEQ ID NO: 320970 - DNA, 25 bp, Rattus norvegicus
gaccatgtggccagagcacaaggca

SEQ ID NO: 320971 - DNA, 25 bp, Rattus norvegicus
gaccatgtggcctgagcacaaggca

SEQ ID NO: 320972 - DNA, 25 bp, Rattus norvegicus
gaccatgttattactgtcttctcac

SEQ ID NO: 320973 - DNA, 25 bp, Rattus norvegicus
gaccatgttatttctgtcttctcac

SEQ ID NO: 320974 - DNA, 25 bp, Rattus norvegicus
gaccatgttgctctgtgattatctc

SEQ ID NO: 320975 - DNA, 25 bp, Rattus norvegicus
gaccatgttgctgtgtgattatctc

SEQ ID NO: 320976 - DNA, 25 bp, Rattus norvegicus
gaccatgttgtgattactctccttg

SEQ ID NO: 320977 - DNA, 25 bp, Rattus norvegicus
gaccatgttgtgtttactctccttg

SEQ ID NO: 320978 - DNA, 25 bp, Rattus norvegicus
gaccatgtttatctctgggaaagaa

SEQ ID NO: 320979 - DNA, 25 bp, Rattus norvegicus
gaccatgtttatgtctgggaaagaa

SEQ ID NO: 320980 - DNA, 25 bp, Rattus norvegicus
gaccatgtttccctcttaatcaatt

SEQ ID NO: 320981 - DNA, 25 bp, Rattus norvegicus
gaccatgtttccgtcttaatcaatt

SEQ ID NO: 320982 - DNA, 25 bp, Rattus norvegicus
gaccattaatccagacactacttgt

SEQ ID NO: 320983 - DNA, 25 bp, Rattus norvegicus
gaccattaatcctgacactacttgt

SEQ ID NO: 320984 - DNA, 25 bp, Rattus norvegicus
gaccattagctgaaccaggcttggt

SEQ ID NO: 320985 - DNA, 25 bp, Rattus norvegicus
gaccattagctgattatctgatctt

SEQ ID NO: 320986 - DNA, 25 bp, Rattus norvegicus
gaccattagctgtaccaggcttggt

SEQ ID NO: 320987 - DNA, 25 bp, Rattus norvegicus
gaccattagctgtttatctgatctt

SEQ ID NO: 320988 - DNA, 25 bp, Rattus norvegicus
gaccattaggacagtgctgtgctgt

SEQ ID NO: 320989 - DNA, 25 bp, Rattus norvegicus
gaccattaggactgtgctgtgctgt

SEQ ID NO: 320990 - DNA, 25 bp, Rattus norvegicus
gaccattaggtccttccagtaattg

SEQ ID NO: 320991 - DNA, 25 bp, Rattus norvegicus
gaccattaggtcgttccagtaattg

SEQ ID NO: 320992 - DNA, 25 bp, Rattus norvegicus
gaccattcactcaccacaggaaatg

SEQ ID NO: 320993 - DNA, 25 bp, Rattus norvegicus
gaccattcactctccacaggaaatg

SEQ ID NO: 320994 - DNA, 25 bp, Rattus norvegicus
gaccattcagatcggatccttccga

SEQ ID NO: 320995 - DNA, 25 bp, Rattus norvegicus
gaccattcagatgggatccttccga

SEQ ID NO: 320996 - DNA, 25 bp, Rattus norvegicus
gaccattcatcccaggtgagcttcg

SEQ ID NO: 320997 - DNA, 25 bp, Rattus norvegicus
gaccattcatccgaggtgagcttcg

SEQ ID NO: 320998 - DNA, 25 bp, Rattus norvegicus
gaccattcattaaagagtttgcatt

SEQ ID NO: 320999 - DNA, 25 bp, Rattus norvegicus
gaccattcattatagagtttgcatt

SEQ ID NO: 321000 - DNA, 25 bp, Rattus norvegicus
gaccattccagaccattcttaacca

SEQ ID NO: 321001 - DNA, 25 bp, Rattus norvegicus
gaccattccagagcattcttaacca

SEQ ID NO: 321002 - DNA, 25 bp, Rattus norvegicus
gaccattccataccattagtcagaa

SEQ ID NO: 321003 - DNA, 25 bp, Rattus norvegicus
gaccattccatagcattagtcagaa

SEQ ID NO: 321004 - DNA, 25 bp, Rattus norvegicus
gaccattcctagagacttgttttgt

SEQ ID NO: 321005 - DNA, 25 bp, Rattus norvegicus
gaccattcctagtgacttgttttgt

SEQ ID NO: 321006 - DNA, 25 bp, Rattus norvegicus
gaccattcggtgaggcagcagcaga

SEQ ID NO: 321007 - DNA, 25 bp, Rattus norvegicus
gaccattcggtgtggcagcagcaga

SEQ ID NO: 321008 - DNA, 25 bp, Rattus norvegicus
gaccattctattctccctttcaagt

SEQ ID NO: 321009 - DNA, 25 bp, Rattus norvegicus
gaccattctattgtccctttcaagt

SEQ ID NO: 321010 - DNA, 25 bp, Rattus norvegicus
gaccattctcggcagctgacgaaga

SEQ ID NO: 321011 - DNA, 25 bp, Rattus norvegicus
gaccattctcgggagctgacgaaga

SEQ ID NO: 321012 - DNA, 25 bp, Rattus norvegicus
gaccattctcttaacactattttta

SEQ ID NO: 321013 - DNA, 25 bp, Rattus norvegicus
gaccattctctttacactattttta

SEQ ID NO: 321014 - DNA, 25 bp, Rattus norvegicus
gaccattctggtaccatcaatagct

SEQ ID NO: 321015 - DNA, 25 bp, Rattus norvegicus
gaccattctggtagtttgttgctat

SEQ ID NO: 321016 - DNA, 25 bp, Rattus norvegicus
gaccattctggttccatcaatagct

SEQ ID NO: 321017 - DNA, 25 bp, Rattus norvegicus
gaccattctggttgtttgttgctat

SEQ ID NO: 321018 - DNA, 25 bp, Rattus norvegicus
gaccattctgtcaaaggctgttcgt

SEQ ID NO: 321019 - DNA, 25 bp, Rattus norvegicus
gaccattctgtctaaggctgttcgt

SEQ ID NO: 321020 - DNA, 25 bp, Rattus norvegicus
gaccattctgtgattaggatctagc

SEQ ID NO: 321021 - DNA, 25 bp, Rattus norvegicus
gaccattctgtgcacgagagccttg

SEQ ID NO: 321022 - DNA, 25 bp, Rattus norvegicus
gaccattctgtggacgagagccttg

SEQ ID NO: 321023 - DNA, 25 bp, Rattus norvegicus
gaccattctgtgtttaggatctagc

SEQ ID NO: 321024 - DNA, 25 bp, Rattus norvegicus
gaccattcttagcagtttcctcagt

SEQ ID NO: 321025 - DNA, 25 bp, Rattus norvegicus
gaccattcttaggagtttcctcagt

SEQ ID NO: 321026 - DNA, 25 bp, Rattus norvegicus
gaccattcttgtcaccacgaaaacg

SEQ ID NO: 321027 - DNA, 25 bp, Rattus norvegicus
gaccattcttgtgaccacgaaaacg

SEQ ID NO: 321028 - DNA, 25 bp, Rattus norvegicus
gaccattctttcctgtttacctttg

SEQ ID NO: 321029 - DNA, 25 bp, Rattus norvegicus
gaccattctttcgtgtttacctttg

SEQ ID NO: 321030 - DNA, 25 bp, Rattus norvegicus
gaccattgaatacccgaattacttt

SEQ ID NO: 321031 - DNA, 25 bp, Rattus norvegicus
gaccattgaatagccgaattacttt

SEQ ID NO: 321032 - DNA, 25 bp, Rattus norvegicus
gaccattgctttactggattcgtta

SEQ ID NO: 321033 - DNA, 25 bp, Rattus norvegicus
gaccattgcttttctggattcgtta

SEQ ID NO: 321034 - DNA, 25 bp, Rattus norvegicus
gaccattggtgacttcaacccaaag

SEQ ID NO: 321035 - DNA, 25 bp, Rattus norvegicus
gaccattggtgagttcaacccaaag

SEQ ID NO: 321036 - DNA, 25 bp, Rattus norvegicus
gaccattgtagacggttggccttcc

SEQ ID NO: 321037 - DNA, 25 bp, Rattus norvegicus
gaccattgtagagggttggccttcc

SEQ ID NO: 321038 - DNA, 25 bp, Rattus norvegicus
gaccattgtaggctctgtcacaaac

SEQ ID NO: 321039 - DNA, 25 bp, Rattus norvegicus
gaccattgtagggtctgtcacaaac

SEQ ID NO: 321040 - DNA, 25 bp, Rattus norvegicus
gaccattgtctcatctgaacattga

SEQ ID NO: 321041 - DNA, 25 bp, Rattus norvegicus
gaccattgtctcttctgaacattga

SEQ ID NO: 321042 - DNA, 25 bp, Rattus norvegicus
gaccattgtgacagccgagtgtcca

SEQ ID NO: 321043 - DNA, 25 bp, Rattus norvegicus
gaccattgtgactgccgagtgtcca

SEQ ID NO: 321044 - DNA, 25 bp, Rattus norvegicus
gaccattgttccaaccaaatcaact

SEQ ID NO: 321045 - DNA, 25 bp, Rattus norvegicus
gaccattgttcctaccaaatcaact

SEQ ID NO: 321046 - DNA, 25 bp, Rattus norvegicus
gaccatttaagtccataagctgttc

SEQ ID NO: 321047 - DNA, 25 bp, Rattus norvegicus
gaccatttaagtgcataagctgttc

SEQ ID NO: 321048 - DNA, 25 bp, Rattus norvegicus
gaccatttagtgactgaatctgtca

SEQ ID NO: 321049 - DNA, 25 bp, Rattus norvegicus
gaccatttagtgtctgaatctgtca

SEQ ID NO: 321050 - DNA, 25 bp, Rattus norvegicus
gaccatttcagtccaactagctggg

SEQ ID NO: 321051 - DNA, 25 bp, Rattus norvegicus
gaccatttcagtccagcagttctaa

SEQ ID NO: 321052 - DNA, 25 bp, Rattus norvegicus
gaccatttcagtgcaactagctggg

SEQ ID NO: 321053 - DNA, 25 bp, Rattus norvegicus
gaccatttcagtgcagcagttctaa

SEQ ID NO: 321054 - DNA, 25 bp, Rattus norvegicus
gaccatttcatgactaacccaagac

SEQ ID NO: 321055 - DNA, 25 bp, Rattus norvegicus
gaccatttcatgtctaacccaagac

SEQ ID NO: 321056 - DNA, 25 bp, Rattus norvegicus
gaccatttccagaaaaggctagtgt

SEQ ID NO: 321057 - DNA, 25 bp, Rattus norvegicus
gaccatttccagtaaaggctagtgt

SEQ ID NO: 321058 - DNA, 25 bp, Rattus norvegicus
gaccatttctggagggaggccataa

SEQ ID NO: 321059 - DNA, 25 bp, Rattus norvegicus
gaccatttctggctttacctgaaaa

SEQ ID NO: 321060 - DNA, 25 bp, Rattus norvegicus
gaccatttctgggtttacctgaaaa

SEQ ID NO: 321061 - DNA, 25 bp, Rattus norvegicus
gaccatttctggtgggaggccataa

SEQ ID NO: 321062 - DNA, 25 bp, Rattus norvegicus
gaccatttggtcaggcaggagcccc

SEQ ID NO: 321063 - DNA, 25 bp, Rattus norvegicus
gaccatttggtctggcaggagcccc

SEQ ID NO: 321064 - DNA, 25 bp, Rattus norvegicus
gaccatttgtacataaaacttgact

SEQ ID NO: 321065 - DNA, 25 bp, Rattus norvegicus
gaccatttgtacttaaaacttgact

SEQ ID NO: 321066 - DNA, 25 bp, Rattus norvegicus
gaccattttaacagtctccttagcc

SEQ ID NO: 321067 - DNA, 25 bp, Rattus norvegicus
gaccattttaactgtctccttagcc

SEQ ID NO: 321068 - DNA, 25 bp, Rattus norvegicus
gaccattttgtcatttgtgtgtgtt

SEQ ID NO: 321069 - DNA, 25 bp, Rattus norvegicus
gaccattttgtcttttgtgtgtgtt

SEQ ID NO: 321070 - DNA, 25 bp, Rattus norvegicus
gaccattttgttccagaatcgccac

SEQ ID NO: 321071 - DNA, 25 bp, Rattus norvegicus
gaccattttgttgcagaatcgccac

SEQ ID NO: 321072 - DNA, 25 bp, Rattus norvegicus
gacccaaacatcatcatctgctgga

SEQ ID NO: 321073 - DNA, 25 bp, Rattus norvegicus
gacccaaacatcttcatctgctgga

SEQ ID NO: 321074 - DNA, 25 bp, Rattus norvegicus
gacccaaacccaaaactgcttgaag

SEQ ID NO: 321075 - DNA, 25 bp, Rattus norvegicus
gacccaaacccataactgcttgaag

SEQ ID NO: 321076 - DNA, 25 bp, Rattus norvegicus
gacccaaactgcacctaggttgtgt

SEQ ID NO: 321077 - DNA, 25 bp, Rattus norvegicus
gacccaaactgctcctaggttgtgt

SEQ ID NO: 321078 - DNA, 25 bp, Rattus norvegicus
gacccaaagcatacaaccagaagat

SEQ ID NO: 321079 - DNA, 25 bp, Rattus norvegicus
gacccaaagcatatggcgtctgcgc

SEQ ID NO: 321080 - DNA, 25 bp, Rattus norvegicus
gacccaaagcattcaaccagaagat

SEQ ID NO: 321081 - DNA, 25 bp, Rattus norvegicus
gacccaaagcatttggcgtctgcgc

SEQ ID NO: 321082 - DNA, 25 bp, Rattus norvegicus
gacccaaagggcagctgaggaccaa

SEQ ID NO: 321083 - DNA, 25 bp, Rattus norvegicus
gacccaaagggctgctgaggaccaa

SEQ ID NO: 321084 - DNA, 25 bp, Rattus norvegicus
gacccaaagtcacatactgcagcag

SEQ ID NO: 321085 - DNA, 25 bp, Rattus norvegicus
gacccaaagtcagatactgcagcag

SEQ ID NO: 321086 - DNA, 25 bp, Rattus norvegicus
gacccaaagtcgctgatccggaagg

SEQ ID NO: 321087 - DNA, 25 bp, Rattus norvegicus
gacccaaagtcggtgatccggaagg

SEQ ID NO: 321088 - DNA, 25 bp, Rattus norvegicus
gacccaaatgataattcctactgat

SEQ ID NO: 321089 - DNA, 25 bp, Rattus norvegicus
gacccaaatgattattcctactgat

SEQ ID NO: 321090 - DNA, 25 bp, Rattus norvegicus
gacccaaatgggattcccctggcta

SEQ ID NO: 321091 - DNA, 25 bp, Rattus norvegicus
gacccaaatgggtttcccctggcta

SEQ ID NO: 321092 - DNA, 25 bp, Rattus norvegicus
gacccaaatgttaccaatacagcat

SEQ ID NO: 321093 - DNA, 25 bp, Rattus norvegicus
gacccaaatgtttccaatacagcat

SEQ ID NO: 321094 - DNA, 25 bp, Rattus norvegicus
gacccaaattggaggcaggctagcc

SEQ ID NO: 321095 - DNA, 25 bp, Rattus norvegicus
gacccaaattggtggcaggctagcc

SEQ ID NO: 321096 - DNA, 25 bp, Rattus norvegicus
gacccaacatccattgatccagaaa

SEQ ID NO: 321097 - DNA, 25 bp, Rattus norvegicus
gacccaacatcctttgatccagaaa

SEQ ID NO: 321098 - DNA, 25 bp, Rattus norvegicus
gacccaacgtcaccgatgctgaaag

SEQ ID NO: 321099 - DNA, 25 bp, Rattus norvegicus
gacccaacgtcagcgatgctgaaag

SEQ ID NO: 321100 - DNA, 25 bp, Rattus norvegicus
gacccaacttgactggacccaatat

SEQ ID NO: 321101 - DNA, 25 bp, Rattus norvegicus
gacccaacttgagtggacccaatat

SEQ ID NO: 321102 - DNA, 25 bp, Rattus norvegicus
gacccaagaataaaagcccctccat

SEQ ID NO: 321103 - DNA, 25 bp, Rattus norvegicus
gacccaagaatataagcccctccat

SEQ ID NO: 321104 - DNA, 25 bp, Rattus norvegicus
gacccaagactaaggttcctccagt

SEQ ID NO: 321105 - DNA, 25 bp, Rattus norvegicus
gacccaagactatggttcctccagt

SEQ ID NO: 321106 - DNA, 25 bp, Rattus norvegicus
gacccaagagcccaaagtgacatcc

SEQ ID NO: 321107 - DNA, 25 bp, Rattus norvegicus
gacccaagagccgaaagtgacatcc

SEQ ID NO: 321108 - DNA, 25 bp, Rattus norvegicus
gacccaagggatccgccaaggcaat

SEQ ID NO: 321109 - DNA, 25 bp, Rattus norvegicus
gacccaagggatgcgccaaggcaat

SEQ ID NO: 321110 - DNA, 25 bp, Rattus norvegicus
gacccaagggtaccagatccatctc

SEQ ID NO: 321111 - DNA, 25 bp, Rattus norvegicus
gacccaagggtagcagatccatctc

SEQ ID NO: 321112 - DNA, 25 bp, Rattus norvegicus
gacccaagtaagaggcccagcggca

SEQ ID NO: 321113 - DNA, 25 bp, Rattus norvegicus
gacccaagtaagtggcccagcggca

SEQ ID NO: 321114 - DNA, 25 bp, Rattus norvegicus
gacccaagtattcttgatggaccct

SEQ ID NO: 321115 - DNA, 25 bp, Rattus norvegicus
gacccaagtattgttgatggaccct

SEQ ID NO: 321116 - DNA, 25 bp, Rattus norvegicus
gacccaagtggaatatcgacctcaa

SEQ ID NO: 321117 - DNA, 25 bp, Rattus norvegicus
gacccaagtggattatcgacctcaa

SEQ ID NO: 321118 - DNA, 25 bp, Rattus norvegicus
gacccaagtggcatggtgaccatta

SEQ ID NO: 321119 - DNA, 25 bp, Rattus norvegicus
gacccaagtggcttggtgaccatta

SEQ ID NO: 321120 - DNA, 25 bp, Rattus norvegicus
gacccaagtttgatgtaacacccat

SEQ ID NO: 321121 - DNA, 25 bp, Rattus norvegicus
gacccaagtttgttgtaacacccat

SEQ ID NO: 321122 - DNA, 25 bp, Rattus norvegicus
gacccaatcactctgtcaatcaaac

SEQ ID NO: 321123 - DNA, 25 bp, Rattus norvegicus
gacccaatcactgtgtcaatcaaac

SEQ ID NO: 321124 - DNA, 25 bp, Rattus norvegicus
gacccaatctagagcagaagccaaa

SEQ ID NO: 321125 - DNA, 25 bp, Rattus norvegicus
gacccaatctagtgcagaagccaaa

SEQ ID NO: 321126 - DNA, 25 bp, Rattus norvegicus
gacccaatctccctgtcagagaaaa

SEQ ID NO: 321127 - DNA, 25 bp, Rattus norvegicus
gacccaatctccgtgtcagagaaaa

SEQ ID NO: 321128 - DNA, 25 bp, Rattus norvegicus
gacccaatgctaatctttccagaag

SEQ ID NO: 321129 - DNA, 25 bp, Rattus norvegicus
gacccaatgctattctttccagaag

SEQ ID NO: 321130 - DNA, 25 bp, Rattus norvegicus
gacccacaagtgctttgctacgacc

SEQ ID NO: 321131 - DNA, 25 bp, Rattus norvegicus
gacccacaagtggtttgctacgacc

SEQ ID NO: 321132 - DNA, 25 bp, Rattus norvegicus
gacccacaagttctagaatgaagga

SEQ ID NO: 321133 - DNA, 25 bp, Rattus norvegicus
gacccacaagttgtagaatgaagga

SEQ ID NO: 321134 - DNA, 25 bp, Rattus norvegicus
gacccacacaggatttatttttgtg

SEQ ID NO: 321135 - DNA, 25 bp, Rattus norvegicus
gacccacacaggttttatttttgtg

SEQ ID NO: 321136 - DNA, 25 bp, Rattus norvegicus
gacccacacatgactcaatatagca

SEQ ID NO: 321137 - DNA, 25 bp, Rattus norvegicus
gacccacacatgtctcaatatagca

SEQ ID NO: 321138 - DNA, 25 bp, Rattus norvegicus
gacccacaccctagaggtgttggaa

SEQ ID NO: 321139 - DNA, 25 bp, Rattus norvegicus
gacccacacccttgaggtgttggaa

SEQ ID NO: 321140 - DNA, 25 bp, Rattus norvegicus
gacccacaccgcattttataaactt

SEQ ID NO: 321141 - DNA, 25 bp, Rattus norvegicus
gacccacaccgctttttataaactt

SEQ ID NO: 321142 - DNA, 25 bp, Rattus norvegicus
gacccacactggagaatacatgcac

SEQ ID NO: 321143 - DNA, 25 bp, Rattus norvegicus
gacccacactggtgaatacatgcac

SEQ ID NO: 321144 - DNA, 25 bp, Rattus norvegicus
gacccacacttgcaagaagccttag

SEQ ID NO: 321145 - DNA, 25 bp, Rattus norvegicus
gacccacacttggaagaagccttag

SEQ ID NO: 321146 - DNA, 25 bp, Rattus norvegicus
gacccacagaacacctaatcgaaat

SEQ ID NO: 321147 - DNA, 25 bp, Rattus norvegicus
gacccacagaactcctaatcgaaat

SEQ ID NO: 321148 - DNA, 25 bp, Rattus norvegicus
gacccacagcccattcctttaaatt

SEQ ID NO: 321149 - DNA, 25 bp, Rattus norvegicus
gacccacagccctttcctttaaatt

SEQ ID NO: 321150 - DNA, 25 bp, Rattus norvegicus
gacccacagtacctcgtggtgtgtt

SEQ ID NO: 321151 - DNA, 25 bp, Rattus norvegicus
gacccacagtacgtcgtggtgtgtt

SEQ ID NO: 321152 - DNA, 25 bp, Rattus norvegicus
gacccacagtgcctactctagaaaa

SEQ ID NO: 321153 - DNA, 25 bp, Rattus norvegicus
gacccacagtgcgtactctagaaaa

SEQ ID NO: 321154 - DNA, 25 bp, Rattus norvegicus
gacccacatattaaacatgcttttt

SEQ ID NO: 321155 - DNA, 25 bp, Rattus norvegicus
gacccacatatttaacatgcttttt

SEQ ID NO: 321156 - DNA, 25 bp, Rattus norvegicus
gacccacatctccatgatttaagcg

SEQ ID NO: 321157 - DNA, 25 bp, Rattus norvegicus
gacccacatctcgatgatttaagcg

SEQ ID NO: 321158 - DNA, 25 bp, Rattus norvegicus
gacccacatgtacatgtccacttgt

SEQ ID NO: 321159 - DNA, 25 bp, Rattus norvegicus
gacccacatgtagatgtccacttgt

SEQ ID NO: 321160 - DNA, 25 bp, Rattus norvegicus
gacccacattgaacatcctgaagca

SEQ ID NO: 321161 - DNA, 25 bp, Rattus norvegicus
gacccacattgatcatcctgaagca

SEQ ID NO: 321162 - DNA, 25 bp, Rattus norvegicus
gacccacatttactctgacaggaca

SEQ ID NO: 321163 - DNA, 25 bp, Rattus norvegicus
gacccacatttagtctgacaggaca

SEQ ID NO: 321164 - DNA, 25 bp, Rattus norvegicus
gacccaccacaaccagcaggttttt

SEQ ID NO: 321165 - DNA, 25 bp, Rattus norvegicus
gacccaccacaagcagcaggttttt

SEQ ID NO: 321166 - DNA, 25 bp, Rattus norvegicus
gacccaccagcacgtgtgcagttta

SEQ ID NO: 321167 - DNA, 25 bp, Rattus norvegicus
gacccaccagcaggtgtgcagttta

SEQ ID NO: 321168 - DNA, 25 bp, Rattus norvegicus
gacccaccaggaagaaagacccagg

SEQ ID NO: 321169 - DNA, 25 bp, Rattus norvegicus
gacccaccaggatgaaagacccagg

SEQ ID NO: 321170 - DNA, 25 bp, Rattus norvegicus
gacccaccagtccacgttaattgtt

SEQ ID NO: 321171 - DNA, 25 bp, Rattus norvegicus
gacccaccagtcgacgttaattgtt

SEQ ID NO: 321172 - DNA, 25 bp, Rattus norvegicus
gacccaccatatcctccagaaaatt

SEQ ID NO: 321173 - DNA, 25 bp, Rattus norvegicus
gacccaccatatgctccagaaaatt

SEQ ID NO: 321174 - DNA, 25 bp, Rattus norvegicus
gacccaccattaacatcagactttc

SEQ ID NO: 321175 - DNA, 25 bp, Rattus norvegicus
gacccaccattatcatcagactttc

SEQ ID NO: 321176 - DNA, 25 bp, Rattus norvegicus
gacccaccccatctggctttaaata

SEQ ID NO: 321177 - DNA, 25 bp, Rattus norvegicus
gacccaccccatgtggctttaaata

SEQ ID NO: 321178 - DNA, 25 bp, Rattus norvegicus
gacccacccgatcggacttagtggt

SEQ ID NO: 321179 - DNA, 25 bp, Rattus norvegicus
gacccacccgatgggacttagtggt

SEQ ID NO: 321180 - DNA, 25 bp, Rattus norvegicus
gacccaccctgaatgccagaaaaaa

SEQ ID NO: 321181 - DNA, 25 bp, Rattus norvegicus
gacccaccctgattgccagaaaaaa

SEQ ID NO: 321182 - DNA, 25 bp, Rattus norvegicus
gacccaccgcatcgatgagaagctt

SEQ ID NO: 321183 - DNA, 25 bp, Rattus norvegicus
gacccaccgcatggatgagaagctt

SEQ ID NO: 321184 - DNA, 25 bp, Rattus norvegicus
gacccaccgctcagaacgttctaga

SEQ ID NO: 321185 - DNA, 25 bp, Rattus norvegicus
gacccaccgctctgaacgttctaga

SEQ ID NO: 321186 - DNA, 25 bp, Rattus norvegicus
gacccacctatgctggtagcaagag

SEQ ID NO: 321187 - DNA, 25 bp, Rattus norvegicus
gacccacctatggtggtagcaagag

SEQ ID NO: 321188 - DNA, 25 bp, Rattus norvegicus
gacccacctcatccctgtaggaaga

SEQ ID NO: 321189 - DNA, 25 bp, Rattus norvegicus
gacccacctcatgcctgtaggaaga

SEQ ID NO: 321190 - DNA, 25 bp, Rattus norvegicus
gacccacctctgacatgcatggtga

SEQ ID NO: 321191 - DNA, 25 bp, Rattus norvegicus
gacccacctctgtcatgcatggtga

SEQ ID NO: 321192 - DNA, 25 bp, Rattus norvegicus
gacccacctgtacgacctgtgtgat

SEQ ID NO: 321193 - DNA, 25 bp, Rattus norvegicus
gacccacctgtaggacctgtgtgat

SEQ ID NO: 321194 - DNA, 25 bp, Rattus norvegicus
gacccacggtagagtcacacagaca

SEQ ID NO: 321195 - DNA, 25 bp, Rattus norvegicus
gacccacggtagtgtcacacagaca

SEQ ID NO: 321196 - DNA, 25 bp, Rattus norvegicus
gacccacgtggcagagccaagaagc

SEQ ID NO: 321197 - DNA, 25 bp, Rattus norvegicus
gacccacgtggctgagccaagaagc

SEQ ID NO: 321198 - DNA, 25 bp, Rattus norvegicus
gacccacgtgggacaaacctcttag

SEQ ID NO: 321199 - DNA, 25 bp, Rattus norvegicus
gacccacgtgggtcaaacctcttag

SEQ ID NO: 321200 - DNA, 25 bp, Rattus norvegicus
gacccactaggtaagacctctggta

SEQ ID NO: 321201 - DNA, 25 bp, Rattus norvegicus
gacccactaggttagacctctggta

SEQ ID NO: 321202 - DNA, 25 bp, Rattus norvegicus
gacccactagttaacctgccagaaa

SEQ ID NO: 321203 - DNA, 25 bp, Rattus norvegicus
gacccactagtttacctgccagaaa

SEQ ID NO: 321204 - DNA, 25 bp, Rattus norvegicus
gacccactcaaaatcttcagactct

SEQ ID NO: 321205 - DNA, 25 bp, Rattus norvegicus
gacccactcaaattcttcagactct

SEQ ID NO: 321206 - DNA, 25 bp, Rattus norvegicus
gacccactcgggacttgaggatgtc

SEQ ID NO: 321207 - DNA, 25 bp, Rattus norvegicus
gacccactcgggtcttgaggatgtc

SEQ ID NO: 321208 - DNA, 25 bp, Rattus norvegicus
gacccactcgtgagtaactttatga

SEQ ID NO: 321209 - DNA, 25 bp, Rattus norvegicus
gacccactcgtgtgtaactttatga

SEQ ID NO: 321210 - DNA, 25 bp, Rattus norvegicus
gacccactgcacaatgaagagtatc

SEQ ID NO: 321211 - DNA, 25 bp, Rattus norvegicus
gacccactgcactatgaagagtatc

SEQ ID NO: 321212 - DNA, 25 bp, Rattus norvegicus
gacccactgggcacaggacacagaa

SEQ ID NO: 321213 - DNA, 25 bp, Rattus norvegicus
gacccactgggctcaggacacagaa

SEQ ID NO: 321214 - DNA, 25 bp, Rattus norvegicus
gacccactgtggatctctttataga

SEQ ID NO: 321215 - DNA, 25 bp, Rattus norvegicus
gacccactgtggttctctttataga

SEQ ID NO: 321216 - DNA, 25 bp, Rattus norvegicus
gacccacttcacatctgttggagaa

SEQ ID NO: 321217 - DNA, 25 bp, Rattus norvegicus
gacccacttcacttctgttggagaa

SEQ ID NO: 321218 - DNA, 25 bp, Rattus norvegicus
gacccactttgtctgctgagtgaat

SEQ ID NO: 321219 - DNA, 25 bp, Rattus norvegicus
gacccactttgtgtgctgagtgaat

SEQ ID NO: 321220 - DNA, 25 bp, Rattus norvegicus
gacccagaacatatgtctttactgc

SEQ ID NO: 321221 - DNA, 25 bp, Rattus norvegicus
gacccagaacatttgtctttactgc

SEQ ID NO: 321222 - DNA, 25 bp, Rattus norvegicus
gacccagaactgaccttataaccta

SEQ ID NO: 321223 - DNA, 25 bp, Rattus norvegicus
gacccagaactgtccttataaccta

SEQ ID NO: 321224 - DNA, 25 bp, Rattus norvegicus
gacccagaagtgctctgtgacagta

SEQ ID NO: 321225 - DNA, 25 bp, Rattus norvegicus
gacccagaagtggtctgtgacagta

SEQ ID NO: 321226 - DNA, 25 bp, Rattus norvegicus
gacccagacctcaacatcgagattg

SEQ ID NO: 321227 - DNA, 25 bp, Rattus norvegicus
gacccagacctctacatcgagattg

SEQ ID NO: 321228 - DNA, 25 bp, Rattus norvegicus
gacccagacgttaaaagcacccagt

SEQ ID NO: 321229 - DNA, 25 bp, Rattus norvegicus
gacccagacgtttaaagcacccagt

SEQ ID NO: 321230 - DNA, 25 bp, Rattus norvegicus
gacccagactacatttcctaagagg

SEQ ID NO: 321231 - DNA, 25 bp, Rattus norvegicus
gacccagactacttttcctaagagg

SEQ ID NO: 321232 - DNA, 25 bp, Rattus norvegicus
gacccagagaaactgcctggctgta

SEQ ID NO: 321233 - DNA, 25 bp, Rattus norvegicus
gacccagagaaagtgcctggctgta

SEQ ID NO: 321234 - DNA, 25 bp, Rattus norvegicus
gacccagagcacagagttacgatga

SEQ ID NO: 321235 - DNA, 25 bp, Rattus norvegicus
gacccagagcactgagttacgatga

SEQ ID NO: 321236 - DNA, 25 bp, Rattus norvegicus
gacccagagctgaggatgacctaac

SEQ ID NO: 321237 - DNA, 25 bp, Rattus norvegicus
gacccagagctgtggatgacctaac

SEQ ID NO: 321238 - DNA, 25 bp, Rattus norvegicus
gacccagaggccaaagtataaattt

SEQ ID NO: 321239 - DNA, 25 bp, Rattus norvegicus
gacccagaggcctaagtataaattt

SEQ ID NO: 321240 - DNA, 25 bp, Rattus norvegicus
gacccagatcaaccgccaggaaatg

SEQ ID NO: 321241 - DNA, 25 bp, Rattus norvegicus
gacccagatcaagcgccaggaaatg

SEQ ID NO: 321242 - DNA, 25 bp, Rattus norvegicus
gacccagatccgctggctttaaata

SEQ ID NO: 321243 - DNA, 25 bp, Rattus norvegicus
gacccagatccggtggctttaaata

SEQ ID NO: 321244 - DNA, 25 bp, Rattus norvegicus
gacccagatctcagttggcttttct

SEQ ID NO: 321245 - DNA, 25 bp, Rattus norvegicus
gacccagatctctgttggcttttct

SEQ ID NO: 321246 - DNA, 25 bp, Rattus norvegicus
gacccagatgaccacctagatattt

SEQ ID NO: 321247 - DNA, 25 bp, Rattus norvegicus
gacccagatgacgacctagatattt

SEQ ID NO: 321248 - DNA, 25 bp, Rattus norvegicus
gacccagatgtgcttgcccggttta

SEQ ID NO: 321249 - DNA, 25 bp, Rattus norvegicus
gacccagatgtggttgcccggttta

SEQ ID NO: 321250 - DNA, 25 bp, Rattus norvegicus
gacccagcaccacttataaacttag

SEQ ID NO: 321251 - DNA, 25 bp, Rattus norvegicus
gacccagcaccagttataaacttag

SEQ ID NO: 321252 - DNA, 25 bp, Rattus norvegicus
gacccagcactgacagtggctgcca

SEQ ID NO: 321253 - DNA, 25 bp, Rattus norvegicus
gacccagcactgtcagtggctgcca

SEQ ID NO: 321254 - DNA, 25 bp, Rattus norvegicus
gacccagcagctagagtctcagata

SEQ ID NO: 321255 - DNA, 25 bp, Rattus norvegicus
gacccagcagcttgagtctcagata

SEQ ID NO: 321256 - DNA, 25 bp, Rattus norvegicus
gacccagcagggaaagagacaccaa

SEQ ID NO: 321257 - DNA, 25 bp, Rattus norvegicus
gacccagcagggtaagagacaccaa

SEQ ID NO: 321258 - DNA, 25 bp, Rattus norvegicus
gacccagccaggctcactggatggc

SEQ ID NO: 321259 - DNA, 25 bp, Rattus norvegicus
gacccagccagggtcactggatggc

SEQ ID NO: 321260 - DNA, 25 bp, Rattus norvegicus
gacccagccattatgtctttttagg

SEQ ID NO: 321261 - DNA, 25 bp, Rattus norvegicus
gacccagccattttgtctttttagg

SEQ ID NO: 321262 - DNA, 25 bp, Rattus norvegicus
gacccagcgaccctgtatgaagtgg

SEQ ID NO: 321263 - DNA, 25 bp, Rattus norvegicus
gacccagcgaccgtgtatgaagtgg

SEQ ID NO: 321264 - DNA, 25 bp, Rattus norvegicus
gacccagcgcatccattgcaaggtg

SEQ ID NO: 321265 - DNA, 25 bp, Rattus norvegicus
gacccagcgcatgcattgcaaggtg

SEQ ID NO: 321266 - DNA, 25 bp, Rattus norvegicus
gacccagctacacatttgccaaagg

SEQ ID NO: 321267 - DNA, 25 bp, Rattus norvegicus
gacccagctacagatttgccaaagg

SEQ ID NO: 321268 - DNA, 25 bp, Rattus norvegicus
gacccagctcagcaactactggtag

SEQ ID NO: 321269 - DNA, 25 bp, Rattus norvegicus
gacccagctcaggaactactggtag

SEQ ID NO: 321270 - DNA, 25 bp, Rattus norvegicus
gacccagctgtgaagcagagcttct

SEQ ID NO: 321271 - DNA, 25 bp, Rattus norvegicus
gacccagctgtgtagcagagcttct

SEQ ID NO: 321272 - DNA, 25 bp, Rattus norvegicus
gacccagcttggacaaaccctcttt

SEQ ID NO: 321273 - DNA, 25 bp, Rattus norvegicus
gacccagcttggtcaaaccctcttt

SEQ ID NO: 321274 - DNA, 25 bp, Rattus norvegicus
gacccagctttgaggagccctggaa

SEQ ID NO: 321275 - DNA, 25 bp, Rattus norvegicus
gacccagctttgtggagccctggaa

SEQ ID NO: 321276 - DNA, 25 bp, Rattus norvegicus
gacccaggaacccaatctagcaaga

SEQ ID NO: 321277 - DNA, 25 bp, Rattus norvegicus
gacccaggaaccgaatctagcaaga

SEQ ID NO: 321278 - DNA, 25 bp, Rattus norvegicus
gacccaggacaaagttacttctccg

SEQ ID NO: 321279 - DNA, 25 bp, Rattus norvegicus
gacccaggacaatgttacttctccg

SEQ ID NO: 321280 - DNA, 25 bp, Rattus norvegicus
gacccaggaggaaacttgccatgct

SEQ ID NO: 321281 - DNA, 25 bp, Rattus norvegicus
gacccaggaggatacttgccatgct

SEQ ID NO: 321282 - DNA, 25 bp, Rattus norvegicus
gacccaggagtaccacttttcatat

SEQ ID NO: 321283 - DNA, 25 bp, Rattus norvegicus
gacccaggagtagcacttttcatat

SEQ ID NO: 321284 - DNA, 25 bp, Rattus norvegicus
gacccaggatgcacggtcctagaaa

SEQ ID NO: 321285 - DNA, 25 bp, Rattus norvegicus
gacccaggatgctcggtcctagaaa

SEQ ID NO: 321286 - DNA, 25 bp, Rattus norvegicus
gacccaggcaagatctaggagctct

SEQ ID NO: 321287 - DNA, 25 bp, Rattus norvegicus
gacccaggcaagttctaggagctct

SEQ ID NO: 321288 - DNA, 25 bp, Rattus norvegicus
gacccaggctcaacgtgtacattgt

SEQ ID NO: 321289 - DNA, 25 bp, Rattus norvegicus
gacccaggctcatcgtgtacattgt

SEQ ID NO: 321290 - DNA, 25 bp, Rattus norvegicus
gacccaggctgcaaagtgagacacc

SEQ ID NO: 321291 - DNA, 25 bp, Rattus norvegicus
gacccaggctgctaagtgagacacc

SEQ ID NO: 321292 - DNA, 25 bp, Rattus norvegicus
gacccagggatgagggactgttcct

SEQ ID NO: 321293 - DNA, 25 bp, Rattus norvegicus
gacccagggatgtgggactgttcct

SEQ ID NO: 321294 - DNA, 25 bp, Rattus norvegicus
gacccagggcagcacattgtgtgct

SEQ ID NO: 321295 - DNA, 25 bp, Rattus norvegicus
gacccagggcaggacattgtgtgct

SEQ ID NO: 321296 - DNA, 25 bp, Rattus norvegicus
gacccagggcatctgaagtgtgttt

SEQ ID NO: 321297 - DNA, 25 bp, Rattus norvegicus
gacccagggcatgtgaagtgtgttt

SEQ ID NO: 321298 - DNA, 25 bp, Rattus norvegicus
gacccagggtagatgcatatgcctt

SEQ ID NO: 321299 - DNA, 25 bp, Rattus norvegicus
gacccagggtagttgcatatgcctt

SEQ ID NO: 321300 - DNA, 25 bp, Rattus norvegicus
gacccaggtcgcctgctagtgcgca

SEQ ID NO: 321301 - DNA, 25 bp, Rattus norvegicus
gacccaggtcgcgtgctagtgcgca

SEQ ID NO: 321302 - DNA, 25 bp, Rattus norvegicus
gacccaggtggtacgcaaggctcag

SEQ ID NO: 321303 - DNA, 25 bp, Rattus norvegicus
gacccaggtggttcgcaaggctcag

SEQ ID NO: 321304 - DNA, 25 bp, Rattus norvegicus
gacccaggtgtcacatgtggtggta

SEQ ID NO: 321305 - DNA, 25 bp, Rattus norvegicus
gacccaggtgtctcatgtggtggta

SEQ ID NO: 321306 - DNA, 25 bp, Rattus norvegicus
gacccaggttcacacaacgatgcgt

SEQ ID NO: 321307 - DNA, 25 bp, Rattus norvegicus
gacccaggttcagacaacgatgcgt

SEQ ID NO: 321308 - DNA, 25 bp, Rattus norvegicus
gacccaggttggagcaagcagattc

SEQ ID NO: 321309 - DNA, 25 bp, Rattus norvegicus
gacccaggttggtgcaagcagattc

SEQ ID NO: 321310 - DNA, 25 bp, Rattus norvegicus
gacccagtaaggagctagcttggtt

SEQ ID NO: 321311 - DNA, 25 bp, Rattus norvegicus
gacccagtaaggtgctagcttggtt

SEQ ID NO: 321312 - DNA, 25 bp, Rattus norvegicus
gacccagtacatcagttcaaagcct

SEQ ID NO: 321313 - DNA, 25 bp, Rattus norvegicus
gacccagtacatgagttcaaagcct

SEQ ID NO: 321314 - DNA, 25 bp, Rattus norvegicus
gacccagtagacctgacactataga

SEQ ID NO: 321315 - DNA, 25 bp, Rattus norvegicus
gacccagtagacgtgacactataga

SEQ ID NO: 321316 - DNA, 25 bp, Rattus norvegicus
gacccagtagagatcaaggctgtga

SEQ ID NO: 321317 - DNA, 25 bp, Rattus norvegicus
gacccagtagagttcaaggctgtga

SEQ ID NO: 321318 - DNA, 25 bp, Rattus norvegicus
gacccagtcaccatctgtagagagt

SEQ ID NO: 321319 - DNA, 25 bp, Rattus norvegicus
gacccagtcaccttctgtagagagt

SEQ ID NO: 321320 - DNA, 25 bp, Rattus norvegicus
gacccagtcccaattaattagctaa

SEQ ID NO: 321321 - DNA, 25 bp, Rattus norvegicus
gacccagtcccatttaattagctaa

SEQ ID NO: 321322 - DNA, 25 bp, Rattus norvegicus
gacccagtcgctcattcagcagaaa

SEQ ID NO: 321323 - DNA, 25 bp, Rattus norvegicus
gacccagtcgctgattcagcagaaa

SEQ ID NO: 321324 - DNA, 25 bp, Rattus norvegicus
gacccagtctgtcttttctatattt

SEQ ID NO: 321325 - DNA, 25 bp, Rattus norvegicus
gacccagtctgtgttttctatattt

SEQ ID NO: 321326 - DNA, 25 bp, Rattus norvegicus
gacccagtgaggagatccgggcctt

SEQ ID NO: 321327 - DNA, 25 bp, Rattus norvegicus
gacccagtgaggtgatccgggcctt

SEQ ID NO: 321328 - DNA, 25 bp, Rattus norvegicus
gacccagtgcacagattcgaatgaa

SEQ ID NO: 321329 - DNA, 25 bp, Rattus norvegicus
gacccagtgcactgattcgaatgaa

SEQ ID NO: 321330 - DNA, 25 bp, Rattus norvegicus
gacccagtgcatatagcaggagtat

SEQ ID NO: 321331 - DNA, 25 bp, Rattus norvegicus
gacccagtgcatttagcaggagtat

SEQ ID NO: 321332 - DNA, 25 bp, Rattus norvegicus
gacccagtgctgaatctgcaggagt

SEQ ID NO: 321333 - DNA, 25 bp, Rattus norvegicus
gacccagtgctgtatctgcaggagt

SEQ ID NO: 321334 - DNA, 25 bp, Rattus norvegicus
gacccagtgggcagccaaggcacta

SEQ ID NO: 321335 - DNA, 25 bp, Rattus norvegicus
gacccagtgggctgccaaggcacta

SEQ ID NO: 321336 - DNA, 25 bp, Rattus norvegicus
gacccagttcttcagctaccataag

SEQ ID NO: 321337 - DNA, 25 bp, Rattus norvegicus
gacccagttcttgagctaccataag

SEQ ID NO: 321338 - DNA, 25 bp, Rattus norvegicus
gacccagttggcctttaatcttgaa

SEQ ID NO: 321339 - DNA, 25 bp, Rattus norvegicus
gacccagttggcgtttaatcttgaa

SEQ ID NO: 321340 - DNA, 25 bp, Rattus norvegicus
gacccagtttcactattgacacagt

SEQ ID NO: 321341 - DNA, 25 bp, Rattus norvegicus
gacccagtttcagtattgacacagt

SEQ ID NO: 321342 - DNA, 25 bp, Rattus norvegicus
gacccagtttggctatcagcaactt

SEQ ID NO: 321343 - DNA, 25 bp, Rattus norvegicus
gacccagtttgggtatcagcaactt

SEQ ID NO: 321344 - DNA, 25 bp, Rattus norvegicus
gacccataaccacctgtaattccag

SEQ ID NO: 321345 - DNA, 25 bp, Rattus norvegicus
gacccataaccagctgtaattccag

SEQ ID NO: 321346 - DNA, 25 bp, Rattus norvegicus
gacccataacttcatgtccaaccga

SEQ ID NO: 321347 - DNA, 25 bp, Rattus norvegicus
gacccataacttgatgtccaaccga

SEQ ID NO: 321348 - DNA, 25 bp, Rattus norvegicus
gacccataagaactagtcgcctctt

SEQ ID NO: 321349 - DNA, 25 bp, Rattus norvegicus
gacccataagaagtagtcgcctctt

SEQ ID NO: 321350 - DNA, 25 bp, Rattus norvegicus
gacccatacctgatggttcagtctg

SEQ ID NO: 321351 - DNA, 25 bp, Rattus norvegicus
gacccatacctgttggttcagtctg

SEQ ID NO: 321352 - DNA, 25 bp, Rattus norvegicus
gacccatagaaccacaaatttaatt

SEQ ID NO: 321353 - DNA, 25 bp, Rattus norvegicus
gacccatagaacgacaaatttaatt

SEQ ID NO: 321354 - DNA, 25 bp, Rattus norvegicus
gacccatagattcttttctagtgac

SEQ ID NO: 321355 - DNA, 25 bp, Rattus norvegicus
gacccatagattgttttctagtgac

SEQ ID NO: 321356 - DNA, 25 bp, Rattus norvegicus
gacccatagccgagttaatattccc

SEQ ID NO: 321357 - DNA, 25 bp, Rattus norvegicus
gacccatagccgtgttaatattccc

SEQ ID NO: 321358 - DNA, 25 bp, Rattus norvegicus
gacccatatccacgtcttaatctgg

SEQ ID NO: 321359 - DNA, 25 bp, Rattus norvegicus
gacccatatccaggtcttaatctgg

SEQ ID NO: 321360 - DNA, 25 bp, Rattus norvegicus
gacccatatgtcacaccaaaataat

SEQ ID NO: 321361 - DNA, 25 bp, Rattus norvegicus
gacccatatgtctcaccaaaataat

SEQ ID NO: 321362 - DNA, 25 bp, Rattus norvegicus
gacccatcacctcattcaggagtgt

SEQ ID NO: 321363 - DNA, 25 bp, Rattus norvegicus
gacccatcacctgattcaggagtgt

SEQ ID NO: 321364 - DNA, 25 bp, Rattus norvegicus
gacccatcgagcaggagcagattcc

SEQ ID NO: 321365 - DNA, 25 bp, Rattus norvegicus
gacccatcgagctggagcagattcc

SEQ ID NO: 321366 - DNA, 25 bp, Rattus norvegicus
gacccatcgcgcagtataatgatta

SEQ ID NO: 321367 - DNA, 25 bp, Rattus norvegicus
gacccatcgcgctgtataatgatta

SEQ ID NO: 321368 - DNA, 25 bp, Rattus norvegicus
gacccatctctaattattttctgga

SEQ ID NO: 321369 - DNA, 25 bp, Rattus norvegicus
gacccatctctatttattttctgga

SEQ ID NO: 321370 - DNA, 25 bp, Rattus norvegicus
gacccatcttagagcagcagacttt

SEQ ID NO: 321371 - DNA, 25 bp, Rattus norvegicus
gacccatcttagtgcagcagacttt

SEQ ID NO: 321372 - DNA, 25 bp, Rattus norvegicus
gacccatgaattcttaagacagctt

SEQ ID NO: 321373 - DNA, 25 bp, Rattus norvegicus
gacccatgaattgttaagacagctt

SEQ ID NO: 321374 - DNA, 25 bp, Rattus norvegicus
gacccatgacacacagacctcagtg

SEQ ID NO: 321375 - DNA, 25 bp, Rattus norvegicus
gacccatgacactcagacctcagtg

SEQ ID NO: 321376 - DNA, 25 bp, Rattus norvegicus
gacccatgactgaccttcataaatg

SEQ ID NO: 321377 - DNA, 25 bp, Rattus norvegicus
gacccatgactgtccttcataaatg

SEQ ID NO: 321378 - DNA, 25 bp, Rattus norvegicus
gacccatgagccaccatcaaatgga

SEQ ID NO: 321379 - DNA, 25 bp, Rattus norvegicus
gacccatgagcctccatcaaatgga

SEQ ID NO: 321380 - DNA, 25 bp, Rattus norvegicus
gacccatgagctacctggcaggcct

SEQ ID NO: 321381 - DNA, 25 bp, Rattus norvegicus
gacccatgagcttcctggcaggcct

SEQ ID NO: 321382 - DNA, 25 bp, Rattus norvegicus
gacccatgcccaatggtattttaaa

SEQ ID NO: 321383 - DNA, 25 bp, Rattus norvegicus
gacccatgcccattggtattttaaa

SEQ ID NO: 321384 - DNA, 25 bp, Rattus norvegicus
gacccatggcttcagacgtgctgaa

SEQ ID NO: 321385 - DNA, 25 bp, Rattus norvegicus
gacccatggcttgagacgtgctgaa

SEQ ID NO: 321386 - DNA, 25 bp, Rattus norvegicus
gacccatgtctacctgttaagggct

SEQ ID NO: 321387 - DNA, 25 bp, Rattus norvegicus
gacccatgtctagctgttaagggct

SEQ ID NO: 321388 - DNA, 25 bp, Rattus norvegicus
gacccatgtgacactttggagctga

SEQ ID NO: 321389 - DNA, 25 bp, Rattus norvegicus
gacccatgtgactctttggagctga

SEQ ID NO: 321390 - DNA, 25 bp, Rattus norvegicus
gacccatgtgatctcttcacggatg

SEQ ID NO: 321391 - DNA, 25 bp, Rattus norvegicus
gacccatgtgatgtcttcacggatg

SEQ ID NO: 321392 - DNA, 25 bp, Rattus norvegicus
gacccattccataacgaaactgcct

SEQ ID NO: 321393 - DNA, 25 bp, Rattus norvegicus
gacccattccattacgaaactgcct

SEQ ID NO: 321394 - DNA, 25 bp, Rattus norvegicus
gacccattctaaatctttcaggcat

SEQ ID NO: 321395 - DNA, 25 bp, Rattus norvegicus
gacccattctaattctttcaggcat

SEQ ID NO: 321396 - DNA, 25 bp, Rattus norvegicus
gacccattctgaaaggaagacccaa

SEQ ID NO: 321397 - DNA, 25 bp, Rattus norvegicus
gacccattctgataggaagacccaa

SEQ ID NO: 321398 - DNA, 25 bp, Rattus norvegicus
gacccattctgtattggtattcacg

SEQ ID NO: 321399 - DNA, 25 bp, Rattus norvegicus
gacccattctgttttggtattcacg

SEQ ID NO: 321400 - DNA, 25 bp, Rattus norvegicus
gacccattcttaattcaatttctcc

SEQ ID NO: 321401 - DNA, 25 bp, Rattus norvegicus
gacccattcttatttcaatttctcc

SEQ ID NO: 321402 - DNA, 25 bp, Rattus norvegicus
gacccattgatcagttcctgggaaa

SEQ ID NO: 321403 - DNA, 25 bp, Rattus norvegicus
gacccattgatctgttcctgggaaa

SEQ ID NO: 321404 - DNA, 25 bp, Rattus norvegicus
gacccattgtaactatggccacctt

SEQ ID NO: 321405 - DNA, 25 bp, Rattus norvegicus
gacccattgtaagtatggccacctt

SEQ ID NO: 321406 - DNA, 25 bp, Rattus norvegicus
gacccatttacgagaaggctcctga

SEQ ID NO: 321407 - DNA, 25 bp, Rattus norvegicus
gacccatttacgtgaaggctcctga

SEQ ID NO: 321408 - DNA, 25 bp, Rattus norvegicus
gacccatttgatcttgctagggaaa

SEQ ID NO: 321409 - DNA, 25 bp, Rattus norvegicus
gacccatttgatgttgctagggaaa

SEQ ID NO: 321410 - DNA, 25 bp, Rattus norvegicus
gaccccaaagagctagcccggctgt

SEQ ID NO: 321411 - DNA, 25 bp, Rattus norvegicus
gaccccaaagaggtagcccggctgt

SEQ ID NO: 321412 - DNA, 25 bp, Rattus norvegicus
gaccccaacttgcaacttcatgtat

SEQ ID NO: 321413 - DNA, 25 bp, Rattus norvegicus
gaccccaacttggaacttcatgtat

SEQ ID NO: 321414 - DNA, 25 bp, Rattus norvegicus
gaccccaagctgctatatttcatgg

SEQ ID NO: 321415 - DNA, 25 bp, Rattus norvegicus
gaccccaagctggtatatttcatgg

SEQ ID NO: 321416 - DNA, 25 bp, Rattus norvegicus
gaccccaaggacacctgtacacata

SEQ ID NO: 321417 - DNA, 25 bp, Rattus norvegicus
gaccccaaggactcctgtacacata

SEQ ID NO: 321418 - DNA, 25 bp, Rattus norvegicus
gaccccaagggtaggcatgttctca

SEQ ID NO: 321419 - DNA, 25 bp, Rattus norvegicus
gaccccaagggttggcatgttctca

SEQ ID NO: 321420 - DNA, 25 bp, Rattus norvegicus
gaccccaagtcacagaggctcttag

SEQ ID NO: 321421 - DNA, 25 bp, Rattus norvegicus
gaccccaagtcagagaggctcttag

SEQ ID NO: 321422 - DNA, 25 bp, Rattus norvegicus
gaccccaatctaaagtccagtctta

SEQ ID NO: 321423 - DNA, 25 bp, Rattus norvegicus
gaccccaatctatagtccagtctta

SEQ ID NO: 321424 - DNA, 25 bp, Rattus norvegicus
gaccccaatgccatctagtctaaag

SEQ ID NO: 321425 - DNA, 25 bp, Rattus norvegicus
gaccccaatgccttctagtctaaag

SEQ ID NO: 321426 - DNA, 25 bp, Rattus norvegicus
gaccccaccaagaagggagacctct

SEQ ID NO: 321427 - DNA, 25 bp, Rattus norvegicus
gaccccaccaagtagggagacctct

SEQ ID NO: 321428 - DNA, 25 bp, Rattus norvegicus
gaccccaccacaagcagcagtttga

SEQ ID NO: 321429 - DNA, 25 bp, Rattus norvegicus
gaccccaccacatgcagcagtttga

SEQ ID NO: 321430 - DNA, 25 bp, Rattus norvegicus
gaccccaccagaagttgatattcca

SEQ ID NO: 321431 - DNA, 25 bp, Rattus norvegicus
gaccccaccagatgttgatattcca

SEQ ID NO: 321432 - DNA, 25 bp, Rattus norvegicus
gaccccactgataaattgttctgaa

SEQ ID NO: 321433 - DNA, 25 bp, Rattus norvegicus
gaccccactgattaattgttctgaa

SEQ ID NO: 321434 - DNA, 25 bp, Rattus norvegicus
gaccccagactgaagagatttttat

SEQ ID NO: 321435 - DNA, 25 bp, Rattus norvegicus
gaccccagactgtagagatttttat

SEQ ID NO: 321436 - DNA, 25 bp, Rattus norvegicus
gaccccagagtcacattaaatgcct

SEQ ID NO: 321437 - DNA, 25 bp, Rattus norvegicus
gaccccagagtctcattaaatgcct

SEQ ID NO: 321438 - DNA, 25 bp, Rattus norvegicus
gaccccagcacacaccagagaatga

SEQ ID NO: 321439 - DNA, 25 bp, Rattus norvegicus
gaccccagcacagaccagagaatga

SEQ ID NO: 321440 - DNA, 25 bp, Rattus norvegicus
gaccccagctaaagggacagtgcta

SEQ ID NO: 321441 - DNA, 25 bp, Rattus norvegicus
gaccccagctaatgggacagtgcta

SEQ ID NO: 321442 - DNA, 25 bp, Rattus norvegicus
gaccccagctgcactgtgtccagga

SEQ ID NO: 321443 - DNA, 25 bp, Rattus norvegicus
gaccccagctgctctgtgtccagga

SEQ ID NO: 321444 - DNA, 25 bp, Rattus norvegicus
gaccccagggatagctgtgtgctta

SEQ ID NO: 321445 - DNA, 25 bp, Rattus norvegicus
gaccccagggattgctgtgtgctta

SEQ ID NO: 321446 - DNA, 25 bp, Rattus norvegicus
gaccccagtaagatggttttgtgct

SEQ ID NO: 321447 - DNA, 25 bp, Rattus norvegicus
gaccccagtaagttggttttgtgct

SEQ ID NO: 321448 - DNA, 25 bp, Rattus norvegicus
gaccccagtcggagtgaaaaccaga

SEQ ID NO: 321449 - DNA, 25 bp, Rattus norvegicus
gaccccagtcggtgtgaaaaccaga

SEQ ID NO: 321450 - DNA, 25 bp, Rattus norvegicus
gaccccagtggcaccatgtgttaag

SEQ ID NO: 321451 - DNA, 25 bp, Rattus norvegicus
gaccccagtggctccatgtgttaag

SEQ ID NO: 321452 - DNA, 25 bp, Rattus norvegicus
gaccccagttccctgcgaagagaga

SEQ ID NO: 321453 - DNA, 25 bp, Rattus norvegicus
gaccccagttccgtgcgaagagaga

SEQ ID NO: 321454 - DNA, 25 bp, Rattus norvegicus
gaccccatactgctgaccggcttgg

SEQ ID NO: 321455 - DNA, 25 bp, Rattus norvegicus
gaccccatactggtgaccggcttgg

SEQ ID NO: 321456 - DNA, 25 bp, Rattus norvegicus
gaccccataggtctttgttactgtg

SEQ ID NO: 321457 - DNA, 25 bp, Rattus norvegicus
gaccccataggtgtttgttactgtg

SEQ ID NO: 321458 - DNA, 25 bp, Rattus norvegicus
gaccccatcaccaaggagaggctga

SEQ ID NO: 321459 - DNA, 25 bp, Rattus norvegicus
gaccccatcacctaggagaggctga

SEQ ID NO: 321460 - DNA, 25 bp, Rattus norvegicus
gaccccatcgtcaactgttttatca

SEQ ID NO: 321461 - DNA, 25 bp, Rattus norvegicus
gaccccatcgtctactgttttatca

SEQ ID NO: 321462 - DNA, 25 bp, Rattus norvegicus
gaccccatctatctgcttgaagttg

SEQ ID NO: 321463 - DNA, 25 bp, Rattus norvegicus
gaccccatctatgtgcttgaagttg

SEQ ID NO: 321464 - DNA, 25 bp, Rattus norvegicus
gaccccatcttgcacaactatgtgc

SEQ ID NO: 321465 - DNA, 25 bp, Rattus norvegicus
gaccccatcttggacaactatgtgc

SEQ ID NO: 321466 - DNA, 25 bp, Rattus norvegicus
gaccccatgaatattctgtgagcta

SEQ ID NO: 321467 - DNA, 25 bp, Rattus norvegicus
gaccccatgaattttctgtgagcta

SEQ ID NO: 321468 - DNA, 25 bp, Rattus norvegicus
gaccccatgaccaggaacaaaataa

SEQ ID NO: 321469 - DNA, 25 bp, Rattus norvegicus
gaccccatgacctggaacaaaataa

SEQ ID NO: 321470 - DNA, 25 bp, Rattus norvegicus
gaccccatgcgtattctgcatagag

SEQ ID NO: 321471 - DNA, 25 bp, Rattus norvegicus
gaccccatgcgttttctgcatagag

SEQ ID NO: 321472 - DNA, 25 bp, Rattus norvegicus
gaccccatggaaaccctactgagag

SEQ ID NO: 321473 - DNA, 25 bp, Rattus norvegicus
gaccccatggaatccctactgagag

SEQ ID NO: 321474 - DNA, 25 bp, Rattus norvegicus
gaccccatggatccctcagatcagg

SEQ ID NO: 321475 - DNA, 25 bp, Rattus norvegicus
gaccccatggatgcctcagatcagg

SEQ ID NO: 321476 - DNA, 25 bp, Rattus norvegicus
gaccccatggctactgttgaatgca

SEQ ID NO: 321477 - DNA, 25 bp, Rattus norvegicus
gaccccatggcttctgttgaatgca

SEQ ID NO: 321478 - DNA, 25 bp, Rattus norvegicus
gaccccatgtcaataacaaagctca

SEQ ID NO: 321479 - DNA, 25 bp, Rattus norvegicus
gaccccatgtcattaacaaagctca

SEQ ID NO: 321480 - DNA, 25 bp, Rattus norvegicus
gaccccatgttcatactgtattttt

SEQ ID NO: 321481 - DNA, 25 bp, Rattus norvegicus
gaccccatgttcttactgtattttt

SEQ ID NO: 321482 - DNA, 25 bp, Rattus norvegicus
gaccccattacaattcgatcgagat

SEQ ID NO: 321483 - DNA, 25 bp, Rattus norvegicus
gaccccattacatttcgatcgagat

SEQ ID NO: 321484 - DNA, 25 bp, Rattus norvegicus
gaccccattctactgcttgaacagt

SEQ ID NO: 321485 - DNA, 25 bp, Rattus norvegicus
gaccccattctagtgcttgaacagt

SEQ ID NO: 321486 - DNA, 25 bp, Rattus norvegicus
gaccccattgacatttaccgttatg

SEQ ID NO: 321487 - DNA, 25 bp, Rattus norvegicus
gaccccattgacttttaccgttatg

SEQ ID NO: 321488 - DNA, 25 bp, Rattus norvegicus
gaccccattgctatagcggttgtga

SEQ ID NO: 321489 - DNA, 25 bp, Rattus norvegicus
gaccccattgctttagcggttgtga

SEQ ID NO: 321490 - DNA, 25 bp, Rattus norvegicus
gaccccattttccaagccagtgact

SEQ ID NO: 321491 - DNA, 25 bp, Rattus norvegicus
gaccccattttcgaagccagtgact

SEQ ID NO: 321492 - DNA, 25 bp, Rattus norvegicus
gaccccgaagagaacatttttgctg

SEQ ID NO: 321493 - DNA, 25 bp, Rattus norvegicus
gaccccgaagagtacatttttgctg

SEQ ID NO: 321494 - DNA, 25 bp, Rattus norvegicus
gaccccgagaatcatgccaaggctt

SEQ ID NO: 321495 - DNA, 25 bp, Rattus norvegicus
gaccccgagaatgatgccaaggctt

SEQ ID NO: 321496 - DNA, 25 bp, Rattus norvegicus
gaccccgagacacatttaggactgt

SEQ ID NO: 321497 - DNA, 25 bp, Rattus norvegicus
gaccccgagacagatttaggactgt

SEQ ID NO: 321498 - DNA, 25 bp, Rattus norvegicus
gaccccgagagtactgggactatga

SEQ ID NO: 321499 - DNA, 25 bp, Rattus norvegicus
gaccccgagagttctgggactatga

SEQ ID NO: 321500 - DNA, 25 bp, Rattus norvegicus
gaccccgagcccactaagttggtat

SEQ ID NO: 321501 - DNA, 25 bp, Rattus norvegicus
gaccccgagccctctaagttggtat

SEQ ID NO: 321502 - DNA, 25 bp, Rattus norvegicus
gaccccgaggatctgctagacaccg

SEQ ID NO: 321503 - DNA, 25 bp, Rattus norvegicus
gaccccgaggatgtgctagacaccg

SEQ ID NO: 321504 - DNA, 25 bp, Rattus norvegicus
gaccccgatgtgatcaagattctag

SEQ ID NO: 321505 - DNA, 25 bp, Rattus norvegicus
gaccccgatgtgttcaagattctag

SEQ ID NO: 321506 - DNA, 25 bp, Rattus norvegicus
gaccccgctgtaaataacaggtatt

SEQ ID NO: 321507 - DNA, 25 bp, Rattus norvegicus
gaccccgctgtatataacaggtatt

SEQ ID NO: 321508 - DNA, 25 bp, Rattus norvegicus
gaccccggacatcaggcagagccta

SEQ ID NO: 321509 - DNA, 25 bp, Rattus norvegicus
gaccccggacatgaggcagagccta

SEQ ID NO: 321510 - DNA, 25 bp, Rattus norvegicus
gaccccggcagaacatcagttagaa

SEQ ID NO: 321511 - DNA, 25 bp, Rattus norvegicus
gaccccggcagatcatcagttagaa

SEQ ID NO: 321512 - DNA, 25 bp, Rattus norvegicus
gaccccggcagtcgcttacagagga

SEQ ID NO: 321513 - DNA, 25 bp, Rattus norvegicus
gaccccggcagtggcttacagagga

SEQ ID NO: 321514 - DNA, 25 bp, Rattus norvegicus
gaccccggcgtgaagtcataaggat

SEQ ID NO: 321515 - DNA, 25 bp, Rattus norvegicus
gaccccggcgtgtagtcataaggat

SEQ ID NO: 321516 - DNA, 25 bp, Rattus norvegicus
gaccccgggagaaagtctttctatg

SEQ ID NO: 321517 - DNA, 25 bp, Rattus norvegicus
gaccccgggagatagtctttctatg

SEQ ID NO: 321518 - DNA, 25 bp, Rattus norvegicus
gaccccgggcagaagatgtgatgaa

SEQ ID NO: 321519 - DNA, 25 bp, Rattus norvegicus
gaccccgggcagtagatgtgatgaa

SEQ ID NO: 321520 - DNA, 25 bp, Rattus norvegicus
gaccccgggccacatctgagaagta

SEQ ID NO: 321521 - DNA, 25 bp, Rattus norvegicus
gaccccgggccagatctgagaagta

SEQ ID NO: 321522 - DNA, 25 bp, Rattus norvegicus
gaccccggtagcagacgggcccaag

SEQ ID NO: 321523 - DNA, 25 bp, Rattus norvegicus
gaccccggtagctgacgggcccaag

SEQ ID NO: 321524 - DNA, 25 bp, Rattus norvegicus
gaccccggtttcaattttgcacacg

SEQ ID NO: 321525 - DNA, 25 bp, Rattus norvegicus
gaccccggtttctattttgcacacg

SEQ ID NO: 321526 - DNA, 25 bp, Rattus norvegicus
gaccccgtagaaattcaagccctgg

SEQ ID NO: 321527 - DNA, 25 bp, Rattus norvegicus
gaccccgtagaatttcaagccctgg

SEQ ID NO: 321528 - DNA, 25 bp, Rattus norvegicus
gaccccgtcattctgtgtgtgtgaa

SEQ ID NO: 321529 - DNA, 25 bp, Rattus norvegicus
gaccccgtcattgtgtgtgtgtgaa

SEQ ID NO: 321530 - DNA, 25 bp, Rattus norvegicus
gaccccgtctttctggaattttgag

SEQ ID NO: 321531 - DNA, 25 bp, Rattus norvegicus
gaccccgtctttgtggaattttgag

SEQ ID NO: 321532 - DNA, 25 bp, Rattus norvegicus
gaccccgtgataattctttgttcta

SEQ ID NO: 321533 - DNA, 25 bp, Rattus norvegicus
gaccccgtgatatttctttgttcta

SEQ ID NO: 321534 - DNA, 25 bp, Rattus norvegicus
gaccccgtgatgctggcaggctata

SEQ ID NO: 321535 - DNA, 25 bp, Rattus norvegicus
gaccccgtgatggtggcaggctata

SEQ ID NO: 321536 - DNA, 25 bp, Rattus norvegicus
gaccccgtgcaaccatcacaagaag

SEQ ID NO: 321537 - DNA, 25 bp, Rattus norvegicus
gaccccgtgcaagcatcacaagaag

SEQ ID NO: 321538 - DNA, 25 bp, Rattus norvegicus
gacccctaattcagtagcggttttg

SEQ ID NO: 321539 - DNA, 25 bp, Rattus norvegicus
gacccctaattctgtagcggttttg

SEQ ID NO: 321540 - DNA, 25 bp, Rattus norvegicus
gacccctattccatcacatgaagta

SEQ ID NO: 321541 - DNA, 25 bp, Rattus norvegicus
gacccctattccttcacatgaagta

SEQ ID NO: 321542 - DNA, 25 bp, Rattus norvegicus
gacccctcaggacttatggcttctg

SEQ ID NO: 321543 - DNA, 25 bp, Rattus norvegicus
gacccctcaggacttggccagagat

SEQ ID NO: 321544 - DNA, 25 bp, Rattus norvegicus
gacccctcaggagttatggcttctg

SEQ ID NO: 321545 - DNA, 25 bp, Rattus norvegicus
gacccctcaggagttggccagagat

SEQ ID NO: 321546 - DNA, 25 bp, Rattus norvegicus
gacccctcatagctggtaagtggct

SEQ ID NO: 321547 - DNA, 25 bp, Rattus norvegicus
gacccctcataggtggtaagtggct

SEQ ID NO: 321548 - DNA, 25 bp, Rattus norvegicus
gacccctctccaaagtgtgataagt

SEQ ID NO: 321549 - DNA, 25 bp, Rattus norvegicus
gacccctctccatagtgtgataagt

SEQ ID NO: 321550 - DNA, 25 bp, Rattus norvegicus
gacccctctgacctagaactgatag

SEQ ID NO: 321551 - DNA, 25 bp, Rattus norvegicus
gacccctctgacgtagaactgatag

SEQ ID NO: 321552 - DNA, 25 bp, Rattus norvegicus
gacccctctgatactctactgaaga

SEQ ID NO: 321553 - DNA, 25 bp, Rattus norvegicus
gacccctctgattctctactgaaga

SEQ ID NO: 321554 - DNA, 25 bp, Rattus norvegicus
gacccctgaagcagtcggtgtgtgc

SEQ ID NO: 321555 - DNA, 25 bp, Rattus norvegicus
gacccctgaagctgtcggtgtgtgc

SEQ ID NO: 321556 - DNA, 25 bp, Rattus norvegicus
gacccctgacgacgtggcttaaata

SEQ ID NO: 321557 - DNA, 25 bp, Rattus norvegicus
gacccctgacgaggtggcttaaata

SEQ ID NO: 321558 - DNA, 25 bp, Rattus norvegicus
gacccctgagtccatggagtcgatt

SEQ ID NO: 321559 - DNA, 25 bp, Rattus norvegicus
gacccctgagtcgatggagtcgatt

SEQ ID NO: 321560 - DNA, 25 bp, Rattus norvegicus
gacccctgatgcaggttaggaacct

SEQ ID NO: 321561 - DNA, 25 bp, Rattus norvegicus
gacccctgatgctggttaggaacct

SEQ ID NO: 321562 - DNA, 25 bp, Rattus norvegicus
gacccctgattaactttctgaaact

SEQ ID NO: 321563 - DNA, 25 bp, Rattus norvegicus
gacccctgattatctttctgaaact

SEQ ID NO: 321564 - DNA, 25 bp, Rattus norvegicus
gacccctgattcatcataaggctaa

SEQ ID NO: 321565 - DNA, 25 bp, Rattus norvegicus
gacccctgattcttcataaggctaa

SEQ ID NO: 321566 - DNA, 25 bp, Rattus norvegicus
gacccctgccatctatgacgacgag

SEQ ID NO: 321567 - DNA, 25 bp, Rattus norvegicus
gacccctgccatgtatgacgacgag

SEQ ID NO: 321568 - DNA, 25 bp, Rattus norvegicus
gacccctgccggaaccataaaagct

SEQ ID NO: 321569 - DNA, 25 bp, Rattus norvegicus
gacccctgccggtaccataaaagct

SEQ ID NO: 321570 - DNA, 25 bp, Rattus norvegicus
gacccctgctgaccgtgatgatcta

SEQ ID NO: 321571 - DNA, 25 bp, Rattus norvegicus
gacccctgctgagcgtgatgatcta

SEQ ID NO: 321572 - DNA, 25 bp, Rattus norvegicus
gacccctgctttatgaaggcctaaa

SEQ ID NO: 321573 - DNA, 25 bp, Rattus norvegicus
gacccctgctttttgaaggcctaaa

SEQ ID NO: 321574 - DNA, 25 bp, Rattus norvegicus
gacccctgggacacacatggtacaa

SEQ ID NO: 321575 - DNA, 25 bp, Rattus norvegicus
gacccctgggactcacatggtacaa

SEQ ID NO: 321576 - DNA, 25 bp, Rattus norvegicus
gacccctgtaggcttgtggctatat

SEQ ID NO: 321577 - DNA, 25 bp, Rattus norvegicus
gacccctgtagggttgtggctatat

SEQ ID NO: 321578 - DNA, 25 bp, Rattus norvegicus
gacccctgtcttaaactgcattttt

SEQ ID NO: 321579 - DNA, 25 bp, Rattus norvegicus
gacccctgtctttaactgcattttt

SEQ ID NO: 321580 - DNA, 25 bp, Rattus norvegicus
gacccctgtgaaagacttgttagat

SEQ ID NO: 321581 - DNA, 25 bp, Rattus norvegicus
gacccctgtgaatgacttgttagat

SEQ ID NO: 321582 - DNA, 25 bp, Rattus norvegicus
gacccctgttctctgctgagaatga

SEQ ID NO: 321583 - DNA, 25 bp, Rattus norvegicus
gacccctgttctgtgctgagaatga

SEQ ID NO: 321584 - DNA, 25 bp, Rattus norvegicus
gaccccttagatacaaatcctgtta

SEQ ID NO: 321585 - DNA, 25 bp, Rattus norvegicus
gaccccttagattcaaatcctgtta

SEQ ID NO: 321586 - DNA, 25 bp, Rattus norvegicus
gaccccttagctattcaggttgaca

SEQ ID NO: 321587 - DNA, 25 bp, Rattus norvegicus
gaccccttagcttttcaggttgaca

SEQ ID NO: 321588 - DNA, 25 bp, Rattus norvegicus
gaccccttcaagatcgagattcata

SEQ ID NO: 321589 - DNA, 25 bp, Rattus norvegicus
gaccccttcaagatctgtagtcagg

SEQ ID NO: 321590 - DNA, 25 bp, Rattus norvegicus
gaccccttcaagttcgagattcata

SEQ ID NO: 321591 - DNA, 25 bp, Rattus norvegicus
gaccccttcaagttctgtagtcagg

SEQ ID NO: 321592 - DNA, 25 bp, Rattus norvegicus
gaccccttccacaagccaagatagg

SEQ ID NO: 321593 - DNA, 25 bp, Rattus norvegicus
gaccccttccactagccaagatagg

SEQ ID NO: 321594 - DNA, 25 bp, Rattus norvegicus
gaccccttctccaatgatgaacagg

SEQ ID NO: 321595 - DNA, 25 bp, Rattus norvegicus
gaccccttctcctatgatgaacagg

SEQ ID NO: 321596 - DNA, 25 bp, Rattus norvegicus
gaccccttggtcataggcctgtaga

SEQ ID NO: 321597 - DNA, 25 bp, Rattus norvegicus
gaccccttggtcttaggcctgtaga

SEQ ID NO: 321598 - DNA, 25 bp, Rattus norvegicus
gacccctttgtcaagtttgtattgt

SEQ ID NO: 321599 - DNA, 25 bp, Rattus norvegicus
gacccctttgtctagtttgtattgt

SEQ ID NO: 321600 - DNA, 25 bp, Rattus norvegicus
gacccgaaacctagcgcagatcatt

SEQ ID NO: 321601 - DNA, 25 bp, Rattus norvegicus
gacccgaaaccttgcgcagatcatt

SEQ ID NO: 321602 - DNA, 25 bp, Rattus norvegicus
gacccgaagtccagagatgtttaac

SEQ ID NO: 321603 - DNA, 25 bp, Rattus norvegicus
gacccgaagtcctgagatgtttaac

SEQ ID NO: 321604 - DNA, 25 bp, Rattus norvegicus
gacccgacgggaattcaggctgagt

SEQ ID NO: 321605 - DNA, 25 bp, Rattus norvegicus
gacccgacgggatttcaggctgagt

SEQ ID NO: 321606 - DNA, 25 bp, Rattus norvegicus
gacccgagaatacaccatcaacatt

SEQ ID NO: 321607 - DNA, 25 bp, Rattus norvegicus
gacccgagaatagaccatcaacatt

SEQ ID NO: 321608 - DNA, 25 bp, Rattus norvegicus
gacccgagactgagttttgtccttt

SEQ ID NO: 321609 - DNA, 25 bp, Rattus norvegicus
gacccgagactgtgttttgtccttt

SEQ ID NO: 321610 - DNA, 25 bp, Rattus norvegicus
gacccgagaggactgaacagcatga

SEQ ID NO: 321611 - DNA, 25 bp, Rattus norvegicus
gacccgagaggagtgaacagcatga

SEQ ID NO: 321612 - DNA, 25 bp, Rattus norvegicus
gacccgagccgaatccgatggttaa

SEQ ID NO: 321613 - DNA, 25 bp, Rattus norvegicus
gacccgagccgattccgatggttaa

SEQ ID NO: 321614 - DNA, 25 bp, Rattus norvegicus
gacccgaggcgcaagctgtccggaa

SEQ ID NO: 321615 - DNA, 25 bp, Rattus norvegicus
gacccgaggcgctagctgtccggaa

SEQ ID NO: 321616 - DNA, 25 bp, Rattus norvegicus
gacccgagttggctcaagtctcaga

SEQ ID NO: 321617 - DNA, 25 bp, Rattus norvegicus
gacccgagttgggtcaagtctcaga

SEQ ID NO: 321618 - DNA, 25 bp, Rattus norvegicus
gacccgatcctaatgtcataccaga

SEQ ID NO: 321619 - DNA, 25 bp, Rattus norvegicus
gacccgatcctattgtcataccaga

SEQ ID NO: 321620 - DNA, 25 bp, Rattus norvegicus
gacccgatctgcaggtgcaacttaa

SEQ ID NO: 321621 - DNA, 25 bp, Rattus norvegicus
gacccgatctgctggtgcaacttaa

SEQ ID NO: 321622 - DNA, 25 bp, Rattus norvegicus
gacccgatggatcaactgcagttgt

SEQ ID NO: 321623 - DNA, 25 bp, Rattus norvegicus
gacccgatggatgaactgcagttgt

SEQ ID NO: 321624 - DNA, 25 bp, Rattus norvegicus
gacccgattggtcctggacacacac

SEQ ID NO: 321625 - DNA, 25 bp, Rattus norvegicus
gacccgattggtgctggacacacac

SEQ ID NO: 321626 - DNA, 25 bp, Rattus norvegicus
gacccgcagtgtattgatgcaaaaa

SEQ ID NO: 321627 - DNA, 25 bp, Rattus norvegicus
gacccgcagtgttttgatgcaaaaa

SEQ ID NO: 321628 - DNA, 25 bp, Rattus norvegicus
gacccgccccaacgagataggaaga

SEQ ID NO: 321629 - DNA, 25 bp, Rattus norvegicus
gacccgccccaaggagataggaaga

SEQ ID NO: 321630 - DNA, 25 bp, Rattus norvegicus
gacccgccggacattctgcaagaaa

SEQ ID NO: 321631 - DNA, 25 bp, Rattus norvegicus
gacccgccggactttctgcaagaaa

SEQ ID NO: 321632 - DNA, 25 bp, Rattus norvegicus
gacccgcttgagaactttttcggcg

SEQ ID NO: 321633 - DNA, 25 bp, Rattus norvegicus
gacccgcttgagtactttttcggcg

SEQ ID NO: 321634 - DNA, 25 bp, Rattus norvegicus
gacccggacacaagcttaatatatt

SEQ ID NO: 321635 - DNA, 25 bp, Rattus norvegicus
gacccggacacatgcttaatatatt

SEQ ID NO: 321636 - DNA, 25 bp, Rattus norvegicus
gacccggacagtcatggtacccttt

SEQ ID NO: 321637 - DNA, 25 bp, Rattus norvegicus
gacccggacagtgatggtacccttt

SEQ ID NO: 321638 - DNA, 25 bp, Rattus norvegicus
gacccggacgaccagaccttcgtga

SEQ ID NO: 321639 - DNA, 25 bp, Rattus norvegicus
gacccggacgacgagaccttcgtga

SEQ ID NO: 321640 - DNA, 25 bp, Rattus norvegicus
gacccggagtgaagacagcctgttg

SEQ ID NO: 321641 - DNA, 25 bp, Rattus norvegicus
gacccggagtgatgacagcctgttg

SEQ ID NO: 321642 - DNA, 25 bp, Rattus norvegicus
gacccggccgtccaagagctcaaga

SEQ ID NO: 321643 - DNA, 25 bp, Rattus norvegicus
gacccggccgtcgaagagctcaaga

SEQ ID NO: 321644 - DNA, 25 bp, Rattus norvegicus
gacccggctggcattgaacttagac

SEQ ID NO: 321645 - DNA, 25 bp, Rattus norvegicus
gacccggctggctttgaacttagac

SEQ ID NO: 321646 - DNA, 25 bp, Rattus norvegicus
gacccgggaggcctccattaaactg

SEQ ID NO: 321647 - DNA, 25 bp, Rattus norvegicus
gacccgggaggcgtccattaaactg

SEQ ID NO: 321648 - DNA, 25 bp, Rattus norvegicus
gacccgggatatacagaagacgttg

SEQ ID NO: 321649 - DNA, 25 bp, Rattus norvegicus
gacccgggatattcagaagacgttg

SEQ ID NO: 321650 - DNA, 25 bp, Rattus norvegicus
gacccgggctgaaatgatcctcaag

SEQ ID NO: 321651 - DNA, 25 bp, Rattus norvegicus
gacccgggctgatatgatcctcaag

SEQ ID NO: 321652 - DNA, 25 bp, Rattus norvegicus
gacccgggtctgactcaaaaagaca

SEQ ID NO: 321653 - DNA, 25 bp, Rattus norvegicus
gacccgggtctgtctcaaaaagaca

SEQ ID NO: 321654 - DNA, 25 bp, Rattus norvegicus
gacccgggttcaagaggctctgaca

SEQ ID NO: 321655 - DNA, 25 bp, Rattus norvegicus
gacccgggttcatgaggctctgaca

SEQ ID NO: 321656 - DNA, 25 bp, Rattus norvegicus
gacccgggttccagccagtgctcgg

SEQ ID NO: 321657 - DNA, 25 bp, Rattus norvegicus
gacccgggttcctgccagtgctcgg

SEQ ID NO: 321658 - DNA, 25 bp, Rattus norvegicus
gacccggtagccaaggagtcagatt

SEQ ID NO: 321659 - DNA, 25 bp, Rattus norvegicus
gacccggtagcctaggagtcagatt

SEQ ID NO: 321660 - DNA, 25 bp, Rattus norvegicus
gacccggtagggaacagcagacatg

SEQ ID NO: 321661 - DNA, 25 bp, Rattus norvegicus
gacccggtagggtacagcagacatg

SEQ ID NO: 321662 - DNA, 25 bp, Rattus norvegicus
gacccggtatccatgtggaggctca

SEQ ID NO: 321663 - DNA, 25 bp, Rattus norvegicus
gacccggtatccttgtggaggctca

SEQ ID NO: 321664 - DNA, 25 bp, Rattus norvegicus
gacccggtcgacaccagcgataggg

SEQ ID NO: 321665 - DNA, 25 bp, Rattus norvegicus
gacccggtcgactccagcgataggg

SEQ ID NO: 321666 - DNA, 25 bp, Rattus norvegicus
gacccgtcccgcaggtagttgagaa

SEQ ID NO: 321667 - DNA, 25 bp, Rattus norvegicus
gacccgtcccgctggtagttgagaa

SEQ ID NO: 321668 - DNA, 25 bp, Rattus norvegicus
gacccgtccgcgatgtagcgggcca

SEQ ID NO: 321669 - DNA, 25 bp, Rattus norvegicus
gacccgtccgcgttgtagcgggcca

SEQ ID NO: 321670 - DNA, 25 bp, Rattus norvegicus
gacccgtcgtcaacctgtctgagat

SEQ ID NO: 321671 - DNA, 25 bp, Rattus norvegicus
gacccgtcgtcatcctgtctgagat

SEQ ID NO: 321672 - DNA, 25 bp, Rattus norvegicus
gacccgtgcgggaaaccatagctct

SEQ ID NO: 321673 - DNA, 25 bp, Rattus norvegicus
gacccgtgcgggtaaccatagctct

SEQ ID NO: 321674 - DNA, 25 bp, Rattus norvegicus
gacccgtgctataataaatgttgcc

SEQ ID NO: 321675 - DNA, 25 bp, Rattus norvegicus
gacccgtgctattataaatgttgcc

SEQ ID NO: 321676 - DNA, 25 bp, Rattus norvegicus
gacccgtgctctatatgttctggaa

SEQ ID NO: 321677 - DNA, 25 bp, Rattus norvegicus
gacccgtgctctttatgttctggaa

SEQ ID NO: 321678 - DNA, 25 bp, Rattus norvegicus
gacccgttcttcacgggccggcctg

SEQ ID NO: 321679 - DNA, 25 bp, Rattus norvegicus
gacccgttcttctcgggccggcctg

SEQ ID NO: 321680 - DNA, 25 bp, Rattus norvegicus
gacccgttggacatctatgtggaga

SEQ ID NO: 321681 - DNA, 25 bp, Rattus norvegicus
gacccgttggacttctatgtggaga

SEQ ID NO: 321682 - DNA, 25 bp, Rattus norvegicus
gacccgtttgtgctgacccttgtgt

SEQ ID NO: 321683 - DNA, 25 bp, Rattus norvegicus
gacccgtttgtggtgacccttgtgt

SEQ ID NO: 321684 - DNA, 25 bp, Rattus norvegicus
gaccctaaagaaagtgcatccccag

SEQ ID NO: 321685 - DNA, 25 bp, Rattus norvegicus
gaccctaaagaactgctgctgtatt

SEQ ID NO: 321686 - DNA, 25 bp, Rattus norvegicus
gaccctaaagaagtgctgctgtatt

SEQ ID NO: 321687 - DNA, 25 bp, Rattus norvegicus
gaccctaaagaatgtgcatccccag

SEQ ID NO: 321688 - DNA, 25 bp, Rattus norvegicus
gaccctaacgtgatctggccaagag

SEQ ID NO: 321689 - DNA, 25 bp, Rattus norvegicus
gaccctaacgtgttctggccaagag

SEQ ID NO: 321690 - DNA, 25 bp, Rattus norvegicus
gaccctaagagtcggacttcctatc

SEQ ID NO: 321691 - DNA, 25 bp, Rattus norvegicus
gaccctaagagtgggacttcctatc

SEQ ID NO: 321692 - DNA, 25 bp, Rattus norvegicus
gaccctaaggttcatttattctctc

SEQ ID NO: 321693 - DNA, 25 bp, Rattus norvegicus
gaccctaaggttgatttattctctc

SEQ ID NO: 321694 - DNA, 25 bp, Rattus norvegicus
gaccctaatggtcgcatgcgcagtg

SEQ ID NO: 321695 - DNA, 25 bp, Rattus norvegicus
gaccctaatggtggcatgcgcagtg

SEQ ID NO: 321696 - DNA, 25 bp, Rattus norvegicus
gaccctaattatctcaacccaggca

SEQ ID NO: 321697 - DNA, 25 bp, Rattus norvegicus
gaccctaattatgtcaacccaggca

SEQ ID NO: 321698 - DNA, 25 bp, Rattus norvegicus
gaccctacacaaaatgtccttttag

SEQ ID NO: 321699 - DNA, 25 bp, Rattus norvegicus
gaccctacacaatatgtccttttag

SEQ ID NO: 321700 - DNA, 25 bp, Rattus norvegicus
gaccctacaggcaggcagctggtgt

SEQ ID NO: 321701 - DNA, 25 bp, Rattus norvegicus
gaccctacaggctggcagctggtgt

SEQ ID NO: 321702 - DNA, 25 bp, Rattus norvegicus
gaccctaccctgagatctgtgaagt

SEQ ID NO: 321703 - DNA, 25 bp, Rattus norvegicus
gaccctaccctgtgatctgtgaagt

SEQ ID NO: 321704 - DNA, 25 bp, Rattus norvegicus
gaccctagaaggagctcgccattgt

SEQ ID NO: 321705 - DNA, 25 bp, Rattus norvegicus
gaccctagaaggtgctcgccattgt

SEQ ID NO: 321706 - DNA, 25 bp, Rattus norvegicus
gaccctagatagaccccagatgtga

SEQ ID NO: 321707 - DNA, 25 bp, Rattus norvegicus
gaccctagatagtccccagatgtga

SEQ ID NO: 321708 - DNA, 25 bp, Rattus norvegicus
gaccctagatgacgatgctgcccag

SEQ ID NO: 321709 - DNA, 25 bp, Rattus norvegicus
gaccctagatgaggatgctgcccag

SEQ ID NO: 321710 - DNA, 25 bp, Rattus norvegicus
gaccctaggagccatatctgtgtta

SEQ ID NO: 321711 - DNA, 25 bp, Rattus norvegicus
gaccctaggagcgatatctgtgtta

SEQ ID NO: 321712 - DNA, 25 bp, Rattus norvegicus
gaccctagggctaggtatgtgccaa

SEQ ID NO: 321713 - DNA, 25 bp, Rattus norvegicus
gaccctagggcttggtatgtgccaa

SEQ ID NO: 321714 - DNA, 25 bp, Rattus norvegicus
gaccctagttcgaatcaaactgaca

SEQ ID NO: 321715 - DNA, 25 bp, Rattus norvegicus
gaccctagttcgtatcaaactgaca

SEQ ID NO: 321716 - DNA, 25 bp, Rattus norvegicus
gaccctatctcacacagtgaaagtg

SEQ ID NO: 321717 - DNA, 25 bp, Rattus norvegicus
gaccctatctcagacagtgaaagtg

SEQ ID NO: 321718 - DNA, 25 bp, Rattus norvegicus
gaccctatgctgattttagaactca

SEQ ID NO: 321719 - DNA, 25 bp, Rattus norvegicus
gaccctatgctgtttttagaactca

SEQ ID NO: 321720 - DNA, 25 bp, Rattus norvegicus
gaccctatttttagacacttccatt

SEQ ID NO: 321721 - DNA, 25 bp, Rattus norvegicus
gaccctattttttgacacttccatt

SEQ ID NO: 321722 - DNA, 25 bp, Rattus norvegicus
gaccctcaacatagaactcaggctt

SEQ ID NO: 321723 - DNA, 25 bp, Rattus norvegicus
gaccctcaacattgaactcaggctt

SEQ ID NO: 321724 - DNA, 25 bp, Rattus norvegicus
gaccctcaagtcactgtagctttag

SEQ ID NO: 321725 - DNA, 25 bp, Rattus norvegicus
gaccctcaagtccaccagttaatgt

SEQ ID NO: 321726 - DNA, 25 bp, Rattus norvegicus
gaccctcaagtcgaccagttaatgt

SEQ ID NO: 321727 - DNA, 25 bp, Rattus norvegicus
gaccctcaagtctctgtagctttag

SEQ ID NO: 321728 - DNA, 25 bp, Rattus norvegicus
gaccctcaagttcctggagctacaa

SEQ ID NO: 321729 - DNA, 25 bp, Rattus norvegicus
gaccctcaagttgctggagctacaa

SEQ ID NO: 321730 - DNA, 25 bp, Rattus norvegicus
gaccctcaccctctttttgaggcag

SEQ ID NO: 321731 - DNA, 25 bp, Rattus norvegicus
gaccctcaccctgtttttgaggcag

SEQ ID NO: 321732 - DNA, 25 bp, Rattus norvegicus
gaccctcacgaaaaagctaatctgt

SEQ ID NO: 321733 - DNA, 25 bp, Rattus norvegicus
gaccctcacgaataagctaatctgt

SEQ ID NO: 321734 - DNA, 25 bp, Rattus norvegicus
gaccctcagagcagccatcaagtat

SEQ ID NO: 321735 - DNA, 25 bp, Rattus norvegicus
gaccctcagagctgccatcaagtat

SEQ ID NO: 321736 - DNA, 25 bp, Rattus norvegicus
gaccctcagaggaaccagtgatgga

SEQ ID NO: 321737 - DNA, 25 bp, Rattus norvegicus
gaccctcagaggtaccagtgatgga

SEQ ID NO: 321738 - DNA, 25 bp, Rattus norvegicus
gaccctcagcaacctacagaattta

SEQ ID NO: 321739 - DNA, 25 bp, Rattus norvegicus
gaccctcagcaagctacagaattta

SEQ ID NO: 321740 - DNA, 25 bp, Rattus norvegicus
gaccctcaggcaattgacagctgac

SEQ ID NO: 321741 - DNA, 25 bp, Rattus norvegicus
gaccctcaggcatttgacagctgac

SEQ ID NO: 321742 - DNA, 25 bp, Rattus norvegicus
gaccctcagggcaaaagatatctcg

SEQ ID NO: 321743 - DNA, 25 bp, Rattus norvegicus
gaccctcagggctaaagatatctcg

SEQ ID NO: 321744 - DNA, 25 bp, Rattus norvegicus
gaccctcagtacatcgagttcgagt

SEQ ID NO: 321745 - DNA, 25 bp, Rattus norvegicus
gaccctcagtacttcgagttcgagt

SEQ ID NO: 321746 - DNA, 25 bp, Rattus norvegicus
gaccctcagtttcactgcagtgcca

SEQ ID NO: 321747 - DNA, 25 bp, Rattus norvegicus
gaccctcagtttgactgcagtgcca

SEQ ID NO: 321748 - DNA, 25 bp, Rattus norvegicus
gaccctcatattatgccctttaaca

SEQ ID NO: 321749 - DNA, 25 bp, Rattus norvegicus
gaccctcatattttgccctttaaca

SEQ ID NO: 321750 - DNA, 25 bp, Rattus norvegicus
gaccctcattgacgaactcaaggcc

SEQ ID NO: 321751 - DNA, 25 bp, Rattus norvegicus
gaccctcattgaggaactcaaggcc

SEQ ID NO: 321752 - DNA, 25 bp, Rattus norvegicus
gaccctcatttcactataccaggaa

SEQ ID NO: 321753 - DNA, 25 bp, Rattus norvegicus
gaccctcatttctctataccaggaa

SEQ ID NO: 321754 - DNA, 25 bp, Rattus norvegicus
gaccctccagtgatgtccaaggaaa

SEQ ID NO: 321755 - DNA, 25 bp, Rattus norvegicus
gaccctccagtgttgtccaaggaaa

SEQ ID NO: 321756 - DNA, 25 bp, Rattus norvegicus
gaccctcccatgatgtgaaaccttt

SEQ ID NO: 321757 - DNA, 25 bp, Rattus norvegicus
gaccctcccatgttgtgaaaccttt

SEQ ID NO: 321758 - DNA, 25 bp, Rattus norvegicus
gaccctccccttatgaagaatgcat

SEQ ID NO: 321759 - DNA, 25 bp, Rattus norvegicus
gaccctccccttttgaagaatgcat

SEQ ID NO: 321760 - DNA, 25 bp, Rattus norvegicus
gaccctcccttcatttgtcttaagt

SEQ ID NO: 321761 - DNA, 25 bp, Rattus norvegicus
gaccctcccttcttttgtcttaagt

SEQ ID NO: 321762 - DNA, 25 bp, Rattus norvegicus
gaccctcctcttcggaagcttgtgg

SEQ ID NO: 321763 - DNA, 25 bp, Rattus norvegicus
gaccctcctcttgggaagcttgtgg

SEQ ID NO: 321764 - DNA, 25 bp, Rattus norvegicus
gaccctcctgcactgtctgttgagt

SEQ ID NO: 321765 - DNA, 25 bp, Rattus norvegicus
gaccctcctgcagtgtctgttgagt

SEQ ID NO: 321766 - DNA, 25 bp, Rattus norvegicus
gaccctcctgccctggaattaaagg

SEQ ID NO: 321767 - DNA, 25 bp, Rattus norvegicus
gaccctcctgccgtggaattaaagg

SEQ ID NO: 321768 - DNA, 25 bp, Rattus norvegicus
gaccctcgacgacgtttcagacgaa

SEQ ID NO: 321769 - DNA, 25 bp, Rattus norvegicus
gaccctcgacgaggtttcagacgaa

SEQ ID NO: 321770 - DNA, 25 bp, Rattus norvegicus
gaccctcggagtaagcccagaacta

SEQ ID NO: 321771 - DNA, 25 bp, Rattus norvegicus
gaccctcggagttagcccagaacta

SEQ ID NO: 321772 - DNA, 25 bp, Rattus norvegicus
gaccctcggatacttcccagtgata

SEQ ID NO: 321773 - DNA, 25 bp, Rattus norvegicus
gaccctcggatagttcccagtgata

SEQ ID NO: 321774 - DNA, 25 bp, Rattus norvegicus
gaccctctagcacaggtacttcaaa

SEQ ID NO: 321775 - DNA, 25 bp, Rattus norvegicus
gaccctctagcagaggtacttcaaa

SEQ ID NO: 321776 - DNA, 25 bp, Rattus norvegicus
gaccctctatcacttcatctgtaaa

SEQ ID NO: 321777 - DNA, 25 bp, Rattus norvegicus
gaccctctatcagttcatctgtaaa

SEQ ID NO: 321778 - DNA, 25 bp, Rattus norvegicus
gaccctctatggcatctactacagg

SEQ ID NO: 321779 - DNA, 25 bp, Rattus norvegicus
gaccctctatgggatctactacagg

SEQ ID NO: 321780 - DNA, 25 bp, Rattus norvegicus
gaccctctcactaaagttgcaactt

SEQ ID NO: 321781 - DNA, 25 bp, Rattus norvegicus
gaccctctcacttaagttgcaactt

SEQ ID NO: 321782 - DNA, 25 bp, Rattus norvegicus
gaccctctccaaatcgaattcaagt

SEQ ID NO: 321783 - DNA, 25 bp, Rattus norvegicus
gaccctctccaattcgaattcaagt

SEQ ID NO: 321784 - DNA, 25 bp, Rattus norvegicus
gaccctctccttatgttaatacatt

SEQ ID NO: 321785 - DNA, 25 bp, Rattus norvegicus
gaccctctccttttgttaatacatt

SEQ ID NO: 321786 - DNA, 25 bp, Rattus norvegicus
gaccctctcggacagtgcgtggaaa

SEQ ID NO: 321787 - DNA, 25 bp, Rattus norvegicus
gaccctctcggagagtgcgtggaaa

SEQ ID NO: 321788 - DNA, 25 bp, Rattus norvegicus
gaccctctctagatagacagacctc

SEQ ID NO: 321789 - DNA, 25 bp, Rattus norvegicus
gaccctctctagttagacagacctc

SEQ ID NO: 321790 - DNA, 25 bp, Rattus norvegicus
gaccctctgactatcgcaatggaaa

SEQ ID NO: 321791 - DNA, 25 bp, Rattus norvegicus
gaccctctgactttcgcaatggaaa

SEQ ID NO: 321792 - DNA, 25 bp, Rattus norvegicus
gaccctctgcatccttttggcagga

SEQ ID NO: 321793 - DNA, 25 bp, Rattus norvegicus
gaccctctgcatgcttttggcagga

SEQ ID NO: 321794 - DNA, 25 bp, Rattus norvegicus
gaccctctgggaagagtcacattct

SEQ ID NO: 321795 - DNA, 25 bp, Rattus norvegicus
gaccctctgggatgagtcacattct

SEQ ID NO: 321796 - DNA, 25 bp, Rattus norvegicus
gaccctctggttctggcgaacggta

SEQ ID NO: 321797 - DNA, 25 bp, Rattus norvegicus
gaccctctggttgtggcgaacggta

SEQ ID NO: 321798 - DNA, 25 bp, Rattus norvegicus
gaccctcttaatactggttctgaag

SEQ ID NO: 321799 - DNA, 25 bp, Rattus norvegicus
gaccctcttaattctggttctgaag

SEQ ID NO: 321800 - DNA, 25 bp, Rattus norvegicus
gaccctcttcttcttttcagggcat

SEQ ID NO: 321801 - DNA, 25 bp, Rattus norvegicus
gaccctcttcttgttttcagggcat

SEQ ID NO: 321802 - DNA, 25 bp, Rattus norvegicus
gaccctcttgggactcatcaaggat

SEQ ID NO: 321803 - DNA, 25 bp, Rattus norvegicus
gaccctcttgggtctcatcaaggat

SEQ ID NO: 321804 - DNA, 25 bp, Rattus norvegicus
gaccctcttgtgaggtgtccatgac

SEQ ID NO: 321805 - DNA, 25 bp, Rattus norvegicus
gaccctcttgtgtggtgtccatgac

SEQ ID NO: 321806 - DNA, 25 bp, Rattus norvegicus
gaccctgaacaacatgcattccgag

SEQ ID NO: 321807 - DNA, 25 bp, Rattus norvegicus
gaccctgaacaagatgcattccgag

SEQ ID NO: 321808 - DNA, 25 bp, Rattus norvegicus
gaccctgaagcccttgcagatgagg

SEQ ID NO: 321809 - DNA, 25 bp, Rattus norvegicus
gaccctgaagccgttgcagatgagg

SEQ ID NO: 321810 - DNA, 25 bp, Rattus norvegicus
gaccctgaaggacggtgccaatcaa

SEQ ID NO: 321811 - DNA, 25 bp, Rattus norvegicus
gaccctgaaggagggtgccaatcaa

SEQ ID NO: 321812 - DNA, 25 bp, Rattus norvegicus
gaccctgaatatcttcttatctgtg

SEQ ID NO: 321813 - DNA, 25 bp, Rattus norvegicus
gaccctgaatatgttcttatctgtg

SEQ ID NO: 321814 - DNA, 25 bp, Rattus norvegicus
gaccctgaatttactgatccttctg

SEQ ID NO: 321815 - DNA, 25 bp, Rattus norvegicus
gaccctgaattttctgatccttctg

SEQ ID NO: 321816 - DNA, 25 bp, Rattus norvegicus
gaccctgacccactgtctgataatg

SEQ ID NO: 321817 - DNA, 25 bp, Rattus norvegicus
gaccctgacccagtgtctgataatg

SEQ ID NO: 321818 - DNA, 25 bp, Rattus norvegicus
gaccctgaccggcaccaaaggcatg

SEQ ID NO: 321819 - DNA, 25 bp, Rattus norvegicus
gaccctgaccgggaccaaaggcatg

SEQ ID NO: 321820 - DNA, 25 bp, Rattus norvegicus
gaccctgacctaaacagtgttgcac

SEQ ID NO: 321821 - DNA, 25 bp, Rattus norvegicus
gaccctgacctatacagtgttgcac

SEQ ID NO: 321822 - DNA, 25 bp, Rattus norvegicus
gaccctgacgtcagagtgctatatt

SEQ ID NO: 321823 - DNA, 25 bp, Rattus norvegicus
gaccctgacgtctgagtgctatatt

SEQ ID NO: 321824 - DNA, 25 bp, Rattus norvegicus
gaccctgactatcctttaccaagtg

SEQ ID NO: 321825 - DNA, 25 bp, Rattus norvegicus
gaccctgactatgctttaccaagtg

SEQ ID NO: 321826 - DNA, 25 bp, Rattus norvegicus
gaccctgactcaaggcaggtgttga

SEQ ID NO: 321827 - DNA, 25 bp, Rattus norvegicus
gaccctgactcacttgtctttgtat

SEQ ID NO: 321828 - DNA, 25 bp, Rattus norvegicus
gaccctgactcagttgtctttgtat

SEQ ID NO: 321829 - DNA, 25 bp, Rattus norvegicus
gaccctgactcatggcaggtgttga

SEQ ID NO: 321830 - DNA, 25 bp, Rattus norvegicus
gaccctgacttcaccgacatgaaaa

SEQ ID NO: 321831 - DNA, 25 bp, Rattus norvegicus
gaccctgacttctccgacatgaaaa

SEQ ID NO: 321832 - DNA, 25 bp, Rattus norvegicus
gaccctgacttgcactgtggtttga

SEQ ID NO: 321833 - DNA, 25 bp, Rattus norvegicus
gaccctgacttggactgtggtttga

SEQ ID NO: 321834 - DNA, 25 bp, Rattus norvegicus
gaccctgagagtattcctgcaggaa

SEQ ID NO: 321835 - DNA, 25 bp, Rattus norvegicus
gaccctgagagttttcctgcaggaa

SEQ ID NO: 321836 - DNA, 25 bp, Rattus norvegicus
gaccctgagatgcatgttttgtact

SEQ ID NO: 321837 - DNA, 25 bp, Rattus norvegicus
gaccctgagatggatgttttgtact

SEQ ID NO: 321838 - DNA, 25 bp, Rattus norvegicus
gaccctgagggcacagacctgagcg

SEQ ID NO: 321839 - DNA, 25 bp, Rattus norvegicus
gaccctgagggcctatgggacatca

SEQ ID NO: 321840 - DNA, 25 bp, Rattus norvegicus
gaccctgagggcgtatgggacatca

SEQ ID NO: 321841 - DNA, 25 bp, Rattus norvegicus
gaccctgagggctcagacctgagcg

SEQ ID NO: 321842 - DNA, 25 bp, Rattus norvegicus
gaccctgagggtagctggtttactc

SEQ ID NO: 321843 - DNA, 25 bp, Rattus norvegicus
gaccctgagggttgctggtttactc

SEQ ID NO: 321844 - DNA, 25 bp, Rattus norvegicus
gaccctgagtacaaggtcagccttc

SEQ ID NO: 321845 - DNA, 25 bp, Rattus norvegicus
gaccctgagtactaggtcagccttc

SEQ ID NO: 321846 - DNA, 25 bp, Rattus norvegicus
gaccctgatctgctttttatcttga

SEQ ID NO: 321847 - DNA, 25 bp, Rattus norvegicus
gaccctgatctggtttttatcttga

SEQ ID NO: 321848 - DNA, 25 bp, Rattus norvegicus
gaccctgatcttccttgaaggcttg

SEQ ID NO: 321849 - DNA, 25 bp, Rattus norvegicus
gaccctgatcttgcttgaaggcttg

SEQ ID NO: 321850 - DNA, 25 bp, Rattus norvegicus
gaccctgatggactcttaacgtact

SEQ ID NO: 321851 - DNA, 25 bp, Rattus norvegicus
gaccctgatggagtcttaacgtact

SEQ ID NO: 321852 - DNA, 25 bp, Rattus norvegicus
gaccctgattcaagttagccactga

SEQ ID NO: 321853 - DNA, 25 bp, Rattus norvegicus
gaccctgattcatgttagccactga

SEQ ID NO: 321854 - DNA, 25 bp, Rattus norvegicus
gaccctgcaaatcctctagagctgg

SEQ ID NO: 321855 - DNA, 25 bp, Rattus norvegicus
gaccctgcaaatgctctagagctgg

SEQ ID NO: 321856 - DNA, 25 bp, Rattus norvegicus
gaccctgcaaccatcatggaacatt

SEQ ID NO: 321857 - DNA, 25 bp, Rattus norvegicus
gaccctgcaaccttcatggaacatt

SEQ ID NO: 321858 - DNA, 25 bp, Rattus norvegicus
gaccctgcacagctgcaagtgggtt

SEQ ID NO: 321859 - DNA, 25 bp, Rattus norvegicus
gaccctgcacaggtgcaagtgggtt

SEQ ID NO: 321860 - DNA, 25 bp, Rattus norvegicus
gaccctgcaggtagttcataaaatt

SEQ ID NO: 321861 - DNA, 25 bp, Rattus norvegicus
gaccctgcaggttgttcataaaatt

SEQ ID NO: 321862 - DNA, 25 bp, Rattus norvegicus
gaccctgccaagattcctgaagcaa

SEQ ID NO: 321863 - DNA, 25 bp, Rattus norvegicus
gaccctgccaagtttcctgaagcaa

SEQ ID NO: 321864 - DNA, 25 bp, Rattus norvegicus
gaccctgccaccaggaattctgtag

SEQ ID NO: 321865 - DNA, 25 bp, Rattus norvegicus
gaccctgccacctggaattctgtag

SEQ ID NO: 321866 - DNA, 25 bp, Rattus norvegicus
gaccctgcccatagaactggtggtg

SEQ ID NO: 321867 - DNA, 25 bp, Rattus norvegicus
gaccctgcccattgaactggtggtg

SEQ ID NO: 321868 - DNA, 25 bp, Rattus norvegicus
gaccctgcgccgaaggatgctggca

SEQ ID NO: 321869 - DNA, 25 bp, Rattus norvegicus
gaccctgcgccgtaggatgctggca

SEQ ID NO: 321870 - DNA, 25 bp, Rattus norvegicus
gaccctgctaaacacctgttttgga

SEQ ID NO: 321871 - DNA, 25 bp, Rattus norvegicus
gaccctgctaaagacctgttttgga

SEQ ID NO: 321872 - DNA, 25 bp, Rattus norvegicus
gaccctgctaacattcagttcttta

SEQ ID NO: 321873 - DNA, 25 bp, Rattus norvegicus
gaccctgctaactttcagttcttta

SEQ ID NO: 321874 - DNA, 25 bp, Rattus norvegicus
gaccctgctgtgagcttttggagta

SEQ ID NO: 321875 - DNA, 25 bp, Rattus norvegicus
gaccctgctgtgtgcttttggagta

SEQ ID NO: 321876 - DNA, 25 bp, Rattus norvegicus
gaccctggaagtctctaaccaaaag

SEQ ID NO: 321877 - DNA, 25 bp, Rattus norvegicus
gaccctggaagtgtctaaccaaaag

SEQ ID NO: 321878 - DNA, 25 bp, Rattus norvegicus
gaccctggacctaattaccatgcta

SEQ ID NO: 321879 - DNA, 25 bp, Rattus norvegicus
gaccctggaccttattaccatgcta

SEQ ID NO: 321880 - DNA, 25 bp, Rattus norvegicus
gaccctggactgctgctatgaacaa

SEQ ID NO: 321881 - DNA, 25 bp, Rattus norvegicus
gaccctggactggtgctatgaacaa

SEQ ID NO: 321882 - DNA, 25 bp, Rattus norvegicus
gaccctggacttaggaacctgtcag

SEQ ID NO: 321883 - DNA, 25 bp, Rattus norvegicus
gaccctggactttggaacctgtcag

SEQ ID NO: 321884 - DNA, 25 bp, Rattus norvegicus
gaccctggagctccttacacagtgc

SEQ ID NO: 321885 - DNA, 25 bp, Rattus norvegicus
gaccctggagctgcttacacagtgc

SEQ ID NO: 321886 - DNA, 25 bp, Rattus norvegicus
gaccctggagtcagcacagatgaga

SEQ ID NO: 321887 - DNA, 25 bp, Rattus norvegicus
gaccctggagtctgcacagatgaga

SEQ ID NO: 321888 - DNA, 25 bp, Rattus norvegicus
gaccctggatatatgaaccccaaga

SEQ ID NO: 321889 - DNA, 25 bp, Rattus norvegicus
gaccctggatatttgaaccccaaga

SEQ ID NO: 321890 - DNA, 25 bp, Rattus norvegicus
gaccctggattacttccttcattgg

SEQ ID NO: 321891 - DNA, 25 bp, Rattus norvegicus
gaccctggattagttccttcattgg

SEQ ID NO: 321892 - DNA, 25 bp, Rattus norvegicus
gaccctggcaagcttgtgtgttcaa

SEQ ID NO: 321893 - DNA, 25 bp, Rattus norvegicus
gaccctggcaaggttgtgtgttcaa

SEQ ID NO: 321894 - DNA, 25 bp, Rattus norvegicus
gaccctggcagtctcttatttaaga

SEQ ID NO: 321895 - DNA, 25 bp, Rattus norvegicus
gaccctggcagtgtcttatttaaga

SEQ ID NO: 321896 - DNA, 25 bp, Rattus norvegicus
gaccctggccagagcattgtcagga

SEQ ID NO: 321897 - DNA, 25 bp, Rattus norvegicus
gaccctggccagtgcattgtcagga

SEQ ID NO: 321898 - DNA, 25 bp, Rattus norvegicus
gaccctggccatacagacagtgcaa

SEQ ID NO: 321899 - DNA, 25 bp, Rattus norvegicus
gaccctggccattcagacagtgcaa

SEQ ID NO: 321900 - DNA, 25 bp, Rattus norvegicus
gaccctgggctacgatggagtctcc

SEQ ID NO: 321901 - DNA, 25 bp, Rattus norvegicus
gaccctgggctaggatggagtctcc

SEQ ID NO: 321902 - DNA, 25 bp, Rattus norvegicus
gaccctgggctcaaatatcagcacc

SEQ ID NO: 321903 - DNA, 25 bp, Rattus norvegicus
gaccctgggctctaatatcagcacc

SEQ ID NO: 321904 - DNA, 25 bp, Rattus norvegicus
gaccctgggtagcatcacctctaaa

SEQ ID NO: 321905 - DNA, 25 bp, Rattus norvegicus
gaccctgggtaggatcacctctaaa

SEQ ID NO: 321906 - DNA, 25 bp, Rattus norvegicus
gaccctgggtctatgttatcattta

SEQ ID NO: 321907 - DNA, 25 bp, Rattus norvegicus
gaccctgggtctttgttatcattta

SEQ ID NO: 321908 - DNA, 25 bp, Rattus norvegicus
gaccctgggtgaacatgatgtcgca

SEQ ID NO: 321909 - DNA, 25 bp, Rattus norvegicus
gaccctgggtgatcatgatgtcgca

SEQ ID NO: 321910 - DNA, 25 bp, Rattus norvegicus
gaccctgggttgaatcaagtgctta

SEQ ID NO: 321911 - DNA, 25 bp, Rattus norvegicus
gaccctgggttgtatcaagtgctta

SEQ ID NO: 321912 - DNA, 25 bp, Rattus norvegicus
gaccctgggtttagatggcttatca

SEQ ID NO: 321913 - DNA, 25 bp, Rattus norvegicus
gaccctgggttttgatggcttatca

SEQ ID NO: 321914 - DNA, 25 bp, Rattus norvegicus
gaccctggtgacactcttacattga

SEQ ID NO: 321915 - DNA, 25 bp, Rattus norvegicus
gaccctggtgactctcttacattga

SEQ ID NO: 321916 - DNA, 25 bp, Rattus norvegicus
gaccctggtgggagcctacccttat

SEQ ID NO: 321917 - DNA, 25 bp, Rattus norvegicus
gaccctggtgggtgcctacccttat

SEQ ID NO: 321918 - DNA, 25 bp, Rattus norvegicus
gaccctggtgttactaaaactggag

SEQ ID NO: 321919 - DNA, 25 bp, Rattus norvegicus
gaccctggtgtttctaaaactggag

SEQ ID NO: 321920 - DNA, 25 bp, Rattus norvegicus
gaccctggttctcaacttgtctgta

SEQ ID NO: 321921 - DNA, 25 bp, Rattus norvegicus
gaccctggttctgaacttgtctgta

SEQ ID NO: 321922 - DNA, 25 bp, Rattus norvegicus
gaccctgtaaaactgtggcaagctt

SEQ ID NO: 321923 - DNA, 25 bp, Rattus norvegicus
gaccctgtaaaagtgtggcaagctt

SEQ ID NO: 321924 - DNA, 25 bp, Rattus norvegicus
gaccctgtaaacacacatatgcata

SEQ ID NO: 321925 - DNA, 25 bp, Rattus norvegicus
gaccctgtaaactcacatatgcata

SEQ ID NO: 321926 - DNA, 25 bp, Rattus norvegicus
gaccctgtactgcagtttgtggtag

SEQ ID NO: 321927 - DNA, 25 bp, Rattus norvegicus
gaccctgtactggagtttgtggtag

SEQ ID NO: 321928 - DNA, 25 bp, Rattus norvegicus
gaccctgtaggtacttctcatttaa

SEQ ID NO: 321929 - DNA, 25 bp, Rattus norvegicus
gaccctgtaggttcttctcatttaa

SEQ ID NO: 321930 - DNA, 25 bp, Rattus norvegicus
gaccctgtattaacaatgtccctgc

SEQ ID NO: 321931 - DNA, 25 bp, Rattus norvegicus
gaccctgtattatcaatgtccctgc

SEQ ID NO: 321932 - DNA, 25 bp, Rattus norvegicus
gaccctgtattgatcattgtccttg

SEQ ID NO: 321933 - DNA, 25 bp, Rattus norvegicus
gaccctgtattgttcattgtccttg

SEQ ID NO: 321934 - DNA, 25 bp, Rattus norvegicus
gaccctgtatttcgtttgtaagact

SEQ ID NO: 321935 - DNA, 25 bp, Rattus norvegicus
gaccctgtatttggtttgtaagact

SEQ ID NO: 321936 - DNA, 25 bp, Rattus norvegicus
gaccctgtcagcattagtggatgga

SEQ ID NO: 321937 - DNA, 25 bp, Rattus norvegicus
gaccctgtcagctttagtggatgga

SEQ ID NO: 321938 - DNA, 25 bp, Rattus norvegicus
gaccctgtccccatcaaagtgcaaa

SEQ ID NO: 321939 - DNA, 25 bp, Rattus norvegicus
gaccctgtccccttcaaagtgcaaa

SEQ ID NO: 321940 - DNA, 25 bp, Rattus norvegicus
gaccctgtctccagtaacttaaact

SEQ ID NO: 321941 - DNA, 25 bp, Rattus norvegicus
gaccctgtctcctgtaacttaaact

SEQ ID NO: 321942 - DNA, 25 bp, Rattus norvegicus
gaccctgtctgaaaggttatctcca

SEQ ID NO: 321943 - DNA, 25 bp, Rattus norvegicus
gaccctgtctgataggttatctcca

SEQ ID NO: 321944 - DNA, 25 bp, Rattus norvegicus
gaccctgtcttaccgtgtggaagaa

SEQ ID NO: 321945 - DNA, 25 bp, Rattus norvegicus
gaccctgtcttagcgtgtggaagaa

SEQ ID NO: 321946 - DNA, 25 bp, Rattus norvegicus
gaccctgtgaatcgcatctcagtgt

SEQ ID NO: 321947 - DNA, 25 bp, Rattus norvegicus
gaccctgtgaatggcatctcagtgt

SEQ ID NO: 321948 - DNA, 25 bp, Rattus norvegicus
gaccctgtgattactctggatccaa

SEQ ID NO: 321949 - DNA, 25 bp, Rattus norvegicus
gaccctgtgatttctctggatccaa

SEQ ID NO: 321950 - DNA, 25 bp, Rattus norvegicus
gaccctgtgcctaggtagcatctat

SEQ ID NO: 321951 - DNA, 25 bp, Rattus norvegicus
gaccctgtgccttggtagcatctat

SEQ ID NO: 321952 - DNA, 25 bp, Rattus norvegicus
gaccctgtggtgcacgtctggaata

SEQ ID NO: 321953 - DNA, 25 bp, Rattus norvegicus
gaccctgtggtggacgtctggaata

SEQ ID NO: 321954 - DNA, 25 bp, Rattus norvegicus
gaccctgtgtacagaaaatgccgtg

SEQ ID NO: 321955 - DNA, 25 bp, Rattus norvegicus
gaccctgtgtactgaaaatgccgtg

SEQ ID NO: 321956 - DNA, 25 bp, Rattus norvegicus
gaccctgtgtgtatccagaagttct

SEQ ID NO: 321957 - DNA, 25 bp, Rattus norvegicus
gaccctgtgtgtttccagaagttct

SEQ ID NO: 321958 - DNA, 25 bp, Rattus norvegicus
gaccctgttaatagtagtccacact

SEQ ID NO: 321959 - DNA, 25 bp, Rattus norvegicus
gaccctgttaattgtagtccacact

SEQ ID NO: 321960 - DNA, 25 bp, Rattus norvegicus
gaccctgttcatattgttttgcttg

SEQ ID NO: 321961 - DNA, 25 bp, Rattus norvegicus
gaccctgttcatcttctggagagag

SEQ ID NO: 321962 - DNA, 25 bp, Rattus norvegicus
gaccctgttcatgttctggagagag

SEQ ID NO: 321963 - DNA, 25 bp, Rattus norvegicus
gaccctgttcattttgttttgcttg

SEQ ID NO: 321964 - DNA, 25 bp, Rattus norvegicus
gaccctgttgatcactgtaactcta

SEQ ID NO: 321965 - DNA, 25 bp, Rattus norvegicus
gaccctgttgatgactgtaactcta

SEQ ID NO: 321966 - DNA, 25 bp, Rattus norvegicus
gaccctgttgctaagcctcagcaag

SEQ ID NO: 321967 - DNA, 25 bp, Rattus norvegicus
gaccctgttgcttagcctcagcaag

SEQ ID NO: 321968 - DNA, 25 bp, Rattus norvegicus
gaccctgttggcaagtctgatacct

SEQ ID NO: 321969 - DNA, 25 bp, Rattus norvegicus
gaccctgttggctagtctgatacct

SEQ ID NO: 321970 - DNA, 25 bp, Rattus norvegicus
gaccctgttgtacgtatttctcctc

SEQ ID NO: 321971 - DNA, 25 bp, Rattus norvegicus
gaccctgttgtaggtatttctcctc

SEQ ID NO: 321972 - DNA, 25 bp, Rattus norvegicus
gaccctgttgtcatttgtaggccgg

SEQ ID NO: 321973 - DNA, 25 bp, Rattus norvegicus
gaccctgttgtcttttgtaggccgg

SEQ ID NO: 321974 - DNA, 25 bp, Rattus norvegicus
gaccctgtttttactgactatgtgc

SEQ ID NO: 321975 - DNA, 25 bp, Rattus norvegicus
gaccctgttttttctgactatgtgc

SEQ ID NO: 321976 - DNA, 25 bp, Rattus norvegicus
gacccttacagcactcaaagactga

SEQ ID NO: 321977 - DNA, 25 bp, Rattus norvegicus
gacccttacagctctcaaagactga

SEQ ID NO: 321978 - DNA, 25 bp, Rattus norvegicus
gacccttagtgaacctaggtcacgt

SEQ ID NO: 321979 - DNA, 25 bp, Rattus norvegicus
gacccttagtgatcctaggtcacgt

SEQ ID NO: 321980 - DNA, 25 bp, Rattus norvegicus
gacccttcaatgagttttctagatt

SEQ ID NO: 321981 - DNA, 25 bp, Rattus norvegicus
gacccttcaatgtgttttctagatt

SEQ ID NO: 321982 - DNA, 25 bp, Rattus norvegicus
gacccttcagtaaagcgtcttgcta

SEQ ID NO: 321983 - DNA, 25 bp, Rattus norvegicus
gacccttcagtatagcgtcttgcta

SEQ ID NO: 321984 - DNA, 25 bp, Rattus norvegicus
gacccttcagtgactgtggaggaac

SEQ ID NO: 321985 - DNA, 25 bp, Rattus norvegicus
gacccttcagtgtctgtggaggaac

SEQ ID NO: 321986 - DNA, 25 bp, Rattus norvegicus
gacccttcccacagatgattctgga

SEQ ID NO: 321987 - DNA, 25 bp, Rattus norvegicus
gacccttcccactgatgattctgga

SEQ ID NO: 321988 - DNA, 25 bp, Rattus norvegicus
gacccttctcatcactttaattaat

SEQ ID NO: 321989 - DNA, 25 bp, Rattus norvegicus
gacccttctcatgactttaattaat

SEQ ID NO: 321990 - DNA, 25 bp, Rattus norvegicus
gacccttcttggaacgctcacaaaa

SEQ ID NO: 321991 - DNA, 25 bp, Rattus norvegicus
gacccttcttggtacgctcacaaaa

SEQ ID NO: 321992 - DNA, 25 bp, Rattus norvegicus
gacccttgaaggagccttaagtatt

SEQ ID NO: 321993 - DNA, 25 bp, Rattus norvegicus
gacccttgaaggtgccttaagtatt

SEQ ID NO: 321994 - DNA, 25 bp, Rattus norvegicus
gacccttgcacaatcactttaacta

SEQ ID NO: 321995 - DNA, 25 bp, Rattus norvegicus
gacccttgcacattcactttaacta

SEQ ID NO: 321996 - DNA, 25 bp, Rattus norvegicus
gacccttggcctaaagtccagaagt

SEQ ID NO: 321997 - DNA, 25 bp, Rattus norvegicus
gacccttggccttaagtccagaagt

SEQ ID NO: 321998 - DNA, 25 bp, Rattus norvegicus
gacccttgggtaacctgggctacat

SEQ ID NO: 321999 - DNA, 25 bp, Rattus norvegicus
gacccttgggtatcctgggctacat

SEQ ID NO: 322000 - DNA, 25 bp, Rattus norvegicus
gacccttggtatatctctaacttta

SEQ ID NO: 322001 - DNA, 25 bp, Rattus norvegicus
gacccttggtatttctctaacttta

SEQ ID NO: 322002 - DNA, 25 bp, Rattus norvegicus
gacccttgtcagaaacattctgtgc

SEQ ID NO: 322003 - DNA, 25 bp, Rattus norvegicus
gacccttgtcagtaacattctgtgc

SEQ ID NO: 322004 - DNA, 25 bp, Rattus norvegicus
gacccttgtgaacttgagatccgag

SEQ ID NO: 322005 - DNA, 25 bp, Rattus norvegicus
gacccttgtgaagttgagatccgag

SEQ ID NO: 322006 - DNA, 25 bp, Rattus norvegicus
gacccttgtgaccaagacttaacct

SEQ ID NO: 322007 - DNA, 25 bp, Rattus norvegicus
gacccttgtgacgaagacttaacct

SEQ ID NO: 322008 - DNA, 25 bp, Rattus norvegicus
gacccttgttttagcaggctcagaa

SEQ ID NO: 322009 - DNA, 25 bp, Rattus norvegicus
gacccttgtttttgcaggctcagaa

SEQ ID NO: 322010 - DNA, 25 bp, Rattus norvegicus
gaccctttaatgaatggttcctcat

SEQ ID NO: 322011 - DNA, 25 bp, Rattus norvegicus
gaccctttaatgtatggttcctcat

SEQ ID NO: 322012 - DNA, 25 bp, Rattus norvegicus
gaccctttacccaatgtgtatgcaa

SEQ ID NO: 322013 - DNA, 25 bp, Rattus norvegicus
gaccctttaccctatgtgtatgcaa

SEQ ID NO: 322014 - DNA, 25 bp, Rattus norvegicus
gaccctttaggtactgtgtggagct

SEQ ID NO: 322015 - DNA, 25 bp, Rattus norvegicus
gaccctttaggttctgtgtggagct

SEQ ID NO: 322016 - DNA, 25 bp, Rattus norvegicus
gaccctttcaacctgtacatcgagt

SEQ ID NO: 322017 - DNA, 25 bp, Rattus norvegicus
gaccctttcaacgtgtacatcgagt

SEQ ID NO: 322018 - DNA, 25 bp, Rattus norvegicus
gaccctttcagtcaaaagaatcact

SEQ ID NO: 322019 - DNA, 25 bp, Rattus norvegicus
gaccctttcagtgaaaagaatcact

SEQ ID NO: 322020 - DNA, 25 bp, Rattus norvegicus
gaccctttgagacggagcacccttg

SEQ ID NO: 322021 - DNA, 25 bp, Rattus norvegicus
gaccctttgagagggagcacccttg

SEQ ID NO: 322022 - DNA, 25 bp, Rattus norvegicus
gaccctttgctacactgaagctgga

SEQ ID NO: 322023 - DNA, 25 bp, Rattus norvegicus
gaccctttgctagactgaagctgga

SEQ ID NO: 322024 - DNA, 25 bp, Rattus norvegicus
gaccctttgtttcctacccgtgtgt

SEQ ID NO: 322025 - DNA, 25 bp, Rattus norvegicus
gaccctttgtttgctacccgtgtgt

SEQ ID NO: 322026 - DNA, 25 bp, Rattus norvegicus
gacccttttcatcagaaagtggcac

SEQ ID NO: 322027 - DNA, 25 bp, Rattus norvegicus
gacccttttcatgagaaagtggcac

SEQ ID NO: 322028 - DNA, 25 bp, Rattus norvegicus
gacccttttgtgacagtcaacattt

SEQ ID NO: 322029 - DNA, 25 bp, Rattus norvegicus
gacccttttgtgtcagtcaacattt

SEQ ID NO: 322030 - DNA, 25 bp, Rattus norvegicus
gaccctttttgccatattttatata

SEQ ID NO: 322031 - DNA, 25 bp, Rattus norvegicus
gaccctttttgcgatattttatata

SEQ ID NO: 322032 - DNA, 25 bp, Rattus norvegicus
gaccgaacatcacaaccgagcgcat

SEQ ID NO: 322033 - DNA, 25 bp, Rattus norvegicus
gaccgaacatcagaaccgagcgcat

SEQ ID NO: 322034 - DNA, 25 bp, Rattus norvegicus
gaccgaaccctcactattgtggata

SEQ ID NO: 322035 - DNA, 25 bp, Rattus norvegicus
gaccgaaccctctctattgtggata

SEQ ID NO: 322036 - DNA, 25 bp, Rattus norvegicus
gaccgaagcctaagagctgcaggta

SEQ ID NO: 322037 - DNA, 25 bp, Rattus norvegicus
gaccgaagcctatgagctgcaggta

SEQ ID NO: 322038 - DNA, 25 bp, Rattus norvegicus
gaccgaagtccaagtaaccactttg

SEQ ID NO: 322039 - DNA, 25 bp, Rattus norvegicus
gaccgaagtccatgtaaccactttg

SEQ ID NO: 322040 - DNA, 25 bp, Rattus norvegicus
gaccgaagtgatcgctgaattgctt

SEQ ID NO: 322041 - DNA, 25 bp, Rattus norvegicus
gaccgaagtgatggctgaattgctt

SEQ ID NO: 322042 - DNA, 25 bp, Rattus norvegicus
gaccgaagtggtcctttgctacctt

SEQ ID NO: 322043 - DNA, 25 bp, Rattus norvegicus
gaccgaagtggtgctttgctacctt

SEQ ID NO: 322044 - DNA, 25 bp, Rattus norvegicus
gaccgaataggcctaaactgcatga

SEQ ID NO: 322045 - DNA, 25 bp, Rattus norvegicus
gaccgaataggcgtaaactgcatga

SEQ ID NO: 322046 - DNA, 25 bp, Rattus norvegicus
gaccgaatcaaaaggactcttcaca

SEQ ID NO: 322047 - DNA, 25 bp, Rattus norvegicus
gaccgaatcaaatggactcttcaca

SEQ ID NO: 322048 - DNA, 25 bp, Rattus norvegicus
gaccgaatcatgaatcactcctcaa

SEQ ID NO: 322049 - DNA, 25 bp, Rattus norvegicus
gaccgaatcatgtatcactcctcaa

SEQ ID NO: 322050 - DNA, 25 bp, Rattus norvegicus
gaccgacattgccttggtttgttat

SEQ ID NO: 322051 - DNA, 25 bp, Rattus norvegicus
gaccgacattgcgttggtttgttat

SEQ ID NO: 322052 - DNA, 25 bp, Rattus norvegicus
gaccgaccagttaagaaagccccag

SEQ ID NO: 322053 - DNA, 25 bp, Rattus norvegicus
gaccgaccagtttagaaagccccag

SEQ ID NO: 322054 - DNA, 25 bp, Rattus norvegicus
gaccgactacttcttatgacttttt

SEQ ID NO: 322055 - DNA, 25 bp, Rattus norvegicus
gaccgactacttgttatgacttttt

SEQ ID NO: 322056 - DNA, 25 bp, Rattus norvegicus
gaccgactcattaaatttgcataac

SEQ ID NO: 322057 - DNA, 25 bp, Rattus norvegicus
gaccgactcatttaatttgcataac

SEQ ID NO: 322058 - DNA, 25 bp, Rattus norvegicus
gaccgactcccacctttaggagaag

SEQ ID NO: 322059 - DNA, 25 bp, Rattus norvegicus
gaccgactcccagctttaggagaag

SEQ ID NO: 322060 - DNA, 25 bp, Rattus norvegicus
gaccgactggatcggctgtgcctcc

SEQ ID NO: 322061 - DNA, 25 bp, Rattus norvegicus
gaccgactggatgggctgtgcctcc

SEQ ID NO: 322062 - DNA, 25 bp, Rattus norvegicus
gaccgagaactcatgcagtcgttta

SEQ ID NO: 322063 - DNA, 25 bp, Rattus norvegicus
gaccgagaactcttgcagtcgttta

SEQ ID NO: 322064 - DNA, 25 bp, Rattus norvegicus
gaccgagaagtgagtttgaccaagc

SEQ ID NO: 322065 - DNA, 25 bp, Rattus norvegicus
gaccgagaagtgtgtttgaccaagc

SEQ ID NO: 322066 - DNA, 25 bp, Rattus norvegicus
gaccgagaccgaattggcatttcca

SEQ ID NO: 322067 - DNA, 25 bp, Rattus norvegicus
gaccgagaccgatttggcatttcca

SEQ ID NO: 322068 - DNA, 25 bp, Rattus norvegicus
gaccgagacggaagtcatgatttca

SEQ ID NO: 322069 - DNA, 25 bp, Rattus norvegicus
gaccgagacggatgtcatgatttca

SEQ ID NO: 322070 - DNA, 25 bp, Rattus norvegicus
gaccgagagagtaagctgactttac

SEQ ID NO: 322071 - DNA, 25 bp, Rattus norvegicus
gaccgagagagttagctgactttac

SEQ ID NO: 322072 - DNA, 25 bp, Rattus norvegicus
gaccgagagtttcaatgcaagtttc

SEQ ID NO: 322073 - DNA, 25 bp, Rattus norvegicus
gaccgagagtttgaatgcaagtttc

SEQ ID NO: 322074 - DNA, 25 bp, Rattus norvegicus
gaccgagatggcctcgtgactagac

SEQ ID NO: 322075 - DNA, 25 bp, Rattus norvegicus
gaccgagatggcgtcgtgactagac

SEQ ID NO: 322076 - DNA, 25 bp, Rattus norvegicus
gaccgagatgtgactctctacttgg

SEQ ID NO: 322077 - DNA, 25 bp, Rattus norvegicus
gaccgagatgtgtctctctacttgg

SEQ ID NO: 322078 - DNA, 25 bp, Rattus norvegicus
gaccgagcaagccttgttggagtat

SEQ ID NO: 322079 - DNA, 25 bp, Rattus norvegicus
gaccgagcaagcgttgttggagtat

SEQ ID NO: 322080 - DNA, 25 bp, Rattus norvegicus
gaccgagcacctccgtgtgataaga

SEQ ID NO: 322081 - DNA, 25 bp, Rattus norvegicus
gaccgagcacctgcgtgtgataaga

SEQ ID NO: 322082 - DNA, 25 bp, Rattus norvegicus
gaccgagcatgcaattctgtgctgg

SEQ ID NO: 322083 - DNA, 25 bp, Rattus norvegicus
gaccgagcatgctattctgtgctgg

SEQ ID NO: 322084 - DNA, 25 bp, Rattus norvegicus
gaccgagccagaatcttcaatgtga

SEQ ID NO: 322085 - DNA, 25 bp, Rattus norvegicus
gaccgagccagattcttcaatgtga

SEQ ID NO: 322086 - DNA, 25 bp, Rattus norvegicus
gaccgagctcatctcattagaaagt

SEQ ID NO: 322087 - DNA, 25 bp, Rattus norvegicus
gaccgagctcatgtcattagaaagt

SEQ ID NO: 322088 - DNA, 25 bp, Rattus norvegicus
gaccgagctgcaaagattccacaat

SEQ ID NO: 322089 - DNA, 25 bp, Rattus norvegicus
gaccgagctgcatagattccacaat

SEQ ID NO: 322090 - DNA, 25 bp, Rattus norvegicus
gaccgaggaatcatttcaagcttaa

SEQ ID NO: 322091 - DNA, 25 bp, Rattus norvegicus
gaccgaggaatcttttcaagcttaa

SEQ ID NO: 322092 - DNA, 25 bp, Rattus norvegicus
gaccgaggagggacatcgccgattt

SEQ ID NO: 322093 - DNA, 25 bp, Rattus norvegicus
gaccgaggagggtcatcgccgattt

SEQ ID NO: 322094 - DNA, 25 bp, Rattus norvegicus
gaccgagtagagcactcttcccagc

SEQ ID NO: 322095 - DNA, 25 bp, Rattus norvegicus
gaccgagtagaggactcttcccagc

SEQ ID NO: 322096 - DNA, 25 bp, Rattus norvegicus
gaccgagtcactcctgggttacaga

SEQ ID NO: 322097 - DNA, 25 bp, Rattus norvegicus
gaccgagtcactgctgggttacaga

SEQ ID NO: 322098 - DNA, 25 bp, Rattus norvegicus
gaccgagtcatgacaaaactggact

SEQ ID NO: 322099 - DNA, 25 bp, Rattus norvegicus
gaccgagtcatgtcaaaactggact

SEQ ID NO: 322100 - DNA, 25 bp, Rattus norvegicus
gaccgagtcgaaaagctcacaactt

SEQ ID NO: 322101 - DNA, 25 bp, Rattus norvegicus
gaccgagtcgaatagctcacaactt

SEQ ID NO: 322102 - DNA, 25 bp, Rattus norvegicus
gaccgagtctgtattactaattcct

SEQ ID NO: 322103 - DNA, 25 bp, Rattus norvegicus
gaccgagtctgttttactaattcct

SEQ ID NO: 322104 - DNA, 25 bp, Rattus norvegicus
gaccgagttcggcatccagaggtcc

SEQ ID NO: 322105 - DNA, 25 bp, Rattus norvegicus
gaccgagttcgggatccagaggtcc

SEQ ID NO: 322106 - DNA, 25 bp, Rattus norvegicus
gaccgagttctgaatgtcttgaaac

SEQ ID NO: 322107 - DNA, 25 bp, Rattus norvegicus
gaccgagttctgtatgtcttgaaac

SEQ ID NO: 322108 - DNA, 25 bp, Rattus norvegicus
gaccgagttgtcacttggttcaagg

SEQ ID NO: 322109 - DNA, 25 bp, Rattus norvegicus
gaccgagttgtctcttggttcaagg

SEQ ID NO: 322110 - DNA, 25 bp, Rattus norvegicus
gaccgatagaatcattggtaatgag

SEQ ID NO: 322111 - DNA, 25 bp, Rattus norvegicus
gaccgatagaatgattggtaatgag

SEQ ID NO: 322112 - DNA, 25 bp, Rattus norvegicus
gaccgatcacgcaggaggcccgttc

SEQ ID NO: 322113 - DNA, 25 bp, Rattus norvegicus
gaccgatcacgctggaggcccgttc

SEQ ID NO: 322114 - DNA, 25 bp, Rattus norvegicus
gaccgatcccagattatggtgtttt

SEQ ID NO: 322115 - DNA, 25 bp, Rattus norvegicus
gaccgatcccagtttatggtgtttt

SEQ ID NO: 322116 - DNA, 25 bp, Rattus norvegicus
gaccgatcggaactgtcccttaagg

SEQ ID NO: 322117 - DNA, 25 bp, Rattus norvegicus
gaccgatcggaagtgtcccttaagg

SEQ ID NO: 322118 - DNA, 25 bp, Rattus norvegicus
gaccgatcttggcacatctgaacaa

SEQ ID NO: 322119 - DNA, 25 bp, Rattus norvegicus
gaccgatcttgggacatctgaacaa

SEQ ID NO: 322120 - DNA, 25 bp, Rattus norvegicus
gaccgatgattgaagactttgcttg

SEQ ID NO: 322121 - DNA, 25 bp, Rattus norvegicus
gaccgatgattgtagactttgcttg

SEQ ID NO: 322122 - DNA, 25 bp, Rattus norvegicus
gaccgatgcactaaatcgtttactg

SEQ ID NO: 322123 - DNA, 25 bp, Rattus norvegicus
gaccgatgcacttaatcgtttactg

SEQ ID NO: 322124 - DNA, 25 bp, Rattus norvegicus
gaccgatgccaacactaggagccat

SEQ ID NO: 322125 - DNA, 25 bp, Rattus norvegicus
gaccgatgccaagactaggagccat

SEQ ID NO: 322126 - DNA, 25 bp, Rattus norvegicus
gaccgatgcctaacacttaatctaa

SEQ ID NO: 322127 - DNA, 25 bp, Rattus norvegicus
gaccgatgcctatcacttaatctaa

SEQ ID NO: 322128 - DNA, 25 bp, Rattus norvegicus
gaccgatgcgtaaccaagtacttgg

SEQ ID NO: 322129 - DNA, 25 bp, Rattus norvegicus
gaccgatgcgtatccaagtacttgg

SEQ ID NO: 322130 - DNA, 25 bp, Rattus norvegicus
gaccgatgggtaattgctccgactt

SEQ ID NO: 322131 - DNA, 25 bp, Rattus norvegicus
gaccgatgggtatttgctccgactt

SEQ ID NO: 322132 - DNA, 25 bp, Rattus norvegicus
gaccgatggtacagttattcatgaa

SEQ ID NO: 322133 - DNA, 25 bp, Rattus norvegicus
gaccgatggtactgttattcatgaa

SEQ ID NO: 322134 - DNA, 25 bp, Rattus norvegicus
gaccgattagagacagcacacctga

SEQ ID NO: 322135 - DNA, 25 bp, Rattus norvegicus
gaccgattagagtcagcacacctga

SEQ ID NO: 322136 - DNA, 25 bp, Rattus norvegicus
gaccgattcaaaccgtaacgcacag

SEQ ID NO: 322137 - DNA, 25 bp, Rattus norvegicus
gaccgattcaaagcgtaacgcacag

SEQ ID NO: 322138 - DNA, 25 bp, Rattus norvegicus
gaccgattcttgcagcgattccgaa

SEQ ID NO: 322139 - DNA, 25 bp, Rattus norvegicus
gaccgattcttggagcgattccgaa

SEQ ID NO: 322140 - DNA, 25 bp, Rattus norvegicus
gaccgattctttattagcgcttgct

SEQ ID NO: 322141 - DNA, 25 bp, Rattus norvegicus
gaccgattcttttttagcgcttgct

SEQ ID NO: 322142 - DNA, 25 bp, Rattus norvegicus
gaccgattggtgactctggaggaat

SEQ ID NO: 322143 - DNA, 25 bp, Rattus norvegicus
gaccgattggtgtctctggaggaat

SEQ ID NO: 322144 - DNA, 25 bp, Rattus norvegicus
gaccgatttggacacttcatggaaa

SEQ ID NO: 322145 - DNA, 25 bp, Rattus norvegicus
gaccgatttggagacttcatggaaa

SEQ ID NO: 322146 - DNA, 25 bp, Rattus norvegicus
gaccgcacccacagtatgacaagag

SEQ ID NO: 322147 - DNA, 25 bp, Rattus norvegicus
gaccgcacccactgtatgacaagag

SEQ ID NO: 322148 - DNA, 25 bp, Rattus norvegicus
gaccgcacggaaatgggatttacca

SEQ ID NO: 322149 - DNA, 25 bp, Rattus norvegicus
gaccgcacggaattgggatttacca

SEQ ID NO: 322150 - DNA, 25 bp, Rattus norvegicus
gaccgcagccatcacgaaaattcta

SEQ ID NO: 322151 - DNA, 25 bp, Rattus norvegicus
gaccgcagccatgacgaaaattcta

SEQ ID NO: 322152 - DNA, 25 bp, Rattus norvegicus
gaccgcaggaaacgacagttatgtt

SEQ ID NO: 322153 - DNA, 25 bp, Rattus norvegicus
gaccgcaggaaaggacagttatgtt

SEQ ID NO: 322154 - DNA, 25 bp, Rattus norvegicus
gaccgcatagctcactactgtggga

SEQ ID NO: 322155 - DNA, 25 bp, Rattus norvegicus
gaccgcatagctgactactgtggga

SEQ ID NO: 322156 - DNA, 25 bp, Rattus norvegicus
gaccgcatgcacagaaggctagctc

SEQ ID NO: 322157 - DNA, 25 bp, Rattus norvegicus
gaccgcatgcactgaaggctagctc

SEQ ID NO: 322158 - DNA, 25 bp, Rattus norvegicus
gaccgccaagtcagcaggtgttgag

SEQ ID NO: 322159 - DNA, 25 bp, Rattus norvegicus
gaccgccaagtctgcaggtgttgag

SEQ ID NO: 322160 - DNA, 25 bp, Rattus norvegicus
gaccgccacccgatgtgactgaaag

SEQ ID NO: 322161 - DNA, 25 bp, Rattus norvegicus
gaccgccacccgttgtgactgaaag

SEQ ID NO: 322162 - DNA, 25 bp, Rattus norvegicus
gaccgccaggccagtcaagcaggaa

SEQ ID NO: 322163 - DNA, 25 bp, Rattus norvegicus
gaccgccaggcctgtcaagcaggaa

SEQ ID NO: 322164 - DNA, 25 bp, Rattus norvegicus
gaccgcccagttataactcttcgaa

SEQ ID NO: 322165 - DNA, 25 bp, Rattus norvegicus
gaccgcccagttttaactcttcgaa

SEQ ID NO: 322166 - DNA, 25 bp, Rattus norvegicus
gaccgccgagagctcattcgtcaga

SEQ ID NO: 322167 - DNA, 25 bp, Rattus norvegicus
gaccgccgagaggtcattcgtcaga

SEQ ID NO: 322168 - DNA, 25 bp, Rattus norvegicus
gaccgccgagtcaggagagctgcac

SEQ ID NO: 322169 - DNA, 25 bp, Rattus norvegicus
gaccgccgagtctggagagctgcac

SEQ ID NO: 322170 - DNA, 25 bp, Rattus norvegicus
gaccgccttgcccatgagattgaag

SEQ ID NO: 322171 - DNA, 25 bp, Rattus norvegicus
gaccgccttgccgatgagattgaag

SEQ ID NO: 322172 - DNA, 25 bp, Rattus norvegicus
gaccgcgaccgacatgggtctgatc

SEQ ID NO: 322173 - DNA, 25 bp, Rattus norvegicus
gaccgcgaccgagatgggtctgatc

SEQ ID NO: 322174 - DNA, 25 bp, Rattus norvegicus
gaccgcgcatcaccatgtaagccgc

SEQ ID NO: 322175 - DNA, 25 bp, Rattus norvegicus
gaccgcgcatcagcatgtaagccgc

SEQ ID NO: 322176 - DNA, 25 bp, Rattus norvegicus
gaccgcgccacgaccatggaagcaa

SEQ ID NO: 322177 - DNA, 25 bp, Rattus norvegicus
gaccgcgccacgtccatggaagcaa

SEQ ID NO: 322178 - DNA, 25 bp, Rattus norvegicus
gaccgcgcgggcagaagctcgaggg

SEQ ID NO: 322179 - DNA, 25 bp, Rattus norvegicus
gaccgcgcgggctgaagctcgaggg

SEQ ID NO: 322180 - DNA, 25 bp, Rattus norvegicus
gaccgcggttccattttggtttcat

SEQ ID NO: 322181 - DNA, 25 bp, Rattus norvegicus
gaccgcggttcctttttggtttcat

SEQ ID NO: 322182 - DNA, 25 bp, Rattus norvegicus
gaccgcgtgataaaactgggttgag

SEQ ID NO: 322183 - DNA, 25 bp, Rattus norvegicus
gaccgcgtgatataactgggttgag

SEQ ID NO: 322184 - DNA, 25 bp, Rattus norvegicus
gaccgctacagtctcaagtcaggca

SEQ ID NO: 322185 - DNA, 25 bp, Rattus norvegicus
gaccgctacagtgtcaagtcaggca

SEQ ID NO: 322186 - DNA, 25 bp, Rattus norvegicus
gaccgctcaggtataggacgtctga

SEQ ID NO: 322187 - DNA, 25 bp, Rattus norvegicus
gaccgctcaggtttaggacgtctga

SEQ ID NO: 322188 - DNA, 25 bp, Rattus norvegicus
gaccgctccgctccgtcttgaaaaa

SEQ ID NO: 322189 - DNA, 25 bp, Rattus norvegicus
gaccgctccgctgcgtcttgaaaaa

SEQ ID NO: 322190 - DNA, 25 bp, Rattus norvegicus
gaccgctctttcaaagaactcctgt

SEQ ID NO: 322191 - DNA, 25 bp, Rattus norvegicus
gaccgctctttctaagaactcctgt

SEQ ID NO: 322192 - DNA, 25 bp, Rattus norvegicus
gaccgctgaagtatttgtgtgctct

SEQ ID NO: 322193 - DNA, 25 bp, Rattus norvegicus
gaccgctgaagtttttgtgtgctct

SEQ ID NO: 322194 - DNA, 25 bp, Rattus norvegicus
gaccgctgagcaacgagaacacttg

SEQ ID NO: 322195 - DNA, 25 bp, Rattus norvegicus
gaccgctgagcatcgagaacacttg

SEQ ID NO: 322196 - DNA, 25 bp, Rattus norvegicus
gaccgctgaggacccagcatggtat

SEQ ID NO: 322197 - DNA, 25 bp, Rattus norvegicus
gaccgctgaggacctgattctcatt

SEQ ID NO: 322198 - DNA, 25 bp, Rattus norvegicus
gaccgctgaggagccagcatggtat

SEQ ID NO: 322199 - DNA, 25 bp, Rattus norvegicus
gaccgctgaggagctgattctcatt

SEQ ID NO: 322200 - DNA, 25 bp, Rattus norvegicus
gaccgctgccccattggtggcaaag

SEQ ID NO: 322201 - DNA, 25 bp, Rattus norvegicus
gaccgctgcccctttggtggcaaag

SEQ ID NO: 322202 - DNA, 25 bp, Rattus norvegicus
gaccgctggcacattgctcttcaat

SEQ ID NO: 322203 - DNA, 25 bp, Rattus norvegicus
gaccgctggcactttgctcttcaat

SEQ ID NO: 322204 - DNA, 25 bp, Rattus norvegicus
gaccgctgtattcagaactgctgtt

SEQ ID NO: 322205 - DNA, 25 bp, Rattus norvegicus
gaccgctgtattgagaactgctgtt

SEQ ID NO: 322206 - DNA, 25 bp, Rattus norvegicus
gaccgcttctgacctgtatcggaaa

SEQ ID NO: 322207 - DNA, 25 bp, Rattus norvegicus
gaccgcttctgagctgtatcggaaa

SEQ ID NO: 322208 - DNA, 25 bp, Rattus norvegicus
gaccgctttataactcagtttacat

SEQ ID NO: 322209 - DNA, 25 bp, Rattus norvegicus
gaccgctttatatctcagtttacat

SEQ ID NO: 322210 - DNA, 25 bp, Rattus norvegicus
gaccgcttttgtcgactttgtggag

SEQ ID NO: 322211 - DNA, 25 bp, Rattus norvegicus
gaccgcttttgtggactttgtggag

SEQ ID NO: 322212 - DNA, 25 bp, Rattus norvegicus
gaccggaaattccaggtctcgctgg

SEQ ID NO: 322213 - DNA, 25 bp, Rattus norvegicus
gaccggaaattcgaggtctcgctgg

SEQ ID NO: 322214 - DNA, 25 bp, Rattus norvegicus
gaccggaaggagacgcccatctgaa

SEQ ID NO: 322215 - DNA, 25 bp, Rattus norvegicus
gaccggaaggagtcgcccatctgaa

SEQ ID NO: 322216 - DNA, 25 bp, Rattus norvegicus
gaccggaatctgcatgtggtccgta

SEQ ID NO: 322217 - DNA, 25 bp, Rattus norvegicus
gaccggaatctggatgtggtccgta

SEQ ID NO: 322218 - DNA, 25 bp, Rattus norvegicus
gaccggacagtgaacgtgtcacgcg

SEQ ID NO: 322219 - DNA, 25 bp, Rattus norvegicus
gaccggacagtgtacgtgtcacgcg

SEQ ID NO: 322220 - DNA, 25 bp, Rattus norvegicus
gaccggactatgaaattccactcgt

SEQ ID NO: 322221 - DNA, 25 bp, Rattus norvegicus
gaccggactatgtaattccactcgt

SEQ ID NO: 322222 - DNA, 25 bp, Rattus norvegicus
gaccggacttatccgtcgccttccg

SEQ ID NO: 322223 - DNA, 25 bp, Rattus norvegicus
gaccggacttatgcgtcgccttccg

SEQ ID NO: 322224 - DNA, 25 bp, Rattus norvegicus
gaccggaggctcatgtacttcaaag

SEQ ID NO: 322225 - DNA, 25 bp, Rattus norvegicus
gaccggaggctcttgtacttcaaag

SEQ ID NO: 322226 - DNA, 25 bp, Rattus norvegicus
gaccggatcccacagtgcttagaac

SEQ ID NO: 322227 - DNA, 25 bp, Rattus norvegicus
gaccggatcccagagtgcttagaac

SEQ ID NO: 322228 - DNA, 25 bp, Rattus norvegicus
gaccggcacactcctgagcatttga

SEQ ID NO: 322229 - DNA, 25 bp, Rattus norvegicus
gaccggcacactgctgagcatttga

SEQ ID NO: 322230 - DNA, 25 bp, Rattus norvegicus
gaccggcaccccagaagaggagcac

SEQ ID NO: 322231 - DNA, 25 bp, Rattus norvegicus
gaccggcacccctgaagaggagcac

SEQ ID NO: 322232 - DNA, 25 bp, Rattus norvegicus
gaccggcatcccaggactacagtga

SEQ ID NO: 322233 - DNA, 25 bp, Rattus norvegicus
gaccggcatccctggactacagtga

SEQ ID NO: 322234 - DNA, 25 bp, Rattus norvegicus
gaccggcgagtgaatgtcacctaca

SEQ ID NO: 322235 - DNA, 25 bp, Rattus norvegicus
gaccggcgagtgtatgtcacctaca

SEQ ID NO: 322236 - DNA, 25 bp, Rattus norvegicus
gaccggctactgaggaagagactct

SEQ ID NO: 322237 - DNA, 25 bp, Rattus norvegicus
gaccggctactgtggaagagactct

SEQ ID NO: 322238 - DNA, 25 bp, Rattus norvegicus
gaccggctcagaatcagtgtttttc

SEQ ID NO: 322239 - DNA, 25 bp, Rattus norvegicus
gaccggctcagattcagtgtttttc

SEQ ID NO: 322240 - DNA, 25 bp, Rattus norvegicus
gaccggctgacgcacaccagtaagt

SEQ ID NO: 322241 - DNA, 25 bp, Rattus norvegicus
gaccggctgacggacaccagtaagt

SEQ ID NO: 322242 - DNA, 25 bp, Rattus norvegicus
gaccggctgtgtactagtcttttgc

SEQ ID NO: 322243 - DNA, 25 bp, Rattus norvegicus
gaccggctgtgttctagtcttttgc

SEQ ID NO: 322244 - DNA, 25 bp, Rattus norvegicus
gaccggcttctcaaagttgtgcaca

SEQ ID NO: 322245 - DNA, 25 bp, Rattus norvegicus
gaccggcttctctaagttgtgcaca

SEQ ID NO: 322246 - DNA, 25 bp, Rattus norvegicus
gaccggcttttcacagctaagagca

SEQ ID NO: 322247 - DNA, 25 bp, Rattus norvegicus
gaccggcttttctcagctaagagca

SEQ ID NO: 322248 - DNA, 25 bp, Rattus norvegicus
gaccgggaacccaagagtgccagat

SEQ ID NO: 322249 - DNA, 25 bp, Rattus norvegicus
gaccgggaaccctagagtgccagat

SEQ ID NO: 322250 - DNA, 25 bp, Rattus norvegicus
gaccgggaatgtactctgctaggga

SEQ ID NO: 322251 - DNA, 25 bp, Rattus norvegicus
gaccgggaatgttctctgctaggga

SEQ ID NO: 322252 - DNA, 25 bp, Rattus norvegicus
gaccgggacatcacagggccgaaaa

SEQ ID NO: 322253 - DNA, 25 bp, Rattus norvegicus
gaccgggacatctcagggccgaaaa

SEQ ID NO: 322254 - DNA, 25 bp, Rattus norvegicus
gaccgggaggtcagcaggatcctaa

SEQ ID NO: 322255 - DNA, 25 bp, Rattus norvegicus
gaccgggaggtctgcaggatcctaa

SEQ ID NO: 322256 - DNA, 25 bp, Rattus norvegicus
gaccgggaggtgcagtatctactca

SEQ ID NO: 322257 - DNA, 25 bp, Rattus norvegicus
gaccgggaggtggagtatctactca

SEQ ID NO: 322258 - DNA, 25 bp, Rattus norvegicus
gaccgggagtatagcaagggcccat

SEQ ID NO: 322259 - DNA, 25 bp, Rattus norvegicus
gaccgggagtattgcaagggcccat

SEQ ID NO: 322260 - DNA, 25 bp, Rattus norvegicus
gaccgggcacatcctgtacagttgg

SEQ ID NO: 322261 - DNA, 25 bp, Rattus norvegicus
gaccgggcacatgctgtacagttgg

SEQ ID NO: 322262 - DNA, 25 bp, Rattus norvegicus
gaccgggcactgcacgatagagaaa

SEQ ID NO: 322263 - DNA, 25 bp, Rattus norvegicus
gaccgggcactggacgatagagaaa

SEQ ID NO: 322264 - DNA, 25 bp, Rattus norvegicus
gaccgggcatgaccttgttgatgaa

SEQ ID NO: 322265 - DNA, 25 bp, Rattus norvegicus
gaccgggcatgagcttgttgatgaa

SEQ ID NO: 322266 - DNA, 25 bp, Rattus norvegicus
gaccgggccctgaggaagtacatga

SEQ ID NO: 322267 - DNA, 25 bp, Rattus norvegicus
gaccgggccctgtggaagtacatga

SEQ ID NO: 322268 - DNA, 25 bp, Rattus norvegicus
gaccgggcttgtcgaagatcagatt

SEQ ID NO: 322269 - DNA, 25 bp, Rattus norvegicus
gaccgggcttgtggaagatcagatt

SEQ ID NO: 322270 - DNA, 25 bp, Rattus norvegicus
gaccggtcaagtattttcgtgaatg

SEQ ID NO: 322271 - DNA, 25 bp, Rattus norvegicus
gaccggtcaagttttttcgtgaatg

SEQ ID NO: 322272 - DNA, 25 bp, Rattus norvegicus
gaccggtcttacactgtgatgtctt

SEQ ID NO: 322273 - DNA, 25 bp, Rattus norvegicus
gaccggtcttactctgtgatgtctt

SEQ ID NO: 322274 - DNA, 25 bp, Rattus norvegicus
gaccggtcttgcacagtactgcaga

SEQ ID NO: 322275 - DNA, 25 bp, Rattus norvegicus
gaccggtcttgctcagtactgcaga

SEQ ID NO: 322276 - DNA, 25 bp, Rattus norvegicus
gaccggtgtgagagtgagggagcgt

SEQ ID NO: 322277 - DNA, 25 bp, Rattus norvegicus
gaccggtgtgagtgtgagggagcgt

SEQ ID NO: 322278 - DNA, 25 bp, Rattus norvegicus
gaccggttaaggagcaaggcagcca

SEQ ID NO: 322279 - DNA, 25 bp, Rattus norvegicus
gaccggttaaggtgcaaggcagcca

SEQ ID NO: 322280 - DNA, 25 bp, Rattus norvegicus
gaccggttcttcatcagacaatgga

SEQ ID NO: 322281 - DNA, 25 bp, Rattus norvegicus
gaccggttcttcttcagacaatgga

SEQ ID NO: 322282 - DNA, 25 bp, Rattus norvegicus
gaccggttgataagagaggctcagt

SEQ ID NO: 322283 - DNA, 25 bp, Rattus norvegicus
gaccggttgatatgagaggctcagt

SEQ ID NO: 322284 - DNA, 25 bp, Rattus norvegicus
gaccggtttccactctggcagaatt

SEQ ID NO: 322285 - DNA, 25 bp, Rattus norvegicus
gaccggtttccagtctggcagaatt

SEQ ID NO: 322286 - DNA, 25 bp, Rattus norvegicus
gaccggttttcacgtacgacgctga

SEQ ID NO: 322287 - DNA, 25 bp, Rattus norvegicus
gaccggttttcaggtacgacgctga

SEQ ID NO: 322288 - DNA, 25 bp, Rattus norvegicus
gaccgtaaccagatttctttgctaa

SEQ ID NO: 322289 - DNA, 25 bp, Rattus norvegicus
gaccgtaaccagttttctttgctaa

SEQ ID NO: 322290 - DNA, 25 bp, Rattus norvegicus
gaccgtactgaacacattccctgtg

SEQ ID NO: 322291 - DNA, 25 bp, Rattus norvegicus
gaccgtactgaagacattccctgtg

SEQ ID NO: 322292 - DNA, 25 bp, Rattus norvegicus
gaccgtactgttctcaatgctgtaa

SEQ ID NO: 322293 - DNA, 25 bp, Rattus norvegicus
gaccgtactgttgtcaatgctgtaa

SEQ ID NO: 322294 - DNA, 25 bp, Rattus norvegicus
gaccgtacttacactctggatctag

SEQ ID NO: 322295 - DNA, 25 bp, Rattus norvegicus
gaccgtacttactctctggatctag

SEQ ID NO: 322296 - DNA, 25 bp, Rattus norvegicus
gaccgtagaatgaaaactgtgcagt

SEQ ID NO: 322297 - DNA, 25 bp, Rattus norvegicus
gaccgtagaatgtaaactgtgcagt

SEQ ID NO: 322298 - DNA, 25 bp, Rattus norvegicus
gaccgtagacgtactgaattaccat

SEQ ID NO: 322299 - DNA, 25 bp, Rattus norvegicus
gaccgtagacgttctgaattaccat

SEQ ID NO: 322300 - DNA, 25 bp, Rattus norvegicus
gaccgtagccgtcgtggaacacata

SEQ ID NO: 322301 - DNA, 25 bp, Rattus norvegicus
gaccgtagccgtggtggaacacata

SEQ ID NO: 322302 - DNA, 25 bp, Rattus norvegicus
gaccgtattaacaatttccaagcat

SEQ ID NO: 322303 - DNA, 25 bp, Rattus norvegicus
gaccgtattaactatttccaagcat

SEQ ID NO: 322304 - DNA, 25 bp, Rattus norvegicus
gaccgtattccaactccagaagatc

SEQ ID NO: 322305 - DNA, 25 bp, Rattus norvegicus
gaccgtattccatctccagaagatc

SEQ ID NO: 322306 - DNA, 25 bp, Rattus norvegicus
gaccgtatttcacctctacattcat

SEQ ID NO: 322307 - DNA, 25 bp, Rattus norvegicus
gaccgtatttcagctctacattcat

SEQ ID NO: 322308 - DNA, 25 bp, Rattus norvegicus
gaccgtcaaccacatgattgcccgg

SEQ ID NO: 322309 - DNA, 25 bp, Rattus norvegicus
gaccgtcaaccagatgattgcccgg

SEQ ID NO: 322310 - DNA, 25 bp, Rattus norvegicus
gaccgtcagtgtcgtcatctgatga

SEQ ID NO: 322311 - DNA, 25 bp, Rattus norvegicus
gaccgtcagtgtggtcatctgatga

SEQ ID NO: 322312 - DNA, 25 bp, Rattus norvegicus
gaccgtcatggaacttgctgtagtt

SEQ ID NO: 322313 - DNA, 25 bp, Rattus norvegicus
gaccgtcatggatcttgctgtagtt

SEQ ID NO: 322314 - DNA, 25 bp, Rattus norvegicus
gaccgtccagtgcatagtggctaga

SEQ ID NO: 322315 - DNA, 25 bp, Rattus norvegicus
gaccgtccagtggatagtggctaga

SEQ ID NO: 322316 - DNA, 25 bp, Rattus norvegicus
gaccgtccctgaaaaagtctggaag

SEQ ID NO: 322317 - DNA, 25 bp, Rattus norvegicus
gaccgtccctgataaagtctggaag

SEQ ID NO: 322318 - DNA, 25 bp, Rattus norvegicus
gaccgtcgctgtataacttgattca

SEQ ID NO: 322319 - DNA, 25 bp, Rattus norvegicus
gaccgtcgctgtttaacttgattca

SEQ ID NO: 322320 - DNA, 25 bp, Rattus norvegicus
gaccgtcgtggcatgtatgcgaaca

SEQ ID NO: 322321 - DNA, 25 bp, Rattus norvegicus
gaccgtcgtggcttgtatgcgaaca

SEQ ID NO: 322322 - DNA, 25 bp, Rattus norvegicus
gaccgtctaggaaagaaagtccgcg

SEQ ID NO: 322323 - DNA, 25 bp, Rattus norvegicus
gaccgtctaggatagaaagtccgcg

SEQ ID NO: 322324 - DNA, 25 bp, Rattus norvegicus
gaccgtctagtgattgactttcatt

SEQ ID NO: 322325 - DNA, 25 bp, Rattus norvegicus
gaccgtctagtgtttgactttcatt

SEQ ID NO: 322326 - DNA, 25 bp, Rattus norvegicus
gaccgtctgtaactatggtcccaga

SEQ ID NO: 322327 - DNA, 25 bp, Rattus norvegicus
gaccgtctgtaagtatggtcccaga

SEQ ID NO: 322328 - DNA, 25 bp, Rattus norvegicus
gaccgtctttaacatcagtcccgaa

SEQ ID NO: 322329 - DNA, 25 bp, Rattus norvegicus
gaccgtctttaagatcagtcccgaa

SEQ ID NO: 322330 - DNA, 25 bp, Rattus norvegicus
gaccgtctttctaggacacagtcat

SEQ ID NO: 322331 - DNA, 25 bp, Rattus norvegicus
gaccgtctttcttggacacagtcat

SEQ ID NO: 322332 - DNA, 25 bp, Rattus norvegicus
gaccgtgaacctctattttcagaag

SEQ ID NO: 322333 - DNA, 25 bp, Rattus norvegicus
gaccgtgaacctgtattttcagaag

SEQ ID NO: 322334 - DNA, 25 bp, Rattus norvegicus
gaccgtgaccttcctattacaaaga

SEQ ID NO: 322335 - DNA, 25 bp, Rattus norvegicus
gaccgtgaccttgctattacaaaga

SEQ ID NO: 322336 - DNA, 25 bp, Rattus norvegicus
gaccgtgatcagagtcctcaagcaa

SEQ ID NO: 322337 - DNA, 25 bp, Rattus norvegicus
gaccgtgatcagtgtcctcaagcaa

SEQ ID NO: 322338 - DNA, 25 bp, Rattus norvegicus
gaccgtgccaatctgctgtaagcgt

SEQ ID NO: 322339 - DNA, 25 bp, Rattus norvegicus
gaccgtgccaatgtgctgtaagcgt

SEQ ID NO: 322340 - DNA, 25 bp, Rattus norvegicus
gaccgtgccgtgacccgccagggaa

SEQ ID NO: 322341 - DNA, 25 bp, Rattus norvegicus
gaccgtgccgtgtcccgccagggaa

SEQ ID NO: 322342 - DNA, 25 bp, Rattus norvegicus
gaccgtgctgcccaaagtgtgatgt

SEQ ID NO: 322343 - DNA, 25 bp, Rattus norvegicus
gaccgtgctgccgaaagtgtgatgt

SEQ ID NO: 322344 - DNA, 25 bp, Rattus norvegicus
gaccgtgctttaacagagctgtttt

SEQ ID NO: 322345 - DNA, 25 bp, Rattus norvegicus
gaccgtgctttatcagagctgtttt

SEQ ID NO: 322346 - DNA, 25 bp, Rattus norvegicus
gaccgtgctttcaattgtacagagg

SEQ ID NO: 322347 - DNA, 25 bp, Rattus norvegicus
gaccgtgctttctattgtacagagg

SEQ ID NO: 322348 - DNA, 25 bp, Rattus norvegicus
gaccgtggcttccacagagtgcgca

SEQ ID NO: 322349 - DNA, 25 bp, Rattus norvegicus
gaccgtggcttcgacagagtgcgca

SEQ ID NO: 322350 - DNA, 25 bp, Rattus norvegicus
gaccgtgggacactgcagagaacaa

SEQ ID NO: 322351 - DNA, 25 bp, Rattus norvegicus
gaccgtgggacagtgcagagaacaa

SEQ ID NO: 322352 - DNA, 25 bp, Rattus norvegicus
gaccgtgggtacaggcttgtacaac

SEQ ID NO: 322353 - DNA, 25 bp, Rattus norvegicus
gaccgtgggtactggcttgtacaac

SEQ ID NO: 322354 - DNA, 25 bp, Rattus norvegicus
gaccgtgggtgtaaccaaatgcctg

SEQ ID NO: 322355 - DNA, 25 bp, Rattus norvegicus
gaccgtgggtgttaccaaatgcctg

SEQ ID NO: 322356 - DNA, 25 bp, Rattus norvegicus
gaccgtggtcgcacgaggtctcgat

SEQ ID NO: 322357 - DNA, 25 bp, Rattus norvegicus
gaccgtggtcgctcgaggtctcgat

SEQ ID NO: 322358 - DNA, 25 bp, Rattus norvegicus
gaccgtgtagctctggcagtctgta

SEQ ID NO: 322359 - DNA, 25 bp, Rattus norvegicus
gaccgtgtagctgtggcagtctgta

SEQ ID NO: 322360 - DNA, 25 bp, Rattus norvegicus
gaccgtgtcagtattctagtggaaa

SEQ ID NO: 322361 - DNA, 25 bp, Rattus norvegicus
gaccgtgtcagttttctagtggaaa

SEQ ID NO: 322362 - DNA, 25 bp, Rattus norvegicus
gaccgtgtccaaatttcttcttaca

SEQ ID NO: 322363 - DNA, 25 bp, Rattus norvegicus
gaccgtgtccaattttcttcttaca

SEQ ID NO: 322364 - DNA, 25 bp, Rattus norvegicus
gaccgtgtcctacagttctttttgg

SEQ ID NO: 322365 - DNA, 25 bp, Rattus norvegicus
gaccgtgtcctagagttctttttgg

SEQ ID NO: 322366 - DNA, 25 bp, Rattus norvegicus
gaccgtgtctggctggtgaattaaa

SEQ ID NO: 322367 - DNA, 25 bp, Rattus norvegicus
gaccgtgtctgggtggtgaattaaa

SEQ ID NO: 322368 - DNA, 25 bp, Rattus norvegicus
gaccgtgtgcaaagaatgccctttc

SEQ ID NO: 322369 - DNA, 25 bp, Rattus norvegicus
gaccgtgtgcaaagatgtccaccaa

SEQ ID NO: 322370 - DNA, 25 bp, Rattus norvegicus
gaccgtgtgcaatgaatgccctttc

SEQ ID NO: 322371 - DNA, 25 bp, Rattus norvegicus
gaccgtgtgcaatgatgtccaccaa

SEQ ID NO: 322372 - DNA, 25 bp, Rattus norvegicus
gaccgtgtttctccactgaatttct

SEQ ID NO: 322373 - DNA, 25 bp, Rattus norvegicus
gaccgtgtttctgcactgaatttct

SEQ ID NO: 322374 - DNA, 25 bp, Rattus norvegicus
gaccgtgtttttaatctgcctgttt

SEQ ID NO: 322375 - DNA, 25 bp, Rattus norvegicus
gaccgtgttttttatctgcctgttt

SEQ ID NO: 322376 - DNA, 25 bp, Rattus norvegicus
gaccgttaacaactgctgcggcaca

SEQ ID NO: 322377 - DNA, 25 bp, Rattus norvegicus
gaccgttaacaagtgctgcggcaca

SEQ ID NO: 322378 - DNA, 25 bp, Rattus norvegicus
gaccgttaagatcccagattctgca

SEQ ID NO: 322379 - DNA, 25 bp, Rattus norvegicus
gaccgttaagatgccagattctgca

SEQ ID NO: 322380 - DNA, 25 bp, Rattus norvegicus
gaccgttaatgcagattgttctcta

SEQ ID NO: 322381 - DNA, 25 bp, Rattus norvegicus
gaccgttaatgctgattgttctcta

SEQ ID NO: 322382 - DNA, 25 bp, Rattus norvegicus
gaccgttagaggagcatccacctaa

SEQ ID NO: 322383 - DNA, 25 bp, Rattus norvegicus
gaccgttagaggtgcatccacctaa

SEQ ID NO: 322384 - DNA, 25 bp, Rattus norvegicus
gaccgttagctcagtagaaatcaga

SEQ ID NO: 322385 - DNA, 25 bp, Rattus norvegicus
gaccgttagctctgtagaaatcaga

SEQ ID NO: 322386 - DNA, 25 bp, Rattus norvegicus
gaccgttatgatcgcatggcctgca

SEQ ID NO: 322387 - DNA, 25 bp, Rattus norvegicus
gaccgttatgatggcatggcctgca

SEQ ID NO: 322388 - DNA, 25 bp, Rattus norvegicus
gaccgttcatctatgttctgaggga

SEQ ID NO: 322389 - DNA, 25 bp, Rattus norvegicus
gaccgttcatctttgttctgaggga

SEQ ID NO: 322390 - DNA, 25 bp, Rattus norvegicus
gaccgttctacacatgccagtggaa

SEQ ID NO: 322391 - DNA, 25 bp, Rattus norvegicus
gaccgttctacagatgccagtggaa

SEQ ID NO: 322392 - DNA, 25 bp, Rattus norvegicus
gaccgttgacacaattcagctgagt

SEQ ID NO: 322393 - DNA, 25 bp, Rattus norvegicus
gaccgttgacactattcagctgagt

SEQ ID NO: 322394 - DNA, 25 bp, Rattus norvegicus
gaccgttgtcaacattcagtccctt

SEQ ID NO: 322395 - DNA, 25 bp, Rattus norvegicus
gaccgttgtcaagattcagtccctt

SEQ ID NO: 322396 - DNA, 25 bp, Rattus norvegicus
gaccgtttatgaatgttgctcccat

SEQ ID NO: 322397 - DNA, 25 bp, Rattus norvegicus
gaccgtttatgattgttgctcccat

SEQ ID NO: 322398 - DNA, 25 bp, Rattus norvegicus
gaccgtttcttcatgtggattttct

SEQ ID NO: 322399 - DNA, 25 bp, Rattus norvegicus
gaccgtttcttcttgtggattttct

SEQ ID NO: 322400 - DNA, 25 bp, Rattus norvegicus
gaccgtttgtgcatatcctggaagt

SEQ ID NO: 322401 - DNA, 25 bp, Rattus norvegicus
gaccgtttgtgcttatcctggaagt

SEQ ID NO: 322402 - DNA, 25 bp, Rattus norvegicus
gaccgttttacaaaggatgattccg

SEQ ID NO: 322403 - DNA, 25 bp, Rattus norvegicus
gaccgttttacataggatgattccg

SEQ ID NO: 322404 - DNA, 25 bp, Rattus norvegicus
gacctaaaggagagtggctgtgata

SEQ ID NO: 322405 - DNA, 25 bp, Rattus norvegicus
gacctaaaggagtgtggctgtgata

SEQ ID NO: 322406 - DNA, 25 bp, Rattus norvegicus
gacctaaaggccatgcttcatcaac

SEQ ID NO: 322407 - DNA, 25 bp, Rattus norvegicus
gacctaaaggccttgcttcatcaac

SEQ ID NO: 322408 - DNA, 25 bp, Rattus norvegicus
gacctaacaaggcatgtagtctcat

SEQ ID NO: 322409 - DNA, 25 bp, Rattus norvegicus
gacctaacaagggatgtagtctcat

SEQ ID NO: 322410 - DNA, 25 bp, Rattus norvegicus
gacctaaccataacattgtcagttc

SEQ ID NO: 322411 - DNA, 25 bp, Rattus norvegicus
gacctaaccatatcattgtcagttc

SEQ ID NO: 322412 - DNA, 25 bp, Rattus norvegicus
gacctaagatctcagtaaggacctg

SEQ ID NO: 322413 - DNA, 25 bp, Rattus norvegicus
gacctaagatctgagtaaggacctg

SEQ ID NO: 322414 - DNA, 25 bp, Rattus norvegicus
gacctaaggcgcatgggttccagga

SEQ ID NO: 322415 - DNA, 25 bp, Rattus norvegicus
gacctaaggcgcttgggttccagga

SEQ ID NO: 322416 - DNA, 25 bp, Rattus norvegicus
gacctaaggctgaggaggcagtcct

SEQ ID NO: 322417 - DNA, 25 bp, Rattus norvegicus
gacctaaggctgtggaggcagtcct

SEQ ID NO: 322418 - DNA, 25 bp, Rattus norvegicus
gacctaagggttagtatgattccag

SEQ ID NO: 322419 - DNA, 25 bp, Rattus norvegicus
gacctaagggttcactgtgttcaga

SEQ ID NO: 322420 - DNA, 25 bp, Rattus norvegicus
gacctaagggttgactgtgttcaga

SEQ ID NO: 322421 - DNA, 25 bp, Rattus norvegicus
gacctaagggtttgtatgattccag

SEQ ID NO: 322422 - DNA, 25 bp, Rattus norvegicus
gacctaagtgcactcagtccttggg

SEQ ID NO: 322423 - DNA, 25 bp, Rattus norvegicus
gacctaagtgcagtcagtccttggg

SEQ ID NO: 322424 - DNA, 25 bp, Rattus norvegicus
gacctaagtgccatttcatcgtgtg

SEQ ID NO: 322425 - DNA, 25 bp, Rattus norvegicus
gacctaagtgccttttcatcgtgtg

SEQ ID NO: 322426 - DNA, 25 bp, Rattus norvegicus
gacctaagttatattgctgtcccgt

SEQ ID NO: 322427 - DNA, 25 bp, Rattus norvegicus
gacctaagttattttgctgtcccgt

SEQ ID NO: 322428 - DNA, 25 bp, Rattus norvegicus
gacctaagtttaatcccatgaccac

SEQ ID NO: 322429 - DNA, 25 bp, Rattus norvegicus
gacctaagtttattcccatgaccac

SEQ ID NO: 322430 - DNA, 25 bp, Rattus norvegicus
gacctaatggaacccctggagtata

SEQ ID NO: 322431 - DNA, 25 bp, Rattus norvegicus
gacctaatggaagccctggagtata

SEQ ID NO: 322432 - DNA, 25 bp, Rattus norvegicus
gacctaatggttcagttatcttctt

SEQ ID NO: 322433 - DNA, 25 bp, Rattus norvegicus
gacctaatggttgagttatcttctt

SEQ ID NO: 322434 - DNA, 25 bp, Rattus norvegicus
gacctaatgtccattcacaatgctg

SEQ ID NO: 322435 - DNA, 25 bp, Rattus norvegicus
gacctaatgtcctttcacaatgctg

SEQ ID NO: 322436 - DNA, 25 bp, Rattus norvegicus
gacctacaagtcatacagagcccag

SEQ ID NO: 322437 - DNA, 25 bp, Rattus norvegicus
gacctacaagtcttacagagcccag

SEQ ID NO: 322438 - DNA, 25 bp, Rattus norvegicus
gacctacacactatggtgtctgaca

SEQ ID NO: 322439 - DNA, 25 bp, Rattus norvegicus
gacctacacactttggtgtctgaca

SEQ ID NO: 322440 - DNA, 25 bp, Rattus norvegicus
gacctacagaatatacctctcaaaa

SEQ ID NO: 322441 - DNA, 25 bp, Rattus norvegicus
gacctacagaatttacctctcaaaa

SEQ ID NO: 322442 - DNA, 25 bp, Rattus norvegicus
gacctacagataactcatcctcatt

SEQ ID NO: 322443 - DNA, 25 bp, Rattus norvegicus
gacctacagatatctcatcctcatt

SEQ ID NO: 322444 - DNA, 25 bp, Rattus norvegicus
gacctacagtttatcatctacctta

SEQ ID NO: 322445 - DNA, 25 bp, Rattus norvegicus
gacctacagtttttcatctacctta

SEQ ID NO: 322446 - DNA, 25 bp, Rattus norvegicus
gacctacatagtacagatcctactg

SEQ ID NO: 322447 - DNA, 25 bp, Rattus norvegicus
gacctacatagttcagatcctactg

SEQ ID NO: 322448 - DNA, 25 bp, Rattus norvegicus
gacctacatgcgagccatagagcat

SEQ ID NO: 322449 - DNA, 25 bp, Rattus norvegicus
gacctacatgcgtgccatagagcat

SEQ ID NO: 322450 - DNA, 25 bp, Rattus norvegicus
gacctacatgtcagcagtttactac

SEQ ID NO: 322451 - DNA, 25 bp, Rattus norvegicus
gacctacatgtctgcagtttactac

SEQ ID NO: 322452 - DNA, 25 bp, Rattus norvegicus
gacctacatttcaacaagacctctg

SEQ ID NO: 322453 - DNA, 25 bp, Rattus norvegicus
gacctacatttctacaagacctctg

SEQ ID NO: 322454 - DNA, 25 bp, Rattus norvegicus
gacctaccactcactaaggtggttt

SEQ ID NO: 322455 - DNA, 25 bp, Rattus norvegicus
gacctaccactctctaaggtggttt

SEQ ID NO: 322456 - DNA, 25 bp, Rattus norvegicus
gacctaccccaacctttgtgatgga

SEQ ID NO: 322457 - DNA, 25 bp, Rattus norvegicus
gacctaccccaagctttgtgatgga

SEQ ID NO: 322458 - DNA, 25 bp, Rattus norvegicus
gacctaccttgtcccattgtagagg

SEQ ID NO: 322459 - DNA, 25 bp, Rattus norvegicus
gacctaccttgtgccattgtagagg

SEQ ID NO: 322460 - DNA, 25 bp, Rattus norvegicus
gacctacggaatcagaaacgcctct

SEQ ID NO: 322461 - DNA, 25 bp, Rattus norvegicus
gacctacggaatgagaaacgcctct

SEQ ID NO: 322462 - DNA, 25 bp, Rattus norvegicus
gacctactgactcacagccattaaa

SEQ ID NO: 322463 - DNA, 25 bp, Rattus norvegicus
gacctactgactgacagccattaaa

SEQ ID NO: 322464 - DNA, 25 bp, Rattus norvegicus
gacctactgtcaaaagatatatcaa

SEQ ID NO: 322465 - DNA, 25 bp, Rattus norvegicus
gacctactgtcataagatatatcaa

SEQ ID NO: 322466 - DNA, 25 bp, Rattus norvegicus
gacctacttctcacacattgatgta

SEQ ID NO: 322467 - DNA, 25 bp, Rattus norvegicus
gacctacttctctcacattgatgta

SEQ ID NO: 322468 - DNA, 25 bp, Rattus norvegicus
gacctacttgccatcttcaagatag

SEQ ID NO: 322469 - DNA, 25 bp, Rattus norvegicus
gacctacttgccttcttcaagatag

SEQ ID NO: 322470 - DNA, 25 bp, Rattus norvegicus
gacctactttgacagttctagccat

SEQ ID NO: 322471 - DNA, 25 bp, Rattus norvegicus
gacctactttgagagttctagccat

SEQ ID NO: 322472 - DNA, 25 bp, Rattus norvegicus
gacctactttggagattgttgtacc

SEQ ID NO: 322473 - DNA, 25 bp, Rattus norvegicus
gacctactttggtgattgttgtacc

SEQ ID NO: 322474 - DNA, 25 bp, Rattus norvegicus
gacctagaacccctgcggtgaagga

SEQ ID NO: 322475 - DNA, 25 bp, Rattus norvegicus
gacctagaacccgtgcggtgaagga

SEQ ID NO: 322476 - DNA, 25 bp, Rattus norvegicus
gacctagaacgtcatttagccttca

SEQ ID NO: 322477 - DNA, 25 bp, Rattus norvegicus
gacctagaacgtgatttagccttca

SEQ ID NO: 322478 - DNA, 25 bp, Rattus norvegicus
gacctagaactgcaccactctggaa

SEQ ID NO: 322479 - DNA, 25 bp, Rattus norvegicus
gacctagaactggaccactctggaa

SEQ ID NO: 322480 - DNA, 25 bp, Rattus norvegicus
gacctagaacttcgtgtttagccta

SEQ ID NO: 322481 - DNA, 25 bp, Rattus norvegicus
gacctagaacttggtgtttagccta

SEQ ID NO: 322482 - DNA, 25 bp, Rattus norvegicus
gacctagaagacaatgtggcccgcc

SEQ ID NO: 322483 - DNA, 25 bp, Rattus norvegicus
gacctagaagactatgtggcccgcc

SEQ ID NO: 322484 - DNA, 25 bp, Rattus norvegicus
gacctagacttcatcattggtgatg

SEQ ID NO: 322485 - DNA, 25 bp, Rattus norvegicus
gacctagacttcttcattggtgatg

SEQ ID NO: 322486 - DNA, 25 bp, Rattus norvegicus
gacctagagcggcttactgactatg

SEQ ID NO: 322487 - DNA, 25 bp, Rattus norvegicus
gacctagagcgggttactgactatg

SEQ ID NO: 322488 - DNA, 25 bp, Rattus norvegicus
gacctagatctgatgttgtagtata

SEQ ID NO: 322489 - DNA, 25 bp, Rattus norvegicus
gacctagatctgttgttgtagtata

SEQ ID NO: 322490 - DNA, 25 bp, Rattus norvegicus
gacctagatgtaaaaccacccacaa

SEQ ID NO: 322491 - DNA, 25 bp, Rattus norvegicus
gacctagatgtataaccacccacaa

SEQ ID NO: 322492 - DNA, 25 bp, Rattus norvegicus
gacctagattcaaacgtgtttctga

SEQ ID NO: 322493 - DNA, 25 bp, Rattus norvegicus
gacctagattcatacgtgtttctga

SEQ ID NO: 322494 - DNA, 25 bp, Rattus norvegicus
gacctagcaaggaggccagtgccta

SEQ ID NO: 322495 - DNA, 25 bp, Rattus norvegicus
gacctagcaaggtggccagtgccta

SEQ ID NO: 322496 - DNA, 25 bp, Rattus norvegicus
gacctagcaggtcacattgctgacc

SEQ ID NO: 322497 - DNA, 25 bp, Rattus norvegicus
gacctagcaggtgacattgctgacc

SEQ ID NO: 322498 - DNA, 25 bp, Rattus norvegicus
gacctagcagtgagcatctcgggct

SEQ ID NO: 322499 - DNA, 25 bp, Rattus norvegicus
gacctagcagtgtgcatctcgggct

SEQ ID NO: 322500 - DNA, 25 bp, Rattus norvegicus
gacctagccggacctggcgcattag

SEQ ID NO: 322501 - DNA, 25 bp, Rattus norvegicus
gacctagccggagctggcgcattag

SEQ ID NO: 322502 - DNA, 25 bp, Rattus norvegicus
gacctagcctgcagggtgctgtgca

SEQ ID NO: 322503 - DNA, 25 bp, Rattus norvegicus
gacctagcctgctgggtgctgtgca

SEQ ID NO: 322504 - DNA, 25 bp, Rattus norvegicus
gacctagctggtccccacagttgaa

SEQ ID NO: 322505 - DNA, 25 bp, Rattus norvegicus
gacctagctggtgcccacagttgaa

SEQ ID NO: 322506 - DNA, 25 bp, Rattus norvegicus
gacctaggattgcttccctgaacca

SEQ ID NO: 322507 - DNA, 25 bp, Rattus norvegicus
gacctaggattggttccctgaacca

SEQ ID NO: 322508 - DNA, 25 bp, Rattus norvegicus
gacctagggcacatggataccattg

SEQ ID NO: 322509 - DNA, 25 bp, Rattus norvegicus
gacctagggcacttggataccattg

SEQ ID NO: 322510 - DNA, 25 bp, Rattus norvegicus
gacctaggttttaccaagtctgcct

SEQ ID NO: 322511 - DNA, 25 bp, Rattus norvegicus
gacctaggtttttccaagtctgcct

SEQ ID NO: 322512 - DNA, 25 bp, Rattus norvegicus
gacctagtcatgatctactgccaga

SEQ ID NO: 322513 - DNA, 25 bp, Rattus norvegicus
gacctagtcatgttctactgccaga

SEQ ID NO: 322514 - DNA, 25 bp, Rattus norvegicus
gacctagtccagacagtgcgattct

SEQ ID NO: 322515 - DNA, 25 bp, Rattus norvegicus
gacctagtccagtcagtgcgattct

SEQ ID NO: 322516 - DNA, 25 bp, Rattus norvegicus
gacctagtcctgagtgttcgaatcc

SEQ ID NO: 322517 - DNA, 25 bp, Rattus norvegicus
gacctagtcctgtgtgttcgaatcc

SEQ ID NO: 322518 - DNA, 25 bp, Rattus norvegicus
gacctagtctagatgcctgcagtac

SEQ ID NO: 322519 - DNA, 25 bp, Rattus norvegicus
gacctagtctagttgcctgcagtac

SEQ ID NO: 322520 - DNA, 25 bp, Rattus norvegicus
gacctagtgtggatctcagatgaaa

SEQ ID NO: 322521 - DNA, 25 bp, Rattus norvegicus
gacctagtgtggttctcagatgaaa

SEQ ID NO: 322522 - DNA, 25 bp, Rattus norvegicus
gacctagttgtgctcacacggcaaa

SEQ ID NO: 322523 - DNA, 25 bp, Rattus norvegicus
gacctagttgtggtcacacggcaaa

SEQ ID NO: 322524 - DNA, 25 bp, Rattus norvegicus
gacctagttttcacatatgaatcag

SEQ ID NO: 322525 - DNA, 25 bp, Rattus norvegicus
gacctagttttctcatatgaatcag

SEQ ID NO: 322526 - DNA, 25 bp, Rattus norvegicus
gacctataagcacttcaaacccaga

SEQ ID NO: 322527 - DNA, 25 bp, Rattus norvegicus
gacctataagcagttcaaacccaga

SEQ ID NO: 322528 - DNA, 25 bp, Rattus norvegicus
gacctatacatcctcaagcatgact

SEQ ID NO: 322529 - DNA, 25 bp, Rattus norvegicus
gacctatacatcgtcaagcatgact

SEQ ID NO: 322530 - DNA, 25 bp, Rattus norvegicus
gacctataggtaagccgggcctggt

SEQ ID NO: 322531 - DNA, 25 bp, Rattus norvegicus
gacctataggtatgccgggcctggt

SEQ ID NO: 322532 - DNA, 25 bp, Rattus norvegicus
gacctatcatctaggtgctgagaac

SEQ ID NO: 322533 - DNA, 25 bp, Rattus norvegicus
gacctatcatcttggtgctgagaac

SEQ ID NO: 322534 - DNA, 25 bp, Rattus norvegicus
gacctatctgacctgcctcatgatg

SEQ ID NO: 322535 - DNA, 25 bp, Rattus norvegicus
gacctatctgacgtgcctcatgatg

SEQ ID NO: 322536 - DNA, 25 bp, Rattus norvegicus
gacctatctgcaattgagtcctcaa

SEQ ID NO: 322537 - DNA, 25 bp, Rattus norvegicus
gacctatctgcatttgagtcctcaa

SEQ ID NO: 322538 - DNA, 25 bp, Rattus norvegicus
gacctatctgttccacttggttagc

SEQ ID NO: 322539 - DNA, 25 bp, Rattus norvegicus
gacctatctgttgcacttggttagc

SEQ ID NO: 322540 - DNA, 25 bp, Rattus norvegicus
gacctatcttcacctggaagtctat

SEQ ID NO: 322541 - DNA, 25 bp, Rattus norvegicus
gacctatcttcagctggaagtctat

SEQ ID NO: 322542 - DNA, 25 bp, Rattus norvegicus
gacctatgaactctttgccactgga

SEQ ID NO: 322543 - DNA, 25 bp, Rattus norvegicus
gacctatgaactgtttgccactgga

SEQ ID NO: 322544 - DNA, 25 bp, Rattus norvegicus
gacctatgagctctgtcactgatat

SEQ ID NO: 322545 - DNA, 25 bp, Rattus norvegicus
gacctatgagctgtgtcactgatat

SEQ ID NO: 322546 - DNA, 25 bp, Rattus norvegicus
gacctatgagtcactgtgggagcta

SEQ ID NO: 322547 - DNA, 25 bp, Rattus norvegicus
gacctatgagtctctgtgggagcta

SEQ ID NO: 322548 - DNA, 25 bp, Rattus norvegicus
gacctatgcttgcatgcagggagta

SEQ ID NO: 322549 - DNA, 25 bp, Rattus norvegicus
gacctatgcttggatgcagggagta

SEQ ID NO: 322550 - DNA, 25 bp, Rattus norvegicus
gacctatggctccatctgcatgtgt

SEQ ID NO: 322551 - DNA, 25 bp, Rattus norvegicus
gacctatggctcgatctgcatgtgt

SEQ ID NO: 322552 - DNA, 25 bp, Rattus norvegicus
gacctatggctgaaactgtttggaa

SEQ ID NO: 322553 - DNA, 25 bp, Rattus norvegicus
gacctatggctgtaactgtttggaa

SEQ ID NO: 322554 - DNA, 25 bp, Rattus norvegicus
gacctatgtaagaacggcctgacca

SEQ ID NO: 322555 - DNA, 25 bp, Rattus norvegicus
gacctatgtaagtacggcctgacca

SEQ ID NO: 322556 - DNA, 25 bp, Rattus norvegicus
gacctatgtatgatggtgcatgtct

SEQ ID NO: 322557 - DNA, 25 bp, Rattus norvegicus
gacctatgtatgttggtgcatgtct

SEQ ID NO: 322558 - DNA, 25 bp, Rattus norvegicus
gacctatgtggccattggatcctag

SEQ ID NO: 322559 - DNA, 25 bp, Rattus norvegicus
gacctatgtggcgattggatcctag

SEQ ID NO: 322560 - DNA, 25 bp, Rattus norvegicus
gacctatgtggtcctctgtagatac

SEQ ID NO: 322561 - DNA, 25 bp, Rattus norvegicus
gacctatgtggtgctctgtagatac

SEQ ID NO: 322562 - DNA, 25 bp, Rattus norvegicus
gacctatgttaaattctccagtgaa

SEQ ID NO: 322563 - DNA, 25 bp, Rattus norvegicus
gacctatgttaatttctccagtgaa

SEQ ID NO: 322564 - DNA, 25 bp, Rattus norvegicus
gacctattacttcatgggaccgtag

SEQ ID NO: 322565 - DNA, 25 bp, Rattus norvegicus
gacctattacttgatgggaccgtag

SEQ ID NO: 322566 - DNA, 25 bp, Rattus norvegicus
gacctattctctacagttaatgtat

SEQ ID NO: 322567 - DNA, 25 bp, Rattus norvegicus
gacctattctcttcagttaatgtat

SEQ ID NO: 322568 - DNA, 25 bp, Rattus norvegicus
gacctattctggatctctcactacg

SEQ ID NO: 322569 - DNA, 25 bp, Rattus norvegicus
gacctattctggttctctcactacg

SEQ ID NO: 322570 - DNA, 25 bp, Rattus norvegicus
gacctattgtggactttgacacttt

SEQ ID NO: 322571 - DNA, 25 bp, Rattus norvegicus
gacctattgtggtctttgacacttt

SEQ ID NO: 322572 - DNA, 25 bp, Rattus norvegicus
gacctatttttgcttatactcagaa

SEQ ID NO: 322573 - DNA, 25 bp, Rattus norvegicus
gacctatttttggttatactcagaa

SEQ ID NO: 322574 - DNA, 25 bp, Rattus norvegicus
gacctcaagagcactaacatcctag

SEQ ID NO: 322575 - DNA, 25 bp, Rattus norvegicus
gacctcaagagctctaacatcctag

SEQ ID NO: 322576 - DNA, 25 bp, Rattus norvegicus
gacctcaaggtgagtcctccaggag

SEQ ID NO: 322577 - DNA, 25 bp, Rattus norvegicus
gacctcaaggtgtgtcctccaggag

SEQ ID NO: 322578 - DNA, 25 bp, Rattus norvegicus
gacctcaagtcccaaatgcctgtga

SEQ ID NO: 322579 - DNA, 25 bp, Rattus norvegicus
gacctcaagtccgaaatgcctgtga

SEQ ID NO: 322580 - DNA, 25 bp, Rattus norvegicus
gacctcacaacaaagtctgataagt

SEQ ID NO: 322581 - DNA, 25 bp, Rattus norvegicus
gacctcacaacatagtctgataagt

SEQ ID NO: 322582 - DNA, 25 bp, Rattus norvegicus
gacctcacactgacaggattctaga

SEQ ID NO: 322583 - DNA, 25 bp, Rattus norvegicus
gacctcacactgtcaggattctaga

SEQ ID NO: 322584 - DNA, 25 bp, Rattus norvegicus
gacctcacagagcaggagttccgca

SEQ ID NO: 322585 - DNA, 25 bp, Rattus norvegicus
gacctcacagaggaggagttccgca

SEQ ID NO: 322586 - DNA, 25 bp, Rattus norvegicus
gacctcacatccacttaaacaatag

SEQ ID NO: 322587 - DNA, 25 bp, Rattus norvegicus
gacctcacatcctcttaaacaatag

SEQ ID NO: 322588 - DNA, 25 bp, Rattus norvegicus
gacctcacccacaagggtgtcgggt

SEQ ID NO: 322589 - DNA, 25 bp, Rattus norvegicus
gacctcacccactagggtgtcgggt

SEQ ID NO: 322590 - DNA, 25 bp, Rattus norvegicus
gacctcacgcccaaggagagtggca

SEQ ID NO: 322591 - DNA, 25 bp, Rattus norvegicus
gacctcacgccctaggagagtggca

SEQ ID NO: 322592 - DNA, 25 bp, Rattus norvegicus
gacctcacggcgaccaacaaggtgt

SEQ ID NO: 322593 - DNA, 25 bp, Rattus norvegicus
gacctcacggcgtccaacaaggtgt

SEQ ID NO: 322594 - DNA, 25 bp, Rattus norvegicus
gacctcactcctcacagaacaggaa

SEQ ID NO: 322595 - DNA, 25 bp, Rattus norvegicus
gacctcactcctgacagaacaggaa

SEQ ID NO: 322596 - DNA, 25 bp, Rattus norvegicus
gacctcactctacctatttgtttgt

SEQ ID NO: 322597 - DNA, 25 bp, Rattus norvegicus
gacctcactctagctatttgtttgt

SEQ ID NO: 322598 - DNA, 25 bp, Rattus norvegicus
gacctcactgacaaccttatgaaga

SEQ ID NO: 322599 - DNA, 25 bp, Rattus norvegicus
gacctcactgactaccttatgaaga

SEQ ID NO: 322600 - DNA, 25 bp, Rattus norvegicus
gacctcactgagctcttctgaaggg

SEQ ID NO: 322601 - DNA, 25 bp, Rattus norvegicus
gacctcactgaggtcttctgaaggg

SEQ ID NO: 322602 - DNA, 25 bp, Rattus norvegicus
gacctcactttgcaaattgggctct

SEQ ID NO: 322603 - DNA, 25 bp, Rattus norvegicus
gacctcactttggaaattgggctct

SEQ ID NO: 322604 - DNA, 25 bp, Rattus norvegicus
gacctcagacgtcaacctgtcattg

SEQ ID NO: 322605 - DNA, 25 bp, Rattus norvegicus
gacctcagacgtgaacctgtcattg

SEQ ID NO: 322606 - DNA, 25 bp, Rattus norvegicus
gacctcagagctcttcttagtttaa

SEQ ID NO: 322607 - DNA, 25 bp, Rattus norvegicus
gacctcagagctgttcttagtttaa

SEQ ID NO: 322608 - DNA, 25 bp, Rattus norvegicus
gacctcagagttccctggacagcca

SEQ ID NO: 322609 - DNA, 25 bp, Rattus norvegicus
gacctcagagttgcctggacagcca

SEQ ID NO: 322610 - DNA, 25 bp, Rattus norvegicus
gacctcagatgacttgttttccaga

SEQ ID NO: 322611 - DNA, 25 bp, Rattus norvegicus
gacctcagatgagttgttttccaga

SEQ ID NO: 322612 - DNA, 25 bp, Rattus norvegicus
gacctcagcgagaacaacatgctgt

SEQ ID NO: 322613 - DNA, 25 bp, Rattus norvegicus
gacctcagcgagtacaacatgctgt

SEQ ID NO: 322614 - DNA, 25 bp, Rattus norvegicus
gacctcagcgatactcaattaatgg

SEQ ID NO: 322615 - DNA, 25 bp, Rattus norvegicus
gacctcagcgattctcaattaatgg

SEQ ID NO: 322616 - DNA, 25 bp, Rattus norvegicus
gacctcagcggtctgttacaaagca

SEQ ID NO: 322617 - DNA, 25 bp, Rattus norvegicus
gacctcagcggtgtgttacaaagca

SEQ ID NO: 322618 - DNA, 25 bp, Rattus norvegicus
gacctcagcttccttgatgatgtca

SEQ ID NO: 322619 - DNA, 25 bp, Rattus norvegicus
gacctcagcttcgttgatgatgtca

SEQ ID NO: 322620 - DNA, 25 bp, Rattus norvegicus
gacctcaggaggagcattcttttga

SEQ ID NO: 322621 - DNA, 25 bp, Rattus norvegicus
gacctcaggaggtgcattcttttga

SEQ ID NO: 322622 - DNA, 25 bp, Rattus norvegicus
gacctcaggcccatggcttttaata

SEQ ID NO: 322623 - DNA, 25 bp, Rattus norvegicus
gacctcaggcccttggcttttaata

SEQ ID NO: 322624 - DNA, 25 bp, Rattus norvegicus
gacctcaggcctcgcgaagacacag

SEQ ID NO: 322625 - DNA, 25 bp, Rattus norvegicus
gacctcaggcctggcgaagacacag

SEQ ID NO: 322626 - DNA, 25 bp, Rattus norvegicus
gacctcaggtcaaagttcttaaatg

SEQ ID NO: 322627 - DNA, 25 bp, Rattus norvegicus
gacctcaggtcaattgacttggtag

SEQ ID NO: 322628 - DNA, 25 bp, Rattus norvegicus
gacctcaggtcatagttcttaaatg

SEQ ID NO: 322629 - DNA, 25 bp, Rattus norvegicus
gacctcaggtcatttgacttggtag

SEQ ID NO: 322630 - DNA, 25 bp, Rattus norvegicus
gacctcaggtctctccctggccatg

SEQ ID NO: 322631 - DNA, 25 bp, Rattus norvegicus
gacctcaggtctgtccctggccatg

SEQ ID NO: 322632 - DNA, 25 bp, Rattus norvegicus
gacctcaggtgtactaggctaaaac

SEQ ID NO: 322633 - DNA, 25 bp, Rattus norvegicus
gacctcaggtgttctaggctaaaac

SEQ ID NO: 322634 - DNA, 25 bp, Rattus norvegicus
gacctcagtcatcatccttttaaac

SEQ ID NO: 322635 - DNA, 25 bp, Rattus norvegicus
gacctcagtcatgatccttttaaac

SEQ ID NO: 322636 - DNA, 25 bp, Rattus norvegicus
gacctcagtggaatttatcggcatc

SEQ ID NO: 322637 - DNA, 25 bp, Rattus norvegicus
gacctcagtggattttatcggcatc

SEQ ID NO: 322638 - DNA, 25 bp, Rattus norvegicus
gacctcagtggccatcttggcacct

SEQ ID NO: 322639 - DNA, 25 bp, Rattus norvegicus
gacctcagtggcgatcttggcacct

SEQ ID NO: 322640 - DNA, 25 bp, Rattus norvegicus
gacctcagtgtacagctatccgtgt

SEQ ID NO: 322641 - DNA, 25 bp, Rattus norvegicus
gacctcagtgtagagctatccgtgt

SEQ ID NO: 322642 - DNA, 25 bp, Rattus norvegicus
gacctcagttaaatcctgggatcca

SEQ ID NO: 322643 - DNA, 25 bp, Rattus norvegicus
gacctcagttaattcctgggatcca

SEQ ID NO: 322644 - DNA, 25 bp, Rattus norvegicus
gacctcatcttccagaaagccattt

SEQ ID NO: 322645 - DNA, 25 bp, Rattus norvegicus
gacctcatcttcgagaaagccattt

SEQ ID NO: 322646 - DNA, 25 bp, Rattus norvegicus
gacctcatggatattcctttatgtg

SEQ ID NO: 322647 - DNA, 25 bp, Rattus norvegicus
gacctcatggattttcctttatgtg

SEQ ID NO: 322648 - DNA, 25 bp, Rattus norvegicus
gacctcatgtgcaacagacagtttg

SEQ ID NO: 322649 - DNA, 25 bp, Rattus norvegicus
gacctcatgtgctacagacagtttg

SEQ ID NO: 322650 - DNA, 25 bp, Rattus norvegicus
gacctcatttaaacataatccttat

SEQ ID NO: 322651 - DNA, 25 bp, Rattus norvegicus
gacctcatttaatcataatccttat

SEQ ID NO: 322652 - DNA, 25 bp, Rattus norvegicus
gacctcatttggaacatgtgcccac

SEQ ID NO: 322653 - DNA, 25 bp, Rattus norvegicus
gacctcatttggtacatgtgcccac

SEQ ID NO: 322654 - DNA, 25 bp, Rattus norvegicus
gacctccaagatctcctcaatgttg

SEQ ID NO: 322655 - DNA, 25 bp, Rattus norvegicus
gacctccaagatgtcctcaatgttg

SEQ ID NO: 322656 - DNA, 25 bp, Rattus norvegicus
gacctccacagactcaaacgttatt

SEQ ID NO: 322657 - DNA, 25 bp, Rattus norvegicus
gacctccacagagtcaaacgttatt

SEQ ID NO: 322658 - DNA, 25 bp, Rattus norvegicus
gacctccagataccgacgagtcagt

SEQ ID NO: 322659 - DNA, 25 bp, Rattus norvegicus
gacctccagatagcgacgagtcagt

SEQ ID NO: 322660 - DNA, 25 bp, Rattus norvegicus
gacctccagcaaacctatttaatgt

SEQ ID NO: 322661 - DNA, 25 bp, Rattus norvegicus
gacctccagcaatcctatttaatgt

SEQ ID NO: 322662 - DNA, 25 bp, Rattus norvegicus
gacctccaggagaccatgagcacag

SEQ ID NO: 322663 - DNA, 25 bp, Rattus norvegicus
gacctccaggagtccatgagcacag

SEQ ID NO: 322664 - DNA, 25 bp, Rattus norvegicus
gacctccagggaaaagaactaatgc

SEQ ID NO: 322665 - DNA, 25 bp, Rattus norvegicus
gacctccagggataagaactaatgc

SEQ ID NO: 322666 - DNA, 25 bp, Rattus norvegicus
gacctccatcttatctagcaagtag

SEQ ID NO: 322667 - DNA, 25 bp, Rattus norvegicus
gacctccatcttttctagcaagtag

SEQ ID NO: 322668 - DNA, 25 bp, Rattus norvegicus
gacctccatgagcaccatatgtgca

SEQ ID NO: 322669 - DNA, 25 bp, Rattus norvegicus
gacctccatgaggaccatatgtgca

SEQ ID NO: 322670 - DNA, 25 bp, Rattus norvegicus
gacctccatgtgagttgtcatacat

SEQ ID NO: 322671 - DNA, 25 bp, Rattus norvegicus
gacctccatgtgtgttgtcatacat

SEQ ID NO: 322672 - DNA, 25 bp, Rattus norvegicus
gacctcccaatgatgttactgactg

SEQ ID NO: 322673 - DNA, 25 bp, Rattus norvegicus
gacctcccaatgttgttactgactg

SEQ ID NO: 322674 - DNA, 25 bp, Rattus norvegicus
gacctcccgtgactgtttcgaggaa

SEQ ID NO: 322675 - DNA, 25 bp, Rattus norvegicus
gacctcccgtgagtgtttcgaggaa

SEQ ID NO: 322676 - DNA, 25 bp, Rattus norvegicus
gacctcccgttgatggtttctgtaa

SEQ ID NO: 322677 - DNA, 25 bp, Rattus norvegicus
gacctcccgttgttggtttctgtaa

SEQ ID NO: 322678 - DNA, 25 bp, Rattus norvegicus
gacctccctgggaaacaacatccta

SEQ ID NO: 322679 - DNA, 25 bp, Rattus norvegicus
gacctccctgggtaacaacatccta

SEQ ID NO: 322680 - DNA, 25 bp, Rattus norvegicus
gacctccctgtgaacgtgggcatat

SEQ ID NO: 322681 - DNA, 25 bp, Rattus norvegicus
gacctccctgtgagaactgtttaca

SEQ ID NO: 322682 - DNA, 25 bp, Rattus norvegicus
gacctccctgtgtacgtgggcatat

SEQ ID NO: 322683 - DNA, 25 bp, Rattus norvegicus
gacctccctgtgtgaactgtttaca

SEQ ID NO: 322684 - DNA, 25 bp, Rattus norvegicus
gacctcccttagcaatctcaggaac

SEQ ID NO: 322685 - DNA, 25 bp, Rattus norvegicus
gacctcccttaggaatctcaggaac

SEQ ID NO: 322686 - DNA, 25 bp, Rattus norvegicus
gacctccggacgactgagtttgcaa

SEQ ID NO: 322687 - DNA, 25 bp, Rattus norvegicus
gacctccggacgtctgagtttgcaa

SEQ ID NO: 322688 - DNA, 25 bp, Rattus norvegicus
gacctccggcaaacacaggacgtgc

SEQ ID NO: 322689 - DNA, 25 bp, Rattus norvegicus
gacctccggcaatcacaggacgtgc

SEQ ID NO: 322690 - DNA, 25 bp, Rattus norvegicus
gacctccgggtcatagaaacagtat

SEQ ID NO: 322691 - DNA, 25 bp, Rattus norvegicus
gacctccgggtcttagaaacagtat

SEQ ID NO: 322692 - DNA, 25 bp, Rattus norvegicus
gacctcctagagatgtagcctgtgt

SEQ ID NO: 322693 - DNA, 25 bp, Rattus norvegicus
gacctcctagagttgtagcctgtgt

SEQ ID NO: 322694 - DNA, 25 bp, Rattus norvegicus
gacctcctagccctgaagtggatgt

SEQ ID NO: 322695 - DNA, 25 bp, Rattus norvegicus
gacctcctagccgtgaagtggatgt

SEQ ID NO: 322696 - DNA, 25 bp, Rattus norvegicus
gacctcctcaacagctgaagtctga

SEQ ID NO: 322697 - DNA, 25 bp, Rattus norvegicus
gacctcctcaactgctgaagtctga

SEQ ID NO: 322698 - DNA, 25 bp, Rattus norvegicus
gacctcctcaggcaacaagcacaga

SEQ ID NO: 322699 - DNA, 25 bp, Rattus norvegicus
gacctcctcagggaacaagcacaga

SEQ ID NO: 322700 - DNA, 25 bp, Rattus norvegicus
gacctcctccttccaaaagctggaa

SEQ ID NO: 322701 - DNA, 25 bp, Rattus norvegicus
gacctcctccttgcaaaagctggaa

SEQ ID NO: 322702 - DNA, 25 bp, Rattus norvegicus
gacctcctgacccttatttatttat

SEQ ID NO: 322703 - DNA, 25 bp, Rattus norvegicus
gacctcctgaccgttatttatttat

SEQ ID NO: 322704 - DNA, 25 bp, Rattus norvegicus
gacctcctgagtctcttcagtgaca

SEQ ID NO: 322705 - DNA, 25 bp, Rattus norvegicus
gacctcctgagtgtcttcagtgaca

SEQ ID NO: 322706 - DNA, 25 bp, Rattus norvegicus
gacctcctgattcctttctgaaagt

SEQ ID NO: 322707 - DNA, 25 bp, Rattus norvegicus
gacctcctgattgctttctgaaagt

SEQ ID NO: 322708 - DNA, 25 bp, Rattus norvegicus
gacctcctggatatacttgttgtag

SEQ ID NO: 322709 - DNA, 25 bp, Rattus norvegicus
gacctcctggatttacttgttgtag

SEQ ID NO: 322710 - DNA, 25 bp, Rattus norvegicus
gacctcctgggaaatccaagacaca

SEQ ID NO: 322711 - DNA, 25 bp, Rattus norvegicus
gacctcctgggatatccaagacaca

SEQ ID NO: 322712 - DNA, 25 bp, Rattus norvegicus
gacctcctgtagagagccatataca

SEQ ID NO: 322713 - DNA, 25 bp, Rattus norvegicus
gacctcctgtagtgagccatataca

SEQ ID NO: 322714 - DNA, 25 bp, Rattus norvegicus
gacctcctgtcccatttttataaga

SEQ ID NO: 322715 - DNA, 25 bp, Rattus norvegicus
gacctcctgtccgatttttataaga

SEQ ID NO: 322716 - DNA, 25 bp, Rattus norvegicus
gacctccttagtacccttcagtggg

SEQ ID NO: 322717 - DNA, 25 bp, Rattus norvegicus
gacctccttagttcccttcagtggg

SEQ ID NO: 322718 - DNA, 25 bp, Rattus norvegicus
gacctccttataaatgaaaactctt

SEQ ID NO: 322719 - DNA, 25 bp, Rattus norvegicus
gacctccttatatatgaaaactctt

SEQ ID NO: 322720 - DNA, 25 bp, Rattus norvegicus
gacctccttgacctgctagagttta

SEQ ID NO: 322721 - DNA, 25 bp, Rattus norvegicus
gacctccttgacgtgctagagttta

SEQ ID NO: 322722 - DNA, 25 bp, Rattus norvegicus
gacctccttggtcagatgttcctgg

SEQ ID NO: 322723 - DNA, 25 bp, Rattus norvegicus
gacctccttggtgagatgttcctgg

SEQ ID NO: 322724 - DNA, 25 bp, Rattus norvegicus
gacctccttgtgaaccaggcatgca

SEQ ID NO: 322725 - DNA, 25 bp, Rattus norvegicus
gacctccttgtgtaccaggcatgca

SEQ ID NO: 322726 - DNA, 25 bp, Rattus norvegicus
gacctcctttctctacacaatgtgg

SEQ ID NO: 322727 - DNA, 25 bp, Rattus norvegicus
gacctcctttctgtacacaatgtgg

SEQ ID NO: 322728 - DNA, 25 bp, Rattus norvegicus
gacctccttttcagtatcttgatat

SEQ ID NO: 322729 - DNA, 25 bp, Rattus norvegicus
gacctccttttctgtatcttgatat

SEQ ID NO: 322730 - DNA, 25 bp, Rattus norvegicus
gacctcgaaataaactctctccggg

SEQ ID NO: 322731 - DNA, 25 bp, Rattus norvegicus
gacctcgaaatatactctctccggg

SEQ ID NO: 322732 - DNA, 25 bp, Rattus norvegicus
gacctcgaagtacttgcgcaggctg

SEQ ID NO: 322733 - DNA, 25 bp, Rattus norvegicus
gacctcgaagtagttgcgcaggctg

SEQ ID NO: 322734 - DNA, 25 bp, Rattus norvegicus
gacctcgagacccaagtgatcgctg

SEQ ID NO: 322735 - DNA, 25 bp, Rattus norvegicus
gacctcgagaccgaagtgatcgctg

SEQ ID NO: 322736 - DNA, 25 bp, Rattus norvegicus
gacctcgagcctaatctgtgaaggt

SEQ ID NO: 322737 - DNA, 25 bp, Rattus norvegicus
gacctcgagccttatctgtgaaggt

SEQ ID NO: 322738 - DNA, 25 bp, Rattus norvegicus
gacctcgatggacaagttatctacc

SEQ ID NO: 322739 - DNA, 25 bp, Rattus norvegicus
gacctcgatggagaagttatctacc

SEQ ID NO: 322740 - DNA, 25 bp, Rattus norvegicus
gacctcggattcattggactcaaac

SEQ ID NO: 322741 - DNA, 25 bp, Rattus norvegicus
gacctcggattctttggactcaaac

SEQ ID NO: 322742 - DNA, 25 bp, Rattus norvegicus
gacctcggctttcggaactttgtct

SEQ ID NO: 322743 - DNA, 25 bp, Rattus norvegicus
gacctcggctttgggaactttgtct

SEQ ID NO: 322744 - DNA, 25 bp, Rattus norvegicus
gacctcgggtagagcatgcttgctt

SEQ ID NO: 322745 - DNA, 25 bp, Rattus norvegicus
gacctcgggtagtgcatgcttgctt

SEQ ID NO: 322746 - DNA, 25 bp, Rattus norvegicus
gacctcggtcagatggtttcatgtc

SEQ ID NO: 322747 - DNA, 25 bp, Rattus norvegicus
gacctcggtcagttggtttcatgtc

SEQ ID NO: 322748 - DNA, 25 bp, Rattus norvegicus
gacctcggtgtaagacttctttagc

SEQ ID NO: 322749 - DNA, 25 bp, Rattus norvegicus
gacctcggtgtatgacttctttagc

SEQ ID NO: 322750 - DNA, 25 bp, Rattus norvegicus
gacctcgtgaccatttttggaacag

SEQ ID NO: 322751 - DNA, 25 bp, Rattus norvegicus
gacctcgtgaccttttttggaacag

SEQ ID NO: 322752 - DNA, 25 bp, Rattus norvegicus
gacctcgtggagaatttttactggg

SEQ ID NO: 322753 - DNA, 25 bp, Rattus norvegicus
gacctcgtggagtatttttactggg

SEQ ID NO: 322754 - DNA, 25 bp, Rattus norvegicus
gacctcgtggtactgtttcttattt

SEQ ID NO: 322755 - DNA, 25 bp, Rattus norvegicus
gacctcgtggtagtgtttcttattt

SEQ ID NO: 322756 - DNA, 25 bp, Rattus norvegicus
gacctctaaagaatctgccagtgcc

SEQ ID NO: 322757 - DNA, 25 bp, Rattus norvegicus
gacctctaaagattctgccagtgcc

SEQ ID NO: 322758 - DNA, 25 bp, Rattus norvegicus
gacctctacatacatgtgcacacat

SEQ ID NO: 322759 - DNA, 25 bp, Rattus norvegicus
gacctctacatagatgtgcacacat

SEQ ID NO: 322760 - DNA, 25 bp, Rattus norvegicus
gacctctaccctatgctgatggaga

SEQ ID NO: 322761 - DNA, 25 bp, Rattus norvegicus
gacctctaccctttgctgatggaga

SEQ ID NO: 322762 - DNA, 25 bp, Rattus norvegicus
gacctctaccgccaggagttcagag

SEQ ID NO: 322763 - DNA, 25 bp, Rattus norvegicus
gacctctaccgcgaggagttcagag

SEQ ID NO: 322764 - DNA, 25 bp, Rattus norvegicus
gacctctagccaacgagtctgaagt

SEQ ID NO: 322765 - DNA, 25 bp, Rattus norvegicus
gacctctagccatcgagtctgaagt

SEQ ID NO: 322766 - DNA, 25 bp, Rattus norvegicus
gacctctaggtgacttttctttcta

SEQ ID NO: 322767 - DNA, 25 bp, Rattus norvegicus
gacctctaggtgtcttttctttcta

SEQ ID NO: 322768 - DNA, 25 bp, Rattus norvegicus
gacctctagttgacagatactggta

SEQ ID NO: 322769 - DNA, 25 bp, Rattus norvegicus
gacctctagttgtcagatactggta

SEQ ID NO: 322770 - DNA, 25 bp, Rattus norvegicus
gacctctatgaacactttcacattg

SEQ ID NO: 322771 - DNA, 25 bp, Rattus norvegicus
gacctctatgaagactttcacattg

SEQ ID NO: 322772 - DNA, 25 bp, Rattus norvegicus
gacctctatgcaaccagtaactgtt

SEQ ID NO: 322773 - DNA, 25 bp, Rattus norvegicus
gacctctatgcatccagtaactgtt

SEQ ID NO: 322774 - DNA, 25 bp, Rattus norvegicus
gacctctatgccaagttacttgctt

SEQ ID NO: 322775 - DNA, 25 bp, Rattus norvegicus
gacctctatgcctagttacttgctt

SEQ ID NO: 322776 - DNA, 25 bp, Rattus norvegicus
gacctctcaaaccacaaggcggaat

SEQ ID NO: 322777 - DNA, 25 bp, Rattus norvegicus
gacctctcaaacgacaaggcggaat

SEQ ID NO: 322778 - DNA, 25 bp, Rattus norvegicus
gacctctcaaggatgctgtagcatt

SEQ ID NO: 322779 - DNA, 25 bp, Rattus norvegicus
gacctctcaaggttgctgtagcatt

SEQ ID NO: 322780 - DNA, 25 bp, Rattus norvegicus
gacctctcagtcataattgctattt

SEQ ID NO: 322781 - DNA, 25 bp, Rattus norvegicus
gacctctcagtcttaattgctattt

SEQ ID NO: 322782 - DNA, 25 bp, Rattus norvegicus
gacctctcatgacccgaggcttcta

SEQ ID NO: 322783 - DNA, 25 bp, Rattus norvegicus
gacctctcatgagccgaggcttcta

SEQ ID NO: 322784 - DNA, 25 bp, Rattus norvegicus
gacctctccaacatcatgttgatgt

SEQ ID NO: 322785 - DNA, 25 bp, Rattus norvegicus
gacctctccaacttcatgttgatgt

SEQ ID NO: 322786 - DNA, 25 bp, Rattus norvegicus
gacctctccattagtactagcactt

SEQ ID NO: 322787 - DNA, 25 bp, Rattus norvegicus
gacctctccatttgtactagcactt

SEQ ID NO: 322788 - DNA, 25 bp, Rattus norvegicus
gacctctcctcactactagattgga

SEQ ID NO: 322789 - DNA, 25 bp, Rattus norvegicus
gacctctcctcagtactagattgga

SEQ ID NO: 322790 - DNA, 25 bp, Rattus norvegicus
gacctctcctggcaccaggaacgaa

SEQ ID NO: 322791 - DNA, 25 bp, Rattus norvegicus
gacctctcctgggaccaggaacgaa

SEQ ID NO: 322792 - DNA, 25 bp, Rattus norvegicus
gacctctccttcacgctgggaaaga

SEQ ID NO: 322793 - DNA, 25 bp, Rattus norvegicus
gacctctccttctcgctgggaaaga

SEQ ID NO: 322794 - DNA, 25 bp, Rattus norvegicus
gacctctcctttctggattttagtt

SEQ ID NO: 322795 - DNA, 25 bp, Rattus norvegicus
gacctctcctttgtggattttagtt

SEQ ID NO: 322796 - DNA, 25 bp, Rattus norvegicus
gacctctcgcctcgaagggagtaca

SEQ ID NO: 322797 - DNA, 25 bp, Rattus norvegicus
gacctctcgcctggaagggagtaca

SEQ ID NO: 322798 - DNA, 25 bp, Rattus norvegicus
gacctctcgggcaagggttagactc

SEQ ID NO: 322799 - DNA, 25 bp, Rattus norvegicus
gacctctcgggctagggttagactc

SEQ ID NO: 322800 - DNA, 25 bp, Rattus norvegicus
gacctctcgtttctctagtatcata

SEQ ID NO: 322801 - DNA, 25 bp, Rattus norvegicus
gacctctcgtttgtctagtatcata

SEQ ID NO: 322802 - DNA, 25 bp, Rattus norvegicus
gacctctctctccaacaatagttat

SEQ ID NO: 322803 - DNA, 25 bp, Rattus norvegicus
gacctctctctcgaacaatagttat

SEQ ID NO: 322804 - DNA, 25 bp, Rattus norvegicus
gacctctctttgactgtggcatgtt

SEQ ID NO: 322805 - DNA, 25 bp, Rattus norvegicus
gacctctctttgtctgtggcatgtt

SEQ ID NO: 322806 - DNA, 25 bp, Rattus norvegicus
gacctctgaactacgggagttgcta

SEQ ID NO: 322807 - DNA, 25 bp, Rattus norvegicus
gacctctgaacttcgggagttgcta

SEQ ID NO: 322808 - DNA, 25 bp, Rattus norvegicus
gacctctgaattccagggcaaccag

SEQ ID NO: 322809 - DNA, 25 bp, Rattus norvegicus
gacctctgaattgcagggcaaccag

SEQ ID NO: 322810 - DNA, 25 bp, Rattus norvegicus
gacctctgacatctcagtcctagga

SEQ ID NO: 322811 - DNA, 25 bp, Rattus norvegicus
gacctctgacatgtcagtcctagga

SEQ ID NO: 322812 - DNA, 25 bp, Rattus norvegicus
gacctctgactgatcgcacaaatgt

SEQ ID NO: 322813 - DNA, 25 bp, Rattus norvegicus
gacctctgactgttcgcacaaatgt

SEQ ID NO: 322814 - DNA, 25 bp, Rattus norvegicus
gacctctgagacaggccataaatga

SEQ ID NO: 322815 - DNA, 25 bp, Rattus norvegicus
gacctctgagactggccataaatga

SEQ ID NO: 322816 - DNA, 25 bp, Rattus norvegicus
gacctctgatgtagtccgcatgcac

SEQ ID NO: 322817 - DNA, 25 bp, Rattus norvegicus
gacctctgatgttgtccgcatgcac

SEQ ID NO: 322818 - DNA, 25 bp, Rattus norvegicus
gacctctgcgctaggccagtgtaat

SEQ ID NO: 322819 - DNA, 25 bp, Rattus norvegicus
gacctctgcgcttggccagtgtaat

SEQ ID NO: 322820 - DNA, 25 bp, Rattus norvegicus
gacctctggcctaacaaagttgctt

SEQ ID NO: 322821 - DNA, 25 bp, Rattus norvegicus
gacctctggccttacaaagttgctt

SEQ ID NO: 322822 - DNA, 25 bp, Rattus norvegicus
gacctctggctccaaacaggcagat

SEQ ID NO: 322823 - DNA, 25 bp, Rattus norvegicus
gacctctggctcgaaacaggcagat

SEQ ID NO: 322824 - DNA, 25 bp, Rattus norvegicus
gacctctgggacaactgcaacagta

SEQ ID NO: 322825 - DNA, 25 bp, Rattus norvegicus
gacctctgggactactgcaacagta

SEQ ID NO: 322826 - DNA, 25 bp, Rattus norvegicus
gacctctggttgacttttctttcct

SEQ ID NO: 322827 - DNA, 25 bp, Rattus norvegicus
gacctctggttgtcttttctttcct

SEQ ID NO: 322828 - DNA, 25 bp, Rattus norvegicus
gacctctgtaccagggtttgatgaa

SEQ ID NO: 322829 - DNA, 25 bp, Rattus norvegicus
gacctctgtacctgggtttgatgaa

SEQ ID NO: 322830 - DNA, 25 bp, Rattus norvegicus
gacctctgtactaaacgggtgcgtt

SEQ ID NO: 322831 - DNA, 25 bp, Rattus norvegicus
gacctctgtactaatgtcatggtat

SEQ ID NO: 322832 - DNA, 25 bp, Rattus norvegicus
gacctctgtacttaacgggtgcgtt

SEQ ID NO: 322833 - DNA, 25 bp, Rattus norvegicus
gacctctgtacttatgtcatggtat

SEQ ID NO: 322834 - DNA, 25 bp, Rattus norvegicus
gacctctgtagtaactaagtgcttc

SEQ ID NO: 322835 - DNA, 25 bp, Rattus norvegicus
gacctctgtagttactaagtgcttc

SEQ ID NO: 322836 - DNA, 25 bp, Rattus norvegicus
gacctctgtcagcaagagctcacta

SEQ ID NO: 322837 - DNA, 25 bp, Rattus norvegicus
gacctctgtcaggaagagctcacta

SEQ ID NO: 322838 - DNA, 25 bp, Rattus norvegicus
gacctcttcaagctgtgttataccc

SEQ ID NO: 322839 - DNA, 25 bp, Rattus norvegicus
gacctcttcaaggtgtgttataccc

SEQ ID NO: 322840 - DNA, 25 bp, Rattus norvegicus
gacctcttcagcacaatatctgcat

SEQ ID NO: 322841 - DNA, 25 bp, Rattus norvegicus
gacctcttcagctcaatatctgcat

SEQ ID NO: 322842 - DNA, 25 bp, Rattus norvegicus
gacctcttgagaaagtcacagccct

SEQ ID NO: 322843 - DNA, 25 bp, Rattus norvegicus
gacctcttgagatagtcacagccct

SEQ ID NO: 322844 - DNA, 25 bp, Rattus norvegicus
gacctcttgaggaagctgtaaaaca

SEQ ID NO: 322845 - DNA, 25 bp, Rattus norvegicus
gacctcttgaggtagctgtaaaaca

SEQ ID NO: 322846 - DNA, 25 bp, Rattus norvegicus
gacctcttgcctatgaatgtggaaa

SEQ ID NO: 322847 - DNA, 25 bp, Rattus norvegicus
gacctcttgcctttgaatgtggaaa

SEQ ID NO: 322848 - DNA, 25 bp, Rattus norvegicus
gacctctttccgcaggtgcaaacat

SEQ ID NO: 322849 - DNA, 25 bp, Rattus norvegicus
gacctctttccggaggtgcaaacat

SEQ ID NO: 322850 - DNA, 25 bp, Rattus norvegicus
gacctgaaactgacctgtgtggtca

SEQ ID NO: 322851 - DNA, 25 bp, Rattus norvegicus
gacctgaaactgtcctgtgtggtca

SEQ ID NO: 322852 - DNA, 25 bp, Rattus norvegicus
gacctgaaatagatgttccctctgc

SEQ ID NO: 322853 - DNA, 25 bp, Rattus norvegicus
gacctgaaatagttgttccctctgc

SEQ ID NO: 322854 - DNA, 25 bp, Rattus norvegicus
gacctgaacacacctttgagttggt

SEQ ID NO: 322855 - DNA, 25 bp, Rattus norvegicus
gacctgaacacagctttgagttggt

SEQ ID NO: 322856 - DNA, 25 bp, Rattus norvegicus
gacctgaacctgcagactgtgagct

SEQ ID NO: 322857 - DNA, 25 bp, Rattus norvegicus
gacctgaacctggagactgtgagct

SEQ ID NO: 322858 - DNA, 25 bp, Rattus norvegicus
gacctgaactttatagccaattact

SEQ ID NO: 322859 - DNA, 25 bp, Rattus norvegicus
gacctgaactttttagccaattact

SEQ ID NO: 322860 - DNA, 25 bp, Rattus norvegicus
gacctgaagaaactgatagcggctc

SEQ ID NO: 322861 - DNA, 25 bp, Rattus norvegicus
gacctgaagaaagtgatagcggctc

SEQ ID NO: 322862 - DNA, 25 bp, Rattus norvegicus
gacctgaagataatggttcatccca

SEQ ID NO: 322863 - DNA, 25 bp, Rattus norvegicus
gacctgaagatattggttcatccca

SEQ ID NO: 322864 - DNA, 25 bp, Rattus norvegicus
gacctgaagcatccttgactttcat

SEQ ID NO: 322865 - DNA, 25 bp, Rattus norvegicus
gacctgaagcatgcttgactttcat

SEQ ID NO: 322866 - DNA, 25 bp, Rattus norvegicus
gacctgaagcctatagattctccag

SEQ ID NO: 322867 - DNA, 25 bp, Rattus norvegicus
gacctgaagcctttagattctccag

SEQ ID NO: 322868 - DNA, 25 bp, Rattus norvegicus
gacctgaagcgcagtacatactatg

SEQ ID NO: 322869 - DNA, 25 bp, Rattus norvegicus
gacctgaagcgctgtacatactatg

SEQ ID NO: 322870 - DNA, 25 bp, Rattus norvegicus
gacctgaagtcaccaagctccacat

SEQ ID NO: 322871 - DNA, 25 bp, Rattus norvegicus
gacctgaagtcagcaagctccacat

SEQ ID NO: 322872 - DNA, 25 bp, Rattus norvegicus
gacctgaatgcccttggacaagaca

SEQ ID NO: 322873 - DNA, 25 bp, Rattus norvegicus
gacctgaatgccgttggacaagaca

SEQ ID NO: 322874 - DNA, 25 bp, Rattus norvegicus
gacctgaatgtcaagtgatgtgctg

SEQ ID NO: 322875 - DNA, 25 bp, Rattus norvegicus
gacctgaatgtctagtgatgtgctg

SEQ ID NO: 322876 - DNA, 25 bp, Rattus norvegicus
gacctgacacgcatagtggaggcca

SEQ ID NO: 322877 - DNA, 25 bp, Rattus norvegicus
gacctgacacgcttagtggaggcca

SEQ ID NO: 322878 - DNA, 25 bp, Rattus norvegicus
gacctgacacttcctgactgtgagt

SEQ ID NO: 322879 - DNA, 25 bp, Rattus norvegicus
gacctgacacttgctgactgtgagt

SEQ ID NO: 322880 - DNA, 25 bp, Rattus norvegicus
gacctgacagagagtcccatcctgg

SEQ ID NO: 322881 - DNA, 25 bp, Rattus norvegicus
gacctgacagagtgtcccatcctgg

SEQ ID NO: 322882 - DNA, 25 bp, Rattus norvegicus
gacctgaccctgagtgctctaagag

SEQ ID NO: 322883 - DNA, 25 bp, Rattus norvegicus
gacctgaccctgtgtgctctaagag

SEQ ID NO: 322884 - DNA, 25 bp, Rattus norvegicus
gacctgacctttaccttagataaat

SEQ ID NO: 322885 - DNA, 25 bp, Rattus norvegicus
gacctgaccttttccttagataaat

SEQ ID NO: 322886 - DNA, 25 bp, Rattus norvegicus
gacctgacggaaccacgtgactgga

SEQ ID NO: 322887 - DNA, 25 bp, Rattus norvegicus
gacctgacggaagcacgtgactgga

SEQ ID NO: 322888 - DNA, 25 bp, Rattus norvegicus
gacctgactatcagaaagccatttg

SEQ ID NO: 322889 - DNA, 25 bp, Rattus norvegicus
gacctgactatctgaaagccatttg

SEQ ID NO: 322890 - DNA, 25 bp, Rattus norvegicus
gacctgactcatccattaatatttg

SEQ ID NO: 322891 - DNA, 25 bp, Rattus norvegicus
gacctgactcatgcattaatatttg

SEQ ID NO: 322892 - DNA, 25 bp, Rattus norvegicus
gacctgactcctcaaagttgtcttc

SEQ ID NO: 322893 - DNA, 25 bp, Rattus norvegicus
gacctgactcctgaaagttgtcttc

SEQ ID NO: 322894 - DNA, 25 bp, Rattus norvegicus
gacctgactgagaacttggaacact

SEQ ID NO: 322895 - DNA, 25 bp, Rattus norvegicus
gacctgactgagtacttggaacact

SEQ ID NO: 322896 - DNA, 25 bp, Rattus norvegicus
gacctgactggaatggctctgctca

SEQ ID NO: 322897 - DNA, 25 bp, Rattus norvegicus
gacctgactggattggctctgctca

SEQ ID NO: 322898 - DNA, 25 bp, Rattus norvegicus
gacctgagacacattgtcacctgga

SEQ ID NO: 322899 - DNA, 25 bp, Rattus norvegicus
gacctgagacactttgtcacctgga

SEQ ID NO: 322900 - DNA, 25 bp, Rattus norvegicus
gacctgagagtcagagtccaggcct

SEQ ID NO: 322901 - DNA, 25 bp, Rattus norvegicus
gacctgagagtctgagtccaggcct

SEQ ID NO: 322902 - DNA, 25 bp, Rattus norvegicus
gacctgagcaggctggcttgacctc

SEQ ID NO: 322903 - DNA, 25 bp, Rattus norvegicus
gacctgagcagggtggcttgacctc

SEQ ID NO: 322904 - DNA, 25 bp, Rattus norvegicus
gacctgagccggcacagactgagtc

SEQ ID NO: 322905 - DNA, 25 bp, Rattus norvegicus
gacctgagccgggacagactgagtc

SEQ ID NO: 322906 - DNA, 25 bp, Rattus norvegicus
gacctgagctagacaccaataaaca

SEQ ID NO: 322907 - DNA, 25 bp, Rattus norvegicus
gacctgagctagtcaccaataaaca

SEQ ID NO: 322908 - DNA, 25 bp, Rattus norvegicus
gacctgaggcagagatgactcctga

SEQ ID NO: 322909 - DNA, 25 bp, Rattus norvegicus
gacctgaggcagtgatgactcctga

SEQ ID NO: 322910 - DNA, 25 bp, Rattus norvegicus
gacctgaggccgagtcatgaaacaa

SEQ ID NO: 322911 - DNA, 25 bp, Rattus norvegicus
gacctgaggccgtgtcatgaaacaa

SEQ ID NO: 322912 - DNA, 25 bp, Rattus norvegicus
gacctgagggccaggaacaactcca

SEQ ID NO: 322913 - DNA, 25 bp, Rattus norvegicus
gacctgagggcctggaacaactcca

SEQ ID NO: 322914 - DNA, 25 bp, Rattus norvegicus
gacctgaggtataaactctccctag

SEQ ID NO: 322915 - DNA, 25 bp, Rattus norvegicus
gacctgaggtattaactctccctag

SEQ ID NO: 322916 - DNA, 25 bp, Rattus norvegicus
gacctgaggtgtatagtgttcccca

SEQ ID NO: 322917 - DNA, 25 bp, Rattus norvegicus
gacctgaggtgtttagtgttcccca

SEQ ID NO: 322918 - DNA, 25 bp, Rattus norvegicus
gacctgagtaccattgtcaaaaaat

SEQ ID NO: 322919 - DNA, 25 bp, Rattus norvegicus
gacctgagtacctttgtcaaaaaat

SEQ ID NO: 322920 - DNA, 25 bp, Rattus norvegicus
gacctgagtgtcacagtgtcaacag

SEQ ID NO: 322921 - DNA, 25 bp, Rattus norvegicus
gacctgagtgtctcagtgtcaacag

SEQ ID NO: 322922 - DNA, 25 bp, Rattus norvegicus
gacctgagtttgctaggtgactcac

SEQ ID NO: 322923 - DNA, 25 bp, Rattus norvegicus
gacctgagtttggtaggtgactcac

SEQ ID NO: 322924 - DNA, 25 bp, Rattus norvegicus
gacctgatactaatgagtgcccctc

SEQ ID NO: 322925 - DNA, 25 bp, Rattus norvegicus
gacctgatactattgagtgcccctc

SEQ ID NO: 322926 - DNA, 25 bp, Rattus norvegicus
gacctgatactcaaatgccatctac

SEQ ID NO: 322927 - DNA, 25 bp, Rattus norvegicus
gacctgatactctaatgccatctac

SEQ ID NO: 322928 - DNA, 25 bp, Rattus norvegicus
gacctgatcggtaggttaatcgctt

SEQ ID NO: 322929 - DNA, 25 bp, Rattus norvegicus
gacctgatcggttggttaatcgctt

SEQ ID NO: 322930 - DNA, 25 bp, Rattus norvegicus
gacctgattcaaattgttccacatg

SEQ ID NO: 322931 - DNA, 25 bp, Rattus norvegicus
gacctgattcaatttgttccacatg

SEQ ID NO: 322932 - DNA, 25 bp, Rattus norvegicus
gacctgattctgacgtctgtttaat

SEQ ID NO: 322933 - DNA, 25 bp, Rattus norvegicus
gacctgattctgtcgtctgtttaat

SEQ ID NO: 322934 - DNA, 25 bp, Rattus norvegicus
gacctgattgtaaagcttctgccat

SEQ ID NO: 322935 - DNA, 25 bp, Rattus norvegicus
gacctgattgtatagcttctgccat

SEQ ID NO: 322936 - DNA, 25 bp, Rattus norvegicus
gacctgcaactgatccgcaaactgg

SEQ ID NO: 322937 - DNA, 25 bp, Rattus norvegicus
gacctgcaactgttccgcaaactgg

SEQ ID NO: 322938 - DNA, 25 bp, Rattus norvegicus
gacctgcacacaagacctctatgta

SEQ ID NO: 322939 - DNA, 25 bp, Rattus norvegicus
gacctgcacacatgacctctatgta

SEQ ID NO: 322940 - DNA, 25 bp, Rattus norvegicus
gacctgcacaggagagagcctgcca

SEQ ID NO: 322941 - DNA, 25 bp, Rattus norvegicus
gacctgcacaggtgagagcctgcca

SEQ ID NO: 322942 - DNA, 25 bp, Rattus norvegicus
gacctgcaccagaagatctaccaga

SEQ ID NO: 322943 - DNA, 25 bp, Rattus norvegicus
gacctgcaccagtagatctaccaga

SEQ ID NO: 322944 - DNA, 25 bp, Rattus norvegicus
gacctgcacgaaaacgcctcgataa

SEQ ID NO: 322945 - DNA, 25 bp, Rattus norvegicus
gacctgcacgaatacgcctcgataa

SEQ ID NO: 322946 - DNA, 25 bp, Rattus norvegicus
gacctgcactctatggactccagaa

SEQ ID NO: 322947 - DNA, 25 bp, Rattus norvegicus
gacctgcactctttggactccagaa

SEQ ID NO: 322948 - DNA, 25 bp, Rattus norvegicus
gacctgcactgaaaattcactcttc

SEQ ID NO: 322949 - DNA, 25 bp, Rattus norvegicus
gacctgcactgataattcactcttc

SEQ ID NO: 322950 - DNA, 25 bp, Rattus norvegicus
gacctgcagagcagtcagactgtgt

SEQ ID NO: 322951 - DNA, 25 bp, Rattus norvegicus
gacctgcagagctgtcagactgtgt

SEQ ID NO: 322952 - DNA, 25 bp, Rattus norvegicus
gacctgcagcgaagggacagttgat

SEQ ID NO: 322953 - DNA, 25 bp, Rattus norvegicus
gacctgcagcgatgggacagttgat

SEQ ID NO: 322954 - DNA, 25 bp, Rattus norvegicus
gacctgcaggatatcttgagccgga

SEQ ID NO: 322955 - DNA, 25 bp, Rattus norvegicus
gacctgcaggatttcttgagccgga

SEQ ID NO: 322956 - DNA, 25 bp, Rattus norvegicus
gacctgcatatcagagcatgagcct

SEQ ID NO: 322957 - DNA, 25 bp, Rattus norvegicus
gacctgcatatctgagcatgagcct

SEQ ID NO: 322958 - DNA, 25 bp, Rattus norvegicus
gacctgcatcatcttatagtggacc

SEQ ID NO: 322959 - DNA, 25 bp, Rattus norvegicus
gacctgcatcatgttatagtggacc

SEQ ID NO: 322960 - DNA, 25 bp, Rattus norvegicus
gacctgcatccaaccaagacaaaag

SEQ ID NO: 322961 - DNA, 25 bp, Rattus norvegicus
gacctgcatccatccaagacaaaag

SEQ ID NO: 322962 - DNA, 25 bp, Rattus norvegicus
gacctgcatgccatttcaggcagtg

SEQ ID NO: 322963 - DNA, 25 bp, Rattus norvegicus
gacctgcatgccttttcaggcagtg

SEQ ID NO: 322964 - DNA, 25 bp, Rattus norvegicus
gacctgccaaacacttttatggaat

SEQ ID NO: 322965 - DNA, 25 bp, Rattus norvegicus
gacctgccaaactcttttatggaat

SEQ ID NO: 322966 - DNA, 25 bp, Rattus norvegicus
gacctgccacaaactccgtagggat

SEQ ID NO: 322967 - DNA, 25 bp, Rattus norvegicus
gacctgccacaacaatggttagttt

SEQ ID NO: 322968 - DNA, 25 bp, Rattus norvegicus
gacctgccacaagaatggttagttt

SEQ ID NO: 322969 - DNA, 25 bp, Rattus norvegicus
gacctgccacaatctccgtagggat

SEQ ID NO: 322970 - DNA, 25 bp, Rattus norvegicus
gacctgccagaactcacagtgattg

SEQ ID NO: 322971 - DNA, 25 bp, Rattus norvegicus
gacctgccagaagtcacagtgattg

SEQ ID NO: 322972 - DNA, 25 bp, Rattus norvegicus
gacctgccagtacttctgtacacat

SEQ ID NO: 322973 - DNA, 25 bp, Rattus norvegicus
gacctgccagtagttctgtacacat

SEQ ID NO: 322974 - DNA, 25 bp, Rattus norvegicus
gacctgccgtgacagatgtatcctt

SEQ ID NO: 322975 - DNA, 25 bp, Rattus norvegicus
gacctgccgtgagagatgtatcctt

SEQ ID NO: 322976 - DNA, 25 bp, Rattus norvegicus
gacctgcctgacaggaatgggaaat

SEQ ID NO: 322977 - DNA, 25 bp, Rattus norvegicus
gacctgcctgactggaatgggaaat

SEQ ID NO: 322978 - DNA, 25 bp, Rattus norvegicus
gacctgcctgccacaggatgaatga

SEQ ID NO: 322979 - DNA, 25 bp, Rattus norvegicus
gacctgcctgcctcaggatgaatga

SEQ ID NO: 322980 - DNA, 25 bp, Rattus norvegicus
gacctgcctggccttgtggttacat

SEQ ID NO: 322981 - DNA, 25 bp, Rattus norvegicus
gacctgcctggcgttgtggttacat

SEQ ID NO: 322982 - DNA, 25 bp, Rattus norvegicus
gacctgcctgtcatggagtccagac

SEQ ID NO: 322983 - DNA, 25 bp, Rattus norvegicus
gacctgcctgtcttggagtccagac

SEQ ID NO: 322984 - DNA, 25 bp, Rattus norvegicus
gacctgcctgtgagtgaaatagccc

SEQ ID NO: 322985 - DNA, 25 bp, Rattus norvegicus
gacctgcctgtgtgtgaaatagccc

SEQ ID NO: 322986 - DNA, 25 bp, Rattus norvegicus
gacctgcctttaaaatcgtacattc

SEQ ID NO: 322987 - DNA, 25 bp, Rattus norvegicus
gacctgcctttataatcgtacattc

SEQ ID NO: 322988 - DNA, 25 bp, Rattus norvegicus
gacctgcgaaccagctaactttgga

SEQ ID NO: 322989 - DNA, 25 bp, Rattus norvegicus
gacctgcgaacctgctaactttgga

SEQ ID NO: 322990 - DNA, 25 bp, Rattus norvegicus
gacctgcgatacagtgaggcagcga

SEQ ID NO: 322991 - DNA, 25 bp, Rattus norvegicus
gacctgcgatactgtgaggcagcga

SEQ ID NO: 322992 - DNA, 25 bp, Rattus norvegicus
gacctgctaacaaggtttgggcatt

SEQ ID NO: 322993 - DNA, 25 bp, Rattus norvegicus
gacctgctaacatggtttgggcatt

SEQ ID NO: 322994 - DNA, 25 bp, Rattus norvegicus
gacctgctaggccaagacccagaag

SEQ ID NO: 322995 - DNA, 25 bp, Rattus norvegicus
gacctgctaggcgaagacccagaag

SEQ ID NO: 322996 - DNA, 25 bp, Rattus norvegicus
gacctgctatatattcatgttgttg

SEQ ID NO: 322997 - DNA, 25 bp, Rattus norvegicus
gacctgctatattttcatgttgttg

SEQ ID NO: 322998 - DNA, 25 bp, Rattus norvegicus
gacctgctattcatgtatttctcat

SEQ ID NO: 322999 - DNA, 25 bp, Rattus norvegicus
gacctgctattcttgtatttctcat

SEQ ID NO: 323000 - DNA, 25 bp, Rattus norvegicus
gacctgctcagcatcatagactcgg

SEQ ID NO: 323001 - DNA, 25 bp, Rattus norvegicus
gacctgctcagcttcatagactcgg

SEQ ID NO: 323002 - DNA, 25 bp, Rattus norvegicus
gacctgctcaggagtgcatctgtga

SEQ ID NO: 323003 - DNA, 25 bp, Rattus norvegicus
gacctgctcaggtgtgcatctgtga

SEQ ID NO: 323004 - DNA, 25 bp, Rattus norvegicus
gacctgctggcaaagtctcaggcta

SEQ ID NO: 323005 - DNA, 25 bp, Rattus norvegicus
gacctgctggcatagtctcaggcta

SEQ ID NO: 323006 - DNA, 25 bp, Rattus norvegicus
gacctgctgggcattagtcatacca

SEQ ID NO: 323007 - DNA, 25 bp, Rattus norvegicus
gacctgctgggctttagtcatacca

SEQ ID NO: 323008 - DNA, 25 bp, Rattus norvegicus
gacctgctgggtacaactgtggaat

SEQ ID NO: 323009 - DNA, 25 bp, Rattus norvegicus
gacctgctgggttcaactgtggaat

SEQ ID NO: 323010 - DNA, 25 bp, Rattus norvegicus
gacctgcttaggcttcgagcacagc

SEQ ID NO: 323011 - DNA, 25 bp, Rattus norvegicus
gacctgcttagggttcgagcacagc

SEQ ID NO: 323012 - DNA, 25 bp, Rattus norvegicus
gacctgcttgccctgtaggagtcaa

SEQ ID NO: 323013 - DNA, 25 bp, Rattus norvegicus
gacctgcttgccgtgtaggagtcaa

SEQ ID NO: 323014 - DNA, 25 bp, Rattus norvegicus
gacctgcttggacatgacggcttct

SEQ ID NO: 323015 - DNA, 25 bp, Rattus norvegicus
gacctgcttggagatgacggcttct

SEQ ID NO: 323016 - DNA, 25 bp, Rattus norvegicus
gacctggaaagtctctaggctcttc

SEQ ID NO: 323017 - DNA, 25 bp, Rattus norvegicus
gacctggaaagtgtctaggctcttc

SEQ ID NO: 323018 - DNA, 25 bp, Rattus norvegicus
gacctggaattcaggctcgatgcgc

SEQ ID NO: 323019 - DNA, 25 bp, Rattus norvegicus
gacctggaattctggctcgatgcgc

SEQ ID NO: 323020 - DNA, 25 bp, Rattus norvegicus
gacctggacactacgatatcctcta

SEQ ID NO: 323021 - DNA, 25 bp, Rattus norvegicus
gacctggacacttcgatatcctcta

SEQ ID NO: 323022 - DNA, 25 bp, Rattus norvegicus
gacctggacagccattgttcatcag

SEQ ID NO: 323023 - DNA, 25 bp, Rattus norvegicus
gacctggacagcgattgttcatcag

SEQ ID NO: 323024 - DNA, 25 bp, Rattus norvegicus
gacctggacaggcactttttggcct

SEQ ID NO: 323025 - DNA, 25 bp, Rattus norvegicus
gacctggacagggactttttggcct

SEQ ID NO: 323026 - DNA, 25 bp, Rattus norvegicus
gacctggacctaagcaaagattctt

SEQ ID NO: 323027 - DNA, 25 bp, Rattus norvegicus
gacctggacctatgcaaagattctt

SEQ ID NO: 323028 - DNA, 25 bp, Rattus norvegicus
gacctggactcactaattgagccaa

SEQ ID NO: 323029 - DNA, 25 bp, Rattus norvegicus
gacctggactcagtaattgagccaa

SEQ ID NO: 323030 - DNA, 25 bp, Rattus norvegicus
gacctggacttgaccaactttggaa

SEQ ID NO: 323031 - DNA, 25 bp, Rattus norvegicus
gacctggacttgtccaactttggaa

SEQ ID NO: 323032 - DNA, 25 bp, Rattus norvegicus
gacctggagataaacgctggagcaa

SEQ ID NO: 323033 - DNA, 25 bp, Rattus norvegicus
gacctggagatatacgctggagcaa

SEQ ID NO: 323034 - DNA, 25 bp, Rattus norvegicus
gacctggagcctcgctttgtttaat

SEQ ID NO: 323035 - DNA, 25 bp, Rattus norvegicus
gacctggagcctggctttgtttaat

SEQ ID NO: 323036 - DNA, 25 bp, Rattus norvegicus
gacctggagctgagacgcagacctt

SEQ ID NO: 323037 - DNA, 25 bp, Rattus norvegicus
gacctggagctgtgacgcagacctt

SEQ ID NO: 323038 - DNA, 25 bp, Rattus norvegicus
gacctggaggaccattccccttgtg

SEQ ID NO: 323039 - DNA, 25 bp, Rattus norvegicus
gacctggaggacgattccccttgtg

SEQ ID NO: 323040 - DNA, 25 bp, Rattus norvegicus
gacctggaggccaagcgcaaagctg

SEQ ID NO: 323041 - DNA, 25 bp, Rattus norvegicus
gacctggaggcctagcgcaaagctg

SEQ ID NO: 323042 - DNA, 25 bp, Rattus norvegicus
gacctggagggaaaaggtcacctcg

SEQ ID NO: 323043 - DNA, 25 bp, Rattus norvegicus
gacctggagggataaggtcacctcg

SEQ ID NO: 323044 - DNA, 25 bp, Rattus norvegicus
gacctggataaactaacctggaata

SEQ ID NO: 323045 - DNA, 25 bp, Rattus norvegicus
gacctggataaagtaacctggaata

SEQ ID NO: 323046 - DNA, 25 bp, Rattus norvegicus
gacctggatcccaattggccaagtc

SEQ ID NO: 323047 - DNA, 25 bp, Rattus norvegicus
gacctggatccctattggccaagtc

SEQ ID NO: 323048 - DNA, 25 bp, Rattus norvegicus
gacctggatgcactgtaaagctcaa

SEQ ID NO: 323049 - DNA, 25 bp, Rattus norvegicus
gacctggatgcagtgtaaagctcaa

SEQ ID NO: 323050 - DNA, 25 bp, Rattus norvegicus
gacctggattcaattccagcactca

SEQ ID NO: 323051 - DNA, 25 bp, Rattus norvegicus
gacctggattcatttccagcactca

SEQ ID NO: 323052 - DNA, 25 bp, Rattus norvegicus
gacctggcaataaatcttgtcatag

SEQ ID NO: 323053 - DNA, 25 bp, Rattus norvegicus
gacctggcaatatatcttgtcatag

SEQ ID NO: 323054 - DNA, 25 bp, Rattus norvegicus
gacctggcaatcaagttgtgtttac

SEQ ID NO: 323055 - DNA, 25 bp, Rattus norvegicus
gacctggcaatctagttgtgtttac

SEQ ID NO: 323056 - DNA, 25 bp, Rattus norvegicus
gacctggcactgaaaactggcattg

SEQ ID NO: 323057 - DNA, 25 bp, Rattus norvegicus
gacctggcactgtaaactggcattg

SEQ ID NO: 323058 - DNA, 25 bp, Rattus norvegicus
gacctggcagaaacggttccttgaa

SEQ ID NO: 323059 - DNA, 25 bp, Rattus norvegicus
gacctggcagaatcggttccttgaa

SEQ ID NO: 323060 - DNA, 25 bp, Rattus norvegicus
gacctggccgctcagctacacgtga

SEQ ID NO: 323061 - DNA, 25 bp, Rattus norvegicus
gacctggccgctgagctacacgtga

SEQ ID NO: 323062 - DNA, 25 bp, Rattus norvegicus
gacctggccttgaccgttctaagga

SEQ ID NO: 323063 - DNA, 25 bp, Rattus norvegicus
gacctggccttgtccgttctaagga

SEQ ID NO: 323064 - DNA, 25 bp, Rattus norvegicus
gacctggcggtgacccctacgggat

SEQ ID NO: 323065 - DNA, 25 bp, Rattus norvegicus
gacctggcggtgtcccctacgggat

SEQ ID NO: 323066 - DNA, 25 bp, Rattus norvegicus
gacctggctgccacgcagcacgagg

SEQ ID NO: 323067 - DNA, 25 bp, Rattus norvegicus
gacctggctgcctcgcagcacgagg

SEQ ID NO: 323068 - DNA, 25 bp, Rattus norvegicus
gacctggcttccagtacgtcaataa

SEQ ID NO: 323069 - DNA, 25 bp, Rattus norvegicus
gacctggcttcctgtacgtcaataa

SEQ ID NO: 323070 - DNA, 25 bp, Rattus norvegicus
gacctggcttgcatacccagggtca

SEQ ID NO: 323071 - DNA, 25 bp, Rattus norvegicus
gacctggcttgcttacccagggtca

SEQ ID NO: 323072 - DNA, 25 bp, Rattus norvegicus
gacctggctttcagtaagaattctc

SEQ ID NO: 323073 - DNA, 25 bp, Rattus norvegicus
gacctggctttctgtaagaattctc

SEQ ID NO: 323074 - DNA, 25 bp, Rattus norvegicus
gacctggcttttcttctgtttcccg

SEQ ID NO: 323075 - DNA, 25 bp, Rattus norvegicus
gacctggcttttgttctgtttcccg

SEQ ID NO: 323076 - DNA, 25 bp, Rattus norvegicus
gacctgggaacacctgggagaacaa

SEQ ID NO: 323077 - DNA, 25 bp, Rattus norvegicus
gacctgggaacagctgggagaacaa

SEQ ID NO: 323078 - DNA, 25 bp, Rattus norvegicus
gacctgggagctctgagggctgtgc

SEQ ID NO: 323079 - DNA, 25 bp, Rattus norvegicus
gacctgggagctgtgagggctgtgc

SEQ ID NO: 323080 - DNA, 25 bp, Rattus norvegicus
gacctgggatctcgttaataaagct

SEQ ID NO: 323081 - DNA, 25 bp, Rattus norvegicus
gacctgggatctggttaataaagct

SEQ ID NO: 323082 - DNA, 25 bp, Rattus norvegicus
gacctgggattactttttgctgcaa

SEQ ID NO: 323083 - DNA, 25 bp, Rattus norvegicus
gacctgggattagtttttgctgcaa

SEQ ID NO: 323084 - DNA, 25 bp, Rattus norvegicus
gacctgggcagtattgagagcacaa

SEQ ID NO: 323085 - DNA, 25 bp, Rattus norvegicus
gacctgggcagttttgagagcacaa

SEQ ID NO: 323086 - DNA, 25 bp, Rattus norvegicus
gacctgggccggcagaaacttgtca

SEQ ID NO: 323087 - DNA, 25 bp, Rattus norvegicus
gacctgggccgggagaaacttgtca

SEQ ID NO: 323088 - DNA, 25 bp, Rattus norvegicus
gacctgggcctaatacaagtgcctt

SEQ ID NO: 323089 - DNA, 25 bp, Rattus norvegicus
gacctgggcctattacaagtgcctt

SEQ ID NO: 323090 - DNA, 25 bp, Rattus norvegicus
gacctgggctagaatctcagagcat

SEQ ID NO: 323091 - DNA, 25 bp, Rattus norvegicus
gacctgggctagtatctcagagcat

SEQ ID NO: 323092 - DNA, 25 bp, Rattus norvegicus
gacctgggctggaaactgctgcgca

SEQ ID NO: 323093 - DNA, 25 bp, Rattus norvegicus
gacctgggctggtaactgctgcgca

SEQ ID NO: 323094 - DNA, 25 bp, Rattus norvegicus
gacctgggcttacacagtttggacc

SEQ ID NO: 323095 - DNA, 25 bp, Rattus norvegicus
gacctgggcttagacagtttggacc

SEQ ID NO: 323096 - DNA, 25 bp, Rattus norvegicus
gacctgggtacgaggattcctttgt

SEQ ID NO: 323097 - DNA, 25 bp, Rattus norvegicus
gacctgggtacgtggattcctttgt

SEQ ID NO: 323098 - DNA, 25 bp, Rattus norvegicus
gacctgggtcagagggcttgattca

SEQ ID NO: 323099 - DNA, 25 bp, Rattus norvegicus
gacctgggtcagtgggcttgattca

SEQ ID NO: 323100 - DNA, 25 bp, Rattus norvegicus
gacctgggttctatgaattcctcaa

SEQ ID NO: 323101 - DNA, 25 bp, Rattus norvegicus
gacctgggttctttgaattcctcaa

SEQ ID NO: 323102 - DNA, 25 bp, Rattus norvegicus
gacctgggtttgcattttggcttca

SEQ ID NO: 323103 - DNA, 25 bp, Rattus norvegicus
gacctgggtttggattttggcttca

SEQ ID NO: 323104 - DNA, 25 bp, Rattus norvegicus
gacctggtatagactgtcctacatc

SEQ ID NO: 323105 - DNA, 25 bp, Rattus norvegicus
gacctggtatagtctgtcctacatc

SEQ ID NO: 323106 - DNA, 25 bp, Rattus norvegicus
gacctggtatttctcatctatatga

SEQ ID NO: 323107 - DNA, 25 bp, Rattus norvegicus
gacctggtatttctgggcaatcccc

SEQ ID NO: 323108 - DNA, 25 bp, Rattus norvegicus
gacctggtatttgtcatctatatga

SEQ ID NO: 323109 - DNA, 25 bp, Rattus norvegicus
gacctggtatttgtgggcaatcccc

SEQ ID NO: 323110 - DNA, 25 bp, Rattus norvegicus
gacctggtcacacagctgatgctgc

SEQ ID NO: 323111 - DNA, 25 bp, Rattus norvegicus
gacctggtcacagagctgatgctgc

SEQ ID NO: 323112 - DNA, 25 bp, Rattus norvegicus
gacctggtcctgaaacttcgggaga

SEQ ID NO: 323113 - DNA, 25 bp, Rattus norvegicus
gacctggtcctgtaacttcgggaga

SEQ ID NO: 323114 - DNA, 25 bp, Rattus norvegicus
gacctggtctgtctggagagttcct

SEQ ID NO: 323115 - DNA, 25 bp, Rattus norvegicus
gacctggtctgtgtggagagttcct

SEQ ID NO: 323116 - DNA, 25 bp, Rattus norvegicus
gacctggtgcttcgtaattacaaga

SEQ ID NO: 323117 - DNA, 25 bp, Rattus norvegicus
gacctggtgcttggtaattacaaga

SEQ ID NO: 323118 - DNA, 25 bp, Rattus norvegicus
gacctggtggcacgaagccaaagaa

SEQ ID NO: 323119 - DNA, 25 bp, Rattus norvegicus
gacctggtggcaggaagccaaagaa

SEQ ID NO: 323120 - DNA, 25 bp, Rattus norvegicus
gacctggtgtacctggagccaagtc

SEQ ID NO: 323121 - DNA, 25 bp, Rattus norvegicus
gacctggtgtacgtggagccaagtc

SEQ ID NO: 323122 - DNA, 25 bp, Rattus norvegicus
gacctggttaatattcttctacatt

SEQ ID NO: 323123 - DNA, 25 bp, Rattus norvegicus
gacctggttaattttcttctacatt

SEQ ID NO: 323124 - DNA, 25 bp, Rattus norvegicus
gacctgtaatctccagtatctggga

SEQ ID NO: 323125 - DNA, 25 bp, Rattus norvegicus
gacctgtaatctgcagtatctggga

SEQ ID NO: 323126 - DNA, 25 bp, Rattus norvegicus
gacctgtacagacagatggacctgc

SEQ ID NO: 323127 - DNA, 25 bp, Rattus norvegicus
gacctgtacagagagatggacctgc

SEQ ID NO: 323128 - DNA, 25 bp, Rattus norvegicus
gacctgtacatgattgccctaatgg

SEQ ID NO: 323129 - DNA, 25 bp, Rattus norvegicus
gacctgtacatgtttgccctaatgg

SEQ ID NO: 323130 - DNA, 25 bp, Rattus norvegicus
gacctgtaccacaccatgtacatgg

SEQ ID NO: 323131 - DNA, 25 bp, Rattus norvegicus
gacctgtaccactccatgtacatgg

SEQ ID NO: 323132 - DNA, 25 bp, Rattus norvegicus
gacctgtaccagagcaatcgactta

SEQ ID NO: 323133 - DNA, 25 bp, Rattus norvegicus
gacctgtaccagtgcaatcgactta

SEQ ID NO: 323134 - DNA, 25 bp, Rattus norvegicus
gacctgtaggaacacatctggcatt

SEQ ID NO: 323135 - DNA, 25 bp, Rattus norvegicus
gacctgtaggaagacatctggcatt

SEQ ID NO: 323136 - DNA, 25 bp, Rattus norvegicus
gacctgtcaagacactcgggctgca

SEQ ID NO: 323137 - DNA, 25 bp, Rattus norvegicus
gacctgtcaagagactcgggctgca

SEQ ID NO: 323138 - DNA, 25 bp, Rattus norvegicus
gacctgtccatcagcttggtgtggt

SEQ ID NO: 323139 - DNA, 25 bp, Rattus norvegicus
gacctgtccatctgcttggtgtggt

SEQ ID NO: 323140 - DNA, 25 bp, Rattus norvegicus
gacctgtccgcgagtaagctgttca

SEQ ID NO: 323141 - DNA, 25 bp, Rattus norvegicus
gacctgtccgcgtgtaagctgttca

SEQ ID NO: 323142 - DNA, 25 bp, Rattus norvegicus
gacctgtcctctaaagttgattttc

SEQ ID NO: 323143 - DNA, 25 bp, Rattus norvegicus
gacctgtcctcttaagttgattttc

SEQ ID NO: 323144 - DNA, 25 bp, Rattus norvegicus
gacctgtccttgagaacatttctat

SEQ ID NO: 323145 - DNA, 25 bp, Rattus norvegicus
gacctgtccttgtgaacatttctat

SEQ ID NO: 323146 - DNA, 25 bp, Rattus norvegicus
gacctgtctttgagcactagcccct

SEQ ID NO: 323147 - DNA, 25 bp, Rattus norvegicus
gacctgtctttgtgcactagcccct

SEQ ID NO: 323148 - DNA, 25 bp, Rattus norvegicus
gacctgtgaacaaagctacgactga

SEQ ID NO: 323149 - DNA, 25 bp, Rattus norvegicus
gacctgtgaacatagctacgactga

SEQ ID NO: 323150 - DNA, 25 bp, Rattus norvegicus
gacctgtgcagccaggaacgtcctg

SEQ ID NO: 323151 - DNA, 25 bp, Rattus norvegicus
gacctgtgcagcgaggaacgtcctg

SEQ ID NO: 323152 - DNA, 25 bp, Rattus norvegicus
gacctgtgcattccagcatttccga

SEQ ID NO: 323153 - DNA, 25 bp, Rattus norvegicus
gacctgtgcattgcagcatttccga

SEQ ID NO: 323154 - DNA, 25 bp, Rattus norvegicus
gacctgtgctgtcaaactgtatgta

SEQ ID NO: 323155 - DNA, 25 bp, Rattus norvegicus
gacctgtgctgtgaaactgtatgta

SEQ ID NO: 323156 - DNA, 25 bp, Rattus norvegicus
gacctgtggaggaatgtttctctaa

SEQ ID NO: 323157 - DNA, 25 bp, Rattus norvegicus
gacctgtggaggtatgtttctctaa

SEQ ID NO: 323158 - DNA, 25 bp, Rattus norvegicus
gacctgtggcaaatgtggctaccct

SEQ ID NO: 323159 - DNA, 25 bp, Rattus norvegicus
gacctgtggcaattgtggctaccct

SEQ ID NO: 323160 - DNA, 25 bp, Rattus norvegicus
gacctgtggtgtatcctgtggtaaa

SEQ ID NO: 323161 - DNA, 25 bp, Rattus norvegicus
gacctgtggtgtttcctgtggtaaa

SEQ ID NO: 323162 - DNA, 25 bp, Rattus norvegicus
gacctgtgtccccaacacggaagag

SEQ ID NO: 323163 - DNA, 25 bp, Rattus norvegicus
gacctgtgtcccgaacacggaagag

SEQ ID NO: 323164 - DNA, 25 bp, Rattus norvegicus
gacctgtgtgatagcctgttatttc

SEQ ID NO: 323165 - DNA, 25 bp, Rattus norvegicus
gacctgtgtgattgcctgttatttc

SEQ ID NO: 323166 - DNA, 25 bp, Rattus norvegicus
gacctgtgtggtatacttgtagctg

SEQ ID NO: 323167 - DNA, 25 bp, Rattus norvegicus
gacctgtgtggtttacttgtagctg

SEQ ID NO: 323168 - DNA, 25 bp, Rattus norvegicus
gacctgtgttatatactttagctgc

SEQ ID NO: 323169 - DNA, 25 bp, Rattus norvegicus
gacctgtgttatttactttagctgc

SEQ ID NO: 323170 - DNA, 25 bp, Rattus norvegicus
gacctgttaaaccttagtgtgtgaa

SEQ ID NO: 323171 - DNA, 25 bp, Rattus norvegicus
gacctgttaaacgttagtgtgtgaa

SEQ ID NO: 323172 - DNA, 25 bp, Rattus norvegicus
gacctgttactgacacaaaatatta

SEQ ID NO: 323173 - DNA, 25 bp, Rattus norvegicus
gacctgttactgtcacaaaatatta

SEQ ID NO: 323174 - DNA, 25 bp, Rattus norvegicus
gacctgttattccatttgtttcatt

SEQ ID NO: 323175 - DNA, 25 bp, Rattus norvegicus
gacctgttattcgatttgtttcatt

SEQ ID NO: 323176 - DNA, 25 bp, Rattus norvegicus
gacctgttcgctcttttttatttga

SEQ ID NO: 323177 - DNA, 25 bp, Rattus norvegicus
gacctgttcgctgttttttatttga

SEQ ID NO: 323178 - DNA, 25 bp, Rattus norvegicus
gacctgttgagcagactgcaagccg

SEQ ID NO: 323179 - DNA, 25 bp, Rattus norvegicus
gacctgttgagctgactgcaagccg

SEQ ID NO: 323180 - DNA, 25 bp, Rattus norvegicus
gacctgttgatactggcccagaata

SEQ ID NO: 323181 - DNA, 25 bp, Rattus norvegicus
gacctgttgatagtggcccagaata

SEQ ID NO: 323182 - DNA, 25 bp, Rattus norvegicus
gacctgttgggtatgactcttgatt

SEQ ID NO: 323183 - DNA, 25 bp, Rattus norvegicus
gacctgttgggtttgactcttgatt

SEQ ID NO: 323184 - DNA, 25 bp, Rattus norvegicus
gacctgttgtgtatcttttttgttt

SEQ ID NO: 323185 - DNA, 25 bp, Rattus norvegicus
gacctgttgtgtttcttttttgttt

SEQ ID NO: 323186 - DNA, 25 bp, Rattus norvegicus
gacctgttgttgatatttttatttc

SEQ ID NO: 323187 - DNA, 25 bp, Rattus norvegicus
gacctgttgttgttatttttatttc

SEQ ID NO: 323188 - DNA, 25 bp, Rattus norvegicus
gacctgtttcgtcatatctgactgt

SEQ ID NO: 323189 - DNA, 25 bp, Rattus norvegicus
gacctgtttcgtgatatctgactgt

SEQ ID NO: 323190 - DNA, 25 bp, Rattus norvegicus
gacctgtttctaattgtgactaaaa

SEQ ID NO: 323191 - DNA, 25 bp, Rattus norvegicus
gacctgtttctatttgtgactaaaa

SEQ ID NO: 323192 - DNA, 25 bp, Rattus norvegicus
gacctgtttggacggacgtcatccc

SEQ ID NO: 323193 - DNA, 25 bp, Rattus norvegicus
gacctgtttggagggacgtcatccc

SEQ ID NO: 323194 - DNA, 25 bp, Rattus norvegicus
gacctgtttgtacaagtactgtggc

SEQ ID NO: 323195 - DNA, 25 bp, Rattus norvegicus
gacctgtttgtagaagtactgtggc

SEQ ID NO: 323196 - DNA, 25 bp, Rattus norvegicus
gacctgttttataaagctcctagtt

SEQ ID NO: 323197 - DNA, 25 bp, Rattus norvegicus
gacctgttttattaagctcctagtt

SEQ ID NO: 323198 - DNA, 25 bp, Rattus norvegicus
gacctgttttgcagcagtttgctag

SEQ ID NO: 323199 - DNA, 25 bp, Rattus norvegicus
gacctgttttgctgcagtttgctag

SEQ ID NO: 323200 - DNA, 25 bp, Rattus norvegicus
gaccttaacataagggctctgcaca

SEQ ID NO: 323201 - DNA, 25 bp, Rattus norvegicus
gaccttaacatatgggctctgcaca

SEQ ID NO: 323202 - DNA, 25 bp, Rattus norvegicus
gaccttaactcactaagtttgcaca

SEQ ID NO: 323203 - DNA, 25 bp, Rattus norvegicus
gaccttaactcagtaagtttgcaca

SEQ ID NO: 323204 - DNA, 25 bp, Rattus norvegicus
gaccttaactctcttcatattcttt

SEQ ID NO: 323205 - DNA, 25 bp, Rattus norvegicus
gaccttaactctgttcatattcttt

SEQ ID NO: 323206 - DNA, 25 bp, Rattus norvegicus
gaccttaatcttagtgcagcctgaa

SEQ ID NO: 323207 - DNA, 25 bp, Rattus norvegicus
gaccttaatctttgtgcagcctgaa

SEQ ID NO: 323208 - DNA, 25 bp, Rattus norvegicus
gaccttaattctaatttcactgctg

SEQ ID NO: 323209 - DNA, 25 bp, Rattus norvegicus
gaccttaattcttatttcactgctg

SEQ ID NO: 323210 - DNA, 25 bp, Rattus norvegicus
gaccttacacagatgacagaatgat

SEQ ID NO: 323211 - DNA, 25 bp, Rattus norvegicus
gaccttacacagttgacagaatgat

SEQ ID NO: 323212 - DNA, 25 bp, Rattus norvegicus
gaccttacccgtcaatacgttggtg

SEQ ID NO: 323213 - DNA, 25 bp, Rattus norvegicus
gaccttacccgtgaatacgttggtg

SEQ ID NO: 323214 - DNA, 25 bp, Rattus norvegicus
gaccttacgttgcatcagggtattt

SEQ ID NO: 323215 - DNA, 25 bp, Rattus norvegicus
gaccttacgttggatcagggtattt

SEQ ID NO: 323216 - DNA, 25 bp, Rattus norvegicus
gaccttactcaaacacacgaggttg

SEQ ID NO: 323217 - DNA, 25 bp, Rattus norvegicus
gaccttactcaatcacacgaggttg

SEQ ID NO: 323218 - DNA, 25 bp, Rattus norvegicus
gaccttactttcatgtgaggcacaa

SEQ ID NO: 323219 - DNA, 25 bp, Rattus norvegicus
gaccttactttcttgtgaggcacaa

SEQ ID NO: 323220 - DNA, 25 bp, Rattus norvegicus
gaccttagaccaattgaatctgttt

SEQ ID NO: 323221 - DNA, 25 bp, Rattus norvegicus
gaccttagaccatttgaatctgttt

SEQ ID NO: 323222 - DNA, 25 bp, Rattus norvegicus
gaccttagactgacatgtccccatt

SEQ ID NO: 323223 - DNA, 25 bp, Rattus norvegicus
gaccttagactgtcatgtccccatt

SEQ ID NO: 323224 - DNA, 25 bp, Rattus norvegicus
gaccttagacttaccaaataggcta

SEQ ID NO: 323225 - DNA, 25 bp, Rattus norvegicus
gaccttagactttccaaataggcta

SEQ ID NO: 323226 - DNA, 25 bp, Rattus norvegicus
gaccttagatgtctggctgagtact

SEQ ID NO: 323227 - DNA, 25 bp, Rattus norvegicus
gaccttagatgtgtggctgagtact

SEQ ID NO: 323228 - DNA, 25 bp, Rattus norvegicus
gaccttagccaaagaagcccacgtg

SEQ ID NO: 323229 - DNA, 25 bp, Rattus norvegicus
gaccttagccaatgaagcccacgtg

SEQ ID NO: 323230 - DNA, 25 bp, Rattus norvegicus
gaccttagcttcaccagacaagttt

SEQ ID NO: 323231 - DNA, 25 bp, Rattus norvegicus
gaccttagcttctccagacaagttt

SEQ ID NO: 323232 - DNA, 25 bp, Rattus norvegicus
gaccttagtgaaagacaggcagact

SEQ ID NO: 323233 - DNA, 25 bp, Rattus norvegicus
gaccttagtgaatgacaggcagact

SEQ ID NO: 323234 - DNA, 25 bp, Rattus norvegicus
gaccttatcggtctcgttacatagg

SEQ ID NO: 323235 - DNA, 25 bp, Rattus norvegicus
gaccttatcggtgtcgttacatagg

SEQ ID NO: 323236 - DNA, 25 bp, Rattus norvegicus
gaccttatctccaaactgaagttag

SEQ ID NO: 323237 - DNA, 25 bp, Rattus norvegicus
gaccttatctcctaactgaagttag

SEQ ID NO: 323238 - DNA, 25 bp, Rattus norvegicus
gaccttatgggacaaacactgccaa

SEQ ID NO: 323239 - DNA, 25 bp, Rattus norvegicus
gaccttatgggagaaacactgccaa

SEQ ID NO: 323240 - DNA, 25 bp, Rattus norvegicus
gaccttcaagacagcaactctgttt

SEQ ID NO: 323241 - DNA, 25 bp, Rattus norvegicus
gaccttcaagactgcaactctgttt

SEQ ID NO: 323242 - DNA, 25 bp, Rattus norvegicus
gaccttcacataattgggcagacct

SEQ ID NO: 323243 - DNA, 25 bp, Rattus norvegicus
gaccttcacatatttgggcagacct

SEQ ID NO: 323244 - DNA, 25 bp, Rattus norvegicus
gaccttcacattcggtggctttttt

SEQ ID NO: 323245 - DNA, 25 bp, Rattus norvegicus
gaccttcacattgggtggctttttt

SEQ ID NO: 323246 - DNA, 25 bp, Rattus norvegicus
gaccttcaggctccttttgaaagca

SEQ ID NO: 323247 - DNA, 25 bp, Rattus norvegicus
gaccttcaggctgcttttgaaagca

SEQ ID NO: 323248 - DNA, 25 bp, Rattus norvegicus
gaccttcatgggagtcctgaacaac

SEQ ID NO: 323249 - DNA, 25 bp, Rattus norvegicus
gaccttcatgggtgtcctgaacaac

SEQ ID NO: 323250 - DNA, 25 bp, Rattus norvegicus
gaccttcccagtatagactattcct

SEQ ID NO: 323251 - DNA, 25 bp, Rattus norvegicus
gaccttcccagtttagactattcct

SEQ ID NO: 323252 - DNA, 25 bp, Rattus norvegicus
gaccttccctaacaggaggtgcttt

SEQ ID NO: 323253 - DNA, 25 bp, Rattus norvegicus
gaccttccctaagaggaggtgcttt

SEQ ID NO: 323254 - DNA, 25 bp, Rattus norvegicus
gaccttccgatccaggttactttag

SEQ ID NO: 323255 - DNA, 25 bp, Rattus norvegicus
gaccttccgatcgaggttactttag

SEQ ID NO: 323256 - DNA, 25 bp, Rattus norvegicus
gaccttccgtgtcagtcattgctgt

SEQ ID NO: 323257 - DNA, 25 bp, Rattus norvegicus
gaccttccgtgtgagtcattgctgt

SEQ ID NO: 323258 - DNA, 25 bp, Rattus norvegicus
gaccttcctcctagccatgtaagag

SEQ ID NO: 323259 - DNA, 25 bp, Rattus norvegicus
gaccttcctccttgccatgtaagag

SEQ ID NO: 323260 - DNA, 25 bp, Rattus norvegicus
gaccttcctgaaacattcctgagag

SEQ ID NO: 323261 - DNA, 25 bp, Rattus norvegicus
gaccttcctgaatcattcctgagag

SEQ ID NO: 323262 - DNA, 25 bp, Rattus norvegicus
gaccttcctggactcaacattgaga

SEQ ID NO: 323263 - DNA, 25 bp, Rattus norvegicus
gaccttcctggagtcaacattgaga

SEQ ID NO: 323264 - DNA, 25 bp, Rattus norvegicus
gaccttcctgggaagaacaggcttt

SEQ ID NO: 323265 - DNA, 25 bp, Rattus norvegicus
gaccttcctgggtagaacaggcttt

SEQ ID NO: 323266 - DNA, 25 bp, Rattus norvegicus
gaccttcctgtccagatgtgagttc

SEQ ID NO: 323267 - DNA, 25 bp, Rattus norvegicus
gaccttcctgtcgagatgtgagttc

SEQ ID NO: 323268 - DNA, 25 bp, Rattus norvegicus
gaccttccttttccttagagactag

SEQ ID NO: 323269 - DNA, 25 bp, Rattus norvegicus
gaccttccttttgcttagagactag

SEQ ID NO: 323270 - DNA, 25 bp, Rattus norvegicus
gaccttcgcacaagtggtgctttga

SEQ ID NO: 323271 - DNA, 25 bp, Rattus norvegicus
gaccttcgcacatgtggtgctttga

SEQ ID NO: 323272 - DNA, 25 bp, Rattus norvegicus
gaccttcgcatgcacaatttgaaca

SEQ ID NO: 323273 - DNA, 25 bp, Rattus norvegicus
gaccttcgcatggacaatttgaaca

SEQ ID NO: 323274 - DNA, 25 bp, Rattus norvegicus
gaccttcgggtcagaggaactaacg

SEQ ID NO: 323275 - DNA, 25 bp, Rattus norvegicus
gaccttcgggtctgaggaactaacg

SEQ ID NO: 323276 - DNA, 25 bp, Rattus norvegicus
gaccttcgtagacaccatatttgca

SEQ ID NO: 323277 - DNA, 25 bp, Rattus norvegicus
gaccttcgtagagaccatatttgca

SEQ ID NO: 323278 - DNA, 25 bp, Rattus norvegicus
gaccttctaaacaggcatggacttg

SEQ ID NO: 323279 - DNA, 25 bp, Rattus norvegicus
gaccttctaaactggcatggacttg

SEQ ID NO: 323280 - DNA, 25 bp, Rattus norvegicus
gaccttctactcagttgactgggat

SEQ ID NO: 323281 - DNA, 25 bp, Rattus norvegicus
gaccttctactctgttgactgggat

SEQ ID NO: 323282 - DNA, 25 bp, Rattus norvegicus
gaccttctaggcagggatgcataat

SEQ ID NO: 323283 - DNA, 25 bp, Rattus norvegicus
gaccttctaggctgggatgcataat

SEQ ID NO: 323284 - DNA, 25 bp, Rattus norvegicus
gaccttctcagcacaaaatgttttg

SEQ ID NO: 323285 - DNA, 25 bp, Rattus norvegicus
gaccttctcagctcaaaatgttttg

SEQ ID NO: 323286 - DNA, 25 bp, Rattus norvegicus
gaccttctggtcaaggccctggaga

SEQ ID NO: 323287 - DNA, 25 bp, Rattus norvegicus
gaccttctggtctaggccctggaga

SEQ ID NO: 323288 - DNA, 25 bp, Rattus norvegicus
gaccttctgtagcagttgatccgat

SEQ ID NO: 323289 - DNA, 25 bp, Rattus norvegicus
gaccttctgtaggagttgatccgat

SEQ ID NO: 323290 - DNA, 25 bp, Rattus norvegicus
gaccttctgtccctgtgacaaaatt

SEQ ID NO: 323291 - DNA, 25 bp, Rattus norvegicus
gaccttctgtccgtgtgacaaaatt

SEQ ID NO: 323292 - DNA, 25 bp, Rattus norvegicus
gaccttcttcctcattaaacaactt

SEQ ID NO: 323293 - DNA, 25 bp, Rattus norvegicus
gaccttcttcctgattaaacaactt

SEQ ID NO: 323294 - DNA, 25 bp, Rattus norvegicus
gaccttcttgctcgactctgattat

SEQ ID NO: 323295 - DNA, 25 bp, Rattus norvegicus
gaccttcttgctggactctgattat

SEQ ID NO: 323296 - DNA, 25 bp, Rattus norvegicus
gaccttctttgcaggaattttctac

SEQ ID NO: 323297 - DNA, 25 bp, Rattus norvegicus
gaccttctttgctggaattttctac

SEQ ID NO: 323298 - DNA, 25 bp, Rattus norvegicus
gaccttgaaattccaggatggcaca

SEQ ID NO: 323299 - DNA, 25 bp, Rattus norvegicus
gaccttgaaattgcaggatggcaca

SEQ ID NO: 323300 - DNA, 25 bp, Rattus norvegicus
gaccttgaacaactggcctggcctc

SEQ ID NO: 323301 - DNA, 25 bp, Rattus norvegicus
gaccttgaacaagtggcctggcctc

SEQ ID NO: 323302 - DNA, 25 bp, Rattus norvegicus
gaccttgaactaaagctggatctca

SEQ ID NO: 323303 - DNA, 25 bp, Rattus norvegicus
gaccttgaactatagctggatctca

SEQ ID NO: 323304 - DNA, 25 bp, Rattus norvegicus
gaccttgaacttatacagtgtcacg

SEQ ID NO: 323305 - DNA, 25 bp, Rattus norvegicus
gaccttgaacttttacagtgtcacg

SEQ ID NO: 323306 - DNA, 25 bp, Rattus norvegicus
gaccttgaagaaatggatccagatt

SEQ ID NO: 323307 - DNA, 25 bp, Rattus norvegicus
gaccttgaagaattggatccagatt

SEQ ID NO: 323308 - DNA, 25 bp, Rattus norvegicus
gaccttgaaggcctttgtgccccat

SEQ ID NO: 323309 - DNA, 25 bp, Rattus norvegicus
gaccttgaaggcgtttgtgccccat

SEQ ID NO: 323310 - DNA, 25 bp, Rattus norvegicus
gaccttgacactaaacaagccttgg

SEQ ID NO: 323311 - DNA, 25 bp, Rattus norvegicus
gaccttgacacttaacaagccttgg

SEQ ID NO: 323312 - DNA, 25 bp, Rattus norvegicus
gaccttgacagtataagatggccca

SEQ ID NO: 323313 - DNA, 25 bp, Rattus norvegicus
gaccttgacagtttaagatggccca

SEQ ID NO: 323314 - DNA, 25 bp, Rattus norvegicus
gaccttgaccagctgttcatcggga

SEQ ID NO: 323315 - DNA, 25 bp, Rattus norvegicus
gaccttgaccaggtgttcatcggga

SEQ ID NO: 323316 - DNA, 25 bp, Rattus norvegicus
gaccttgacgtcattgatggcctgt

SEQ ID NO: 323317 - DNA, 25 bp, Rattus norvegicus
gaccttgacgtctttgatggcctgt

SEQ ID NO: 323318 - DNA, 25 bp, Rattus norvegicus
gaccttgactccatgaacgtcactg

SEQ ID NO: 323319 - DNA, 25 bp, Rattus norvegicus
gaccttgactccttgaacgtcactg

SEQ ID NO: 323320 - DNA, 25 bp, Rattus norvegicus
gaccttgactttcagggcaagcgag

SEQ ID NO: 323321 - DNA, 25 bp, Rattus norvegicus
gaccttgactttgagggcaagcgag

SEQ ID NO: 323322 - DNA, 25 bp, Rattus norvegicus
gaccttgagaagctacctgggcttc

SEQ ID NO: 323323 - DNA, 25 bp, Rattus norvegicus
gaccttgagaaggtacctgggcttc

SEQ ID NO: 323324 - DNA, 25 bp, Rattus norvegicus
gaccttgagactcacgttcaccatg

SEQ ID NO: 323325 - DNA, 25 bp, Rattus norvegicus
gaccttgagactgacgttcaccatg

SEQ ID NO: 323326 - DNA, 25 bp, Rattus norvegicus
gaccttgagagtctgggaaccaccc

SEQ ID NO: 323327 - DNA, 25 bp, Rattus norvegicus
gaccttgagagtgtgggaaccaccc

SEQ ID NO: 323328 - DNA, 25 bp, Rattus norvegicus
gaccttgaggcactataagcagtca

SEQ ID NO: 323329 - DNA, 25 bp, Rattus norvegicus
gaccttgaggcagtataagcagtca

SEQ ID NO: 323330 - DNA, 25 bp, Rattus norvegicus
gaccttgaggttctttgatgcttta

SEQ ID NO: 323331 - DNA, 25 bp, Rattus norvegicus
gaccttgaggttgtttgatgcttta

SEQ ID NO: 323332 - DNA, 25 bp, Rattus norvegicus
gaccttgagtgcaggtgtataggct

SEQ ID NO: 323333 - DNA, 25 bp, Rattus norvegicus
gaccttgagtgctggtgtataggct

SEQ ID NO: 323334 - DNA, 25 bp, Rattus norvegicus
gaccttgagttgatttctgcagtaa

SEQ ID NO: 323335 - DNA, 25 bp, Rattus norvegicus
gaccttgagttgttttctgcagtaa

SEQ ID NO: 323336 - DNA, 25 bp, Rattus norvegicus
gaccttgatcctaacatcgatgtga

SEQ ID NO: 323337 - DNA, 25 bp, Rattus norvegicus
gaccttgatccttacatcgatgtga

SEQ ID NO: 323338 - DNA, 25 bp, Rattus norvegicus
gaccttgatgacacaacagccacat

SEQ ID NO: 323339 - DNA, 25 bp, Rattus norvegicus
gaccttgatgacatgcttccaggat

SEQ ID NO: 323340 - DNA, 25 bp, Rattus norvegicus
gaccttgatgactcaacagccacat

SEQ ID NO: 323341 - DNA, 25 bp, Rattus norvegicus
gaccttgatgacttgcttccaggat

SEQ ID NO: 323342 - DNA, 25 bp, Rattus norvegicus
gaccttgatggcaagctttaggact

SEQ ID NO: 323343 - DNA, 25 bp, Rattus norvegicus
gaccttgatggctagctttaggact

SEQ ID NO: 323344 - DNA, 25 bp, Rattus norvegicus
gaccttgcagaaagtcctagaacta

SEQ ID NO: 323345 - DNA, 25 bp, Rattus norvegicus
gaccttgcagaactcagaatgtatc

SEQ ID NO: 323346 - DNA, 25 bp, Rattus norvegicus
gaccttgcagaagtcagaatgtatc

SEQ ID NO: 323347 - DNA, 25 bp, Rattus norvegicus
gaccttgcagaatgtcctagaacta

SEQ ID NO: 323348 - DNA, 25 bp, Rattus norvegicus
gaccttgcagctctgtgatgttagt

SEQ ID NO: 323349 - DNA, 25 bp, Rattus norvegicus
gaccttgcagctgtgtgatgttagt

SEQ ID NO: 323350 - DNA, 25 bp, Rattus norvegicus
gaccttgccatgctgtataagtcgt

SEQ ID NO: 323351 - DNA, 25 bp, Rattus norvegicus
gaccttgccatggtgtataagtcgt

SEQ ID NO: 323352 - DNA, 25 bp, Rattus norvegicus
gaccttgccccaagtcacatggctg

SEQ ID NO: 323353 - DNA, 25 bp, Rattus norvegicus
gaccttgccccatgtcacatggctg

SEQ ID NO: 323354 - DNA, 25 bp, Rattus norvegicus
gaccttgcccgaagagctattgttt

SEQ ID NO: 323355 - DNA, 25 bp, Rattus norvegicus
gaccttgcccgatgagctattgttt

SEQ ID NO: 323356 - DNA, 25 bp, Rattus norvegicus
gaccttgccctcactaagcaaatgt

SEQ ID NO: 323357 - DNA, 25 bp, Rattus norvegicus
gaccttgccctctctaagcaaatgt

SEQ ID NO: 323358 - DNA, 25 bp, Rattus norvegicus
gaccttgctaatagggttgtcaccc

SEQ ID NO: 323359 - DNA, 25 bp, Rattus norvegicus
gaccttgctaattgggttgtcaccc

SEQ ID NO: 323360 - DNA, 25 bp, Rattus norvegicus
gaccttgctggacaagtcatggcac

SEQ ID NO: 323361 - DNA, 25 bp, Rattus norvegicus
gaccttgctggagaagtcatggcac

SEQ ID NO: 323362 - DNA, 25 bp, Rattus norvegicus
gaccttgctgtcagactatgaagtg

SEQ ID NO: 323363 - DNA, 25 bp, Rattus norvegicus
gaccttgctgtctgactatgaagtg

SEQ ID NO: 323364 - DNA, 25 bp, Rattus norvegicus
gaccttggacccactttccagagaa

SEQ ID NO: 323365 - DNA, 25 bp, Rattus norvegicus
gaccttggaccctctttccagagaa

SEQ ID NO: 323366 - DNA, 25 bp, Rattus norvegicus
gaccttggactgacaggcttgcatt

SEQ ID NO: 323367 - DNA, 25 bp, Rattus norvegicus
gaccttggactgtcaggcttgcatt

SEQ ID NO: 323368 - DNA, 25 bp, Rattus norvegicus
gaccttggagatagatacgattgaa

SEQ ID NO: 323369 - DNA, 25 bp, Rattus norvegicus
gaccttggagattgatacgattgaa

SEQ ID NO: 323370 - DNA, 25 bp, Rattus norvegicus
gaccttggagttatctcaacctatt

SEQ ID NO: 323371 - DNA, 25 bp, Rattus norvegicus
gaccttggagttttctcaacctatt

SEQ ID NO: 323372 - DNA, 25 bp, Rattus norvegicus
gaccttggattgagtgtgcccagta

SEQ ID NO: 323373 - DNA, 25 bp, Rattus norvegicus
gaccttggattgtgtgtgcccagta

SEQ ID NO: 323374 - DNA, 25 bp, Rattus norvegicus
gaccttggccaacttgctatatcag

SEQ ID NO: 323375 - DNA, 25 bp, Rattus norvegicus
gaccttggccaagttgctatatcag

SEQ ID NO: 323376 - DNA, 25 bp, Rattus norvegicus
gaccttggctctccatatgttgtga

SEQ ID NO: 323377 - DNA, 25 bp, Rattus norvegicus
gaccttggctctgcatatgttgtga

SEQ ID NO: 323378 - DNA, 25 bp, Rattus norvegicus
gaccttgggcaacatatgactcact

SEQ ID NO: 323379 - DNA, 25 bp, Rattus norvegicus
gaccttgggcaagatatgactcact

SEQ ID NO: 323380 - DNA, 25 bp, Rattus norvegicus
gaccttgggcagcacctaagtctat

SEQ ID NO: 323381 - DNA, 25 bp, Rattus norvegicus
gaccttgggcaggacctaagtctat

SEQ ID NO: 323382 - DNA, 25 bp, Rattus norvegicus
gaccttgggtaccactaggaccaga

SEQ ID NO: 323383 - DNA, 25 bp, Rattus norvegicus
gaccttgggtacgactaggaccaga

SEQ ID NO: 323384 - DNA, 25 bp, Rattus norvegicus
gaccttgggttcagaatcgtgcact

SEQ ID NO: 323385 - DNA, 25 bp, Rattus norvegicus
gaccttgggttctgaatcgtgcact

SEQ ID NO: 323386 - DNA, 25 bp, Rattus norvegicus
gaccttgggtttactgttagacact

SEQ ID NO: 323387 - DNA, 25 bp, Rattus norvegicus
gaccttgggtttcttccacaacagg

SEQ ID NO: 323388 - DNA, 25 bp, Rattus norvegicus
gaccttgggtttgttccacaacagg

SEQ ID NO: 323389 - DNA, 25 bp, Rattus norvegicus
gaccttgggttttctgttagacact

SEQ ID NO: 323390 - DNA, 25 bp, Rattus norvegicus
gaccttggtattcctgtctttggaa

SEQ ID NO: 323391 - DNA, 25 bp, Rattus norvegicus
gaccttggtattgctgtctttggaa

SEQ ID NO: 323392 - DNA, 25 bp, Rattus norvegicus
gaccttggtcccctgcccaagagag

SEQ ID NO: 323393 - DNA, 25 bp, Rattus norvegicus
gaccttggtcccgtgcccaagagag

SEQ ID NO: 323394 - DNA, 25 bp, Rattus norvegicus
gaccttggtctgatcgacttggtga

SEQ ID NO: 323395 - DNA, 25 bp, Rattus norvegicus
gaccttggtctgttcgacttggtga

SEQ ID NO: 323396 - DNA, 25 bp, Rattus norvegicus
gaccttggtgatcagtctcaggaat

SEQ ID NO: 323397 - DNA, 25 bp, Rattus norvegicus
gaccttggtgatgagtctcaggaat

SEQ ID NO: 323398 - DNA, 25 bp, Rattus norvegicus
gaccttggtgctccctgaagattta

SEQ ID NO: 323399 - DNA, 25 bp, Rattus norvegicus
gaccttggtgctgcctgaagattta

SEQ ID NO: 323400 - DNA, 25 bp, Rattus norvegicus
gaccttggtgtactttggcagctga

SEQ ID NO: 323401 - DNA, 25 bp, Rattus norvegicus
gaccttggtgtagtttggcagctga

SEQ ID NO: 323402 - DNA, 25 bp, Rattus norvegicus
gaccttggttggacctttgacacat

SEQ ID NO: 323403 - DNA, 25 bp, Rattus norvegicus
gaccttggttggtcctttgacacat

SEQ ID NO: 323404 - DNA, 25 bp, Rattus norvegicus
gaccttgtacagacagggaccacag

SEQ ID NO: 323405 - DNA, 25 bp, Rattus norvegicus
gaccttgtacagtcagggaccacag

SEQ ID NO: 323406 - DNA, 25 bp, Rattus norvegicus
gaccttgtactccagtttggctgta

SEQ ID NO: 323407 - DNA, 25 bp, Rattus norvegicus
gaccttgtactcgagtttggctgta

SEQ ID NO: 323408 - DNA, 25 bp, Rattus norvegicus
gaccttgtcaaccaggctcctgaga

SEQ ID NO: 323409 - DNA, 25 bp, Rattus norvegicus
gaccttgtcaacgaggctcctgaga

SEQ ID NO: 323410 - DNA, 25 bp, Rattus norvegicus
gaccttgtccaaatgctgagaatca

SEQ ID NO: 323411 - DNA, 25 bp, Rattus norvegicus
gaccttgtccaattgctgagaatca

SEQ ID NO: 323412 - DNA, 25 bp, Rattus norvegicus
gaccttgtccccagcctgtgtagat

SEQ ID NO: 323413 - DNA, 25 bp, Rattus norvegicus
gaccttgtcccctgcctgtgtagat

SEQ ID NO: 323414 - DNA, 25 bp, Rattus norvegicus
gaccttgtctttcttgatttcctgc

SEQ ID NO: 323415 - DNA, 25 bp, Rattus norvegicus
gaccttgtctttgttgatttcctgc

SEQ ID NO: 323416 - DNA, 25 bp, Rattus norvegicus
gaccttgtgatgagaattgacctga

SEQ ID NO: 323417 - DNA, 25 bp, Rattus norvegicus
gaccttgtgatgtgaattgacctga

SEQ ID NO: 323418 - DNA, 25 bp, Rattus norvegicus
gaccttgtgcctcagggctcaaatc

SEQ ID NO: 323419 - DNA, 25 bp, Rattus norvegicus
gaccttgtgcctgagggctcaaatc

SEQ ID NO: 323420 - DNA, 25 bp, Rattus norvegicus
gaccttgtggagacccttgaaagaa

SEQ ID NO: 323421 - DNA, 25 bp, Rattus norvegicus
gaccttgtggagcagatcagaagaa

SEQ ID NO: 323422 - DNA, 25 bp, Rattus norvegicus
gaccttgtggaggagatcagaagaa

SEQ ID NO: 323423 - DNA, 25 bp, Rattus norvegicus
gaccttgtggagtcccttgaaagaa

SEQ ID NO: 323424 - DNA, 25 bp, Rattus norvegicus
gaccttgtgtttatgaacctttcag

SEQ ID NO: 323425 - DNA, 25 bp, Rattus norvegicus
gaccttgtgtttttgaacctttcag

SEQ ID NO: 323426 - DNA, 25 bp, Rattus norvegicus
gaccttgttaagcagttccagctgg

SEQ ID NO: 323427 - DNA, 25 bp, Rattus norvegicus
gaccttgttaagcatgctggttgca

SEQ ID NO: 323428 - DNA, 25 bp, Rattus norvegicus
gaccttgttaaggagttccagctgg

SEQ ID NO: 323429 - DNA, 25 bp, Rattus norvegicus
gaccttgttaaggatgctggttgca

SEQ ID NO: 323430 - DNA, 25 bp, Rattus norvegicus
gaccttgttatgacaaccaggctgg

SEQ ID NO: 323431 - DNA, 25 bp, Rattus norvegicus
gaccttgttatgtcaaccaggctgg

SEQ ID NO: 323432 - DNA, 25 bp, Rattus norvegicus
gaccttgttcaaatatgtaaaccag

SEQ ID NO: 323433 - DNA, 25 bp, Rattus norvegicus
gaccttgttcaacctctgacatgac

SEQ ID NO: 323434 - DNA, 25 bp, Rattus norvegicus
gaccttgttcaagctctgacatgac

SEQ ID NO: 323435 - DNA, 25 bp, Rattus norvegicus
gaccttgttcaattatgtaaaccag

SEQ ID NO: 323436 - DNA, 25 bp, Rattus norvegicus
gaccttgttcagcagtcgtgtaact

SEQ ID NO: 323437 - DNA, 25 bp, Rattus norvegicus
gaccttgttcaggagtcgtgtaact

SEQ ID NO: 323438 - DNA, 25 bp, Rattus norvegicus
gaccttgttggaccttctacagatt

SEQ ID NO: 323439 - DNA, 25 bp, Rattus norvegicus
gaccttgttggagcttctacagatt

SEQ ID NO: 323440 - DNA, 25 bp, Rattus norvegicus
gaccttgttgtcaaaggagtcactg

SEQ ID NO: 323441 - DNA, 25 bp, Rattus norvegicus
gaccttgttgtctaaggagtcactg

SEQ ID NO: 323442 - DNA, 25 bp, Rattus norvegicus
gacctttaacctacacttatccaag

SEQ ID NO: 323443 - DNA, 25 bp, Rattus norvegicus
gacctttaaccttcacttatccaag

SEQ ID NO: 323444 - DNA, 25 bp, Rattus norvegicus
gacctttaagtactcccatttgcat

SEQ ID NO: 323445 - DNA, 25 bp, Rattus norvegicus
gacctttaagtagtcccatttgcat

SEQ ID NO: 323446 - DNA, 25 bp, Rattus norvegicus
gacctttaatggcttacccttgcaa

SEQ ID NO: 323447 - DNA, 25 bp, Rattus norvegicus
gacctttaatgggttacccttgcaa

SEQ ID NO: 323448 - DNA, 25 bp, Rattus norvegicus
gacctttacaggaggcctttctagt

SEQ ID NO: 323449 - DNA, 25 bp, Rattus norvegicus
gacctttacaggtggcctttctagt

SEQ ID NO: 323450 - DNA, 25 bp, Rattus norvegicus
gacctttagacactggaccaggcct

SEQ ID NO: 323451 - DNA, 25 bp, Rattus norvegicus
gacctttagacagtggaccaggcct

SEQ ID NO: 323452 - DNA, 25 bp, Rattus norvegicus
gacctttagcgtatctagcaaccta

SEQ ID NO: 323453 - DNA, 25 bp, Rattus norvegicus
gacctttagcgtttctagcaaccta

SEQ ID NO: 323454 - DNA, 25 bp, Rattus norvegicus
gacctttaggcacgttcgctttgca

SEQ ID NO: 323455 - DNA, 25 bp, Rattus norvegicus
gacctttaggcaggttcgctttgca

SEQ ID NO: 323456 - DNA, 25 bp, Rattus norvegicus
gacctttatcacaaactctaatgga

SEQ ID NO: 323457 - DNA, 25 bp, Rattus norvegicus
gacctttatcactaactctaatgga

SEQ ID NO: 323458 - DNA, 25 bp, Rattus norvegicus
gacctttcaggtagtgtatctcaaa

SEQ ID NO: 323459 - DNA, 25 bp, Rattus norvegicus
gacctttcaggttgtgtatctcaaa

SEQ ID NO: 323460 - DNA, 25 bp, Rattus norvegicus
gacctttcatggagaccttgggcag

SEQ ID NO: 323461 - DNA, 25 bp, Rattus norvegicus
gacctttcatggtgaccttgggcag

SEQ ID NO: 323462 - DNA, 25 bp, Rattus norvegicus
gacctttccagccattggtttggaa

SEQ ID NO: 323463 - DNA, 25 bp, Rattus norvegicus
gacctttccagcgattggtttggaa

SEQ ID NO: 323464 - DNA, 25 bp, Rattus norvegicus
gacctttccggaaaagttctgagca

SEQ ID NO: 323465 - DNA, 25 bp, Rattus norvegicus
gacctttccggataagttctgagca

SEQ ID NO: 323466 - DNA, 25 bp, Rattus norvegicus
gacctttcctcgaagtacatctgta

SEQ ID NO: 323467 - DNA, 25 bp, Rattus norvegicus
gacctttcctcgtagtacatctgta

SEQ ID NO: 323468 - DNA, 25 bp, Rattus norvegicus
gacctttcctctagtcatacaggga

SEQ ID NO: 323469 - DNA, 25 bp, Rattus norvegicus
gacctttcctcttgtcatacaggga

SEQ ID NO: 323470 - DNA, 25 bp, Rattus norvegicus
gacctttcgactcatgttgctggaa

SEQ ID NO: 323471 - DNA, 25 bp, Rattus norvegicus
gacctttcgactgatgttgctggaa

SEQ ID NO: 323472 - DNA, 25 bp, Rattus norvegicus
gacctttcggcgacctcagatagac

SEQ ID NO: 323473 - DNA, 25 bp, Rattus norvegicus
gacctttcggcgtcctcagatagac

SEQ ID NO: 323474 - DNA, 25 bp, Rattus norvegicus
gacctttctcctcattgacaaagtc

SEQ ID NO: 323475 - DNA, 25 bp, Rattus norvegicus
gacctttctcctgattgacaaagtc

SEQ ID NO: 323476 - DNA, 25 bp, Rattus norvegicus
gacctttctcttactgagattctac

SEQ ID NO: 323477 - DNA, 25 bp, Rattus norvegicus
gacctttctcttctatcttttttct

SEQ ID NO: 323478 - DNA, 25 bp, Rattus norvegicus
gacctttctcttgtatcttttttct

SEQ ID NO: 323479 - DNA, 25 bp, Rattus norvegicus
gacctttctctttctgagattctac

SEQ ID NO: 323480 - DNA, 25 bp, Rattus norvegicus
gacctttctgctcctagggctgggt

SEQ ID NO: 323481 - DNA, 25 bp, Rattus norvegicus
gacctttctgctgctagggctgggt

SEQ ID NO: 323482 - DNA, 25 bp, Rattus norvegicus
gacctttgagatatctgagcctgtg

SEQ ID NO: 323483 - DNA, 25 bp, Rattus norvegicus
gacctttgagatttctgagcctgtg

SEQ ID NO: 323484 - DNA, 25 bp, Rattus norvegicus
gacctttgagtaagcacttgcctga

SEQ ID NO: 323485 - DNA, 25 bp, Rattus norvegicus
gacctttgagtatgcacttgcctga

SEQ ID NO: 323486 - DNA, 25 bp, Rattus norvegicus
gacctttgatctactgggtgagtca

SEQ ID NO: 323487 - DNA, 25 bp, Rattus norvegicus
gacctttgatcttctgggtgagtca

SEQ ID NO: 323488 - DNA, 25 bp, Rattus norvegicus
gacctttgcaatcttctgcttttga

SEQ ID NO: 323489 - DNA, 25 bp, Rattus norvegicus
gacctttgcaatgttctgcttttga

SEQ ID NO: 323490 - DNA, 25 bp, Rattus norvegicus
gacctttgcctacaatgtcttttca

SEQ ID NO: 323491 - DNA, 25 bp, Rattus norvegicus
gacctttgcctagaatgtcttttca

SEQ ID NO: 323492 - DNA, 25 bp, Rattus norvegicus
gacctttgcctcattattttgtcaa

SEQ ID NO: 323493 - DNA, 25 bp, Rattus norvegicus
gacctttgcctctttattttgtcaa

SEQ ID NO: 323494 - DNA, 25 bp, Rattus norvegicus
gacctttgcctgacatctgaatggt

SEQ ID NO: 323495 - DNA, 25 bp, Rattus norvegicus
gacctttgcctgtcatctgaatggt

SEQ ID NO: 323496 - DNA, 25 bp, Rattus norvegicus
gacctttggaaacccggattgcctc

SEQ ID NO: 323497 - DNA, 25 bp, Rattus norvegicus
gacctttggaaagccggattgcctc

SEQ ID NO: 323498 - DNA, 25 bp, Rattus norvegicus
gacctttggagtaacagttggcatt

SEQ ID NO: 323499 - DNA, 25 bp, Rattus norvegicus
gacctttggagttacagttggcatt

SEQ ID NO: 323500 - DNA, 25 bp, Rattus norvegicus
gacctttgggtactttgctcacgtg

SEQ ID NO: 323501 - DNA, 25 bp, Rattus norvegicus
gacctttgggtagtttgctcacgtg

SEQ ID NO: 323502 - DNA, 25 bp, Rattus norvegicus
gacctttgggtcaccggcctgcagg

SEQ ID NO: 323503 - DNA, 25 bp, Rattus norvegicus
gacctttgggtctccggcctgcagg

SEQ ID NO: 323504 - DNA, 25 bp, Rattus norvegicus
gacctttggttcctcatctttagat

SEQ ID NO: 323505 - DNA, 25 bp, Rattus norvegicus
gacctttggttcgtcatctttagat

SEQ ID NO: 323506 - DNA, 25 bp, Rattus norvegicus
gacctttgtacaaattagctcccat

SEQ ID NO: 323507 - DNA, 25 bp, Rattus norvegicus
gacctttgtacatattagctcccat

SEQ ID NO: 323508 - DNA, 25 bp, Rattus norvegicus
gacctttgtagacataggctcctcc

SEQ ID NO: 323509 - DNA, 25 bp, Rattus norvegicus
gacctttgtagagataggctcctcc

SEQ ID NO: 323510 - DNA, 25 bp, Rattus norvegicus
gacctttgtggtcattttctcaaga

SEQ ID NO: 323511 - DNA, 25 bp, Rattus norvegicus
gacctttgtggtcttctgtgattat

SEQ ID NO: 323512 - DNA, 25 bp, Rattus norvegicus
gacctttgtggtgattttctcaaga

SEQ ID NO: 323513 - DNA, 25 bp, Rattus norvegicus
gacctttgtggtgttctgtgattat

SEQ ID NO: 323514 - DNA, 25 bp, Rattus norvegicus
gacctttgtgtaaggtggcctcagc

SEQ ID NO: 323515 - DNA, 25 bp, Rattus norvegicus
gacctttgtgtaagtagttcttgca

SEQ ID NO: 323516 - DNA, 25 bp, Rattus norvegicus
gacctttgtgtatggtggcctcagc

SEQ ID NO: 323517 - DNA, 25 bp, Rattus norvegicus
gacctttgtgtatgtagttcttgca

SEQ ID NO: 323518 - DNA, 25 bp, Rattus norvegicus
gacctttgttatcttctgtgggaaa

SEQ ID NO: 323519 - DNA, 25 bp, Rattus norvegicus
gacctttgttatgttctgtgggaaa

SEQ ID NO: 323520 - DNA, 25 bp, Rattus norvegicus
gaccttttaaagagtttcagctaag

SEQ ID NO: 323521 - DNA, 25 bp, Rattus norvegicus
gaccttttaaagtgtttcagctaag

SEQ ID NO: 323522 - DNA, 25 bp, Rattus norvegicus
gaccttttaagaaactcagactcca

SEQ ID NO: 323523 - DNA, 25 bp, Rattus norvegicus
gaccttttaagatactcagactcca

SEQ ID NO: 323524 - DNA, 25 bp, Rattus norvegicus
gaccttttactaatgttcctccttg

SEQ ID NO: 323525 - DNA, 25 bp, Rattus norvegicus
gaccttttactattgttcctccttg

SEQ ID NO: 323526 - DNA, 25 bp, Rattus norvegicus
gaccttttagttctgggaccttcat

SEQ ID NO: 323527 - DNA, 25 bp, Rattus norvegicus
gaccttttagttgtgggaccttcat

SEQ ID NO: 323528 - DNA, 25 bp, Rattus norvegicus
gaccttttatttagacaacctgcta

SEQ ID NO: 323529 - DNA, 25 bp, Rattus norvegicus
gaccttttattttgacaacctgcta

SEQ ID NO: 323530 - DNA, 25 bp, Rattus norvegicus
gaccttttcacacagtcagctatat

SEQ ID NO: 323531 - DNA, 25 bp, Rattus norvegicus
gaccttttcacagagtcagctatat

SEQ ID NO: 323532 - DNA, 25 bp, Rattus norvegicus
gaccttttccaacatccaatcatag

SEQ ID NO: 323533 - DNA, 25 bp, Rattus norvegicus
gaccttttccaagatccaatcatag

SEQ ID NO: 323534 - DNA, 25 bp, Rattus norvegicus
gaccttttccatctctttgggatat

SEQ ID NO: 323535 - DNA, 25 bp, Rattus norvegicus
gaccttttccatgtctttgggatat

SEQ ID NO: 323536 - DNA, 25 bp, Rattus norvegicus
gaccttttctatatgttctactctg

SEQ ID NO: 323537 - DNA, 25 bp, Rattus norvegicus
gaccttttctatttgttctactctg

SEQ ID NO: 323538 - DNA, 25 bp, Rattus norvegicus
gaccttttctcacataggtgtcatt

SEQ ID NO: 323539 - DNA, 25 bp, Rattus norvegicus
gaccttttctcacgctcaactttat

SEQ ID NO: 323540 - DNA, 25 bp, Rattus norvegicus
gaccttttctcagataggtgtcatt

SEQ ID NO: 323541 - DNA, 25 bp, Rattus norvegicus
gaccttttctcaggctcaactttat

SEQ ID NO: 323542 - DNA, 25 bp, Rattus norvegicus
gaccttttctctacaagttgtgcga

SEQ ID NO: 323543 - DNA, 25 bp, Rattus norvegicus
gaccttttctctcatttttgatagc

SEQ ID NO: 323544 - DNA, 25 bp, Rattus norvegicus
gaccttttctctgatttttgatagc

SEQ ID NO: 323545 - DNA, 25 bp, Rattus norvegicus
gaccttttctcttcaagttgtgcga

SEQ ID NO: 323546 - DNA, 25 bp, Rattus norvegicus
gaccttttcttcaatgcgcagttgg

SEQ ID NO: 323547 - DNA, 25 bp, Rattus norvegicus
gaccttttcttctatgcgcagttgg

SEQ ID NO: 323548 - DNA, 25 bp, Rattus norvegicus
gaccttttgaagacagtgtgtgcac

SEQ ID NO: 323549 - DNA, 25 bp, Rattus norvegicus
gaccttttgaagtcagtgtgtgcac

SEQ ID NO: 323550 - DNA, 25 bp, Rattus norvegicus
gaccttttgcatactcttcagacac

SEQ ID NO: 323551 - DNA, 25 bp, Rattus norvegicus
gaccttttgcattctcttcagacac

SEQ ID NO: 323552 - DNA, 25 bp, Rattus norvegicus
gaccttttggctccagtttcatgtt

SEQ ID NO: 323553 - DNA, 25 bp, Rattus norvegicus
gaccttttggctgcagtttcatgtt

SEQ ID NO: 323554 - DNA, 25 bp, Rattus norvegicus
gaccttttgggcactccacagaaaa

SEQ ID NO: 323555 - DNA, 25 bp, Rattus norvegicus
gaccttttgggctctccacagaaaa

SEQ ID NO: 323556 - DNA, 25 bp, Rattus norvegicus
gacctttttctcagtaagcatcata

SEQ ID NO: 323557 - DNA, 25 bp, Rattus norvegicus
gacctttttctctgtaagcatcata

SEQ ID NO: 323558 - DNA, 25 bp, Rattus norvegicus
gaccttttttcactgtatgtgctac

SEQ ID NO: 323559 - DNA, 25 bp, Rattus norvegicus
gaccttttttcagtgtatgtgctac

SEQ ID NO: 323560 - DNA, 25 bp, Rattus norvegicus
gacgaaaacaccaccagtatccaag

SEQ ID NO: 323561 - DNA, 25 bp, Rattus norvegicus
gacgaaaacacctccagtatccaag

SEQ ID NO: 323562 - DNA, 25 bp, Rattus norvegicus
gacgaaacaaatcaaaaccccagat

SEQ ID NO: 323563 - DNA, 25 bp, Rattus norvegicus
gacgaaacaaatgaaaaccccagat

SEQ ID NO: 323564 - DNA, 25 bp, Rattus norvegicus
gacgaaacagtccatagcctaggac

SEQ ID NO: 323565 - DNA, 25 bp, Rattus norvegicus
gacgaaacagtcgatagcctaggac

SEQ ID NO: 323566 - DNA, 25 bp, Rattus norvegicus
gacgaaacatttatcctagtgtgga

SEQ ID NO: 323567 - DNA, 25 bp, Rattus norvegicus
gacgaaacatttttcctagtgtgga

SEQ ID NO: 323568 - DNA, 25 bp, Rattus norvegicus
gacgaaaccgtcctgttccgctact

SEQ ID NO: 323569 - DNA, 25 bp, Rattus norvegicus
gacgaaaccgtcgtgttccgctact

SEQ ID NO: 323570 - DNA, 25 bp, Rattus norvegicus
gacgaaactcagcacgagcagctca

SEQ ID NO: 323571 - DNA, 25 bp, Rattus norvegicus
gacgaaactcaggacgagcagctca

SEQ ID NO: 323572 - DNA, 25 bp, Rattus norvegicus
gacgaaagaccacccaactctcaga

SEQ ID NO: 323573 - DNA, 25 bp, Rattus norvegicus
gacgaaagaccagccaactctcaga

SEQ ID NO: 323574 - DNA, 25 bp, Rattus norvegicus
gacgaaagagaacctttgttcctga

SEQ ID NO: 323575 - DNA, 25 bp, Rattus norvegicus
gacgaaagagaagctttgttcctga

SEQ ID NO: 323576 - DNA, 25 bp, Rattus norvegicus
gacgaaagcacgcagtaactccttt

SEQ ID NO: 323577 - DNA, 25 bp, Rattus norvegicus
gacgaaagcacggagtaactccttt

SEQ ID NO: 323578 - DNA, 25 bp, Rattus norvegicus
gacgaaagccaactcgcctggagct

SEQ ID NO: 323579 - DNA, 25 bp, Rattus norvegicus
gacgaaagccaagtcgcctggagct

SEQ ID NO: 323580 - DNA, 25 bp, Rattus norvegicus
gacgaaagcccaagcggtggaaccc

SEQ ID NO: 323581 - DNA, 25 bp, Rattus norvegicus
gacgaaagcccatgcggtggaaccc

SEQ ID NO: 323582 - DNA, 25 bp, Rattus norvegicus
gacgaaaggaacatctccttctata

SEQ ID NO: 323583 - DNA, 25 bp, Rattus norvegicus
gacgaaaggaacttctccttctata

SEQ ID NO: 323584 - DNA, 25 bp, Rattus norvegicus
gacgaaatctagaccatcaccaaaa

SEQ ID NO: 323585 - DNA, 25 bp, Rattus norvegicus
gacgaaatctagtccatcaccaaaa

SEQ ID NO: 323586 - DNA, 25 bp, Rattus norvegicus
gacgaaatctctagagtcctttgcc

SEQ ID NO: 323587 - DNA, 25 bp, Rattus norvegicus
gacgaaatctcttgagtcctttgcc

SEQ ID NO: 323588 - DNA, 25 bp, Rattus norvegicus
gacgaacaagagatatttccaatga

SEQ ID NO: 323589 - DNA, 25 bp, Rattus norvegicus
gacgaacaagagttatttccaatga

SEQ ID NO: 323590 - DNA, 25 bp, Rattus norvegicus
gacgaacctttcctatgtaaactgt

SEQ ID NO: 323591 - DNA, 25 bp, Rattus norvegicus
gacgaacctttcgtatgtaaactgt

SEQ ID NO: 323592 - DNA, 25 bp, Rattus norvegicus
gacgaactcttcagaatgctcagca

SEQ ID NO: 323593 - DNA, 25 bp, Rattus norvegicus
gacgaactcttctgaatgctcagca

SEQ ID NO: 323594 - DNA, 25 bp, Rattus norvegicus
gacgaactgagcaggtccacggcgc

SEQ ID NO: 323595 - DNA, 25 bp, Rattus norvegicus
gacgaactgagctggtccacggcgc

SEQ ID NO: 323596 - DNA, 25 bp, Rattus norvegicus
gacgaactgcatatcctggacatgg

SEQ ID NO: 323597 - DNA, 25 bp, Rattus norvegicus
gacgaactgcatttcctggacatgg

SEQ ID NO: 323598 - DNA, 25 bp, Rattus norvegicus
gacgaactggtcatgcgcggctgcc

SEQ ID NO: 323599 - DNA, 25 bp, Rattus norvegicus
gacgaactggtcttgcgcggctgcc

SEQ ID NO: 323600 - DNA, 25 bp, Rattus norvegicus
gacgaacttgtaactgttagtctgt

SEQ ID NO: 323601 - DNA, 25 bp, Rattus norvegicus
gacgaacttgtatctgttagtctgt

SEQ ID NO: 323602 - DNA, 25 bp, Rattus norvegicus
gacgaagaaaatcccgttctctctc

SEQ ID NO: 323603 - DNA, 25 bp, Rattus norvegicus
gacgaagaaaatgccgttctctctc

SEQ ID NO: 323604 - DNA, 25 bp, Rattus norvegicus
gacgaagaatcgacctccagttcct

SEQ ID NO: 323605 - DNA, 25 bp, Rattus norvegicus
gacgaagaatcgtcctccagttcct

SEQ ID NO: 323606 - DNA, 25 bp, Rattus norvegicus
gacgaagagctgaaggacgcctttc

SEQ ID NO: 323607 - DNA, 25 bp, Rattus norvegicus
gacgaagagctgtaggacgcctttc

SEQ ID NO: 323608 - DNA, 25 bp, Rattus norvegicus
gacgaagagtttcaagcacccctcc

SEQ ID NO: 323609 - DNA, 25 bp, Rattus norvegicus
gacgaagagtttgaagcacccctcc

SEQ ID NO: 323610 - DNA, 25 bp, Rattus norvegicus
gacgaagcttctccaaagttcctga

SEQ ID NO: 323611 - DNA, 25 bp, Rattus norvegicus
gacgaagcttctgcaaagttcctga

SEQ ID NO: 323612 - DNA, 25 bp, Rattus norvegicus
gacgaaggaacaccgccgggaaata

SEQ ID NO: 323613 - DNA, 25 bp, Rattus norvegicus
gacgaaggaacagcgccgggaaata

SEQ ID NO: 323614 - DNA, 25 bp, Rattus norvegicus
gacgaaggacagagtgtttagcttt

SEQ ID NO: 323615 - DNA, 25 bp, Rattus norvegicus
gacgaaggacagtgtgtttagcttt

SEQ ID NO: 323616 - DNA, 25 bp, Rattus norvegicus
gacgaagtattcctgatgtataaca

SEQ ID NO: 323617 - DNA, 25 bp, Rattus norvegicus
gacgaagtattcgtgatgtataaca

SEQ ID NO: 323618 - DNA, 25 bp, Rattus norvegicus
gacgaagtctcacccctgtgttcaa

SEQ ID NO: 323619 - DNA, 25 bp, Rattus norvegicus
gacgaagtctcagccctgtgttcaa

SEQ ID NO: 323620 - DNA, 25 bp, Rattus norvegicus
gacgaagtcttcaaatgccctttcc

SEQ ID NO: 323621 - DNA, 25 bp, Rattus norvegicus
gacgaagtcttctaatgccctttcc

SEQ ID NO: 323622 - DNA, 25 bp, Rattus norvegicus
gacgaagtgttgctttgttcattga

SEQ ID NO: 323623 - DNA, 25 bp, Rattus norvegicus
gacgaagtgttggtttgttcattga

SEQ ID NO: 323624 - DNA, 25 bp, Rattus norvegicus
gacgaagttcttatgtgggcacttg

SEQ ID NO: 323625 - DNA, 25 bp, Rattus norvegicus
gacgaagttcttttgtgggcacttg

SEQ ID NO: 323626 - DNA, 25 bp, Rattus norvegicus
gacgaataaattaccctgaagttga

SEQ ID NO: 323627 - DNA, 25 bp, Rattus norvegicus
gacgaataaatttccctgaagttga

SEQ ID NO: 323628 - DNA, 25 bp, Rattus norvegicus
gacgaatatgatagtttgatgtacc

SEQ ID NO: 323629 - DNA, 25 bp, Rattus norvegicus
gacgaatatgattgtttgatgtacc

SEQ ID NO: 323630 - DNA, 25 bp, Rattus norvegicus
gacgaatctatcagtggttttaagt

SEQ ID NO: 323631 - DNA, 25 bp, Rattus norvegicus
gacgaatctatctgtggttttaagt

SEQ ID NO: 323632 - DNA, 25 bp, Rattus norvegicus
gacgaatgcaggacagttcccaccg

SEQ ID NO: 323633 - DNA, 25 bp, Rattus norvegicus
gacgaatgcaggtcagttcccaccg

SEQ ID NO: 323634 - DNA, 25 bp, Rattus norvegicus
gacgaatggtgcaaggttctccaga

SEQ ID NO: 323635 - DNA, 25 bp, Rattus norvegicus
gacgaatggtgctaggttctccaga

SEQ ID NO: 323636 - DNA, 25 bp, Rattus norvegicus
gacgaatgtatcacgtgccacgtta

SEQ ID NO: 323637 - DNA, 25 bp, Rattus norvegicus
gacgaatgtatctcgtgccacgtta

SEQ ID NO: 323638 - DNA, 25 bp, Rattus norvegicus
gacgaattatttctgcggaacgcca

SEQ ID NO: 323639 - DNA, 25 bp, Rattus norvegicus
gacgaattatttgtgcggaacgcca

SEQ ID NO: 323640 - DNA, 25 bp, Rattus norvegicus
gacgaattctagctttcttaagact

SEQ ID NO: 323641 - DNA, 25 bp, Rattus norvegicus
gacgaattctaggtttcttaagact

SEQ ID NO: 323642 - DNA, 25 bp, Rattus norvegicus
gacgaattctgacctggacttgagt

SEQ ID NO: 323643 - DNA, 25 bp, Rattus norvegicus
gacgaattctgagctggacttgagt

SEQ ID NO: 323644 - DNA, 25 bp, Rattus norvegicus
gacgaattgggccattcctggaaca

SEQ ID NO: 323645 - DNA, 25 bp, Rattus norvegicus
gacgaattgggcgattcctggaaca

SEQ ID NO: 323646 - DNA, 25 bp, Rattus norvegicus
gacgacaacactccgctgagggcag

SEQ ID NO: 323647 - DNA, 25 bp, Rattus norvegicus
gacgacaacactgcgctgagggcag

SEQ ID NO: 323648 - DNA, 25 bp, Rattus norvegicus
gacgacaagcttccctcaaatgtga

SEQ ID NO: 323649 - DNA, 25 bp, Rattus norvegicus
gacgacaagcttgcctcaaatgtga

SEQ ID NO: 323650 - DNA, 25 bp, Rattus norvegicus
gacgacaagtcccttcttaggtatt

SEQ ID NO: 323651 - DNA, 25 bp, Rattus norvegicus
gacgacaagtccgttcttaggtatt

SEQ ID NO: 323652 - DNA, 25 bp, Rattus norvegicus
gacgacaatggtaggccgtttctta

SEQ ID NO: 323653 - DNA, 25 bp, Rattus norvegicus
gacgacaatggttggccgtttctta

SEQ ID NO: 323654 - DNA, 25 bp, Rattus norvegicus
gacgacacaaagctggtctcagaag

SEQ ID NO: 323655 - DNA, 25 bp, Rattus norvegicus
gacgacacaaaggtggtctcagaag

SEQ ID NO: 323656 - DNA, 25 bp, Rattus norvegicus
gacgacacaaccaatttgaagatga

SEQ ID NO: 323657 - DNA, 25 bp, Rattus norvegicus
gacgacacaacctatttgaagatga

SEQ ID NO: 323658 - DNA, 25 bp, Rattus norvegicus
gacgacacactcctgctaaaggaag

SEQ ID NO: 323659 - DNA, 25 bp, Rattus norvegicus
gacgacacactcgtgctaaaggaag

SEQ ID NO: 323660 - DNA, 25 bp, Rattus norvegicus
gacgacacagtcaacatgggcaaag

SEQ ID NO: 323661 - DNA, 25 bp, Rattus norvegicus
gacgacacagtctacatgggcaaag

SEQ ID NO: 323662 - DNA, 25 bp, Rattus norvegicus
gacgacacgcttcgcaaacaggcat

SEQ ID NO: 323663 - DNA, 25 bp, Rattus norvegicus
gacgacacgcttggcaaacaggcat

SEQ ID NO: 323664 - DNA, 25 bp, Rattus norvegicus
gacgacactgtgatccatgagcaca

SEQ ID NO: 323665 - DNA, 25 bp, Rattus norvegicus
gacgacactgtgttccatgagcaca

SEQ ID NO: 323666 - DNA, 25 bp, Rattus norvegicus
gacgacagagtcacaggtcctggtg

SEQ ID NO: 323667 - DNA, 25 bp, Rattus norvegicus
gacgacagagtctcaggtcctggtg

SEQ ID NO: 323668 - DNA, 25 bp, Rattus norvegicus
gacgacagcagaaacctcaaggccc

SEQ ID NO: 323669 - DNA, 25 bp, Rattus norvegicus
gacgacagcagatacctcaaggccc

SEQ ID NO: 323670 - DNA, 25 bp, Rattus norvegicus
gacgacagcccaaactaagctttga

SEQ ID NO: 323671 - DNA, 25 bp, Rattus norvegicus
gacgacagcccatactaagctttga

SEQ ID NO: 323672 - DNA, 25 bp, Rattus norvegicus
gacgacagcctgagcaacagcgagg

SEQ ID NO: 323673 - DNA, 25 bp, Rattus norvegicus
gacgacagcctgtgcaacagcgagg

SEQ ID NO: 323674 - DNA, 25 bp, Rattus norvegicus
gacgacaggaagaggcagccccgaa

SEQ ID NO: 323675 - DNA, 25 bp, Rattus norvegicus
gacgacaggaagtggcagccccgaa

SEQ ID NO: 323676 - DNA, 25 bp, Rattus norvegicus
gacgacaggatgatcctcatagctt

SEQ ID NO: 323677 - DNA, 25 bp, Rattus norvegicus
gacgacaggatgttcctcatagctt

SEQ ID NO: 323678 - DNA, 25 bp, Rattus norvegicus
gacgacaggctgagcgcagtctgca

SEQ ID NO: 323679 - DNA, 25 bp, Rattus norvegicus
gacgacaggctgtgcgcagtctgca

SEQ ID NO: 323680 - DNA, 25 bp, Rattus norvegicus
gacgacagggcaaccgaggagctct

SEQ ID NO: 323681 - DNA, 25 bp, Rattus norvegicus
gacgacagggcatccgaggagctct

SEQ ID NO: 323682 - DNA, 25 bp, Rattus norvegicus
gacgacatcctactcaccaggaaag

SEQ ID NO: 323683 - DNA, 25 bp, Rattus norvegicus
gacgacatcctagtcaccaggaaag

SEQ ID NO: 323684 - DNA, 25 bp, Rattus norvegicus
gacgacatctgtaatgacgacatat

SEQ ID NO: 323685 - DNA, 25 bp, Rattus norvegicus
gacgacatctgttatgacgacatat

SEQ ID NO: 323686 - DNA, 25 bp, Rattus norvegicus
gacgacatgggcactgtaggtcaca

SEQ ID NO: 323687 - DNA, 25 bp, Rattus norvegicus
gacgacatgggctctgtaggtcaca

SEQ ID NO: 323688 - DNA, 25 bp, Rattus norvegicus
gacgacattataactgtacggactt

SEQ ID NO: 323689 - DNA, 25 bp, Rattus norvegicus
gacgacattatatctgtacggactt

SEQ ID NO: 323690 - DNA, 25 bp, Rattus norvegicus
gacgacattcacagcatttcaaacc

SEQ ID NO: 323691 - DNA, 25 bp, Rattus norvegicus
gacgacattcactgcatttcaaacc

SEQ ID NO: 323692 - DNA, 25 bp, Rattus norvegicus
gacgaccaatatcctttctatcatg

SEQ ID NO: 323693 - DNA, 25 bp, Rattus norvegicus
gacgaccaatatgctttctatcatg

SEQ ID NO: 323694 - DNA, 25 bp, Rattus norvegicus
gacgaccaccagagttcacacgata

SEQ ID NO: 323695 - DNA, 25 bp, Rattus norvegicus
gacgaccaccagtgttcacacgata

SEQ ID NO: 323696 - DNA, 25 bp, Rattus norvegicus
gacgaccactttcccaaagcactag

SEQ ID NO: 323697 - DNA, 25 bp, Rattus norvegicus
gacgaccactttgccaaagcactag

SEQ ID NO: 323698 - DNA, 25 bp, Rattus norvegicus
gacgaccatctcatctgttaaattg

SEQ ID NO: 323699 - DNA, 25 bp, Rattus norvegicus
gacgaccatctcttctgttaaattg

SEQ ID NO: 323700 - DNA, 25 bp, Rattus norvegicus
gacgacccttctagacactttaatt

SEQ ID NO: 323701 - DNA, 25 bp, Rattus norvegicus
gacgacccttcttgacactttaatt

SEQ ID NO: 323702 - DNA, 25 bp, Rattus norvegicus
gacgaccgcatcatgtgtcgctgag

SEQ ID NO: 323703 - DNA, 25 bp, Rattus norvegicus
gacgaccgcatcttgtgtcgctgag

SEQ ID NO: 323704 - DNA, 25 bp, Rattus norvegicus
gacgaccgcggcaaccgagccccgg

SEQ ID NO: 323705 - DNA, 25 bp, Rattus norvegicus
gacgaccgcggctaccgagccccgg

SEQ ID NO: 323706 - DNA, 25 bp, Rattus norvegicus
gacgaccgtctcaagaaccgatggc

SEQ ID NO: 323707 - DNA, 25 bp, Rattus norvegicus
gacgaccgtctctagaaccgatggc

SEQ ID NO: 323708 - DNA, 25 bp, Rattus norvegicus
gacgacctagatattaaatggcttt

SEQ ID NO: 323709 - DNA, 25 bp, Rattus norvegicus
gacgacctagattttaaatggcttt

SEQ ID NO: 323710 - DNA, 25 bp, Rattus norvegicus
gacgacctcaacacagtagcagctg

SEQ ID NO: 323711 - DNA, 25 bp, Rattus norvegicus
gacgacctcaactcagtagcagctg

SEQ ID NO: 323712 - DNA, 25 bp, Rattus norvegicus
gacgacctcgtactgatggctgcca

SEQ ID NO: 323713 - DNA, 25 bp, Rattus norvegicus
gacgacctcgtagtgatggctgcca

SEQ ID NO: 323714 - DNA, 25 bp, Rattus norvegicus
gacgacctgtatcacgacgacattg

SEQ ID NO: 323715 - DNA, 25 bp, Rattus norvegicus
gacgacctgtatgacgacgacattg

SEQ ID NO: 323716 - DNA, 25 bp, Rattus norvegicus
gacgacctttataaactgtccatga

SEQ ID NO: 323717 - DNA, 25 bp, Rattus norvegicus
gacgacctttattaactgtccatga

SEQ ID NO: 323718 - DNA, 25 bp, Rattus norvegicus
gacgacctttgtagagtgacctgcc

SEQ ID NO: 323719 - DNA, 25 bp, Rattus norvegicus
gacgacctttgttgagtgacctgcc

SEQ ID NO: 323720 - DNA, 25 bp, Rattus norvegicus
gacgacgaatgaattgtttctttac

SEQ ID NO: 323721 - DNA, 25 bp, Rattus norvegicus
gacgacgaatgatttgtttctttac

SEQ ID NO: 323722 - DNA, 25 bp, Rattus norvegicus
gacgacgaccctatcatgagtggta

SEQ ID NO: 323723 - DNA, 25 bp, Rattus norvegicus
gacgacgaccctttcatgagtggta

SEQ ID NO: 323724 - DNA, 25 bp, Rattus norvegicus
gacgacgactcacggctggccgaaa

SEQ ID NO: 323725 - DNA, 25 bp, Rattus norvegicus
gacgacgactcagggctggccgaaa

SEQ ID NO: 323726 - DNA, 25 bp, Rattus norvegicus
gacgacgacttaatgtcacaggaga

SEQ ID NO: 323727 - DNA, 25 bp, Rattus norvegicus
gacgacgacttattgtcacaggaga

SEQ ID NO: 323728 - DNA, 25 bp, Rattus norvegicus
gacgacgaggacatttacaccacct

SEQ ID NO: 323729 - DNA, 25 bp, Rattus norvegicus
gacgacgaggacttttacaccacct

SEQ ID NO: 323730 - DNA, 25 bp, Rattus norvegicus
gacgacgatgcgatcttccgggaac

SEQ ID NO: 323731 - DNA, 25 bp, Rattus norvegicus
gacgacgatgcgttcttccgggaac

SEQ ID NO: 323732 - DNA, 25 bp, Rattus norvegicus
gacgacgcacatcaatcaccagctg

SEQ ID NO: 323733 - DNA, 25 bp, Rattus norvegicus
gacgacgcacatgaatcaccagctg

SEQ ID NO: 323734 - DNA, 25 bp, Rattus norvegicus
gacgacgccccacatgcagatacgg

SEQ ID NO: 323735 - DNA, 25 bp, Rattus norvegicus
gacgacgccccagatgcagatacgg

SEQ ID NO: 323736 - DNA, 25 bp, Rattus norvegicus
gacgacgctctgactcatttaggta

SEQ ID NO: 323737 - DNA, 25 bp, Rattus norvegicus
gacgacgctctgtctcatttaggta

SEQ ID NO: 323738 - DNA, 25 bp, Rattus norvegicus
gacgacggcattagtgcttacgaat

SEQ ID NO: 323739 - DNA, 25 bp, Rattus norvegicus
gacgacggcatttgtgcttacgaat

SEQ ID NO: 323740 - DNA, 25 bp, Rattus norvegicus
gacgacggtgggatgctgggagtat

SEQ ID NO: 323741 - DNA, 25 bp, Rattus norvegicus
gacgacggtgggttgctgggagtat

SEQ ID NO: 323742 - DNA, 25 bp, Rattus norvegicus
gacgacggtggtcaaaatggatccc

SEQ ID NO: 323743 - DNA, 25 bp, Rattus norvegicus
gacgacggtggtgaaaatggatccc

SEQ ID NO: 323744 - DNA, 25 bp, Rattus norvegicus
gacgacgtcctcatgtctagtgtga

SEQ ID NO: 323745 - DNA, 25 bp, Rattus norvegicus
gacgacgtcctcttgtctagtgtga

SEQ ID NO: 323746 - DNA, 25 bp, Rattus norvegicus
gacgacgtcgttcaactcatgacct

SEQ ID NO: 323747 - DNA, 25 bp, Rattus norvegicus
gacgacgtcgttgaactcatgacct

SEQ ID NO: 323748 - DNA, 25 bp, Rattus norvegicus
gacgacgtgttcctgctgtgatccg

SEQ ID NO: 323749 - DNA, 25 bp, Rattus norvegicus
gacgacgtgttcgtgctgtgatccg

SEQ ID NO: 323750 - DNA, 25 bp, Rattus norvegicus
gacgacgttgttacaaaagctgttc

SEQ ID NO: 323751 - DNA, 25 bp, Rattus norvegicus
gacgacgttgtttcaaaagctgttc

SEQ ID NO: 323752 - DNA, 25 bp, Rattus norvegicus
gacgactaacctagaataaacacct

SEQ ID NO: 323753 - DNA, 25 bp, Rattus norvegicus
gacgactaaccttgaataaacacct

SEQ ID NO: 323754 - DNA, 25 bp, Rattus norvegicus
gacgactaccttcatctctttggag

SEQ ID NO: 323755 - DNA, 25 bp, Rattus norvegicus
gacgactaccttgatctctttggag

SEQ ID NO: 323756 - DNA, 25 bp, Rattus norvegicus
gacgactacgaacatgatcccaaat

SEQ ID NO: 323757 - DNA, 25 bp, Rattus norvegicus
gacgactacgaagatgatcccaaat

SEQ ID NO: 323758 - DNA, 25 bp, Rattus norvegicus
gacgactatgtcatacattcacggt

SEQ ID NO: 323759 - DNA, 25 bp, Rattus norvegicus
gacgactatgtcttacattcacggt

SEQ ID NO: 323760 - DNA, 25 bp, Rattus norvegicus
gacgactctgcacccgaggacaagt

SEQ ID NO: 323761 - DNA, 25 bp, Rattus norvegicus
gacgactctgcagccgaggacaagt

SEQ ID NO: 323762 - DNA, 25 bp, Rattus norvegicus
gacgactctgtgattcctggagatc

SEQ ID NO: 323763 - DNA, 25 bp, Rattus norvegicus
gacgactctgtgtttcctggagatc

SEQ ID NO: 323764 - DNA, 25 bp, Rattus norvegicus
gacgactgaataatactcggcttca

SEQ ID NO: 323765 - DNA, 25 bp, Rattus norvegicus
gacgactgaatattactcggcttca

SEQ ID NO: 323766 - DNA, 25 bp, Rattus norvegicus
gacgactgatccactgggcacacaa

SEQ ID NO: 323767 - DNA, 25 bp, Rattus norvegicus
gacgactgatcctctgggcacacaa

SEQ ID NO: 323768 - DNA, 25 bp, Rattus norvegicus
gacgactgcttcattgattcttgag

SEQ ID NO: 323769 - DNA, 25 bp, Rattus norvegicus
gacgactgcttctttgattcttgag

SEQ ID NO: 323770 - DNA, 25 bp, Rattus norvegicus
gacgactggattacatttttacaag

SEQ ID NO: 323771 - DNA, 25 bp, Rattus norvegicus
gacgactggatttcatttttacaag

SEQ ID NO: 323772 - DNA, 25 bp, Rattus norvegicus
gacgactggtctcgctcagatggca

SEQ ID NO: 323773 - DNA, 25 bp, Rattus norvegicus
gacgactggtctggctcagatggca

SEQ ID NO: 323774 - DNA, 25 bp, Rattus norvegicus
gacgactgtaacatcccaggacttt

SEQ ID NO: 323775 - DNA, 25 bp, Rattus norvegicus
gacgactgtaacttcccaggacttt

SEQ ID NO: 323776 - DNA, 25 bp, Rattus norvegicus
gacgacttaatccaaggaacgcatg

SEQ ID NO: 323777 - DNA, 25 bp, Rattus norvegicus
gacgacttaatcgaaggaacgcatg

SEQ ID NO: 323778 - DNA, 25 bp, Rattus norvegicus
gacgacttagcaattcaaggtcttg

SEQ ID NO: 323779 - DNA, 25 bp, Rattus norvegicus
gacgacttagcatttcaaggtcttg

SEQ ID NO: 323780 - DNA, 25 bp, Rattus norvegicus
gacgacttcattaaccttcgactag

SEQ ID NO: 323781 - DNA, 25 bp, Rattus norvegicus
gacgacttcatttaccttcgactag

SEQ ID NO: 323782 - DNA, 25 bp, Rattus norvegicus
gacgacttccttagggatcctgagg

SEQ ID NO: 323783 - DNA, 25 bp, Rattus norvegicus
gacgacttcctttgggatcctgagg

SEQ ID NO: 323784 - DNA, 25 bp, Rattus norvegicus
gacgacttcggtcaactttgacaat

SEQ ID NO: 323785 - DNA, 25 bp, Rattus norvegicus
gacgacttcggtgaactttgacaat

SEQ ID NO: 323786 - DNA, 25 bp, Rattus norvegicus
gacgacttcgtgaatgcgatccgca

SEQ ID NO: 323787 - DNA, 25 bp, Rattus norvegicus
gacgacttcgtgtatgcgatccgca

SEQ ID NO: 323788 - DNA, 25 bp, Rattus norvegicus
gacgacttctgcaaagtacacctct

SEQ ID NO: 323789 - DNA, 25 bp, Rattus norvegicus
gacgacttctgctaagtacacctct

SEQ ID NO: 323790 - DNA, 25 bp, Rattus norvegicus
gacgagaaatcccttaatcccagtt

SEQ ID NO: 323791 - DNA, 25 bp, Rattus norvegicus
gacgagaaatccgttaatcccagtt

SEQ ID NO: 323792 - DNA, 25 bp, Rattus norvegicus
gacgagaagttgcatccactgagtt

SEQ ID NO: 323793 - DNA, 25 bp, Rattus norvegicus
gacgagaagttggatccactgagtt

SEQ ID NO: 323794 - DNA, 25 bp, Rattus norvegicus
gacgagaatggccacagaatggtct

SEQ ID NO: 323795 - DNA, 25 bp, Rattus norvegicus
gacgagaatggcgacagaatggtct

SEQ ID NO: 323796 - DNA, 25 bp, Rattus norvegicus
gacgagacagacaacggctctgcag

SEQ ID NO: 323797 - DNA, 25 bp, Rattus norvegicus
gacgagacagactacggctctgcag

SEQ ID NO: 323798 - DNA, 25 bp, Rattus norvegicus
gacgagacccaaatgatccgcgtcc

SEQ ID NO: 323799 - DNA, 25 bp, Rattus norvegicus
gacgagacccaattgatccgcgtcc

SEQ ID NO: 323800 - DNA, 25 bp, Rattus norvegicus
gacgagaccgccattgtgcataaat

SEQ ID NO: 323801 - DNA, 25 bp, Rattus norvegicus
gacgagaccgcctttgtgcataaat

SEQ ID NO: 323802 - DNA, 25 bp, Rattus norvegicus
gacgagactcatcaagctctgtttg

SEQ ID NO: 323803 - DNA, 25 bp, Rattus norvegicus
gacgagactcatgaagctctgtttg

SEQ ID NO: 323804 - DNA, 25 bp, Rattus norvegicus
gacgagacttgtcttttgagatttt

SEQ ID NO: 323805 - DNA, 25 bp, Rattus norvegicus
gacgagacttgtgttttgagatttt

SEQ ID NO: 323806 - DNA, 25 bp, Rattus norvegicus
gacgagagcagcagtggtccagaca

SEQ ID NO: 323807 - DNA, 25 bp, Rattus norvegicus
gacgagagcagctgtggtccagaca

SEQ ID NO: 323808 - DNA, 25 bp, Rattus norvegicus
gacgagagctggattgttacccctc

SEQ ID NO: 323809 - DNA, 25 bp, Rattus norvegicus
gacgagagctggtttgttacccctc

SEQ ID NO: 323810 - DNA, 25 bp, Rattus norvegicus
gacgagatacatatcagctttgggt

SEQ ID NO: 323811 - DNA, 25 bp, Rattus norvegicus
gacgagatacatttcagctttgggt

SEQ ID NO: 323812 - DNA, 25 bp, Rattus norvegicus
gacgagatgacgatgcttttggttt

SEQ ID NO: 323813 - DNA, 25 bp, Rattus norvegicus
gacgagatgacgttgcttttggttt

SEQ ID NO: 323814 - DNA, 25 bp, Rattus norvegicus
gacgagatgactctcagaatcctat

SEQ ID NO: 323815 - DNA, 25 bp, Rattus norvegicus
gacgagatgactgtcagaatcctat

SEQ ID NO: 323816 - DNA, 25 bp, Rattus norvegicus
gacgagatgctccaaatggtcccaa

SEQ ID NO: 323817 - DNA, 25 bp, Rattus norvegicus
gacgagatgctcgaaatggtcccaa

SEQ ID NO: 323818 - DNA, 25 bp, Rattus norvegicus
gacgagatttgtcggtttgtttgtt

SEQ ID NO: 323819 - DNA, 25 bp, Rattus norvegicus
gacgagatttgtgggtttgtttgtt

SEQ ID NO: 323820 - DNA, 25 bp, Rattus norvegicus
gacgagcaacttcgatgtttgcact

SEQ ID NO: 323821 - DNA, 25 bp, Rattus norvegicus
gacgagcaacttggatgtttgcact

SEQ ID NO: 323822 - DNA, 25 bp, Rattus norvegicus
gacgagcacacacaagacccgcagt

SEQ ID NO: 323823 - DNA, 25 bp, Rattus norvegicus
gacgagcacacagaagacccgcagt

SEQ ID NO: 323824 - DNA, 25 bp, Rattus norvegicus
gacgagcacctgcatgcagactgct

SEQ ID NO: 323825 - DNA, 25 bp, Rattus norvegicus
gacgagcacctggatgcagactgct

SEQ ID NO: 323826 - DNA, 25 bp, Rattus norvegicus
gacgagcactaacttctgcctgcta

SEQ ID NO: 323827 - DNA, 25 bp, Rattus norvegicus
gacgagcactaagttctgcctgcta

SEQ ID NO: 323828 - DNA, 25 bp, Rattus norvegicus
gacgagcactaccagtaccggcatg

SEQ ID NO: 323829 - DNA, 25 bp, Rattus norvegicus
gacgagcactacgagtaccggcatg

SEQ ID NO: 323830 - DNA, 25 bp, Rattus norvegicus
gacgagcagattctacaacagtaat

SEQ ID NO: 323831 - DNA, 25 bp, Rattus norvegicus
gacgagcagattgtacaacagtaat

SEQ ID NO: 323832 - DNA, 25 bp, Rattus norvegicus
gacgagcagcagacttattgttgaa

SEQ ID NO: 323833 - DNA, 25 bp, Rattus norvegicus
gacgagcagcagtcttattgttgaa

SEQ ID NO: 323834 - DNA, 25 bp, Rattus norvegicus
gacgagcagccgaggctgatgcatt

SEQ ID NO: 323835 - DNA, 25 bp, Rattus norvegicus
gacgagcagccgtggctgatgcatt

SEQ ID NO: 323836 - DNA, 25 bp, Rattus norvegicus
gacgagcagggtcctttcatggatt

SEQ ID NO: 323837 - DNA, 25 bp, Rattus norvegicus
gacgagcagggtgctttcatggatt

SEQ ID NO: 323838 - DNA, 25 bp, Rattus norvegicus
gacgagcagtatcatttagccacca

SEQ ID NO: 323839 - DNA, 25 bp, Rattus norvegicus
gacgagcagtatgatttagccacca

SEQ ID NO: 323840 - DNA, 25 bp, Rattus norvegicus
gacgagccaagcacacatggtggac

SEQ ID NO: 323841 - DNA, 25 bp, Rattus norvegicus
gacgagccaagctcacatggtggac

SEQ ID NO: 323842 - DNA, 25 bp, Rattus norvegicus
gacgagcccttccaatacaagaact

SEQ ID NO: 323843 - DNA, 25 bp, Rattus norvegicus
gacgagcccttcgaatacaagaact

SEQ ID NO: 323844 - DNA, 25 bp, Rattus norvegicus
gacgagcgctaccagaaatacaagt

SEQ ID NO: 323845 - DNA, 25 bp, Rattus norvegicus
gacgagcgctacgagaaatacaagt

SEQ ID NO: 323846 - DNA, 25 bp, Rattus norvegicus
gacgagctcatcaagctgtacctgt

SEQ ID NO: 323847 - DNA, 25 bp, Rattus norvegicus
gacgagctcatctagctgtacctgt

SEQ ID NO: 323848 - DNA, 25 bp, Rattus norvegicus
gacgagctctaactggaaggacctt

SEQ ID NO: 323849 - DNA, 25 bp, Rattus norvegicus
gacgagctctaagtggaaggacctt

SEQ ID NO: 323850 - DNA, 25 bp, Rattus norvegicus
gacgagctgatcctgtgaacaacac

SEQ ID NO: 323851 - DNA, 25 bp, Rattus norvegicus
gacgagctgatcgtgtgaacaacac

SEQ ID NO: 323852 - DNA, 25 bp, Rattus norvegicus
gacgagctgccaaaattctacgatg

SEQ ID NO: 323853 - DNA, 25 bp, Rattus norvegicus
gacgagctgccataattctacgatg

SEQ ID NO: 323854 - DNA, 25 bp, Rattus norvegicus
gacgagctgccccaggtggataacc

SEQ ID NO: 323855 - DNA, 25 bp, Rattus norvegicus
gacgagctgcccgaggtggataacc

SEQ ID NO: 323856 - DNA, 25 bp, Rattus norvegicus
gacgagctggaccacgccctcaatg

SEQ ID NO: 323857 - DNA, 25 bp, Rattus norvegicus
gacgagctggacgacgccctcaatg

SEQ ID NO: 323858 - DNA, 25 bp, Rattus norvegicus
gacgaggaagatctgctgcaaccat

SEQ ID NO: 323859 - DNA, 25 bp, Rattus norvegicus
gacgaggaagatgtgctgcaaccat

SEQ ID NO: 323860 - DNA, 25 bp, Rattus norvegicus
gacgaggacagtctagccttcctgc

SEQ ID NO: 323861 - DNA, 25 bp, Rattus norvegicus
gacgaggacagtgtagccttcctgc

SEQ ID NO: 323862 - DNA, 25 bp, Rattus norvegicus
gacgaggaggtgctggacgcgcttc

SEQ ID NO: 323863 - DNA, 25 bp, Rattus norvegicus
gacgaggaggtggtggacgcgcttc

SEQ ID NO: 323864 - DNA, 25 bp, Rattus norvegicus
gacgaggagtctcatcacaactgat

SEQ ID NO: 323865 - DNA, 25 bp, Rattus norvegicus
gacgaggagtctgatcacaactgat

SEQ ID NO: 323866 - DNA, 25 bp, Rattus norvegicus
gacgaggccaacattactgagtgac

SEQ ID NO: 323867 - DNA, 25 bp, Rattus norvegicus
gacgaggccaactttactgagtgac

SEQ ID NO: 323868 - DNA, 25 bp, Rattus norvegicus
gacgaggcctctcaagtttcaggta

SEQ ID NO: 323869 - DNA, 25 bp, Rattus norvegicus
gacgaggcctctgaagtttcaggta

SEQ ID NO: 323870 - DNA, 25 bp, Rattus norvegicus
gacgaggctgataaatcttcactgt

SEQ ID NO: 323871 - DNA, 25 bp, Rattus norvegicus
gacgaggctgattaatcttcactgt

SEQ ID NO: 323872 - DNA, 25 bp, Rattus norvegicus
gacgagggagcaacttttctcatgt

SEQ ID NO: 323873 - DNA, 25 bp, Rattus norvegicus
gacgagggagcatcttttctcatgt

SEQ ID NO: 323874 - DNA, 25 bp, Rattus norvegicus
gacgagggcagcaccaattcaggca

SEQ ID NO: 323875 - DNA, 25 bp, Rattus norvegicus
gacgagggcagctccaattcaggca

SEQ ID NO: 323876 - DNA, 25 bp, Rattus norvegicus
gacgagggcatcagatttcctggga

SEQ ID NO: 323877 - DNA, 25 bp, Rattus norvegicus
gacgagggcatctgatttcctggga

SEQ ID NO: 323878 - DNA, 25 bp, Rattus norvegicus
gacgagggttccatatgcacagaca

SEQ ID NO: 323879 - DNA, 25 bp, Rattus norvegicus
gacgagggttccttatgcacagaca

SEQ ID NO: 323880 - DNA, 25 bp, Rattus norvegicus
gacgaggtcactcactgaaggcaga

SEQ ID NO: 323881 - DNA, 25 bp, Rattus norvegicus
gacgaggtcactgactgaaggcaga

SEQ ID NO: 323882 - DNA, 25 bp, Rattus norvegicus
gacgaggtggccagggttagagcga

SEQ ID NO: 323883 - DNA, 25 bp, Rattus norvegicus
gacgaggtggcctgggttagagcga

SEQ ID NO: 323884 - DNA, 25 bp, Rattus norvegicus
gacgagtacagtaagcagctcctac

SEQ ID NO: 323885 - DNA, 25 bp, Rattus norvegicus
gacgagtacagttagcagctcctac

SEQ ID NO: 323886 - DNA, 25 bp, Rattus norvegicus
gacgagtcattcatttccaacaaag

SEQ ID NO: 323887 - DNA, 25 bp, Rattus norvegicus
gacgagtcattcttttccaacaaag

SEQ ID NO: 323888 - DNA, 25 bp, Rattus norvegicus
gacgagtcgtctacagggagtcaga

SEQ ID NO: 323889 - DNA, 25 bp, Rattus norvegicus
gacgagtcgtcttcagggagtcaga

SEQ ID NO: 323890 - DNA, 25 bp, Rattus norvegicus
gacgagtgccgccaaacctttaagg

SEQ ID NO: 323891 - DNA, 25 bp, Rattus norvegicus
gacgagtgccgcgaaacctttaagg

SEQ ID NO: 323892 - DNA, 25 bp, Rattus norvegicus
gacgagtggcggaaacccttagact

SEQ ID NO: 323893 - DNA, 25 bp, Rattus norvegicus
gacgagtggcggtaacccttagact

SEQ ID NO: 323894 - DNA, 25 bp, Rattus norvegicus
gacgagtgtctgattgcattacctt

SEQ ID NO: 323895 - DNA, 25 bp, Rattus norvegicus
gacgagtgtctgtttgcattacctt

SEQ ID NO: 323896 - DNA, 25 bp, Rattus norvegicus
gacgagtgttctaaacccaacggag

SEQ ID NO: 323897 - DNA, 25 bp, Rattus norvegicus
gacgagtgttcttaacccaacggag

SEQ ID NO: 323898 - DNA, 25 bp, Rattus norvegicus
gacgagttacatatgacctggagga

SEQ ID NO: 323899 - DNA, 25 bp, Rattus norvegicus
gacgagttacatttgacctggagga

SEQ ID NO: 323900 - DNA, 25 bp, Rattus norvegicus
gacgagttcttacccttgttcatat

SEQ ID NO: 323901 - DNA, 25 bp, Rattus norvegicus
gacgagttcttagccttgttcatat

SEQ ID NO: 323902 - DNA, 25 bp, Rattus norvegicus
gacgagtttttcacagagctgcctt

SEQ ID NO: 323903 - DNA, 25 bp, Rattus norvegicus
gacgagtttttctcagagctgcctt

SEQ ID NO: 323904 - DNA, 25 bp, Rattus norvegicus
gacgataagtgcaagaggctgccat

SEQ ID NO: 323905 - DNA, 25 bp, Rattus norvegicus
gacgataagtgctagaggctgccat

SEQ ID NO: 323906 - DNA, 25 bp, Rattus norvegicus
gacgatacccctatcatgactcaga

SEQ ID NO: 323907 - DNA, 25 bp, Rattus norvegicus
gacgatacccctttcatgactcaga

SEQ ID NO: 323908 - DNA, 25 bp, Rattus norvegicus
gacgatacctatcaacgtgtgtgaa

SEQ ID NO: 323909 - DNA, 25 bp, Rattus norvegicus
gacgatacctatgaacgtgtgtgaa

SEQ ID NO: 323910 - DNA, 25 bp, Rattus norvegicus
gacgatagcaggattcttgagtgga

SEQ ID NO: 323911 - DNA, 25 bp, Rattus norvegicus
gacgatagcaggtttcttgagtgga

SEQ ID NO: 323912 - DNA, 25 bp, Rattus norvegicus
gacgatagggccacatagcatctta

SEQ ID NO: 323913 - DNA, 25 bp, Rattus norvegicus
gacgatagggcctcatagcatctta

SEQ ID NO: 323914 - DNA, 25 bp, Rattus norvegicus
gacgatatggtcagtcagctgcctg

SEQ ID NO: 323915 - DNA, 25 bp, Rattus norvegicus
gacgatatggtctgtcagctgcctg

SEQ ID NO: 323916 - DNA, 25 bp, Rattus norvegicus
gacgatcaaggcctggttatccacc

SEQ ID NO: 323917 - DNA, 25 bp, Rattus norvegicus
gacgatcaaggcgtggttatccacc

SEQ ID NO: 323918 - DNA, 25 bp, Rattus norvegicus
gacgatcacttcacaactaaattca

SEQ ID NO: 323919 - DNA, 25 bp, Rattus norvegicus
gacgatcacttctcaactaaattca

SEQ ID NO: 323920 - DNA, 25 bp, Rattus norvegicus
gacgatcagcaaatactcagtggac

SEQ ID NO: 323921 - DNA, 25 bp, Rattus norvegicus
gacgatcagcaattactcagtggac

SEQ ID NO: 323922 - DNA, 25 bp, Rattus norvegicus
gacgatcagtgtcacaatgacccat

SEQ ID NO: 323923 - DNA, 25 bp, Rattus norvegicus
gacgatcagtgtgacaatgacccat

SEQ ID NO: 323924 - DNA, 25 bp, Rattus norvegicus
gacgatccctgcagggattcagaca

SEQ ID NO: 323925 - DNA, 25 bp, Rattus norvegicus
gacgatccctgctgggattcagaca

SEQ ID NO: 323926 - DNA, 25 bp, Rattus norvegicus
gacgatccgcggagtccttagggca

SEQ ID NO: 323927 - DNA, 25 bp, Rattus norvegicus
gacgatccgcggtgtccttagggca

SEQ ID NO: 323928 - DNA, 25 bp, Rattus norvegicus
gacgatcctaggcacttgccacatt

SEQ ID NO: 323929 - DNA, 25 bp, Rattus norvegicus
gacgatcctagggacttgccacatt

SEQ ID NO: 323930 - DNA, 25 bp, Rattus norvegicus
gacgatctatttctattcttatgcc

SEQ ID NO: 323931 - DNA, 25 bp, Rattus norvegicus
gacgatctatttgtattcttatgcc

SEQ ID NO: 323932 - DNA, 25 bp, Rattus norvegicus
gacgatgaaagccagcgacaagttt

SEQ ID NO: 323933 - DNA, 25 bp, Rattus norvegicus
gacgatgaaagcgagcgacaagttt

SEQ ID NO: 323934 - DNA, 25 bp, Rattus norvegicus
gacgatgaacgacaactggccccgg

SEQ ID NO: 323935 - DNA, 25 bp, Rattus norvegicus
gacgatgaacgagaactggccccgg

SEQ ID NO: 323936 - DNA, 25 bp, Rattus norvegicus
gacgatgacatcatgctgctagaca

SEQ ID NO: 323937 - DNA, 25 bp, Rattus norvegicus
gacgatgacatcttgctgctagaca

SEQ ID NO: 323938 - DNA, 25 bp, Rattus norvegicus
gacgatgacctgctagatgctctct

SEQ ID NO: 323939 - DNA, 25 bp, Rattus norvegicus
gacgatgacctggtagatgctctct

SEQ ID NO: 323940 - DNA, 25 bp, Rattus norvegicus
gacgatgacgacagtggagcaccca

SEQ ID NO: 323941 - DNA, 25 bp, Rattus norvegicus
gacgatgacgactgtggagcaccca

SEQ ID NO: 323942 - DNA, 25 bp, Rattus norvegicus
gacgatgacgatcgttccgacagcg

SEQ ID NO: 323943 - DNA, 25 bp, Rattus norvegicus
gacgatgacgatggttccgacagcg

SEQ ID NO: 323944 - DNA, 25 bp, Rattus norvegicus
gacgatgagtgtctgatcccttctc

SEQ ID NO: 323945 - DNA, 25 bp, Rattus norvegicus
gacgatgagtgtgtgatcccttctc

SEQ ID NO: 323946 - DNA, 25 bp, Rattus norvegicus
gacgatgagttgagatccggactgc

SEQ ID NO: 323947 - DNA, 25 bp, Rattus norvegicus
gacgatgagttgtgatccggactgc

SEQ ID NO: 323948 - DNA, 25 bp, Rattus norvegicus
gacgatgatgacctctctgtacaac

SEQ ID NO: 323949 - DNA, 25 bp, Rattus norvegicus
gacgatgatgacgtctctgtacaac

SEQ ID NO: 323950 - DNA, 25 bp, Rattus norvegicus
gacgatgctgtaactttccacattt

SEQ ID NO: 323951 - DNA, 25 bp, Rattus norvegicus
gacgatgctgtatctttccacattt

SEQ ID NO: 323952 - DNA, 25 bp, Rattus norvegicus
gacgatggattccttaacggctcct

SEQ ID NO: 323953 - DNA, 25 bp, Rattus norvegicus
gacgatggattcgttaacggctcct

SEQ ID NO: 323954 - DNA, 25 bp, Rattus norvegicus
gacgatggccatcccgcagtagaag

SEQ ID NO: 323955 - DNA, 25 bp, Rattus norvegicus
gacgatggccatgccgcagtagaag

SEQ ID NO: 323956 - DNA, 25 bp, Rattus norvegicus
gacgatggctaccagattgtctaca

SEQ ID NO: 323957 - DNA, 25 bp, Rattus norvegicus
gacgatggctacgagattgtctaca

SEQ ID NO: 323958 - DNA, 25 bp, Rattus norvegicus
gacgatgggcccagagccacacgaa

SEQ ID NO: 323959 - DNA, 25 bp, Rattus norvegicus
gacgatgggccctgagccacacgaa

SEQ ID NO: 323960 - DNA, 25 bp, Rattus norvegicus
gacgatggttatccacaagccagaa

SEQ ID NO: 323961 - DNA, 25 bp, Rattus norvegicus
gacgatggttatgcacaagccagaa

SEQ ID NO: 323962 - DNA, 25 bp, Rattus norvegicus
gacgatggttcccacagcgagtctc

SEQ ID NO: 323963 - DNA, 25 bp, Rattus norvegicus
gacgatggttccgacagcgagtctc

SEQ ID NO: 323964 - DNA, 25 bp, Rattus norvegicus
gacgatgtcacacccatatcctgga

SEQ ID NO: 323965 - DNA, 25 bp, Rattus norvegicus
gacgatgtcacagccatatcctgga

SEQ ID NO: 323966 - DNA, 25 bp, Rattus norvegicus
gacgatgtgttcactcttcaatatt

SEQ ID NO: 323967 - DNA, 25 bp, Rattus norvegicus
gacgatgtgttctctcttcaatatt

SEQ ID NO: 323968 - DNA, 25 bp, Rattus norvegicus
gacgatgttcgtattaagcttttgc

SEQ ID NO: 323969 - DNA, 25 bp, Rattus norvegicus
gacgatgttcgttttaagcttttgc

SEQ ID NO: 323970 - DNA, 25 bp, Rattus norvegicus
gacgattcagatccatgtggcctta

SEQ ID NO: 323971 - DNA, 25 bp, Rattus norvegicus
gacgattcagatgcatgtggcctta

SEQ ID NO: 323972 - DNA, 25 bp, Rattus norvegicus
gacgattccggtctgccatcatcct

SEQ ID NO: 323973 - DNA, 25 bp, Rattus norvegicus
gacgattccggtgtgccatcatcct

SEQ ID NO: 323974 - DNA, 25 bp, Rattus norvegicus
gacgattcttgtatctaggtattta

SEQ ID NO: 323975 - DNA, 25 bp, Rattus norvegicus
gacgattcttgtttctaggtattta

SEQ ID NO: 323976 - DNA, 25 bp, Rattus norvegicus
gacgattgtacgatggtcgggacaa

SEQ ID NO: 323977 - DNA, 25 bp, Rattus norvegicus
gacgattgtacgttggtcgggacaa

SEQ ID NO: 323978 - DNA, 25 bp, Rattus norvegicus
gacgattgtgtcaacgacatgtttt

SEQ ID NO: 323979 - DNA, 25 bp, Rattus norvegicus
gacgattgtgtctacgacatgtttt

SEQ ID NO: 323980 - DNA, 25 bp, Rattus norvegicus
gacgatttatttctatctgggaaaa

SEQ ID NO: 323981 - DNA, 25 bp, Rattus norvegicus
gacgatttatttgtatctgggaaaa

SEQ ID NO: 323982 - DNA, 25 bp, Rattus norvegicus
gacgatttgatcacaggcaatctat

SEQ ID NO: 323983 - DNA, 25 bp, Rattus norvegicus
gacgatttgatctcaggcaatctat

SEQ ID NO: 323984 - DNA, 25 bp, Rattus norvegicus
gacgcaaactgtcttcagccagctg

SEQ ID NO: 323985 - DNA, 25 bp, Rattus norvegicus
gacgcaaactgtgttcagccagctg

SEQ ID NO: 323986 - DNA, 25 bp, Rattus norvegicus
gacgcaaagggacttcggctttaag

SEQ ID NO: 323987 - DNA, 25 bp, Rattus norvegicus
gacgcaaagggagttcggctttaag

SEQ ID NO: 323988 - DNA, 25 bp, Rattus norvegicus
gacgcaaaggtgaggccatcaattt

SEQ ID NO: 323989 - DNA, 25 bp, Rattus norvegicus
gacgcaaaggtgtggccatcaattt

SEQ ID NO: 323990 - DNA, 25 bp, Rattus norvegicus
gacgcaagatgccttgcagctgctg

SEQ ID NO: 323991 - DNA, 25 bp, Rattus norvegicus
gacgcaagatgcgttgcagctgctg

SEQ ID NO: 323992 - DNA, 25 bp, Rattus norvegicus
gacgcaaggtctattatcccaacag

SEQ ID NO: 323993 - DNA, 25 bp, Rattus norvegicus
gacgcaaggtcttttatcccaacag

SEQ ID NO: 323994 - DNA, 25 bp, Rattus norvegicus
gacgcaataattcgagggcaaactt

SEQ ID NO: 323995 - DNA, 25 bp, Rattus norvegicus
gacgcaataattggagggcaaactt

SEQ ID NO: 323996 - DNA, 25 bp, Rattus norvegicus
gacgcacacagacaatatgaccttt

SEQ ID NO: 323997 - DNA, 25 bp, Rattus norvegicus
gacgcacacagagaatatgaccttt

SEQ ID NO: 323998 - DNA, 25 bp, Rattus norvegicus
gacgcacactggactatggcctgaa

SEQ ID NO: 323999 - DNA, 25 bp, Rattus norvegicus
gacgcacactggaggttgctttcaa

SEQ ID NO: 324000 - DNA, 25 bp, Rattus norvegicus
gacgcacactggtctatggcctgaa

SEQ ID NO: 324001 - DNA, 25 bp, Rattus norvegicus
gacgcacactggtggttgctttcaa

SEQ ID NO: 324002 - DNA, 25 bp, Rattus norvegicus
gacgcacagacaacatgcaggcact

SEQ ID NO: 324003 - DNA, 25 bp, Rattus norvegicus
gacgcacagacatcatgcaggcact

SEQ ID NO: 324004 - DNA, 25 bp, Rattus norvegicus
gacgcacagggcatatgttggcaaa

SEQ ID NO: 324005 - DNA, 25 bp, Rattus norvegicus
gacgcacagggcttatgttggcaaa

SEQ ID NO: 324006 - DNA, 25 bp, Rattus norvegicus
gacgcaccgaagactctttcttctt

SEQ ID NO: 324007 - DNA, 25 bp, Rattus norvegicus
gacgcaccgaagtctctttcttctt

SEQ ID NO: 324008 - DNA, 25 bp, Rattus norvegicus
gacgcacctctgatgtggttagcaa

SEQ ID NO: 324009 - DNA, 25 bp, Rattus norvegicus
gacgcacctctgttgtggttagcaa

SEQ ID NO: 324010 - DNA, 25 bp, Rattus norvegicus
gacgcacgtggaaaggcactgcctt

SEQ ID NO: 324011 - DNA, 25 bp, Rattus norvegicus
gacgcacgtggataggcactgcctt

SEQ ID NO: 324012 - DNA, 25 bp, Rattus norvegicus
gacgcactatatagcctaggtggcc

SEQ ID NO: 324013 - DNA, 25 bp, Rattus norvegicus
gacgcactatattgcctaggtggcc

SEQ ID NO: 324014 - DNA, 25 bp, Rattus norvegicus
gacgcacttccaaaaatgatgcagt

SEQ ID NO: 324015 - DNA, 25 bp, Rattus norvegicus
gacgcacttccataaatgatgcagt

SEQ ID NO: 324016 - DNA, 25 bp, Rattus norvegicus
gacgcagaaagacttgatccggtta

SEQ ID NO: 324017 - DNA, 25 bp, Rattus norvegicus
gacgcagaaagagttgatccggtta

SEQ ID NO: 324018 - DNA, 25 bp, Rattus norvegicus
gacgcagaaagcagcaagaatttag

SEQ ID NO: 324019 - DNA, 25 bp, Rattus norvegicus
gacgcagaaagctgcaagaatttag

SEQ ID NO: 324020 - DNA, 25 bp, Rattus norvegicus
gacgcagaacaaaaccacaggaggg

SEQ ID NO: 324021 - DNA, 25 bp, Rattus norvegicus
gacgcagaacaataccacaggaggg

SEQ ID NO: 324022 - DNA, 25 bp, Rattus norvegicus
gacgcagaagatccagattttccat

SEQ ID NO: 324023 - DNA, 25 bp, Rattus norvegicus
gacgcagaagatgcagattttccat

SEQ ID NO: 324024 - DNA, 25 bp, Rattus norvegicus
gacgcagacacacctataatcaatg

SEQ ID NO: 324025 - DNA, 25 bp, Rattus norvegicus
gacgcagacacagctataatcaatg

SEQ ID NO: 324026 - DNA, 25 bp, Rattus norvegicus
gacgcagacctgaattccattgtga

SEQ ID NO: 324027 - DNA, 25 bp, Rattus norvegicus
gacgcagacctgtattccattgtga

SEQ ID NO: 324028 - DNA, 25 bp, Rattus norvegicus
gacgcagaccttaacacttctaatg

SEQ ID NO: 324029 - DNA, 25 bp, Rattus norvegicus
gacgcagacctttacacttctaatg

SEQ ID NO: 324030 - DNA, 25 bp, Rattus norvegicus
gacgcagaggtcacaaagcaccgtt

SEQ ID NO: 324031 - DNA, 25 bp, Rattus norvegicus
gacgcagaggtctcaaagcaccgtt

SEQ ID NO: 324032 - DNA, 25 bp, Rattus norvegicus
gacgcagatctcagtgtaggttaaa

SEQ ID NO: 324033 - DNA, 25 bp, Rattus norvegicus
gacgcagatctctgtgtaggttaaa

SEQ ID NO: 324034 - DNA, 25 bp, Rattus norvegicus
gacgcagcaggtcttctatcagaaa

SEQ ID NO: 324035 - DNA, 25 bp, Rattus norvegicus
gacgcagcaggtgttctatcagaaa

SEQ ID NO: 324036 - DNA, 25 bp, Rattus norvegicus
gacgcagcgcgtatgggtgttcata

SEQ ID NO: 324037 - DNA, 25 bp, Rattus norvegicus
gacgcagcgcgtttgggtgttcata

SEQ ID NO: 324038 - DNA, 25 bp, Rattus norvegicus
gacgcagcgtgcactgaggacctgt

SEQ ID NO: 324039 - DNA, 25 bp, Rattus norvegicus
gacgcagcgtgctctgaggacctgt

SEQ ID NO: 324040 - DNA, 25 bp, Rattus norvegicus
gacgcagcttataaaccaggcatga

SEQ ID NO: 324041 - DNA, 25 bp, Rattus norvegicus
gacgcagcttattaaccaggcatga

SEQ ID NO: 324042 - DNA, 25 bp, Rattus norvegicus
gacgcaggaaacaattggacctctg

SEQ ID NO: 324043 - DNA, 25 bp, Rattus norvegicus
gacgcaggaaactattggacctctg

SEQ ID NO: 324044 - DNA, 25 bp, Rattus norvegicus
gacgcaggccttcaagaacaaccta

SEQ ID NO: 324045 - DNA, 25 bp, Rattus norvegicus
gacgcaggccttgaagaacaaccta

SEQ ID NO: 324046 - DNA, 25 bp, Rattus norvegicus
gacgcagggctacgcagcatcttga

SEQ ID NO: 324047 - DNA, 25 bp, Rattus norvegicus
gacgcagggctaggcagcatcttga

SEQ ID NO: 324048 - DNA, 25 bp, Rattus norvegicus
gacgcagggttcatcacaggttttt

SEQ ID NO: 324049 - DNA, 25 bp, Rattus norvegicus
gacgcagggttcttcacaggttttt

SEQ ID NO: 324050 - DNA, 25 bp, Rattus norvegicus
gacgcaggttctagaaagttacaat

SEQ ID NO: 324051 - DNA, 25 bp, Rattus norvegicus
gacgcaggttcttgaaagttacaat

SEQ ID NO: 324052 - DNA, 25 bp, Rattus norvegicus
gacgcagtcacacttactgtgcaga

SEQ ID NO: 324053 - DNA, 25 bp, Rattus norvegicus
gacgcagtcacagttactgtgcaga

SEQ ID NO: 324054 - DNA, 25 bp, Rattus norvegicus
gacgcagtcccgctctgaggaaagc

SEQ ID NO: 324055 - DNA, 25 bp, Rattus norvegicus
gacgcagtcccggtctgaggaaagc

SEQ ID NO: 324056 - DNA, 25 bp, Rattus norvegicus
gacgcagtctccactttaaaactaa

SEQ ID NO: 324057 - DNA, 25 bp, Rattus norvegicus
gacgcagtctcctctttaaaactaa

SEQ ID NO: 324058 - DNA, 25 bp, Rattus norvegicus
gacgcatcagagaggcgcctgctca

SEQ ID NO: 324059 - DNA, 25 bp, Rattus norvegicus
gacgcatcagagtggcgcctgctca

SEQ ID NO: 324060 - DNA, 25 bp, Rattus norvegicus
gacgcatcttagagctctcaggagc

SEQ ID NO: 324061 - DNA, 25 bp, Rattus norvegicus
gacgcatcttagtgctctcaggagc

SEQ ID NO: 324062 - DNA, 25 bp, Rattus norvegicus
gacgcatgcagtagttcgcttcaaa

SEQ ID NO: 324063 - DNA, 25 bp, Rattus norvegicus
gacgcatgcagttgttcgcttcaaa

SEQ ID NO: 324064 - DNA, 25 bp, Rattus norvegicus
gacgcatgggatcttttctggtcca

SEQ ID NO: 324065 - DNA, 25 bp, Rattus norvegicus
gacgcatgggatgttttctggtcca

SEQ ID NO: 324066 - DNA, 25 bp, Rattus norvegicus
gacgcatggtgaacctgaaactatc

SEQ ID NO: 324067 - DNA, 25 bp, Rattus norvegicus
gacgcatggtgatcctgaaactatc

SEQ ID NO: 324068 - DNA, 25 bp, Rattus norvegicus
gacgcatgtaaactgtgcccttggg

SEQ ID NO: 324069 - DNA, 25 bp, Rattus norvegicus
gacgcatgtaaagtgtgcccttggg

SEQ ID NO: 324070 - DNA, 25 bp, Rattus norvegicus
gacgcatgtcagagtggctgcagca

SEQ ID NO: 324071 - DNA, 25 bp, Rattus norvegicus
gacgcatgtcagtgtggctgcagca

SEQ ID NO: 324072 - DNA, 25 bp, Rattus norvegicus
gacgcatgtcttcattaatggctta

SEQ ID NO: 324073 - DNA, 25 bp, Rattus norvegicus
gacgcatgtcttgattaatggctta

SEQ ID NO: 324074 - DNA, 25 bp, Rattus norvegicus
gacgcattataaccattcatttcac

SEQ ID NO: 324075 - DNA, 25 bp, Rattus norvegicus
gacgcattataagcattcatttcac

SEQ ID NO: 324076 - DNA, 25 bp, Rattus norvegicus
gacgcattattgacacttctctgac

SEQ ID NO: 324077 - DNA, 25 bp, Rattus norvegicus
gacgcattattgtcacttctctgac

SEQ ID NO: 324078 - DNA, 25 bp, Rattus norvegicus
gacgcattctgtattctgttgactg

SEQ ID NO: 324079 - DNA, 25 bp, Rattus norvegicus
gacgcattctgttttctgttgactg

SEQ ID NO: 324080 - DNA, 25 bp, Rattus norvegicus
gacgcattgctaatttctggttttg

SEQ ID NO: 324081 - DNA, 25 bp, Rattus norvegicus
gacgcattgctattttctggttttg

SEQ ID NO: 324082 - DNA, 25 bp, Rattus norvegicus
gacgcattggcaacaaacagctctc

SEQ ID NO: 324083 - DNA, 25 bp, Rattus norvegicus
gacgcattggcatcaaacagctctc

SEQ ID NO: 324084 - DNA, 25 bp, Rattus norvegicus
gacgcatttcagcagggcacagtat

SEQ ID NO: 324085 - DNA, 25 bp, Rattus norvegicus
gacgcatttcaggagggcacagtat

SEQ ID NO: 324086 - DNA, 25 bp, Rattus norvegicus
gacgccaaaaagacaccagctcttt

SEQ ID NO: 324087 - DNA, 25 bp, Rattus norvegicus
gacgccaaaaagtcaccagctcttt

SEQ ID NO: 324088 - DNA, 25 bp, Rattus norvegicus
gacgccaaaattccaccaaatacca

SEQ ID NO: 324089 - DNA, 25 bp, Rattus norvegicus
gacgccaaaattgcaccaaatacca

SEQ ID NO: 324090 - DNA, 25 bp, Rattus norvegicus
gacgccaaacctaaagtcactcggg

SEQ ID NO: 324091 - DNA, 25 bp, Rattus norvegicus
gacgccaaaccttaagtcactcggg

SEQ ID NO: 324092 - DNA, 25 bp, Rattus norvegicus
gacgccaacaacctgcatggatttg

SEQ ID NO: 324093 - DNA, 25 bp, Rattus norvegicus
gacgccaacaacgtgcatggatttg

SEQ ID NO: 324094 - DNA, 25 bp, Rattus norvegicus
gacgccaacacccagcgcagaggag

SEQ ID NO: 324095 - DNA, 25 bp, Rattus norvegicus
gacgccaacaccgagcgcagaggag

SEQ ID NO: 324096 - DNA, 25 bp, Rattus norvegicus
gacgccaagagtaaactacctttcg

SEQ ID NO: 324097 - DNA, 25 bp, Rattus norvegicus
gacgccaagagttaactacctttcg

SEQ ID NO: 324098 - DNA, 25 bp, Rattus norvegicus
gacgccaagggcacactggtagaag

SEQ ID NO: 324099 - DNA, 25 bp, Rattus norvegicus
gacgccaagggctcactggtagaag

SEQ ID NO: 324100 - DNA, 25 bp, Rattus norvegicus
gacgccacgttcctcaggttctgag

SEQ ID NO: 324101 - DNA, 25 bp, Rattus norvegicus
gacgccacgttcgtcaggttctgag

SEQ ID NO: 324102 - DNA, 25 bp, Rattus norvegicus
gacgccagagacattctgacttctc

SEQ ID NO: 324103 - DNA, 25 bp, Rattus norvegicus
gacgccagagactttctgacttctc

SEQ ID NO: 324104 - DNA, 25 bp, Rattus norvegicus
gacgccagccggcacatgaagcaga

SEQ ID NO: 324105 - DNA, 25 bp, Rattus norvegicus
gacgccagccgggacatgaagcaga

SEQ ID NO: 324106 - DNA, 25 bp, Rattus norvegicus
gacgccagggtcaacattagcctcc

SEQ ID NO: 324107 - DNA, 25 bp, Rattus norvegicus
gacgccagggtctacattagcctcc

SEQ ID NO: 324108 - DNA, 25 bp, Rattus norvegicus
gacgccagtgacattgtggtagcat

SEQ ID NO: 324109 - DNA, 25 bp, Rattus norvegicus
gacgccagtgactttgtggtagcat

SEQ ID NO: 324110 - DNA, 25 bp, Rattus norvegicus
gacgccatcacgctcatcagatgag

SEQ ID NO: 324111 - DNA, 25 bp, Rattus norvegicus
gacgccatcacggtcatcagatgag

SEQ ID NO: 324112 - DNA, 25 bp, Rattus norvegicus
gacgccatgacacgcactgatgcgc

SEQ ID NO: 324113 - DNA, 25 bp, Rattus norvegicus
gacgccatgacaggcactgatgcgc

SEQ ID NO: 324114 - DNA, 25 bp, Rattus norvegicus
gacgccatgttgatctgacctgtat

SEQ ID NO: 324115 - DNA, 25 bp, Rattus norvegicus
gacgccatgttgttctgacctgtat

SEQ ID NO: 324116 - DNA, 25 bp, Rattus norvegicus
gacgccattgataaaaaccttcctt

SEQ ID NO: 324117 - DNA, 25 bp, Rattus norvegicus
gacgccattgattaaaaccttcctt

SEQ ID NO: 324118 - DNA, 25 bp, Rattus norvegicus
gacgcccaacatcgtgttagggtta

SEQ ID NO: 324119 - DNA, 25 bp, Rattus norvegicus
gacgcccaacatggtgttagggtta

SEQ ID NO: 324120 - DNA, 25 bp, Rattus norvegicus
gacgcccacgttcatgtaggacaca

SEQ ID NO: 324121 - DNA, 25 bp, Rattus norvegicus
gacgcccacgttgatgtaggacaca

SEQ ID NO: 324122 - DNA, 25 bp, Rattus norvegicus
gacgcccactccactcagaggtgga

SEQ ID NO: 324123 - DNA, 25 bp, Rattus norvegicus
gacgcccactcctctcagaggtgga

SEQ ID NO: 324124 - DNA, 25 bp, Rattus norvegicus
gacgcccaggacattttggacactt

SEQ ID NO: 324125 - DNA, 25 bp, Rattus norvegicus
gacgcccaggactttttggacactt

SEQ ID NO: 324126 - DNA, 25 bp, Rattus norvegicus
gacgccccataaatgcttaaagtga

SEQ ID NO: 324127 - DNA, 25 bp, Rattus norvegicus
gacgccccataattgcttaaagtga

SEQ ID NO: 324128 - DNA, 25 bp, Rattus norvegicus
gacgcccgagccatccatagtcaag

SEQ ID NO: 324129 - DNA, 25 bp, Rattus norvegicus
gacgcccgagccttccatagtcaag

SEQ ID NO: 324130 - DNA, 25 bp, Rattus norvegicus
gacgccctcgtcattgtacagagtt

SEQ ID NO: 324131 - DNA, 25 bp, Rattus norvegicus
gacgccctcgtctttgtacagagtt

SEQ ID NO: 324132 - DNA, 25 bp, Rattus norvegicus
gacgccctgaccatcacagaagtta

SEQ ID NO: 324133 - DNA, 25 bp, Rattus norvegicus
gacgccctgaccttcacagaagtta

SEQ ID NO: 324134 - DNA, 25 bp, Rattus norvegicus
gacgccctgcttctgtgatgtaaaa

SEQ ID NO: 324135 - DNA, 25 bp, Rattus norvegicus
gacgccctgcttgtgtgatgtaaaa

SEQ ID NO: 324136 - DNA, 25 bp, Rattus norvegicus
gacgccctggagcttgaatgatccc

SEQ ID NO: 324137 - DNA, 25 bp, Rattus norvegicus
gacgccctggaggttgaatgatccc

SEQ ID NO: 324138 - DNA, 25 bp, Rattus norvegicus
gacgcccttgagacacacccaagaa

SEQ ID NO: 324139 - DNA, 25 bp, Rattus norvegicus
gacgcccttgagtcacacccaagaa

SEQ ID NO: 324140 - DNA, 25 bp, Rattus norvegicus
gacgccgatggaattatttcaccaa

SEQ ID NO: 324141 - DNA, 25 bp, Rattus norvegicus
gacgccgatggatttatttcaccaa

SEQ ID NO: 324142 - DNA, 25 bp, Rattus norvegicus
gacgccgatttgagaaagcagcaca

SEQ ID NO: 324143 - DNA, 25 bp, Rattus norvegicus
gacgccgatttgtgaaagcagcaca

SEQ ID NO: 324144 - DNA, 25 bp, Rattus norvegicus
gacgccgccagcatcgtgaaaagga

SEQ ID NO: 324145 - DNA, 25 bp, Rattus norvegicus
gacgccgccagcttcgtgaaaagga

SEQ ID NO: 324146 - DNA, 25 bp, Rattus norvegicus
gacgccgggagtcccaagaccagaa

SEQ ID NO: 324147 - DNA, 25 bp, Rattus norvegicus
gacgccgggagtgccaagaccagaa

SEQ ID NO: 324148 - DNA, 25 bp, Rattus norvegicus
gacgccgggcggactattcaggctt

SEQ ID NO: 324149 - DNA, 25 bp, Rattus norvegicus
gacgccgggcggtctattcaggctt

SEQ ID NO: 324150 - DNA, 25 bp, Rattus norvegicus
gacgccggtctccaaagcaatggaa

SEQ ID NO: 324151 - DNA, 25 bp, Rattus norvegicus
gacgccggtctcgaaagcaatggaa

SEQ ID NO: 324152 - DNA, 25 bp, Rattus norvegicus
gacgccgtcgagaatgtcgtagtta

SEQ ID NO: 324153 - DNA, 25 bp, Rattus norvegicus
gacgccgtcgagtatgtcgtagtta

SEQ ID NO: 324154 - DNA, 25 bp, Rattus norvegicus
gacgcctaaaatatttgtaactaca

SEQ ID NO: 324155 - DNA, 25 bp, Rattus norvegicus
gacgcctaaaatttttgtaactaca

SEQ ID NO: 324156 - DNA, 25 bp, Rattus norvegicus
gacgcctacaaaatcttgtatattt

SEQ ID NO: 324157 - DNA, 25 bp, Rattus norvegicus
gacgcctacaaattcttgtatattt

SEQ ID NO: 324158 - DNA, 25 bp, Rattus norvegicus
gacgcctatatgatgcaggtgccat

SEQ ID NO: 324159 - DNA, 25 bp, Rattus norvegicus
gacgcctatatgttgcaggtgccat

SEQ ID NO: 324160 - DNA, 25 bp, Rattus norvegicus
gacgcctatgagcagccaacctaga

SEQ ID NO: 324161 - DNA, 25 bp, Rattus norvegicus
gacgcctatgaggagccaacctaga

SEQ ID NO: 324162 - DNA, 25 bp, Rattus norvegicus
gacgcctcggtgatgtacagaaaat

SEQ ID NO: 324163 - DNA, 25 bp, Rattus norvegicus
gacgcctcggtgttgtacagaaaat

SEQ ID NO: 324164 - DNA, 25 bp, Rattus norvegicus
gacgcctctaccagtgggtggagca

SEQ ID NO: 324165 - DNA, 25 bp, Rattus norvegicus
gacgcctctacctgtgggtggagca

SEQ ID NO: 324166 - DNA, 25 bp, Rattus norvegicus
gacgcctctcgaagctgtttgctgg

SEQ ID NO: 324167 - DNA, 25 bp, Rattus norvegicus
gacgcctctcgatgctgtttgctgg

SEQ ID NO: 324168 - DNA, 25 bp, Rattus norvegicus
gacgcctgacagcagcttccatgcg

SEQ ID NO: 324169 - DNA, 25 bp, Rattus norvegicus
gacgcctgacaggagcttccatgcg

SEQ ID NO: 324170 - DNA, 25 bp, Rattus norvegicus
gacgcctgtctgaacctgtgctgtg

SEQ ID NO: 324171 - DNA, 25 bp, Rattus norvegicus
gacgcctgtctgtacctgtgctgtg

SEQ ID NO: 324172 - DNA, 25 bp, Rattus norvegicus
gacgccttcatcacaggactgggaa

SEQ ID NO: 324173 - DNA, 25 bp, Rattus norvegicus
gacgccttcatctcaggactgggaa

SEQ ID NO: 324174 - DNA, 25 bp, Rattus norvegicus
gacgccttcctgctcgatgttgagg

SEQ ID NO: 324175 - DNA, 25 bp, Rattus norvegicus
gacgccttcctggtcgatgttgagg

SEQ ID NO: 324176 - DNA, 25 bp, Rattus norvegicus
gacgcctttcatatggcctctgcgg

SEQ ID NO: 324177 - DNA, 25 bp, Rattus norvegicus
gacgcctttcatttggcctctgcgg

SEQ ID NO: 324178 - DNA, 25 bp, Rattus norvegicus
gacgcctttcggcagtttgacacca

SEQ ID NO: 324179 - DNA, 25 bp, Rattus norvegicus
gacgcctttcgggagtttgacacca

SEQ ID NO: 324180 - DNA, 25 bp, Rattus norvegicus
gacgcctttgttattagccatttgg

SEQ ID NO: 324181 - DNA, 25 bp, Rattus norvegicus
gacgcctttgtttttagccatttgg

SEQ ID NO: 324182 - DNA, 25 bp, Rattus norvegicus
gacgccttttagcatctgacatttg

SEQ ID NO: 324183 - DNA, 25 bp, Rattus norvegicus
gacgccttttaggatctgacatttg

SEQ ID NO: 324184 - DNA, 25 bp, Rattus norvegicus
gacgccttttgaaagtccgcttgcg

SEQ ID NO: 324185 - DNA, 25 bp, Rattus norvegicus
gacgccttttgaacatacagtagga

SEQ ID NO: 324186 - DNA, 25 bp, Rattus norvegicus
gacgccttttgatagtccgcttgcg

SEQ ID NO: 324187 - DNA, 25 bp, Rattus norvegicus
gacgccttttgatcatacagtagga

SEQ ID NO: 324188 - DNA, 25 bp, Rattus norvegicus
gacgcgacagttcaagagcaagcct

SEQ ID NO: 324189 - DNA, 25 bp, Rattus norvegicus
gacgcgacagttgaagagcaagcct

SEQ ID NO: 324190 - DNA, 25 bp, Rattus norvegicus
gacgcgagtacaaatcgtgctgcaa

SEQ ID NO: 324191 - DNA, 25 bp, Rattus norvegicus
gacgcgagtacatatcgtgctgcaa

SEQ ID NO: 324192 - DNA, 25 bp, Rattus norvegicus
gacgcgatcagtattctagggcact

SEQ ID NO: 324193 - DNA, 25 bp, Rattus norvegicus
gacgcgatcagttttctagggcact

SEQ ID NO: 324194 - DNA, 25 bp, Rattus norvegicus
gacgcgccgggcagggcaaaaactc

SEQ ID NO: 324195 - DNA, 25 bp, Rattus norvegicus
gacgcgccgggctgggcaaaaactc

SEQ ID NO: 324196 - DNA, 25 bp, Rattus norvegicus
gacgcgcgactacgtggactacagt

SEQ ID NO: 324197 - DNA, 25 bp, Rattus norvegicus
gacgcgcgactaggtggactacagt

SEQ ID NO: 324198 - DNA, 25 bp, Rattus norvegicus
gacgcgctgcagagttttagctgga

SEQ ID NO: 324199 - DNA, 25 bp, Rattus norvegicus
gacgcgctgcagtgttttagctgga

SEQ ID NO: 324200 - DNA, 25 bp, Rattus norvegicus
gacgcggaaggtaatgttcatgtat

SEQ ID NO: 324201 - DNA, 25 bp, Rattus norvegicus
gacgcggaaggttatgttcatgtat

SEQ ID NO: 324202 - DNA, 25 bp, Rattus norvegicus
gacgcggagaagcacgacgggccct

SEQ ID NO: 324203 - DNA, 25 bp, Rattus norvegicus
gacgcggagaaggacgacgggccct

SEQ ID NO: 324204 - DNA, 25 bp, Rattus norvegicus
gacgcggcaccactgtctcatgaca

SEQ ID NO: 324205 - DNA, 25 bp, Rattus norvegicus
gacgcggcaccagtgtctcatgaca

SEQ ID NO: 324206 - DNA, 25 bp, Rattus norvegicus
gacgcggtatccaattaactcaatt

SEQ ID NO: 324207 - DNA, 25 bp, Rattus norvegicus
gacgcggtatcctattaactcaatt

SEQ ID NO: 324208 - DNA, 25 bp, Rattus norvegicus
gacgcggtcattaaagaagtttctt

SEQ ID NO: 324209 - DNA, 25 bp, Rattus norvegicus
gacgcggtcatttaagaagtttctt

SEQ ID NO: 324210 - DNA, 25 bp, Rattus norvegicus
gacgcggtgtgacttttcccatatg

SEQ ID NO: 324211 - DNA, 25 bp, Rattus norvegicus
gacgcggtgtgagttttcccatatg

SEQ ID NO: 324212 - DNA, 25 bp, Rattus norvegicus
gacgcggttttacccacagactctg

SEQ ID NO: 324213 - DNA, 25 bp, Rattus norvegicus
gacgcggttttagccacagactctg

SEQ ID NO: 324214 - DNA, 25 bp, Rattus norvegicus
gacgcgtagcttctgtatctgtaat

SEQ ID NO: 324215 - DNA, 25 bp, Rattus norvegicus
gacgcgtagcttgtgtatctgtaat

SEQ ID NO: 324216 - DNA, 25 bp, Rattus norvegicus
gacgcgtatgaaaactgctgccccg

SEQ ID NO: 324217 - DNA, 25 bp, Rattus norvegicus
gacgcgtatgaatactgctgccccg

SEQ ID NO: 324218 - DNA, 25 bp, Rattus norvegicus
gacgcgtccattaagcgcatcgcga

SEQ ID NO: 324219 - DNA, 25 bp, Rattus norvegicus
gacgcgtccatttagcgcatcgcga

SEQ ID NO: 324220 - DNA, 25 bp, Rattus norvegicus
gacgcgtctgggagtctggacacat

SEQ ID NO: 324221 - DNA, 25 bp, Rattus norvegicus
gacgcgtctgggtgtctggacacat

SEQ ID NO: 324222 - DNA, 25 bp, Rattus norvegicus
gacgcgtgcagcacctgtaatgtgc

SEQ ID NO: 324223 - DNA, 25 bp, Rattus norvegicus
gacgcgtgcagctcctgtaatgtgc

SEQ ID NO: 324224 - DNA, 25 bp, Rattus norvegicus
gacgcgtgttgaatgttcttcatct

SEQ ID NO: 324225 - DNA, 25 bp, Rattus norvegicus
gacgcgtgttgattgttcttcatct

SEQ ID NO: 324226 - DNA, 25 bp, Rattus norvegicus
gacgcgttccatatttctcaataaa

SEQ ID NO: 324227 - DNA, 25 bp, Rattus norvegicus
gacgcgttccatttttctcaataaa

SEQ ID NO: 324228 - DNA, 25 bp, Rattus norvegicus
gacgctaagcagactttcttatggc

SEQ ID NO: 324229 - DNA, 25 bp, Rattus norvegicus
gacgctaagcagtctttcttatggc

SEQ ID NO: 324230 - DNA, 25 bp, Rattus norvegicus
gacgctacacacagtaaaggctggt

SEQ ID NO: 324231 - DNA, 25 bp, Rattus norvegicus
gacgctacacactgtaaaggctggt

SEQ ID NO: 324232 - DNA, 25 bp, Rattus norvegicus
gacgctactatgagaagccttgccg

SEQ ID NO: 324233 - DNA, 25 bp, Rattus norvegicus
gacgctactatgtgaagccttgccg

SEQ ID NO: 324234 - DNA, 25 bp, Rattus norvegicus
gacgctacttttcatttgccccaac

SEQ ID NO: 324235 - DNA, 25 bp, Rattus norvegicus
gacgctacttttgatttgccccaac

SEQ ID NO: 324236 - DNA, 25 bp, Rattus norvegicus
gacgctagagcacgttttgttctca

SEQ ID NO: 324237 - DNA, 25 bp, Rattus norvegicus
gacgctagagcaggttttgttctca

SEQ ID NO: 324238 - DNA, 25 bp, Rattus norvegicus
gacgctatgggaaggtgctcactga

SEQ ID NO: 324239 - DNA, 25 bp, Rattus norvegicus
gacgctatgggatggtgctcactga

SEQ ID NO: 324240 - DNA, 25 bp, Rattus norvegicus
gacgctattgtgaatcgcttagcct

SEQ ID NO: 324241 - DNA, 25 bp, Rattus norvegicus
gacgctattgtgtatcgcttagcct

SEQ ID NO: 324242 - DNA, 25 bp, Rattus norvegicus
gacgctatttcgctggttctgagac

SEQ ID NO: 324243 - DNA, 25 bp, Rattus norvegicus
gacgctatttcggtggttctgagac

SEQ ID NO: 324244 - DNA, 25 bp, Rattus norvegicus
gacgctcacctcacatctttgatta

SEQ ID NO: 324245 - DNA, 25 bp, Rattus norvegicus
gacgctcacctctcatctttgatta

SEQ ID NO: 324246 - DNA, 25 bp, Rattus norvegicus
gacgctcagaacaactagtactccc

SEQ ID NO: 324247 - DNA, 25 bp, Rattus norvegicus
gacgctcagaactactagtactccc

SEQ ID NO: 324248 - DNA, 25 bp, Rattus norvegicus
gacgctcagagtcccctgttaaaat

SEQ ID NO: 324249 - DNA, 25 bp, Rattus norvegicus
gacgctcagagtgccctgttaaaat

SEQ ID NO: 324250 - DNA, 25 bp, Rattus norvegicus
gacgctcagggcagtagctcacttt

SEQ ID NO: 324251 - DNA, 25 bp, Rattus norvegicus
gacgctcagggctgtagctcacttt

SEQ ID NO: 324252 - DNA, 25 bp, Rattus norvegicus
gacgctcctgtcattagggtctctt

SEQ ID NO: 324253 - DNA, 25 bp, Rattus norvegicus
gacgctcctgtctttagggtctctt

SEQ ID NO: 324254 - DNA, 25 bp, Rattus norvegicus
gacgctcgagtaagacgtttctgtc

SEQ ID NO: 324255 - DNA, 25 bp, Rattus norvegicus
gacgctcgagtatgacgtttctgtc

SEQ ID NO: 324256 - DNA, 25 bp, Rattus norvegicus
gacgctcgcgctcaagttcgagaac

SEQ ID NO: 324257 - DNA, 25 bp, Rattus norvegicus
gacgctcgcgctgaagttcgagaac

SEQ ID NO: 324258 - DNA, 25 bp, Rattus norvegicus
gacgctcgctgtactggaagaccta

SEQ ID NO: 324259 - DNA, 25 bp, Rattus norvegicus
gacgctcgctgttctggaagaccta

SEQ ID NO: 324260 - DNA, 25 bp, Rattus norvegicus
gacgctctctacactcttgtgtaaa

SEQ ID NO: 324261 - DNA, 25 bp, Rattus norvegicus
gacgctctctactctcttgtgtaaa

SEQ ID NO: 324262 - DNA, 25 bp, Rattus norvegicus
gacgctctctgactgagtcgaagta

SEQ ID NO: 324263 - DNA, 25 bp, Rattus norvegicus
gacgctctctgagtgagtcgaagta

SEQ ID NO: 324264 - DNA, 25 bp, Rattus norvegicus
gacgctctgatgcttatgatcgcca

SEQ ID NO: 324265 - DNA, 25 bp, Rattus norvegicus
gacgctctgatggttatgatcgcca

SEQ ID NO: 324266 - DNA, 25 bp, Rattus norvegicus
gacgctgaaacaatccaggcctagg

SEQ ID NO: 324267 - DNA, 25 bp, Rattus norvegicus
gacgctgaaacattccaggcctagg

SEQ ID NO: 324268 - DNA, 25 bp, Rattus norvegicus
gacgctgaaataatgctgctaggat

SEQ ID NO: 324269 - DNA, 25 bp, Rattus norvegicus
gacgctgaaatattgctgctaggat

SEQ ID NO: 324270 - DNA, 25 bp, Rattus norvegicus
gacgctgaatgaaaccatctttgca

SEQ ID NO: 324271 - DNA, 25 bp, Rattus norvegicus
gacgctgaatgataccatctttgca

SEQ ID NO: 324272 - DNA, 25 bp, Rattus norvegicus
gacgctgaatgtcgagtccaacttc

SEQ ID NO: 324273 - DNA, 25 bp, Rattus norvegicus
gacgctgaatgtggagtccaacttc

SEQ ID NO: 324274 - DNA, 25 bp, Rattus norvegicus
gacgctgaccccacgggacataaag

SEQ ID NO: 324275 - DNA, 25 bp, Rattus norvegicus
gacgctgacccctcgggacataaag

SEQ ID NO: 324276 - DNA, 25 bp, Rattus norvegicus
gacgctgactgtacctgataaaaag

SEQ ID NO: 324277 - DNA, 25 bp, Rattus norvegicus
gacgctgactgttcctgataaaaag

SEQ ID NO: 324278 - DNA, 25 bp, Rattus norvegicus
gacgctgagctaaattggatcccct

SEQ ID NO: 324279 - DNA, 25 bp, Rattus norvegicus
gacgctgagctatattggatcccct

SEQ ID NO: 324280 - DNA, 25 bp, Rattus norvegicus
gacgctgatattacaatcttctgaa

SEQ ID NO: 324281 - DNA, 25 bp, Rattus norvegicus
gacgctgatatttcaatcttctgaa

SEQ ID NO: 324282 - DNA, 25 bp, Rattus norvegicus
gacgctgccaatatcagaactgtca

SEQ ID NO: 324283 - DNA, 25 bp, Rattus norvegicus
gacgctgccaatttcagaactgtca

SEQ ID NO: 324284 - DNA, 25 bp, Rattus norvegicus
gacgctgctagcatgacaggagctt

SEQ ID NO: 324285 - DNA, 25 bp, Rattus norvegicus
gacgctgctagcttgacaggagctt

SEQ ID NO: 324286 - DNA, 25 bp, Rattus norvegicus
gacgctgctgaacaagtttggcaac

SEQ ID NO: 324287 - DNA, 25 bp, Rattus norvegicus
gacgctgctgaagaagtttggcaac

SEQ ID NO: 324288 - DNA, 25 bp, Rattus norvegicus
gacgctggagcccttgtatataatg

SEQ ID NO: 324289 - DNA, 25 bp, Rattus norvegicus
gacgctggagccgttgtatataatg

SEQ ID NO: 324290 - DNA, 25 bp, Rattus norvegicus
gacgctggccttcggaacagacaaa

SEQ ID NO: 324291 - DNA, 25 bp, Rattus norvegicus
gacgctggccttgggaacagacaaa

SEQ ID NO: 324292 - DNA, 25 bp, Rattus norvegicus
gacgctgtatgtcaaaacatcctgt

SEQ ID NO: 324293 - DNA, 25 bp, Rattus norvegicus
gacgctgtatgtgaaaacatcctgt

SEQ ID NO: 324294 - DNA, 25 bp, Rattus norvegicus
gacgctgtcattaagctaagtgctc

SEQ ID NO: 324295 - DNA, 25 bp, Rattus norvegicus
gacgctgtcatttagctaagtgctc

SEQ ID NO: 324296 - DNA, 25 bp, Rattus norvegicus
gacgctgtcttgctttagctactaa

SEQ ID NO: 324297 - DNA, 25 bp, Rattus norvegicus
gacgctgtcttggtttagctactaa

SEQ ID NO: 324298 - DNA, 25 bp, Rattus norvegicus
gacgctgtgagcactcagttcatgt

SEQ ID NO: 324299 - DNA, 25 bp, Rattus norvegicus
gacgctgtgagctctcagttcatgt

SEQ ID NO: 324300 - DNA, 25 bp, Rattus norvegicus
gacgctgtggctacgttccggaaaa

SEQ ID NO: 324301 - DNA, 25 bp, Rattus norvegicus
gacgctgtggcttcgttccggaaaa

SEQ ID NO: 324302 - DNA, 25 bp, Rattus norvegicus
gacgctgtggtgaaaatctttcttc

SEQ ID NO: 324303 - DNA, 25 bp, Rattus norvegicus
gacgctgtggtgtaaatctttcttc

SEQ ID NO: 324304 - DNA, 25 bp, Rattus norvegicus
gacgctgtgtaaaagcctacaactg

SEQ ID NO: 324305 - DNA, 25 bp, Rattus norvegicus
gacgctgtgtaatagcctacaactg

SEQ ID NO: 324306 - DNA, 25 bp, Rattus norvegicus
gacgctgttacaatgttgactgtgt

SEQ ID NO: 324307 - DNA, 25 bp, Rattus norvegicus
gacgctgttacattgttgactgtgt

SEQ ID NO: 324308 - DNA, 25 bp, Rattus norvegicus
gacgctgttatgcactctatttcat

SEQ ID NO: 324309 - DNA, 25 bp, Rattus norvegicus
gacgctgttatggactctatttcat

SEQ ID NO: 324310 - DNA, 25 bp, Rattus norvegicus
gacgctgttccaatggcggaatcca

SEQ ID NO: 324311 - DNA, 25 bp, Rattus norvegicus
gacgctgttccattggcggaatcca

SEQ ID NO: 324312 - DNA, 25 bp, Rattus norvegicus
gacgctgttcccatacagggagtga

SEQ ID NO: 324313 - DNA, 25 bp, Rattus norvegicus
gacgctgttcccttacagggagtga

SEQ ID NO: 324314 - DNA, 25 bp, Rattus norvegicus
gacgctgttgaaatctggtttctcc

SEQ ID NO: 324315 - DNA, 25 bp, Rattus norvegicus
gacgctgttgaattctggtttctcc

SEQ ID NO: 324316 - DNA, 25 bp, Rattus norvegicus
gacgctgtttcgacctgagcaggag

SEQ ID NO: 324317 - DNA, 25 bp, Rattus norvegicus
gacgctgtttcgtcctgagcaggag

SEQ ID NO: 324318 - DNA, 25 bp, Rattus norvegicus
gacgctgttttcctgcaagaaccgg

SEQ ID NO: 324319 - DNA, 25 bp, Rattus norvegicus
gacgctgttttcgtgcaagaaccgg

SEQ ID NO: 324320 - DNA, 25 bp, Rattus norvegicus
gacgcttaaacgatttcaaggcact

SEQ ID NO: 324321 - DNA, 25 bp, Rattus norvegicus
gacgcttaaacgttttcaaggcact

SEQ ID NO: 324322 - DNA, 25 bp, Rattus norvegicus
gacgcttaccttactatgttcttag

SEQ ID NO: 324323 - DNA, 25 bp, Rattus norvegicus
gacgcttacctttctatgttcttag

SEQ ID NO: 324324 - DNA, 25 bp, Rattus norvegicus
gacgcttactagatctagccttcaa

SEQ ID NO: 324325 - DNA, 25 bp, Rattus norvegicus
gacgcttactagttctagccttcaa

SEQ ID NO: 324326 - DNA, 25 bp, Rattus norvegicus
gacgcttatgttactggatttgcca

SEQ ID NO: 324327 - DNA, 25 bp, Rattus norvegicus
gacgcttatgtttctggatttgcca

SEQ ID NO: 324328 - DNA, 25 bp, Rattus norvegicus
gacgcttcacacatgggacctggaa

SEQ ID NO: 324329 - DNA, 25 bp, Rattus norvegicus
gacgcttcacacttgggacctggaa

SEQ ID NO: 324330 - DNA, 25 bp, Rattus norvegicus
gacgcttccaacatagttctagcat

SEQ ID NO: 324331 - DNA, 25 bp, Rattus norvegicus
gacgcttccaacttagttctagcat

SEQ ID NO: 324332 - DNA, 25 bp, Rattus norvegicus
gacgcttctactcggtggaattctg

SEQ ID NO: 324333 - DNA, 25 bp, Rattus norvegicus
gacgcttctactgggtggaattctg

SEQ ID NO: 324334 - DNA, 25 bp, Rattus norvegicus
gacgcttctagtatccttattttgt

SEQ ID NO: 324335 - DNA, 25 bp, Rattus norvegicus
gacgcttctagtttccttattttgt

SEQ ID NO: 324336 - DNA, 25 bp, Rattus norvegicus
gacgcttgaagtacactggtctaaa

SEQ ID NO: 324337 - DNA, 25 bp, Rattus norvegicus
gacgcttgaagttcactggtctaaa

SEQ ID NO: 324338 - DNA, 25 bp, Rattus norvegicus
gacgcttgactgcaatctttcagtt

SEQ ID NO: 324339 - DNA, 25 bp, Rattus norvegicus
gacgcttgactggaatctttcagtt

SEQ ID NO: 324340 - DNA, 25 bp, Rattus norvegicus
gacgcttggagaagacaggagtcta

SEQ ID NO: 324341 - DNA, 25 bp, Rattus norvegicus
gacgcttggagatgacaggagtcta

SEQ ID NO: 324342 - DNA, 25 bp, Rattus norvegicus
gacgcttgttcaagattttctgaga

SEQ ID NO: 324343 - DNA, 25 bp, Rattus norvegicus
gacgcttgttcatgattttctgaga

SEQ ID NO: 324344 - DNA, 25 bp, Rattus norvegicus
gacgcttgttgaaaattgaccttta

SEQ ID NO: 324345 - DNA, 25 bp, Rattus norvegicus
gacgcttgttgataattgaccttta

SEQ ID NO: 324346 - DNA, 25 bp, Rattus norvegicus
gacgctttcaggaatgtgccgcagt

SEQ ID NO: 324347 - DNA, 25 bp, Rattus norvegicus
gacgctttcaggtatgtgccgcagt

SEQ ID NO: 324348 - DNA, 25 bp, Rattus norvegicus
gacgctttctgcctcaggagactgg

SEQ ID NO: 324349 - DNA, 25 bp, Rattus norvegicus
gacgctttctgcgtcaggagactgg

SEQ ID NO: 324350 - DNA, 25 bp, Rattus norvegicus
gacgctttgtcaatgttgtgcccac

SEQ ID NO: 324351 - DNA, 25 bp, Rattus norvegicus
gacgctttgtcattgttgtgcccac

SEQ ID NO: 324352 - DNA, 25 bp, Rattus norvegicus
gacgctttgtgcacttagcttttga

SEQ ID NO: 324353 - DNA, 25 bp, Rattus norvegicus
gacgctttgtgctcttagcttttga

SEQ ID NO: 324354 - DNA, 25 bp, Rattus norvegicus
gacgcttttaaacccctgaagtgta

SEQ ID NO: 324355 - DNA, 25 bp, Rattus norvegicus
gacgcttttaaagccctgaagtgta

SEQ ID NO: 324356 - DNA, 25 bp, Rattus norvegicus
gacgcttttatcatttgaccagtga

SEQ ID NO: 324357 - DNA, 25 bp, Rattus norvegicus
gacgcttttatcttttgaccagtga

SEQ ID NO: 324358 - DNA, 25 bp, Rattus norvegicus
gacgcttttctcattaaatggtggg

SEQ ID NO: 324359 - DNA, 25 bp, Rattus norvegicus
gacgcttttctctttaaatggtggg

SEQ ID NO: 324360 - DNA, 25 bp, Rattus norvegicus
gacggaaaactcctcaagctcaact

SEQ ID NO: 324361 - DNA, 25 bp, Rattus norvegicus
gacggaaaactcgtcaagctcaact

SEQ ID NO: 324362 - DNA, 25 bp, Rattus norvegicus
gacggaaacaatatcacgttcttct

SEQ ID NO: 324363 - DNA, 25 bp, Rattus norvegicus
gacggaaacaatttcacgttcttct

SEQ ID NO: 324364 - DNA, 25 bp, Rattus norvegicus
gacggaaaccgcatcctggagcgcc

SEQ ID NO: 324365 - DNA, 25 bp, Rattus norvegicus
gacggaaaccgcttcctggagcgcc

SEQ ID NO: 324366 - DNA, 25 bp, Rattus norvegicus
gacggaaactacatactgtgcaaat

SEQ ID NO: 324367 - DNA, 25 bp, Rattus norvegicus
gacggaaactacttactgtgcaaat

SEQ ID NO: 324368 - DNA, 25 bp, Rattus norvegicus
gacggaaactttcacgatgcgctta

SEQ ID NO: 324369 - DNA, 25 bp, Rattus norvegicus
gacggaaactttgacgatgcgctta

SEQ ID NO: 324370 - DNA, 25 bp, Rattus norvegicus
gacggaacaccaacatcaaaaactt

SEQ ID NO: 324371 - DNA, 25 bp, Rattus norvegicus
gacggaacaccacgcagaggcacag

SEQ ID NO: 324372 - DNA, 25 bp, Rattus norvegicus
gacggaacaccaggcagaggcacag

SEQ ID NO: 324373 - DNA, 25 bp, Rattus norvegicus
gacggaacaccatcatcaaaaactt

SEQ ID NO: 324374 - DNA, 25 bp, Rattus norvegicus
gacggaaccccgatctgagaaggaa

SEQ ID NO: 324375 - DNA, 25 bp, Rattus norvegicus
gacggaaccccgttctgagaaggaa

SEQ ID NO: 324376 - DNA, 25 bp, Rattus norvegicus
gacggaaccctactgtccaatggga

SEQ ID NO: 324377 - DNA, 25 bp, Rattus norvegicus
gacggaaccctagtgtccaatggga

SEQ ID NO: 324378 - DNA, 25 bp, Rattus norvegicus
gacggaacctgcagagaggctacac

SEQ ID NO: 324379 - DNA, 25 bp, Rattus norvegicus
gacggaacctgctgagaggctacac

SEQ ID NO: 324380 - DNA, 25 bp, Rattus norvegicus
gacggaagatacattggtgctttga

SEQ ID NO: 324381 - DNA, 25 bp, Rattus norvegicus
gacggaagatactttggtgctttga

SEQ ID NO: 324382 - DNA, 25 bp, Rattus norvegicus
gacggaagcacacagctgggctcca

SEQ ID NO: 324383 - DNA, 25 bp, Rattus norvegicus
gacggaagcacagagctgggctcca

SEQ ID NO: 324384 - DNA, 25 bp, Rattus norvegicus
gacggaagcagcacaggactcacga

SEQ ID NO: 324385 - DNA, 25 bp, Rattus norvegicus
gacggaagcagctcaggactcacga

SEQ ID NO: 324386 - DNA, 25 bp, Rattus norvegicus
gacggaagctttacaatttgtcaca

SEQ ID NO: 324387 - DNA, 25 bp, Rattus norvegicus
gacggaagcttttcaatttgtcaca

SEQ ID NO: 324388 - DNA, 25 bp, Rattus norvegicus
gacggaagggcacactatgtctttt

SEQ ID NO: 324389 - DNA, 25 bp, Rattus norvegicus
gacggaagggcagactatgtctttt

SEQ ID NO: 324390 - DNA, 25 bp, Rattus norvegicus
gacggaagtacaacctctttgagat

SEQ ID NO: 324391 - DNA, 25 bp, Rattus norvegicus
gacggaagtacatcctctttgagat

SEQ ID NO: 324392 - DNA, 25 bp, Rattus norvegicus
gacggaagtcagcatctcaggatta

SEQ ID NO: 324393 - DNA, 25 bp, Rattus norvegicus
gacggaagtcaggatctcaggatta

SEQ ID NO: 324394 - DNA, 25 bp, Rattus norvegicus
gacggaagtgttccctgttctgtcc

SEQ ID NO: 324395 - DNA, 25 bp, Rattus norvegicus
gacggaagtgttgcctgttctgtcc

SEQ ID NO: 324396 - DNA, 25 bp, Rattus norvegicus
gacggaagttgcatcaaagaccctt

SEQ ID NO: 324397 - DNA, 25 bp, Rattus norvegicus
gacggaagttgcttcaaagaccctt

SEQ ID NO: 324398 - DNA, 25 bp, Rattus norvegicus
gacggaatacagcacgagccccagt

SEQ ID NO: 324399 - DNA, 25 bp, Rattus norvegicus
gacggaatacaggacgagccccagt

SEQ ID NO: 324400 - DNA, 25 bp, Rattus norvegicus
gacggaatctgtagtcattcattag

SEQ ID NO: 324401 - DNA, 25 bp, Rattus norvegicus
gacggaatctgttgtcattcattag

SEQ ID NO: 324402 - DNA, 25 bp, Rattus norvegicus
gacggaatgaccacttcaaacgcct

SEQ ID NO: 324403 - DNA, 25 bp, Rattus norvegicus
gacggaatgacctcttcaaacgcct

SEQ ID NO: 324404 - DNA, 25 bp, Rattus norvegicus
gacggacaaaatagactgaaatctt

SEQ ID NO: 324405 - DNA, 25 bp, Rattus norvegicus
gacggacaaaattgactgaaatctt

SEQ ID NO: 324406 - DNA, 25 bp, Rattus norvegicus
gacggacaccatattaaggcacaca

SEQ ID NO: 324407 - DNA, 25 bp, Rattus norvegicus
gacggacaccattttaaggcacaca

SEQ ID NO: 324408 - DNA, 25 bp, Rattus norvegicus
gacggacacctgatcttaggtcaca

SEQ ID NO: 324409 - DNA, 25 bp, Rattus norvegicus
gacggacacctgttcttaggtcaca

SEQ ID NO: 324410 - DNA, 25 bp, Rattus norvegicus
gacggacagaccaccttcctaagca

SEQ ID NO: 324411 - DNA, 25 bp, Rattus norvegicus
gacggacagacctccttcctaagca

SEQ ID NO: 324412 - DNA, 25 bp, Rattus norvegicus
gacggacagagtctagatcactgct

SEQ ID NO: 324413 - DNA, 25 bp, Rattus norvegicus
gacggacagagtgtagatcactgct

SEQ ID NO: 324414 - DNA, 25 bp, Rattus norvegicus
gacggacatacactctccatatcca

SEQ ID NO: 324415 - DNA, 25 bp, Rattus norvegicus
gacggacatacagtctccatatcca

SEQ ID NO: 324416 - DNA, 25 bp, Rattus norvegicus
gacggacatcgcagtgaactgggct

SEQ ID NO: 324417 - DNA, 25 bp, Rattus norvegicus
gacggacatcgctgtgaactgggct

SEQ ID NO: 324418 - DNA, 25 bp, Rattus norvegicus
gacggacatgtgatatcctttacaa

SEQ ID NO: 324419 - DNA, 25 bp, Rattus norvegicus
gacggacatgtgttatcctttacaa

SEQ ID NO: 324420 - DNA, 25 bp, Rattus norvegicus
gacggacattctatgtgatgacagt

SEQ ID NO: 324421 - DNA, 25 bp, Rattus norvegicus
gacggacattctttgtgatgacagt

SEQ ID NO: 324422 - DNA, 25 bp, Rattus norvegicus
gacggacattttctttcaactcagt

SEQ ID NO: 324423 - DNA, 25 bp, Rattus norvegicus
gacggacattttgtttcaactcagt

SEQ ID NO: 324424 - DNA, 25 bp, Rattus norvegicus
gacggaccagggattgctttcttat

SEQ ID NO: 324425 - DNA, 25 bp, Rattus norvegicus
gacggaccagggtttgctttcttat

SEQ ID NO: 324426 - DNA, 25 bp, Rattus norvegicus
gacggaccgtccatctgaggagcct

SEQ ID NO: 324427 - DNA, 25 bp, Rattus norvegicus
gacggaccgtccttctgaggagcct

SEQ ID NO: 324428 - DNA, 25 bp, Rattus norvegicus
gacggacctgctactacaagggtag

SEQ ID NO: 324429 - DNA, 25 bp, Rattus norvegicus
gacggacctgcttctacaagggtag

SEQ ID NO: 324430 - DNA, 25 bp, Rattus norvegicus
gacggaccttggagatggacaaacc

SEQ ID NO: 324431 - DNA, 25 bp, Rattus norvegicus
gacggaccttggtgatggacaaacc

SEQ ID NO: 324432 - DNA, 25 bp, Rattus norvegicus
gacggacctttaagcttcatcgaga

SEQ ID NO: 324433 - DNA, 25 bp, Rattus norvegicus
gacggacctttatgcttcatcgaga

SEQ ID NO: 324434 - DNA, 25 bp, Rattus norvegicus
gacggacctttgcaatcgcgcagtt

SEQ ID NO: 324435 - DNA, 25 bp, Rattus norvegicus
gacggacctttggaatcgcgcagtt

SEQ ID NO: 324436 - DNA, 25 bp, Rattus norvegicus
gacggacgctctcggacctaaaccg

SEQ ID NO: 324437 - DNA, 25 bp, Rattus norvegicus
gacggacgctctgggacctaaaccg

SEQ ID NO: 324438 - DNA, 25 bp, Rattus norvegicus
gacggacgcttgcaagagctgtacc

SEQ ID NO: 324439 - DNA, 25 bp, Rattus norvegicus
gacggacgcttggaagagctgtacc

SEQ ID NO: 324440 - DNA, 25 bp, Rattus norvegicus
gacggacggagaatgagtctttcct

SEQ ID NO: 324441 - DNA, 25 bp, Rattus norvegicus
gacggacggagattgagtctttcct

SEQ ID NO: 324442 - DNA, 25 bp, Rattus norvegicus
gacggacgtgtgctattatcaccaa

SEQ ID NO: 324443 - DNA, 25 bp, Rattus norvegicus
gacggacgtgtggtattatcaccaa

SEQ ID NO: 324444 - DNA, 25 bp, Rattus norvegicus
gacggactatccaacgaagcttaag

SEQ ID NO: 324445 - DNA, 25 bp, Rattus norvegicus
gacggactatcctacgaagcttaag

SEQ ID NO: 324446 - DNA, 25 bp, Rattus norvegicus
gacggactccctcagttctctgaga

SEQ ID NO: 324447 - DNA, 25 bp, Rattus norvegicus
gacggactccctgagttctctgaga

SEQ ID NO: 324448 - DNA, 25 bp, Rattus norvegicus
gacggacttcgtctgcaaacagcag

SEQ ID NO: 324449 - DNA, 25 bp, Rattus norvegicus
gacggacttcgtgtgcaaacagcag

SEQ ID NO: 324450 - DNA, 25 bp, Rattus norvegicus
gacggagaacgcacttaaggaccta

SEQ ID NO: 324451 - DNA, 25 bp, Rattus norvegicus
gacggagaacgctcttaaggaccta

SEQ ID NO: 324452 - DNA, 25 bp, Rattus norvegicus
gacggagaagatctgaagtctacac

SEQ ID NO: 324453 - DNA, 25 bp, Rattus norvegicus
gacggagaagatgtgaagtctacac

SEQ ID NO: 324454 - DNA, 25 bp, Rattus norvegicus
gacggagaatcccttcgagtatgac

SEQ ID NO: 324455 - DNA, 25 bp, Rattus norvegicus
gacggagaatccgttcgagtatgac

SEQ ID NO: 324456 - DNA, 25 bp, Rattus norvegicus
gacggagaatgcatcgttaccatga

SEQ ID NO: 324457 - DNA, 25 bp, Rattus norvegicus
gacggagaatgcttcgttaccatga

SEQ ID NO: 324458 - DNA, 25 bp, Rattus norvegicus
gacggagaccacacgaatttcctgt

SEQ ID NO: 324459 - DNA, 25 bp, Rattus norvegicus
gacggagaccactcgaatttcctgt

SEQ ID NO: 324460 - DNA, 25 bp, Rattus norvegicus
gacggagacctcaggccggctagta

SEQ ID NO: 324461 - DNA, 25 bp, Rattus norvegicus
gacggagacctctggccggctagta

SEQ ID NO: 324462 - DNA, 25 bp, Rattus norvegicus
gacggagacgagcaagcagcacttt

SEQ ID NO: 324463 - DNA, 25 bp, Rattus norvegicus
gacggagacgaggaagcagcacttt

SEQ ID NO: 324464 - DNA, 25 bp, Rattus norvegicus
gacggagacgatctcattcgagaga

SEQ ID NO: 324465 - DNA, 25 bp, Rattus norvegicus
gacggagacgatgtcattcgagaga

SEQ ID NO: 324466 - DNA, 25 bp, Rattus norvegicus
gacggagacgtcaaggcccggatcc

SEQ ID NO: 324467 - DNA, 25 bp, Rattus norvegicus
gacggagacgtctaggcccggatcc

SEQ ID NO: 324468 - DNA, 25 bp, Rattus norvegicus
gacggagagtccactgtagtttctc

SEQ ID NO: 324469 - DNA, 25 bp, Rattus norvegicus
gacggagagtcctctgtagtttctc

SEQ ID NO: 324470 - DNA, 25 bp, Rattus norvegicus
gacggagatgggaacatcgactact

SEQ ID NO: 324471 - DNA, 25 bp, Rattus norvegicus
gacggagatgggtacatcgactact

SEQ ID NO: 324472 - DNA, 25 bp, Rattus norvegicus
gacggagatttcacgcaaatggtat

SEQ ID NO: 324473 - DNA, 25 bp, Rattus norvegicus
gacggagatttctcgcaaatggtat

SEQ ID NO: 324474 - DNA, 25 bp, Rattus norvegicus
gacggagcaggaagcacagacccca

SEQ ID NO: 324475 - DNA, 25 bp, Rattus norvegicus
gacggagcaggatgcacagacccca

SEQ ID NO: 324476 - DNA, 25 bp, Rattus norvegicus
gacggagccaagcaggacgcaaact

SEQ ID NO: 324477 - DNA, 25 bp, Rattus norvegicus
gacggagccaaggaggacgcaaact

SEQ ID NO: 324478 - DNA, 25 bp, Rattus norvegicus
gacggagccacacacatggaagcct

SEQ ID NO: 324479 - DNA, 25 bp, Rattus norvegicus
gacggagccacagacatggaagcct

SEQ ID NO: 324480 - DNA, 25 bp, Rattus norvegicus
gacggagcgcagcatggacttctac

SEQ ID NO: 324481 - DNA, 25 bp, Rattus norvegicus
gacggagcgcaggatggacttctac

SEQ ID NO: 324482 - DNA, 25 bp, Rattus norvegicus
gacggaggcaacaggcgctgtttct

SEQ ID NO: 324483 - DNA, 25 bp, Rattus norvegicus
gacggaggcaactggcgctgtttct

SEQ ID NO: 324484 - DNA, 25 bp, Rattus norvegicus
gacggagggaatacatttaatatac

SEQ ID NO: 324485 - DNA, 25 bp, Rattus norvegicus
gacggagggaattcatttaatatac

SEQ ID NO: 324486 - DNA, 25 bp, Rattus norvegicus
gacggaggtgttatctcagttgaat

SEQ ID NO: 324487 - DNA, 25 bp, Rattus norvegicus
gacggaggtgttttctcagttgaat

SEQ ID NO: 324488 - DNA, 25 bp, Rattus norvegicus
gacggagtcaacaacctggtggatt

SEQ ID NO: 324489 - DNA, 25 bp, Rattus norvegicus
gacggagtcaactacctggtggatt

SEQ ID NO: 324490 - DNA, 25 bp, Rattus norvegicus
gacggagtccgactgttcatcgaga

SEQ ID NO: 324491 - DNA, 25 bp, Rattus norvegicus
gacggagtccgagtgttcatcgaga

SEQ ID NO: 324492 - DNA, 25 bp, Rattus norvegicus
gacggagtgggaatcctcgtccact

SEQ ID NO: 324493 - DNA, 25 bp, Rattus norvegicus
gacggagtgggattcctcgtccact

SEQ ID NO: 324494 - DNA, 25 bp, Rattus norvegicus
gacggagttcaaagggcagcagtca

SEQ ID NO: 324495 - DNA, 25 bp, Rattus norvegicus
gacggagttcaacgtgttcaccttt

SEQ ID NO: 324496 - DNA, 25 bp, Rattus norvegicus
gacggagttcaaggtgttcaccttt

SEQ ID NO: 324497 - DNA, 25 bp, Rattus norvegicus
gacggagttcaatgggcagcagtca

SEQ ID NO: 324498 - DNA, 25 bp, Rattus norvegicus
gacggataaagactcaacctcctcc

SEQ ID NO: 324499 - DNA, 25 bp, Rattus norvegicus
gacggataaagagtcaacctcctcc

SEQ ID NO: 324500 - DNA, 25 bp, Rattus norvegicus
gacggatagggtcacactggctcac

SEQ ID NO: 324501 - DNA, 25 bp, Rattus norvegicus
gacggatagggtgacactggctcac

SEQ ID NO: 324502 - DNA, 25 bp, Rattus norvegicus
gacggatatatcaggccaacgagta

SEQ ID NO: 324503 - DNA, 25 bp, Rattus norvegicus
gacggatatatctggccaacgagta

SEQ ID NO: 324504 - DNA, 25 bp, Rattus norvegicus
gacggatcaaagacaggaactgctg

SEQ ID NO: 324505 - DNA, 25 bp, Rattus norvegicus
gacggatcaaagtcaggaactgctg

SEQ ID NO: 324506 - DNA, 25 bp, Rattus norvegicus
gacggatcccacacttgtgacttaa

SEQ ID NO: 324507 - DNA, 25 bp, Rattus norvegicus
gacggatcccactcttgtgacttaa

SEQ ID NO: 324508 - DNA, 25 bp, Rattus norvegicus
gacggatcccagcaaggttctttgt

SEQ ID NO: 324509 - DNA, 25 bp, Rattus norvegicus
gacggatcccaggaaggttctttgt

SEQ ID NO: 324510 - DNA, 25 bp, Rattus norvegicus
gacggatcgaatacattaatacgga

SEQ ID NO: 324511 - DNA, 25 bp, Rattus norvegicus
gacggatcgaattcattaatacgga

SEQ ID NO: 324512 - DNA, 25 bp, Rattus norvegicus
gacggatcgataagggcgccttgat

SEQ ID NO: 324513 - DNA, 25 bp, Rattus norvegicus
gacggatcgatatgggcgccttgat

SEQ ID NO: 324514 - DNA, 25 bp, Rattus norvegicus
gacggatgaaggagaattgacacac

SEQ ID NO: 324515 - DNA, 25 bp, Rattus norvegicus
gacggatgaaggtgaattgacacac

SEQ ID NO: 324516 - DNA, 25 bp, Rattus norvegicus
gacggattatttacattgtccttat

SEQ ID NO: 324517 - DNA, 25 bp, Rattus norvegicus
gacggattattttcattgtccttat

SEQ ID NO: 324518 - DNA, 25 bp, Rattus norvegicus
gacggattcaggcaagccacccatg

SEQ ID NO: 324519 - DNA, 25 bp, Rattus norvegicus
gacggattcagggaagccacccatg

SEQ ID NO: 324520 - DNA, 25 bp, Rattus norvegicus
gacggattgtttcttcctgtttaca

SEQ ID NO: 324521 - DNA, 25 bp, Rattus norvegicus
gacggattgtttgttcctgtttaca

SEQ ID NO: 324522 - DNA, 25 bp, Rattus norvegicus
gacggcaacctgcagtattacctgt

SEQ ID NO: 324523 - DNA, 25 bp, Rattus norvegicus
gacggcaacctggagtattacctgt

SEQ ID NO: 324524 - DNA, 25 bp, Rattus norvegicus
gacggcaagaccatcaaggctcaga

SEQ ID NO: 324525 - DNA, 25 bp, Rattus norvegicus
gacggcaagaccttcaaggctcaga

SEQ ID NO: 324526 - DNA, 25 bp, Rattus norvegicus
gacggcaagatcactcaggtcttta

SEQ ID NO: 324527 - DNA, 25 bp, Rattus norvegicus
gacggcaagatctctcaggtcttta

SEQ ID NO: 324528 - DNA, 25 bp, Rattus norvegicus
gacggcaaggctccagatcctgtca

SEQ ID NO: 324529 - DNA, 25 bp, Rattus norvegicus
gacggcaaggctgcagatcctgtca

SEQ ID NO: 324530 - DNA, 25 bp, Rattus norvegicus
gacggcaagttcaaagccttcgagg

SEQ ID NO: 324531 - DNA, 25 bp, Rattus norvegicus
gacggcaagttctaagccttcgagg

SEQ ID NO: 324532 - DNA, 25 bp, Rattus norvegicus
gacggcacaactcttactctaggga

SEQ ID NO: 324533 - DNA, 25 bp, Rattus norvegicus
gacggcacaactgttactctaggga

SEQ ID NO: 324534 - DNA, 25 bp, Rattus norvegicus
gacggcacagatacattcctcatag

SEQ ID NO: 324535 - DNA, 25 bp, Rattus norvegicus
gacggcacagattcattcctcatag

SEQ ID NO: 324536 - DNA, 25 bp, Rattus norvegicus
gacggcacagttatgccagctagca

SEQ ID NO: 324537 - DNA, 25 bp, Rattus norvegicus
gacggcacagttttgccagctagca

SEQ ID NO: 324538 - DNA, 25 bp, Rattus norvegicus
gacggcacgtgacatggaaagctac

SEQ ID NO: 324539 - DNA, 25 bp, Rattus norvegicus
gacggcacgtgagatggaaagctac

SEQ ID NO: 324540 - DNA, 25 bp, Rattus norvegicus
gacggcactggcaaattcctgagtc

SEQ ID NO: 324541 - DNA, 25 bp, Rattus norvegicus
gacggcactggctaattcctgagtc

SEQ ID NO: 324542 - DNA, 25 bp, Rattus norvegicus
gacggcagagtaaaagttccagcat

SEQ ID NO: 324543 - DNA, 25 bp, Rattus norvegicus
gacggcagagtataagttccagcat

SEQ ID NO: 324544 - DNA, 25 bp, Rattus norvegicus
gacggcagcatgaggtccatcacca

SEQ ID NO: 324545 - DNA, 25 bp, Rattus norvegicus
gacggcagcatgtggtccatcacca

SEQ ID NO: 324546 - DNA, 25 bp, Rattus norvegicus
gacggcagctttcggaactgtagtt

SEQ ID NO: 324547 - DNA, 25 bp, Rattus norvegicus
gacggcagctttgggaactgtagtt

SEQ ID NO: 324548 - DNA, 25 bp, Rattus norvegicus
gacggcagtccacaccacgaaaagc

SEQ ID NO: 324549 - DNA, 25 bp, Rattus norvegicus
gacggcagtccagaccacgaaaagc

SEQ ID NO: 324550 - DNA, 25 bp, Rattus norvegicus
gacggcagtgacaggtgaccacagt

SEQ ID NO: 324551 - DNA, 25 bp, Rattus norvegicus
gacggcagtgactggtgaccacagt

SEQ ID NO: 324552 - DNA, 25 bp, Rattus norvegicus
gacggcagtgctattcaggttctta

SEQ ID NO: 324553 - DNA, 25 bp, Rattus norvegicus
gacggcagtgcttttcaggttctta

SEQ ID NO: 324554 - DNA, 25 bp, Rattus norvegicus
gacggcatctggaaggccagcttca

SEQ ID NO: 324555 - DNA, 25 bp, Rattus norvegicus
gacggcatctggtaggccagcttca

SEQ ID NO: 324556 - DNA, 25 bp, Rattus norvegicus
gacggcatctgtcaaatcatcatca

SEQ ID NO: 324557 - DNA, 25 bp, Rattus norvegicus
gacggcatctgtgaaatcatcatca

SEQ ID NO: 324558 - DNA, 25 bp, Rattus norvegicus
gacggcatcttcctaagtgatctgt

SEQ ID NO: 324559 - DNA, 25 bp, Rattus norvegicus
gacggcatcttcgtaagtgatctgt

SEQ ID NO: 324560 - DNA, 25 bp, Rattus norvegicus
gacggcatggaaaaaactactgcat

SEQ ID NO: 324561 - DNA, 25 bp, Rattus norvegicus
gacggcatggaataaactactgcat

SEQ ID NO: 324562 - DNA, 25 bp, Rattus norvegicus
gacggcatggccagtgatcctaaag

SEQ ID NO: 324563 - DNA, 25 bp, Rattus norvegicus
gacggcatggcctgtgatcctaaag

SEQ ID NO: 324564 - DNA, 25 bp, Rattus norvegicus
gacggcatgtccagtgttcctcata

SEQ ID NO: 324565 - DNA, 25 bp, Rattus norvegicus
gacggcatgtcctgtgttcctcata

SEQ ID NO: 324566 - DNA, 25 bp, Rattus norvegicus
gacggcatgtggatggtaagcccaa

SEQ ID NO: 324567 - DNA, 25 bp, Rattus norvegicus
gacggcatgtggttggtaagcccaa

SEQ ID NO: 324568 - DNA, 25 bp, Rattus norvegicus
gacggccaagtgatcagtgatgagc

SEQ ID NO: 324569 - DNA, 25 bp, Rattus norvegicus
gacggccaagtgttcagtgatgagc

SEQ ID NO: 324570 - DNA, 25 bp, Rattus norvegicus
gacggccaccaaccagaaagcatgt

SEQ ID NO: 324571 - DNA, 25 bp, Rattus norvegicus
gacggccaccaagcagaaagcatgt

SEQ ID NO: 324572 - DNA, 25 bp, Rattus norvegicus
gacggccaccagaaattaaccacat

SEQ ID NO: 324573 - DNA, 25 bp, Rattus norvegicus
gacggccaccagtaattaaccacat

SEQ ID NO: 324574 - DNA, 25 bp, Rattus norvegicus
gacggccagcctcttggatgtgatc

SEQ ID NO: 324575 - DNA, 25 bp, Rattus norvegicus
gacggccagcctgttggatgtgatc

SEQ ID NO: 324576 - DNA, 25 bp, Rattus norvegicus
gacggccaggtcaattatgaagagt

SEQ ID NO: 324577 - DNA, 25 bp, Rattus norvegicus
gacggccaggtctattatgaagagt

SEQ ID NO: 324578 - DNA, 25 bp, Rattus norvegicus
gacggccagtttacatacgtacaat

SEQ ID NO: 324579 - DNA, 25 bp, Rattus norvegicus
gacggccagttttcatacgtacaat

SEQ ID NO: 324580 - DNA, 25 bp, Rattus norvegicus
gacggccatgtgcttccttgaaaat

SEQ ID NO: 324581 - DNA, 25 bp, Rattus norvegicus
gacggccatgtggttccttgaaaat

SEQ ID NO: 324582 - DNA, 25 bp, Rattus norvegicus
gacggccatgttatgagggtcctcc

SEQ ID NO: 324583 - DNA, 25 bp, Rattus norvegicus
gacggccatgttttgagggtcctcc

SEQ ID NO: 324584 - DNA, 25 bp, Rattus norvegicus
gacggccctggtcgttttgataact

SEQ ID NO: 324585 - DNA, 25 bp, Rattus norvegicus
gacggccctggtggttttgataact

SEQ ID NO: 324586 - DNA, 25 bp, Rattus norvegicus
gacggcccttcgaatgtgattttat

SEQ ID NO: 324587 - DNA, 25 bp, Rattus norvegicus
gacggcccttcgtatgtgattttat

SEQ ID NO: 324588 - DNA, 25 bp, Rattus norvegicus
gacggccgaaggacctggattcaac

SEQ ID NO: 324589 - DNA, 25 bp, Rattus norvegicus
gacggccgaaggtcctggattcaac

SEQ ID NO: 324590 - DNA, 25 bp, Rattus norvegicus
gacggccgtgtcatagatcagtacc

SEQ ID NO: 324591 - DNA, 25 bp, Rattus norvegicus
gacggccgtgtcttagatcagtacc

SEQ ID NO: 324592 - DNA, 25 bp, Rattus norvegicus
gacggcctagacactggatttttct

SEQ ID NO: 324593 - DNA, 25 bp, Rattus norvegicus
gacggcctagactctggatttttct

SEQ ID NO: 324594 - DNA, 25 bp, Rattus norvegicus
gacggcctgtgtctctcaaaacact

SEQ ID NO: 324595 - DNA, 25 bp, Rattus norvegicus
gacggcctgtgtgtctcaaaacact

SEQ ID NO: 324596 - DNA, 25 bp, Rattus norvegicus
gacggcgaccgcagttgtgcatcgc

SEQ ID NO: 324597 - DNA, 25 bp, Rattus norvegicus
gacggcgaccgctgttgtgcatcgc

SEQ ID NO: 324598 - DNA, 25 bp, Rattus norvegicus
gacggcgacgccacaaggaagaaaa

SEQ ID NO: 324599 - DNA, 25 bp, Rattus norvegicus
gacggcgacgcctcaaggaagaaaa

SEQ ID NO: 324600 - DNA, 25 bp, Rattus norvegicus
gacggcgagctgatgatttcctaac

SEQ ID NO: 324601 - DNA, 25 bp, Rattus norvegicus
gacggcgagctgttgatttcctaac

SEQ ID NO: 324602 - DNA, 25 bp, Rattus norvegicus
gacggcgcatgcacgaagccctcgg

SEQ ID NO: 324603 - DNA, 25 bp, Rattus norvegicus
gacggcgcatgctcgaagccctcgg

SEQ ID NO: 324604 - DNA, 25 bp, Rattus norvegicus
gacggcgcattgctagtgcttcaac

SEQ ID NO: 324605 - DNA, 25 bp, Rattus norvegicus
gacggcgcattggtagtgcttcaac

SEQ ID NO: 324606 - DNA, 25 bp, Rattus norvegicus
gacggcgccagcaacctgggagggc

SEQ ID NO: 324607 - DNA, 25 bp, Rattus norvegicus
gacggcgccagctacctgggagggc

SEQ ID NO: 324608 - DNA, 25 bp, Rattus norvegicus
gacggcgcctgtaaactttttgtat

SEQ ID NO: 324609 - DNA, 25 bp, Rattus norvegicus
gacggcgcctgttaactttttgtat

SEQ ID NO: 324610 - DNA, 25 bp, Rattus norvegicus
gacggcggcggcaacgggtgcgcag

SEQ ID NO: 324611 - DNA, 25 bp, Rattus norvegicus
gacggcggcggctacgggtgcgcag

SEQ ID NO: 324612 - DNA, 25 bp, Rattus norvegicus
gacggcggttgcaaatattttaacg

SEQ ID NO: 324613 - DNA, 25 bp, Rattus norvegicus
gacggcggttgctaatattttaacg

SEQ ID NO: 324614 - DNA, 25 bp, Rattus norvegicus
gacggctccaagaaaatggcacaga

SEQ ID NO: 324615 - DNA, 25 bp, Rattus norvegicus
gacggctccaagtaaatggcacaga

SEQ ID NO: 324616 - DNA, 25 bp, Rattus norvegicus
gacggctcctggcaagatgctgctt

SEQ ID NO: 324617 - DNA, 25 bp, Rattus norvegicus
gacggctcctgggaagatgctgctt

SEQ ID NO: 324618 - DNA, 25 bp, Rattus norvegicus
gacggctctgtaaatgcctatgcca

SEQ ID NO: 324619 - DNA, 25 bp, Rattus norvegicus
gacggctctgtatatgcctatgcca

SEQ ID NO: 324620 - DNA, 25 bp, Rattus norvegicus
gacggctgattgctgagtgtcatct

SEQ ID NO: 324621 - DNA, 25 bp, Rattus norvegicus
gacggctgattggtgagtgtcatct

SEQ ID NO: 324622 - DNA, 25 bp, Rattus norvegicus
gacggctgcaaaatacatcctcaaa

SEQ ID NO: 324623 - DNA, 25 bp, Rattus norvegicus
gacggctgcaaattacatcctcaaa

SEQ ID NO: 324624 - DNA, 25 bp, Rattus norvegicus
gacggctgctttctgtctgtccagt

SEQ ID NO: 324625 - DNA, 25 bp, Rattus norvegicus
gacggctgctttgtgtctgtccagt

SEQ ID NO: 324626 - DNA, 25 bp, Rattus norvegicus
gacggctgtgtcatttacaatggcc

SEQ ID NO: 324627 - DNA, 25 bp, Rattus norvegicus
gacggctgtgtcttttacaatggcc

SEQ ID NO: 324628 - DNA, 25 bp, Rattus norvegicus
gacggctgtttgaggtttgtccaac

SEQ ID NO: 324629 - DNA, 25 bp, Rattus norvegicus
gacggctgtttgtggtttgtccaac

SEQ ID NO: 324630 - DNA, 25 bp, Rattus norvegicus
gacggcttaggcaaaaggtcctgga

SEQ ID NO: 324631 - DNA, 25 bp, Rattus norvegicus
gacggcttaggctaaaggtcctgga

SEQ ID NO: 324632 - DNA, 25 bp, Rattus norvegicus
gacggcttcagcaactcagagttgg

SEQ ID NO: 324633 - DNA, 25 bp, Rattus norvegicus
gacggcttcagctactcagagttgg

SEQ ID NO: 324634 - DNA, 25 bp, Rattus norvegicus
gacggcttcgaacacgaacagccaa

SEQ ID NO: 324635 - DNA, 25 bp, Rattus norvegicus
gacggcttcgaagacgaacagccaa

SEQ ID NO: 324636 - DNA, 25 bp, Rattus norvegicus
gacggctttacaagtaccacgtgcg

SEQ ID NO: 324637 - DNA, 25 bp, Rattus norvegicus
gacggctttacatgtaccacgtgcg

SEQ ID NO: 324638 - DNA, 25 bp, Rattus norvegicus
gacggctttaccatgtagggacaca

SEQ ID NO: 324639 - DNA, 25 bp, Rattus norvegicus
gacggctttaccttgtagggacaca

SEQ ID NO: 324640 - DNA, 25 bp, Rattus norvegicus
gacggctttcgtcaatgtacttgac

SEQ ID NO: 324641 - DNA, 25 bp, Rattus norvegicus
gacggctttcgtgaatgtacttgac

SEQ ID NO: 324642 - DNA, 25 bp, Rattus norvegicus
gacggcttttagcagtctgttctct

SEQ ID NO: 324643 - DNA, 25 bp, Rattus norvegicus
gacggcttttaggagtctgttctct

SEQ ID NO: 324644 - DNA, 25 bp, Rattus norvegicus
gacggcttttatacaaagtatctat

SEQ ID NO: 324645 - DNA, 25 bp, Rattus norvegicus
gacggcttttattcaaagtatctat

SEQ ID NO: 324646 - DNA, 25 bp, Rattus norvegicus
gacgggaaaagaaccgctcagtttg

SEQ ID NO: 324647 - DNA, 25 bp, Rattus norvegicus
gacgggaaaagatccgctcagtttg

SEQ ID NO: 324648 - DNA, 25 bp, Rattus norvegicus
gacgggaaaccccactgtactcttg

SEQ ID NO: 324649 - DNA, 25 bp, Rattus norvegicus
gacgggaaacccgactgtactcttg

SEQ ID NO: 324650 - DNA, 25 bp, Rattus norvegicus
gacgggaaggtgatcgtctcttctt

SEQ ID NO: 324651 - DNA, 25 bp, Rattus norvegicus
gacgggaaggtgttcgtctcttctt

SEQ ID NO: 324652 - DNA, 25 bp, Rattus norvegicus
gacgggaatcgtcagtgaactatta

SEQ ID NO: 324653 - DNA, 25 bp, Rattus norvegicus
gacgggaatcgtgagtgaactatta

SEQ ID NO: 324654 - DNA, 25 bp, Rattus norvegicus
gacgggaatggcaccattgacttcc

SEQ ID NO: 324655 - DNA, 25 bp, Rattus norvegicus
gacgggaatggctccattgacttcc

SEQ ID NO: 324656 - DNA, 25 bp, Rattus norvegicus
gacgggaattatcgctctcaccttg

SEQ ID NO: 324657 - DNA, 25 bp, Rattus norvegicus
gacgggaattatggctctcaccttg

SEQ ID NO: 324658 - DNA, 25 bp, Rattus norvegicus
gacgggaattccagaccagtgttat

SEQ ID NO: 324659 - DNA, 25 bp, Rattus norvegicus
gacgggaattcctgaccagtgttat

SEQ ID NO: 324660 - DNA, 25 bp, Rattus norvegicus
gacgggacactactgtatgccctag

SEQ ID NO: 324661 - DNA, 25 bp, Rattus norvegicus
gacgggacactagtgtatgccctag

SEQ ID NO: 324662 - DNA, 25 bp, Rattus norvegicus
gacgggaccacaacaaccccagagt

SEQ ID NO: 324663 - DNA, 25 bp, Rattus norvegicus
gacgggaccacatcaaccccagagt

SEQ ID NO: 324664 - DNA, 25 bp, Rattus norvegicus
gacgggaccggtactgagccttcgc

SEQ ID NO: 324665 - DNA, 25 bp, Rattus norvegicus
gacgggaccggttctgagccttcgc

SEQ ID NO: 324666 - DNA, 25 bp, Rattus norvegicus
gacgggacgttcaccagcgagctca

SEQ ID NO: 324667 - DNA, 25 bp, Rattus norvegicus
gacgggacgttctccagcgagctca

SEQ ID NO: 324668 - DNA, 25 bp, Rattus norvegicus
gacgggactcaacccacagacagac

SEQ ID NO: 324669 - DNA, 25 bp, Rattus norvegicus
gacgggactcaagccacagacagac

SEQ ID NO: 324670 - DNA, 25 bp, Rattus norvegicus
gacgggagaactcaccgaagcctat

SEQ ID NO: 324671 - DNA, 25 bp, Rattus norvegicus
gacgggagaactgaccgaagcctat

SEQ ID NO: 324672 - DNA, 25 bp, Rattus norvegicus
gacgggagacgcatcaagaaggaca

SEQ ID NO: 324673 - DNA, 25 bp, Rattus norvegicus
gacgggagacgcttcaagaaggaca

SEQ ID NO: 324674 - DNA, 25 bp, Rattus norvegicus
gacgggagactgctgagctctcata

SEQ ID NO: 324675 - DNA, 25 bp, Rattus norvegicus
gacgggagactggtgagctctcata

SEQ ID NO: 324676 - DNA, 25 bp, Rattus norvegicus
gacgggagcatacacctctgaggaa

SEQ ID NO: 324677 - DNA, 25 bp, Rattus norvegicus
gacgggagcatagacctctgaggaa

SEQ ID NO: 324678 - DNA, 25 bp, Rattus norvegicus
gacgggagctgaaccttgagcagta

SEQ ID NO: 324679 - DNA, 25 bp, Rattus norvegicus
gacgggagctgatccttgagcagta

SEQ ID NO: 324680 - DNA, 25 bp, Rattus norvegicus
gacgggatacatccgggtttgtttt

SEQ ID NO: 324681 - DNA, 25 bp, Rattus norvegicus
gacgggatacatgcgggtttgtttt

SEQ ID NO: 324682 - DNA, 25 bp, Rattus norvegicus
gacgggatgcatcgtctgctgatca

SEQ ID NO: 324683 - DNA, 25 bp, Rattus norvegicus
gacgggatgcatggtctgctgatca

SEQ ID NO: 324684 - DNA, 25 bp, Rattus norvegicus
gacgggatggatcttgtacaacttc

SEQ ID NO: 324685 - DNA, 25 bp, Rattus norvegicus
gacgggatggatgttgtacaacttc

SEQ ID NO: 324686 - DNA, 25 bp, Rattus norvegicus
gacgggattgatcgaacctgccttc

SEQ ID NO: 324687 - DNA, 25 bp, Rattus norvegicus
gacgggattgatggaacctgccttc

SEQ ID NO: 324688 - DNA, 25 bp, Rattus norvegicus
gacgggcactttctttcttcttggg

SEQ ID NO: 324689 - DNA, 25 bp, Rattus norvegicus
gacgggcactttgtttcttcttggg

SEQ ID NO: 324690 - DNA, 25 bp, Rattus norvegicus
gacgggcagcaccaatttaatcaca

SEQ ID NO: 324691 - DNA, 25 bp, Rattus norvegicus
gacgggcagcacgaatttaatcaca

SEQ ID NO: 324692 - DNA, 25 bp, Rattus norvegicus
gacgggcaggaaactgactcccaag

SEQ ID NO: 324693 - DNA, 25 bp, Rattus norvegicus
gacgggcaggaatctgactcccaag

SEQ ID NO: 324694 - DNA, 25 bp, Rattus norvegicus
gacgggcctctcagtactaccagga

SEQ ID NO: 324695 - DNA, 25 bp, Rattus norvegicus
gacgggcctctctgtactaccagga

SEQ ID NO: 324696 - DNA, 25 bp, Rattus norvegicus
gacgggctatttatgccgtaaatat

SEQ ID NO: 324697 - DNA, 25 bp, Rattus norvegicus
gacgggctatttttgccgtaaatat

SEQ ID NO: 324698 - DNA, 25 bp, Rattus norvegicus
gacgggcttcccaggagtgtagtta

SEQ ID NO: 324699 - DNA, 25 bp, Rattus norvegicus
gacgggcttccctggagtgtagtta

SEQ ID NO: 324700 - DNA, 25 bp, Rattus norvegicus
gacgggcttggcatcggtgacaaca

SEQ ID NO: 324701 - DNA, 25 bp, Rattus norvegicus
gacgggcttggcttcggtgacaaca

SEQ ID NO: 324702 - DNA, 25 bp, Rattus norvegicus
gacgggctttgaatttctggacaac

SEQ ID NO: 324703 - DNA, 25 bp, Rattus norvegicus
gacgggctttgattttctggacaac

SEQ ID NO: 324704 - DNA, 25 bp, Rattus norvegicus
gacgggctttggaggaatcctgtac

SEQ ID NO: 324705 - DNA, 25 bp, Rattus norvegicus
gacgggctttggtggaatcctgtac

SEQ ID NO: 324706 - DNA, 25 bp, Rattus norvegicus
gacgggctttgtacattcagggact

SEQ ID NO: 324707 - DNA, 25 bp, Rattus norvegicus
gacgggctttgttcattcagggact

SEQ ID NO: 324708 - DNA, 25 bp, Rattus norvegicus
gacgggtcatacctgtcagaagatc

SEQ ID NO: 324709 - DNA, 25 bp, Rattus norvegicus
gacgggtcatacgtgtcagaagatc

SEQ ID NO: 324710 - DNA, 25 bp, Rattus norvegicus
gacgggtctggacatgtcacagctc

SEQ ID NO: 324711 - DNA, 25 bp, Rattus norvegicus
gacgggtctggagatgtcacagctc

SEQ ID NO: 324712 - DNA, 25 bp, Rattus norvegicus
gacgggtggtctatagtagctaagc

SEQ ID NO: 324713 - DNA, 25 bp, Rattus norvegicus
gacgggtggtctttagtagctaagc

SEQ ID NO: 324714 - DNA, 25 bp, Rattus norvegicus
gacgggtgtgacacccaattgtact

SEQ ID NO: 324715 - DNA, 25 bp, Rattus norvegicus
gacgggtgtgactcccaattgtact

SEQ ID NO: 324716 - DNA, 25 bp, Rattus norvegicus
gacgggttatccagcaccactacat

SEQ ID NO: 324717 - DNA, 25 bp, Rattus norvegicus
gacgggttatcctgcaccactacat

SEQ ID NO: 324718 - DNA, 25 bp, Rattus norvegicus
gacgggtttcctaatgcttcccttg

SEQ ID NO: 324719 - DNA, 25 bp, Rattus norvegicus
gacgggtttccttatgcttcccttg

SEQ ID NO: 324720 - DNA, 25 bp, Rattus norvegicus
gacggtaagccactcagcctgagct

SEQ ID NO: 324721 - DNA, 25 bp, Rattus norvegicus
gacggtaagccagtcagcctgagct

SEQ ID NO: 324722 - DNA, 25 bp, Rattus norvegicus
gacggtaagggcagtctcccagaga

SEQ ID NO: 324723 - DNA, 25 bp, Rattus norvegicus
gacggtaagggctgtctcccagaga

SEQ ID NO: 324724 - DNA, 25 bp, Rattus norvegicus
gacggtagaatcatgtgcctgtctg

SEQ ID NO: 324725 - DNA, 25 bp, Rattus norvegicus
gacggtagaatcttgtgcctgtctg

SEQ ID NO: 324726 - DNA, 25 bp, Rattus norvegicus
gacggtagagaccactacgacttat

SEQ ID NO: 324727 - DNA, 25 bp, Rattus norvegicus
gacggtagagacgactacgacttat

SEQ ID NO: 324728 - DNA, 25 bp, Rattus norvegicus
gacggtagccacagcaaacagcgaa

SEQ ID NO: 324729 - DNA, 25 bp, Rattus norvegicus
gacggtagccactgcaaacagcgaa

SEQ ID NO: 324730 - DNA, 25 bp, Rattus norvegicus
gacggtatcatcaccattgaaggct

SEQ ID NO: 324731 - DNA, 25 bp, Rattus norvegicus
gacggtatcatctccattgaaggct

SEQ ID NO: 324732 - DNA, 25 bp, Rattus norvegicus
gacggtatgattcctcagagatcct

SEQ ID NO: 324733 - DNA, 25 bp, Rattus norvegicus
gacggtatgattgctcagagatcct

SEQ ID NO: 324734 - DNA, 25 bp, Rattus norvegicus
gacggtattatcattacgtgctaga

SEQ ID NO: 324735 - DNA, 25 bp, Rattus norvegicus
gacggtattatctttacgtgctaga

SEQ ID NO: 324736 - DNA, 25 bp, Rattus norvegicus
gacggtatttgcctgtagttcttgt

SEQ ID NO: 324737 - DNA, 25 bp, Rattus norvegicus
gacggtatttgcgtgtagttcttgt

SEQ ID NO: 324738 - DNA, 25 bp, Rattus norvegicus
gacggtcaccgtcaaagtgccacag

SEQ ID NO: 324739 - DNA, 25 bp, Rattus norvegicus
gacggtcaccgtgaaagtgccacag

SEQ ID NO: 324740 - DNA, 25 bp, Rattus norvegicus
gacggtcactgtaagtcatcacaaa

SEQ ID NO: 324741 - DNA, 25 bp, Rattus norvegicus
gacggtcactgttagtcatcacaaa

SEQ ID NO: 324742 - DNA, 25 bp, Rattus norvegicus
gacggtcaggtcactaagcaaccca

SEQ ID NO: 324743 - DNA, 25 bp, Rattus norvegicus
gacggtcaggtctctaagcaaccca

SEQ ID NO: 324744 - DNA, 25 bp, Rattus norvegicus
gacggtcctgtccttgtttgaaaat

SEQ ID NO: 324745 - DNA, 25 bp, Rattus norvegicus
gacggtcctgtcgttgtttgaaaat

SEQ ID NO: 324746 - DNA, 25 bp, Rattus norvegicus
gacggtctaagaaggctctggaatt

SEQ ID NO: 324747 - DNA, 25 bp, Rattus norvegicus
gacggtctaagatggctctggaatt

SEQ ID NO: 324748 - DNA, 25 bp, Rattus norvegicus
gacggtctcatgaagtctaggctgg

SEQ ID NO: 324749 - DNA, 25 bp, Rattus norvegicus
gacggtctcatgtagtctaggctgg

SEQ ID NO: 324750 - DNA, 25 bp, Rattus norvegicus
gacggtctcttcagcattgtaatga

SEQ ID NO: 324751 - DNA, 25 bp, Rattus norvegicus
gacggtctcttctgcattgtaatga

SEQ ID NO: 324752 - DNA, 25 bp, Rattus norvegicus
gacggtcttcacagtgtgttttaaa

SEQ ID NO: 324753 - DNA, 25 bp, Rattus norvegicus
gacggtcttcactgtgtgttttaaa

SEQ ID NO: 324754 - DNA, 25 bp, Rattus norvegicus
gacggtgaagacactgggcatcatc

SEQ ID NO: 324755 - DNA, 25 bp, Rattus norvegicus
gacggtgaagactctgggcatcatc

SEQ ID NO: 324756 - DNA, 25 bp, Rattus norvegicus
gacggtgacgctacagaacattttc

SEQ ID NO: 324757 - DNA, 25 bp, Rattus norvegicus
gacggtgacgcttcagaacattttc

SEQ ID NO: 324758 - DNA, 25 bp, Rattus norvegicus
gacggtgactggcatggtcccaatt

SEQ ID NO: 324759 - DNA, 25 bp, Rattus norvegicus
gacggtgactgggatggtcccaatt

SEQ ID NO: 324760 - DNA, 25 bp, Rattus norvegicus
gacggtgattcacgctctctttgaa

SEQ ID NO: 324761 - DNA, 25 bp, Rattus norvegicus
gacggtgattcaggctctctttgaa

SEQ ID NO: 324762 - DNA, 25 bp, Rattus norvegicus
gacggtgcaaacacaagccttggtt

SEQ ID NO: 324763 - DNA, 25 bp, Rattus norvegicus
gacggtgcaaactcaagccttggtt

SEQ ID NO: 324764 - DNA, 25 bp, Rattus norvegicus
gacggtgcgcagcactcctgatgac

SEQ ID NO: 324765 - DNA, 25 bp, Rattus norvegicus
gacggtgcgcaggactcctgatgac

SEQ ID NO: 324766 - DNA, 25 bp, Rattus norvegicus
gacggtgctacgaatctgggactgt

SEQ ID NO: 324767 - DNA, 25 bp, Rattus norvegicus
gacggtgctacgtatctgggactgt

SEQ ID NO: 324768 - DNA, 25 bp, Rattus norvegicus
gacggtgctgaacgatctgcctcta

SEQ ID NO: 324769 - DNA, 25 bp, Rattus norvegicus
gacggtgctgaaggatctgcctcta

SEQ ID NO: 324770 - DNA, 25 bp, Rattus norvegicus
gacggtgctggaaccatggtgtcca

SEQ ID NO: 324771 - DNA, 25 bp, Rattus norvegicus
gacggtgctggatccatggtgtcca

SEQ ID NO: 324772 - DNA, 25 bp, Rattus norvegicus
gacggtgtataacgtggctcgcccc

SEQ ID NO: 324773 - DNA, 25 bp, Rattus norvegicus
gacggtgtataaggtggctcgcccc

SEQ ID NO: 324774 - DNA, 25 bp, Rattus norvegicus
gacggtgtcactcatgactatgcat

SEQ ID NO: 324775 - DNA, 25 bp, Rattus norvegicus
gacggtgtcactgatgactatgcat

SEQ ID NO: 324776 - DNA, 25 bp, Rattus norvegicus
gacggtgtccttcacagtctgagta

SEQ ID NO: 324777 - DNA, 25 bp, Rattus norvegicus
gacggtgtccttgacagtctgagta

SEQ ID NO: 324778 - DNA, 25 bp, Rattus norvegicus
gacggtgtctgcaataccagagttt

SEQ ID NO: 324779 - DNA, 25 bp, Rattus norvegicus
gacggtgtctgctataccagagttt

SEQ ID NO: 324780 - DNA, 25 bp, Rattus norvegicus
gacggtgtctgtcagtatgttttgc

SEQ ID NO: 324781 - DNA, 25 bp, Rattus norvegicus
gacggtgtctgtgagtatgttttgc

SEQ ID NO: 324782 - DNA, 25 bp, Rattus norvegicus
gacggtgtgaacatcactgccacaa

SEQ ID NO: 324783 - DNA, 25 bp, Rattus norvegicus
gacggtgtgaacttcactgccacaa

SEQ ID NO: 324784 - DNA, 25 bp, Rattus norvegicus
gacggtgtgaccaccagctgcaatg

SEQ ID NO: 324785 - DNA, 25 bp, Rattus norvegicus
gacggtgtgacctccagctgcaatg

SEQ ID NO: 324786 - DNA, 25 bp, Rattus norvegicus
gacggtgtggccaatgtgtccattg

SEQ ID NO: 324787 - DNA, 25 bp, Rattus norvegicus
gacggtgtggcctatgtgtccattg

SEQ ID NO: 324788 - DNA, 25 bp, Rattus norvegicus
gacggtgttactcgaaacattttga

SEQ ID NO: 324789 - DNA, 25 bp, Rattus norvegicus
gacggtgttactggaaacattttga

SEQ ID NO: 324790 - DNA, 25 bp, Rattus norvegicus
gacggtgttcagagccgaagccgat

SEQ ID NO: 324791 - DNA, 25 bp, Rattus norvegicus
gacggtgttcagtgccgaagccgat

SEQ ID NO: 324792 - DNA, 25 bp, Rattus norvegicus
gacggtgttcataatggctctagtg

SEQ ID NO: 324793 - DNA, 25 bp, Rattus norvegicus
gacggtgttcattatggctctagtg

SEQ ID NO: 324794 - DNA, 25 bp, Rattus norvegicus
gacggtgttgccattttaagctagt

SEQ ID NO: 324795 - DNA, 25 bp, Rattus norvegicus
gacggtgttgcctttttaagctagt

SEQ ID NO: 324796 - DNA, 25 bp, Rattus norvegicus
gacggttccattatagtttgctact

SEQ ID NO: 324797 - DNA, 25 bp, Rattus norvegicus
gacggttccattttagtttgctact

SEQ ID NO: 324798 - DNA, 25 bp, Rattus norvegicus
gacggttcctgcaagtgtggagaaa

SEQ ID NO: 324799 - DNA, 25 bp, Rattus norvegicus
gacggttcctgctagtgtggagaaa

SEQ ID NO: 324800 - DNA, 25 bp, Rattus norvegicus
gacggttctgtcatgtgtcaattag

SEQ ID NO: 324801 - DNA, 25 bp, Rattus norvegicus
gacggttctgtcttgtgtcaattag

SEQ ID NO: 324802 - DNA, 25 bp, Rattus norvegicus
gacggttctttcatcatgtacagca

SEQ ID NO: 324803 - DNA, 25 bp, Rattus norvegicus
gacggttctttcttcatgtacagca

SEQ ID NO: 324804 - DNA, 25 bp, Rattus norvegicus
gacggttgggatcttgccagataac

SEQ ID NO: 324805 - DNA, 25 bp, Rattus norvegicus
gacggttgggatgttgccagataac

SEQ ID NO: 324806 - DNA, 25 bp, Rattus norvegicus
gacggttgtctgaactactcagctg

SEQ ID NO: 324807 - DNA, 25 bp, Rattus norvegicus
gacggttgtctgtactactcagctg

SEQ ID NO: 324808 - DNA, 25 bp, Rattus norvegicus
gacggttgtttcaacacaatacact

SEQ ID NO: 324809 - DNA, 25 bp, Rattus norvegicus
gacggttgtttctacacaatacact

SEQ ID NO: 324810 - DNA, 25 bp, Rattus norvegicus
gacggtttcactctgtaactctctc

SEQ ID NO: 324811 - DNA, 25 bp, Rattus norvegicus
gacggtttcactgtgtaactctctc

SEQ ID NO: 324812 - DNA, 25 bp, Rattus norvegicus
gacggtttcaggatcacaacagcaa

SEQ ID NO: 324813 - DNA, 25 bp, Rattus norvegicus
gacggtttcaggttcacaacagcaa

SEQ ID NO: 324814 - DNA, 25 bp, Rattus norvegicus
gacggtttctgtctagtgtacaact

SEQ ID NO: 324815 - DNA, 25 bp, Rattus norvegicus
gacggtttctgtgtagtgtacaact

SEQ ID NO: 324816 - DNA, 25 bp, Rattus norvegicus
gacggttttataccctgcccgccaa

SEQ ID NO: 324817 - DNA, 25 bp, Rattus norvegicus
gacggttttatagcctgcccgccaa

SEQ ID NO: 324818 - DNA, 25 bp, Rattus norvegicus
gacggtttttagctatttgaatagg

SEQ ID NO: 324819 - DNA, 25 bp, Rattus norvegicus
gacggtttttaggtatttgaatagg

SEQ ID NO: 324820 - DNA, 25 bp, Rattus norvegicus
gacgtaaacccactgtgacagtgca

SEQ ID NO: 324821 - DNA, 25 bp, Rattus norvegicus
gacgtaaacccagtgtgacagtgca

SEQ ID NO: 324822 - DNA, 25 bp, Rattus norvegicus
gacgtaaatgtccaacctgggcctc

SEQ ID NO: 324823 - DNA, 25 bp, Rattus norvegicus
gacgtaaatgtcgaacctgggcctc

SEQ ID NO: 324824 - DNA, 25 bp, Rattus norvegicus
gacgtaatccttaatgacatcccat

SEQ ID NO: 324825 - DNA, 25 bp, Rattus norvegicus
gacgtaatcctttatgacatcccat

SEQ ID NO: 324826 - DNA, 25 bp, Rattus norvegicus
gacgtacactgtatctatcaaatca

SEQ ID NO: 324827 - DNA, 25 bp, Rattus norvegicus
gacgtacactgtttctatcaaatca

SEQ ID NO: 324828 - DNA, 25 bp, Rattus norvegicus
gacgtacagcgtagagttccttccg

SEQ ID NO: 324829 - DNA, 25 bp, Rattus norvegicus
gacgtacagcgttgagttccttccg

SEQ ID NO: 324830 - DNA, 25 bp, Rattus norvegicus
gacgtacatcttagtacttcttccc

SEQ ID NO: 324831 - DNA, 25 bp, Rattus norvegicus
gacgtacatctttgtacttcttccc

SEQ ID NO: 324832 - DNA, 25 bp, Rattus norvegicus
gacgtactaacaccctgtcttagaa

SEQ ID NO: 324833 - DNA, 25 bp, Rattus norvegicus
gacgtactaacagcctgtcttagaa

SEQ ID NO: 324834 - DNA, 25 bp, Rattus norvegicus
gacgtactgcgtaaggtgtgttttt

SEQ ID NO: 324835 - DNA, 25 bp, Rattus norvegicus
gacgtactgcgttaggtgtgttttt

SEQ ID NO: 324836 - DNA, 25 bp, Rattus norvegicus
gacgtagacggcaatgggaccatca

SEQ ID NO: 324837 - DNA, 25 bp, Rattus norvegicus
gacgtagacggctatgggaccatca

SEQ ID NO: 324838 - DNA, 25 bp, Rattus norvegicus
gacgtagattcccaagtcactgctg

SEQ ID NO: 324839 - DNA, 25 bp, Rattus norvegicus
gacgtagattccgaagtcactgctg

SEQ ID NO: 324840 - DNA, 25 bp, Rattus norvegicus
gacgtagccaatctaagaccttctg

SEQ ID NO: 324841 - DNA, 25 bp, Rattus norvegicus
gacgtagccaatgtaagaccttctg

SEQ ID NO: 324842 - DNA, 25 bp, Rattus norvegicus
gacgtagcctctcgattttgatgga

SEQ ID NO: 324843 - DNA, 25 bp, Rattus norvegicus
gacgtagcctctggattttgatgga

SEQ ID NO: 324844 - DNA, 25 bp, Rattus norvegicus
gacgtagcctttctactgagacaaa

SEQ ID NO: 324845 - DNA, 25 bp, Rattus norvegicus
gacgtagcctttgtactgagacaaa

SEQ ID NO: 324846 - DNA, 25 bp, Rattus norvegicus
gacgtagctgagaacttcacttgac

SEQ ID NO: 324847 - DNA, 25 bp, Rattus norvegicus
gacgtagctgagtacttcacttgac

SEQ ID NO: 324848 - DNA, 25 bp, Rattus norvegicus
gacgtagcttgtcctcggtgtctct

SEQ ID NO: 324849 - DNA, 25 bp, Rattus norvegicus
gacgtagcttgtgctcggtgtctct

SEQ ID NO: 324850 - DNA, 25 bp, Rattus norvegicus
gacgtagggcttaagtttcccatat

SEQ ID NO: 324851 - DNA, 25 bp, Rattus norvegicus
gacgtagggctttagtttcccatat

SEQ ID NO: 324852 - DNA, 25 bp, Rattus norvegicus
gacgtagtcaccacagattcaggga

SEQ ID NO: 324853 - DNA, 25 bp, Rattus norvegicus
gacgtagtcacctcagattcaggga

SEQ ID NO: 324854 - DNA, 25 bp, Rattus norvegicus
gacgtagtcgttctcattccttttt

SEQ ID NO: 324855 - DNA, 25 bp, Rattus norvegicus
gacgtagtcgttgtcattccttttt

SEQ ID NO: 324856 - DNA, 25 bp, Rattus norvegicus
gacgtagtgattaggtgtgctcttc

SEQ ID NO: 324857 - DNA, 25 bp, Rattus norvegicus
gacgtagtgatttggtgtgctcttc

SEQ ID NO: 324858 - DNA, 25 bp, Rattus norvegicus
gacgtagttcacaatgaggacatcc

SEQ ID NO: 324859 - DNA, 25 bp, Rattus norvegicus
gacgtagttcactatgaggacatcc

SEQ ID NO: 324860 - DNA, 25 bp, Rattus norvegicus
gacgtatatttcattgagctaccgc

SEQ ID NO: 324861 - DNA, 25 bp, Rattus norvegicus
gacgtatatttctttgagctaccgc

SEQ ID NO: 324862 - DNA, 25 bp, Rattus norvegicus
gacgtatcacgtaggttccgttgtc

SEQ ID NO: 324863 - DNA, 25 bp, Rattus norvegicus
gacgtatcacgttggttccgttgtc

SEQ ID NO: 324864 - DNA, 25 bp, Rattus norvegicus
gacgtattacctcatggatccaagc

SEQ ID NO: 324865 - DNA, 25 bp, Rattus norvegicus
gacgtattacctgatggatccaagc

SEQ ID NO: 324866 - DNA, 25 bp, Rattus norvegicus
gacgtattcactctcctctgaaaga

SEQ ID NO: 324867 - DNA, 25 bp, Rattus norvegicus
gacgtattcactgtcctctgaaaga

SEQ ID NO: 324868 - DNA, 25 bp, Rattus norvegicus
gacgtattcattatctcacttttct

SEQ ID NO: 324869 - DNA, 25 bp, Rattus norvegicus
gacgtattcattttctcacttttct

SEQ ID NO: 324870 - DNA, 25 bp, Rattus norvegicus
gacgtattctacatggttaccctgc

SEQ ID NO: 324871 - DNA, 25 bp, Rattus norvegicus
gacgtattctacttggttaccctgc

SEQ ID NO: 324872 - DNA, 25 bp, Rattus norvegicus
gacgtcaacaagaaccacttcctag

SEQ ID NO: 324873 - DNA, 25 bp, Rattus norvegicus
gacgtcaacaagtaccacttcctag

SEQ ID NO: 324874 - DNA, 25 bp, Rattus norvegicus
gacgtcaagtccaaactgagcagca

SEQ ID NO: 324875 - DNA, 25 bp, Rattus norvegicus
gacgtcaagtcctaactgagcagca

SEQ ID NO: 324876 - DNA, 25 bp, Rattus norvegicus
gacgtcaagtggctttgtcaagacc

SEQ ID NO: 324877 - DNA, 25 bp, Rattus norvegicus
gacgtcaagtgggtttgtcaagacc

SEQ ID NO: 324878 - DNA, 25 bp, Rattus norvegicus
gacgtcacccatctgttttggaaca

SEQ ID NO: 324879 - DNA, 25 bp, Rattus norvegicus
gacgtcacccatgtgttttggaaca

SEQ ID NO: 324880 - DNA, 25 bp, Rattus norvegicus
gacgtcacctttctctgaatctaag

SEQ ID NO: 324881 - DNA, 25 bp, Rattus norvegicus
gacgtcacctttgtctgaatctaag

SEQ ID NO: 324882 - DNA, 25 bp, Rattus norvegicus
gacgtcacggaaatcagttgaggac

SEQ ID NO: 324883 - DNA, 25 bp, Rattus norvegicus
gacgtcacggaattcagttgaggac

SEQ ID NO: 324884 - DNA, 25 bp, Rattus norvegicus
gacgtcacgggcaccatgtcaaagt

SEQ ID NO: 324885 - DNA, 25 bp, Rattus norvegicus
gacgtcacgggctccatgtcaaagt

SEQ ID NO: 324886 - DNA, 25 bp, Rattus norvegicus
gacgtcactaggcaaggactggcat

SEQ ID NO: 324887 - DNA, 25 bp, Rattus norvegicus
gacgtcactagggaaggactggcat

SEQ ID NO: 324888 - DNA, 25 bp, Rattus norvegicus
gacgtcactgaccagattcaggaag

SEQ ID NO: 324889 - DNA, 25 bp, Rattus norvegicus
gacgtcactgaccaggaatcctacg

SEQ ID NO: 324890 - DNA, 25 bp, Rattus norvegicus
gacgtcactgacgagattcaggaag

SEQ ID NO: 324891 - DNA, 25 bp, Rattus norvegicus
gacgtcactgacgaggaatcctacg

SEQ ID NO: 324892 - DNA, 25 bp, Rattus norvegicus
gacgtcagccttccctgaggctgct

SEQ ID NO: 324893 - DNA, 25 bp, Rattus norvegicus
gacgtcagccttgcctgaggctgct

SEQ ID NO: 324894 - DNA, 25 bp, Rattus norvegicus
gacgtcagggtgagtgggtgcccaa

SEQ ID NO: 324895 - DNA, 25 bp, Rattus norvegicus
gacgtcagggtgtgtgggtgcccaa

SEQ ID NO: 324896 - DNA, 25 bp, Rattus norvegicus
gacgtcatccaaacagtgggctcat

SEQ ID NO: 324897 - DNA, 25 bp, Rattus norvegicus
gacgtcatccaatcagtgggctcat

SEQ ID NO: 324898 - DNA, 25 bp, Rattus norvegicus
gacgtcatcgtgagttgtagccagg

SEQ ID NO: 324899 - DNA, 25 bp, Rattus norvegicus
gacgtcatcgtgtgttgtagccagg

SEQ ID NO: 324900 - DNA, 25 bp, Rattus norvegicus
gacgtcatttcactcgccaaagata

SEQ ID NO: 324901 - DNA, 25 bp, Rattus norvegicus
gacgtcatttcagtcgccaaagata

SEQ ID NO: 324902 - DNA, 25 bp, Rattus norvegicus
gacgtccaagggagcatttcccaag

SEQ ID NO: 324903 - DNA, 25 bp, Rattus norvegicus
gacgtccaagggtgcatttcccaag

SEQ ID NO: 324904 - DNA, 25 bp, Rattus norvegicus
gacgtccaattgatagttttctttc

SEQ ID NO: 324905 - DNA, 25 bp, Rattus norvegicus
gacgtccaattgttagttttctttc

SEQ ID NO: 324906 - DNA, 25 bp, Rattus norvegicus
gacgtccacctcagatactttgtaa

SEQ ID NO: 324907 - DNA, 25 bp, Rattus norvegicus
gacgtccacctctgatactttgtaa

SEQ ID NO: 324908 - DNA, 25 bp, Rattus norvegicus
gacgtccaggtaccgcagttcccga

SEQ ID NO: 324909 - DNA, 25 bp, Rattus norvegicus
gacgtccaggtagcgcagttcccga

SEQ ID NO: 324910 - DNA, 25 bp, Rattus norvegicus
gacgtccctggtcgaacaggtgctt

SEQ ID NO: 324911 - DNA, 25 bp, Rattus norvegicus
gacgtccctggtggaacaggtgctt

SEQ ID NO: 324912 - DNA, 25 bp, Rattus norvegicus
gacgtccgggccaacaaacgtgaat

SEQ ID NO: 324913 - DNA, 25 bp, Rattus norvegicus
gacgtccgggcctacaaacgtgaat

SEQ ID NO: 324914 - DNA, 25 bp, Rattus norvegicus
gacgtcctctgtctggagaaatcaa

SEQ ID NO: 324915 - DNA, 25 bp, Rattus norvegicus
gacgtcctctgtgtggagaaatcaa

SEQ ID NO: 324916 - DNA, 25 bp, Rattus norvegicus
gacgtcctttcgatggttttgcagc

SEQ ID NO: 324917 - DNA, 25 bp, Rattus norvegicus
gacgtcctttcgttggttttgcagc

SEQ ID NO: 324918 - DNA, 25 bp, Rattus norvegicus
gacgtcctttctaacatgtttgcat

SEQ ID NO: 324919 - DNA, 25 bp, Rattus norvegicus
gacgtcctttcttacatgtttgcat

SEQ ID NO: 324920 - DNA, 25 bp, Rattus norvegicus
gacgtctaacttattgaggtacctg

SEQ ID NO: 324921 - DNA, 25 bp, Rattus norvegicus
gacgtctaactttttgaggtacctg

SEQ ID NO: 324922 - DNA, 25 bp, Rattus norvegicus
gacgtctaccagcaaggtccaatgt

SEQ ID NO: 324923 - DNA, 25 bp, Rattus norvegicus
gacgtctaccaggaaggtccaatgt

SEQ ID NO: 324924 - DNA, 25 bp, Rattus norvegicus
gacgtctacgatctatacatcaagt

SEQ ID NO: 324925 - DNA, 25 bp, Rattus norvegicus
gacgtctacgatgtatacatcaagt

SEQ ID NO: 324926 - DNA, 25 bp, Rattus norvegicus
gacgtctatgagctacatcctgcag

SEQ ID NO: 324927 - DNA, 25 bp, Rattus norvegicus
gacgtctatgaggtacatcctgcag

SEQ ID NO: 324928 - DNA, 25 bp, Rattus norvegicus
gacgtctcagtcaaaacccactaaa

SEQ ID NO: 324929 - DNA, 25 bp, Rattus norvegicus
gacgtctcagtctaaacccactaaa

SEQ ID NO: 324930 - DNA, 25 bp, Rattus norvegicus
gacgtctgagagcagccggccatca

SEQ ID NO: 324931 - DNA, 25 bp, Rattus norvegicus
gacgtctgagaggagccggccatca

SEQ ID NO: 324932 - DNA, 25 bp, Rattus norvegicus
gacgtcttaggacaacagcggccat

SEQ ID NO: 324933 - DNA, 25 bp, Rattus norvegicus
gacgtcttaggagaacagcggccat

SEQ ID NO: 324934 - DNA, 25 bp, Rattus norvegicus
gacgtcttcactccaaatcatgtgc

SEQ ID NO: 324935 - DNA, 25 bp, Rattus norvegicus
gacgtcttcactgcaaatcatgtgc

SEQ ID NO: 324936 - DNA, 25 bp, Rattus norvegicus
gacgtcttcgaaaagacctgcaagg

SEQ ID NO: 324937 - DNA, 25 bp, Rattus norvegicus
gacgtcttcgaatagacctgcaagg

SEQ ID NO: 324938 - DNA, 25 bp, Rattus norvegicus
gacgtgaaaactagtgtggtaggaa

SEQ ID NO: 324939 - DNA, 25 bp, Rattus norvegicus
gacgtgaaaacttgtgtggtaggaa

SEQ ID NO: 324940 - DNA, 25 bp, Rattus norvegicus
gacgtgaacagcacttgctctgaca

SEQ ID NO: 324941 - DNA, 25 bp, Rattus norvegicus
gacgtgaacagctcttgctctgaca

SEQ ID NO: 324942 - DNA, 25 bp, Rattus norvegicus
gacgtgaacgtgaagagcatctcaa

SEQ ID NO: 324943 - DNA, 25 bp, Rattus norvegicus
gacgtgaacgtgtagagcatctcaa

SEQ ID NO: 324944 - DNA, 25 bp, Rattus norvegicus
gacgtgaactgcactgacagcgctg

SEQ ID NO: 324945 - DNA, 25 bp, Rattus norvegicus
gacgtgaactgctctgacagcgctg

SEQ ID NO: 324946 - DNA, 25 bp, Rattus norvegicus
gacgtgacaagcagggtccgctaca

SEQ ID NO: 324947 - DNA, 25 bp, Rattus norvegicus
gacgtgacaagctgggtccgctaca

SEQ ID NO: 324948 - DNA, 25 bp, Rattus norvegicus
gacgtgactctgcttacctctagaa

SEQ ID NO: 324949 - DNA, 25 bp, Rattus norvegicus
gacgtgactctggttacctctagaa

SEQ ID NO: 324950 - DNA, 25 bp, Rattus norvegicus
gacgtgactgttatcctgacattgt

SEQ ID NO: 324951 - DNA, 25 bp, Rattus norvegicus
gacgtgactgttttcctgacattgt

SEQ ID NO: 324952 - DNA, 25 bp, Rattus norvegicus
gacgtgacttatattatgtagcatg

SEQ ID NO: 324953 - DNA, 25 bp, Rattus norvegicus
gacgtgacttattttatgtagcatg

SEQ ID NO: 324954 - DNA, 25 bp, Rattus norvegicus
gacgtgacttggagcacaactgaca

SEQ ID NO: 324955 - DNA, 25 bp, Rattus norvegicus
gacgtgacttggtgcacaactgaca

SEQ ID NO: 324956 - DNA, 25 bp, Rattus norvegicus
gacgtgacttttcatggctcctgct

SEQ ID NO: 324957 - DNA, 25 bp, Rattus norvegicus
gacgtgacttttgatggctcctgct

SEQ ID NO: 324958 - DNA, 25 bp, Rattus norvegicus
gacgtgagtgcacgctcatctcaga

SEQ ID NO: 324959 - DNA, 25 bp, Rattus norvegicus
gacgtgagtgcaggctcatctcaga

SEQ ID NO: 324960 - DNA, 25 bp, Rattus norvegicus
gacgtgagttctattccaggttcaa

SEQ ID NO: 324961 - DNA, 25 bp, Rattus norvegicus
gacgtgagttcttttccaggttcaa

SEQ ID NO: 324962 - DNA, 25 bp, Rattus norvegicus
gacgtgatccaaatctgtggccatg

SEQ ID NO: 324963 - DNA, 25 bp, Rattus norvegicus
gacgtgatccaattctgtggccatg

SEQ ID NO: 324964 - DNA, 25 bp, Rattus norvegicus
gacgtgatgccgaaggccacagctg

SEQ ID NO: 324965 - DNA, 25 bp, Rattus norvegicus
gacgtgatgccgtaggccacagctg

SEQ ID NO: 324966 - DNA, 25 bp, Rattus norvegicus
gacgtgattcaacttcaatatctag

SEQ ID NO: 324967 - DNA, 25 bp, Rattus norvegicus
gacgtgattcaagttcaatatctag

SEQ ID NO: 324968 - DNA, 25 bp, Rattus norvegicus
gacgtgcacctgaatgctttctatc

SEQ ID NO: 324969 - DNA, 25 bp, Rattus norvegicus
gacgtgcacctgtatgctttctatc

SEQ ID NO: 324970 - DNA, 25 bp, Rattus norvegicus
gacgtgcagaatccggccagaacat

SEQ ID NO: 324971 - DNA, 25 bp, Rattus norvegicus
gacgtgcagaatgcggccagaacat

SEQ ID NO: 324972 - DNA, 25 bp, Rattus norvegicus
gacgtgcagataaggcagccttcaa

SEQ ID NO: 324973 - DNA, 25 bp, Rattus norvegicus
gacgtgcagatatggcagccttcaa

SEQ ID NO: 324974 - DNA, 25 bp, Rattus norvegicus
gacgtgcagtcacttgacccatagt

SEQ ID NO: 324975 - DNA, 25 bp, Rattus norvegicus
gacgtgcagtcagttgacccatagt

SEQ ID NO: 324976 - DNA, 25 bp, Rattus norvegicus
gacgtgcatgcgcacaacatcagag

SEQ ID NO: 324977 - DNA, 25 bp, Rattus norvegicus
gacgtgcatgcggacaacatcagag

SEQ ID NO: 324978 - DNA, 25 bp, Rattus norvegicus
gacgtgccagccacaggactgcaaa

SEQ ID NO: 324979 - DNA, 25 bp, Rattus norvegicus
gacgtgccagcctcaggactgcaaa

SEQ ID NO: 324980 - DNA, 25 bp, Rattus norvegicus
gacgtgcccaccacagtgagcaaag

SEQ ID NO: 324981 - DNA, 25 bp, Rattus norvegicus
gacgtgcccacctcagtgagcaaag

SEQ ID NO: 324982 - DNA, 25 bp, Rattus norvegicus
gacgtgcggtagagtttgagcccct

SEQ ID NO: 324983 - DNA, 25 bp, Rattus norvegicus
gacgtgcggtagtgtttgagcccct

SEQ ID NO: 324984 - DNA, 25 bp, Rattus norvegicus
gacgtgctcaagactcgattccaga

SEQ ID NO: 324985 - DNA, 25 bp, Rattus norvegicus
gacgtgctcaagtctcgattccaga

SEQ ID NO: 324986 - DNA, 25 bp, Rattus norvegicus
gacgtgctgcagaattaccaggaat

SEQ ID NO: 324987 - DNA, 25 bp, Rattus norvegicus
gacgtgctgcagtattaccaggaat

SEQ ID NO: 324988 - DNA, 25 bp, Rattus norvegicus
gacgtgctgggtacctgaatgtgaa

SEQ ID NO: 324989 - DNA, 25 bp, Rattus norvegicus
gacgtgctgggttcctgaatgtgaa

SEQ ID NO: 324990 - DNA, 25 bp, Rattus norvegicus
gacgtgctgtgcctcagcggcggcg

SEQ ID NO: 324991 - DNA, 25 bp, Rattus norvegicus
gacgtgctgtgcgtcagcggcggcg

SEQ ID NO: 324992 - DNA, 25 bp, Rattus norvegicus
gacgtgcttcccagccacggtggcg

SEQ ID NO: 324993 - DNA, 25 bp, Rattus norvegicus
gacgtgcttccctgccacggtggcg

SEQ ID NO: 324994 - DNA, 25 bp, Rattus norvegicus
gacgtggaagcccacctatcaggaa

SEQ ID NO: 324995 - DNA, 25 bp, Rattus norvegicus
gacgtggaagccgacctatcaggaa

SEQ ID NO: 324996 - DNA, 25 bp, Rattus norvegicus
gacgtggaataaagagctcttttct

SEQ ID NO: 324997 - DNA, 25 bp, Rattus norvegicus
gacgtggaataatgagctcttttct

SEQ ID NO: 324998 - DNA, 25 bp, Rattus norvegicus
gacgtggactttccagtgacttcgc

SEQ ID NO: 324999 - DNA, 25 bp, Rattus norvegicus
gacgtggactttgcagtgacttcgc

SEQ ID NO: 325000 - DNA, 25 bp, Rattus norvegicus
gacgtggagataaccgtgctttggt

SEQ ID NO: 325001 - DNA, 25 bp, Rattus norvegicus
gacgtggagatatccgtgctttggt

SEQ ID NO: 325002 - DNA, 25 bp, Rattus norvegicus
gacgtggcagacagcttcactaaca

SEQ ID NO: 325003 - DNA, 25 bp, Rattus norvegicus
gacgtggcagactgcttcactaaca

SEQ ID NO: 325004 - DNA, 25 bp, Rattus norvegicus
gacgtggcatgccttgtcatgagat

SEQ ID NO: 325005 - DNA, 25 bp, Rattus norvegicus
gacgtggcatgcgttgtcatgagat

SEQ ID NO: 325006 - DNA, 25 bp, Rattus norvegicus
gacgtggcccaccttgtacaaaact

SEQ ID NO: 325007 - DNA, 25 bp, Rattus norvegicus
gacgtggcccacgttgtacaaaact

SEQ ID NO: 325008 - DNA, 25 bp, Rattus norvegicus
gacgtggcccagagcttgggtctca

SEQ ID NO: 325009 - DNA, 25 bp, Rattus norvegicus
gacgtggcccagtgcttgggtctca

SEQ ID NO: 325010 - DNA, 25 bp, Rattus norvegicus
gacgtggctctcacagaagattgca

SEQ ID NO: 325011 - DNA, 25 bp, Rattus norvegicus
gacgtggctctctcagaagattgca

SEQ ID NO: 325012 - DNA, 25 bp, Rattus norvegicus
gacgtggctctgcagatccatttca

SEQ ID NO: 325013 - DNA, 25 bp, Rattus norvegicus
gacgtggctctggagatccatttca

SEQ ID NO: 325014 - DNA, 25 bp, Rattus norvegicus
gacgtggctcttaggttatgaacta

SEQ ID NO: 325015 - DNA, 25 bp, Rattus norvegicus
gacgtggctctttggttatgaacta

SEQ ID NO: 325016 - DNA, 25 bp, Rattus norvegicus
gacgtgggagagatcagcactgcct

SEQ ID NO: 325017 - DNA, 25 bp, Rattus norvegicus
gacgtgggagagttcagcactgcct

SEQ ID NO: 325018 - DNA, 25 bp, Rattus norvegicus
gacgtgggcaatacagaccagtcac

SEQ ID NO: 325019 - DNA, 25 bp, Rattus norvegicus
gacgtgggcaattcagaccagtcac

SEQ ID NO: 325020 - DNA, 25 bp, Rattus norvegicus
gacgtgggccaacgatcaccaacat

SEQ ID NO: 325021 - DNA, 25 bp, Rattus norvegicus
gacgtgggccaaggatcaccaacat

SEQ ID NO: 325022 - DNA, 25 bp, Rattus norvegicus
gacgtgggtttaactctgtaagttt

SEQ ID NO: 325023 - DNA, 25 bp, Rattus norvegicus
gacgtgggtttatctctgtaagttt

SEQ ID NO: 325024 - DNA, 25 bp, Rattus norvegicus
gacgtggtagataacaagtgcttta

SEQ ID NO: 325025 - DNA, 25 bp, Rattus norvegicus
gacgtggtagattacaagtgcttta

SEQ ID NO: 325026 - DNA, 25 bp, Rattus norvegicus
gacgtggtatccctgtgtctccatg

SEQ ID NO: 325027 - DNA, 25 bp, Rattus norvegicus
gacgtggtatccgtgtgtctccatg

SEQ ID NO: 325028 - DNA, 25 bp, Rattus norvegicus
gacgtggtattaaaaagctactgaa

SEQ ID NO: 325029 - DNA, 25 bp, Rattus norvegicus
gacgtggtattataaagctactgaa

SEQ ID NO: 325030 - DNA, 25 bp, Rattus norvegicus
gacgtggtccaaaatagcccaggct

SEQ ID NO: 325031 - DNA, 25 bp, Rattus norvegicus
gacgtggtccaatatagcccaggct

SEQ ID NO: 325032 - DNA, 25 bp, Rattus norvegicus
gacgtggtcttcacgccaaggtgaa

SEQ ID NO: 325033 - DNA, 25 bp, Rattus norvegicus
gacgtggtcttctcgccaaggtgaa

SEQ ID NO: 325034 - DNA, 25 bp, Rattus norvegicus
gacgtggtggtcatcagaataacta

SEQ ID NO: 325035 - DNA, 25 bp, Rattus norvegicus
gacgtggtggtcttcagaataacta

SEQ ID NO: 325036 - DNA, 25 bp, Rattus norvegicus
gacgtggtgtgcatgggtctttacc

SEQ ID NO: 325037 - DNA, 25 bp, Rattus norvegicus
gacgtggtgtgcttgggtctttacc

SEQ ID NO: 325038 - DNA, 25 bp, Rattus norvegicus
gacgtgtaccttcacatctgtgatg

SEQ ID NO: 325039 - DNA, 25 bp, Rattus norvegicus
gacgtgtaccttgacatctgtgatg

SEQ ID NO: 325040 - DNA, 25 bp, Rattus norvegicus
gacgtgtactttcccagcaacggag

SEQ ID NO: 325041 - DNA, 25 bp, Rattus norvegicus
gacgtgtactttgccagcaacggag

SEQ ID NO: 325042 - DNA, 25 bp, Rattus norvegicus
gacgtgtagaacagcaaggtatttt

SEQ ID NO: 325043 - DNA, 25 bp, Rattus norvegicus
gacgtgtagaactgcaaggtatttt

SEQ ID NO: 325044 - DNA, 25 bp, Rattus norvegicus
gacgtgtatctgcttgcaatcattg

SEQ ID NO: 325045 - DNA, 25 bp, Rattus norvegicus
gacgtgtatctggttgcaatcattg

SEQ ID NO: 325046 - DNA, 25 bp, Rattus norvegicus
gacgtgtcacaaagtctgaccggaa

SEQ ID NO: 325047 - DNA, 25 bp, Rattus norvegicus
gacgtgtcacaatgtctgaccggaa

SEQ ID NO: 325048 - DNA, 25 bp, Rattus norvegicus
gacgtgtcacacaagtgctgtacta

SEQ ID NO: 325049 - DNA, 25 bp, Rattus norvegicus
gacgtgtcacactagtgctgtacta

SEQ ID NO: 325050 - DNA, 25 bp, Rattus norvegicus
gacgtgtgaaggacatctgtctgaa

SEQ ID NO: 325051 - DNA, 25 bp, Rattus norvegicus
gacgtgtgaaggtcatctgtctgaa

SEQ ID NO: 325052 - DNA, 25 bp, Rattus norvegicus
gacgtgtgaatcatcccaggcagct

SEQ ID NO: 325053 - DNA, 25 bp, Rattus norvegicus
gacgtgtgaatcttcccaggcagct

SEQ ID NO: 325054 - DNA, 25 bp, Rattus norvegicus
gacgtgtgacccagtgactgaacac

SEQ ID NO: 325055 - DNA, 25 bp, Rattus norvegicus
gacgtgtgaccctgtgactgaacac

SEQ ID NO: 325056 - DNA, 25 bp, Rattus norvegicus
gacgtgtgacttatgttgtacttaa

SEQ ID NO: 325057 - DNA, 25 bp, Rattus norvegicus
gacgtgtgacttttgttgtacttaa

SEQ ID NO: 325058 - DNA, 25 bp, Rattus norvegicus
gacgtgtgattgcttttgtgctcag

SEQ ID NO: 325059 - DNA, 25 bp, Rattus norvegicus
gacgtgtgattggttttgtgctcag

SEQ ID NO: 325060 - DNA, 25 bp, Rattus norvegicus
gacgtgtggagcattggcattttgc

SEQ ID NO: 325061 - DNA, 25 bp, Rattus norvegicus
gacgtgtggagctttggcattttgc

SEQ ID NO: 325062 - DNA, 25 bp, Rattus norvegicus
gacgtgtgtctcagatctttattac

SEQ ID NO: 325063 - DNA, 25 bp, Rattus norvegicus
gacgtgtgtctctgatctttattac

SEQ ID NO: 325064 - DNA, 25 bp, Rattus norvegicus
gacgtgtgtgatcttttgtttcttt

SEQ ID NO: 325065 - DNA, 25 bp, Rattus norvegicus
gacgtgtgtgatgttttgtttcttt

SEQ ID NO: 325066 - DNA, 25 bp, Rattus norvegicus
gacgtgtgttccacatgaggaccat

SEQ ID NO: 325067 - DNA, 25 bp, Rattus norvegicus
gacgtgtgttcctcatgaggaccat

SEQ ID NO: 325068 - DNA, 25 bp, Rattus norvegicus
gacgtgttaccacgtgtactatcct

SEQ ID NO: 325069 - DNA, 25 bp, Rattus norvegicus
gacgtgttaccaggtgtactatcct

SEQ ID NO: 325070 - DNA, 25 bp, Rattus norvegicus
gacgtgttagttactagtttgcaaa

SEQ ID NO: 325071 - DNA, 25 bp, Rattus norvegicus
gacgtgttagtttctagtttgcaaa

SEQ ID NO: 325072 - DNA, 25 bp, Rattus norvegicus
gacgtgttatgactccagaatttcc

SEQ ID NO: 325073 - DNA, 25 bp, Rattus norvegicus
gacgtgttatgagtccagaatttcc

SEQ ID NO: 325074 - DNA, 25 bp, Rattus norvegicus
gacgtgttcccaacatgaaaaagat

SEQ ID NO: 325075 - DNA, 25 bp, Rattus norvegicus
gacgtgttcccatcatgaaaaagat

SEQ ID NO: 325076 - DNA, 25 bp, Rattus norvegicus
gacgtgttcgtcataagcttgtttc

SEQ ID NO: 325077 - DNA, 25 bp, Rattus norvegicus
gacgtgttcgtcttaagcttgtttc

SEQ ID NO: 325078 - DNA, 25 bp, Rattus norvegicus
gacgtgttgcctattcttcaagtac

SEQ ID NO: 325079 - DNA, 25 bp, Rattus norvegicus
gacgtgttgccttttcttcaagtac

SEQ ID NO: 325080 - DNA, 25 bp, Rattus norvegicus
gacgtgtttcagatccaggcaacct

SEQ ID NO: 325081 - DNA, 25 bp, Rattus norvegicus
gacgtgtttcagttccaggcaacct

SEQ ID NO: 325082 - DNA, 25 bp, Rattus norvegicus
gacgtgtttctcagttgctaagtaa

SEQ ID NO: 325083 - DNA, 25 bp, Rattus norvegicus
gacgtgtttctctgttgctaagtaa

SEQ ID NO: 325084 - DNA, 25 bp, Rattus norvegicus
gacgtgtttgtcagctgtgcatgaa

SEQ ID NO: 325085 - DNA, 25 bp, Rattus norvegicus
gacgtgtttgtctgctgtgcatgaa

SEQ ID NO: 325086 - DNA, 25 bp, Rattus norvegicus
gacgtgttttatatccttccaagtt

SEQ ID NO: 325087 - DNA, 25 bp, Rattus norvegicus
gacgtgttttatttccttccaagtt

SEQ ID NO: 325088 - DNA, 25 bp, Rattus norvegicus
gacgtgttttcacatgttacttcag

SEQ ID NO: 325089 - DNA, 25 bp, Rattus norvegicus
gacgtgttttcagatgttacttcag

SEQ ID NO: 325090 - DNA, 25 bp, Rattus norvegicus
gacgttaaagccagagactaattct

SEQ ID NO: 325091 - DNA, 25 bp, Rattus norvegicus
gacgttaaagcctgagactaattct

SEQ ID NO: 325092 - DNA, 25 bp, Rattus norvegicus
gacgttaagcctcatatttgcacta

SEQ ID NO: 325093 - DNA, 25 bp, Rattus norvegicus
gacgttaagcctgatatttgcacta

SEQ ID NO: 325094 - DNA, 25 bp, Rattus norvegicus
gacgttaccaacactttgcaggaca

SEQ ID NO: 325095 - DNA, 25 bp, Rattus norvegicus
gacgttaccaactctttgcaggaca

SEQ ID NO: 325096 - DNA, 25 bp, Rattus norvegicus
gacgttactgggaacgaagctcggt

SEQ ID NO: 325097 - DNA, 25 bp, Rattus norvegicus
gacgttactgggtacgaagctcggt

SEQ ID NO: 325098 - DNA, 25 bp, Rattus norvegicus
gacgttagttctcataggcaagttc

SEQ ID NO: 325099 - DNA, 25 bp, Rattus norvegicus
gacgttagttctgataggcaagttc

SEQ ID NO: 325100 - DNA, 25 bp, Rattus norvegicus
gacgttattgtacggcactcaagca

SEQ ID NO: 325101 - DNA, 25 bp, Rattus norvegicus
gacgttattgtagggcactcaagca

SEQ ID NO: 325102 - DNA, 25 bp, Rattus norvegicus
gacgttcacgccagtctccagtgga

SEQ ID NO: 325103 - DNA, 25 bp, Rattus norvegicus
gacgttcacgcctgtctccagtgga

SEQ ID NO: 325104 - DNA, 25 bp, Rattus norvegicus
gacgttcacggaaaccaatgcctgt

SEQ ID NO: 325105 - DNA, 25 bp, Rattus norvegicus
gacgttcacggataccaatgcctgt

SEQ ID NO: 325106 - DNA, 25 bp, Rattus norvegicus
gacgttcactctcaatagatggtta

SEQ ID NO: 325107 - DNA, 25 bp, Rattus norvegicus
gacgttcactctgaatagatggtta

SEQ ID NO: 325108 - DNA, 25 bp, Rattus norvegicus
gacgttcagaaaaggcacctcgcaa

SEQ ID NO: 325109 - DNA, 25 bp, Rattus norvegicus
gacgttcagaaatggcacctcgcaa

SEQ ID NO: 325110 - DNA, 25 bp, Rattus norvegicus
gacgttcagctgataagtaaaactt

SEQ ID NO: 325111 - DNA, 25 bp, Rattus norvegicus
gacgttcagctgttaagtaaaactt

SEQ ID NO: 325112 - DNA, 25 bp, Rattus norvegicus
gacgttccaatactcttaattgtta

SEQ ID NO: 325113 - DNA, 25 bp, Rattus norvegicus
gacgttccaatagtcttaattgtta

SEQ ID NO: 325114 - DNA, 25 bp, Rattus norvegicus
gacgttcccacgaggaggttctaat

SEQ ID NO: 325115 - DNA, 25 bp, Rattus norvegicus
gacgttcccacgtggaggttctaat

SEQ ID NO: 325116 - DNA, 25 bp, Rattus norvegicus
gacgttccgggacaggtttaatcag

SEQ ID NO: 325117 - DNA, 25 bp, Rattus norvegicus
gacgttccgggagaggtttaatcag

SEQ ID NO: 325118 - DNA, 25 bp, Rattus norvegicus
gacgttcctaaaaccattcagatgg

SEQ ID NO: 325119 - DNA, 25 bp, Rattus norvegicus
gacgttcctaaatccattcagatgg

SEQ ID NO: 325120 - DNA, 25 bp, Rattus norvegicus
gacgttcgtaatcggttcctgtatt

SEQ ID NO: 325121 - DNA, 25 bp, Rattus norvegicus
gacgttcgtaatgggttcctgtatt

SEQ ID NO: 325122 - DNA, 25 bp, Rattus norvegicus
gacgttcgtcccaagcagtaagaga

SEQ ID NO: 325123 - DNA, 25 bp, Rattus norvegicus
gacgttcgtccctagcagtaagaga

SEQ ID NO: 325124 - DNA, 25 bp, Rattus norvegicus
gacgttctagtcagtgttcatcagt

SEQ ID NO: 325125 - DNA, 25 bp, Rattus norvegicus
gacgttctagtctgtgttcatcagt

SEQ ID NO: 325126 - DNA, 25 bp, Rattus norvegicus
gacgttctcacaacaaatccaagga

SEQ ID NO: 325127 - DNA, 25 bp, Rattus norvegicus
gacgttctcacatcaaatccaagga

SEQ ID NO: 325128 - DNA, 25 bp, Rattus norvegicus
gacgttctcgaaaccgaagttatga

SEQ ID NO: 325129 - DNA, 25 bp, Rattus norvegicus
gacgttctcgaatccgaagttatga

SEQ ID NO: 325130 - DNA, 25 bp, Rattus norvegicus
gacgttctgctcatggtctgaggct

SEQ ID NO: 325131 - DNA, 25 bp, Rattus norvegicus
gacgttctgctcttggtctgaggct

SEQ ID NO: 325132 - DNA, 25 bp, Rattus norvegicus
gacgttctgcttcctggtcaagagc

SEQ ID NO: 325133 - DNA, 25 bp, Rattus norvegicus
gacgttctgcttgctggtcaagagc

SEQ ID NO: 325134 - DNA, 25 bp, Rattus norvegicus
gacgttctgttacacctgctaagtt

SEQ ID NO: 325135 - DNA, 25 bp, Rattus norvegicus
gacgttctgttagacctgctaagtt

SEQ ID NO: 325136 - DNA, 25 bp, Rattus norvegicus
gacgttgacttcactagttgtcctt

SEQ ID NO: 325137 - DNA, 25 bp, Rattus norvegicus
gacgttgacttctctagttgtcctt

SEQ ID NO: 325138 - DNA, 25 bp, Rattus norvegicus
gacgttgccgatacaccagcacttg

SEQ ID NO: 325139 - DNA, 25 bp, Rattus norvegicus
gacgttgccgattcaccagcacttg

SEQ ID NO: 325140 - DNA, 25 bp, Rattus norvegicus
gacgttgcgtttcctctgtggaaaa

SEQ ID NO: 325141 - DNA, 25 bp, Rattus norvegicus
gacgttgcgtttgctctgtggaaaa

SEQ ID NO: 325142 - DNA, 25 bp, Rattus norvegicus
gacgttgctatacttgttcagactc

SEQ ID NO: 325143 - DNA, 25 bp, Rattus norvegicus
gacgttgctatagttgttcagactc

SEQ ID NO: 325144 - DNA, 25 bp, Rattus norvegicus
gacgttgctttgaggcccggatctg

SEQ ID NO: 325145 - DNA, 25 bp, Rattus norvegicus
gacgttgctttgtggcccggatctg

SEQ ID NO: 325146 - DNA, 25 bp, Rattus norvegicus
gacgttggcttcaggcacgaactga

SEQ ID NO: 325147 - DNA, 25 bp, Rattus norvegicus
gacgttggcttctggcacgaactga

SEQ ID NO: 325148 - DNA, 25 bp, Rattus norvegicus
gacgttggtcaactctgttaactct

SEQ ID NO: 325149 - DNA, 25 bp, Rattus norvegicus
gacgttggtcaagtctgttaactct

SEQ ID NO: 325150 - DNA, 25 bp, Rattus norvegicus
gacgttggtctcaggttaagaagct

SEQ ID NO: 325151 - DNA, 25 bp, Rattus norvegicus
gacgttggtctctggttaagaagct

SEQ ID NO: 325152 - DNA, 25 bp, Rattus norvegicus
gacgttggttctatcattgtgtagc

SEQ ID NO: 325153 - DNA, 25 bp, Rattus norvegicus
gacgttggttctttcattgtgtagc

SEQ ID NO: 325154 - DNA, 25 bp, Rattus norvegicus
gacgttgtagataacttggacacat

SEQ ID NO: 325155 - DNA, 25 bp, Rattus norvegicus
gacgttgtagattacttggacacat

SEQ ID NO: 325156 - DNA, 25 bp, Rattus norvegicus
gacgttgtctgcagacagttaattt

SEQ ID NO: 325157 - DNA, 25 bp, Rattus norvegicus
gacgttgtctgctgacagttaattt

SEQ ID NO: 325158 - DNA, 25 bp, Rattus norvegicus
gacgttgtggacatgcctatggaca

SEQ ID NO: 325159 - DNA, 25 bp, Rattus norvegicus
gacgttgtggacttgcctatggaca

SEQ ID NO: 325160 - DNA, 25 bp, Rattus norvegicus
gacgtttacatcatactgacggttg

SEQ ID NO: 325161 - DNA, 25 bp, Rattus norvegicus
gacgtttacatcttactgacggttg

SEQ ID NO: 325162 - DNA, 25 bp, Rattus norvegicus
gacgtttactgtcaagctgcaagct

SEQ ID NO: 325163 - DNA, 25 bp, Rattus norvegicus
gacgtttactgtgaagctgcaagct

SEQ ID NO: 325164 - DNA, 25 bp, Rattus norvegicus
gacgtttagtcaagttcaggcctca

SEQ ID NO: 325165 - DNA, 25 bp, Rattus norvegicus
gacgtttagtcatgttcaggcctca

SEQ ID NO: 325166 - DNA, 25 bp, Rattus norvegicus
gacgtttatactcgaatgtgccttc

SEQ ID NO: 325167 - DNA, 25 bp, Rattus norvegicus
gacgtttatactggaatgtgccttc

SEQ ID NO: 325168 - DNA, 25 bp, Rattus norvegicus
gacgtttatgtgagtgtatcttgaa

SEQ ID NO: 325169 - DNA, 25 bp, Rattus norvegicus
gacgtttatgtgtgtgtatcttgaa

SEQ ID NO: 325170 - DNA, 25 bp, Rattus norvegicus
gacgtttcagctctcaaagcgccat

SEQ ID NO: 325171 - DNA, 25 bp, Rattus norvegicus
gacgtttcagctgtcaaagcgccat

SEQ ID NO: 325172 - DNA, 25 bp, Rattus norvegicus
gacgtttcagtcatagactcagaac

SEQ ID NO: 325173 - DNA, 25 bp, Rattus norvegicus
gacgtttcagtcttagactcagaac

SEQ ID NO: 325174 - DNA, 25 bp, Rattus norvegicus
gacgtttccaaacttaatggcccag

SEQ ID NO: 325175 - DNA, 25 bp, Rattus norvegicus
gacgtttccaaagttaatggcccag

SEQ ID NO: 325176 - DNA, 25 bp, Rattus norvegicus
gacgtttctgatccagcagaagact

SEQ ID NO: 325177 - DNA, 25 bp, Rattus norvegicus
gacgtttctgatgcagcagaagact

SEQ ID NO: 325178 - DNA, 25 bp, Rattus norvegicus
gacgtttctgtcacagtggatccat

SEQ ID NO: 325179 - DNA, 25 bp, Rattus norvegicus
gacgtttctgtctcagtggatccat

SEQ ID NO: 325180 - DNA, 25 bp, Rattus norvegicus
gacgtttgagttacaggccagagtt

SEQ ID NO: 325181 - DNA, 25 bp, Rattus norvegicus
gacgtttgagtttcaggccagagtt

SEQ ID NO: 325182 - DNA, 25 bp, Rattus norvegicus
gacgtttgcataaacagttccccga

SEQ ID NO: 325183 - DNA, 25 bp, Rattus norvegicus
gacgtttgcatatacagttccccga

SEQ ID NO: 325184 - DNA, 25 bp, Rattus norvegicus
gacgtttgccagcttttgggatagt

SEQ ID NO: 325185 - DNA, 25 bp, Rattus norvegicus
gacgtttgccaggttttgggatagt

SEQ ID NO: 325186 - DNA, 25 bp, Rattus norvegicus
gacgtttggagcagctatcggtgca

SEQ ID NO: 325187 - DNA, 25 bp, Rattus norvegicus
gacgtttggagctgctatcggtgca

SEQ ID NO: 325188 - DNA, 25 bp, Rattus norvegicus
gacgtttgtgtcaggcatttgcatc

SEQ ID NO: 325189 - DNA, 25 bp, Rattus norvegicus
gacgtttgtgtctggcatttgcatc

SEQ ID NO: 325190 - DNA, 25 bp, Rattus norvegicus
gacgttttaagtcttcattgtacaa

SEQ ID NO: 325191 - DNA, 25 bp, Rattus norvegicus
gacgttttaagtgttcattgtacaa

SEQ ID NO: 325192 - DNA, 25 bp, Rattus norvegicus
gacgttttaattattgtgatctatt

SEQ ID NO: 325193 - DNA, 25 bp, Rattus norvegicus
gacgttttaatttttgtgatctatt

SEQ ID NO: 325194 - DNA, 25 bp, Rattus norvegicus
gacgttttagttctgtgaacagcta

SEQ ID NO: 325195 - DNA, 25 bp, Rattus norvegicus
gacgttttagttgtgtgaacagcta

SEQ ID NO: 325196 - DNA, 25 bp, Rattus norvegicus
gacgttttatttagttgttctcaga

SEQ ID NO: 325197 - DNA, 25 bp, Rattus norvegicus
gacgttttattttgttgttctcaga

SEQ ID NO: 325198 - DNA, 25 bp, Rattus norvegicus
gacgttttcgagatactgtggcaca

SEQ ID NO: 325199 - DNA, 25 bp, Rattus norvegicus
gacgttttcgagttactgtggcaca

SEQ ID NO: 325200 - DNA, 25 bp, Rattus norvegicus
gacgtttttcataagcaccctagta

SEQ ID NO: 325201 - DNA, 25 bp, Rattus norvegicus
gacgtttttcattagcaccctagta

SEQ ID NO: 325202 - DNA, 25 bp, Rattus norvegicus
gacgtttttgtactttatgtgctgt

SEQ ID NO: 325203 - DNA, 25 bp, Rattus norvegicus
gacgtttttgtagtttatgtgctgt

SEQ ID NO: 325204 - DNA, 25 bp, Rattus norvegicus
gactaaaaacccagctctagtgtga

SEQ ID NO: 325205 - DNA, 25 bp, Rattus norvegicus
gactaaaaaccctgctctagtgtga

SEQ ID NO: 325206 - DNA, 25 bp, Rattus norvegicus
gactaaaaaccgctccgcatgagtt

SEQ ID NO: 325207 - DNA, 25 bp, Rattus norvegicus
gactaaaaaccggtccgcatgagtt

SEQ ID NO: 325208 - DNA, 25 bp, Rattus norvegicus
gactaaaacaggcaggtctgtctgt

SEQ ID NO: 325209 - DNA, 25 bp, Rattus norvegicus
gactaaaacagggaggtctgtctgt

SEQ ID NO: 325210 - DNA, 25 bp, Rattus norvegicus
gactaaaagtggaacctcagctgtg

SEQ ID NO: 325211 - DNA, 25 bp, Rattus norvegicus
gactaaaagtggtacctcagctgtg

SEQ ID NO: 325212 - DNA, 25 bp, Rattus norvegicus
gactaaaatcccatgactgtggagt

SEQ ID NO: 325213 - DNA, 25 bp, Rattus norvegicus
gactaaaatcccttgactgtggagt

SEQ ID NO: 325214 - DNA, 25 bp, Rattus norvegicus
gactaaaatcctatgatgttacaca

SEQ ID NO: 325215 - DNA, 25 bp, Rattus norvegicus
gactaaaatcctttgatgttacaca

SEQ ID NO: 325216 - DNA, 25 bp, Rattus norvegicus
gactaaacacgtccggtctgaagtt

SEQ ID NO: 325217 - DNA, 25 bp, Rattus norvegicus
gactaaacacgtgcggtctgaagtt

SEQ ID NO: 325218 - DNA, 25 bp, Rattus norvegicus
gactaaaccatcaaccgaagagtac

SEQ ID NO: 325219 - DNA, 25 bp, Rattus norvegicus
gactaaaccatctaccgaagagtac

SEQ ID NO: 325220 - DNA, 25 bp, Rattus norvegicus
gactaaacctcaccatccaggtaaa

SEQ ID NO: 325221 - DNA, 25 bp, Rattus norvegicus
gactaaacctcagcatccaggtaaa

SEQ ID NO: 325222 - DNA, 25 bp, Rattus norvegicus
gactaaacctcccatcatgaaacgg

SEQ ID NO: 325223 - DNA, 25 bp, Rattus norvegicus
gactaaacctccgatcatgaaacgg

SEQ ID NO: 325224 - DNA, 25 bp, Rattus norvegicus
gactaaaccttgcattaaggcatat

SEQ ID NO: 325225 - DNA, 25 bp, Rattus norvegicus
gactaaaccttggattaaggcatat

SEQ ID NO: 325226 - DNA, 25 bp, Rattus norvegicus
gactaaactgtgctgtcattttgct

SEQ ID NO: 325227 - DNA, 25 bp, Rattus norvegicus
gactaaactgtggtgtcattttgct

SEQ ID NO: 325228 - DNA, 25 bp, Rattus norvegicus
gactaaagaatgagccttgcttaca

SEQ ID NO: 325229 - DNA, 25 bp, Rattus norvegicus
gactaaagaatgtgccttgcttaca

SEQ ID NO: 325230 - DNA, 25 bp, Rattus norvegicus
gactaaagcagtccaattcattttt

SEQ ID NO: 325231 - DNA, 25 bp, Rattus norvegicus
gactaaagcagtgcaattcattttt

SEQ ID NO: 325232 - DNA, 25 bp, Rattus norvegicus
gactaaagcgacaggtccctctcag

SEQ ID NO: 325233 - DNA, 25 bp, Rattus norvegicus
gactaaagcgactggtccctctcag

SEQ ID NO: 325234 - DNA, 25 bp, Rattus norvegicus
gactaaaggatcctgctgacaccca

SEQ ID NO: 325235 - DNA, 25 bp, Rattus norvegicus
gactaaaggatcgtgctgacaccca

SEQ ID NO: 325236 - DNA, 25 bp, Rattus norvegicus
gactaaatactgatgaaagccctga

SEQ ID NO: 325237 - DNA, 25 bp, Rattus norvegicus
gactaaatactgttgaaagccctga

SEQ ID NO: 325238 - DNA, 25 bp, Rattus norvegicus
gactaaatcaggaacaccgtaccta

SEQ ID NO: 325239 - DNA, 25 bp, Rattus norvegicus
gactaaatcaggtacaccgtaccta

SEQ ID NO: 325240 - DNA, 25 bp, Rattus norvegicus
gactaaatgagacggttgaccacga

SEQ ID NO: 325241 - DNA, 25 bp, Rattus norvegicus
gactaaatgagagggttgaccacga

SEQ ID NO: 325242 - DNA, 25 bp, Rattus norvegicus
gactaaattcggacacacacggctg

SEQ ID NO: 325243 - DNA, 25 bp, Rattus norvegicus
gactaaattcggtcacacacggctg

SEQ ID NO: 325244 - DNA, 25 bp, Rattus norvegicus
gactaacagaagagtccctcacact

SEQ ID NO: 325245 - DNA, 25 bp, Rattus norvegicus
gactaacagaagtgtccctcacact

SEQ ID NO: 325246 - DNA, 25 bp, Rattus norvegicus
gactaacagggcattatctcgtctg

SEQ ID NO: 325247 - DNA, 25 bp, Rattus norvegicus
gactaacagggctttatctcgtctg

SEQ ID NO: 325248 - DNA, 25 bp, Rattus norvegicus
gactaacaggtgctatctcttctta

SEQ ID NO: 325249 - DNA, 25 bp, Rattus norvegicus
gactaacaggtggtatctcttctta

SEQ ID NO: 325250 - DNA, 25 bp, Rattus norvegicus
gactaacatcctcgtgtgggaagca

SEQ ID NO: 325251 - DNA, 25 bp, Rattus norvegicus
gactaacatcctggtgtgggaagca

SEQ ID NO: 325252 - DNA, 25 bp, Rattus norvegicus
gactaaccacggaaggaccaggcct

SEQ ID NO: 325253 - DNA, 25 bp, Rattus norvegicus
gactaaccacggtaggaccaggcct

SEQ ID NO: 325254 - DNA, 25 bp, Rattus norvegicus
gactaaccacgtcttatgttttcga

SEQ ID NO: 325255 - DNA, 25 bp, Rattus norvegicus
gactaaccacgtgttatgttttcga

SEQ ID NO: 325256 - DNA, 25 bp, Rattus norvegicus
gactaaccacttcactgggctcggt

SEQ ID NO: 325257 - DNA, 25 bp, Rattus norvegicus
gactaaccacttgactgggctcggt

SEQ ID NO: 325258 - DNA, 25 bp, Rattus norvegicus
gactaacccacacgttggtttacat

SEQ ID NO: 325259 - DNA, 25 bp, Rattus norvegicus
gactaacccacaggttggtttacat

SEQ ID NO: 325260 - DNA, 25 bp, Rattus norvegicus
gactaacccattcattttctctaat

SEQ ID NO: 325261 - DNA, 25 bp, Rattus norvegicus
gactaacccattgattttctctaat

SEQ ID NO: 325262 - DNA, 25 bp, Rattus norvegicus
gactaacccgtgattgtcatttgaa

SEQ ID NO: 325263 - DNA, 25 bp, Rattus norvegicus
gactaacccgtgtttgtcatttgaa

SEQ ID NO: 325264 - DNA, 25 bp, Rattus norvegicus
gactaaccgcgtatacaggatctga

SEQ ID NO: 325265 - DNA, 25 bp, Rattus norvegicus
gactaaccgcgtttacaggatctga

SEQ ID NO: 325266 - DNA, 25 bp, Rattus norvegicus
gactaacctctgataatgggcccac

SEQ ID NO: 325267 - DNA, 25 bp, Rattus norvegicus
gactaacctctgttaatgggcccac

SEQ ID NO: 325268 - DNA, 25 bp, Rattus norvegicus
gactaacctgagctatatctgaaga

SEQ ID NO: 325269 - DNA, 25 bp, Rattus norvegicus
gactaacctgaggtatatctgaaga

SEQ ID NO: 325270 - DNA, 25 bp, Rattus norvegicus
gactaacgcacaactcctctttggg

SEQ ID NO: 325271 - DNA, 25 bp, Rattus norvegicus
gactaacgcacatctcctctttggg

SEQ ID NO: 325272 - DNA, 25 bp, Rattus norvegicus
gactaactagccagtgggccagctg

SEQ ID NO: 325273 - DNA, 25 bp, Rattus norvegicus
gactaactagcctgtgggccagctg

SEQ ID NO: 325274 - DNA, 25 bp, Rattus norvegicus
gactaactcagccttaagtcctgac

SEQ ID NO: 325275 - DNA, 25 bp, Rattus norvegicus
gactaactcagcgttaagtcctgac

SEQ ID NO: 325276 - DNA, 25 bp, Rattus norvegicus
gactaactctccagtcctttttcat

SEQ ID NO: 325277 - DNA, 25 bp, Rattus norvegicus
gactaactctcctgtcctttttcat

SEQ ID NO: 325278 - DNA, 25 bp, Rattus norvegicus
gactaactcttacgcctattttact

SEQ ID NO: 325279 - DNA, 25 bp, Rattus norvegicus
gactaactcttaggcctattttact

SEQ ID NO: 325280 - DNA, 25 bp, Rattus norvegicus
gactaactgcacagcttagcctgac

SEQ ID NO: 325281 - DNA, 25 bp, Rattus norvegicus
gactaactgcactgcttagcctgac

SEQ ID NO: 325282 - DNA, 25 bp, Rattus norvegicus
gactaagaaggcctgccattccgta

SEQ ID NO: 325283 - DNA, 25 bp, Rattus norvegicus
gactaagaaggcgtgccattccgta

SEQ ID NO: 325284 - DNA, 25 bp, Rattus norvegicus
gactaagaatgcaccttcatagaaa

SEQ ID NO: 325285 - DNA, 25 bp, Rattus norvegicus
gactaagaatgctccttcatagaaa

SEQ ID NO: 325286 - DNA, 25 bp, Rattus norvegicus
gactaagactccctgcacataaatt

SEQ ID NO: 325287 - DNA, 25 bp, Rattus norvegicus
gactaagactccgtgcacataaatt

SEQ ID NO: 325288 - DNA, 25 bp, Rattus norvegicus
gactaagagagcctctaaccaccac

SEQ ID NO: 325289 - DNA, 25 bp, Rattus norvegicus
gactaagagagcgtctaaccaccac

SEQ ID NO: 325290 - DNA, 25 bp, Rattus norvegicus
gactaagcaaagctagtgccctgcc

SEQ ID NO: 325291 - DNA, 25 bp, Rattus norvegicus
gactaagcaaaggtagtgccctgcc

SEQ ID NO: 325292 - DNA, 25 bp, Rattus norvegicus
gactaagcagatccggctccgagta

SEQ ID NO: 325293 - DNA, 25 bp, Rattus norvegicus
gactaagcagatgcggctccgagta

SEQ ID NO: 325294 - DNA, 25 bp, Rattus norvegicus
gactaagcataaacttatctcattt

SEQ ID NO: 325295 - DNA, 25 bp, Rattus norvegicus
gactaagcataatcttatctcattt

SEQ ID NO: 325296 - DNA, 25 bp, Rattus norvegicus
gactaagcatctctatctgggccca

SEQ ID NO: 325297 - DNA, 25 bp, Rattus norvegicus
gactaagcatctgtatctgggccca

SEQ ID NO: 325298 - DNA, 25 bp, Rattus norvegicus
gactaagcccagcatggtttggaca

SEQ ID NO: 325299 - DNA, 25 bp, Rattus norvegicus
gactaagcccaggatggtttggaca

SEQ ID NO: 325300 - DNA, 25 bp, Rattus norvegicus
gactaagcccatattccgcaaaaag

SEQ ID NO: 325301 - DNA, 25 bp, Rattus norvegicus
gactaagcccattttccgcaaaaag

SEQ ID NO: 325302 - DNA, 25 bp, Rattus norvegicus
gactaaggacgaagttttccacttg

SEQ ID NO: 325303 - DNA, 25 bp, Rattus norvegicus
gactaaggacgatgttttccacttg

SEQ ID NO: 325304 - DNA, 25 bp, Rattus norvegicus
gactaaggagtcagttctgggtgct

SEQ ID NO: 325305 - DNA, 25 bp, Rattus norvegicus
gactaaggagtctgttctgggtgct

SEQ ID NO: 325306 - DNA, 25 bp, Rattus norvegicus
gactaaggctaaccttgacttgctt

SEQ ID NO: 325307 - DNA, 25 bp, Rattus norvegicus
gactaaggctaagcttgacttgctt

SEQ ID NO: 325308 - DNA, 25 bp, Rattus norvegicus
gactaagggacaattcaggaactga

SEQ ID NO: 325309 - DNA, 25 bp, Rattus norvegicus
gactaagggacatttcaggaactga

SEQ ID NO: 325310 - DNA, 25 bp, Rattus norvegicus
gactaagggacgcatctaacatcag

SEQ ID NO: 325311 - DNA, 25 bp, Rattus norvegicus
gactaagggacggatctaacatcag

SEQ ID NO: 325312 - DNA, 25 bp, Rattus norvegicus
gactaaggtgcgctgtgttctccgc

SEQ ID NO: 325313 - DNA, 25 bp, Rattus norvegicus
gactaaggtgcggtgtgttctccgc

SEQ ID NO: 325314 - DNA, 25 bp, Rattus norvegicus
gactaaggttagcacttctctcggg

SEQ ID NO: 325315 - DNA, 25 bp, Rattus norvegicus
gactaaggttaggacttctctcggg

SEQ ID NO: 325316 - DNA, 25 bp, Rattus norvegicus
gactaagtctagagttgcatgcagt

SEQ ID NO: 325317 - DNA, 25 bp, Rattus norvegicus
gactaagtctagtgttgcatgcagt

SEQ ID NO: 325318 - DNA, 25 bp, Rattus norvegicus
gactaagtcttgactcgactgcact

SEQ ID NO: 325319 - DNA, 25 bp, Rattus norvegicus
gactaagtcttgtctcgactgcact

SEQ ID NO: 325320 - DNA, 25 bp, Rattus norvegicus
gactaagtgcctcatgccagctgga

SEQ ID NO: 325321 - DNA, 25 bp, Rattus norvegicus
gactaagtgcctgatgccagctgga

SEQ ID NO: 325322 - DNA, 25 bp, Rattus norvegicus
gactaagtggacattcctcggtgga

SEQ ID NO: 325323 - DNA, 25 bp, Rattus norvegicus
gactaagtggactttcctcggtgga

SEQ ID NO: 325324 - DNA, 25 bp, Rattus norvegicus
gactaagtgtccagaataccagcat

SEQ ID NO: 325325 - DNA, 25 bp, Rattus norvegicus
gactaagtgtcctgaataccagcat

SEQ ID NO: 325326 - DNA, 25 bp, Rattus norvegicus
gactaagttaatctggtccttacag

SEQ ID NO: 325327 - DNA, 25 bp, Rattus norvegicus
gactaagttaatgtggtccttacag

SEQ ID NO: 325328 - DNA, 25 bp, Rattus norvegicus
gactaagttattctgtcctgctcct

SEQ ID NO: 325329 - DNA, 25 bp, Rattus norvegicus
gactaagttattgtgtcctgctcct

SEQ ID NO: 325330 - DNA, 25 bp, Rattus norvegicus
gactaataactgagcaccaggtcca

SEQ ID NO: 325331 - DNA, 25 bp, Rattus norvegicus
gactaataactgtgcaccaggtcca

SEQ ID NO: 325332 - DNA, 25 bp, Rattus norvegicus
gactaataccgcaagacgatatgct

SEQ ID NO: 325333 - DNA, 25 bp, Rattus norvegicus
gactaataccgctagacgatatgct

SEQ ID NO: 325334 - DNA, 25 bp, Rattus norvegicus
gactaatatggtcactgccactgta

SEQ ID NO: 325335 - DNA, 25 bp, Rattus norvegicus
gactaatatggtgactgccactgta

SEQ ID NO: 325336 - DNA, 25 bp, Rattus norvegicus
gactaatcaataaatccaagtgttt

SEQ ID NO: 325337 - DNA, 25 bp, Rattus norvegicus
gactaatcaatatatccaagtgttt

SEQ ID NO: 325338 - DNA, 25 bp, Rattus norvegicus
gactaatcgagtaatctgaccccat

SEQ ID NO: 325339 - DNA, 25 bp, Rattus norvegicus
gactaatcgagttatctgaccccat

SEQ ID NO: 325340 - DNA, 25 bp, Rattus norvegicus
gactaatctgacatcctttaatttt

SEQ ID NO: 325341 - DNA, 25 bp, Rattus norvegicus
gactaatctgacttcctttaatttt

SEQ ID NO: 325342 - DNA, 25 bp, Rattus norvegicus
gactaatctgttcagtctcccttgc

SEQ ID NO: 325343 - DNA, 25 bp, Rattus norvegicus
gactaatctgttgagtctcccttgc

SEQ ID NO: 325344 - DNA, 25 bp, Rattus norvegicus
gactaatctttaacttccaatttga

SEQ ID NO: 325345 - DNA, 25 bp, Rattus norvegicus
gactaatctttatcttccaatttga

SEQ ID NO: 325346 - DNA, 25 bp, Rattus norvegicus
gactaatgctacagtgaacctgggt

SEQ ID NO: 325347 - DNA, 25 bp, Rattus norvegicus
gactaatgctactgtgaacctgggt

SEQ ID NO: 325348 - DNA, 25 bp, Rattus norvegicus
gactaatgctgcaaccatgggatta

SEQ ID NO: 325349 - DNA, 25 bp, Rattus norvegicus
gactaatgctgctaccatgggatta

SEQ ID NO: 325350 - DNA, 25 bp, Rattus norvegicus
gactaatggagcaccacactgcagt

SEQ ID NO: 325351 - DNA, 25 bp, Rattus norvegicus
gactaatggagctccacactgcagt

SEQ ID NO: 325352 - DNA, 25 bp, Rattus norvegicus
gactaatgttttctgttttcaaata

SEQ ID NO: 325353 - DNA, 25 bp, Rattus norvegicus
gactaatgttttgtgttttcaaata

SEQ ID NO: 325354 - DNA, 25 bp, Rattus norvegicus
gactaattaagtctctattgccctt

SEQ ID NO: 325355 - DNA, 25 bp, Rattus norvegicus
gactaattaagtgtctattgccctt

SEQ ID NO: 325356 - DNA, 25 bp, Rattus norvegicus
gactaattagggatccactggcttc

SEQ ID NO: 325357 - DNA, 25 bp, Rattus norvegicus
gactaattagggttccactggcttc

SEQ ID NO: 325358 - DNA, 25 bp, Rattus norvegicus
gactaattattcacatcctaccatc

SEQ ID NO: 325359 - DNA, 25 bp, Rattus norvegicus
gactaattattctcatcctaccatc

SEQ ID NO: 325360 - DNA, 25 bp, Rattus norvegicus
gactaattctgaatctccttctgtt

SEQ ID NO: 325361 - DNA, 25 bp, Rattus norvegicus
gactaattctgattctccttctgtt

SEQ ID NO: 325362 - DNA, 25 bp, Rattus norvegicus
gactaattgattctgggcttccagc

SEQ ID NO: 325363 - DNA, 25 bp, Rattus norvegicus
gactaattgattgtgggcttccagc

SEQ ID NO: 325364 - DNA, 25 bp, Rattus norvegicus
gactaatttaacaggtgcgtttcag

SEQ ID NO: 325365 - DNA, 25 bp, Rattus norvegicus
gactaatttaactggtgcgtttcag

SEQ ID NO: 325366 - DNA, 25 bp, Rattus norvegicus
gactaatttactctatatccctcac

SEQ ID NO: 325367 - DNA, 25 bp, Rattus norvegicus
gactaatttactgtatatccctcac

SEQ ID NO: 325368 - DNA, 25 bp, Rattus norvegicus
gactaatttgtgagcccattgcctg

SEQ ID NO: 325369 - DNA, 25 bp, Rattus norvegicus
gactaatttgtgtgcccattgcctg

SEQ ID NO: 325370 - DNA, 25 bp, Rattus norvegicus
gactacaaacagagctcctgagatg

SEQ ID NO: 325371 - DNA, 25 bp, Rattus norvegicus
gactacaaacagtgctcctgagatg

SEQ ID NO: 325372 - DNA, 25 bp, Rattus norvegicus
gactacaaactcatcatctcgggag

SEQ ID NO: 325373 - DNA, 25 bp, Rattus norvegicus
gactacaaactcttcatctcgggag

SEQ ID NO: 325374 - DNA, 25 bp, Rattus norvegicus
gactacaaccctatctggtgttaca

SEQ ID NO: 325375 - DNA, 25 bp, Rattus norvegicus
gactacaaccctttctggtgttaca

SEQ ID NO: 325376 - DNA, 25 bp, Rattus norvegicus
gactacaaccttagagctactagcc

SEQ ID NO: 325377 - DNA, 25 bp, Rattus norvegicus
gactacaacctttgagctactagcc

SEQ ID NO: 325378 - DNA, 25 bp, Rattus norvegicus
gactacaacggcatggtgggcactg

SEQ ID NO: 325379 - DNA, 25 bp, Rattus norvegicus
gactacaacggcttggtgggcactg

SEQ ID NO: 325380 - DNA, 25 bp, Rattus norvegicus
gactacaacttgatgacctctttca

SEQ ID NO: 325381 - DNA, 25 bp, Rattus norvegicus
gactacaacttgttgacctctttca

SEQ ID NO: 325382 - DNA, 25 bp, Rattus norvegicus
gactacaagaacactttccccaagt

SEQ ID NO: 325383 - DNA, 25 bp, Rattus norvegicus
gactacaagaactctttccccaagt

SEQ ID NO: 325384 - DNA, 25 bp, Rattus norvegicus
gactacaagagtaccggacccgtgt

SEQ ID NO: 325385 - DNA, 25 bp, Rattus norvegicus
gactacaagagttccggacccgtgt

SEQ ID NO: 325386 - DNA, 25 bp, Rattus norvegicus
gactacaaggctaaacttaggctcc

SEQ ID NO: 325387 - DNA, 25 bp, Rattus norvegicus
gactacaaggcttaacttaggctcc

SEQ ID NO: 325388 - DNA, 25 bp, Rattus norvegicus
gactacaatacgaggcggagctata

SEQ ID NO: 325389 - DNA, 25 bp, Rattus norvegicus
gactacaatacgtggcggagctata

SEQ ID NO: 325390 - DNA, 25 bp, Rattus norvegicus
gactacacctccaacagtgcaattg

SEQ ID NO: 325391 - DNA, 25 bp, Rattus norvegicus
gactacacctcctacagtgcaattg

SEQ ID NO: 325392 - DNA, 25 bp, Rattus norvegicus
gactacagaacactctcgtgggact

SEQ ID NO: 325393 - DNA, 25 bp, Rattus norvegicus
gactacagaacagtctcgtgggact

SEQ ID NO: 325394 - DNA, 25 bp, Rattus norvegicus
gactacagaagcacactgtgtgaca

SEQ ID NO: 325395 - DNA, 25 bp, Rattus norvegicus
gactacagaagctcactgtgtgaca

SEQ ID NO: 325396 - DNA, 25 bp, Rattus norvegicus
gactacagaccacccagcttcaaag

SEQ ID NO: 325397 - DNA, 25 bp, Rattus norvegicus
gactacagaccagccagcttcaaag

SEQ ID NO: 325398 - DNA, 25 bp, Rattus norvegicus
gactacagacgcacttgacagggct

SEQ ID NO: 325399 - DNA, 25 bp, Rattus norvegicus
gactacagacgctcttgacagggct

SEQ ID NO: 325400 - DNA, 25 bp, Rattus norvegicus
gactacagaggaagcttggacctga

SEQ ID NO: 325401 - DNA, 25 bp, Rattus norvegicus
gactacagaggatgcttggacctga

SEQ ID NO: 325402 - DNA, 25 bp, Rattus norvegicus
gactacagagtacaccacatctcaa

SEQ ID NO: 325403 - DNA, 25 bp, Rattus norvegicus
gactacagagtagaccacatctcaa

SEQ ID NO: 325404 - DNA, 25 bp, Rattus norvegicus
gactacagatcacgacggagccaat

SEQ ID NO: 325405 - DNA, 25 bp, Rattus norvegicus
gactacagatcaggacggagccaat

SEQ ID NO: 325406 - DNA, 25 bp, Rattus norvegicus
gactacagcacaccggatgatcccg

SEQ ID NO: 325407 - DNA, 25 bp, Rattus norvegicus
gactacagcacagcggatgatcccg

SEQ ID NO: 325408 - DNA, 25 bp, Rattus norvegicus
gactacagcaccagtcgctggaaga

SEQ ID NO: 325409 - DNA, 25 bp, Rattus norvegicus
gactacagcacctgtcgctggaaga

SEQ ID NO: 325410 - DNA, 25 bp, Rattus norvegicus
gactacagcacgctggatgacaacc

SEQ ID NO: 325411 - DNA, 25 bp, Rattus norvegicus
gactacagcacggtggatgacaacc

SEQ ID NO: 325412 - DNA, 25 bp, Rattus norvegicus
gactacagcaggcactggctgccaa

SEQ ID NO: 325413 - DNA, 25 bp, Rattus norvegicus
gactacagcagggactggctgccaa

SEQ ID NO: 325414 - DNA, 25 bp, Rattus norvegicus
gactacagccaacactacagccgtg

SEQ ID NO: 325415 - DNA, 25 bp, Rattus norvegicus
gactacagccaagactacagccgtg

SEQ ID NO: 325416 - DNA, 25 bp, Rattus norvegicus
gactacagcctgacaaaatccatct

SEQ ID NO: 325417 - DNA, 25 bp, Rattus norvegicus
gactacagcctgtcaaaatccatct

SEQ ID NO: 325418 - DNA, 25 bp, Rattus norvegicus
gactacagctcccaggtacaaggtt

SEQ ID NO: 325419 - DNA, 25 bp, Rattus norvegicus
gactacagctccgaggtacaaggtt

SEQ ID NO: 325420 - DNA, 25 bp, Rattus norvegicus
gactacaggcctccagattgtaact

SEQ ID NO: 325421 - DNA, 25 bp, Rattus norvegicus
gactacaggcctgcagattgtaact

SEQ ID NO: 325422 - DNA, 25 bp, Rattus norvegicus
gactacagggaacccatctcagtgt

SEQ ID NO: 325423 - DNA, 25 bp, Rattus norvegicus
gactacagggaagccatctcagtgt

SEQ ID NO: 325424 - DNA, 25 bp, Rattus norvegicus
gactacagggcaactgttgtctttc

SEQ ID NO: 325425 - DNA, 25 bp, Rattus norvegicus
gactacagggcatctgttgtctttc

SEQ ID NO: 325426 - DNA, 25 bp, Rattus norvegicus
gactacagggttcagctccgagtat

SEQ ID NO: 325427 - DNA, 25 bp, Rattus norvegicus
gactacagggttgagctccgagtat

SEQ ID NO: 325428 - DNA, 25 bp, Rattus norvegicus
gactacaggtcccatttagcaatgg

SEQ ID NO: 325429 - DNA, 25 bp, Rattus norvegicus
gactacaggtccgatttagcaatgg

SEQ ID NO: 325430 - DNA, 25 bp, Rattus norvegicus
gactacagtcaaatactggagggat

SEQ ID NO: 325431 - DNA, 25 bp, Rattus norvegicus
gactacagtcaattactggagggat

SEQ ID NO: 325432 - DNA, 25 bp, Rattus norvegicus
gactacagtcagctccgagggacat

SEQ ID NO: 325433 - DNA, 25 bp, Rattus norvegicus
gactacagtcaggtccgagggacat

SEQ ID NO: 325434 - DNA, 25 bp, Rattus norvegicus
gactacagtgacaggtgaccacaat

SEQ ID NO: 325435 - DNA, 25 bp, Rattus norvegicus
gactacagtgactggtgaccacaat

SEQ ID NO: 325436 - DNA, 25 bp, Rattus norvegicus
gactacagtttgctacagtgggtat

SEQ ID NO: 325437 - DNA, 25 bp, Rattus norvegicus
gactacagtttggtacagtgggtat

SEQ ID NO: 325438 - DNA, 25 bp, Rattus norvegicus
gactacataagtatcactaggccat

SEQ ID NO: 325439 - DNA, 25 bp, Rattus norvegicus
gactacataagtttcactaggccat

SEQ ID NO: 325440 - DNA, 25 bp, Rattus norvegicus
gactacatagggagactcagtctca

SEQ ID NO: 325441 - DNA, 25 bp, Rattus norvegicus
gactacatagggtgactcagtctca

SEQ ID NO: 325442 - DNA, 25 bp, Rattus norvegicus
gactacatcagaattatattggtgc

SEQ ID NO: 325443 - DNA, 25 bp, Rattus norvegicus
gactacatcagatttatattggtgc

SEQ ID NO: 325444 - DNA, 25 bp, Rattus norvegicus
gactacatccatcaacggctgcaga

SEQ ID NO: 325445 - DNA, 25 bp, Rattus norvegicus
gactacatccatgaacggctgcaga

SEQ ID NO: 325446 - DNA, 25 bp, Rattus norvegicus
gactacatcccactcttcatgagga

SEQ ID NO: 325447 - DNA, 25 bp, Rattus norvegicus
gactacatcccagtcttcatgagga

SEQ ID NO: 325448 - DNA, 25 bp, Rattus norvegicus
gactacatcgagcagacgctggtca

SEQ ID NO: 325449 - DNA, 25 bp, Rattus norvegicus
gactacatcgaggagacgctggtca

SEQ ID NO: 325450 - DNA, 25 bp, Rattus norvegicus
gactacatgaatacctgcactccta

SEQ ID NO: 325451 - DNA, 25 bp, Rattus norvegicus
gactacatgaattcctgcactccta

SEQ ID NO: 325452 - DNA, 25 bp, Rattus norvegicus
gactacatgagacctttctccaaaa

SEQ ID NO: 325453 - DNA, 25 bp, Rattus norvegicus
gactacatgagagctttctccaaaa

SEQ ID NO: 325454 - DNA, 25 bp, Rattus norvegicus
gactacatgagccaccgggtccagt

SEQ ID NO: 325455 - DNA, 25 bp, Rattus norvegicus
gactacatgagcgaccgggtccagt

SEQ ID NO: 325456 - DNA, 25 bp, Rattus norvegicus
gactacatgccaaagcctgtgaaca

SEQ ID NO: 325457 - DNA, 25 bp, Rattus norvegicus
gactacatgccatagcctgtgaaca

SEQ ID NO: 325458 - DNA, 25 bp, Rattus norvegicus
gactacatgcccatcgctgtgctga

SEQ ID NO: 325459 - DNA, 25 bp, Rattus norvegicus
gactacatgcccttcgctgtgctga

SEQ ID NO: 325460 - DNA, 25 bp, Rattus norvegicus
gactacatgcttctgtgtgcaggta

SEQ ID NO: 325461 - DNA, 25 bp, Rattus norvegicus
gactacatgcttgtgtgtgcaggta

SEQ ID NO: 325462 - DNA, 25 bp, Rattus norvegicus
gactacatgtgactacacacataac

SEQ ID NO: 325463 - DNA, 25 bp, Rattus norvegicus
gactacatgtgagtacacacataac

SEQ ID NO: 325464 - DNA, 25 bp, Rattus norvegicus
gactacattacaacgggccaggaag

SEQ ID NO: 325465 - DNA, 25 bp, Rattus norvegicus
gactacattacatcgggccaggaag

SEQ ID NO: 325466 - DNA, 25 bp, Rattus norvegicus
gactacattccaaagtgtcctgact

SEQ ID NO: 325467 - DNA, 25 bp, Rattus norvegicus
gactacattccatagtgtcctgact

SEQ ID NO: 325468 - DNA, 25 bp, Rattus norvegicus
gactacattggaagctgagttgact

SEQ ID NO: 325469 - DNA, 25 bp, Rattus norvegicus
gactacattggatgctgagttgact

SEQ ID NO: 325470 - DNA, 25 bp, Rattus norvegicus
gactacatttaacgtccattctgtg

SEQ ID NO: 325471 - DNA, 25 bp, Rattus norvegicus
gactacatttaaggtccattctgtg

SEQ ID NO: 325472 - DNA, 25 bp, Rattus norvegicus
gactacatttgaatatccagatgtt

SEQ ID NO: 325473 - DNA, 25 bp, Rattus norvegicus
gactacatttgattatccagatgtt

SEQ ID NO: 325474 - DNA, 25 bp, Rattus norvegicus
gactaccaacccaaagatcagaatt

SEQ ID NO: 325475 - DNA, 25 bp, Rattus norvegicus
gactaccaaccctaagatcagaatt

SEQ ID NO: 325476 - DNA, 25 bp, Rattus norvegicus
gactaccaagacaacaaggctgacg

SEQ ID NO: 325477 - DNA, 25 bp, Rattus norvegicus
gactaccaagactacaaggctgacg

SEQ ID NO: 325478 - DNA, 25 bp, Rattus norvegicus
gactaccaatgtacaagttgcactg

SEQ ID NO: 325479 - DNA, 25 bp, Rattus norvegicus
gactaccaatgttcaagttgcactg

SEQ ID NO: 325480 - DNA, 25 bp, Rattus norvegicus
gactaccaccctaggcattgtctta

SEQ ID NO: 325481 - DNA, 25 bp, Rattus norvegicus
gactaccacccttggcattgtctta

SEQ ID NO: 325482 - DNA, 25 bp, Rattus norvegicus
gactaccacctgaggattactggaa

SEQ ID NO: 325483 - DNA, 25 bp, Rattus norvegicus
gactaccacctgtggattactggaa

SEQ ID NO: 325484 - DNA, 25 bp, Rattus norvegicus
gactaccacttaattctaactcttc

SEQ ID NO: 325485 - DNA, 25 bp, Rattus norvegicus
gactaccacttatttctaactcttc

SEQ ID NO: 325486 - DNA, 25 bp, Rattus norvegicus
gactacccagaacatctagagatca

SEQ ID NO: 325487 - DNA, 25 bp, Rattus norvegicus
gactacccagaagatctagagatca

SEQ ID NO: 325488 - DNA, 25 bp, Rattus norvegicus
gactacccagagatcaggttccagg

SEQ ID NO: 325489 - DNA, 25 bp, Rattus norvegicus
gactacccagagttcaggttccagg

SEQ ID NO: 325490 - DNA, 25 bp, Rattus norvegicus
gactaccccgtaagaggccagacag

SEQ ID NO: 325491 - DNA, 25 bp, Rattus norvegicus
gactaccccgtatgaggccagacag

SEQ ID NO: 325492 - DNA, 25 bp, Rattus norvegicus
gactacccctaaactgggcgatggt

SEQ ID NO: 325493 - DNA, 25 bp, Rattus norvegicus
gactacccctaatctgggcgatggt

SEQ ID NO: 325494 - DNA, 25 bp, Rattus norvegicus
gactaccgggcgctctatgactaca

SEQ ID NO: 325495 - DNA, 25 bp, Rattus norvegicus
gactaccgggcggtctatgactaca

SEQ ID NO: 325496 - DNA, 25 bp, Rattus norvegicus
gactaccgtaagcaccaggcaagaa

SEQ ID NO: 325497 - DNA, 25 bp, Rattus norvegicus
gactaccgtaaggaccaggcaagaa

SEQ ID NO: 325498 - DNA, 25 bp, Rattus norvegicus
gactacctacccctgggcagatgaa

SEQ ID NO: 325499 - DNA, 25 bp, Rattus norvegicus
gactacctacccgtgggcagatgaa

SEQ ID NO: 325500 - DNA, 25 bp, Rattus norvegicus
gactacctaggactctttcatgtga

SEQ ID NO: 325501 - DNA, 25 bp, Rattus norvegicus
gactacctaggagtctttcatgtga

SEQ ID NO: 325502 - DNA, 25 bp, Rattus norvegicus
gactacctagtcatggcagagcaga

SEQ ID NO: 325503 - DNA, 25 bp, Rattus norvegicus
gactacctagtcttggcagagcaga

SEQ ID NO: 325504 - DNA, 25 bp, Rattus norvegicus
gactacctagtgagaccagggctaa

SEQ ID NO: 325505 - DNA, 25 bp, Rattus norvegicus
gactacctagtgtgaccagggctaa

SEQ ID NO: 325506 - DNA, 25 bp, Rattus norvegicus
gactacctcagtctatatcatacca

SEQ ID NO: 325507 - DNA, 25 bp, Rattus norvegicus
gactacctcagtgtatatcatacca

SEQ ID NO: 325508 - DNA, 25 bp, Rattus norvegicus
gactacctctggagcctggtggaca

SEQ ID NO: 325509 - DNA, 25 bp, Rattus norvegicus
gactacctctggtgcctggtggaca

SEQ ID NO: 325510 - DNA, 25 bp, Rattus norvegicus
gactacctgaccaatgccataattg

SEQ ID NO: 325511 - DNA, 25 bp, Rattus norvegicus
gactacctgacctatgccataattg

SEQ ID NO: 325512 - DNA, 25 bp, Rattus norvegicus
gactacctgagaaatcgctttgtgt

SEQ ID NO: 325513 - DNA, 25 bp, Rattus norvegicus
gactacctgagatatcgctttgtgt

SEQ ID NO: 325514 - DNA, 25 bp, Rattus norvegicus
gactaccttcccaaacaaagagctg

SEQ ID NO: 325515 - DNA, 25 bp, Rattus norvegicus
gactaccttccctaacaaagagctg

SEQ ID NO: 325516 - DNA, 25 bp, Rattus norvegicus
gactaccttcttcaagcggcgacag

SEQ ID NO: 325517 - DNA, 25 bp, Rattus norvegicus
gactaccttcttgaagcggcgacag

SEQ ID NO: 325518 - DNA, 25 bp, Rattus norvegicus
gactaccttgcacaggacgcctact

SEQ ID NO: 325519 - DNA, 25 bp, Rattus norvegicus
gactaccttgcagaggacgcctact

SEQ ID NO: 325520 - DNA, 25 bp, Rattus norvegicus
gactacgaccagattgccatggtat

SEQ ID NO: 325521 - DNA, 25 bp, Rattus norvegicus
gactacgaccagtttgccatggtat

SEQ ID NO: 325522 - DNA, 25 bp, Rattus norvegicus
gactacgaggtgatttctgactgtg

SEQ ID NO: 325523 - DNA, 25 bp, Rattus norvegicus
gactacgaggtgttttctgactgtg

SEQ ID NO: 325524 - DNA, 25 bp, Rattus norvegicus
gactacgatgagaacgcgttcctgt

SEQ ID NO: 325525 - DNA, 25 bp, Rattus norvegicus
gactacgatgagtacgcgttcctgt

SEQ ID NO: 325526 - DNA, 25 bp, Rattus norvegicus
gactacgccattcgccagagtcaga

SEQ ID NO: 325527 - DNA, 25 bp, Rattus norvegicus
gactacgccattggccagagtcaga

SEQ ID NO: 325528 - DNA, 25 bp, Rattus norvegicus
gactacgcccgtctgaagactccga

SEQ ID NO: 325529 - DNA, 25 bp, Rattus norvegicus
gactacgcccgtgtgaagactccga

SEQ ID NO: 325530 - DNA, 25 bp, Rattus norvegicus
gactacgggtcaatcatgttatcaa

SEQ ID NO: 325531 - DNA, 25 bp, Rattus norvegicus
gactacgggtcattcatgttatcaa

SEQ ID NO: 325532 - DNA, 25 bp, Rattus norvegicus
gactacggtgctacttgggaattgg

SEQ ID NO: 325533 - DNA, 25 bp, Rattus norvegicus
gactacggtgcttcttgggaattgg

SEQ ID NO: 325534 - DNA, 25 bp, Rattus norvegicus
gactacgtgatactcttacaaatga

SEQ ID NO: 325535 - DNA, 25 bp, Rattus norvegicus
gactacgtgatagtcttacaaatga

SEQ ID NO: 325536 - DNA, 25 bp, Rattus norvegicus
gactactaagatctcttcatttcat

SEQ ID NO: 325537 - DNA, 25 bp, Rattus norvegicus
gactactaagatgtcttcatttcat

SEQ ID NO: 325538 - DNA, 25 bp, Rattus norvegicus
gactactaaggccttctgtgtaatt

SEQ ID NO: 325539 - DNA, 25 bp, Rattus norvegicus
gactactaaggcgttctgtgtaatt

SEQ ID NO: 325540 - DNA, 25 bp, Rattus norvegicus
gactactacctgattgatttacctg

SEQ ID NO: 325541 - DNA, 25 bp, Rattus norvegicus
gactactacctgcatgactgagccc

SEQ ID NO: 325542 - DNA, 25 bp, Rattus norvegicus
gactactacctggatgactgagccc

SEQ ID NO: 325543 - DNA, 25 bp, Rattus norvegicus
gactactacctgtttgatttacctg

SEQ ID NO: 325544 - DNA, 25 bp, Rattus norvegicus
gactactacgagcatctgacaccca

SEQ ID NO: 325545 - DNA, 25 bp, Rattus norvegicus
gactactacgaggatctgacaccca

SEQ ID NO: 325546 - DNA, 25 bp, Rattus norvegicus
gactactacgtgctcaactatgatg

SEQ ID NO: 325547 - DNA, 25 bp, Rattus norvegicus
gactactacgtggtcaactatgatg

SEQ ID NO: 325548 - DNA, 25 bp, Rattus norvegicus
gactactacgttcagatgtgcaagg

SEQ ID NO: 325549 - DNA, 25 bp, Rattus norvegicus
gactactacgttgagatgtgcaagg

SEQ ID NO: 325550 - DNA, 25 bp, Rattus norvegicus
gactactactatattcttctcataa

SEQ ID NO: 325551 - DNA, 25 bp, Rattus norvegicus
gactactactattttcttctcataa

SEQ ID NO: 325552 - DNA, 25 bp, Rattus norvegicus
gactactactcccttaaaggagctg

SEQ ID NO: 325553 - DNA, 25 bp, Rattus norvegicus
gactactactccgttaaaggagctg

SEQ ID NO: 325554 - DNA, 25 bp, Rattus norvegicus
gactactagctgacatcacaggctt

SEQ ID NO: 325555 - DNA, 25 bp, Rattus norvegicus
gactactagctgtcatcacaggctt

SEQ ID NO: 325556 - DNA, 25 bp, Rattus norvegicus
gactactaggtcatcgcggagcagg

SEQ ID NO: 325557 - DNA, 25 bp, Rattus norvegicus
gactactaggtcttcgcggagcagg

SEQ ID NO: 325558 - DNA, 25 bp, Rattus norvegicus
gactactatgttctggacgacgctg

SEQ ID NO: 325559 - DNA, 25 bp, Rattus norvegicus
gactactatgttgtggacgacgctg

SEQ ID NO: 325560 - DNA, 25 bp, Rattus norvegicus
gactactcaataagacgactcctca

SEQ ID NO: 325561 - DNA, 25 bp, Rattus norvegicus
gactactcaatatgacgactcctca

SEQ ID NO: 325562 - DNA, 25 bp, Rattus norvegicus
gactactccgagcatcctagcggag

SEQ ID NO: 325563 - DNA, 25 bp, Rattus norvegicus
gactactccgaggatcctagcggag

SEQ ID NO: 325564 - DNA, 25 bp, Rattus norvegicus
gactactctctaaatgttaccagga

SEQ ID NO: 325565 - DNA, 25 bp, Rattus norvegicus
gactactctctatatgttaccagga

SEQ ID NO: 325566 - DNA, 25 bp, Rattus norvegicus
gactactctgtcactcagacaacac

SEQ ID NO: 325567 - DNA, 25 bp, Rattus norvegicus
gactactctgtctctcagacaacac

SEQ ID NO: 325568 - DNA, 25 bp, Rattus norvegicus
gactactgagcaccaccagcaactg

SEQ ID NO: 325569 - DNA, 25 bp, Rattus norvegicus
gactactgagcagcaccagcaactg

SEQ ID NO: 325570 - DNA, 25 bp, Rattus norvegicus
gactactgaggacgatcgtccgtgt

SEQ ID NO: 325571 - DNA, 25 bp, Rattus norvegicus
gactactgaggaggatcgtccgtgt

SEQ ID NO: 325572 - DNA, 25 bp, Rattus norvegicus
gactactgagtaacacttatcgtga

SEQ ID NO: 325573 - DNA, 25 bp, Rattus norvegicus
gactactgagtatcacttatcgtga

SEQ ID NO: 325574 - DNA, 25 bp, Rattus norvegicus
gactactgcgcaatagttgcaacac

SEQ ID NO: 325575 - DNA, 25 bp, Rattus norvegicus
gactactgcgcattagttgcaacac

SEQ ID NO: 325576 - DNA, 25 bp, Rattus norvegicus
gactactggagtacagagcacatga

SEQ ID NO: 325577 - DNA, 25 bp, Rattus norvegicus
gactactggagttcagagcacatga

SEQ ID NO: 325578 - DNA, 25 bp, Rattus norvegicus
gactactgggacacctcagaaagga

SEQ ID NO: 325579 - DNA, 25 bp, Rattus norvegicus
gactactgggactcctcagaaagga

SEQ ID NO: 325580 - DNA, 25 bp, Rattus norvegicus
gactactgggttagtaatgatacac

SEQ ID NO: 325581 - DNA, 25 bp, Rattus norvegicus
gactactgggtttgtaatgatacac

SEQ ID NO: 325582 - DNA, 25 bp, Rattus norvegicus
gactactgtaaaagcgccaccggaa

SEQ ID NO: 325583 - DNA, 25 bp, Rattus norvegicus
gactactgtaaatgcgccaccggaa

SEQ ID NO: 325584 - DNA, 25 bp, Rattus norvegicus
gactactgtagccatctaacacatt

SEQ ID NO: 325585 - DNA, 25 bp, Rattus norvegicus
gactactgtagcgatctaacacatt

SEQ ID NO: 325586 - DNA, 25 bp, Rattus norvegicus
gactactgtggtcccagaggtaact

SEQ ID NO: 325587 - DNA, 25 bp, Rattus norvegicus
gactactgtggtgccagaggtaact

SEQ ID NO: 325588 - DNA, 25 bp, Rattus norvegicus
gactactgtgtccttgtcgtggaca

SEQ ID NO: 325589 - DNA, 25 bp, Rattus norvegicus
gactactgtgtcgttgtcgtggaca

SEQ ID NO: 325590 - DNA, 25 bp, Rattus norvegicus
gactactgtttaattgtgcttttta

SEQ ID NO: 325591 - DNA, 25 bp, Rattus norvegicus
gactactgtttatttgtgcttttta

SEQ ID NO: 325592 - DNA, 25 bp, Rattus norvegicus
gactacttactcctgatccacggat

SEQ ID NO: 325593 - DNA, 25 bp, Rattus norvegicus
gactacttactcgtgatccacggat

SEQ ID NO: 325594 - DNA, 25 bp, Rattus norvegicus
gactacttattgagcatctcctgca

SEQ ID NO: 325595 - DNA, 25 bp, Rattus norvegicus
gactacttattgtgcatctcctgca

SEQ ID NO: 325596 - DNA, 25 bp, Rattus norvegicus
gactacttcaacagacatgccgtgg

SEQ ID NO: 325597 - DNA, 25 bp, Rattus norvegicus
gactacttcaactgacatgccgtgg

SEQ ID NO: 325598 - DNA, 25 bp, Rattus norvegicus
gactacttcaatcacttcgccaaaa

SEQ ID NO: 325599 - DNA, 25 bp, Rattus norvegicus
gactacttcaatgacttcgccaaaa

SEQ ID NO: 325600 - DNA, 25 bp, Rattus norvegicus
gactacttgcagaatttacggctgg

SEQ ID NO: 325601 - DNA, 25 bp, Rattus norvegicus
gactacttgcagtatttacggctgg

SEQ ID NO: 325602 - DNA, 25 bp, Rattus norvegicus
gactacttggtgactgatcctgaac

SEQ ID NO: 325603 - DNA, 25 bp, Rattus norvegicus
gactacttggtgtctgatcctgaac

SEQ ID NO: 325604 - DNA, 25 bp, Rattus norvegicus
gactactttaaacactgagctccag

SEQ ID NO: 325605 - DNA, 25 bp, Rattus norvegicus
gactactttaaagactgagctccag

SEQ ID NO: 325606 - DNA, 25 bp, Rattus norvegicus
gactactttgggattccagcgtata

SEQ ID NO: 325607 - DNA, 25 bp, Rattus norvegicus
gactactttgggtttccagcgtata

SEQ ID NO: 325608 - DNA, 25 bp, Rattus norvegicus
gactactttgtgatttactcccatg

SEQ ID NO: 325609 - DNA, 25 bp, Rattus norvegicus
gactactttgtgttttactcccatg

SEQ ID NO: 325610 - DNA, 25 bp, Rattus norvegicus
gactacttttgaactctacccaatc

SEQ ID NO: 325611 - DNA, 25 bp, Rattus norvegicus
gactacttttgatctctacccaatc

SEQ ID NO: 325612 - DNA, 25 bp, Rattus norvegicus
gactacttttgtacttgatactgtt

SEQ ID NO: 325613 - DNA, 25 bp, Rattus norvegicus
gactacttttgttcttgatactgtt

SEQ ID NO: 325614 - DNA, 25 bp, Rattus norvegicus
gactagaaagaaacgcccaggtctc

SEQ ID NO: 325615 - DNA, 25 bp, Rattus norvegicus
gactagaaagaatcgcccaggtctc

SEQ ID NO: 325616 - DNA, 25 bp, Rattus norvegicus
gactagaacattatttatcccaccc

SEQ ID NO: 325617 - DNA, 25 bp, Rattus norvegicus
gactagaacattttttatcccaccc

SEQ ID NO: 325618 - DNA, 25 bp, Rattus norvegicus
gactagaagcatcctacgattgtgt

SEQ ID NO: 325619 - DNA, 25 bp, Rattus norvegicus
gactagaagcatgctacgattgtgt

SEQ ID NO: 325620 - DNA, 25 bp, Rattus norvegicus
gactagaattgtacagagccagaga

SEQ ID NO: 325621 - DNA, 25 bp, Rattus norvegicus
gactagaattgttcagagccagaga

SEQ ID NO: 325622 - DNA, 25 bp, Rattus norvegicus
gactagacgtcccaggactgaccat

SEQ ID NO: 325623 - DNA, 25 bp, Rattus norvegicus
gactagacgtccgaggactgaccat

SEQ ID NO: 325624 - DNA, 25 bp, Rattus norvegicus
gactagactagaccacactcacctg

SEQ ID NO: 325625 - DNA, 25 bp, Rattus norvegicus
gactagactagagcacactcacctg

SEQ ID NO: 325626 - DNA, 25 bp, Rattus norvegicus
gactagacttttaacctcaggagac

SEQ ID NO: 325627 - DNA, 25 bp, Rattus norvegicus
gactagactttttacctcaggagac

SEQ ID NO: 325628 - DNA, 25 bp, Rattus norvegicus
gactagagcatccacgttgcatgtg

SEQ ID NO: 325629 - DNA, 25 bp, Rattus norvegicus
gactagagcatcgacgttgcatgtg

SEQ ID NO: 325630 - DNA, 25 bp, Rattus norvegicus
gactagagccaaagcatcagaatat

SEQ ID NO: 325631 - DNA, 25 bp, Rattus norvegicus
gactagagccaatgcatcagaatat

SEQ ID NO: 325632 - DNA, 25 bp, Rattus norvegicus
gactagaggatcagggtacagccct

SEQ ID NO: 325633 - DNA, 25 bp, Rattus norvegicus
gactagaggatctgggtacagccct

SEQ ID NO: 325634 - DNA, 25 bp, Rattus norvegicus
gactagaggccacttttgaaccctg

SEQ ID NO: 325635 - DNA, 25 bp, Rattus norvegicus
gactagaggccagttttgaaccctg

SEQ ID NO: 325636 - DNA, 25 bp, Rattus norvegicus
gactagagggaacacaacagacatt

SEQ ID NO: 325637 - DNA, 25 bp, Rattus norvegicus
gactagagggaagacaacagacatt

SEQ ID NO: 325638 - DNA, 25 bp, Rattus norvegicus
gactagagtaagagatcttttcatt

SEQ ID NO: 325639 - DNA, 25 bp, Rattus norvegicus
gactagagtaagtgatcttttcatt

SEQ ID NO: 325640 - DNA, 25 bp, Rattus norvegicus
gactagagtcccactgtcaaaatgt

SEQ ID NO: 325641 - DNA, 25 bp, Rattus norvegicus
gactagagtccctctgtcaaaatgt

SEQ ID NO: 325642 - DNA, 25 bp, Rattus norvegicus
gactagatacctctcttaacttctg

SEQ ID NO: 325643 - DNA, 25 bp, Rattus norvegicus
gactagatacctgtcttaacttctg

SEQ ID NO: 325644 - DNA, 25 bp, Rattus norvegicus
gactagatggctatgttaactgact

SEQ ID NO: 325645 - DNA, 25 bp, Rattus norvegicus
gactagatggctttgttaactgact

SEQ ID NO: 325646 - DNA, 25 bp, Rattus norvegicus
gactagattggccttaaactcatag

SEQ ID NO: 325647 - DNA, 25 bp, Rattus norvegicus
gactagattggcgttaaactcatag

SEQ ID NO: 325648 - DNA, 25 bp, Rattus norvegicus
gactagcaaacaacttccctgagga

SEQ ID NO: 325649 - DNA, 25 bp, Rattus norvegicus
gactagcaaacatcttccctgagga

SEQ ID NO: 325650 - DNA, 25 bp, Rattus norvegicus
gactagcacatgcagtaacctttat

SEQ ID NO: 325651 - DNA, 25 bp, Rattus norvegicus
gactagcacatggagtaacctttat

SEQ ID NO: 325652 - DNA, 25 bp, Rattus norvegicus
gactagcacctgagtgccgacataa

SEQ ID NO: 325653 - DNA, 25 bp, Rattus norvegicus
gactagcacctgtgtgccgacataa

SEQ ID NO: 325654 - DNA, 25 bp, Rattus norvegicus
gactagcagagcaggcctctaaatc

SEQ ID NO: 325655 - DNA, 25 bp, Rattus norvegicus
gactagcagagctggcctctaaatc

SEQ ID NO: 325656 - DNA, 25 bp, Rattus norvegicus
gactagcaggtgacactgtgacaat

SEQ ID NO: 325657 - DNA, 25 bp, Rattus norvegicus
gactagcaggtgtcactgtgacaat

SEQ ID NO: 325658 - DNA, 25 bp, Rattus norvegicus
gactagcagtgcagtcccagtaaag

SEQ ID NO: 325659 - DNA, 25 bp, Rattus norvegicus
gactagcagtgctgtcccagtaaag

SEQ ID NO: 325660 - DNA, 25 bp, Rattus norvegicus
gactagcatgctaacggccgcctgt

SEQ ID NO: 325661 - DNA, 25 bp, Rattus norvegicus
gactagcatgcttacggccgcctgt

SEQ ID NO: 325662 - DNA, 25 bp, Rattus norvegicus
gactagcattttacaaagtgttctg

SEQ ID NO: 325663 - DNA, 25 bp, Rattus norvegicus
gactagcatttttcaaagtgttctg

SEQ ID NO: 325664 - DNA, 25 bp, Rattus norvegicus
gactagccagaaatctaccctggaa

SEQ ID NO: 325665 - DNA, 25 bp, Rattus norvegicus
gactagccagaattctaccctggaa

SEQ ID NO: 325666 - DNA, 25 bp, Rattus norvegicus
gactagccctttccggtccttggtg

SEQ ID NO: 325667 - DNA, 25 bp, Rattus norvegicus
gactagccctttgcggtccttggtg

SEQ ID NO: 325668 - DNA, 25 bp, Rattus norvegicus
gactagcctccgatcaggaagtagt

SEQ ID NO: 325669 - DNA, 25 bp, Rattus norvegicus
gactagcctccgttcaggaagtagt

SEQ ID NO: 325670 - DNA, 25 bp, Rattus norvegicus
gactagccttttctgggttgggtct

SEQ ID NO: 325671 - DNA, 25 bp, Rattus norvegicus
gactagccttttgtgggttgggtct

SEQ ID NO: 325672 - DNA, 25 bp, Rattus norvegicus
gactagcgacagatctccacaggag

SEQ ID NO: 325673 - DNA, 25 bp, Rattus norvegicus
gactagcgacagttctccacaggag

SEQ ID NO: 325674 - DNA, 25 bp, Rattus norvegicus
gactagctaaatagtccttcctggg

SEQ ID NO: 325675 - DNA, 25 bp, Rattus norvegicus
gactagctaaattgtccttcctggg

SEQ ID NO: 325676 - DNA, 25 bp, Rattus norvegicus
gactagctatgacaggacacccagg

SEQ ID NO: 325677 - DNA, 25 bp, Rattus norvegicus
gactagctatgagaggacacccagg

SEQ ID NO: 325678 - DNA, 25 bp, Rattus norvegicus
gactagctgctgagttgttcggagc

SEQ ID NO: 325679 - DNA, 25 bp, Rattus norvegicus
gactagctgctgtgttgttcggagc

SEQ ID NO: 325680 - DNA, 25 bp, Rattus norvegicus
gactagctgcttatagaatttcctg

SEQ ID NO: 325681 - DNA, 25 bp, Rattus norvegicus
gactagctgcttttagaatttcctg

SEQ ID NO: 325682 - DNA, 25 bp, Rattus norvegicus
gactagctgtcaatgtttatcctgt

SEQ ID NO: 325683 - DNA, 25 bp, Rattus norvegicus
gactagctgtcattgtttatcctgt

SEQ ID NO: 325684 - DNA, 25 bp, Rattus norvegicus
gactagcttaaacttgctgtctgtc

SEQ ID NO: 325685 - DNA, 25 bp, Rattus norvegicus
gactagcttaaagttgctgtctgtc

SEQ ID NO: 325686 - DNA, 25 bp, Rattus norvegicus
gactaggaactcagggttttctcct

SEQ ID NO: 325687 - DNA, 25 bp, Rattus norvegicus
gactaggaactctgggttttctcct

SEQ ID NO: 325688 - DNA, 25 bp, Rattus norvegicus
gactaggacttaaaaggcctgtata

SEQ ID NO: 325689 - DNA, 25 bp, Rattus norvegicus
gactaggacttataaggcctgtata

SEQ ID NO: 325690 - DNA, 25 bp, Rattus norvegicus
gactaggagcaaactcagggtccgg

SEQ ID NO: 325691 - DNA, 25 bp, Rattus norvegicus
gactaggagcaatctcagggtccgg

SEQ ID NO: 325692 - DNA, 25 bp, Rattus norvegicus
gactaggagggcacttgtcttccac

SEQ ID NO: 325693 - DNA, 25 bp, Rattus norvegicus
gactaggagggctcttgtcttccac

SEQ ID NO: 325694 - DNA, 25 bp, Rattus norvegicus
gactaggcaaacacactgctgctgg

SEQ ID NO: 325695 - DNA, 25 bp, Rattus norvegicus
gactaggcaaactcactgctgctgg

SEQ ID NO: 325696 - DNA, 25 bp, Rattus norvegicus
gactaggcaactaaatggtatcttg

SEQ ID NO: 325697 - DNA, 25 bp, Rattus norvegicus
gactaggcaacttaatggtatcttg

SEQ ID NO: 325698 - DNA, 25 bp, Rattus norvegicus
gactaggccagaagttcccaaatgt

SEQ ID NO: 325699 - DNA, 25 bp, Rattus norvegicus
gactaggccagatgttcccaaatgt

SEQ ID NO: 325700 - DNA, 25 bp, Rattus norvegicus
gactaggccctcagtttagagctga

SEQ ID NO: 325701 - DNA, 25 bp, Rattus norvegicus
gactaggccctctgtttagagctga

SEQ ID NO: 325702 - DNA, 25 bp, Rattus norvegicus
gactaggcctaactttgtttcccag

SEQ ID NO: 325703 - DNA, 25 bp, Rattus norvegicus
gactaggcctaagtttgtttcccag

SEQ ID NO: 325704 - DNA, 25 bp, Rattus norvegicus
gactaggctatccagggtccttgat

SEQ ID NO: 325705 - DNA, 25 bp, Rattus norvegicus
gactaggctatcgagggtccttgat

SEQ ID NO: 325706 - DNA, 25 bp, Rattus norvegicus
gactaggctggcattatttctaagt

SEQ ID NO: 325707 - DNA, 25 bp, Rattus norvegicus
gactaggctggctttatttctaagt

SEQ ID NO: 325708 - DNA, 25 bp, Rattus norvegicus
gactaggcttctatgaggttggcag

SEQ ID NO: 325709 - DNA, 25 bp, Rattus norvegicus
gactaggcttctttgaggttggcag

SEQ ID NO: 325710 - DNA, 25 bp, Rattus norvegicus
gactaggcttgcatacagggcttct

SEQ ID NO: 325711 - DNA, 25 bp, Rattus norvegicus
gactaggcttgcttacagggcttct

SEQ ID NO: 325712 - DNA, 25 bp, Rattus norvegicus
gactagggaaaaaatggcccgaagt

SEQ ID NO: 325713 - DNA, 25 bp, Rattus norvegicus
gactagggaaaatatggcccgaagt

SEQ ID NO: 325714 - DNA, 25 bp, Rattus norvegicus
gactagggcaagaacgcctcacact

SEQ ID NO: 325715 - DNA, 25 bp, Rattus norvegicus
gactagggcaagtacgcctcacact

SEQ ID NO: 325716 - DNA, 25 bp, Rattus norvegicus
gactagggcacaaggtcttgcgctt

SEQ ID NO: 325717 - DNA, 25 bp, Rattus norvegicus
gactagggcacatggtcttgcgctt

SEQ ID NO: 325718 - DNA, 25 bp, Rattus norvegicus
gactagggcttgagtctctgctcac

SEQ ID NO: 325719 - DNA, 25 bp, Rattus norvegicus
gactagggcttgtgtctctgctcac

SEQ ID NO: 325720 - DNA, 25 bp, Rattus norvegicus
gactaggtaatgctgatccccacag

SEQ ID NO: 325721 - DNA, 25 bp, Rattus norvegicus
gactaggtaatggtgatccccacag

SEQ ID NO: 325722 - DNA, 25 bp, Rattus norvegicus
gactaggtactaacactttctcatt

SEQ ID NO: 325723 - DNA, 25 bp, Rattus norvegicus
gactaggtactatcactttctcatt

SEQ ID NO: 325724 - DNA, 25 bp, Rattus norvegicus
gactaggtatcacggtttcttttgc

SEQ ID NO: 325725 - DNA, 25 bp, Rattus norvegicus
gactaggtatcagggtttcttttgc

SEQ ID NO: 325726 - DNA, 25 bp, Rattus norvegicus
gactaggtcagaattttacttctct

SEQ ID NO: 325727 - DNA, 25 bp, Rattus norvegicus
gactaggtcagatttttacttctct

SEQ ID NO: 325728 - DNA, 25 bp, Rattus norvegicus
gactaggtctacactcatcataaca

SEQ ID NO: 325729 - DNA, 25 bp, Rattus norvegicus
gactaggtctactctcatcataaca

SEQ ID NO: 325730 - DNA, 25 bp, Rattus norvegicus
gactaggttaaaactggtgccactc

SEQ ID NO: 325731 - DNA, 25 bp, Rattus norvegicus
gactaggttaaatctggtgccactc

SEQ ID NO: 325732 - DNA, 25 bp, Rattus norvegicus
gactagtaaacaatgacctcccgtt

SEQ ID NO: 325733 - DNA, 25 bp, Rattus norvegicus
gactagtaaacattgacctcccgtt

SEQ ID NO: 325734 - DNA, 25 bp, Rattus norvegicus
gactagtaacttctccgggacctct

SEQ ID NO: 325735 - DNA, 25 bp, Rattus norvegicus
gactagtaacttgtccgggacctct

SEQ ID NO: 325736 - DNA, 25 bp, Rattus norvegicus
gactagtactctataatcctgccat

SEQ ID NO: 325737 - DNA, 25 bp, Rattus norvegicus
gactagtactctttaatcctgccat

SEQ ID NO: 325738 - DNA, 25 bp, Rattus norvegicus
gactagtaggataattctcgtgccg

SEQ ID NO: 325739 - DNA, 25 bp, Rattus norvegicus
gactagtaggattattctcgtgccg

SEQ ID NO: 325740 - DNA, 25 bp, Rattus norvegicus
gactagtatctgaattgcttatcgt

SEQ ID NO: 325741 - DNA, 25 bp, Rattus norvegicus
gactagtatctgtattgcttatcgt

SEQ ID NO: 325742 - DNA, 25 bp, Rattus norvegicus
gactagtatgtcacttagctatgct

SEQ ID NO: 325743 - DNA, 25 bp, Rattus norvegicus
gactagtatgtctcttagctatgct

SEQ ID NO: 325744 - DNA, 25 bp, Rattus norvegicus
gactagtcaaacagcctgcaagttg

SEQ ID NO: 325745 - DNA, 25 bp, Rattus norvegicus
gactagtcaaactgcctgcaagttg

SEQ ID NO: 325746 - DNA, 25 bp, Rattus norvegicus
gactagtcaagtattggtgcactga

SEQ ID NO: 325747 - DNA, 25 bp, Rattus norvegicus
gactagtcaagttttggtgcactga

SEQ ID NO: 325748 - DNA, 25 bp, Rattus norvegicus
gactagtcacttaacctctttggga

SEQ ID NO: 325749 - DNA, 25 bp, Rattus norvegicus
gactagtcactttacctctttggga

SEQ ID NO: 325750 - DNA, 25 bp, Rattus norvegicus
gactagtcataacctactgtgttaa

SEQ ID NO: 325751 - DNA, 25 bp, Rattus norvegicus
gactagtcataagctactgtgttaa

SEQ ID NO: 325752 - DNA, 25 bp, Rattus norvegicus
gactagtccagaccccagcaaatgg

SEQ ID NO: 325753 - DNA, 25 bp, Rattus norvegicus
gactagtccagagcccagcaaatgg

SEQ ID NO: 325754 - DNA, 25 bp, Rattus norvegicus
gactagtccttgcatgagttaccag

SEQ ID NO: 325755 - DNA, 25 bp, Rattus norvegicus
gactagtccttggatgagttaccag

SEQ ID NO: 325756 - DNA, 25 bp, Rattus norvegicus
gactagtctacaactttacggacct

SEQ ID NO: 325757 - DNA, 25 bp, Rattus norvegicus
gactagtctacatctttacggacct

SEQ ID NO: 325758 - DNA, 25 bp, Rattus norvegicus
gactagtcttaacatctactttttt

SEQ ID NO: 325759 - DNA, 25 bp, Rattus norvegicus
gactagtcttaagatctactttttt

SEQ ID NO: 325760 - DNA, 25 bp, Rattus norvegicus
gactagtgactccaacaagggccta

SEQ ID NO: 325761 - DNA, 25 bp, Rattus norvegicus
gactagtgactcgaacaagggccta

SEQ ID NO: 325762 - DNA, 25 bp, Rattus norvegicus
gactagtgactgagtacctatttat

SEQ ID NO: 325763 - DNA, 25 bp, Rattus norvegicus
gactagtgactgtgtacctatttat

SEQ ID NO: 325764 - DNA, 25 bp, Rattus norvegicus
gactagtgcttcacttacactggag

SEQ ID NO: 325765 - DNA, 25 bp, Rattus norvegicus
gactagtgcttctcttacactggag

SEQ ID NO: 325766 - DNA, 25 bp, Rattus norvegicus
gactagtggaagagccttagatctt

SEQ ID NO: 325767 - DNA, 25 bp, Rattus norvegicus
gactagtggaagtgccttagatctt

SEQ ID NO: 325768 - DNA, 25 bp, Rattus norvegicus
gactagtggaccacagctctgggta

SEQ ID NO: 325769 - DNA, 25 bp, Rattus norvegicus
gactagtggacctcagctctgggta

SEQ ID NO: 325770 - DNA, 25 bp, Rattus norvegicus
gactagtggcttaggccttagcgat

SEQ ID NO: 325771 - DNA, 25 bp, Rattus norvegicus
gactagtggctttggccttagcgat

SEQ ID NO: 325772 - DNA, 25 bp, Rattus norvegicus
gactagtggtccctggcttcactgg

SEQ ID NO: 325773 - DNA, 25 bp, Rattus norvegicus
gactagtggtccgtggcttcactgg

SEQ ID NO: 325774 - DNA, 25 bp, Rattus norvegicus
gactagtggttcatcccaggagaat

SEQ ID NO: 325775 - DNA, 25 bp, Rattus norvegicus
gactagtggttcttcccaggagaat

SEQ ID NO: 325776 - DNA, 25 bp, Rattus norvegicus
gactagtgtagtacttaccccacat

SEQ ID NO: 325777 - DNA, 25 bp, Rattus norvegicus
gactagtgtagttcttaccccacat

SEQ ID NO: 325778 - DNA, 25 bp, Rattus norvegicus
gactagtgtctaaggctgctcacgg

SEQ ID NO: 325779 - DNA, 25 bp, Rattus norvegicus
gactagtgtctatggctgctcacgg

SEQ ID NO: 325780 - DNA, 25 bp, Rattus norvegicus
gactagtgtgggactctacaagcca

SEQ ID NO: 325781 - DNA, 25 bp, Rattus norvegicus
gactagtgtgggtctctacaagcca

SEQ ID NO: 325782 - DNA, 25 bp, Rattus norvegicus
gactagtgtttacgattgcacctcc

SEQ ID NO: 325783 - DNA, 25 bp, Rattus norvegicus
gactagtgtttaggattgcacctcc

SEQ ID NO: 325784 - DNA, 25 bp, Rattus norvegicus
gactagttggatagctgtacctcaa

SEQ ID NO: 325785 - DNA, 25 bp, Rattus norvegicus
gactagttggattgctgtacctcaa

SEQ ID NO: 325786 - DNA, 25 bp, Rattus norvegicus
gactagttggcaagggcgagctact

SEQ ID NO: 325787 - DNA, 25 bp, Rattus norvegicus
gactagttggcatgggcgagctact

SEQ ID NO: 325788 - DNA, 25 bp, Rattus norvegicus
gactagttttctcctactgaaccca

SEQ ID NO: 325789 - DNA, 25 bp, Rattus norvegicus
gactagttttctgctactgaaccca

SEQ ID NO: 325790 - DNA, 25 bp, Rattus norvegicus
gactataacatacagttccccaagg

SEQ ID NO: 325791 - DNA, 25 bp, Rattus norvegicus
gactataacatagagttccccaagg

SEQ ID NO: 325792 - DNA, 25 bp, Rattus norvegicus
gactataagtcgatttcctgtttgt

SEQ ID NO: 325793 - DNA, 25 bp, Rattus norvegicus
gactataagtcgttttcctgtttgt

SEQ ID NO: 325794 - DNA, 25 bp, Rattus norvegicus
gactataagtgtatcctgtatggaa

SEQ ID NO: 325795 - DNA, 25 bp, Rattus norvegicus
gactataagtgtttcctgtatggaa

SEQ ID NO: 325796 - DNA, 25 bp, Rattus norvegicus
gactataatagtagagctccaggcc

SEQ ID NO: 325797 - DNA, 25 bp, Rattus norvegicus
gactataatagttgagctccaggcc

SEQ ID NO: 325798 - DNA, 25 bp, Rattus norvegicus
gactataccccacaagactgctttt

SEQ ID NO: 325799 - DNA, 25 bp, Rattus norvegicus
gactataccccagaagactgctttt

SEQ ID NO: 325800 - DNA, 25 bp, Rattus norvegicus
gactatactacactacttcagagct

SEQ ID NO: 325801 - DNA, 25 bp, Rattus norvegicus
gactatactacagtacttcagagct

SEQ ID NO: 325802 - DNA, 25 bp, Rattus norvegicus
gactatactgtgagggtatctgtaa

SEQ ID NO: 325803 - DNA, 25 bp, Rattus norvegicus
gactatactgtgtgggtatctgtaa

SEQ ID NO: 325804 - DNA, 25 bp, Rattus norvegicus
gactatagaaagatttgctgcccaa

SEQ ID NO: 325805 - DNA, 25 bp, Rattus norvegicus
gactatagaaagttttgctgcccaa

SEQ ID NO: 325806 - DNA, 25 bp, Rattus norvegicus
gactatagggccacctaggcagaca

SEQ ID NO: 325807 - DNA, 25 bp, Rattus norvegicus
gactatagggcctcctaggcagaca

SEQ ID NO: 325808 - DNA, 25 bp, Rattus norvegicus
gactataggtacaagttccactaag

SEQ ID NO: 325809 - DNA, 25 bp, Rattus norvegicus
gactataggtactagttccactaag

SEQ ID NO: 325810 - DNA, 25 bp, Rattus norvegicus
gactatagtcatcataatgggcatc

SEQ ID NO: 325811 - DNA, 25 bp, Rattus norvegicus
gactatagtcatgataatgggcatc

SEQ ID NO: 325812 - DNA, 25 bp, Rattus norvegicus
gactatatacttcacttggtgccac

SEQ ID NO: 325813 - DNA, 25 bp, Rattus norvegicus
gactatatacttgacttggtgccac

SEQ ID NO: 325814 - DNA, 25 bp, Rattus norvegicus
gactatatcgtcactgacatctttt

SEQ ID NO: 325815 - DNA, 25 bp, Rattus norvegicus
gactatatcgtctctgacatctttt

SEQ ID NO: 325816 - DNA, 25 bp, Rattus norvegicus
gactatatcttcaaaagctccaagg

SEQ ID NO: 325817 - DNA, 25 bp, Rattus norvegicus
gactatatcttctaaagctccaagg

SEQ ID NO: 325818 - DNA, 25 bp, Rattus norvegicus
gactatatgtgtccctttgtattgt

SEQ ID NO: 325819 - DNA, 25 bp, Rattus norvegicus
gactatatgtgtgcctttgtattgt

SEQ ID NO: 325820 - DNA, 25 bp, Rattus norvegicus
gactatattctcctgtctaccagag

SEQ ID NO: 325821 - DNA, 25 bp, Rattus norvegicus
gactatattctcgtgtctaccagag

SEQ ID NO: 325822 - DNA, 25 bp, Rattus norvegicus
gactatatttatacaacagaagctt

SEQ ID NO: 325823 - DNA, 25 bp, Rattus norvegicus
gactatatttattcaacagaagctt

SEQ ID NO: 325824 - DNA, 25 bp, Rattus norvegicus
gactatcaacgtacagaacagcgtg

SEQ ID NO: 325825 - DNA, 25 bp, Rattus norvegicus
gactatcaacgttcagaacagcgtg

SEQ ID NO: 325826 - DNA, 25 bp, Rattus norvegicus
gactatcacataatcagcacaaatc

SEQ ID NO: 325827 - DNA, 25 bp, Rattus norvegicus
gactatcacatattcagcacaaatc

SEQ ID NO: 325828 - DNA, 25 bp, Rattus norvegicus
gactatcaccaaagtcctgaggagc

SEQ ID NO: 325829 - DNA, 25 bp, Rattus norvegicus
gactatcaccaatgtcctgaggagc

SEQ ID NO: 325830 - DNA, 25 bp, Rattus norvegicus
gactatcaggccattggaagctttg

SEQ ID NO: 325831 - DNA, 25 bp, Rattus norvegicus
gactatcaggcctttggaagctttg

SEQ ID NO: 325832 - DNA, 25 bp, Rattus norvegicus
gactatcattctctgacaatccctc

SEQ ID NO: 325833 - DNA, 25 bp, Rattus norvegicus
gactatcattctgtgacaatccctc

SEQ ID NO: 325834 - DNA, 25 bp, Rattus norvegicus
gactatcattggatgttgagttaca

SEQ ID NO: 325835 - DNA, 25 bp, Rattus norvegicus
gactatcattggttgttgagttaca

SEQ ID NO: 325836 - DNA, 25 bp, Rattus norvegicus
gactatccatgtaccagataatgta

SEQ ID NO: 325837 - DNA, 25 bp, Rattus norvegicus
gactatccatgttccagataatgta

SEQ ID NO: 325838 - DNA, 25 bp, Rattus norvegicus
gactatccattcagacagatcttac

SEQ ID NO: 325839 - DNA, 25 bp, Rattus norvegicus
gactatccattctgacagatcttac

SEQ ID NO: 325840 - DNA, 25 bp, Rattus norvegicus
gactatcccagtcctttccagaatg

SEQ ID NO: 325841 - DNA, 25 bp, Rattus norvegicus
gactatcccagtgctttccagaatg

SEQ ID NO: 325842 - DNA, 25 bp, Rattus norvegicus
gactatcctacaatgttgtctgcag

SEQ ID NO: 325843 - DNA, 25 bp, Rattus norvegicus
gactatcctacattgttgtctgcag

SEQ ID NO: 325844 - DNA, 25 bp, Rattus norvegicus
gactatcctggcacacactgaaatg

SEQ ID NO: 325845 - DNA, 25 bp, Rattus norvegicus
gactatcctggctcacactgaaatg

SEQ ID NO: 325846 - DNA, 25 bp, Rattus norvegicus
gactatcctggtagttgccagacca

SEQ ID NO: 325847 - DNA, 25 bp, Rattus norvegicus
gactatcctggttgttgccagacca

SEQ ID NO: 325848 - DNA, 25 bp, Rattus norvegicus
gactatccttgactagtttctccga

SEQ ID NO: 325849 - DNA, 25 bp, Rattus norvegicus
gactatccttgagtagtttctccga

SEQ ID NO: 325850 - DNA, 25 bp, Rattus norvegicus
gactatcgaatgcacaagatcactt

SEQ ID NO: 325851 - DNA, 25 bp, Rattus norvegicus
gactatcgaatggacaagatcactt

SEQ ID NO: 325852 - DNA, 25 bp, Rattus norvegicus
gactatcgacacagtgattctgtga

SEQ ID NO: 325853 - DNA, 25 bp, Rattus norvegicus
gactatcgacactgtgattctgtga

SEQ ID NO: 325854 - DNA, 25 bp, Rattus norvegicus
gactatcgcggtccctttttccttt

SEQ ID NO: 325855 - DNA, 25 bp, Rattus norvegicus
gactatcgcggtgcctttttccttt

SEQ ID NO: 325856 - DNA, 25 bp, Rattus norvegicus
gactatctactgcttctgtaaccat

SEQ ID NO: 325857 - DNA, 25 bp, Rattus norvegicus
gactatctactggttctgtaaccat

SEQ ID NO: 325858 - DNA, 25 bp, Rattus norvegicus
gactatctgcagatggcaaaatcat

SEQ ID NO: 325859 - DNA, 25 bp, Rattus norvegicus
gactatctgcagttggcaaaatcat

SEQ ID NO: 325860 - DNA, 25 bp, Rattus norvegicus
gactatctggtgatttctacattcc

SEQ ID NO: 325861 - DNA, 25 bp, Rattus norvegicus
gactatctggtgttttctacattcc

SEQ ID NO: 325862 - DNA, 25 bp, Rattus norvegicus
gactatctgtagacctgtcaccagt

SEQ ID NO: 325863 - DNA, 25 bp, Rattus norvegicus
gactatctgtagtcctgtcaccagt

SEQ ID NO: 325864 - DNA, 25 bp, Rattus norvegicus
gactatctgtatcttatggcttcca

SEQ ID NO: 325865 - DNA, 25 bp, Rattus norvegicus
gactatctgtatgttatggcttcca

SEQ ID NO: 325866 - DNA, 25 bp, Rattus norvegicus
gactatctgttacatgtactctgaa

SEQ ID NO: 325867 - DNA, 25 bp, Rattus norvegicus
gactatctgttagatgtactctgaa

SEQ ID NO: 325868 - DNA, 25 bp, Rattus norvegicus
gactatcttatcaagcaagctggtt

SEQ ID NO: 325869 - DNA, 25 bp, Rattus norvegicus
gactatcttatctagcaagctggtt

SEQ ID NO: 325870 - DNA, 25 bp, Rattus norvegicus
gactatcttatgcatggtttattcc

SEQ ID NO: 325871 - DNA, 25 bp, Rattus norvegicus
gactatcttatggatggtttattcc

SEQ ID NO: 325872 - DNA, 25 bp, Rattus norvegicus
gactatcttgctattgtgaccactg

SEQ ID NO: 325873 - DNA, 25 bp, Rattus norvegicus
gactatcttgcttttgtgaccactg

SEQ ID NO: 325874 - DNA, 25 bp, Rattus norvegicus
gactatcttgttcattatctggaca

SEQ ID NO: 325875 - DNA, 25 bp, Rattus norvegicus
gactatcttgttgattatctggaca

SEQ ID NO: 325876 - DNA, 25 bp, Rattus norvegicus
gactatgaaaaaatcctggtggctc

SEQ ID NO: 325877 - DNA, 25 bp, Rattus norvegicus
gactatgaaaaattcctggtggctc

SEQ ID NO: 325878 - DNA, 25 bp, Rattus norvegicus
gactatgaacccattgatgccaccg

SEQ ID NO: 325879 - DNA, 25 bp, Rattus norvegicus
gactatgaaccctttgatgccaccg

SEQ ID NO: 325880 - DNA, 25 bp, Rattus norvegicus
gactatgaactgaatctgcggaacc

SEQ ID NO: 325881 - DNA, 25 bp, Rattus norvegicus
gactatgaactgtatctgcggaacc

SEQ ID NO: 325882 - DNA, 25 bp, Rattus norvegicus
gactatgaacttcgaccgctaggga

SEQ ID NO: 325883 - DNA, 25 bp, Rattus norvegicus
gactatgaacttggaccgctaggga

SEQ ID NO: 325884 - DNA, 25 bp, Rattus norvegicus
gactatgaagcacacaccatttccc

SEQ ID NO: 325885 - DNA, 25 bp, Rattus norvegicus
gactatgaagcagacaccatttccc

SEQ ID NO: 325886 - DNA, 25 bp, Rattus norvegicus
gactatgacagcaatgtacgaccat

SEQ ID NO: 325887 - DNA, 25 bp, Rattus norvegicus
gactatgacagctatgtacgaccat

SEQ ID NO: 325888 - DNA, 25 bp, Rattus norvegicus
gactatgaccagcagggctttgaaa

SEQ ID NO: 325889 - DNA, 25 bp, Rattus norvegicus
gactatgaccaggagggctttgaaa

SEQ ID NO: 325890 - DNA, 25 bp, Rattus norvegicus
gactatgacctacactcattctaaa

SEQ ID NO: 325891 - DNA, 25 bp, Rattus norvegicus
gactatgacctagactcattctaaa

SEQ ID NO: 325892 - DNA, 25 bp, Rattus norvegicus
gactatgacgaaaggaacatctcct

SEQ ID NO: 325893 - DNA, 25 bp, Rattus norvegicus
gactatgacgaatggaacatctcct

SEQ ID NO: 325894 - DNA, 25 bp, Rattus norvegicus
gactatgacgagatcctggagttca

SEQ ID NO: 325895 - DNA, 25 bp, Rattus norvegicus
gactatgacgagttcctggagttca

SEQ ID NO: 325896 - DNA, 25 bp, Rattus norvegicus
gactatgagaaactggtgaagcgcc

SEQ ID NO: 325897 - DNA, 25 bp, Rattus norvegicus
gactatgagaaagtggtgaagcgcc

SEQ ID NO: 325898 - DNA, 25 bp, Rattus norvegicus
gactatgatcccacgtctgaagagt

SEQ ID NO: 325899 - DNA, 25 bp, Rattus norvegicus
gactatgatccctcgtctgaagagt

SEQ ID NO: 325900 - DNA, 25 bp, Rattus norvegicus
gactatgcagccaaagtggccctaa

SEQ ID NO: 325901 - DNA, 25 bp, Rattus norvegicus
gactatgcagcctaagtggccctaa

SEQ ID NO: 325902 - DNA, 25 bp, Rattus norvegicus
gactatgcgctccagaatcctacta

SEQ ID NO: 325903 - DNA, 25 bp, Rattus norvegicus
gactatgcgctcgagaatcctacta

SEQ ID NO: 325904 - DNA, 25 bp, Rattus norvegicus
gactatgcgtagcaacaccattctc

SEQ ID NO: 325905 - DNA, 25 bp, Rattus norvegicus
gactatgcgtaggaacaccattctc

SEQ ID NO: 325906 - DNA, 25 bp, Rattus norvegicus
gactatgctttcctaacagacggct

SEQ ID NO: 325907 - DNA, 25 bp, Rattus norvegicus
gactatgctttcgtaacagacggct

SEQ ID NO: 325908 - DNA, 25 bp, Rattus norvegicus
gactatggacagcttagcccacaaa

SEQ ID NO: 325909 - DNA, 25 bp, Rattus norvegicus
gactatggacaggttagcccacaaa

SEQ ID NO: 325910 - DNA, 25 bp, Rattus norvegicus
gactatggactcaaagtgctttcaa

SEQ ID NO: 325911 - DNA, 25 bp, Rattus norvegicus
gactatggactctaagtgctttcaa

SEQ ID NO: 325912 - DNA, 25 bp, Rattus norvegicus
gactatggagccactcagtaacaat

SEQ ID NO: 325913 - DNA, 25 bp, Rattus norvegicus
gactatggagcctctcagtaacaat

SEQ ID NO: 325914 - DNA, 25 bp, Rattus norvegicus
gactatgggtatccatctgcaggca

SEQ ID NO: 325915 - DNA, 25 bp, Rattus norvegicus
gactatgggtatgcatctgcaggca

SEQ ID NO: 325916 - DNA, 25 bp, Rattus norvegicus
gactatggtacaatcttcagattat

SEQ ID NO: 325917 - DNA, 25 bp, Rattus norvegicus
gactatggtacattcttcagattat

SEQ ID NO: 325918 - DNA, 25 bp, Rattus norvegicus
gactatgtaaatcacttgttactta

SEQ ID NO: 325919 - DNA, 25 bp, Rattus norvegicus
gactatgtaaatgacttgttactta

SEQ ID NO: 325920 - DNA, 25 bp, Rattus norvegicus
gactatgtaagaagacctggcgtat

SEQ ID NO: 325921 - DNA, 25 bp, Rattus norvegicus
gactatgtaagactgtttcccaaaa

SEQ ID NO: 325922 - DNA, 25 bp, Rattus norvegicus
gactatgtaagagtgtttcccaaaa

SEQ ID NO: 325923 - DNA, 25 bp, Rattus norvegicus
gactatgtaagatgacctggcgtat

SEQ ID NO: 325924 - DNA, 25 bp, Rattus norvegicus
gactatgtagccaatgtggaacaat

SEQ ID NO: 325925 - DNA, 25 bp, Rattus norvegicus
gactatgtagcctatgtggaacaat

SEQ ID NO: 325926 - DNA, 25 bp, Rattus norvegicus
gactatgtcatgctaatgttgttta

SEQ ID NO: 325927 - DNA, 25 bp, Rattus norvegicus
gactatgtcatggtaatgttgttta

SEQ ID NO: 325928 - DNA, 25 bp, Rattus norvegicus
gactatgtcctcaagcagatccgca

SEQ ID NO: 325929 - DNA, 25 bp, Rattus norvegicus
gactatgtcctctagcagatccgca

SEQ ID NO: 325930 - DNA, 25 bp, Rattus norvegicus
gactatgtccttctcctttggagga

SEQ ID NO: 325931 - DNA, 25 bp, Rattus norvegicus
gactatgtccttgtcctttggagga

SEQ ID NO: 325932 - DNA, 25 bp, Rattus norvegicus
gactatgtcgcacagccagcaaatt

SEQ ID NO: 325933 - DNA, 25 bp, Rattus norvegicus
gactatgtcgcagagccagcaaatt

SEQ ID NO: 325934 - DNA, 25 bp, Rattus norvegicus
gactatgtcgtgacagccagtgctg

SEQ ID NO: 325935 - DNA, 25 bp, Rattus norvegicus
gactatgtcgtgtcagccagtgctg

SEQ ID NO: 325936 - DNA, 25 bp, Rattus norvegicus
gactatgtctacagtgcctccatga

SEQ ID NO: 325937 - DNA, 25 bp, Rattus norvegicus
gactatgtctactgtgcctccatga

SEQ ID NO: 325938 - DNA, 25 bp, Rattus norvegicus
gactatgtctatcccagcttcatta

SEQ ID NO: 325939 - DNA, 25 bp, Rattus norvegicus
gactatgtctatgccagcttcatta

SEQ ID NO: 325940 - DNA, 25 bp, Rattus norvegicus
gactatgtgagtcaaccatcctcag

SEQ ID NO: 325941 - DNA, 25 bp, Rattus norvegicus
gactatgtgagtgaaccatcctcag

SEQ ID NO: 325942 - DNA, 25 bp, Rattus norvegicus
gactatgtgatgcatgtgcgtttct

SEQ ID NO: 325943 - DNA, 25 bp, Rattus norvegicus
gactatgtgatggatgtgcgtttct

SEQ ID NO: 325944 - DNA, 25 bp, Rattus norvegicus
gactatgtgcttagactatggcgca

SEQ ID NO: 325945 - DNA, 25 bp, Rattus norvegicus
gactatgtgctttgactatggcgca

SEQ ID NO: 325946 - DNA, 25 bp, Rattus norvegicus
gactatgtgggcattgaattcacag

SEQ ID NO: 325947 - DNA, 25 bp, Rattus norvegicus
gactatgtgggctttgaattcacag

SEQ ID NO: 325948 - DNA, 25 bp, Rattus norvegicus
gactatgtggtcataacagcctttt

SEQ ID NO: 325949 - DNA, 25 bp, Rattus norvegicus
gactatgtggtcttaacagcctttt

SEQ ID NO: 325950 - DNA, 25 bp, Rattus norvegicus
gactatgtggtgacattgagcagca

SEQ ID NO: 325951 - DNA, 25 bp, Rattus norvegicus
gactatgtggtgtcattgagcagca

SEQ ID NO: 325952 - DNA, 25 bp, Rattus norvegicus
gactatgttatgagctcataccaac

SEQ ID NO: 325953 - DNA, 25 bp, Rattus norvegicus
gactatgttatgtgctcataccaac

SEQ ID NO: 325954 - DNA, 25 bp, Rattus norvegicus
gactatgtttatatactttgcaggg

SEQ ID NO: 325955 - DNA, 25 bp, Rattus norvegicus
gactatgtttatttactttgcaggg

SEQ ID NO: 325956 - DNA, 25 bp, Rattus norvegicus
gactattatcagcatggcctcattg

SEQ ID NO: 325957 - DNA, 25 bp, Rattus norvegicus
gactattatcaggatggcctcattg

SEQ ID NO: 325958 - DNA, 25 bp, Rattus norvegicus
gactattcaactatatgcgcctaca

SEQ ID NO: 325959 - DNA, 25 bp, Rattus norvegicus
gactattcaactttatgcgcctaca

SEQ ID NO: 325960 - DNA, 25 bp, Rattus norvegicus
gactattcagagagggcttgctctt

SEQ ID NO: 325961 - DNA, 25 bp, Rattus norvegicus
gactattcagagtgggcttgctctt

SEQ ID NO: 325962 - DNA, 25 bp, Rattus norvegicus
gactattcattcatgttgcaggaac

SEQ ID NO: 325963 - DNA, 25 bp, Rattus norvegicus
gactattcattcttgttgcaggaac

SEQ ID NO: 325964 - DNA, 25 bp, Rattus norvegicus
gactattccactctcttttgtaaaa

SEQ ID NO: 325965 - DNA, 25 bp, Rattus norvegicus
gactattccactgtcttttgtaaaa

SEQ ID NO: 325966 - DNA, 25 bp, Rattus norvegicus
gactattccgtccatatctagttat

SEQ ID NO: 325967 - DNA, 25 bp, Rattus norvegicus
gactattccgtcgatatctagttat

SEQ ID NO: 325968 - DNA, 25 bp, Rattus norvegicus
gactattcctatagagactctcttt

SEQ ID NO: 325969 - DNA, 25 bp, Rattus norvegicus
gactattcctattgagactctcttt

SEQ ID NO: 325970 - DNA, 25 bp, Rattus norvegicus
gactattcctgactgcttttgggac

SEQ ID NO: 325971 - DNA, 25 bp, Rattus norvegicus
gactattcctgagtgcttttgggac

SEQ ID NO: 325972 - DNA, 25 bp, Rattus norvegicus
gactattcctttctggctacataaa

SEQ ID NO: 325973 - DNA, 25 bp, Rattus norvegicus
gactattcctttgtggctacataaa

SEQ ID NO: 325974 - DNA, 25 bp, Rattus norvegicus
gactattctgaaacacttgggaacc

SEQ ID NO: 325975 - DNA, 25 bp, Rattus norvegicus
gactattctgaatcacttgggaacc

SEQ ID NO: 325976 - DNA, 25 bp, Rattus norvegicus
gactattctgcccaattttctgtaa

SEQ ID NO: 325977 - DNA, 25 bp, Rattus norvegicus
gactattctgccgaattttctgtaa

SEQ ID NO: 325978 - DNA, 25 bp, Rattus norvegicus
gactattctgtaaagcttcaaccaa

SEQ ID NO: 325979 - DNA, 25 bp, Rattus norvegicus
gactattctgtatagcttcaaccaa

SEQ ID NO: 325980 - DNA, 25 bp, Rattus norvegicus
gactattcttgtaaaacatgccctg

SEQ ID NO: 325981 - DNA, 25 bp, Rattus norvegicus
gactattcttgttaaacatgccctg

SEQ ID NO: 325982 - DNA, 25 bp, Rattus norvegicus
gactattgaacccaaatccagaccc

SEQ ID NO: 325983 - DNA, 25 bp, Rattus norvegicus
gactattgaaccgaaatccagaccc

SEQ ID NO: 325984 - DNA, 25 bp, Rattus norvegicus
gactattgacagactatgcctacag

SEQ ID NO: 325985 - DNA, 25 bp, Rattus norvegicus
gactattgacagtctatgcctacag

SEQ ID NO: 325986 - DNA, 25 bp, Rattus norvegicus
gactattgcattcacttttgtgcca

SEQ ID NO: 325987 - DNA, 25 bp, Rattus norvegicus
gactattgcattgacttttgtgcca

SEQ ID NO: 325988 - DNA, 25 bp, Rattus norvegicus
gactattgctgcattcccggatggg

SEQ ID NO: 325989 - DNA, 25 bp, Rattus norvegicus
gactattgctgctttcccggatggg

SEQ ID NO: 325990 - DNA, 25 bp, Rattus norvegicus
gactattggattcgagctctccatt

SEQ ID NO: 325991 - DNA, 25 bp, Rattus norvegicus
gactattggattggagctctccatt

SEQ ID NO: 325992 - DNA, 25 bp, Rattus norvegicus
gactattgttctcctacttggatgt

SEQ ID NO: 325993 - DNA, 25 bp, Rattus norvegicus
gactattgttctgctacttggatgt

SEQ ID NO: 325994 - DNA, 25 bp, Rattus norvegicus
gactatttagtgaggcctggttcac

SEQ ID NO: 325995 - DNA, 25 bp, Rattus norvegicus
gactatttagtgtggcctggttcac

SEQ ID NO: 325996 - DNA, 25 bp, Rattus norvegicus
gactatttatttcctatggctcaat

SEQ ID NO: 325997 - DNA, 25 bp, Rattus norvegicus
gactatttatttgctatggctcaat

SEQ ID NO: 325998 - DNA, 25 bp, Rattus norvegicus
gactatttcatgaatcgcattgtgc

SEQ ID NO: 325999 - DNA, 25 bp, Rattus norvegicus
gactatttcatgtatcgcattgtgc

SEQ ID NO: 326000 - DNA, 25 bp, Rattus norvegicus
gactatttccacactagaaaatacg

SEQ ID NO: 326001 - DNA, 25 bp, Rattus norvegicus
gactatttccactctagaaaatacg

SEQ ID NO: 326002 - DNA, 25 bp, Rattus norvegicus
gactatttccccataacatgtgatg

SEQ ID NO: 326003 - DNA, 25 bp, Rattus norvegicus
gactatttccccttaacatgtgatg

SEQ ID NO: 326004 - DNA, 25 bp, Rattus norvegicus
gactatttctccagacatgtgtgct

SEQ ID NO: 326005 - DNA, 25 bp, Rattus norvegicus
gactatttctcctgacatgtgtgct

SEQ ID NO: 326006 - DNA, 25 bp, Rattus norvegicus
gactatttctgtcaagcgactccct

SEQ ID NO: 326007 - DNA, 25 bp, Rattus norvegicus
gactatttctgtcattactcagctg

SEQ ID NO: 326008 - DNA, 25 bp, Rattus norvegicus
gactatttctgtgaagcgactccct

SEQ ID NO: 326009 - DNA, 25 bp, Rattus norvegicus
gactatttctgtgattactcagctg

SEQ ID NO: 326010 - DNA, 25 bp, Rattus norvegicus
gactatttgcgtatgtgtggcctta

SEQ ID NO: 326011 - DNA, 25 bp, Rattus norvegicus
gactatttgcgtttgtgtggcctta

SEQ ID NO: 326012 - DNA, 25 bp, Rattus norvegicus
gactatttgggaagacggagcctta

SEQ ID NO: 326013 - DNA, 25 bp, Rattus norvegicus
gactatttgggatgacggagcctta

SEQ ID NO: 326014 - DNA, 25 bp, Rattus norvegicus
gactatttgtggacagtactcaagt

SEQ ID NO: 326015 - DNA, 25 bp, Rattus norvegicus
gactatttgtggtcagtactcaagt

SEQ ID NO: 326016 - DNA, 25 bp, Rattus norvegicus
gactattttacaaaccagggaggtg

SEQ ID NO: 326017 - DNA, 25 bp, Rattus norvegicus
gactattttacataccagggaggtg

SEQ ID NO: 326018 - DNA, 25 bp, Rattus norvegicus
gactattttataatacatggcccaa

SEQ ID NO: 326019 - DNA, 25 bp, Rattus norvegicus
gactattttatacttcaggctgctt

SEQ ID NO: 326020 - DNA, 25 bp, Rattus norvegicus
gactattttatagttcaggctgctt

SEQ ID NO: 326021 - DNA, 25 bp, Rattus norvegicus
gactattttatattacatggcccaa

SEQ ID NO: 326022 - DNA, 25 bp, Rattus norvegicus
gactattttatgcacggagctactg

SEQ ID NO: 326023 - DNA, 25 bp, Rattus norvegicus
gactattttatggacggagctactg

SEQ ID NO: 326024 - DNA, 25 bp, Rattus norvegicus
gactattttattcatcacttcattg

SEQ ID NO: 326025 - DNA, 25 bp, Rattus norvegicus
gactattttattgatcacttcattg

SEQ ID NO: 326026 - DNA, 25 bp, Rattus norvegicus
gactattttctgaatgtggcctaca

SEQ ID NO: 326027 - DNA, 25 bp, Rattus norvegicus
gactattttctgtatgtggcctaca

SEQ ID NO: 326028 - DNA, 25 bp, Rattus norvegicus
gactattttggtcaaattgccctgc

SEQ ID NO: 326029 - DNA, 25 bp, Rattus norvegicus
gactattttggtgaaattgccctgc

SEQ ID NO: 326030 - DNA, 25 bp, Rattus norvegicus
gactcaaaccaacaagattccagct

SEQ ID NO: 326031 - DNA, 25 bp, Rattus norvegicus
gactcaaaccaagaagattccagct

SEQ ID NO: 326032 - DNA, 25 bp, Rattus norvegicus
gactcaaaccgtaatgttcacatta

SEQ ID NO: 326033 - DNA, 25 bp, Rattus norvegicus
gactcaaaccgttatgttcacatta

SEQ ID NO: 326034 - DNA, 25 bp, Rattus norvegicus
gactcaaagacacttatgctgacat

SEQ ID NO: 326035 - DNA, 25 bp, Rattus norvegicus
gactcaaagacagttatgctgacat

SEQ ID NO: 326036 - DNA, 25 bp, Rattus norvegicus
gactcaaagctacttaggtgacact

SEQ ID NO: 326037 - DNA, 25 bp, Rattus norvegicus
gactcaaagctagttaggtgacact

SEQ ID NO: 326038 - DNA, 25 bp, Rattus norvegicus
gactcaaaggcacttgggccattca

SEQ ID NO: 326039 - DNA, 25 bp, Rattus norvegicus
gactcaaaggcagttgggccattca

SEQ ID NO: 326040 - DNA, 25 bp, Rattus norvegicus
gactcaaagtaacgcagtgactgat

SEQ ID NO: 326041 - DNA, 25 bp, Rattus norvegicus
gactcaaagtaaggcagtgactgat

SEQ ID NO: 326042 - DNA, 25 bp, Rattus norvegicus
gactcaaagttcatcatggctacat

SEQ ID NO: 326043 - DNA, 25 bp, Rattus norvegicus
gactcaaagttcttcatggctacat

SEQ ID NO: 326044 - DNA, 25 bp, Rattus norvegicus
gactcaaatacccagaaggtggatg

SEQ ID NO: 326045 - DNA, 25 bp, Rattus norvegicus
gactcaaataccgagaaggtggatg

SEQ ID NO: 326046 - DNA, 25 bp, Rattus norvegicus
gactcaaatccactggttggcccaa

SEQ ID NO: 326047 - DNA, 25 bp, Rattus norvegicus
gactcaaatccagtggttggcccaa

SEQ ID NO: 326048 - DNA, 25 bp, Rattus norvegicus
gactcaacaatgcatatgcagaggt

SEQ ID NO: 326049 - DNA, 25 bp, Rattus norvegicus
gactcaacaatggatatgcagaggt

SEQ ID NO: 326050 - DNA, 25 bp, Rattus norvegicus
gactcaacatttaaacacttctatt

SEQ ID NO: 326051 - DNA, 25 bp, Rattus norvegicus
gactcaacattttaacacttctatt

SEQ ID NO: 326052 - DNA, 25 bp, Rattus norvegicus
gactcaaccatacgactaaaggcaa

SEQ ID NO: 326053 - DNA, 25 bp, Rattus norvegicus
gactcaaccataggactaaaggcaa

SEQ ID NO: 326054 - DNA, 25 bp, Rattus norvegicus
gactcaaccatcacagaacagcaag

SEQ ID NO: 326055 - DNA, 25 bp, Rattus norvegicus
gactcaaccatctcagaacagcaag

SEQ ID NO: 326056 - DNA, 25 bp, Rattus norvegicus
gactcaacccataaatcactgcttt

SEQ ID NO: 326057 - DNA, 25 bp, Rattus norvegicus
gactcaacccattaatcactgcttt

SEQ ID NO: 326058 - DNA, 25 bp, Rattus norvegicus
gactcaaccgctacaaaatcatcaa

SEQ ID NO: 326059 - DNA, 25 bp, Rattus norvegicus
gactcaaccgctccctggaggaaga

SEQ ID NO: 326060 - DNA, 25 bp, Rattus norvegicus
gactcaaccgctgcctggaggaaga

SEQ ID NO: 326061 - DNA, 25 bp, Rattus norvegicus
gactcaaccgcttcaaaatcatcaa

SEQ ID NO: 326062 - DNA, 25 bp, Rattus norvegicus
gactcaactgatagtgtcacatatt

SEQ ID NO: 326063 - DNA, 25 bp, Rattus norvegicus
gactcaactgattgtgtcacatatt

SEQ ID NO: 326064 - DNA, 25 bp, Rattus norvegicus
gactcaactgcaagaagaccttctg

SEQ ID NO: 326065 - DNA, 25 bp, Rattus norvegicus
gactcaactgcatgaagaccttctg

SEQ ID NO: 326066 - DNA, 25 bp, Rattus norvegicus
gactcaacttgactgggtagccaac

SEQ ID NO: 326067 - DNA, 25 bp, Rattus norvegicus
gactcaacttgagtgggtagccaac

SEQ ID NO: 326068 - DNA, 25 bp, Rattus norvegicus
gactcaactttaatctgcttatttg

SEQ ID NO: 326069 - DNA, 25 bp, Rattus norvegicus
gactcaactttattctgcttatttg

SEQ ID NO: 326070 - DNA, 25 bp, Rattus norvegicus
gactcaagacctctggttgtttgga

SEQ ID NO: 326071 - DNA, 25 bp, Rattus norvegicus
gactcaagacctgtggttgtttgga

SEQ ID NO: 326072 - DNA, 25 bp, Rattus norvegicus
gactcaagactaaagggaacctctg

SEQ ID NO: 326073 - DNA, 25 bp, Rattus norvegicus
gactcaagactatagggaacctctg

SEQ ID NO: 326074 - DNA, 25 bp, Rattus norvegicus
gactcaagacttactcattcactgc

SEQ ID NO: 326075 - DNA, 25 bp, Rattus norvegicus
gactcaagactttctcattcactgc

SEQ ID NO: 326076 - DNA, 25 bp, Rattus norvegicus
gactcaagcaagcttcatcccagtt

SEQ ID NO: 326077 - DNA, 25 bp, Rattus norvegicus
gactcaagcaaggttcatcccagtt

SEQ ID NO: 326078 - DNA, 25 bp, Rattus norvegicus
gactcaagctgtctattttttatat

SEQ ID NO: 326079 - DNA, 25 bp, Rattus norvegicus
gactcaagctgtgtattttttatat

SEQ ID NO: 326080 - DNA, 25 bp, Rattus norvegicus
gactcaagcttgaaggtggactgtt

SEQ ID NO: 326081 - DNA, 25 bp, Rattus norvegicus
gactcaagcttgtaggtggactgtt

SEQ ID NO: 326082 - DNA, 25 bp, Rattus norvegicus
gactcaaggcttctttgggtcaatt

SEQ ID NO: 326083 - DNA, 25 bp, Rattus norvegicus
gactcaaggcttgtttgggtcaatt

SEQ ID NO: 326084 - DNA, 25 bp, Rattus norvegicus
gactcaagtaagatttggcttccat

SEQ ID NO: 326085 - DNA, 25 bp, Rattus norvegicus
gactcaagtaagttttggcttccat

SEQ ID NO: 326086 - DNA, 25 bp, Rattus norvegicus
gactcaagtgagactcgtgcctgtc

SEQ ID NO: 326087 - DNA, 25 bp, Rattus norvegicus
gactcaagtgagtctcgtgcctgtc

SEQ ID NO: 326088 - DNA, 25 bp, Rattus norvegicus
gactcaagttttatgctttctcttt

SEQ ID NO: 326089 - DNA, 25 bp, Rattus norvegicus
gactcaagttttctgttctgccttc

SEQ ID NO: 326090 - DNA, 25 bp, Rattus norvegicus
gactcaagttttgtgttctgccttc

SEQ ID NO: 326091 - DNA, 25 bp, Rattus norvegicus
gactcaagttttttgctttctcttt

SEQ ID NO: 326092 - DNA, 25 bp, Rattus norvegicus
gactcaatagtcagtgcgggctcat

SEQ ID NO: 326093 - DNA, 25 bp, Rattus norvegicus
gactcaatagtctgtgcgggctcat

SEQ ID NO: 326094 - DNA, 25 bp, Rattus norvegicus
gactcaatcatacacttgtcaatcc

SEQ ID NO: 326095 - DNA, 25 bp, Rattus norvegicus
gactcaatcatagacttgtcaatcc

SEQ ID NO: 326096 - DNA, 25 bp, Rattus norvegicus
gactcaatcattctcacagtatcca

SEQ ID NO: 326097 - DNA, 25 bp, Rattus norvegicus
gactcaatcattgtcacagtatcca

SEQ ID NO: 326098 - DNA, 25 bp, Rattus norvegicus
gactcaatcttacttgtcaggcttg

SEQ ID NO: 326099 - DNA, 25 bp, Rattus norvegicus
gactcaatcttagttgtcaggcttg

SEQ ID NO: 326100 - DNA, 25 bp, Rattus norvegicus
gactcaatggtcaattcaggtcagt

SEQ ID NO: 326101 - DNA, 25 bp, Rattus norvegicus
gactcaatggtctattcaggtcagt

SEQ ID NO: 326102 - DNA, 25 bp, Rattus norvegicus
gactcaatgttacccagaatgatgt

SEQ ID NO: 326103 - DNA, 25 bp, Rattus norvegicus
gactcaatgttagccagaatgatgt

SEQ ID NO: 326104 - DNA, 25 bp, Rattus norvegicus
gactcaattctgaactgtgtctgaa

SEQ ID NO: 326105 - DNA, 25 bp, Rattus norvegicus
gactcaattctgtactgtgtctgaa

SEQ ID NO: 326106 - DNA, 25 bp, Rattus norvegicus
gactcacaactgaatgactgccttg

SEQ ID NO: 326107 - DNA, 25 bp, Rattus norvegicus
gactcacaactgtatgactgccttg

SEQ ID NO: 326108 - DNA, 25 bp, Rattus norvegicus
gactcacaaggcaagactgactggg

SEQ ID NO: 326109 - DNA, 25 bp, Rattus norvegicus
gactcacaaggctagactgactggg

SEQ ID NO: 326110 - DNA, 25 bp, Rattus norvegicus
gactcacacaggagccaggacactg

SEQ ID NO: 326111 - DNA, 25 bp, Rattus norvegicus
gactcacacaggtgccaggacactg

SEQ ID NO: 326112 - DNA, 25 bp, Rattus norvegicus
gactcacacatgctgggccaatacc

SEQ ID NO: 326113 - DNA, 25 bp, Rattus norvegicus
gactcacacatggtgggccaatacc

SEQ ID NO: 326114 - DNA, 25 bp, Rattus norvegicus
gactcacaccttagtcaaggcgttg

SEQ ID NO: 326115 - DNA, 25 bp, Rattus norvegicus
gactcacacctttgtcaaggcgttg

SEQ ID NO: 326116 - DNA, 25 bp, Rattus norvegicus
gactcacactcactgtttagttcca

SEQ ID NO: 326117 - DNA, 25 bp, Rattus norvegicus
gactcacactcagtgtttagttcca

SEQ ID NO: 326118 - DNA, 25 bp, Rattus norvegicus
gactcacactgcctgccaaagagat

SEQ ID NO: 326119 - DNA, 25 bp, Rattus norvegicus
gactcacactgcgtgccaaagagat

SEQ ID NO: 326120 - DNA, 25 bp, Rattus norvegicus
gactcacagactatacgagacttgg

SEQ ID NO: 326121 - DNA, 25 bp, Rattus norvegicus
gactcacagactcacagacttacag

SEQ ID NO: 326122 - DNA, 25 bp, Rattus norvegicus
gactcacagactgacagacttacag

SEQ ID NO: 326123 - DNA, 25 bp, Rattus norvegicus
gactcacagactttacgagacttgg

SEQ ID NO: 326124 - DNA, 25 bp, Rattus norvegicus
gactcacagtgcattgtctgggtac

SEQ ID NO: 326125 - DNA, 25 bp, Rattus norvegicus
gactcacagtgctttgtctgggtac

SEQ ID NO: 326126 - DNA, 25 bp, Rattus norvegicus
gactcacatggtctggcacaggtcc

SEQ ID NO: 326127 - DNA, 25 bp, Rattus norvegicus
gactcacatggtgtggcacaggtcc

SEQ ID NO: 326128 - DNA, 25 bp, Rattus norvegicus
gactcacattcacactgattaagga

SEQ ID NO: 326129 - DNA, 25 bp, Rattus norvegicus
gactcacattcagactgattaagga

SEQ ID NO: 326130 - DNA, 25 bp, Rattus norvegicus
gactcaccacaccttagttgtttag

SEQ ID NO: 326131 - DNA, 25 bp, Rattus norvegicus
gactcaccacacgttagttgtttag

SEQ ID NO: 326132 - DNA, 25 bp, Rattus norvegicus
gactcaccagtgcattgactgtcta

SEQ ID NO: 326133 - DNA, 25 bp, Rattus norvegicus
gactcaccagtggattgactgtcta

SEQ ID NO: 326134 - DNA, 25 bp, Rattus norvegicus
gactcacccaagatgtagagcagaa

SEQ ID NO: 326135 - DNA, 25 bp, Rattus norvegicus
gactcacccaagttgtagagcagaa

SEQ ID NO: 326136 - DNA, 25 bp, Rattus norvegicus
gactcacccataccctgcataagtg

SEQ ID NO: 326137 - DNA, 25 bp, Rattus norvegicus
gactcacccatagcctgcataagtg

SEQ ID NO: 326138 - DNA, 25 bp, Rattus norvegicus
gactcaccggtgatctctgtaaagc

SEQ ID NO: 326139 - DNA, 25 bp, Rattus norvegicus
gactcaccggtgttctctgtaaagc

SEQ ID NO: 326140 - DNA, 25 bp, Rattus norvegicus
gactcaccttataagtgactatagt

SEQ ID NO: 326141 - DNA, 25 bp, Rattus norvegicus
gactcaccttattagtgactatagt

SEQ ID NO: 326142 - DNA, 25 bp, Rattus norvegicus
gactcacgagacacagcgttactaa

SEQ ID NO: 326143 - DNA, 25 bp, Rattus norvegicus
gactcacgagactcagcgttactaa

SEQ ID NO: 326144 - DNA, 25 bp, Rattus norvegicus
gactcacggtgtacactgatactga

SEQ ID NO: 326145 - DNA, 25 bp, Rattus norvegicus
gactcacggtgttcactgatactga

SEQ ID NO: 326146 - DNA, 25 bp, Rattus norvegicus
gactcacggtttaggtgtcttccta

SEQ ID NO: 326147 - DNA, 25 bp, Rattus norvegicus
gactcacggttttggtgtcttccta

SEQ ID NO: 326148 - DNA, 25 bp, Rattus norvegicus
gactcactagcaattaaggaattta

SEQ ID NO: 326149 - DNA, 25 bp, Rattus norvegicus
gactcactagcatttaaggaattta

SEQ ID NO: 326150 - DNA, 25 bp, Rattus norvegicus
gactcactcccgaatttggcctgcg

SEQ ID NO: 326151 - DNA, 25 bp, Rattus norvegicus
gactcactcccgtatttggcctgcg

SEQ ID NO: 326152 - DNA, 25 bp, Rattus norvegicus
gactcactcgtcagcacgttcaggc

SEQ ID NO: 326153 - DNA, 25 bp, Rattus norvegicus
gactcactcgtctgcacgttcaggc

SEQ ID NO: 326154 - DNA, 25 bp, Rattus norvegicus
gactcactctttatccataggagaa

SEQ ID NO: 326155 - DNA, 25 bp, Rattus norvegicus
gactcactctttttccataggagaa

SEQ ID NO: 326156 - DNA, 25 bp, Rattus norvegicus
gactcactgatccagctgcagggtt

SEQ ID NO: 326157 - DNA, 25 bp, Rattus norvegicus
gactcactgatcgagctgcagggtt

SEQ ID NO: 326158 - DNA, 25 bp, Rattus norvegicus
gactcactggcgactctaacttgga

SEQ ID NO: 326159 - DNA, 25 bp, Rattus norvegicus
gactcactggcgtctctaacttgga

SEQ ID NO: 326160 - DNA, 25 bp, Rattus norvegicus
gactcactgggcaggtgccaggatt

SEQ ID NO: 326161 - DNA, 25 bp, Rattus norvegicus
gactcactgggctggtgccaggatt

SEQ ID NO: 326162 - DNA, 25 bp, Rattus norvegicus
gactcactggtgactaagcctgctc

SEQ ID NO: 326163 - DNA, 25 bp, Rattus norvegicus
gactcactggtgtctaagcctgctc

SEQ ID NO: 326164 - DNA, 25 bp, Rattus norvegicus
gactcactgtaccaagtagactgat

SEQ ID NO: 326165 - DNA, 25 bp, Rattus norvegicus
gactcactgtacgaagtagactgat

SEQ ID NO: 326166 - DNA, 25 bp, Rattus norvegicus
gactcactgttcctggtcaatggga

SEQ ID NO: 326167 - DNA, 25 bp, Rattus norvegicus
gactcactgttcgtggtcaatggga

SEQ ID NO: 326168 - DNA, 25 bp, Rattus norvegicus
gactcactgtttacttatctctaat

SEQ ID NO: 326169 - DNA, 25 bp, Rattus norvegicus
gactcactgtttccctgtagagaga

SEQ ID NO: 326170 - DNA, 25 bp, Rattus norvegicus
gactcactgtttgcctgtagagaga

SEQ ID NO: 326171 - DNA, 25 bp, Rattus norvegicus
gactcactgttttcttatctctaat

SEQ ID NO: 326172 - DNA, 25 bp, Rattus norvegicus
gactcacttacactcactcttcaat

SEQ ID NO: 326173 - DNA, 25 bp, Rattus norvegicus
gactcacttacagtcactcttcaat

SEQ ID NO: 326174 - DNA, 25 bp, Rattus norvegicus
gactcacttaggaccaagctgcgga

SEQ ID NO: 326175 - DNA, 25 bp, Rattus norvegicus
gactcacttaggtccaagctgcgga

SEQ ID NO: 326176 - DNA, 25 bp, Rattus norvegicus
gactcacttggaacttgtacagaat

SEQ ID NO: 326177 - DNA, 25 bp, Rattus norvegicus
gactcacttggatcttgtacagaat

SEQ ID NO: 326178 - DNA, 25 bp, Rattus norvegicus
gactcactttcaatgtagaatcctt

SEQ ID NO: 326179 - DNA, 25 bp, Rattus norvegicus
gactcactttcattgtagaatcctt

SEQ ID NO: 326180 - DNA, 25 bp, Rattus norvegicus
gactcactttctatagagctgccct

SEQ ID NO: 326181 - DNA, 25 bp, Rattus norvegicus
gactcactttctatatttacagcag

SEQ ID NO: 326182 - DNA, 25 bp, Rattus norvegicus
gactcactttctttagagctgccct

SEQ ID NO: 326183 - DNA, 25 bp, Rattus norvegicus
gactcactttctttatttacagcag

SEQ ID NO: 326184 - DNA, 25 bp, Rattus norvegicus
gactcacttttgacttacagtagtt

SEQ ID NO: 326185 - DNA, 25 bp, Rattus norvegicus
gactcacttttgtcttacagtagtt

SEQ ID NO: 326186 - DNA, 25 bp, Rattus norvegicus
gactcagaacttacaggagaccctg

SEQ ID NO: 326187 - DNA, 25 bp, Rattus norvegicus
gactcagaactttcaggagaccctg

SEQ ID NO: 326188 - DNA, 25 bp, Rattus norvegicus
gactcagaagtaagcgatgtaatta

SEQ ID NO: 326189 - DNA, 25 bp, Rattus norvegicus
gactcagaagtatgcgatgtaatta

SEQ ID NO: 326190 - DNA, 25 bp, Rattus norvegicus
gactcagacatactgtgttcgtcct

SEQ ID NO: 326191 - DNA, 25 bp, Rattus norvegicus
gactcagacatagtgtgttcgtcct

SEQ ID NO: 326192 - DNA, 25 bp, Rattus norvegicus
gactcagaccagagcagtgctcctg

SEQ ID NO: 326193 - DNA, 25 bp, Rattus norvegicus
gactcagaccagtgcagtgctcctg

SEQ ID NO: 326194 - DNA, 25 bp, Rattus norvegicus
gactcagacctgaatatggcaccaa

SEQ ID NO: 326195 - DNA, 25 bp, Rattus norvegicus
gactcagacctgtatatggcaccaa

SEQ ID NO: 326196 - DNA, 25 bp, Rattus norvegicus
gactcagactaactcccaatttagg

SEQ ID NO: 326197 - DNA, 25 bp, Rattus norvegicus
gactcagactaagtcccaatttagg

SEQ ID NO: 326198 - DNA, 25 bp, Rattus norvegicus
gactcagagagcacttgttcaatat

SEQ ID NO: 326199 - DNA, 25 bp, Rattus norvegicus
gactcagagagctcttgttcaatat

SEQ ID NO: 326200 - DNA, 25 bp, Rattus norvegicus
gactcagagctgagattgcagccct

SEQ ID NO: 326201 - DNA, 25 bp, Rattus norvegicus
gactcagagctgtgattgcagccct

SEQ ID NO: 326202 - DNA, 25 bp, Rattus norvegicus
gactcagagggtaatacatacacat

SEQ ID NO: 326203 - DNA, 25 bp, Rattus norvegicus
gactcagagggttatacatacacat

SEQ ID NO: 326204 - DNA, 25 bp, Rattus norvegicus
gactcagagtaacaccatggtgtgg

SEQ ID NO: 326205 - DNA, 25 bp, Rattus norvegicus
gactcagagtaagaccatggtgtgg

SEQ ID NO: 326206 - DNA, 25 bp, Rattus norvegicus
gactcagcaaacatttgttgattga

SEQ ID NO: 326207 - DNA, 25 bp, Rattus norvegicus
gactcagcaaacttttgttgattga

SEQ ID NO: 326208 - DNA, 25 bp, Rattus norvegicus
gactcagcaagcagccttcagtgaa

SEQ ID NO: 326209 - DNA, 25 bp, Rattus norvegicus
gactcagcaagctgccttcagtgaa

SEQ ID NO: 326210 - DNA, 25 bp, Rattus norvegicus
gactcagcactgcacttggctcaga

SEQ ID NO: 326211 - DNA, 25 bp, Rattus norvegicus
gactcagcactggacttggctcaga

SEQ ID NO: 326212 - DNA, 25 bp, Rattus norvegicus
gactcagcagcgactggtaaaccca

SEQ ID NO: 326213 - DNA, 25 bp, Rattus norvegicus
gactcagcagcgagaacaccgagaa

SEQ ID NO: 326214 - DNA, 25 bp, Rattus norvegicus
gactcagcagcgtctggtaaaccca

SEQ ID NO: 326215 - DNA, 25 bp, Rattus norvegicus
gactcagcagcgtgaacaccgagaa

SEQ ID NO: 326216 - DNA, 25 bp, Rattus norvegicus
gactcagcaggaaacagtcgcccaa

SEQ ID NO: 326217 - DNA, 25 bp, Rattus norvegicus
gactcagcaggatacagtcgcccaa

SEQ ID NO: 326218 - DNA, 25 bp, Rattus norvegicus
gactcagcagtaccacaaattatcg

SEQ ID NO: 326219 - DNA, 25 bp, Rattus norvegicus
gactcagcagtagcacaaattatcg

SEQ ID NO: 326220 - DNA, 25 bp, Rattus norvegicus
gactcagcatagaccgagccaggtg

SEQ ID NO: 326221 - DNA, 25 bp, Rattus norvegicus
gactcagcatagtccgagccaggtg

SEQ ID NO: 326222 - DNA, 25 bp, Rattus norvegicus
gactcagcatccacgaagcatcatg

SEQ ID NO: 326223 - DNA, 25 bp, Rattus norvegicus
gactcagcatcctcgaagcatcatg

SEQ ID NO: 326224 - DNA, 25 bp, Rattus norvegicus
gactcagccaatccaaccagtgaaa

SEQ ID NO: 326225 - DNA, 25 bp, Rattus norvegicus
gactcagccaatgcaaccagtgaaa

SEQ ID NO: 326226 - DNA, 25 bp, Rattus norvegicus
gactcagccagcaatgtgtacaccg

SEQ ID NO: 326227 - DNA, 25 bp, Rattus norvegicus
gactcagccagctatgtgtacaccg

SEQ ID NO: 326228 - DNA, 25 bp, Rattus norvegicus
gactcagccaggaaccatcaagatt

SEQ ID NO: 326229 - DNA, 25 bp, Rattus norvegicus
gactcagccaggtaccatcaagatt

SEQ ID NO: 326230 - DNA, 25 bp, Rattus norvegicus
gactcagccatgatatcagcagggt

SEQ ID NO: 326231 - DNA, 25 bp, Rattus norvegicus
gactcagccatgttatcagcagggt

SEQ ID NO: 326232 - DNA, 25 bp, Rattus norvegicus
gactcagcccctcatgggaactaag

SEQ ID NO: 326233 - DNA, 25 bp, Rattus norvegicus
gactcagcccctgatgggaactaag

SEQ ID NO: 326234 - DNA, 25 bp, Rattus norvegicus
gactcagcctcaagtaatttggtgt

SEQ ID NO: 326235 - DNA, 25 bp, Rattus norvegicus
gactcagcctcatgtaatttggtgt

SEQ ID NO: 326236 - DNA, 25 bp, Rattus norvegicus
gactcagcctgcagttaattagcat

SEQ ID NO: 326237 - DNA, 25 bp, Rattus norvegicus
gactcagcctgctgttaattagcat

SEQ ID NO: 326238 - DNA, 25 bp, Rattus norvegicus
gactcagcgggacaaactccagcca

SEQ ID NO: 326239 - DNA, 25 bp, Rattus norvegicus
gactcagcgggagaaactccagcca

SEQ ID NO: 326240 - DNA, 25 bp, Rattus norvegicus
gactcagcgtgtcacctaagctaga

SEQ ID NO: 326241 - DNA, 25 bp, Rattus norvegicus
gactcagcgtgtgacctaagctaga

SEQ ID NO: 326242 - DNA, 25 bp, Rattus norvegicus
gactcagcgttactaatgagacatt

SEQ ID NO: 326243 - DNA, 25 bp, Rattus norvegicus
gactcagcgttagtaatgagacatt

SEQ ID NO: 326244 - DNA, 25 bp, Rattus norvegicus
gactcagctagccatgtgacatttt

SEQ ID NO: 326245 - DNA, 25 bp, Rattus norvegicus
gactcagctagcgatgtgacatttt

SEQ ID NO: 326246 - DNA, 25 bp, Rattus norvegicus
gactcagctcctagaggcggtagca

SEQ ID NO: 326247 - DNA, 25 bp, Rattus norvegicus
gactcagctccttgaggcggtagca

SEQ ID NO: 326248 - DNA, 25 bp, Rattus norvegicus
gactcagctctaagtaaattctcct

SEQ ID NO: 326249 - DNA, 25 bp, Rattus norvegicus
gactcagctctatgtaaattctcct

SEQ ID NO: 326250 - DNA, 25 bp, Rattus norvegicus
gactcagctctcagtcgatgcctga

SEQ ID NO: 326251 - DNA, 25 bp, Rattus norvegicus
gactcagctctctgtcgatgcctga

SEQ ID NO: 326252 - DNA, 25 bp, Rattus norvegicus
gactcagctctgagttatattttgt

SEQ ID NO: 326253 - DNA, 25 bp, Rattus norvegicus
gactcagctctgtgttatattttgt

SEQ ID NO: 326254 - DNA, 25 bp, Rattus norvegicus
gactcagctgccagttgtcttgtgt

SEQ ID NO: 326255 - DNA, 25 bp, Rattus norvegicus
gactcagctgcctgttgtcttgtgt

SEQ ID NO: 326256 - DNA, 25 bp, Rattus norvegicus
gactcagctttgacaagctctacct

SEQ ID NO: 326257 - DNA, 25 bp, Rattus norvegicus
gactcagctttgtcaagctctacct

SEQ ID NO: 326258 - DNA, 25 bp, Rattus norvegicus
gactcaggaaatcggcagagttcac

SEQ ID NO: 326259 - DNA, 25 bp, Rattus norvegicus
gactcaggaaatgggcagagttcac

SEQ ID NO: 326260 - DNA, 25 bp, Rattus norvegicus
gactcaggaagacccacagcactat

SEQ ID NO: 326261 - DNA, 25 bp, Rattus norvegicus
gactcaggaagagccacagcactat

SEQ ID NO: 326262 - DNA, 25 bp, Rattus norvegicus
gactcaggagctccagactgctaag

SEQ ID NO: 326263 - DNA, 25 bp, Rattus norvegicus
gactcaggagctgcagactgctaag

SEQ ID NO: 326264 - DNA, 25 bp, Rattus norvegicus
gactcaggaggtagtcatttccttg

SEQ ID NO: 326265 - DNA, 25 bp, Rattus norvegicus
gactcaggaggtcgctttccagctg

SEQ ID NO: 326266 - DNA, 25 bp, Rattus norvegicus
gactcaggaggtggctttccagctg

SEQ ID NO: 326267 - DNA, 25 bp, Rattus norvegicus
gactcaggaggttgtcatttccttg

SEQ ID NO: 326268 - DNA, 25 bp, Rattus norvegicus
gactcaggagtgaccacgcatgtca

SEQ ID NO: 326269 - DNA, 25 bp, Rattus norvegicus
gactcaggagtgtccacgcatgtca

SEQ ID NO: 326270 - DNA, 25 bp, Rattus norvegicus
gactcaggcctaaggtgtcgcagac

SEQ ID NO: 326271 - DNA, 25 bp, Rattus norvegicus
gactcaggcctatggtgtcgcagac

SEQ ID NO: 326272 - DNA, 25 bp, Rattus norvegicus
gactcaggctctagcatcagcagta

SEQ ID NO: 326273 - DNA, 25 bp, Rattus norvegicus
gactcaggctcttgcatcagcagta

SEQ ID NO: 326274 - DNA, 25 bp, Rattus norvegicus
gactcaggctgcaatgaaggtcatt

SEQ ID NO: 326275 - DNA, 25 bp, Rattus norvegicus
gactcaggctgctatgaaggtcatt

SEQ ID NO: 326276 - DNA, 25 bp, Rattus norvegicus
gactcaggcttcacagggaggctga

SEQ ID NO: 326277 - DNA, 25 bp, Rattus norvegicus
gactcaggcttctcagggaggctga

SEQ ID NO: 326278 - DNA, 25 bp, Rattus norvegicus
gactcagggcggagttccgcatcca

SEQ ID NO: 326279 - DNA, 25 bp, Rattus norvegicus
gactcagggcggtgttccgcatcca

SEQ ID NO: 326280 - DNA, 25 bp, Rattus norvegicus
gactcagggtcccagaactgtagct

SEQ ID NO: 326281 - DNA, 25 bp, Rattus norvegicus
gactcagggtccgagaactgtagct

SEQ ID NO: 326282 - DNA, 25 bp, Rattus norvegicus
gactcaggtcatattctaccgagag

SEQ ID NO: 326283 - DNA, 25 bp, Rattus norvegicus
gactcaggtcattttctaccgagag

SEQ ID NO: 326284 - DNA, 25 bp, Rattus norvegicus
gactcaggtgaaaactctgtctcct

SEQ ID NO: 326285 - DNA, 25 bp, Rattus norvegicus
gactcaggtgaatactctgtctcct

SEQ ID NO: 326286 - DNA, 25 bp, Rattus norvegicus
gactcaggtgccagagtgtcactga

SEQ ID NO: 326287 - DNA, 25 bp, Rattus norvegicus
gactcaggtgccagcactgctggaa

SEQ ID NO: 326288 - DNA, 25 bp, Rattus norvegicus
gactcaggtgcctgagtgtcactga

SEQ ID NO: 326289 - DNA, 25 bp, Rattus norvegicus
gactcaggtgcctgcactgctggaa

SEQ ID NO: 326290 - DNA, 25 bp, Rattus norvegicus
gactcaggtgggagcatttgtactg

SEQ ID NO: 326291 - DNA, 25 bp, Rattus norvegicus
gactcaggtgggtgcatttgtactg

SEQ ID NO: 326292 - DNA, 25 bp, Rattus norvegicus
gactcaggtttgacaccacgacatt

SEQ ID NO: 326293 - DNA, 25 bp, Rattus norvegicus
gactcaggtttgtcaccacgacatt

SEQ ID NO: 326294 - DNA, 25 bp, Rattus norvegicus
gactcagtactcatttaagcgggta

SEQ ID NO: 326295 - DNA, 25 bp, Rattus norvegicus
gactcagtactcttttaagcgggta

SEQ ID NO: 326296 - DNA, 25 bp, Rattus norvegicus
gactcagtactgacacgtccgtgag

SEQ ID NO: 326297 - DNA, 25 bp, Rattus norvegicus
gactcagtactgtcacgtccgtgag

SEQ ID NO: 326298 - DNA, 25 bp, Rattus norvegicus
gactcagtaggcagcccttgaggga

SEQ ID NO: 326299 - DNA, 25 bp, Rattus norvegicus
gactcagtaggctgcccttgaggga

SEQ ID NO: 326300 - DNA, 25 bp, Rattus norvegicus
gactcagtatctcaggccaaaggtt

SEQ ID NO: 326301 - DNA, 25 bp, Rattus norvegicus
gactcagtatctgaggccaaaggtt

SEQ ID NO: 326302 - DNA, 25 bp, Rattus norvegicus
gactcagtcccgaccgggatctcag

SEQ ID NO: 326303 - DNA, 25 bp, Rattus norvegicus
gactcagtcccgtccgggatctcag

SEQ ID NO: 326304 - DNA, 25 bp, Rattus norvegicus
gactcagtcctgatgacagcagaaa

SEQ ID NO: 326305 - DNA, 25 bp, Rattus norvegicus
gactcagtcctgttgacagcagaaa

SEQ ID NO: 326306 - DNA, 25 bp, Rattus norvegicus
gactcagtcgcgaggatgttccaac

SEQ ID NO: 326307 - DNA, 25 bp, Rattus norvegicus
gactcagtcgcgtggatgttccaac

SEQ ID NO: 326308 - DNA, 25 bp, Rattus norvegicus
gactcagtcggcagcaaacaacctt

SEQ ID NO: 326309 - DNA, 25 bp, Rattus norvegicus
gactcagtcggctgcaaacaacctt

SEQ ID NO: 326310 - DNA, 25 bp, Rattus norvegicus
gactcagtctgtaagtgcttctagt

SEQ ID NO: 326311 - DNA, 25 bp, Rattus norvegicus
gactcagtctgttagtgcttctagt

SEQ ID NO: 326312 - DNA, 25 bp, Rattus norvegicus
gactcagtcttcatcaagaaggctg

SEQ ID NO: 326313 - DNA, 25 bp, Rattus norvegicus
gactcagtcttcttcaagaaggctg

SEQ ID NO: 326314 - DNA, 25 bp, Rattus norvegicus
gactcagtcttgaattggaactctt

SEQ ID NO: 326315 - DNA, 25 bp, Rattus norvegicus
gactcagtcttgtattggaactctt

SEQ ID NO: 326316 - DNA, 25 bp, Rattus norvegicus
gactcagtgaacctccaaggtgact

SEQ ID NO: 326317 - DNA, 25 bp, Rattus norvegicus
gactcagtgaacgtccaaggtgact

SEQ ID NO: 326318 - DNA, 25 bp, Rattus norvegicus
gactcagtgactaccgtgggctggt

SEQ ID NO: 326319 - DNA, 25 bp, Rattus norvegicus
gactcagtgacttccgtgggctggt

SEQ ID NO: 326320 - DNA, 25 bp, Rattus norvegicus
gactcagtggtacaaccttctccaa

SEQ ID NO: 326321 - DNA, 25 bp, Rattus norvegicus
gactcagtggtagaaccttctccaa

SEQ ID NO: 326322 - DNA, 25 bp, Rattus norvegicus
gactcagtggtgacttctcgggctg

SEQ ID NO: 326323 - DNA, 25 bp, Rattus norvegicus
gactcagtggtgtcttctcgggctg

SEQ ID NO: 326324 - DNA, 25 bp, Rattus norvegicus
gactcagtgtaccaaagtttccctc

SEQ ID NO: 326325 - DNA, 25 bp, Rattus norvegicus
gactcagtgtacgaaagtttccctc

SEQ ID NO: 326326 - DNA, 25 bp, Rattus norvegicus
gactcagtgtagcagtgagctcctt

SEQ ID NO: 326327 - DNA, 25 bp, Rattus norvegicus
gactcagtgtaggagtgagctcctt

SEQ ID NO: 326328 - DNA, 25 bp, Rattus norvegicus
gactcagtgtcacgctccaaggctg

SEQ ID NO: 326329 - DNA, 25 bp, Rattus norvegicus
gactcagtgtcaggctccaaggctg

SEQ ID NO: 326330 - DNA, 25 bp, Rattus norvegicus
gactcagttattcacaaaccccaga

SEQ ID NO: 326331 - DNA, 25 bp, Rattus norvegicus
gactcagttattgacaaaccccaga

SEQ ID NO: 326332 - DNA, 25 bp, Rattus norvegicus
gactcagttcagaatttacctaggg

SEQ ID NO: 326333 - DNA, 25 bp, Rattus norvegicus
gactcagttcagtatttacctaggg

SEQ ID NO: 326334 - DNA, 25 bp, Rattus norvegicus
gactcagttggtcaattctcctttc

SEQ ID NO: 326335 - DNA, 25 bp, Rattus norvegicus
gactcagttggtgaattctcctttc

SEQ ID NO: 326336 - DNA, 25 bp, Rattus norvegicus
gactcagtttacacctctgtaacaa

SEQ ID NO: 326337 - DNA, 25 bp, Rattus norvegicus
gactcagtttactcctctgtaacaa

SEQ ID NO: 326338 - DNA, 25 bp, Rattus norvegicus
gactcagtttctcaaacagcagctt

SEQ ID NO: 326339 - DNA, 25 bp, Rattus norvegicus
gactcagtttctgaaacagcagctt

SEQ ID NO: 326340 - DNA, 25 bp, Rattus norvegicus
gactcagttttgattacctttctgt

SEQ ID NO: 326341 - DNA, 25 bp, Rattus norvegicus
gactcagttttgtttacctttctgt

SEQ ID NO: 326342 - DNA, 25 bp, Rattus norvegicus
gactcagtttttactgcgttctggt

SEQ ID NO: 326343 - DNA, 25 bp, Rattus norvegicus
gactcagttttttctgcgttctggt

SEQ ID NO: 326344 - DNA, 25 bp, Rattus norvegicus
gactcataaaccatactctagtgct

SEQ ID NO: 326345 - DNA, 25 bp, Rattus norvegicus
gactcataaaccttactctagtgct

SEQ ID NO: 326346 - DNA, 25 bp, Rattus norvegicus
gactcataagagcacggatcttctt

SEQ ID NO: 326347 - DNA, 25 bp, Rattus norvegicus
gactcataagaggacggatcttctt

SEQ ID NO: 326348 - DNA, 25 bp, Rattus norvegicus
gactcataagccctgcacagttgtg

SEQ ID NO: 326349 - DNA, 25 bp, Rattus norvegicus
gactcataagccgtgcacagttgtg

SEQ ID NO: 326350 - DNA, 25 bp, Rattus norvegicus
gactcatacaagctatcacactggt

SEQ ID NO: 326351 - DNA, 25 bp, Rattus norvegicus
gactcatacaaggtatcacactggt

SEQ ID NO: 326352 - DNA, 25 bp, Rattus norvegicus
gactcataccagcagcgccagtagg

SEQ ID NO: 326353 - DNA, 25 bp, Rattus norvegicus
gactcataccaggagcgccagtagg

SEQ ID NO: 326354 - DNA, 25 bp, Rattus norvegicus
gactcatacgggaacttctccagac

SEQ ID NO: 326355 - DNA, 25 bp, Rattus norvegicus
gactcatacgggtacttctccagac

SEQ ID NO: 326356 - DNA, 25 bp, Rattus norvegicus
gactcatactaacgatctgcagcat

SEQ ID NO: 326357 - DNA, 25 bp, Rattus norvegicus
gactcatactaaggatctgcagcat

SEQ ID NO: 326358 - DNA, 25 bp, Rattus norvegicus
gactcatagagaaaggcctgccttt

SEQ ID NO: 326359 - DNA, 25 bp, Rattus norvegicus
gactcatagagataggcctgccttt

SEQ ID NO: 326360 - DNA, 25 bp, Rattus norvegicus
gactcatatcacatgaatctgtggc

SEQ ID NO: 326361 - DNA, 25 bp, Rattus norvegicus
gactcatatcacttgaatctgtggc

SEQ ID NO: 326362 - DNA, 25 bp, Rattus norvegicus
gactcatcagtactttgtgtgttac

SEQ ID NO: 326363 - DNA, 25 bp, Rattus norvegicus
gactcatcagtagtttgtgtgttac

SEQ ID NO: 326364 - DNA, 25 bp, Rattus norvegicus
gactcatcattaatatcccattcct

SEQ ID NO: 326365 - DNA, 25 bp, Rattus norvegicus
gactcatcattattatcccattcct

SEQ ID NO: 326366 - DNA, 25 bp, Rattus norvegicus
gactcatccacacagctcattgaaa

SEQ ID NO: 326367 - DNA, 25 bp, Rattus norvegicus
gactcatccacagagctcattgaaa

SEQ ID NO: 326368 - DNA, 25 bp, Rattus norvegicus
gactcatcgagtccagctacgccaa

SEQ ID NO: 326369 - DNA, 25 bp, Rattus norvegicus
gactcatcgagtgcagctacgccaa

SEQ ID NO: 326370 - DNA, 25 bp, Rattus norvegicus
gactcatctaacaccattcaatcag

SEQ ID NO: 326371 - DNA, 25 bp, Rattus norvegicus
gactcatctaactccattcaatcag

SEQ ID NO: 326372 - DNA, 25 bp, Rattus norvegicus
gactcatctattaacacattctgaa

SEQ ID NO: 326373 - DNA, 25 bp, Rattus norvegicus
gactcatctatttacacattctgaa

SEQ ID NO: 326374 - DNA, 25 bp, Rattus norvegicus
gactcatctcgcataaaatcagaaa

SEQ ID NO: 326375 - DNA, 25 bp, Rattus norvegicus
gactcatctcgcttaaaatcagaaa

SEQ ID NO: 326376 - DNA, 25 bp, Rattus norvegicus
gactcatctctcaagttcaggacta

SEQ ID NO: 326377 - DNA, 25 bp, Rattus norvegicus
gactcatctctctagttcaggacta

SEQ ID NO: 326378 - DNA, 25 bp, Rattus norvegicus
gactcatcttaactattggtccagt

SEQ ID NO: 326379 - DNA, 25 bp, Rattus norvegicus
gactcatcttaagtattggtccagt

SEQ ID NO: 326380 - DNA, 25 bp, Rattus norvegicus
gactcatcttcgactgacctaatgg

SEQ ID NO: 326381 - DNA, 25 bp, Rattus norvegicus
gactcatcttcgtctgacctaatgg

SEQ ID NO: 326382 - DNA, 25 bp, Rattus norvegicus
gactcatctttcataatccttacat

SEQ ID NO: 326383 - DNA, 25 bp, Rattus norvegicus
gactcatctttcttaatccttacat

SEQ ID NO: 326384 - DNA, 25 bp, Rattus norvegicus
gactcatcttttagactcagagcag

SEQ ID NO: 326385 - DNA, 25 bp, Rattus norvegicus
gactcatctttttgactcagagcag

SEQ ID NO: 326386 - DNA, 25 bp, Rattus norvegicus
gactcatgaccaagttctggcgttc

SEQ ID NO: 326387 - DNA, 25 bp, Rattus norvegicus
gactcatgaccatgttctggcgttc

SEQ ID NO: 326388 - DNA, 25 bp, Rattus norvegicus
gactcatgagtcatatacctggaat

SEQ ID NO: 326389 - DNA, 25 bp, Rattus norvegicus
gactcatgagtcttatacctggaat

SEQ ID NO: 326390 - DNA, 25 bp, Rattus norvegicus
gactcatgatatatgcctttggcta

SEQ ID NO: 326391 - DNA, 25 bp, Rattus norvegicus
gactcatgatatttgcctttggcta

SEQ ID NO: 326392 - DNA, 25 bp, Rattus norvegicus
gactcatgcaagatcctgggttcaa

SEQ ID NO: 326393 - DNA, 25 bp, Rattus norvegicus
gactcatgcaagttcctgggttcaa

SEQ ID NO: 326394 - DNA, 25 bp, Rattus norvegicus
gactcatgccggaattaccagacag

SEQ ID NO: 326395 - DNA, 25 bp, Rattus norvegicus
gactcatgccggtattaccagacag

SEQ ID NO: 326396 - DNA, 25 bp, Rattus norvegicus
gactcatgctaactttattgcctct

SEQ ID NO: 326397 - DNA, 25 bp, Rattus norvegicus
gactcatgctaagtttattgcctct

SEQ ID NO: 326398 - DNA, 25 bp, Rattus norvegicus
gactcatggaccattgctagttctc

SEQ ID NO: 326399 - DNA, 25 bp, Rattus norvegicus
gactcatggacctttgctagttctc

SEQ ID NO: 326400 - DNA, 25 bp, Rattus norvegicus
gactcatggcccagccagaagagat

SEQ ID NO: 326401 - DNA, 25 bp, Rattus norvegicus
gactcatggccctgccagaagagat

SEQ ID NO: 326402 - DNA, 25 bp, Rattus norvegicus
gactcatggtacacaggctgacgta

SEQ ID NO: 326403 - DNA, 25 bp, Rattus norvegicus
gactcatggtactcaggctgacgta

SEQ ID NO: 326404 - DNA, 25 bp, Rattus norvegicus
gactcatgtggtcccctaggcctgg

SEQ ID NO: 326405 - DNA, 25 bp, Rattus norvegicus
gactcatgtggtgccctaggcctgg

SEQ ID NO: 326406 - DNA, 25 bp, Rattus norvegicus
gactcatgtgttaactgcagcagcc

SEQ ID NO: 326407 - DNA, 25 bp, Rattus norvegicus
gactcatgtgtttactgcagcagcc

SEQ ID NO: 326408 - DNA, 25 bp, Rattus norvegicus
gactcattaagaccccagcagacag

SEQ ID NO: 326409 - DNA, 25 bp, Rattus norvegicus
gactcattaagagcccagcagacag

SEQ ID NO: 326410 - DNA, 25 bp, Rattus norvegicus
gactcattcaacctccagagagaag

SEQ ID NO: 326411 - DNA, 25 bp, Rattus norvegicus
gactcattcaacgtccagagagaag

SEQ ID NO: 326412 - DNA, 25 bp, Rattus norvegicus
gactcattcagtacacctcatgacg

SEQ ID NO: 326413 - DNA, 25 bp, Rattus norvegicus
gactcattcagttcacctcatgacg

SEQ ID NO: 326414 - DNA, 25 bp, Rattus norvegicus
gactcattcatacaattttctatga

SEQ ID NO: 326415 - DNA, 25 bp, Rattus norvegicus
gactcattcatagaattttctatga

SEQ ID NO: 326416 - DNA, 25 bp, Rattus norvegicus
gactcattcatcattgttccttgga

SEQ ID NO: 326417 - DNA, 25 bp, Rattus norvegicus
gactcattcatctttgttccttgga

SEQ ID NO: 326418 - DNA, 25 bp, Rattus norvegicus
gactcattcatgaccatctcacaat

SEQ ID NO: 326419 - DNA, 25 bp, Rattus norvegicus
gactcattcatgtccatctcacaat

SEQ ID NO: 326420 - DNA, 25 bp, Rattus norvegicus
gactcattccgtagtgatcggctac

SEQ ID NO: 326421 - DNA, 25 bp, Rattus norvegicus
gactcattccgttgtgatcggctac

SEQ ID NO: 326422 - DNA, 25 bp, Rattus norvegicus
gactcattccttaataagccccaaa

SEQ ID NO: 326423 - DNA, 25 bp, Rattus norvegicus
gactcattccttatgacaagctgta

SEQ ID NO: 326424 - DNA, 25 bp, Rattus norvegicus
gactcattcctttataagccccaaa

SEQ ID NO: 326425 - DNA, 25 bp, Rattus norvegicus
gactcattccttttgacaagctgta

SEQ ID NO: 326426 - DNA, 25 bp, Rattus norvegicus
gactcattgatgcttgtgttaatta

SEQ ID NO: 326427 - DNA, 25 bp, Rattus norvegicus
gactcattgatggttgtgttaatta

SEQ ID NO: 326428 - DNA, 25 bp, Rattus norvegicus
gactcattgcatatttagttgcttc

SEQ ID NO: 326429 - DNA, 25 bp, Rattus norvegicus
gactcattgcatttttagttgcttc

SEQ ID NO: 326430 - DNA, 25 bp, Rattus norvegicus
gactcattgctgatgtgtgcttgtt

SEQ ID NO: 326431 - DNA, 25 bp, Rattus norvegicus
gactcattgctgttgtgtgcttgtt

SEQ ID NO: 326432 - DNA, 25 bp, Rattus norvegicus
gactcattggagattcttgctcacc

SEQ ID NO: 326433 - DNA, 25 bp, Rattus norvegicus
gactcattggagtttcttgctcacc

SEQ ID NO: 326434 - DNA, 25 bp, Rattus norvegicus
gactcattggtgacagagccagcga

SEQ ID NO: 326435 - DNA, 25 bp, Rattus norvegicus
gactcattggtgtcagagccagcga

SEQ ID NO: 326436 - DNA, 25 bp, Rattus norvegicus
gactcattgtaacttgccactacca

SEQ ID NO: 326437 - DNA, 25 bp, Rattus norvegicus
gactcattgtaagttgccactacca

SEQ ID NO: 326438 - DNA, 25 bp, Rattus norvegicus
gactcattgttaacatctctcttta

SEQ ID NO: 326439 - DNA, 25 bp, Rattus norvegicus
gactcattgttatcatctctcttta

SEQ ID NO: 326440 - DNA, 25 bp, Rattus norvegicus
gactcattgttgaatgtgatccaca

SEQ ID NO: 326441 - DNA, 25 bp, Rattus norvegicus
gactcattgttgtatgtgatccaca

SEQ ID NO: 326442 - DNA, 25 bp, Rattus norvegicus
gactcatttagcattttgtatggtg

SEQ ID NO: 326443 - DNA, 25 bp, Rattus norvegicus
gactcatttagctttttgtatggtg

SEQ ID NO: 326444 - DNA, 25 bp, Rattus norvegicus
gactcatttgagaattctgcctctt

SEQ ID NO: 326445 - DNA, 25 bp, Rattus norvegicus
gactcatttgagagtcagaggcagg

SEQ ID NO: 326446 - DNA, 25 bp, Rattus norvegicus
gactcatttgagtattctgcctctt

SEQ ID NO: 326447 - DNA, 25 bp, Rattus norvegicus
gactcatttgagtgtcagaggcagg

SEQ ID NO: 326448 - DNA, 25 bp, Rattus norvegicus
gactcatttgctaattcagggcaga

SEQ ID NO: 326449 - DNA, 25 bp, Rattus norvegicus
gactcatttgcttattcagggcaga

SEQ ID NO: 326450 - DNA, 25 bp, Rattus norvegicus
gactcatttgtaacttttcagcact

SEQ ID NO: 326451 - DNA, 25 bp, Rattus norvegicus
gactcatttgtatcttttcagcact

SEQ ID NO: 326452 - DNA, 25 bp, Rattus norvegicus
gactcattttatccagtggatccca

SEQ ID NO: 326453 - DNA, 25 bp, Rattus norvegicus
gactcattttatgcagtggatccca

SEQ ID NO: 326454 - DNA, 25 bp, Rattus norvegicus
gactcattttctaagccgggcattg

SEQ ID NO: 326455 - DNA, 25 bp, Rattus norvegicus
gactcattttctctcagtggttgaa

SEQ ID NO: 326456 - DNA, 25 bp, Rattus norvegicus
gactcattttctgtcagtggttgaa

SEQ ID NO: 326457 - DNA, 25 bp, Rattus norvegicus
gactcattttcttagccgggcattg

SEQ ID NO: 326458 - DNA, 25 bp, Rattus norvegicus
gactcattttgccagcgtaagcatt

SEQ ID NO: 326459 - DNA, 25 bp, Rattus norvegicus
gactcattttgcgagcgtaagcatt

SEQ ID NO: 326460 - DNA, 25 bp, Rattus norvegicus
gactcattttgtactgtatcttgaa

SEQ ID NO: 326461 - DNA, 25 bp, Rattus norvegicus
gactcattttgttctgtatcttgaa

SEQ ID NO: 326462 - DNA, 25 bp, Rattus norvegicus
gactcatttttaagtgtcactactg

SEQ ID NO: 326463 - DNA, 25 bp, Rattus norvegicus
gactcatttttatgtgtcactactg

SEQ ID NO: 326464 - DNA, 25 bp, Rattus norvegicus
gactccaaaaccacatatgaccaga

SEQ ID NO: 326465 - DNA, 25 bp, Rattus norvegicus
gactccaaaacctcatatgaccaga

SEQ ID NO: 326466 - DNA, 25 bp, Rattus norvegicus
gactccaaacctcggtctctattag

SEQ ID NO: 326467 - DNA, 25 bp, Rattus norvegicus
gactccaaacctgggtctctattag

SEQ ID NO: 326468 - DNA, 25 bp, Rattus norvegicus
gactccaaaggtaaggccctagctt

SEQ ID NO: 326469 - DNA, 25 bp, Rattus norvegicus
gactccaaaggttaggccctagctt

SEQ ID NO: 326470 - DNA, 25 bp, Rattus norvegicus
gactccaaatgaacaggacctttat

SEQ ID NO: 326471 - DNA, 25 bp, Rattus norvegicus
gactccaaatgatcaggacctttat

SEQ ID NO: 326472 - DNA, 25 bp, Rattus norvegicus
gactccaacgtgcaaaccattgttg

SEQ ID NO: 326473 - DNA, 25 bp, Rattus norvegicus
gactccaacgtggaaaccattgttg

SEQ ID NO: 326474 - DNA, 25 bp, Rattus norvegicus
gactccaactggctaggctggatta

SEQ ID NO: 326475 - DNA, 25 bp, Rattus norvegicus
gactccaactgggtaggctggatta

SEQ ID NO: 326476 - DNA, 25 bp, Rattus norvegicus
gactccaagatcaagttcccattgc

SEQ ID NO: 326477 - DNA, 25 bp, Rattus norvegicus
gactccaagatctagttcccattgc

SEQ ID NO: 326478 - DNA, 25 bp, Rattus norvegicus
gactccaagatgacctagtgcttca

SEQ ID NO: 326479 - DNA, 25 bp, Rattus norvegicus
gactccaagatgtcctagtgcttca

SEQ ID NO: 326480 - DNA, 25 bp, Rattus norvegicus
gactccaagcaacaagatctcgctc

SEQ ID NO: 326481 - DNA, 25 bp, Rattus norvegicus
gactccaagcaagaagatctcgctc

SEQ ID NO: 326482 - DNA, 25 bp, Rattus norvegicus
gactccaaggagatcagaccccaag

SEQ ID NO: 326483 - DNA, 25 bp, Rattus norvegicus
gactccaaggagttcagaccccaag

SEQ ID NO: 326484 - DNA, 25 bp, Rattus norvegicus
gactccaatggacagccagagggta

SEQ ID NO: 326485 - DNA, 25 bp, Rattus norvegicus
gactccaatggagagccagagggta

SEQ ID NO: 326486 - DNA, 25 bp, Rattus norvegicus
gactccacaaatcgtctctttggtt

SEQ ID NO: 326487 - DNA, 25 bp, Rattus norvegicus
gactccacaaatggtctctttggtt

SEQ ID NO: 326488 - DNA, 25 bp, Rattus norvegicus
gactccacaagaaggttcaccagcg

SEQ ID NO: 326489 - DNA, 25 bp, Rattus norvegicus
gactccacaagatggttcaccagcg

SEQ ID NO: 326490 - DNA, 25 bp, Rattus norvegicus
gactccacagacaagcttaaactgg

SEQ ID NO: 326491 - DNA, 25 bp, Rattus norvegicus
gactccacagactagcttaaactgg

SEQ ID NO: 326492 - DNA, 25 bp, Rattus norvegicus
gactccacgtggaacctctttgaga

SEQ ID NO: 326493 - DNA, 25 bp, Rattus norvegicus
gactccacgtggtacctctttgaga

SEQ ID NO: 326494 - DNA, 25 bp, Rattus norvegicus
gactccactgtgagatgggcgcact

SEQ ID NO: 326495 - DNA, 25 bp, Rattus norvegicus
gactccactgtgtgatgggcgcact

SEQ ID NO: 326496 - DNA, 25 bp, Rattus norvegicus
gactccactttcatctagttggttg

SEQ ID NO: 326497 - DNA, 25 bp, Rattus norvegicus
gactccactttcttctagttggttg

SEQ ID NO: 326498 - DNA, 25 bp, Rattus norvegicus
gactccagacttactaaagctgcct

SEQ ID NO: 326499 - DNA, 25 bp, Rattus norvegicus
gactccagactttctaaagctgcct

SEQ ID NO: 326500 - DNA, 25 bp, Rattus norvegicus
gactccagagacatgtcattgtacc

SEQ ID NO: 326501 - DNA, 25 bp, Rattus norvegicus
gactccagagacttgtcattgtacc

SEQ ID NO: 326502 - DNA, 25 bp, Rattus norvegicus
gactccagagtcactgcaaccatag

SEQ ID NO: 326503 - DNA, 25 bp, Rattus norvegicus
gactccagagtctctgcaaccatag

SEQ ID NO: 326504 - DNA, 25 bp, Rattus norvegicus
gactccagatgtaaacttacgcctc

SEQ ID NO: 326505 - DNA, 25 bp, Rattus norvegicus
gactccagatgttaacttacgcctc

SEQ ID NO: 326506 - DNA, 25 bp, Rattus norvegicus
gactccagattcataatagagttca

SEQ ID NO: 326507 - DNA, 25 bp, Rattus norvegicus
gactccagattcttaatagagttca

SEQ ID NO: 326508 - DNA, 25 bp, Rattus norvegicus
gactccagcacacgcgttctcaagg

SEQ ID NO: 326509 - DNA, 25 bp, Rattus norvegicus
gactccagcacaggcgttctcaagg

SEQ ID NO: 326510 - DNA, 25 bp, Rattus norvegicus
gactccagccatagcaagggtcagg

SEQ ID NO: 326511 - DNA, 25 bp, Rattus norvegicus
gactccagccattgcaagggtcagg

SEQ ID NO: 326512 - DNA, 25 bp, Rattus norvegicus
gactccagccctatttatgttagtt

SEQ ID NO: 326513 - DNA, 25 bp, Rattus norvegicus
gactccagccctttttatgttagtt

SEQ ID NO: 326514 - DNA, 25 bp, Rattus norvegicus
gactccagcgccctgcaggtgtcag

SEQ ID NO: 326515 - DNA, 25 bp, Rattus norvegicus
gactccagcgccgtgcaggtgtcag

SEQ ID NO: 326516 - DNA, 25 bp, Rattus norvegicus
gactccagctgtatatgaagcagag

SEQ ID NO: 326517 - DNA, 25 bp, Rattus norvegicus
gactccagctgtttatgaagcagag

SEQ ID NO: 326518 - DNA, 25 bp, Rattus norvegicus
gactccaggagtatcttattttcac

SEQ ID NO: 326519 - DNA, 25 bp, Rattus norvegicus
gactccaggagtttcttattttcac

SEQ ID NO: 326520 - DNA, 25 bp, Rattus norvegicus
gactccaggcagaggcattcatgga

SEQ ID NO: 326521 - DNA, 25 bp, Rattus norvegicus
gactccaggcagtggcattcatgga

SEQ ID NO: 326522 - DNA, 25 bp, Rattus norvegicus
gactccaggcctacccagggaaaca

SEQ ID NO: 326523 - DNA, 25 bp, Rattus norvegicus
gactccaggccttcccagggaaaca

SEQ ID NO: 326524 - DNA, 25 bp, Rattus norvegicus
gactccaggctgcatcatgtatcat

SEQ ID NO: 326525 - DNA, 25 bp, Rattus norvegicus
gactccaggctggatcatgtatcat

SEQ ID NO: 326526 - DNA, 25 bp, Rattus norvegicus
gactccagtaggcaacttggaagtt

SEQ ID NO: 326527 - DNA, 25 bp, Rattus norvegicus
gactccagtagggaacttggaagtt

SEQ ID NO: 326528 - DNA, 25 bp, Rattus norvegicus
gactccagtgatcatgctgacgact

SEQ ID NO: 326529 - DNA, 25 bp, Rattus norvegicus
gactccagtgatgatgctgacgact

SEQ ID NO: 326530 - DNA, 25 bp, Rattus norvegicus
gactccagtggacgaagcacccagg

SEQ ID NO: 326531 - DNA, 25 bp, Rattus norvegicus
gactccagtggaggaagcacccagg

SEQ ID NO: 326532 - DNA, 25 bp, Rattus norvegicus
gactccagtggcagtgtcaagcgca

SEQ ID NO: 326533 - DNA, 25 bp, Rattus norvegicus
gactccagtggctgtgtcaagcgca

SEQ ID NO: 326534 - DNA, 25 bp, Rattus norvegicus
gactccagtgtcaccgtgggcatga

SEQ ID NO: 326535 - DNA, 25 bp, Rattus norvegicus
gactccagtgtcatcgttagctagt

SEQ ID NO: 326536 - DNA, 25 bp, Rattus norvegicus
gactccagtgtctccgtgggcatga

SEQ ID NO: 326537 - DNA, 25 bp, Rattus norvegicus
gactccagtgtcttcgttagctagt

SEQ ID NO: 326538 - DNA, 25 bp, Rattus norvegicus
gactccagtgtgaaaacacagcatg

SEQ ID NO: 326539 - DNA, 25 bp, Rattus norvegicus
gactccagtgtgtaaacacagcatg

SEQ ID NO: 326540 - DNA, 25 bp, Rattus norvegicus
gactccagtgttaccatctttagtg

SEQ ID NO: 326541 - DNA, 25 bp, Rattus norvegicus
gactccagtgtttccatctttagtg

SEQ ID NO: 326542 - DNA, 25 bp, Rattus norvegicus
gactccagttccaggaagatcccag

SEQ ID NO: 326543 - DNA, 25 bp, Rattus norvegicus
gactccagttcctggaagatcccag

SEQ ID NO: 326544 - DNA, 25 bp, Rattus norvegicus
gactccatagacacgctgcgtgact

SEQ ID NO: 326545 - DNA, 25 bp, Rattus norvegicus
gactccatagactcgctgcgtgact

SEQ ID NO: 326546 - DNA, 25 bp, Rattus norvegicus
gactccatagtgactgtgcacatcg

SEQ ID NO: 326547 - DNA, 25 bp, Rattus norvegicus
gactccatagtgtctgtgcacatcg

SEQ ID NO: 326548 - DNA, 25 bp, Rattus norvegicus
gactccatcaagacaatccagggcc

SEQ ID NO: 326549 - DNA, 25 bp, Rattus norvegicus
gactccatcaagtcaatccagggcc

SEQ ID NO: 326550 - DNA, 25 bp, Rattus norvegicus
gactccatcagccagatcttaggtt

SEQ ID NO: 326551 - DNA, 25 bp, Rattus norvegicus
gactccatcagcgagatcttaggtt

SEQ ID NO: 326552 - DNA, 25 bp, Rattus norvegicus
gactccatctcaatggcccaggaag

SEQ ID NO: 326553 - DNA, 25 bp, Rattus norvegicus
gactccatctcattggcccaggaag

SEQ ID NO: 326554 - DNA, 25 bp, Rattus norvegicus
gactccatctggcaaaccatcctga

SEQ ID NO: 326555 - DNA, 25 bp, Rattus norvegicus
gactccatctgggaaaccatcctga

SEQ ID NO: 326556 - DNA, 25 bp, Rattus norvegicus
gactccatgataatctgaggcagcc

SEQ ID NO: 326557 - DNA, 25 bp, Rattus norvegicus
gactccatgatattctgaggcagcc

SEQ ID NO: 326558 - DNA, 25 bp, Rattus norvegicus
gactccatgcagctgaccagaatgc

SEQ ID NO: 326559 - DNA, 25 bp, Rattus norvegicus
gactccatgcaggtgaccagaatgc

SEQ ID NO: 326560 - DNA, 25 bp, Rattus norvegicus
gactccatgctgattgtatttccag

SEQ ID NO: 326561 - DNA, 25 bp, Rattus norvegicus
gactccatgctgtttgtatttccag

SEQ ID NO: 326562 - DNA, 25 bp, Rattus norvegicus
gactccatgtcaacgaggcacctgt

SEQ ID NO: 326563 - DNA, 25 bp, Rattus norvegicus
gactccatgtcatcgaggcacctgt

SEQ ID NO: 326564 - DNA, 25 bp, Rattus norvegicus
gactccattcacatgagaactgcag

SEQ ID NO: 326565 - DNA, 25 bp, Rattus norvegicus
gactccattcacttgagaactgcag

SEQ ID NO: 326566 - DNA, 25 bp, Rattus norvegicus
gactccattcatagggctgaacaca

SEQ ID NO: 326567 - DNA, 25 bp, Rattus norvegicus
gactccattcattgggctgaacaca

SEQ ID NO: 326568 - DNA, 25 bp, Rattus norvegicus
gactccattgtaaaagctctctctc

SEQ ID NO: 326569 - DNA, 25 bp, Rattus norvegicus
gactccattgtataagctctctctc

SEQ ID NO: 326570 - DNA, 25 bp, Rattus norvegicus
gactccattgtcctgaaatctacta

SEQ ID NO: 326571 - DNA, 25 bp, Rattus norvegicus
gactccattgtcgtgaaatctacta

SEQ ID NO: 326572 - DNA, 25 bp, Rattus norvegicus
gactccatttagaacactctctatg

SEQ ID NO: 326573 - DNA, 25 bp, Rattus norvegicus
gactccatttagtacactctctatg

SEQ ID NO: 326574 - DNA, 25 bp, Rattus norvegicus
gactccattttcctgtactgcatag

SEQ ID NO: 326575 - DNA, 25 bp, Rattus norvegicus
gactccattttcgtgtactgcatag

SEQ ID NO: 326576 - DNA, 25 bp, Rattus norvegicus
gactcccaagaaagcagattcccaa

SEQ ID NO: 326577 - DNA, 25 bp, Rattus norvegicus
gactcccaagaatgcagattcccaa

SEQ ID NO: 326578 - DNA, 25 bp, Rattus norvegicus
gactcccaaggacgcattccggcag

SEQ ID NO: 326579 - DNA, 25 bp, Rattus norvegicus
gactcccaaggaggcattccggcag

SEQ ID NO: 326580 - DNA, 25 bp, Rattus norvegicus
gactcccaaggcagtgtgaggtgtt

SEQ ID NO: 326581 - DNA, 25 bp, Rattus norvegicus
gactcccaaggctgtgtgaggtgtt

SEQ ID NO: 326582 - DNA, 25 bp, Rattus norvegicus
gactcccaagtgattctgctttaga

SEQ ID NO: 326583 - DNA, 25 bp, Rattus norvegicus
gactcccaagtgtttctgctttaga

SEQ ID NO: 326584 - DNA, 25 bp, Rattus norvegicus
gactcccacacaccctatgtgaata

SEQ ID NO: 326585 - DNA, 25 bp, Rattus norvegicus
gactcccacacagcctatgtgaata

SEQ ID NO: 326586 - DNA, 25 bp, Rattus norvegicus
gactcccaccccagattgtaaataa

SEQ ID NO: 326587 - DNA, 25 bp, Rattus norvegicus
gactcccacccctgattgtaaataa

SEQ ID NO: 326588 - DNA, 25 bp, Rattus norvegicus
gactcccagcagaggatgtgatcat

SEQ ID NO: 326589 - DNA, 25 bp, Rattus norvegicus
gactcccagcagtggatgtgatcat

SEQ ID NO: 326590 - DNA, 25 bp, Rattus norvegicus
gactcccaggaacccacttgcaaat

SEQ ID NO: 326591 - DNA, 25 bp, Rattus norvegicus
gactcccaggaagccacttgcaaat

SEQ ID NO: 326592 - DNA, 25 bp, Rattus norvegicus
gactcccattcactttggagctctt

SEQ ID NO: 326593 - DNA, 25 bp, Rattus norvegicus
gactcccattcagtttggagctctt

SEQ ID NO: 326594 - DNA, 25 bp, Rattus norvegicus
gactccccaacaacttaaattacac

SEQ ID NO: 326595 - DNA, 25 bp, Rattus norvegicus
gactccccaacaccctgagatgaaa

SEQ ID NO: 326596 - DNA, 25 bp, Rattus norvegicus
gactccccaacagcctgagatgaaa

SEQ ID NO: 326597 - DNA, 25 bp, Rattus norvegicus
gactccccaacatcttaaattacac

SEQ ID NO: 326598 - DNA, 25 bp, Rattus norvegicus
gactccccaagtcccgaagaagata

SEQ ID NO: 326599 - DNA, 25 bp, Rattus norvegicus
gactccccaagtgccgaagaagata

SEQ ID NO: 326600 - DNA, 25 bp, Rattus norvegicus
gactccccacacctttgtgtaattg

SEQ ID NO: 326601 - DNA, 25 bp, Rattus norvegicus
gactccccacacgtttgtgtaattg

SEQ ID NO: 326602 - DNA, 25 bp, Rattus norvegicus
gactccccagtaatttttctgatga

SEQ ID NO: 326603 - DNA, 25 bp, Rattus norvegicus
gactccccagtattttttctgatga

SEQ ID NO: 326604 - DNA, 25 bp, Rattus norvegicus
gactccccccacagaaaatacagga

SEQ ID NO: 326605 - DNA, 25 bp, Rattus norvegicus
gactccccccactgaaaatacagga

SEQ ID NO: 326606 - DNA, 25 bp, Rattus norvegicus
gactcccctggtctcaatccttggg

SEQ ID NO: 326607 - DNA, 25 bp, Rattus norvegicus
gactcccctggtgtcaatccttggg

SEQ ID NO: 326608 - DNA, 25 bp, Rattus norvegicus
gactcccctgtgaactcaaaaggca

SEQ ID NO: 326609 - DNA, 25 bp, Rattus norvegicus
gactcccctgtgcacaagtccgagg

SEQ ID NO: 326610 - DNA, 25 bp, Rattus norvegicus
gactcccctgtggacaagtccgagg

SEQ ID NO: 326611 - DNA, 25 bp, Rattus norvegicus
gactcccctgtgtactcaaaaggca

SEQ ID NO: 326612 - DNA, 25 bp, Rattus norvegicus
gactcccgcttcataaaaaccttgt

SEQ ID NO: 326613 - DNA, 25 bp, Rattus norvegicus
gactcccgcttcttaaaaaccttgt

SEQ ID NO: 326614 - DNA, 25 bp, Rattus norvegicus
gactcccggcgaagttgtaagcata

SEQ ID NO: 326615 - DNA, 25 bp, Rattus norvegicus
gactcccggcgatgttgtaagcata

SEQ ID NO: 326616 - DNA, 25 bp, Rattus norvegicus
gactcccgggccatggcccgagatg

SEQ ID NO: 326617 - DNA, 25 bp, Rattus norvegicus
gactcccgggccttggcccgagatg

SEQ ID NO: 326618 - DNA, 25 bp, Rattus norvegicus
gactcccgtatgctaaagttgctca

SEQ ID NO: 326619 - DNA, 25 bp, Rattus norvegicus
gactcccgtatggtaaagttgctca

SEQ ID NO: 326620 - DNA, 25 bp, Rattus norvegicus
gactcccgtggaccatctggtgtgt

SEQ ID NO: 326621 - DNA, 25 bp, Rattus norvegicus
gactcccgtggagcatctggtgtgt

SEQ ID NO: 326622 - DNA, 25 bp, Rattus norvegicus
gactcccgtttgaggagcacacggt

SEQ ID NO: 326623 - DNA, 25 bp, Rattus norvegicus
gactcccgtttgtggagcacacggt

SEQ ID NO: 326624 - DNA, 25 bp, Rattus norvegicus
gactccctaaggacatacttttaag

SEQ ID NO: 326625 - DNA, 25 bp, Rattus norvegicus
gactccctaaggtcatacttttaag

SEQ ID NO: 326626 - DNA, 25 bp, Rattus norvegicus
gactccctaagtccctttgacaaga

SEQ ID NO: 326627 - DNA, 25 bp, Rattus norvegicus
gactccctaagtgcctttgacaaga

SEQ ID NO: 326628 - DNA, 25 bp, Rattus norvegicus
gactccctcaagcattcaaggagga

SEQ ID NO: 326629 - DNA, 25 bp, Rattus norvegicus
gactccctcaaggattcaaggagga

SEQ ID NO: 326630 - DNA, 25 bp, Rattus norvegicus
gactccctcagaagatgttattaat

SEQ ID NO: 326631 - DNA, 25 bp, Rattus norvegicus
gactccctcagatgatgttattaat

SEQ ID NO: 326632 - DNA, 25 bp, Rattus norvegicus
gactccctccacagaatgtaggtga

SEQ ID NO: 326633 - DNA, 25 bp, Rattus norvegicus
gactccctccactgaatgtaggtga

SEQ ID NO: 326634 - DNA, 25 bp, Rattus norvegicus
gactccctcgagatgacagtattaa

SEQ ID NO: 326635 - DNA, 25 bp, Rattus norvegicus
gactccctcgagttgacagtattaa

SEQ ID NO: 326636 - DNA, 25 bp, Rattus norvegicus
gactccctctgcaggactctgggta

SEQ ID NO: 326637 - DNA, 25 bp, Rattus norvegicus
gactccctctgctggactctgggta

SEQ ID NO: 326638 - DNA, 25 bp, Rattus norvegicus
gactccctcttaaatgacagccatg

SEQ ID NO: 326639 - DNA, 25 bp, Rattus norvegicus
gactccctcttatatgacagccatg

SEQ ID NO: 326640 - DNA, 25 bp, Rattus norvegicus
gactccctcttcagcatcgaagaat

SEQ ID NO: 326641 - DNA, 25 bp, Rattus norvegicus
gactccctcttctgcatcgaagaat

SEQ ID NO: 326642 - DNA, 25 bp, Rattus norvegicus
gactccctgacaattcaccatagat

SEQ ID NO: 326643 - DNA, 25 bp, Rattus norvegicus
gactccctgacatttcaccatagat

SEQ ID NO: 326644 - DNA, 25 bp, Rattus norvegicus
gactccctgataagtgctgtgcatg

SEQ ID NO: 326645 - DNA, 25 bp, Rattus norvegicus
gactccctgatatgtgctgtgcatg

SEQ ID NO: 326646 - DNA, 25 bp, Rattus norvegicus
gactccctggagaggatccgggcaa

SEQ ID NO: 326647 - DNA, 25 bp, Rattus norvegicus
gactccctggagtggatccgggcaa

SEQ ID NO: 326648 - DNA, 25 bp, Rattus norvegicus
gactccctggtcatgctttgtttgt

SEQ ID NO: 326649 - DNA, 25 bp, Rattus norvegicus
gactccctggtcttgctttgtttgt

SEQ ID NO: 326650 - DNA, 25 bp, Rattus norvegicus
gactcccttcctcgcttgaaagaga

SEQ ID NO: 326651 - DNA, 25 bp, Rattus norvegicus
gactcccttcctggcttgaaagaga

SEQ ID NO: 326652 - DNA, 25 bp, Rattus norvegicus
gactccgaaattcacctctgaactt

SEQ ID NO: 326653 - DNA, 25 bp, Rattus norvegicus
gactccgaaattgacctctgaactt

SEQ ID NO: 326654 - DNA, 25 bp, Rattus norvegicus
gactccgagatcaccattctgcaaa

SEQ ID NO: 326655 - DNA, 25 bp, Rattus norvegicus
gactccgagatctccattctgcaaa

SEQ ID NO: 326656 - DNA, 25 bp, Rattus norvegicus
gactccgcacggactggaaagtttg

SEQ ID NO: 326657 - DNA, 25 bp, Rattus norvegicus
gactccgcacggtctggaaagtttg

SEQ ID NO: 326658 - DNA, 25 bp, Rattus norvegicus
gactccgcactgaataaacctttct

SEQ ID NO: 326659 - DNA, 25 bp, Rattus norvegicus
gactccgcactgtataaacctttct

SEQ ID NO: 326660 - DNA, 25 bp, Rattus norvegicus
gactccgctctcagcggcggcagta

SEQ ID NO: 326661 - DNA, 25 bp, Rattus norvegicus
gactccgctctctgcggcggcagta

SEQ ID NO: 326662 - DNA, 25 bp, Rattus norvegicus
gactccggactacatgaatcttctc

SEQ ID NO: 326663 - DNA, 25 bp, Rattus norvegicus
gactccggactagatgaatcttctc

SEQ ID NO: 326664 - DNA, 25 bp, Rattus norvegicus
gactccggagagcaatgtactgtac

SEQ ID NO: 326665 - DNA, 25 bp, Rattus norvegicus
gactccggagaggaatgtactgtac

SEQ ID NO: 326666 - DNA, 25 bp, Rattus norvegicus
gactccggcagtatcaagaagaaca

SEQ ID NO: 326667 - DNA, 25 bp, Rattus norvegicus
gactccggcagtttcaagaagaaca

SEQ ID NO: 326668 - DNA, 25 bp, Rattus norvegicus
gactccgggaaacagatgcaaactt

SEQ ID NO: 326669 - DNA, 25 bp, Rattus norvegicus
gactccgggaaagagatgcaaactt

SEQ ID NO: 326670 - DNA, 25 bp, Rattus norvegicus
gactccgggatccttatggtattaa

SEQ ID NO: 326671 - DNA, 25 bp, Rattus norvegicus
gactccgggatcgttatggtattaa

SEQ ID NO: 326672 - DNA, 25 bp, Rattus norvegicus
gactccgtccctcaatcttgagagg

SEQ ID NO: 326673 - DNA, 25 bp, Rattus norvegicus
gactccgtccctgaatcttgagagg

SEQ ID NO: 326674 - DNA, 25 bp, Rattus norvegicus
gactccgtctgtcaatgtaatcccc

SEQ ID NO: 326675 - DNA, 25 bp, Rattus norvegicus
gactccgtctgtgaatgtaatcccc

SEQ ID NO: 326676 - DNA, 25 bp, Rattus norvegicus
gactccgtgtagaggaagtggtttt

SEQ ID NO: 326677 - DNA, 25 bp, Rattus norvegicus
gactccgtgtagtggaagtggtttt

SEQ ID NO: 326678 - DNA, 25 bp, Rattus norvegicus
gactccgttgtcctagaaaagcagc

SEQ ID NO: 326679 - DNA, 25 bp, Rattus norvegicus
gactccgttgtcgtagaaaagcagc

SEQ ID NO: 326680 - DNA, 25 bp, Rattus norvegicus
gactccgttgtgatagtgttgtcaa

SEQ ID NO: 326681 - DNA, 25 bp, Rattus norvegicus
gactccgttgtgttagtgttgtcaa

SEQ ID NO: 326682 - DNA, 25 bp, Rattus norvegicus
gactcctaaactctctggcactgta

SEQ ID NO: 326683 - DNA, 25 bp, Rattus norvegicus
gactcctaaactgtctggcactgta

SEQ ID NO: 326684 - DNA, 25 bp, Rattus norvegicus
gactcctaacaaagcctaatggcct

SEQ ID NO: 326685 - DNA, 25 bp, Rattus norvegicus
gactcctaacaatgcctaatggcct

SEQ ID NO: 326686 - DNA, 25 bp, Rattus norvegicus
gactcctaacgcagtgtagatgcct

SEQ ID NO: 326687 - DNA, 25 bp, Rattus norvegicus
gactcctaacgctgtgtagatgcct

SEQ ID NO: 326688 - DNA, 25 bp, Rattus norvegicus
gactcctaactgaaaacacacccaa

SEQ ID NO: 326689 - DNA, 25 bp, Rattus norvegicus
gactcctaactgtaaacacacccaa

SEQ ID NO: 326690 - DNA, 25 bp, Rattus norvegicus
gactcctaagaaccctcattacatg

SEQ ID NO: 326691 - DNA, 25 bp, Rattus norvegicus
gactcctaagaagcctcattacatg

SEQ ID NO: 326692 - DNA, 25 bp, Rattus norvegicus
gactcctactaactaagctttcaga

SEQ ID NO: 326693 - DNA, 25 bp, Rattus norvegicus
gactcctactaagtaagctttcaga

SEQ ID NO: 326694 - DNA, 25 bp, Rattus norvegicus
gactcctattttatccagtggttgg

SEQ ID NO: 326695 - DNA, 25 bp, Rattus norvegicus
gactcctattttttccagtggttgg

SEQ ID NO: 326696 - DNA, 25 bp, Rattus norvegicus
gactcctcacatacatcataaaagc

SEQ ID NO: 326697 - DNA, 25 bp, Rattus norvegicus
gactcctcacattcatcataaaagc

SEQ ID NO: 326698 - DNA, 25 bp, Rattus norvegicus
gactcctcactgcagacatgctgaa

SEQ ID NO: 326699 - DNA, 25 bp, Rattus norvegicus
gactcctcactggagacatgctgaa

SEQ ID NO: 326700 - DNA, 25 bp, Rattus norvegicus
gactcctcatacacctgggaaatgt

SEQ ID NO: 326701 - DNA, 25 bp, Rattus norvegicus
gactcctcatactcctgggaaatgt

SEQ ID NO: 326702 - DNA, 25 bp, Rattus norvegicus
gactcctccactaacgcgatgtttg

SEQ ID NO: 326703 - DNA, 25 bp, Rattus norvegicus
gactcctccacttacgcgatgtttg

SEQ ID NO: 326704 - DNA, 25 bp, Rattus norvegicus
gactcctccgagacggtgcgcaggt

SEQ ID NO: 326705 - DNA, 25 bp, Rattus norvegicus
gactcctccgagtcggtgcgcaggt

SEQ ID NO: 326706 - DNA, 25 bp, Rattus norvegicus
gactcctccgtgctttctgcttgag

SEQ ID NO: 326707 - DNA, 25 bp, Rattus norvegicus
gactcctccgtggtttctgcttgag

SEQ ID NO: 326708 - DNA, 25 bp, Rattus norvegicus
gactcctctattaggtgtctaagac

SEQ ID NO: 326709 - DNA, 25 bp, Rattus norvegicus
gactcctctatttggtgtctaagac

SEQ ID NO: 326710 - DNA, 25 bp, Rattus norvegicus
gactcctctcggctcaaatggaaat

SEQ ID NO: 326711 - DNA, 25 bp, Rattus norvegicus
gactcctctcgggtcaaatggaaat

SEQ ID NO: 326712 - DNA, 25 bp, Rattus norvegicus
gactcctctgcaatctctgtggaag

SEQ ID NO: 326713 - DNA, 25 bp, Rattus norvegicus
gactcctctgcattctctgtggaag

SEQ ID NO: 326714 - DNA, 25 bp, Rattus norvegicus
gactcctctgcgcaaagagcatgag

SEQ ID NO: 326715 - DNA, 25 bp, Rattus norvegicus
gactcctctgcggaaagagcatgag

SEQ ID NO: 326716 - DNA, 25 bp, Rattus norvegicus
gactcctctgtaagcaagtttcctg

SEQ ID NO: 326717 - DNA, 25 bp, Rattus norvegicus
gactcctctgtatgcaagtttcctg

SEQ ID NO: 326718 - DNA, 25 bp, Rattus norvegicus
gactcctctgtgcaattactagctg

SEQ ID NO: 326719 - DNA, 25 bp, Rattus norvegicus
gactcctctgtggaattactagctg

SEQ ID NO: 326720 - DNA, 25 bp, Rattus norvegicus
gactcctcttatctcagagcagcaa

SEQ ID NO: 326721 - DNA, 25 bp, Rattus norvegicus
gactcctcttatgtcagagcagcaa

SEQ ID NO: 326722 - DNA, 25 bp, Rattus norvegicus
gactcctcttgtagaaagaaccctg

SEQ ID NO: 326723 - DNA, 25 bp, Rattus norvegicus
gactcctcttgtccctaagaaagtg

SEQ ID NO: 326724 - DNA, 25 bp, Rattus norvegicus
gactcctcttgtgcctaagaaagtg

SEQ ID NO: 326725 - DNA, 25 bp, Rattus norvegicus
gactcctcttgttgaaagaaccctg

SEQ ID NO: 326726 - DNA, 25 bp, Rattus norvegicus
gactcctgaaatctctgtagtgatt

SEQ ID NO: 326727 - DNA, 25 bp, Rattus norvegicus
gactcctgaaatgtctgtagtgatt

SEQ ID NO: 326728 - DNA, 25 bp, Rattus norvegicus
gactcctgaagacatttcccctttt

SEQ ID NO: 326729 - DNA, 25 bp, Rattus norvegicus
gactcctgaagagatttcccctttt

SEQ ID NO: 326730 - DNA, 25 bp, Rattus norvegicus
gactcctgaagcactggaaacccta

SEQ ID NO: 326731 - DNA, 25 bp, Rattus norvegicus
gactcctgaagcaggctgtggctga

SEQ ID NO: 326732 - DNA, 25 bp, Rattus norvegicus
gactcctgaagctctggaaacccta

SEQ ID NO: 326733 - DNA, 25 bp, Rattus norvegicus
gactcctgaagctggctgtggctga

SEQ ID NO: 326734 - DNA, 25 bp, Rattus norvegicus
gactcctgactgatttctgggaaac

SEQ ID NO: 326735 - DNA, 25 bp, Rattus norvegicus
gactcctgactgttttctgggaaac

SEQ ID NO: 326736 - DNA, 25 bp, Rattus norvegicus
gactcctgagccactttcaagaaaa

SEQ ID NO: 326737 - DNA, 25 bp, Rattus norvegicus
gactcctgagcctctttcaagaaaa

SEQ ID NO: 326738 - DNA, 25 bp, Rattus norvegicus
gactcctgaggaaatgccagccttt

SEQ ID NO: 326739 - DNA, 25 bp, Rattus norvegicus
gactcctgaggatatgccagccttt

SEQ ID NO: 326740 - DNA, 25 bp, Rattus norvegicus
gactcctgaggcattgggttataga

SEQ ID NO: 326741 - DNA, 25 bp, Rattus norvegicus
gactcctgaggctttgggttataga

SEQ ID NO: 326742 - DNA, 25 bp, Rattus norvegicus
gactcctgagtcattgcggtcaatg

SEQ ID NO: 326743 - DNA, 25 bp, Rattus norvegicus
gactcctgagtctttgcggtcaatg

SEQ ID NO: 326744 - DNA, 25 bp, Rattus norvegicus
gactcctgagttcgctgtttccttc

SEQ ID NO: 326745 - DNA, 25 bp, Rattus norvegicus
gactcctgagttggctgtttccttc

SEQ ID NO: 326746 - DNA, 25 bp, Rattus norvegicus
gactcctgatagaactgtaaatcca

SEQ ID NO: 326747 - DNA, 25 bp, Rattus norvegicus
gactcctgatagtactgtaaatcca

SEQ ID NO: 326748 - DNA, 25 bp, Rattus norvegicus
gactcctgcgccatgagagcgaagt

SEQ ID NO: 326749 - DNA, 25 bp, Rattus norvegicus
gactcctgcgccttgagagcgaagt

SEQ ID NO: 326750 - DNA, 25 bp, Rattus norvegicus
gactcctggagtctgacctctgtca

SEQ ID NO: 326751 - DNA, 25 bp, Rattus norvegicus
gactcctggagtgtgacctctgtca

SEQ ID NO: 326752 - DNA, 25 bp, Rattus norvegicus
gactcctggcccatgaatctttttt

SEQ ID NO: 326753 - DNA, 25 bp, Rattus norvegicus
gactcctggcccttgaatctttttt

SEQ ID NO: 326754 - DNA, 25 bp, Rattus norvegicus
gactcctgggtaactgagttttgct

SEQ ID NO: 326755 - DNA, 25 bp, Rattus norvegicus
gactcctgggtatctgagttttgct

SEQ ID NO: 326756 - DNA, 25 bp, Rattus norvegicus
gactcctggtccaacgttgggataa

SEQ ID NO: 326757 - DNA, 25 bp, Rattus norvegicus
gactcctggtcctacgttgggataa

SEQ ID NO: 326758 - DNA, 25 bp, Rattus norvegicus
gactcctggtgaaggccgtgtcaca

SEQ ID NO: 326759 - DNA, 25 bp, Rattus norvegicus
gactcctggtgatggccgtgtcaca

SEQ ID NO: 326760 - DNA, 25 bp, Rattus norvegicus
gactcctggtgtaccatatgtattt

SEQ ID NO: 326761 - DNA, 25 bp, Rattus norvegicus
gactcctggtgttccatatgtattt

SEQ ID NO: 326762 - DNA, 25 bp, Rattus norvegicus
gactcctgtcaaagtccagagcatt

SEQ ID NO: 326763 - DNA, 25 bp, Rattus norvegicus
gactcctgtcaatgtccagagcatt

SEQ ID NO: 326764 - DNA, 25 bp, Rattus norvegicus
gactcctgtcagagttgtccagtca

SEQ ID NO: 326765 - DNA, 25 bp, Rattus norvegicus
gactcctgtcagtgttgtccagtca

SEQ ID NO: 326766 - DNA, 25 bp, Rattus norvegicus
gactcctgtccaaggctattttgaa

SEQ ID NO: 326767 - DNA, 25 bp, Rattus norvegicus
gactcctgtccatggctattttgaa

SEQ ID NO: 326768 - DNA, 25 bp, Rattus norvegicus
gactcctgtcctcccattgaaaaat

SEQ ID NO: 326769 - DNA, 25 bp, Rattus norvegicus
gactcctgtcctgccattgaaaaat

SEQ ID NO: 326770 - DNA, 25 bp, Rattus norvegicus
gactcctgtgggattgagggcttcc

SEQ ID NO: 326771 - DNA, 25 bp, Rattus norvegicus
gactcctgtgggtttgagggcttcc

SEQ ID NO: 326772 - DNA, 25 bp, Rattus norvegicus
gactcctgtgtacagatgctcttta

SEQ ID NO: 326773 - DNA, 25 bp, Rattus norvegicus
gactcctgtgtagagatgctcttta

SEQ ID NO: 326774 - DNA, 25 bp, Rattus norvegicus
gactccttactcatgggacagggac

SEQ ID NO: 326775 - DNA, 25 bp, Rattus norvegicus
gactccttactcttgggacagggac

SEQ ID NO: 326776 - DNA, 25 bp, Rattus norvegicus
gactccttagtcatcctatagcaat

SEQ ID NO: 326777 - DNA, 25 bp, Rattus norvegicus
gactccttagtcttcctatagcaat

SEQ ID NO: 326778 - DNA, 25 bp, Rattus norvegicus
gactccttatttatcttgttctatt

SEQ ID NO: 326779 - DNA, 25 bp, Rattus norvegicus
gactccttatttttcttgttctatt

SEQ ID NO: 326780 - DNA, 25 bp, Rattus norvegicus
gactccttcactctctagtgatgtt

SEQ ID NO: 326781 - DNA, 25 bp, Rattus norvegicus
gactccttcactgtctagtgatgtt

SEQ ID NO: 326782 - DNA, 25 bp, Rattus norvegicus
gactccttcattcgagatggaccat

SEQ ID NO: 326783 - DNA, 25 bp, Rattus norvegicus
gactccttcattggagatggaccat

SEQ ID NO: 326784 - DNA, 25 bp, Rattus norvegicus
gactccttccacagagcatgacaag

SEQ ID NO: 326785 - DNA, 25 bp, Rattus norvegicus
gactccttccactgagcatgacaag

SEQ ID NO: 326786 - DNA, 25 bp, Rattus norvegicus
gactccttcccacataggtgtgatt

SEQ ID NO: 326787 - DNA, 25 bp, Rattus norvegicus
gactccttcccagataggtgtgatt

SEQ ID NO: 326788 - DNA, 25 bp, Rattus norvegicus
gactccttccccaatgtcagtcaaa

SEQ ID NO: 326789 - DNA, 25 bp, Rattus norvegicus
gactccttcccctatgtcagtcaaa

SEQ ID NO: 326790 - DNA, 25 bp, Rattus norvegicus
gactccttcttaaagcacgctatca

SEQ ID NO: 326791 - DNA, 25 bp, Rattus norvegicus
gactccttcttatagcacgctatca

SEQ ID NO: 326792 - DNA, 25 bp, Rattus norvegicus
gactccttgagtccattttcatttg

SEQ ID NO: 326793 - DNA, 25 bp, Rattus norvegicus
gactccttgagtgcattttcatttg

SEQ ID NO: 326794 - DNA, 25 bp, Rattus norvegicus
gactccttgctaatccagaaacttg

SEQ ID NO: 326795 - DNA, 25 bp, Rattus norvegicus
gactccttgctattccagaaacttg

SEQ ID NO: 326796 - DNA, 25 bp, Rattus norvegicus
gactccttggtaaattttatactgc

SEQ ID NO: 326797 - DNA, 25 bp, Rattus norvegicus
gactccttggtatattttatactgc

SEQ ID NO: 326798 - DNA, 25 bp, Rattus norvegicus
gactccttgttactgacgtagtttg

SEQ ID NO: 326799 - DNA, 25 bp, Rattus norvegicus
gactccttgttagtgacgtagtttg

SEQ ID NO: 326800 - DNA, 25 bp, Rattus norvegicus
gactcctttatcattatcaactcct

SEQ ID NO: 326801 - DNA, 25 bp, Rattus norvegicus
gactcctttatctttatcaactcct

SEQ ID NO: 326802 - DNA, 25 bp, Rattus norvegicus
gactcctttggaacatggcctctaa

SEQ ID NO: 326803 - DNA, 25 bp, Rattus norvegicus
gactcctttggatcatggcctctaa

SEQ ID NO: 326804 - DNA, 25 bp, Rattus norvegicus
gactcgaacccgcaacctttgaatg

SEQ ID NO: 326805 - DNA, 25 bp, Rattus norvegicus
gactcgaacccggaacctttgaatg

SEQ ID NO: 326806 - DNA, 25 bp, Rattus norvegicus
gactcgaagctcatcctcacggagg

SEQ ID NO: 326807 - DNA, 25 bp, Rattus norvegicus
gactcgaagctcttcctcacggagg

SEQ ID NO: 326808 - DNA, 25 bp, Rattus norvegicus
gactcgaagtttcttaaagccttct

SEQ ID NO: 326809 - DNA, 25 bp, Rattus norvegicus
gactcgaagtttgttaaagccttct

SEQ ID NO: 326810 - DNA, 25 bp, Rattus norvegicus
gactcgaatagcactttattgtctt

SEQ ID NO: 326811 - DNA, 25 bp, Rattus norvegicus
gactcgaatagctctttattgtctt

SEQ ID NO: 326812 - DNA, 25 bp, Rattus norvegicus
gactcgacccgcaggtctcagaact

SEQ ID NO: 326813 - DNA, 25 bp, Rattus norvegicus
gactcgacccgctggtctcagaact

SEQ ID NO: 326814 - DNA, 25 bp, Rattus norvegicus
gactcgactcaaatttctccattgt

SEQ ID NO: 326815 - DNA, 25 bp, Rattus norvegicus
gactcgactcaattttctccattgt

SEQ ID NO: 326816 - DNA, 25 bp, Rattus norvegicus
gactcgactcataaatcaggtgttg

SEQ ID NO: 326817 - DNA, 25 bp, Rattus norvegicus
gactcgactcattaatcaggtgttg

SEQ ID NO: 326818 - DNA, 25 bp, Rattus norvegicus
gactcgagccttaactcttgttatc

SEQ ID NO: 326819 - DNA, 25 bp, Rattus norvegicus
gactcgagcctttactcttgttatc

SEQ ID NO: 326820 - DNA, 25 bp, Rattus norvegicus
gactcgagggctatactgcgatcat

SEQ ID NO: 326821 - DNA, 25 bp, Rattus norvegicus
gactcgagggctttactgcgatcat

SEQ ID NO: 326822 - DNA, 25 bp, Rattus norvegicus
gactcgagtcgtatgtattcctggg

SEQ ID NO: 326823 - DNA, 25 bp, Rattus norvegicus
gactcgagtcgtttgtattcctggg

SEQ ID NO: 326824 - DNA, 25 bp, Rattus norvegicus
gactcgagtctcagtactgaccata

SEQ ID NO: 326825 - DNA, 25 bp, Rattus norvegicus
gactcgagtctctgtactgaccata

SEQ ID NO: 326826 - DNA, 25 bp, Rattus norvegicus
gactcgatggacaatctactggcta

SEQ ID NO: 326827 - DNA, 25 bp, Rattus norvegicus
gactcgatggactatctactggcta

SEQ ID NO: 326828 - DNA, 25 bp, Rattus norvegicus
gactcgcaagtcctacaggtttcat

SEQ ID NO: 326829 - DNA, 25 bp, Rattus norvegicus
gactcgcaagtcgtacaggtttcat

SEQ ID NO: 326830 - DNA, 25 bp, Rattus norvegicus
gactcgcacactcactcatggttag

SEQ ID NO: 326831 - DNA, 25 bp, Rattus norvegicus
gactcgcacactgactcatggttag

SEQ ID NO: 326832 - DNA, 25 bp, Rattus norvegicus
gactcgcacttaattcgattcctga

SEQ ID NO: 326833 - DNA, 25 bp, Rattus norvegicus
gactcgcacttatttcgattcctga

SEQ ID NO: 326834 - DNA, 25 bp, Rattus norvegicus
gactcgcagaaccagaagtccactt

SEQ ID NO: 326835 - DNA, 25 bp, Rattus norvegicus
gactcgcagaacgagaagtccactt

SEQ ID NO: 326836 - DNA, 25 bp, Rattus norvegicus
gactcgccactgaagtgtaggcttt

SEQ ID NO: 326837 - DNA, 25 bp, Rattus norvegicus
gactcgccactgtagtgtaggcttt

SEQ ID NO: 326838 - DNA, 25 bp, Rattus norvegicus
gactcgcctttcatagcatgtgatt

SEQ ID NO: 326839 - DNA, 25 bp, Rattus norvegicus
gactcgcctttcttagcatgtgatt

SEQ ID NO: 326840 - DNA, 25 bp, Rattus norvegicus
gactcgcggacgacgacgttgccgc

SEQ ID NO: 326841 - DNA, 25 bp, Rattus norvegicus
gactcgcggacgtcgacgttgccgc

SEQ ID NO: 326842 - DNA, 25 bp, Rattus norvegicus
gactcgctacatcagagctggtgta

SEQ ID NO: 326843 - DNA, 25 bp, Rattus norvegicus
gactcgctacatgagagctggtgta

SEQ ID NO: 326844 - DNA, 25 bp, Rattus norvegicus
gactcgctagagaccagagcaggaa

SEQ ID NO: 326845 - DNA, 25 bp, Rattus norvegicus
gactcgctagagtccagagcaggaa

SEQ ID NO: 326846 - DNA, 25 bp, Rattus norvegicus
gactcgctcaagcacatacagccta

SEQ ID NO: 326847 - DNA, 25 bp, Rattus norvegicus
gactcgctcaaggacatacagccta

SEQ ID NO: 326848 - DNA, 25 bp, Rattus norvegicus
gactcgctccagaccacagagagat

SEQ ID NO: 326849 - DNA, 25 bp, Rattus norvegicus
gactcgctccagtccacagagagat

SEQ ID NO: 326850 - DNA, 25 bp, Rattus norvegicus
gactcgctcttacccaaagaggctg

SEQ ID NO: 326851 - DNA, 25 bp, Rattus norvegicus
gactcgctcttagccaaagaggctg

SEQ ID NO: 326852 - DNA, 25 bp, Rattus norvegicus
gactcgctgtatcttgattactctt

SEQ ID NO: 326853 - DNA, 25 bp, Rattus norvegicus
gactcgctgtatgttgattactctt

SEQ ID NO: 326854 - DNA, 25 bp, Rattus norvegicus
gactcgctgtcgatgagcagcggtt

SEQ ID NO: 326855 - DNA, 25 bp, Rattus norvegicus
gactcgctgtcgttgagcagcggtt

SEQ ID NO: 326856 - DNA, 25 bp, Rattus norvegicus
gactcggactcccaagtctatggga

SEQ ID NO: 326857 - DNA, 25 bp, Rattus norvegicus
gactcggactccgaagtctatggga

SEQ ID NO: 326858 - DNA, 25 bp, Rattus norvegicus
gactcggccaagcttgtcctggtaa

SEQ ID NO: 326859 - DNA, 25 bp, Rattus norvegicus
gactcggccaaggttgtcctggtaa

SEQ ID NO: 326860 - DNA, 25 bp, Rattus norvegicus
gactcggccctaagtccatgggtac

SEQ ID NO: 326861 - DNA, 25 bp, Rattus norvegicus
gactcggccctatgtccatgggtac

SEQ ID NO: 326862 - DNA, 25 bp, Rattus norvegicus
gactcggcgcagagtctgtgttcat

SEQ ID NO: 326863 - DNA, 25 bp, Rattus norvegicus
gactcggcgcagtgtctgtgttcat

SEQ ID NO: 326864 - DNA, 25 bp, Rattus norvegicus
gactcggcgtctaaatcttcaaagg

SEQ ID NO: 326865 - DNA, 25 bp, Rattus norvegicus
gactcggcgtcttaatcttcaaagg

SEQ ID NO: 326866 - DNA, 25 bp, Rattus norvegicus
gactcggctgtaactcaggactgaa

SEQ ID NO: 326867 - DNA, 25 bp, Rattus norvegicus
gactcggctgtatctcaggactgaa

SEQ ID NO: 326868 - DNA, 25 bp, Rattus norvegicus
gactcgggaaacctttaacctgctg

SEQ ID NO: 326869 - DNA, 25 bp, Rattus norvegicus
gactcgggaaacgtttaacctgctg

SEQ ID NO: 326870 - DNA, 25 bp, Rattus norvegicus
gactcgggtggcctatgacaatttg

SEQ ID NO: 326871 - DNA, 25 bp, Rattus norvegicus
gactcgggtggcgtatgacaatttg

SEQ ID NO: 326872 - DNA, 25 bp, Rattus norvegicus
gactcgggtgtcatgaaagcttgtt

SEQ ID NO: 326873 - DNA, 25 bp, Rattus norvegicus
gactcgggtgtcttgaaagcttgtt

SEQ ID NO: 326874 - DNA, 25 bp, Rattus norvegicus
gactcgggtttcacttatatcttac

SEQ ID NO: 326875 - DNA, 25 bp, Rattus norvegicus
gactcgggtttctcttatatcttac

SEQ ID NO: 326876 - DNA, 25 bp, Rattus norvegicus
gactcggtaattacgactctccgtt

SEQ ID NO: 326877 - DNA, 25 bp, Rattus norvegicus
gactcggtaatttcgactctccgtt

SEQ ID NO: 326878 - DNA, 25 bp, Rattus norvegicus
gactcggtcagcaacgtggatatgt

SEQ ID NO: 326879 - DNA, 25 bp, Rattus norvegicus
gactcggtcagctacgtggatatgt

SEQ ID NO: 326880 - DNA, 25 bp, Rattus norvegicus
gactcggtctcaaaattagcaaaat

SEQ ID NO: 326881 - DNA, 25 bp, Rattus norvegicus
gactcggtctcataattagcaaaat

SEQ ID NO: 326882 - DNA, 25 bp, Rattus norvegicus
gactcggtgacaaatcctcaaagga

SEQ ID NO: 326883 - DNA, 25 bp, Rattus norvegicus
gactcggtgacatatcctcaaagga

SEQ ID NO: 326884 - DNA, 25 bp, Rattus norvegicus
gactcggtgtgcaacatgctgctgt

SEQ ID NO: 326885 - DNA, 25 bp, Rattus norvegicus
gactcggtgtgctacatgctgctgt

SEQ ID NO: 326886 - DNA, 25 bp, Rattus norvegicus
gactcggttctcaagaattctggac

SEQ ID NO: 326887 - DNA, 25 bp, Rattus norvegicus
gactcggttctctagaattctggac

SEQ ID NO: 326888 - DNA, 25 bp, Rattus norvegicus
gactcggttgtcattgtactaatta

SEQ ID NO: 326889 - DNA, 25 bp, Rattus norvegicus
gactcggttgtctttgtactaatta

SEQ ID NO: 326890 - DNA, 25 bp, Rattus norvegicus
gactcggtttaccttagtgccttag

SEQ ID NO: 326891 - DNA, 25 bp, Rattus norvegicus
gactcggtttacgttagtgccttag

SEQ ID NO: 326892 - DNA, 25 bp, Rattus norvegicus
gactcgtaggtaattcaggagacat

SEQ ID NO: 326893 - DNA, 25 bp, Rattus norvegicus
gactcgtaggtatttcaggagacat

SEQ ID NO: 326894 - DNA, 25 bp, Rattus norvegicus
gactcgtattggcttatctcattta

SEQ ID NO: 326895 - DNA, 25 bp, Rattus norvegicus
gactcgtattgggttatctcattta

SEQ ID NO: 326896 - DNA, 25 bp, Rattus norvegicus
gactcgtcgcctacggtgttggaga

SEQ ID NO: 326897 - DNA, 25 bp, Rattus norvegicus
gactcgtcgccttcggtgttggaga

SEQ ID NO: 326898 - DNA, 25 bp, Rattus norvegicus
gactcgtcttcactctaagagctga

SEQ ID NO: 326899 - DNA, 25 bp, Rattus norvegicus
gactcgtcttcagtctaagagctga

SEQ ID NO: 326900 - DNA, 25 bp, Rattus norvegicus
gactcgtgacctcctaggccaagac

SEQ ID NO: 326901 - DNA, 25 bp, Rattus norvegicus
gactcgtgacctgctaggccaagac

SEQ ID NO: 326902 - DNA, 25 bp, Rattus norvegicus
gactcgtgagtcctttgtcagggct

SEQ ID NO: 326903 - DNA, 25 bp, Rattus norvegicus
gactcgtgagtcgtttgtcagggct

SEQ ID NO: 326904 - DNA, 25 bp, Rattus norvegicus
gactcgtgcaacatactgcgggcat

SEQ ID NO: 326905 - DNA, 25 bp, Rattus norvegicus
gactcgtgcaacttactgcgggcat

SEQ ID NO: 326906 - DNA, 25 bp, Rattus norvegicus
gactcgtgcaatattttctgtgcta

SEQ ID NO: 326907 - DNA, 25 bp, Rattus norvegicus
gactcgtgcaattttttctgtgcta

SEQ ID NO: 326908 - DNA, 25 bp, Rattus norvegicus
gactcgtgcattcagagccttttgt

SEQ ID NO: 326909 - DNA, 25 bp, Rattus norvegicus
gactcgtgcattgagagccttttgt

SEQ ID NO: 326910 - DNA, 25 bp, Rattus norvegicus
gactcgtggtatatattgtttttgt

SEQ ID NO: 326911 - DNA, 25 bp, Rattus norvegicus
gactcgtggtatttattgtttttgt

SEQ ID NO: 326912 - DNA, 25 bp, Rattus norvegicus
gactcgtgttgtatcaaggccctaa

SEQ ID NO: 326913 - DNA, 25 bp, Rattus norvegicus
gactcgtgttgtttcaaggccctaa

SEQ ID NO: 326914 - DNA, 25 bp, Rattus norvegicus
gactcgttgcctaggaaagggcctc

SEQ ID NO: 326915 - DNA, 25 bp, Rattus norvegicus
gactcgttgccttggaaagggcctc

SEQ ID NO: 326916 - DNA, 25 bp, Rattus norvegicus
gactctaaacctagcacggagcccg

SEQ ID NO: 326917 - DNA, 25 bp, Rattus norvegicus
gactctaaaccttgcacggagcccg

SEQ ID NO: 326918 - DNA, 25 bp, Rattus norvegicus
gactctaaattcagtttccaccact

SEQ ID NO: 326919 - DNA, 25 bp, Rattus norvegicus
gactctaaattctgtttccaccact

SEQ ID NO: 326920 - DNA, 25 bp, Rattus norvegicus
gactctaaatttctccggtgaggca

SEQ ID NO: 326921 - DNA, 25 bp, Rattus norvegicus
gactctaaatttgtccggtgaggca

SEQ ID NO: 326922 - DNA, 25 bp, Rattus norvegicus
gactctaacaggagtgattgacgac

SEQ ID NO: 326923 - DNA, 25 bp, Rattus norvegicus
gactctaacaggtgtgattgacgac

SEQ ID NO: 326924 - DNA, 25 bp, Rattus norvegicus
gactctaaccacactggcaggtgta

SEQ ID NO: 326925 - DNA, 25 bp, Rattus norvegicus
gactctaaccactctggcaggtgta

SEQ ID NO: 326926 - DNA, 25 bp, Rattus norvegicus
gactctaactctatgtctttatgac

SEQ ID NO: 326927 - DNA, 25 bp, Rattus norvegicus
gactctaactctttgtctttatgac

SEQ ID NO: 326928 - DNA, 25 bp, Rattus norvegicus
gactctaagataccctgagccttta

SEQ ID NO: 326929 - DNA, 25 bp, Rattus norvegicus
gactctaagatagcctgagccttta

SEQ ID NO: 326930 - DNA, 25 bp, Rattus norvegicus
gactctaaggtcatctaactccaag

SEQ ID NO: 326931 - DNA, 25 bp, Rattus norvegicus
gactctaaggtcttctaactccaag

SEQ ID NO: 326932 - DNA, 25 bp, Rattus norvegicus
gactctaagtcacataacatcattt

SEQ ID NO: 326933 - DNA, 25 bp, Rattus norvegicus
gactctaagtcagataacatcattt

SEQ ID NO: 326934 - DNA, 25 bp, Rattus norvegicus
gactctacacgaaactactgaatga

SEQ ID NO: 326935 - DNA, 25 bp, Rattus norvegicus
gactctacacgatactactgaatga

SEQ ID NO: 326936 - DNA, 25 bp, Rattus norvegicus
gactctaccactacacgagggtttt

SEQ ID NO: 326937 - DNA, 25 bp, Rattus norvegicus
gactctaccacttcacgagggtttt

SEQ ID NO: 326938 - DNA, 25 bp, Rattus norvegicus
gactctacgggcaagctatgtggga

SEQ ID NO: 326939 - DNA, 25 bp, Rattus norvegicus
gactctacgggctagctatgtggga

SEQ ID NO: 326940 - DNA, 25 bp, Rattus norvegicus
gactctacgtgcagtgaggaaaggc

SEQ ID NO: 326941 - DNA, 25 bp, Rattus norvegicus
gactctacgtgctgtgaggaaaggc

SEQ ID NO: 326942 - DNA, 25 bp, Rattus norvegicus
gactctactagtagagcatcctgac

SEQ ID NO: 326943 - DNA, 25 bp, Rattus norvegicus
gactctactagttgagcatcctgac

SEQ ID NO: 326944 - DNA, 25 bp, Rattus norvegicus
gactctactggaccctagtgcaaag

SEQ ID NO: 326945 - DNA, 25 bp, Rattus norvegicus
gactctactggagcctagtgcaaag

SEQ ID NO: 326946 - DNA, 25 bp, Rattus norvegicus
gactctagactacagatgccaacca

SEQ ID NO: 326947 - DNA, 25 bp, Rattus norvegicus
gactctagactagagatgccaacca

SEQ ID NO: 326948 - DNA, 25 bp, Rattus norvegicus
gactctagagtcatccatccagggt

SEQ ID NO: 326949 - DNA, 25 bp, Rattus norvegicus
gactctagagtcttccatccagggt

SEQ ID NO: 326950 - DNA, 25 bp, Rattus norvegicus
gactctagagtgactataggcgtta

SEQ ID NO: 326951 - DNA, 25 bp, Rattus norvegicus
gactctagagtgatcttcaagctaa

SEQ ID NO: 326952 - DNA, 25 bp, Rattus norvegicus
gactctagagtgtctataggcgtta

SEQ ID NO: 326953 - DNA, 25 bp, Rattus norvegicus
gactctagagtgttcttcaagctaa

SEQ ID NO: 326954 - DNA, 25 bp, Rattus norvegicus
gactctagcctgacagacacaagat

SEQ ID NO: 326955 - DNA, 25 bp, Rattus norvegicus
gactctagcctgtcagacacaagat

SEQ ID NO: 326956 - DNA, 25 bp, Rattus norvegicus
gactctagccttcagggtgcacagg

SEQ ID NO: 326957 - DNA, 25 bp, Rattus norvegicus
gactctagccttctacatgtgctga

SEQ ID NO: 326958 - DNA, 25 bp, Rattus norvegicus
gactctagccttgagggtgcacagg

SEQ ID NO: 326959 - DNA, 25 bp, Rattus norvegicus
gactctagccttgtacatgtgctga

SEQ ID NO: 326960 - DNA, 25 bp, Rattus norvegicus
gactctaggaatcctgcctgagccc

SEQ ID NO: 326961 - DNA, 25 bp, Rattus norvegicus
gactctaggaatgctgcctgagccc

SEQ ID NO: 326962 - DNA, 25 bp, Rattus norvegicus
gactctaggactaaacctccactta

SEQ ID NO: 326963 - DNA, 25 bp, Rattus norvegicus
gactctaggacttaacctccactta

SEQ ID NO: 326964 - DNA, 25 bp, Rattus norvegicus
gactctagggttatggtctgagaca

SEQ ID NO: 326965 - DNA, 25 bp, Rattus norvegicus
gactctagggttttggtctgagaca

SEQ ID NO: 326966 - DNA, 25 bp, Rattus norvegicus
gactctaggtaaagcattgggtaca

SEQ ID NO: 326967 - DNA, 25 bp, Rattus norvegicus
gactctaggtaatgcattgggtaca

SEQ ID NO: 326968 - DNA, 25 bp, Rattus norvegicus
gactctaggtataccacagttcggg

SEQ ID NO: 326969 - DNA, 25 bp, Rattus norvegicus
gactctaggtattccacagttcggg

SEQ ID NO: 326970 - DNA, 25 bp, Rattus norvegicus
gactctaggtttctgtcccaatgaa

SEQ ID NO: 326971 - DNA, 25 bp, Rattus norvegicus
gactctaggtttgtgtcccaatgaa

SEQ ID NO: 326972 - DNA, 25 bp, Rattus norvegicus
gactctagttcaagataaccgtttt

SEQ ID NO: 326973 - DNA, 25 bp, Rattus norvegicus
gactctagttcatgataaccgtttt

SEQ ID NO: 326974 - DNA, 25 bp, Rattus norvegicus
gactctataatcacctatctgcata

SEQ ID NO: 326975 - DNA, 25 bp, Rattus norvegicus
gactctataatctcctatctgcata

SEQ ID NO: 326976 - DNA, 25 bp, Rattus norvegicus
gactctatcatgaacagtttcctga

SEQ ID NO: 326977 - DNA, 25 bp, Rattus norvegicus
gactctatcatgtacagtttcctga

SEQ ID NO: 326978 - DNA, 25 bp, Rattus norvegicus
gactctatctcaatgacagtacctg

SEQ ID NO: 326979 - DNA, 25 bp, Rattus norvegicus
gactctatctcattgacagtacctg

SEQ ID NO: 326980 - DNA, 25 bp, Rattus norvegicus
gactctatctgcatggatctgttgg

SEQ ID NO: 326981 - DNA, 25 bp, Rattus norvegicus
gactctatctgcttggatctgttgg

SEQ ID NO: 326982 - DNA, 25 bp, Rattus norvegicus
gactctatctttacaccagtcagag

SEQ ID NO: 326983 - DNA, 25 bp, Rattus norvegicus
gactctatcttttcaccagtcagag

SEQ ID NO: 326984 - DNA, 25 bp, Rattus norvegicus
gactctatggatatggaaccgtcat

SEQ ID NO: 326985 - DNA, 25 bp, Rattus norvegicus
gactctatggatttggaaccgtcat

SEQ ID NO: 326986 - DNA, 25 bp, Rattus norvegicus
gactctattacgagcgacgccccgt

SEQ ID NO: 326987 - DNA, 25 bp, Rattus norvegicus
gactctattacgtgcgacgccccgt

SEQ ID NO: 326988 - DNA, 25 bp, Rattus norvegicus
gactctattgagattcaaagctctc

SEQ ID NO: 326989 - DNA, 25 bp, Rattus norvegicus
gactctattgagtttcaaagctctc

SEQ ID NO: 326990 - DNA, 25 bp, Rattus norvegicus
gactctatttacacctatgtgacag

SEQ ID NO: 326991 - DNA, 25 bp, Rattus norvegicus
gactctatttactcctatgtgacag

SEQ ID NO: 326992 - DNA, 25 bp, Rattus norvegicus
gactctcaagaacgtgcaggctctc

SEQ ID NO: 326993 - DNA, 25 bp, Rattus norvegicus
gactctcaagaaggtgcaggctctc

SEQ ID NO: 326994 - DNA, 25 bp, Rattus norvegicus
gactctcaagcaatagaacccaagt

SEQ ID NO: 326995 - DNA, 25 bp, Rattus norvegicus
gactctcaagcattagaacccaagt

SEQ ID NO: 326996 - DNA, 25 bp, Rattus norvegicus
gactctcacaggattgtattctgac

SEQ ID NO: 326997 - DNA, 25 bp, Rattus norvegicus
gactctcacaggtttgtattctgac

SEQ ID NO: 326998 - DNA, 25 bp, Rattus norvegicus
gactctcaccatacaggaagatttg

SEQ ID NO: 326999 - DNA, 25 bp, Rattus norvegicus
gactctcaccattcaggaagatttg

SEQ ID NO: 327000 - DNA, 25 bp, Rattus norvegicus
gactctcactgcctagcagaactag

SEQ ID NO: 327001 - DNA, 25 bp, Rattus norvegicus
gactctcactgcgtagcagaactag

SEQ ID NO: 327002 - DNA, 25 bp, Rattus norvegicus
gactctcagaagaactctcatgaag

SEQ ID NO: 327003 - DNA, 25 bp, Rattus norvegicus
gactctcagaagtactctcatgaag

SEQ ID NO: 327004 - DNA, 25 bp, Rattus norvegicus
gactctcagcacagcatgtaggtga

SEQ ID NO: 327005 - DNA, 25 bp, Rattus norvegicus
gactctcagcactgcatgtaggtga

SEQ ID NO: 327006 - DNA, 25 bp, Rattus norvegicus
gactctcagcatcgaaggacatcag

SEQ ID NO: 327007 - DNA, 25 bp, Rattus norvegicus
gactctcagcatggaaggacatcag

SEQ ID NO: 327008 - DNA, 25 bp, Rattus norvegicus
gactctcagctacctgcaggactga

SEQ ID NO: 327009 - DNA, 25 bp, Rattus norvegicus
gactctcagctagctgcaggactga

SEQ ID NO: 327010 - DNA, 25 bp, Rattus norvegicus
gactctcagcttacatgggagggaa

SEQ ID NO: 327011 - DNA, 25 bp, Rattus norvegicus
gactctcagctttcatgggagggaa

SEQ ID NO: 327012 - DNA, 25 bp, Rattus norvegicus
gactctcaggaaacactcagcggtg

SEQ ID NO: 327013 - DNA, 25 bp, Rattus norvegicus
gactctcaggaatcactcagcggtg

SEQ ID NO: 327014 - DNA, 25 bp, Rattus norvegicus
gactctcagggccaaccaaatgcta

SEQ ID NO: 327015 - DNA, 25 bp, Rattus norvegicus
gactctcagggcgaaccaaatgcta

SEQ ID NO: 327016 - DNA, 25 bp, Rattus norvegicus
gactctcagtcaccaggtagaccag

SEQ ID NO: 327017 - DNA, 25 bp, Rattus norvegicus
gactctcagtcagcaggtagaccag

SEQ ID NO: 327018 - DNA, 25 bp, Rattus norvegicus
gactctcagtgtaggagcagagctc

SEQ ID NO: 327019 - DNA, 25 bp, Rattus norvegicus
gactctcagtgttggagcagagctc

SEQ ID NO: 327020 - DNA, 25 bp, Rattus norvegicus
gactctcatagtaagaatactcagt

SEQ ID NO: 327021 - DNA, 25 bp, Rattus norvegicus
gactctcatagttagaatactcagt

SEQ ID NO: 327022 - DNA, 25 bp, Rattus norvegicus
gactctcatataactagtttcccta

SEQ ID NO: 327023 - DNA, 25 bp, Rattus norvegicus
gactctcatatatctagtttcccta

SEQ ID NO: 327024 - DNA, 25 bp, Rattus norvegicus
gactctcatcctcatatcatatgct

SEQ ID NO: 327025 - DNA, 25 bp, Rattus norvegicus
gactctcatcctgatatcatatgct

SEQ ID NO: 327026 - DNA, 25 bp, Rattus norvegicus
gactctcatctcactacttaatctg

SEQ ID NO: 327027 - DNA, 25 bp, Rattus norvegicus
gactctcatctctctacttaatctg

SEQ ID NO: 327028 - DNA, 25 bp, Rattus norvegicus
gactctcatttcatgttaactacaa

SEQ ID NO: 327029 - DNA, 25 bp, Rattus norvegicus
gactctcatttcttgttaactacaa

SEQ ID NO: 327030 - DNA, 25 bp, Rattus norvegicus
gactctccaagcctgaggtcttata

SEQ ID NO: 327031 - DNA, 25 bp, Rattus norvegicus
gactctccaagcgtgaggtcttata

SEQ ID NO: 327032 - DNA, 25 bp, Rattus norvegicus
gactctccatatatcagagcccttg

SEQ ID NO: 327033 - DNA, 25 bp, Rattus norvegicus
gactctccatatttcagagcccttg

SEQ ID NO: 327034 - DNA, 25 bp, Rattus norvegicus
gactctccatccactcggagaatag

SEQ ID NO: 327035 - DNA, 25 bp, Rattus norvegicus
gactctccatcctctcggagaatag

SEQ ID NO: 327036 - DNA, 25 bp, Rattus norvegicus
gactctcccaaactgactgtgtgtg

SEQ ID NO: 327037 - DNA, 25 bp, Rattus norvegicus
gactctcccaaagtgactgtgtgtg

SEQ ID NO: 327038 - DNA, 25 bp, Rattus norvegicus
gactctcccactccagacatgtaat

SEQ ID NO: 327039 - DNA, 25 bp, Rattus norvegicus
gactctcccactgcagacatgtaat

SEQ ID NO: 327040 - DNA, 25 bp, Rattus norvegicus
gactctcccatacctttgtggtgtg

SEQ ID NO: 327041 - DNA, 25 bp, Rattus norvegicus
gactctcccatagctttgtggtgtg

SEQ ID NO: 327042 - DNA, 25 bp, Rattus norvegicus
gactctcccattcatctgttttgtg

SEQ ID NO: 327043 - DNA, 25 bp, Rattus norvegicus
gactctcccattgatctgttttgtg

SEQ ID NO: 327044 - DNA, 25 bp, Rattus norvegicus
gactctccccagaattttcaattat

SEQ ID NO: 327045 - DNA, 25 bp, Rattus norvegicus
gactctccccagtattttcaattat

SEQ ID NO: 327046 - DNA, 25 bp, Rattus norvegicus
gactctcccgcgagaatgacagggt

SEQ ID NO: 327047 - DNA, 25 bp, Rattus norvegicus
gactctcccgcgtgaatgacagggt

SEQ ID NO: 327048 - DNA, 25 bp, Rattus norvegicus
gactctccctatacaaacggttacg

SEQ ID NO: 327049 - DNA, 25 bp, Rattus norvegicus
gactctccctattcaaacggttacg

SEQ ID NO: 327050 - DNA, 25 bp, Rattus norvegicus
gactctccgttcagggacgaggctt

SEQ ID NO: 327051 - DNA, 25 bp, Rattus norvegicus
gactctccgttctgggacgaggctt

SEQ ID NO: 327052 - DNA, 25 bp, Rattus norvegicus
gactctcctgtactcttcagcaaag

SEQ ID NO: 327053 - DNA, 25 bp, Rattus norvegicus
gactctcctgtagtcttcagcaaag

SEQ ID NO: 327054 - DNA, 25 bp, Rattus norvegicus
gactctccttctctgcagacaacat

SEQ ID NO: 327055 - DNA, 25 bp, Rattus norvegicus
gactctccttctgtgcagacaacat

SEQ ID NO: 327056 - DNA, 25 bp, Rattus norvegicus
gactctccttgacgtgggccttgaa

SEQ ID NO: 327057 - DNA, 25 bp, Rattus norvegicus
gactctccttgaggtgggccttgaa

SEQ ID NO: 327058 - DNA, 25 bp, Rattus norvegicus
gactctcctttgaggagccaaggca

SEQ ID NO: 327059 - DNA, 25 bp, Rattus norvegicus
gactctcctttgtggagccaaggca

SEQ ID NO: 327060 - DNA, 25 bp, Rattus norvegicus
gactctcgctttctgtgctttttga

SEQ ID NO: 327061 - DNA, 25 bp, Rattus norvegicus
gactctcgctttgtgtgctttttga

SEQ ID NO: 327062 - DNA, 25 bp, Rattus norvegicus
gactctctacataagttgggaccca

SEQ ID NO: 327063 - DNA, 25 bp, Rattus norvegicus
gactctctacattagttgggaccca

SEQ ID NO: 327064 - DNA, 25 bp, Rattus norvegicus
gactctctagagaagggaatgacag

SEQ ID NO: 327065 - DNA, 25 bp, Rattus norvegicus
gactctctagagtagggaatgacag

SEQ ID NO: 327066 - DNA, 25 bp, Rattus norvegicus
gactctctcaaactccccagatggg

SEQ ID NO: 327067 - DNA, 25 bp, Rattus norvegicus
gactctctcaaagtccccagatggg

SEQ ID NO: 327068 - DNA, 25 bp, Rattus norvegicus
gactctctcctcatggaggtagcaa

SEQ ID NO: 327069 - DNA, 25 bp, Rattus norvegicus
gactctctcctcttggaggtagcaa

SEQ ID NO: 327070 - DNA, 25 bp, Rattus norvegicus
gactctctgaccacttcctgggtga

SEQ ID NO: 327071 - DNA, 25 bp, Rattus norvegicus
gactctctgacctcttcctgggtga

SEQ ID NO: 327072 - DNA, 25 bp, Rattus norvegicus
gactctctgacgaacgaatttctgt

SEQ ID NO: 327073 - DNA, 25 bp, Rattus norvegicus
gactctctgacgtacgaatttctgt

SEQ ID NO: 327074 - DNA, 25 bp, Rattus norvegicus
gactctctgagaactgcaaacggaa

SEQ ID NO: 327075 - DNA, 25 bp, Rattus norvegicus
gactctctgagatctgcaaacggaa

SEQ ID NO: 327076 - DNA, 25 bp, Rattus norvegicus
gactctctggtacttagctgctggt

SEQ ID NO: 327077 - DNA, 25 bp, Rattus norvegicus
gactctctggtagttagctgctggt

SEQ ID NO: 327078 - DNA, 25 bp, Rattus norvegicus
gactctctgtgcctcgtgtatgaag

SEQ ID NO: 327079 - DNA, 25 bp, Rattus norvegicus
gactctctgtgcgtcgtgtatgaag

SEQ ID NO: 327080 - DNA, 25 bp, Rattus norvegicus
gactctctgtttcttgggttttaat

SEQ ID NO: 327081 - DNA, 25 bp, Rattus norvegicus
gactctctgtttgttgggttttaat

SEQ ID NO: 327082 - DNA, 25 bp, Rattus norvegicus
gactctcttaagattgtggacctat

SEQ ID NO: 327083 - DNA, 25 bp, Rattus norvegicus
gactctcttaagtttgtggacctat

SEQ ID NO: 327084 - DNA, 25 bp, Rattus norvegicus
gactctcttatgatggctgcttagc

SEQ ID NO: 327085 - DNA, 25 bp, Rattus norvegicus
gactctcttatgttggctgcttagc

SEQ ID NO: 327086 - DNA, 25 bp, Rattus norvegicus
gactctcttcctctggcctggttca

SEQ ID NO: 327087 - DNA, 25 bp, Rattus norvegicus
gactctcttcctgtggcctggttca

SEQ ID NO: 327088 - DNA, 25 bp, Rattus norvegicus
gactctgaaatgctgtgtgttcact

SEQ ID NO: 327089 - DNA, 25 bp, Rattus norvegicus
gactctgaaatggtgtgtgttcact

SEQ ID NO: 327090 - DNA, 25 bp, Rattus norvegicus
gactctgaaccaactctattgacat

SEQ ID NO: 327091 - DNA, 25 bp, Rattus norvegicus
gactctgaaccatctctattgacat

SEQ ID NO: 327092 - DNA, 25 bp, Rattus norvegicus
gactctgaagccattgtgccgtata

SEQ ID NO: 327093 - DNA, 25 bp, Rattus norvegicus
gactctgaagcctttgtgccgtata

SEQ ID NO: 327094 - DNA, 25 bp, Rattus norvegicus
gactctgaaggacctgaacgcccgc

SEQ ID NO: 327095 - DNA, 25 bp, Rattus norvegicus
gactctgaaggagctgaacgcccgc

SEQ ID NO: 327096 - DNA, 25 bp, Rattus norvegicus
gactctgaattccttggcatggtag

SEQ ID NO: 327097 - DNA, 25 bp, Rattus norvegicus
gactctgaattcgttggcatggtag

SEQ ID NO: 327098 - DNA, 25 bp, Rattus norvegicus
gactctgacagacatagatttgggt

SEQ ID NO: 327099 - DNA, 25 bp, Rattus norvegicus
gactctgacagagatagatttgggt

SEQ ID NO: 327100 - DNA, 25 bp, Rattus norvegicus
gactctgacattagcgtataggctg

SEQ ID NO: 327101 - DNA, 25 bp, Rattus norvegicus
gactctgacatttgcgtataggctg

SEQ ID NO: 327102 - DNA, 25 bp, Rattus norvegicus
gactctgaccagagcctgaaatctt

SEQ ID NO: 327103 - DNA, 25 bp, Rattus norvegicus
gactctgaccagtgcctgaaatctt

SEQ ID NO: 327104 - DNA, 25 bp, Rattus norvegicus
gactctgaccatactcttgtgtgta

SEQ ID NO: 327105 - DNA, 25 bp, Rattus norvegicus
gactctgaccattctcttgtgtgta

SEQ ID NO: 327106 - DNA, 25 bp, Rattus norvegicus
gactctgactacatgcttatttttg

SEQ ID NO: 327107 - DNA, 25 bp, Rattus norvegicus
gactctgactacttgcttatttttg

SEQ ID NO: 327108 - DNA, 25 bp, Rattus norvegicus
gactctgactgacatgtcttctgag

SEQ ID NO: 327109 - DNA, 25 bp, Rattus norvegicus
gactctgactgacgtcctgtggagc

SEQ ID NO: 327110 - DNA, 25 bp, Rattus norvegicus
gactctgactgagatgtcttctgag

SEQ ID NO: 327111 - DNA, 25 bp, Rattus norvegicus
gactctgactgaggtcctgtggagc

SEQ ID NO: 327112 - DNA, 25 bp, Rattus norvegicus
gactctgactgtctttacagccaaa

SEQ ID NO: 327113 - DNA, 25 bp, Rattus norvegicus
gactctgactgtgtttacagccaaa

SEQ ID NO: 327114 - DNA, 25 bp, Rattus norvegicus
gactctgacttcaaattagtattac

SEQ ID NO: 327115 - DNA, 25 bp, Rattus norvegicus
gactctgacttccaggtggtgtacc

SEQ ID NO: 327116 - DNA, 25 bp, Rattus norvegicus
gactctgacttcgaggtggtgtacc

SEQ ID NO: 327117 - DNA, 25 bp, Rattus norvegicus
gactctgacttctaattagtattac

SEQ ID NO: 327118 - DNA, 25 bp, Rattus norvegicus
gactctgagatgcaaaggcctgtaa

SEQ ID NO: 327119 - DNA, 25 bp, Rattus norvegicus
gactctgagatggaaaggcctgtaa

SEQ ID NO: 327120 - DNA, 25 bp, Rattus norvegicus
gactctgagcaccaagcgccaggac

SEQ ID NO: 327121 - DNA, 25 bp, Rattus norvegicus
gactctgagcacgaagcgccaggac

SEQ ID NO: 327122 - DNA, 25 bp, Rattus norvegicus
gactctgagcagcaggatcagcaag

SEQ ID NO: 327123 - DNA, 25 bp, Rattus norvegicus
gactctgagcaggaggatcagcaag

SEQ ID NO: 327124 - DNA, 25 bp, Rattus norvegicus
gactctgagctcaggaagggtccac

SEQ ID NO: 327125 - DNA, 25 bp, Rattus norvegicus
gactctgagctctggaagggtccac

SEQ ID NO: 327126 - DNA, 25 bp, Rattus norvegicus
gactctgaggaactgactgcccatt

SEQ ID NO: 327127 - DNA, 25 bp, Rattus norvegicus
gactctgaggaagtgactgcccatt

SEQ ID NO: 327128 - DNA, 25 bp, Rattus norvegicus
gactctgaggacacagcacctgggt

SEQ ID NO: 327129 - DNA, 25 bp, Rattus norvegicus
gactctgaggactcagcacctgggt

SEQ ID NO: 327130 - DNA, 25 bp, Rattus norvegicus
gactctgaggcaccggcagaaacgc

SEQ ID NO: 327131 - DNA, 25 bp, Rattus norvegicus
gactctgaggcagcggcagaaacgc

SEQ ID NO: 327132 - DNA, 25 bp, Rattus norvegicus
gactctgaggccatgtgaggtgcta

SEQ ID NO: 327133 - DNA, 25 bp, Rattus norvegicus
gactctgaggccttgtgaggtgcta

SEQ ID NO: 327134 - DNA, 25 bp, Rattus norvegicus
gactctgagtctcacaaagccttca

SEQ ID NO: 327135 - DNA, 25 bp, Rattus norvegicus
gactctgagtctgacaaagccttca

SEQ ID NO: 327136 - DNA, 25 bp, Rattus norvegicus
gactctgagtgaaactacccttttg

SEQ ID NO: 327137 - DNA, 25 bp, Rattus norvegicus
gactctgagtgaattctttcttttt

SEQ ID NO: 327138 - DNA, 25 bp, Rattus norvegicus
gactctgagtgatactacccttttg

SEQ ID NO: 327139 - DNA, 25 bp, Rattus norvegicus
gactctgagtgatttctttcttttt

SEQ ID NO: 327140 - DNA, 25 bp, Rattus norvegicus
gactctgagtggcactatctccaaa

SEQ ID NO: 327141 - DNA, 25 bp, Rattus norvegicus
gactctgagtgggactatctccaaa

SEQ ID NO: 327142 - DNA, 25 bp, Rattus norvegicus
gactctgagttcctgagtctcaaaa

SEQ ID NO: 327143 - DNA, 25 bp, Rattus norvegicus
gactctgagttcgtgagtctcaaaa

SEQ ID NO: 327144 - DNA, 25 bp, Rattus norvegicus
gactctgagtttctataagcaactt

SEQ ID NO: 327145 - DNA, 25 bp, Rattus norvegicus
gactctgagtttgtataagcaactt

SEQ ID NO: 327146 - DNA, 25 bp, Rattus norvegicus
gactctgatcatcaaagctagggct

SEQ ID NO: 327147 - DNA, 25 bp, Rattus norvegicus
gactctgatcatgaaagctagggct

SEQ ID NO: 327148 - DNA, 25 bp, Rattus norvegicus
gactctgatctgcaaaaaggcaaat

SEQ ID NO: 327149 - DNA, 25 bp, Rattus norvegicus
gactctgatctggaaaaaggcaaat

SEQ ID NO: 327150 - DNA, 25 bp, Rattus norvegicus
gactctgatcttaggctggattaca

SEQ ID NO: 327151 - DNA, 25 bp, Rattus norvegicus
gactctgatctttggctggattaca

SEQ ID NO: 327152 - DNA, 25 bp, Rattus norvegicus
gactctgatggcactgggaagcgtt

SEQ ID NO: 327153 - DNA, 25 bp, Rattus norvegicus
gactctgatggctctgggaagcgtt

SEQ ID NO: 327154 - DNA, 25 bp, Rattus norvegicus
gactctgcaatgagatctttatggg

SEQ ID NO: 327155 - DNA, 25 bp, Rattus norvegicus
gactctgcaatgtgatctttatggg

SEQ ID NO: 327156 - DNA, 25 bp, Rattus norvegicus
gactctgcacaacctgttgaggtaa

SEQ ID NO: 327157 - DNA, 25 bp, Rattus norvegicus
gactctgcacaagctgttgaggtaa

SEQ ID NO: 327158 - DNA, 25 bp, Rattus norvegicus
gactctgcactcaagttttcatgaa

SEQ ID NO: 327159 - DNA, 25 bp, Rattus norvegicus
gactctgcactctagttttcatgaa

SEQ ID NO: 327160 - DNA, 25 bp, Rattus norvegicus
gactctgcagatctgcgtacttgga

SEQ ID NO: 327161 - DNA, 25 bp, Rattus norvegicus
gactctgcagatgtgcgtacttgga

SEQ ID NO: 327162 - DNA, 25 bp, Rattus norvegicus
gactctgcagcaccgcctgagggat

SEQ ID NO: 327163 - DNA, 25 bp, Rattus norvegicus
gactctgcagcacggatgtttttat

SEQ ID NO: 327164 - DNA, 25 bp, Rattus norvegicus
gactctgcagcagcgcctgagggat

SEQ ID NO: 327165 - DNA, 25 bp, Rattus norvegicus
gactctgcagcagggatgtttttat

SEQ ID NO: 327166 - DNA, 25 bp, Rattus norvegicus
gactctgcatacatggcttatggca

SEQ ID NO: 327167 - DNA, 25 bp, Rattus norvegicus
gactctgcatacttggcttatggca

SEQ ID NO: 327168 - DNA, 25 bp, Rattus norvegicus
gactctgccaatcactggactggat

SEQ ID NO: 327169 - DNA, 25 bp, Rattus norvegicus
gactctgccaatcggaactgtccgt

SEQ ID NO: 327170 - DNA, 25 bp, Rattus norvegicus
gactctgccaatgactggactggat

SEQ ID NO: 327171 - DNA, 25 bp, Rattus norvegicus
gactctgccaatgggaactgtccgt

SEQ ID NO: 327172 - DNA, 25 bp, Rattus norvegicus
gactctgccctgcatatgtctgaag

SEQ ID NO: 327173 - DNA, 25 bp, Rattus norvegicus
gactctgccctggatatgtctgaag

SEQ ID NO: 327174 - DNA, 25 bp, Rattus norvegicus
gactctgccgagaactatctttaca

SEQ ID NO: 327175 - DNA, 25 bp, Rattus norvegicus
gactctgccgagtactatctttaca

SEQ ID NO: 327176 - DNA, 25 bp, Rattus norvegicus
gactctgccggcatgtggccaggaa

SEQ ID NO: 327177 - DNA, 25 bp, Rattus norvegicus
gactctgccggcttgtggccaggaa

SEQ ID NO: 327178 - DNA, 25 bp, Rattus norvegicus
gactctgcctgcatggcttagtagt

SEQ ID NO: 327179 - DNA, 25 bp, Rattus norvegicus
gactctgcctgcttggcttagtagt

SEQ ID NO: 327180 - DNA, 25 bp, Rattus norvegicus
gactctgcctgtcaagcactggtca

SEQ ID NO: 327181 - DNA, 25 bp, Rattus norvegicus
gactctgcctgtgaagcactggtca

SEQ ID NO: 327182 - DNA, 25 bp, Rattus norvegicus
gactctgccttacctctgtaaatat

SEQ ID NO: 327183 - DNA, 25 bp, Rattus norvegicus
gactctgccttagctctgtaaatat

SEQ ID NO: 327184 - DNA, 25 bp, Rattus norvegicus
gactctgcgatgattggcttctttc

SEQ ID NO: 327185 - DNA, 25 bp, Rattus norvegicus
gactctgcgatgtttggcttctttc

SEQ ID NO: 327186 - DNA, 25 bp, Rattus norvegicus
gactctgctaaaactgtgtcctgcc

SEQ ID NO: 327187 - DNA, 25 bp, Rattus norvegicus
gactctgctaaaatggagcccgcct

SEQ ID NO: 327188 - DNA, 25 bp, Rattus norvegicus
gactctgctaaatctgtgtcctgcc

SEQ ID NO: 327189 - DNA, 25 bp, Rattus norvegicus
gactctgctaaattggagcccgcct

SEQ ID NO: 327190 - DNA, 25 bp, Rattus norvegicus
gactctgctcttactgatttcttaa

SEQ ID NO: 327191 - DNA, 25 bp, Rattus norvegicus
gactctgctcttagaataaaccttg

SEQ ID NO: 327192 - DNA, 25 bp, Rattus norvegicus
gactctgctctttctgatttcttaa

SEQ ID NO: 327193 - DNA, 25 bp, Rattus norvegicus
gactctgctctttgaataaaccttg

SEQ ID NO: 327194 - DNA, 25 bp, Rattus norvegicus
gactctgctgaaagtaagctgtcaa

SEQ ID NO: 327195 - DNA, 25 bp, Rattus norvegicus
gactctgctgaatgtaagctgtcaa

SEQ ID NO: 327196 - DNA, 25 bp, Rattus norvegicus
gactctgctgacacaaggaaaggtt

SEQ ID NO: 327197 - DNA, 25 bp, Rattus norvegicus
gactctgctgactcaaggaaaggtt

SEQ ID NO: 327198 - DNA, 25 bp, Rattus norvegicus
gactctgctgagagacgtaggctct

SEQ ID NO: 327199 - DNA, 25 bp, Rattus norvegicus
gactctgctgagtgacgtaggctct

SEQ ID NO: 327200 - DNA, 25 bp, Rattus norvegicus
gactctgctgctaatattactctaa

SEQ ID NO: 327201 - DNA, 25 bp, Rattus norvegicus
gactctgctgcttatattactctaa

SEQ ID NO: 327202 - DNA, 25 bp, Rattus norvegicus
gactctgctgttacctgtatgataa

SEQ ID NO: 327203 - DNA, 25 bp, Rattus norvegicus
gactctgctgtttcctgtatgataa

SEQ ID NO: 327204 - DNA, 25 bp, Rattus norvegicus
gactctgcttttagtgctttgtaaa

SEQ ID NO: 327205 - DNA, 25 bp, Rattus norvegicus
gactctgctttttgtgctttgtaaa

SEQ ID NO: 327206 - DNA, 25 bp, Rattus norvegicus
gactctggaatcatcactttgcatg

SEQ ID NO: 327207 - DNA, 25 bp, Rattus norvegicus
gactctggaatcttcactttgcatg

SEQ ID NO: 327208 - DNA, 25 bp, Rattus norvegicus
gactctggaccaccagtatctcaag

SEQ ID NO: 327209 - DNA, 25 bp, Rattus norvegicus
gactctggaccagcagtatctcaag

SEQ ID NO: 327210 - DNA, 25 bp, Rattus norvegicus
gactctggacctatccaagtatcca

SEQ ID NO: 327211 - DNA, 25 bp, Rattus norvegicus
gactctggacctttccaagtatcca

SEQ ID NO: 327212 - DNA, 25 bp, Rattus norvegicus
gactctggagacaacaaggctaccc

SEQ ID NO: 327213 - DNA, 25 bp, Rattus norvegicus
gactctggagactacaaggctaccc

SEQ ID NO: 327214 - DNA, 25 bp, Rattus norvegicus
gactctggagtcatgggcctggctt

SEQ ID NO: 327215 - DNA, 25 bp, Rattus norvegicus
gactctggagtcttgggcctggctt

SEQ ID NO: 327216 - DNA, 25 bp, Rattus norvegicus
gactctggccagctggaagtgtctc

SEQ ID NO: 327217 - DNA, 25 bp, Rattus norvegicus
gactctggccaggtggaagtgtctc

SEQ ID NO: 327218 - DNA, 25 bp, Rattus norvegicus
gactctggccttcgaggtcatacac

SEQ ID NO: 327219 - DNA, 25 bp, Rattus norvegicus
gactctggccttggaggtcatacac

SEQ ID NO: 327220 - DNA, 25 bp, Rattus norvegicus
gactctggctggctatcatgtacaa

SEQ ID NO: 327221 - DNA, 25 bp, Rattus norvegicus
gactctggctgggtatcatgtacaa

SEQ ID NO: 327222 - DNA, 25 bp, Rattus norvegicus
gactctggcttcagcaatcattggt

SEQ ID NO: 327223 - DNA, 25 bp, Rattus norvegicus
gactctggcttctgcaatcattggt

SEQ ID NO: 327224 - DNA, 25 bp, Rattus norvegicus
gactctgggagtcgcatacatgctt

SEQ ID NO: 327225 - DNA, 25 bp, Rattus norvegicus
gactctgggagtggcatacatgctt

SEQ ID NO: 327226 - DNA, 25 bp, Rattus norvegicus
gactctgggcccagactctgaaata

SEQ ID NO: 327227 - DNA, 25 bp, Rattus norvegicus
gactctgggccctgactctgaaata

SEQ ID NO: 327228 - DNA, 25 bp, Rattus norvegicus
gactctgggtatatgcacttatgta

SEQ ID NO: 327229 - DNA, 25 bp, Rattus norvegicus
gactctgggtatttgcacttatgta

SEQ ID NO: 327230 - DNA, 25 bp, Rattus norvegicus
gactctggtaaactctgtgaattcc

SEQ ID NO: 327231 - DNA, 25 bp, Rattus norvegicus
gactctggtaaagtctgtgaattcc

SEQ ID NO: 327232 - DNA, 25 bp, Rattus norvegicus
gactctggtatacagtactggctga

SEQ ID NO: 327233 - DNA, 25 bp, Rattus norvegicus
gactctggtatagagtactggctga

SEQ ID NO: 327234 - DNA, 25 bp, Rattus norvegicus
gactctggtcatctgagacatttcc

SEQ ID NO: 327235 - DNA, 25 bp, Rattus norvegicus
gactctggtcatgtgagacatttcc

SEQ ID NO: 327236 - DNA, 25 bp, Rattus norvegicus
gactctggtgagcaactacttggaa

SEQ ID NO: 327237 - DNA, 25 bp, Rattus norvegicus
gactctggtgaggaactacttggaa

SEQ ID NO: 327238 - DNA, 25 bp, Rattus norvegicus
gactctggttacctttgaagctcca

SEQ ID NO: 327239 - DNA, 25 bp, Rattus norvegicus
gactctggttacgtttgaagctcca

SEQ ID NO: 327240 - DNA, 25 bp, Rattus norvegicus
gactctgtacccaactggaactatt

SEQ ID NO: 327241 - DNA, 25 bp, Rattus norvegicus
gactctgtaccctactggaactatt

SEQ ID NO: 327242 - DNA, 25 bp, Rattus norvegicus
gactctgtagcccaacagcagggat

SEQ ID NO: 327243 - DNA, 25 bp, Rattus norvegicus
gactctgtagccgaacagcagggat

SEQ ID NO: 327244 - DNA, 25 bp, Rattus norvegicus
gactctgtagctccagcgtaggaaa

SEQ ID NO: 327245 - DNA, 25 bp, Rattus norvegicus
gactctgtagctgcagcgtaggaaa

SEQ ID NO: 327246 - DNA, 25 bp, Rattus norvegicus
gactctgtatctagtcctctaatac

SEQ ID NO: 327247 - DNA, 25 bp, Rattus norvegicus
gactctgtatcttgtcctctaatac

SEQ ID NO: 327248 - DNA, 25 bp, Rattus norvegicus
gactctgtcaggatccagggacttg

SEQ ID NO: 327249 - DNA, 25 bp, Rattus norvegicus
gactctgtcaggttccagggacttg

SEQ ID NO: 327250 - DNA, 25 bp, Rattus norvegicus
gactctgtcccaaacaagaaatctg

SEQ ID NO: 327251 - DNA, 25 bp, Rattus norvegicus
gactctgtcccatacaagaaatctg

SEQ ID NO: 327252 - DNA, 25 bp, Rattus norvegicus
gactctgtcgagaattagagcagca

SEQ ID NO: 327253 - DNA, 25 bp, Rattus norvegicus
gactctgtcgagtattagagcagca

SEQ ID NO: 327254 - DNA, 25 bp, Rattus norvegicus
gactctgtctacattctgccagaaa

SEQ ID NO: 327255 - DNA, 25 bp, Rattus norvegicus
gactctgtctactttctgccagaaa

SEQ ID NO: 327256 - DNA, 25 bp, Rattus norvegicus
gactctgtctcaaacagaggagaca

SEQ ID NO: 327257 - DNA, 25 bp, Rattus norvegicus
gactctgtctcatacagaggagaca

SEQ ID NO: 327258 - DNA, 25 bp, Rattus norvegicus
gactctgtgacaagtgctggtttca

SEQ ID NO: 327259 - DNA, 25 bp, Rattus norvegicus
gactctgtgacatgtgctggtttca

SEQ ID NO: 327260 - DNA, 25 bp, Rattus norvegicus
gactctgtgctcagtactttggatg

SEQ ID NO: 327261 - DNA, 25 bp, Rattus norvegicus
gactctgtgctctgtactttggatg

SEQ ID NO: 327262 - DNA, 25 bp, Rattus norvegicus
gactctgtggtactcattagctgaa

SEQ ID NO: 327263 - DNA, 25 bp, Rattus norvegicus
gactctgtggtagtcattagctgaa

SEQ ID NO: 327264 - DNA, 25 bp, Rattus norvegicus
gactctgtggtcactgtgctgaata

SEQ ID NO: 327265 - DNA, 25 bp, Rattus norvegicus
gactctgtggtcctgagtgccagaa

SEQ ID NO: 327266 - DNA, 25 bp, Rattus norvegicus
gactctgtggtcgtgagtgccagaa

SEQ ID NO: 327267 - DNA, 25 bp, Rattus norvegicus
gactctgtggtctctgtgctgaata

SEQ ID NO: 327268 - DNA, 25 bp, Rattus norvegicus
gactctgtgtgcagccttagggtta

SEQ ID NO: 327269 - DNA, 25 bp, Rattus norvegicus
gactctgtgtgctgccttagggtta

SEQ ID NO: 327270 - DNA, 25 bp, Rattus norvegicus
gactctgttcctctacagcaatgat

SEQ ID NO: 327271 - DNA, 25 bp, Rattus norvegicus
gactctgttcctgtacagcaatgat

SEQ ID NO: 327272 - DNA, 25 bp, Rattus norvegicus
gactctgttgcccattagagggacc

SEQ ID NO: 327273 - DNA, 25 bp, Rattus norvegicus
gactctgttgccgattagagggacc

SEQ ID NO: 327274 - DNA, 25 bp, Rattus norvegicus
gactctgttgctaaccagacagcat

SEQ ID NO: 327275 - DNA, 25 bp, Rattus norvegicus
gactctgttgcttaccagacagcat

SEQ ID NO: 327276 - DNA, 25 bp, Rattus norvegicus
gactctgttgtaaaccctctgtttg

SEQ ID NO: 327277 - DNA, 25 bp, Rattus norvegicus
gactctgttgtataccctctgtttg

SEQ ID NO: 327278 - DNA, 25 bp, Rattus norvegicus
gactctgttgttattgtgacgctta

SEQ ID NO: 327279 - DNA, 25 bp, Rattus norvegicus
gactctgttgtttttgtgacgctta

SEQ ID NO: 327280 - DNA, 25 bp, Rattus norvegicus
gactctgttttgaaatcttgcattt

SEQ ID NO: 327281 - DNA, 25 bp, Rattus norvegicus
gactctgttttgtaatcttgcattt

SEQ ID NO: 327282 - DNA, 25 bp, Rattus norvegicus
gactcttaactccagagagagcctt

SEQ ID NO: 327283 - DNA, 25 bp, Rattus norvegicus
gactcttaactcgagagagagcctt

SEQ ID NO: 327284 - DNA, 25 bp, Rattus norvegicus
gactcttaacttctaaagccaccta

SEQ ID NO: 327285 - DNA, 25 bp, Rattus norvegicus
gactcttaacttgtaaagccaccta

SEQ ID NO: 327286 - DNA, 25 bp, Rattus norvegicus
gactcttaagttagttgtattaata

SEQ ID NO: 327287 - DNA, 25 bp, Rattus norvegicus
gactcttaagtttgttgtattaata

SEQ ID NO: 327288 - DNA, 25 bp, Rattus norvegicus
gactcttaattgagcactttagtgg

SEQ ID NO: 327289 - DNA, 25 bp, Rattus norvegicus
gactcttaattgtgcactttagtgg

SEQ ID NO: 327290 - DNA, 25 bp, Rattus norvegicus
gactcttacagccatgggttttctt

SEQ ID NO: 327291 - DNA, 25 bp, Rattus norvegicus
gactcttacagcgatgggttttctt

SEQ ID NO: 327292 - DNA, 25 bp, Rattus norvegicus
gactcttacattcctgttgctgtgt

SEQ ID NO: 327293 - DNA, 25 bp, Rattus norvegicus
gactcttacattgctgttgctgtgt

SEQ ID NO: 327294 - DNA, 25 bp, Rattus norvegicus
gactcttaggtgagatccagctgtt

SEQ ID NO: 327295 - DNA, 25 bp, Rattus norvegicus
gactcttaggtgtgatccagctgtt

SEQ ID NO: 327296 - DNA, 25 bp, Rattus norvegicus
gactcttatcgacaacattcctagc

SEQ ID NO: 327297 - DNA, 25 bp, Rattus norvegicus
gactcttatcgagaacattcctagc

SEQ ID NO: 327298 - DNA, 25 bp, Rattus norvegicus
gactcttatgttctgcaggcttgca

SEQ ID NO: 327299 - DNA, 25 bp, Rattus norvegicus
gactcttatgttgtgcaggcttgca

SEQ ID NO: 327300 - DNA, 25 bp, Rattus norvegicus
gactcttccaacaggcaggatggta

SEQ ID NO: 327301 - DNA, 25 bp, Rattus norvegicus
gactcttccaactggcaggatggta

SEQ ID NO: 327302 - DNA, 25 bp, Rattus norvegicus
gactcttcccaccttatctgaggat

SEQ ID NO: 327303 - DNA, 25 bp, Rattus norvegicus
gactcttcccacgttatctgaggat

SEQ ID NO: 327304 - DNA, 25 bp, Rattus norvegicus
gactcttcctcaatccgtaaagtgg

SEQ ID NO: 327305 - DNA, 25 bp, Rattus norvegicus
gactcttcctcattccgtaaagtgg

SEQ ID NO: 327306 - DNA, 25 bp, Rattus norvegicus
gactcttcgggcctttctttccatg

SEQ ID NO: 327307 - DNA, 25 bp, Rattus norvegicus
gactcttcgggcgtttctttccatg

SEQ ID NO: 327308 - DNA, 25 bp, Rattus norvegicus
gactcttcgggtcacagttgctgtt

SEQ ID NO: 327309 - DNA, 25 bp, Rattus norvegicus
gactcttcgggtgacagttgctgtt

SEQ ID NO: 327310 - DNA, 25 bp, Rattus norvegicus
gactcttctctaatccctgtggaat

SEQ ID NO: 327311 - DNA, 25 bp, Rattus norvegicus
gactcttctctattccctgtggaat

SEQ ID NO: 327312 - DNA, 25 bp, Rattus norvegicus
gactcttctgaaaggctctgttgct

SEQ ID NO: 327313 - DNA, 25 bp, Rattus norvegicus
gactcttctgaatggctctgttgct

SEQ ID NO: 327314 - DNA, 25 bp, Rattus norvegicus
gactcttctgggaaagccatgcctg

SEQ ID NO: 327315 - DNA, 25 bp, Rattus norvegicus
gactcttctgggtaagccatgcctg

SEQ ID NO: 327316 - DNA, 25 bp, Rattus norvegicus
gactcttcttatcacacttgcggat

SEQ ID NO: 327317 - DNA, 25 bp, Rattus norvegicus
gactcttcttatgacacttgcggat

SEQ ID NO: 327318 - DNA, 25 bp, Rattus norvegicus
gactcttgaagtcctaaaggaagaa

SEQ ID NO: 327319 - DNA, 25 bp, Rattus norvegicus
gactcttgaagtgctaaaggaagaa

SEQ ID NO: 327320 - DNA, 25 bp, Rattus norvegicus
gactcttgaattagggtttattcct

SEQ ID NO: 327321 - DNA, 25 bp, Rattus norvegicus
gactcttgaatttgggtttattcct

SEQ ID NO: 327322 - DNA, 25 bp, Rattus norvegicus
gactcttgagggacgtcactgggca

SEQ ID NO: 327323 - DNA, 25 bp, Rattus norvegicus
gactcttgagggtcgtcactgggca

SEQ ID NO: 327324 - DNA, 25 bp, Rattus norvegicus
gactcttgatcaatgtcagcccaga

SEQ ID NO: 327325 - DNA, 25 bp, Rattus norvegicus
gactcttgatcattgtcagcccaga

SEQ ID NO: 327326 - DNA, 25 bp, Rattus norvegicus
gactcttgcaacagtctaattacat

SEQ ID NO: 327327 - DNA, 25 bp, Rattus norvegicus
gactcttgcaacagttctgttcatt

SEQ ID NO: 327328 - DNA, 25 bp, Rattus norvegicus
gactcttgcaactgtctaattacat

SEQ ID NO: 327329 - DNA, 25 bp, Rattus norvegicus
gactcttgcaactgttctgttcatt

SEQ ID NO: 327330 - DNA, 25 bp, Rattus norvegicus
gactcttgcatgctcgctaagcttg

SEQ ID NO: 327331 - DNA, 25 bp, Rattus norvegicus
gactcttgcatggtcgctaagcttg

SEQ ID NO: 327332 - DNA, 25 bp, Rattus norvegicus
gactcttgccacctctgccaggaga

SEQ ID NO: 327333 - DNA, 25 bp, Rattus norvegicus
gactcttgccacgtctgccaggaga

SEQ ID NO: 327334 - DNA, 25 bp, Rattus norvegicus
gactcttgccggaattaacaccgtg

SEQ ID NO: 327335 - DNA, 25 bp, Rattus norvegicus
gactcttgccggtattaacaccgtg

SEQ ID NO: 327336 - DNA, 25 bp, Rattus norvegicus
gactcttgcctgctgttctctgtaa

SEQ ID NO: 327337 - DNA, 25 bp, Rattus norvegicus
gactcttgcctggtgttctctgtaa

SEQ ID NO: 327338 - DNA, 25 bp, Rattus norvegicus
gactcttggaaaagccttcagattt

SEQ ID NO: 327339 - DNA, 25 bp, Rattus norvegicus
gactcttggaaatgccttcagattt

SEQ ID NO: 327340 - DNA, 25 bp, Rattus norvegicus
gactcttggcctcgataccagggaa

SEQ ID NO: 327341 - DNA, 25 bp, Rattus norvegicus
gactcttggcctggataccagggaa

SEQ ID NO: 327342 - DNA, 25 bp, Rattus norvegicus
gactcttgggatacttacacatttg

SEQ ID NO: 327343 - DNA, 25 bp, Rattus norvegicus
gactcttgggattcttacacatttg

SEQ ID NO: 327344 - DNA, 25 bp, Rattus norvegicus
gactcttggtaactcagaccctagt

SEQ ID NO: 327345 - DNA, 25 bp, Rattus norvegicus
gactcttggtaagtcagaccctagt

SEQ ID NO: 327346 - DNA, 25 bp, Rattus norvegicus
gactcttgttagagtcgctttgaca

SEQ ID NO: 327347 - DNA, 25 bp, Rattus norvegicus
gactcttgttagtgtcgctttgaca

SEQ ID NO: 327348 - DNA, 25 bp, Rattus norvegicus
gactcttgttctataaggtactgtt

SEQ ID NO: 327349 - DNA, 25 bp, Rattus norvegicus
gactcttgttctttaaggtactgtt

SEQ ID NO: 327350 - DNA, 25 bp, Rattus norvegicus
gactcttgtttacgttcttgtccct

SEQ ID NO: 327351 - DNA, 25 bp, Rattus norvegicus
gactcttgtttaggttcttgtccct

SEQ ID NO: 327352 - DNA, 25 bp, Rattus norvegicus
gactctttaaaacactcacccatgt

SEQ ID NO: 327353 - DNA, 25 bp, Rattus norvegicus
gactctttaaaagactcacccatgt

SEQ ID NO: 327354 - DNA, 25 bp, Rattus norvegicus
gactctttaacacctgagcacttcc

SEQ ID NO: 327355 - DNA, 25 bp, Rattus norvegicus
gactctttaacaccttttgctctaa

SEQ ID NO: 327356 - DNA, 25 bp, Rattus norvegicus
gactctttaacagctgagcacttcc

SEQ ID NO: 327357 - DNA, 25 bp, Rattus norvegicus
gactctttaacagcttttgctctaa

SEQ ID NO: 327358 - DNA, 25 bp, Rattus norvegicus
gactctttaagcaaagggcttctct

SEQ ID NO: 327359 - DNA, 25 bp, Rattus norvegicus
gactctttaagctaagggcttctct

SEQ ID NO: 327360 - DNA, 25 bp, Rattus norvegicus
gactctttacacactcagaaatcat

SEQ ID NO: 327361 - DNA, 25 bp, Rattus norvegicus
gactctttacactctcagaaatcat

SEQ ID NO: 327362 - DNA, 25 bp, Rattus norvegicus
gactctttactcattagctcttgga

SEQ ID NO: 327363 - DNA, 25 bp, Rattus norvegicus
gactctttactctttagctcttgga

SEQ ID NO: 327364 - DNA, 25 bp, Rattus norvegicus
gactctttatggatgcacagcacaa

SEQ ID NO: 327365 - DNA, 25 bp, Rattus norvegicus
gactctttatggttgcacagcacaa

SEQ ID NO: 327366 - DNA, 25 bp, Rattus norvegicus
gactctttcaagctctttctgaact

SEQ ID NO: 327367 - DNA, 25 bp, Rattus norvegicus
gactctttcaaggtctttctgaact

SEQ ID NO: 327368 - DNA, 25 bp, Rattus norvegicus
gactctttcagcaaatgaccacaaa

SEQ ID NO: 327369 - DNA, 25 bp, Rattus norvegicus
gactctttcagctaatgaccacaaa

SEQ ID NO: 327370 - DNA, 25 bp, Rattus norvegicus
gactctttccttctcttgaatttga

SEQ ID NO: 327371 - DNA, 25 bp, Rattus norvegicus
gactctttccttgtcttgaatttga

SEQ ID NO: 327372 - DNA, 25 bp, Rattus norvegicus
gactctttctagaattcagactcta

SEQ ID NO: 327373 - DNA, 25 bp, Rattus norvegicus
gactctttctagtattcagactcta

SEQ ID NO: 327374 - DNA, 25 bp, Rattus norvegicus
gactctttcttgcaactttgtttct

SEQ ID NO: 327375 - DNA, 25 bp, Rattus norvegicus
gactctttcttggaactttgtttct

SEQ ID NO: 327376 - DNA, 25 bp, Rattus norvegicus
gactctttgcctactgttacagtgt

SEQ ID NO: 327377 - DNA, 25 bp, Rattus norvegicus
gactctttgccttctgttacagtgt

SEQ ID NO: 327378 - DNA, 25 bp, Rattus norvegicus
gactctttgctgacgtgcactttgc

SEQ ID NO: 327379 - DNA, 25 bp, Rattus norvegicus
gactctttgctgctggagtttggct

SEQ ID NO: 327380 - DNA, 25 bp, Rattus norvegicus
gactctttgctgcttcatcgaatgc

SEQ ID NO: 327381 - DNA, 25 bp, Rattus norvegicus
gactctttgctggtggagtttggct

SEQ ID NO: 327382 - DNA, 25 bp, Rattus norvegicus
gactctttgctggttcatcgaatgc

SEQ ID NO: 327383 - DNA, 25 bp, Rattus norvegicus
gactctttgctgtcgtgcactttgc

SEQ ID NO: 327384 - DNA, 25 bp, Rattus norvegicus
gactcttttaagagtctctttccac

SEQ ID NO: 327385 - DNA, 25 bp, Rattus norvegicus
gactcttttaagtgtctctttccac

SEQ ID NO: 327386 - DNA, 25 bp, Rattus norvegicus
gactcttttagactttgactcctgg

SEQ ID NO: 327387 - DNA, 25 bp, Rattus norvegicus
gactcttttagagtttgactcctgg

SEQ ID NO: 327388 - DNA, 25 bp, Rattus norvegicus
gactcttttccgattactaggagag

SEQ ID NO: 327389 - DNA, 25 bp, Rattus norvegicus
gactcttttccgtttactaggagag

SEQ ID NO: 327390 - DNA, 25 bp, Rattus norvegicus
gactcttttcctcagagatctactg

SEQ ID NO: 327391 - DNA, 25 bp, Rattus norvegicus
gactcttttcctgagagatctactg

SEQ ID NO: 327392 - DNA, 25 bp, Rattus norvegicus
gactctttttataaacttaccagca

SEQ ID NO: 327393 - DNA, 25 bp, Rattus norvegicus
gactctttttattaacttaccagca

SEQ ID NO: 327394 - DNA, 25 bp, Rattus norvegicus
gactctttttggagagtgcagcctt

SEQ ID NO: 327395 - DNA, 25 bp, Rattus norvegicus
gactctttttggtgagtgcagcctt

SEQ ID NO: 327396 - DNA, 25 bp, Rattus norvegicus
gactcttttttcacattctgttcta

SEQ ID NO: 327397 - DNA, 25 bp, Rattus norvegicus
gactcttttttctcattctgttcta

SEQ ID NO: 327398 - DNA, 25 bp, Rattus norvegicus
gactgaaaagctccccaacttggga

SEQ ID NO: 327399 - DNA, 25 bp, Rattus norvegicus
gactgaaaagctgcccaacttggga

SEQ ID NO: 327400 - DNA, 25 bp, Rattus norvegicus
gactgaaacaaccaggcagcccaga

SEQ ID NO: 327401 - DNA, 25 bp, Rattus norvegicus
gactgaaacaacgaggcagcccaga

SEQ ID NO: 327402 - DNA, 25 bp, Rattus norvegicus
gactgaaactctagccgcaggcatc

SEQ ID NO: 327403 - DNA, 25 bp, Rattus norvegicus
gactgaaactcttgccgcaggcatc

SEQ ID NO: 327404 - DNA, 25 bp, Rattus norvegicus
gactgaaactggctcccctgaaaga

SEQ ID NO: 327405 - DNA, 25 bp, Rattus norvegicus
gactgaaactgggtcccctgaaaga

SEQ ID NO: 327406 - DNA, 25 bp, Rattus norvegicus
gactgaaactgtcttctctctctta

SEQ ID NO: 327407 - DNA, 25 bp, Rattus norvegicus
gactgaaactgtgttctctctctta

SEQ ID NO: 327408 - DNA, 25 bp, Rattus norvegicus
gactgaaacttcagtccacacttta

SEQ ID NO: 327409 - DNA, 25 bp, Rattus norvegicus
gactgaaacttctgtccacacttta

SEQ ID NO: 327410 - DNA, 25 bp, Rattus norvegicus
gactgaaacttgaatcactgcgaat

SEQ ID NO: 327411 - DNA, 25 bp, Rattus norvegicus
gactgaaacttgtatcactgcgaat

SEQ ID NO: 327412 - DNA, 25 bp, Rattus norvegicus
gactgaaagatcctggcagcccatt

SEQ ID NO: 327413 - DNA, 25 bp, Rattus norvegicus
gactgaaagatcgtggcagcccatt

SEQ ID NO: 327414 - DNA, 25 bp, Rattus norvegicus
gactgaaagtctctttctcaagaga

SEQ ID NO: 327415 - DNA, 25 bp, Rattus norvegicus
gactgaaagtctgtttctcaagaga

SEQ ID NO: 327416 - DNA, 25 bp, Rattus norvegicus
gactgaaagtgtaaactcctctctg

SEQ ID NO: 327417 - DNA, 25 bp, Rattus norvegicus
gactgaaagtgttaactcctctctg

SEQ ID NO: 327418 - DNA, 25 bp, Rattus norvegicus
gactgaaagttgagcaggtctcctt

SEQ ID NO: 327419 - DNA, 25 bp, Rattus norvegicus
gactgaaagttgtgcaggtctcctt

SEQ ID NO: 327420 - DNA, 25 bp, Rattus norvegicus
gactgaaatcttaactagagatcct

SEQ ID NO: 327421 - DNA, 25 bp, Rattus norvegicus
gactgaaatctttactagagatcct

SEQ ID NO: 327422 - DNA, 25 bp, Rattus norvegicus
gactgaaatgttcgtttctttcctt

SEQ ID NO: 327423 - DNA, 25 bp, Rattus norvegicus
gactgaaatgttggtttctttcctt

SEQ ID NO: 327424 - DNA, 25 bp, Rattus norvegicus
gactgaacactaaacctgtggcatg

SEQ ID NO: 327425 - DNA, 25 bp, Rattus norvegicus
gactgaacactatacctgtggcatg

SEQ ID NO: 327426 - DNA, 25 bp, Rattus norvegicus
gactgaacactgacactggtttacc

SEQ ID NO: 327427 - DNA, 25 bp, Rattus norvegicus
gactgaacactgtcactggtttacc

SEQ ID NO: 327428 - DNA, 25 bp, Rattus norvegicus
gactgaacatccaaaattcccgtgt

SEQ ID NO: 327429 - DNA, 25 bp, Rattus norvegicus
gactgaacatcctaaattcccgtgt

SEQ ID NO: 327430 - DNA, 25 bp, Rattus norvegicus
gactgaacatttctcacatggtact

SEQ ID NO: 327431 - DNA, 25 bp, Rattus norvegicus
gactgaacatttgtcacatggtact

SEQ ID NO: 327432 - DNA, 25 bp, Rattus norvegicus
gactgaaccctgaagccaagcttct

SEQ ID NO: 327433 - DNA, 25 bp, Rattus norvegicus
gactgaaccctgtagccaagcttct

SEQ ID NO: 327434 - DNA, 25 bp, Rattus norvegicus
gactgaacctatcaacctatgaaca

SEQ ID NO: 327435 - DNA, 25 bp, Rattus norvegicus
gactgaacctatgaacctatgaaca

SEQ ID NO: 327436 - DNA, 25 bp, Rattus norvegicus
gactgaacctcaatctgaactaaaa

SEQ ID NO: 327437 - DNA, 25 bp, Rattus norvegicus
gactgaacctcattctgaactaaaa

SEQ ID NO: 327438 - DNA, 25 bp, Rattus norvegicus
gactgaaccttgagtatttcttggg

SEQ ID NO: 327439 - DNA, 25 bp, Rattus norvegicus
gactgaaccttgtgtatttcttggg

SEQ ID NO: 327440 - DNA, 25 bp, Rattus norvegicus
gactgaacgtgcagaccaccagaca

SEQ ID NO: 327441 - DNA, 25 bp, Rattus norvegicus
gactgaacgtgctgaccaccagaca

SEQ ID NO: 327442 - DNA, 25 bp, Rattus norvegicus
gactgaactcagagatttttgaaaa

SEQ ID NO: 327443 - DNA, 25 bp, Rattus norvegicus
gactgaactcagtgatttttgaaaa

SEQ ID NO: 327444 - DNA, 25 bp, Rattus norvegicus
gactgaactgcgagtgccactgaaa

SEQ ID NO: 327445 - DNA, 25 bp, Rattus norvegicus
gactgaactgcgtgtgccactgaaa

SEQ ID NO: 327446 - DNA, 25 bp, Rattus norvegicus
gactgaactggactagactagcctt

SEQ ID NO: 327447 - DNA, 25 bp, Rattus norvegicus
gactgaactggagtagactagcctt

SEQ ID NO: 327448 - DNA, 25 bp, Rattus norvegicus
gactgaagacagagctttcctcgtg

SEQ ID NO: 327449 - DNA, 25 bp, Rattus norvegicus
gactgaagacagtgctttcctcgtg

SEQ ID NO: 327450 - DNA, 25 bp, Rattus norvegicus
gactgaagacgaccaggcaacctgg

SEQ ID NO: 327451 - DNA, 25 bp, Rattus norvegicus
gactgaagacgagcaggcaacctgg

SEQ ID NO: 327452 - DNA, 25 bp, Rattus norvegicus
gactgaagcactagcactgtgacat

SEQ ID NO: 327453 - DNA, 25 bp, Rattus norvegicus
gactgaagcacttgcactgtgacat

SEQ ID NO: 327454 - DNA, 25 bp, Rattus norvegicus
gactgaagcagtagacaatccccaa

SEQ ID NO: 327455 - DNA, 25 bp, Rattus norvegicus
gactgaagcagttgacaatccccaa

SEQ ID NO: 327456 - DNA, 25 bp, Rattus norvegicus
gactgaagccacagggcatccaaga

SEQ ID NO: 327457 - DNA, 25 bp, Rattus norvegicus
gactgaagccactgggcatccaaga

SEQ ID NO: 327458 - DNA, 25 bp, Rattus norvegicus
gactgaagcttccaaacgccttaaa

SEQ ID NO: 327459 - DNA, 25 bp, Rattus norvegicus
gactgaagcttcgaaacgccttaaa

SEQ ID NO: 327460 - DNA, 25 bp, Rattus norvegicus
gactgaaggccaatagagatgctca

SEQ ID NO: 327461 - DNA, 25 bp, Rattus norvegicus
gactgaaggccattagagatgctca

SEQ ID NO: 327462 - DNA, 25 bp, Rattus norvegicus
gactgaaggctgattcatcccaggg

SEQ ID NO: 327463 - DNA, 25 bp, Rattus norvegicus
gactgaaggctgtttcatcccaggg

SEQ ID NO: 327464 - DNA, 25 bp, Rattus norvegicus
gactgaagtacacccaagcgcatat

SEQ ID NO: 327465 - DNA, 25 bp, Rattus norvegicus
gactgaagtacagccaagcgcatat

SEQ ID NO: 327466 - DNA, 25 bp, Rattus norvegicus
gactgaagtgctcttaagacccctt

SEQ ID NO: 327467 - DNA, 25 bp, Rattus norvegicus
gactgaagtgctgttaagacccctt

SEQ ID NO: 327468 - DNA, 25 bp, Rattus norvegicus
gactgaagtgtaaaacctccatttg

SEQ ID NO: 327469 - DNA, 25 bp, Rattus norvegicus
gactgaagtgtataacctccatttg

SEQ ID NO: 327470 - DNA, 25 bp, Rattus norvegicus
gactgaagtgttactctgagattct

SEQ ID NO: 327471 - DNA, 25 bp, Rattus norvegicus
gactgaagtgtttctctgagattct

SEQ ID NO: 327472 - DNA, 25 bp, Rattus norvegicus
gactgaagttgtcctgccagactcc

SEQ ID NO: 327473 - DNA, 25 bp, Rattus norvegicus
gactgaagttgtgctgccagactcc

SEQ ID NO: 327474 - DNA, 25 bp, Rattus norvegicus
gactgaatcactctgcccattgatg

SEQ ID NO: 327475 - DNA, 25 bp, Rattus norvegicus
gactgaatcactgtgcccattgatg

SEQ ID NO: 327476 - DNA, 25 bp, Rattus norvegicus
gactgaatcatcaacatcaccggca

SEQ ID NO: 327477 - DNA, 25 bp, Rattus norvegicus
gactgaatcatctacatcaccggca

SEQ ID NO: 327478 - DNA, 25 bp, Rattus norvegicus
gactgaatcattaatgggctccttt

SEQ ID NO: 327479 - DNA, 25 bp, Rattus norvegicus
gactgaatcatttatgggctccttt

SEQ ID NO: 327480 - DNA, 25 bp, Rattus norvegicus
gactgaatccagaagccctcaaagg

SEQ ID NO: 327481 - DNA, 25 bp, Rattus norvegicus
gactgaatccagtagccctcaaagg

SEQ ID NO: 327482 - DNA, 25 bp, Rattus norvegicus
gactgaatgcaacattgacctatac

SEQ ID NO: 327483 - DNA, 25 bp, Rattus norvegicus
gactgaatgcaagattgacctatac

SEQ ID NO: 327484 - DNA, 25 bp, Rattus norvegicus
gactgaatgctcaccaagagcactg

SEQ ID NO: 327485 - DNA, 25 bp, Rattus norvegicus
gactgaatgctctccaagagcactg

SEQ ID NO: 327486 - DNA, 25 bp, Rattus norvegicus
gactgaatgggcaatatgatggatc

SEQ ID NO: 327487 - DNA, 25 bp, Rattus norvegicus
gactgaatgggctatatgatggatc

SEQ ID NO: 327488 - DNA, 25 bp, Rattus norvegicus
gactgaatggtcacacttctcttga

SEQ ID NO: 327489 - DNA, 25 bp, Rattus norvegicus
gactgaatggtctcacttctcttga

SEQ ID NO: 327490 - DNA, 25 bp, Rattus norvegicus
gactgaatggtgaccagcctggtgc

SEQ ID NO: 327491 - DNA, 25 bp, Rattus norvegicus
gactgaatggtgtccagcctggtgc

SEQ ID NO: 327492 - DNA, 25 bp, Rattus norvegicus
gactgaatgtctactcgctagggaa

SEQ ID NO: 327493 - DNA, 25 bp, Rattus norvegicus
gactgaatgtcttctcgctagggaa

SEQ ID NO: 327494 - DNA, 25 bp, Rattus norvegicus
gactgaattagcctagacgctcctt

SEQ ID NO: 327495 - DNA, 25 bp, Rattus norvegicus
gactgaattagcgtagacgctcctt

SEQ ID NO: 327496 - DNA, 25 bp, Rattus norvegicus
gactgaattcgtcggtcttggcttt

SEQ ID NO: 327497 - DNA, 25 bp, Rattus norvegicus
gactgaattcgtgggtcttggcttt

SEQ ID NO: 327498 - DNA, 25 bp, Rattus norvegicus
gactgaattggaagctttctctctt

SEQ ID NO: 327499 - DNA, 25 bp, Rattus norvegicus
gactgaattggatgctttctctctt

SEQ ID NO: 327500 - DNA, 25 bp, Rattus norvegicus
gactgaatttgtcttccctgtagct

SEQ ID NO: 327501 - DNA, 25 bp, Rattus norvegicus
gactgaatttgtgttccctgtagct

SEQ ID NO: 327502 - DNA, 25 bp, Rattus norvegicus
gactgaattttcactcacgggacta

SEQ ID NO: 327503 - DNA, 25 bp, Rattus norvegicus
gactgaattttctctcacgggacta

SEQ ID NO: 327504 - DNA, 25 bp, Rattus norvegicus
gactgacaaggccaacctttaagaa

SEQ ID NO: 327505 - DNA, 25 bp, Rattus norvegicus
gactgacaaggcgaacctttaagaa

SEQ ID NO: 327506 - DNA, 25 bp, Rattus norvegicus
gactgacaagtcagctcgaacagca

SEQ ID NO: 327507 - DNA, 25 bp, Rattus norvegicus
gactgacaagtctgctcgaacagca

SEQ ID NO: 327508 - DNA, 25 bp, Rattus norvegicus
gactgacaatcaagccaccacgggt

SEQ ID NO: 327509 - DNA, 25 bp, Rattus norvegicus
gactgacaatcatgccaccacgggt

SEQ ID NO: 327510 - DNA, 25 bp, Rattus norvegicus
gactgacactctcgattatagctat

SEQ ID NO: 327511 - DNA, 25 bp, Rattus norvegicus
gactgacactctggattatagctat

SEQ ID NO: 327512 - DNA, 25 bp, Rattus norvegicus
gactgacacttaaaccagatcttta

SEQ ID NO: 327513 - DNA, 25 bp, Rattus norvegicus
gactgacacttataccagatcttta

SEQ ID NO: 327514 - DNA, 25 bp, Rattus norvegicus
gactgacagaacacaccgttggttt

SEQ ID NO: 327515 - DNA, 25 bp, Rattus norvegicus
gactgacagaactcaccgttggttt

SEQ ID NO: 327516 - DNA, 25 bp, Rattus norvegicus
gactgacagaatcgagcattgccta

SEQ ID NO: 327517 - DNA, 25 bp, Rattus norvegicus
gactgacagaatggagcattgccta

SEQ ID NO: 327518 - DNA, 25 bp, Rattus norvegicus
gactgacagatcctaatgtagccaa

SEQ ID NO: 327519 - DNA, 25 bp, Rattus norvegicus
gactgacagatcgtaatgtagccaa

SEQ ID NO: 327520 - DNA, 25 bp, Rattus norvegicus
gactgacagccgattgccataattt

SEQ ID NO: 327521 - DNA, 25 bp, Rattus norvegicus
gactgacagccgtttgccataattt

SEQ ID NO: 327522 - DNA, 25 bp, Rattus norvegicus
gactgacaggccaagggtagtagct

SEQ ID NO: 327523 - DNA, 25 bp, Rattus norvegicus
gactgacaggcctagggtagtagct

SEQ ID NO: 327524 - DNA, 25 bp, Rattus norvegicus
gactgaccagaccagcattcacaat

SEQ ID NO: 327525 - DNA, 25 bp, Rattus norvegicus
gactgaccagacgagcattcacaat

SEQ ID NO: 327526 - DNA, 25 bp, Rattus norvegicus
gactgaccagctcagcaggcggcaa

SEQ ID NO: 327527 - DNA, 25 bp, Rattus norvegicus
gactgaccagctgagcaggcggcaa

SEQ ID NO: 327528 - DNA, 25 bp, Rattus norvegicus
gactgaccaggtaagcattatctta

SEQ ID NO: 327529 - DNA, 25 bp, Rattus norvegicus
gactgaccaggttagcattatctta

SEQ ID NO: 327530 - DNA, 25 bp, Rattus norvegicus
gactgaccatacacatgtccaggag

SEQ ID NO: 327531 - DNA, 25 bp, Rattus norvegicus
gactgaccatactcatgtccaggag

SEQ ID NO: 327532 - DNA, 25 bp, Rattus norvegicus
gactgaccatgtagcaaggctcaca

SEQ ID NO: 327533 - DNA, 25 bp, Rattus norvegicus
gactgaccatgttgcaaggctcaca

SEQ ID NO: 327534 - DNA, 25 bp, Rattus norvegicus
gactgacccagtcagagctgtgcct

SEQ ID NO: 327535 - DNA, 25 bp, Rattus norvegicus
gactgacccagtgagagctgtgcct

SEQ ID NO: 327536 - DNA, 25 bp, Rattus norvegicus
gactgacccctaaaggcatgtataa

SEQ ID NO: 327537 - DNA, 25 bp, Rattus norvegicus
gactgacccctataggcatgtataa

SEQ ID NO: 327538 - DNA, 25 bp, Rattus norvegicus
gactgacccgagcagccaaggtgtt

SEQ ID NO: 327539 - DNA, 25 bp, Rattus norvegicus
gactgacccgaggagccaaggtgtt

SEQ ID NO: 327540 - DNA, 25 bp, Rattus norvegicus
gactgacccggaagtggctggaaaa

SEQ ID NO: 327541 - DNA, 25 bp, Rattus norvegicus
gactgacccggatgtggctggaaaa

SEQ ID NO: 327542 - DNA, 25 bp, Rattus norvegicus
gactgaccctcgaaggtgtctatgc

SEQ ID NO: 327543 - DNA, 25 bp, Rattus norvegicus
gactgaccctcgtaggtgtctatgc

SEQ ID NO: 327544 - DNA, 25 bp, Rattus norvegicus
gactgaccgctacctcacggagaat

SEQ ID NO: 327545 - DNA, 25 bp, Rattus norvegicus
gactgaccgctagctcacggagaat

SEQ ID NO: 327546 - DNA, 25 bp, Rattus norvegicus
gactgaccgtaaacccatgtgtgga

SEQ ID NO: 327547 - DNA, 25 bp, Rattus norvegicus
gactgaccgtaatcccatgtgtgga

SEQ ID NO: 327548 - DNA, 25 bp, Rattus norvegicus
gactgacctcaaaaactcccagaga

SEQ ID NO: 327549 - DNA, 25 bp, Rattus norvegicus
gactgacctcaataactcccagaga

SEQ ID NO: 327550 - DNA, 25 bp, Rattus norvegicus
gactgacctcagataagtctgatct

SEQ ID NO: 327551 - DNA, 25 bp, Rattus norvegicus
gactgacctcagttaagtctgatct

SEQ ID NO: 327552 - DNA, 25 bp, Rattus norvegicus
gactgacctcatatgtttgttaacc

SEQ ID NO: 327553 - DNA, 25 bp, Rattus norvegicus
gactgacctcatttgtttgttaacc

SEQ ID NO: 327554 - DNA, 25 bp, Rattus norvegicus
gactgacctctgagtacattgtctc

SEQ ID NO: 327555 - DNA, 25 bp, Rattus norvegicus
gactgacctctgtgtacattgtctc

SEQ ID NO: 327556 - DNA, 25 bp, Rattus norvegicus
gactgacctggccaagctcttgata

SEQ ID NO: 327557 - DNA, 25 bp, Rattus norvegicus
gactgacctggcgaagctcttgata

SEQ ID NO: 327558 - DNA, 25 bp, Rattus norvegicus
gactgacctgtacagattctgctgc

SEQ ID NO: 327559 - DNA, 25 bp, Rattus norvegicus
gactgacctgtagagattctgctgc

SEQ ID NO: 327560 - DNA, 25 bp, Rattus norvegicus
gactgaccttggcatttactcggct

SEQ ID NO: 327561 - DNA, 25 bp, Rattus norvegicus
gactgaccttgggatttactcggct

SEQ ID NO: 327562 - DNA, 25 bp, Rattus norvegicus
gactgaccttgtacatggtagagca

SEQ ID NO: 327563 - DNA, 25 bp, Rattus norvegicus
gactgaccttgttcatggtagagca

SEQ ID NO: 327564 - DNA, 25 bp, Rattus norvegicus
gactgacctttgcatcttcattaat

SEQ ID NO: 327565 - DNA, 25 bp, Rattus norvegicus
gactgacctttggatcttcattaat

SEQ ID NO: 327566 - DNA, 25 bp, Rattus norvegicus
gactgacggtccagggttgtttaag

SEQ ID NO: 327567 - DNA, 25 bp, Rattus norvegicus
gactgacggtcctgggttgtttaag

SEQ ID NO: 327568 - DNA, 25 bp, Rattus norvegicus
gactgacgtaacatttctggtgctg

SEQ ID NO: 327569 - DNA, 25 bp, Rattus norvegicus
gactgacgtaacttttctggtgctg

SEQ ID NO: 327570 - DNA, 25 bp, Rattus norvegicus
gactgacgtactagccctaaagggc

SEQ ID NO: 327571 - DNA, 25 bp, Rattus norvegicus
gactgacgtacttgccctaaagggc

SEQ ID NO: 327572 - DNA, 25 bp, Rattus norvegicus
gactgacgtggcatgcgtatccaga

SEQ ID NO: 327573 - DNA, 25 bp, Rattus norvegicus
gactgacgtggcttgcgtatccaga

SEQ ID NO: 327574 - DNA, 25 bp, Rattus norvegicus
gactgacgtgtcataaactttgaaa

SEQ ID NO: 327575 - DNA, 25 bp, Rattus norvegicus
gactgacgtgtcttaaactttgaaa

SEQ ID NO: 327576 - DNA, 25 bp, Rattus norvegicus
gactgactaactaatcagctggtaa

SEQ ID NO: 327577 - DNA, 25 bp, Rattus norvegicus
gactgactaactctgtctcgtacat

SEQ ID NO: 327578 - DNA, 25 bp, Rattus norvegicus
gactgactaactgtgtctcgtacat

SEQ ID NO: 327579 - DNA, 25 bp, Rattus norvegicus
gactgactaacttatcagctggtaa

SEQ ID NO: 327580 - DNA, 25 bp, Rattus norvegicus
gactgactagtcatttgtgaatttt

SEQ ID NO: 327581 - DNA, 25 bp, Rattus norvegicus
gactgactagtcttttgtgaatttt

SEQ ID NO: 327582 - DNA, 25 bp, Rattus norvegicus
gactgactcagcctcaggctggaca

SEQ ID NO: 327583 - DNA, 25 bp, Rattus norvegicus
gactgactcagcgtcaggctggaca

SEQ ID NO: 327584 - DNA, 25 bp, Rattus norvegicus
gactgactccaacacagacttgtga

SEQ ID NO: 327585 - DNA, 25 bp, Rattus norvegicus
gactgactccaagacagacttgtga

SEQ ID NO: 327586 - DNA, 25 bp, Rattus norvegicus
gactgactctgaaggacatcgggct

SEQ ID NO: 327587 - DNA, 25 bp, Rattus norvegicus
gactgactctgatggacatcgggct

SEQ ID NO: 327588 - DNA, 25 bp, Rattus norvegicus
gactgactcttcacaggaataaggt

SEQ ID NO: 327589 - DNA, 25 bp, Rattus norvegicus
gactgactcttctcaggaataaggt

SEQ ID NO: 327590 - DNA, 25 bp, Rattus norvegicus
gactgactgattccagatgtccgga

SEQ ID NO: 327591 - DNA, 25 bp, Rattus norvegicus
gactgactgattgcagatgtccgga

SEQ ID NO: 327592 - DNA, 25 bp, Rattus norvegicus
gactgactggtactcctgggatata

SEQ ID NO: 327593 - DNA, 25 bp, Rattus norvegicus
gactgactggtagtcctgggatata

SEQ ID NO: 327594 - DNA, 25 bp, Rattus norvegicus
gactgacttaaaattgctgtgccta

SEQ ID NO: 327595 - DNA, 25 bp, Rattus norvegicus
gactgacttaaatttgctgtgccta

SEQ ID NO: 327596 - DNA, 25 bp, Rattus norvegicus
gactgacttagtaccttactggtga

SEQ ID NO: 327597 - DNA, 25 bp, Rattus norvegicus
gactgacttagttccttactggtga

SEQ ID NO: 327598 - DNA, 25 bp, Rattus norvegicus
gactgacttcctactgtagacttga

SEQ ID NO: 327599 - DNA, 25 bp, Rattus norvegicus
gactgacttccttctgtagacttga

SEQ ID NO: 327600 - DNA, 25 bp, Rattus norvegicus
gactgacttctaaatttgctctctt

SEQ ID NO: 327601 - DNA, 25 bp, Rattus norvegicus
gactgacttctatatttgctctctt

SEQ ID NO: 327602 - DNA, 25 bp, Rattus norvegicus
gactgacttgctatgtgggattaca

SEQ ID NO: 327603 - DNA, 25 bp, Rattus norvegicus
gactgacttgctttgtgggattaca

SEQ ID NO: 327604 - DNA, 25 bp, Rattus norvegicus
gactgacttggcaaagctgcttcct

SEQ ID NO: 327605 - DNA, 25 bp, Rattus norvegicus
gactgacttggctaagctgcttcct

SEQ ID NO: 327606 - DNA, 25 bp, Rattus norvegicus
gactgacttgttcatttctactttg

SEQ ID NO: 327607 - DNA, 25 bp, Rattus norvegicus
gactgacttgttgatttctactttg

SEQ ID NO: 327608 - DNA, 25 bp, Rattus norvegicus
gactgactttatctcctacagggag

SEQ ID NO: 327609 - DNA, 25 bp, Rattus norvegicus
gactgactttatgtcctacagggag

SEQ ID NO: 327610 - DNA, 25 bp, Rattus norvegicus
gactgactttttaggctgacttaaa

SEQ ID NO: 327611 - DNA, 25 bp, Rattus norvegicus
gactgacttttttggctgacttaaa

SEQ ID NO: 327612 - DNA, 25 bp, Rattus norvegicus
gactgagaaacaagggtctttccca

SEQ ID NO: 327613 - DNA, 25 bp, Rattus norvegicus
gactgagaaacatgggtctttccca

SEQ ID NO: 327614 - DNA, 25 bp, Rattus norvegicus
gactgagaacaacactgctttggtt

SEQ ID NO: 327615 - DNA, 25 bp, Rattus norvegicus
gactgagaacaagactgctttggtt

SEQ ID NO: 327616 - DNA, 25 bp, Rattus norvegicus
gactgagacaggattccctggccca

SEQ ID NO: 327617 - DNA, 25 bp, Rattus norvegicus
gactgagacaggtttccctggccca

SEQ ID NO: 327618 - DNA, 25 bp, Rattus norvegicus
gactgagacagtcgacacgccgcct

SEQ ID NO: 327619 - DNA, 25 bp, Rattus norvegicus
gactgagacagtggacacgccgcct

SEQ ID NO: 327620 - DNA, 25 bp, Rattus norvegicus
gactgagaccagatgctaggagaaa

SEQ ID NO: 327621 - DNA, 25 bp, Rattus norvegicus
gactgagaccagttgctaggagaaa

SEQ ID NO: 327622 - DNA, 25 bp, Rattus norvegicus
gactgagacgacagctagccttgtg

SEQ ID NO: 327623 - DNA, 25 bp, Rattus norvegicus
gactgagacgactgctagccttgtg

SEQ ID NO: 327624 - DNA, 25 bp, Rattus norvegicus
gactgagacgccacgggacatggaa

SEQ ID NO: 327625 - DNA, 25 bp, Rattus norvegicus
gactgagacgcctcgggacatggaa

SEQ ID NO: 327626 - DNA, 25 bp, Rattus norvegicus
gactgagactcacggttttcaaaac

SEQ ID NO: 327627 - DNA, 25 bp, Rattus norvegicus
gactgagactcagggttttcaaaac

SEQ ID NO: 327628 - DNA, 25 bp, Rattus norvegicus
gactgagagaggaccttgtttccct

SEQ ID NO: 327629 - DNA, 25 bp, Rattus norvegicus
gactgagagaggtccttgtttccct

SEQ ID NO: 327630 - DNA, 25 bp, Rattus norvegicus
gactgagagatgctcttgctttcta

SEQ ID NO: 327631 - DNA, 25 bp, Rattus norvegicus
gactgagagatggtcttgctttcta

SEQ ID NO: 327632 - DNA, 25 bp, Rattus norvegicus
gactgagagcacaacttggtgtttt

SEQ ID NO: 327633 - DNA, 25 bp, Rattus norvegicus
gactgagagcactacttggtgtttt

SEQ ID NO: 327634 - DNA, 25 bp, Rattus norvegicus
gactgagaggcgctggcccctcctt

SEQ ID NO: 327635 - DNA, 25 bp, Rattus norvegicus
gactgagaggcggtggcccctcctt

SEQ ID NO: 327636 - DNA, 25 bp, Rattus norvegicus
gactgagaggctccagcccctctac

SEQ ID NO: 327637 - DNA, 25 bp, Rattus norvegicus
gactgagaggctgcagcccctctac

SEQ ID NO: 327638 - DNA, 25 bp, Rattus norvegicus
gactgagagggacaagccatcttga

SEQ ID NO: 327639 - DNA, 25 bp, Rattus norvegicus
gactgagagggagaagccatcttga

SEQ ID NO: 327640 - DNA, 25 bp, Rattus norvegicus
gactgagagtctcaagagcagccca

SEQ ID NO: 327641 - DNA, 25 bp, Rattus norvegicus
gactgagagtctgaagagcagccca

SEQ ID NO: 327642 - DNA, 25 bp, Rattus norvegicus
gactgagatacaataggccctacct

SEQ ID NO: 327643 - DNA, 25 bp, Rattus norvegicus
gactgagatacattaggccctacct

SEQ ID NO: 327644 - DNA, 25 bp, Rattus norvegicus
gactgagatcacaaatggtccttca

SEQ ID NO: 327645 - DNA, 25 bp, Rattus norvegicus
gactgagatcactaatggtccttca

SEQ ID NO: 327646 - DNA, 25 bp, Rattus norvegicus
gactgagatcatctctttgccttct

SEQ ID NO: 327647 - DNA, 25 bp, Rattus norvegicus
gactgagatcatgtctttgccttct

SEQ ID NO: 327648 - DNA, 25 bp, Rattus norvegicus
gactgagatctacaagttgacccgt

SEQ ID NO: 327649 - DNA, 25 bp, Rattus norvegicus
gactgagatctagaagttgacccgt

SEQ ID NO: 327650 - DNA, 25 bp, Rattus norvegicus
gactgagatctcacaccatggatgc

SEQ ID NO: 327651 - DNA, 25 bp, Rattus norvegicus
gactgagatctctcaccatggatgc

SEQ ID NO: 327652 - DNA, 25 bp, Rattus norvegicus
gactgagatggaatggcccttccct

SEQ ID NO: 327653 - DNA, 25 bp, Rattus norvegicus
gactgagatggattggcccttccct

SEQ ID NO: 327654 - DNA, 25 bp, Rattus norvegicus
gactgagatggtatgtctaccctga

SEQ ID NO: 327655 - DNA, 25 bp, Rattus norvegicus
gactgagatggtttgtctaccctga

SEQ ID NO: 327656 - DNA, 25 bp, Rattus norvegicus
gactgagcactaccgagaccgggaa

SEQ ID NO: 327657 - DNA, 25 bp, Rattus norvegicus
gactgagcactagcgagaccgggaa

SEQ ID NO: 327658 - DNA, 25 bp, Rattus norvegicus
gactgagcagagcatgtttgaagaa

SEQ ID NO: 327659 - DNA, 25 bp, Rattus norvegicus
gactgagcagaggatgtttgaagaa

SEQ ID NO: 327660 - DNA, 25 bp, Rattus norvegicus
gactgagcagatccgaggctttccc

SEQ ID NO: 327661 - DNA, 25 bp, Rattus norvegicus
gactgagcagatgcgaggctttccc

SEQ ID NO: 327662 - DNA, 25 bp, Rattus norvegicus
gactgagcagctactcggagatctt

SEQ ID NO: 327663 - DNA, 25 bp, Rattus norvegicus
gactgagcagcttctcggagatctt

SEQ ID NO: 327664 - DNA, 25 bp, Rattus norvegicus
gactgagcaggaatccccagtccag

SEQ ID NO: 327665 - DNA, 25 bp, Rattus norvegicus
gactgagcaggattccccagtccag

SEQ ID NO: 327666 - DNA, 25 bp, Rattus norvegicus
gactgagcagggaacacttgttcta

SEQ ID NO: 327667 - DNA, 25 bp, Rattus norvegicus
gactgagcagggatgaccttctgtt

SEQ ID NO: 327668 - DNA, 25 bp, Rattus norvegicus
gactgagcagggtacacttgttcta

SEQ ID NO: 327669 - DNA, 25 bp, Rattus norvegicus
gactgagcagggttgaccttctgtt

SEQ ID NO: 327670 - DNA, 25 bp, Rattus norvegicus
gactgagcatcacaacactttccat

SEQ ID NO: 327671 - DNA, 25 bp, Rattus norvegicus
gactgagcatcagaacactttccat

SEQ ID NO: 327672 - DNA, 25 bp, Rattus norvegicus
gactgagcatgaatgaccgtggacg

SEQ ID NO: 327673 - DNA, 25 bp, Rattus norvegicus
gactgagcatgattgaccgtggacg

SEQ ID NO: 327674 - DNA, 25 bp, Rattus norvegicus
gactgagccagaacacagaacgtct

SEQ ID NO: 327675 - DNA, 25 bp, Rattus norvegicus
gactgagccagactctattccagcc

SEQ ID NO: 327676 - DNA, 25 bp, Rattus norvegicus
gactgagccagagtctattccagcc

SEQ ID NO: 327677 - DNA, 25 bp, Rattus norvegicus
gactgagccagatcacagaacgtct

SEQ ID NO: 327678 - DNA, 25 bp, Rattus norvegicus
gactgagccagtctctgctagatac

SEQ ID NO: 327679 - DNA, 25 bp, Rattus norvegicus
gactgagccagtgtctgctagatac

SEQ ID NO: 327680 - DNA, 25 bp, Rattus norvegicus
gactgagccatgacaagacagcata

SEQ ID NO: 327681 - DNA, 25 bp, Rattus norvegicus
gactgagccatgtcaagacagcata

SEQ ID NO: 327682 - DNA, 25 bp, Rattus norvegicus
gactgagcccatcaagaagatgttc

SEQ ID NO: 327683 - DNA, 25 bp, Rattus norvegicus
gactgagcccatcactttgggtaat

SEQ ID NO: 327684 - DNA, 25 bp, Rattus norvegicus
gactgagcccatgaagaagatgttc

SEQ ID NO: 327685 - DNA, 25 bp, Rattus norvegicus
gactgagcccatgactttgggtaat

SEQ ID NO: 327686 - DNA, 25 bp, Rattus norvegicus
gactgagcgagtaccgagccacaga

SEQ ID NO: 327687 - DNA, 25 bp, Rattus norvegicus
gactgagcgagttccgagccacaga

SEQ ID NO: 327688 - DNA, 25 bp, Rattus norvegicus
gactgagctaatctgttctttctga

SEQ ID NO: 327689 - DNA, 25 bp, Rattus norvegicus
gactgagctaatgtgttctttctga

SEQ ID NO: 327690 - DNA, 25 bp, Rattus norvegicus
gactgagctacacagctgtgcctct

SEQ ID NO: 327691 - DNA, 25 bp, Rattus norvegicus
gactgagctacagagctgtgcctct

SEQ ID NO: 327692 - DNA, 25 bp, Rattus norvegicus
gactgagctgaacctaggctccctt

SEQ ID NO: 327693 - DNA, 25 bp, Rattus norvegicus
gactgagctgaagctaggctccctt

SEQ ID NO: 327694 - DNA, 25 bp, Rattus norvegicus
gactgagctgagctgtttggccctc

SEQ ID NO: 327695 - DNA, 25 bp, Rattus norvegicus
gactgagctgaggtgtttggccctc

SEQ ID NO: 327696 - DNA, 25 bp, Rattus norvegicus
gactgagctggcaacttattcttga

SEQ ID NO: 327697 - DNA, 25 bp, Rattus norvegicus
gactgagctggctacttattcttga

SEQ ID NO: 327698 - DNA, 25 bp, Rattus norvegicus
gactgagctgggactttgaagcaca

SEQ ID NO: 327699 - DNA, 25 bp, Rattus norvegicus
gactgagctgggtctttgaagcaca

SEQ ID NO: 327700 - DNA, 25 bp, Rattus norvegicus
gactgagcttctatctagactggct

SEQ ID NO: 327701 - DNA, 25 bp, Rattus norvegicus
gactgagcttctttctagactggct

SEQ ID NO: 327702 - DNA, 25 bp, Rattus norvegicus
gactgaggacacattcattgccgac

SEQ ID NO: 327703 - DNA, 25 bp, Rattus norvegicus
gactgaggacactttcattgccgac

SEQ ID NO: 327704 - DNA, 25 bp, Rattus norvegicus
gactgaggacctatgttatacttaa

SEQ ID NO: 327705 - DNA, 25 bp, Rattus norvegicus
gactgaggacctttgttatacttaa

SEQ ID NO: 327706 - DNA, 25 bp, Rattus norvegicus
gactgaggacttcttggccactttc

SEQ ID NO: 327707 - DNA, 25 bp, Rattus norvegicus
gactgaggacttgttggccactttc

SEQ ID NO: 327708 - DNA, 25 bp, Rattus norvegicus
gactgaggatcaattgcttgttaat

SEQ ID NO: 327709 - DNA, 25 bp, Rattus norvegicus
gactgaggatcatttgcttgttaat

SEQ ID NO: 327710 - DNA, 25 bp, Rattus norvegicus
gactgaggattgattgtagggaacc

SEQ ID NO: 327711 - DNA, 25 bp, Rattus norvegicus
gactgaggattgtttgtagggaacc

SEQ ID NO: 327712 - DNA, 25 bp, Rattus norvegicus
gactgaggcctccaaactgggaata

SEQ ID NO: 327713 - DNA, 25 bp, Rattus norvegicus
gactgaggcctcgaaactgggaata

SEQ ID NO: 327714 - DNA, 25 bp, Rattus norvegicus
gactgaggcctgagacttgtgccca

SEQ ID NO: 327715 - DNA, 25 bp, Rattus norvegicus
gactgaggcctgtgacttgtgccca

SEQ ID NO: 327716 - DNA, 25 bp, Rattus norvegicus
gactgaggcgtcacctgctggaaga

SEQ ID NO: 327717 - DNA, 25 bp, Rattus norvegicus
gactgaggcgtctcctgctggaaga

SEQ ID NO: 327718 - DNA, 25 bp, Rattus norvegicus
gactgaggctcaagacctcttctgt

SEQ ID NO: 327719 - DNA, 25 bp, Rattus norvegicus
gactgaggctcatgacctcttctgt

SEQ ID NO: 327720 - DNA, 25 bp, Rattus norvegicus
gactgaggctgccatgttcgactcc

SEQ ID NO: 327721 - DNA, 25 bp, Rattus norvegicus
gactgaggctgcgatgttcgactcc

SEQ ID NO: 327722 - DNA, 25 bp, Rattus norvegicus
gactgagggaccatggttctcccac

SEQ ID NO: 327723 - DNA, 25 bp, Rattus norvegicus
gactgagggaccttggttctcccac

SEQ ID NO: 327724 - DNA, 25 bp, Rattus norvegicus
gactgagggcacctgtgtccacctg

SEQ ID NO: 327725 - DNA, 25 bp, Rattus norvegicus
gactgagggcacgtgtgtccacctg

SEQ ID NO: 327726 - DNA, 25 bp, Rattus norvegicus
gactgagggtacctgactctaacct

SEQ ID NO: 327727 - DNA, 25 bp, Rattus norvegicus
gactgagggtacgtgactctaacct

SEQ ID NO: 327728 - DNA, 25 bp, Rattus norvegicus
gactgagggtgcatgtttctcatcc

SEQ ID NO: 327729 - DNA, 25 bp, Rattus norvegicus
gactgagggtgcttgtttctcatcc

SEQ ID NO: 327730 - DNA, 25 bp, Rattus norvegicus
gactgaggtcccacccagaattttt

SEQ ID NO: 327731 - DNA, 25 bp, Rattus norvegicus
gactgaggtccctcccagaattttt

SEQ ID NO: 327732 - DNA, 25 bp, Rattus norvegicus
gactgaggtgctaggctttgcactg

SEQ ID NO: 327733 - DNA, 25 bp, Rattus norvegicus
gactgaggtgcttggctttgcactg

SEQ ID NO: 327734 - DNA, 25 bp, Rattus norvegicus
gactgagtagccaagagccaccttt

SEQ ID NO: 327735 - DNA, 25 bp, Rattus norvegicus
gactgagtagcctagagccaccttt

SEQ ID NO: 327736 - DNA, 25 bp, Rattus norvegicus
gactgagtatgtagcccttagacca

SEQ ID NO: 327737 - DNA, 25 bp, Rattus norvegicus
gactgagtatgttgcccttagacca

SEQ ID NO: 327738 - DNA, 25 bp, Rattus norvegicus
gactgagtcacccaagcctgatgct

SEQ ID NO: 327739 - DNA, 25 bp, Rattus norvegicus
gactgagtcaccgaagcctgatgct

SEQ ID NO: 327740 - DNA, 25 bp, Rattus norvegicus
gactgagtccaccttggccagagat

SEQ ID NO: 327741 - DNA, 25 bp, Rattus norvegicus
gactgagtccacgttggccagagat

SEQ ID NO: 327742 - DNA, 25 bp, Rattus norvegicus
gactgagtccagatgtgatttttaa

SEQ ID NO: 327743 - DNA, 25 bp, Rattus norvegicus
gactgagtccagttgtgatttttaa

SEQ ID NO: 327744 - DNA, 25 bp, Rattus norvegicus
gactgagtcctgaatgggctaggca

SEQ ID NO: 327745 - DNA, 25 bp, Rattus norvegicus
gactgagtcctgtatgggctaggca

SEQ ID NO: 327746 - DNA, 25 bp, Rattus norvegicus
gactgagtcgaactggacgccgaac

SEQ ID NO: 327747 - DNA, 25 bp, Rattus norvegicus
gactgagtcgaagtggacgccgaac

SEQ ID NO: 327748 - DNA, 25 bp, Rattus norvegicus
gactgagtctgacgagtcacctcat

SEQ ID NO: 327749 - DNA, 25 bp, Rattus norvegicus
gactgagtctgaggagtcacctcat

SEQ ID NO: 327750 - DNA, 25 bp, Rattus norvegicus
gactgagtctgcagcctggttctag

SEQ ID NO: 327751 - DNA, 25 bp, Rattus norvegicus
gactgagtctgctgcctggttctag

SEQ ID NO: 327752 - DNA, 25 bp, Rattus norvegicus
gactgagtgaacatgggatcgtaca

SEQ ID NO: 327753 - DNA, 25 bp, Rattus norvegicus
gactgagtgaacttgggatcgtaca

SEQ ID NO: 327754 - DNA, 25 bp, Rattus norvegicus
gactgagtgagtcgctcctaggcct

SEQ ID NO: 327755 - DNA, 25 bp, Rattus norvegicus
gactgagtgagtggctcctaggcct

SEQ ID NO: 327756 - DNA, 25 bp, Rattus norvegicus
gactgagttacgcaatttctcggca

SEQ ID NO: 327757 - DNA, 25 bp, Rattus norvegicus
gactgagttacggaatttctcggca

SEQ ID NO: 327758 - DNA, 25 bp, Rattus norvegicus
gactgagttctcatcacctagcaac

SEQ ID NO: 327759 - DNA, 25 bp, Rattus norvegicus
gactgagttctcttcacctagcaac

SEQ ID NO: 327760 - DNA, 25 bp, Rattus norvegicus
gactgagttcttctcgagagctcca

SEQ ID NO: 327761 - DNA, 25 bp, Rattus norvegicus
gactgagttcttgtcgagagctcca

SEQ ID NO: 327762 - DNA, 25 bp, Rattus norvegicus
gactgatacagaagacctgtgtcaa

SEQ ID NO: 327763 - DNA, 25 bp, Rattus norvegicus
gactgatacagatgacctgtgtcaa

SEQ ID NO: 327764 - DNA, 25 bp, Rattus norvegicus
gactgataccggctcagcggctgct

SEQ ID NO: 327765 - DNA, 25 bp, Rattus norvegicus
gactgataccgggtcagcggctgct

SEQ ID NO: 327766 - DNA, 25 bp, Rattus norvegicus
gactgataccttatgtgttctttgg

SEQ ID NO: 327767 - DNA, 25 bp, Rattus norvegicus
gactgataccttttgtgttctttgg

SEQ ID NO: 327768 - DNA, 25 bp, Rattus norvegicus
gactgatagcttcaggctccagcac

SEQ ID NO: 327769 - DNA, 25 bp, Rattus norvegicus
gactgatagcttgaggctccagcac

SEQ ID NO: 327770 - DNA, 25 bp, Rattus norvegicus
gactgataggcaagcaatcccaacg

SEQ ID NO: 327771 - DNA, 25 bp, Rattus norvegicus
gactgataggcatgcaatcccaacg

SEQ ID NO: 327772 - DNA, 25 bp, Rattus norvegicus
gactgatatcgactttggacaccca

SEQ ID NO: 327773 - DNA, 25 bp, Rattus norvegicus
gactgatatcgagtttggacaccca

SEQ ID NO: 327774 - DNA, 25 bp, Rattus norvegicus
gactgatatgacctcaggttcccac

SEQ ID NO: 327775 - DNA, 25 bp, Rattus norvegicus
gactgatatgacgtcaggttcccac

SEQ ID NO: 327776 - DNA, 25 bp, Rattus norvegicus
gactgatcaagaactggctcagcct

SEQ ID NO: 327777 - DNA, 25 bp, Rattus norvegicus
gactgatcaagatctggctcagcct

SEQ ID NO: 327778 - DNA, 25 bp, Rattus norvegicus
gactgatcagtgaggtggcccgtta

SEQ ID NO: 327779 - DNA, 25 bp, Rattus norvegicus
gactgatcagtgtggtggcccgtta

SEQ ID NO: 327780 - DNA, 25 bp, Rattus norvegicus
gactgatcattcactgcacatgcgg

SEQ ID NO: 327781 - DNA, 25 bp, Rattus norvegicus
gactgatcattctctgcacatgcgg

SEQ ID NO: 327782 - DNA, 25 bp, Rattus norvegicus
gactgatccctgaggcatgtgcatg

SEQ ID NO: 327783 - DNA, 25 bp, Rattus norvegicus
gactgatccctgtggcatgtgcatg

SEQ ID NO: 327784 - DNA, 25 bp, Rattus norvegicus
gactgatcctgacctgtgaactctg

SEQ ID NO: 327785 - DNA, 25 bp, Rattus norvegicus
gactgatcctgagctgtgaactctg

SEQ ID NO: 327786 - DNA, 25 bp, Rattus norvegicus
gactgatcctttctctttcacatat

SEQ ID NO: 327787 - DNA, 25 bp, Rattus norvegicus
gactgatcctttgtctttcacatat

SEQ ID NO: 327788 - DNA, 25 bp, Rattus norvegicus
gactgatcggctacatcaagctgca

SEQ ID NO: 327789 - DNA, 25 bp, Rattus norvegicus
gactgatcggcttcatcaagctgca

SEQ ID NO: 327790 - DNA, 25 bp, Rattus norvegicus
gactgatctctgatgtgtattttcc

SEQ ID NO: 327791 - DNA, 25 bp, Rattus norvegicus
gactgatctctgttgtgtattttcc

SEQ ID NO: 327792 - DNA, 25 bp, Rattus norvegicus
gactgatctgctatttaaacttctg

SEQ ID NO: 327793 - DNA, 25 bp, Rattus norvegicus
gactgatctgctttttaaacttctg

SEQ ID NO: 327794 - DNA, 25 bp, Rattus norvegicus
gactgatcttgcctggtgcagttct

SEQ ID NO: 327795 - DNA, 25 bp, Rattus norvegicus
gactgatcttgcgtggtgcagttct

SEQ ID NO: 327796 - DNA, 25 bp, Rattus norvegicus
gactgatgacagagcgctgctgatg

SEQ ID NO: 327797 - DNA, 25 bp, Rattus norvegicus
gactgatgacagtgcgctgctgatg

SEQ ID NO: 327798 - DNA, 25 bp, Rattus norvegicus
gactgatgacttcttcatgttccgt

SEQ ID NO: 327799 - DNA, 25 bp, Rattus norvegicus
gactgatgacttgttcatgttccgt

SEQ ID NO: 327800 - DNA, 25 bp, Rattus norvegicus
gactgatgagtgacaagtgttattg

SEQ ID NO: 327801 - DNA, 25 bp, Rattus norvegicus
gactgatgagtgtcaagtgttattg

SEQ ID NO: 327802 - DNA, 25 bp, Rattus norvegicus
gactgatgatgtctgcatttctata

SEQ ID NO: 327803 - DNA, 25 bp, Rattus norvegicus
gactgatgatgtgtgcatttctata

SEQ ID NO: 327804 - DNA, 25 bp, Rattus norvegicus
gactgatgatttccaccgggtaccc

SEQ ID NO: 327805 - DNA, 25 bp, Rattus norvegicus
gactgatgatttctatgtgttcggc

SEQ ID NO: 327806 - DNA, 25 bp, Rattus norvegicus
gactgatgatttgcaccgggtaccc

SEQ ID NO: 327807 - DNA, 25 bp, Rattus norvegicus
gactgatgatttgtatgtgttcggc

SEQ ID NO: 327808 - DNA, 25 bp, Rattus norvegicus
gactgatgcagcaaactgagctctt

SEQ ID NO: 327809 - DNA, 25 bp, Rattus norvegicus
gactgatgcagctaactgagctctt

SEQ ID NO: 327810 - DNA, 25 bp, Rattus norvegicus
gactgatgcattcagaacccagaca

SEQ ID NO: 327811 - DNA, 25 bp, Rattus norvegicus
gactgatgcattgagaacccagaca

SEQ ID NO: 327812 - DNA, 25 bp, Rattus norvegicus
gactgatgccatcgtgtagctgttc

SEQ ID NO: 327813 - DNA, 25 bp, Rattus norvegicus
gactgatgccatggtgtagctgttc

SEQ ID NO: 327814 - DNA, 25 bp, Rattus norvegicus
gactgatgctgtcacatgccttgga

SEQ ID NO: 327815 - DNA, 25 bp, Rattus norvegicus
gactgatgctgtgacatgccttgga

SEQ ID NO: 327816 - DNA, 25 bp, Rattus norvegicus
gactgatggcacagggctacgaccc

SEQ ID NO: 327817 - DNA, 25 bp, Rattus norvegicus
gactgatggcactgggctacgaccc

SEQ ID NO: 327818 - DNA, 25 bp, Rattus norvegicus
gactgatggcgaatacggctctgta

SEQ ID NO: 327819 - DNA, 25 bp, Rattus norvegicus
gactgatggcgattacggctctgta

SEQ ID NO: 327820 - DNA, 25 bp, Rattus norvegicus
gactgatggctgatgactgagaaga

SEQ ID NO: 327821 - DNA, 25 bp, Rattus norvegicus
gactgatggctgttgactgagaaga

SEQ ID NO: 327822 - DNA, 25 bp, Rattus norvegicus
gactgatgggttcttcctaaaataa

SEQ ID NO: 327823 - DNA, 25 bp, Rattus norvegicus
gactgatgggttgttcctaaaataa

SEQ ID NO: 327824 - DNA, 25 bp, Rattus norvegicus
gactgatgtcccctgggttttgaat

SEQ ID NO: 327825 - DNA, 25 bp, Rattus norvegicus
gactgatgtcccgtgggttttgaat

SEQ ID NO: 327826 - DNA, 25 bp, Rattus norvegicus
gactgatgtctccttccagtggtta

SEQ ID NO: 327827 - DNA, 25 bp, Rattus norvegicus
gactgatgtctcgttccagtggtta

SEQ ID NO: 327828 - DNA, 25 bp, Rattus norvegicus
gactgatgtggaaaatgtcacctcc

SEQ ID NO: 327829 - DNA, 25 bp, Rattus norvegicus
gactgatgtggataatgtcacctcc

SEQ ID NO: 327830 - DNA, 25 bp, Rattus norvegicus
gactgatgtgtacccaactgtgttc

SEQ ID NO: 327831 - DNA, 25 bp, Rattus norvegicus
gactgatgtgtagccaactgtgttc

SEQ ID NO: 327832 - DNA, 25 bp, Rattus norvegicus
gactgatgttgtatggtttatgtta

SEQ ID NO: 327833 - DNA, 25 bp, Rattus norvegicus
gactgatgttgtttggtttatgtta

SEQ ID NO: 327834 - DNA, 25 bp, Rattus norvegicus
gactgattaatcctgcctgatctgg

SEQ ID NO: 327835 - DNA, 25 bp, Rattus norvegicus
gactgattaatcgtgcctgatctgg

SEQ ID NO: 327836 - DNA, 25 bp, Rattus norvegicus
gactgattagaactggaccatgctc

SEQ ID NO: 327837 - DNA, 25 bp, Rattus norvegicus
gactgattagaagtggaccatgctc

SEQ ID NO: 327838 - DNA, 25 bp, Rattus norvegicus
gactgattcagcatgtttctatgtg

SEQ ID NO: 327839 - DNA, 25 bp, Rattus norvegicus
gactgattcagcttgtttctatgtg

SEQ ID NO: 327840 - DNA, 25 bp, Rattus norvegicus
gactgattcagtactttccagcttt

SEQ ID NO: 327841 - DNA, 25 bp, Rattus norvegicus
gactgattcagttctttccagcttt

SEQ ID NO: 327842 - DNA, 25 bp, Rattus norvegicus
gactgattctcaccagcgtttctga

SEQ ID NO: 327843 - DNA, 25 bp, Rattus norvegicus
gactgattctcagcagcgtttctga

SEQ ID NO: 327844 - DNA, 25 bp, Rattus norvegicus
gactgattgagtctggccttcctga

SEQ ID NO: 327845 - DNA, 25 bp, Rattus norvegicus
gactgattgagtgtggccttcctga

SEQ ID NO: 327846 - DNA, 25 bp, Rattus norvegicus
gactgattgcttatacacgtgtgca

SEQ ID NO: 327847 - DNA, 25 bp, Rattus norvegicus
gactgattgcttattcatgtggaag

SEQ ID NO: 327848 - DNA, 25 bp, Rattus norvegicus
gactgattgcttttacacgtgtgca

SEQ ID NO: 327849 - DNA, 25 bp, Rattus norvegicus
gactgattgctttttcatgtggaag

SEQ ID NO: 327850 - DNA, 25 bp, Rattus norvegicus
gactgattggtgacttcacccatga

SEQ ID NO: 327851 - DNA, 25 bp, Rattus norvegicus
gactgattggtgtcttcacccatga

SEQ ID NO: 327852 - DNA, 25 bp, Rattus norvegicus
gactgattggttctaaagacatttc

SEQ ID NO: 327853 - DNA, 25 bp, Rattus norvegicus
gactgattggttgtaaagacatttc

SEQ ID NO: 327854 - DNA, 25 bp, Rattus norvegicus
gactgattgtccaagatgcactact

SEQ ID NO: 327855 - DNA, 25 bp, Rattus norvegicus
gactgattgtcctagatgcactact

SEQ ID NO: 327856 - DNA, 25 bp, Rattus norvegicus
gactgatttcataccacgtgagatt

SEQ ID NO: 327857 - DNA, 25 bp, Rattus norvegicus
gactgatttcattccacgtgagatt

SEQ ID NO: 327858 - DNA, 25 bp, Rattus norvegicus
gactgatttctgacctttcactgat

SEQ ID NO: 327859 - DNA, 25 bp, Rattus norvegicus
gactgatttctgtcctttcactgat

SEQ ID NO: 327860 - DNA, 25 bp, Rattus norvegicus
gactgattttgtactcttgacccaa

SEQ ID NO: 327861 - DNA, 25 bp, Rattus norvegicus
gactgattttgttctcttgacccaa

SEQ ID NO: 327862 - DNA, 25 bp, Rattus norvegicus
gactgcaaacctcttagtatttcca

SEQ ID NO: 327863 - DNA, 25 bp, Rattus norvegicus
gactgcaaacctgttagtatttcca

SEQ ID NO: 327864 - DNA, 25 bp, Rattus norvegicus
gactgcaaagatcacttcgtcacca

SEQ ID NO: 327865 - DNA, 25 bp, Rattus norvegicus
gactgcaaagatgacttcgtcacca

SEQ ID NO: 327866 - DNA, 25 bp, Rattus norvegicus
gactgcaaatgcagttacgtaacta

SEQ ID NO: 327867 - DNA, 25 bp, Rattus norvegicus
gactgcaaatgctgttacgtaacta

SEQ ID NO: 327868 - DNA, 25 bp, Rattus norvegicus
gactgcaaattaactgggccagcct

SEQ ID NO: 327869 - DNA, 25 bp, Rattus norvegicus
gactgcaaattatctgggccagcct

SEQ ID NO: 327870 - DNA, 25 bp, Rattus norvegicus
gactgcaacaaaacggtgaaccctt

SEQ ID NO: 327871 - DNA, 25 bp, Rattus norvegicus
gactgcaacaaatcggtgaaccctt

SEQ ID NO: 327872 - DNA, 25 bp, Rattus norvegicus
gactgcaacatgattataccactga

SEQ ID NO: 327873 - DNA, 25 bp, Rattus norvegicus
gactgcaacatgtttataccactga

SEQ ID NO: 327874 - DNA, 25 bp, Rattus norvegicus
gactgcaactccaacgataaacctg

SEQ ID NO: 327875 - DNA, 25 bp, Rattus norvegicus
gactgcaactccacaaagagctact

SEQ ID NO: 327876 - DNA, 25 bp, Rattus norvegicus
gactgcaactcctacgataaacctg

SEQ ID NO: 327877 - DNA, 25 bp, Rattus norvegicus
gactgcaactcctcaaagagctact

SEQ ID NO: 327878 - DNA, 25 bp, Rattus norvegicus
gactgcaactgtagcatttgcaaga

SEQ ID NO: 327879 - DNA, 25 bp, Rattus norvegicus
gactgcaactgttgcatttgcaaga

SEQ ID NO: 327880 - DNA, 25 bp, Rattus norvegicus
gactgcaacttgacaatcacggttt

SEQ ID NO: 327881 - DNA, 25 bp, Rattus norvegicus
gactgcaacttgtcaatcacggttt

SEQ ID NO: 327882 - DNA, 25 bp, Rattus norvegicus
gactgcaagcgaatgtcccttttga

SEQ ID NO: 327883 - DNA, 25 bp, Rattus norvegicus
gactgcaagcgattgtcccttttga

SEQ ID NO: 327884 - DNA, 25 bp, Rattus norvegicus
gactgcaagggcctgtctgtgccct

SEQ ID NO: 327885 - DNA, 25 bp, Rattus norvegicus
gactgcaagggcgtgtctgtgccct

SEQ ID NO: 327886 - DNA, 25 bp, Rattus norvegicus
gactgcaagtgaaaccctagtgcct

SEQ ID NO: 327887 - DNA, 25 bp, Rattus norvegicus
gactgcaagtgataccctagtgcct

SEQ ID NO: 327888 - DNA, 25 bp, Rattus norvegicus
gactgcaagtgtactgtcactcaca

SEQ ID NO: 327889 - DNA, 25 bp, Rattus norvegicus
gactgcaagtgttctgtcactcaca

SEQ ID NO: 327890 - DNA, 25 bp, Rattus norvegicus
gactgcaatacccacagattatgct

SEQ ID NO: 327891 - DNA, 25 bp, Rattus norvegicus
gactgcaataccgacagattatgct

SEQ ID NO: 327892 - DNA, 25 bp, Rattus norvegicus
gactgcaatgcccagaacactctgt

SEQ ID NO: 327893 - DNA, 25 bp, Rattus norvegicus
gactgcaatgccgagaacactctgt

SEQ ID NO: 327894 - DNA, 25 bp, Rattus norvegicus
gactgcaatgtgcactggtgccttt

SEQ ID NO: 327895 - DNA, 25 bp, Rattus norvegicus
gactgcaatgtggactggtgccttt

SEQ ID NO: 327896 - DNA, 25 bp, Rattus norvegicus
gactgcaattcccttactcagaagg

SEQ ID NO: 327897 - DNA, 25 bp, Rattus norvegicus
gactgcaattccgttactcagaagg

SEQ ID NO: 327898 - DNA, 25 bp, Rattus norvegicus
gactgcacactgacttattggaacg

SEQ ID NO: 327899 - DNA, 25 bp, Rattus norvegicus
gactgcacactgtcttattggaacg

SEQ ID NO: 327900 - DNA, 25 bp, Rattus norvegicus
gactgcacagcccttaatgggtttg

SEQ ID NO: 327901 - DNA, 25 bp, Rattus norvegicus
gactgcacagccgttaatgggtttg

SEQ ID NO: 327902 - DNA, 25 bp, Rattus norvegicus
gactgcacagtcagcccaatagagt

SEQ ID NO: 327903 - DNA, 25 bp, Rattus norvegicus
gactgcacagtctgcccaatagagt

SEQ ID NO: 327904 - DNA, 25 bp, Rattus norvegicus
gactgcacagtgaggtgcccattta

SEQ ID NO: 327905 - DNA, 25 bp, Rattus norvegicus
gactgcacagtgtggtgcccattta

SEQ ID NO: 327906 - DNA, 25 bp, Rattus norvegicus
gactgcaccaataaaggccccattt

SEQ ID NO: 327907 - DNA, 25 bp, Rattus norvegicus
gactgcaccaattaaggccccattt

SEQ ID NO: 327908 - DNA, 25 bp, Rattus norvegicus
gactgcaccaggaccttggaggtca

SEQ ID NO: 327909 - DNA, 25 bp, Rattus norvegicus
gactgcaccaggtccttggaggtca

SEQ ID NO: 327910 - DNA, 25 bp, Rattus norvegicus
gactgcaccattctcaacagcggca

SEQ ID NO: 327911 - DNA, 25 bp, Rattus norvegicus
gactgcaccattgtcaacagcggca

SEQ ID NO: 327912 - DNA, 25 bp, Rattus norvegicus
gactgcacccacatggagtcagggt

SEQ ID NO: 327913 - DNA, 25 bp, Rattus norvegicus
gactgcacccacttggagtcagggt

SEQ ID NO: 327914 - DNA, 25 bp, Rattus norvegicus
gactgcactctgaggtgatgaccag

SEQ ID NO: 327915 - DNA, 25 bp, Rattus norvegicus
gactgcactctgtggtgatgaccag

SEQ ID NO: 327916 - DNA, 25 bp, Rattus norvegicus
gactgcactcttcatagctgcaatt

SEQ ID NO: 327917 - DNA, 25 bp, Rattus norvegicus
gactgcactcttgatagctgcaatt

SEQ ID NO: 327918 - DNA, 25 bp, Rattus norvegicus
gactgcactgggaaggaggtatatt

SEQ ID NO: 327919 - DNA, 25 bp, Rattus norvegicus
gactgcactgggtaggaggtatatt

SEQ ID NO: 327920 - DNA, 25 bp, Rattus norvegicus
gactgcactgtcatttttaccaagg

SEQ ID NO: 327921 - DNA, 25 bp, Rattus norvegicus
gactgcactgtcttttttaccaagg

SEQ ID NO: 327922 - DNA, 25 bp, Rattus norvegicus
gactgcacttcaccctagatgtgtg

SEQ ID NO: 327923 - DNA, 25 bp, Rattus norvegicus
gactgcacttcagcctagatgtgtg

SEQ ID NO: 327924 - DNA, 25 bp, Rattus norvegicus
gactgcagaccacccagagggagac

SEQ ID NO: 327925 - DNA, 25 bp, Rattus norvegicus
gactgcagaccagccagagggagac

SEQ ID NO: 327926 - DNA, 25 bp, Rattus norvegicus
gactgcagacgccatcagcaaagaa

SEQ ID NO: 327927 - DNA, 25 bp, Rattus norvegicus
gactgcagacgcgatcagcaaagaa

SEQ ID NO: 327928 - DNA, 25 bp, Rattus norvegicus
gactgcagactgcatcatgctctat

SEQ ID NO: 327929 - DNA, 25 bp, Rattus norvegicus
gactgcagactggatcatgctctat

SEQ ID NO: 327930 - DNA, 25 bp, Rattus norvegicus
gactgcagagaacgccaccagtgga

SEQ ID NO: 327931 - DNA, 25 bp, Rattus norvegicus
gactgcagagaaggccaccagtgga

SEQ ID NO: 327932 - DNA, 25 bp, Rattus norvegicus
gactgcagccagatctgtttgtcac

SEQ ID NO: 327933 - DNA, 25 bp, Rattus norvegicus
gactgcagccagttctgtttgtcac

SEQ ID NO: 327934 - DNA, 25 bp, Rattus norvegicus
gactgcagccatctcactgtcaaag

SEQ ID NO: 327935 - DNA, 25 bp, Rattus norvegicus
gactgcagccatgtcactgtcaaag

SEQ ID NO: 327936 - DNA, 25 bp, Rattus norvegicus
gactgcagcctgacttcacatgagt

SEQ ID NO: 327937 - DNA, 25 bp, Rattus norvegicus
gactgcagcctgagctgaggctgaa

SEQ ID NO: 327938 - DNA, 25 bp, Rattus norvegicus
gactgcagcctgtcttcacatgagt

SEQ ID NO: 327939 - DNA, 25 bp, Rattus norvegicus
gactgcagcctgtgctgaggctgaa

SEQ ID NO: 327940 - DNA, 25 bp, Rattus norvegicus
gactgcagcgctctcaggaaggtca

SEQ ID NO: 327941 - DNA, 25 bp, Rattus norvegicus
gactgcagcgctgtcaggaaggtca

SEQ ID NO: 327942 - DNA, 25 bp, Rattus norvegicus
gactgcagctcacaaggctttggct

SEQ ID NO: 327943 - DNA, 25 bp, Rattus norvegicus
gactgcagctcagaaggctttggct

SEQ ID NO: 327944 - DNA, 25 bp, Rattus norvegicus
gactgcagctggagtttttcgtgtt

SEQ ID NO: 327945 - DNA, 25 bp, Rattus norvegicus
gactgcagctggtgtttttcgtgtt

SEQ ID NO: 327946 - DNA, 25 bp, Rattus norvegicus
gactgcagcttcaacccggtgagat

SEQ ID NO: 327947 - DNA, 25 bp, Rattus norvegicus
gactgcagcttctacccggtgagat

SEQ ID NO: 327948 - DNA, 25 bp, Rattus norvegicus
gactgcaggaccaaggtgtctacgt

SEQ ID NO: 327949 - DNA, 25 bp, Rattus norvegicus
gactgcaggacctaggtgtctacgt

SEQ ID NO: 327950 - DNA, 25 bp, Rattus norvegicus
gactgcaggcagaatctgttataca

SEQ ID NO: 327951 - DNA, 25 bp, Rattus norvegicus
gactgcaggcagtatctgttataca

SEQ ID NO: 327952 - DNA, 25 bp, Rattus norvegicus
gactgcaggccgcaacatgttttac

SEQ ID NO: 327953 - DNA, 25 bp, Rattus norvegicus
gactgcaggccggaacatgttttac

SEQ ID NO: 327954 - DNA, 25 bp, Rattus norvegicus
gactgcaggtcaacatactggtcaa

SEQ ID NO: 327955 - DNA, 25 bp, Rattus norvegicus
gactgcaggtcatcatactggtcaa

SEQ ID NO: 327956 - DNA, 25 bp, Rattus norvegicus
gactgcagtctaatggaaggtttgt

SEQ ID NO: 327957 - DNA, 25 bp, Rattus norvegicus
gactgcagtctattggaaggtttgt

SEQ ID NO: 327958 - DNA, 25 bp, Rattus norvegicus
gactgcagtctgatttcagggtaaa

SEQ ID NO: 327959 - DNA, 25 bp, Rattus norvegicus
gactgcagtctgttttcagggtaaa

SEQ ID NO: 327960 - DNA, 25 bp, Rattus norvegicus
gactgcagtgaaagcgtcgctccgg

SEQ ID NO: 327961 - DNA, 25 bp, Rattus norvegicus
gactgcagtgaatgcgtcgctccgg

SEQ ID NO: 327962 - DNA, 25 bp, Rattus norvegicus
gactgcagtgacctccgtcgcagaa

SEQ ID NO: 327963 - DNA, 25 bp, Rattus norvegicus
gactgcagtgacgtccgtcgcagaa

SEQ ID NO: 327964 - DNA, 25 bp, Rattus norvegicus
gactgcagtgcacgcggcctcttaa

SEQ ID NO: 327965 - DNA, 25 bp, Rattus norvegicus
gactgcagtgcaggcggcctcttaa

SEQ ID NO: 327966 - DNA, 25 bp, Rattus norvegicus
gactgcagtgctacttcataattca

SEQ ID NO: 327967 - DNA, 25 bp, Rattus norvegicus
gactgcagtgcttcttcataattca

SEQ ID NO: 327968 - DNA, 25 bp, Rattus norvegicus
gactgcagtggaacctgatattcaa

SEQ ID NO: 327969 - DNA, 25 bp, Rattus norvegicus
gactgcagtggatcctgatattcaa

SEQ ID NO: 327970 - DNA, 25 bp, Rattus norvegicus
gactgcagtggtaatgggttttgaa

SEQ ID NO: 327971 - DNA, 25 bp, Rattus norvegicus
gactgcagtggttatgggttttgaa

SEQ ID NO: 327972 - DNA, 25 bp, Rattus norvegicus
gactgcataaccatttctcatttaa

SEQ ID NO: 327973 - DNA, 25 bp, Rattus norvegicus
gactgcataaccttttctcatttaa

SEQ ID NO: 327974 - DNA, 25 bp, Rattus norvegicus
gactgcatacgtactttgaaacaca

SEQ ID NO: 327975 - DNA, 25 bp, Rattus norvegicus
gactgcatacgttctttgaaacaca

SEQ ID NO: 327976 - DNA, 25 bp, Rattus norvegicus
gactgcatcaaactcctggattcca

SEQ ID NO: 327977 - DNA, 25 bp, Rattus norvegicus
gactgcatcaaagtcctggattcca

SEQ ID NO: 327978 - DNA, 25 bp, Rattus norvegicus
gactgcatcaggcaacagctgtcga

SEQ ID NO: 327979 - DNA, 25 bp, Rattus norvegicus
gactgcatcagggaacagctgtcga

SEQ ID NO: 327980 - DNA, 25 bp, Rattus norvegicus
gactgcatcccacttgctgggtgac

SEQ ID NO: 327981 - DNA, 25 bp, Rattus norvegicus
gactgcatcccagttgctgggtgac

SEQ ID NO: 327982 - DNA, 25 bp, Rattus norvegicus
gactgcatccttcatatcagaccgt

SEQ ID NO: 327983 - DNA, 25 bp, Rattus norvegicus
gactgcatccttgatatcagaccgt

SEQ ID NO: 327984 - DNA, 25 bp, Rattus norvegicus
gactgcatcgctcctgcataaagca

SEQ ID NO: 327985 - DNA, 25 bp, Rattus norvegicus
gactgcatcgctgctgcataaagca

SEQ ID NO: 327986 - DNA, 25 bp, Rattus norvegicus
gactgcatctctacagtgcaacagt

SEQ ID NO: 327987 - DNA, 25 bp, Rattus norvegicus
gactgcatctcttcagtgcaacagt

SEQ ID NO: 327988 - DNA, 25 bp, Rattus norvegicus
gactgcatctggacttagggatctc

SEQ ID NO: 327989 - DNA, 25 bp, Rattus norvegicus
gactgcatctggtcttagggatctc

SEQ ID NO: 327990 - DNA, 25 bp, Rattus norvegicus
gactgcatcttgaatgctagccctt

SEQ ID NO: 327991 - DNA, 25 bp, Rattus norvegicus
gactgcatcttgtatgctagccctt

SEQ ID NO: 327992 - DNA, 25 bp, Rattus norvegicus
gactgcatgccgatagacgctgaga

SEQ ID NO: 327993 - DNA, 25 bp, Rattus norvegicus
gactgcatgccgttagacgctgaga

SEQ ID NO: 327994 - DNA, 25 bp, Rattus norvegicus
gactgcatgttcctgactaaatgta

SEQ ID NO: 327995 - DNA, 25 bp, Rattus norvegicus
gactgcatgttcgtgactaaatgta

SEQ ID NO: 327996 - DNA, 25 bp, Rattus norvegicus
gactgcattcagagactgtacctgc

SEQ ID NO: 327997 - DNA, 25 bp, Rattus norvegicus
gactgcattcagtgactgtacctgc

SEQ ID NO: 327998 - DNA, 25 bp, Rattus norvegicus
gactgcattgcacagcgtcacacac

SEQ ID NO: 327999 - DNA, 25 bp, Rattus norvegicus
gactgcattgcagagcgtcacacac

SEQ ID NO: 328000 - DNA, 25 bp, Rattus norvegicus
gactgcattggcatcggcaggatgc

SEQ ID NO: 328001 - DNA, 25 bp, Rattus norvegicus
gactgcattggcttcggcaggatgc

SEQ ID NO: 328002 - DNA, 25 bp, Rattus norvegicus
gactgccaaagtaatgctgtagctc

SEQ ID NO: 328003 - DNA, 25 bp, Rattus norvegicus
gactgccaaagttatgctgtagctc

SEQ ID NO: 328004 - DNA, 25 bp, Rattus norvegicus
gactgccaaatcatctcactatgga

SEQ ID NO: 328005 - DNA, 25 bp, Rattus norvegicus
gactgccaaatcttctcactatgga

SEQ ID NO: 328006 - DNA, 25 bp, Rattus norvegicus
gactgccaaccacttttgattcaag

SEQ ID NO: 328007 - DNA, 25 bp, Rattus norvegicus
gactgccaaccagttttgattcaag

SEQ ID NO: 328008 - DNA, 25 bp, Rattus norvegicus
gactgccaagctctgtcaggaatga

SEQ ID NO: 328009 - DNA, 25 bp, Rattus norvegicus
gactgccaagctgtgtcaggaatga

SEQ ID NO: 328010 - DNA, 25 bp, Rattus norvegicus
gactgccacacaattcaacaaaggg

SEQ ID NO: 328011 - DNA, 25 bp, Rattus norvegicus
gactgccacacatttcaacaaaggg

SEQ ID NO: 328012 - DNA, 25 bp, Rattus norvegicus
gactgccacaggaagctcagactaa

SEQ ID NO: 328013 - DNA, 25 bp, Rattus norvegicus
gactgccacaggtagctcagactaa

SEQ ID NO: 328014 - DNA, 25 bp, Rattus norvegicus
gactgccagcatagtgttcagcaac

SEQ ID NO: 328015 - DNA, 25 bp, Rattus norvegicus
gactgccagcattgtgttcagcaac

SEQ ID NO: 328016 - DNA, 25 bp, Rattus norvegicus
gactgccaggtgaccagcatcattt

SEQ ID NO: 328017 - DNA, 25 bp, Rattus norvegicus
gactgccaggtgtccagcatcattt

SEQ ID NO: 328018 - DNA, 25 bp, Rattus norvegicus
gactgccagtgccttggtccagaag

SEQ ID NO: 328019 - DNA, 25 bp, Rattus norvegicus
gactgccagtgcgttggtccagaag

SEQ ID NO: 328020 - DNA, 25 bp, Rattus norvegicus
gactgccagtggatcaaagttgtat

SEQ ID NO: 328021 - DNA, 25 bp, Rattus norvegicus
gactgccagtggttcaaagttgtat

SEQ ID NO: 328022 - DNA, 25 bp, Rattus norvegicus
gactgccagttgagctttgttccaa

SEQ ID NO: 328023 - DNA, 25 bp, Rattus norvegicus
gactgccagttgtgctttgttccaa

SEQ ID NO: 328024 - DNA, 25 bp, Rattus norvegicus
gactgccatgcgatccaccagaaag

SEQ ID NO: 328025 - DNA, 25 bp, Rattus norvegicus
gactgccatgcgttccaccagaaag

SEQ ID NO: 328026 - DNA, 25 bp, Rattus norvegicus
gactgccatgctccagggttgagaa

SEQ ID NO: 328027 - DNA, 25 bp, Rattus norvegicus
gactgccatgctgcagggttgagaa

SEQ ID NO: 328028 - DNA, 25 bp, Rattus norvegicus
gactgccatgtgcatactgcaaact

SEQ ID NO: 328029 - DNA, 25 bp, Rattus norvegicus
gactgccatgtggatactgcaaact

SEQ ID NO: 328030 - DNA, 25 bp, Rattus norvegicus
gactgccattgcagggactatggtg

SEQ ID NO: 328031 - DNA, 25 bp, Rattus norvegicus
gactgccattgctgggactatggtg

SEQ ID NO: 328032 - DNA, 25 bp, Rattus norvegicus
gactgcccaagacaaagtgtataac

SEQ ID NO: 328033 - DNA, 25 bp, Rattus norvegicus
gactgcccaagagaaagtgtataac

SEQ ID NO: 328034 - DNA, 25 bp, Rattus norvegicus
gactgcccaagtataagtggtgcta

SEQ ID NO: 328035 - DNA, 25 bp, Rattus norvegicus
gactgcccaagtttaagtggtgcta

SEQ ID NO: 328036 - DNA, 25 bp, Rattus norvegicus
gactgcccacagatcatgaataact

SEQ ID NO: 328037 - DNA, 25 bp, Rattus norvegicus
gactgcccacagttcatgaataact

SEQ ID NO: 328038 - DNA, 25 bp, Rattus norvegicus
gactgccccaaaccctactaggaat

SEQ ID NO: 328039 - DNA, 25 bp, Rattus norvegicus
gactgccccaaagcctactaggaat

SEQ ID NO: 328040 - DNA, 25 bp, Rattus norvegicus
gactgccccactcaacacttaaatg

SEQ ID NO: 328041 - DNA, 25 bp, Rattus norvegicus
gactgccccactgaacacttaaatg

SEQ ID NO: 328042 - DNA, 25 bp, Rattus norvegicus
gactgccccagtaagatttaaactt

SEQ ID NO: 328043 - DNA, 25 bp, Rattus norvegicus
gactgccccagttagatttaaactt

SEQ ID NO: 328044 - DNA, 25 bp, Rattus norvegicus
gactgcccctaacatacctggtaat

SEQ ID NO: 328045 - DNA, 25 bp, Rattus norvegicus
gactgcccctaagatacctggtaat

SEQ ID NO: 328046 - DNA, 25 bp, Rattus norvegicus
gactgcccctctataaaagcacagc

SEQ ID NO: 328047 - DNA, 25 bp, Rattus norvegicus
gactgcccctctttaaaagcacagc

SEQ ID NO: 328048 - DNA, 25 bp, Rattus norvegicus
gactgcccctgtactgagattagat

SEQ ID NO: 328049 - DNA, 25 bp, Rattus norvegicus
gactgcccctgttctgagattagat

SEQ ID NO: 328050 - DNA, 25 bp, Rattus norvegicus
gactgcccgtacatggttcatgtgc

SEQ ID NO: 328051 - DNA, 25 bp, Rattus norvegicus
gactgcccgtacttggttcatgtgc

SEQ ID NO: 328052 - DNA, 25 bp, Rattus norvegicus
gactgccctaccattgcaaaattca

SEQ ID NO: 328053 - DNA, 25 bp, Rattus norvegicus
gactgccctacctttgcaaaattca

SEQ ID NO: 328054 - DNA, 25 bp, Rattus norvegicus
gactgccctagacgattctgggaaa

SEQ ID NO: 328055 - DNA, 25 bp, Rattus norvegicus
gactgccctagaggattctgggaaa

SEQ ID NO: 328056 - DNA, 25 bp, Rattus norvegicus
gactgccctatcataggcctcagaa

SEQ ID NO: 328057 - DNA, 25 bp, Rattus norvegicus
gactgccctatcttaggcctcagaa

SEQ ID NO: 328058 - DNA, 25 bp, Rattus norvegicus
gactgccgctttctcagtgactttg

SEQ ID NO: 328059 - DNA, 25 bp, Rattus norvegicus
gactgccgctttgtcagtgactttg

SEQ ID NO: 328060 - DNA, 25 bp, Rattus norvegicus
gactgccgttatcacagcaagccca

SEQ ID NO: 328061 - DNA, 25 bp, Rattus norvegicus
gactgccgttatgacagcaagccca

SEQ ID NO: 328062 - DNA, 25 bp, Rattus norvegicus
gactgcctagagagagatgctgcaa

SEQ ID NO: 328063 - DNA, 25 bp, Rattus norvegicus
gactgcctagagtgagatgctgcaa

SEQ ID NO: 328064 - DNA, 25 bp, Rattus norvegicus
gactgcctaggtagattctggcccg

SEQ ID NO: 328065 - DNA, 25 bp, Rattus norvegicus
gactgcctaggttgattctggcccg

SEQ ID NO: 328066 - DNA, 25 bp, Rattus norvegicus
gactgcctagtgctatttgtattct

SEQ ID NO: 328067 - DNA, 25 bp, Rattus norvegicus
gactgcctagtggtatttgtattct

SEQ ID NO: 328068 - DNA, 25 bp, Rattus norvegicus
gactgcctatacaccagtttcagag

SEQ ID NO: 328069 - DNA, 25 bp, Rattus norvegicus
gactgcctatactccagtttcagag

SEQ ID NO: 328070 - DNA, 25 bp, Rattus norvegicus
gactgcctatcactgggcgttggtc

SEQ ID NO: 328071 - DNA, 25 bp, Rattus norvegicus
gactgcctatcagtgggcgttggtc

SEQ ID NO: 328072 - DNA, 25 bp, Rattus norvegicus
gactgcctcacacggaaatgccttg

SEQ ID NO: 328073 - DNA, 25 bp, Rattus norvegicus
gactgcctcacagggaaatgccttg

SEQ ID NO: 328074 - DNA, 25 bp, Rattus norvegicus
gactgcctcatgatgactcatgggt

SEQ ID NO: 328075 - DNA, 25 bp, Rattus norvegicus
gactgcctcatgttgactcatgggt

SEQ ID NO: 328076 - DNA, 25 bp, Rattus norvegicus
gactgcctctccaagaaatgactgt

SEQ ID NO: 328077 - DNA, 25 bp, Rattus norvegicus
gactgcctctcctagaaatgactgt

SEQ ID NO: 328078 - DNA, 25 bp, Rattus norvegicus
gactgcctctctaccaaataagttt

SEQ ID NO: 328079 - DNA, 25 bp, Rattus norvegicus
gactgcctctcttccaaataagttt

SEQ ID NO: 328080 - DNA, 25 bp, Rattus norvegicus
gactgcctgagtagatctttaccca

SEQ ID NO: 328081 - DNA, 25 bp, Rattus norvegicus
gactgcctgagttgatctttaccca

SEQ ID NO: 328082 - DNA, 25 bp, Rattus norvegicus
gactgcctgcagctggaactgatgt

SEQ ID NO: 328083 - DNA, 25 bp, Rattus norvegicus
gactgcctgcaggtggaactgatgt

SEQ ID NO: 328084 - DNA, 25 bp, Rattus norvegicus
gactgcctggatctcaatgccatta

SEQ ID NO: 328085 - DNA, 25 bp, Rattus norvegicus
gactgcctggatgtcaatgccatta

SEQ ID NO: 328086 - DNA, 25 bp, Rattus norvegicus
gactgcctggcaaattttttagcta

SEQ ID NO: 328087 - DNA, 25 bp, Rattus norvegicus
gactgcctggcatattttttagcta

SEQ ID NO: 328088 - DNA, 25 bp, Rattus norvegicus
gactgcctgtgacgaggtcaccaac

SEQ ID NO: 328089 - DNA, 25 bp, Rattus norvegicus
gactgcctgtgaggaggtcaccaac

SEQ ID NO: 328090 - DNA, 25 bp, Rattus norvegicus
gactgcctgtttagaggagcctgaa

SEQ ID NO: 328091 - DNA, 25 bp, Rattus norvegicus
gactgcctgtttctaatcatgatta

SEQ ID NO: 328092 - DNA, 25 bp, Rattus norvegicus
gactgcctgtttgtaatcatgatta

SEQ ID NO: 328093 - DNA, 25 bp, Rattus norvegicus
gactgcctgttttgaggagcctgaa

SEQ ID NO: 328094 - DNA, 25 bp, Rattus norvegicus
gactgccttaagaattcagtttctt

SEQ ID NO: 328095 - DNA, 25 bp, Rattus norvegicus
gactgccttaagtattcagtttctt

SEQ ID NO: 328096 - DNA, 25 bp, Rattus norvegicus
gactgccttcaaatcaagcaactag

SEQ ID NO: 328097 - DNA, 25 bp, Rattus norvegicus
gactgccttcaacttgagtggtctt

SEQ ID NO: 328098 - DNA, 25 bp, Rattus norvegicus
gactgccttcaagttgagtggtctt

SEQ ID NO: 328099 - DNA, 25 bp, Rattus norvegicus
gactgccttcaattcaagcaactag

SEQ ID NO: 328100 - DNA, 25 bp, Rattus norvegicus
gactgccttcatattcttcctgact

SEQ ID NO: 328101 - DNA, 25 bp, Rattus norvegicus
gactgccttcattttcttcctgact

SEQ ID NO: 328102 - DNA, 25 bp, Rattus norvegicus
gactgccttctccactgtaattggg

SEQ ID NO: 328103 - DNA, 25 bp, Rattus norvegicus
gactgccttctcgactgtaattggg

SEQ ID NO: 328104 - DNA, 25 bp, Rattus norvegicus
gactgccttgagcttagaattcctg

SEQ ID NO: 328105 - DNA, 25 bp, Rattus norvegicus
gactgccttgaggttagaattcctg

SEQ ID NO: 328106 - DNA, 25 bp, Rattus norvegicus
gactgcctttaaagatgtagacgcc

SEQ ID NO: 328107 - DNA, 25 bp, Rattus norvegicus
gactgcctttaatgatgtagacgcc

SEQ ID NO: 328108 - DNA, 25 bp, Rattus norvegicus
gactgcctttagcaccactaactgg

SEQ ID NO: 328109 - DNA, 25 bp, Rattus norvegicus
gactgcctttaggaccactaactgg

SEQ ID NO: 328110 - DNA, 25 bp, Rattus norvegicus
gactgcgaagccctggtgaccctgt

SEQ ID NO: 328111 - DNA, 25 bp, Rattus norvegicus
gactgcgaagccgtggtgaccctgt

SEQ ID NO: 328112 - DNA, 25 bp, Rattus norvegicus
gactgcgactttacctgaagaccaa

SEQ ID NO: 328113 - DNA, 25 bp, Rattus norvegicus
gactgcgacttttcctgaagaccaa

SEQ ID NO: 328114 - DNA, 25 bp, Rattus norvegicus
gactgcgatggccacccaaatgggt

SEQ ID NO: 328115 - DNA, 25 bp, Rattus norvegicus
gactgcgatggcgacccaaatgggt

SEQ ID NO: 328116 - DNA, 25 bp, Rattus norvegicus
gactgcgcactcatcacattgaata

SEQ ID NO: 328117 - DNA, 25 bp, Rattus norvegicus
gactgcgcactcttcacattgaata

SEQ ID NO: 328118 - DNA, 25 bp, Rattus norvegicus
gactgcgcactgcattcagatttat

SEQ ID NO: 328119 - DNA, 25 bp, Rattus norvegicus
gactgcgcactggattcagatttat

SEQ ID NO: 328120 - DNA, 25 bp, Rattus norvegicus
gactgcgcgagcagggcccgcgtaa

SEQ ID NO: 328121 - DNA, 25 bp, Rattus norvegicus
gactgcgcgagctgggcccgcgtaa

SEQ ID NO: 328122 - DNA, 25 bp, Rattus norvegicus
gactgcgctcacatacaggcgagga

SEQ ID NO: 328123 - DNA, 25 bp, Rattus norvegicus
gactgcgctcacttacaggcgagga

SEQ ID NO: 328124 - DNA, 25 bp, Rattus norvegicus
gactgcgctcctcaagcaaatggaa

SEQ ID NO: 328125 - DNA, 25 bp, Rattus norvegicus
gactgcgctcctgaagcaaatggaa

SEQ ID NO: 328126 - DNA, 25 bp, Rattus norvegicus
gactgcgctggacacttttcgctta

SEQ ID NO: 328127 - DNA, 25 bp, Rattus norvegicus
gactgcgctggagacttttcgctta

SEQ ID NO: 328128 - DNA, 25 bp, Rattus norvegicus
gactgcggacctcttcagaaggagt

SEQ ID NO: 328129 - DNA, 25 bp, Rattus norvegicus
gactgcggacctgttcagaaggagt

SEQ ID NO: 328130 - DNA, 25 bp, Rattus norvegicus
gactgcggaggcaacagcagcagct

SEQ ID NO: 328131 - DNA, 25 bp, Rattus norvegicus
gactgcggaggctacagcagcagct

SEQ ID NO: 328132 - DNA, 25 bp, Rattus norvegicus
gactgcggcacgacgtctacgttgt

SEQ ID NO: 328133 - DNA, 25 bp, Rattus norvegicus
gactgcggcacgtcgtctacgttgt

SEQ ID NO: 328134 - DNA, 25 bp, Rattus norvegicus
gactgcggcattaaatttttctggt

SEQ ID NO: 328135 - DNA, 25 bp, Rattus norvegicus
gactgcggcatttaatttttctggt

SEQ ID NO: 328136 - DNA, 25 bp, Rattus norvegicus
gactgcgggaatcagttactgccac

SEQ ID NO: 328137 - DNA, 25 bp, Rattus norvegicus
gactgcgggaatgagttactgccac

SEQ ID NO: 328138 - DNA, 25 bp, Rattus norvegicus
gactgcggttctacgatccttcttt

SEQ ID NO: 328139 - DNA, 25 bp, Rattus norvegicus
gactgcggttcttcgatccttcttt

SEQ ID NO: 328140 - DNA, 25 bp, Rattus norvegicus
gactgcggtttcatttgtgttcctg

SEQ ID NO: 328141 - DNA, 25 bp, Rattus norvegicus
gactgcggtttcttttgtgttcctg

SEQ ID NO: 328142 - DNA, 25 bp, Rattus norvegicus
gactgcgtctaaataaacatcgctt

SEQ ID NO: 328143 - DNA, 25 bp, Rattus norvegicus
gactgcgtctaattaaacatcgctt

SEQ ID NO: 328144 - DNA, 25 bp, Rattus norvegicus
gactgcgttcacatgagatccttgt

SEQ ID NO: 328145 - DNA, 25 bp, Rattus norvegicus
gactgcgttcacttgagatccttgt

SEQ ID NO: 328146 - DNA, 25 bp, Rattus norvegicus
gactgctaaagaaggtccccagaga

SEQ ID NO: 328147 - DNA, 25 bp, Rattus norvegicus
gactgctaaagatggtccccagaga

SEQ ID NO: 328148 - DNA, 25 bp, Rattus norvegicus
gactgctaaagcactgaggtcacta

SEQ ID NO: 328149 - DNA, 25 bp, Rattus norvegicus
gactgctaaagctctgaggtcacta

SEQ ID NO: 328150 - DNA, 25 bp, Rattus norvegicus
gactgctaacacaattgctctttca

SEQ ID NO: 328151 - DNA, 25 bp, Rattus norvegicus
gactgctaacactattgctctttca

SEQ ID NO: 328152 - DNA, 25 bp, Rattus norvegicus
gactgctaagagcacgcttctgata

SEQ ID NO: 328153 - DNA, 25 bp, Rattus norvegicus
gactgctaagaggacgcttctgata

SEQ ID NO: 328154 - DNA, 25 bp, Rattus norvegicus
gactgctaagatctcgcccagtggc

SEQ ID NO: 328155 - DNA, 25 bp, Rattus norvegicus
gactgctaagatgtcgcccagtggc

SEQ ID NO: 328156 - DNA, 25 bp, Rattus norvegicus
gactgctaatgcaaatgggcctttt

SEQ ID NO: 328157 - DNA, 25 bp, Rattus norvegicus
gactgctaatgctaatgggcctttt

SEQ ID NO: 328158 - DNA, 25 bp, Rattus norvegicus
gactgctaccttacaaagcttggga

SEQ ID NO: 328159 - DNA, 25 bp, Rattus norvegicus
gactgctacctttcaaagcttggga

SEQ ID NO: 328160 - DNA, 25 bp, Rattus norvegicus
gactgctactagacccaacttggga

SEQ ID NO: 328161 - DNA, 25 bp, Rattus norvegicus
gactgctactagtcccaacttggga

SEQ ID NO: 328162 - DNA, 25 bp, Rattus norvegicus
gactgctactggatgttcttgtggc

SEQ ID NO: 328163 - DNA, 25 bp, Rattus norvegicus
gactgctactggttgttcttgtggc

SEQ ID NO: 328164 - DNA, 25 bp, Rattus norvegicus
gactgctactgtctggtttgctcag

SEQ ID NO: 328165 - DNA, 25 bp, Rattus norvegicus
gactgctactgtgtggtttgctcag

SEQ ID NO: 328166 - DNA, 25 bp, Rattus norvegicus
gactgctactttccaagatccaatc

SEQ ID NO: 328167 - DNA, 25 bp, Rattus norvegicus
gactgctactttgcaagatccaatc

SEQ ID NO: 328168 - DNA, 25 bp, Rattus norvegicus
gactgctagaccaacgaattacctt

SEQ ID NO: 328169 - DNA, 25 bp, Rattus norvegicus
gactgctagacctacgaattacctt

SEQ ID NO: 328170 - DNA, 25 bp, Rattus norvegicus
gactgctatcatcttcttcaactat

SEQ ID NO: 328171 - DNA, 25 bp, Rattus norvegicus
gactgctatcatgttcttcaactat

SEQ ID NO: 328172 - DNA, 25 bp, Rattus norvegicus
gactgctatggtcgcctttcagata

SEQ ID NO: 328173 - DNA, 25 bp, Rattus norvegicus
gactgctatggtggcctttcagata

SEQ ID NO: 328174 - DNA, 25 bp, Rattus norvegicus
gactgctattccaacgagtactcgt

SEQ ID NO: 328175 - DNA, 25 bp, Rattus norvegicus
gactgctattcctacgagtactcgt

SEQ ID NO: 328176 - DNA, 25 bp, Rattus norvegicus
gactgctatttgatggacgctccct

SEQ ID NO: 328177 - DNA, 25 bp, Rattus norvegicus
gactgctatttgttggacgctccct

SEQ ID NO: 328178 - DNA, 25 bp, Rattus norvegicus
gactgctcagaaccaaagggcccat

SEQ ID NO: 328179 - DNA, 25 bp, Rattus norvegicus
gactgctcagaagcaaagggcccat

SEQ ID NO: 328180 - DNA, 25 bp, Rattus norvegicus
gactgctcagagaatcctccaaaat

SEQ ID NO: 328181 - DNA, 25 bp, Rattus norvegicus
gactgctcagagtatcctccaaaat

SEQ ID NO: 328182 - DNA, 25 bp, Rattus norvegicus
gactgctcagataacatgtgggcca

SEQ ID NO: 328183 - DNA, 25 bp, Rattus norvegicus
gactgctcagattacatgtgggcca

SEQ ID NO: 328184 - DNA, 25 bp, Rattus norvegicus
gactgctcagccatctggtggagag

SEQ ID NO: 328185 - DNA, 25 bp, Rattus norvegicus
gactgctcagccatgatttggcatt

SEQ ID NO: 328186 - DNA, 25 bp, Rattus norvegicus
gactgctcagccttctggtggagag

SEQ ID NO: 328187 - DNA, 25 bp, Rattus norvegicus
gactgctcagccttgatttggcatt

SEQ ID NO: 328188 - DNA, 25 bp, Rattus norvegicus
gactgctcagtccacatgcgtgtca

SEQ ID NO: 328189 - DNA, 25 bp, Rattus norvegicus
gactgctcagtcgacatgcgtgtca

SEQ ID NO: 328190 - DNA, 25 bp, Rattus norvegicus
gactgctcatcactatcgtcagtga

SEQ ID NO: 328191 - DNA, 25 bp, Rattus norvegicus
gactgctcatcagtatcgtcagtga

SEQ ID NO: 328192 - DNA, 25 bp, Rattus norvegicus
gactgctcccaaaacaccttgaaga

SEQ ID NO: 328193 - DNA, 25 bp, Rattus norvegicus
gactgctcccaatacaccttgaaga

SEQ ID NO: 328194 - DNA, 25 bp, Rattus norvegicus
gactgctccgtgatcaactgtgaaa

SEQ ID NO: 328195 - DNA, 25 bp, Rattus norvegicus
gactgctccgtgttcaactgtgaaa

SEQ ID NO: 328196 - DNA, 25 bp, Rattus norvegicus
gactgctcctggcatcgtttaagaa

SEQ ID NO: 328197 - DNA, 25 bp, Rattus norvegicus
gactgctcctgggatcgtttaagaa

SEQ ID NO: 328198 - DNA, 25 bp, Rattus norvegicus
gactgctcgcagagcccacagaagt

SEQ ID NO: 328199 - DNA, 25 bp, Rattus norvegicus
gactgctcgcagtgcccacagaagt

SEQ ID NO: 328200 - DNA, 25 bp, Rattus norvegicus
gactgctcgtaacttcatttggaca

SEQ ID NO: 328201 - DNA, 25 bp, Rattus norvegicus
gactgctcgtaagttcatttggaca

SEQ ID NO: 328202 - DNA, 25 bp, Rattus norvegicus
gactgctctaacactagcttcttag

SEQ ID NO: 328203 - DNA, 25 bp, Rattus norvegicus
gactgctctaactctagcttcttag

SEQ ID NO: 328204 - DNA, 25 bp, Rattus norvegicus
gactgctctcttcagcatctaggta

SEQ ID NO: 328205 - DNA, 25 bp, Rattus norvegicus
gactgctctcttgagcatctaggta

SEQ ID NO: 328206 - DNA, 25 bp, Rattus norvegicus
gactgctctgacatcaataatcatg

SEQ ID NO: 328207 - DNA, 25 bp, Rattus norvegicus
gactgctctgacttcaataatcatg

SEQ ID NO: 328208 - DNA, 25 bp, Rattus norvegicus
gactgctctgagaagaatcccgact

SEQ ID NO: 328209 - DNA, 25 bp, Rattus norvegicus
gactgctctgagtagaatcccgact

SEQ ID NO: 328210 - DNA, 25 bp, Rattus norvegicus
gactgctctgcacggactggactca

SEQ ID NO: 328211 - DNA, 25 bp, Rattus norvegicus
gactgctctgcagggactggactca

SEQ ID NO: 328212 - DNA, 25 bp, Rattus norvegicus
gactgctctggcaattcagtttgtg

SEQ ID NO: 328213 - DNA, 25 bp, Rattus norvegicus
gactgctctggctattcagtttgtg

SEQ ID NO: 328214 - DNA, 25 bp, Rattus norvegicus
gactgctcttagctcctgttagcat

SEQ ID NO: 328215 - DNA, 25 bp, Rattus norvegicus
gactgctcttaggtcctgttagcat

SEQ ID NO: 328216 - DNA, 25 bp, Rattus norvegicus
gactgctcttcccagaatgacatga

SEQ ID NO: 328217 - DNA, 25 bp, Rattus norvegicus
gactgctcttccgagaatgacatga

SEQ ID NO: 328218 - DNA, 25 bp, Rattus norvegicus
gactgctgaagacaacgtggcttta

SEQ ID NO: 328219 - DNA, 25 bp, Rattus norvegicus
gactgctgaagagaacgtggcttta

SEQ ID NO: 328220 - DNA, 25 bp, Rattus norvegicus
gactgctgaattaatttctccttgt

SEQ ID NO: 328221 - DNA, 25 bp, Rattus norvegicus
gactgctgaatttatttctccttgt

SEQ ID NO: 328222 - DNA, 25 bp, Rattus norvegicus
gactgctgacaacttgttcatcatt

SEQ ID NO: 328223 - DNA, 25 bp, Rattus norvegicus
gactgctgacaagttgttcatcatt

SEQ ID NO: 328224 - DNA, 25 bp, Rattus norvegicus
gactgctgacatctggttaactagg

SEQ ID NO: 328225 - DNA, 25 bp, Rattus norvegicus
gactgctgacatgtggttaactagg

SEQ ID NO: 328226 - DNA, 25 bp, Rattus norvegicus
gactgctgacgtacctctgtgattc

SEQ ID NO: 328227 - DNA, 25 bp, Rattus norvegicus
gactgctgacgttcctctgtgattc

SEQ ID NO: 328228 - DNA, 25 bp, Rattus norvegicus
gactgctgagatcggattccttgtg

SEQ ID NO: 328229 - DNA, 25 bp, Rattus norvegicus
gactgctgagatgggattccttgtg

SEQ ID NO: 328230 - DNA, 25 bp, Rattus norvegicus
gactgctgagccatgtggtccgtta

SEQ ID NO: 328231 - DNA, 25 bp, Rattus norvegicus
gactgctgagccttgtggtccgtta

SEQ ID NO: 328232 - DNA, 25 bp, Rattus norvegicus
gactgctgagttcggcatacgacat

SEQ ID NO: 328233 - DNA, 25 bp, Rattus norvegicus
gactgctgagttgggcatacgacat

SEQ ID NO: 328234 - DNA, 25 bp, Rattus norvegicus
gactgctgattcatgagcgccttca

SEQ ID NO: 328235 - DNA, 25 bp, Rattus norvegicus
gactgctgattcttgagcgccttca

SEQ ID NO: 328236 - DNA, 25 bp, Rattus norvegicus
gactgctgcagtcgcatcacaatat

SEQ ID NO: 328237 - DNA, 25 bp, Rattus norvegicus
gactgctgcagtggcatcacaatat

SEQ ID NO: 328238 - DNA, 25 bp, Rattus norvegicus
gactgctgctgcagtgcaaagaaca

SEQ ID NO: 328239 - DNA, 25 bp, Rattus norvegicus
gactgctgctgctgtgcaaagaaca

SEQ ID NO: 328240 - DNA, 25 bp, Rattus norvegicus
gactgctgctgtacttgctgttaaa

SEQ ID NO: 328241 - DNA, 25 bp, Rattus norvegicus
gactgctgctgttcttgctgttaaa

SEQ ID NO: 328242 - DNA, 25 bp, Rattus norvegicus
gactgctgggaactgtctcctgccc

SEQ ID NO: 328243 - DNA, 25 bp, Rattus norvegicus
gactgctgggaagtgtctcctgccc

SEQ ID NO: 328244 - DNA, 25 bp, Rattus norvegicus
gactgctgggtcagaccaaggccat

SEQ ID NO: 328245 - DNA, 25 bp, Rattus norvegicus
gactgctgggtctgaccaaggccat

SEQ ID NO: 328246 - DNA, 25 bp, Rattus norvegicus
gactgctgggtgaacctgagctaca

SEQ ID NO: 328247 - DNA, 25 bp, Rattus norvegicus
gactgctgggtgtacctgagctaca

SEQ ID NO: 328248 - DNA, 25 bp, Rattus norvegicus
gactgctgggttacagggtattcat

SEQ ID NO: 328249 - DNA, 25 bp, Rattus norvegicus
gactgctgggtttcagggtattcat

SEQ ID NO: 328250 - DNA, 25 bp, Rattus norvegicus
gactgctggtccattggtgtcatca

SEQ ID NO: 328251 - DNA, 25 bp, Rattus norvegicus
gactgctggtcctttggtgtcatca

SEQ ID NO: 328252 - DNA, 25 bp, Rattus norvegicus
gactgctggttaccttgaagcttac

SEQ ID NO: 328253 - DNA, 25 bp, Rattus norvegicus
gactgctggttagcttgaagcttac

SEQ ID NO: 328254 - DNA, 25 bp, Rattus norvegicus
gactgctggttgatcactttatgga

SEQ ID NO: 328255 - DNA, 25 bp, Rattus norvegicus
gactgctggttgttcactttatgga

SEQ ID NO: 328256 - DNA, 25 bp, Rattus norvegicus
gactgctgtcagagctggaacatac

SEQ ID NO: 328257 - DNA, 25 bp, Rattus norvegicus
gactgctgtcagtgctggaacatac

SEQ ID NO: 328258 - DNA, 25 bp, Rattus norvegicus
gactgctgtcgccagaagacgtgtt

SEQ ID NO: 328259 - DNA, 25 bp, Rattus norvegicus
gactgctgtcgcgagaagacgtgtt

SEQ ID NO: 328260 - DNA, 25 bp, Rattus norvegicus
gactgctgtctcatggtacgctacc

SEQ ID NO: 328261 - DNA, 25 bp, Rattus norvegicus
gactgctgtctcttggtacgctacc

SEQ ID NO: 328262 - DNA, 25 bp, Rattus norvegicus
gactgctgtggacgtcaagttcctt

SEQ ID NO: 328263 - DNA, 25 bp, Rattus norvegicus
gactgctgtggaggtcaagttcctt

SEQ ID NO: 328264 - DNA, 25 bp, Rattus norvegicus
gactgctgtgtaaccatgaggtgtt

SEQ ID NO: 328265 - DNA, 25 bp, Rattus norvegicus
gactgctgtgtatccatgaggtgtt

SEQ ID NO: 328266 - DNA, 25 bp, Rattus norvegicus
gactgcttagcaattgagaaaccca

SEQ ID NO: 328267 - DNA, 25 bp, Rattus norvegicus
gactgcttagcatttgagaaaccca

SEQ ID NO: 328268 - DNA, 25 bp, Rattus norvegicus
gactgcttagtcaatccacaagtaa

SEQ ID NO: 328269 - DNA, 25 bp, Rattus norvegicus
gactgcttagtctatccacaagtaa

SEQ ID NO: 328270 - DNA, 25 bp, Rattus norvegicus
gactgcttagtgattccccatctgt

SEQ ID NO: 328271 - DNA, 25 bp, Rattus norvegicus
gactgcttagtgtttccccatctgt

SEQ ID NO: 328272 - DNA, 25 bp, Rattus norvegicus
gactgcttatagagcctcaaggtct

SEQ ID NO: 328273 - DNA, 25 bp, Rattus norvegicus
gactgcttatagtgcctcaaggtct

SEQ ID NO: 328274 - DNA, 25 bp, Rattus norvegicus
gactgcttcacaatactatctctaa

SEQ ID NO: 328275 - DNA, 25 bp, Rattus norvegicus
gactgcttcacattactatctctaa

SEQ ID NO: 328276 - DNA, 25 bp, Rattus norvegicus
gactgcttcagcagctggcttcgtt

SEQ ID NO: 328277 - DNA, 25 bp, Rattus norvegicus
gactgcttcagctgctggcttcgtt

SEQ ID NO: 328278 - DNA, 25 bp, Rattus norvegicus
gactgcttccagaagtaacctgtga

SEQ ID NO: 328279 - DNA, 25 bp, Rattus norvegicus
gactgcttccagattgtggtgggta

SEQ ID NO: 328280 - DNA, 25 bp, Rattus norvegicus
gactgcttccagtagtaacctgtga

SEQ ID NO: 328281 - DNA, 25 bp, Rattus norvegicus
gactgcttccagtttgtggtgggta

SEQ ID NO: 328282 - DNA, 25 bp, Rattus norvegicus
gactgcttgatgattccataccaga

SEQ ID NO: 328283 - DNA, 25 bp, Rattus norvegicus
gactgcttgatgtttccataccaga

SEQ ID NO: 328284 - DNA, 25 bp, Rattus norvegicus
gactgcttgggaatgttgccagcct

SEQ ID NO: 328285 - DNA, 25 bp, Rattus norvegicus
gactgcttgggattgttgccagcct

SEQ ID NO: 328286 - DNA, 25 bp, Rattus norvegicus
gactgctttacaaatgagtccttat

SEQ ID NO: 328287 - DNA, 25 bp, Rattus norvegicus
gactgctttacatatgagtccttat

SEQ ID NO: 328288 - DNA, 25 bp, Rattus norvegicus
gactgctttctcagtctactgacta

SEQ ID NO: 328289 - DNA, 25 bp, Rattus norvegicus
gactgctttctctgtctactgacta

SEQ ID NO: 328290 - DNA, 25 bp, Rattus norvegicus
gactgctttgggagccttcgagaat

SEQ ID NO: 328291 - DNA, 25 bp, Rattus norvegicus
gactgctttgggtgccttcgagaat

SEQ ID NO: 328292 - DNA, 25 bp, Rattus norvegicus
gactgctttgtaagtcaggccattt

SEQ ID NO: 328293 - DNA, 25 bp, Rattus norvegicus
gactgctttgtaagttttgtgattt

SEQ ID NO: 328294 - DNA, 25 bp, Rattus norvegicus
gactgctttgtatgtcaggccattt

SEQ ID NO: 328295 - DNA, 25 bp, Rattus norvegicus
gactgctttgtatgttttgtgattt

SEQ ID NO: 328296 - DNA, 25 bp, Rattus norvegicus
gactgcttttaaccatgacgtacta

SEQ ID NO: 328297 - DNA, 25 bp, Rattus norvegicus
gactgcttttaagcatgacgtacta

SEQ ID NO: 328298 - DNA, 25 bp, Rattus norvegicus
gactgcttttgtatacacttccggg

SEQ ID NO: 328299 - DNA, 25 bp, Rattus norvegicus
gactgcttttgtttacacttccggg

SEQ ID NO: 328300 - DNA, 25 bp, Rattus norvegicus
gactgctttttgcttctgtattgag

SEQ ID NO: 328301 - DNA, 25 bp, Rattus norvegicus
gactgctttttggttctgtattgag

SEQ ID NO: 328302 - DNA, 25 bp, Rattus norvegicus
gactggaaagacaattgctccctcc

SEQ ID NO: 328303 - DNA, 25 bp, Rattus norvegicus
gactggaaagactattgctccctcc

SEQ ID NO: 328304 - DNA, 25 bp, Rattus norvegicus
gactggaaagctaagaatcactcgg

SEQ ID NO: 328305 - DNA, 25 bp, Rattus norvegicus
gactggaaagcttagaatcactcgg

SEQ ID NO: 328306 - DNA, 25 bp, Rattus norvegicus
gactggaaagtcatgtgttcacgct

SEQ ID NO: 328307 - DNA, 25 bp, Rattus norvegicus
gactggaaagtcttgtgttcacgct

SEQ ID NO: 328308 - DNA, 25 bp, Rattus norvegicus
gactggaaagttagcaaaccctggt

SEQ ID NO: 328309 - DNA, 25 bp, Rattus norvegicus
gactggaaagtttgcaaaccctggt

SEQ ID NO: 328310 - DNA, 25 bp, Rattus norvegicus
gactggaaatccctgctgtggtttt

SEQ ID NO: 328311 - DNA, 25 bp, Rattus norvegicus
gactggaaatccgtgctgtggtttt

SEQ ID NO: 328312 - DNA, 25 bp, Rattus norvegicus
gactggaacaagcatgtgcctgaga

SEQ ID NO: 328313 - DNA, 25 bp, Rattus norvegicus
gactggaacaaggatgtgcctgaga

SEQ ID NO: 328314 - DNA, 25 bp, Rattus norvegicus
gactggaacaatacagccactgtga

SEQ ID NO: 328315 - DNA, 25 bp, Rattus norvegicus
gactggaacaattcagccactgtga

SEQ ID NO: 328316 - DNA, 25 bp, Rattus norvegicus
gactggaacagaccactctttggaa

SEQ ID NO: 328317 - DNA, 25 bp, Rattus norvegicus
gactggaacagagcactctttggaa

SEQ ID NO: 328318 - DNA, 25 bp, Rattus norvegicus
gactggaacagtaatcgtttagtga

SEQ ID NO: 328319 - DNA, 25 bp, Rattus norvegicus
gactggaacagttatcgtttagtga

SEQ ID NO: 328320 - DNA, 25 bp, Rattus norvegicus
gactggaaccacatgaccggaagta

SEQ ID NO: 328321 - DNA, 25 bp, Rattus norvegicus
gactggaaccacttgaccggaagta

SEQ ID NO: 328322 - DNA, 25 bp, Rattus norvegicus
gactggaacctacattcgagattga

SEQ ID NO: 328323 - DNA, 25 bp, Rattus norvegicus
gactggaacctagattcgagattga

SEQ ID NO: 328324 - DNA, 25 bp, Rattus norvegicus
gactggaagcgtcatctccaagccc

SEQ ID NO: 328325 - DNA, 25 bp, Rattus norvegicus
gactggaagcgtgatctccaagccc

SEQ ID NO: 328326 - DNA, 25 bp, Rattus norvegicus
gactggaaggatccatggaccgtaa

SEQ ID NO: 328327 - DNA, 25 bp, Rattus norvegicus
gactggaaggatgcatggaccgtaa

SEQ ID NO: 328328 - DNA, 25 bp, Rattus norvegicus
gactggaatctgcttgttaaccatt

SEQ ID NO: 328329 - DNA, 25 bp, Rattus norvegicus
gactggaatctggttgttaaccatt

SEQ ID NO: 328330 - DNA, 25 bp, Rattus norvegicus
gactggaatgatcttctcgcagatt

SEQ ID NO: 328331 - DNA, 25 bp, Rattus norvegicus
gactggaatgatgttctcgcagatt

SEQ ID NO: 328332 - DNA, 25 bp, Rattus norvegicus
gactggaatgcacatggcagcacat

SEQ ID NO: 328333 - DNA, 25 bp, Rattus norvegicus
gactggaatgcagatggcagcacat

SEQ ID NO: 328334 - DNA, 25 bp, Rattus norvegicus
gactggaattgcaacttgtcctttt

SEQ ID NO: 328335 - DNA, 25 bp, Rattus norvegicus
gactggaattgctacttgtcctttt

SEQ ID NO: 328336 - DNA, 25 bp, Rattus norvegicus
gactggaattgtcgctgttctgatt

SEQ ID NO: 328337 - DNA, 25 bp, Rattus norvegicus
gactggaattgtggctgttctgatt

SEQ ID NO: 328338 - DNA, 25 bp, Rattus norvegicus
gactggacaaagagcagctccttct

SEQ ID NO: 328339 - DNA, 25 bp, Rattus norvegicus
gactggacaaagtgcagctccttct

SEQ ID NO: 328340 - DNA, 25 bp, Rattus norvegicus
gactggacaattaagtggccctgat

SEQ ID NO: 328341 - DNA, 25 bp, Rattus norvegicus
gactggacaatttagtggccctgat

SEQ ID NO: 328342 - DNA, 25 bp, Rattus norvegicus
gactggacaccaacaaaccttgcaa

SEQ ID NO: 328343 - DNA, 25 bp, Rattus norvegicus
gactggacaccatcaaaccttgcaa

SEQ ID NO: 328344 - DNA, 25 bp, Rattus norvegicus
gactggacaccgactaaggactggg

SEQ ID NO: 328345 - DNA, 25 bp, Rattus norvegicus
gactggacaccgtctaaggactggg

SEQ ID NO: 328346 - DNA, 25 bp, Rattus norvegicus
gactggacagacattcttggagagt

SEQ ID NO: 328347 - DNA, 25 bp, Rattus norvegicus
gactggacagactttcttggagagt

SEQ ID NO: 328348 - DNA, 25 bp, Rattus norvegicus
gactggacaggtactgggcattata

SEQ ID NO: 328349 - DNA, 25 bp, Rattus norvegicus
gactggacaggttctgggcattata

SEQ ID NO: 328350 - DNA, 25 bp, Rattus norvegicus
gactggacatgacattggtctctat

SEQ ID NO: 328351 - DNA, 25 bp, Rattus norvegicus
gactggacatgagattggtctctat

SEQ ID NO: 328352 - DNA, 25 bp, Rattus norvegicus
gactggacccaacaaggctgtgtga

SEQ ID NO: 328353 - DNA, 25 bp, Rattus norvegicus
gactggacccaagaaggctgtgtga

SEQ ID NO: 328354 - DNA, 25 bp, Rattus norvegicus
gactggacccataggtggaaggaaa

SEQ ID NO: 328355 - DNA, 25 bp, Rattus norvegicus
gactggacccattggtggaaggaaa

SEQ ID NO: 328356 - DNA, 25 bp, Rattus norvegicus
gactggacctgcaccgaaggcattg

SEQ ID NO: 328357 - DNA, 25 bp, Rattus norvegicus
gactggacctgctccgaaggcattg

SEQ ID NO: 328358 - DNA, 25 bp, Rattus norvegicus
gactggaccttgaggtacataccta

SEQ ID NO: 328359 - DNA, 25 bp, Rattus norvegicus
gactggaccttgtggtacataccta

SEQ ID NO: 328360 - DNA, 25 bp, Rattus norvegicus
gactggacgatgagctacttttgtt

SEQ ID NO: 328361 - DNA, 25 bp, Rattus norvegicus
gactggacgatgtgctacttttgtt

SEQ ID NO: 328362 - DNA, 25 bp, Rattus norvegicus
gactggacgggaatacttcatgcta

SEQ ID NO: 328363 - DNA, 25 bp, Rattus norvegicus
gactggacgggattacttcatgcta

SEQ ID NO: 328364 - DNA, 25 bp, Rattus norvegicus
gactggactacaattttaaccgaca

SEQ ID NO: 328365 - DNA, 25 bp, Rattus norvegicus
gactggactacatttttaaccgaca

SEQ ID NO: 328366 - DNA, 25 bp, Rattus norvegicus
gactggactcacatacctggacaag

SEQ ID NO: 328367 - DNA, 25 bp, Rattus norvegicus
gactggactcacttacctggacaag

SEQ ID NO: 328368 - DNA, 25 bp, Rattus norvegicus
gactggactccaaggacaggaacgc

SEQ ID NO: 328369 - DNA, 25 bp, Rattus norvegicus
gactggactccaattgcttgtcgag

SEQ ID NO: 328370 - DNA, 25 bp, Rattus norvegicus
gactggactccatggacaggaacgc

SEQ ID NO: 328371 - DNA, 25 bp, Rattus norvegicus
gactggactccatttgcttgtcgag

SEQ ID NO: 328372 - DNA, 25 bp, Rattus norvegicus
gactggactgcaagaggccctgtga

SEQ ID NO: 328373 - DNA, 25 bp, Rattus norvegicus
gactggactgcatgaggccctgtga

SEQ ID NO: 328374 - DNA, 25 bp, Rattus norvegicus
gactggactggactgtgtcagcatt

SEQ ID NO: 328375 - DNA, 25 bp, Rattus norvegicus
gactggactggagtgtgtcagcatt

SEQ ID NO: 328376 - DNA, 25 bp, Rattus norvegicus
gactggagaagcactgtgaagtgac

SEQ ID NO: 328377 - DNA, 25 bp, Rattus norvegicus
gactggagaagctctgtgaagtgac

SEQ ID NO: 328378 - DNA, 25 bp, Rattus norvegicus
gactggagacttcttactctgtggc

SEQ ID NO: 328379 - DNA, 25 bp, Rattus norvegicus
gactggagacttgttactctgtggc

SEQ ID NO: 328380 - DNA, 25 bp, Rattus norvegicus
gactggagagataccacgaaagaat

SEQ ID NO: 328381 - DNA, 25 bp, Rattus norvegicus
gactggagagattccacgaaagaat

SEQ ID NO: 328382 - DNA, 25 bp, Rattus norvegicus
gactggagcagtatgcagtgccgct

SEQ ID NO: 328383 - DNA, 25 bp, Rattus norvegicus
gactggagcagtcatgttcaaacgt

SEQ ID NO: 328384 - DNA, 25 bp, Rattus norvegicus
gactggagcagtgatgttcaaacgt

SEQ ID NO: 328385 - DNA, 25 bp, Rattus norvegicus
gactggagcagtttgcagtgccgct

SEQ ID NO: 328386 - DNA, 25 bp, Rattus norvegicus
gactggagcccaacgatattgtgta

SEQ ID NO: 328387 - DNA, 25 bp, Rattus norvegicus
gactggagcccatcgatattgtgta

SEQ ID NO: 328388 - DNA, 25 bp, Rattus norvegicus
gactggagccttaggcatcctggca

SEQ ID NO: 328389 - DNA, 25 bp, Rattus norvegicus
gactggagcctttggcatcctggca

SEQ ID NO: 328390 - DNA, 25 bp, Rattus norvegicus
gactggagcgtgcagcactctctat

SEQ ID NO: 328391 - DNA, 25 bp, Rattus norvegicus
gactggagcgtggagcactctctat

SEQ ID NO: 328392 - DNA, 25 bp, Rattus norvegicus
gactggagctacacccaatgggact

SEQ ID NO: 328393 - DNA, 25 bp, Rattus norvegicus
gactggagctactcccaatgggact

SEQ ID NO: 328394 - DNA, 25 bp, Rattus norvegicus
gactggaggccgaacaccgcacaac

SEQ ID NO: 328395 - DNA, 25 bp, Rattus norvegicus
gactggaggccgtacaccgcacaac

SEQ ID NO: 328396 - DNA, 25 bp, Rattus norvegicus
gactggaggtgacagttcctcccct

SEQ ID NO: 328397 - DNA, 25 bp, Rattus norvegicus
gactggaggtgagagttcctcccct

SEQ ID NO: 328398 - DNA, 25 bp, Rattus norvegicus
gactggagtaacagtgtgttttgaa

SEQ ID NO: 328399 - DNA, 25 bp, Rattus norvegicus
gactggagtaactgtgtgttttgaa

SEQ ID NO: 328400 - DNA, 25 bp, Rattus norvegicus
gactggagtcacagtgtctacacca

SEQ ID NO: 328401 - DNA, 25 bp, Rattus norvegicus
gactggagtcactgtgtctacacca

SEQ ID NO: 328402 - DNA, 25 bp, Rattus norvegicus
gactggagtcctctctaaactgtta

SEQ ID NO: 328403 - DNA, 25 bp, Rattus norvegicus
gactggagtcctgtctaaactgtta

SEQ ID NO: 328404 - DNA, 25 bp, Rattus norvegicus
gactggagtgcacgctcagcagctt

SEQ ID NO: 328405 - DNA, 25 bp, Rattus norvegicus
gactggagtgcaggctcagcagctt

SEQ ID NO: 328406 - DNA, 25 bp, Rattus norvegicus
gactggagtgtgcaagaccttccct

SEQ ID NO: 328407 - DNA, 25 bp, Rattus norvegicus
gactggagtgtggaagaccttccct

SEQ ID NO: 328408 - DNA, 25 bp, Rattus norvegicus
gactggatacagcttcctaggaatt

SEQ ID NO: 328409 - DNA, 25 bp, Rattus norvegicus
gactggatacaggttcctaggaatt

SEQ ID NO: 328410 - DNA, 25 bp, Rattus norvegicus
gactggataccccaactcaattgta

SEQ ID NO: 328411 - DNA, 25 bp, Rattus norvegicus
gactggatacccgaactcaattgta

SEQ ID NO: 328412 - DNA, 25 bp, Rattus norvegicus
gactggatagttcgagctcccttta

SEQ ID NO: 328413 - DNA, 25 bp, Rattus norvegicus
gactggatagttggagctcccttta

SEQ ID NO: 328414 - DNA, 25 bp, Rattus norvegicus
gactggatcaacacggtgattgcaa

SEQ ID NO: 328415 - DNA, 25 bp, Rattus norvegicus
gactggatcaactcggtgattgcaa

SEQ ID NO: 328416 - DNA, 25 bp, Rattus norvegicus
gactggatccagcttagcaacatga

SEQ ID NO: 328417 - DNA, 25 bp, Rattus norvegicus
gactggatccaggttagcaacatga

SEQ ID NO: 328418 - DNA, 25 bp, Rattus norvegicus
gactggatctcacccatgtctggaa

SEQ ID NO: 328419 - DNA, 25 bp, Rattus norvegicus
gactggatctcagccatgtctggaa

SEQ ID NO: 328420 - DNA, 25 bp, Rattus norvegicus
gactggatgaatccttccttctcgg

SEQ ID NO: 328421 - DNA, 25 bp, Rattus norvegicus
gactggatgaatgcttccttctcgg

SEQ ID NO: 328422 - DNA, 25 bp, Rattus norvegicus
gactggatgattaccacacacattg

SEQ ID NO: 328423 - DNA, 25 bp, Rattus norvegicus
gactggatgatttccacacacattg

SEQ ID NO: 328424 - DNA, 25 bp, Rattus norvegicus
gactggatgggcacaagcttggtcc

SEQ ID NO: 328425 - DNA, 25 bp, Rattus norvegicus
gactggatgggctcaagcttggtcc

SEQ ID NO: 328426 - DNA, 25 bp, Rattus norvegicus
gactggatgtagaaaccattcctta

SEQ ID NO: 328427 - DNA, 25 bp, Rattus norvegicus
gactggatgtagtaaccattcctta

SEQ ID NO: 328428 - DNA, 25 bp, Rattus norvegicus
gactggatgtccatgtatttctgtg

SEQ ID NO: 328429 - DNA, 25 bp, Rattus norvegicus
gactggatgtccttgtatttctgtg

SEQ ID NO: 328430 - DNA, 25 bp, Rattus norvegicus
gactggatgtttaaagacgctctca

SEQ ID NO: 328431 - DNA, 25 bp, Rattus norvegicus
gactggatgttttaagacgctctca

SEQ ID NO: 328432 - DNA, 25 bp, Rattus norvegicus
gactggattcttcgatactgcatgg

SEQ ID NO: 328433 - DNA, 25 bp, Rattus norvegicus
gactggattcttggatactgcatgg

SEQ ID NO: 328434 - DNA, 25 bp, Rattus norvegicus
gactggattgttctcagggctacac

SEQ ID NO: 328435 - DNA, 25 bp, Rattus norvegicus
gactggattgttgtcagggctacac

SEQ ID NO: 328436 - DNA, 25 bp, Rattus norvegicus
gactggatttcacccgactaaaaag

SEQ ID NO: 328437 - DNA, 25 bp, Rattus norvegicus
gactggatttcaccttttggctctt

SEQ ID NO: 328438 - DNA, 25 bp, Rattus norvegicus
gactggatttcagccgactaaaaag

SEQ ID NO: 328439 - DNA, 25 bp, Rattus norvegicus
gactggatttcagcttttggctctt

SEQ ID NO: 328440 - DNA, 25 bp, Rattus norvegicus
gactggatttgaacttcctgttctg

SEQ ID NO: 328441 - DNA, 25 bp, Rattus norvegicus
gactggatttgatcttcctgttctg

SEQ ID NO: 328442 - DNA, 25 bp, Rattus norvegicus
gactggattttgataacgttcatga

SEQ ID NO: 328443 - DNA, 25 bp, Rattus norvegicus
gactggattttgttaacgttcatga

SEQ ID NO: 328444 - DNA, 25 bp, Rattus norvegicus
gactggcaaagcctaaacccttagg

SEQ ID NO: 328445 - DNA, 25 bp, Rattus norvegicus
gactggcaaagcgtaaacccttagg

SEQ ID NO: 328446 - DNA, 25 bp, Rattus norvegicus
gactggcaaagtcccacttcaaaaa

SEQ ID NO: 328447 - DNA, 25 bp, Rattus norvegicus
gactggcaaagtgccacttcaaaaa

SEQ ID NO: 328448 - DNA, 25 bp, Rattus norvegicus
gactggcaaccaatttattcccaac

SEQ ID NO: 328449 - DNA, 25 bp, Rattus norvegicus
gactggcaaccattttattcccaac

SEQ ID NO: 328450 - DNA, 25 bp, Rattus norvegicus
gactggcaacgcacatatttatttc

SEQ ID NO: 328451 - DNA, 25 bp, Rattus norvegicus
gactggcaacgctcatatttatttc

SEQ ID NO: 328452 - DNA, 25 bp, Rattus norvegicus
gactggcaagcaaagtttataaacc

SEQ ID NO: 328453 - DNA, 25 bp, Rattus norvegicus
gactggcaagcatagtttataaacc

SEQ ID NO: 328454 - DNA, 25 bp, Rattus norvegicus
gactggcaatggactctgaaatcct

SEQ ID NO: 328455 - DNA, 25 bp, Rattus norvegicus
gactggcaatggtctctgaaatcct

SEQ ID NO: 328456 - DNA, 25 bp, Rattus norvegicus
gactggcacctcaaggtaaccttgt

SEQ ID NO: 328457 - DNA, 25 bp, Rattus norvegicus
gactggcacctctaggtaaccttgt

SEQ ID NO: 328458 - DNA, 25 bp, Rattus norvegicus
gactggcacggaacatcgaggacaa

SEQ ID NO: 328459 - DNA, 25 bp, Rattus norvegicus
gactggcacggatcatcgaggacaa

SEQ ID NO: 328460 - DNA, 25 bp, Rattus norvegicus
gactggcacgtgacctttgtaggat

SEQ ID NO: 328461 - DNA, 25 bp, Rattus norvegicus
gactggcacgtgtcctttgtaggat

SEQ ID NO: 328462 - DNA, 25 bp, Rattus norvegicus
gactggcactcaacctaatggctaa

SEQ ID NO: 328463 - DNA, 25 bp, Rattus norvegicus
gactggcactcatcctaatggctaa

SEQ ID NO: 328464 - DNA, 25 bp, Rattus norvegicus
gactggcagacaaagtgtgagcatc

SEQ ID NO: 328465 - DNA, 25 bp, Rattus norvegicus
gactggcagacatagtgtgagcatc

SEQ ID NO: 328466 - DNA, 25 bp, Rattus norvegicus
gactggcagcaaatctcagcattgt

SEQ ID NO: 328467 - DNA, 25 bp, Rattus norvegicus
gactggcagcaattctcagcattgt

SEQ ID NO: 328468 - DNA, 25 bp, Rattus norvegicus
gactggcaggtgctcttgcagatac

SEQ ID NO: 328469 - DNA, 25 bp, Rattus norvegicus
gactggcaggtggtcttgcagatac

SEQ ID NO: 328470 - DNA, 25 bp, Rattus norvegicus
gactggcagtgcaccgctgtagaat

SEQ ID NO: 328471 - DNA, 25 bp, Rattus norvegicus
gactggcagtgctccgctgtagaat

SEQ ID NO: 328472 - DNA, 25 bp, Rattus norvegicus
gactggcatagcaactaaccatatt

SEQ ID NO: 328473 - DNA, 25 bp, Rattus norvegicus
gactggcatagctactaaccatatt

SEQ ID NO: 328474 - DNA, 25 bp, Rattus norvegicus
gactggcatctacttctaaattctg

SEQ ID NO: 328475 - DNA, 25 bp, Rattus norvegicus
gactggcatctagttctaaattctg

SEQ ID NO: 328476 - DNA, 25 bp, Rattus norvegicus
gactggcattctatatattctctta

SEQ ID NO: 328477 - DNA, 25 bp, Rattus norvegicus
gactggcattctttatattctctta

SEQ ID NO: 328478 - DNA, 25 bp, Rattus norvegicus
gactggcatttgagtgggttttaac

SEQ ID NO: 328479 - DNA, 25 bp, Rattus norvegicus
gactggcatttgtgtgggttttaac

SEQ ID NO: 328480 - DNA, 25 bp, Rattus norvegicus
gactggccacttcgtgttattgtcc

SEQ ID NO: 328481 - DNA, 25 bp, Rattus norvegicus
gactggccacttggtgttattgtcc

SEQ ID NO: 328482 - DNA, 25 bp, Rattus norvegicus
gactggcccaagcatgttttgacta

SEQ ID NO: 328483 - DNA, 25 bp, Rattus norvegicus
gactggcccaaggatgttttgacta

SEQ ID NO: 328484 - DNA, 25 bp, Rattus norvegicus
gactggcctaagaattcagcactgt

SEQ ID NO: 328485 - DNA, 25 bp, Rattus norvegicus
gactggcctaagtattcagcactgt

SEQ ID NO: 328486 - DNA, 25 bp, Rattus norvegicus
gactggcctcagaaggcatgaaaag

SEQ ID NO: 328487 - DNA, 25 bp, Rattus norvegicus
gactggcctcagtaggcatgaaaag

SEQ ID NO: 328488 - DNA, 25 bp, Rattus norvegicus
gactggcctgaaagagagcatttac

SEQ ID NO: 328489 - DNA, 25 bp, Rattus norvegicus
gactggcctgaatgagagcatttac

SEQ ID NO: 328490 - DNA, 25 bp, Rattus norvegicus
gactggcctggcatttagttcagag

SEQ ID NO: 328491 - DNA, 25 bp, Rattus norvegicus
gactggcctggcttttagttcagag

SEQ ID NO: 328492 - DNA, 25 bp, Rattus norvegicus
gactggcctgggacttgctatagag

SEQ ID NO: 328493 - DNA, 25 bp, Rattus norvegicus
gactggcctgggtcttgctatagag

SEQ ID NO: 328494 - DNA, 25 bp, Rattus norvegicus
gactggcctgtcaatggaaagcact

SEQ ID NO: 328495 - DNA, 25 bp, Rattus norvegicus
gactggcctgtctatggaaagcact

SEQ ID NO: 328496 - DNA, 25 bp, Rattus norvegicus
gactggccttgaaatgaccctccta

SEQ ID NO: 328497 - DNA, 25 bp, Rattus norvegicus
gactggccttgatatgaccctccta

SEQ ID NO: 328498 - DNA, 25 bp, Rattus norvegicus
gactggcgtcttacttctgagggcg

SEQ ID NO: 328499 - DNA, 25 bp, Rattus norvegicus
gactggcgtctttcttctgagggcg

SEQ ID NO: 328500 - DNA, 25 bp, Rattus norvegicus
gactggctaaatctacatgaggaat

SEQ ID NO: 328501 - DNA, 25 bp, Rattus norvegicus
gactggctaaatgtacatgaggaat

SEQ ID NO: 328502 - DNA, 25 bp, Rattus norvegicus
gactggctaaggacgatcagctgaa

SEQ ID NO: 328503 - DNA, 25 bp, Rattus norvegicus
gactggctaaggtcgatcagctgaa

SEQ ID NO: 328504 - DNA, 25 bp, Rattus norvegicus
gactggctacatcaagctaaacgct

SEQ ID NO: 328505 - DNA, 25 bp, Rattus norvegicus
gactggctacatgaagctaaacgct

SEQ ID NO: 328506 - DNA, 25 bp, Rattus norvegicus
gactggctagtgactatctattatg

SEQ ID NO: 328507 - DNA, 25 bp, Rattus norvegicus
gactggctagtgtctatctattatg

SEQ ID NO: 328508 - DNA, 25 bp, Rattus norvegicus
gactggctatctcctttcacacata

SEQ ID NO: 328509 - DNA, 25 bp, Rattus norvegicus
gactggctatctgctttcacacata

SEQ ID NO: 328510 - DNA, 25 bp, Rattus norvegicus
gactggctcaaaaacgtcctggtca

SEQ ID NO: 328511 - DNA, 25 bp, Rattus norvegicus
gactggctcaaatacgtcctggtca

SEQ ID NO: 328512 - DNA, 25 bp, Rattus norvegicus
gactggctcaatcgcaagacgttca

SEQ ID NO: 328513 - DNA, 25 bp, Rattus norvegicus
gactggctcaatggcaagacgttca

SEQ ID NO: 328514 - DNA, 25 bp, Rattus norvegicus
gactggctcaggcaatatccaccta

SEQ ID NO: 328515 - DNA, 25 bp, Rattus norvegicus
gactggctcagggaatatccaccta

SEQ ID NO: 328516 - DNA, 25 bp, Rattus norvegicus
gactggctccatatccaacagaagt

SEQ ID NO: 328517 - DNA, 25 bp, Rattus norvegicus
gactggctccatttccaacagaagt

SEQ ID NO: 328518 - DNA, 25 bp, Rattus norvegicus
gactggctctttcctgtggaaatca

SEQ ID NO: 328519 - DNA, 25 bp, Rattus norvegicus
gactggctctttgctgtggaaatca

SEQ ID NO: 328520 - DNA, 25 bp, Rattus norvegicus
gactggctgcagaggtcacagcttc

SEQ ID NO: 328521 - DNA, 25 bp, Rattus norvegicus
gactggctgcagtggtcacagcttc

SEQ ID NO: 328522 - DNA, 25 bp, Rattus norvegicus
gactggctgcccattgaactgaggg

SEQ ID NO: 328523 - DNA, 25 bp, Rattus norvegicus
gactggctgccctttgaactgaggg

SEQ ID NO: 328524 - DNA, 25 bp, Rattus norvegicus
gactggctgcttctattacatttcc

SEQ ID NO: 328525 - DNA, 25 bp, Rattus norvegicus
gactggctgcttgtattacatttcc

SEQ ID NO: 328526 - DNA, 25 bp, Rattus norvegicus
gactggctggtcatcactctcggtg

SEQ ID NO: 328527 - DNA, 25 bp, Rattus norvegicus
gactggctggtcttcactctcggtg

SEQ ID NO: 328528 - DNA, 25 bp, Rattus norvegicus
gactggctgtttatgcatctgagtt

SEQ ID NO: 328529 - DNA, 25 bp, Rattus norvegicus
gactggctgtttttgcatctgagtt

SEQ ID NO: 328530 - DNA, 25 bp, Rattus norvegicus
gactggcttagtacatttcacattt

SEQ ID NO: 328531 - DNA, 25 bp, Rattus norvegicus
gactggcttagttcatttcacattt

SEQ ID NO: 328532 - DNA, 25 bp, Rattus norvegicus
gactggcttcaacatcagatccaag

SEQ ID NO: 328533 - DNA, 25 bp, Rattus norvegicus
gactggcttcaagatcagatccaag

SEQ ID NO: 328534 - DNA, 25 bp, Rattus norvegicus
gactggcttcttatgactctgaaac

SEQ ID NO: 328535 - DNA, 25 bp, Rattus norvegicus
gactggcttcttttgactctgaaac

SEQ ID NO: 328536 - DNA, 25 bp, Rattus norvegicus
gactggcttgtgaatggaaccggtt

SEQ ID NO: 328537 - DNA, 25 bp, Rattus norvegicus
gactggcttgtgtatggaaccggtt

SEQ ID NO: 328538 - DNA, 25 bp, Rattus norvegicus
gactggctttcccaactgaatgtat

SEQ ID NO: 328539 - DNA, 25 bp, Rattus norvegicus
gactggctttccgaactgaatgtat

SEQ ID NO: 328540 - DNA, 25 bp, Rattus norvegicus
gactgggaaataacctggttctaac

SEQ ID NO: 328541 - DNA, 25 bp, Rattus norvegicus
gactgggaaatatcctggttctaac

SEQ ID NO: 328542 - DNA, 25 bp, Rattus norvegicus
gactgggaagatccatttcgcagat

SEQ ID NO: 328543 - DNA, 25 bp, Rattus norvegicus
gactgggaagatgcatttcgcagat

SEQ ID NO: 328544 - DNA, 25 bp, Rattus norvegicus
gactgggaatcaatcttgggtttgt

SEQ ID NO: 328545 - DNA, 25 bp, Rattus norvegicus
gactgggaatcattcttgggtttgt

SEQ ID NO: 328546 - DNA, 25 bp, Rattus norvegicus
gactgggaccccacttgcatgaaga

SEQ ID NO: 328547 - DNA, 25 bp, Rattus norvegicus
gactgggacccctcttgcatgaaga

SEQ ID NO: 328548 - DNA, 25 bp, Rattus norvegicus
gactgggagattacctttgattatt

SEQ ID NO: 328549 - DNA, 25 bp, Rattus norvegicus
gactgggagatttcctttgattatt

SEQ ID NO: 328550 - DNA, 25 bp, Rattus norvegicus
gactgggatcaaaacaggaccggaa

SEQ ID NO: 328551 - DNA, 25 bp, Rattus norvegicus
gactgggatcaatacaggaccggaa

SEQ ID NO: 328552 - DNA, 25 bp, Rattus norvegicus
gactgggatccacaactttatagac

SEQ ID NO: 328553 - DNA, 25 bp, Rattus norvegicus
gactgggatccacaagaccttatca

SEQ ID NO: 328554 - DNA, 25 bp, Rattus norvegicus
gactgggatccagaactttatagac

SEQ ID NO: 328555 - DNA, 25 bp, Rattus norvegicus
gactgggatccagaagaccttatca

SEQ ID NO: 328556 - DNA, 25 bp, Rattus norvegicus
gactgggatgcaatttggagtcctt

SEQ ID NO: 328557 - DNA, 25 bp, Rattus norvegicus
gactgggatgcattttggagtcctt

SEQ ID NO: 328558 - DNA, 25 bp, Rattus norvegicus
gactgggcaaagctagagccctgcc

SEQ ID NO: 328559 - DNA, 25 bp, Rattus norvegicus
gactgggcaaaggtagagccctgcc

SEQ ID NO: 328560 - DNA, 25 bp, Rattus norvegicus
gactgggcacacatcctgactggga

SEQ ID NO: 328561 - DNA, 25 bp, Rattus norvegicus
gactgggcacacttcctgactggga

SEQ ID NO: 328562 - DNA, 25 bp, Rattus norvegicus
gactgggcacccaaagctggtaaat

SEQ ID NO: 328563 - DNA, 25 bp, Rattus norvegicus
gactgggcaccctaagctggtaaat

SEQ ID NO: 328564 - DNA, 25 bp, Rattus norvegicus
gactgggcattgaactctgatcctt

SEQ ID NO: 328565 - DNA, 25 bp, Rattus norvegicus
gactgggcattgtactctgatcctt

SEQ ID NO: 328566 - DNA, 25 bp, Rattus norvegicus
gactgggccataaatgtagtaagac

SEQ ID NO: 328567 - DNA, 25 bp, Rattus norvegicus
gactgggccatatatgtagtaagac

SEQ ID NO: 328568 - DNA, 25 bp, Rattus norvegicus
gactgggcccaaaatttgcgtgttt

SEQ ID NO: 328569 - DNA, 25 bp, Rattus norvegicus
gactgggcccaatatttgcgtgttt

SEQ ID NO: 328570 - DNA, 25 bp, Rattus norvegicus
gactgggcccatctaggagcagctt

SEQ ID NO: 328571 - DNA, 25 bp, Rattus norvegicus
gactgggcccatgtaggagcagctt

SEQ ID NO: 328572 - DNA, 25 bp, Rattus norvegicus
gactgggccctcattttgtgctgta

SEQ ID NO: 328573 - DNA, 25 bp, Rattus norvegicus
gactgggccctctttttgtgctgta

SEQ ID NO: 328574 - DNA, 25 bp, Rattus norvegicus
gactgggcctgtagtggacttttga

SEQ ID NO: 328575 - DNA, 25 bp, Rattus norvegicus
gactgggcctgttgtggacttttga

SEQ ID NO: 328576 - DNA, 25 bp, Rattus norvegicus
gactgggctaaaactactgtttcaa

SEQ ID NO: 328577 - DNA, 25 bp, Rattus norvegicus
gactgggctaaatctactgtttcaa

SEQ ID NO: 328578 - DNA, 25 bp, Rattus norvegicus
gactgggctactagggtgatgcact

SEQ ID NO: 328579 - DNA, 25 bp, Rattus norvegicus
gactgggctacttgggtgatgcact

SEQ ID NO: 328580 - DNA, 25 bp, Rattus norvegicus
gactgggctcacctgctactgagga

SEQ ID NO: 328581 - DNA, 25 bp, Rattus norvegicus
gactgggctcacgtgctactgagga

SEQ ID NO: 328582 - DNA, 25 bp, Rattus norvegicus
gactgggtaccaaagcctttggaaa

SEQ ID NO: 328583 - DNA, 25 bp, Rattus norvegicus
gactgggtaccatagcctttggaaa

SEQ ID NO: 328584 - DNA, 25 bp, Rattus norvegicus
gactgggtagccaacaaaccctagg

SEQ ID NO: 328585 - DNA, 25 bp, Rattus norvegicus
gactgggtagcctacaaaccctagg

SEQ ID NO: 328586 - DNA, 25 bp, Rattus norvegicus
gactgggtcacacggtgcactagca

SEQ ID NO: 328587 - DNA, 25 bp, Rattus norvegicus
gactgggtcacagggtgcactagca

SEQ ID NO: 328588 - DNA, 25 bp, Rattus norvegicus
gactgggtcaccaatgagctgaatc

SEQ ID NO: 328589 - DNA, 25 bp, Rattus norvegicus
gactgggtcacctatgagctgaatc

SEQ ID NO: 328590 - DNA, 25 bp, Rattus norvegicus
gactgggtcatgacataagactcct

SEQ ID NO: 328591 - DNA, 25 bp, Rattus norvegicus
gactgggtcatgtcataagactcct

SEQ ID NO: 328592 - DNA, 25 bp, Rattus norvegicus
gactgggtccagatcgggtctaaaa

SEQ ID NO: 328593 - DNA, 25 bp, Rattus norvegicus
gactgggtccagttcgggtctaaaa

SEQ ID NO: 328594 - DNA, 25 bp, Rattus norvegicus
gactgggtcgtgactaatgcttaca

SEQ ID NO: 328595 - DNA, 25 bp, Rattus norvegicus
gactgggtcgtgtctaatgcttaca

SEQ ID NO: 328596 - DNA, 25 bp, Rattus norvegicus
gactgggtctctatcgtaaagcatc

SEQ ID NO: 328597 - DNA, 25 bp, Rattus norvegicus
gactgggtctctttcgtaaagcatc

SEQ ID NO: 328598 - DNA, 25 bp, Rattus norvegicus
gactgggtcttaccaagtagccctg

SEQ ID NO: 328599 - DNA, 25 bp, Rattus norvegicus
gactgggtcttagcaagtagccctg

SEQ ID NO: 328600 - DNA, 25 bp, Rattus norvegicus
gactgggtgaacatgtacatcaact

SEQ ID NO: 328601 - DNA, 25 bp, Rattus norvegicus
gactgggtgaacttgtacatcaact

SEQ ID NO: 328602 - DNA, 25 bp, Rattus norvegicus
gactgggtgaccacaaccaagccat

SEQ ID NO: 328603 - DNA, 25 bp, Rattus norvegicus
gactgggtgacctcaaccaagccat

SEQ ID NO: 328604 - DNA, 25 bp, Rattus norvegicus
gactgggtgactaatctttgtggcg

SEQ ID NO: 328605 - DNA, 25 bp, Rattus norvegicus
gactgggtgactacaacacactctg

SEQ ID NO: 328606 - DNA, 25 bp, Rattus norvegicus
gactgggtgacttatctttgtggcg

SEQ ID NO: 328607 - DNA, 25 bp, Rattus norvegicus
gactgggtgacttcaacacactctg

SEQ ID NO: 328608 - DNA, 25 bp, Rattus norvegicus
gactgggtggtcaagttctgtgtcc

SEQ ID NO: 328609 - DNA, 25 bp, Rattus norvegicus
gactgggtggtctagttctgtgtcc

SEQ ID NO: 328610 - DNA, 25 bp, Rattus norvegicus
gactgggtgtccagtagcatcacca

SEQ ID NO: 328611 - DNA, 25 bp, Rattus norvegicus
gactgggtgtcctgtagcatcacca

SEQ ID NO: 328612 - DNA, 25 bp, Rattus norvegicus
gactgggttctaacattctgacctt

SEQ ID NO: 328613 - DNA, 25 bp, Rattus norvegicus
gactgggttctatcattctgacctt

SEQ ID NO: 328614 - DNA, 25 bp, Rattus norvegicus
gactgggttctcatgcggtactaac

SEQ ID NO: 328615 - DNA, 25 bp, Rattus norvegicus
gactgggttctcttgcggtactaac

SEQ ID NO: 328616 - DNA, 25 bp, Rattus norvegicus
gactgggttgggattccccaagcag

SEQ ID NO: 328617 - DNA, 25 bp, Rattus norvegicus
gactgggttgggtttccccaagcag

SEQ ID NO: 328618 - DNA, 25 bp, Rattus norvegicus
gactgggttttacttctttcttctg

SEQ ID NO: 328619 - DNA, 25 bp, Rattus norvegicus
gactgggttttagttctttcttctg

SEQ ID NO: 328620 - DNA, 25 bp, Rattus norvegicus
gactggtaacgaaaagtggacccat

SEQ ID NO: 328621 - DNA, 25 bp, Rattus norvegicus
gactggtaacgataagtggacccat

SEQ ID NO: 328622 - DNA, 25 bp, Rattus norvegicus
gactggtaccaaagactgtcctctg

SEQ ID NO: 328623 - DNA, 25 bp, Rattus norvegicus
gactggtaccaatgactgtcctctg

SEQ ID NO: 328624 - DNA, 25 bp, Rattus norvegicus
gactggtaggctcacaagactgata

SEQ ID NO: 328625 - DNA, 25 bp, Rattus norvegicus
gactggtaggctgacaagactgata

SEQ ID NO: 328626 - DNA, 25 bp, Rattus norvegicus
gactggtatcataagctctgctgca

SEQ ID NO: 328627 - DNA, 25 bp, Rattus norvegicus
gactggtatcattagctctgctgca

SEQ ID NO: 328628 - DNA, 25 bp, Rattus norvegicus
gactggtatctcaggatgtatctgt

SEQ ID NO: 328629 - DNA, 25 bp, Rattus norvegicus
gactggtatctctggatgtatctgt

SEQ ID NO: 328630 - DNA, 25 bp, Rattus norvegicus
gactggtcaaggaggttccaaactt

SEQ ID NO: 328631 - DNA, 25 bp, Rattus norvegicus
gactggtcaaggtggttccaaactt

SEQ ID NO: 328632 - DNA, 25 bp, Rattus norvegicus
gactggtcacatcgttttacactgg

SEQ ID NO: 328633 - DNA, 25 bp, Rattus norvegicus
gactggtcacatggttttacactgg

SEQ ID NO: 328634 - DNA, 25 bp, Rattus norvegicus
gactggtcagttcctacaatcaaaa

SEQ ID NO: 328635 - DNA, 25 bp, Rattus norvegicus
gactggtcagttgctacaatcaaaa

SEQ ID NO: 328636 - DNA, 25 bp, Rattus norvegicus
gactggtcctgacaggtcctcacag

SEQ ID NO: 328637 - DNA, 25 bp, Rattus norvegicus
gactggtcctgagaggtcctcacag

SEQ ID NO: 328638 - DNA, 25 bp, Rattus norvegicus
gactggtcctttcccagtattgaat

SEQ ID NO: 328639 - DNA, 25 bp, Rattus norvegicus
gactggtcctttgccagtattgaat

SEQ ID NO: 328640 - DNA, 25 bp, Rattus norvegicus
gactggtcgctcacttggacgatga

SEQ ID NO: 328641 - DNA, 25 bp, Rattus norvegicus
gactggtcgctctcttggacgatga

SEQ ID NO: 328642 - DNA, 25 bp, Rattus norvegicus
gactggtctagaatgctttctatga

SEQ ID NO: 328643 - DNA, 25 bp, Rattus norvegicus
gactggtctagattgctttctatga

SEQ ID NO: 328644 - DNA, 25 bp, Rattus norvegicus
gactggtctcaacttctgatactgc

SEQ ID NO: 328645 - DNA, 25 bp, Rattus norvegicus
gactggtctcaagttctgatactgc

SEQ ID NO: 328646 - DNA, 25 bp, Rattus norvegicus
gactggtctcatatgcgtggtatca

SEQ ID NO: 328647 - DNA, 25 bp, Rattus norvegicus
gactggtctcatttgcgtggtatca

SEQ ID NO: 328648 - DNA, 25 bp, Rattus norvegicus
gactggtctggcaaagatactttat

SEQ ID NO: 328649 - DNA, 25 bp, Rattus norvegicus
gactggtctggcattatttgacact

SEQ ID NO: 328650 - DNA, 25 bp, Rattus norvegicus
gactggtctggctaagatactttat

SEQ ID NO: 328651 - DNA, 25 bp, Rattus norvegicus
gactggtctggctttatttgacact

SEQ ID NO: 328652 - DNA, 25 bp, Rattus norvegicus
gactggtctttgaaaacatacccaa

SEQ ID NO: 328653 - DNA, 25 bp, Rattus norvegicus
gactggtctttgtaaacatacccaa

SEQ ID NO: 328654 - DNA, 25 bp, Rattus norvegicus
gactggtgaacaaagccgcttgtct

SEQ ID NO: 328655 - DNA, 25 bp, Rattus norvegicus
gactggtgaacatagccgcttgtct

SEQ ID NO: 328656 - DNA, 25 bp, Rattus norvegicus
gactggtgacacactgtattttgta

SEQ ID NO: 328657 - DNA, 25 bp, Rattus norvegicus
gactggtgacactctgtattttgta

SEQ ID NO: 328658 - DNA, 25 bp, Rattus norvegicus
gactggtgacagagtacttccctag

SEQ ID NO: 328659 - DNA, 25 bp, Rattus norvegicus
gactggtgacagtgtacttccctag

SEQ ID NO: 328660 - DNA, 25 bp, Rattus norvegicus
gactggtgacttcgagagagctcta

SEQ ID NO: 328661 - DNA, 25 bp, Rattus norvegicus
gactggtgacttggagagagctcta

SEQ ID NO: 328662 - DNA, 25 bp, Rattus norvegicus
gactggtgagttcaaattgcgtaag

SEQ ID NO: 328663 - DNA, 25 bp, Rattus norvegicus
gactggtgagttgaaattgcgtaag

SEQ ID NO: 328664 - DNA, 25 bp, Rattus norvegicus
gactggtgataacctactgctccta

SEQ ID NO: 328665 - DNA, 25 bp, Rattus norvegicus
gactggtgataagctactgctccta

SEQ ID NO: 328666 - DNA, 25 bp, Rattus norvegicus
gactggtgatgaaagctgactcctt

SEQ ID NO: 328667 - DNA, 25 bp, Rattus norvegicus
gactggtgatgatagctgactcctt

SEQ ID NO: 328668 - DNA, 25 bp, Rattus norvegicus
gactggtgcgtgcagagctgagaag

SEQ ID NO: 328669 - DNA, 25 bp, Rattus norvegicus
gactggtgcgtggagagctgagaag

SEQ ID NO: 328670 - DNA, 25 bp, Rattus norvegicus
gactggtggaacactacatcgtact

SEQ ID NO: 328671 - DNA, 25 bp, Rattus norvegicus
gactggtggaactctacatcgtact

SEQ ID NO: 328672 - DNA, 25 bp, Rattus norvegicus
gactggtggtctcaattagtatccc

SEQ ID NO: 328673 - DNA, 25 bp, Rattus norvegicus
gactggtggtctgaattagtatccc

SEQ ID NO: 328674 - DNA, 25 bp, Rattus norvegicus
gactggtggttactgattcccttgg

SEQ ID NO: 328675 - DNA, 25 bp, Rattus norvegicus
gactggtggttagtgattcccttgg

SEQ ID NO: 328676 - DNA, 25 bp, Rattus norvegicus
gactggtgttttcttcgtggtccac

SEQ ID NO: 328677 - DNA, 25 bp, Rattus norvegicus
gactggtgttttgttcgtggtccac

SEQ ID NO: 328678 - DNA, 25 bp, Rattus norvegicus
gactggttaagtctggatcaactca

SEQ ID NO: 328679 - DNA, 25 bp, Rattus norvegicus
gactggttaagtgtggatcaactca

SEQ ID NO: 328680 - DNA, 25 bp, Rattus norvegicus
gactggttactacctgaaccgtgct

SEQ ID NO: 328681 - DNA, 25 bp, Rattus norvegicus
gactggttactagctgaaccgtgct

SEQ ID NO: 328682 - DNA, 25 bp, Rattus norvegicus
gactggttcaaccttgctattctac

SEQ ID NO: 328683 - DNA, 25 bp, Rattus norvegicus
gactggttcaacgttgctattctac

SEQ ID NO: 328684 - DNA, 25 bp, Rattus norvegicus
gactggttcgcccttattaagcaag

SEQ ID NO: 328685 - DNA, 25 bp, Rattus norvegicus
gactggttcgccgttattaagcaag

SEQ ID NO: 328686 - DNA, 25 bp, Rattus norvegicus
gactggttcgttcatctgtacatct

SEQ ID NO: 328687 - DNA, 25 bp, Rattus norvegicus
gactggttcgttgatctgtacatct

SEQ ID NO: 328688 - DNA, 25 bp, Rattus norvegicus
gactggttctctatgaggccttcaa

SEQ ID NO: 328689 - DNA, 25 bp, Rattus norvegicus
gactggttctctttgaggccttcaa

SEQ ID NO: 328690 - DNA, 25 bp, Rattus norvegicus
gactggttggccagttttagtaaca

SEQ ID NO: 328691 - DNA, 25 bp, Rattus norvegicus
gactggttggcctgttttagtaaca

SEQ ID NO: 328692 - DNA, 25 bp, Rattus norvegicus
gactggttgggaaagagacctcaat

SEQ ID NO: 328693 - DNA, 25 bp, Rattus norvegicus
gactggttgggatagagacctcaat

SEQ ID NO: 328694 - DNA, 25 bp, Rattus norvegicus
gactggttgtgcaaacctgtaatcc

SEQ ID NO: 328695 - DNA, 25 bp, Rattus norvegicus
gactggttgtgctaacctgtaatcc

SEQ ID NO: 328696 - DNA, 25 bp, Rattus norvegicus
gactggtttcatctccattcacagt

SEQ ID NO: 328697 - DNA, 25 bp, Rattus norvegicus
gactggtttcatgtccattcacagt

SEQ ID NO: 328698 - DNA, 25 bp, Rattus norvegicus
gactggtttcctcttgggcggcata

SEQ ID NO: 328699 - DNA, 25 bp, Rattus norvegicus
gactggtttcctgttgggcggcata

SEQ ID NO: 328700 - DNA, 25 bp, Rattus norvegicus
gactggtttctgatactattctccg

SEQ ID NO: 328701 - DNA, 25 bp, Rattus norvegicus
gactggtttctgttactattctccg

SEQ ID NO: 328702 - DNA, 25 bp, Rattus norvegicus
gactgtaaatacatggctttctccg

SEQ ID NO: 328703 - DNA, 25 bp, Rattus norvegicus
gactgtaaatacttggctttctccg

SEQ ID NO: 328704 - DNA, 25 bp, Rattus norvegicus
gactgtaacccacagtcagtacact

SEQ ID NO: 328705 - DNA, 25 bp, Rattus norvegicus
gactgtaacccagagtcagtacact

SEQ ID NO: 328706 - DNA, 25 bp, Rattus norvegicus
gactgtaacgtccttcctttaatag

SEQ ID NO: 328707 - DNA, 25 bp, Rattus norvegicus
gactgtaacgtcgttcctttaatag

SEQ ID NO: 328708 - DNA, 25 bp, Rattus norvegicus
gactgtaatcagagactacatgtga

SEQ ID NO: 328709 - DNA, 25 bp, Rattus norvegicus
gactgtaatcagtgactacatgtga

SEQ ID NO: 328710 - DNA, 25 bp, Rattus norvegicus
gactgtaatgtcatcctgggctctg

SEQ ID NO: 328711 - DNA, 25 bp, Rattus norvegicus
gactgtaatgtcttcctgggctctg

SEQ ID NO: 328712 - DNA, 25 bp, Rattus norvegicus
gactgtaatgtgatcactgcctttg

SEQ ID NO: 328713 - DNA, 25 bp, Rattus norvegicus
gactgtaatgtgttcactgcctttg

SEQ ID NO: 328714 - DNA, 25 bp, Rattus norvegicus
gactgtaattttcatgctgctgctg

SEQ ID NO: 328715 - DNA, 25 bp, Rattus norvegicus
gactgtaattttgatgctgctgctg

SEQ ID NO: 328716 - DNA, 25 bp, Rattus norvegicus
gactgtacagggacatgcggatgct

SEQ ID NO: 328717 - DNA, 25 bp, Rattus norvegicus
gactgtacagggtcatgcggatgct

SEQ ID NO: 328718 - DNA, 25 bp, Rattus norvegicus
gactgtacagtcctgatgctgtcag

SEQ ID NO: 328719 - DNA, 25 bp, Rattus norvegicus
gactgtacagtcgtgatgctgtcag

SEQ ID NO: 328720 - DNA, 25 bp, Rattus norvegicus
gactgtaccacacacatgtatactt

SEQ ID NO: 328721 - DNA, 25 bp, Rattus norvegicus
gactgtaccacagacatgtatactt

SEQ ID NO: 328722 - DNA, 25 bp, Rattus norvegicus
gactgtaccagtaagagccgatgaa

SEQ ID NO: 328723 - DNA, 25 bp, Rattus norvegicus
gactgtaccagttagagccgatgaa

SEQ ID NO: 328724 - DNA, 25 bp, Rattus norvegicus
gactgtacccatatagttttggaca

SEQ ID NO: 328725 - DNA, 25 bp, Rattus norvegicus
gactgtacccatttagttttggaca

SEQ ID NO: 328726 - DNA, 25 bp, Rattus norvegicus
gactgtaccctcaaaactctgaagc

SEQ ID NO: 328727 - DNA, 25 bp, Rattus norvegicus
gactgtaccctctaaactctgaagc

SEQ ID NO: 328728 - DNA, 25 bp, Rattus norvegicus
gactgtacctggatttcacttgaat

SEQ ID NO: 328729 - DNA, 25 bp, Rattus norvegicus
gactgtacctggttttcacttgaat

SEQ ID NO: 328730 - DNA, 25 bp, Rattus norvegicus
gactgtaccttcatcaacttgtgag

SEQ ID NO: 328731 - DNA, 25 bp, Rattus norvegicus
gactgtaccttcttcaacttgtgag

SEQ ID NO: 328732 - DNA, 25 bp, Rattus norvegicus
gactgtacgacccaaggacactgta

SEQ ID NO: 328733 - DNA, 25 bp, Rattus norvegicus
gactgtacgaccgaaggacactgta

SEQ ID NO: 328734 - DNA, 25 bp, Rattus norvegicus
gactgtacggttacatctgctgtat

SEQ ID NO: 328735 - DNA, 25 bp, Rattus norvegicus
gactgtacggtttcatctgctgtat

SEQ ID NO: 328736 - DNA, 25 bp, Rattus norvegicus
gactgtacgtgaccggtttccatga

SEQ ID NO: 328737 - DNA, 25 bp, Rattus norvegicus
gactgtacgtgagcggtttccatga

SEQ ID NO: 328738 - DNA, 25 bp, Rattus norvegicus
gactgtactcaaattcgcaaccatt

SEQ ID NO: 328739 - DNA, 25 bp, Rattus norvegicus
gactgtactcaatttcgcaaccatt

SEQ ID NO: 328740 - DNA, 25 bp, Rattus norvegicus
gactgtactcctaacttattggcta

SEQ ID NO: 328741 - DNA, 25 bp, Rattus norvegicus
gactgtactccttacttattggcta

SEQ ID NO: 328742 - DNA, 25 bp, Rattus norvegicus
gactgtactgtcagatgttgtgaaa

SEQ ID NO: 328743 - DNA, 25 bp, Rattus norvegicus
gactgtactgtctgatgttgtgaaa

SEQ ID NO: 328744 - DNA, 25 bp, Rattus norvegicus
gactgtacttctctgattcagctca

SEQ ID NO: 328745 - DNA, 25 bp, Rattus norvegicus
gactgtacttctgtgattcagctca

SEQ ID NO: 328746 - DNA, 25 bp, Rattus norvegicus
gactgtactttgaggtagagccctg

SEQ ID NO: 328747 - DNA, 25 bp, Rattus norvegicus
gactgtactttgtggtagagccctg

SEQ ID NO: 328748 - DNA, 25 bp, Rattus norvegicus
gactgtagactgatttggcctgctg

SEQ ID NO: 328749 - DNA, 25 bp, Rattus norvegicus
gactgtagactgttttggcctgctg

SEQ ID NO: 328750 - DNA, 25 bp, Rattus norvegicus
gactgtagattccattgtagccccg

SEQ ID NO: 328751 - DNA, 25 bp, Rattus norvegicus
gactgtagattcgattgtagccccg

SEQ ID NO: 328752 - DNA, 25 bp, Rattus norvegicus
gactgtagggataacctctgagctg

SEQ ID NO: 328753 - DNA, 25 bp, Rattus norvegicus
gactgtagggattacctctgagctg

SEQ ID NO: 328754 - DNA, 25 bp, Rattus norvegicus
gactgtagtagcaaatgtaacacat

SEQ ID NO: 328755 - DNA, 25 bp, Rattus norvegicus
gactgtagtagctaatgtaacacat

SEQ ID NO: 328756 - DNA, 25 bp, Rattus norvegicus
gactgtagtcccaaaaaagccttgt

SEQ ID NO: 328757 - DNA, 25 bp, Rattus norvegicus
gactgtagtccctaaaaagccttgt

SEQ ID NO: 328758 - DNA, 25 bp, Rattus norvegicus
gactgtagtctcactaaagtggcct

SEQ ID NO: 328759 - DNA, 25 bp, Rattus norvegicus
gactgtagtctctctaaagtggcct

SEQ ID NO: 328760 - DNA, 25 bp, Rattus norvegicus
gactgtagtgtgctgcgtgactatc

SEQ ID NO: 328761 - DNA, 25 bp, Rattus norvegicus
gactgtagtgtggtgcgtgactatc

SEQ ID NO: 328762 - DNA, 25 bp, Rattus norvegicus
gactgtagttttactactgctatga

SEQ ID NO: 328763 - DNA, 25 bp, Rattus norvegicus
gactgtagtttttctactgctatga

SEQ ID NO: 328764 - DNA, 25 bp, Rattus norvegicus
gactgtatacatagcctatgtgcat

SEQ ID NO: 328765 - DNA, 25 bp, Rattus norvegicus
gactgtatacattgcctatgtgcat

SEQ ID NO: 328766 - DNA, 25 bp, Rattus norvegicus
gactgtatagaccagttccgggcca

SEQ ID NO: 328767 - DNA, 25 bp, Rattus norvegicus
gactgtatagacgagttccgggcca

SEQ ID NO: 328768 - DNA, 25 bp, Rattus norvegicus
gactgtatcactccctcagagtata

SEQ ID NO: 328769 - DNA, 25 bp, Rattus norvegicus
gactgtatcactgcctcagagtata

SEQ ID NO: 328770 - DNA, 25 bp, Rattus norvegicus
gactgtatccccagctattgggatc

SEQ ID NO: 328771 - DNA, 25 bp, Rattus norvegicus
gactgtatcccctgctattgggatc

SEQ ID NO: 328772 - DNA, 25 bp, Rattus norvegicus
gactgtatcgacctttgccaggagc

SEQ ID NO: 328773 - DNA, 25 bp, Rattus norvegicus
gactgtatcgacgtttgccaggagc

SEQ ID NO: 328774 - DNA, 25 bp, Rattus norvegicus
gactgtatctgtatgctgtggaaca

SEQ ID NO: 328775 - DNA, 25 bp, Rattus norvegicus
gactgtatctgtttgctgtggaaca

SEQ ID NO: 328776 - DNA, 25 bp, Rattus norvegicus
gactgtatcttcaactcttttctat

SEQ ID NO: 328777 - DNA, 25 bp, Rattus norvegicus
gactgtatcttctactcttttctat

SEQ ID NO: 328778 - DNA, 25 bp, Rattus norvegicus
gactgtatgaggacagccgcgttct

SEQ ID NO: 328779 - DNA, 25 bp, Rattus norvegicus
gactgtatgaggtcagccgcgttct

SEQ ID NO: 328780 - DNA, 25 bp, Rattus norvegicus
gactgtatgatcagagagacctatc

SEQ ID NO: 328781 - DNA, 25 bp, Rattus norvegicus
gactgtatgatctgagagacctatc

SEQ ID NO: 328782 - DNA, 25 bp, Rattus norvegicus
gactgtatgatgcatcttgttttat

SEQ ID NO: 328783 - DNA, 25 bp, Rattus norvegicus
gactgtatgatggatcttgttttat

SEQ ID NO: 328784 - DNA, 25 bp, Rattus norvegicus
gactgtatgccacttctgggcaaca

SEQ ID NO: 328785 - DNA, 25 bp, Rattus norvegicus
gactgtatgccagttctgggcaaca

SEQ ID NO: 328786 - DNA, 25 bp, Rattus norvegicus
gactgtatggcgaggcagacttttt

SEQ ID NO: 328787 - DNA, 25 bp, Rattus norvegicus
gactgtatggcgtggcagacttttt

SEQ ID NO: 328788 - DNA, 25 bp, Rattus norvegicus
gactgtatgtttagcattcctagaa

SEQ ID NO: 328789 - DNA, 25 bp, Rattus norvegicus
gactgtatgttttgcattcctagaa

SEQ ID NO: 328790 - DNA, 25 bp, Rattus norvegicus
gactgtattacacttgatcgggcat

SEQ ID NO: 328791 - DNA, 25 bp, Rattus norvegicus
gactgtattacagttgatcgggcat

SEQ ID NO: 328792 - DNA, 25 bp, Rattus norvegicus
gactgtattagcatatgttctccat

SEQ ID NO: 328793 - DNA, 25 bp, Rattus norvegicus
gactgtattagcttatgttctccat

SEQ ID NO: 328794 - DNA, 25 bp, Rattus norvegicus
gactgtcaaactcaggccagcctga

SEQ ID NO: 328795 - DNA, 25 bp, Rattus norvegicus
gactgtcaaactgaggccagcctga

SEQ ID NO: 328796 - DNA, 25 bp, Rattus norvegicus
gactgtcaagttagcaacccatttt

SEQ ID NO: 328797 - DNA, 25 bp, Rattus norvegicus
gactgtcaagtttgcaacccatttt

SEQ ID NO: 328798 - DNA, 25 bp, Rattus norvegicus
gactgtcaatctacttttaaccaag

SEQ ID NO: 328799 - DNA, 25 bp, Rattus norvegicus
gactgtcaatcttcttttaaccaag

SEQ ID NO: 328800 - DNA, 25 bp, Rattus norvegicus
gactgtcaattgactattttgccat

SEQ ID NO: 328801 - DNA, 25 bp, Rattus norvegicus
gactgtcaattgtctattttgccat

SEQ ID NO: 328802 - DNA, 25 bp, Rattus norvegicus
gactgtcacagtcatactgcccact

SEQ ID NO: 328803 - DNA, 25 bp, Rattus norvegicus
gactgtcacagtgatactgcccact

SEQ ID NO: 328804 - DNA, 25 bp, Rattus norvegicus
gactgtcacattattaagccgcatt

SEQ ID NO: 328805 - DNA, 25 bp, Rattus norvegicus
gactgtcacatttttaagccgcatt

SEQ ID NO: 328806 - DNA, 25 bp, Rattus norvegicus
gactgtcacctgaaagattttctgg

SEQ ID NO: 328807 - DNA, 25 bp, Rattus norvegicus
gactgtcacctgcagatcaagagcc

SEQ ID NO: 328808 - DNA, 25 bp, Rattus norvegicus
gactgtcacctggagatcaagagcc

SEQ ID NO: 328809 - DNA, 25 bp, Rattus norvegicus
gactgtcacctgtaagattttctgg

SEQ ID NO: 328810 - DNA, 25 bp, Rattus norvegicus
gactgtcaccttcggaacgcacgga

SEQ ID NO: 328811 - DNA, 25 bp, Rattus norvegicus
gactgtcaccttgggaacgcacgga

SEQ ID NO: 328812 - DNA, 25 bp, Rattus norvegicus
gactgtcactcaagcaaatgccata

SEQ ID NO: 328813 - DNA, 25 bp, Rattus norvegicus
gactgtcactcatgcaaatgccata

SEQ ID NO: 328814 - DNA, 25 bp, Rattus norvegicus
gactgtcagaatcctattcttttat

SEQ ID NO: 328815 - DNA, 25 bp, Rattus norvegicus
gactgtcagaatgctattcttttat

SEQ ID NO: 328816 - DNA, 25 bp, Rattus norvegicus
gactgtcagagcatccgttcatgga

SEQ ID NO: 328817 - DNA, 25 bp, Rattus norvegicus
gactgtcagagcttccgttcatgga

SEQ ID NO: 328818 - DNA, 25 bp, Rattus norvegicus
gactgtcagagtccggatttttatg

SEQ ID NO: 328819 - DNA, 25 bp, Rattus norvegicus
gactgtcagagtgcggatttttatg

SEQ ID NO: 328820 - DNA, 25 bp, Rattus norvegicus
gactgtcagcatagtatcacactaa

SEQ ID NO: 328821 - DNA, 25 bp, Rattus norvegicus
gactgtcagcattgtatcacactaa

SEQ ID NO: 328822 - DNA, 25 bp, Rattus norvegicus
gactgtcagctgagacgaatctatc

SEQ ID NO: 328823 - DNA, 25 bp, Rattus norvegicus
gactgtcagctgtgacgaatctatc

SEQ ID NO: 328824 - DNA, 25 bp, Rattus norvegicus
gactgtcagcttacataatacccat

SEQ ID NO: 328825 - DNA, 25 bp, Rattus norvegicus
gactgtcagcttcttagtagcattt

SEQ ID NO: 328826 - DNA, 25 bp, Rattus norvegicus
gactgtcagcttgttagtagcattt

SEQ ID NO: 328827 - DNA, 25 bp, Rattus norvegicus
gactgtcagctttcataatacccat

SEQ ID NO: 328828 - DNA, 25 bp, Rattus norvegicus
gactgtcaggaacacaagatccaac

SEQ ID NO: 328829 - DNA, 25 bp, Rattus norvegicus
gactgtcaggaagacaagatccaac

SEQ ID NO: 328830 - DNA, 25 bp, Rattus norvegicus
gactgtcaggccatgtgtgggactt

SEQ ID NO: 328831 - DNA, 25 bp, Rattus norvegicus
gactgtcaggccttgtgtgggactt

SEQ ID NO: 328832 - DNA, 25 bp, Rattus norvegicus
gactgtcagtacagctgtgtctgtc

SEQ ID NO: 328833 - DNA, 25 bp, Rattus norvegicus
gactgtcagtactgctgtgtctgtc

SEQ ID NO: 328834 - DNA, 25 bp, Rattus norvegicus
gactgtcagtctcctgtgaacaaca

SEQ ID NO: 328835 - DNA, 25 bp, Rattus norvegicus
gactgtcagtctgctgtgaacaaca

SEQ ID NO: 328836 - DNA, 25 bp, Rattus norvegicus
gactgtcagtgtagagcatgtagca

SEQ ID NO: 328837 - DNA, 25 bp, Rattus norvegicus
gactgtcagtgtcaggctcttaggc

SEQ ID NO: 328838 - DNA, 25 bp, Rattus norvegicus
gactgtcagtgtgaggctcttaggc

SEQ ID NO: 328839 - DNA, 25 bp, Rattus norvegicus
gactgtcagtgttgagcatgtagca

SEQ ID NO: 328840 - DNA, 25 bp, Rattus norvegicus
gactgtcataacaagtgctgccttt

SEQ ID NO: 328841 - DNA, 25 bp, Rattus norvegicus
gactgtcataactagtgctgccttt

SEQ ID NO: 328842 - DNA, 25 bp, Rattus norvegicus
gactgtcatcataggtcactctgag

SEQ ID NO: 328843 - DNA, 25 bp, Rattus norvegicus
gactgtcatcattggtcactctgag

SEQ ID NO: 328844 - DNA, 25 bp, Rattus norvegicus
gactgtcatgaactatccctgttgc

SEQ ID NO: 328845 - DNA, 25 bp, Rattus norvegicus
gactgtcatgaagtatccctgttgc

SEQ ID NO: 328846 - DNA, 25 bp, Rattus norvegicus
gactgtcatgtgatccttagtactg

SEQ ID NO: 328847 - DNA, 25 bp, Rattus norvegicus
gactgtcatgtgttccttagtactg

SEQ ID NO: 328848 - DNA, 25 bp, Rattus norvegicus
gactgtccacgcatgctgtttgata

SEQ ID NO: 328849 - DNA, 25 bp, Rattus norvegicus
gactgtccacgcttgctgtttgata

SEQ ID NO: 328850 - DNA, 25 bp, Rattus norvegicus
gactgtccagaacgtttagacggca

SEQ ID NO: 328851 - DNA, 25 bp, Rattus norvegicus
gactgtccagaaggtttagacggca

SEQ ID NO: 328852 - DNA, 25 bp, Rattus norvegicus
gactgtccagtaagtgggatccgtt

SEQ ID NO: 328853 - DNA, 25 bp, Rattus norvegicus
gactgtccagtatgtgggatccgtt

SEQ ID NO: 328854 - DNA, 25 bp, Rattus norvegicus
gactgtccagtgagtgtcgctgttt

SEQ ID NO: 328855 - DNA, 25 bp, Rattus norvegicus
gactgtccagtgtgtgtcgctgttt

SEQ ID NO: 328856 - DNA, 25 bp, Rattus norvegicus
gactgtccatatctacctacgtagt

SEQ ID NO: 328857 - DNA, 25 bp, Rattus norvegicus
gactgtccatatgtacctacgtagt

SEQ ID NO: 328858 - DNA, 25 bp, Rattus norvegicus
gactgtccatgcaactcgaattaaa

SEQ ID NO: 328859 - DNA, 25 bp, Rattus norvegicus
gactgtccatgctactcgaattaaa

SEQ ID NO: 328860 - DNA, 25 bp, Rattus norvegicus
gactgtccatgtcccaagtctgcag

SEQ ID NO: 328861 - DNA, 25 bp, Rattus norvegicus
gactgtccatgtgccaagtctgcag

SEQ ID NO: 328862 - DNA, 25 bp, Rattus norvegicus
gactgtccatttacaggttgctttt

SEQ ID NO: 328863 - DNA, 25 bp, Rattus norvegicus
gactgtccatttacattttataaag

SEQ ID NO: 328864 - DNA, 25 bp, Rattus norvegicus
gactgtccattttcaggttgctttt

SEQ ID NO: 328865 - DNA, 25 bp, Rattus norvegicus
gactgtccattttcattttataaag

SEQ ID NO: 328866 - DNA, 25 bp, Rattus norvegicus
gactgtcccagaataaggccggccg

SEQ ID NO: 328867 - DNA, 25 bp, Rattus norvegicus
gactgtcccagattaaggccggccg

SEQ ID NO: 328868 - DNA, 25 bp, Rattus norvegicus
gactgtcccattagaattgggctgg

SEQ ID NO: 328869 - DNA, 25 bp, Rattus norvegicus
gactgtcccatttgaattgggctgg

SEQ ID NO: 328870 - DNA, 25 bp, Rattus norvegicus
gactgtcccctcaagaagccaagag

SEQ ID NO: 328871 - DNA, 25 bp, Rattus norvegicus
gactgtcccctctagaagccaagag

SEQ ID NO: 328872 - DNA, 25 bp, Rattus norvegicus
gactgtccggtcatggatggtgcca

SEQ ID NO: 328873 - DNA, 25 bp, Rattus norvegicus
gactgtccggtcttggatggtgcca

SEQ ID NO: 328874 - DNA, 25 bp, Rattus norvegicus
gactgtcctaataacctatttctga

SEQ ID NO: 328875 - DNA, 25 bp, Rattus norvegicus
gactgtcctaattacctatttctga

SEQ ID NO: 328876 - DNA, 25 bp, Rattus norvegicus
gactgtcctcagacccgtgtgaagg

SEQ ID NO: 328877 - DNA, 25 bp, Rattus norvegicus
gactgtcctcagtcccgtgtgaagg

SEQ ID NO: 328878 - DNA, 25 bp, Rattus norvegicus
gactgtcctgaaatgtgtgtctcat

SEQ ID NO: 328879 - DNA, 25 bp, Rattus norvegicus
gactgtcctgaattgtgtgtctcat

SEQ ID NO: 328880 - DNA, 25 bp, Rattus norvegicus
gactgtcctgctcgtgacaagctga

SEQ ID NO: 328881 - DNA, 25 bp, Rattus norvegicus
gactgtcctgctggtgacaagctga

SEQ ID NO: 328882 - DNA, 25 bp, Rattus norvegicus
gactgtcctgtaactggagaagctg

SEQ ID NO: 328883 - DNA, 25 bp, Rattus norvegicus
gactgtcctgtatctggagaagctg

SEQ ID NO: 328884 - DNA, 25 bp, Rattus norvegicus
gactgtcctttgctgttttggaata

SEQ ID NO: 328885 - DNA, 25 bp, Rattus norvegicus
gactgtcctttggtgttttggaata

SEQ ID NO: 328886 - DNA, 25 bp, Rattus norvegicus
gactgtcgagcaatctcatagcttt

SEQ ID NO: 328887 - DNA, 25 bp, Rattus norvegicus
gactgtcgagcattctcatagcttt

SEQ ID NO: 328888 - DNA, 25 bp, Rattus norvegicus
gactgtcggagtaggagccccgggc

SEQ ID NO: 328889 - DNA, 25 bp, Rattus norvegicus
gactgtcggagttggagccccgggc

SEQ ID NO: 328890 - DNA, 25 bp, Rattus norvegicus
gactgtctaactcaagaggccgctg

SEQ ID NO: 328891 - DNA, 25 bp, Rattus norvegicus
gactgtctaactcccaagccagatt

SEQ ID NO: 328892 - DNA, 25 bp, Rattus norvegicus
gactgtctaactccttactataatg

SEQ ID NO: 328893 - DNA, 25 bp, Rattus norvegicus
gactgtctaactgaagaggccgctg

SEQ ID NO: 328894 - DNA, 25 bp, Rattus norvegicus
gactgtctaactgccaagccagatt

SEQ ID NO: 328895 - DNA, 25 bp, Rattus norvegicus
gactgtctaactgcttactataatg

SEQ ID NO: 328896 - DNA, 25 bp, Rattus norvegicus
gactgtctacacaaagctttctcat

SEQ ID NO: 328897 - DNA, 25 bp, Rattus norvegicus
gactgtctacactaagctttctcat

SEQ ID NO: 328898 - DNA, 25 bp, Rattus norvegicus
gactgtctatccacaagggagccag

SEQ ID NO: 328899 - DNA, 25 bp, Rattus norvegicus
gactgtctatcctcaagggagccag

SEQ ID NO: 328900 - DNA, 25 bp, Rattus norvegicus
gactgtctatgcaaatggtcatcag

SEQ ID NO: 328901 - DNA, 25 bp, Rattus norvegicus
gactgtctatgctaatggtcatcag

SEQ ID NO: 328902 - DNA, 25 bp, Rattus norvegicus
gactgtctcaccaagatcttcaagt

SEQ ID NO: 328903 - DNA, 25 bp, Rattus norvegicus
gactgtctcacctagatcttcaagt

SEQ ID NO: 328904 - DNA, 25 bp, Rattus norvegicus
gactgtctcagtcctcagcaattaa

SEQ ID NO: 328905 - DNA, 25 bp, Rattus norvegicus
gactgtctcagtctaagcatcctgg

SEQ ID NO: 328906 - DNA, 25 bp, Rattus norvegicus
gactgtctcagtgctcagcaattaa

SEQ ID NO: 328907 - DNA, 25 bp, Rattus norvegicus
gactgtctcagtgtaagcatcctgg

SEQ ID NO: 328908 - DNA, 25 bp, Rattus norvegicus
gactgtctcattaacactgtggctt

SEQ ID NO: 328909 - DNA, 25 bp, Rattus norvegicus
gactgtctcatttacactgtggctt

SEQ ID NO: 328910 - DNA, 25 bp, Rattus norvegicus
gactgtctcctgacttagccgagct

SEQ ID NO: 328911 - DNA, 25 bp, Rattus norvegicus
gactgtctcctgtcttagccgagct

SEQ ID NO: 328912 - DNA, 25 bp, Rattus norvegicus
gactgtctctctcatgatgggctta

SEQ ID NO: 328913 - DNA, 25 bp, Rattus norvegicus
gactgtctctctgatgatgggctta

SEQ ID NO: 328914 - DNA, 25 bp, Rattus norvegicus
gactgtctctgaactattaccgtgt

SEQ ID NO: 328915 - DNA, 25 bp, Rattus norvegicus
gactgtctctgatctattaccgtgt

SEQ ID NO: 328916 - DNA, 25 bp, Rattus norvegicus
gactgtctctttaggagtccaagct

SEQ ID NO: 328917 - DNA, 25 bp, Rattus norvegicus
gactgtctcttttggagtccaagct

SEQ ID NO: 328918 - DNA, 25 bp, Rattus norvegicus
gactgtctgactccttggttggttg

SEQ ID NO: 328919 - DNA, 25 bp, Rattus norvegicus
gactgtctgactgcttggttggttg

SEQ ID NO: 328920 - DNA, 25 bp, Rattus norvegicus
gactgtctgagaatttgggagttca

SEQ ID NO: 328921 - DNA, 25 bp, Rattus norvegicus
gactgtctgagattttgggagttca

SEQ ID NO: 328922 - DNA, 25 bp, Rattus norvegicus
gactgtctggagcaaatcgtccgct

SEQ ID NO: 328923 - DNA, 25 bp, Rattus norvegicus
gactgtctggaggaaatcgtccgct

SEQ ID NO: 328924 - DNA, 25 bp, Rattus norvegicus
gactgtctggatctaagtctccctg

SEQ ID NO: 328925 - DNA, 25 bp, Rattus norvegicus
gactgtctggatgtaagtctccctg

SEQ ID NO: 328926 - DNA, 25 bp, Rattus norvegicus
gactgtctggctacgcgcaaaggaa

SEQ ID NO: 328927 - DNA, 25 bp, Rattus norvegicus
gactgtctggcttcgcgcaaaggaa

SEQ ID NO: 328928 - DNA, 25 bp, Rattus norvegicus
gactgtctgggacgactgtaagcta

SEQ ID NO: 328929 - DNA, 25 bp, Rattus norvegicus
gactgtctgggaggactgtaagcta

SEQ ID NO: 328930 - DNA, 25 bp, Rattus norvegicus
gactgtctggtaagcatttttataa

SEQ ID NO: 328931 - DNA, 25 bp, Rattus norvegicus
gactgtctggtatgcatttttataa

SEQ ID NO: 328932 - DNA, 25 bp, Rattus norvegicus
gactgtctgtaacatgctgtttcct

SEQ ID NO: 328933 - DNA, 25 bp, Rattus norvegicus
gactgtctgtaagatgctgtttcct

SEQ ID NO: 328934 - DNA, 25 bp, Rattus norvegicus
gactgtctgtccattcgaaattaca

SEQ ID NO: 328935 - DNA, 25 bp, Rattus norvegicus
gactgtctgtcctttcgaaattaca

SEQ ID NO: 328936 - DNA, 25 bp, Rattus norvegicus
gactgtcttactcaagcttaccgta

SEQ ID NO: 328937 - DNA, 25 bp, Rattus norvegicus
gactgtcttactgaagcttaccgta

SEQ ID NO: 328938 - DNA, 25 bp, Rattus norvegicus
gactgtcttatcatctagcatcttg

SEQ ID NO: 328939 - DNA, 25 bp, Rattus norvegicus
gactgtcttatcttctagcatcttg

SEQ ID NO: 328940 - DNA, 25 bp, Rattus norvegicus
gactgtcttcttcctggttatgtat

SEQ ID NO: 328941 - DNA, 25 bp, Rattus norvegicus
gactgtcttcttccttgaataactg

SEQ ID NO: 328942 - DNA, 25 bp, Rattus norvegicus
gactgtcttcttgctggttatgtat

SEQ ID NO: 328943 - DNA, 25 bp, Rattus norvegicus
gactgtcttcttgcttgaataactg

SEQ ID NO: 328944 - DNA, 25 bp, Rattus norvegicus
gactgtcttgatcagctgtcacctt

SEQ ID NO: 328945 - DNA, 25 bp, Rattus norvegicus
gactgtcttgatgagctgtcacctt

SEQ ID NO: 328946 - DNA, 25 bp, Rattus norvegicus
gactgtcttgccaatgctgacctac

SEQ ID NO: 328947 - DNA, 25 bp, Rattus norvegicus
gactgtcttgcctatgctgacctac

SEQ ID NO: 328948 - DNA, 25 bp, Rattus norvegicus
gactgtcttgtcatgtggtgacgga

SEQ ID NO: 328949 - DNA, 25 bp, Rattus norvegicus
gactgtcttgtcttgtggtgacgga

SEQ ID NO: 328950 - DNA, 25 bp, Rattus norvegicus
gactgtctttgtattgtagagcctt

SEQ ID NO: 328951 - DNA, 25 bp, Rattus norvegicus
gactgtctttgttttgtagagcctt

SEQ ID NO: 328952 - DNA, 25 bp, Rattus norvegicus
gactgtctttttaccttgtcaccat

SEQ ID NO: 328953 - DNA, 25 bp, Rattus norvegicus
gactgtcttttttccttgtcaccat

SEQ ID NO: 328954 - DNA, 25 bp, Rattus norvegicus
gactgtgaaagcagaacaagccctg

SEQ ID NO: 328955 - DNA, 25 bp, Rattus norvegicus
gactgtgaaagctgaacaagccctg

SEQ ID NO: 328956 - DNA, 25 bp, Rattus norvegicus
gactgtgaaccaattcccaagaagt

SEQ ID NO: 328957 - DNA, 25 bp, Rattus norvegicus
gactgtgaaccatttcccaagaagt

SEQ ID NO: 328958 - DNA, 25 bp, Rattus norvegicus
gactgtgaacggctcctggtacatt

SEQ ID NO: 328959 - DNA, 25 bp, Rattus norvegicus
gactgtgaacgggtcctggtacatt

SEQ ID NO: 328960 - DNA, 25 bp, Rattus norvegicus
gactgtgaactcatctcgaagccat

SEQ ID NO: 328961 - DNA, 25 bp, Rattus norvegicus
gactgtgaactcttctcgaagccat

SEQ ID NO: 328962 - DNA, 25 bp, Rattus norvegicus
gactgtgaattaatttcatgccata

SEQ ID NO: 328963 - DNA, 25 bp, Rattus norvegicus
gactgtgaattattttcatgccata

SEQ ID NO: 328964 - DNA, 25 bp, Rattus norvegicus
gactgtgacaagctccagtgtcctg

SEQ ID NO: 328965 - DNA, 25 bp, Rattus norvegicus
gactgtgacaaggtccagtgtcctg

SEQ ID NO: 328966 - DNA, 25 bp, Rattus norvegicus
gactgtgacactatcattatcttca

SEQ ID NO: 328967 - DNA, 25 bp, Rattus norvegicus
gactgtgacactttcattatcttca

SEQ ID NO: 328968 - DNA, 25 bp, Rattus norvegicus
gactgtgacccgaaaccatgagctg

SEQ ID NO: 328969 - DNA, 25 bp, Rattus norvegicus
gactgtgacccgtaaccatgagctg

SEQ ID NO: 328970 - DNA, 25 bp, Rattus norvegicus
gactgtgaccgtagctgggaacttt

SEQ ID NO: 328971 - DNA, 25 bp, Rattus norvegicus
gactgtgaccgttgctgggaacttt

SEQ ID NO: 328972 - DNA, 25 bp, Rattus norvegicus
gactgtgacgacaaaaccaacctgt

SEQ ID NO: 328973 - DNA, 25 bp, Rattus norvegicus
gactgtgacgactaaaccaacctgt

SEQ ID NO: 328974 - DNA, 25 bp, Rattus norvegicus
gactgtgactcaacgtgctggatat

SEQ ID NO: 328975 - DNA, 25 bp, Rattus norvegicus
gactgtgactcatcgtgctggatat

SEQ ID NO: 328976 - DNA, 25 bp, Rattus norvegicus
gactgtgactctcaagccgaggcca

SEQ ID NO: 328977 - DNA, 25 bp, Rattus norvegicus
gactgtgactctgaagccgaggcca

SEQ ID NO: 328978 - DNA, 25 bp, Rattus norvegicus
gactgtgacttgatatgtaagccat

SEQ ID NO: 328979 - DNA, 25 bp, Rattus norvegicus
gactgtgacttgttatgtaagccat

SEQ ID NO: 328980 - DNA, 25 bp, Rattus norvegicus
gactgtgagaagcttcagcaccgct

SEQ ID NO: 328981 - DNA, 25 bp, Rattus norvegicus
gactgtgagaaggttcagcaccgct

SEQ ID NO: 328982 - DNA, 25 bp, Rattus norvegicus
gactgtgagcgccatggccctgctt

SEQ ID NO: 328983 - DNA, 25 bp, Rattus norvegicus
gactgtgagcgcgatggccctgctt

SEQ ID NO: 328984 - DNA, 25 bp, Rattus norvegicus
gactgtgagctcctcaaggccagga

SEQ ID NO: 328985 - DNA, 25 bp, Rattus norvegicus
gactgtgagctcgtcaaggccagga

SEQ ID NO: 328986 - DNA, 25 bp, Rattus norvegicus
gactgtgagctgcttgttgcattaa

SEQ ID NO: 328987 - DNA, 25 bp, Rattus norvegicus
gactgtgagctggttgttgcattaa

SEQ ID NO: 328988 - DNA, 25 bp, Rattus norvegicus
gactgtgagggccatgatgtagcct

SEQ ID NO: 328989 - DNA, 25 bp, Rattus norvegicus
gactgtgagggcgatgatgtagcct

SEQ ID NO: 328990 - DNA, 25 bp, Rattus norvegicus
gactgtgaggttcgtttgttctgtt

SEQ ID NO: 328991 - DNA, 25 bp, Rattus norvegicus
gactgtgaggttggtttgttctgtt

SEQ ID NO: 328992 - DNA, 25 bp, Rattus norvegicus
gactgtgagtagcacatcatacacc

SEQ ID NO: 328993 - DNA, 25 bp, Rattus norvegicus
gactgtgagtaggacatcatacacc

SEQ ID NO: 328994 - DNA, 25 bp, Rattus norvegicus
gactgtgagtcacacttcaccgatg

SEQ ID NO: 328995 - DNA, 25 bp, Rattus norvegicus
gactgtgagtcaccctgatcattat

SEQ ID NO: 328996 - DNA, 25 bp, Rattus norvegicus
gactgtgagtcagacttcaccgatg

SEQ ID NO: 328997 - DNA, 25 bp, Rattus norvegicus
gactgtgagtcagcctgatcattat

SEQ ID NO: 328998 - DNA, 25 bp, Rattus norvegicus
gactgtgagtggatcacctcaccca

SEQ ID NO: 328999 - DNA, 25 bp, Rattus norvegicus
gactgtgagtggttcacctcaccca

SEQ ID NO: 329000 - DNA, 25 bp, Rattus norvegicus
gactgtgatccaaattggctgttcc

SEQ ID NO: 329001 - DNA, 25 bp, Rattus norvegicus
gactgtgatccatattggctgttcc

SEQ ID NO: 329002 - DNA, 25 bp, Rattus norvegicus
gactgtgatctaaaagtgcaagcca

SEQ ID NO: 329003 - DNA, 25 bp, Rattus norvegicus
gactgtgatctataagtgcaagcca

SEQ ID NO: 329004 - DNA, 25 bp, Rattus norvegicus
gactgtgatgaaacttgctaccaac

SEQ ID NO: 329005 - DNA, 25 bp, Rattus norvegicus
gactgtgatgaatcttgctaccaac

SEQ ID NO: 329006 - DNA, 25 bp, Rattus norvegicus
gactgtgatgatagtgaggctagcc

SEQ ID NO: 329007 - DNA, 25 bp, Rattus norvegicus
gactgtgatgattgtgaggctagcc

SEQ ID NO: 329008 - DNA, 25 bp, Rattus norvegicus
gactgtgatgtcacaggctgtctta

SEQ ID NO: 329009 - DNA, 25 bp, Rattus norvegicus
gactgtgatgtctcaggctgtctta

SEQ ID NO: 329010 - DNA, 25 bp, Rattus norvegicus
gactgtgatttcaattgtccaaaat

SEQ ID NO: 329011 - DNA, 25 bp, Rattus norvegicus
gactgtgatttctattgtccaaaat

SEQ ID NO: 329012 - DNA, 25 bp, Rattus norvegicus
gactgtgcaaacattatactcctga

SEQ ID NO: 329013 - DNA, 25 bp, Rattus norvegicus
gactgtgcaaactttatactcctga

SEQ ID NO: 329014 - DNA, 25 bp, Rattus norvegicus
gactgtgcaagtcctctatgagact

SEQ ID NO: 329015 - DNA, 25 bp, Rattus norvegicus
gactgtgcaagtgctctatgagact

SEQ ID NO: 329016 - DNA, 25 bp, Rattus norvegicus
gactgtgcactcactgagttgtgtt

SEQ ID NO: 329017 - DNA, 25 bp, Rattus norvegicus
gactgtgcactctctgagttgtgtt

SEQ ID NO: 329018 - DNA, 25 bp, Rattus norvegicus
gactgtgcactgacaatggtatcat

SEQ ID NO: 329019 - DNA, 25 bp, Rattus norvegicus
gactgtgcactgtcaatggtatcat

SEQ ID NO: 329020 - DNA, 25 bp, Rattus norvegicus
gactgtgcaggcaactctcgaggac

SEQ ID NO: 329021 - DNA, 25 bp, Rattus norvegicus
gactgtgcaggctactctcgaggac

SEQ ID NO: 329022 - DNA, 25 bp, Rattus norvegicus
gactgtgccaaaatcaggcccttat

SEQ ID NO: 329023 - DNA, 25 bp, Rattus norvegicus
gactgtgccaaattcaggcccttat

SEQ ID NO: 329024 - DNA, 25 bp, Rattus norvegicus
gactgtgccactcggagaccgtatt

SEQ ID NO: 329025 - DNA, 25 bp, Rattus norvegicus
gactgtgccactgggagaccgtatt

SEQ ID NO: 329026 - DNA, 25 bp, Rattus norvegicus
gactgtgcccataagatcctgcctg

SEQ ID NO: 329027 - DNA, 25 bp, Rattus norvegicus
gactgtgcccatccgagcttgctgg

SEQ ID NO: 329028 - DNA, 25 bp, Rattus norvegicus
gactgtgcccatgcgagcttgctgg

SEQ ID NO: 329029 - DNA, 25 bp, Rattus norvegicus
gactgtgcccattagatcctgcctg

SEQ ID NO: 329030 - DNA, 25 bp, Rattus norvegicus
gactgtgcctaaagctggccactgg

SEQ ID NO: 329031 - DNA, 25 bp, Rattus norvegicus
gactgtgcctaatgctggccactgg

SEQ ID NO: 329032 - DNA, 25 bp, Rattus norvegicus
gactgtgcctagagtggtctttcta

SEQ ID NO: 329033 - DNA, 25 bp, Rattus norvegicus
gactgtgcctagtgtggtctttcta

SEQ ID NO: 329034 - DNA, 25 bp, Rattus norvegicus
gactgtgcgagacccatcatgagaa

SEQ ID NO: 329035 - DNA, 25 bp, Rattus norvegicus
gactgtgcgagagccatcatgagaa

SEQ ID NO: 329036 - DNA, 25 bp, Rattus norvegicus
gactgtgcgtagaacattttctgta

SEQ ID NO: 329037 - DNA, 25 bp, Rattus norvegicus
gactgtgcgtagtacattttctgta

SEQ ID NO: 329038 - DNA, 25 bp, Rattus norvegicus
gactgtgctaccattttggctgttt

SEQ ID NO: 329039 - DNA, 25 bp, Rattus norvegicus
gactgtgctacctttttggctgttt

SEQ ID NO: 329040 - DNA, 25 bp, Rattus norvegicus
gactgtgctattcataaccctaaac

SEQ ID NO: 329041 - DNA, 25 bp, Rattus norvegicus
gactgtgctattgataaccctaaac

SEQ ID NO: 329042 - DNA, 25 bp, Rattus norvegicus
gactgtgctctgaaatatatcctga

SEQ ID NO: 329043 - DNA, 25 bp, Rattus norvegicus
gactgtgctctgatctgtgctggga

SEQ ID NO: 329044 - DNA, 25 bp, Rattus norvegicus
gactgtgctctgcagtgaaaaacag

SEQ ID NO: 329045 - DNA, 25 bp, Rattus norvegicus
gactgtgctctggagtgaaaaacag

SEQ ID NO: 329046 - DNA, 25 bp, Rattus norvegicus
gactgtgctctgtaatatatcctga

SEQ ID NO: 329047 - DNA, 25 bp, Rattus norvegicus
gactgtgctctgttctgtgctggga

SEQ ID NO: 329048 - DNA, 25 bp, Rattus norvegicus
gactgtgctgaaatcctgtcagatg

SEQ ID NO: 329049 - DNA, 25 bp, Rattus norvegicus
gactgtgctgaattcctgtcagatg

SEQ ID NO: 329050 - DNA, 25 bp, Rattus norvegicus
gactgtgctgcgctctgcaaatgaa

SEQ ID NO: 329051 - DNA, 25 bp, Rattus norvegicus
gactgtgctgcggtctgcaaatgaa

SEQ ID NO: 329052 - DNA, 25 bp, Rattus norvegicus
gactgtgctggtctgattctgtata

SEQ ID NO: 329053 - DNA, 25 bp, Rattus norvegicus
gactgtgctggtgtgattctgtata

SEQ ID NO: 329054 - DNA, 25 bp, Rattus norvegicus
gactgtgcttacaaactgactgagt

SEQ ID NO: 329055 - DNA, 25 bp, Rattus norvegicus
gactgtgcttactaactgactgagt

SEQ ID NO: 329056 - DNA, 25 bp, Rattus norvegicus
gactgtggaaggaaaacgacctctt

SEQ ID NO: 329057 - DNA, 25 bp, Rattus norvegicus
gactgtggaaggtaaacgacctctt

SEQ ID NO: 329058 - DNA, 25 bp, Rattus norvegicus
gactgtggacatcagtagcagccct

SEQ ID NO: 329059 - DNA, 25 bp, Rattus norvegicus
gactgtggacatgagtagcagccct

SEQ ID NO: 329060 - DNA, 25 bp, Rattus norvegicus
gactgtggagatcagaggataactt

SEQ ID NO: 329061 - DNA, 25 bp, Rattus norvegicus
gactgtggagatgagaggataactt

SEQ ID NO: 329062 - DNA, 25 bp, Rattus norvegicus
gactgtggagtcataacccttaggt

SEQ ID NO: 329063 - DNA, 25 bp, Rattus norvegicus
gactgtggagtcttaacccttaggt

SEQ ID NO: 329064 - DNA, 25 bp, Rattus norvegicus
gactgtggcaggctctaaaatgcaa

SEQ ID NO: 329065 - DNA, 25 bp, Rattus norvegicus
gactgtggcagggtctaaaatgcaa

SEQ ID NO: 329066 - DNA, 25 bp, Rattus norvegicus
gactgtggcgtcagtaataattgct

SEQ ID NO: 329067 - DNA, 25 bp, Rattus norvegicus
gactgtggcgtctgtaataattgct

SEQ ID NO: 329068 - DNA, 25 bp, Rattus norvegicus
gactgtggcgtgacctggagtttca

SEQ ID NO: 329069 - DNA, 25 bp, Rattus norvegicus
gactgtggcgtgtcctggagtttca

SEQ ID NO: 329070 - DNA, 25 bp, Rattus norvegicus
gactgtggctctcaatcctgagcac

SEQ ID NO: 329071 - DNA, 25 bp, Rattus norvegicus
gactgtggctctgaatcctgagcac

SEQ ID NO: 329072 - DNA, 25 bp, Rattus norvegicus
gactgtggcttcaaaaagaaaggca

SEQ ID NO: 329073 - DNA, 25 bp, Rattus norvegicus
gactgtggcttctaaaagaaaggca

SEQ ID NO: 329074 - DNA, 25 bp, Rattus norvegicus
gactgtggtagcaggagaactctac

SEQ ID NO: 329075 - DNA, 25 bp, Rattus norvegicus
gactgtggtagctggagaactctac

SEQ ID NO: 329076 - DNA, 25 bp, Rattus norvegicus
gactgtggtcagcagatcccagtga

SEQ ID NO: 329077 - DNA, 25 bp, Rattus norvegicus
gactgtggtcaggagatcccagtga

SEQ ID NO: 329078 - DNA, 25 bp, Rattus norvegicus
gactgtggtctaccagatgatccag

SEQ ID NO: 329079 - DNA, 25 bp, Rattus norvegicus
gactgtggtctagcagatgatccag

SEQ ID NO: 329080 - DNA, 25 bp, Rattus norvegicus
gactgtggtgccaactttgaagact

SEQ ID NO: 329081 - DNA, 25 bp, Rattus norvegicus
gactgtggtgccaggaggccttact

SEQ ID NO: 329082 - DNA, 25 bp, Rattus norvegicus
gactgtggtgcctactttgaagact

SEQ ID NO: 329083 - DNA, 25 bp, Rattus norvegicus
gactgtggtgcctggaggccttact

SEQ ID NO: 329084 - DNA, 25 bp, Rattus norvegicus
gactgtggtggcacttccagctcca

SEQ ID NO: 329085 - DNA, 25 bp, Rattus norvegicus
gactgtggtggctcttccagctcca

SEQ ID NO: 329086 - DNA, 25 bp, Rattus norvegicus
gactgtggttctctttgttgagctt

SEQ ID NO: 329087 - DNA, 25 bp, Rattus norvegicus
gactgtggttctgtttgttgagctt

SEQ ID NO: 329088 - DNA, 25 bp, Rattus norvegicus
gactgtgtaacgagtgcctcacgga

SEQ ID NO: 329089 - DNA, 25 bp, Rattus norvegicus
gactgtgtaacgtgtgcctcacgga

SEQ ID NO: 329090 - DNA, 25 bp, Rattus norvegicus
gactgtgtaagcacatatcgtgttg

SEQ ID NO: 329091 - DNA, 25 bp, Rattus norvegicus
gactgtgtaagctcatatcgtgttg

SEQ ID NO: 329092 - DNA, 25 bp, Rattus norvegicus
gactgtgtaattaatggctcctgag

SEQ ID NO: 329093 - DNA, 25 bp, Rattus norvegicus
gactgtgtaatttatggctcctgag

SEQ ID NO: 329094 - DNA, 25 bp, Rattus norvegicus
gactgtgtactgattcctgctaata

SEQ ID NO: 329095 - DNA, 25 bp, Rattus norvegicus
gactgtgtactgtttcctgctaata

SEQ ID NO: 329096 - DNA, 25 bp, Rattus norvegicus
gactgtgtagcaccagcaaccagaa

SEQ ID NO: 329097 - DNA, 25 bp, Rattus norvegicus
gactgtgtagcagcagcaaccagaa

SEQ ID NO: 329098 - DNA, 25 bp, Rattus norvegicus
gactgtgtagccacaaaggcccaaa

SEQ ID NO: 329099 - DNA, 25 bp, Rattus norvegicus
gactgtgtagcctcaaaggcccaaa

SEQ ID NO: 329100 - DNA, 25 bp, Rattus norvegicus
gactgtgtataacccattgtgttca

SEQ ID NO: 329101 - DNA, 25 bp, Rattus norvegicus
gactgtgtataagccattgtgttca

SEQ ID NO: 329102 - DNA, 25 bp, Rattus norvegicus
gactgtgtatctcgagcgtaacccc

SEQ ID NO: 329103 - DNA, 25 bp, Rattus norvegicus
gactgtgtatctggagcgtaacccc

SEQ ID NO: 329104 - DNA, 25 bp, Rattus norvegicus
gactgtgtattacttcacctgccaa

SEQ ID NO: 329105 - DNA, 25 bp, Rattus norvegicus
gactgtgtattagttcacctgccaa

SEQ ID NO: 329106 - DNA, 25 bp, Rattus norvegicus
gactgtgtcaatctccagcagcata

SEQ ID NO: 329107 - DNA, 25 bp, Rattus norvegicus
gactgtgtcaatgtccagcagcata

SEQ ID NO: 329108 - DNA, 25 bp, Rattus norvegicus
gactgtgtcacgctgtccagattca

SEQ ID NO: 329109 - DNA, 25 bp, Rattus norvegicus
gactgtgtcacggtgtccagattca

SEQ ID NO: 329110 - DNA, 25 bp, Rattus norvegicus
gactgtgtcagcactagagctccgt

SEQ ID NO: 329111 - DNA, 25 bp, Rattus norvegicus
gactgtgtcagctctagagctccgt

SEQ ID NO: 329112 - DNA, 25 bp, Rattus norvegicus
gactgtgtcaggaaccagtgtcaga

SEQ ID NO: 329113 - DNA, 25 bp, Rattus norvegicus
gactgtgtcaggtaccagtgtcaga

SEQ ID NO: 329114 - DNA, 25 bp, Rattus norvegicus
gactgtgtcatgaattcctaggaga

SEQ ID NO: 329115 - DNA, 25 bp, Rattus norvegicus
gactgtgtcatgtattcctaggaga

SEQ ID NO: 329116 - DNA, 25 bp, Rattus norvegicus
gactgtgtcccacaatcagaaacct

SEQ ID NO: 329117 - DNA, 25 bp, Rattus norvegicus
gactgtgtcccagaatcagaaacct

SEQ ID NO: 329118 - DNA, 25 bp, Rattus norvegicus
gactgtgtcgcacgtcatgtgacca

SEQ ID NO: 329119 - DNA, 25 bp, Rattus norvegicus
gactgtgtcgcaggtcatgtgacca

SEQ ID NO: 329120 - DNA, 25 bp, Rattus norvegicus
gactgtgtcttgatggtaaaacctc

SEQ ID NO: 329121 - DNA, 25 bp, Rattus norvegicus
gactgtgtcttgttggtaaaacctc

SEQ ID NO: 329122 - DNA, 25 bp, Rattus norvegicus
gactgtgtgaccctgaatttcatac

SEQ ID NO: 329123 - DNA, 25 bp, Rattus norvegicus
gactgtgtgaccgtgaatttcatac

SEQ ID NO: 329124 - DNA, 25 bp, Rattus norvegicus
gactgtgtgagtcgacatgctcatt

SEQ ID NO: 329125 - DNA, 25 bp, Rattus norvegicus
gactgtgtgagtggacatgctcatt

SEQ ID NO: 329126 - DNA, 25 bp, Rattus norvegicus
gactgtgtggatacctgagccagca

SEQ ID NO: 329127 - DNA, 25 bp, Rattus norvegicus
gactgtgtggattcctgagccagca

SEQ ID NO: 329128 - DNA, 25 bp, Rattus norvegicus
gactgtgtgtgcagggctgtttcca

SEQ ID NO: 329129 - DNA, 25 bp, Rattus norvegicus
gactgtgtgtgctgggctgtttcca

SEQ ID NO: 329130 - DNA, 25 bp, Rattus norvegicus
gactgtgttaataacttcattccat

SEQ ID NO: 329131 - DNA, 25 bp, Rattus norvegicus
gactgtgttaattacttcattccat

SEQ ID NO: 329132 - DNA, 25 bp, Rattus norvegicus
gactgtgttagaagttctggagcta

SEQ ID NO: 329133 - DNA, 25 bp, Rattus norvegicus
gactgtgttagatgttctggagcta

SEQ ID NO: 329134 - DNA, 25 bp, Rattus norvegicus
gactgtgttcatctttaactgttgt

SEQ ID NO: 329135 - DNA, 25 bp, Rattus norvegicus
gactgtgttcatgtttaactgttgt

SEQ ID NO: 329136 - DNA, 25 bp, Rattus norvegicus
gactgtgttcgtatcattcaatagc

SEQ ID NO: 329137 - DNA, 25 bp, Rattus norvegicus
gactgtgttcgtttcattcaatagc

SEQ ID NO: 329138 - DNA, 25 bp, Rattus norvegicus
gactgtgttctgatactactgtgtt

SEQ ID NO: 329139 - DNA, 25 bp, Rattus norvegicus
gactgtgttctgttactactgtgtt

SEQ ID NO: 329140 - DNA, 25 bp, Rattus norvegicus
gactgtgttcttctcccaagtaaga

SEQ ID NO: 329141 - DNA, 25 bp, Rattus norvegicus
gactgtgttcttgtcccaagtaaga

SEQ ID NO: 329142 - DNA, 25 bp, Rattus norvegicus
gactgtgttgagacctgtttgctca

SEQ ID NO: 329143 - DNA, 25 bp, Rattus norvegicus
gactgtgttgagtcctgtttgctca

SEQ ID NO: 329144 - DNA, 25 bp, Rattus norvegicus
gactgtgttgctcacacctcggaaa

SEQ ID NO: 329145 - DNA, 25 bp, Rattus norvegicus
gactgtgttgctgacacctcggaaa

SEQ ID NO: 329146 - DNA, 25 bp, Rattus norvegicus
gactgtgtttatatttactgtttct

SEQ ID NO: 329147 - DNA, 25 bp, Rattus norvegicus
gactgtgtttatttttactgtttct

SEQ ID NO: 329148 - DNA, 25 bp, Rattus norvegicus
gactgtgtttccaagaactttctct

SEQ ID NO: 329149 - DNA, 25 bp, Rattus norvegicus
gactgtgtttcctagaactttctct

SEQ ID NO: 329150 - DNA, 25 bp, Rattus norvegicus
gactgtgtttgtcaataggagactt

SEQ ID NO: 329151 - DNA, 25 bp, Rattus norvegicus
gactgtgtttgtgaataggagactt

SEQ ID NO: 329152 - DNA, 25 bp, Rattus norvegicus
gactgttaacatattctccttggta

SEQ ID NO: 329153 - DNA, 25 bp, Rattus norvegicus
gactgttaacattttctccttggta

SEQ ID NO: 329154 - DNA, 25 bp, Rattus norvegicus
gactgttaagatactgctgccttag

SEQ ID NO: 329155 - DNA, 25 bp, Rattus norvegicus
gactgttaagattctgctgccttag

SEQ ID NO: 329156 - DNA, 25 bp, Rattus norvegicus
gactgttaagctcaccctaaactaa

SEQ ID NO: 329157 - DNA, 25 bp, Rattus norvegicus
gactgttaagctgaccctaaactaa

SEQ ID NO: 329158 - DNA, 25 bp, Rattus norvegicus
gactgttacaggaaagtgtgtgtgt

SEQ ID NO: 329159 - DNA, 25 bp, Rattus norvegicus
gactgttacaggtaagtgtgtgtgt

SEQ ID NO: 329160 - DNA, 25 bp, Rattus norvegicus
gactgttacataaaggccgtcagca

SEQ ID NO: 329161 - DNA, 25 bp, Rattus norvegicus
gactgttacatataggccgtcagca

SEQ ID NO: 329162 - DNA, 25 bp, Rattus norvegicus
gactgttaccaactaggactgccaa

SEQ ID NO: 329163 - DNA, 25 bp, Rattus norvegicus
gactgttaccaagtaggactgccaa

SEQ ID NO: 329164 - DNA, 25 bp, Rattus norvegicus
gactgttaccttatcttctgagcta

SEQ ID NO: 329165 - DNA, 25 bp, Rattus norvegicus
gactgttaccttttcttctgagcta

SEQ ID NO: 329166 - DNA, 25 bp, Rattus norvegicus
gactgttactctatattatttttat

SEQ ID NO: 329167 - DNA, 25 bp, Rattus norvegicus
gactgttactctttattatttttat

SEQ ID NO: 329168 - DNA, 25 bp, Rattus norvegicus
gactgttactgacctgcgttttaca

SEQ ID NO: 329169 - DNA, 25 bp, Rattus norvegicus
gactgttactgagctgcgttttaca

SEQ ID NO: 329170 - DNA, 25 bp, Rattus norvegicus
gactgttactggctccttgagtgac

SEQ ID NO: 329171 - DNA, 25 bp, Rattus norvegicus
gactgttactgggtccttgagtgac

SEQ ID NO: 329172 - DNA, 25 bp, Rattus norvegicus
gactgttagagactgttgctgtgtt

SEQ ID NO: 329173 - DNA, 25 bp, Rattus norvegicus
gactgttagagagtgttgctgtgtt

SEQ ID NO: 329174 - DNA, 25 bp, Rattus norvegicus
gactgttagctgactcatttcttgt

SEQ ID NO: 329175 - DNA, 25 bp, Rattus norvegicus
gactgttagctgtctcatttcttgt

SEQ ID NO: 329176 - DNA, 25 bp, Rattus norvegicus
gactgttaggacagttctgacacct

SEQ ID NO: 329177 - DNA, 25 bp, Rattus norvegicus
gactgttaggactgttctgacacct

SEQ ID NO: 329178 - DNA, 25 bp, Rattus norvegicus
gactgttaggttacttccaaggcat

SEQ ID NO: 329179 - DNA, 25 bp, Rattus norvegicus
gactgttaggtttcttccaaggcat

SEQ ID NO: 329180 - DNA, 25 bp, Rattus norvegicus
gactgttatcctacctaaaattcaa

SEQ ID NO: 329181 - DNA, 25 bp, Rattus norvegicus
gactgttatccttcctaaaattcaa

SEQ ID NO: 329182 - DNA, 25 bp, Rattus norvegicus
gactgttatgaacgtcatgctccaa

SEQ ID NO: 329183 - DNA, 25 bp, Rattus norvegicus
gactgttatgaaggtcatgctccaa

SEQ ID NO: 329184 - DNA, 25 bp, Rattus norvegicus
gactgttatgcgatgactgagcttc

SEQ ID NO: 329185 - DNA, 25 bp, Rattus norvegicus
gactgttatgcgttgactgagcttc

SEQ ID NO: 329186 - DNA, 25 bp, Rattus norvegicus
gactgttatttaatggaccctgagg

SEQ ID NO: 329187 - DNA, 25 bp, Rattus norvegicus
gactgttatttattggaccctgagg

SEQ ID NO: 329188 - DNA, 25 bp, Rattus norvegicus
gactgttcaaccacttatgtgtcag

SEQ ID NO: 329189 - DNA, 25 bp, Rattus norvegicus
gactgttcaacctcttatgtgtcag

SEQ ID NO: 329190 - DNA, 25 bp, Rattus norvegicus
gactgttcaaggacttaactgttaa

SEQ ID NO: 329191 - DNA, 25 bp, Rattus norvegicus
gactgttcaaggtcttaactgttaa

SEQ ID NO: 329192 - DNA, 25 bp, Rattus norvegicus
gactgttcagagactgttcagagta

SEQ ID NO: 329193 - DNA, 25 bp, Rattus norvegicus
gactgttcagagtctgttcagagta

SEQ ID NO: 329194 - DNA, 25 bp, Rattus norvegicus
gactgttcctgacagcttttcatct

SEQ ID NO: 329195 - DNA, 25 bp, Rattus norvegicus
gactgttcctgagagcttttcatct

SEQ ID NO: 329196 - DNA, 25 bp, Rattus norvegicus
gactgttccttaagagggccgtttc

SEQ ID NO: 329197 - DNA, 25 bp, Rattus norvegicus
gactgttccttatgagggccgtttc

SEQ ID NO: 329198 - DNA, 25 bp, Rattus norvegicus
gactgttctctgaaacgtcagtggg

SEQ ID NO: 329199 - DNA, 25 bp, Rattus norvegicus
gactgttctctgaaatagccgtttg

SEQ ID NO: 329200 - DNA, 25 bp, Rattus norvegicus
gactgttctctgtaacgtcagtggg

SEQ ID NO: 329201 - DNA, 25 bp, Rattus norvegicus
gactgttctctgtaatagccgtttg

SEQ ID NO: 329202 - DNA, 25 bp, Rattus norvegicus
gactgttctcttagtatagtttgtg

SEQ ID NO: 329203 - DNA, 25 bp, Rattus norvegicus
gactgttctctttgtatagtttgtg

SEQ ID NO: 329204 - DNA, 25 bp, Rattus norvegicus
gactgttctgaaaatctcggccttg

SEQ ID NO: 329205 - DNA, 25 bp, Rattus norvegicus
gactgttctgaatatctcggccttg

SEQ ID NO: 329206 - DNA, 25 bp, Rattus norvegicus
gactgttctgcaaaaacgtcccagg

SEQ ID NO: 329207 - DNA, 25 bp, Rattus norvegicus
gactgttctgcataaacgtcccagg

SEQ ID NO: 329208 - DNA, 25 bp, Rattus norvegicus
gactgttcttatagtgtccccaagt

SEQ ID NO: 329209 - DNA, 25 bp, Rattus norvegicus
gactgttcttattgtgtccccaagt

SEQ ID NO: 329210 - DNA, 25 bp, Rattus norvegicus
gactgttgaaataatgatgtcttta

SEQ ID NO: 329211 - DNA, 25 bp, Rattus norvegicus
gactgttgaaattatgatgtcttta

SEQ ID NO: 329212 - DNA, 25 bp, Rattus norvegicus
gactgttgaaccagctctgctgtaa

SEQ ID NO: 329213 - DNA, 25 bp, Rattus norvegicus
gactgttgaacctgctctgctgtaa

SEQ ID NO: 329214 - DNA, 25 bp, Rattus norvegicus
gactgttgacatagtcaccggtgtc

SEQ ID NO: 329215 - DNA, 25 bp, Rattus norvegicus
gactgttgacattgtcaccggtgtc

SEQ ID NO: 329216 - DNA, 25 bp, Rattus norvegicus
gactgttgatttaatgtccattaaa

SEQ ID NO: 329217 - DNA, 25 bp, Rattus norvegicus
gactgttgattttatgtccattaaa

SEQ ID NO: 329218 - DNA, 25 bp, Rattus norvegicus
gactgttgcagtacgtttctagacc

SEQ ID NO: 329219 - DNA, 25 bp, Rattus norvegicus
gactgttgcagttcgtttctagacc

SEQ ID NO: 329220 - DNA, 25 bp, Rattus norvegicus
gactgttgctacatgagaggtgtga

SEQ ID NO: 329221 - DNA, 25 bp, Rattus norvegicus
gactgttgctacttgagaggtgtga

SEQ ID NO: 329222 - DNA, 25 bp, Rattus norvegicus
gactgttggagtatatgtttctcta

SEQ ID NO: 329223 - DNA, 25 bp, Rattus norvegicus
gactgttggagtttatgtttctcta

SEQ ID NO: 329224 - DNA, 25 bp, Rattus norvegicus
gactgttgggcaatgttttagttac

SEQ ID NO: 329225 - DNA, 25 bp, Rattus norvegicus
gactgttgggcattgttttagttac

SEQ ID NO: 329226 - DNA, 25 bp, Rattus norvegicus
gactgttgggctcttttccttgttg

SEQ ID NO: 329227 - DNA, 25 bp, Rattus norvegicus
gactgttgggctgttttccttgttg

SEQ ID NO: 329228 - DNA, 25 bp, Rattus norvegicus
gactgttggtgaaggccaggcccca

SEQ ID NO: 329229 - DNA, 25 bp, Rattus norvegicus
gactgttggtgatggccaggcccca

SEQ ID NO: 329230 - DNA, 25 bp, Rattus norvegicus
gactgttgtaacatcatgcttctta

SEQ ID NO: 329231 - DNA, 25 bp, Rattus norvegicus
gactgttgtaacttcatgcttctta

SEQ ID NO: 329232 - DNA, 25 bp, Rattus norvegicus
gactgttgtagactgattactgcct

SEQ ID NO: 329233 - DNA, 25 bp, Rattus norvegicus
gactgttgtagagtgattactgcct

SEQ ID NO: 329234 - DNA, 25 bp, Rattus norvegicus
gactgttgtagtactggtgcagcct

SEQ ID NO: 329235 - DNA, 25 bp, Rattus norvegicus
gactgttgtagttctggtgcagcct

SEQ ID NO: 329236 - DNA, 25 bp, Rattus norvegicus
gactgttgtcatcttcgaggtggaa

SEQ ID NO: 329237 - DNA, 25 bp, Rattus norvegicus
gactgttgtcatgttcgaggtggaa

SEQ ID NO: 329238 - DNA, 25 bp, Rattus norvegicus
gactgttgtctgacttgttcctgac

SEQ ID NO: 329239 - DNA, 25 bp, Rattus norvegicus
gactgttgtctgtcttgttcctgac

SEQ ID NO: 329240 - DNA, 25 bp, Rattus norvegicus
gactgttgtgcaaatctggcagcct

SEQ ID NO: 329241 - DNA, 25 bp, Rattus norvegicus
gactgttgtgcatatctggcagcct

SEQ ID NO: 329242 - DNA, 25 bp, Rattus norvegicus
gactgttgtgctctttgcttttaca

SEQ ID NO: 329243 - DNA, 25 bp, Rattus norvegicus
gactgttgtgctgtttgcttttaca

SEQ ID NO: 329244 - DNA, 25 bp, Rattus norvegicus
gactgttgtggcaatcatggtttaa

SEQ ID NO: 329245 - DNA, 25 bp, Rattus norvegicus
gactgttgtggctatcatggtttaa

SEQ ID NO: 329246 - DNA, 25 bp, Rattus norvegicus
gactgttgttggagagctacttgct

SEQ ID NO: 329247 - DNA, 25 bp, Rattus norvegicus
gactgttgttggcagttgaactaca

SEQ ID NO: 329248 - DNA, 25 bp, Rattus norvegicus
gactgttgttgggagttgaactaca

SEQ ID NO: 329249 - DNA, 25 bp, Rattus norvegicus
gactgttgttggtgagctacttgct

SEQ ID NO: 329250 - DNA, 25 bp, Rattus norvegicus
gactgtttaatgcaactctgggaaa

SEQ ID NO: 329251 - DNA, 25 bp, Rattus norvegicus
gactgtttaatggaactctgggaaa

SEQ ID NO: 329252 - DNA, 25 bp, Rattus norvegicus
gactgtttacacattaaaagccggt

SEQ ID NO: 329253 - DNA, 25 bp, Rattus norvegicus
gactgtttacactttaaaagccggt

SEQ ID NO: 329254 - DNA, 25 bp, Rattus norvegicus
gactgtttacatactccaaatcact

SEQ ID NO: 329255 - DNA, 25 bp, Rattus norvegicus
gactgtttacattctccaaatcact

SEQ ID NO: 329256 - DNA, 25 bp, Rattus norvegicus
gactgtttagtgcagctcggtatac

SEQ ID NO: 329257 - DNA, 25 bp, Rattus norvegicus
gactgtttagtggagctcggtatac

SEQ ID NO: 329258 - DNA, 25 bp, Rattus norvegicus
gactgtttattgatttctttctctc

SEQ ID NO: 329259 - DNA, 25 bp, Rattus norvegicus
gactgtttattgttttctttctctc

SEQ ID NO: 329260 - DNA, 25 bp, Rattus norvegicus
gactgtttcagaattgcatcccaag

SEQ ID NO: 329261 - DNA, 25 bp, Rattus norvegicus
gactgtttcagatttgcatcccaag

SEQ ID NO: 329262 - DNA, 25 bp, Rattus norvegicus
gactgtttcttgaagctctccagat

SEQ ID NO: 329263 - DNA, 25 bp, Rattus norvegicus
gactgtttcttgtagctctccagat

SEQ ID NO: 329264 - DNA, 25 bp, Rattus norvegicus
gactgtttgaagctagccatttgcc

SEQ ID NO: 329265 - DNA, 25 bp, Rattus norvegicus
gactgtttgaaggtagccatttgcc

SEQ ID NO: 329266 - DNA, 25 bp, Rattus norvegicus
gactgtttgcctcacagaatcctca

SEQ ID NO: 329267 - DNA, 25 bp, Rattus norvegicus
gactgtttgcctgacagaatcctca

SEQ ID NO: 329268 - DNA, 25 bp, Rattus norvegicus
gactgtttgtctctaggtttttgtg

SEQ ID NO: 329269 - DNA, 25 bp, Rattus norvegicus
gactgtttgtctgtaggtttttgtg

SEQ ID NO: 329270 - DNA, 25 bp, Rattus norvegicus
gactgtttgttcaacgaaggctcca

SEQ ID NO: 329271 - DNA, 25 bp, Rattus norvegicus
gactgtttgttctacgaaggctcca

SEQ ID NO: 329272 - DNA, 25 bp, Rattus norvegicus
gactgttttatgatccctaaacgtg

SEQ ID NO: 329273 - DNA, 25 bp, Rattus norvegicus
gactgttttatgttccctaaacgtg

SEQ ID NO: 329274 - DNA, 25 bp, Rattus norvegicus
gactgttttcccataaatactcata

SEQ ID NO: 329275 - DNA, 25 bp, Rattus norvegicus
gactgttttcccttaaatactcata

SEQ ID NO: 329276 - DNA, 25 bp, Rattus norvegicus
gactgttttctacagacgccatcgt

SEQ ID NO: 329277 - DNA, 25 bp, Rattus norvegicus
gactgttttctagagacgccatcgt

SEQ ID NO: 329278 - DNA, 25 bp, Rattus norvegicus
gactgttttctgcttaaagaactgt

SEQ ID NO: 329279 - DNA, 25 bp, Rattus norvegicus
gactgttttctggttaaagaactgt

SEQ ID NO: 329280 - DNA, 25 bp, Rattus norvegicus
gactgttttgagatgtcctctgcca

SEQ ID NO: 329281 - DNA, 25 bp, Rattus norvegicus
gactgttttgagttgtcctctgcca

SEQ ID NO: 329282 - DNA, 25 bp, Rattus norvegicus
gactgtttttaactgtctgaccatg

SEQ ID NO: 329283 - DNA, 25 bp, Rattus norvegicus
gactgtttttaagtgtctgaccatg

SEQ ID NO: 329284 - DNA, 25 bp, Rattus norvegicus
gactgtttttctcatgagggctctt

SEQ ID NO: 329285 - DNA, 25 bp, Rattus norvegicus
gactgtttttctgatgagggctctt

SEQ ID NO: 329286 - DNA, 25 bp, Rattus norvegicus
gactgttttttcatcttctcattaa

SEQ ID NO: 329287 - DNA, 25 bp, Rattus norvegicus
gactgttttttcttcttctcattaa

SEQ ID NO: 329288 - DNA, 25 bp, Rattus norvegicus
gacttaaaaccccacagagcaggaa

SEQ ID NO: 329289 - DNA, 25 bp, Rattus norvegicus
gacttaaaacccgacagagcaggaa

SEQ ID NO: 329290 - DNA, 25 bp, Rattus norvegicus
gacttaaaactacaactgcccactt

SEQ ID NO: 329291 - DNA, 25 bp, Rattus norvegicus
gacttaaaactagaactgcccactt

SEQ ID NO: 329292 - DNA, 25 bp, Rattus norvegicus
gacttaaaagtccttcgcataaatg

SEQ ID NO: 329293 - DNA, 25 bp, Rattus norvegicus
gacttaaaagtcgttcgcataaatg

SEQ ID NO: 329294 - DNA, 25 bp, Rattus norvegicus
gacttaaactggctcacaggaccta

SEQ ID NO: 329295 - DNA, 25 bp, Rattus norvegicus
gacttaaactgggtcacaggaccta

SEQ ID NO: 329296 - DNA, 25 bp, Rattus norvegicus
gacttaaacttgcatgcgcgtccct

SEQ ID NO: 329297 - DNA, 25 bp, Rattus norvegicus
gacttaaacttggatgcgcgtccct

SEQ ID NO: 329298 - DNA, 25 bp, Rattus norvegicus
gacttaaactttatggcctcctgtg

SEQ ID NO: 329299 - DNA, 25 bp, Rattus norvegicus
gacttaaactttttggcctcctgtg

SEQ ID NO: 329300 - DNA, 25 bp, Rattus norvegicus
gacttaaagttacttcaacttgatc

SEQ ID NO: 329301 - DNA, 25 bp, Rattus norvegicus
gacttaaagttagttcaacttgatc

SEQ ID NO: 329302 - DNA, 25 bp, Rattus norvegicus
gacttaacaaacatctgcttttcct

SEQ ID NO: 329303 - DNA, 25 bp, Rattus norvegicus
gacttaacaaacttctgcttttcct

SEQ ID NO: 329304 - DNA, 25 bp, Rattus norvegicus
gacttaacaaggcacctggccacat

SEQ ID NO: 329305 - DNA, 25 bp, Rattus norvegicus
gacttaacaagggacctggccacat

SEQ ID NO: 329306 - DNA, 25 bp, Rattus norvegicus
gacttaacagtaccaacagcagcgg

SEQ ID NO: 329307 - DNA, 25 bp, Rattus norvegicus
gacttaacagtagcaacagcagcgg

SEQ ID NO: 329308 - DNA, 25 bp, Rattus norvegicus
gacttaacccaaaggtgatggactt

SEQ ID NO: 329309 - DNA, 25 bp, Rattus norvegicus
gacttaacccaatggtgatggactt

SEQ ID NO: 329310 - DNA, 25 bp, Rattus norvegicus
gacttaacccagaaaatgaaccatt

SEQ ID NO: 329311 - DNA, 25 bp, Rattus norvegicus
gacttaacccagtaaatgaaccatt

SEQ ID NO: 329312 - DNA, 25 bp, Rattus norvegicus
gacttaagagtgattgcccctcagg

SEQ ID NO: 329313 - DNA, 25 bp, Rattus norvegicus
gacttaagagtgtttgcccctcagg

SEQ ID NO: 329314 - DNA, 25 bp, Rattus norvegicus
gacttaagcatcagttgatatccta

SEQ ID NO: 329315 - DNA, 25 bp, Rattus norvegicus
gacttaagcatctgttgatatccta

SEQ ID NO: 329316 - DNA, 25 bp, Rattus norvegicus
gacttaagcgcaagagacaccaaat

SEQ ID NO: 329317 - DNA, 25 bp, Rattus norvegicus
gacttaagcgcatgagacaccaaat

SEQ ID NO: 329318 - DNA, 25 bp, Rattus norvegicus
gacttaagtcataaggaagcccatg

SEQ ID NO: 329319 - DNA, 25 bp, Rattus norvegicus
gacttaagtcattaggaagcccatg

SEQ ID NO: 329320 - DNA, 25 bp, Rattus norvegicus
gacttaagtggtaggctcattatgg

SEQ ID NO: 329321 - DNA, 25 bp, Rattus norvegicus
gacttaagtggttggctcattatgg

SEQ ID NO: 329322 - DNA, 25 bp, Rattus norvegicus
gacttaagttttacccaggatagat

SEQ ID NO: 329323 - DNA, 25 bp, Rattus norvegicus
gacttaagtttttcccaggatagat

SEQ ID NO: 329324 - DNA, 25 bp, Rattus norvegicus
gacttaataaagaaattcctggcct

SEQ ID NO: 329325 - DNA, 25 bp, Rattus norvegicus
gacttaataaagtaattcctggcct

SEQ ID NO: 329326 - DNA, 25 bp, Rattus norvegicus
gacttaatcaaaactcttttcaatt

SEQ ID NO: 329327 - DNA, 25 bp, Rattus norvegicus
gacttaatcaaatctcttttcaatt

SEQ ID NO: 329328 - DNA, 25 bp, Rattus norvegicus
gacttaatcgggagctttcccagaa

SEQ ID NO: 329329 - DNA, 25 bp, Rattus norvegicus
gacttaatcgggtgctttcccagaa

SEQ ID NO: 329330 - DNA, 25 bp, Rattus norvegicus
gacttaatgatgactcgttgggcat

SEQ ID NO: 329331 - DNA, 25 bp, Rattus norvegicus
gacttaatgatgtctcgttgggcat

SEQ ID NO: 329332 - DNA, 25 bp, Rattus norvegicus
gacttaatgtccacagataaaggct

SEQ ID NO: 329333 - DNA, 25 bp, Rattus norvegicus
gacttaatgtcctcagataaaggct

SEQ ID NO: 329334 - DNA, 25 bp, Rattus norvegicus
gacttaatgtggatttcgcttgttg

SEQ ID NO: 329335 - DNA, 25 bp, Rattus norvegicus
gacttaatgtggttttcgcttgttg

SEQ ID NO: 329336 - DNA, 25 bp, Rattus norvegicus
gacttaattatcatttgttgccaga

SEQ ID NO: 329337 - DNA, 25 bp, Rattus norvegicus
gacttaattatcttttgttgccaga

SEQ ID NO: 329338 - DNA, 25 bp, Rattus norvegicus
gacttacaaaggctgcatattttcc

SEQ ID NO: 329339 - DNA, 25 bp, Rattus norvegicus
gacttacaaagggtgcatattttcc

SEQ ID NO: 329340 - DNA, 25 bp, Rattus norvegicus
gacttacaacgtcatcgaggcggcc

SEQ ID NO: 329341 - DNA, 25 bp, Rattus norvegicus
gacttacaacgtgatcgaggcggcc

SEQ ID NO: 329342 - DNA, 25 bp, Rattus norvegicus
gacttacaagatcgcgtctctatta

SEQ ID NO: 329343 - DNA, 25 bp, Rattus norvegicus
gacttacaagatggcgtctctatta

SEQ ID NO: 329344 - DNA, 25 bp, Rattus norvegicus
gacttacacatcattgactgcaact

SEQ ID NO: 329345 - DNA, 25 bp, Rattus norvegicus
gacttacacatctttgactgcaact

SEQ ID NO: 329346 - DNA, 25 bp, Rattus norvegicus
gacttacacgagcagggcgtttgca

SEQ ID NO: 329347 - DNA, 25 bp, Rattus norvegicus
gacttacacgaggagggcgtttgca

SEQ ID NO: 329348 - DNA, 25 bp, Rattus norvegicus
gacttacactagatcctgtctccaa

SEQ ID NO: 329349 - DNA, 25 bp, Rattus norvegicus
gacttacactagttcctgtctccaa

SEQ ID NO: 329350 - DNA, 25 bp, Rattus norvegicus
gacttacagctaactggattcccag

SEQ ID NO: 329351 - DNA, 25 bp, Rattus norvegicus
gacttacagctatctggattcccag

SEQ ID NO: 329352 - DNA, 25 bp, Rattus norvegicus
gacttacatccgctggcaggacttg

SEQ ID NO: 329353 - DNA, 25 bp, Rattus norvegicus
gacttacatccggtggcaggacttg

SEQ ID NO: 329354 - DNA, 25 bp, Rattus norvegicus
gacttacatcgtagagccagagcct

SEQ ID NO: 329355 - DNA, 25 bp, Rattus norvegicus
gacttacatcgttgagccagagcct

SEQ ID NO: 329356 - DNA, 25 bp, Rattus norvegicus
gacttacatggcaggtatatgtcat

SEQ ID NO: 329357 - DNA, 25 bp, Rattus norvegicus
gacttacatggctggtatatgtcat

SEQ ID NO: 329358 - DNA, 25 bp, Rattus norvegicus
gacttaccagctactgtctgttagg

SEQ ID NO: 329359 - DNA, 25 bp, Rattus norvegicus
gacttaccagcttctgtctgttagg

SEQ ID NO: 329360 - DNA, 25 bp, Rattus norvegicus
gacttaccaggactgtagcaattgc

SEQ ID NO: 329361 - DNA, 25 bp, Rattus norvegicus
gacttaccaggagtgtagcaattgc

SEQ ID NO: 329362 - DNA, 25 bp, Rattus norvegicus
gacttaccatgtacagttgtgactg

SEQ ID NO: 329363 - DNA, 25 bp, Rattus norvegicus
gacttaccatgttcagttgtgactg

SEQ ID NO: 329364 - DNA, 25 bp, Rattus norvegicus
gacttaccgttaagctctcatagaa

SEQ ID NO: 329365 - DNA, 25 bp, Rattus norvegicus
gacttaccgttatgctctcatagaa

SEQ ID NO: 329366 - DNA, 25 bp, Rattus norvegicus
gacttacctcaacatggtacacgct

SEQ ID NO: 329367 - DNA, 25 bp, Rattus norvegicus
gacttacctcaagatggtacacgct

SEQ ID NO: 329368 - DNA, 25 bp, Rattus norvegicus
gacttacctggtactaaacccacag

SEQ ID NO: 329369 - DNA, 25 bp, Rattus norvegicus
gacttacctggttctaaacccacag

SEQ ID NO: 329370 - DNA, 25 bp, Rattus norvegicus
gacttaccttgtcacttacagcaga

SEQ ID NO: 329371 - DNA, 25 bp, Rattus norvegicus
gacttaccttgtgacttacagcaga

SEQ ID NO: 329372 - DNA, 25 bp, Rattus norvegicus
gacttacgcacaccaatctctcaga

SEQ ID NO: 329373 - DNA, 25 bp, Rattus norvegicus
gacttacgcacagcaatctctcaga

SEQ ID NO: 329374 - DNA, 25 bp, Rattus norvegicus
gacttacggaggaggtccaacttct

SEQ ID NO: 329375 - DNA, 25 bp, Rattus norvegicus
gacttacggaggtggtccaacttct

SEQ ID NO: 329376 - DNA, 25 bp, Rattus norvegicus
gacttacgtaggagttgacttcatt

SEQ ID NO: 329377 - DNA, 25 bp, Rattus norvegicus
gacttacgtaggtgttgacttcatt

SEQ ID NO: 329378 - DNA, 25 bp, Rattus norvegicus
gacttacgtcttattgatggaccga

SEQ ID NO: 329379 - DNA, 25 bp, Rattus norvegicus
gacttacgtctttttgatggaccga

SEQ ID NO: 329380 - DNA, 25 bp, Rattus norvegicus
gacttactaacaactaccacagttt

SEQ ID NO: 329381 - DNA, 25 bp, Rattus norvegicus
gacttactaacatctaccacagttt

SEQ ID NO: 329382 - DNA, 25 bp, Rattus norvegicus
gacttactagtccaatctgtcttga

SEQ ID NO: 329383 - DNA, 25 bp, Rattus norvegicus
gacttactagtcgaatctgtcttga

SEQ ID NO: 329384 - DNA, 25 bp, Rattus norvegicus
gacttactcactcacatttctcttc

SEQ ID NO: 329385 - DNA, 25 bp, Rattus norvegicus
gacttactcactgacatttctcttc

SEQ ID NO: 329386 - DNA, 25 bp, Rattus norvegicus
gacttactcgggatggcagacttgc

SEQ ID NO: 329387 - DNA, 25 bp, Rattus norvegicus
gacttactcgggttggcagacttgc

SEQ ID NO: 329388 - DNA, 25 bp, Rattus norvegicus
gacttactctgaattccatgggttg

SEQ ID NO: 329389 - DNA, 25 bp, Rattus norvegicus
gacttactctgatttccatgggttg

SEQ ID NO: 329390 - DNA, 25 bp, Rattus norvegicus
gacttactgaggaaacggcgagaac

SEQ ID NO: 329391 - DNA, 25 bp, Rattus norvegicus
gacttactgaggtaacggcgagaac

SEQ ID NO: 329392 - DNA, 25 bp, Rattus norvegicus
gacttactggtcaaacttcctacac

SEQ ID NO: 329393 - DNA, 25 bp, Rattus norvegicus
gacttactggtcatagaaggctttc

SEQ ID NO: 329394 - DNA, 25 bp, Rattus norvegicus
gacttactggtctaacttcctacac

SEQ ID NO: 329395 - DNA, 25 bp, Rattus norvegicus
gacttactggtcttagaaggctttc

SEQ ID NO: 329396 - DNA, 25 bp, Rattus norvegicus
gacttactggttacaagcttgttcc

SEQ ID NO: 329397 - DNA, 25 bp, Rattus norvegicus
gacttactggtttcaagcttgttcc

SEQ ID NO: 329398 - DNA, 25 bp, Rattus norvegicus
gacttactgttgaacagcagtgcta

SEQ ID NO: 329399 - DNA, 25 bp, Rattus norvegicus
gacttactgttgtacagcagtgcta

SEQ ID NO: 329400 - DNA, 25 bp, Rattus norvegicus
gacttacttatactgatccattcca

SEQ ID NO: 329401 - DNA, 25 bp, Rattus norvegicus
gacttacttatagtgatccattcca

SEQ ID NO: 329402 - DNA, 25 bp, Rattus norvegicus
gacttacttctgagtgcttttgtta

SEQ ID NO: 329403 - DNA, 25 bp, Rattus norvegicus
gacttacttctgtgtgcttttgtta

SEQ ID NO: 329404 - DNA, 25 bp, Rattus norvegicus
gacttacttcttcttacagccttca

SEQ ID NO: 329405 - DNA, 25 bp, Rattus norvegicus
gacttacttcttgttacagccttca

SEQ ID NO: 329406 - DNA, 25 bp, Rattus norvegicus
gacttactttagaagatgcctagcc

SEQ ID NO: 329407 - DNA, 25 bp, Rattus norvegicus
gacttactttagtagatgcctagcc

SEQ ID NO: 329408 - DNA, 25 bp, Rattus norvegicus
gacttactttccattttcctgtgga

SEQ ID NO: 329409 - DNA, 25 bp, Rattus norvegicus
gacttactttcctttttcctgtgga

SEQ ID NO: 329410 - DNA, 25 bp, Rattus norvegicus
gacttactttggaagcctgtcatct

SEQ ID NO: 329411 - DNA, 25 bp, Rattus norvegicus
gacttactttggtagcctgtcatct

SEQ ID NO: 329412 - DNA, 25 bp, Rattus norvegicus
gacttagaatcaagtgtgtctgcat

SEQ ID NO: 329413 - DNA, 25 bp, Rattus norvegicus
gacttagaatcatgtgtgtctgcat

SEQ ID NO: 329414 - DNA, 25 bp, Rattus norvegicus
gacttagacaagagcaaccccatat

SEQ ID NO: 329415 - DNA, 25 bp, Rattus norvegicus
gacttagacaagtgcaaccccatat

SEQ ID NO: 329416 - DNA, 25 bp, Rattus norvegicus
gacttagactgacacttcctgaata

SEQ ID NO: 329417 - DNA, 25 bp, Rattus norvegicus
gacttagactgagacttcctgaata

SEQ ID NO: 329418 - DNA, 25 bp, Rattus norvegicus
gacttagacttacttagagcttatt

SEQ ID NO: 329419 - DNA, 25 bp, Rattus norvegicus
gacttagacttagttagagcttatt

SEQ ID NO: 329420 - DNA, 25 bp, Rattus norvegicus
gacttagagactcggctgaatcaga

SEQ ID NO: 329421 - DNA, 25 bp, Rattus norvegicus
gacttagagactgggctgaatcaga

SEQ ID NO: 329422 - DNA, 25 bp, Rattus norvegicus
gacttagagctgctgatgcgacgac

SEQ ID NO: 329423 - DNA, 25 bp, Rattus norvegicus
gacttagagctggtgatgcgacgac

SEQ ID NO: 329424 - DNA, 25 bp, Rattus norvegicus
gacttagaggccatgcggatgcaga

SEQ ID NO: 329425 - DNA, 25 bp, Rattus norvegicus
gacttagaggccttgcggatgcaga

SEQ ID NO: 329426 - DNA, 25 bp, Rattus norvegicus
gacttagaggtcatgatctgtcttg

SEQ ID NO: 329427 - DNA, 25 bp, Rattus norvegicus
gacttagaggtcttgatctgtcttg

SEQ ID NO: 329428 - DNA, 25 bp, Rattus norvegicus
gacttagagtgcatggtgcccgtca

SEQ ID NO: 329429 - DNA, 25 bp, Rattus norvegicus
gacttagagtgcttggtgcccgtca

SEQ ID NO: 329430 - DNA, 25 bp, Rattus norvegicus
gacttagatcatcgcaggctcagat

SEQ ID NO: 329431 - DNA, 25 bp, Rattus norvegicus
gacttagatcatggcaggctcagat

SEQ ID NO: 329432 - DNA, 25 bp, Rattus norvegicus
gacttagatgtgaaatccagtgcag

SEQ ID NO: 329433 - DNA, 25 bp, Rattus norvegicus
gacttagatgtgtaatccagtgcag

SEQ ID NO: 329434 - DNA, 25 bp, Rattus norvegicus
gacttagcagttacactgggccctt

SEQ ID NO: 329435 - DNA, 25 bp, Rattus norvegicus
gacttagcagtttcactgggccctt

SEQ ID NO: 329436 - DNA, 25 bp, Rattus norvegicus
gacttagcatcacttggtcctcaga

SEQ ID NO: 329437 - DNA, 25 bp, Rattus norvegicus
gacttagcatcagttggtcctcaga

SEQ ID NO: 329438 - DNA, 25 bp, Rattus norvegicus
gacttagcctgactgcatagcttag

SEQ ID NO: 329439 - DNA, 25 bp, Rattus norvegicus
gacttagcctgagtgcatagcttag

SEQ ID NO: 329440 - DNA, 25 bp, Rattus norvegicus
gacttagcctggatgaccttacatt

SEQ ID NO: 329441 - DNA, 25 bp, Rattus norvegicus
gacttagcctggttgaccttacatt

SEQ ID NO: 329442 - DNA, 25 bp, Rattus norvegicus
gacttagctgcaattatagttttct

SEQ ID NO: 329443 - DNA, 25 bp, Rattus norvegicus
gacttagctgcatttatagttttct

SEQ ID NO: 329444 - DNA, 25 bp, Rattus norvegicus
gacttagcttgtctttggctcatcc

SEQ ID NO: 329445 - DNA, 25 bp, Rattus norvegicus
gacttagcttgtgtttggctcatcc

SEQ ID NO: 329446 - DNA, 25 bp, Rattus norvegicus
gacttaggaacgacaggccacttaa

SEQ ID NO: 329447 - DNA, 25 bp, Rattus norvegicus
gacttaggaacgtcaggccacttaa

SEQ ID NO: 329448 - DNA, 25 bp, Rattus norvegicus
gacttaggaattcgcctttcatgac

SEQ ID NO: 329449 - DNA, 25 bp, Rattus norvegicus
gacttaggaattggcctttcatgac

SEQ ID NO: 329450 - DNA, 25 bp, Rattus norvegicus
gacttaggagatacagccttctgcc

SEQ ID NO: 329451 - DNA, 25 bp, Rattus norvegicus
gacttaggagattcagccttctgcc

SEQ ID NO: 329452 - DNA, 25 bp, Rattus norvegicus
gacttaggccgcactatcggccgaa

SEQ ID NO: 329453 - DNA, 25 bp, Rattus norvegicus
gacttaggccgctctatcggccgaa

SEQ ID NO: 329454 - DNA, 25 bp, Rattus norvegicus
gacttaggcctcctggtcagttgag

SEQ ID NO: 329455 - DNA, 25 bp, Rattus norvegicus
gacttaggcctcgtggtcagttgag

SEQ ID NO: 329456 - DNA, 25 bp, Rattus norvegicus
gacttaggctcaaaatttttgaaca

SEQ ID NO: 329457 - DNA, 25 bp, Rattus norvegicus
gacttaggctcataatttttgaaca

SEQ ID NO: 329458 - DNA, 25 bp, Rattus norvegicus
gacttagggactcggcctctgctga

SEQ ID NO: 329459 - DNA, 25 bp, Rattus norvegicus
gacttagggactgggcctctgctga

SEQ ID NO: 329460 - DNA, 25 bp, Rattus norvegicus
gacttagggctacgaccacccactt

SEQ ID NO: 329461 - DNA, 25 bp, Rattus norvegicus
gacttagggctaggaccacccactt

SEQ ID NO: 329462 - DNA, 25 bp, Rattus norvegicus
gacttagggttactgattgtttcct

SEQ ID NO: 329463 - DNA, 25 bp, Rattus norvegicus
gacttagggttagtgattgtttcct

SEQ ID NO: 329464 - DNA, 25 bp, Rattus norvegicus
gacttaggtttcagtgaacaccgtt

SEQ ID NO: 329465 - DNA, 25 bp, Rattus norvegicus
gacttaggtttctgtgaacaccgtt

SEQ ID NO: 329466 - DNA, 25 bp, Rattus norvegicus
gacttagtattcattttgcttcaga

SEQ ID NO: 329467 - DNA, 25 bp, Rattus norvegicus
gacttagtattctttttgcttcaga

SEQ ID NO: 329468 - DNA, 25 bp, Rattus norvegicus
gacttagtctctaaacctgttgcag

SEQ ID NO: 329469 - DNA, 25 bp, Rattus norvegicus
gacttagtctcttaacctgttgcag

SEQ ID NO: 329470 - DNA, 25 bp, Rattus norvegicus
gacttagtctttcattcattttcat

SEQ ID NO: 329471 - DNA, 25 bp, Rattus norvegicus
gacttagtctttgattcattttcat

SEQ ID NO: 329472 - DNA, 25 bp, Rattus norvegicus
gacttagtgagacacactcctcatg

SEQ ID NO: 329473 - DNA, 25 bp, Rattus norvegicus
gacttagtgagagacactcctcatg

SEQ ID NO: 329474 - DNA, 25 bp, Rattus norvegicus
gacttagtgtatactagactactga

SEQ ID NO: 329475 - DNA, 25 bp, Rattus norvegicus
gacttagtgtattctagactactga

SEQ ID NO: 329476 - DNA, 25 bp, Rattus norvegicus
gacttagtgtttatcaggtggacca

SEQ ID NO: 329477 - DNA, 25 bp, Rattus norvegicus
gacttagtgtttttcaggtggacca

SEQ ID NO: 329478 - DNA, 25 bp, Rattus norvegicus
gacttagtttctcatgattttccca

SEQ ID NO: 329479 - DNA, 25 bp, Rattus norvegicus
gacttagtttctgatgattttccca

SEQ ID NO: 329480 - DNA, 25 bp, Rattus norvegicus
gacttatacatgcaagacctgtgga

SEQ ID NO: 329481 - DNA, 25 bp, Rattus norvegicus
gacttatacatggaagacctgtgga

SEQ ID NO: 329482 - DNA, 25 bp, Rattus norvegicus
gacttatcaggaagagccactcact

SEQ ID NO: 329483 - DNA, 25 bp, Rattus norvegicus
gacttatcaggatgagccactcact

SEQ ID NO: 329484 - DNA, 25 bp, Rattus norvegicus
gacttatcagtaagccccgaatttt

SEQ ID NO: 329485 - DNA, 25 bp, Rattus norvegicus
gacttatcagtatgccccgaatttt

SEQ ID NO: 329486 - DNA, 25 bp, Rattus norvegicus
gacttatcccgaccaagtgtcgaga

SEQ ID NO: 329487 - DNA, 25 bp, Rattus norvegicus
gacttatcccgagcaagtgtcgaga

SEQ ID NO: 329488 - DNA, 25 bp, Rattus norvegicus
gacttatccctcctgttacagaagt

SEQ ID NO: 329489 - DNA, 25 bp, Rattus norvegicus
gacttatccctcgtgttacagaagt

SEQ ID NO: 329490 - DNA, 25 bp, Rattus norvegicus
gacttatccgtaccccttttgtaga

SEQ ID NO: 329491 - DNA, 25 bp, Rattus norvegicus
gacttatccgtagcccttttgtaga

SEQ ID NO: 329492 - DNA, 25 bp, Rattus norvegicus
gacttatctagaacagtgccactat

SEQ ID NO: 329493 - DNA, 25 bp, Rattus norvegicus
gacttatctagatcagtgccactat

SEQ ID NO: 329494 - DNA, 25 bp, Rattus norvegicus
gacttatgatgaactggtagcccag

SEQ ID NO: 329495 - DNA, 25 bp, Rattus norvegicus
gacttatgatgatctggtagcccag

SEQ ID NO: 329496 - DNA, 25 bp, Rattus norvegicus
gacttatgctggattctggctttgt

SEQ ID NO: 329497 - DNA, 25 bp, Rattus norvegicus
gacttatgctggtttctggctttgt

SEQ ID NO: 329498 - DNA, 25 bp, Rattus norvegicus
gacttatgggatcaaatcacgcttt

SEQ ID NO: 329499 - DNA, 25 bp, Rattus norvegicus
gacttatgggatgaaatcacgcttt

SEQ ID NO: 329500 - DNA, 25 bp, Rattus norvegicus
gacttatgtaataggcagacggtga

SEQ ID NO: 329501 - DNA, 25 bp, Rattus norvegicus
gacttatgtaattggcagacggtga

SEQ ID NO: 329502 - DNA, 25 bp, Rattus norvegicus
gacttatgtacaatgtcgggttcta

SEQ ID NO: 329503 - DNA, 25 bp, Rattus norvegicus
gacttatgtacattgtcgggttcta

SEQ ID NO: 329504 - DNA, 25 bp, Rattus norvegicus
gacttatgtactagtctactgtaga

SEQ ID NO: 329505 - DNA, 25 bp, Rattus norvegicus
gacttatgtacttgtctactgtaga

SEQ ID NO: 329506 - DNA, 25 bp, Rattus norvegicus
gacttatgtcctccaactcagaaaa

SEQ ID NO: 329507 - DNA, 25 bp, Rattus norvegicus
gacttatgtcctgcaactcagaaaa

SEQ ID NO: 329508 - DNA, 25 bp, Rattus norvegicus
gacttattaaacagccaccgttctt

SEQ ID NO: 329509 - DNA, 25 bp, Rattus norvegicus
gacttattaaactgccaccgttctt

SEQ ID NO: 329510 - DNA, 25 bp, Rattus norvegicus
gacttattagtgacgaggctgtgac

SEQ ID NO: 329511 - DNA, 25 bp, Rattus norvegicus
gacttattagtgtcgaggctgtgac

SEQ ID NO: 329512 - DNA, 25 bp, Rattus norvegicus
gacttattatctactacattctaga

SEQ ID NO: 329513 - DNA, 25 bp, Rattus norvegicus
gacttattatcttctacattctaga

SEQ ID NO: 329514 - DNA, 25 bp, Rattus norvegicus
gacttattgactcagcttggccaca

SEQ ID NO: 329515 - DNA, 25 bp, Rattus norvegicus
gacttattgactgagcttggccaca

SEQ ID NO: 329516 - DNA, 25 bp, Rattus norvegicus
gacttatttcagctgtagacattac

SEQ ID NO: 329517 - DNA, 25 bp, Rattus norvegicus
gacttatttcaggtgtagacattac

SEQ ID NO: 329518 - DNA, 25 bp, Rattus norvegicus
gacttatttcatatcttgttttcct

SEQ ID NO: 329519 - DNA, 25 bp, Rattus norvegicus
gacttatttcatttcttgttttcct

SEQ ID NO: 329520 - DNA, 25 bp, Rattus norvegicus
gacttcaaaaacagtttctcgccct

SEQ ID NO: 329521 - DNA, 25 bp, Rattus norvegicus
gacttcaaaaactgtttctcgccct

SEQ ID NO: 329522 - DNA, 25 bp, Rattus norvegicus
gacttcaaaagcagaacagcactag

SEQ ID NO: 329523 - DNA, 25 bp, Rattus norvegicus
gacttcaaaagctgaacagcactag

SEQ ID NO: 329524 - DNA, 25 bp, Rattus norvegicus
gacttcaaacctaggattgtcccct

SEQ ID NO: 329525 - DNA, 25 bp, Rattus norvegicus
gacttcaaaccttggattgtcccct

SEQ ID NO: 329526 - DNA, 25 bp, Rattus norvegicus
gacttcaaagccagtggtgtccact

SEQ ID NO: 329527 - DNA, 25 bp, Rattus norvegicus
gacttcaaagcctgtggtgtccact

SEQ ID NO: 329528 - DNA, 25 bp, Rattus norvegicus
gacttcaaagtcacaatggcatgct

SEQ ID NO: 329529 - DNA, 25 bp, Rattus norvegicus
gacttcaaagtctcaatggcatgct

SEQ ID NO: 329530 - DNA, 25 bp, Rattus norvegicus
gacttcaacagcaactcccattctt

SEQ ID NO: 329531 - DNA, 25 bp, Rattus norvegicus
gacttcaacagctactcccattctt

SEQ ID NO: 329532 - DNA, 25 bp, Rattus norvegicus
gacttcaacggtattgtggcgtgta

SEQ ID NO: 329533 - DNA, 25 bp, Rattus norvegicus
gacttcaacggttttgtggcgtgta

SEQ ID NO: 329534 - DNA, 25 bp, Rattus norvegicus
gacttcaagaaaccacaggacagat

SEQ ID NO: 329535 - DNA, 25 bp, Rattus norvegicus
gacttcaagaaagcacaggacagat

SEQ ID NO: 329536 - DNA, 25 bp, Rattus norvegicus
gacttcaagcaaccaccctgtgtgt

SEQ ID NO: 329537 - DNA, 25 bp, Rattus norvegicus
gacttcaagcaagcaccctgtgtgt

SEQ ID NO: 329538 - DNA, 25 bp, Rattus norvegicus
gacttcaaggcgattctatcttact

SEQ ID NO: 329539 - DNA, 25 bp, Rattus norvegicus
gacttcaaggcgtttctatcttact

SEQ ID NO: 329540 - DNA, 25 bp, Rattus norvegicus
gacttcaagtcaactaggcaaccaa

SEQ ID NO: 329541 - DNA, 25 bp, Rattus norvegicus
gacttcaagtcatctaggcaaccaa

SEQ ID NO: 329542 - DNA, 25 bp, Rattus norvegicus
gacttcaagtccacagagcagcgat

SEQ ID NO: 329543 - DNA, 25 bp, Rattus norvegicus
gacttcaagtcctcagagcagcgat

SEQ ID NO: 329544 - DNA, 25 bp, Rattus norvegicus
gacttcaagttccaaagcatccaag

SEQ ID NO: 329545 - DNA, 25 bp, Rattus norvegicus
gacttcaagttcgaaagcatccaag

SEQ ID NO: 329546 - DNA, 25 bp, Rattus norvegicus
gacttcaatagcacaacacccggag

SEQ ID NO: 329547 - DNA, 25 bp, Rattus norvegicus
gacttcaatagctcaacacccggag

SEQ ID NO: 329548 - DNA, 25 bp, Rattus norvegicus
gacttcacacataccaatactgcat

SEQ ID NO: 329549 - DNA, 25 bp, Rattus norvegicus
gacttcacacattccaatactgcat

SEQ ID NO: 329550 - DNA, 25 bp, Rattus norvegicus
gacttcacagcaaacttggctcagg

SEQ ID NO: 329551 - DNA, 25 bp, Rattus norvegicus
gacttcacagcaacaagagggccaa

SEQ ID NO: 329552 - DNA, 25 bp, Rattus norvegicus
gacttcacagcatacttggctcagg

SEQ ID NO: 329553 - DNA, 25 bp, Rattus norvegicus
gacttcacagcatcaagagggccaa

SEQ ID NO: 329554 - DNA, 25 bp, Rattus norvegicus
gacttcacagctacaaataccttat

SEQ ID NO: 329555 - DNA, 25 bp, Rattus norvegicus
gacttcacagcttcaaataccttat

SEQ ID NO: 329556 - DNA, 25 bp, Rattus norvegicus
gacttcacagtaatctttaatatga

SEQ ID NO: 329557 - DNA, 25 bp, Rattus norvegicus
gacttcacagtattctttaatatga

SEQ ID NO: 329558 - DNA, 25 bp, Rattus norvegicus
gacttcacagtgcaggagctctcag

SEQ ID NO: 329559 - DNA, 25 bp, Rattus norvegicus
gacttcacagtggaggagctctcag

SEQ ID NO: 329560 - DNA, 25 bp, Rattus norvegicus
gacttcacatggagtcattatcttg

SEQ ID NO: 329561 - DNA, 25 bp, Rattus norvegicus
gacttcacatggtgtcattatcttg

SEQ ID NO: 329562 - DNA, 25 bp, Rattus norvegicus
gacttcaccaacctgctggagcagg

SEQ ID NO: 329563 - DNA, 25 bp, Rattus norvegicus
gacttcaccaacgtgctggagcagg

SEQ ID NO: 329564 - DNA, 25 bp, Rattus norvegicus
gacttcaccaagaaaggcttcctct

SEQ ID NO: 329565 - DNA, 25 bp, Rattus norvegicus
gacttcaccaagaagctgaccgctt

SEQ ID NO: 329566 - DNA, 25 bp, Rattus norvegicus
gacttcaccaagtaaggcttcctct

SEQ ID NO: 329567 - DNA, 25 bp, Rattus norvegicus
gacttcaccaagtagctgaccgctt

SEQ ID NO: 329568 - DNA, 25 bp, Rattus norvegicus
gacttcaccagaactatggcatgtt

SEQ ID NO: 329569 - DNA, 25 bp, Rattus norvegicus
gacttcaccagatctatggcatgtt

SEQ ID NO: 329570 - DNA, 25 bp, Rattus norvegicus
gacttcaccagtagccttctgaaat

SEQ ID NO: 329571 - DNA, 25 bp, Rattus norvegicus
gacttcaccagttgccttctgaaat

SEQ ID NO: 329572 - DNA, 25 bp, Rattus norvegicus
gacttcacctgcacaggaaaggctt

SEQ ID NO: 329573 - DNA, 25 bp, Rattus norvegicus
gacttcacctgctcaggaaaggctt

SEQ ID NO: 329574 - DNA, 25 bp, Rattus norvegicus
gacttcacggctcccaacatctggg

SEQ ID NO: 329575 - DNA, 25 bp, Rattus norvegicus
gacttcacggctgccaacatctggg

SEQ ID NO: 329576 - DNA, 25 bp, Rattus norvegicus
gacttcacgtggacaggttacttca

SEQ ID NO: 329577 - DNA, 25 bp, Rattus norvegicus
gacttcacgtggtcaggttacttca

SEQ ID NO: 329578 - DNA, 25 bp, Rattus norvegicus
gacttcactgaacattcacgtgcaa

SEQ ID NO: 329579 - DNA, 25 bp, Rattus norvegicus
gacttcactgaagattcacgtgcaa

SEQ ID NO: 329580 - DNA, 25 bp, Rattus norvegicus
gacttcactgtgaacgagtgcccag

SEQ ID NO: 329581 - DNA, 25 bp, Rattus norvegicus
gacttcactgtgaatattacctgca

SEQ ID NO: 329582 - DNA, 25 bp, Rattus norvegicus
gacttcactgtgtacgagtgcccag

SEQ ID NO: 329583 - DNA, 25 bp, Rattus norvegicus
gacttcactgtgtatattacctgca

SEQ ID NO: 329584 - DNA, 25 bp, Rattus norvegicus
gacttcactttcaagtctgctgtaa

SEQ ID NO: 329585 - DNA, 25 bp, Rattus norvegicus
gacttcactttctagtctgctgtaa

SEQ ID NO: 329586 - DNA, 25 bp, Rattus norvegicus
gacttcagaattacatttccagggt

SEQ ID NO: 329587 - DNA, 25 bp, Rattus norvegicus
gacttcagaatttcatttccagggt

SEQ ID NO: 329588 - DNA, 25 bp, Rattus norvegicus
gacttcagagtaattctgcttgcca

SEQ ID NO: 329589 - DNA, 25 bp, Rattus norvegicus
gacttcagagtatttctgcttgcca

SEQ ID NO: 329590 - DNA, 25 bp, Rattus norvegicus
gacttcagcagcactcgagagagct

SEQ ID NO: 329591 - DNA, 25 bp, Rattus norvegicus
gacttcagcagctctcgagagagct

SEQ ID NO: 329592 - DNA, 25 bp, Rattus norvegicus
gacttcagcatgatgatgtgggtta

SEQ ID NO: 329593 - DNA, 25 bp, Rattus norvegicus
gacttcagcatgttgatgtgggtta

SEQ ID NO: 329594 - DNA, 25 bp, Rattus norvegicus
gacttcagcattcttggcagcttac

SEQ ID NO: 329595 - DNA, 25 bp, Rattus norvegicus
gacttcagcattgttggcagcttac

SEQ ID NO: 329596 - DNA, 25 bp, Rattus norvegicus
gacttcagcctacattgatcctgga

SEQ ID NO: 329597 - DNA, 25 bp, Rattus norvegicus
gacttcagcctagattgatcctgga

SEQ ID NO: 329598 - DNA, 25 bp, Rattus norvegicus
gacttcagctcgatgatgcgtctgt

SEQ ID NO: 329599 - DNA, 25 bp, Rattus norvegicus
gacttcagctcgttgatgcgtctgt

SEQ ID NO: 329600 - DNA, 25 bp, Rattus norvegicus
gacttcagctgactatagttccaca

SEQ ID NO: 329601 - DNA, 25 bp, Rattus norvegicus
gacttcagctgagtatagttccaca

SEQ ID NO: 329602 - DNA, 25 bp, Rattus norvegicus
gacttcaggaaaatggtcactactg

SEQ ID NO: 329603 - DNA, 25 bp, Rattus norvegicus
gacttcaggaaattggtcactactg

SEQ ID NO: 329604 - DNA, 25 bp, Rattus norvegicus
gacttcaggacccttgtagtgcttc

SEQ ID NO: 329605 - DNA, 25 bp, Rattus norvegicus
gacttcaggaccgttgtagtgcttc

SEQ ID NO: 329606 - DNA, 25 bp, Rattus norvegicus
gacttcaggctgaggatgtacggct

SEQ ID NO: 329607 - DNA, 25 bp, Rattus norvegicus
gacttcaggctgtggatgtacggct

SEQ ID NO: 329608 - DNA, 25 bp, Rattus norvegicus
gacttcaggtaaccccagagctcgg

SEQ ID NO: 329609 - DNA, 25 bp, Rattus norvegicus
gacttcaggtaagcccagagctcgg

SEQ ID NO: 329610 - DNA, 25 bp, Rattus norvegicus
gacttcagtacccatctctgtgtgg

SEQ ID NO: 329611 - DNA, 25 bp, Rattus norvegicus
gacttcagtaccgatctctgtgtgg

SEQ ID NO: 329612 - DNA, 25 bp, Rattus norvegicus
gacttcagtgaacagcgctggtacg

SEQ ID NO: 329613 - DNA, 25 bp, Rattus norvegicus
gacttcagtgaagagcgctggtacg

SEQ ID NO: 329614 - DNA, 25 bp, Rattus norvegicus
gacttcagttacatcagtgtagagc

SEQ ID NO: 329615 - DNA, 25 bp, Rattus norvegicus
gacttcagttacttcagtgtagagc

SEQ ID NO: 329616 - DNA, 25 bp, Rattus norvegicus
gacttcagttatcgagcaggctttt

SEQ ID NO: 329617 - DNA, 25 bp, Rattus norvegicus
gacttcagttatggagcaggctttt

SEQ ID NO: 329618 - DNA, 25 bp, Rattus norvegicus
gacttcagttcaacatctctgtgaa

SEQ ID NO: 329619 - DNA, 25 bp, Rattus norvegicus
gacttcagttcaagcatttttccag

SEQ ID NO: 329620 - DNA, 25 bp, Rattus norvegicus
gacttcagttcatcatctctgtgaa

SEQ ID NO: 329621 - DNA, 25 bp, Rattus norvegicus
gacttcagttcatgcatttttccag

SEQ ID NO: 329622 - DNA, 25 bp, Rattus norvegicus
gacttcataagcacagactccccaa

SEQ ID NO: 329623 - DNA, 25 bp, Rattus norvegicus
gacttcataagctcagactccccaa

SEQ ID NO: 329624 - DNA, 25 bp, Rattus norvegicus
gacttcatagatacacttggcttgt

SEQ ID NO: 329625 - DNA, 25 bp, Rattus norvegicus
gacttcatagattcacttggcttgt

SEQ ID NO: 329626 - DNA, 25 bp, Rattus norvegicus
gacttcatcatgctcaaaggctgtg

SEQ ID NO: 329627 - DNA, 25 bp, Rattus norvegicus
gacttcatcatggtcaaaggctgtg

SEQ ID NO: 329628 - DNA, 25 bp, Rattus norvegicus
gacttcatccagaatggtgtgcatc

SEQ ID NO: 329629 - DNA, 25 bp, Rattus norvegicus
gacttcatccagtatggtgtgcatc

SEQ ID NO: 329630 - DNA, 25 bp, Rattus norvegicus
gacttcatcctaatcattttggtta

SEQ ID NO: 329631 - DNA, 25 bp, Rattus norvegicus
gacttcatcctattcattttggtta

SEQ ID NO: 329632 - DNA, 25 bp, Rattus norvegicus
gacttcatcgagcaggcccagtgat

SEQ ID NO: 329633 - DNA, 25 bp, Rattus norvegicus
gacttcatcgaggaggcccagtgat

SEQ ID NO: 329634 - DNA, 25 bp, Rattus norvegicus
gacttcatcgctctggttcaggccg

SEQ ID NO: 329635 - DNA, 25 bp, Rattus norvegicus
gacttcatcgctgtggttcaggccg

SEQ ID NO: 329636 - DNA, 25 bp, Rattus norvegicus
gacttcatctgcatgcaaggtgctt

SEQ ID NO: 329637 - DNA, 25 bp, Rattus norvegicus
gacttcatctgcttgcaaggtgctt

SEQ ID NO: 329638 - DNA, 25 bp, Rattus norvegicus
gacttcatctgtcgaggtgtgctcg

SEQ ID NO: 329639 - DNA, 25 bp, Rattus norvegicus
gacttcatctgtggaggtgtgctcg

SEQ ID NO: 329640 - DNA, 25 bp, Rattus norvegicus
gacttcatgcctcctccaaagagta

SEQ ID NO: 329641 - DNA, 25 bp, Rattus norvegicus
gacttcatgcctgctccaaagagta

SEQ ID NO: 329642 - DNA, 25 bp, Rattus norvegicus
gacttcatgctaaatatcttttgta

SEQ ID NO: 329643 - DNA, 25 bp, Rattus norvegicus
gacttcatgctaaattattttcttg

SEQ ID NO: 329644 - DNA, 25 bp, Rattus norvegicus
gacttcatgctatatatcttttgta

SEQ ID NO: 329645 - DNA, 25 bp, Rattus norvegicus
gacttcatgctatattattttcttg

SEQ ID NO: 329646 - DNA, 25 bp, Rattus norvegicus
gacttcatggatcctgtcatcagct

SEQ ID NO: 329647 - DNA, 25 bp, Rattus norvegicus
gacttcatggatgctgtcatcagct

SEQ ID NO: 329648 - DNA, 25 bp, Rattus norvegicus
gacttcatggcaacattggagccca

SEQ ID NO: 329649 - DNA, 25 bp, Rattus norvegicus
gacttcatggcatcattggagccca

SEQ ID NO: 329650 - DNA, 25 bp, Rattus norvegicus
gacttcatggctaatccttgctgta

SEQ ID NO: 329651 - DNA, 25 bp, Rattus norvegicus
gacttcatggcttatccttgctgta

SEQ ID NO: 329652 - DNA, 25 bp, Rattus norvegicus
gacttcatgggcaggtgttttctaa

SEQ ID NO: 329653 - DNA, 25 bp, Rattus norvegicus
gacttcatgggctggtgttttctaa

SEQ ID NO: 329654 - DNA, 25 bp, Rattus norvegicus
gacttcatgtccagggtgggccttg

SEQ ID NO: 329655 - DNA, 25 bp, Rattus norvegicus
gacttcatgtcctgggtgggccttg

SEQ ID NO: 329656 - DNA, 25 bp, Rattus norvegicus
gacttcattacccaacatgcctgta

SEQ ID NO: 329657 - DNA, 25 bp, Rattus norvegicus
gacttcattaccgaacatgcctgta

SEQ ID NO: 329658 - DNA, 25 bp, Rattus norvegicus
gacttcattactctggaggagccct

SEQ ID NO: 329659 - DNA, 25 bp, Rattus norvegicus
gacttcattactgtggaggagccct

SEQ ID NO: 329660 - DNA, 25 bp, Rattus norvegicus
gacttcattcaaattgctctgcaga

SEQ ID NO: 329661 - DNA, 25 bp, Rattus norvegicus
gacttcattcaatttgctctgcaga

SEQ ID NO: 329662 - DNA, 25 bp, Rattus norvegicus
gacttcattcatataacagcctgtt

SEQ ID NO: 329663 - DNA, 25 bp, Rattus norvegicus
gacttcattcatttaacagcctgtt

SEQ ID NO: 329664 - DNA, 25 bp, Rattus norvegicus
gacttcattcttaacttgttcttac

SEQ ID NO: 329665 - DNA, 25 bp, Rattus norvegicus
gacttcattctttacttgttcttac

SEQ ID NO: 329666 - DNA, 25 bp, Rattus norvegicus
gacttcattgagacgcattacctga

SEQ ID NO: 329667 - DNA, 25 bp, Rattus norvegicus
gacttcattgagtcgcattacctga

SEQ ID NO: 329668 - DNA, 25 bp, Rattus norvegicus
gacttcattgttaccaaggcgcgag

SEQ ID NO: 329669 - DNA, 25 bp, Rattus norvegicus
gacttcattgtttccaaggcgcgag

SEQ ID NO: 329670 - DNA, 25 bp, Rattus norvegicus
gacttcatttatatgcacccacttt

SEQ ID NO: 329671 - DNA, 25 bp, Rattus norvegicus
gacttcatttatttgcacccacttt

SEQ ID NO: 329672 - DNA, 25 bp, Rattus norvegicus
gacttcatttcaatggccattctca

SEQ ID NO: 329673 - DNA, 25 bp, Rattus norvegicus
gacttcatttcattggccattctca

SEQ ID NO: 329674 - DNA, 25 bp, Rattus norvegicus
gacttcatttctcatgggttggagg

SEQ ID NO: 329675 - DNA, 25 bp, Rattus norvegicus
gacttcatttctgatgggttggagg

SEQ ID NO: 329676 - DNA, 25 bp, Rattus norvegicus
gacttccaaaggaccggcgcacttg

SEQ ID NO: 329677 - DNA, 25 bp, Rattus norvegicus
gacttccaaaggtccggcgcacttg

SEQ ID NO: 329678 - DNA, 25 bp, Rattus norvegicus
gacttccaaccaacacagagggtca

SEQ ID NO: 329679 - DNA, 25 bp, Rattus norvegicus
gacttccaaccatcacagagggtca

SEQ ID NO: 329680 - DNA, 25 bp, Rattus norvegicus
gacttccacacaaatatcatcgcac

SEQ ID NO: 329681 - DNA, 25 bp, Rattus norvegicus
gacttccacacatatatcatcgcac

SEQ ID NO: 329682 - DNA, 25 bp, Rattus norvegicus
gacttccaccgcagtgagaaggcaa

SEQ ID NO: 329683 - DNA, 25 bp, Rattus norvegicus
gacttccaccgctgtgagaaggcaa

SEQ ID NO: 329684 - DNA, 25 bp, Rattus norvegicus
gacttccactccagtaaattctcat

SEQ ID NO: 329685 - DNA, 25 bp, Rattus norvegicus
gacttccactcctgtaaattctcat

SEQ ID NO: 329686 - DNA, 25 bp, Rattus norvegicus
gacttccagagcaaaagaccatcac

SEQ ID NO: 329687 - DNA, 25 bp, Rattus norvegicus
gacttccagagctaaagaccatcac

SEQ ID NO: 329688 - DNA, 25 bp, Rattus norvegicus
gacttccaggacattttcattttgt

SEQ ID NO: 329689 - DNA, 25 bp, Rattus norvegicus
gacttccaggactttttcattttgt

SEQ ID NO: 329690 - DNA, 25 bp, Rattus norvegicus
gacttccaggagaactgtgtcttcc

SEQ ID NO: 329691 - DNA, 25 bp, Rattus norvegicus
gacttccaggagtactgtgtcttcc

SEQ ID NO: 329692 - DNA, 25 bp, Rattus norvegicus
gacttccaggcccatggtacaatct

SEQ ID NO: 329693 - DNA, 25 bp, Rattus norvegicus
gacttccaggccgatggtacaatct

SEQ ID NO: 329694 - DNA, 25 bp, Rattus norvegicus
gacttccagggcataagggctaact

SEQ ID NO: 329695 - DNA, 25 bp, Rattus norvegicus
gacttccagggcttaagggctaact

SEQ ID NO: 329696 - DNA, 25 bp, Rattus norvegicus
gacttccagggtcttggtagccaga

SEQ ID NO: 329697 - DNA, 25 bp, Rattus norvegicus
gacttccagggtgttggtagccaga

SEQ ID NO: 329698 - DNA, 25 bp, Rattus norvegicus
gacttccagtgtccaaatcggacag

SEQ ID NO: 329699 - DNA, 25 bp, Rattus norvegicus
gacttccagtgtgcaaatcggacag

SEQ ID NO: 329700 - DNA, 25 bp, Rattus norvegicus
gacttccatgataggtttctctgta

SEQ ID NO: 329701 - DNA, 25 bp, Rattus norvegicus
gacttccatgattggtttctctgta

SEQ ID NO: 329702 - DNA, 25 bp, Rattus norvegicus
gacttccatgggagtgtatcacagt

SEQ ID NO: 329703 - DNA, 25 bp, Rattus norvegicus
gacttccatgggtgtgtatcacagt

SEQ ID NO: 329704 - DNA, 25 bp, Rattus norvegicus
gacttccatgttcagtgtctgcagg

SEQ ID NO: 329705 - DNA, 25 bp, Rattus norvegicus
gacttccatgttgagtgtctgcagg

SEQ ID NO: 329706 - DNA, 25 bp, Rattus norvegicus
gacttccattcacaggtgactgttg

SEQ ID NO: 329707 - DNA, 25 bp, Rattus norvegicus
gacttccattcagaggtgactgttg

SEQ ID NO: 329708 - DNA, 25 bp, Rattus norvegicus
gacttccattctccaattgtgcttg

SEQ ID NO: 329709 - DNA, 25 bp, Rattus norvegicus
gacttccattctgcaattgtgcttg

SEQ ID NO: 329710 - DNA, 25 bp, Rattus norvegicus
gacttcccaatcactgtataatcca

SEQ ID NO: 329711 - DNA, 25 bp, Rattus norvegicus
gacttcccaatctctgtataatcca

SEQ ID NO: 329712 - DNA, 25 bp, Rattus norvegicus
gacttcccagccagggccttaaaat

SEQ ID NO: 329713 - DNA, 25 bp, Rattus norvegicus
gacttcccagcctgggccttaaaat

SEQ ID NO: 329714 - DNA, 25 bp, Rattus norvegicus
gacttcccatgcataggccatgtca

SEQ ID NO: 329715 - DNA, 25 bp, Rattus norvegicus
gacttcccatgcttaggccatgtca

SEQ ID NO: 329716 - DNA, 25 bp, Rattus norvegicus
gacttccccaggaggtttcagctga

SEQ ID NO: 329717 - DNA, 25 bp, Rattus norvegicus
gacttccccaggtggtttcagctga

SEQ ID NO: 329718 - DNA, 25 bp, Rattus norvegicus
gacttccccgttaaaatgttagcag

SEQ ID NO: 329719 - DNA, 25 bp, Rattus norvegicus
gacttccccgtttaaatgttagcag

SEQ ID NO: 329720 - DNA, 25 bp, Rattus norvegicus
gacttcccctggagaattctaatca

SEQ ID NO: 329721 - DNA, 25 bp, Rattus norvegicus
gacttcccctggtgaattctaatca

SEQ ID NO: 329722 - DNA, 25 bp, Rattus norvegicus
gacttcccgttaaccagtcatttga

SEQ ID NO: 329723 - DNA, 25 bp, Rattus norvegicus
gacttcccgttatccagtcatttga

SEQ ID NO: 329724 - DNA, 25 bp, Rattus norvegicus
gacttccctaatacccactcttgta

SEQ ID NO: 329725 - DNA, 25 bp, Rattus norvegicus
gacttccctaattcccactcttgta

SEQ ID NO: 329726 - DNA, 25 bp, Rattus norvegicus
gacttccctttgcacttgatgtata

SEQ ID NO: 329727 - DNA, 25 bp, Rattus norvegicus
gacttccctttggacttgatgtata

SEQ ID NO: 329728 - DNA, 25 bp, Rattus norvegicus
gacttccgagctcacgatgctgatg

SEQ ID NO: 329729 - DNA, 25 bp, Rattus norvegicus
gacttccgagctgacgatgctgatg

SEQ ID NO: 329730 - DNA, 25 bp, Rattus norvegicus
gacttccggaagattgagcctctat

SEQ ID NO: 329731 - DNA, 25 bp, Rattus norvegicus
gacttccggaagtttgagcctctat

SEQ ID NO: 329732 - DNA, 25 bp, Rattus norvegicus
gacttccgggttatatagccgcgat

SEQ ID NO: 329733 - DNA, 25 bp, Rattus norvegicus
gacttccgggttttatagccgcgat

SEQ ID NO: 329734 - DNA, 25 bp, Rattus norvegicus
gacttcctaagtattcctgacttca

SEQ ID NO: 329735 - DNA, 25 bp, Rattus norvegicus
gacttcctaagttttcctgacttca

SEQ ID NO: 329736 - DNA, 25 bp, Rattus norvegicus
gacttcctaccaatttcaatgcaga

SEQ ID NO: 329737 - DNA, 25 bp, Rattus norvegicus
gacttcctaccattttcaatgcaga

SEQ ID NO: 329738 - DNA, 25 bp, Rattus norvegicus
gacttcctacgcatgttgctggata

SEQ ID NO: 329739 - DNA, 25 bp, Rattus norvegicus
gacttcctacgcttgttgctggata

SEQ ID NO: 329740 - DNA, 25 bp, Rattus norvegicus
gacttcctactcagtgtgggaggtt

SEQ ID NO: 329741 - DNA, 25 bp, Rattus norvegicus
gacttcctactctgtgtgggaggtt

SEQ ID NO: 329742 - DNA, 25 bp, Rattus norvegicus
gacttcctaggaagggatgcactgt

SEQ ID NO: 329743 - DNA, 25 bp, Rattus norvegicus
gacttcctaggatgggatgcactgt

SEQ ID NO: 329744 - DNA, 25 bp, Rattus norvegicus
gacttcctatataatttttcctaag

SEQ ID NO: 329745 - DNA, 25 bp, Rattus norvegicus
gacttcctatattatttttcctaag

SEQ ID NO: 329746 - DNA, 25 bp, Rattus norvegicus
gacttcctatctattccattgtggt

SEQ ID NO: 329747 - DNA, 25 bp, Rattus norvegicus
gacttcctatcttttccattgtggt

SEQ ID NO: 329748 - DNA, 25 bp, Rattus norvegicus
gacttcctcagcacatttgtatttt

SEQ ID NO: 329749 - DNA, 25 bp, Rattus norvegicus
gacttcctcagctcatttgtatttt

SEQ ID NO: 329750 - DNA, 25 bp, Rattus norvegicus
gacttcctcagtcagccctggaggg

SEQ ID NO: 329751 - DNA, 25 bp, Rattus norvegicus
gacttcctcagtcgttatagacacc

SEQ ID NO: 329752 - DNA, 25 bp, Rattus norvegicus
gacttcctcagtgagccctggaggg

SEQ ID NO: 329753 - DNA, 25 bp, Rattus norvegicus
gacttcctcagtggttatagacacc

SEQ ID NO: 329754 - DNA, 25 bp, Rattus norvegicus
gacttcctcatgctatcggtgaagg

SEQ ID NO: 329755 - DNA, 25 bp, Rattus norvegicus
gacttcctcatggtatcggtgaagg

SEQ ID NO: 329756 - DNA, 25 bp, Rattus norvegicus
gacttcctccaaattcctgtatgaa

SEQ ID NO: 329757 - DNA, 25 bp, Rattus norvegicus
gacttcctccaatttcctgtatgaa

SEQ ID NO: 329758 - DNA, 25 bp, Rattus norvegicus
gacttcctccctctgaaaatatgaa

SEQ ID NO: 329759 - DNA, 25 bp, Rattus norvegicus
gacttcctccctgtgaaaatatgaa

SEQ ID NO: 329760 - DNA, 25 bp, Rattus norvegicus
gacttcctccgaagacaaacggtga

SEQ ID NO: 329761 - DNA, 25 bp, Rattus norvegicus
gacttcctccgatgacaaacggtga

SEQ ID NO: 329762 - DNA, 25 bp, Rattus norvegicus
gacttcctgagcctattgtgagtgc

SEQ ID NO: 329763 - DNA, 25 bp, Rattus norvegicus
gacttcctgagcgtattgtgagtgc

SEQ ID NO: 329764 - DNA, 25 bp, Rattus norvegicus
gacttcctgaggaggcattatataa

SEQ ID NO: 329765 - DNA, 25 bp, Rattus norvegicus
gacttcctgaggtggcattatataa

SEQ ID NO: 329766 - DNA, 25 bp, Rattus norvegicus
gacttcctgatgaacccaatggtta

SEQ ID NO: 329767 - DNA, 25 bp, Rattus norvegicus
gacttcctgatgtacccaatggtta

SEQ ID NO: 329768 - DNA, 25 bp, Rattus norvegicus
gacttcctgcagcagctagcttgag

SEQ ID NO: 329769 - DNA, 25 bp, Rattus norvegicus
gacttcctgcaggagctagcttgag

SEQ ID NO: 329770 - DNA, 25 bp, Rattus norvegicus
gacttcctgcggctttcgaagaggt

SEQ ID NO: 329771 - DNA, 25 bp, Rattus norvegicus
gacttcctgcgggtttcgaagaggt

SEQ ID NO: 329772 - DNA, 25 bp, Rattus norvegicus
gacttcctgctaaccaaaactaaca

SEQ ID NO: 329773 - DNA, 25 bp, Rattus norvegicus
gacttcctgctatccaaaactaaca

SEQ ID NO: 329774 - DNA, 25 bp, Rattus norvegicus
gacttcctggtcaatcctggtgatc

SEQ ID NO: 329775 - DNA, 25 bp, Rattus norvegicus
gacttcctggtctatcctggtgatc

SEQ ID NO: 329776 - DNA, 25 bp, Rattus norvegicus
gacttcctgtatactccatgggtta

SEQ ID NO: 329777 - DNA, 25 bp, Rattus norvegicus
gacttcctgtatctataccctggga

SEQ ID NO: 329778 - DNA, 25 bp, Rattus norvegicus
gacttcctgtatgtataccctggga

SEQ ID NO: 329779 - DNA, 25 bp, Rattus norvegicus
gacttcctgtattctccatgggtta

SEQ ID NO: 329780 - DNA, 25 bp, Rattus norvegicus
gacttcctgtccctagaatagttgg

SEQ ID NO: 329781 - DNA, 25 bp, Rattus norvegicus
gacttcctgtccgtagaatagttgg

SEQ ID NO: 329782 - DNA, 25 bp, Rattus norvegicus
gacttcctgttccatcacagaggcc

SEQ ID NO: 329783 - DNA, 25 bp, Rattus norvegicus
gacttcctgttcgatcacagaggcc

SEQ ID NO: 329784 - DNA, 25 bp, Rattus norvegicus
gacttcctgtttaggctctgcctcg

SEQ ID NO: 329785 - DNA, 25 bp, Rattus norvegicus
gacttcctgttttggctctgcctcg

SEQ ID NO: 329786 - DNA, 25 bp, Rattus norvegicus
gacttccttattcaattcttctata

SEQ ID NO: 329787 - DNA, 25 bp, Rattus norvegicus
gacttccttattgaattcttctata

SEQ ID NO: 329788 - DNA, 25 bp, Rattus norvegicus
gacttccttcatcaggatgcctgaa

SEQ ID NO: 329789 - DNA, 25 bp, Rattus norvegicus
gacttccttcatgaggatgcctgaa

SEQ ID NO: 329790 - DNA, 25 bp, Rattus norvegicus
gacttccttctcagttctgtactga

SEQ ID NO: 329791 - DNA, 25 bp, Rattus norvegicus
gacttccttctcatgttacatagca

SEQ ID NO: 329792 - DNA, 25 bp, Rattus norvegicus
gacttccttctctgttctgtactga

SEQ ID NO: 329793 - DNA, 25 bp, Rattus norvegicus
gacttccttctcttgttacatagca

SEQ ID NO: 329794 - DNA, 25 bp, Rattus norvegicus
gacttccttctgcaatgaagccttt

SEQ ID NO: 329795 - DNA, 25 bp, Rattus norvegicus
gacttccttctggaatgaagccttt

SEQ ID NO: 329796 - DNA, 25 bp, Rattus norvegicus
gacttccttcttcactcaaaggttg

SEQ ID NO: 329797 - DNA, 25 bp, Rattus norvegicus
gacttccttcttgactcaaaggttg

SEQ ID NO: 329798 - DNA, 25 bp, Rattus norvegicus
gacttccttgataacatgccgtaca

SEQ ID NO: 329799 - DNA, 25 bp, Rattus norvegicus
gacttccttgattacatgccgtaca

SEQ ID NO: 329800 - DNA, 25 bp, Rattus norvegicus
gacttccttggcatggtctatggta

SEQ ID NO: 329801 - DNA, 25 bp, Rattus norvegicus
gacttccttggcttggtctatggta

SEQ ID NO: 329802 - DNA, 25 bp, Rattus norvegicus
gacttcctttggctaattctgtagt

SEQ ID NO: 329803 - DNA, 25 bp, Rattus norvegicus
gacttcctttgggtaattctgtagt

SEQ ID NO: 329804 - DNA, 25 bp, Rattus norvegicus
gacttccttttcaggtgacaacttt

SEQ ID NO: 329805 - DNA, 25 bp, Rattus norvegicus
gacttccttttctggtgacaacttt

SEQ ID NO: 329806 - DNA, 25 bp, Rattus norvegicus
gacttcgacgagatccttgtcatga

SEQ ID NO: 329807 - DNA, 25 bp, Rattus norvegicus
gacttcgacgagttccttgtcatga

SEQ ID NO: 329808 - DNA, 25 bp, Rattus norvegicus
gacttcgagagtcctgtccaacctc

SEQ ID NO: 329809 - DNA, 25 bp, Rattus norvegicus
gacttcgagagtgctgtccaacctc

SEQ ID NO: 329810 - DNA, 25 bp, Rattus norvegicus
gacttcgagcaacagatggccactg

SEQ ID NO: 329811 - DNA, 25 bp, Rattus norvegicus
gacttcgagcaagagatggccactg

SEQ ID NO: 329812 - DNA, 25 bp, Rattus norvegicus
gacttcgaggaaagacacctttaca

SEQ ID NO: 329813 - DNA, 25 bp, Rattus norvegicus
gacttcgaggaatgacacctttaca

SEQ ID NO: 329814 - DNA, 25 bp, Rattus norvegicus
gacttcgcaacgcagtgtctgaaat

SEQ ID NO: 329815 - DNA, 25 bp, Rattus norvegicus
gacttcgcaacggagtgtctgaaat

SEQ ID NO: 329816 - DNA, 25 bp, Rattus norvegicus
gacttcgcactgaggttttgtgtag

SEQ ID NO: 329817 - DNA, 25 bp, Rattus norvegicus
gacttcgcactgtggttttgtgtag

SEQ ID NO: 329818 - DNA, 25 bp, Rattus norvegicus
gacttcgcagtcattgggctccaag

SEQ ID NO: 329819 - DNA, 25 bp, Rattus norvegicus
gacttcgcagtctttgggctccaag

SEQ ID NO: 329820 - DNA, 25 bp, Rattus norvegicus
gacttcgccccaacaaaattgtaag

SEQ ID NO: 329821 - DNA, 25 bp, Rattus norvegicus
gacttcgccccatcaaaattgtaag

SEQ ID NO: 329822 - DNA, 25 bp, Rattus norvegicus
gacttcgcctctcaagaaaccgtaa

SEQ ID NO: 329823 - DNA, 25 bp, Rattus norvegicus
gacttcgcctctgaagaaaccgtaa

SEQ ID NO: 329824 - DNA, 25 bp, Rattus norvegicus
gacttcggcagtatggtgatccatt

SEQ ID NO: 329825 - DNA, 25 bp, Rattus norvegicus
gacttcggcagtttggtgatccatt

SEQ ID NO: 329826 - DNA, 25 bp, Rattus norvegicus
gacttcggcatgagcagggacatct

SEQ ID NO: 329827 - DNA, 25 bp, Rattus norvegicus
gacttcggcatgtgcagggacatct

SEQ ID NO: 329828 - DNA, 25 bp, Rattus norvegicus
gacttcggcgggactgagcagcaaa

SEQ ID NO: 329829 - DNA, 25 bp, Rattus norvegicus
gacttcggcgggtctgagcagcaaa

SEQ ID NO: 329830 - DNA, 25 bp, Rattus norvegicus
gacttcggctatcaacaaactgtta

SEQ ID NO: 329831 - DNA, 25 bp, Rattus norvegicus
gacttcggctatgaacaaactgtta

SEQ ID NO: 329832 - DNA, 25 bp, Rattus norvegicus
gacttcgggcagcagtacacgtcaa

SEQ ID NO: 329833 - DNA, 25 bp, Rattus norvegicus
gacttcgggcaggagtacacgtcaa

SEQ ID NO: 329834 - DNA, 25 bp, Rattus norvegicus
gacttcggtgtccagggtagacctc

SEQ ID NO: 329835 - DNA, 25 bp, Rattus norvegicus
gacttcggtgtcgagggtagacctc

SEQ ID NO: 329836 - DNA, 25 bp, Rattus norvegicus
gacttcggttcactgaaggcgttct

SEQ ID NO: 329837 - DNA, 25 bp, Rattus norvegicus
gacttcggttcagtgaaggcgttct

SEQ ID NO: 329838 - DNA, 25 bp, Rattus norvegicus
gacttcggttgaccacctgacaatg

SEQ ID NO: 329839 - DNA, 25 bp, Rattus norvegicus
gacttcggttgagcacctgacaatg

SEQ ID NO: 329840 - DNA, 25 bp, Rattus norvegicus
gacttcgtactcactttgttgtgtt

SEQ ID NO: 329841 - DNA, 25 bp, Rattus norvegicus
gacttcgtactctctttgttgtgtt

SEQ ID NO: 329842 - DNA, 25 bp, Rattus norvegicus
gacttcgtccatcagggatctgctg

SEQ ID NO: 329843 - DNA, 25 bp, Rattus norvegicus
gacttcgtccatgagggatctgctg

SEQ ID NO: 329844 - DNA, 25 bp, Rattus norvegicus
gacttcgtgaacagtttaagccaag

SEQ ID NO: 329845 - DNA, 25 bp, Rattus norvegicus
gacttcgtgaactgtttaagccaag

SEQ ID NO: 329846 - DNA, 25 bp, Rattus norvegicus
gacttcgtgcagattcagctggaga

SEQ ID NO: 329847 - DNA, 25 bp, Rattus norvegicus
gacttcgtgcagtttcagctggaga

SEQ ID NO: 329848 - DNA, 25 bp, Rattus norvegicus
gacttcgtgcggaacttcatgcgga

SEQ ID NO: 329849 - DNA, 25 bp, Rattus norvegicus
gacttcgtgcggtacttcatgcgga

SEQ ID NO: 329850 - DNA, 25 bp, Rattus norvegicus
gacttcgtggcgatcccatttgata

SEQ ID NO: 329851 - DNA, 25 bp, Rattus norvegicus
gacttcgtggcgttcccatttgata

SEQ ID NO: 329852 - DNA, 25 bp, Rattus norvegicus
gacttcgtgggtcagagcaccacca

SEQ ID NO: 329853 - DNA, 25 bp, Rattus norvegicus
gacttcgtgggtgagagcaccacca

SEQ ID NO: 329854 - DNA, 25 bp, Rattus norvegicus
gacttcgttggtcatgaaagggcaa

SEQ ID NO: 329855 - DNA, 25 bp, Rattus norvegicus
gacttcgttggtgatgaaagggcaa

SEQ ID NO: 329856 - DNA, 25 bp, Rattus norvegicus
gacttcgtttatcttggtgtgtatg

SEQ ID NO: 329857 - DNA, 25 bp, Rattus norvegicus
gacttcgtttatgttggtgtgtatg

SEQ ID NO: 329858 - DNA, 25 bp, Rattus norvegicus
gacttctaagacagagggcacattc

SEQ ID NO: 329859 - DNA, 25 bp, Rattus norvegicus
gacttctaagactgagggcacattc

SEQ ID NO: 329860 - DNA, 25 bp, Rattus norvegicus
gacttctaatctatgtgtgcttttt

SEQ ID NO: 329861 - DNA, 25 bp, Rattus norvegicus
gacttctaatctttgtgtgcttttt

SEQ ID NO: 329862 - DNA, 25 bp, Rattus norvegicus
gacttctacaaaagtaatttcgaga

SEQ ID NO: 329863 - DNA, 25 bp, Rattus norvegicus
gacttctacaaaagttctttccaga

SEQ ID NO: 329864 - DNA, 25 bp, Rattus norvegicus
gacttctacaaatgtaatttcgaga

SEQ ID NO: 329865 - DNA, 25 bp, Rattus norvegicus
gacttctacaaatgttctttccaga

SEQ ID NO: 329866 - DNA, 25 bp, Rattus norvegicus
gacttctacggcaagggaacctcaa

SEQ ID NO: 329867 - DNA, 25 bp, Rattus norvegicus
gacttctacggctagggaacctcaa

SEQ ID NO: 329868 - DNA, 25 bp, Rattus norvegicus
gacttctaggtcagcaatgtattca

SEQ ID NO: 329869 - DNA, 25 bp, Rattus norvegicus
gacttctaggtctgcaatgtattca

SEQ ID NO: 329870 - DNA, 25 bp, Rattus norvegicus
gacttctataagaccaaaccgctcc

SEQ ID NO: 329871 - DNA, 25 bp, Rattus norvegicus
gacttctataagtccaaaccgctcc

SEQ ID NO: 329872 - DNA, 25 bp, Rattus norvegicus
gacttctatctgcagtttctttata

SEQ ID NO: 329873 - DNA, 25 bp, Rattus norvegicus
gacttctatctggagtttctttata

SEQ ID NO: 329874 - DNA, 25 bp, Rattus norvegicus
gacttctatgacaaacctctcagca

SEQ ID NO: 329875 - DNA, 25 bp, Rattus norvegicus
gacttctatgactaacctctcagca

SEQ ID NO: 329876 - DNA, 25 bp, Rattus norvegicus
gacttctatgccatagtgtggacgg

SEQ ID NO: 329877 - DNA, 25 bp, Rattus norvegicus
gacttctatgccttagtgtggacgg

SEQ ID NO: 329878 - DNA, 25 bp, Rattus norvegicus
gacttctatgtgcttgtcccaaaga

SEQ ID NO: 329879 - DNA, 25 bp, Rattus norvegicus
gacttctatgtggttgtcccaaaga

SEQ ID NO: 329880 - DNA, 25 bp, Rattus norvegicus
gacttctatttcctaagtggctgta

SEQ ID NO: 329881 - DNA, 25 bp, Rattus norvegicus
gacttctatttcgtaagtggctgta

SEQ ID NO: 329882 - DNA, 25 bp, Rattus norvegicus
gacttctcaaggattgcttgtaaaa

SEQ ID NO: 329883 - DNA, 25 bp, Rattus norvegicus
gacttctcaaggtttgcttgtaaaa

SEQ ID NO: 329884 - DNA, 25 bp, Rattus norvegicus
gacttctcactgcagcatgttggca

SEQ ID NO: 329885 - DNA, 25 bp, Rattus norvegicus
gacttctcactggagcatgttggca

SEQ ID NO: 329886 - DNA, 25 bp, Rattus norvegicus
gacttctcaggtattcttaaaggct

SEQ ID NO: 329887 - DNA, 25 bp, Rattus norvegicus
gacttctcaggttttcttaaaggct

SEQ ID NO: 329888 - DNA, 25 bp, Rattus norvegicus
gacttctcagtacagaatgcagttg

SEQ ID NO: 329889 - DNA, 25 bp, Rattus norvegicus
gacttctcagtagagaatgcagttg

SEQ ID NO: 329890 - DNA, 25 bp, Rattus norvegicus
gacttctcagtgagctatttacagg

SEQ ID NO: 329891 - DNA, 25 bp, Rattus norvegicus
gacttctcagtgtgctatttacagg

SEQ ID NO: 329892 - DNA, 25 bp, Rattus norvegicus
gacttctcagttcatttcccataaa

SEQ ID NO: 329893 - DNA, 25 bp, Rattus norvegicus
gacttctcagttgatttcccataaa

SEQ ID NO: 329894 - DNA, 25 bp, Rattus norvegicus
gacttctcatctacgtattatttga

SEQ ID NO: 329895 - DNA, 25 bp, Rattus norvegicus
gacttctcatcttcgtattatttga

SEQ ID NO: 329896 - DNA, 25 bp, Rattus norvegicus
gacttctcattcaatcttctatcgt

SEQ ID NO: 329897 - DNA, 25 bp, Rattus norvegicus
gacttctcattctatcttctatcgt

SEQ ID NO: 329898 - DNA, 25 bp, Rattus norvegicus
gacttctccaccagggatgaggatc

SEQ ID NO: 329899 - DNA, 25 bp, Rattus norvegicus
gacttctccacctgggatgaggatc

SEQ ID NO: 329900 - DNA, 25 bp, Rattus norvegicus
gacttctccagaatcctttgtttca

SEQ ID NO: 329901 - DNA, 25 bp, Rattus norvegicus
gacttctccagattcctttgtttca

SEQ ID NO: 329902 - DNA, 25 bp, Rattus norvegicus
gacttctcctctcttttaactacat

SEQ ID NO: 329903 - DNA, 25 bp, Rattus norvegicus
gacttctcctctgttttaactacat

SEQ ID NO: 329904 - DNA, 25 bp, Rattus norvegicus
gacttctcctgacatgggagagcat

SEQ ID NO: 329905 - DNA, 25 bp, Rattus norvegicus
gacttctcctgagatgggagagcat

SEQ ID NO: 329906 - DNA, 25 bp, Rattus norvegicus
gacttctcctggagttccttttggt

SEQ ID NO: 329907 - DNA, 25 bp, Rattus norvegicus
gacttctcctggtgttccttttggt

SEQ ID NO: 329908 - DNA, 25 bp, Rattus norvegicus
gacttctcggtgagttgactcaaac

SEQ ID NO: 329909 - DNA, 25 bp, Rattus norvegicus
gacttctcggtgtgttgactcaaac

SEQ ID NO: 329910 - DNA, 25 bp, Rattus norvegicus
gacttctctcaacgatggattgtga

SEQ ID NO: 329911 - DNA, 25 bp, Rattus norvegicus
gacttctctcaacgtttgctgtcca

SEQ ID NO: 329912 - DNA, 25 bp, Rattus norvegicus
gacttctctcaaggatggattgtga

SEQ ID NO: 329913 - DNA, 25 bp, Rattus norvegicus
gacttctctcaaggtttgctgtcca

SEQ ID NO: 329914 - DNA, 25 bp, Rattus norvegicus
gacttctctcagagactatgacgtg

SEQ ID NO: 329915 - DNA, 25 bp, Rattus norvegicus
gacttctctcagtgactatgacgtg

SEQ ID NO: 329916 - DNA, 25 bp, Rattus norvegicus
gacttctctcccagctataagagga

SEQ ID NO: 329917 - DNA, 25 bp, Rattus norvegicus
gacttctctccctgctataagagga

SEQ ID NO: 329918 - DNA, 25 bp, Rattus norvegicus
gacttctctgaaacaaaccacggca

SEQ ID NO: 329919 - DNA, 25 bp, Rattus norvegicus
gacttctctgaatcaaaccacggca

SEQ ID NO: 329920 - DNA, 25 bp, Rattus norvegicus
gacttctctgggatagccttgtaaa

SEQ ID NO: 329921 - DNA, 25 bp, Rattus norvegicus
gacttctctgggttagccttgtaaa

SEQ ID NO: 329922 - DNA, 25 bp, Rattus norvegicus
gacttctctgtgagcttcaggaacc

SEQ ID NO: 329923 - DNA, 25 bp, Rattus norvegicus
gacttctctgtgatctttcatttta

SEQ ID NO: 329924 - DNA, 25 bp, Rattus norvegicus
gacttctctgtgtgcttcaggaacc

SEQ ID NO: 329925 - DNA, 25 bp, Rattus norvegicus
gacttctctgtgttctttcatttta

SEQ ID NO: 329926 - DNA, 25 bp, Rattus norvegicus
gacttctcttaaatccacctaggag

SEQ ID NO: 329927 - DNA, 25 bp, Rattus norvegicus
gacttctcttaattccacctaggag

SEQ ID NO: 329928 - DNA, 25 bp, Rattus norvegicus
gacttctcttttaattctgctgaca

SEQ ID NO: 329929 - DNA, 25 bp, Rattus norvegicus
gacttctcttttagcctgacatcaa

SEQ ID NO: 329930 - DNA, 25 bp, Rattus norvegicus
gacttctctttttattctgctgaca

SEQ ID NO: 329931 - DNA, 25 bp, Rattus norvegicus
gacttctctttttgcctgacatcaa

SEQ ID NO: 329932 - DNA, 25 bp, Rattus norvegicus
gacttctgaagcattatcctctctg

SEQ ID NO: 329933 - DNA, 25 bp, Rattus norvegicus
gacttctgaagctttatcctctctg

SEQ ID NO: 329934 - DNA, 25 bp, Rattus norvegicus
gacttctgaagtccctctcttggag

SEQ ID NO: 329935 - DNA, 25 bp, Rattus norvegicus
gacttctgaagtgcctctcttggag

SEQ ID NO: 329936 - DNA, 25 bp, Rattus norvegicus
gacttctgacaccaagctgatttgc

SEQ ID NO: 329937 - DNA, 25 bp, Rattus norvegicus
gacttctgacacgaagctgatttgc

SEQ ID NO: 329938 - DNA, 25 bp, Rattus norvegicus
gacttctgacctacttgccaagaga

SEQ ID NO: 329939 - DNA, 25 bp, Rattus norvegicus
gacttctgaccttcttgccaagaga

SEQ ID NO: 329940 - DNA, 25 bp, Rattus norvegicus
gacttctgagatacttgctggtaaa

SEQ ID NO: 329941 - DNA, 25 bp, Rattus norvegicus
gacttctgagattcttgctggtaaa

SEQ ID NO: 329942 - DNA, 25 bp, Rattus norvegicus
gacttctgaggacgtcttcaaagaa

SEQ ID NO: 329943 - DNA, 25 bp, Rattus norvegicus
gacttctgaggaggtcttcaaagaa

SEQ ID NO: 329944 - DNA, 25 bp, Rattus norvegicus
gacttctgagtcaatcaactgccaa

SEQ ID NO: 329945 - DNA, 25 bp, Rattus norvegicus
gacttctgagtctatcaactgccaa

SEQ ID NO: 329946 - DNA, 25 bp, Rattus norvegicus
gacttctgagtgaagcacttgccgc

SEQ ID NO: 329947 - DNA, 25 bp, Rattus norvegicus
gacttctgagtgtagcacttgccgc

SEQ ID NO: 329948 - DNA, 25 bp, Rattus norvegicus
gacttctgatcaacatagctcacag

SEQ ID NO: 329949 - DNA, 25 bp, Rattus norvegicus
gacttctgatcatcatagctcacag

SEQ ID NO: 329950 - DNA, 25 bp, Rattus norvegicus
gacttctgcaaaacaaacaccttca

SEQ ID NO: 329951 - DNA, 25 bp, Rattus norvegicus
gacttctgcaaatcaaacaccttca

SEQ ID NO: 329952 - DNA, 25 bp, Rattus norvegicus
gacttctggaagaacagtcacaagt

SEQ ID NO: 329953 - DNA, 25 bp, Rattus norvegicus
gacttctggaagtacagtcacaagt

SEQ ID NO: 329954 - DNA, 25 bp, Rattus norvegicus
gacttctggcgtattataacgttga

SEQ ID NO: 329955 - DNA, 25 bp, Rattus norvegicus
gacttctggcgttttataacgttga

SEQ ID NO: 329956 - DNA, 25 bp, Rattus norvegicus
gacttctggtttagtgtttctttag

SEQ ID NO: 329957 - DNA, 25 bp, Rattus norvegicus
gacttctggttttgtgtttctttag

SEQ ID NO: 329958 - DNA, 25 bp, Rattus norvegicus
gacttctgtacaaatgctgtgccac

SEQ ID NO: 329959 - DNA, 25 bp, Rattus norvegicus
gacttctgtacatatgctgtgccac

SEQ ID NO: 329960 - DNA, 25 bp, Rattus norvegicus
gacttctgtagcatttaggtcctgc

SEQ ID NO: 329961 - DNA, 25 bp, Rattus norvegicus
gacttctgtagcttttaggtcctgc

SEQ ID NO: 329962 - DNA, 25 bp, Rattus norvegicus
gacttctgtaggcaagttttatctt

SEQ ID NO: 329963 - DNA, 25 bp, Rattus norvegicus
gacttctgtagggaagttttatctt

SEQ ID NO: 329964 - DNA, 25 bp, Rattus norvegicus
gacttctgtataccatcatttgaat

SEQ ID NO: 329965 - DNA, 25 bp, Rattus norvegicus
gacttctgtatagcatcatttgaat

SEQ ID NO: 329966 - DNA, 25 bp, Rattus norvegicus
gacttctgtcacacacacatggaaa

SEQ ID NO: 329967 - DNA, 25 bp, Rattus norvegicus
gacttctgtcactcacacatggaaa

SEQ ID NO: 329968 - DNA, 25 bp, Rattus norvegicus
gacttctgtcatcactactgggtta

SEQ ID NO: 329969 - DNA, 25 bp, Rattus norvegicus
gacttctgtcatctttatggtttgc

SEQ ID NO: 329970 - DNA, 25 bp, Rattus norvegicus
gacttctgtcatgactactgggtta

SEQ ID NO: 329971 - DNA, 25 bp, Rattus norvegicus
gacttctgtcatgtttatggtttgc

SEQ ID NO: 329972 - DNA, 25 bp, Rattus norvegicus
gacttctgtccaacactaatttatt

SEQ ID NO: 329973 - DNA, 25 bp, Rattus norvegicus
gacttctgtccatcactaatttatt

SEQ ID NO: 329974 - DNA, 25 bp, Rattus norvegicus
gacttctgtttgatggcttgcagca

SEQ ID NO: 329975 - DNA, 25 bp, Rattus norvegicus
gacttctgtttgttggcttgcagca

SEQ ID NO: 329976 - DNA, 25 bp, Rattus norvegicus
gacttcttaacacacatcactcaat

SEQ ID NO: 329977 - DNA, 25 bp, Rattus norvegicus
gacttcttaacagacatcactcaat

SEQ ID NO: 329978 - DNA, 25 bp, Rattus norvegicus
gacttcttacaacattctccaacaa

SEQ ID NO: 329979 - DNA, 25 bp, Rattus norvegicus
gacttcttacaagattctccaacaa

SEQ ID NO: 329980 - DNA, 25 bp, Rattus norvegicus
gacttcttaggaaaacaggtatgca

SEQ ID NO: 329981 - DNA, 25 bp, Rattus norvegicus
gacttcttaggataacaggtatgca

SEQ ID NO: 329982 - DNA, 25 bp, Rattus norvegicus
gacttcttagtcatcttttcggttc

SEQ ID NO: 329983 - DNA, 25 bp, Rattus norvegicus
gacttcttagtcttcttttcggttc

SEQ ID NO: 329984 - DNA, 25 bp, Rattus norvegicus
gacttcttatctatctatgctttgt

SEQ ID NO: 329985 - DNA, 25 bp, Rattus norvegicus
gacttcttatctttctatgctttgt

SEQ ID NO: 329986 - DNA, 25 bp, Rattus norvegicus
gacttcttcaaccaacaaaacccat

SEQ ID NO: 329987 - DNA, 25 bp, Rattus norvegicus
gacttcttcaacgaacaaaacccat

SEQ ID NO: 329988 - DNA, 25 bp, Rattus norvegicus
gacttcttcaagatcaattagatag

SEQ ID NO: 329989 - DNA, 25 bp, Rattus norvegicus
gacttcttcaagttcaattagatag

SEQ ID NO: 329990 - DNA, 25 bp, Rattus norvegicus
gacttcttcaatcaaagcacctttt

SEQ ID NO: 329991 - DNA, 25 bp, Rattus norvegicus
gacttcttcaatgaaagcacctttt

SEQ ID NO: 329992 - DNA, 25 bp, Rattus norvegicus
gacttcttcacactgaccctagaga

SEQ ID NO: 329993 - DNA, 25 bp, Rattus norvegicus
gacttcttcacagtgaccctagaga

SEQ ID NO: 329994 - DNA, 25 bp, Rattus norvegicus
gacttcttctccagcataaacaagg

SEQ ID NO: 329995 - DNA, 25 bp, Rattus norvegicus
gacttcttctcctgcataaacaagg

SEQ ID NO: 329996 - DNA, 25 bp, Rattus norvegicus
gacttcttcttcagtgatgctcagt

SEQ ID NO: 329997 - DNA, 25 bp, Rattus norvegicus
gacttcttcttctgtgatgctcagt

SEQ ID NO: 329998 - DNA, 25 bp, Rattus norvegicus
gacttcttgaagatcttatcagcaa

SEQ ID NO: 329999 - DNA, 25 bp, Rattus norvegicus
gacttcttgaagttcttatcagcaa

SEQ ID NO: 330000 - DNA, 25 bp, Rattus norvegicus
gacttcttgacaactcaggccaaaa

SEQ ID NO: 330001 - DNA, 25 bp, Rattus norvegicus
gacttcttgacatctcaggccaaaa

SEQ ID NO: 330002 - DNA, 25 bp, Rattus norvegicus
gacttcttgagactgattatatgag

SEQ ID NO: 330003 - DNA, 25 bp, Rattus norvegicus
gacttcttgagagtgattatatgag

SEQ ID NO: 330004 - DNA, 25 bp, Rattus norvegicus
gacttcttgagtcagtgaattccgt

SEQ ID NO: 330005 - DNA, 25 bp, Rattus norvegicus
gacttcttgagtgagtgaattccgt

SEQ ID NO: 330006 - DNA, 25 bp, Rattus norvegicus
gacttcttggaacatggagcctatg

SEQ ID NO: 330007 - DNA, 25 bp, Rattus norvegicus
gacttcttggaagatggagcctatg

SEQ ID NO: 330008 - DNA, 25 bp, Rattus norvegicus
gacttcttggctctgatgactcaga

SEQ ID NO: 330009 - DNA, 25 bp, Rattus norvegicus
gacttcttggctgtgatgactcaga

SEQ ID NO: 330010 - DNA, 25 bp, Rattus norvegicus
gacttcttggtaccacacttctcaa

SEQ ID NO: 330011 - DNA, 25 bp, Rattus norvegicus
gacttcttggtagcacacttctcaa

SEQ ID NO: 330012 - DNA, 25 bp, Rattus norvegicus
gacttctttagtcgtatccagcacc

SEQ ID NO: 330013 - DNA, 25 bp, Rattus norvegicus
gacttctttagtggtatccagcacc

SEQ ID NO: 330014 - DNA, 25 bp, Rattus norvegicus
gacttctttctaaacattgcctaca

SEQ ID NO: 330015 - DNA, 25 bp, Rattus norvegicus
gacttctttctatacattgcctaca

SEQ ID NO: 330016 - DNA, 25 bp, Rattus norvegicus
gacttctttgatcatgaccctgtgc

SEQ ID NO: 330017 - DNA, 25 bp, Rattus norvegicus
gacttctttgatgatgaccctgtgc

SEQ ID NO: 330018 - DNA, 25 bp, Rattus norvegicus
gacttctttggacgtgtggtcatca

SEQ ID NO: 330019 - DNA, 25 bp, Rattus norvegicus
gacttctttggaggtgtggtcatca

SEQ ID NO: 330020 - DNA, 25 bp, Rattus norvegicus
gacttctttgggatttctcatccaa

SEQ ID NO: 330021 - DNA, 25 bp, Rattus norvegicus
gacttctttgggttttctcatccaa

SEQ ID NO: 330022 - DNA, 25 bp, Rattus norvegicus
gacttcttttgcatcaccatgatga

SEQ ID NO: 330023 - DNA, 25 bp, Rattus norvegicus
gacttcttttgcttcaccatgatga

SEQ ID NO: 330024 - DNA, 25 bp, Rattus norvegicus
gacttgaaaagtcgcccaacccctg

SEQ ID NO: 330025 - DNA, 25 bp, Rattus norvegicus
gacttgaaaagtggcccaacccctg

SEQ ID NO: 330026 - DNA, 25 bp, Rattus norvegicus
gacttgaaagacagacccaagttca

SEQ ID NO: 330027 - DNA, 25 bp, Rattus norvegicus
gacttgaaagactgacccaagttca

SEQ ID NO: 330028 - DNA, 25 bp, Rattus norvegicus
gacttgaaaggacttgggctcgtcc

SEQ ID NO: 330029 - DNA, 25 bp, Rattus norvegicus
gacttgaaaggagttgggctcgtcc

SEQ ID NO: 330030 - DNA, 25 bp, Rattus norvegicus
gacttgaacattccatctctcagag

SEQ ID NO: 330031 - DNA, 25 bp, Rattus norvegicus
gacttgaacattgcatctctcagag

SEQ ID NO: 330032 - DNA, 25 bp, Rattus norvegicus
gacttgaacctgcatcctctgcaag

SEQ ID NO: 330033 - DNA, 25 bp, Rattus norvegicus
gacttgaacctggatcctctgcaag

SEQ ID NO: 330034 - DNA, 25 bp, Rattus norvegicus
gacttgaacgttaattcgtgaccct

SEQ ID NO: 330035 - DNA, 25 bp, Rattus norvegicus
gacttgaacgtttattcgtgaccct

SEQ ID NO: 330036 - DNA, 25 bp, Rattus norvegicus
gacttgaactccaatggtgacagat

SEQ ID NO: 330037 - DNA, 25 bp, Rattus norvegicus
gacttgaactcctatggtgacagat

SEQ ID NO: 330038 - DNA, 25 bp, Rattus norvegicus
gacttgaacttgatttgaaactgaa

SEQ ID NO: 330039 - DNA, 25 bp, Rattus norvegicus
gacttgaacttgttttgaaactgaa

SEQ ID NO: 330040 - DNA, 25 bp, Rattus norvegicus
gacttgaagaaccttatgccatatg

SEQ ID NO: 330041 - DNA, 25 bp, Rattus norvegicus
gacttgaagaacgttatgccatatg

SEQ ID NO: 330042 - DNA, 25 bp, Rattus norvegicus
gacttgaagatcatttctccttccc

SEQ ID NO: 330043 - DNA, 25 bp, Rattus norvegicus
gacttgaagatcttttctccttccc

SEQ ID NO: 330044 - DNA, 25 bp, Rattus norvegicus
gacttgaagatgaccgggcatggca

SEQ ID NO: 330045 - DNA, 25 bp, Rattus norvegicus
gacttgaagatgtccgggcatggca

SEQ ID NO: 330046 - DNA, 25 bp, Rattus norvegicus
gacttgaagcaaccccagggtgtac

SEQ ID NO: 330047 - DNA, 25 bp, Rattus norvegicus
gacttgaagcaagcccagggtgtac

SEQ ID NO: 330048 - DNA, 25 bp, Rattus norvegicus
gacttgaagcataccagctctggct

SEQ ID NO: 330049 - DNA, 25 bp, Rattus norvegicus
gacttgaagcattccagctctggct

SEQ ID NO: 330050 - DNA, 25 bp, Rattus norvegicus
gacttgaagctgatctgagcacaca

SEQ ID NO: 330051 - DNA, 25 bp, Rattus norvegicus
gacttgaagctgttctgagcacaca

SEQ ID NO: 330052 - DNA, 25 bp, Rattus norvegicus
gacttgaagttacagctttgctcac

SEQ ID NO: 330053 - DNA, 25 bp, Rattus norvegicus
gacttgaagttagagctttgctcac

SEQ ID NO: 330054 - DNA, 25 bp, Rattus norvegicus
gacttgaatccaacccaattatctt

SEQ ID NO: 330055 - DNA, 25 bp, Rattus norvegicus
gacttgaatccatcccaattatctt

SEQ ID NO: 330056 - DNA, 25 bp, Rattus norvegicus
gacttgaatgagctcttccctgaaa

SEQ ID NO: 330057 - DNA, 25 bp, Rattus norvegicus
gacttgaatgaggtcttccctgaaa

SEQ ID NO: 330058 - DNA, 25 bp, Rattus norvegicus
gacttgaatgctagttacacttgtt

SEQ ID NO: 330059 - DNA, 25 bp, Rattus norvegicus
gacttgaatgcttgttacacttgtt

SEQ ID NO: 330060 - DNA, 25 bp, Rattus norvegicus
gacttgaattcgcactcagacccct

SEQ ID NO: 330061 - DNA, 25 bp, Rattus norvegicus
gacttgaattcggactcagacccct

SEQ ID NO: 330062 - DNA, 25 bp, Rattus norvegicus
gacttgacagagcaacggtctcaca

SEQ ID NO: 330063 - DNA, 25 bp, Rattus norvegicus
gacttgacagaggaacggtctcaca

SEQ ID NO: 330064 - DNA, 25 bp, Rattus norvegicus
gacttgacagtcaatggcttgaaaa

SEQ ID NO: 330065 - DNA, 25 bp, Rattus norvegicus
gacttgacagtctatggcttgaaaa

SEQ ID NO: 330066 - DNA, 25 bp, Rattus norvegicus
gacttgaccaacctggaacttgctg

SEQ ID NO: 330067 - DNA, 25 bp, Rattus norvegicus
gacttgaccaacgtggaacttgctg

SEQ ID NO: 330068 - DNA, 25 bp, Rattus norvegicus
gacttgacctggaacttcgagggta

SEQ ID NO: 330069 - DNA, 25 bp, Rattus norvegicus
gacttgacctggtacttcgagggta

SEQ ID NO: 330070 - DNA, 25 bp, Rattus norvegicus
gacttgaccttaagggagtttcctt

SEQ ID NO: 330071 - DNA, 25 bp, Rattus norvegicus
gacttgaccttatgggagtttcctt

SEQ ID NO: 330072 - DNA, 25 bp, Rattus norvegicus
gacttgactaggcagcgctggtaca

SEQ ID NO: 330073 - DNA, 25 bp, Rattus norvegicus
gacttgactagggagcgctggtaca

SEQ ID NO: 330074 - DNA, 25 bp, Rattus norvegicus
gacttgactgacctgaactccatag

SEQ ID NO: 330075 - DNA, 25 bp, Rattus norvegicus
gacttgactgacgtgaactccatag

SEQ ID NO: 330076 - DNA, 25 bp, Rattus norvegicus
gacttgactgctatattctaccagg

SEQ ID NO: 330077 - DNA, 25 bp, Rattus norvegicus
gacttgactgctttattctaccagg

SEQ ID NO: 330078 - DNA, 25 bp, Rattus norvegicus
gacttgacttgtactagtgttgtaa

SEQ ID NO: 330079 - DNA, 25 bp, Rattus norvegicus
gacttgacttgttctagtgttgtaa

SEQ ID NO: 330080 - DNA, 25 bp, Rattus norvegicus
gacttgactttgaaacatccctgtt

SEQ ID NO: 330081 - DNA, 25 bp, Rattus norvegicus
gacttgactttgattgtagcccatt

SEQ ID NO: 330082 - DNA, 25 bp, Rattus norvegicus
gacttgactttgtaacatccctgtt

SEQ ID NO: 330083 - DNA, 25 bp, Rattus norvegicus
gacttgactttgtttgtagcccatt

SEQ ID NO: 330084 - DNA, 25 bp, Rattus norvegicus
gacttgagacaactactctaacctt

SEQ ID NO: 330085 - DNA, 25 bp, Rattus norvegicus
gacttgagacaagtactctaacctt

SEQ ID NO: 330086 - DNA, 25 bp, Rattus norvegicus
gacttgagactaatctgcagctata

SEQ ID NO: 330087 - DNA, 25 bp, Rattus norvegicus
gacttgagactattctgcagctata

SEQ ID NO: 330088 - DNA, 25 bp, Rattus norvegicus
gacttgagatgtatgcccgggagct

SEQ ID NO: 330089 - DNA, 25 bp, Rattus norvegicus
gacttgagatgtccacctacatggc

SEQ ID NO: 330090 - DNA, 25 bp, Rattus norvegicus
gacttgagatgtgcacctacatggc

SEQ ID NO: 330091 - DNA, 25 bp, Rattus norvegicus
gacttgagatgtttgcccgggagct

SEQ ID NO: 330092 - DNA, 25 bp, Rattus norvegicus
gacttgagcacacagacccagtgta

SEQ ID NO: 330093 - DNA, 25 bp, Rattus norvegicus
gacttgagcacagagacccagtgta

SEQ ID NO: 330094 - DNA, 25 bp, Rattus norvegicus
gacttgaggcaaacaaatggtgttt

SEQ ID NO: 330095 - DNA, 25 bp, Rattus norvegicus
gacttgaggcaatcaaatggtgttt

SEQ ID NO: 330096 - DNA, 25 bp, Rattus norvegicus
gacttgaggccaacgtctattgcaa

SEQ ID NO: 330097 - DNA, 25 bp, Rattus norvegicus
gacttgaggccatcgtctattgcaa

SEQ ID NO: 330098 - DNA, 25 bp, Rattus norvegicus
gacttgaggcttactactgggacac

SEQ ID NO: 330099 - DNA, 25 bp, Rattus norvegicus
gacttgaggctttctactgggacac

SEQ ID NO: 330100 - DNA, 25 bp, Rattus norvegicus
gacttgaggtacaacttctgttttg

SEQ ID NO: 330101 - DNA, 25 bp, Rattus norvegicus
gacttgaggtactacttctgttttg

SEQ ID NO: 330102 - DNA, 25 bp, Rattus norvegicus
gacttgagtgagctctgtcccttcc

SEQ ID NO: 330103 - DNA, 25 bp, Rattus norvegicus
gacttgagtgaggtctgtcccttcc

SEQ ID NO: 330104 - DNA, 25 bp, Rattus norvegicus
gacttgagtgtacttgtgcctttga

SEQ ID NO: 330105 - DNA, 25 bp, Rattus norvegicus
gacttgagtgtagttgtgcctttga

SEQ ID NO: 330106 - DNA, 25 bp, Rattus norvegicus
gacttgataattcaccccttttgtt

SEQ ID NO: 330107 - DNA, 25 bp, Rattus norvegicus
gacttgataattgaccccttttgtt

SEQ ID NO: 330108 - DNA, 25 bp, Rattus norvegicus
gacttgatattgcttcatgccttga

SEQ ID NO: 330109 - DNA, 25 bp, Rattus norvegicus
gacttgatattggttcatgccttga

SEQ ID NO: 330110 - DNA, 25 bp, Rattus norvegicus
gacttgatcaataaccttggcacta

SEQ ID NO: 330111 - DNA, 25 bp, Rattus norvegicus
gacttgatcaatatttctctacttt

SEQ ID NO: 330112 - DNA, 25 bp, Rattus norvegicus
gacttgatcaattaccttggcacta

SEQ ID NO: 330113 - DNA, 25 bp, Rattus norvegicus
gacttgatcaatttttctctacttt

SEQ ID NO: 330114 - DNA, 25 bp, Rattus norvegicus
gacttgatccgaatcagccaggacc

SEQ ID NO: 330115 - DNA, 25 bp, Rattus norvegicus
gacttgatccgattcagccaggacc

SEQ ID NO: 330116 - DNA, 25 bp, Rattus norvegicus
gacttgatctccaagcttcttaggc

SEQ ID NO: 330117 - DNA, 25 bp, Rattus norvegicus
gacttgatctcctagcttcttaggc

SEQ ID NO: 330118 - DNA, 25 bp, Rattus norvegicus
gacttgatgatgagcgtgaacacca

SEQ ID NO: 330119 - DNA, 25 bp, Rattus norvegicus
gacttgatgatgtgcgtgaacacca

SEQ ID NO: 330120 - DNA, 25 bp, Rattus norvegicus
gacttgatggagaccctcacggagt

SEQ ID NO: 330121 - DNA, 25 bp, Rattus norvegicus
gacttgatggagtccctcacggagt

SEQ ID NO: 330122 - DNA, 25 bp, Rattus norvegicus
gacttgatgtacaccatcaacccta

SEQ ID NO: 330123 - DNA, 25 bp, Rattus norvegicus
gacttgatgtactccatcaacccta

SEQ ID NO: 330124 - DNA, 25 bp, Rattus norvegicus
gacttgatttctcaagccctcatga

SEQ ID NO: 330125 - DNA, 25 bp, Rattus norvegicus
gacttgatttctgaagccctcatga

SEQ ID NO: 330126 - DNA, 25 bp, Rattus norvegicus
gacttgcaatgcctggaggtaccat

SEQ ID NO: 330127 - DNA, 25 bp, Rattus norvegicus
gacttgcaatgcgtggaggtaccat

SEQ ID NO: 330128 - DNA, 25 bp, Rattus norvegicus
gacttgcacaatcattccagttgac

SEQ ID NO: 330129 - DNA, 25 bp, Rattus norvegicus
gacttgcacaatgattccagttgac

SEQ ID NO: 330130 - DNA, 25 bp, Rattus norvegicus
gacttgcaccatctggcttgtaata

SEQ ID NO: 330131 - DNA, 25 bp, Rattus norvegicus
gacttgcaccatgtggcttgtaata

SEQ ID NO: 330132 - DNA, 25 bp, Rattus norvegicus
gacttgcacctccaatgctttagtt

SEQ ID NO: 330133 - DNA, 25 bp, Rattus norvegicus
gacttgcacctcgaatgctttagtt

SEQ ID NO: 330134 - DNA, 25 bp, Rattus norvegicus
gacttgcacggcagcatgcttggag

SEQ ID NO: 330135 - DNA, 25 bp, Rattus norvegicus
gacttgcacggctgcatgcttggag

SEQ ID NO: 330136 - DNA, 25 bp, Rattus norvegicus
gacttgcagcaacgttaccccagag

SEQ ID NO: 330137 - DNA, 25 bp, Rattus norvegicus
gacttgcagcaaggttaccccagag

SEQ ID NO: 330138 - DNA, 25 bp, Rattus norvegicus
gacttgcagtttccctaactgtttt

SEQ ID NO: 330139 - DNA, 25 bp, Rattus norvegicus
gacttgcagtttgcctaactgtttt

SEQ ID NO: 330140 - DNA, 25 bp, Rattus norvegicus
gacttgcatagccttcaggaccggg

SEQ ID NO: 330141 - DNA, 25 bp, Rattus norvegicus
gacttgcatagcgttcaggaccggg

SEQ ID NO: 330142 - DNA, 25 bp, Rattus norvegicus
gacttgcatccaatttgtatttttg

SEQ ID NO: 330143 - DNA, 25 bp, Rattus norvegicus
gacttgcatccattttgtatttttg

SEQ ID NO: 330144 - DNA, 25 bp, Rattus norvegicus
gacttgcattatcttagtgttcttc

SEQ ID NO: 330145 - DNA, 25 bp, Rattus norvegicus
gacttgcattatgttagtgttcttc

SEQ ID NO: 330146 - DNA, 25 bp, Rattus norvegicus
gacttgcccagaagggtggcttact

SEQ ID NO: 330147 - DNA, 25 bp, Rattus norvegicus
gacttgcccagatgggtggcttact

SEQ ID NO: 330148 - DNA, 25 bp, Rattus norvegicus
gacttgcccaggacagatggacttg

SEQ ID NO: 330149 - DNA, 25 bp, Rattus norvegicus
gacttgcccaggtcagatggacttg

SEQ ID NO: 330150 - DNA, 25 bp, Rattus norvegicus
gacttgccctttcaaaccactggtg

SEQ ID NO: 330151 - DNA, 25 bp, Rattus norvegicus
gacttgccctttgaaaccactggtg

SEQ ID NO: 330152 - DNA, 25 bp, Rattus norvegicus
gacttgcctggaaagactgtgcgtt

SEQ ID NO: 330153 - DNA, 25 bp, Rattus norvegicus
gacttgcctggatagactgtgcgtt

SEQ ID NO: 330154 - DNA, 25 bp, Rattus norvegicus
gacttgcctgtaattcccacatttg

SEQ ID NO: 330155 - DNA, 25 bp, Rattus norvegicus
gacttgcctgtacatgccgatagcc

SEQ ID NO: 330156 - DNA, 25 bp, Rattus norvegicus
gacttgcctgtagatgccgatagcc

SEQ ID NO: 330157 - DNA, 25 bp, Rattus norvegicus
gacttgcctgtatttcccacatttg

SEQ ID NO: 330158 - DNA, 25 bp, Rattus norvegicus
gacttgcctttaattctgttagact

SEQ ID NO: 330159 - DNA, 25 bp, Rattus norvegicus
gacttgcctttatttctgttagact

SEQ ID NO: 330160 - DNA, 25 bp, Rattus norvegicus
gacttgcgaactcttgaagctgcct

SEQ ID NO: 330161 - DNA, 25 bp, Rattus norvegicus
gacttgcgaactgttgaagctgcct

SEQ ID NO: 330162 - DNA, 25 bp, Rattus norvegicus
gacttgcgcgtaattccacttgaaa

SEQ ID NO: 330163 - DNA, 25 bp, Rattus norvegicus
gacttgcgcgtatttccacttgaaa

SEQ ID NO: 330164 - DNA, 25 bp, Rattus norvegicus
gacttgcggatgaacgccctgcgga

SEQ ID NO: 330165 - DNA, 25 bp, Rattus norvegicus
gacttgcggatgtacgccctgcgga

SEQ ID NO: 330166 - DNA, 25 bp, Rattus norvegicus
gacttgcgtcgtctgatactcagta

SEQ ID NO: 330167 - DNA, 25 bp, Rattus norvegicus
gacttgcgtcgtgtgatactcagta

SEQ ID NO: 330168 - DNA, 25 bp, Rattus norvegicus
gacttgctaagtcactacatcctgc

SEQ ID NO: 330169 - DNA, 25 bp, Rattus norvegicus
gacttgctaagtgactacatcctgc

SEQ ID NO: 330170 - DNA, 25 bp, Rattus norvegicus
gacttgctactgatgaagccaatga

SEQ ID NO: 330171 - DNA, 25 bp, Rattus norvegicus
gacttgctactgttgaagccaatga

SEQ ID NO: 330172 - DNA, 25 bp, Rattus norvegicus
gacttgctagcgaaatgacatcttt

SEQ ID NO: 330173 - DNA, 25 bp, Rattus norvegicus
gacttgctagcgtaatgacatcttt

SEQ ID NO: 330174 - DNA, 25 bp, Rattus norvegicus
gacttgctcaagctacagctagtgt

SEQ ID NO: 330175 - DNA, 25 bp, Rattus norvegicus
gacttgctcaaggtacagctagtgt

SEQ ID NO: 330176 - DNA, 25 bp, Rattus norvegicus
gacttgctcagactttctgtcacgt

SEQ ID NO: 330177 - DNA, 25 bp, Rattus norvegicus
gacttgctcagagtttctgtcacgt

SEQ ID NO: 330178 - DNA, 25 bp, Rattus norvegicus
gacttgctcagtccagtgggctata

SEQ ID NO: 330179 - DNA, 25 bp, Rattus norvegicus
gacttgctcagtgcagtgggctata

SEQ ID NO: 330180 - DNA, 25 bp, Rattus norvegicus
gacttgctcttcaagaggagcctcg

SEQ ID NO: 330181 - DNA, 25 bp, Rattus norvegicus
gacttgctcttctagaggagcctcg

SEQ ID NO: 330182 - DNA, 25 bp, Rattus norvegicus
gacttgctgaacattaatgccatgc

SEQ ID NO: 330183 - DNA, 25 bp, Rattus norvegicus
gacttgctgaactttaatgccatgc

SEQ ID NO: 330184 - DNA, 25 bp, Rattus norvegicus
gacttgctgctcaaagttatgctgc

SEQ ID NO: 330185 - DNA, 25 bp, Rattus norvegicus
gacttgctgctctaagttatgctgc

SEQ ID NO: 330186 - DNA, 25 bp, Rattus norvegicus
gacttgctgtccatatttactatct

SEQ ID NO: 330187 - DNA, 25 bp, Rattus norvegicus
gacttgctgtccttatttactatct

SEQ ID NO: 330188 - DNA, 25 bp, Rattus norvegicus
gacttgcttcttccaacatagaaaa

SEQ ID NO: 330189 - DNA, 25 bp, Rattus norvegicus
gacttgcttcttgcaacatagaaaa

SEQ ID NO: 330190 - DNA, 25 bp, Rattus norvegicus
gacttgcttgaactgagattgccat

SEQ ID NO: 330191 - DNA, 25 bp, Rattus norvegicus
gacttgcttgaagtgagattgccat

SEQ ID NO: 330192 - DNA, 25 bp, Rattus norvegicus
gacttgcttgcgctagattttcttt

SEQ ID NO: 330193 - DNA, 25 bp, Rattus norvegicus
gacttgcttgcggtagattttcttt

SEQ ID NO: 330194 - DNA, 25 bp, Rattus norvegicus
gacttgctttgcattattggaacca

SEQ ID NO: 330195 - DNA, 25 bp, Rattus norvegicus
gacttgctttgccttagcacatgag

SEQ ID NO: 330196 - DNA, 25 bp, Rattus norvegicus
gacttgctttgcgttagcacatgag

SEQ ID NO: 330197 - DNA, 25 bp, Rattus norvegicus
gacttgctttgctttattggaacca

SEQ ID NO: 330198 - DNA, 25 bp, Rattus norvegicus
gacttggaaaaacagagagccttga

SEQ ID NO: 330199 - DNA, 25 bp, Rattus norvegicus
gacttggaaaaagagagagccttga

SEQ ID NO: 330200 - DNA, 25 bp, Rattus norvegicus
gacttggaaactctcctgaccttgg

SEQ ID NO: 330201 - DNA, 25 bp, Rattus norvegicus
gacttggaaactgtcctgaccttgg

SEQ ID NO: 330202 - DNA, 25 bp, Rattus norvegicus
gacttggaaatcacatggcctcatg

SEQ ID NO: 330203 - DNA, 25 bp, Rattus norvegicus
gacttggaaatctcatggcctcatg

SEQ ID NO: 330204 - DNA, 25 bp, Rattus norvegicus
gacttggaagacatcgccaggctct

SEQ ID NO: 330205 - DNA, 25 bp, Rattus norvegicus
gacttggaagacttcgccaggctct

SEQ ID NO: 330206 - DNA, 25 bp, Rattus norvegicus
gacttggaagataagctgaagtgca

SEQ ID NO: 330207 - DNA, 25 bp, Rattus norvegicus
gacttggaagattagctgaagtgca

SEQ ID NO: 330208 - DNA, 25 bp, Rattus norvegicus
gacttggaagccacgtctgaacact

SEQ ID NO: 330209 - DNA, 25 bp, Rattus norvegicus
gacttggaagcctcgtctgaacact

SEQ ID NO: 330210 - DNA, 25 bp, Rattus norvegicus
gacttggaatcaagttgtgcactat

SEQ ID NO: 330211 - DNA, 25 bp, Rattus norvegicus
gacttggaatcatgttgtgcactat

SEQ ID NO: 330212 - DNA, 25 bp, Rattus norvegicus
gacttggaattaaggcttccgcttt

SEQ ID NO: 330213 - DNA, 25 bp, Rattus norvegicus
gacttggaattatggcttccgcttt

SEQ ID NO: 330214 - DNA, 25 bp, Rattus norvegicus
gacttggaattgctgactctcccgc

SEQ ID NO: 330215 - DNA, 25 bp, Rattus norvegicus
gacttggaattggtgactctcccgc

SEQ ID NO: 330216 - DNA, 25 bp, Rattus norvegicus
gacttggaatttactatctatgatg

SEQ ID NO: 330217 - DNA, 25 bp, Rattus norvegicus
gacttggaattttctatctatgatg

SEQ ID NO: 330218 - DNA, 25 bp, Rattus norvegicus
gacttggacactagggcttccagac

SEQ ID NO: 330219 - DNA, 25 bp, Rattus norvegicus
gacttggacactatatcaggcccat

SEQ ID NO: 330220 - DNA, 25 bp, Rattus norvegicus
gacttggacacttgggcttccagac

SEQ ID NO: 330221 - DNA, 25 bp, Rattus norvegicus
gacttggacactttatcaggcccat

SEQ ID NO: 330222 - DNA, 25 bp, Rattus norvegicus
gacttggacattcagcgatagcatt

SEQ ID NO: 330223 - DNA, 25 bp, Rattus norvegicus
gacttggacattgagcgatagcatt

SEQ ID NO: 330224 - DNA, 25 bp, Rattus norvegicus
gacttggaccaccaggcttttggga

SEQ ID NO: 330225 - DNA, 25 bp, Rattus norvegicus
gacttggaccacgaggcttttggga

SEQ ID NO: 330226 - DNA, 25 bp, Rattus norvegicus
gacttggaccgaacacacagttgta

SEQ ID NO: 330227 - DNA, 25 bp, Rattus norvegicus
gacttggaccgatcacacagttgta

SEQ ID NO: 330228 - DNA, 25 bp, Rattus norvegicus
gacttggactctccgtagctttacg

SEQ ID NO: 330229 - DNA, 25 bp, Rattus norvegicus
gacttggactctgcgtagctttacg

SEQ ID NO: 330230 - DNA, 25 bp, Rattus norvegicus
gacttggactgccatggacgtctgt

SEQ ID NO: 330231 - DNA, 25 bp, Rattus norvegicus
gacttggactgcgatggacgtctgt

SEQ ID NO: 330232 - DNA, 25 bp, Rattus norvegicus
gacttggacttaactacctcagact

SEQ ID NO: 330233 - DNA, 25 bp, Rattus norvegicus
gacttggacttatctacctcagact

SEQ ID NO: 330234 - DNA, 25 bp, Rattus norvegicus
gacttggagaaccatcaccacgaga

SEQ ID NO: 330235 - DNA, 25 bp, Rattus norvegicus
gacttggagaacgatcaccacgaga

SEQ ID NO: 330236 - DNA, 25 bp, Rattus norvegicus
gacttggagccaaggacacgtggat

SEQ ID NO: 330237 - DNA, 25 bp, Rattus norvegicus
gacttggagccatggacacgtggat

SEQ ID NO: 330238 - DNA, 25 bp, Rattus norvegicus
gacttggagcggagcgagaccccct

SEQ ID NO: 330239 - DNA, 25 bp, Rattus norvegicus
gacttggagcggtgcgagaccccct

SEQ ID NO: 330240 - DNA, 25 bp, Rattus norvegicus
gacttggaggcgcttatccaccacg

SEQ ID NO: 330241 - DNA, 25 bp, Rattus norvegicus
gacttggaggcggttatccaccacg

SEQ ID NO: 330242 - DNA, 25 bp, Rattus norvegicus
gacttggaggctcattgaccacaga

SEQ ID NO: 330243 - DNA, 25 bp, Rattus norvegicus
gacttggaggctgattgaccacaga

SEQ ID NO: 330244 - DNA, 25 bp, Rattus norvegicus
gacttggatgtgctcctgggattac

SEQ ID NO: 330245 - DNA, 25 bp, Rattus norvegicus
gacttggatgtggtcctgggattac

SEQ ID NO: 330246 - DNA, 25 bp, Rattus norvegicus
gacttggattataaattagccctgg

SEQ ID NO: 330247 - DNA, 25 bp, Rattus norvegicus
gacttggattattaattagccctgg

SEQ ID NO: 330248 - DNA, 25 bp, Rattus norvegicus
gacttggattccatagtgctgttat

SEQ ID NO: 330249 - DNA, 25 bp, Rattus norvegicus
gacttggattccatcagcgttttga

SEQ ID NO: 330250 - DNA, 25 bp, Rattus norvegicus
gacttggattccttagtgctgttat

SEQ ID NO: 330251 - DNA, 25 bp, Rattus norvegicus
gacttggattccttcagcgttttga

SEQ ID NO: 330252 - DNA, 25 bp, Rattus norvegicus
gacttggattttcagctacaggcct

SEQ ID NO: 330253 - DNA, 25 bp, Rattus norvegicus
gacttggattttgagctacaggcct

SEQ ID NO: 330254 - DNA, 25 bp, Rattus norvegicus
gacttggcacagctaaagcctttgc

SEQ ID NO: 330255 - DNA, 25 bp, Rattus norvegicus
gacttggcacaggtaaagcctttgc

SEQ ID NO: 330256 - DNA, 25 bp, Rattus norvegicus
gacttggcagatcagctgcatgctg

SEQ ID NO: 330257 - DNA, 25 bp, Rattus norvegicus
gacttggcagatgagctgcatgctg

SEQ ID NO: 330258 - DNA, 25 bp, Rattus norvegicus
gacttggcagcacagatcactctaa

SEQ ID NO: 330259 - DNA, 25 bp, Rattus norvegicus
gacttggcagcacttacatacttca

SEQ ID NO: 330260 - DNA, 25 bp, Rattus norvegicus
gacttggcagcagagatcactctaa

SEQ ID NO: 330261 - DNA, 25 bp, Rattus norvegicus
gacttggcagcagttacatacttca

SEQ ID NO: 330262 - DNA, 25 bp, Rattus norvegicus
gacttggcagctaatggtgcttgtt

SEQ ID NO: 330263 - DNA, 25 bp, Rattus norvegicus
gacttggcagcttatggtgcttgtt

SEQ ID NO: 330264 - DNA, 25 bp, Rattus norvegicus
gacttggcattacaccagtcactat

SEQ ID NO: 330265 - DNA, 25 bp, Rattus norvegicus
gacttggcattagaccagtcactat

SEQ ID NO: 330266 - DNA, 25 bp, Rattus norvegicus
gacttggctatgagcatttcagttt

SEQ ID NO: 330267 - DNA, 25 bp, Rattus norvegicus
gacttggctatgtgcatttcagttt

SEQ ID NO: 330268 - DNA, 25 bp, Rattus norvegicus
gacttggctccaaattttcatctat

SEQ ID NO: 330269 - DNA, 25 bp, Rattus norvegicus
gacttggctccatattttcatctat

SEQ ID NO: 330270 - DNA, 25 bp, Rattus norvegicus
gacttggctctaatggttcaggttc

SEQ ID NO: 330271 - DNA, 25 bp, Rattus norvegicus
gacttggctctattggttcaggttc

SEQ ID NO: 330272 - DNA, 25 bp, Rattus norvegicus
gacttggctggcacatttgccaggg

SEQ ID NO: 330273 - DNA, 25 bp, Rattus norvegicus
gacttggctggctcatttgccaggg

SEQ ID NO: 330274 - DNA, 25 bp, Rattus norvegicus
gacttggcttcaccgaagcaaccga

SEQ ID NO: 330275 - DNA, 25 bp, Rattus norvegicus
gacttggcttcagcgaagcaaccga

SEQ ID NO: 330276 - DNA, 25 bp, Rattus norvegicus
gacttggcttccatgtgccttaaaa

SEQ ID NO: 330277 - DNA, 25 bp, Rattus norvegicus
gacttggcttccttgtgccttaaaa

SEQ ID NO: 330278 - DNA, 25 bp, Rattus norvegicus
gacttggctttgacacgggcggtcc

SEQ ID NO: 330279 - DNA, 25 bp, Rattus norvegicus
gacttggctttgtcacgggcggtcc

SEQ ID NO: 330280 - DNA, 25 bp, Rattus norvegicus
gacttgggaagcatgtcccttcctg

SEQ ID NO: 330281 - DNA, 25 bp, Rattus norvegicus
gacttgggaagcttgtcccttcctg

SEQ ID NO: 330282 - DNA, 25 bp, Rattus norvegicus
gacttgggaaggaacactgtcaaat

SEQ ID NO: 330283 - DNA, 25 bp, Rattus norvegicus
gacttgggaaggtacactgtcaaat

SEQ ID NO: 330284 - DNA, 25 bp, Rattus norvegicus
gacttgggacaaagagcaactcgaa

SEQ ID NO: 330285 - DNA, 25 bp, Rattus norvegicus
gacttgggacaatgagcaactcgaa

SEQ ID NO: 330286 - DNA, 25 bp, Rattus norvegicus
gacttgggagtccaaagccagtctt

SEQ ID NO: 330287 - DNA, 25 bp, Rattus norvegicus
gacttgggagtcgaaagccagtctt

SEQ ID NO: 330288 - DNA, 25 bp, Rattus norvegicus
gacttgggagtgctagctttctctc

SEQ ID NO: 330289 - DNA, 25 bp, Rattus norvegicus
gacttgggagtggtagctttctctc

SEQ ID NO: 330290 - DNA, 25 bp, Rattus norvegicus
gacttgggatgtcggctccgaacca

SEQ ID NO: 330291 - DNA, 25 bp, Rattus norvegicus
gacttgggatgtgggctccgaacca

SEQ ID NO: 330292 - DNA, 25 bp, Rattus norvegicus
gacttgggccacctctctctctcgc

SEQ ID NO: 330293 - DNA, 25 bp, Rattus norvegicus
gacttgggccacgtctctctctcgc

SEQ ID NO: 330294 - DNA, 25 bp, Rattus norvegicus
gacttgggctccatagttacactaa

SEQ ID NO: 330295 - DNA, 25 bp, Rattus norvegicus
gacttgggctccttagttacactaa

SEQ ID NO: 330296 - DNA, 25 bp, Rattus norvegicus
gacttgggtaagatcctagagcatt

SEQ ID NO: 330297 - DNA, 25 bp, Rattus norvegicus
gacttgggtaagttcctagagcatt

SEQ ID NO: 330298 - DNA, 25 bp, Rattus norvegicus
gacttgggtcatctgtgttacactt

SEQ ID NO: 330299 - DNA, 25 bp, Rattus norvegicus
gacttgggtcatgtgtgttacactt

SEQ ID NO: 330300 - DNA, 25 bp, Rattus norvegicus
gacttgggtgtgagcaagacatctt

SEQ ID NO: 330301 - DNA, 25 bp, Rattus norvegicus
gacttgggtgtgtgcaagacatctt

SEQ ID NO: 330302 - DNA, 25 bp, Rattus norvegicus
gacttgggtgttagcatcataatgt

SEQ ID NO: 330303 - DNA, 25 bp, Rattus norvegicus
gacttgggtgtttgcatcataatgt

SEQ ID NO: 330304 - DNA, 25 bp, Rattus norvegicus
gacttgggttaactcttcttatcca

SEQ ID NO: 330305 - DNA, 25 bp, Rattus norvegicus
gacttgggttaagtcttcttatcca

SEQ ID NO: 330306 - DNA, 25 bp, Rattus norvegicus
gacttgggttctatacagttgcctt

SEQ ID NO: 330307 - DNA, 25 bp, Rattus norvegicus
gacttgggttctccaggatcaacga

SEQ ID NO: 330308 - DNA, 25 bp, Rattus norvegicus
gacttgggttctgcaggatcaacga

SEQ ID NO: 330309 - DNA, 25 bp, Rattus norvegicus
gacttgggttctttacagttgcctt

SEQ ID NO: 330310 - DNA, 25 bp, Rattus norvegicus
gacttggtaccgcaaacagcacatg

SEQ ID NO: 330311 - DNA, 25 bp, Rattus norvegicus
gacttggtaccggaaacagcacatg

SEQ ID NO: 330312 - DNA, 25 bp, Rattus norvegicus
gacttggtacctagggcttggtcca

SEQ ID NO: 330313 - DNA, 25 bp, Rattus norvegicus
gacttggtaccttgggcttggtcca

SEQ ID NO: 330314 - DNA, 25 bp, Rattus norvegicus
gacttggtagatctccctgaagcca

SEQ ID NO: 330315 - DNA, 25 bp, Rattus norvegicus
gacttggtagatgtccctgaagcca

SEQ ID NO: 330316 - DNA, 25 bp, Rattus norvegicus
gacttggtaggcattgggcgctcaa

SEQ ID NO: 330317 - DNA, 25 bp, Rattus norvegicus
gacttggtaggctttgggcgctcaa

SEQ ID NO: 330318 - DNA, 25 bp, Rattus norvegicus
gacttggtcactctgtctctgtttc

SEQ ID NO: 330319 - DNA, 25 bp, Rattus norvegicus
gacttggtcactgtgtctctgtttc

SEQ ID NO: 330320 - DNA, 25 bp, Rattus norvegicus
gacttggtccagactctgatctagc

SEQ ID NO: 330321 - DNA, 25 bp, Rattus norvegicus
gacttggtccagtctctgatctagc

SEQ ID NO: 330322 - DNA, 25 bp, Rattus norvegicus
gacttggtcctcataggctctttag

SEQ ID NO: 330323 - DNA, 25 bp, Rattus norvegicus
gacttggtcctcttaggctctttag

SEQ ID NO: 330324 - DNA, 25 bp, Rattus norvegicus
gacttggtcttcacatctgggatag

SEQ ID NO: 330325 - DNA, 25 bp, Rattus norvegicus
gacttggtcttctcatctgggatag

SEQ ID NO: 330326 - DNA, 25 bp, Rattus norvegicus
gacttggtcttgacagagctccctg

SEQ ID NO: 330327 - DNA, 25 bp, Rattus norvegicus
gacttggtcttgtcagagctccctg

SEQ ID NO: 330328 - DNA, 25 bp, Rattus norvegicus
gacttggtgacactctagcgcgctg

SEQ ID NO: 330329 - DNA, 25 bp, Rattus norvegicus
gacttggtgacagtctagcgcgctg

SEQ ID NO: 330330 - DNA, 25 bp, Rattus norvegicus
gacttggtgagaaccaggttccaga

SEQ ID NO: 330331 - DNA, 25 bp, Rattus norvegicus
gacttggtgagatccaggttccaga

SEQ ID NO: 330332 - DNA, 25 bp, Rattus norvegicus
gacttggtgataattttactagcag

SEQ ID NO: 330333 - DNA, 25 bp, Rattus norvegicus
gacttggtgatatttttactagcag

SEQ ID NO: 330334 - DNA, 25 bp, Rattus norvegicus
gacttggtgcatctgttctttctag

SEQ ID NO: 330335 - DNA, 25 bp, Rattus norvegicus
gacttggtgcatgtgttctttctag

SEQ ID NO: 330336 - DNA, 25 bp, Rattus norvegicus
gacttggtgcctcagggtctcaaga

SEQ ID NO: 330337 - DNA, 25 bp, Rattus norvegicus
gacttggtgcctgagggtctcaaga

SEQ ID NO: 330338 - DNA, 25 bp, Rattus norvegicus
gacttggtggcaaactcttttactt

SEQ ID NO: 330339 - DNA, 25 bp, Rattus norvegicus
gacttggtggcatactcttttactt

SEQ ID NO: 330340 - DNA, 25 bp, Rattus norvegicus
gacttggttaccagttttgcatgta

SEQ ID NO: 330341 - DNA, 25 bp, Rattus norvegicus
gacttggttacctgttttgcatgta

SEQ ID NO: 330342 - DNA, 25 bp, Rattus norvegicus
gacttggttcctcgcaggagtccta

SEQ ID NO: 330343 - DNA, 25 bp, Rattus norvegicus
gacttggttcctggcaggagtccta

SEQ ID NO: 330344 - DNA, 25 bp, Rattus norvegicus
gacttggttctgctactgacaaatc

SEQ ID NO: 330345 - DNA, 25 bp, Rattus norvegicus
gacttggttctggtactgacaaatc

SEQ ID NO: 330346 - DNA, 25 bp, Rattus norvegicus
gacttggtttgtctctcgaggatgc

SEQ ID NO: 330347 - DNA, 25 bp, Rattus norvegicus
gacttggtttgtgtctcgaggatgc

SEQ ID NO: 330348 - DNA, 25 bp, Rattus norvegicus
gacttgtaaagcacacacgcaggct

SEQ ID NO: 330349 - DNA, 25 bp, Rattus norvegicus
gacttgtaaagctcacacgcaggct

SEQ ID NO: 330350 - DNA, 25 bp, Rattus norvegicus
gacttgtacaacatcaggatccttc

SEQ ID NO: 330351 - DNA, 25 bp, Rattus norvegicus
gacttgtacaacttcaggatccttc

SEQ ID NO: 330352 - DNA, 25 bp, Rattus norvegicus
gacttgtagaggactcgggagcatc

SEQ ID NO: 330353 - DNA, 25 bp, Rattus norvegicus
gacttgtagaggtctcgggagcatc

SEQ ID NO: 330354 - DNA, 25 bp, Rattus norvegicus
gacttgtagttaacttctgttcaga

SEQ ID NO: 330355 - DNA, 25 bp, Rattus norvegicus
gacttgtagttatcttctgttcaga

SEQ ID NO: 330356 - DNA, 25 bp, Rattus norvegicus
gacttgtagttcattctgaccaggc

SEQ ID NO: 330357 - DNA, 25 bp, Rattus norvegicus
gacttgtagttctttctgaccaggc

SEQ ID NO: 330358 - DNA, 25 bp, Rattus norvegicus
gacttgtatcacaacattgaatttt

SEQ ID NO: 330359 - DNA, 25 bp, Rattus norvegicus
gacttgtatcactacattgaatttt

SEQ ID NO: 330360 - DNA, 25 bp, Rattus norvegicus
gacttgtcagacacagtgggccgtt

SEQ ID NO: 330361 - DNA, 25 bp, Rattus norvegicus
gacttgtcagactcagtgggccgtt

SEQ ID NO: 330362 - DNA, 25 bp, Rattus norvegicus
gacttgtcagttatcatcttctctc

SEQ ID NO: 330363 - DNA, 25 bp, Rattus norvegicus
gacttgtcagttttcatcttctctc

SEQ ID NO: 330364 - DNA, 25 bp, Rattus norvegicus
gacttgtcattgaaccctgagtgtt

SEQ ID NO: 330365 - DNA, 25 bp, Rattus norvegicus
gacttgtcattgtaccctgagtgtt

SEQ ID NO: 330366 - DNA, 25 bp, Rattus norvegicus
gacttgtccagcatggatgtggcca

SEQ ID NO: 330367 - DNA, 25 bp, Rattus norvegicus
gacttgtccagcttggatgtggcca

SEQ ID NO: 330368 - DNA, 25 bp, Rattus norvegicus
gacttgtccccgagatgttgatgtt

SEQ ID NO: 330369 - DNA, 25 bp, Rattus norvegicus
gacttgtccccgtgatgttgatgtt

SEQ ID NO: 330370 - DNA, 25 bp, Rattus norvegicus
gacttgtctctacaaggtccagcct

SEQ ID NO: 330371 - DNA, 25 bp, Rattus norvegicus
gacttgtctctagaaggtccagcct

SEQ ID NO: 330372 - DNA, 25 bp, Rattus norvegicus
gacttgtctgctcaggaaacctcta

SEQ ID NO: 330373 - DNA, 25 bp, Rattus norvegicus
gacttgtctgctgaggaaacctcta

SEQ ID NO: 330374 - DNA, 25 bp, Rattus norvegicus
gacttgtctggaagggctttacatt

SEQ ID NO: 330375 - DNA, 25 bp, Rattus norvegicus
gacttgtctggatgggctttacatt

SEQ ID NO: 330376 - DNA, 25 bp, Rattus norvegicus
gacttgtcttcaactgttagctagc

SEQ ID NO: 330377 - DNA, 25 bp, Rattus norvegicus
gacttgtcttcatctgttagctagc

SEQ ID NO: 330378 - DNA, 25 bp, Rattus norvegicus
gacttgtcttgaagccgataccttg

SEQ ID NO: 330379 - DNA, 25 bp, Rattus norvegicus
gacttgtcttgatgccgataccttg

SEQ ID NO: 330380 - DNA, 25 bp, Rattus norvegicus
gacttgtcttgcactttgttagatg

SEQ ID NO: 330381 - DNA, 25 bp, Rattus norvegicus
gacttgtcttgctctttgttagatg

SEQ ID NO: 330382 - DNA, 25 bp, Rattus norvegicus
gacttgtgactaagccggttttcaa

SEQ ID NO: 330383 - DNA, 25 bp, Rattus norvegicus
gacttgtgactatgccggttttcaa

SEQ ID NO: 330384 - DNA, 25 bp, Rattus norvegicus
gacttgtgagagaggttagactgat

SEQ ID NO: 330385 - DNA, 25 bp, Rattus norvegicus
gacttgtgagagtggttagactgat

SEQ ID NO: 330386 - DNA, 25 bp, Rattus norvegicus
gacttgtgagcccatcagacctgtg

SEQ ID NO: 330387 - DNA, 25 bp, Rattus norvegicus
gacttgtgagccgatcagacctgtg

SEQ ID NO: 330388 - DNA, 25 bp, Rattus norvegicus
gacttgtgagtcctaatgcgtacgt

SEQ ID NO: 330389 - DNA, 25 bp, Rattus norvegicus
gacttgtgagtcgtaatgcgtacgt

SEQ ID NO: 330390 - DNA, 25 bp, Rattus norvegicus
gacttgtgcaacaactttggaactt

SEQ ID NO: 330391 - DNA, 25 bp, Rattus norvegicus
gacttgtgcaactactttggaactt

SEQ ID NO: 330392 - DNA, 25 bp, Rattus norvegicus
gacttgtgcagtacagctcttgctg

SEQ ID NO: 330393 - DNA, 25 bp, Rattus norvegicus
gacttgtgcagttcagctcttgctg

SEQ ID NO: 330394 - DNA, 25 bp, Rattus norvegicus
gacttgtgccgaaaacgtgagccaa

SEQ ID NO: 330395 - DNA, 25 bp, Rattus norvegicus
gacttgtgccgataacgtgagccaa

SEQ ID NO: 330396 - DNA, 25 bp, Rattus norvegicus
gacttgtgctgtctatggttatcaa

SEQ ID NO: 330397 - DNA, 25 bp, Rattus norvegicus
gacttgtgctgtgtatggttatcaa

SEQ ID NO: 330398 - DNA, 25 bp, Rattus norvegicus
gacttgtggaccaaagcacctgtac

SEQ ID NO: 330399 - DNA, 25 bp, Rattus norvegicus
gacttgtggacctaagcacctgtac

SEQ ID NO: 330400 - DNA, 25 bp, Rattus norvegicus
gacttgtggcctcggccagacccta

SEQ ID NO: 330401 - DNA, 25 bp, Rattus norvegicus
gacttgtggcctgggccagacccta

SEQ ID NO: 330402 - DNA, 25 bp, Rattus norvegicus
gacttgtggctactcagctttgtcc

SEQ ID NO: 330403 - DNA, 25 bp, Rattus norvegicus
gacttgtggctagtcagctttgtcc

SEQ ID NO: 330404 - DNA, 25 bp, Rattus norvegicus
gacttgtgtaaactgtccctggaca

SEQ ID NO: 330405 - DNA, 25 bp, Rattus norvegicus
gacttgtgtaaagtgtccctggaca

SEQ ID NO: 330406 - DNA, 25 bp, Rattus norvegicus
gacttgtgtgtcctttcttataatt

SEQ ID NO: 330407 - DNA, 25 bp, Rattus norvegicus
gacttgtgtgtcgtttcttataatt

SEQ ID NO: 330408 - DNA, 25 bp, Rattus norvegicus
gacttgttacaactttaccgagact

SEQ ID NO: 330409 - DNA, 25 bp, Rattus norvegicus
gacttgttacaagtttaccgagact

SEQ ID NO: 330410 - DNA, 25 bp, Rattus norvegicus
gacttgttacatcgaggttctcttg

SEQ ID NO: 330411 - DNA, 25 bp, Rattus norvegicus
gacttgttacatggaggttctcttg

SEQ ID NO: 330412 - DNA, 25 bp, Rattus norvegicus
gacttgttagccctacaccctttgt

SEQ ID NO: 330413 - DNA, 25 bp, Rattus norvegicus
gacttgttagccgtacaccctttgt

SEQ ID NO: 330414 - DNA, 25 bp, Rattus norvegicus
gacttgttagcgcatctcatggtag

SEQ ID NO: 330415 - DNA, 25 bp, Rattus norvegicus
gacttgttagcggatctcatggtag

SEQ ID NO: 330416 - DNA, 25 bp, Rattus norvegicus
gacttgttaggaatggagactctga

SEQ ID NO: 330417 - DNA, 25 bp, Rattus norvegicus
gacttgttaggattggagactctga

SEQ ID NO: 330418 - DNA, 25 bp, Rattus norvegicus
gacttgttcacaacggatatatcct

SEQ ID NO: 330419 - DNA, 25 bp, Rattus norvegicus
gacttgttcacatcggatatatcct

SEQ ID NO: 330420 - DNA, 25 bp, Rattus norvegicus
gacttgttcagaagcttgttcctgt

SEQ ID NO: 330421 - DNA, 25 bp, Rattus norvegicus
gacttgttcagatgcttgttcctgt

SEQ ID NO: 330422 - DNA, 25 bp, Rattus norvegicus
gacttgttcatacgtgacgtgatcc

SEQ ID NO: 330423 - DNA, 25 bp, Rattus norvegicus
gacttgttcataggtgacgtgatcc

SEQ ID NO: 330424 - DNA, 25 bp, Rattus norvegicus
gacttgttccttagtccagttgttg

SEQ ID NO: 330425 - DNA, 25 bp, Rattus norvegicus
gacttgttcctttgtccagttgttg

SEQ ID NO: 330426 - DNA, 25 bp, Rattus norvegicus
gacttgttggcacttgctcttggac

SEQ ID NO: 330427 - DNA, 25 bp, Rattus norvegicus
gacttgttggcagttgctcttggac

SEQ ID NO: 330428 - DNA, 25 bp, Rattus norvegicus
gacttgttgtagatcagtagtgttc

SEQ ID NO: 330429 - DNA, 25 bp, Rattus norvegicus
gacttgttgtagttcagtagtgttc

SEQ ID NO: 330430 - DNA, 25 bp, Rattus norvegicus
gacttgttgtcacggactctactga

SEQ ID NO: 330431 - DNA, 25 bp, Rattus norvegicus
gacttgttgtcagggactctactga

SEQ ID NO: 330432 - DNA, 25 bp, Rattus norvegicus
gacttgtttaacattctgctgcttg

SEQ ID NO: 330433 - DNA, 25 bp, Rattus norvegicus
gacttgtttaactttctgctgcttg

SEQ ID NO: 330434 - DNA, 25 bp, Rattus norvegicus
gacttgtttaatattgcatcccaaa

SEQ ID NO: 330435 - DNA, 25 bp, Rattus norvegicus
gacttgtttaattttgcatcccaaa

SEQ ID NO: 330436 - DNA, 25 bp, Rattus norvegicus
gacttgtttagtcgtgaggctgtat

SEQ ID NO: 330437 - DNA, 25 bp, Rattus norvegicus
gacttgtttagtggtgaggctgtat

SEQ ID NO: 330438 - DNA, 25 bp, Rattus norvegicus
gacttgtttcctagaagcatccttc

SEQ ID NO: 330439 - DNA, 25 bp, Rattus norvegicus
gacttgtttccttgaagcatccttc

SEQ ID NO: 330440 - DNA, 25 bp, Rattus norvegicus
gacttgtttctgaagcaccggcgga

SEQ ID NO: 330441 - DNA, 25 bp, Rattus norvegicus
gacttgtttctgtagcaccggcgga

SEQ ID NO: 330442 - DNA, 25 bp, Rattus norvegicus
gacttgtttgctctattcagtggat

SEQ ID NO: 330443 - DNA, 25 bp, Rattus norvegicus
gacttgtttgctgtattcagtggat

SEQ ID NO: 330444 - DNA, 25 bp, Rattus norvegicus
gactttaaaatactgcaaccctctc

SEQ ID NO: 330445 - DNA, 25 bp, Rattus norvegicus
gactttaaaatagtgcaaccctctc

SEQ ID NO: 330446 - DNA, 25 bp, Rattus norvegicus
gactttaaaattcttcctatgcagc

SEQ ID NO: 330447 - DNA, 25 bp, Rattus norvegicus
gactttaaaattgttcctatgcagc

SEQ ID NO: 330448 - DNA, 25 bp, Rattus norvegicus
gactttaaagtcagatgttggcaga

SEQ ID NO: 330449 - DNA, 25 bp, Rattus norvegicus
gactttaaagtctgatgttggcaga

SEQ ID NO: 330450 - DNA, 25 bp, Rattus norvegicus
gactttaaatgtatgtagccctatt

SEQ ID NO: 330451 - DNA, 25 bp, Rattus norvegicus
gactttaaatgtttgtagccctatt

SEQ ID NO: 330452 - DNA, 25 bp, Rattus norvegicus
gactttaacagtcttaccataggtg

SEQ ID NO: 330453 - DNA, 25 bp, Rattus norvegicus
gactttaacagtgttaccataggtg

SEQ ID NO: 330454 - DNA, 25 bp, Rattus norvegicus
gactttaatcgcacacttagttatt

SEQ ID NO: 330455 - DNA, 25 bp, Rattus norvegicus
gactttaatcgctcacttagttatt

SEQ ID NO: 330456 - DNA, 25 bp, Rattus norvegicus
gactttaatctcaaagctggcttcc

SEQ ID NO: 330457 - DNA, 25 bp, Rattus norvegicus
gactttaatctctaagctggcttcc

SEQ ID NO: 330458 - DNA, 25 bp, Rattus norvegicus
gactttaattatctgacctcatgta

SEQ ID NO: 330459 - DNA, 25 bp, Rattus norvegicus
gactttaattatgtgacctcatgta

SEQ ID NO: 330460 - DNA, 25 bp, Rattus norvegicus
gactttacaagacacctaggccgca

SEQ ID NO: 330461 - DNA, 25 bp, Rattus norvegicus
gactttacaagagacctaggccgca

SEQ ID NO: 330462 - DNA, 25 bp, Rattus norvegicus
gactttaccaaacggagctcacacc

SEQ ID NO: 330463 - DNA, 25 bp, Rattus norvegicus
gactttaccaaagggagctcacacc

SEQ ID NO: 330464 - DNA, 25 bp, Rattus norvegicus
gactttaccataaatctgagcagca

SEQ ID NO: 330465 - DNA, 25 bp, Rattus norvegicus
gactttaccatatatctgagcagca

SEQ ID NO: 330466 - DNA, 25 bp, Rattus norvegicus
gactttacccatcacatagatctta

SEQ ID NO: 330467 - DNA, 25 bp, Rattus norvegicus
gactttacccatgacatagatctta

SEQ ID NO: 330468 - DNA, 25 bp, Rattus norvegicus
gactttacctgcatattccacagca

SEQ ID NO: 330469 - DNA, 25 bp, Rattus norvegicus
gactttacctgcttattccacagca

SEQ ID NO: 330470 - DNA, 25 bp, Rattus norvegicus
gactttacggctcggcggagcctcc

SEQ ID NO: 330471 - DNA, 25 bp, Rattus norvegicus
gactttacggctgggcggagcctcc

SEQ ID NO: 330472 - DNA, 25 bp, Rattus norvegicus
gactttactattcaaactgttttca

SEQ ID NO: 330473 - DNA, 25 bp, Rattus norvegicus
gactttactattgaaactgttttca

SEQ ID NO: 330474 - DNA, 25 bp, Rattus norvegicus
gactttactgacattacacatacaa

SEQ ID NO: 330475 - DNA, 25 bp, Rattus norvegicus
gactttactgactttacacatacaa

SEQ ID NO: 330476 - DNA, 25 bp, Rattus norvegicus
gactttagacagctgctccagcatc

SEQ ID NO: 330477 - DNA, 25 bp, Rattus norvegicus
gactttagacaggtgctccagcatc

SEQ ID NO: 330478 - DNA, 25 bp, Rattus norvegicus
gactttagacatagtgactcagctc

SEQ ID NO: 330479 - DNA, 25 bp, Rattus norvegicus
gactttagacattgtgactcagctc

SEQ ID NO: 330480 - DNA, 25 bp, Rattus norvegicus
gactttagcaccctgttccaggaaa

SEQ ID NO: 330481 - DNA, 25 bp, Rattus norvegicus
gactttagcaccgtgttccaggaaa

SEQ ID NO: 330482 - DNA, 25 bp, Rattus norvegicus
gactttataatacagggatcccaat

SEQ ID NO: 330483 - DNA, 25 bp, Rattus norvegicus
gactttataatagagggatcccaat

SEQ ID NO: 330484 - DNA, 25 bp, Rattus norvegicus
gactttataatcctgcagtggcatg

SEQ ID NO: 330485 - DNA, 25 bp, Rattus norvegicus
gactttataatcgtgcagtggcatg

SEQ ID NO: 330486 - DNA, 25 bp, Rattus norvegicus
gactttataattagctggtgaccag

SEQ ID NO: 330487 - DNA, 25 bp, Rattus norvegicus
gactttataatttgctggtgaccag

SEQ ID NO: 330488 - DNA, 25 bp, Rattus norvegicus
gactttatataactttgactcctac

SEQ ID NO: 330489 - DNA, 25 bp, Rattus norvegicus
gactttatataagtttgactcctac

SEQ ID NO: 330490 - DNA, 25 bp, Rattus norvegicus
gactttatatgtccgtaccggtcct

SEQ ID NO: 330491 - DNA, 25 bp, Rattus norvegicus
gactttatatgtgcgtaccggtcct

SEQ ID NO: 330492 - DNA, 25 bp, Rattus norvegicus
gactttatcaatcctaggtaacccg

SEQ ID NO: 330493 - DNA, 25 bp, Rattus norvegicus
gactttatcaatgctaggtaacccg

SEQ ID NO: 330494 - DNA, 25 bp, Rattus norvegicus
gactttatctcaagctgaaccactg

SEQ ID NO: 330495 - DNA, 25 bp, Rattus norvegicus
gactttatctcatgctgaaccactg

SEQ ID NO: 330496 - DNA, 25 bp, Rattus norvegicus
gactttatcttcatttcaggctttg

SEQ ID NO: 330497 - DNA, 25 bp, Rattus norvegicus
gactttatcttcttttcaggctttg

SEQ ID NO: 330498 - DNA, 25 bp, Rattus norvegicus
gactttatgacaacagtgcccttct

SEQ ID NO: 330499 - DNA, 25 bp, Rattus norvegicus
gactttatgacatcagtgcccttct

SEQ ID NO: 330500 - DNA, 25 bp, Rattus norvegicus
gactttatgactcacgtgcttagcc

SEQ ID NO: 330501 - DNA, 25 bp, Rattus norvegicus
gactttatgactgacgtgcttagcc

SEQ ID NO: 330502 - DNA, 25 bp, Rattus norvegicus
gactttatgagtcaagccagtctga

SEQ ID NO: 330503 - DNA, 25 bp, Rattus norvegicus
gactttatgagtgaagccagtctga

SEQ ID NO: 330504 - DNA, 25 bp, Rattus norvegicus
gactttatgatcctctctcctttgt

SEQ ID NO: 330505 - DNA, 25 bp, Rattus norvegicus
gactttatgatcgtctctcctttgt

SEQ ID NO: 330506 - DNA, 25 bp, Rattus norvegicus
gactttatgtagcaacacctctggt

SEQ ID NO: 330507 - DNA, 25 bp, Rattus norvegicus
gactttatgtaggaacacctctggt

SEQ ID NO: 330508 - DNA, 25 bp, Rattus norvegicus
gactttatgtcacattaacagggca

SEQ ID NO: 330509 - DNA, 25 bp, Rattus norvegicus
gactttatgtcagattaacagggca

SEQ ID NO: 330510 - DNA, 25 bp, Rattus norvegicus
gactttattcaacaaatggcatgtg

SEQ ID NO: 330511 - DNA, 25 bp, Rattus norvegicus
gactttattcaagaaatggcatgtg

SEQ ID NO: 330512 - DNA, 25 bp, Rattus norvegicus
gactttatttgccatctgcttgaga

SEQ ID NO: 330513 - DNA, 25 bp, Rattus norvegicus
gactttatttgcgatctgcttgaga

SEQ ID NO: 330514 - DNA, 25 bp, Rattus norvegicus
gactttcaagatcacgggccgactt

SEQ ID NO: 330515 - DNA, 25 bp, Rattus norvegicus
gactttcaagatcggagctccgagc

SEQ ID NO: 330516 - DNA, 25 bp, Rattus norvegicus
gactttcaagatgacgggccgactt

SEQ ID NO: 330517 - DNA, 25 bp, Rattus norvegicus
gactttcaagatgggagctccgagc

SEQ ID NO: 330518 - DNA, 25 bp, Rattus norvegicus
gactttcaattgaatcttagctgta

SEQ ID NO: 330519 - DNA, 25 bp, Rattus norvegicus
gactttcaattgtatcttagctgta

SEQ ID NO: 330520 - DNA, 25 bp, Rattus norvegicus
gactttcacaccaacaagcgcgtgt

SEQ ID NO: 330521 - DNA, 25 bp, Rattus norvegicus
gactttcacacctacaagcgcgtgt

SEQ ID NO: 330522 - DNA, 25 bp, Rattus norvegicus
gactttcacatacctgagcacgtgt

SEQ ID NO: 330523 - DNA, 25 bp, Rattus norvegicus
gactttcacatagctgagcacgtgt

SEQ ID NO: 330524 - DNA, 25 bp, Rattus norvegicus
gactttcacctactaactggtcatg

SEQ ID NO: 330525 - DNA, 25 bp, Rattus norvegicus
gactttcacctagtaactggtcatg

SEQ ID NO: 330526 - DNA, 25 bp, Rattus norvegicus
gactttcactttatgggtaagccac

SEQ ID NO: 330527 - DNA, 25 bp, Rattus norvegicus
gactttcactttttgggtaagccac

SEQ ID NO: 330528 - DNA, 25 bp, Rattus norvegicus
gactttcagaaaagattcccgggct

SEQ ID NO: 330529 - DNA, 25 bp, Rattus norvegicus
gactttcagaaatgattcccgggct

SEQ ID NO: 330530 - DNA, 25 bp, Rattus norvegicus
gactttcagaatcataagcccctgg

SEQ ID NO: 330531 - DNA, 25 bp, Rattus norvegicus
gactttcagaatgataagcccctgg

SEQ ID NO: 330532 - DNA, 25 bp, Rattus norvegicus
gactttcagcgccattctaaacaga

SEQ ID NO: 330533 - DNA, 25 bp, Rattus norvegicus
gactttcagcgcgattctaaacaga

SEQ ID NO: 330534 - DNA, 25 bp, Rattus norvegicus
gactttcagtctactggattcttca

SEQ ID NO: 330535 - DNA, 25 bp, Rattus norvegicus
gactttcagtcttctggattcttca

SEQ ID NO: 330536 - DNA, 25 bp, Rattus norvegicus
gactttcagtgtcgagatgcctcag

SEQ ID NO: 330537 - DNA, 25 bp, Rattus norvegicus
gactttcagtgtggagatgcctcag

SEQ ID NO: 330538 - DNA, 25 bp, Rattus norvegicus
gactttcagttgactcctgaggaca

SEQ ID NO: 330539 - DNA, 25 bp, Rattus norvegicus
gactttcagttgtctcctgaggaca

SEQ ID NO: 330540 - DNA, 25 bp, Rattus norvegicus
gactttcatctgctttcctttttca

SEQ ID NO: 330541 - DNA, 25 bp, Rattus norvegicus
gactttcatctggtttcctttttca

SEQ ID NO: 330542 - DNA, 25 bp, Rattus norvegicus
gactttcatgaaaggcaggaatgca

SEQ ID NO: 330543 - DNA, 25 bp, Rattus norvegicus
gactttcatgaatggcaggaatgca

SEQ ID NO: 330544 - DNA, 25 bp, Rattus norvegicus
gactttcatgatatattaactggga

SEQ ID NO: 330545 - DNA, 25 bp, Rattus norvegicus
gactttcatgatttattaactggga

SEQ ID NO: 330546 - DNA, 25 bp, Rattus norvegicus
gactttcattcccagctttgctaaa

SEQ ID NO: 330547 - DNA, 25 bp, Rattus norvegicus
gactttcattccgagctttgctaaa

SEQ ID NO: 330548 - DNA, 25 bp, Rattus norvegicus
gactttcatttacctcaggaccatt

SEQ ID NO: 330549 - DNA, 25 bp, Rattus norvegicus
gactttcatttagctcaggaccatt

SEQ ID NO: 330550 - DNA, 25 bp, Rattus norvegicus
gactttccaaacaaaggctcgatgg

SEQ ID NO: 330551 - DNA, 25 bp, Rattus norvegicus
gactttccaaacagtctctgtggtt

SEQ ID NO: 330552 - DNA, 25 bp, Rattus norvegicus
gactttccaaactaaggctcgatgg

SEQ ID NO: 330553 - DNA, 25 bp, Rattus norvegicus
gactttccaaactgtctctgtggtt

SEQ ID NO: 330554 - DNA, 25 bp, Rattus norvegicus
gactttccaaatacttgctctaagc

SEQ ID NO: 330555 - DNA, 25 bp, Rattus norvegicus
gactttccaaattcttgctctaagc

SEQ ID NO: 330556 - DNA, 25 bp, Rattus norvegicus
gactttccaagtagacacagcctct

SEQ ID NO: 330557 - DNA, 25 bp, Rattus norvegicus
gactttccaagttgacacagcctct

SEQ ID NO: 330558 - DNA, 25 bp, Rattus norvegicus
gactttccagtgcttggactgtgct

SEQ ID NO: 330559 - DNA, 25 bp, Rattus norvegicus
gactttccagtggttggactgtgct

SEQ ID NO: 330560 - DNA, 25 bp, Rattus norvegicus
gactttcccaagacagatgactcca

SEQ ID NO: 330561 - DNA, 25 bp, Rattus norvegicus
gactttcccaagtcagatgactcca

SEQ ID NO: 330562 - DNA, 25 bp, Rattus norvegicus
gactttcccacacatttaaactcta

SEQ ID NO: 330563 - DNA, 25 bp, Rattus norvegicus
gactttcccacagatttaaactcta

SEQ ID NO: 330564 - DNA, 25 bp, Rattus norvegicus
gactttccccttcatatttctcaga

SEQ ID NO: 330565 - DNA, 25 bp, Rattus norvegicus
gactttccccttgatatttctcaga

SEQ ID NO: 330566 - DNA, 25 bp, Rattus norvegicus
gactttccgtagaaagatgtctcgt

SEQ ID NO: 330567 - DNA, 25 bp, Rattus norvegicus
gactttccgtagtaagatgtctcgt

SEQ ID NO: 330568 - DNA, 25 bp, Rattus norvegicus
gactttcctattctttgctgcttaa

SEQ ID NO: 330569 - DNA, 25 bp, Rattus norvegicus
gactttcctattgtttgctgcttaa

SEQ ID NO: 330570 - DNA, 25 bp, Rattus norvegicus
gactttcctcaccttcatggatgga

SEQ ID NO: 330571 - DNA, 25 bp, Rattus norvegicus
gactttcctcacgttcatggatgga

SEQ ID NO: 330572 - DNA, 25 bp, Rattus norvegicus
gactttcctcctaatgcagagtatc

SEQ ID NO: 330573 - DNA, 25 bp, Rattus norvegicus
gactttcctccttatgcagagtatc

SEQ ID NO: 330574 - DNA, 25 bp, Rattus norvegicus
gactttcctctcagattacatctct

SEQ ID NO: 330575 - DNA, 25 bp, Rattus norvegicus
gactttcctctctgattacatctct

SEQ ID NO: 330576 - DNA, 25 bp, Rattus norvegicus
gactttcctgaaaggttggccccag

SEQ ID NO: 330577 - DNA, 25 bp, Rattus norvegicus
gactttcctgaatggttggccccag

SEQ ID NO: 330578 - DNA, 25 bp, Rattus norvegicus
gactttcctgtgagaggaggacgat

SEQ ID NO: 330579 - DNA, 25 bp, Rattus norvegicus
gactttcctgtgtgaggaggacgat

SEQ ID NO: 330580 - DNA, 25 bp, Rattus norvegicus
gactttcctttcaaattgacttgac

SEQ ID NO: 330581 - DNA, 25 bp, Rattus norvegicus
gactttcctttctaattgacttgac

SEQ ID NO: 330582 - DNA, 25 bp, Rattus norvegicus
gactttccttttccaggtctttcac

SEQ ID NO: 330583 - DNA, 25 bp, Rattus norvegicus
gactttccttttgcaggtctttcac

SEQ ID NO: 330584 - DNA, 25 bp, Rattus norvegicus
gactttcgaacaattgccatctctt

SEQ ID NO: 330585 - DNA, 25 bp, Rattus norvegicus
gactttcgaacatttgccatctctt

SEQ ID NO: 330586 - DNA, 25 bp, Rattus norvegicus
gactttcgagatcacgtcgcccaac

SEQ ID NO: 330587 - DNA, 25 bp, Rattus norvegicus
gactttcgagatgacgtcgcccaac

SEQ ID NO: 330588 - DNA, 25 bp, Rattus norvegicus
gactttcgatatattctgtgtaatg

SEQ ID NO: 330589 - DNA, 25 bp, Rattus norvegicus
gactttcgatattttctgtgtaatg

SEQ ID NO: 330590 - DNA, 25 bp, Rattus norvegicus
gactttctaagaactgagccacttc

SEQ ID NO: 330591 - DNA, 25 bp, Rattus norvegicus
gactttctaagatctgagccacttc

SEQ ID NO: 330592 - DNA, 25 bp, Rattus norvegicus
gactttctacctaaacattctctca

SEQ ID NO: 330593 - DNA, 25 bp, Rattus norvegicus
gactttctaccttaacattctctca

SEQ ID NO: 330594 - DNA, 25 bp, Rattus norvegicus
gactttctagaaacaatggccaaga

SEQ ID NO: 330595 - DNA, 25 bp, Rattus norvegicus
gactttctagaaattgccttgctta

SEQ ID NO: 330596 - DNA, 25 bp, Rattus norvegicus
gactttctagaatcaatggccaaga

SEQ ID NO: 330597 - DNA, 25 bp, Rattus norvegicus
gactttctagaatttgccttgctta

SEQ ID NO: 330598 - DNA, 25 bp, Rattus norvegicus
gactttctcagaatgatgctgggca

SEQ ID NO: 330599 - DNA, 25 bp, Rattus norvegicus
gactttctcagattgatgctgggca

SEQ ID NO: 330600 - DNA, 25 bp, Rattus norvegicus
gactttctcataaccaggcaaacag

SEQ ID NO: 330601 - DNA, 25 bp, Rattus norvegicus
gactttctcatatccaggcaaacag

SEQ ID NO: 330602 - DNA, 25 bp, Rattus norvegicus
gactttctccaaaacaatcccagta

SEQ ID NO: 330603 - DNA, 25 bp, Rattus norvegicus
gactttctccaaccactaattgcaa

SEQ ID NO: 330604 - DNA, 25 bp, Rattus norvegicus
gactttctccaagcactaattgcaa

SEQ ID NO: 330605 - DNA, 25 bp, Rattus norvegicus
gactttctccaatacaatcccagta

SEQ ID NO: 330606 - DNA, 25 bp, Rattus norvegicus
gactttctcctcacatcactgtgag

SEQ ID NO: 330607 - DNA, 25 bp, Rattus norvegicus
gactttctcctctcatcactgtgag

SEQ ID NO: 330608 - DNA, 25 bp, Rattus norvegicus
gactttctccttcctctagagaggt

SEQ ID NO: 330609 - DNA, 25 bp, Rattus norvegicus
gactttctccttgctctagagaggt

SEQ ID NO: 330610 - DNA, 25 bp, Rattus norvegicus
gactttctcgttattgtgaaggcta

SEQ ID NO: 330611 - DNA, 25 bp, Rattus norvegicus
gactttctcgtttttgtgaaggcta

SEQ ID NO: 330612 - DNA, 25 bp, Rattus norvegicus
gactttctctatcaattcttaccaa

SEQ ID NO: 330613 - DNA, 25 bp, Rattus norvegicus
gactttctctatgaattcttaccaa

SEQ ID NO: 330614 - DNA, 25 bp, Rattus norvegicus
gactttctctggaggatcattgcct

SEQ ID NO: 330615 - DNA, 25 bp, Rattus norvegicus
gactttctctggtggatcattgcct

SEQ ID NO: 330616 - DNA, 25 bp, Rattus norvegicus
gactttctctgtcccttcactgaag

SEQ ID NO: 330617 - DNA, 25 bp, Rattus norvegicus
gactttctctgtgccttcactgaag

SEQ ID NO: 330618 - DNA, 25 bp, Rattus norvegicus
gactttctgatgatggtgtggacct

SEQ ID NO: 330619 - DNA, 25 bp, Rattus norvegicus
gactttctgatgttggtgtggacct

SEQ ID NO: 330620 - DNA, 25 bp, Rattus norvegicus
gactttctgcatcatggcttcctgt

SEQ ID NO: 330621 - DNA, 25 bp, Rattus norvegicus
gactttctgcatccctagggtacta

SEQ ID NO: 330622 - DNA, 25 bp, Rattus norvegicus
gactttctgcatgatggcttcctgt

SEQ ID NO: 330623 - DNA, 25 bp, Rattus norvegicus
gactttctgcatgcctagggtacta

SEQ ID NO: 330624 - DNA, 25 bp, Rattus norvegicus
gactttctgggtctagaatctgact

SEQ ID NO: 330625 - DNA, 25 bp, Rattus norvegicus
gactttctgggtgtagaatctgact

SEQ ID NO: 330626 - DNA, 25 bp, Rattus norvegicus
gactttctggtcctgatgctagaat

SEQ ID NO: 330627 - DNA, 25 bp, Rattus norvegicus
gactttctggtcgtgatgctagaat

SEQ ID NO: 330628 - DNA, 25 bp, Rattus norvegicus
gactttctggtgagatatctgatgt

SEQ ID NO: 330629 - DNA, 25 bp, Rattus norvegicus
gactttctggtgtgatatctgatgt

SEQ ID NO: 330630 - DNA, 25 bp, Rattus norvegicus
gactttctgtcaatgttcgatgaga

SEQ ID NO: 330631 - DNA, 25 bp, Rattus norvegicus
gactttctgtcattgttcgatgaga

SEQ ID NO: 330632 - DNA, 25 bp, Rattus norvegicus
gactttctgttgaagctgttctttg

SEQ ID NO: 330633 - DNA, 25 bp, Rattus norvegicus
gactttctgttgtagctgttctttg

SEQ ID NO: 330634 - DNA, 25 bp, Rattus norvegicus
gactttcttcatcactgcagcattt

SEQ ID NO: 330635 - DNA, 25 bp, Rattus norvegicus
gactttcttcatgactgcagcattt

SEQ ID NO: 330636 - DNA, 25 bp, Rattus norvegicus
gactttcttctaaagtgccctgaat

SEQ ID NO: 330637 - DNA, 25 bp, Rattus norvegicus
gactttcttctatagtgccctgaat

SEQ ID NO: 330638 - DNA, 25 bp, Rattus norvegicus
gactttcttgccatgatgaactatg

SEQ ID NO: 330639 - DNA, 25 bp, Rattus norvegicus
gactttcttgccttgatgaactatg

SEQ ID NO: 330640 - DNA, 25 bp, Rattus norvegicus
gactttcttgcgctcattttgtaat

SEQ ID NO: 330641 - DNA, 25 bp, Rattus norvegicus
gactttcttgcggtcattttgtaat

SEQ ID NO: 330642 - DNA, 25 bp, Rattus norvegicus
gactttgaaaccatgctgctactaa

SEQ ID NO: 330643 - DNA, 25 bp, Rattus norvegicus
gactttgaaaccttgctgctactaa

SEQ ID NO: 330644 - DNA, 25 bp, Rattus norvegicus
gactttgaacagaactcctctggtt

SEQ ID NO: 330645 - DNA, 25 bp, Rattus norvegicus
gactttgaacagtactcctctggtt

SEQ ID NO: 330646 - DNA, 25 bp, Rattus norvegicus
gactttgaactcatagcatcgtggc

SEQ ID NO: 330647 - DNA, 25 bp, Rattus norvegicus
gactttgaactcttagcatcgtggc

SEQ ID NO: 330648 - DNA, 25 bp, Rattus norvegicus
gactttgaacttcctggcagctctg

SEQ ID NO: 330649 - DNA, 25 bp, Rattus norvegicus
gactttgaacttgctggcagctctg

SEQ ID NO: 330650 - DNA, 25 bp, Rattus norvegicus
gactttgaagccatgacagcccctg

SEQ ID NO: 330651 - DNA, 25 bp, Rattus norvegicus
gactttgaagccttgacagcccctg

SEQ ID NO: 330652 - DNA, 25 bp, Rattus norvegicus
gactttgaaggaaatctccagcacg

SEQ ID NO: 330653 - DNA, 25 bp, Rattus norvegicus
gactttgaaggatatctccagcacg

SEQ ID NO: 330654 - DNA, 25 bp, Rattus norvegicus
gactttgaccctcaaagcttgatca

SEQ ID NO: 330655 - DNA, 25 bp, Rattus norvegicus
gactttgaccctgaaagcttgatca

SEQ ID NO: 330656 - DNA, 25 bp, Rattus norvegicus
gactttgaccgcattatcggagcca

SEQ ID NO: 330657 - DNA, 25 bp, Rattus norvegicus
gactttgaccgctttatcggagcca

SEQ ID NO: 330658 - DNA, 25 bp, Rattus norvegicus
gactttgaccttcaacatgatccag

SEQ ID NO: 330659 - DNA, 25 bp, Rattus norvegicus
gactttgaccttgaacatgatccag

SEQ ID NO: 330660 - DNA, 25 bp, Rattus norvegicus
gactttgacggtcacctggcagcat

SEQ ID NO: 330661 - DNA, 25 bp, Rattus norvegicus
gactttgacggtgacctggcagcat

SEQ ID NO: 330662 - DNA, 25 bp, Rattus norvegicus
gactttgagaccattgatgcaggct

SEQ ID NO: 330663 - DNA, 25 bp, Rattus norvegicus
gactttgagacctttgatgcaggct

SEQ ID NO: 330664 - DNA, 25 bp, Rattus norvegicus
gactttgagaggctcccaacttgga

SEQ ID NO: 330665 - DNA, 25 bp, Rattus norvegicus
gactttgagagggtcccaacttgga

SEQ ID NO: 330666 - DNA, 25 bp, Rattus norvegicus
gactttgagcttacacaaggtccac

SEQ ID NO: 330667 - DNA, 25 bp, Rattus norvegicus
gactttgagctttcacaaggtccac

SEQ ID NO: 330668 - DNA, 25 bp, Rattus norvegicus
gactttgaggtcacagcaagacact

SEQ ID NO: 330669 - DNA, 25 bp, Rattus norvegicus
gactttgaggtctcagcaagacact

SEQ ID NO: 330670 - DNA, 25 bp, Rattus norvegicus
gactttgatgatattgggctcggct

SEQ ID NO: 330671 - DNA, 25 bp, Rattus norvegicus
gactttgatgattttgggctcggct

SEQ ID NO: 330672 - DNA, 25 bp, Rattus norvegicus
gactttgatgtcctggttattaaca

SEQ ID NO: 330673 - DNA, 25 bp, Rattus norvegicus
gactttgatgtcgtggttattaaca

SEQ ID NO: 330674 - DNA, 25 bp, Rattus norvegicus
gactttgatgttcctttatttccca

SEQ ID NO: 330675 - DNA, 25 bp, Rattus norvegicus
gactttgatgttgctttatttccca

SEQ ID NO: 330676 - DNA, 25 bp, Rattus norvegicus
gactttgattcacaatgaacacaaa

SEQ ID NO: 330677 - DNA, 25 bp, Rattus norvegicus
gactttgattcagaatgaacacaaa

SEQ ID NO: 330678 - DNA, 25 bp, Rattus norvegicus
gactttgattccaacaacaacgaca

SEQ ID NO: 330679 - DNA, 25 bp, Rattus norvegicus
gactttgattcctacaacaacgaca

SEQ ID NO: 330680 - DNA, 25 bp, Rattus norvegicus
gactttgatttcaagccagggaagc

SEQ ID NO: 330681 - DNA, 25 bp, Rattus norvegicus
gactttgatttctagccagggaagc

SEQ ID NO: 330682 - DNA, 25 bp, Rattus norvegicus
gactttgcaaagaatctaactcaat

SEQ ID NO: 330683 - DNA, 25 bp, Rattus norvegicus
gactttgcaaagtatctaactcaat

SEQ ID NO: 330684 - DNA, 25 bp, Rattus norvegicus
gactttgcaacgactgtcctaagga

SEQ ID NO: 330685 - DNA, 25 bp, Rattus norvegicus
gactttgcaacgtctgtcctaagga

SEQ ID NO: 330686 - DNA, 25 bp, Rattus norvegicus
gactttgcaagccttcttggttaca

SEQ ID NO: 330687 - DNA, 25 bp, Rattus norvegicus
gactttgcaagcgttcttggttaca

SEQ ID NO: 330688 - DNA, 25 bp, Rattus norvegicus
gactttgcaaggaaccatcattaaa

SEQ ID NO: 330689 - DNA, 25 bp, Rattus norvegicus
gactttgcaaggtaccatcattaaa

SEQ ID NO: 330690 - DNA, 25 bp, Rattus norvegicus
gactttgcacagaatctaacatctt

SEQ ID NO: 330691 - DNA, 25 bp, Rattus norvegicus
gactttgcacagtatctaacatctt

SEQ ID NO: 330692 - DNA, 25 bp, Rattus norvegicus
gactttgcagccatggagtttctag

SEQ ID NO: 330693 - DNA, 25 bp, Rattus norvegicus
gactttgcagcccaggttttctctc

SEQ ID NO: 330694 - DNA, 25 bp, Rattus norvegicus
gactttgcagccgaggttttctctc

SEQ ID NO: 330695 - DNA, 25 bp, Rattus norvegicus
gactttgcagccttggagtttctag

SEQ ID NO: 330696 - DNA, 25 bp, Rattus norvegicus
gactttgcagtcattctttaataag

SEQ ID NO: 330697 - DNA, 25 bp, Rattus norvegicus
gactttgcagtctttctttaataag

SEQ ID NO: 330698 - DNA, 25 bp, Rattus norvegicus
gactttgcatcaagttagccagcca

SEQ ID NO: 330699 - DNA, 25 bp, Rattus norvegicus
gactttgcatcatgttagccagcca

SEQ ID NO: 330700 - DNA, 25 bp, Rattus norvegicus
gactttgccaataactaagtggttg

SEQ ID NO: 330701 - DNA, 25 bp, Rattus norvegicus
gactttgccaattactaagtggttg

SEQ ID NO: 330702 - DNA, 25 bp, Rattus norvegicus
gactttgccagcactgtgtttgaat

SEQ ID NO: 330703 - DNA, 25 bp, Rattus norvegicus
gactttgccagcctctgcattagag

SEQ ID NO: 330704 - DNA, 25 bp, Rattus norvegicus
gactttgccagcgtctgcattagag

SEQ ID NO: 330705 - DNA, 25 bp, Rattus norvegicus
gactttgccagctctgtgtttgaat

SEQ ID NO: 330706 - DNA, 25 bp, Rattus norvegicus
gactttgccagtaatgatatcctca

SEQ ID NO: 330707 - DNA, 25 bp, Rattus norvegicus
gactttgccagttatgatatcctca

SEQ ID NO: 330708 - DNA, 25 bp, Rattus norvegicus
gactttgcccagaggagagaccagt

SEQ ID NO: 330709 - DNA, 25 bp, Rattus norvegicus
gactttgcccagtggagagaccagt

SEQ ID NO: 330710 - DNA, 25 bp, Rattus norvegicus
gactttgccctgaatgtatgatgac

SEQ ID NO: 330711 - DNA, 25 bp, Rattus norvegicus
gactttgccctgtatgtatgatgac

SEQ ID NO: 330712 - DNA, 25 bp, Rattus norvegicus
gactttgccgagagaaatggctttt

SEQ ID NO: 330713 - DNA, 25 bp, Rattus norvegicus
gactttgccgagtgaaatggctttt

SEQ ID NO: 330714 - DNA, 25 bp, Rattus norvegicus
gactttgcctatctatcttcctggg

SEQ ID NO: 330715 - DNA, 25 bp, Rattus norvegicus
gactttgcctatgtatcttcctggg

SEQ ID NO: 330716 - DNA, 25 bp, Rattus norvegicus
gactttgcctcacttgagaaattag

SEQ ID NO: 330717 - DNA, 25 bp, Rattus norvegicus
gactttgcctcagttgagaaattag

SEQ ID NO: 330718 - DNA, 25 bp, Rattus norvegicus
gactttgccttcagtgctgagctta

SEQ ID NO: 330719 - DNA, 25 bp, Rattus norvegicus
gactttgccttctgtgctgagctta

SEQ ID NO: 330720 - DNA, 25 bp, Rattus norvegicus
gactttgccttgaatgctcatcatt

SEQ ID NO: 330721 - DNA, 25 bp, Rattus norvegicus
gactttgccttgtatgctcatcatt

SEQ ID NO: 330722 - DNA, 25 bp, Rattus norvegicus
gactttgctaacatggtgacttctc

SEQ ID NO: 330723 - DNA, 25 bp, Rattus norvegicus
gactttgctaacttggtgacttctc

SEQ ID NO: 330724 - DNA, 25 bp, Rattus norvegicus
gactttgctaataatacctcacatt

SEQ ID NO: 330725 - DNA, 25 bp, Rattus norvegicus
gactttgctaattatacctcacatt

SEQ ID NO: 330726 - DNA, 25 bp, Rattus norvegicus
gactttgctagcaccagtcatgtaa

SEQ ID NO: 330727 - DNA, 25 bp, Rattus norvegicus
gactttgctagctccagtcatgtaa

SEQ ID NO: 330728 - DNA, 25 bp, Rattus norvegicus
gactttgctcatcgtaagacatcac

SEQ ID NO: 330729 - DNA, 25 bp, Rattus norvegicus
gactttgctcatggtaagacatcac

SEQ ID NO: 330730 - DNA, 25 bp, Rattus norvegicus
gactttgctgaaaatcatccgtaaa

SEQ ID NO: 330731 - DNA, 25 bp, Rattus norvegicus
gactttgctgaatatcatccgtaaa

SEQ ID NO: 330732 - DNA, 25 bp, Rattus norvegicus
gactttgctgatagtgcatctctaa

SEQ ID NO: 330733 - DNA, 25 bp, Rattus norvegicus
gactttgctgatatgagggcgcaca

SEQ ID NO: 330734 - DNA, 25 bp, Rattus norvegicus
gactttgctgattgtgcatctctaa

SEQ ID NO: 330735 - DNA, 25 bp, Rattus norvegicus
gactttgctgatttgagggcgcaca

SEQ ID NO: 330736 - DNA, 25 bp, Rattus norvegicus
gactttgctgctattagacttctgt

SEQ ID NO: 330737 - DNA, 25 bp, Rattus norvegicus
gactttgctgcttttagacttctgt

SEQ ID NO: 330738 - DNA, 25 bp, Rattus norvegicus
gactttgctggaactgtgcactgtt

SEQ ID NO: 330739 - DNA, 25 bp, Rattus norvegicus
gactttgctggatctgtgcactgtt

SEQ ID NO: 330740 - DNA, 25 bp, Rattus norvegicus
gactttgcttatacagagacccgag

SEQ ID NO: 330741 - DNA, 25 bp, Rattus norvegicus
gactttgcttattcagagacccgag

SEQ ID NO: 330742 - DNA, 25 bp, Rattus norvegicus
gactttgctttaagtgtgtgaattc

SEQ ID NO: 330743 - DNA, 25 bp, Rattus norvegicus
gactttgctttatgtgtgtgaattc

SEQ ID NO: 330744 - DNA, 25 bp, Rattus norvegicus
gactttggaaaaagaacttcagact

SEQ ID NO: 330745 - DNA, 25 bp, Rattus norvegicus
gactttggaaaatgaacttcagact

SEQ ID NO: 330746 - DNA, 25 bp, Rattus norvegicus
gactttggacacagctcactgagga

SEQ ID NO: 330747 - DNA, 25 bp, Rattus norvegicus
gactttggacactgctcactgagga

SEQ ID NO: 330748 - DNA, 25 bp, Rattus norvegicus
gactttggactcagccacaaggaat

SEQ ID NO: 330749 - DNA, 25 bp, Rattus norvegicus
gactttggactctgccacaaggaat

SEQ ID NO: 330750 - DNA, 25 bp, Rattus norvegicus
gactttggaggcataggcatcctac

SEQ ID NO: 330751 - DNA, 25 bp, Rattus norvegicus
gactttggaggcttaggcatcctac

SEQ ID NO: 330752 - DNA, 25 bp, Rattus norvegicus
gactttggaggtcttcctggtccag

SEQ ID NO: 330753 - DNA, 25 bp, Rattus norvegicus
gactttggaggtgttcctggtccag

SEQ ID NO: 330754 - DNA, 25 bp, Rattus norvegicus
gactttggatcaaggtctccatgca

SEQ ID NO: 330755 - DNA, 25 bp, Rattus norvegicus
gactttggatcatggtctccatgca

SEQ ID NO: 330756 - DNA, 25 bp, Rattus norvegicus
gactttggcactctcaatgagatct

SEQ ID NO: 330757 - DNA, 25 bp, Rattus norvegicus
gactttggcactgtcaatgagatct

SEQ ID NO: 330758 - DNA, 25 bp, Rattus norvegicus
gactttggcataatcttacaatgtt

SEQ ID NO: 330759 - DNA, 25 bp, Rattus norvegicus
gactttggcatattcttacaatgtt

SEQ ID NO: 330760 - DNA, 25 bp, Rattus norvegicus
gactttggcattctgaacacttcat

SEQ ID NO: 330761 - DNA, 25 bp, Rattus norvegicus
gactttggcattgtgaacacttcat

SEQ ID NO: 330762 - DNA, 25 bp, Rattus norvegicus
gactttggcttgctctacctgtcat

SEQ ID NO: 330763 - DNA, 25 bp, Rattus norvegicus
gactttggcttggtctacctgtcat

SEQ ID NO: 330764 - DNA, 25 bp, Rattus norvegicus
gactttgggagaacaccaggttaca

SEQ ID NO: 330765 - DNA, 25 bp, Rattus norvegicus
gactttgggagatcaccaggttaca

SEQ ID NO: 330766 - DNA, 25 bp, Rattus norvegicus
gactttgggaggctggcactcacct

SEQ ID NO: 330767 - DNA, 25 bp, Rattus norvegicus
gactttgggagggtggcactcacct

SEQ ID NO: 330768 - DNA, 25 bp, Rattus norvegicus
gactttgggatgattcctgtggatg

SEQ ID NO: 330769 - DNA, 25 bp, Rattus norvegicus
gactttgggatgtttcctgtggatg

SEQ ID NO: 330770 - DNA, 25 bp, Rattus norvegicus
gactttgggtaaactcaagagcatt

SEQ ID NO: 330771 - DNA, 25 bp, Rattus norvegicus
gactttgggtaatctcaagagcatt

SEQ ID NO: 330772 - DNA, 25 bp, Rattus norvegicus
gactttggtaaacgtcctgagtgta

SEQ ID NO: 330773 - DNA, 25 bp, Rattus norvegicus
gactttggtaaaggtcctgagtgta

SEQ ID NO: 330774 - DNA, 25 bp, Rattus norvegicus
gactttggtctgagcttgtccacaa

SEQ ID NO: 330775 - DNA, 25 bp, Rattus norvegicus
gactttggtctgtgcttgtccacaa

SEQ ID NO: 330776 - DNA, 25 bp, Rattus norvegicus
gactttggtgcacgtggctagctat

SEQ ID NO: 330777 - DNA, 25 bp, Rattus norvegicus
gactttggtgcaggtggctagctat

SEQ ID NO: 330778 - DNA, 25 bp, Rattus norvegicus
gactttggtgctacctcagctgagg

SEQ ID NO: 330779 - DNA, 25 bp, Rattus norvegicus
gactttggtgcttcctcagctgagg

SEQ ID NO: 330780 - DNA, 25 bp, Rattus norvegicus
gactttggtgtacagtgcagtgaac

SEQ ID NO: 330781 - DNA, 25 bp, Rattus norvegicus
gactttggtgtagagtgcagtgaac

SEQ ID NO: 330782 - DNA, 25 bp, Rattus norvegicus
gactttggtttgcagtctttctttg

SEQ ID NO: 330783 - DNA, 25 bp, Rattus norvegicus
gactttggtttggagtctttctttg

SEQ ID NO: 330784 - DNA, 25 bp, Rattus norvegicus
gactttgtacacaagtactccatga

SEQ ID NO: 330785 - DNA, 25 bp, Rattus norvegicus
gactttgtacactagtactccatga

SEQ ID NO: 330786 - DNA, 25 bp, Rattus norvegicus
gactttgtaccgacactcatttgta

SEQ ID NO: 330787 - DNA, 25 bp, Rattus norvegicus
gactttgtaccgtcactcatttgta

SEQ ID NO: 330788 - DNA, 25 bp, Rattus norvegicus
gactttgtactcagtggtacctgcc

SEQ ID NO: 330789 - DNA, 25 bp, Rattus norvegicus
gactttgtactctgtggtacctgcc

SEQ ID NO: 330790 - DNA, 25 bp, Rattus norvegicus
gactttgtagctacactgttcttga

SEQ ID NO: 330791 - DNA, 25 bp, Rattus norvegicus
gactttgtagcttcactgttcttga

SEQ ID NO: 330792 - DNA, 25 bp, Rattus norvegicus
gactttgtcaccagggtggactcat

SEQ ID NO: 330793 - DNA, 25 bp, Rattus norvegicus
gactttgtcacctgggtggactcat

SEQ ID NO: 330794 - DNA, 25 bp, Rattus norvegicus
gactttgtgaccagtgtgcctgtaa

SEQ ID NO: 330795 - DNA, 25 bp, Rattus norvegicus
gactttgtgacctgtgtgcctgtaa

SEQ ID NO: 330796 - DNA, 25 bp, Rattus norvegicus
gactttgtgcatacttctagggact

SEQ ID NO: 330797 - DNA, 25 bp, Rattus norvegicus
gactttgtgcattcttctagggact

SEQ ID NO: 330798 - DNA, 25 bp, Rattus norvegicus
gactttgtggaactgatgggcccta

SEQ ID NO: 330799 - DNA, 25 bp, Rattus norvegicus
gactttgtggaagtgatgggcccta

SEQ ID NO: 330800 - DNA, 25 bp, Rattus norvegicus
gactttgtggcaaggcccagcagga

SEQ ID NO: 330801 - DNA, 25 bp, Rattus norvegicus
gactttgtggcatggcccagcagga

SEQ ID NO: 330802 - DNA, 25 bp, Rattus norvegicus
gactttgttaatccataacccgaca

SEQ ID NO: 330803 - DNA, 25 bp, Rattus norvegicus
gactttgttaatgcataacccgaca

SEQ ID NO: 330804 - DNA, 25 bp, Rattus norvegicus
gactttgttacactcttgctctctg

SEQ ID NO: 330805 - DNA, 25 bp, Rattus norvegicus
gactttgttacagtcttgctctctg

SEQ ID NO: 330806 - DNA, 25 bp, Rattus norvegicus
gactttgttcttcgccatggcttct

SEQ ID NO: 330807 - DNA, 25 bp, Rattus norvegicus
gactttgttcttggccatggcttct

SEQ ID NO: 330808 - DNA, 25 bp, Rattus norvegicus
gactttgttgcactgacttccgatt

SEQ ID NO: 330809 - DNA, 25 bp, Rattus norvegicus
gactttgttgcagtgacttccgatt

SEQ ID NO: 330810 - DNA, 25 bp, Rattus norvegicus
gactttgttggaaataccctagcac

SEQ ID NO: 330811 - DNA, 25 bp, Rattus norvegicus
gactttgttggatataccctagcac

SEQ ID NO: 330812 - DNA, 25 bp, Rattus norvegicus
gactttgttgtaaagctgctgtgaa

SEQ ID NO: 330813 - DNA, 25 bp, Rattus norvegicus
gactttgttgtatagctgctgtgaa

SEQ ID NO: 330814 - DNA, 25 bp, Rattus norvegicus
gactttgtttacaaccttcaggtgc

SEQ ID NO: 330815 - DNA, 25 bp, Rattus norvegicus
gactttgtttactaccttcaggtgc

SEQ ID NO: 330816 - DNA, 25 bp, Rattus norvegicus
gactttgtttccaagcttggtgctg

SEQ ID NO: 330817 - DNA, 25 bp, Rattus norvegicus
gactttgtttcctagcttggtgctg

SEQ ID NO: 330818 - DNA, 25 bp, Rattus norvegicus
gactttgttttgattcggtacatct

SEQ ID NO: 330819 - DNA, 25 bp, Rattus norvegicus
gactttgttttgtttcggtacatct

SEQ ID NO: 330820 - DNA, 25 bp, Rattus norvegicus
gacttttaaagcacagtcttaggta

SEQ ID NO: 330821 - DNA, 25 bp, Rattus norvegicus
gacttttaaagctcagtcttaggta

SEQ ID NO: 330822 - DNA, 25 bp, Rattus norvegicus
gacttttacatcaagtaggcgctgc

SEQ ID NO: 330823 - DNA, 25 bp, Rattus norvegicus
gacttttacatctagtaggcgctgc

SEQ ID NO: 330824 - DNA, 25 bp, Rattus norvegicus
gacttttacatgactatgagctaga

SEQ ID NO: 330825 - DNA, 25 bp, Rattus norvegicus
gacttttacatgtctatgagctaga

SEQ ID NO: 330826 - DNA, 25 bp, Rattus norvegicus
gacttttacctcctgaatagcttag

SEQ ID NO: 330827 - DNA, 25 bp, Rattus norvegicus
gacttttacctcgtgaatagcttag

SEQ ID NO: 330828 - DNA, 25 bp, Rattus norvegicus
gacttttagctacttttaattctca

SEQ ID NO: 330829 - DNA, 25 bp, Rattus norvegicus
gacttttagctagttttaattctca

SEQ ID NO: 330830 - DNA, 25 bp, Rattus norvegicus
gacttttagctgacataatgtatta

SEQ ID NO: 330831 - DNA, 25 bp, Rattus norvegicus
gacttttagctgtcataatgtatta

SEQ ID NO: 330832 - DNA, 25 bp, Rattus norvegicus
gacttttagtggcacgagcgacccc

SEQ ID NO: 330833 - DNA, 25 bp, Rattus norvegicus
gacttttagtgggacgagcgacccc

SEQ ID NO: 330834 - DNA, 25 bp, Rattus norvegicus
gacttttatacaatgatcttcacgt

SEQ ID NO: 330835 - DNA, 25 bp, Rattus norvegicus
gacttttatacattgatcttcacgt

SEQ ID NO: 330836 - DNA, 25 bp, Rattus norvegicus
gacttttatggccacattgccgctg

SEQ ID NO: 330837 - DNA, 25 bp, Rattus norvegicus
gacttttatggcgacattgccgctg

SEQ ID NO: 330838 - DNA, 25 bp, Rattus norvegicus
gacttttattctacacgtgtactaa

SEQ ID NO: 330839 - DNA, 25 bp, Rattus norvegicus
gacttttattcttcacgtgtactaa

SEQ ID NO: 330840 - DNA, 25 bp, Rattus norvegicus
gacttttcaaacattgggcccattg

SEQ ID NO: 330841 - DNA, 25 bp, Rattus norvegicus
gacttttcaaactttgggcccattg

SEQ ID NO: 330842 - DNA, 25 bp, Rattus norvegicus
gacttttcaaagctagacccaggca

SEQ ID NO: 330843 - DNA, 25 bp, Rattus norvegicus
gacttttcaaaggtagacccaggca

SEQ ID NO: 330844 - DNA, 25 bp, Rattus norvegicus
gacttttcaattaagcaggcccgcg

SEQ ID NO: 330845 - DNA, 25 bp, Rattus norvegicus
gacttttcaatttagcaggcccgcg

SEQ ID NO: 330846 - DNA, 25 bp, Rattus norvegicus
gacttttcacaacgttttgcagcat

SEQ ID NO: 330847 - DNA, 25 bp, Rattus norvegicus
gacttttcacaaggttttgcagcat

SEQ ID NO: 330848 - DNA, 25 bp, Rattus norvegicus
gacttttcacttctctctggttgaa

SEQ ID NO: 330849 - DNA, 25 bp, Rattus norvegicus
gacttttcacttgtctctggttgaa

SEQ ID NO: 330850 - DNA, 25 bp, Rattus norvegicus
gacttttcagccagtaccattttat

SEQ ID NO: 330851 - DNA, 25 bp, Rattus norvegicus
gacttttcagcctgtaccattttat

SEQ ID NO: 330852 - DNA, 25 bp, Rattus norvegicus
gacttttcagttcacttctccagcc

SEQ ID NO: 330853 - DNA, 25 bp, Rattus norvegicus
gacttttcagttgacttctccagcc

SEQ ID NO: 330854 - DNA, 25 bp, Rattus norvegicus
gacttttccagcctgtcctgaatca

SEQ ID NO: 330855 - DNA, 25 bp, Rattus norvegicus
gacttttccagcgtgtcctgaatca

SEQ ID NO: 330856 - DNA, 25 bp, Rattus norvegicus
gacttttccatcaagctttggtggt

SEQ ID NO: 330857 - DNA, 25 bp, Rattus norvegicus
gacttttccatctagctttggtggt

SEQ ID NO: 330858 - DNA, 25 bp, Rattus norvegicus
gacttttcccagctaatctaatatg

SEQ ID NO: 330859 - DNA, 25 bp, Rattus norvegicus
gacttttcccaggtaatctaatatg

SEQ ID NO: 330860 - DNA, 25 bp, Rattus norvegicus
gacttttcccatatgctggattcca

SEQ ID NO: 330861 - DNA, 25 bp, Rattus norvegicus
gacttttcccatttgctggattcca

SEQ ID NO: 330862 - DNA, 25 bp, Rattus norvegicus
gacttttccgacagacttttgtaga

SEQ ID NO: 330863 - DNA, 25 bp, Rattus norvegicus
gacttttccgactgacttttgtaga

SEQ ID NO: 330864 - DNA, 25 bp, Rattus norvegicus
gacttttcctatcttatgtcccaag

SEQ ID NO: 330865 - DNA, 25 bp, Rattus norvegicus
gacttttcctatgttatgtcccaag

SEQ ID NO: 330866 - DNA, 25 bp, Rattus norvegicus
gacttttcgagaacatgtacaggca

SEQ ID NO: 330867 - DNA, 25 bp, Rattus norvegicus
gacttttcgagatcatgtacaggca

SEQ ID NO: 330868 - DNA, 25 bp, Rattus norvegicus
gacttttcgccgcagactatgaagg

SEQ ID NO: 330869 - DNA, 25 bp, Rattus norvegicus
gacttttcgccggagactatgaagg

SEQ ID NO: 330870 - DNA, 25 bp, Rattus norvegicus
gacttttctagcacctttgtaatga

SEQ ID NO: 330871 - DNA, 25 bp, Rattus norvegicus
gacttttctagctcctttgtaatga

SEQ ID NO: 330872 - DNA, 25 bp, Rattus norvegicus
gacttttctatcacctatatatctg

SEQ ID NO: 330873 - DNA, 25 bp, Rattus norvegicus
gacttttctatctcctatatatctg

SEQ ID NO: 330874 - DNA, 25 bp, Rattus norvegicus
gacttttctcagatttcataccctg

SEQ ID NO: 330875 - DNA, 25 bp, Rattus norvegicus
gacttttctcagttttcataccctg

SEQ ID NO: 330876 - DNA, 25 bp, Rattus norvegicus
gacttttctgacagctgtggttctg

SEQ ID NO: 330877 - DNA, 25 bp, Rattus norvegicus
gacttttctgactgctgtggttctg

SEQ ID NO: 330878 - DNA, 25 bp, Rattus norvegicus
gacttttcttacacggtcagtcatt

SEQ ID NO: 330879 - DNA, 25 bp, Rattus norvegicus
gacttttcttactcggtcagtcatt

SEQ ID NO: 330880 - DNA, 25 bp, Rattus norvegicus
gacttttgaagcactacccgaatct

SEQ ID NO: 330881 - DNA, 25 bp, Rattus norvegicus
gacttttgaagctctacccgaatct

SEQ ID NO: 330882 - DNA, 25 bp, Rattus norvegicus
gacttttgaagtcatatggtcttga

SEQ ID NO: 330883 - DNA, 25 bp, Rattus norvegicus
gacttttgaagtgatatggtcttga

SEQ ID NO: 330884 - DNA, 25 bp, Rattus norvegicus
gacttttgacatcgagagcctcaga

SEQ ID NO: 330885 - DNA, 25 bp, Rattus norvegicus
gacttttgacatggagagcctcaga

SEQ ID NO: 330886 - DNA, 25 bp, Rattus norvegicus
gacttttgaggaaaccaccgacttt

SEQ ID NO: 330887 - DNA, 25 bp, Rattus norvegicus
gacttttgaggataccaccgacttt

SEQ ID NO: 330888 - DNA, 25 bp, Rattus norvegicus
gacttttggcaaaatttccacgaag

SEQ ID NO: 330889 - DNA, 25 bp, Rattus norvegicus
gacttttggcaatatttccacgaag

SEQ ID NO: 330890 - DNA, 25 bp, Rattus norvegicus
gacttttgggatacggcggtgccct

SEQ ID NO: 330891 - DNA, 25 bp, Rattus norvegicus
gacttttgggattcggcggtgccct

SEQ ID NO: 330892 - DNA, 25 bp, Rattus norvegicus
gacttttgtaatcccaacctgcagg

SEQ ID NO: 330893 - DNA, 25 bp, Rattus norvegicus
gacttttgtaatgccaacctgcagg

SEQ ID NO: 330894 - DNA, 25 bp, Rattus norvegicus
gacttttgtattacaccctgagttt

SEQ ID NO: 330895 - DNA, 25 bp, Rattus norvegicus
gacttttgtattccatttcacaggc

SEQ ID NO: 330896 - DNA, 25 bp, Rattus norvegicus
gacttttgtattgcatttcacaggc

SEQ ID NO: 330897 - DNA, 25 bp, Rattus norvegicus
gacttttgtatttcaccctgagttt

SEQ ID NO: 330898 - DNA, 25 bp, Rattus norvegicus
gacttttgtcatcgcattttgttct

SEQ ID NO: 330899 - DNA, 25 bp, Rattus norvegicus
gacttttgtcatggcattttgttct

SEQ ID NO: 330900 - DNA, 25 bp, Rattus norvegicus
gacttttgtgctcctatacttgtat

SEQ ID NO: 330901 - DNA, 25 bp, Rattus norvegicus
gacttttgtgctgctatacttgtat

SEQ ID NO: 330902 - DNA, 25 bp, Rattus norvegicus
gacttttgtgtcagccgaggttata

SEQ ID NO: 330903 - DNA, 25 bp, Rattus norvegicus
gacttttgtgtcattggactgtcct

SEQ ID NO: 330904 - DNA, 25 bp, Rattus norvegicus
gacttttgtgtccagctagagatcg

SEQ ID NO: 330905 - DNA, 25 bp, Rattus norvegicus
gacttttgtgtcgagctagagatcg

SEQ ID NO: 330906 - DNA, 25 bp, Rattus norvegicus
gacttttgtgtctgccgaggttata

SEQ ID NO: 330907 - DNA, 25 bp, Rattus norvegicus
gacttttgtgtctttggactgtcct

SEQ ID NO: 330908 - DNA, 25 bp, Rattus norvegicus
gacttttgttctacgtagtttccat

SEQ ID NO: 330909 - DNA, 25 bp, Rattus norvegicus
gacttttgttcttcgtagtttccat

SEQ ID NO: 330910 - DNA, 25 bp, Rattus norvegicus
gacttttgtttcacctgtcttgaat

SEQ ID NO: 330911 - DNA, 25 bp, Rattus norvegicus
gacttttgtttctcctgtcttgaat

SEQ ID NO: 330912 - DNA, 25 bp, Rattus norvegicus
gactttttacataggcgctgaggac

SEQ ID NO: 330913 - DNA, 25 bp, Rattus norvegicus
gactttttacattggcgctgaggac

SEQ ID NO: 330914 - DNA, 25 bp, Rattus norvegicus
gactttttagacaggtgctggtgta

SEQ ID NO: 330915 - DNA, 25 bp, Rattus norvegicus
gactttttagactggtgctggtgta

SEQ ID NO: 330916 - DNA, 25 bp, Rattus norvegicus
gactttttagtgatctacttgtaca

SEQ ID NO: 330917 - DNA, 25 bp, Rattus norvegicus
gactttttagtgttctacttgtaca

SEQ ID NO: 330918 - DNA, 25 bp, Rattus norvegicus
gactttttcaataggctaggctatc

SEQ ID NO: 330919 - DNA, 25 bp, Rattus norvegicus
gactttttcaattggctaggctatc

SEQ ID NO: 330920 - DNA, 25 bp, Rattus norvegicus
gactttttcagccttcatcagagaa

SEQ ID NO: 330921 - DNA, 25 bp, Rattus norvegicus
gactttttcagcgttcatcagagaa

SEQ ID NO: 330922 - DNA, 25 bp, Rattus norvegicus
gactttttcagtaaacagattgata

SEQ ID NO: 330923 - DNA, 25 bp, Rattus norvegicus
gactttttcagttaacagattgata

SEQ ID NO: 330924 - DNA, 25 bp, Rattus norvegicus
gactttttcatcctgattgacgcac

SEQ ID NO: 330925 - DNA, 25 bp, Rattus norvegicus
gactttttcatcgtgattgacgcac

SEQ ID NO: 330926 - DNA, 25 bp, Rattus norvegicus
gactttttccagacatcaacgcttt

SEQ ID NO: 330927 - DNA, 25 bp, Rattus norvegicus
gactttttccagtcatcaacgcttt

SEQ ID NO: 330928 - DNA, 25 bp, Rattus norvegicus
gactttttctttatgcgtcctctag

SEQ ID NO: 330929 - DNA, 25 bp, Rattus norvegicus
gactttttctttttgcgtcctctag

SEQ ID NO: 330930 - DNA, 25 bp, Rattus norvegicus
gactttttgactacgttctcagttg

SEQ ID NO: 330931 - DNA, 25 bp, Rattus norvegicus
gactttttgacttcgttctcagttg

SEQ ID NO: 330932 - DNA, 25 bp, Rattus norvegicus
gactttttgtgtcagtgccatgtat

SEQ ID NO: 330933 - DNA, 25 bp, Rattus norvegicus
gactttttgtgtgagtgccatgtat

SEQ ID NO: 330934 - DNA, 25 bp, Rattus norvegicus
gacttttttaggctgctgttggcta

SEQ ID NO: 330935 - DNA, 25 bp, Rattus norvegicus
gacttttttagggtgctgttggcta

SEQ ID NO: 330936 - DNA, 25 bp, Rattus norvegicus
gacttttttctcatcattagccaga

SEQ ID NO: 330937 - DNA, 25 bp, Rattus norvegicus
gacttttttctcatgttatattctg

SEQ ID NO: 330938 - DNA, 25 bp, Rattus norvegicus
gacttttttctcttcattagccaga

SEQ ID NO: 330939 - DNA, 25 bp, Rattus norvegicus
gacttttttctcttgttatattctg

SEQ ID NO: 330940 - DNA, 25 bp, Rattus norvegicus
gacttttttgcactgattcagccaa

SEQ ID NO: 330941 - DNA, 25 bp, Rattus norvegicus
gacttttttgcagtgattcagccaa

SEQ ID NO: 330942 - DNA, 25 bp, Rattus norvegicus
gagaaaaacagtcctcccgaactct

SEQ ID NO: 330943 - DNA, 25 bp, Rattus norvegicus
gagaaaaacagtgctcccgaactct

SEQ ID NO: 330944 - DNA, 25 bp, Rattus norvegicus
gagaaaaacatcacggggtgctttt

SEQ ID NO: 330945 - DNA, 25 bp, Rattus norvegicus
gagaaaaacatctcggggtgctttt

SEQ ID NO: 330946 - DNA, 25 bp, Rattus norvegicus
gagaaaaacatgcttggccaagatc

SEQ ID NO: 330947 - DNA, 25 bp, Rattus norvegicus
gagaaaaacatggttggccaagatc

SEQ ID NO: 330948 - DNA, 25 bp, Rattus norvegicus
gagaaaaactttcagagctctcctg

SEQ ID NO: 330949 - DNA, 25 bp, Rattus norvegicus
gagaaaaactttgagagctctcctg

SEQ ID NO: 330950 - DNA, 25 bp, Rattus norvegicus
gagaaaaaggtacgctgcacttaca

SEQ ID NO: 330951 - DNA, 25 bp, Rattus norvegicus
gagaaaaaggtaggctgcacttaca

SEQ ID NO: 330952 - DNA, 25 bp, Rattus norvegicus
gagaaaaataaaatcccacctggca

SEQ ID NO: 330953 - DNA, 25 bp, Rattus norvegicus
gagaaaaataaattcccacctggca

SEQ ID NO: 330954 - DNA, 25 bp, Rattus norvegicus
gagaaaaatcctctgccttcaaaag

SEQ ID NO: 330955 - DNA, 25 bp, Rattus norvegicus
gagaaaaatcctgtgccttcaaaag

SEQ ID NO: 330956 - DNA, 25 bp, Rattus norvegicus
gagaaaaattgtactgtccactttt

SEQ ID NO: 330957 - DNA, 25 bp, Rattus norvegicus
gagaaaaattgttctgtccactttt

SEQ ID NO: 330958 - DNA, 25 bp, Rattus norvegicus
gagaaaacacctctatcacacattg

SEQ ID NO: 330959 - DNA, 25 bp, Rattus norvegicus
gagaaaacacctgtatcacacattg

SEQ ID NO: 330960 - DNA, 25 bp, Rattus norvegicus
gagaaaacatccctatacaagaacc

SEQ ID NO: 330961 - DNA, 25 bp, Rattus norvegicus
gagaaaacatccgtatacaagaacc

SEQ ID NO: 330962 - DNA, 25 bp, Rattus norvegicus
gagaaaaccaatattcctgcccagc

SEQ ID NO: 330963 - DNA, 25 bp, Rattus norvegicus
gagaaaaccaattttcctgcccagc

SEQ ID NO: 330964 - DNA, 25 bp, Rattus norvegicus
gagaaaaccgctactgagcaatgca

SEQ ID NO: 330965 - DNA, 25 bp, Rattus norvegicus
gagaaaaccgcttctgagcaatgca

SEQ ID NO: 330966 - DNA, 25 bp, Rattus norvegicus
gagaaaacctgaccccaacgacaat

SEQ ID NO: 330967 - DNA, 25 bp, Rattus norvegicus
gagaaaacctgagcccaacgacaat

SEQ ID NO: 330968 - DNA, 25 bp, Rattus norvegicus
gagaaaacgccgcattgtacatagt

SEQ ID NO: 330969 - DNA, 25 bp, Rattus norvegicus
gagaaaacgccggattgtacatagt

SEQ ID NO: 330970 - DNA, 25 bp, Rattus norvegicus
gagaaaacgcctattcagtcaagat

SEQ ID NO: 330971 - DNA, 25 bp, Rattus norvegicus
gagaaaacgccttttcagtcaagat

SEQ ID NO: 330972 - DNA, 25 bp, Rattus norvegicus
gagaaaacggtgactgccatgcagc

SEQ ID NO: 330973 - DNA, 25 bp, Rattus norvegicus
gagaaaacggtgtctgccatgcagc

SEQ ID NO: 330974 - DNA, 25 bp, Rattus norvegicus
gagaaaacgtcgcatctcgcgcctt

SEQ ID NO: 330975 - DNA, 25 bp, Rattus norvegicus
gagaaaacgtcggatctcgcgcctt

SEQ ID NO: 330976 - DNA, 25 bp, Rattus norvegicus
gagaaaagcatgacctttgcaacct

SEQ ID NO: 330977 - DNA, 25 bp, Rattus norvegicus
gagaaaagcatgtcctttgcaacct

SEQ ID NO: 330978 - DNA, 25 bp, Rattus norvegicus
gagaaaagctctacacgctatcacc

SEQ ID NO: 330979 - DNA, 25 bp, Rattus norvegicus
gagaaaagctcttcacgctatcacc

SEQ ID NO: 330980 - DNA, 25 bp, Rattus norvegicus
gagaaaagctttctctaccccggca

SEQ ID NO: 330981 - DNA, 25 bp, Rattus norvegicus
gagaaaagctttgtctaccccggca

SEQ ID NO: 330982 - DNA, 25 bp, Rattus norvegicus
gagaaaaggcttctcatgtttgatt

SEQ ID NO: 330983 - DNA, 25 bp, Rattus norvegicus
gagaaaaggcttgtcatgtttgatt

SEQ ID NO: 330984 - DNA, 25 bp, Rattus norvegicus
gagaaaagtggtatgtacccctgaa

SEQ ID NO: 330985 - DNA, 25 bp, Rattus norvegicus
gagaaaagtggtttgtacccctgaa

SEQ ID NO: 330986 - DNA, 25 bp, Rattus norvegicus
gagaaaagtgttactttcgacttct

SEQ ID NO: 330987 - DNA, 25 bp, Rattus norvegicus
gagaaaagtgtttctttcgacttct

SEQ ID NO: 330988 - DNA, 25 bp, Rattus norvegicus
gagaaaatacatctcccctgtgctt

SEQ ID NO: 330989 - DNA, 25 bp, Rattus norvegicus
gagaaaatacatgtcccctgtgctt

SEQ ID NO: 330990 - DNA, 25 bp, Rattus norvegicus
gagaaaatactgaccccactgaaag

SEQ ID NO: 330991 - DNA, 25 bp, Rattus norvegicus
gagaaaatactgatccttggcatta

SEQ ID NO: 330992 - DNA, 25 bp, Rattus norvegicus
gagaaaatactgtccccactgaaag

SEQ ID NO: 330993 - DNA, 25 bp, Rattus norvegicus
gagaaaatactgttccttggcatta

SEQ ID NO: 330994 - DNA, 25 bp, Rattus norvegicus
gagaaaatcctcaattaaccccatt

SEQ ID NO: 330995 - DNA, 25 bp, Rattus norvegicus
gagaaaatcctctattaaccccatt

SEQ ID NO: 330996 - DNA, 25 bp, Rattus norvegicus
gagaaaatcttcactctacatccac

SEQ ID NO: 330997 - DNA, 25 bp, Rattus norvegicus
gagaaaatcttcaggcttctggaga

SEQ ID NO: 330998 - DNA, 25 bp, Rattus norvegicus
gagaaaatcttctctctacatccac

SEQ ID NO: 330999 - DNA, 25 bp, Rattus norvegicus
gagaaaatcttctggcttctggaga

SEQ ID NO: 331000 - DNA, 25 bp, Rattus norvegicus
gagaaaatgaatacccatcctccct

SEQ ID NO: 331001 - DNA, 25 bp, Rattus norvegicus
gagaaaatgaattcccatcctccct

SEQ ID NO: 331002 - DNA, 25 bp, Rattus norvegicus
gagaaaatgcacctgtccctcctgg

SEQ ID NO: 331003 - DNA, 25 bp, Rattus norvegicus
gagaaaatgcacgtgtccctcctgg

SEQ ID NO: 331004 - DNA, 25 bp, Rattus norvegicus
gagaaaatggaacgatttattccca

SEQ ID NO: 331005 - DNA, 25 bp, Rattus norvegicus
gagaaaatggaaggatttattccca

SEQ ID NO: 331006 - DNA, 25 bp, Rattus norvegicus
gagaaaatggtcaccgtggccctcc

SEQ ID NO: 331007 - DNA, 25 bp, Rattus norvegicus
gagaaaatggtctccgtggccctcc

SEQ ID NO: 331008 - DNA, 25 bp, Rattus norvegicus
gagaaaattcctcgcagggcgctct

SEQ ID NO: 331009 - DNA, 25 bp, Rattus norvegicus
gagaaaattcctggcagggcgctct

SEQ ID NO: 331010 - DNA, 25 bp, Rattus norvegicus
gagaaaattctcaggactcctggcc

SEQ ID NO: 331011 - DNA, 25 bp, Rattus norvegicus
gagaaaattctctggactcctggcc

SEQ ID NO: 331012 - DNA, 25 bp, Rattus norvegicus
gagaaacaaagtcccttcacaaccg

SEQ ID NO: 331013 - DNA, 25 bp, Rattus norvegicus
gagaaacaaagtgccttcacaaccg

SEQ ID NO: 331014 - DNA, 25 bp, Rattus norvegicus
gagaaacaacccaggagcgcaggaa

SEQ ID NO: 331015 - DNA, 25 bp, Rattus norvegicus
gagaaacaaccctggagcgcaggaa

SEQ ID NO: 331016 - DNA, 25 bp, Rattus norvegicus
gagaaacacaggcaggtacagctcc

SEQ ID NO: 331017 - DNA, 25 bp, Rattus norvegicus
gagaaacacaggcttgacctgccat

SEQ ID NO: 331018 - DNA, 25 bp, Rattus norvegicus
gagaaacacagggaggtacagctcc

SEQ ID NO: 331019 - DNA, 25 bp, Rattus norvegicus
gagaaacacagggttgacctgccat

SEQ ID NO: 331020 - DNA, 25 bp, Rattus norvegicus
gagaaacacatcattacccagcatc

SEQ ID NO: 331021 - DNA, 25 bp, Rattus norvegicus
gagaaacacatctttacccagcatc

SEQ ID NO: 331022 - DNA, 25 bp, Rattus norvegicus
gagaaacactgaatacccatcggtt

SEQ ID NO: 331023 - DNA, 25 bp, Rattus norvegicus
gagaaacactgattacccatcggtt

SEQ ID NO: 331024 - DNA, 25 bp, Rattus norvegicus
gagaaacagataccctgcctggtgt

SEQ ID NO: 331025 - DNA, 25 bp, Rattus norvegicus
gagaaacagatagcctgcctggtgt

SEQ ID NO: 331026 - DNA, 25 bp, Rattus norvegicus
gagaaacagcacattgaggaggcct

SEQ ID NO: 331027 - DNA, 25 bp, Rattus norvegicus
gagaaacagcactttgaggaggcct

SEQ ID NO: 331028 - DNA, 25 bp, Rattus norvegicus
gagaaacagcagatcgcagcggtgt

SEQ ID NO: 331029 - DNA, 25 bp, Rattus norvegicus
gagaaacagcagttcgcagcggtgt

SEQ ID NO: 331030 - DNA, 25 bp, Rattus norvegicus
gagaaacagccaaaggtcgtacttt

SEQ ID NO: 331031 - DNA, 25 bp, Rattus norvegicus
gagaaacagccataggtcgtacttt

SEQ ID NO: 331032 - DNA, 25 bp, Rattus norvegicus
gagaaacagcccaaatcagtagcac

SEQ ID NO: 331033 - DNA, 25 bp, Rattus norvegicus
gagaaacagccctaatcagtagcac

SEQ ID NO: 331034 - DNA, 25 bp, Rattus norvegicus
gagaaacaggacatctgccacggcc

SEQ ID NO: 331035 - DNA, 25 bp, Rattus norvegicus
gagaaacaggacttctgccacggcc

SEQ ID NO: 331036 - DNA, 25 bp, Rattus norvegicus
gagaaacagtccaagtatccatgaa

SEQ ID NO: 331037 - DNA, 25 bp, Rattus norvegicus
gagaaacagtcctagtatccatgaa

SEQ ID NO: 331038 - DNA, 25 bp, Rattus norvegicus
gagaaacagtgtaacctgctgttgg

SEQ ID NO: 331039 - DNA, 25 bp, Rattus norvegicus
gagaaacagtgttacctgctgttgg

SEQ ID NO: 331040 - DNA, 25 bp, Rattus norvegicus
gagaaacatagccttcagctctaat

SEQ ID NO: 331041 - DNA, 25 bp, Rattus norvegicus
gagaaacatagcgttcagctctaat

SEQ ID NO: 331042 - DNA, 25 bp, Rattus norvegicus
gagaaacatgacctacttcaccggg

SEQ ID NO: 331043 - DNA, 25 bp, Rattus norvegicus
gagaaacatgacgtacttcaccggg

SEQ ID NO: 331044 - DNA, 25 bp, Rattus norvegicus
gagaaacatgtcacagctggtagaa

SEQ ID NO: 331045 - DNA, 25 bp, Rattus norvegicus
gagaaacatgtctcagctggtagaa

SEQ ID NO: 331046 - DNA, 25 bp, Rattus norvegicus
gagaaacattgcacatcctgctcgg

SEQ ID NO: 331047 - DNA, 25 bp, Rattus norvegicus
gagaaacattgctcatcctgctcgg

SEQ ID NO: 331048 - DNA, 25 bp, Rattus norvegicus
gagaaacattgtcctgggataccct

SEQ ID NO: 331049 - DNA, 25 bp, Rattus norvegicus
gagaaacattgtgctgggataccct

SEQ ID NO: 331050 - DNA, 25 bp, Rattus norvegicus
gagaaacatttcacattcactgaat

SEQ ID NO: 331051 - DNA, 25 bp, Rattus norvegicus
gagaaacatttctcattcactgaat

SEQ ID NO: 331052 - DNA, 25 bp, Rattus norvegicus
gagaaaccaaacatacggctgaatc

SEQ ID NO: 331053 - DNA, 25 bp, Rattus norvegicus
gagaaaccaaacttacggctgaatc

SEQ ID NO: 331054 - DNA, 25 bp, Rattus norvegicus
gagaaaccaccccaatagctttaca

SEQ ID NO: 331055 - DNA, 25 bp, Rattus norvegicus
gagaaaccacccgaatagctttaca

SEQ ID NO: 331056 - DNA, 25 bp, Rattus norvegicus
gagaaaccattcaatccagagagca

SEQ ID NO: 331057 - DNA, 25 bp, Rattus norvegicus
gagaaaccattctatccagagagca

SEQ ID NO: 331058 - DNA, 25 bp, Rattus norvegicus
gagaaacccaagaactctgacctca

SEQ ID NO: 331059 - DNA, 25 bp, Rattus norvegicus
gagaaacccaagtactctgacctca

SEQ ID NO: 331060 - DNA, 25 bp, Rattus norvegicus
gagaaacccaatacacttctcccag

SEQ ID NO: 331061 - DNA, 25 bp, Rattus norvegicus
gagaaacccaattcacttctcccag

SEQ ID NO: 331062 - DNA, 25 bp, Rattus norvegicus
gagaaacccaggcaagtctgccact

SEQ ID NO: 331063 - DNA, 25 bp, Rattus norvegicus
gagaaacccagggaagtctgccact

SEQ ID NO: 331064 - DNA, 25 bp, Rattus norvegicus
gagaaacccgaacagaccctgaagc

SEQ ID NO: 331065 - DNA, 25 bp, Rattus norvegicus
gagaaacccgaagagaccctgaagc

SEQ ID NO: 331066 - DNA, 25 bp, Rattus norvegicus
gagaaacccgctcaatgtgatgaat

SEQ ID NO: 331067 - DNA, 25 bp, Rattus norvegicus
gagaaacccgctgaatgtgatgaat

SEQ ID NO: 331068 - DNA, 25 bp, Rattus norvegicus
gagaaacccgtgctgctttcaaaag

SEQ ID NO: 331069 - DNA, 25 bp, Rattus norvegicus
gagaaacccgtggtgctttcaaaag

SEQ ID NO: 331070 - DNA, 25 bp, Rattus norvegicus
gagaaaccctacactttggactgga

SEQ ID NO: 331071 - DNA, 25 bp, Rattus norvegicus
gagaaaccctactctttggactgga

SEQ ID NO: 331072 - DNA, 25 bp, Rattus norvegicus
gagaaaccggccaatcaggtcaaaa

SEQ ID NO: 331073 - DNA, 25 bp, Rattus norvegicus
gagaaaccggcctatcaggtcaaaa

SEQ ID NO: 331074 - DNA, 25 bp, Rattus norvegicus
gagaaacctccaaagggcactgcac

SEQ ID NO: 331075 - DNA, 25 bp, Rattus norvegicus
gagaaacctccatagggcactgcac

SEQ ID NO: 331076 - DNA, 25 bp, Rattus norvegicus
gagaaacctccgactctaggagtgt

SEQ ID NO: 331077 - DNA, 25 bp, Rattus norvegicus
gagaaacctccgtctctaggagtgt

SEQ ID NO: 331078 - DNA, 25 bp, Rattus norvegicus
gagaaacctcctattcttggtggct

SEQ ID NO: 331079 - DNA, 25 bp, Rattus norvegicus
gagaaacctccttttcttggtggct

SEQ ID NO: 331080 - DNA, 25 bp, Rattus norvegicus
gagaaacctctgactggatgttcgg

SEQ ID NO: 331081 - DNA, 25 bp, Rattus norvegicus
gagaaacctctgtctggatgttcgg

SEQ ID NO: 331082 - DNA, 25 bp, Rattus norvegicus
gagaaacctcttaactcactagaaa

SEQ ID NO: 331083 - DNA, 25 bp, Rattus norvegicus
gagaaacctcttctgggatatcaag

SEQ ID NO: 331084 - DNA, 25 bp, Rattus norvegicus
gagaaacctcttgtgggatatcaag

SEQ ID NO: 331085 - DNA, 25 bp, Rattus norvegicus
gagaaacctctttactcactagaaa

SEQ ID NO: 331086 - DNA, 25 bp, Rattus norvegicus
gagaaacctgaactgcaacctgtca

SEQ ID NO: 331087 - DNA, 25 bp, Rattus norvegicus
gagaaacctgaagtgcaacctgtca

SEQ ID NO: 331088 - DNA, 25 bp, Rattus norvegicus
gagaaacctgcaaaactaacccgag

SEQ ID NO: 331089 - DNA, 25 bp, Rattus norvegicus
gagaaacctgcataactaacccgag

SEQ ID NO: 331090 - DNA, 25 bp, Rattus norvegicus
gagaaaccttttccagtccttgtca

SEQ ID NO: 331091 - DNA, 25 bp, Rattus norvegicus
gagaaaccttttgcagtccttgtca

SEQ ID NO: 331092 - DNA, 25 bp, Rattus norvegicus
gagaaacgacctcccaaatttgtgg

SEQ ID NO: 331093 - DNA, 25 bp, Rattus norvegicus
gagaaacgacctgccaaatttgtgg

SEQ ID NO: 331094 - DNA, 25 bp, Rattus norvegicus
gagaaacgcaaacttctggtggtgt

SEQ ID NO: 331095 - DNA, 25 bp, Rattus norvegicus
gagaaacgcaaagttctggtggtgt

SEQ ID NO: 331096 - DNA, 25 bp, Rattus norvegicus
gagaaacggaccagcctacgctttt

SEQ ID NO: 331097 - DNA, 25 bp, Rattus norvegicus
gagaaacggacctgcctacgctttt

SEQ ID NO: 331098 - DNA, 25 bp, Rattus norvegicus
gagaaacggcagcaagacccttaca

SEQ ID NO: 331099 - DNA, 25 bp, Rattus norvegicus
gagaaacggcaggaagacccttaca

SEQ ID NO: 331100 - DNA, 25 bp, Rattus norvegicus
gagaaacgtcagcatcactaccagt

SEQ ID NO: 331101 - DNA, 25 bp, Rattus norvegicus
gagaaacgtcagctggctcaccagg

SEQ ID NO: 331102 - DNA, 25 bp, Rattus norvegicus
gagaaacgtcaggatcactaccagt

SEQ ID NO: 331103 - DNA, 25 bp, Rattus norvegicus
gagaaacgtcaggtggctcaccagg

SEQ ID NO: 331104 - DNA, 25 bp, Rattus norvegicus
gagaaactaaaacccctgcacatgt

SEQ ID NO: 331105 - DNA, 25 bp, Rattus norvegicus
gagaaactaaaagccctgcacatgt

SEQ ID NO: 331106 - DNA, 25 bp, Rattus norvegicus
gagaaactcggtctgactgttcgat

SEQ ID NO: 331107 - DNA, 25 bp, Rattus norvegicus
gagaaactcggtgtgactgttcgat

SEQ ID NO: 331108 - DNA, 25 bp, Rattus norvegicus
gagaaactctcacctgtggctacac

SEQ ID NO: 331109 - DNA, 25 bp, Rattus norvegicus
gagaaactctcagctgtggctacac

SEQ ID NO: 331110 - DNA, 25 bp, Rattus norvegicus
gagaaactcttcagcaagtccttga

SEQ ID NO: 331111 - DNA, 25 bp, Rattus norvegicus
gagaaactcttctgcaagtccttga

SEQ ID NO: 331112 - DNA, 25 bp, Rattus norvegicus
gagaaactgacccacctaagttaca

SEQ ID NO: 331113 - DNA, 25 bp, Rattus norvegicus
gagaaactgaccgacctaagttaca

SEQ ID NO: 331114 - DNA, 25 bp, Rattus norvegicus
gagaaactgagccactacctgccca

SEQ ID NO: 331115 - DNA, 25 bp, Rattus norvegicus
gagaaactgagcgactacctgccca

SEQ ID NO: 331116 - DNA, 25 bp, Rattus norvegicus
gagaaactgctcagcgttgtcgaca

SEQ ID NO: 331117 - DNA, 25 bp, Rattus norvegicus
gagaaactgctcctctggtggacat

SEQ ID NO: 331118 - DNA, 25 bp, Rattus norvegicus
gagaaactgctcgtctggtggacat

SEQ ID NO: 331119 - DNA, 25 bp, Rattus norvegicus
gagaaactgctctgcgttgtcgaca

SEQ ID NO: 331120 - DNA, 25 bp, Rattus norvegicus
gagaaactgggcctgacccggattc

SEQ ID NO: 331121 - DNA, 25 bp, Rattus norvegicus
gagaaactgggcgtgacccggattc

SEQ ID NO: 331122 - DNA, 25 bp, Rattus norvegicus
gagaaactgtgaccactcgggccca

SEQ ID NO: 331123 - DNA, 25 bp, Rattus norvegicus
gagaaactgtgagcactcgggccca

SEQ ID NO: 331124 - DNA, 25 bp, Rattus norvegicus
gagaaacttaagacaacccctcagt

SEQ ID NO: 331125 - DNA, 25 bp, Rattus norvegicus
gagaaacttaagtcaacccctcagt

SEQ ID NO: 331126 - DNA, 25 bp, Rattus norvegicus
gagaaacttaccaggccatattcct

SEQ ID NO: 331127 - DNA, 25 bp, Rattus norvegicus
gagaaacttacctggccatattcct

SEQ ID NO: 331128 - DNA, 25 bp, Rattus norvegicus
gagaaacttctgcaacaccatgtaa

SEQ ID NO: 331129 - DNA, 25 bp, Rattus norvegicus
gagaaacttctggaacaccatgtaa

SEQ ID NO: 331130 - DNA, 25 bp, Rattus norvegicus
gagaaacttcttcatggctggcttt

SEQ ID NO: 331131 - DNA, 25 bp, Rattus norvegicus
gagaaacttcttgatggctggcttt

SEQ ID NO: 331132 - DNA, 25 bp, Rattus norvegicus
gagaaagaacccctccttaaatctg

SEQ ID NO: 331133 - DNA, 25 bp, Rattus norvegicus
gagaaagaacccgtccttaaatctg

SEQ ID NO: 331134 - DNA, 25 bp, Rattus norvegicus
gagaaagaactacggccacgcttcc

SEQ ID NO: 331135 - DNA, 25 bp, Rattus norvegicus
gagaaagaactagggccacgcttcc

SEQ ID NO: 331136 - DNA, 25 bp, Rattus norvegicus
gagaaagaagacagacccctgacct

SEQ ID NO: 331137 - DNA, 25 bp, Rattus norvegicus
gagaaagaagactgacccctgacct

SEQ ID NO: 331138 - DNA, 25 bp, Rattus norvegicus
gagaaagaattcaggctctctcctt

SEQ ID NO: 331139 - DNA, 25 bp, Rattus norvegicus
gagaaagaattctggctctctcctt

SEQ ID NO: 331140 - DNA, 25 bp, Rattus norvegicus
gagaaagacaaccttcttcccaaca

SEQ ID NO: 331141 - DNA, 25 bp, Rattus norvegicus
gagaaagacaacgttcttcccaaca

SEQ ID NO: 331142 - DNA, 25 bp, Rattus norvegicus
gagaaagaccacattactcccagtc

SEQ ID NO: 331143 - DNA, 25 bp, Rattus norvegicus
gagaaagaccactttactcccagtc

SEQ ID NO: 331144 - DNA, 25 bp, Rattus norvegicus
gagaaagacgtcacctgctattgcc

SEQ ID NO: 331145 - DNA, 25 bp, Rattus norvegicus
gagaaagacgtctcctgctattgcc

SEQ ID NO: 331146 - DNA, 25 bp, Rattus norvegicus
gagaaagactgtcaagcagcccacc

SEQ ID NO: 331147 - DNA, 25 bp, Rattus norvegicus
gagaaagactgtgaagcagcccacc

SEQ ID NO: 331148 - DNA, 25 bp, Rattus norvegicus
gagaaagagcctcctcaacaagcct

SEQ ID NO: 331149 - DNA, 25 bp, Rattus norvegicus
gagaaagagcctgctcaacaagcct

SEQ ID NO: 331150 - DNA, 25 bp, Rattus norvegicus
gagaaagatcttaccttactccttt

SEQ ID NO: 331151 - DNA, 25 bp, Rattus norvegicus
gagaaagatctttccttactccttt

SEQ ID NO: 331152 - DNA, 25 bp, Rattus norvegicus
gagaaagatgctctctctgtccgcc

SEQ ID NO: 331153 - DNA, 25 bp, Rattus norvegicus
gagaaagatgctgtctctgtccgcc

SEQ ID NO: 331154 - DNA, 25 bp, Rattus norvegicus
gagaaagattccaaccacagtccat

SEQ ID NO: 331155 - DNA, 25 bp, Rattus norvegicus
gagaaagattcctaccacagtccat

SEQ ID NO: 331156 - DNA, 25 bp, Rattus norvegicus
gagaaagcaaacactgctaattgca

SEQ ID NO: 331157 - DNA, 25 bp, Rattus norvegicus
gagaaagcaaactctgctaattgca

SEQ ID NO: 331158 - DNA, 25 bp, Rattus norvegicus
gagaaagcaatcatccttcctcgtc

SEQ ID NO: 331159 - DNA, 25 bp, Rattus norvegicus
gagaaagcaatcttccttcctcgtc

SEQ ID NO: 331160 - DNA, 25 bp, Rattus norvegicus
gagaaagcaattctttggtctcttt

SEQ ID NO: 331161 - DNA, 25 bp, Rattus norvegicus
gagaaagcaattgtttggtctcttt

SEQ ID NO: 331162 - DNA, 25 bp, Rattus norvegicus
gagaaagcacacaggcactcttgag

SEQ ID NO: 331163 - DNA, 25 bp, Rattus norvegicus
gagaaagcacactggcactcttgag

SEQ ID NO: 331164 - DNA, 25 bp, Rattus norvegicus
gagaaagcacttagaggaaccttga

SEQ ID NO: 331165 - DNA, 25 bp, Rattus norvegicus
gagaaagcactttgaggaaccttga

SEQ ID NO: 331166 - DNA, 25 bp, Rattus norvegicus
gagaaagcagtcatcctttttaatt

SEQ ID NO: 331167 - DNA, 25 bp, Rattus norvegicus
gagaaagcagtcttcctttttaatt

SEQ ID NO: 331168 - DNA, 25 bp, Rattus norvegicus
gagaaagcatctccttacctcaggg

SEQ ID NO: 331169 - DNA, 25 bp, Rattus norvegicus
gagaaagcatctgcttacctcaggg

SEQ ID NO: 331170 - DNA, 25 bp, Rattus norvegicus
gagaaagcattcctcagatctgata

SEQ ID NO: 331171 - DNA, 25 bp, Rattus norvegicus
gagaaagcattcgtcagatctgata

SEQ ID NO: 331172 - DNA, 25 bp, Rattus norvegicus
gagaaagccaggagtctttacccgc

SEQ ID NO: 331173 - DNA, 25 bp, Rattus norvegicus
gagaaagccaggtgtctttacccgc

SEQ ID NO: 331174 - DNA, 25 bp, Rattus norvegicus
gagaaagccattacagagcccaact

SEQ ID NO: 331175 - DNA, 25 bp, Rattus norvegicus
gagaaagccatttcagagcccaact

SEQ ID NO: 331176 - DNA, 25 bp, Rattus norvegicus
gagaaagcccagctagtcctagaat

SEQ ID NO: 331177 - DNA, 25 bp, Rattus norvegicus
gagaaagcccagctgtgtcatcttt

SEQ ID NO: 331178 - DNA, 25 bp, Rattus norvegicus
gagaaagcccaggtagtcctagaat

SEQ ID NO: 331179 - DNA, 25 bp, Rattus norvegicus
gagaaagcccaggtgtgtcatcttt

SEQ ID NO: 331180 - DNA, 25 bp, Rattus norvegicus
gagaaagccccaagtgatgaccctg

SEQ ID NO: 331181 - DNA, 25 bp, Rattus norvegicus
gagaaagccccatgtgatgaccctg

SEQ ID NO: 331182 - DNA, 25 bp, Rattus norvegicus
gagaaagcccctctgtaaaacgcat

SEQ ID NO: 331183 - DNA, 25 bp, Rattus norvegicus
gagaaagcccctgtgtaaaacgcat

SEQ ID NO: 331184 - DNA, 25 bp, Rattus norvegicus
gagaaagccctcaagagaatgaagg

SEQ ID NO: 331185 - DNA, 25 bp, Rattus norvegicus
gagaaagccctctagagaatgaagg

SEQ ID NO: 331186 - DNA, 25 bp, Rattus norvegicus
gagaaagccctgcaccggtttggat

SEQ ID NO: 331187 - DNA, 25 bp, Rattus norvegicus
gagaaagccctggaccggtttggat

SEQ ID NO: 331188 - DNA, 25 bp, Rattus norvegicus
gagaaagcctaacttcctgagccag

SEQ ID NO: 331189 - DNA, 25 bp, Rattus norvegicus
gagaaagcctaagttcctgagccag

SEQ ID NO: 331190 - DNA, 25 bp, Rattus norvegicus
gagaaagcctcaattccttaaacaa

SEQ ID NO: 331191 - DNA, 25 bp, Rattus norvegicus
gagaaagcctcatttccttaaacaa

SEQ ID NO: 331192 - DNA, 25 bp, Rattus norvegicus
gagaaagcctgccttgtaaaaccaa

SEQ ID NO: 331193 - DNA, 25 bp, Rattus norvegicus
gagaaagcctgcgttgtaaaaccaa

SEQ ID NO: 331194 - DNA, 25 bp, Rattus norvegicus
gagaaagcctggctgatctgccctc

SEQ ID NO: 331195 - DNA, 25 bp, Rattus norvegicus
gagaaagcctgggtgatctgccctc

SEQ ID NO: 331196 - DNA, 25 bp, Rattus norvegicus
gagaaagcctgtctatacatacata

SEQ ID NO: 331197 - DNA, 25 bp, Rattus norvegicus
gagaaagcctgtgtatacatacata

SEQ ID NO: 331198 - DNA, 25 bp, Rattus norvegicus
gagaaagccttcatcacataccgaa

SEQ ID NO: 331199 - DNA, 25 bp, Rattus norvegicus
gagaaagccttcttcacataccgaa

SEQ ID NO: 331200 - DNA, 25 bp, Rattus norvegicus
gagaaagcgaaaccagcagctgcaa

SEQ ID NO: 331201 - DNA, 25 bp, Rattus norvegicus
gagaaagcgaaagcagcagctgcaa

SEQ ID NO: 331202 - DNA, 25 bp, Rattus norvegicus
gagaaagcgcagacactctcgatct

SEQ ID NO: 331203 - DNA, 25 bp, Rattus norvegicus
gagaaagcgcagtcactctcgatct

SEQ ID NO: 331204 - DNA, 25 bp, Rattus norvegicus
gagaaagcgcctctcagtgtgactt

SEQ ID NO: 331205 - DNA, 25 bp, Rattus norvegicus
gagaaagcgcctgtcagtgtgactt

SEQ ID NO: 331206 - DNA, 25 bp, Rattus norvegicus
gagaaagcgctcaccagtgtcaaga

SEQ ID NO: 331207 - DNA, 25 bp, Rattus norvegicus
gagaaagcgctctccagtgtcaaga

SEQ ID NO: 331208 - DNA, 25 bp, Rattus norvegicus
gagaaagcggacaccattttgagca

SEQ ID NO: 331209 - DNA, 25 bp, Rattus norvegicus
gagaaagcggactccattttgagca

SEQ ID NO: 331210 - DNA, 25 bp, Rattus norvegicus
gagaaagcgtacatcatcctggatg

SEQ ID NO: 331211 - DNA, 25 bp, Rattus norvegicus
gagaaagcgtacttcatcctggatg

SEQ ID NO: 331212 - DNA, 25 bp, Rattus norvegicus
gagaaagctctcacaggccggctgt

SEQ ID NO: 331213 - DNA, 25 bp, Rattus norvegicus
gagaaagctctcagtgtctatccaa

SEQ ID NO: 331214 - DNA, 25 bp, Rattus norvegicus
gagaaagctctctcaggccggctgt

SEQ ID NO: 331215 - DNA, 25 bp, Rattus norvegicus
gagaaagctctctgtgtctatccaa

SEQ ID NO: 331216 - DNA, 25 bp, Rattus norvegicus
gagaaagctctgactactccagtgt

SEQ ID NO: 331217 - DNA, 25 bp, Rattus norvegicus
gagaaagctctgtctactccagtgt

SEQ ID NO: 331218 - DNA, 25 bp, Rattus norvegicus
gagaaagctcttagccttgtacttt

SEQ ID NO: 331219 - DNA, 25 bp, Rattus norvegicus
gagaaagctctttgccttgtacttt

SEQ ID NO: 331220 - DNA, 25 bp, Rattus norvegicus
gagaaagctgatcccggtgcttcaa

SEQ ID NO: 331221 - DNA, 25 bp, Rattus norvegicus
gagaaagctgatgccggtgcttcaa

SEQ ID NO: 331222 - DNA, 25 bp, Rattus norvegicus
gagaaagctgccaagaatccaagaa

SEQ ID NO: 331223 - DNA, 25 bp, Rattus norvegicus
gagaaagctgcctagaatccaagaa

SEQ ID NO: 331224 - DNA, 25 bp, Rattus norvegicus
gagaaagctgctagtcttccctggt

SEQ ID NO: 331225 - DNA, 25 bp, Rattus norvegicus
gagaaagctgcttgtcttccctggt

SEQ ID NO: 331226 - DNA, 25 bp, Rattus norvegicus
gagaaagcttgcagtttcaactggg

SEQ ID NO: 331227 - DNA, 25 bp, Rattus norvegicus
gagaaagcttgctgtttcaactggg

SEQ ID NO: 331228 - DNA, 25 bp, Rattus norvegicus
gagaaagctttcattcagatcttat

SEQ ID NO: 331229 - DNA, 25 bp, Rattus norvegicus
gagaaagctttccactctgaaggat

SEQ ID NO: 331230 - DNA, 25 bp, Rattus norvegicus
gagaaagctttcgactctgaaggat

SEQ ID NO: 331231 - DNA, 25 bp, Rattus norvegicus
gagaaagctttctttcagatcttat

SEQ ID NO: 331232 - DNA, 25 bp, Rattus norvegicus
gagaaaggaactccgccatgcatta

SEQ ID NO: 331233 - DNA, 25 bp, Rattus norvegicus
gagaaaggaactgcgccatgcatta

SEQ ID NO: 331234 - DNA, 25 bp, Rattus norvegicus
gagaaaggaccaacgcatccacttg

SEQ ID NO: 331235 - DNA, 25 bp, Rattus norvegicus
gagaaaggaccatcgcatccacttg

SEQ ID NO: 331236 - DNA, 25 bp, Rattus norvegicus
gagaaaggagcaacttcacctggcc

SEQ ID NO: 331237 - DNA, 25 bp, Rattus norvegicus
gagaaaggagcatcttcacctggcc

SEQ ID NO: 331238 - DNA, 25 bp, Rattus norvegicus
gagaaaggatctacccattcaccca

SEQ ID NO: 331239 - DNA, 25 bp, Rattus norvegicus
gagaaaggatcttcccattcaccca

SEQ ID NO: 331240 - DNA, 25 bp, Rattus norvegicus
gagaaaggatgtcttgcctgcccta

SEQ ID NO: 331241 - DNA, 25 bp, Rattus norvegicus
gagaaaggatgtgttgcctgcccta

SEQ ID NO: 331242 - DNA, 25 bp, Rattus norvegicus
gagaaaggcacaaagctgctaacat

SEQ ID NO: 331243 - DNA, 25 bp, Rattus norvegicus
gagaaaggcacatagctgctaacat

SEQ ID NO: 331244 - DNA, 25 bp, Rattus norvegicus
gagaaaggccaaattagtgcagctt

SEQ ID NO: 331245 - DNA, 25 bp, Rattus norvegicus
gagaaaggccaatttagtgcagctt

SEQ ID NO: 331246 - DNA, 25 bp, Rattus norvegicus
gagaaaggcccaacccagaagtagt

SEQ ID NO: 331247 - DNA, 25 bp, Rattus norvegicus
gagaaaggcccatcccagaagtagt

SEQ ID NO: 331248 - DNA, 25 bp, Rattus norvegicus
gagaaaggccttcagaccaggtgct

SEQ ID NO: 331249 - DNA, 25 bp, Rattus norvegicus
gagaaaggccttgagaccaggtgct

SEQ ID NO: 331250 - DNA, 25 bp, Rattus norvegicus
gagaaaggctctcggtttcttccct

SEQ ID NO: 331251 - DNA, 25 bp, Rattus norvegicus
gagaaaggctctgggtttcttccct

SEQ ID NO: 331252 - DNA, 25 bp, Rattus norvegicus
gagaaaggctggatgttcctcttta

SEQ ID NO: 331253 - DNA, 25 bp, Rattus norvegicus
gagaaaggctggttgttcctcttta

SEQ ID NO: 331254 - DNA, 25 bp, Rattus norvegicus
gagaaaggtgccagtgtcgtcctcc

SEQ ID NO: 331255 - DNA, 25 bp, Rattus norvegicus
gagaaaggtgcctgtgtcgtcctcc

SEQ ID NO: 331256 - DNA, 25 bp, Rattus norvegicus
gagaaagtaagtcacccatcctacc

SEQ ID NO: 331257 - DNA, 25 bp, Rattus norvegicus
gagaaagtaagtgacccatcctacc

SEQ ID NO: 331258 - DNA, 25 bp, Rattus norvegicus
gagaaagtagtgcttcgtccagtat

SEQ ID NO: 331259 - DNA, 25 bp, Rattus norvegicus
gagaaagtagtggttcgtccagtat

SEQ ID NO: 331260 - DNA, 25 bp, Rattus norvegicus
gagaaagtcagccaacagacagaaa

SEQ ID NO: 331261 - DNA, 25 bp, Rattus norvegicus
gagaaagtcagcgaacagacagaaa

SEQ ID NO: 331262 - DNA, 25 bp, Rattus norvegicus
gagaaagtccaacaaacgctataga

SEQ ID NO: 331263 - DNA, 25 bp, Rattus norvegicus
gagaaagtccaagaaacgctataga

SEQ ID NO: 331264 - DNA, 25 bp, Rattus norvegicus
gagaaagtccctacaattgctttgg

SEQ ID NO: 331265 - DNA, 25 bp, Rattus norvegicus
gagaaagtcccttcaattgctttgg

SEQ ID NO: 331266 - DNA, 25 bp, Rattus norvegicus
gagaaagtcctaacactctggcgga

SEQ ID NO: 331267 - DNA, 25 bp, Rattus norvegicus
gagaaagtcctatcactctggcgga

SEQ ID NO: 331268 - DNA, 25 bp, Rattus norvegicus
gagaaagtcgccacaacacttcctt

SEQ ID NO: 331269 - DNA, 25 bp, Rattus norvegicus
gagaaagtcgcctcaacacttcctt

SEQ ID NO: 331270 - DNA, 25 bp, Rattus norvegicus
gagaaagtctagaataaggctacaa

SEQ ID NO: 331271 - DNA, 25 bp, Rattus norvegicus
gagaaagtctagtataaggctacaa

SEQ ID NO: 331272 - DNA, 25 bp, Rattus norvegicus
gagaaagtggagattttggcccctc

SEQ ID NO: 331273 - DNA, 25 bp, Rattus norvegicus
gagaaagtggagtttttggcccctc

SEQ ID NO: 331274 - DNA, 25 bp, Rattus norvegicus
gagaaagtgtcaactgcgtgcagca

SEQ ID NO: 331275 - DNA, 25 bp, Rattus norvegicus
gagaaagtgtcatctgcgtgcagca

SEQ ID NO: 331276 - DNA, 25 bp, Rattus norvegicus
gagaaagtttccacagatagcattt

SEQ ID NO: 331277 - DNA, 25 bp, Rattus norvegicus
gagaaagtttcccaggcgccggagc

SEQ ID NO: 331278 - DNA, 25 bp, Rattus norvegicus
gagaaagtttccgaggcgccggagc

SEQ ID NO: 331279 - DNA, 25 bp, Rattus norvegicus
gagaaagtttcctcagatagcattt

SEQ ID NO: 331280 - DNA, 25 bp, Rattus norvegicus
gagaaataagtacggccgcctctct

SEQ ID NO: 331281 - DNA, 25 bp, Rattus norvegicus
gagaaataagtagggccgcctctct

SEQ ID NO: 331282 - DNA, 25 bp, Rattus norvegicus
gagaaatacacacaggaatcacatg

SEQ ID NO: 331283 - DNA, 25 bp, Rattus norvegicus
gagaaatacacagaggaatcacatg

SEQ ID NO: 331284 - DNA, 25 bp, Rattus norvegicus
gagaaatacagcacctatggcattg

SEQ ID NO: 331285 - DNA, 25 bp, Rattus norvegicus
gagaaatacagctcctatggcattg

SEQ ID NO: 331286 - DNA, 25 bp, Rattus norvegicus
gagaaatactacatccacacggctt

SEQ ID NO: 331287 - DNA, 25 bp, Rattus norvegicus
gagaaatactacttccacacggctt

SEQ ID NO: 331288 - DNA, 25 bp, Rattus norvegicus
gagaaatactctaccacttcagttt

SEQ ID NO: 331289 - DNA, 25 bp, Rattus norvegicus
gagaaatactcttccacttcagttt

SEQ ID NO: 331290 - DNA, 25 bp, Rattus norvegicus
gagaaatagtctaacttccccgcac

SEQ ID NO: 331291 - DNA, 25 bp, Rattus norvegicus
gagaaatagtcttacttccccgcac

SEQ ID NO: 331292 - DNA, 25 bp, Rattus norvegicus
gagaaatatcccacctaggcatagg

SEQ ID NO: 331293 - DNA, 25 bp, Rattus norvegicus
gagaaatatccctcctaggcatagg

SEQ ID NO: 331294 - DNA, 25 bp, Rattus norvegicus
gagaaatattttctgccagtttgaa

SEQ ID NO: 331295 - DNA, 25 bp, Rattus norvegicus
gagaaatattttgtgccagtttgaa

SEQ ID NO: 331296 - DNA, 25 bp, Rattus norvegicus
gagaaatcaaaaacccattcatagg

SEQ ID NO: 331297 - DNA, 25 bp, Rattus norvegicus
gagaaatcaaaatcccattcatagg

SEQ ID NO: 331298 - DNA, 25 bp, Rattus norvegicus
gagaaatcaacacttctcacagttg

SEQ ID NO: 331299 - DNA, 25 bp, Rattus norvegicus
gagaaatcaacagttctcacagttg

SEQ ID NO: 331300 - DNA, 25 bp, Rattus norvegicus
gagaaatcaagtcacagccccaggt

SEQ ID NO: 331301 - DNA, 25 bp, Rattus norvegicus
gagaaatcaagtgacagccccaggt

SEQ ID NO: 331302 - DNA, 25 bp, Rattus norvegicus
gagaaatcacaacacatgggctaca

SEQ ID NO: 331303 - DNA, 25 bp, Rattus norvegicus
gagaaatcacaagacatgggctaca

SEQ ID NO: 331304 - DNA, 25 bp, Rattus norvegicus
gagaaatcaccccaagacactgagc

SEQ ID NO: 331305 - DNA, 25 bp, Rattus norvegicus
gagaaatcacccgaagacactgagc

SEQ ID NO: 331306 - DNA, 25 bp, Rattus norvegicus
gagaaatccagccacatcatcttag

SEQ ID NO: 331307 - DNA, 25 bp, Rattus norvegicus
gagaaatccagcgacatcatcttag

SEQ ID NO: 331308 - DNA, 25 bp, Rattus norvegicus
gagaaatcccagaggagacggcact

SEQ ID NO: 331309 - DNA, 25 bp, Rattus norvegicus
gagaaatcccagtggagacggcact

SEQ ID NO: 331310 - DNA, 25 bp, Rattus norvegicus
gagaaatccctacagcttttcaact

SEQ ID NO: 331311 - DNA, 25 bp, Rattus norvegicus
gagaaatccctagagcttttcaact

SEQ ID NO: 331312 - DNA, 25 bp, Rattus norvegicus
gagaaatcctccaattgcgagccca

SEQ ID NO: 331313 - DNA, 25 bp, Rattus norvegicus
gagaaatcctcctattgcgagccca

SEQ ID NO: 331314 - DNA, 25 bp, Rattus norvegicus
gagaaatcctttatgctttgccctc

SEQ ID NO: 331315 - DNA, 25 bp, Rattus norvegicus
gagaaatcctttttgctttgccctc

SEQ ID NO: 331316 - DNA, 25 bp, Rattus norvegicus
gagaaatcgggcagctgtagctccc

SEQ ID NO: 331317 - DNA, 25 bp, Rattus norvegicus
gagaaatcgggctgctgtagctccc

SEQ ID NO: 331318 - DNA, 25 bp, Rattus norvegicus
gagaaatctatcaggagccctgttt

SEQ ID NO: 331319 - DNA, 25 bp, Rattus norvegicus
gagaaatctatctggagccctgttt

SEQ ID NO: 331320 - DNA, 25 bp, Rattus norvegicus
gagaaatctcacagatcctgtaaaa

SEQ ID NO: 331321 - DNA, 25 bp, Rattus norvegicus
gagaaatctcactgatcctgtaaaa

SEQ ID NO: 331322 - DNA, 25 bp, Rattus norvegicus
gagaaatctctgaaccccaagatgt

SEQ ID NO: 331323 - DNA, 25 bp, Rattus norvegicus
gagaaatctctgtaccccaagatgt

SEQ ID NO: 331324 - DNA, 25 bp, Rattus norvegicus
gagaaatctgccataagtctttgaa

SEQ ID NO: 331325 - DNA, 25 bp, Rattus norvegicus
gagaaatctgccttaagtctttgaa

SEQ ID NO: 331326 - DNA, 25 bp, Rattus norvegicus
gagaaatctggaactcccttgggct

SEQ ID NO: 331327 - DNA, 25 bp, Rattus norvegicus
gagaaatctggatctcccttgggct

SEQ ID NO: 331328 - DNA, 25 bp, Rattus norvegicus
gagaaatctgggacctgctctgagc

SEQ ID NO: 331329 - DNA, 25 bp, Rattus norvegicus
gagaaatctgggtcctgctctgagc

SEQ ID NO: 331330 - DNA, 25 bp, Rattus norvegicus
gagaaatctgtacctgctgctcctt

SEQ ID NO: 331331 - DNA, 25 bp, Rattus norvegicus
gagaaatctgtagctgctgctcctt

SEQ ID NO: 331332 - DNA, 25 bp, Rattus norvegicus
gagaaatgaaccacccttacagact

SEQ ID NO: 331333 - DNA, 25 bp, Rattus norvegicus
gagaaatgaacctcccttacagact

SEQ ID NO: 331334 - DNA, 25 bp, Rattus norvegicus
gagaaatgagctctgaggacacagc

SEQ ID NO: 331335 - DNA, 25 bp, Rattus norvegicus
gagaaatgagctgtgaggacacagc

SEQ ID NO: 331336 - DNA, 25 bp, Rattus norvegicus
gagaaatgcactctgtcatcctaaa

SEQ ID NO: 331337 - DNA, 25 bp, Rattus norvegicus
gagaaatgcactgtgtcatcctaaa

SEQ ID NO: 331338 - DNA, 25 bp, Rattus norvegicus
gagaaatgcagtcgccatctggcac

SEQ ID NO: 331339 - DNA, 25 bp, Rattus norvegicus
gagaaatgcagtggccatctggcac

SEQ ID NO: 331340 - DNA, 25 bp, Rattus norvegicus
gagaaatgccagcatggccacaacc

SEQ ID NO: 331341 - DNA, 25 bp, Rattus norvegicus
gagaaatgccaggatggccacaacc

SEQ ID NO: 331342 - DNA, 25 bp, Rattus norvegicus
gagaaatgcctgaacctttgtggta

SEQ ID NO: 331343 - DNA, 25 bp, Rattus norvegicus
gagaaatgcctgtacctttgtggta

SEQ ID NO: 331344 - DNA, 25 bp, Rattus norvegicus
gagaaatgcttgatggctgcttaag

SEQ ID NO: 331345 - DNA, 25 bp, Rattus norvegicus
gagaaatgcttgttggctgcttaag

SEQ ID NO: 331346 - DNA, 25 bp, Rattus norvegicus
gagaaatggctgctaccaccttaag

SEQ ID NO: 331347 - DNA, 25 bp, Rattus norvegicus
gagaaatggctggtaccaccttaag

SEQ ID NO: 331348 - DNA, 25 bp, Rattus norvegicus
gagaaatgtaccacagtcctgatgt

SEQ ID NO: 331349 - DNA, 25 bp, Rattus norvegicus
gagaaatgtaccctgtagtcttaag

SEQ ID NO: 331350 - DNA, 25 bp, Rattus norvegicus
gagaaatgtaccgtgtagtcttaag

SEQ ID NO: 331351 - DNA, 25 bp, Rattus norvegicus
gagaaatgtacctcagtcctgatgt

SEQ ID NO: 331352 - DNA, 25 bp, Rattus norvegicus
gagaaatgtgtgagtccctccctgc

SEQ ID NO: 331353 - DNA, 25 bp, Rattus norvegicus
gagaaatgtgtgtgtccctccctgc

SEQ ID NO: 331354 - DNA, 25 bp, Rattus norvegicus
gagaaatgttaccatcaggagatga

SEQ ID NO: 331355 - DNA, 25 bp, Rattus norvegicus
gagaaatgttacgatcaggagatga

SEQ ID NO: 331356 - DNA, 25 bp, Rattus norvegicus
gagaaatgtttgatcctaattccct

SEQ ID NO: 331357 - DNA, 25 bp, Rattus norvegicus
gagaaatgtttgttcctaattccct

SEQ ID NO: 331358 - DNA, 25 bp, Rattus norvegicus
gagaaattcatcacctttagcaagg

SEQ ID NO: 331359 - DNA, 25 bp, Rattus norvegicus
gagaaattcatctcctttagcaagg

SEQ ID NO: 331360 - DNA, 25 bp, Rattus norvegicus
gagaaattcccgctcatctcggtgc

SEQ ID NO: 331361 - DNA, 25 bp, Rattus norvegicus
gagaaattcccggtcatctcggtgc

SEQ ID NO: 331362 - DNA, 25 bp, Rattus norvegicus
gagaaattccctaaagctcaggaag

SEQ ID NO: 331363 - DNA, 25 bp, Rattus norvegicus
gagaaattcccttaagctcaggaag

SEQ ID NO: 331364 - DNA, 25 bp, Rattus norvegicus
gagaaattccttcttacctttgcac

SEQ ID NO: 331365 - DNA, 25 bp, Rattus norvegicus
gagaaattccttgttacctttgcac

SEQ ID NO: 331366 - DNA, 25 bp, Rattus norvegicus
gagaaattcttgaggcctgatgcct

SEQ ID NO: 331367 - DNA, 25 bp, Rattus norvegicus
gagaaattcttgtggcctgatgcct

SEQ ID NO: 331368 - DNA, 25 bp, Rattus norvegicus
gagaaattctttcccttgctggtac

SEQ ID NO: 331369 - DNA, 25 bp, Rattus norvegicus
gagaaattctttgccttgctggtac

SEQ ID NO: 331370 - DNA, 25 bp, Rattus norvegicus
gagaaattgaacaggcaaatgaaca

SEQ ID NO: 331371 - DNA, 25 bp, Rattus norvegicus
gagaaattgaactggcaaatgaaca

SEQ ID NO: 331372 - DNA, 25 bp, Rattus norvegicus
gagaaattgaataccttcacagaag

SEQ ID NO: 331373 - DNA, 25 bp, Rattus norvegicus
gagaaattgaattccttcacagaag

SEQ ID NO: 331374 - DNA, 25 bp, Rattus norvegicus
gagaaattgattcttcctttcccga

SEQ ID NO: 331375 - DNA, 25 bp, Rattus norvegicus
gagaaattgattgttcctttcccga

SEQ ID NO: 331376 - DNA, 25 bp, Rattus norvegicus
gagaaatttccacagacgtcttcca

SEQ ID NO: 331377 - DNA, 25 bp, Rattus norvegicus
gagaaatttccagagacgtcttcca

SEQ ID NO: 331378 - DNA, 25 bp, Rattus norvegicus
gagaaatttcccattcattccatgg

SEQ ID NO: 331379 - DNA, 25 bp, Rattus norvegicus
gagaaatttccctttcattccatgg

SEQ ID NO: 331380 - DNA, 25 bp, Rattus norvegicus
gagaaatttgccatcctatgtcttt

SEQ ID NO: 331381 - DNA, 25 bp, Rattus norvegicus
gagaaatttgccttcctatgtcttt

SEQ ID NO: 331382 - DNA, 25 bp, Rattus norvegicus
gagaaatttgttactccggctctcc

SEQ ID NO: 331383 - DNA, 25 bp, Rattus norvegicus
gagaaatttgtttctccggctctcc

SEQ ID NO: 331384 - DNA, 25 bp, Rattus norvegicus
gagaaattttctaagtcattagacc

SEQ ID NO: 331385 - DNA, 25 bp, Rattus norvegicus
gagaaattttcttagtcattagacc

SEQ ID NO: 331386 - DNA, 25 bp, Rattus norvegicus
gagaacaaaacaccccagacagatt

SEQ ID NO: 331387 - DNA, 25 bp, Rattus norvegicus
gagaacaaaacagcccagacagatt

SEQ ID NO: 331388 - DNA, 25 bp, Rattus norvegicus
gagaacaaagaaaactgcctaccat

SEQ ID NO: 331389 - DNA, 25 bp, Rattus norvegicus
gagaacaaagaatactgcctaccat

SEQ ID NO: 331390 - DNA, 25 bp, Rattus norvegicus
gagaacaaagtcctcccgactgtca

SEQ ID NO: 331391 - DNA, 25 bp, Rattus norvegicus
gagaacaaagtcgtcccgactgtca

SEQ ID NO: 331392 - DNA, 25 bp, Rattus norvegicus
gagaacaacagtctccacgggcaca

SEQ ID NO: 331393 - DNA, 25 bp, Rattus norvegicus
gagaacaacagtgtccacgggcaca

SEQ ID NO: 331394 - DNA, 25 bp, Rattus norvegicus
gagaacaaccaaagactcgctctga

SEQ ID NO: 331395 - DNA, 25 bp, Rattus norvegicus
gagaacaaccaatgactcgctctga

SEQ ID NO: 331396 - DNA, 25 bp, Rattus norvegicus
gagaacaaccatcattttcacatga

SEQ ID NO: 331397 - DNA, 25 bp, Rattus norvegicus
gagaacaaccatgattttcacatga

SEQ ID NO: 331398 - DNA, 25 bp, Rattus norvegicus
gagaacaactcccaaagtgtgtagg

SEQ ID NO: 331399 - DNA, 25 bp, Rattus norvegicus
gagaacaactccgaaagtgtgtagg

SEQ ID NO: 331400 - DNA, 25 bp, Rattus norvegicus
gagaacaactgaatttggctgagca

SEQ ID NO: 331401 - DNA, 25 bp, Rattus norvegicus
gagaacaactgattttggctgagca

SEQ ID NO: 331402 - DNA, 25 bp, Rattus norvegicus
gagaacaactggcttcagcatgaga

SEQ ID NO: 331403 - DNA, 25 bp, Rattus norvegicus
gagaacaactgggttcagcatgaga

SEQ ID NO: 331404 - DNA, 25 bp, Rattus norvegicus
gagaacaagatcctcatcctgctag

SEQ ID NO: 331405 - DNA, 25 bp, Rattus norvegicus
gagaacaagatcgtcatcctgctag

SEQ ID NO: 331406 - DNA, 25 bp, Rattus norvegicus
gagaacaagatgacgtggacgccac

SEQ ID NO: 331407 - DNA, 25 bp, Rattus norvegicus
gagaacaagatgtcgtggacgccac

SEQ ID NO: 331408 - DNA, 25 bp, Rattus norvegicus
gagaacaatgaacccggttcccttc

SEQ ID NO: 331409 - DNA, 25 bp, Rattus norvegicus
gagaacaatgaagccggttcccttc

SEQ ID NO: 331410 - DNA, 25 bp, Rattus norvegicus
gagaacacactgactattagttttt

SEQ ID NO: 331411 - DNA, 25 bp, Rattus norvegicus
gagaacacactgtctattagttttt

SEQ ID NO: 331412 - DNA, 25 bp, Rattus norvegicus
gagaacacaggaacaggtaaccctt

SEQ ID NO: 331413 - DNA, 25 bp, Rattus norvegicus
gagaacacaggatcaggtaaccctt

SEQ ID NO: 331414 - DNA, 25 bp, Rattus norvegicus
gagaacacagtgaacatcagcatag

SEQ ID NO: 331415 - DNA, 25 bp, Rattus norvegicus
gagaacacagtgtacatcagcatag

SEQ ID NO: 331416 - DNA, 25 bp, Rattus norvegicus
gagaacacatcgaggacctggagat

SEQ ID NO: 331417 - DNA, 25 bp, Rattus norvegicus
gagaacacatcgtggacctggagat

SEQ ID NO: 331418 - DNA, 25 bp, Rattus norvegicus
gagaacacatgaatgccttcccggt

SEQ ID NO: 331419 - DNA, 25 bp, Rattus norvegicus
gagaacacatgattgccttcccggt

SEQ ID NO: 331420 - DNA, 25 bp, Rattus norvegicus
gagaacacattgacacagggtcagg

SEQ ID NO: 331421 - DNA, 25 bp, Rattus norvegicus
gagaacacattgtcacagggtcagg

SEQ ID NO: 331422 - DNA, 25 bp, Rattus norvegicus
gagaacaccaatccctgaacatttt

SEQ ID NO: 331423 - DNA, 25 bp, Rattus norvegicus
gagaacaccaatgcctgaacatttt

SEQ ID NO: 331424 - DNA, 25 bp, Rattus norvegicus
gagaacaccatcaatatcgaccagg

SEQ ID NO: 331425 - DNA, 25 bp, Rattus norvegicus
gagaacaccatctatatcgaccagg

SEQ ID NO: 331426 - DNA, 25 bp, Rattus norvegicus
gagaacacccctcagataggcacag

SEQ ID NO: 331427 - DNA, 25 bp, Rattus norvegicus
gagaacacccctgagataggcacag

SEQ ID NO: 331428 - DNA, 25 bp, Rattus norvegicus
gagaacaccgcacaatagccaggct

SEQ ID NO: 331429 - DNA, 25 bp, Rattus norvegicus
gagaacaccgcagaatagccaggct

SEQ ID NO: 331430 - DNA, 25 bp, Rattus norvegicus
gagaacaccgtccatactatactat

SEQ ID NO: 331431 - DNA, 25 bp, Rattus norvegicus
gagaacaccgtcgatactatactat

SEQ ID NO: 331432 - DNA, 25 bp, Rattus norvegicus
gagaacacgctaagcctctcctcat

SEQ ID NO: 331433 - DNA, 25 bp, Rattus norvegicus
gagaacacgctatgcctctcctcat

SEQ ID NO: 331434 - DNA, 25 bp, Rattus norvegicus
gagaacacgctcattgctaagacag

SEQ ID NO: 331435 - DNA, 25 bp, Rattus norvegicus
gagaacacgctctttgctaagacag

SEQ ID NO: 331436 - DNA, 25 bp, Rattus norvegicus
gagaacacggacacctgaaagctgt

SEQ ID NO: 331437 - DNA, 25 bp, Rattus norvegicus
gagaacacggactcctgaaagctgt

SEQ ID NO: 331438 - DNA, 25 bp, Rattus norvegicus
gagaacacgtccaaatcaggcctga

SEQ ID NO: 331439 - DNA, 25 bp, Rattus norvegicus
gagaacacgtcctaatcaggcctga

SEQ ID NO: 331440 - DNA, 25 bp, Rattus norvegicus
gagaacacgtggactactccagcat

SEQ ID NO: 331441 - DNA, 25 bp, Rattus norvegicus
gagaacacgtggtctactccagcat

SEQ ID NO: 331442 - DNA, 25 bp, Rattus norvegicus
gagaacactcaacaaggccaggcct

SEQ ID NO: 331443 - DNA, 25 bp, Rattus norvegicus
gagaacactcaagaaggccaggcct

SEQ ID NO: 331444 - DNA, 25 bp, Rattus norvegicus
gagaacactctgaaccatgtgcaag

SEQ ID NO: 331445 - DNA, 25 bp, Rattus norvegicus
gagaacactctgctttctagggaaa

SEQ ID NO: 331446 - DNA, 25 bp, Rattus norvegicus
gagaacactctggtttctagggaaa

SEQ ID NO: 331447 - DNA, 25 bp, Rattus norvegicus
gagaacactctgtaccatgtgcaag

SEQ ID NO: 331448 - DNA, 25 bp, Rattus norvegicus
gagaacactgcaccttaaggtgtaa

SEQ ID NO: 331449 - DNA, 25 bp, Rattus norvegicus
gagaacactgcagcttaaggtgtaa

SEQ ID NO: 331450 - DNA, 25 bp, Rattus norvegicus
gagaacactgtgacccttggaaatg

SEQ ID NO: 331451 - DNA, 25 bp, Rattus norvegicus
gagaacactgtgtcccttggaaatg

SEQ ID NO: 331452 - DNA, 25 bp, Rattus norvegicus
gagaacactgttagctcttcagcag

SEQ ID NO: 331453 - DNA, 25 bp, Rattus norvegicus
gagaacactgtttgctcttcagcag

SEQ ID NO: 331454 - DNA, 25 bp, Rattus norvegicus
gagaacacttcacaggcgagccact

SEQ ID NO: 331455 - DNA, 25 bp, Rattus norvegicus
gagaacacttcagaggcgagccact

SEQ ID NO: 331456 - DNA, 25 bp, Rattus norvegicus
gagaacacttgaagctcttgcagaa

SEQ ID NO: 331457 - DNA, 25 bp, Rattus norvegicus
gagaacacttgacgctgcagcaaaa

SEQ ID NO: 331458 - DNA, 25 bp, Rattus norvegicus
gagaacacttgaggctgcagcaaaa

SEQ ID NO: 331459 - DNA, 25 bp, Rattus norvegicus
gagaacacttgatgctcttgcagaa

SEQ ID NO: 331460 - DNA, 25 bp, Rattus norvegicus
gagaacacttgtcatgctgacaaat

SEQ ID NO: 331461 - DNA, 25 bp, Rattus norvegicus
gagaacacttgtgatgctgacaaat

SEQ ID NO: 331462 - DNA, 25 bp, Rattus norvegicus
gagaacactttgaggtctcttttcc

SEQ ID NO: 331463 - DNA, 25 bp, Rattus norvegicus
gagaacactttgtggtctcttttcc

SEQ ID NO: 331464 - DNA, 25 bp, Rattus norvegicus
gagaacacttttcgcttctgagccc

SEQ ID NO: 331465 - DNA, 25 bp, Rattus norvegicus
gagaacacttttggcttctgagccc

SEQ ID NO: 331466 - DNA, 25 bp, Rattus norvegicus
gagaacagaaccacctagataggaa

SEQ ID NO: 331467 - DNA, 25 bp, Rattus norvegicus
gagaacagaacctcctagataggaa

SEQ ID NO: 331468 - DNA, 25 bp, Rattus norvegicus
gagaacagagctatttggtcaacat

SEQ ID NO: 331469 - DNA, 25 bp, Rattus norvegicus
gagaacagagctttttggtcaacat

SEQ ID NO: 331470 - DNA, 25 bp, Rattus norvegicus
gagaacagaggccacccgatgtttc

SEQ ID NO: 331471 - DNA, 25 bp, Rattus norvegicus
gagaacagaggcctagaccatctga

SEQ ID NO: 331472 - DNA, 25 bp, Rattus norvegicus
gagaacagaggcgacccgatgtttc

SEQ ID NO: 331473 - DNA, 25 bp, Rattus norvegicus
gagaacagaggcgtagaccatctga

SEQ ID NO: 331474 - DNA, 25 bp, Rattus norvegicus
gagaacagcagcctttcatttgctt

SEQ ID NO: 331475 - DNA, 25 bp, Rattus norvegicus
gagaacagcagcgtttcatttgctt

SEQ ID NO: 331476 - DNA, 25 bp, Rattus norvegicus
gagaacagcgagagctccccaaaga

SEQ ID NO: 331477 - DNA, 25 bp, Rattus norvegicus
gagaacagcgagtgctccccaaaga

SEQ ID NO: 331478 - DNA, 25 bp, Rattus norvegicus
gagaacagctcaccactggcttctg

SEQ ID NO: 331479 - DNA, 25 bp, Rattus norvegicus
gagaacagctcagcactggcttctg

SEQ ID NO: 331480 - DNA, 25 bp, Rattus norvegicus
gagaacagctcccacagagtggaag

SEQ ID NO: 331481 - DNA, 25 bp, Rattus norvegicus
gagaacagctccgacagagtggaag

SEQ ID NO: 331482 - DNA, 25 bp, Rattus norvegicus
gagaacaggaccatccgtgttcaca

SEQ ID NO: 331483 - DNA, 25 bp, Rattus norvegicus
gagaacaggaccttccgtgttcaca

SEQ ID NO: 331484 - DNA, 25 bp, Rattus norvegicus
gagaacaggagtcagtttccctttc

SEQ ID NO: 331485 - DNA, 25 bp, Rattus norvegicus
gagaacaggagtgagtttccctttc

SEQ ID NO: 331486 - DNA, 25 bp, Rattus norvegicus
gagaacagtacgcaatccctcggaa

SEQ ID NO: 331487 - DNA, 25 bp, Rattus norvegicus
gagaacagtacggaatccctcggaa

SEQ ID NO: 331488 - DNA, 25 bp, Rattus norvegicus
gagaacagtgcaatgtctgcctctt

SEQ ID NO: 331489 - DNA, 25 bp, Rattus norvegicus
gagaacagtgcacgagcacctcctc

SEQ ID NO: 331490 - DNA, 25 bp, Rattus norvegicus
gagaacagtgcaggagcacctcctc

SEQ ID NO: 331491 - DNA, 25 bp, Rattus norvegicus
gagaacagtgcattgtctgcctctt

SEQ ID NO: 331492 - DNA, 25 bp, Rattus norvegicus
gagaacagtgccaccaaaacctgat

SEQ ID NO: 331493 - DNA, 25 bp, Rattus norvegicus
gagaacagtgcctccaaaacctgat

SEQ ID NO: 331494 - DNA, 25 bp, Rattus norvegicus
gagaacagttcaaactccgggagat

SEQ ID NO: 331495 - DNA, 25 bp, Rattus norvegicus
gagaacagttcatactccgggagat

SEQ ID NO: 331496 - DNA, 25 bp, Rattus norvegicus
gagaacatatctctaagctaccttt

SEQ ID NO: 331497 - DNA, 25 bp, Rattus norvegicus
gagaacatatctgtaagctaccttt

SEQ ID NO: 331498 - DNA, 25 bp, Rattus norvegicus
gagaacatatgaagccaggctgagg

SEQ ID NO: 331499 - DNA, 25 bp, Rattus norvegicus
gagaacatatgatgccaggctgagg

SEQ ID NO: 331500 - DNA, 25 bp, Rattus norvegicus
gagaacatcaaaccttttaccacct

SEQ ID NO: 331501 - DNA, 25 bp, Rattus norvegicus
gagaacatcaaagcttttaccacct

SEQ ID NO: 331502 - DNA, 25 bp, Rattus norvegicus
gagaacatcactcagacggtcagtt

SEQ ID NO: 331503 - DNA, 25 bp, Rattus norvegicus
gagaacatcactgagacggtcagtt

SEQ ID NO: 331504 - DNA, 25 bp, Rattus norvegicus
gagaacatcgatccctttgacgtgg

SEQ ID NO: 331505 - DNA, 25 bp, Rattus norvegicus
gagaacatcgatgcctttgacgtgg

SEQ ID NO: 331506 - DNA, 25 bp, Rattus norvegicus
gagaacatctctaaggacctctaca

SEQ ID NO: 331507 - DNA, 25 bp, Rattus norvegicus
gagaacatctcttaggacctctaca

SEQ ID NO: 331508 - DNA, 25 bp, Rattus norvegicus
gagaacatgaccatgcttccctcat

SEQ ID NO: 331509 - DNA, 25 bp, Rattus norvegicus
gagaacatgaccttgcttccctcat

SEQ ID NO: 331510 - DNA, 25 bp, Rattus norvegicus
gagaacatgcctccaaaagatgcgg

SEQ ID NO: 331511 - DNA, 25 bp, Rattus norvegicus
gagaacatgcctgcaaaagatgcgg

SEQ ID NO: 331512 - DNA, 25 bp, Rattus norvegicus
gagaacatggtcatgtgtagcccag

SEQ ID NO: 331513 - DNA, 25 bp, Rattus norvegicus
gagaacatggtcttgtgtagcccag

SEQ ID NO: 331514 - DNA, 25 bp, Rattus norvegicus
gagaacatgtatattggtcccctcc

SEQ ID NO: 331515 - DNA, 25 bp, Rattus norvegicus
gagaacatgtattttggtcccctcc

SEQ ID NO: 331516 - DNA, 25 bp, Rattus norvegicus
gagaacatgtttccaggagggccaa

SEQ ID NO: 331517 - DNA, 25 bp, Rattus norvegicus
gagaacatgtttgcaggagggccaa

SEQ ID NO: 331518 - DNA, 25 bp, Rattus norvegicus
gagaacattggtctggtacacttct

SEQ ID NO: 331519 - DNA, 25 bp, Rattus norvegicus
gagaacattggtgtggtacacttct

SEQ ID NO: 331520 - DNA, 25 bp, Rattus norvegicus
gagaacattgttaacctctgattgt

SEQ ID NO: 331521 - DNA, 25 bp, Rattus norvegicus
gagaacattgtttacctctgattgt

SEQ ID NO: 331522 - DNA, 25 bp, Rattus norvegicus
gagaacatttcacctacttcaagaa

SEQ ID NO: 331523 - DNA, 25 bp, Rattus norvegicus
gagaacatttcagctacttcaagaa

SEQ ID NO: 331524 - DNA, 25 bp, Rattus norvegicus
gagaacattttacccttactgaata

SEQ ID NO: 331525 - DNA, 25 bp, Rattus norvegicus
gagaacattttagccttactgaata

SEQ ID NO: 331526 - DNA, 25 bp, Rattus norvegicus
gagaacattttgctcagtttggcca

SEQ ID NO: 331527 - DNA, 25 bp, Rattus norvegicus
gagaacattttggtcagtttggcca

SEQ ID NO: 331528 - DNA, 25 bp, Rattus norvegicus
gagaaccaaactcgatccctgggta

SEQ ID NO: 331529 - DNA, 25 bp, Rattus norvegicus
gagaaccaaactggatccctgggta

SEQ ID NO: 331530 - DNA, 25 bp, Rattus norvegicus
gagaaccaactgctggtcctgtgga

SEQ ID NO: 331531 - DNA, 25 bp, Rattus norvegicus
gagaaccaactggtggtcctgtgga

SEQ ID NO: 331532 - DNA, 25 bp, Rattus norvegicus
gagaaccaaggacatccctgacctg

SEQ ID NO: 331533 - DNA, 25 bp, Rattus norvegicus
gagaaccaaggagatccctgacctg

SEQ ID NO: 331534 - DNA, 25 bp, Rattus norvegicus
gagaaccaaggccacccaagagtga

SEQ ID NO: 331535 - DNA, 25 bp, Rattus norvegicus
gagaaccaaggcgacccaagagtga

SEQ ID NO: 331536 - DNA, 25 bp, Rattus norvegicus
gagaaccaagtaatctgtccctgtc

SEQ ID NO: 331537 - DNA, 25 bp, Rattus norvegicus
gagaaccaagtattctgtccctgtc

SEQ ID NO: 331538 - DNA, 25 bp, Rattus norvegicus
gagaaccaagttaccaatatcctag

SEQ ID NO: 331539 - DNA, 25 bp, Rattus norvegicus
gagaaccaagtttccaatatcctag

SEQ ID NO: 331540 - DNA, 25 bp, Rattus norvegicus
gagaaccaccttactcttgtttact

SEQ ID NO: 331541 - DNA, 25 bp, Rattus norvegicus
gagaaccacctttctcttgtttact

SEQ ID NO: 331542 - DNA, 25 bp, Rattus norvegicus
gagaaccacgttaactgttattgta

SEQ ID NO: 331543 - DNA, 25 bp, Rattus norvegicus
gagaaccacgtttactgttattgta

SEQ ID NO: 331544 - DNA, 25 bp, Rattus norvegicus
gagaaccagaataggcccagcctat

SEQ ID NO: 331545 - DNA, 25 bp, Rattus norvegicus
gagaaccagaattggcccagcctat

SEQ ID NO: 331546 - DNA, 25 bp, Rattus norvegicus
gagaaccagatcaacagtgccgatg

SEQ ID NO: 331547 - DNA, 25 bp, Rattus norvegicus
gagaaccagatctacagtgccgatg

SEQ ID NO: 331548 - DNA, 25 bp, Rattus norvegicus
gagaaccaggaacgctctgtctttg

SEQ ID NO: 331549 - DNA, 25 bp, Rattus norvegicus
gagaaccaggaaggctctgtctttg

SEQ ID NO: 331550 - DNA, 25 bp, Rattus norvegicus
gagaaccaggccaaactgcagccag

SEQ ID NO: 331551 - DNA, 25 bp, Rattus norvegicus
gagaaccaggccatctgtgaaagat

SEQ ID NO: 331552 - DNA, 25 bp, Rattus norvegicus
gagaaccaggcctaactgcagccag

SEQ ID NO: 331553 - DNA, 25 bp, Rattus norvegicus
gagaaccaggccttctgtgaaagat

SEQ ID NO: 331554 - DNA, 25 bp, Rattus norvegicus
gagaaccagggaccagcctctgaga

SEQ ID NO: 331555 - DNA, 25 bp, Rattus norvegicus
gagaaccagggagcagcctctgaga

SEQ ID NO: 331556 - DNA, 25 bp, Rattus norvegicus
gagaaccagggccatgttgtctgta

SEQ ID NO: 331557 - DNA, 25 bp, Rattus norvegicus
gagaaccagggcgatgttgtctgta

SEQ ID NO: 331558 - DNA, 25 bp, Rattus norvegicus
gagaaccaggtaatagcgtttgaat

SEQ ID NO: 331559 - DNA, 25 bp, Rattus norvegicus
gagaaccaggtattagcgtttgaat

SEQ ID NO: 331560 - DNA, 25 bp, Rattus norvegicus
gagaaccagtccctactgcggatgc

SEQ ID NO: 331561 - DNA, 25 bp, Rattus norvegicus
gagaaccagtccgtactgcggatgc

SEQ ID NO: 331562 - DNA, 25 bp, Rattus norvegicus
gagaaccagttcaattacctcttcg

SEQ ID NO: 331563 - DNA, 25 bp, Rattus norvegicus
gagaaccagttctattacctcttcg

SEQ ID NO: 331564 - DNA, 25 bp, Rattus norvegicus
gagaaccatcacacatctgtcatta

SEQ ID NO: 331565 - DNA, 25 bp, Rattus norvegicus
gagaaccatcactcatctgtcatta

SEQ ID NO: 331566 - DNA, 25 bp, Rattus norvegicus
gagaaccatcctcgtagcacaagat

SEQ ID NO: 331567 - DNA, 25 bp, Rattus norvegicus
gagaaccatcctggtagcacaagat

SEQ ID NO: 331568 - DNA, 25 bp, Rattus norvegicus
gagaaccatctgacccggcgtgacg

SEQ ID NO: 331569 - DNA, 25 bp, Rattus norvegicus
gagaaccatctgtcccggcgtgacg

SEQ ID NO: 331570 - DNA, 25 bp, Rattus norvegicus
gagaaccattgcctgtttacctaca

SEQ ID NO: 331571 - DNA, 25 bp, Rattus norvegicus
gagaaccattgcgtgtttacctaca

SEQ ID NO: 331572 - DNA, 25 bp, Rattus norvegicus
gagaacccaatgctgcctataggct

SEQ ID NO: 331573 - DNA, 25 bp, Rattus norvegicus
gagaacccaatggtgcctataggct

SEQ ID NO: 331574 - DNA, 25 bp, Rattus norvegicus
gagaacccaggacataccacgaaga

SEQ ID NO: 331575 - DNA, 25 bp, Rattus norvegicus
gagaacccaggacgtcaaatatata

SEQ ID NO: 331576 - DNA, 25 bp, Rattus norvegicus
gagaacccaggagataccacgaaga

SEQ ID NO: 331577 - DNA, 25 bp, Rattus norvegicus
gagaacccaggaggtcaaatatata

SEQ ID NO: 331578 - DNA, 25 bp, Rattus norvegicus
gagaacccagtacccttgctgggcg

SEQ ID NO: 331579 - DNA, 25 bp, Rattus norvegicus
gagaacccagtagccttgctgggcg

SEQ ID NO: 331580 - DNA, 25 bp, Rattus norvegicus
gagaacccatatcgcacatggtctg

SEQ ID NO: 331581 - DNA, 25 bp, Rattus norvegicus
gagaacccatatggcacatggtctg

SEQ ID NO: 331582 - DNA, 25 bp, Rattus norvegicus
gagaacccatgcatttatggacact

SEQ ID NO: 331583 - DNA, 25 bp, Rattus norvegicus
gagaacccatgcttttatggacact

SEQ ID NO: 331584 - DNA, 25 bp, Rattus norvegicus
gagaaccctaaaagcatgctcccta

SEQ ID NO: 331585 - DNA, 25 bp, Rattus norvegicus
gagaaccctaaatgcatgctcccta

SEQ ID NO: 331586 - DNA, 25 bp, Rattus norvegicus
gagaaccctaccacagaggtcctga

SEQ ID NO: 331587 - DNA, 25 bp, Rattus norvegicus
gagaaccctacctcagaggtcctga

SEQ ID NO: 331588 - DNA, 25 bp, Rattus norvegicus
gagaaccctattcaccatcctgtgt

SEQ ID NO: 331589 - DNA, 25 bp, Rattus norvegicus
gagaaccctattgaccatcctgtgt

SEQ ID NO: 331590 - DNA, 25 bp, Rattus norvegicus
gagaaccctcaccaagtgtaccata

SEQ ID NO: 331591 - DNA, 25 bp, Rattus norvegicus
gagaaccctcacgaagtgtaccata

SEQ ID NO: 331592 - DNA, 25 bp, Rattus norvegicus
gagaaccctcagcaaaaacaagtag

SEQ ID NO: 331593 - DNA, 25 bp, Rattus norvegicus
gagaaccctcaggaaaaacaagtag

SEQ ID NO: 331594 - DNA, 25 bp, Rattus norvegicus
gagaaccctcttcccattaaagtga

SEQ ID NO: 331595 - DNA, 25 bp, Rattus norvegicus
gagaaccctcttgccattaaagtga

SEQ ID NO: 331596 - DNA, 25 bp, Rattus norvegicus
gagaaccctgacctcactgtttaag

SEQ ID NO: 331597 - DNA, 25 bp, Rattus norvegicus
gagaaccctgacgtcactgtttaag

SEQ ID NO: 331598 - DNA, 25 bp, Rattus norvegicus
gagaaccctgcacatccagtacagg

SEQ ID NO: 331599 - DNA, 25 bp, Rattus norvegicus
gagaaccctgcagatccagtacagg

SEQ ID NO: 331600 - DNA, 25 bp, Rattus norvegicus
gagaaccctgctcatacccaagatg

SEQ ID NO: 331601 - DNA, 25 bp, Rattus norvegicus
gagaaccctgctgatacccaagatg

SEQ ID NO: 331602 - DNA, 25 bp, Rattus norvegicus
gagaaccctggcaagtggtgttcca

SEQ ID NO: 331603 - DNA, 25 bp, Rattus norvegicus
gagaaccctggctagtggtgttcca

SEQ ID NO: 331604 - DNA, 25 bp, Rattus norvegicus
gagaaccctgtactgcaactgtttt

SEQ ID NO: 331605 - DNA, 25 bp, Rattus norvegicus
gagaaccctgtagtgcaactgtttt

SEQ ID NO: 331606 - DNA, 25 bp, Rattus norvegicus
gagaacccttgaacctttggaatca

SEQ ID NO: 331607 - DNA, 25 bp, Rattus norvegicus
gagaacccttgatcctttggaatca

SEQ ID NO: 331608 - DNA, 25 bp, Rattus norvegicus
gagaacccttgcatcttttgaaaga

SEQ ID NO: 331609 - DNA, 25 bp, Rattus norvegicus
gagaacccttgcttcttttgaaaga

SEQ ID NO: 331610 - DNA, 25 bp, Rattus norvegicus
gagaaccgaactaaccaagcatcct

SEQ ID NO: 331611 - DNA, 25 bp, Rattus norvegicus
gagaaccgaacttaccaagcatcct

SEQ ID NO: 331612 - DNA, 25 bp, Rattus norvegicus
gagaaccgaagtatcatcatgatga

SEQ ID NO: 331613 - DNA, 25 bp, Rattus norvegicus
gagaaccgaagtttcatcatgatga

SEQ ID NO: 331614 - DNA, 25 bp, Rattus norvegicus
gagaaccgacgccaaatagtgtgtg

SEQ ID NO: 331615 - DNA, 25 bp, Rattus norvegicus
gagaaccgacgcgaaatagtgtgtg

SEQ ID NO: 331616 - DNA, 25 bp, Rattus norvegicus
gagaaccggaagcagcgtcgacatc

SEQ ID NO: 331617 - DNA, 25 bp, Rattus norvegicus
gagaaccggaaggagcgtcgacatc

SEQ ID NO: 331618 - DNA, 25 bp, Rattus norvegicus
gagaaccggctcaggcaagttgtcc

SEQ ID NO: 331619 - DNA, 25 bp, Rattus norvegicus
gagaaccggctctggcaagttgtcc

SEQ ID NO: 331620 - DNA, 25 bp, Rattus norvegicus
gagaaccggcttagcagttgtttat

SEQ ID NO: 331621 - DNA, 25 bp, Rattus norvegicus
gagaaccggctttgcagttgtttat

SEQ ID NO: 331622 - DNA, 25 bp, Rattus norvegicus
gagaaccgggacaatcctgatgtga

SEQ ID NO: 331623 - DNA, 25 bp, Rattus norvegicus
gagaaccgggactatcctgatgtga

SEQ ID NO: 331624 - DNA, 25 bp, Rattus norvegicus
gagaacctagatactatagctgtat

SEQ ID NO: 331625 - DNA, 25 bp, Rattus norvegicus
gagaacctagattctatagctgtat

SEQ ID NO: 331626 - DNA, 25 bp, Rattus norvegicus
gagaacctagccagcagtgcagact

SEQ ID NO: 331627 - DNA, 25 bp, Rattus norvegicus
gagaacctagcctgcagtgcagact

SEQ ID NO: 331628 - DNA, 25 bp, Rattus norvegicus
gagaacctagtaaattgctactgtt

SEQ ID NO: 331629 - DNA, 25 bp, Rattus norvegicus
gagaacctagtatattgctactgtt

SEQ ID NO: 331630 - DNA, 25 bp, Rattus norvegicus
gagaacctattgcttgtcacttgaa

SEQ ID NO: 331631 - DNA, 25 bp, Rattus norvegicus
gagaacctattggttgtcacttgaa

SEQ ID NO: 331632 - DNA, 25 bp, Rattus norvegicus
gagaacctcaaacctttgcgagagc

SEQ ID NO: 331633 - DNA, 25 bp, Rattus norvegicus
gagaacctcaaagctttgcgagagc

SEQ ID NO: 331634 - DNA, 25 bp, Rattus norvegicus
gagaacctcagcattgtgcacgata

SEQ ID NO: 331635 - DNA, 25 bp, Rattus norvegicus
gagaacctcagctttgtgcacgata

SEQ ID NO: 331636 - DNA, 25 bp, Rattus norvegicus
gagaacctcagtctttagggtcaaa

SEQ ID NO: 331637 - DNA, 25 bp, Rattus norvegicus
gagaacctcagtgtttagggtcaaa

SEQ ID NO: 331638 - DNA, 25 bp, Rattus norvegicus
gagaacctctacacatacctcttaa

SEQ ID NO: 331639 - DNA, 25 bp, Rattus norvegicus
gagaacctctactcatacctcttaa

SEQ ID NO: 331640 - DNA, 25 bp, Rattus norvegicus
gagaacctctccacggagtttctgt

SEQ ID NO: 331641 - DNA, 25 bp, Rattus norvegicus
gagaacctctcctcggagtttctgt

SEQ ID NO: 331642 - DNA, 25 bp, Rattus norvegicus
gagaacctctgaaacacatccagcg

SEQ ID NO: 331643 - DNA, 25 bp, Rattus norvegicus
gagaacctctgatacacatccagcg

SEQ ID NO: 331644 - DNA, 25 bp, Rattus norvegicus
gagaacctctttcttgttcaccagg

SEQ ID NO: 331645 - DNA, 25 bp, Rattus norvegicus
gagaacctctttgttgttcaccagg

SEQ ID NO: 331646 - DNA, 25 bp, Rattus norvegicus
gagaacctgactaattggccactgg

SEQ ID NO: 331647 - DNA, 25 bp, Rattus norvegicus
gagaacctgacttattggccactgg

SEQ ID NO: 331648 - DNA, 25 bp, Rattus norvegicus
gagaacctgatgctggtcctgcatc

SEQ ID NO: 331649 - DNA, 25 bp, Rattus norvegicus
gagaacctgatggtggtcctgcatc

SEQ ID NO: 331650 - DNA, 25 bp, Rattus norvegicus
gagaacctgcccacctaaagtgagg

SEQ ID NO: 331651 - DNA, 25 bp, Rattus norvegicus
gagaacctgccctcctaaagtgagg

SEQ ID NO: 331652 - DNA, 25 bp, Rattus norvegicus
gagaacctgcctcacagaaacaaat

SEQ ID NO: 331653 - DNA, 25 bp, Rattus norvegicus
gagaacctgcctgacagaaacaaat

SEQ ID NO: 331654 - DNA, 25 bp, Rattus norvegicus
gagaacctgctgacattcactgatg

SEQ ID NO: 331655 - DNA, 25 bp, Rattus norvegicus
gagaacctgctgtcattcactgatg

SEQ ID NO: 331656 - DNA, 25 bp, Rattus norvegicus
gagaacctggagatgaccttcacat

SEQ ID NO: 331657 - DNA, 25 bp, Rattus norvegicus
gagaacctggagttgaccttcacat

SEQ ID NO: 331658 - DNA, 25 bp, Rattus norvegicus
gagaacctggcaccagaaacctgtt

SEQ ID NO: 331659 - DNA, 25 bp, Rattus norvegicus
gagaacctggcagcagaaacctgtt

SEQ ID NO: 331660 - DNA, 25 bp, Rattus norvegicus
gagaacctgggcatcagcctggcaa

SEQ ID NO: 331661 - DNA, 25 bp, Rattus norvegicus
gagaacctgggcttcagcctggcaa

SEQ ID NO: 331662 - DNA, 25 bp, Rattus norvegicus
gagaacctgtcaagtcatccgagat

SEQ ID NO: 331663 - DNA, 25 bp, Rattus norvegicus
gagaacctgtcatgtcatccgagat

SEQ ID NO: 331664 - DNA, 25 bp, Rattus norvegicus
gagaaccttctaatgcccatatctg

SEQ ID NO: 331665 - DNA, 25 bp, Rattus norvegicus
gagaaccttctattgcccatatctg

SEQ ID NO: 331666 - DNA, 25 bp, Rattus norvegicus
gagaaccttgggaatttcttctgaa

SEQ ID NO: 331667 - DNA, 25 bp, Rattus norvegicus
gagaaccttgggtatttcttctgaa

SEQ ID NO: 331668 - DNA, 25 bp, Rattus norvegicus
gagaacctttcactggaacccaaag

SEQ ID NO: 331669 - DNA, 25 bp, Rattus norvegicus
gagaacctttcagtggaacccaaag

SEQ ID NO: 331670 - DNA, 25 bp, Rattus norvegicus
gagaacctttgaactacttcagcag

SEQ ID NO: 331671 - DNA, 25 bp, Rattus norvegicus
gagaacctttgatctacttcagcag

SEQ ID NO: 331672 - DNA, 25 bp, Rattus norvegicus
gagaacgaactgcatctgaaaatgt

SEQ ID NO: 331673 - DNA, 25 bp, Rattus norvegicus
gagaacgaactggatctgaaaatgt

SEQ ID NO: 331674 - DNA, 25 bp, Rattus norvegicus
gagaacgaatatccctgcttccagt

SEQ ID NO: 331675 - DNA, 25 bp, Rattus norvegicus
gagaacgaatatgcctgcttccagt

SEQ ID NO: 331676 - DNA, 25 bp, Rattus norvegicus
gagaacgacaacatccaggatgacc

SEQ ID NO: 331677 - DNA, 25 bp, Rattus norvegicus
gagaacgacaacttccaggatgacc

SEQ ID NO: 331678 - DNA, 25 bp, Rattus norvegicus
gagaacgacaagctctgaggaatga

SEQ ID NO: 331679 - DNA, 25 bp, Rattus norvegicus
gagaacgacaaggtctgaggaatga

SEQ ID NO: 331680 - DNA, 25 bp, Rattus norvegicus
gagaacgacagcacccaaaagccaa

SEQ ID NO: 331681 - DNA, 25 bp, Rattus norvegicus
gagaacgacagctcccaaaagccaa

SEQ ID NO: 331682 - DNA, 25 bp, Rattus norvegicus
gagaacgacatcaacatcctgcggg

SEQ ID NO: 331683 - DNA, 25 bp, Rattus norvegicus
gagaacgacatctacatcctgcggg

SEQ ID NO: 331684 - DNA, 25 bp, Rattus norvegicus
gagaacgacatgcttgacctggctt

SEQ ID NO: 331685 - DNA, 25 bp, Rattus norvegicus
gagaacgacatggttgacctggctt

SEQ ID NO: 331686 - DNA, 25 bp, Rattus norvegicus
gagaacgaccagcaaaccacggcca

SEQ ID NO: 331687 - DNA, 25 bp, Rattus norvegicus
gagaacgaccaggaaaccacggcca

SEQ ID NO: 331688 - DNA, 25 bp, Rattus norvegicus
gagaacgacccaactccaacatggt

SEQ ID NO: 331689 - DNA, 25 bp, Rattus norvegicus
gagaacgacccatctccaacatggt

SEQ ID NO: 331690 - DNA, 25 bp, Rattus norvegicus
gagaacgagctcatctgcagggctt

SEQ ID NO: 331691 - DNA, 25 bp, Rattus norvegicus
gagaacgagctcttctgcagggctt

SEQ ID NO: 331692 - DNA, 25 bp, Rattus norvegicus
gagaacgaggacagcaagctgccct

SEQ ID NO: 331693 - DNA, 25 bp, Rattus norvegicus
gagaacgaggactgcaagctgccct

SEQ ID NO: 331694 - DNA, 25 bp, Rattus norvegicus
gagaacgagtctagcctttgggcca

SEQ ID NO: 331695 - DNA, 25 bp, Rattus norvegicus
gagaacgagtcttgcctttgggcca

SEQ ID NO: 331696 - DNA, 25 bp, Rattus norvegicus
gagaacgatttccacacagcgagaa

SEQ ID NO: 331697 - DNA, 25 bp, Rattus norvegicus
gagaacgatttccatcgcctggcac

SEQ ID NO: 331698 - DNA, 25 bp, Rattus norvegicus
gagaacgatttcgacacagcgagaa

SEQ ID NO: 331699 - DNA, 25 bp, Rattus norvegicus
gagaacgatttcgatcgcctggcac

SEQ ID NO: 331700 - DNA, 25 bp, Rattus norvegicus
gagaacgccatcatcagtgacgagt

SEQ ID NO: 331701 - DNA, 25 bp, Rattus norvegicus
gagaacgccatcttcagtgacgagt

SEQ ID NO: 331702 - DNA, 25 bp, Rattus norvegicus
gagaacgcggcaccaccacatcgat

SEQ ID NO: 331703 - DNA, 25 bp, Rattus norvegicus
gagaacgcggcagcaccacatcgat

SEQ ID NO: 331704 - DNA, 25 bp, Rattus norvegicus
gagaacgcttacatctgaccaggaa

SEQ ID NO: 331705 - DNA, 25 bp, Rattus norvegicus
gagaacgcttacttctgaccaggaa

SEQ ID NO: 331706 - DNA, 25 bp, Rattus norvegicus
gagaacggccgtatcattgcgggta

SEQ ID NO: 331707 - DNA, 25 bp, Rattus norvegicus
gagaacggccgtttcattgcgggta

SEQ ID NO: 331708 - DNA, 25 bp, Rattus norvegicus
gagaacgggaaacgctggacacaaa

SEQ ID NO: 331709 - DNA, 25 bp, Rattus norvegicus
gagaacgggaaaggctggacacaaa

SEQ ID NO: 331710 - DNA, 25 bp, Rattus norvegicus
gagaacggtttcaatggcttacctt

SEQ ID NO: 331711 - DNA, 25 bp, Rattus norvegicus
gagaacggtttctatggcttacctt

SEQ ID NO: 331712 - DNA, 25 bp, Rattus norvegicus
gagaacgtaaacatctgctccgtga

SEQ ID NO: 331713 - DNA, 25 bp, Rattus norvegicus
gagaacgtaaacttctgctccgtga

SEQ ID NO: 331714 - DNA, 25 bp, Rattus norvegicus
gagaacgtactactcttggcatagg

SEQ ID NO: 331715 - DNA, 25 bp, Rattus norvegicus
gagaacgtactagtcttggcatagg

SEQ ID NO: 331716 - DNA, 25 bp, Rattus norvegicus
gagaacgtcagccttgtgatctcac

SEQ ID NO: 331717 - DNA, 25 bp, Rattus norvegicus
gagaacgtcagcgttgtgatctcac

SEQ ID NO: 331718 - DNA, 25 bp, Rattus norvegicus
gagaacgtcctcctttgtgtttgct

SEQ ID NO: 331719 - DNA, 25 bp, Rattus norvegicus
gagaacgtcctcgtttgtgtttgct

SEQ ID NO: 331720 - DNA, 25 bp, Rattus norvegicus
gagaacgtgctgacactgttgcgag

SEQ ID NO: 331721 - DNA, 25 bp, Rattus norvegicus
gagaacgtgctgtcactgttgcgag

SEQ ID NO: 331722 - DNA, 25 bp, Rattus norvegicus
gagaacgtggagattcaccagacct

SEQ ID NO: 331723 - DNA, 25 bp, Rattus norvegicus
gagaacgtggagtttcaccagacct

SEQ ID NO: 331724 - DNA, 25 bp, Rattus norvegicus
gagaacgttactaatttatcccagt

SEQ ID NO: 331725 - DNA, 25 bp, Rattus norvegicus
gagaacgttacttatttatcccagt

SEQ ID NO: 331726 - DNA, 25 bp, Rattus norvegicus
gagaacgttccaaatcaatgaataa

SEQ ID NO: 331727 - DNA, 25 bp, Rattus norvegicus
gagaacgttccatatcaatgaataa

SEQ ID NO: 331728 - DNA, 25 bp, Rattus norvegicus
gagaacgttgccatatactcaactt

SEQ ID NO: 331729 - DNA, 25 bp, Rattus norvegicus
gagaacgttgccttatactcaactt

SEQ ID NO: 331730 - DNA, 25 bp, Rattus norvegicus
gagaactaactacgttacccctctg

SEQ ID NO: 331731 - DNA, 25 bp, Rattus norvegicus
gagaactaactaggttacccctctg

SEQ ID NO: 331732 - DNA, 25 bp, Rattus norvegicus
gagaactaagtactcctttcctcaa

SEQ ID NO: 331733 - DNA, 25 bp, Rattus norvegicus
gagaactaagtagtcctttcctcaa

SEQ ID NO: 331734 - DNA, 25 bp, Rattus norvegicus
gagaactacagcctcacttggcaaa

SEQ ID NO: 331735 - DNA, 25 bp, Rattus norvegicus
gagaactacagcgtcacttggcaaa

SEQ ID NO: 331736 - DNA, 25 bp, Rattus norvegicus
gagaactacattcggcggagtgaca

SEQ ID NO: 331737 - DNA, 25 bp, Rattus norvegicus
gagaactacattgggcggagtgaca

SEQ ID NO: 331738 - DNA, 25 bp, Rattus norvegicus
gagaactatcagaccagcttacaga

SEQ ID NO: 331739 - DNA, 25 bp, Rattus norvegicus
gagaactatcagtccagcttacaga

SEQ ID NO: 331740 - DNA, 25 bp, Rattus norvegicus
gagaactatgacagacattcacggt

SEQ ID NO: 331741 - DNA, 25 bp, Rattus norvegicus
gagaactatgacagagattcacatt

SEQ ID NO: 331742 - DNA, 25 bp, Rattus norvegicus
gagaactatgactgacattcacggt

SEQ ID NO: 331743 - DNA, 25 bp, Rattus norvegicus
gagaactatgactgagattcacatt

SEQ ID NO: 331744 - DNA, 25 bp, Rattus norvegicus
gagaactatgagaaccccagcagct

SEQ ID NO: 331745 - DNA, 25 bp, Rattus norvegicus
gagaactatgagctgatccattcca

SEQ ID NO: 331746 - DNA, 25 bp, Rattus norvegicus
gagaactatgaggtgatccattcca

SEQ ID NO: 331747 - DNA, 25 bp, Rattus norvegicus
gagaactatgagtaccccagcagct

SEQ ID NO: 331748 - DNA, 25 bp, Rattus norvegicus
gagaactatttcagcagagccttct

SEQ ID NO: 331749 - DNA, 25 bp, Rattus norvegicus
gagaactatttctgcagagccttct

SEQ ID NO: 331750 - DNA, 25 bp, Rattus norvegicus
gagaactcaagtacgcccttaggta

SEQ ID NO: 331751 - DNA, 25 bp, Rattus norvegicus
gagaactcaagttcgcccttaggta

SEQ ID NO: 331752 - DNA, 25 bp, Rattus norvegicus
gagaactcacgtaagtacctgttat

SEQ ID NO: 331753 - DNA, 25 bp, Rattus norvegicus
gagaactcacgttagtacctgttat

SEQ ID NO: 331754 - DNA, 25 bp, Rattus norvegicus
gagaactcagcccttactctgactg

SEQ ID NO: 331755 - DNA, 25 bp, Rattus norvegicus
gagaactcagccgttactctgactg

SEQ ID NO: 331756 - DNA, 25 bp, Rattus norvegicus
gagaactcatcgaagtggtccacct

SEQ ID NO: 331757 - DNA, 25 bp, Rattus norvegicus
gagaactcatcgtagtggtccacct

SEQ ID NO: 331758 - DNA, 25 bp, Rattus norvegicus
gagaactcatgtcttttcagaggct

SEQ ID NO: 331759 - DNA, 25 bp, Rattus norvegicus
gagaactcatgtgttttcagaggct

SEQ ID NO: 331760 - DNA, 25 bp, Rattus norvegicus
gagaactccagcattcctcagaggg

SEQ ID NO: 331761 - DNA, 25 bp, Rattus norvegicus
gagaactccagctttcctcagaggg

SEQ ID NO: 331762 - DNA, 25 bp, Rattus norvegicus
gagaactccatccagggctgttggt

SEQ ID NO: 331763 - DNA, 25 bp, Rattus norvegicus
gagaactccatcgagggctgttggt

SEQ ID NO: 331764 - DNA, 25 bp, Rattus norvegicus
gagaactccgtgaacttctgagtgt

SEQ ID NO: 331765 - DNA, 25 bp, Rattus norvegicus
gagaactccgtgtacttctgagtgt

SEQ ID NO: 331766 - DNA, 25 bp, Rattus norvegicus
gagaactcggacattttgctgctaa

SEQ ID NO: 331767 - DNA, 25 bp, Rattus norvegicus
gagaactcggactttttgctgctaa

SEQ ID NO: 331768 - DNA, 25 bp, Rattus norvegicus
gagaactctagcacagcagggcagt

SEQ ID NO: 331769 - DNA, 25 bp, Rattus norvegicus
gagaactctagctcagcagggcagt

SEQ ID NO: 331770 - DNA, 25 bp, Rattus norvegicus
gagaactctcaaaaaacggctcttt

SEQ ID NO: 331771 - DNA, 25 bp, Rattus norvegicus
gagaactctcaataaacggctcttt

SEQ ID NO: 331772 - DNA, 25 bp, Rattus norvegicus
gagaactctcatattagggtacttg

SEQ ID NO: 331773 - DNA, 25 bp, Rattus norvegicus
gagaactctcattttagggtacttg

SEQ ID NO: 331774 - DNA, 25 bp, Rattus norvegicus
gagaactctctcactgaactggaac

SEQ ID NO: 331775 - DNA, 25 bp, Rattus norvegicus
gagaactctctctctgaactggaac

SEQ ID NO: 331776 - DNA, 25 bp, Rattus norvegicus
gagaactctgcacatcttgatgata

SEQ ID NO: 331777 - DNA, 25 bp, Rattus norvegicus
gagaactctgcacgttgtcctctga

SEQ ID NO: 331778 - DNA, 25 bp, Rattus norvegicus
gagaactctgcagatcttgatgata

SEQ ID NO: 331779 - DNA, 25 bp, Rattus norvegicus
gagaactctgcaggttgtcctctga

SEQ ID NO: 331780 - DNA, 25 bp, Rattus norvegicus
gagaactctggtcactaggacggat

SEQ ID NO: 331781 - DNA, 25 bp, Rattus norvegicus
gagaactctggtgactaggacggat

SEQ ID NO: 331782 - DNA, 25 bp, Rattus norvegicus
gagaactcttaacccacttttgatt

SEQ ID NO: 331783 - DNA, 25 bp, Rattus norvegicus
gagaactcttaagccacttttgatt

SEQ ID NO: 331784 - DNA, 25 bp, Rattus norvegicus
gagaactctttccacttatggccac

SEQ ID NO: 331785 - DNA, 25 bp, Rattus norvegicus
gagaactctttcgacttatggccac

SEQ ID NO: 331786 - DNA, 25 bp, Rattus norvegicus
gagaactcttttcatatcccttggg

SEQ ID NO: 331787 - DNA, 25 bp, Rattus norvegicus
gagaactcttttgatatcccttggg

SEQ ID NO: 331788 - DNA, 25 bp, Rattus norvegicus
gagaactgacctctgtagttgtcct

SEQ ID NO: 331789 - DNA, 25 bp, Rattus norvegicus
gagaactgacctgtgtagttgtcct

SEQ ID NO: 331790 - DNA, 25 bp, Rattus norvegicus
gagaactgacttcacaagtttctgt

SEQ ID NO: 331791 - DNA, 25 bp, Rattus norvegicus
gagaactgacttgacaagtttctgt

SEQ ID NO: 331792 - DNA, 25 bp, Rattus norvegicus
gagaactgagcacaattcactggat

SEQ ID NO: 331793 - DNA, 25 bp, Rattus norvegicus
gagaactgagcagaattcactggat

SEQ ID NO: 331794 - DNA, 25 bp, Rattus norvegicus
gagaactgaggccagcgcttcccag

SEQ ID NO: 331795 - DNA, 25 bp, Rattus norvegicus
gagaactgaggcgagcgcttcccag

SEQ ID NO: 331796 - DNA, 25 bp, Rattus norvegicus
gagaactgatacctgggaagtcact

SEQ ID NO: 331797 - DNA, 25 bp, Rattus norvegicus
gagaactgatacgtgggaagtcact

SEQ ID NO: 331798 - DNA, 25 bp, Rattus norvegicus
gagaactgatgcactttgaagggat

SEQ ID NO: 331799 - DNA, 25 bp, Rattus norvegicus
gagaactgatgctctttgaagggat

SEQ ID NO: 331800 - DNA, 25 bp, Rattus norvegicus
gagaactgattcaatttattccttc

SEQ ID NO: 331801 - DNA, 25 bp, Rattus norvegicus
gagaactgattctatttattccttc

SEQ ID NO: 331802 - DNA, 25 bp, Rattus norvegicus
gagaactgcaagaccactctgggct

SEQ ID NO: 331803 - DNA, 25 bp, Rattus norvegicus
gagaactgcaagatgtactacgttg

SEQ ID NO: 331804 - DNA, 25 bp, Rattus norvegicus
gagaactgcaagtccactctgggct

SEQ ID NO: 331805 - DNA, 25 bp, Rattus norvegicus
gagaactgcaagttgtactacgttg

SEQ ID NO: 331806 - DNA, 25 bp, Rattus norvegicus
gagaactgcagacgcgacttacgca

SEQ ID NO: 331807 - DNA, 25 bp, Rattus norvegicus
gagaactgcagaggcgacttacgca

SEQ ID NO: 331808 - DNA, 25 bp, Rattus norvegicus
gagaactgcagtaaggccacaccca

SEQ ID NO: 331809 - DNA, 25 bp, Rattus norvegicus
gagaactgcagttaggccacaccca

SEQ ID NO: 331810 - DNA, 25 bp, Rattus norvegicus
gagaactgcattcagggctcatatc

SEQ ID NO: 331811 - DNA, 25 bp, Rattus norvegicus
gagaactgcattgagggctcatatc

SEQ ID NO: 331812 - DNA, 25 bp, Rattus norvegicus
gagaactgccaccacctttagaatt

SEQ ID NO: 331813 - DNA, 25 bp, Rattus norvegicus
gagaactgccacgacctttagaatt

SEQ ID NO: 331814 - DNA, 25 bp, Rattus norvegicus
gagaactgccttacccaagaaggag

SEQ ID NO: 331815 - DNA, 25 bp, Rattus norvegicus
gagaactgcctttcccaagaaggag

SEQ ID NO: 331816 - DNA, 25 bp, Rattus norvegicus
gagaactgcggcagcatctacaggc

SEQ ID NO: 331817 - DNA, 25 bp, Rattus norvegicus
gagaactgcggctgcatctacaggc

SEQ ID NO: 331818 - DNA, 25 bp, Rattus norvegicus
gagaactgcttcattccatatgtgt

SEQ ID NO: 331819 - DNA, 25 bp, Rattus norvegicus
gagaactgcttctttccatatgtgt

SEQ ID NO: 331820 - DNA, 25 bp, Rattus norvegicus
gagaactgctttcttagcctgctta

SEQ ID NO: 331821 - DNA, 25 bp, Rattus norvegicus
gagaactgctttgttagcctgctta

SEQ ID NO: 331822 - DNA, 25 bp, Rattus norvegicus
gagaactggagcagggtcttgacta

SEQ ID NO: 331823 - DNA, 25 bp, Rattus norvegicus
gagaactggagctgggtcttgacta

SEQ ID NO: 331824 - DNA, 25 bp, Rattus norvegicus
gagaactggccaagctgagcgcaga

SEQ ID NO: 331825 - DNA, 25 bp, Rattus norvegicus
gagaactggccatgctgagcgcaga

SEQ ID NO: 331826 - DNA, 25 bp, Rattus norvegicus
gagaactgggccaccggctgagcct

SEQ ID NO: 331827 - DNA, 25 bp, Rattus norvegicus
gagaactgggcctccggctgagcct

SEQ ID NO: 331828 - DNA, 25 bp, Rattus norvegicus
gagaactgggtgaacatggtcttta

SEQ ID NO: 331829 - DNA, 25 bp, Rattus norvegicus
gagaactgggtgagtctgacttgtt

SEQ ID NO: 331830 - DNA, 25 bp, Rattus norvegicus
gagaactgggtgtacatggtcttta

SEQ ID NO: 331831 - DNA, 25 bp, Rattus norvegicus
gagaactgggtgtgtctgacttgtt

SEQ ID NO: 331832 - DNA, 25 bp, Rattus norvegicus
gagaactggtcactagtacctccgt

SEQ ID NO: 331833 - DNA, 25 bp, Rattus norvegicus
gagaactggtcagtagtacctccgt

SEQ ID NO: 331834 - DNA, 25 bp, Rattus norvegicus
gagaactggttcagggtgtgcccca

SEQ ID NO: 331835 - DNA, 25 bp, Rattus norvegicus
gagaactggttctgggtgtgcccca

SEQ ID NO: 331836 - DNA, 25 bp, Rattus norvegicus
gagaactgtaagacgtgcactggat

SEQ ID NO: 331837 - DNA, 25 bp, Rattus norvegicus
gagaactgtaagtcgtgcactggat

SEQ ID NO: 331838 - DNA, 25 bp, Rattus norvegicus
gagaactgtacacatgcaaccttcc

SEQ ID NO: 331839 - DNA, 25 bp, Rattus norvegicus
gagaactgtacagatgcaaccttcc

SEQ ID NO: 331840 - DNA, 25 bp, Rattus norvegicus
gagaactgtaccactatggccacaa

SEQ ID NO: 331841 - DNA, 25 bp, Rattus norvegicus
gagaactgtacctctatggccacaa

SEQ ID NO: 331842 - DNA, 25 bp, Rattus norvegicus
gagaactgtagactggaccccttcc

SEQ ID NO: 331843 - DNA, 25 bp, Rattus norvegicus
gagaactgtagagtggaccccttcc

SEQ ID NO: 331844 - DNA, 25 bp, Rattus norvegicus
gagaactgtattcaactcagagaca

SEQ ID NO: 331845 - DNA, 25 bp, Rattus norvegicus
gagaactgtattgaactcagagaca

SEQ ID NO: 331846 - DNA, 25 bp, Rattus norvegicus
gagaactgtcccatggaactgtaca

SEQ ID NO: 331847 - DNA, 25 bp, Rattus norvegicus
gagaactgtcccttggaactgtaca

SEQ ID NO: 331848 - DNA, 25 bp, Rattus norvegicus
gagaactgtctgctttactgaaatt

SEQ ID NO: 331849 - DNA, 25 bp, Rattus norvegicus
gagaactgtctggtttactgaaatt

SEQ ID NO: 331850 - DNA, 25 bp, Rattus norvegicus
gagaactgtgccacagctgtgcggt

SEQ ID NO: 331851 - DNA, 25 bp, Rattus norvegicus
gagaactgtgcctcagctgtgcggt

SEQ ID NO: 331852 - DNA, 25 bp, Rattus norvegicus
gagaactgtggtatttaaaatgcca

SEQ ID NO: 331853 - DNA, 25 bp, Rattus norvegicus
gagaactgtggtttttaaaatgcca

SEQ ID NO: 331854 - DNA, 25 bp, Rattus norvegicus
gagaactgttttctccacggttcct

SEQ ID NO: 331855 - DNA, 25 bp, Rattus norvegicus
gagaactgttttgtccacggttcct

SEQ ID NO: 331856 - DNA, 25 bp, Rattus norvegicus
gagaacttaagcagtacgaccattg

SEQ ID NO: 331857 - DNA, 25 bp, Rattus norvegicus
gagaacttaagctgtacgaccattg

SEQ ID NO: 331858 - DNA, 25 bp, Rattus norvegicus
gagaacttaccaccagaaatccttg

SEQ ID NO: 331859 - DNA, 25 bp, Rattus norvegicus
gagaacttaccagcagaaatccttg

SEQ ID NO: 331860 - DNA, 25 bp, Rattus norvegicus
gagaacttacccaccaaaggatgtg

SEQ ID NO: 331861 - DNA, 25 bp, Rattus norvegicus
gagaacttaccctccaaaggatgtg

SEQ ID NO: 331862 - DNA, 25 bp, Rattus norvegicus
gagaacttactaaaggcacttcctt

SEQ ID NO: 331863 - DNA, 25 bp, Rattus norvegicus
gagaacttactataggcacttcctt

SEQ ID NO: 331864 - DNA, 25 bp, Rattus norvegicus
gagaacttagatcttccagggaact

SEQ ID NO: 331865 - DNA, 25 bp, Rattus norvegicus
gagaacttagatgttccagggaact

SEQ ID NO: 331866 - DNA, 25 bp, Rattus norvegicus
gagaacttagctacctgactttcag

SEQ ID NO: 331867 - DNA, 25 bp, Rattus norvegicus
gagaacttagcttcctgactttcag

SEQ ID NO: 331868 - DNA, 25 bp, Rattus norvegicus
gagaacttcaagctggatgccacac

SEQ ID NO: 331869 - DNA, 25 bp, Rattus norvegicus
gagaacttcaaggtggatgccacac

SEQ ID NO: 331870 - DNA, 25 bp, Rattus norvegicus
gagaacttcacacgacacctagaat

SEQ ID NO: 331871 - DNA, 25 bp, Rattus norvegicus
gagaacttcacaggacacctagaat

SEQ ID NO: 331872 - DNA, 25 bp, Rattus norvegicus
gagaacttcatcctgggcttagaat

SEQ ID NO: 331873 - DNA, 25 bp, Rattus norvegicus
gagaacttcatcgtgggcttagaat

SEQ ID NO: 331874 - DNA, 25 bp, Rattus norvegicus
gagaacttctacaacgtcatcctgt

SEQ ID NO: 331875 - DNA, 25 bp, Rattus norvegicus
gagaacttctactacgtcatcctgt

SEQ ID NO: 331876 - DNA, 25 bp, Rattus norvegicus
gagaacttctcgctcagtgaccgct

SEQ ID NO: 331877 - DNA, 25 bp, Rattus norvegicus
gagaacttctcggtcagtgaccgct

SEQ ID NO: 331878 - DNA, 25 bp, Rattus norvegicus
gagaacttctggcatatcgcctctt

SEQ ID NO: 331879 - DNA, 25 bp, Rattus norvegicus
gagaacttctgggatatcgcctctt

SEQ ID NO: 331880 - DNA, 25 bp, Rattus norvegicus
gagaacttcttcagggtaggcatcg

SEQ ID NO: 331881 - DNA, 25 bp, Rattus norvegicus
gagaacttcttctgggtaggcatcg

SEQ ID NO: 331882 - DNA, 25 bp, Rattus norvegicus
gagaacttgcagaccaacttctgaa

SEQ ID NO: 331883 - DNA, 25 bp, Rattus norvegicus
gagaacttgcagtccaacttctgaa

SEQ ID NO: 331884 - DNA, 25 bp, Rattus norvegicus
gagaacttgcccagcatattcaaag

SEQ ID NO: 331885 - DNA, 25 bp, Rattus norvegicus
gagaacttgccctgcatattcaaag

SEQ ID NO: 331886 - DNA, 25 bp, Rattus norvegicus
gagaacttgcctaacatgtgcaggt

SEQ ID NO: 331887 - DNA, 25 bp, Rattus norvegicus
gagaacttgccttacatgtgcaggt

SEQ ID NO: 331888 - DNA, 25 bp, Rattus norvegicus
gagaacttgtgtccacttccaagaa

SEQ ID NO: 331889 - DNA, 25 bp, Rattus norvegicus
gagaacttgtgtgcacttccaagaa

SEQ ID NO: 331890 - DNA, 25 bp, Rattus norvegicus
gagaactttaatagtgattcactgg

SEQ ID NO: 331891 - DNA, 25 bp, Rattus norvegicus
gagaactttaattgtgattcactgg

SEQ ID NO: 331892 - DNA, 25 bp, Rattus norvegicus
gagaactttattaagcaagcccctt

SEQ ID NO: 331893 - DNA, 25 bp, Rattus norvegicus
gagaactttatttagcaagcccctt

SEQ ID NO: 331894 - DNA, 25 bp, Rattus norvegicus
gagaactttccacgcattggcacaa

SEQ ID NO: 331895 - DNA, 25 bp, Rattus norvegicus
gagaactttccaggcattggcacaa

SEQ ID NO: 331896 - DNA, 25 bp, Rattus norvegicus
gagaactttgagcacgtcgggcact

SEQ ID NO: 331897 - DNA, 25 bp, Rattus norvegicus
gagaactttgaggacgtcgggcact

SEQ ID NO: 331898 - DNA, 25 bp, Rattus norvegicus
gagaacttttcaatacaccagtaca

SEQ ID NO: 331899 - DNA, 25 bp, Rattus norvegicus
gagaacttttcattacaccagtaca

SEQ ID NO: 331900 - DNA, 25 bp, Rattus norvegicus
gagaactttttgcttcaggcctccg

SEQ ID NO: 331901 - DNA, 25 bp, Rattus norvegicus
gagaactttttggttcaggcctccg

SEQ ID NO: 331902 - DNA, 25 bp, Rattus norvegicus
gagaagaaacccacacaagcttatt

SEQ ID NO: 331903 - DNA, 25 bp, Rattus norvegicus
gagaagaaaccctcacaagcttatt

SEQ ID NO: 331904 - DNA, 25 bp, Rattus norvegicus
gagaagaaacttcacaaccaggaaa

SEQ ID NO: 331905 - DNA, 25 bp, Rattus norvegicus
gagaagaaacttgacaaccaggaaa

SEQ ID NO: 331906 - DNA, 25 bp, Rattus norvegicus
gagaagaaagcgagccctcatgtca

SEQ ID NO: 331907 - DNA, 25 bp, Rattus norvegicus
gagaagaaagcgtgccctcatgtca

SEQ ID NO: 331908 - DNA, 25 bp, Rattus norvegicus
gagaagaacaccctgccgaccaaag

SEQ ID NO: 331909 - DNA, 25 bp, Rattus norvegicus
gagaagaacaccgtgccgaccaaag

SEQ ID NO: 331910 - DNA, 25 bp, Rattus norvegicus
gagaagaacccgcatcaaagcataa

SEQ ID NO: 331911 - DNA, 25 bp, Rattus norvegicus
gagaagaacccggatcaaagcataa

SEQ ID NO: 331912 - DNA, 25 bp, Rattus norvegicus
gagaagaacctgactctggcaagag

SEQ ID NO: 331913 - DNA, 25 bp, Rattus norvegicus
gagaagaacctgatattccagatga

SEQ ID NO: 331914 - DNA, 25 bp, Rattus norvegicus
gagaagaacctgtctctggcaagag

SEQ ID NO: 331915 - DNA, 25 bp, Rattus norvegicus
gagaagaacctgttattccagatga

SEQ ID NO: 331916 - DNA, 25 bp, Rattus norvegicus
gagaagaacgccacaaacaccatgc

SEQ ID NO: 331917 - DNA, 25 bp, Rattus norvegicus
gagaagaacgcctcaaacaccatgc

SEQ ID NO: 331918 - DNA, 25 bp, Rattus norvegicus
gagaagaatcttactgatcggctcg

SEQ ID NO: 331919 - DNA, 25 bp, Rattus norvegicus
gagaagaatctttctgatcggctcg

SEQ ID NO: 331920 - DNA, 25 bp, Rattus norvegicus
gagaagacaatgaggcttgctcctt

SEQ ID NO: 331921 - DNA, 25 bp, Rattus norvegicus
gagaagacaatgtggcttgctcctt

SEQ ID NO: 331922 - DNA, 25 bp, Rattus norvegicus
gagaagacacagactagcattctag

SEQ ID NO: 331923 - DNA, 25 bp, Rattus norvegicus
gagaagacacagtctagcattctag

SEQ ID NO: 331924 - DNA, 25 bp, Rattus norvegicus
gagaagacacctcacatcaacctct

SEQ ID NO: 331925 - DNA, 25 bp, Rattus norvegicus
gagaagacacctgacatcaacctct

SEQ ID NO: 331926 - DNA, 25 bp, Rattus norvegicus
gagaagacactcagatctttctcct

SEQ ID NO: 331927 - DNA, 25 bp, Rattus norvegicus
gagaagacactcaggcattggtttg

SEQ ID NO: 331928 - DNA, 25 bp, Rattus norvegicus
gagaagacactctgatctttctcct

SEQ ID NO: 331929 - DNA, 25 bp, Rattus norvegicus
gagaagacactctggcattggtttg

SEQ ID NO: 331930 - DNA, 25 bp, Rattus norvegicus
gagaagacagcgacctctgcaggtt

SEQ ID NO: 331931 - DNA, 25 bp, Rattus norvegicus
gagaagacagcgtcctctgcaggtt

SEQ ID NO: 331932 - DNA, 25 bp, Rattus norvegicus
gagaagacagttcccgcactggcct

SEQ ID NO: 331933 - DNA, 25 bp, Rattus norvegicus
gagaagacagttgccgcactggcct

SEQ ID NO: 331934 - DNA, 25 bp, Rattus norvegicus
gagaagacatctctttctgctcact

SEQ ID NO: 331935 - DNA, 25 bp, Rattus norvegicus
gagaagacatctgtttctgctcact

SEQ ID NO: 331936 - DNA, 25 bp, Rattus norvegicus
gagaagacatttcactgcaacgagt

SEQ ID NO: 331937 - DNA, 25 bp, Rattus norvegicus
gagaagacatttgactgcaacgagt

SEQ ID NO: 331938 - DNA, 25 bp, Rattus norvegicus
gagaagaccactcacttgaatattg

SEQ ID NO: 331939 - DNA, 25 bp, Rattus norvegicus
gagaagaccactgacttgaatattg

SEQ ID NO: 331940 - DNA, 25 bp, Rattus norvegicus
gagaagaccagacaacattcttgaa

SEQ ID NO: 331941 - DNA, 25 bp, Rattus norvegicus
gagaagaccagagaacattcttgaa

SEQ ID NO: 331942 - DNA, 25 bp, Rattus norvegicus
gagaagacccaaattaacacaactg

SEQ ID NO: 331943 - DNA, 25 bp, Rattus norvegicus
gagaagacccaatttaacacaactg

SEQ ID NO: 331944 - DNA, 25 bp, Rattus norvegicus
gagaagacccagaggtcctagccag

SEQ ID NO: 331945 - DNA, 25 bp, Rattus norvegicus
gagaagacccagtggtcctagccag

SEQ ID NO: 331946 - DNA, 25 bp, Rattus norvegicus
gagaagacccccagaattcacatat

SEQ ID NO: 331947 - DNA, 25 bp, Rattus norvegicus
gagaagaccccctgaattcacatat

SEQ ID NO: 331948 - DNA, 25 bp, Rattus norvegicus
gagaagacccctaattctgtagcgg

SEQ ID NO: 331949 - DNA, 25 bp, Rattus norvegicus
gagaagacccctcaccagtgagaga

SEQ ID NO: 331950 - DNA, 25 bp, Rattus norvegicus
gagaagacccctgaccagtgagaga

SEQ ID NO: 331951 - DNA, 25 bp, Rattus norvegicus
gagaagaccccttattctgtagcgg

SEQ ID NO: 331952 - DNA, 25 bp, Rattus norvegicus
gagaagacctatctacctagtactt

SEQ ID NO: 331953 - DNA, 25 bp, Rattus norvegicus
gagaagacctatgtacctagtactt

SEQ ID NO: 331954 - DNA, 25 bp, Rattus norvegicus
gagaagacctgacagccagtgcaca

SEQ ID NO: 331955 - DNA, 25 bp, Rattus norvegicus
gagaagacctgagagccagtgcaca

SEQ ID NO: 331956 - DNA, 25 bp, Rattus norvegicus
gagaagacctttaacaagctgcttg

SEQ ID NO: 331957 - DNA, 25 bp, Rattus norvegicus
gagaagaccttttacaagctgcttg

SEQ ID NO: 331958 - DNA, 25 bp, Rattus norvegicus
gagaagacgtgcactattttcaccc

SEQ ID NO: 331959 - DNA, 25 bp, Rattus norvegicus
gagaagacgtgctctattttcaccc

SEQ ID NO: 331960 - DNA, 25 bp, Rattus norvegicus
gagaagactacgcttgcctttgact

SEQ ID NO: 331961 - DNA, 25 bp, Rattus norvegicus
gagaagactacggttgcctttgact

SEQ ID NO: 331962 - DNA, 25 bp, Rattus norvegicus
gagaagactcacaagctggtcctaa

SEQ ID NO: 331963 - DNA, 25 bp, Rattus norvegicus
gagaagactcactagctggtcctaa

SEQ ID NO: 331964 - DNA, 25 bp, Rattus norvegicus
gagaagactccccattaacttatta

SEQ ID NO: 331965 - DNA, 25 bp, Rattus norvegicus
gagaagactcccgattaacttatta

SEQ ID NO: 331966 - DNA, 25 bp, Rattus norvegicus
gagaagactgatccccaggtttgaa

SEQ ID NO: 331967 - DNA, 25 bp, Rattus norvegicus
gagaagactgatgcccaggtttgaa

SEQ ID NO: 331968 - DNA, 25 bp, Rattus norvegicus
gagaagactttactccctgtttcca

SEQ ID NO: 331969 - DNA, 25 bp, Rattus norvegicus
gagaagactttagtccctgtttcca

SEQ ID NO: 331970 - DNA, 25 bp, Rattus norvegicus
gagaagagacacaggcatggcaaag

SEQ ID NO: 331971 - DNA, 25 bp, Rattus norvegicus
gagaagagacactggcatggcaaag

SEQ ID NO: 331972 - DNA, 25 bp, Rattus norvegicus
gagaagagacagcaagtcaccgtct

SEQ ID NO: 331973 - DNA, 25 bp, Rattus norvegicus
gagaagagacaggaagtcaccgtct

SEQ ID NO: 331974 - DNA, 25 bp, Rattus norvegicus
gagaagagcactaacttgcacgact

SEQ ID NO: 331975 - DNA, 25 bp, Rattus norvegicus
gagaagagcacttacttgcacgact

SEQ ID NO: 331976 - DNA, 25 bp, Rattus norvegicus
gagaagagcagcagagtcatcaaat

SEQ ID NO: 331977 - DNA, 25 bp, Rattus norvegicus
gagaagagcagctgagtcatcaaat

SEQ ID NO: 331978 - DNA, 25 bp, Rattus norvegicus
gagaagagccaaccctatgggaagt

SEQ ID NO: 331979 - DNA, 25 bp, Rattus norvegicus
gagaagagccaagcctatgggaagt

SEQ ID NO: 331980 - DNA, 25 bp, Rattus norvegicus
gagaagagccatcagcaccgcacac

SEQ ID NO: 331981 - DNA, 25 bp, Rattus norvegicus
gagaagagccatgagcaccgcacac

SEQ ID NO: 331982 - DNA, 25 bp, Rattus norvegicus
gagaagagcctcctgcctgaaccac

SEQ ID NO: 331983 - DNA, 25 bp, Rattus norvegicus
gagaagagcctcgtgcctgaaccac

SEQ ID NO: 331984 - DNA, 25 bp, Rattus norvegicus
gagaagagccttaattctgggccac

SEQ ID NO: 331985 - DNA, 25 bp, Rattus norvegicus
gagaagagcctttattctgggccac

SEQ ID NO: 331986 - DNA, 25 bp, Rattus norvegicus
gagaagagctcaaccatgtccgcca

SEQ ID NO: 331987 - DNA, 25 bp, Rattus norvegicus
gagaagagctcaagtcctcctgaac

SEQ ID NO: 331988 - DNA, 25 bp, Rattus norvegicus
gagaagagctcatccatgtccgcca

SEQ ID NO: 331989 - DNA, 25 bp, Rattus norvegicus
gagaagagctcatgtcctcctgaac

SEQ ID NO: 331990 - DNA, 25 bp, Rattus norvegicus
gagaagagctgcacactgccagact

SEQ ID NO: 331991 - DNA, 25 bp, Rattus norvegicus
gagaagagctgctcactgccagact

SEQ ID NO: 331992 - DNA, 25 bp, Rattus norvegicus
gagaagagcttcaactgccactctg

SEQ ID NO: 331993 - DNA, 25 bp, Rattus norvegicus
gagaagagcttctactgccactctg

SEQ ID NO: 331994 - DNA, 25 bp, Rattus norvegicus
gagaagaggattagacactccccac

SEQ ID NO: 331995 - DNA, 25 bp, Rattus norvegicus
gagaagaggatttgacactccccac

SEQ ID NO: 331996 - DNA, 25 bp, Rattus norvegicus
gagaagaggctcaaaggctctacaa

SEQ ID NO: 331997 - DNA, 25 bp, Rattus norvegicus
gagaagaggctctaaggctctacaa

SEQ ID NO: 331998 - DNA, 25 bp, Rattus norvegicus
gagaagaggttcacaaccctcctga

SEQ ID NO: 331999 - DNA, 25 bp, Rattus norvegicus
gagaagaggttctcaaccctcctga

SEQ ID NO: 332000 - DNA, 25 bp, Rattus norvegicus
gagaagagtctgactcctgcagaat

SEQ ID NO: 332001 - DNA, 25 bp, Rattus norvegicus
gagaagagtctgtctcctgcagaat

SEQ ID NO: 332002 - DNA, 25 bp, Rattus norvegicus
gagaagagtttgacccgtgctgagt

SEQ ID NO: 332003 - DNA, 25 bp, Rattus norvegicus
gagaagagtttgtcccgtgctgagt

SEQ ID NO: 332004 - DNA, 25 bp, Rattus norvegicus
gagaagatcaaactaccatgagtcc

SEQ ID NO: 332005 - DNA, 25 bp, Rattus norvegicus
gagaagatcaaagtaccatgagtcc

SEQ ID NO: 332006 - DNA, 25 bp, Rattus norvegicus
gagaagatcacgcataccggccagg

SEQ ID NO: 332007 - DNA, 25 bp, Rattus norvegicus
gagaagatcacggataccggccagg

SEQ ID NO: 332008 - DNA, 25 bp, Rattus norvegicus
gagaagatcctgcagcacagatgca

SEQ ID NO: 332009 - DNA, 25 bp, Rattus norvegicus
gagaagatcctggagcacagatgca

SEQ ID NO: 332010 - DNA, 25 bp, Rattus norvegicus
gagaagatctctcctagctttcctg

SEQ ID NO: 332011 - DNA, 25 bp, Rattus norvegicus
gagaagatctctgctagctttcctg

SEQ ID NO: 332012 - DNA, 25 bp, Rattus norvegicus
gagaagatctgaccttccacaccag

SEQ ID NO: 332013 - DNA, 25 bp, Rattus norvegicus
gagaagatctgagcttccacaccag

SEQ ID NO: 332014 - DNA, 25 bp, Rattus norvegicus
gagaagatctgcagcggtgccacca

SEQ ID NO: 332015 - DNA, 25 bp, Rattus norvegicus
gagaagatctgctgcggtgccacca

SEQ ID NO: 332016 - DNA, 25 bp, Rattus norvegicus
gagaagatcttcacacttccaggca

SEQ ID NO: 332017 - DNA, 25 bp, Rattus norvegicus
gagaagatcttcagattcctgccgt

SEQ ID NO: 332018 - DNA, 25 bp, Rattus norvegicus
gagaagatcttcctagccctttttt

SEQ ID NO: 332019 - DNA, 25 bp, Rattus norvegicus
gagaagatcttcgtagccctttttt

SEQ ID NO: 332020 - DNA, 25 bp, Rattus norvegicus
gagaagatcttctcacttccaggca

SEQ ID NO: 332021 - DNA, 25 bp, Rattus norvegicus
gagaagatcttctgattcctgccgt

SEQ ID NO: 332022 - DNA, 25 bp, Rattus norvegicus
gagaagatgattaaaccatgttcaa

SEQ ID NO: 332023 - DNA, 25 bp, Rattus norvegicus
gagaagatgatttaaccatgttcaa

SEQ ID NO: 332024 - DNA, 25 bp, Rattus norvegicus
gagaagatgcatccccgggatttca

SEQ ID NO: 332025 - DNA, 25 bp, Rattus norvegicus
gagaagatgcatgcccgggatttca

SEQ ID NO: 332026 - DNA, 25 bp, Rattus norvegicus
gagaagatgcgaactgcccgtcggc

SEQ ID NO: 332027 - DNA, 25 bp, Rattus norvegicus
gagaagatgcgatctgcccgtcggc

SEQ ID NO: 332028 - DNA, 25 bp, Rattus norvegicus
gagaagatgctgacccaccgaatag

SEQ ID NO: 332029 - DNA, 25 bp, Rattus norvegicus
gagaagatgctgtcccaccgaatag

SEQ ID NO: 332030 - DNA, 25 bp, Rattus norvegicus
gagaagatgtttatcacagtatgaa

SEQ ID NO: 332031 - DNA, 25 bp, Rattus norvegicus
gagaagatgtttttcacagtatgaa

SEQ ID NO: 332032 - DNA, 25 bp, Rattus norvegicus
gagaagattctacgctttgcttggc

SEQ ID NO: 332033 - DNA, 25 bp, Rattus norvegicus
gagaagattctaggctttgcttggc

SEQ ID NO: 332034 - DNA, 25 bp, Rattus norvegicus
gagaagattggtacatctgggtcaa

SEQ ID NO: 332035 - DNA, 25 bp, Rattus norvegicus
gagaagattggttcatctgggtcaa

SEQ ID NO: 332036 - DNA, 25 bp, Rattus norvegicus
gagaagattgtgctcctcctgcaac

SEQ ID NO: 332037 - DNA, 25 bp, Rattus norvegicus
gagaagattgtggtcctcctgcaac

SEQ ID NO: 332038 - DNA, 25 bp, Rattus norvegicus
gagaagcaaatcatttcatgttatt

SEQ ID NO: 332039 - DNA, 25 bp, Rattus norvegicus
gagaagcaaatcttttcatgttatt

SEQ ID NO: 332040 - DNA, 25 bp, Rattus norvegicus
gagaagcaacgcacatgtccggatg

SEQ ID NO: 332041 - DNA, 25 bp, Rattus norvegicus
gagaagcaacgctcatgtccggatg

SEQ ID NO: 332042 - DNA, 25 bp, Rattus norvegicus
gagaagcaactacagtcctgagcca

SEQ ID NO: 332043 - DNA, 25 bp, Rattus norvegicus
gagaagcaactagagtcctgagcca

SEQ ID NO: 332044 - DNA, 25 bp, Rattus norvegicus
gagaagcacaggcaccggtccagta

SEQ ID NO: 332045 - DNA, 25 bp, Rattus norvegicus
gagaagcacagggaccggtccagta

SEQ ID NO: 332046 - DNA, 25 bp, Rattus norvegicus
gagaagcactgcactgcctatagga

SEQ ID NO: 332047 - DNA, 25 bp, Rattus norvegicus
gagaagcactgctctgcctatagga

SEQ ID NO: 332048 - DNA, 25 bp, Rattus norvegicus
gagaagcacttaactcatgcgtctt

SEQ ID NO: 332049 - DNA, 25 bp, Rattus norvegicus
gagaagcacttatctcatgcgtctt

SEQ ID NO: 332050 - DNA, 25 bp, Rattus norvegicus
gagaagcactttcccagtagagcaa

SEQ ID NO: 332051 - DNA, 25 bp, Rattus norvegicus
gagaagcactttgccagtagagcaa

SEQ ID NO: 332052 - DNA, 25 bp, Rattus norvegicus
gagaagcagcccagcagtgcgaaaa

SEQ ID NO: 332053 - DNA, 25 bp, Rattus norvegicus
gagaagcagccctgcagtgcgaaaa

SEQ ID NO: 332054 - DNA, 25 bp, Rattus norvegicus
gagaagcagcctctgcctcccagag

SEQ ID NO: 332055 - DNA, 25 bp, Rattus norvegicus
gagaagcagcctgtgcctcccagag

SEQ ID NO: 332056 - DNA, 25 bp, Rattus norvegicus
gagaagcagctcattagcatccgca

SEQ ID NO: 332057 - DNA, 25 bp, Rattus norvegicus
gagaagcagctctttagcatccgca

SEQ ID NO: 332058 - DNA, 25 bp, Rattus norvegicus
gagaagcaggagagttgccccaagt

SEQ ID NO: 332059 - DNA, 25 bp, Rattus norvegicus
gagaagcaggagtgttgccccaagt

SEQ ID NO: 332060 - DNA, 25 bp, Rattus norvegicus
gagaagcagtgcatcccggagaaga

SEQ ID NO: 332061 - DNA, 25 bp, Rattus norvegicus
gagaagcagtgcttcccggagaaga

SEQ ID NO: 332062 - DNA, 25 bp, Rattus norvegicus
gagaagcatcctagacatgagtcct

SEQ ID NO: 332063 - DNA, 25 bp, Rattus norvegicus
gagaagcatccttgacatgagtcct

SEQ ID NO: 332064 - DNA, 25 bp, Rattus norvegicus
gagaagcatcttcacaccagcagga

SEQ ID NO: 332065 - DNA, 25 bp, Rattus norvegicus
gagaagcatcttgacaccagcagga

SEQ ID NO: 332066 - DNA, 25 bp, Rattus norvegicus
gagaagccaaacatccactgacgga

SEQ ID NO: 332067 - DNA, 25 bp, Rattus norvegicus
gagaagccaaacttccactgacgga

SEQ ID NO: 332068 - DNA, 25 bp, Rattus norvegicus
gagaagccaaatagccaaccatcaa

SEQ ID NO: 332069 - DNA, 25 bp, Rattus norvegicus
gagaagccaaattgccaaccatcaa

SEQ ID NO: 332070 - DNA, 25 bp, Rattus norvegicus
gagaagccaagaccactgcgtgtga

SEQ ID NO: 332071 - DNA, 25 bp, Rattus norvegicus
gagaagccaagagcactgcgtgtga

SEQ ID NO: 332072 - DNA, 25 bp, Rattus norvegicus
gagaagccaagtacagcctgagctg

SEQ ID NO: 332073 - DNA, 25 bp, Rattus norvegicus
gagaagccaagttcagcctgagctg

SEQ ID NO: 332074 - DNA, 25 bp, Rattus norvegicus
gagaagccaattacacagtgtcgtc

SEQ ID NO: 332075 - DNA, 25 bp, Rattus norvegicus
gagaagccaatttcacagtgtcgtc

SEQ ID NO: 332076 - DNA, 25 bp, Rattus norvegicus
gagaagccacacatggtgtctttga

SEQ ID NO: 332077 - DNA, 25 bp, Rattus norvegicus
gagaagccacacttggtgtctttga

SEQ ID NO: 332078 - DNA, 25 bp, Rattus norvegicus
gagaagccacccagtgatggtcgct

SEQ ID NO: 332079 - DNA, 25 bp, Rattus norvegicus
gagaagccacccatgtgccttcaaa

SEQ ID NO: 332080 - DNA, 25 bp, Rattus norvegicus
gagaagccaccctgtgatggtcgct

SEQ ID NO: 332081 - DNA, 25 bp, Rattus norvegicus
gagaagccacccttgtgccttcaaa

SEQ ID NO: 332082 - DNA, 25 bp, Rattus norvegicus
gagaagccaccgatgttgccgctga

SEQ ID NO: 332083 - DNA, 25 bp, Rattus norvegicus
gagaagccaccgttgttgccgctga

SEQ ID NO: 332084 - DNA, 25 bp, Rattus norvegicus
gagaagccacctctatgtaggagtt

SEQ ID NO: 332085 - DNA, 25 bp, Rattus norvegicus
gagaagccacctgtatgtaggagtt

SEQ ID NO: 332086 - DNA, 25 bp, Rattus norvegicus
gagaagccaggacagacgctaactc

SEQ ID NO: 332087 - DNA, 25 bp, Rattus norvegicus
gagaagccaggagagacgctaactc

SEQ ID NO: 332088 - DNA, 25 bp, Rattus norvegicus
gagaagccagtcaacacacactgtg

SEQ ID NO: 332089 - DNA, 25 bp, Rattus norvegicus
gagaagccagtccttttttgagttt

SEQ ID NO: 332090 - DNA, 25 bp, Rattus norvegicus
gagaagccagtcgttttttgagttt

SEQ ID NO: 332091 - DNA, 25 bp, Rattus norvegicus
gagaagccagtctacacacactgtg

SEQ ID NO: 332092 - DNA, 25 bp, Rattus norvegicus
gagaagccatgtcttgataaaccaa

SEQ ID NO: 332093 - DNA, 25 bp, Rattus norvegicus
gagaagccatgtgttgataaaccaa

SEQ ID NO: 332094 - DNA, 25 bp, Rattus norvegicus
gagaagccatttctggtcacagcgc

SEQ ID NO: 332095 - DNA, 25 bp, Rattus norvegicus
gagaagccatttgtggtcacagcgc

SEQ ID NO: 332096 - DNA, 25 bp, Rattus norvegicus
gagaagcccactatgtgaggactaa

SEQ ID NO: 332097 - DNA, 25 bp, Rattus norvegicus
gagaagcccactttgtgaggactaa

SEQ ID NO: 332098 - DNA, 25 bp, Rattus norvegicus
gagaagcccaggaagagaggctcat

SEQ ID NO: 332099 - DNA, 25 bp, Rattus norvegicus
gagaagcccaggtagagaggctcat

SEQ ID NO: 332100 - DNA, 25 bp, Rattus norvegicus
gagaagcccatgattcattttgtgt

SEQ ID NO: 332101 - DNA, 25 bp, Rattus norvegicus
gagaagcccatgtttcattttgtgt

SEQ ID NO: 332102 - DNA, 25 bp, Rattus norvegicus
gagaagccccaaagtctttcatata

SEQ ID NO: 332103 - DNA, 25 bp, Rattus norvegicus
gagaagccccaatgtctttcatata

SEQ ID NO: 332104 - DNA, 25 bp, Rattus norvegicus
gagaagccccacagggatctgagta

SEQ ID NO: 332105 - DNA, 25 bp, Rattus norvegicus
gagaagccccactgggatctgagta

SEQ ID NO: 332106 - DNA, 25 bp, Rattus norvegicus
gagaagccccagcagtaggaagcct

SEQ ID NO: 332107 - DNA, 25 bp, Rattus norvegicus
gagaagccccaggagtaggaagcct

SEQ ID NO: 332108 - DNA, 25 bp, Rattus norvegicus
gagaagcccgggaagcagcgctctt

SEQ ID NO: 332109 - DNA, 25 bp, Rattus norvegicus
gagaagcccgggtagcagcgctctt

SEQ ID NO: 332110 - DNA, 25 bp, Rattus norvegicus
gagaagccctgtacattttctccac

SEQ ID NO: 332111 - DNA, 25 bp, Rattus norvegicus
gagaagccctgttcattttctccac

SEQ ID NO: 332112 - DNA, 25 bp, Rattus norvegicus
gagaagcccttcagatgtgcagaat

SEQ ID NO: 332113 - DNA, 25 bp, Rattus norvegicus
gagaagcccttctgatgtgcagaat

SEQ ID NO: 332114 - DNA, 25 bp, Rattus norvegicus
gagaagcccttgaagctccaagtgt

SEQ ID NO: 332115 - DNA, 25 bp, Rattus norvegicus
gagaagcccttgactagggagataa

SEQ ID NO: 332116 - DNA, 25 bp, Rattus norvegicus
gagaagcccttgcatatcgccagga

SEQ ID NO: 332117 - DNA, 25 bp, Rattus norvegicus
gagaagcccttggatatcgccagga

SEQ ID NO: 332118 - DNA, 25 bp, Rattus norvegicus
gagaagcccttgtagctccaagtgt

SEQ ID NO: 332119 - DNA, 25 bp, Rattus norvegicus
gagaagcccttgtctagggagataa

SEQ ID NO: 332120 - DNA, 25 bp, Rattus norvegicus
gagaagccgcaaagaccgagattaa

SEQ ID NO: 332121 - DNA, 25 bp, Rattus norvegicus
gagaagccgcaatgaccgagattaa

SEQ ID NO: 332122 - DNA, 25 bp, Rattus norvegicus
gagaagccggtcaagtactactaga

SEQ ID NO: 332123 - DNA, 25 bp, Rattus norvegicus
gagaagccggtctagtactactaga

SEQ ID NO: 332124 - DNA, 25 bp, Rattus norvegicus
gagaagccgtacagttgcgatgcgt

SEQ ID NO: 332125 - DNA, 25 bp, Rattus norvegicus
gagaagccgtactgttgcgatgcgt

SEQ ID NO: 332126 - DNA, 25 bp, Rattus norvegicus
gagaagccgtatcagtgtgacatat

SEQ ID NO: 332127 - DNA, 25 bp, Rattus norvegicus
gagaagccgtatgagtgtgacatat

SEQ ID NO: 332128 - DNA, 25 bp, Rattus norvegicus
gagaagcctaagacccatattcttg

SEQ ID NO: 332129 - DNA, 25 bp, Rattus norvegicus
gagaagcctaagtcccatattcttg

SEQ ID NO: 332130 - DNA, 25 bp, Rattus norvegicus
gagaagcctatgatatgcagagtaa

SEQ ID NO: 332131 - DNA, 25 bp, Rattus norvegicus
gagaagcctatgttatgcagagtaa

SEQ ID NO: 332132 - DNA, 25 bp, Rattus norvegicus
gagaagcctccgaccggagtgtaga

SEQ ID NO: 332133 - DNA, 25 bp, Rattus norvegicus
gagaagcctccgtccggagtgtaga

SEQ ID NO: 332134 - DNA, 25 bp, Rattus norvegicus
gagaagcctcctctctgagggacta

SEQ ID NO: 332135 - DNA, 25 bp, Rattus norvegicus
gagaagcctcctgtctgagggacta

SEQ ID NO: 332136 - DNA, 25 bp, Rattus norvegicus
gagaagcctgacagagacttggaga

SEQ ID NO: 332137 - DNA, 25 bp, Rattus norvegicus
gagaagcctgacagccattttgcct

SEQ ID NO: 332138 - DNA, 25 bp, Rattus norvegicus
gagaagcctgactgagacttggaga

SEQ ID NO: 332139 - DNA, 25 bp, Rattus norvegicus
gagaagcctgactgccattttgcct

SEQ ID NO: 332140 - DNA, 25 bp, Rattus norvegicus
gagaagcctggtcgctctgtagcct

SEQ ID NO: 332141 - DNA, 25 bp, Rattus norvegicus
gagaagcctggtggctctgtagcct

SEQ ID NO: 332142 - DNA, 25 bp, Rattus norvegicus
gagaagccttcactgtccacaaggt

SEQ ID NO: 332143 - DNA, 25 bp, Rattus norvegicus
gagaagccttcagtgtccacaaggt

SEQ ID NO: 332144 - DNA, 25 bp, Rattus norvegicus
gagaagccttcgcatcaaaacgaga

SEQ ID NO: 332145 - DNA, 25 bp, Rattus norvegicus
gagaagccttcggatcaaaacgaga

SEQ ID NO: 332146 - DNA, 25 bp, Rattus norvegicus
gagaagcctttccacactggcttga

SEQ ID NO: 332147 - DNA, 25 bp, Rattus norvegicus
gagaagcctttcgacactggcttga

SEQ ID NO: 332148 - DNA, 25 bp, Rattus norvegicus
gagaagcgatcacctgccagtactc

SEQ ID NO: 332149 - DNA, 25 bp, Rattus norvegicus
gagaagcgatcagctgccagtactc

SEQ ID NO: 332150 - DNA, 25 bp, Rattus norvegicus
gagaagcgcagtagtcccattgaac

SEQ ID NO: 332151 - DNA, 25 bp, Rattus norvegicus
gagaagcgcagttgtcccattgaac

SEQ ID NO: 332152 - DNA, 25 bp, Rattus norvegicus
gagaagcgctccctcgaggcctatt

SEQ ID NO: 332153 - DNA, 25 bp, Rattus norvegicus
gagaagcgctccgtcgaggcctatt

SEQ ID NO: 332154 - DNA, 25 bp, Rattus norvegicus
gagaagcgctttcgtgatgctgctt

SEQ ID NO: 332155 - DNA, 25 bp, Rattus norvegicus
gagaagcgctttggtgatgctgctt

SEQ ID NO: 332156 - DNA, 25 bp, Rattus norvegicus
gagaagcggaggcacaaagggcgaa

SEQ ID NO: 332157 - DNA, 25 bp, Rattus norvegicus
gagaagcggagggacaaagggcgaa

SEQ ID NO: 332158 - DNA, 25 bp, Rattus norvegicus
gagaagcggatacgacttacattaa

SEQ ID NO: 332159 - DNA, 25 bp, Rattus norvegicus
gagaagcggataggacttacattaa

SEQ ID NO: 332160 - DNA, 25 bp, Rattus norvegicus
gagaagcggcctaccagttttcggg

SEQ ID NO: 332161 - DNA, 25 bp, Rattus norvegicus
gagaagcggccttccagttttcggg

SEQ ID NO: 332162 - DNA, 25 bp, Rattus norvegicus
gagaagctaaccagcggccagagct

SEQ ID NO: 332163 - DNA, 25 bp, Rattus norvegicus
gagaagctaacctgcggccagagct

SEQ ID NO: 332164 - DNA, 25 bp, Rattus norvegicus
gagaagctaatccttatccagaaat

SEQ ID NO: 332165 - DNA, 25 bp, Rattus norvegicus
gagaagctaatcgttatccagaaat

SEQ ID NO: 332166 - DNA, 25 bp, Rattus norvegicus
gagaagctaattccaaccctccctt

SEQ ID NO: 332167 - DNA, 25 bp, Rattus norvegicus
gagaagctaattgcaaccctccctt

SEQ ID NO: 332168 - DNA, 25 bp, Rattus norvegicus
gagaagctacagaccagtgacgtca

SEQ ID NO: 332169 - DNA, 25 bp, Rattus norvegicus
gagaagctacagtccagtgacgtca

SEQ ID NO: 332170 - DNA, 25 bp, Rattus norvegicus
gagaagctagtactgtccgttgatg

SEQ ID NO: 332171 - DNA, 25 bp, Rattus norvegicus
gagaagctagtagtgtccgttgatg

SEQ ID NO: 332172 - DNA, 25 bp, Rattus norvegicus
gagaagctatgacgcgaccttcccc

SEQ ID NO: 332173 - DNA, 25 bp, Rattus norvegicus
gagaagctatgaggcgaccttcccc

SEQ ID NO: 332174 - DNA, 25 bp, Rattus norvegicus
gagaagctcaaacagttgaccaaaa

SEQ ID NO: 332175 - DNA, 25 bp, Rattus norvegicus
gagaagctcaaagagttgaccaaaa

SEQ ID NO: 332176 - DNA, 25 bp, Rattus norvegicus
gagaagctcacacgcatctgatagt

SEQ ID NO: 332177 - DNA, 25 bp, Rattus norvegicus
gagaagctcacaggcatctgatagt

SEQ ID NO: 332178 - DNA, 25 bp, Rattus norvegicus
gagaagctcagcacaaacgcaggca

SEQ ID NO: 332179 - DNA, 25 bp, Rattus norvegicus
gagaagctcagctcaaacgcaggca

SEQ ID NO: 332180 - DNA, 25 bp, Rattus norvegicus
gagaagctcatcacatttcctttca

SEQ ID NO: 332181 - DNA, 25 bp, Rattus norvegicus
gagaagctcatctcatttcctttca

SEQ ID NO: 332182 - DNA, 25 bp, Rattus norvegicus
gagaagctcatgatccgcattggca

SEQ ID NO: 332183 - DNA, 25 bp, Rattus norvegicus
gagaagctcatgttccgcattggca

SEQ ID NO: 332184 - DNA, 25 bp, Rattus norvegicus
gagaagctcattatacgccttgcag

SEQ ID NO: 332185 - DNA, 25 bp, Rattus norvegicus
gagaagctcattttacgccttgcag

SEQ ID NO: 332186 - DNA, 25 bp, Rattus norvegicus
gagaagctccagaaagtccccagtg

SEQ ID NO: 332187 - DNA, 25 bp, Rattus norvegicus
gagaagctccagtaagtccccagtg

SEQ ID NO: 332188 - DNA, 25 bp, Rattus norvegicus
gagaagctcctcatgcaagatcaga

SEQ ID NO: 332189 - DNA, 25 bp, Rattus norvegicus
gagaagctcctcttgcaagatcaga

SEQ ID NO: 332190 - DNA, 25 bp, Rattus norvegicus
gagaagctcttccaggcccggaaac

SEQ ID NO: 332191 - DNA, 25 bp, Rattus norvegicus
gagaagctcttcgaggcccggaaac

SEQ ID NO: 332192 - DNA, 25 bp, Rattus norvegicus
gagaagctgaataactacccttcgc

SEQ ID NO: 332193 - DNA, 25 bp, Rattus norvegicus
gagaagctgaattactacccttcgc

SEQ ID NO: 332194 - DNA, 25 bp, Rattus norvegicus
gagaagctgaccctagcctatgaag

SEQ ID NO: 332195 - DNA, 25 bp, Rattus norvegicus
gagaagctgaccgtagcctatgaag

SEQ ID NO: 332196 - DNA, 25 bp, Rattus norvegicus
gagaagctgagtatggaacccatga

SEQ ID NO: 332197 - DNA, 25 bp, Rattus norvegicus
gagaagctgagtccttgatgccacc

SEQ ID NO: 332198 - DNA, 25 bp, Rattus norvegicus
gagaagctgagtgcttgatgccacc

SEQ ID NO: 332199 - DNA, 25 bp, Rattus norvegicus
gagaagctgagtttggaacccatga

SEQ ID NO: 332200 - DNA, 25 bp, Rattus norvegicus
gagaagctgccactcggaacatgga

SEQ ID NO: 332201 - DNA, 25 bp, Rattus norvegicus
gagaagctgccagtcggaacatgga

SEQ ID NO: 332202 - DNA, 25 bp, Rattus norvegicus
gagaagctgcccctcggactgtttc

SEQ ID NO: 332203 - DNA, 25 bp, Rattus norvegicus
gagaagctgcccgtcggactgtttc

SEQ ID NO: 332204 - DNA, 25 bp, Rattus norvegicus
gagaagctgcctcgcaaagtgctgc

SEQ ID NO: 332205 - DNA, 25 bp, Rattus norvegicus
gagaagctgcctctccagaaacata

SEQ ID NO: 332206 - DNA, 25 bp, Rattus norvegicus
gagaagctgcctggcaaagtgctgc

SEQ ID NO: 332207 - DNA, 25 bp, Rattus norvegicus
gagaagctgcctgtccagaaacata

SEQ ID NO: 332208 - DNA, 25 bp, Rattus norvegicus
gagaagctgctgactagaccacttt

SEQ ID NO: 332209 - DNA, 25 bp, Rattus norvegicus
gagaagctgctgtctagaccacttt

SEQ ID NO: 332210 - DNA, 25 bp, Rattus norvegicus
gagaagctggccactgagaatgcca

SEQ ID NO: 332211 - DNA, 25 bp, Rattus norvegicus
gagaagctggcctctgagaatgcca

SEQ ID NO: 332212 - DNA, 25 bp, Rattus norvegicus
gagaagctgtaaaagccacgaggct

SEQ ID NO: 332213 - DNA, 25 bp, Rattus norvegicus
gagaagctgtaatagccacgaggct

SEQ ID NO: 332214 - DNA, 25 bp, Rattus norvegicus
gagaagctgtgaccctgcagtgcct

SEQ ID NO: 332215 - DNA, 25 bp, Rattus norvegicus
gagaagctgtgactacccgtaagat

SEQ ID NO: 332216 - DNA, 25 bp, Rattus norvegicus
gagaagctgtgagcctgcagtgcct

SEQ ID NO: 332217 - DNA, 25 bp, Rattus norvegicus
gagaagctgtgagtacccgtaagat

SEQ ID NO: 332218 - DNA, 25 bp, Rattus norvegicus
gagaagctgttcctgacactatatt

SEQ ID NO: 332219 - DNA, 25 bp, Rattus norvegicus
gagaagctgttcgtgacactatatt

SEQ ID NO: 332220 - DNA, 25 bp, Rattus norvegicus
gagaagcttactagcaattcagtta

SEQ ID NO: 332221 - DNA, 25 bp, Rattus norvegicus
gagaagcttacttgcaattcagtta

SEQ ID NO: 332222 - DNA, 25 bp, Rattus norvegicus
gagaagcttgctctttatccaggtc

SEQ ID NO: 332223 - DNA, 25 bp, Rattus norvegicus
gagaagcttgctgtttatccaggtc

SEQ ID NO: 332224 - DNA, 25 bp, Rattus norvegicus
gagaagctttacaaactgcacttta

SEQ ID NO: 332225 - DNA, 25 bp, Rattus norvegicus
gagaagctttactaactgcacttta

SEQ ID NO: 332226 - DNA, 25 bp, Rattus norvegicus
gagaagctttcacagcccagtgata

SEQ ID NO: 332227 - DNA, 25 bp, Rattus norvegicus
gagaagctttcagagcccagtgata

SEQ ID NO: 332228 - DNA, 25 bp, Rattus norvegicus
gagaaggaaccaagctgcagcccac

SEQ ID NO: 332229 - DNA, 25 bp, Rattus norvegicus
gagaaggaaccacccagctcatacc

SEQ ID NO: 332230 - DNA, 25 bp, Rattus norvegicus
gagaaggaaccagccagctcatacc

SEQ ID NO: 332231 - DNA, 25 bp, Rattus norvegicus
gagaaggaaccatgctgcagcccac

SEQ ID NO: 332232 - DNA, 25 bp, Rattus norvegicus
gagaaggaaccgcgaccaccgccag

SEQ ID NO: 332233 - DNA, 25 bp, Rattus norvegicus
gagaaggaaccgggaccaccgccag

SEQ ID NO: 332234 - DNA, 25 bp, Rattus norvegicus
gagaaggaacttcggagccctcccg

SEQ ID NO: 332235 - DNA, 25 bp, Rattus norvegicus
gagaaggaacttgggagccctcccg

SEQ ID NO: 332236 - DNA, 25 bp, Rattus norvegicus
gagaaggaagccagtggcggcgcct

SEQ ID NO: 332237 - DNA, 25 bp, Rattus norvegicus
gagaaggaagcctgtggcggcgcct

SEQ ID NO: 332238 - DNA, 25 bp, Rattus norvegicus
gagaaggaagctcgcccctgagcaa

SEQ ID NO: 332239 - DNA, 25 bp, Rattus norvegicus
gagaaggaagctggcccctgagcaa

SEQ ID NO: 332240 - DNA, 25 bp, Rattus norvegicus
gagaaggaaggcaccatcgttgtcc

SEQ ID NO: 332241 - DNA, 25 bp, Rattus norvegicus
gagaaggaaggctccatcgttgtcc

SEQ ID NO: 332242 - DNA, 25 bp, Rattus norvegicus
gagaaggaatccacagtcctggaat

SEQ ID NO: 332243 - DNA, 25 bp, Rattus norvegicus
gagaaggaatcctcagtcctggaat

SEQ ID NO: 332244 - DNA, 25 bp, Rattus norvegicus
gagaaggaattcagccctggcttgc

SEQ ID NO: 332245 - DNA, 25 bp, Rattus norvegicus
gagaaggaattcatgctgggcaaag

SEQ ID NO: 332246 - DNA, 25 bp, Rattus norvegicus
gagaaggaattctgccctggcttgc

SEQ ID NO: 332247 - DNA, 25 bp, Rattus norvegicus
gagaaggaattcttgctgggcaaag

SEQ ID NO: 332248 - DNA, 25 bp, Rattus norvegicus
gagaaggaattgatctccttgtggg

SEQ ID NO: 332249 - DNA, 25 bp, Rattus norvegicus
gagaaggaattgttctccttgtggg

SEQ ID NO: 332250 - DNA, 25 bp, Rattus norvegicus
gagaaggacactctaccctatgaag

SEQ ID NO: 332251 - DNA, 25 bp, Rattus norvegicus
gagaaggacactgtaccctatgaag

SEQ ID NO: 332252 - DNA, 25 bp, Rattus norvegicus
gagaaggacagacgccccatgtcag

SEQ ID NO: 332253 - DNA, 25 bp, Rattus norvegicus
gagaaggacagaggccccatgtcag

SEQ ID NO: 332254 - DNA, 25 bp, Rattus norvegicus
gagaaggacccacatgcacagaaga

SEQ ID NO: 332255 - DNA, 25 bp, Rattus norvegicus
gagaaggacccagatgcacagaaga

SEQ ID NO: 332256 - DNA, 25 bp, Rattus norvegicus
gagaaggaccttaacaccctgagga

SEQ ID NO: 332257 - DNA, 25 bp, Rattus norvegicus
gagaaggaccttagacaagctataa

SEQ ID NO: 332258 - DNA, 25 bp, Rattus norvegicus
gagaaggacctttacaccctgagga

SEQ ID NO: 332259 - DNA, 25 bp, Rattus norvegicus
gagaaggacctttgacaagctataa

SEQ ID NO: 332260 - DNA, 25 bp, Rattus norvegicus
gagaaggacgcacccaccaagggaa

SEQ ID NO: 332261 - DNA, 25 bp, Rattus norvegicus
gagaaggacgcagccaccaagggaa

SEQ ID NO: 332262 - DNA, 25 bp, Rattus norvegicus
gagaaggacgtccatgcagcatcca

SEQ ID NO: 332263 - DNA, 25 bp, Rattus norvegicus
gagaaggacgtcgatgcagcatcca

SEQ ID NO: 332264 - DNA, 25 bp, Rattus norvegicus
gagaaggagaccaagcagtctgaca

SEQ ID NO: 332265 - DNA, 25 bp, Rattus norvegicus
gagaaggagacctagcagtctgaca

SEQ ID NO: 332266 - DNA, 25 bp, Rattus norvegicus
gagaaggagctcaaccaggcctgtt

SEQ ID NO: 332267 - DNA, 25 bp, Rattus norvegicus
gagaaggagctcatccaactggaaa

SEQ ID NO: 332268 - DNA, 25 bp, Rattus norvegicus
gagaaggagctctaccaggcctgtt

SEQ ID NO: 332269 - DNA, 25 bp, Rattus norvegicus
gagaaggagctcttccaactggaaa

SEQ ID NO: 332270 - DNA, 25 bp, Rattus norvegicus
gagaaggagtagcagcccagcccct

SEQ ID NO: 332271 - DNA, 25 bp, Rattus norvegicus
gagaaggagtaggagcccagcccct

SEQ ID NO: 332272 - DNA, 25 bp, Rattus norvegicus
gagaaggagtctcacccgattctca

SEQ ID NO: 332273 - DNA, 25 bp, Rattus norvegicus
gagaaggagtctgacccgattctca

SEQ ID NO: 332274 - DNA, 25 bp, Rattus norvegicus
gagaaggatcacaacctcaatggaa

SEQ ID NO: 332275 - DNA, 25 bp, Rattus norvegicus
gagaaggatcactacctcaatggaa

SEQ ID NO: 332276 - DNA, 25 bp, Rattus norvegicus
gagaaggatctaactgcaggtgaaa

SEQ ID NO: 332277 - DNA, 25 bp, Rattus norvegicus
gagaaggatctatctgcaggtgaaa

SEQ ID NO: 332278 - DNA, 25 bp, Rattus norvegicus
gagaaggatctgagttcctcttgcc

SEQ ID NO: 332279 - DNA, 25 bp, Rattus norvegicus
gagaaggatctgtgttcctcttgcc

SEQ ID NO: 332280 - DNA, 25 bp, Rattus norvegicus
gagaaggattccagaggctttttac

SEQ ID NO: 332281 - DNA, 25 bp, Rattus norvegicus
gagaaggattcctgaggctttttac

SEQ ID NO: 332282 - DNA, 25 bp, Rattus norvegicus
gagaaggcaaatcccgtttccagat

SEQ ID NO: 332283 - DNA, 25 bp, Rattus norvegicus
gagaaggcaaatgccgtttccagat

SEQ ID NO: 332284 - DNA, 25 bp, Rattus norvegicus
gagaaggcaagccagattacctcag

SEQ ID NO: 332285 - DNA, 25 bp, Rattus norvegicus
gagaaggcaagcgagattacctcag

SEQ ID NO: 332286 - DNA, 25 bp, Rattus norvegicus
gagaaggcactgctgctgcatgctt

SEQ ID NO: 332287 - DNA, 25 bp, Rattus norvegicus
gagaaggcactggtgctgcatgctt

SEQ ID NO: 332288 - DNA, 25 bp, Rattus norvegicus
gagaaggccaagcatgctagtaatt

SEQ ID NO: 332289 - DNA, 25 bp, Rattus norvegicus
gagaaggccaaggatgctagtaatt

SEQ ID NO: 332290 - DNA, 25 bp, Rattus norvegicus
gagaaggccatgcagtttcaacagg

SEQ ID NO: 332291 - DNA, 25 bp, Rattus norvegicus
gagaaggccatggagtttcaacagg

SEQ ID NO: 332292 - DNA, 25 bp, Rattus norvegicus
gagaaggccccaactatttcagcag

SEQ ID NO: 332293 - DNA, 25 bp, Rattus norvegicus
gagaaggccccatctatttcagcag

SEQ ID NO: 332294 - DNA, 25 bp, Rattus norvegicus
gagaaggccgctctggcattcaata

SEQ ID NO: 332295 - DNA, 25 bp, Rattus norvegicus
gagaaggccgctgtggcattcaata

SEQ ID NO: 332296 - DNA, 25 bp, Rattus norvegicus
gagaaggcctctatttcaaccctta

SEQ ID NO: 332297 - DNA, 25 bp, Rattus norvegicus
gagaaggcctctttttcaaccctta

SEQ ID NO: 332298 - DNA, 25 bp, Rattus norvegicus
gagaaggctactccggaggaaccca

SEQ ID NO: 332299 - DNA, 25 bp, Rattus norvegicus
gagaaggctactgcggaggaaccca

SEQ ID NO: 332300 - DNA, 25 bp, Rattus norvegicus
gagaaggctctgagctgcaggccaa

SEQ ID NO: 332301 - DNA, 25 bp, Rattus norvegicus
gagaaggctctgtgctgcaggccaa

SEQ ID NO: 332302 - DNA, 25 bp, Rattus norvegicus
gagaaggctgcaccactgttaagca

SEQ ID NO: 332303 - DNA, 25 bp, Rattus norvegicus
gagaaggctgcagcactgttaagca

SEQ ID NO: 332304 - DNA, 25 bp, Rattus norvegicus
gagaaggctggtaattcacttaatt

SEQ ID NO: 332305 - DNA, 25 bp, Rattus norvegicus
gagaaggctggttattcacttaatt

SEQ ID NO: 332306 - DNA, 25 bp, Rattus norvegicus
gagaaggctgtgactacctccagac

SEQ ID NO: 332307 - DNA, 25 bp, Rattus norvegicus
gagaaggctgtgtctacctccagac

SEQ ID NO: 332308 - DNA, 25 bp, Rattus norvegicus
gagaagggaacaacgcacgcttcct

SEQ ID NO: 332309 - DNA, 25 bp, Rattus norvegicus
gagaagggaacatcgcacgcttcct

SEQ ID NO: 332310 - DNA, 25 bp, Rattus norvegicus
gagaagggacatcaatgcaaggaaa

SEQ ID NO: 332311 - DNA, 25 bp, Rattus norvegicus
gagaagggacatgaatgcaaggaaa

SEQ ID NO: 332312 - DNA, 25 bp, Rattus norvegicus
gagaagggaccactttccctcacct

SEQ ID NO: 332313 - DNA, 25 bp, Rattus norvegicus
gagaagggaccagtttccctcacct

SEQ ID NO: 332314 - DNA, 25 bp, Rattus norvegicus
gagaagggacccaccagggtctgtt

SEQ ID NO: 332315 - DNA, 25 bp, Rattus norvegicus
gagaagggaccctccagggtctgtt

SEQ ID NO: 332316 - DNA, 25 bp, Rattus norvegicus
gagaagggacggacagtttgaacct

SEQ ID NO: 332317 - DNA, 25 bp, Rattus norvegicus
gagaagggacggtcagtttgaacct

SEQ ID NO: 332318 - DNA, 25 bp, Rattus norvegicus
gagaagggacttatccaagttcaca

SEQ ID NO: 332319 - DNA, 25 bp, Rattus norvegicus
gagaagggacttttccaagttcaca

SEQ ID NO: 332320 - DNA, 25 bp, Rattus norvegicus
gagaagggagctctctgtgcattcc

SEQ ID NO: 332321 - DNA, 25 bp, Rattus norvegicus
gagaagggagctgtctgtgcattcc

SEQ ID NO: 332322 - DNA, 25 bp, Rattus norvegicus
gagaagggatccaggcggtcaccac

SEQ ID NO: 332323 - DNA, 25 bp, Rattus norvegicus
gagaagggatcctggcggtcaccac

SEQ ID NO: 332324 - DNA, 25 bp, Rattus norvegicus
gagaagggcaatcgagagccacaac

SEQ ID NO: 332325 - DNA, 25 bp, Rattus norvegicus
gagaagggcaatggagagccacaac

SEQ ID NO: 332326 - DNA, 25 bp, Rattus norvegicus
gagaagggccaaaatccgtcactac

SEQ ID NO: 332327 - DNA, 25 bp, Rattus norvegicus
gagaagggccaatatccgtcactac

SEQ ID NO: 332328 - DNA, 25 bp, Rattus norvegicus
gagaagggcctccatatttatattt

SEQ ID NO: 332329 - DNA, 25 bp, Rattus norvegicus
gagaagggcctcgatatttatattt

SEQ ID NO: 332330 - DNA, 25 bp, Rattus norvegicus
gagaagggcttacagtttgatgaaa

SEQ ID NO: 332331 - DNA, 25 bp, Rattus norvegicus
gagaagggcttagagtttgatgaaa

SEQ ID NO: 332332 - DNA, 25 bp, Rattus norvegicus
gagaagggcttcacacccgtgtgca

SEQ ID NO: 332333 - DNA, 25 bp, Rattus norvegicus
gagaagggcttctcacccgtgtgca

SEQ ID NO: 332334 - DNA, 25 bp, Rattus norvegicus
gagaagggtcagatccttctactcc

SEQ ID NO: 332335 - DNA, 25 bp, Rattus norvegicus
gagaagggtcagttccttctactcc

SEQ ID NO: 332336 - DNA, 25 bp, Rattus norvegicus
gagaagggtccgcacactgttgtcc

SEQ ID NO: 332337 - DNA, 25 bp, Rattus norvegicus
gagaagggtccggacactgttgtcc

SEQ ID NO: 332338 - DNA, 25 bp, Rattus norvegicus
gagaagggtcctaatccttgctcaa

SEQ ID NO: 332339 - DNA, 25 bp, Rattus norvegicus
gagaagggtccttatccttgctcaa

SEQ ID NO: 332340 - DNA, 25 bp, Rattus norvegicus
gagaaggtcaccactgtgtatttat

SEQ ID NO: 332341 - DNA, 25 bp, Rattus norvegicus
gagaaggtcacctctgtgtatttat

SEQ ID NO: 332342 - DNA, 25 bp, Rattus norvegicus
gagaaggtcagacgcaagtcccagc

SEQ ID NO: 332343 - DNA, 25 bp, Rattus norvegicus
gagaaggtcagaggcaagtcccagc

SEQ ID NO: 332344 - DNA, 25 bp, Rattus norvegicus
gagaaggtcagtctccactgtcctg

SEQ ID NO: 332345 - DNA, 25 bp, Rattus norvegicus
gagaaggtcagtgtccactgtcctg

SEQ ID NO: 332346 - DNA, 25 bp, Rattus norvegicus
gagaaggtccacctgaacctgcttc

SEQ ID NO: 332347 - DNA, 25 bp, Rattus norvegicus
gagaaggtccacgtgaacctgcttc

SEQ ID NO: 332348 - DNA, 25 bp, Rattus norvegicus
gagaaggtcttcctggctacagaga

SEQ ID NO: 332349 - DNA, 25 bp, Rattus norvegicus
gagaaggtcttcgtggctacagaga

SEQ ID NO: 332350 - DNA, 25 bp, Rattus norvegicus
gagaaggtgcttccatacctgtcat

SEQ ID NO: 332351 - DNA, 25 bp, Rattus norvegicus
gagaaggtgcttgcatacctgtcat

SEQ ID NO: 332352 - DNA, 25 bp, Rattus norvegicus
gagaaggtggcaaaccgctgtcccc

SEQ ID NO: 332353 - DNA, 25 bp, Rattus norvegicus
gagaaggtggcataccgctgtcccc

SEQ ID NO: 332354 - DNA, 25 bp, Rattus norvegicus
gagaaggtggccactttggactata

SEQ ID NO: 332355 - DNA, 25 bp, Rattus norvegicus
gagaaggtggcctctttggactata

SEQ ID NO: 332356 - DNA, 25 bp, Rattus norvegicus
gagaaggttccaccttacgctcgta

SEQ ID NO: 332357 - DNA, 25 bp, Rattus norvegicus
gagaaggttccagcttacgctcgta

SEQ ID NO: 332358 - DNA, 25 bp, Rattus norvegicus
gagaaggttctaatcagtgcataag

SEQ ID NO: 332359 - DNA, 25 bp, Rattus norvegicus
gagaaggttctattcagtgcataag

SEQ ID NO: 332360 - DNA, 25 bp, Rattus norvegicus
gagaaggttcttactcccaaagcct

SEQ ID NO: 332361 - DNA, 25 bp, Rattus norvegicus
gagaaggttctttctcccaaagcct

SEQ ID NO: 332362 - DNA, 25 bp, Rattus norvegicus
gagaaggttggtcccttccagccat

SEQ ID NO: 332363 - DNA, 25 bp, Rattus norvegicus
gagaaggttggtgccttccagccat

SEQ ID NO: 332364 - DNA, 25 bp, Rattus norvegicus
gagaaggttgtcacttacccagcta

SEQ ID NO: 332365 - DNA, 25 bp, Rattus norvegicus
gagaaggttgtctcttacccagcta

SEQ ID NO: 332366 - DNA, 25 bp, Rattus norvegicus
gagaaggttttcacgctcagaccag

SEQ ID NO: 332367 - DNA, 25 bp, Rattus norvegicus
gagaaggttttctcgctcagaccag

SEQ ID NO: 332368 - DNA, 25 bp, Rattus norvegicus
gagaagtaaacactcctactaagga

SEQ ID NO: 332369 - DNA, 25 bp, Rattus norvegicus
gagaagtaaacagtcctactaagga

SEQ ID NO: 332370 - DNA, 25 bp, Rattus norvegicus
gagaagtaacttattcctttcagtg

SEQ ID NO: 332371 - DNA, 25 bp, Rattus norvegicus
gagaagtaactttttcctttcagtg

SEQ ID NO: 332372 - DNA, 25 bp, Rattus norvegicus
gagaagtacctgcaaggcacgctgt

SEQ ID NO: 332373 - DNA, 25 bp, Rattus norvegicus
gagaagtacctggaaggcacgctgt

SEQ ID NO: 332374 - DNA, 25 bp, Rattus norvegicus
gagaagtactacacgcgcctgggta

SEQ ID NO: 332375 - DNA, 25 bp, Rattus norvegicus
gagaagtactactcgcgcctgggta

SEQ ID NO: 332376 - DNA, 25 bp, Rattus norvegicus
gagaagtactgtaagaggccccggt

SEQ ID NO: 332377 - DNA, 25 bp, Rattus norvegicus
gagaagtactgttagaggccccggt

SEQ ID NO: 332378 - DNA, 25 bp, Rattus norvegicus
gagaagtacttcagaagcatcttga

SEQ ID NO: 332379 - DNA, 25 bp, Rattus norvegicus
gagaagtacttctgaagcatcttga

SEQ ID NO: 332380 - DNA, 25 bp, Rattus norvegicus
gagaagtatattctccatccccagc

SEQ ID NO: 332381 - DNA, 25 bp, Rattus norvegicus
gagaagtatattgtccatccccagc

SEQ ID NO: 332382 - DNA, 25 bp, Rattus norvegicus
gagaagtatcctatatcctacaaga

SEQ ID NO: 332383 - DNA, 25 bp, Rattus norvegicus
gagaagtatcctttatcctacaaga

SEQ ID NO: 332384 - DNA, 25 bp, Rattus norvegicus
gagaagtatctgacactggctcaca

SEQ ID NO: 332385 - DNA, 25 bp, Rattus norvegicus
gagaagtatctgtcactggctcaca

SEQ ID NO: 332386 - DNA, 25 bp, Rattus norvegicus
gagaagtatgccaagtacctgcccc

SEQ ID NO: 332387 - DNA, 25 bp, Rattus norvegicus
gagaagtatgcctagtacctgcccc

SEQ ID NO: 332388 - DNA, 25 bp, Rattus norvegicus
gagaagtatgctcaaccccaagaga

SEQ ID NO: 332389 - DNA, 25 bp, Rattus norvegicus
gagaagtatgctgaaccccaagaga

SEQ ID NO: 332390 - DNA, 25 bp, Rattus norvegicus
gagaagtatttcctaaccaacatat

SEQ ID NO: 332391 - DNA, 25 bp, Rattus norvegicus
gagaagtatttcgtaaccaacatat

SEQ ID NO: 332392 - DNA, 25 bp, Rattus norvegicus
gagaagtcacggacctggactcact

SEQ ID NO: 332393 - DNA, 25 bp, Rattus norvegicus
gagaagtcacggtcctggactcact

SEQ ID NO: 332394 - DNA, 25 bp, Rattus norvegicus
gagaagtcagacagccaggttatac

SEQ ID NO: 332395 - DNA, 25 bp, Rattus norvegicus
gagaagtcagactgccaggttatac

SEQ ID NO: 332396 - DNA, 25 bp, Rattus norvegicus
gagaagtcagttcccactttaatat

SEQ ID NO: 332397 - DNA, 25 bp, Rattus norvegicus
gagaagtcagttgccactttaatat

SEQ ID NO: 332398 - DNA, 25 bp, Rattus norvegicus
gagaagtccagcatgatccgcaagt

SEQ ID NO: 332399 - DNA, 25 bp, Rattus norvegicus
gagaagtccagccacctgacaggca

SEQ ID NO: 332400 - DNA, 25 bp, Rattus norvegicus
gagaagtccagcgacctgacaggca

SEQ ID NO: 332401 - DNA, 25 bp, Rattus norvegicus
gagaagtccagcttgatccgcaagt

SEQ ID NO: 332402 - DNA, 25 bp, Rattus norvegicus
gagaagtccaggactgtccatgcat

SEQ ID NO: 332403 - DNA, 25 bp, Rattus norvegicus
gagaagtccaggtctgtccatgcat

SEQ ID NO: 332404 - DNA, 25 bp, Rattus norvegicus
gagaagtcccaacagcagcatccat

SEQ ID NO: 332405 - DNA, 25 bp, Rattus norvegicus
gagaagtcccaagagcagcatccat

SEQ ID NO: 332406 - DNA, 25 bp, Rattus norvegicus
gagaagtcctccagcatggaaacca

SEQ ID NO: 332407 - DNA, 25 bp, Rattus norvegicus
gagaagtcctcctgcatggaaacca

SEQ ID NO: 332408 - DNA, 25 bp, Rattus norvegicus
gagaagtcgggcagcttccaccttc

SEQ ID NO: 332409 - DNA, 25 bp, Rattus norvegicus
gagaagtcgggctgcttccaccttc

SEQ ID NO: 332410 - DNA, 25 bp, Rattus norvegicus
gagaagtcgtggaactaagggaact

SEQ ID NO: 332411 - DNA, 25 bp, Rattus norvegicus
gagaagtcgtggtactaagggaact

SEQ ID NO: 332412 - DNA, 25 bp, Rattus norvegicus
gagaagtctcgtatccctcggagta

SEQ ID NO: 332413 - DNA, 25 bp, Rattus norvegicus
gagaagtctcgtttccctcggagta

SEQ ID NO: 332414 - DNA, 25 bp, Rattus norvegicus
gagaagtctctccatttattttgaa

SEQ ID NO: 332415 - DNA, 25 bp, Rattus norvegicus
gagaagtctctcgatttattttgaa

SEQ ID NO: 332416 - DNA, 25 bp, Rattus norvegicus
gagaagtctcttctcaatccatgga

SEQ ID NO: 332417 - DNA, 25 bp, Rattus norvegicus
gagaagtctcttgtcaatccatgga

SEQ ID NO: 332418 - DNA, 25 bp, Rattus norvegicus
gagaagtctgacaatatccggaaga

SEQ ID NO: 332419 - DNA, 25 bp, Rattus norvegicus
gagaagtctgactatatccggaaga

SEQ ID NO: 332420 - DNA, 25 bp, Rattus norvegicus
gagaagtcttcaacgcatttgtcat

SEQ ID NO: 332421 - DNA, 25 bp, Rattus norvegicus
gagaagtcttcatcgcatttgtcat

SEQ ID NO: 332422 - DNA, 25 bp, Rattus norvegicus
gagaagtcttgtatcctgagtgaat

SEQ ID NO: 332423 - DNA, 25 bp, Rattus norvegicus
gagaagtcttgtttcctgagtgaat

SEQ ID NO: 332424 - DNA, 25 bp, Rattus norvegicus
gagaagtctttaaaatgcctgcatt

SEQ ID NO: 332425 - DNA, 25 bp, Rattus norvegicus
gagaagtctttataatgcctgcatt

SEQ ID NO: 332426 - DNA, 25 bp, Rattus norvegicus
gagaagtctttgacgcttggagaca

SEQ ID NO: 332427 - DNA, 25 bp, Rattus norvegicus
gagaagtctttgtcgcttggagaca

SEQ ID NO: 332428 - DNA, 25 bp, Rattus norvegicus
gagaagtgaaccaacgctcttacac

SEQ ID NO: 332429 - DNA, 25 bp, Rattus norvegicus
gagaagtgaacctacgctcttacac

SEQ ID NO: 332430 - DNA, 25 bp, Rattus norvegicus
gagaagtgcactaagccctaaaggc

SEQ ID NO: 332431 - DNA, 25 bp, Rattus norvegicus
gagaagtgcacttagccctaaaggc

SEQ ID NO: 332432 - DNA, 25 bp, Rattus norvegicus
gagaagtgctctatgaagcctccac

SEQ ID NO: 332433 - DNA, 25 bp, Rattus norvegicus
gagaagtgctctttgaagcctccac

SEQ ID NO: 332434 - DNA, 25 bp, Rattus norvegicus
gagaagtgctgcagcttccagttca

SEQ ID NO: 332435 - DNA, 25 bp, Rattus norvegicus
gagaagtgctgctgcttccagttca

SEQ ID NO: 332436 - DNA, 25 bp, Rattus norvegicus
gagaagtggcctcacctatgatctt

SEQ ID NO: 332437 - DNA, 25 bp, Rattus norvegicus
gagaagtggcctgacctatgatctt

SEQ ID NO: 332438 - DNA, 25 bp, Rattus norvegicus
gagaagtggtttaagcatcggcaga

SEQ ID NO: 332439 - DNA, 25 bp, Rattus norvegicus
gagaagtggttttagcatcggcaga

SEQ ID NO: 332440 - DNA, 25 bp, Rattus norvegicus
gagaagtgtcgaatgtgccaaattt

SEQ ID NO: 332441 - DNA, 25 bp, Rattus norvegicus
gagaagtgtcgattgtgccaaattt

SEQ ID NO: 332442 - DNA, 25 bp, Rattus norvegicus
gagaagtgtgctaggagccctctac

SEQ ID NO: 332443 - DNA, 25 bp, Rattus norvegicus
gagaagtgtgcttggagccctctac

SEQ ID NO: 332444 - DNA, 25 bp, Rattus norvegicus
gagaagtgtggcaagcccctactga

SEQ ID NO: 332445 - DNA, 25 bp, Rattus norvegicus
gagaagtgtggctagcccctactga

SEQ ID NO: 332446 - DNA, 25 bp, Rattus norvegicus
gagaagttaattccctcttactgtc

SEQ ID NO: 332447 - DNA, 25 bp, Rattus norvegicus
gagaagttaattgcctcttactgtc

SEQ ID NO: 332448 - DNA, 25 bp, Rattus norvegicus
gagaagttactccagtcagaagaac

SEQ ID NO: 332449 - DNA, 25 bp, Rattus norvegicus
gagaagttactcgagtcagaagaac

SEQ ID NO: 332450 - DNA, 25 bp, Rattus norvegicus
gagaagttcacacttaggtgccaat

SEQ ID NO: 332451 - DNA, 25 bp, Rattus norvegicus
gagaagttcacagttaggtgccaat

SEQ ID NO: 332452 - DNA, 25 bp, Rattus norvegicus
gagaagttcatccacaaaccatcct

SEQ ID NO: 332453 - DNA, 25 bp, Rattus norvegicus
gagaagttcatcgacaaaccatcct

SEQ ID NO: 332454 - DNA, 25 bp, Rattus norvegicus
gagaagttccaccaaagcccactgt

SEQ ID NO: 332455 - DNA, 25 bp, Rattus norvegicus
gagaagttccacgaaagcccactgt

SEQ ID NO: 332456 - DNA, 25 bp, Rattus norvegicus
gagaagttcccaaatgggctccctc

SEQ ID NO: 332457 - DNA, 25 bp, Rattus norvegicus
gagaagttcccatatgggctccctc

SEQ ID NO: 332458 - DNA, 25 bp, Rattus norvegicus
gagaagttccctcagagacgtttga

SEQ ID NO: 332459 - DNA, 25 bp, Rattus norvegicus
gagaagttccctcgcaagctctgct

SEQ ID NO: 332460 - DNA, 25 bp, Rattus norvegicus
gagaagttccctgagagacgtttga

SEQ ID NO: 332461 - DNA, 25 bp, Rattus norvegicus
gagaagttccctggcaagctctgct

SEQ ID NO: 332462 - DNA, 25 bp, Rattus norvegicus
gagaagttccgtactgaggctccca

SEQ ID NO: 332463 - DNA, 25 bp, Rattus norvegicus
gagaagttccgttctgaggctccca

SEQ ID NO: 332464 - DNA, 25 bp, Rattus norvegicus
gagaagttctcaccccttagagcta

SEQ ID NO: 332465 - DNA, 25 bp, Rattus norvegicus
gagaagttctcagcccttagagcta

SEQ ID NO: 332466 - DNA, 25 bp, Rattus norvegicus
gagaagttgattcccagtcctatgg

SEQ ID NO: 332467 - DNA, 25 bp, Rattus norvegicus
gagaagttgattgccagtcctatgg

SEQ ID NO: 332468 - DNA, 25 bp, Rattus norvegicus
gagaagttggccagactgcacttca

SEQ ID NO: 332469 - DNA, 25 bp, Rattus norvegicus
gagaagttggcctgactgcacttca

SEQ ID NO: 332470 - DNA, 25 bp, Rattus norvegicus
gagaagttgtctccagaggttgaaa

SEQ ID NO: 332471 - DNA, 25 bp, Rattus norvegicus
gagaagttgtctgcagaggttgaaa

SEQ ID NO: 332472 - DNA, 25 bp, Rattus norvegicus
gagaagttgtgtataatccttgcga

SEQ ID NO: 332473 - DNA, 25 bp, Rattus norvegicus
gagaagttgtgtttaatccttgcga

SEQ ID NO: 332474 - DNA, 25 bp, Rattus norvegicus
gagaagtttattctgccattttgaa

SEQ ID NO: 332475 - DNA, 25 bp, Rattus norvegicus
gagaagtttattgtgccattttgaa

SEQ ID NO: 332476 - DNA, 25 bp, Rattus norvegicus
gagaagtttcagacagtagcaatca

SEQ ID NO: 332477 - DNA, 25 bp, Rattus norvegicus
gagaagtttcagtcagtagcaatca

SEQ ID NO: 332478 - DNA, 25 bp, Rattus norvegicus
gagaagtttctcagctgtaacagtt

SEQ ID NO: 332479 - DNA, 25 bp, Rattus norvegicus
gagaagtttctctgctgtaacagtt

SEQ ID NO: 332480 - DNA, 25 bp, Rattus norvegicus
gagaagtttcttatgggtcacacaa

SEQ ID NO: 332481 - DNA, 25 bp, Rattus norvegicus
gagaagtttcttttgggtcacacaa

SEQ ID NO: 332482 - DNA, 25 bp, Rattus norvegicus
gagaagtttgccctgggagcccttt

SEQ ID NO: 332483 - DNA, 25 bp, Rattus norvegicus
gagaagtttgccgtgggagcccttt

SEQ ID NO: 332484 - DNA, 25 bp, Rattus norvegicus
gagaagtttgtgcaaccctgccgct

SEQ ID NO: 332485 - DNA, 25 bp, Rattus norvegicus
gagaagtttgtggaaccctgccgct

SEQ ID NO: 332486 - DNA, 25 bp, Rattus norvegicus
gagaagtttttcatctgtttcctgc

SEQ ID NO: 332487 - DNA, 25 bp, Rattus norvegicus
gagaagtttttcttctgtttcctgc

SEQ ID NO: 332488 - DNA, 25 bp, Rattus norvegicus
gagaataaatatcccaacaggtttt

SEQ ID NO: 332489 - DNA, 25 bp, Rattus norvegicus
gagaataaatatgccaacaggtttt

SEQ ID NO: 332490 - DNA, 25 bp, Rattus norvegicus
gagaataaccatactttctatttca

SEQ ID NO: 332491 - DNA, 25 bp, Rattus norvegicus
gagaataaccatcgaagcctccctt

SEQ ID NO: 332492 - DNA, 25 bp, Rattus norvegicus
gagaataaccatggaagcctccctt

SEQ ID NO: 332493 - DNA, 25 bp, Rattus norvegicus
gagaataaccattctttctatttca

SEQ ID NO: 332494 - DNA, 25 bp, Rattus norvegicus
gagaataactaaccagcaactctgt

SEQ ID NO: 332495 - DNA, 25 bp, Rattus norvegicus
gagaataactaagcagcaactctgt

SEQ ID NO: 332496 - DNA, 25 bp, Rattus norvegicus
gagaataactctcattgccaccctg

SEQ ID NO: 332497 - DNA, 25 bp, Rattus norvegicus
gagaataactctgattgccaccctg

SEQ ID NO: 332498 - DNA, 25 bp, Rattus norvegicus
gagaataagatcactccactcctgc

SEQ ID NO: 332499 - DNA, 25 bp, Rattus norvegicus
gagaataagatctctccactcctgc

SEQ ID NO: 332500 - DNA, 25 bp, Rattus norvegicus
gagaataaggcacccatctgcttgc

SEQ ID NO: 332501 - DNA, 25 bp, Rattus norvegicus
gagaataaggcagccatctgcttgc

SEQ ID NO: 332502 - DNA, 25 bp, Rattus norvegicus
gagaataaggtaaactgggcccaga

SEQ ID NO: 332503 - DNA, 25 bp, Rattus norvegicus
gagaataaggtatactgggcccaga

SEQ ID NO: 332504 - DNA, 25 bp, Rattus norvegicus
gagaataagtcaagtgcctcttaaa

SEQ ID NO: 332505 - DNA, 25 bp, Rattus norvegicus
gagaataagtcatgtgcctcttaaa

SEQ ID NO: 332506 - DNA, 25 bp, Rattus norvegicus
gagaataatcctccaagtccctaga

SEQ ID NO: 332507 - DNA, 25 bp, Rattus norvegicus
gagaataatcctgcaagtccctaga

SEQ ID NO: 332508 - DNA, 25 bp, Rattus norvegicus
gagaatacaagtcgtgtcctcaccc

SEQ ID NO: 332509 - DNA, 25 bp, Rattus norvegicus
gagaatacaagtggtgtcctcaccc

SEQ ID NO: 332510 - DNA, 25 bp, Rattus norvegicus
gagaatacacaacaccacatcctgg

SEQ ID NO: 332511 - DNA, 25 bp, Rattus norvegicus
gagaatacacaagaccacatcctgg

SEQ ID NO: 332512 - DNA, 25 bp, Rattus norvegicus
gagaatacacacctaaccacagaga

SEQ ID NO: 332513 - DNA, 25 bp, Rattus norvegicus
gagaatacacacgtaaccacagaga

SEQ ID NO: 332514 - DNA, 25 bp, Rattus norvegicus
gagaatacacagagccatcaacgac

SEQ ID NO: 332515 - DNA, 25 bp, Rattus norvegicus
gagaatacacagtgccatcaacgac

SEQ ID NO: 332516 - DNA, 25 bp, Rattus norvegicus
gagaatacacatcgtcctctgggag

SEQ ID NO: 332517 - DNA, 25 bp, Rattus norvegicus
gagaatacacatggtcctctgggag

SEQ ID NO: 332518 - DNA, 25 bp, Rattus norvegicus
gagaatacagaacccaagccacagc

SEQ ID NO: 332519 - DNA, 25 bp, Rattus norvegicus
gagaatacagaagccaagccacagc

SEQ ID NO: 332520 - DNA, 25 bp, Rattus norvegicus
gagaataccacaccagacacttttc

SEQ ID NO: 332521 - DNA, 25 bp, Rattus norvegicus
gagaataccacagcagacacttttc

SEQ ID NO: 332522 - DNA, 25 bp, Rattus norvegicus
gagaataccgtcatgctgcaaagcc

SEQ ID NO: 332523 - DNA, 25 bp, Rattus norvegicus
gagaataccgtcttgctgcaaagcc

SEQ ID NO: 332524 - DNA, 25 bp, Rattus norvegicus
gagaatacgagtcccacgcgtccaa

SEQ ID NO: 332525 - DNA, 25 bp, Rattus norvegicus
gagaatacgagtgccacgcgtccaa

SEQ ID NO: 332526 - DNA, 25 bp, Rattus norvegicus
gagaatagccagacactttttgact

SEQ ID NO: 332527 - DNA, 25 bp, Rattus norvegicus
gagaatagccagtcactttttgact

SEQ ID NO: 332528 - DNA, 25 bp, Rattus norvegicus
gagaatagccttcatgctgtggcct

SEQ ID NO: 332529 - DNA, 25 bp, Rattus norvegicus
gagaatagccttcttccagacacag

SEQ ID NO: 332530 - DNA, 25 bp, Rattus norvegicus
gagaatagccttgatgctgtggcct

SEQ ID NO: 332531 - DNA, 25 bp, Rattus norvegicus
gagaatagccttgttccagacacag

SEQ ID NO: 332532 - DNA, 25 bp, Rattus norvegicus
gagaatagcgggatagatggcaaac

SEQ ID NO: 332533 - DNA, 25 bp, Rattus norvegicus
gagaatagcgggttagatggcaaac

SEQ ID NO: 332534 - DNA, 25 bp, Rattus norvegicus
gagaatagcttcatgacctctttct

SEQ ID NO: 332535 - DNA, 25 bp, Rattus norvegicus
gagaatagcttcttgacctctttct

SEQ ID NO: 332536 - DNA, 25 bp, Rattus norvegicus
gagaatagggttctgcgtgtccttc

SEQ ID NO: 332537 - DNA, 25 bp, Rattus norvegicus
gagaatagggttgtgcgtgtccttc

SEQ ID NO: 332538 - DNA, 25 bp, Rattus norvegicus
gagaatagtttcctgctttaagcaa

SEQ ID NO: 332539 - DNA, 25 bp, Rattus norvegicus
gagaatagtttcgtgctttaagcaa

SEQ ID NO: 332540 - DNA, 25 bp, Rattus norvegicus
gagaatatagtcatttttactgtgg

SEQ ID NO: 332541 - DNA, 25 bp, Rattus norvegicus
gagaatatagtcctgcacacttgca

SEQ ID NO: 332542 - DNA, 25 bp, Rattus norvegicus
gagaatatagtcgtgcacacttgca

SEQ ID NO: 332543 - DNA, 25 bp, Rattus norvegicus
gagaatatagtcttttttactgtgg

SEQ ID NO: 332544 - DNA, 25 bp, Rattus norvegicus
gagaatatctctccgaatgccctgc

SEQ ID NO: 332545 - DNA, 25 bp, Rattus norvegicus
gagaatatctctgcgaatgccctgc

SEQ ID NO: 332546 - DNA, 25 bp, Rattus norvegicus
gagaatatgaataggcctggtaccc

SEQ ID NO: 332547 - DNA, 25 bp, Rattus norvegicus
gagaatatgaattggcctggtaccc

SEQ ID NO: 332548 - DNA, 25 bp, Rattus norvegicus
gagaatatgacgctctgctgccctg

SEQ ID NO: 332549 - DNA, 25 bp, Rattus norvegicus
gagaatatgacggtctgctgccctg

SEQ ID NO: 332550 - DNA, 25 bp, Rattus norvegicus
gagaatatgcccacttgtcacaggc

SEQ ID NO: 332551 - DNA, 25 bp, Rattus norvegicus
gagaatatgccctcttgtcacaggc

SEQ ID NO: 332552 - DNA, 25 bp, Rattus norvegicus
gagaatatgtgcctagtcttgctat

SEQ ID NO: 332553 - DNA, 25 bp, Rattus norvegicus
gagaatatgtgcgtagtcttgctat

SEQ ID NO: 332554 - DNA, 25 bp, Rattus norvegicus
gagaatattcctctcgtgatcacaa

SEQ ID NO: 332555 - DNA, 25 bp, Rattus norvegicus
gagaatattcctgtcgtgatcacaa

SEQ ID NO: 332556 - DNA, 25 bp, Rattus norvegicus
gagaatattgttcttgcctaactta

SEQ ID NO: 332557 - DNA, 25 bp, Rattus norvegicus
gagaatattgttgttgcctaactta

SEQ ID NO: 332558 - DNA, 25 bp, Rattus norvegicus
gagaatattttcataaactcctggg

SEQ ID NO: 332559 - DNA, 25 bp, Rattus norvegicus
gagaatattttcttaaactcctggg

SEQ ID NO: 332560 - DNA, 25 bp, Rattus norvegicus
gagaatcaaactatggcgacgccga

SEQ ID NO: 332561 - DNA, 25 bp, Rattus norvegicus
gagaatcaaactttggcgacgccga

SEQ ID NO: 332562 - DNA, 25 bp, Rattus norvegicus
gagaatcaacgcattcatcgagaaa

SEQ ID NO: 332563 - DNA, 25 bp, Rattus norvegicus
gagaatcaacgctttcatcgagaaa

SEQ ID NO: 332564 - DNA, 25 bp, Rattus norvegicus
gagaatcaactaaacattgtcacta

SEQ ID NO: 332565 - DNA, 25 bp, Rattus norvegicus
gagaatcaactatacattgtcacta

SEQ ID NO: 332566 - DNA, 25 bp, Rattus norvegicus
gagaatcaagagcctcctgccacct

SEQ ID NO: 332567 - DNA, 25 bp, Rattus norvegicus
gagaatcaagaggctcctgccacct

SEQ ID NO: 332568 - DNA, 25 bp, Rattus norvegicus
gagaatcacccaacagtacttcgct

SEQ ID NO: 332569 - DNA, 25 bp, Rattus norvegicus
gagaatcacccatcagtacttcgct

SEQ ID NO: 332570 - DNA, 25 bp, Rattus norvegicus
gagaatcacccgactcctaatttta

SEQ ID NO: 332571 - DNA, 25 bp, Rattus norvegicus
gagaatcacccgtctcctaatttta

SEQ ID NO: 332572 - DNA, 25 bp, Rattus norvegicus
gagaatcactctctgttaacataag

SEQ ID NO: 332573 - DNA, 25 bp, Rattus norvegicus
gagaatcactctgtgttaacataag

SEQ ID NO: 332574 - DNA, 25 bp, Rattus norvegicus
gagaatcactgtacccagttttctt

SEQ ID NO: 332575 - DNA, 25 bp, Rattus norvegicus
gagaatcactgtatattcaccatga

SEQ ID NO: 332576 - DNA, 25 bp, Rattus norvegicus
gagaatcactgttcccagttttctt

SEQ ID NO: 332577 - DNA, 25 bp, Rattus norvegicus
gagaatcactgtttattcaccatga

SEQ ID NO: 332578 - DNA, 25 bp, Rattus norvegicus
gagaatcacttgctggcagacacat

SEQ ID NO: 332579 - DNA, 25 bp, Rattus norvegicus
gagaatcacttggtggcagacacat

SEQ ID NO: 332580 - DNA, 25 bp, Rattus norvegicus
gagaatcagatcaccatccgggcag

SEQ ID NO: 332581 - DNA, 25 bp, Rattus norvegicus
gagaatcagatctccatccgggcag

SEQ ID NO: 332582 - DNA, 25 bp, Rattus norvegicus
gagaatcagcctcccactaatggac

SEQ ID NO: 332583 - DNA, 25 bp, Rattus norvegicus
gagaatcagcctgccactaatggac

SEQ ID NO: 332584 - DNA, 25 bp, Rattus norvegicus
gagaatcaggagagcgccccttgca

SEQ ID NO: 332585 - DNA, 25 bp, Rattus norvegicus
gagaatcaggagtgcgccccttgca

SEQ ID NO: 332586 - DNA, 25 bp, Rattus norvegicus
gagaatcagggcacctacaggctca

SEQ ID NO: 332587 - DNA, 25 bp, Rattus norvegicus
gagaatcagggctcctacaggctca

SEQ ID NO: 332588 - DNA, 25 bp, Rattus norvegicus
gagaatcaggtgctggagctccact

SEQ ID NO: 332589 - DNA, 25 bp, Rattus norvegicus
gagaatcaggtggtggagctccact

SEQ ID NO: 332590 - DNA, 25 bp, Rattus norvegicus
gagaatcagtatagggagtcccttg

SEQ ID NO: 332591 - DNA, 25 bp, Rattus norvegicus
gagaatcagtattgggagtcccttg

SEQ ID NO: 332592 - DNA, 25 bp, Rattus norvegicus
gagaatcagtgtacccattttccag

SEQ ID NO: 332593 - DNA, 25 bp, Rattus norvegicus
gagaatcagtgttcccattttccag

SEQ ID NO: 332594 - DNA, 25 bp, Rattus norvegicus
gagaatccacgacttgtaagaaaat

SEQ ID NO: 332595 - DNA, 25 bp, Rattus norvegicus
gagaatccacgagttgtaagaaaat

SEQ ID NO: 332596 - DNA, 25 bp, Rattus norvegicus
gagaatccactgacccttagataat

SEQ ID NO: 332597 - DNA, 25 bp, Rattus norvegicus
gagaatccactgtcccttagataat

SEQ ID NO: 332598 - DNA, 25 bp, Rattus norvegicus
gagaatccaggcactgctgaaggaa

SEQ ID NO: 332599 - DNA, 25 bp, Rattus norvegicus
gagaatccaggctctgctgaaggaa

SEQ ID NO: 332600 - DNA, 25 bp, Rattus norvegicus
gagaatccatgaaagactgtccaat

SEQ ID NO: 332601 - DNA, 25 bp, Rattus norvegicus
gagaatccatgatagactgtccaat

SEQ ID NO: 332602 - DNA, 25 bp, Rattus norvegicus
gagaatccccaaagggcgggccatg

SEQ ID NO: 332603 - DNA, 25 bp, Rattus norvegicus
gagaatccccaatgggcgggccatg

SEQ ID NO: 332604 - DNA, 25 bp, Rattus norvegicus
gagaatccctgcagaggcgctactc

SEQ ID NO: 332605 - DNA, 25 bp, Rattus norvegicus
gagaatccctgctgaggcgctactc

SEQ ID NO: 332606 - DNA, 25 bp, Rattus norvegicus
gagaatcctatgcttatccactgta

SEQ ID NO: 332607 - DNA, 25 bp, Rattus norvegicus
gagaatcctatggttatccactgta

SEQ ID NO: 332608 - DNA, 25 bp, Rattus norvegicus
gagaatcctcagcatgtgaccagtg

SEQ ID NO: 332609 - DNA, 25 bp, Rattus norvegicus
gagaatcctcaggatgtgaccagtg

SEQ ID NO: 332610 - DNA, 25 bp, Rattus norvegicus
gagaatcctcatcccgtgttttgtc

SEQ ID NO: 332611 - DNA, 25 bp, Rattus norvegicus
gagaatcctcatgccgtgttttgtc

SEQ ID NO: 332612 - DNA, 25 bp, Rattus norvegicus
gagaatcctgtcattaccacagtaa

SEQ ID NO: 332613 - DNA, 25 bp, Rattus norvegicus
gagaatcctgtctttaccacagtaa

SEQ ID NO: 332614 - DNA, 25 bp, Rattus norvegicus
gagaatccttccaatagcaacgccc

SEQ ID NO: 332615 - DNA, 25 bp, Rattus norvegicus
gagaatccttcctatagcaacgccc

SEQ ID NO: 332616 - DNA, 25 bp, Rattus norvegicus
gagaatccttggaaccgtcaaccat

SEQ ID NO: 332617 - DNA, 25 bp, Rattus norvegicus
gagaatccttggtaccgtcaaccat

SEQ ID NO: 332618 - DNA, 25 bp, Rattus norvegicus
gagaatcctttgctcttttcattgg

SEQ ID NO: 332619 - DNA, 25 bp, Rattus norvegicus
gagaatcctttggtcttttcattgg

SEQ ID NO: 332620 - DNA, 25 bp, Rattus norvegicus
gagaatcgcattctgctgtacgcgt

SEQ ID NO: 332621 - DNA, 25 bp, Rattus norvegicus
gagaatcgcattgtgctgtacgcgt

SEQ ID NO: 332622 - DNA, 25 bp, Rattus norvegicus
gagaatctagaacctttgtagttgg

SEQ ID NO: 332623 - DNA, 25 bp, Rattus norvegicus
gagaatctagaagctttgtagttgg

SEQ ID NO: 332624 - DNA, 25 bp, Rattus norvegicus
gagaatctatgcagtctacgctgca

SEQ ID NO: 332625 - DNA, 25 bp, Rattus norvegicus
gagaatctatgctgtctacgctgca

SEQ ID NO: 332626 - DNA, 25 bp, Rattus norvegicus
gagaatctcagactcatgacctttt

SEQ ID NO: 332627 - DNA, 25 bp, Rattus norvegicus
gagaatctcagagtcatgacctttt

SEQ ID NO: 332628 - DNA, 25 bp, Rattus norvegicus
gagaatctcagtcttcaggtcaaac

SEQ ID NO: 332629 - DNA, 25 bp, Rattus norvegicus
gagaatctcagtgttcaggtcaaac

SEQ ID NO: 332630 - DNA, 25 bp, Rattus norvegicus
gagaatctcctcaatcttaatgtaa

SEQ ID NO: 332631 - DNA, 25 bp, Rattus norvegicus
gagaatctcctctatcttaatgtaa

SEQ ID NO: 332632 - DNA, 25 bp, Rattus norvegicus
gagaatctcgttattaggtatcata

SEQ ID NO: 332633 - DNA, 25 bp, Rattus norvegicus
gagaatctcgtttttaggtatcata

SEQ ID NO: 332634 - DNA, 25 bp, Rattus norvegicus
gagaatctcttaacatctgcctgag

SEQ ID NO: 332635 - DNA, 25 bp, Rattus norvegicus
gagaatctcttatcatctgcctgag

SEQ ID NO: 332636 - DNA, 25 bp, Rattus norvegicus
gagaatctgagtatggtggctcatg

SEQ ID NO: 332637 - DNA, 25 bp, Rattus norvegicus
gagaatctgagtttggtggctcatg

SEQ ID NO: 332638 - DNA, 25 bp, Rattus norvegicus
gagaatctggccaggattgacctct

SEQ ID NO: 332639 - DNA, 25 bp, Rattus norvegicus
gagaatctggcctggattgacctct

SEQ ID NO: 332640 - DNA, 25 bp, Rattus norvegicus
gagaatctgtagatcaagggcagcc

SEQ ID NO: 332641 - DNA, 25 bp, Rattus norvegicus
gagaatctgtagttcaagggcagcc

SEQ ID NO: 332642 - DNA, 25 bp, Rattus norvegicus
gagaatctgtatctactgcctttat

SEQ ID NO: 332643 - DNA, 25 bp, Rattus norvegicus
gagaatctgtatgtactgcctttat

SEQ ID NO: 332644 - DNA, 25 bp, Rattus norvegicus
gagaatctgtcgcttgaggccctga

SEQ ID NO: 332645 - DNA, 25 bp, Rattus norvegicus
gagaatctgtcggttgaggccctga

SEQ ID NO: 332646 - DNA, 25 bp, Rattus norvegicus
gagaatctgtctcctacctgttcag

SEQ ID NO: 332647 - DNA, 25 bp, Rattus norvegicus
gagaatctgtctgctacctgttcag

SEQ ID NO: 332648 - DNA, 25 bp, Rattus norvegicus
gagaatctgtgtacatttcccatct

SEQ ID NO: 332649 - DNA, 25 bp, Rattus norvegicus
gagaatctgtgttcatttcccatct

SEQ ID NO: 332650 - DNA, 25 bp, Rattus norvegicus
gagaatcttcccaaccgaagcattt

SEQ ID NO: 332651 - DNA, 25 bp, Rattus norvegicus
gagaatcttccctaccgaagcattt

SEQ ID NO: 332652 - DNA, 25 bp, Rattus norvegicus
gagaatcttgccactgagcctttgt

SEQ ID NO: 332653 - DNA, 25 bp, Rattus norvegicus
gagaatcttgcctctgagcctttgt

SEQ ID NO: 332654 - DNA, 25 bp, Rattus norvegicus
gagaatcttggacacttcatcatgt

SEQ ID NO: 332655 - DNA, 25 bp, Rattus norvegicus
gagaatcttggagacttcatcatgt

SEQ ID NO: 332656 - DNA, 25 bp, Rattus norvegicus
gagaatctttctagcccatggtact

SEQ ID NO: 332657 - DNA, 25 bp, Rattus norvegicus
gagaatctttcttgcccatggtact

SEQ ID NO: 332658 - DNA, 25 bp, Rattus norvegicus
gagaatctttttcgtggtcctctaa

SEQ ID NO: 332659 - DNA, 25 bp, Rattus norvegicus
gagaatctttttggtggtcctctaa

SEQ ID NO: 332660 - DNA, 25 bp, Rattus norvegicus
gagaatgaaactcccacatccttgt

SEQ ID NO: 332661 - DNA, 25 bp, Rattus norvegicus
gagaatgaaactgccacatccttgt

SEQ ID NO: 332662 - DNA, 25 bp, Rattus norvegicus
gagaatgaaatccttaagtccccag

SEQ ID NO: 332663 - DNA, 25 bp, Rattus norvegicus
gagaatgaaatcgttaagtccccag

SEQ ID NO: 332664 - DNA, 25 bp, Rattus norvegicus
gagaatgaacagatcttcctggaga

SEQ ID NO: 332665 - DNA, 25 bp, Rattus norvegicus
gagaatgaacagttcttcctggaga

SEQ ID NO: 332666 - DNA, 25 bp, Rattus norvegicus
gagaatgaacttaacgtcctggctt

SEQ ID NO: 332667 - DNA, 25 bp, Rattus norvegicus
gagaatgaactttacgtcctggctt

SEQ ID NO: 332668 - DNA, 25 bp, Rattus norvegicus
gagaatgacactctcctgtgtacgc

SEQ ID NO: 332669 - DNA, 25 bp, Rattus norvegicus
gagaatgacactgtcctgtgtacgc

SEQ ID NO: 332670 - DNA, 25 bp, Rattus norvegicus
gagaatgacccacagggaccccaat

SEQ ID NO: 332671 - DNA, 25 bp, Rattus norvegicus
gagaatgacccagagggaccccaat

SEQ ID NO: 332672 - DNA, 25 bp, Rattus norvegicus
gagaatgaccctcgcaacgccgagt

SEQ ID NO: 332673 - DNA, 25 bp, Rattus norvegicus
gagaatgaccctggcaacgccgagt

SEQ ID NO: 332674 - DNA, 25 bp, Rattus norvegicus
gagaatgacctgaagccgagaacgc

SEQ ID NO: 332675 - DNA, 25 bp, Rattus norvegicus
gagaatgacctgtagccgagaacgc

SEQ ID NO: 332676 - DNA, 25 bp, Rattus norvegicus
gagaatgactatagcatggcacaga

SEQ ID NO: 332677 - DNA, 25 bp, Rattus norvegicus
gagaatgactattgcatggcacaga

SEQ ID NO: 332678 - DNA, 25 bp, Rattus norvegicus
gagaatgagagtcccctgaagtcct

SEQ ID NO: 332679 - DNA, 25 bp, Rattus norvegicus
gagaatgagagtgccctgaagtcct

SEQ ID NO: 332680 - DNA, 25 bp, Rattus norvegicus
gagaatgagataattatgcacatat

SEQ ID NO: 332681 - DNA, 25 bp, Rattus norvegicus
gagaatgagatatttatgcacatat

SEQ ID NO: 332682 - DNA, 25 bp, Rattus norvegicus
gagaatgagttcagcccagtctgca

SEQ ID NO: 332683 - DNA, 25 bp, Rattus norvegicus
gagaatgagttctgcccagtctgca

SEQ ID NO: 332684 - DNA, 25 bp, Rattus norvegicus
gagaatgcatctaggctgttgtgca

SEQ ID NO: 332685 - DNA, 25 bp, Rattus norvegicus
gagaatgcatcttggctgttgtgca

SEQ ID NO: 332686 - DNA, 25 bp, Rattus norvegicus
gagaatgcattcactttgagcccat

SEQ ID NO: 332687 - DNA, 25 bp, Rattus norvegicus
gagaatgcattctctttgagcccat

SEQ ID NO: 332688 - DNA, 25 bp, Rattus norvegicus
gagaatgccagtccacagcccttct

SEQ ID NO: 332689 - DNA, 25 bp, Rattus norvegicus
gagaatgccagtgcacagcccttct

SEQ ID NO: 332690 - DNA, 25 bp, Rattus norvegicus
gagaatgccattatccacgtggacc

SEQ ID NO: 332691 - DNA, 25 bp, Rattus norvegicus
gagaatgccattttccacgtggacc

SEQ ID NO: 332692 - DNA, 25 bp, Rattus norvegicus
gagaatgccgcgatattgtcttttt

SEQ ID NO: 332693 - DNA, 25 bp, Rattus norvegicus
gagaatgccgcgttattgtcttttt

SEQ ID NO: 332694 - DNA, 25 bp, Rattus norvegicus
gagaatgccttaagcaggaatagca

SEQ ID NO: 332695 - DNA, 25 bp, Rattus norvegicus
gagaatgccttatgcaggaatagca

SEQ ID NO: 332696 - DNA, 25 bp, Rattus norvegicus
gagaatgcggtcagccccatacgga

SEQ ID NO: 332697 - DNA, 25 bp, Rattus norvegicus
gagaatgcggtctgccccatacgga

SEQ ID NO: 332698 - DNA, 25 bp, Rattus norvegicus
gagaatgctcaccaggcaacctaca

SEQ ID NO: 332699 - DNA, 25 bp, Rattus norvegicus
gagaatgctcacgaggcaacctaca

SEQ ID NO: 332700 - DNA, 25 bp, Rattus norvegicus
gagaatgctctcagtattgccagga

SEQ ID NO: 332701 - DNA, 25 bp, Rattus norvegicus
gagaatgctctctgtattgccagga

SEQ ID NO: 332702 - DNA, 25 bp, Rattus norvegicus
gagaatgctgcactttgcaccttag

SEQ ID NO: 332703 - DNA, 25 bp, Rattus norvegicus
gagaatgctgcagtttgcaccttag

SEQ ID NO: 332704 - DNA, 25 bp, Rattus norvegicus
gagaatgctttcctgttcatacttg

SEQ ID NO: 332705 - DNA, 25 bp, Rattus norvegicus
gagaatgctttcgtgttcatacttg

SEQ ID NO: 332706 - DNA, 25 bp, Rattus norvegicus
gagaatggaagccagacctcctccg

SEQ ID NO: 332707 - DNA, 25 bp, Rattus norvegicus
gagaatggaagcgagacctcctccg

SEQ ID NO: 332708 - DNA, 25 bp, Rattus norvegicus
gagaatggaatacctcccttcatta

SEQ ID NO: 332709 - DNA, 25 bp, Rattus norvegicus
gagaatggaatagctcccttcatta

SEQ ID NO: 332710 - DNA, 25 bp, Rattus norvegicus
gagaatggacttcaacattaaaacc

SEQ ID NO: 332711 - DNA, 25 bp, Rattus norvegicus
gagaatggacttgaacattaaaacc

SEQ ID NO: 332712 - DNA, 25 bp, Rattus norvegicus
gagaatggcattacctatagaggtt

SEQ ID NO: 332713 - DNA, 25 bp, Rattus norvegicus
gagaatggcatttcctatagaggtt

SEQ ID NO: 332714 - DNA, 25 bp, Rattus norvegicus
gagaatggccctctctcaccttgtg

SEQ ID NO: 332715 - DNA, 25 bp, Rattus norvegicus
gagaatggccctgtctcaccttgtg

SEQ ID NO: 332716 - DNA, 25 bp, Rattus norvegicus
gagaatggcctacccttctgatggt

SEQ ID NO: 332717 - DNA, 25 bp, Rattus norvegicus
gagaatggcctagccttctgatggt

SEQ ID NO: 332718 - DNA, 25 bp, Rattus norvegicus
gagaatggcctgcagcaggcccaat

SEQ ID NO: 332719 - DNA, 25 bp, Rattus norvegicus
gagaatggcctggagcaggcccaat

SEQ ID NO: 332720 - DNA, 25 bp, Rattus norvegicus
gagaatggccttcagcaaagcccag

SEQ ID NO: 332721 - DNA, 25 bp, Rattus norvegicus
gagaatggccttgagcaaagcccag

SEQ ID NO: 332722 - DNA, 25 bp, Rattus norvegicus
gagaatggcgctctcatcatgggcc

SEQ ID NO: 332723 - DNA, 25 bp, Rattus norvegicus
gagaatggcgctgtcatcatgggcc

SEQ ID NO: 332724 - DNA, 25 bp, Rattus norvegicus
gagaatggctccaggtggtaataat

SEQ ID NO: 332725 - DNA, 25 bp, Rattus norvegicus
gagaatggctcctggtggtaataat

SEQ ID NO: 332726 - DNA, 25 bp, Rattus norvegicus
gagaatggctgtacttcttcaggaa

SEQ ID NO: 332727 - DNA, 25 bp, Rattus norvegicus
gagaatggctgttcttcttcaggaa

SEQ ID NO: 332728 - DNA, 25 bp, Rattus norvegicus
gagaatgggcctagaagcccagaaa

SEQ ID NO: 332729 - DNA, 25 bp, Rattus norvegicus
gagaatgggccttgaagcccagaaa

SEQ ID NO: 332730 - DNA, 25 bp, Rattus norvegicus
gagaatggtactacatccctccacc

SEQ ID NO: 332731 - DNA, 25 bp, Rattus norvegicus
gagaatggtacttcatccctccacc

SEQ ID NO: 332732 - DNA, 25 bp, Rattus norvegicus
gagaatggtcacaacacgtatccct

SEQ ID NO: 332733 - DNA, 25 bp, Rattus norvegicus
gagaatggtcactacacgtatccct

SEQ ID NO: 332734 - DNA, 25 bp, Rattus norvegicus
gagaatggtgagagctgccctacct

SEQ ID NO: 332735 - DNA, 25 bp, Rattus norvegicus
gagaatggtgagtgctgccctacct

SEQ ID NO: 332736 - DNA, 25 bp, Rattus norvegicus
gagaatggttctcccctccttgcca

SEQ ID NO: 332737 - DNA, 25 bp, Rattus norvegicus
gagaatggttctgccctccttgcca

SEQ ID NO: 332738 - DNA, 25 bp, Rattus norvegicus
gagaatgtacagaccattgggcaga

SEQ ID NO: 332739 - DNA, 25 bp, Rattus norvegicus
gagaatgtacagtccattgggcaga

SEQ ID NO: 332740 - DNA, 25 bp, Rattus norvegicus
gagaatgtagaccactgaccacctg

SEQ ID NO: 332741 - DNA, 25 bp, Rattus norvegicus
gagaatgtagacgactgaccacctg

SEQ ID NO: 332742 - DNA, 25 bp, Rattus norvegicus
gagaatgtatgcacctctcactcag

SEQ ID NO: 332743 - DNA, 25 bp, Rattus norvegicus
gagaatgtatgctcctctcactcag

SEQ ID NO: 332744 - DNA, 25 bp, Rattus norvegicus
gagaatgtcagaactcattccggat

SEQ ID NO: 332745 - DNA, 25 bp, Rattus norvegicus
gagaatgtcagatctcattccggat

SEQ ID NO: 332746 - DNA, 25 bp, Rattus norvegicus
gagaatgtccccaagcaatcctgag

SEQ ID NO: 332747 - DNA, 25 bp, Rattus norvegicus
gagaatgtcccctagcaatcctgag

SEQ ID NO: 332748 - DNA, 25 bp, Rattus norvegicus
gagaatgtcctcataggtcgcactc

SEQ ID NO: 332749 - DNA, 25 bp, Rattus norvegicus
gagaatgtcctcttaggtcgcactc

SEQ ID NO: 332750 - DNA, 25 bp, Rattus norvegicus
gagaatgtctagaaggccctccagg

SEQ ID NO: 332751 - DNA, 25 bp, Rattus norvegicus
gagaatgtctagtaggccctccagg

SEQ ID NO: 332752 - DNA, 25 bp, Rattus norvegicus
gagaatgtctcacgagttctgtgat

SEQ ID NO: 332753 - DNA, 25 bp, Rattus norvegicus
gagaatgtctcaggagttctgtgat

SEQ ID NO: 332754 - DNA, 25 bp, Rattus norvegicus
gagaatgtctctaggaattgggcat

SEQ ID NO: 332755 - DNA, 25 bp, Rattus norvegicus
gagaatgtctcttggaattgggcat

SEQ ID NO: 332756 - DNA, 25 bp, Rattus norvegicus
gagaatgtcttacccttttacctct

SEQ ID NO: 332757 - DNA, 25 bp, Rattus norvegicus
gagaatgtcttagccttttacctct

SEQ ID NO: 332758 - DNA, 25 bp, Rattus norvegicus
gagaatgtcttcactggctggctgc

SEQ ID NO: 332759 - DNA, 25 bp, Rattus norvegicus
gagaatgtcttctctggctggctgc

SEQ ID NO: 332760 - DNA, 25 bp, Rattus norvegicus
gagaatgtgaccctcaagactccat

SEQ ID NO: 332761 - DNA, 25 bp, Rattus norvegicus
gagaatgtgaccgtcaagactccat

SEQ ID NO: 332762 - DNA, 25 bp, Rattus norvegicus
gagaatgtgaggatgtccgtgataa

SEQ ID NO: 332763 - DNA, 25 bp, Rattus norvegicus
gagaatgtgaggttgtccgtgataa

SEQ ID NO: 332764 - DNA, 25 bp, Rattus norvegicus
gagaatgtgcaaaccataccaccct

SEQ ID NO: 332765 - DNA, 25 bp, Rattus norvegicus
gagaatgtgcaatccataccaccct

SEQ ID NO: 332766 - DNA, 25 bp, Rattus norvegicus
gagaatgtggttccttcttccttac

SEQ ID NO: 332767 - DNA, 25 bp, Rattus norvegicus
gagaatgtggttgcttcttccttac

SEQ ID NO: 332768 - DNA, 25 bp, Rattus norvegicus
gagaatgtgtccatgtctcactcag

SEQ ID NO: 332769 - DNA, 25 bp, Rattus norvegicus
gagaatgtgtccttgtctcactcag

SEQ ID NO: 332770 - DNA, 25 bp, Rattus norvegicus
gagaatgttcatatggcgctcacag

SEQ ID NO: 332771 - DNA, 25 bp, Rattus norvegicus
gagaatgttcatttggcgctcacag

SEQ ID NO: 332772 - DNA, 25 bp, Rattus norvegicus
gagaatgttcttaattctgctcccc

SEQ ID NO: 332773 - DNA, 25 bp, Rattus norvegicus
gagaatgttcttatccacttaacgc

SEQ ID NO: 332774 - DNA, 25 bp, Rattus norvegicus
gagaatgttcttctcttgtcaacca

SEQ ID NO: 332775 - DNA, 25 bp, Rattus norvegicus
gagaatgttcttgtcttgtcaacca

SEQ ID NO: 332776 - DNA, 25 bp, Rattus norvegicus
gagaatgttctttattctgctcccc

SEQ ID NO: 332777 - DNA, 25 bp, Rattus norvegicus
gagaatgttcttttccacttaacgc

SEQ ID NO: 332778 - DNA, 25 bp, Rattus norvegicus
gagaatgtttctctatctcaaacaa

SEQ ID NO: 332779 - DNA, 25 bp, Rattus norvegicus
gagaatgtttctgtatctcaaacaa

SEQ ID NO: 332780 - DNA, 25 bp, Rattus norvegicus
gagaattaaacaccacttcctgagg

SEQ ID NO: 332781 - DNA, 25 bp, Rattus norvegicus
gagaattaaacagcacttcctgagg

SEQ ID NO: 332782 - DNA, 25 bp, Rattus norvegicus
gagaattaccctcagcctctcagag

SEQ ID NO: 332783 - DNA, 25 bp, Rattus norvegicus
gagaattaccctgagcctctcagag

SEQ ID NO: 332784 - DNA, 25 bp, Rattus norvegicus
gagaattactttctaatcctgctaa

SEQ ID NO: 332785 - DNA, 25 bp, Rattus norvegicus
gagaattactttgtaatcctgctaa

SEQ ID NO: 332786 - DNA, 25 bp, Rattus norvegicus
gagaattagctcctgacccacactg

SEQ ID NO: 332787 - DNA, 25 bp, Rattus norvegicus
gagaattagctcgtgacccacactg

SEQ ID NO: 332788 - DNA, 25 bp, Rattus norvegicus
gagaattatctgcagtaaagttggg

SEQ ID NO: 332789 - DNA, 25 bp, Rattus norvegicus
gagaattatctggagtaaagttggg

SEQ ID NO: 332790 - DNA, 25 bp, Rattus norvegicus
gagaattatcttacaggtcctatgg

SEQ ID NO: 332791 - DNA, 25 bp, Rattus norvegicus
gagaattatcttagtccccgaggat

SEQ ID NO: 332792 - DNA, 25 bp, Rattus norvegicus
gagaattatctttcaggtcctatgg

SEQ ID NO: 332793 - DNA, 25 bp, Rattus norvegicus
gagaattatctttgtccccgaggat

SEQ ID NO: 332794 - DNA, 25 bp, Rattus norvegicus
gagaattcacctaggatgtattcat

SEQ ID NO: 332795 - DNA, 25 bp, Rattus norvegicus
gagaattcaccttggatgtattcat

SEQ ID NO: 332796 - DNA, 25 bp, Rattus norvegicus
gagaattcatgaaacacctgtcaac

SEQ ID NO: 332797 - DNA, 25 bp, Rattus norvegicus
gagaattcatgatacacctgtcaac

SEQ ID NO: 332798 - DNA, 25 bp, Rattus norvegicus
gagaattcatgcatttcgttttaat

SEQ ID NO: 332799 - DNA, 25 bp, Rattus norvegicus
gagaattcatgcttttcgttttaat

SEQ ID NO: 332800 - DNA, 25 bp, Rattus norvegicus
gagaattcatttacagtgccatacg

SEQ ID NO: 332801 - DNA, 25 bp, Rattus norvegicus
gagaattcattttcagtgccatacg

SEQ ID NO: 332802 - DNA, 25 bp, Rattus norvegicus
gagaattccaggcatcacttatttt

SEQ ID NO: 332803 - DNA, 25 bp, Rattus norvegicus
gagaattccagggatcacttatttt

SEQ ID NO: 332804 - DNA, 25 bp, Rattus norvegicus
gagaattccgctacggtggagcagc

SEQ ID NO: 332805 - DNA, 25 bp, Rattus norvegicus
gagaattccgcttcggtggagcagc

SEQ ID NO: 332806 - DNA, 25 bp, Rattus norvegicus
gagaattccgggacatccaaggcaa

SEQ ID NO: 332807 - DNA, 25 bp, Rattus norvegicus
gagaattccgggtcatccaaggcaa

SEQ ID NO: 332808 - DNA, 25 bp, Rattus norvegicus
gagaattcctcccatgctgaaagaa

SEQ ID NO: 332809 - DNA, 25 bp, Rattus norvegicus
gagaattcctccgatgctgaaagaa

SEQ ID NO: 332810 - DNA, 25 bp, Rattus norvegicus
gagaattccttcaccagaggcccag

SEQ ID NO: 332811 - DNA, 25 bp, Rattus norvegicus
gagaattccttctccagaggcccag

SEQ ID NO: 332812 - DNA, 25 bp, Rattus norvegicus
gagaattctaccaagaggtctcctg

SEQ ID NO: 332813 - DNA, 25 bp, Rattus norvegicus
gagaattctacctagaggtctcctg

SEQ ID NO: 332814 - DNA, 25 bp, Rattus norvegicus
gagaattctccaataatgtccccag

SEQ ID NO: 332815 - DNA, 25 bp, Rattus norvegicus
gagaattctccattaatgtccccag

SEQ ID NO: 332816 - DNA, 25 bp, Rattus norvegicus
gagaattctcggcagcctgtccaac

SEQ ID NO: 332817 - DNA, 25 bp, Rattus norvegicus
gagaattctcgggagcctgtccaac

SEQ ID NO: 332818 - DNA, 25 bp, Rattus norvegicus
gagaattcttctcaccaggttttgt

SEQ ID NO: 332819 - DNA, 25 bp, Rattus norvegicus
gagaattcttctgaccaggttttgt

SEQ ID NO: 332820 - DNA, 25 bp, Rattus norvegicus
gagaattgaccgagggctacctaaa

SEQ ID NO: 332821 - DNA, 25 bp, Rattus norvegicus
gagaattgaccgtgggctacctaaa

SEQ ID NO: 332822 - DNA, 25 bp, Rattus norvegicus
gagaattgagtgcactctcctgtcc

SEQ ID NO: 332823 - DNA, 25 bp, Rattus norvegicus
gagaattgagtggactctcctgtcc

SEQ ID NO: 332824 - DNA, 25 bp, Rattus norvegicus
gagaattgatgcattcccatatgat

SEQ ID NO: 332825 - DNA, 25 bp, Rattus norvegicus
gagaattgatgctttcccatatgat

SEQ ID NO: 332826 - DNA, 25 bp, Rattus norvegicus
gagaattgattacccagcgagagct

SEQ ID NO: 332827 - DNA, 25 bp, Rattus norvegicus
gagaattgattagccagcgagagct

SEQ ID NO: 332828 - DNA, 25 bp, Rattus norvegicus
gagaattgcagccagctcatccaga

SEQ ID NO: 332829 - DNA, 25 bp, Rattus norvegicus
gagaattgcagcgagctcatccaga

SEQ ID NO: 332830 - DNA, 25 bp, Rattus norvegicus
gagaattgccacataattggagcat

SEQ ID NO: 332831 - DNA, 25 bp, Rattus norvegicus
gagaattgccacttaattggagcat

SEQ ID NO: 332832 - DNA, 25 bp, Rattus norvegicus
gagaattgcccaagatgtcctgcgg

SEQ ID NO: 332833 - DNA, 25 bp, Rattus norvegicus
gagaattgcccatgatgtcctgcgg

SEQ ID NO: 332834 - DNA, 25 bp, Rattus norvegicus
gagaattgccggatttagcaagaaa

SEQ ID NO: 332835 - DNA, 25 bp, Rattus norvegicus
gagaattgccggttttagcaagaaa

SEQ ID NO: 332836 - DNA, 25 bp, Rattus norvegicus
gagaattgctttcttaacctgtagc

SEQ ID NO: 332837 - DNA, 25 bp, Rattus norvegicus
gagaattgctttgttaacctgtagc

SEQ ID NO: 332838 - DNA, 25 bp, Rattus norvegicus
gagaattggaatcctccacatcctc

SEQ ID NO: 332839 - DNA, 25 bp, Rattus norvegicus
gagaattggaatgctccacatcctc

SEQ ID NO: 332840 - DNA, 25 bp, Rattus norvegicus
gagaattggagacccctttctctgt

SEQ ID NO: 332841 - DNA, 25 bp, Rattus norvegicus
gagaattggagagccctttctctgt

SEQ ID NO: 332842 - DNA, 25 bp, Rattus norvegicus
gagaattgtcagagctcagagcttg

SEQ ID NO: 332843 - DNA, 25 bp, Rattus norvegicus
gagaattgtcagtgctcagagcttg

SEQ ID NO: 332844 - DNA, 25 bp, Rattus norvegicus
gagaatttacatcctgcagccataa

SEQ ID NO: 332845 - DNA, 25 bp, Rattus norvegicus
gagaatttacatgctgcagccataa

SEQ ID NO: 332846 - DNA, 25 bp, Rattus norvegicus
gagaatttcacaatatcagtaaaag

SEQ ID NO: 332847 - DNA, 25 bp, Rattus norvegicus
gagaatttcacattatcagtaaaag

SEQ ID NO: 332848 - DNA, 25 bp, Rattus norvegicus
gagaatttcagtcacaccatttcca

SEQ ID NO: 332849 - DNA, 25 bp, Rattus norvegicus
gagaatttcagtgacaccatttcca

SEQ ID NO: 332850 - DNA, 25 bp, Rattus norvegicus
gagaatttcatcagccattgaggtg

SEQ ID NO: 332851 - DNA, 25 bp, Rattus norvegicus
gagaatttcatctgccattgaggtg

SEQ ID NO: 332852 - DNA, 25 bp, Rattus norvegicus
gagaatttcccaattcaagcgtgtt

SEQ ID NO: 332853 - DNA, 25 bp, Rattus norvegicus
gagaatttcccatttcaagcgtgtt

SEQ ID NO: 332854 - DNA, 25 bp, Rattus norvegicus
gagaatttctcactttttgtgctat

SEQ ID NO: 332855 - DNA, 25 bp, Rattus norvegicus
gagaatttctcagtttttgtgctat

SEQ ID NO: 332856 - DNA, 25 bp, Rattus norvegicus
gagaatttgagcaagcctgggatac

SEQ ID NO: 332857 - DNA, 25 bp, Rattus norvegicus
gagaatttgagctagcctgggatac

SEQ ID NO: 332858 - DNA, 25 bp, Rattus norvegicus
gagaatttgcacacccagtgtttga

SEQ ID NO: 332859 - DNA, 25 bp, Rattus norvegicus
gagaatttgcactcccagtgtttga

SEQ ID NO: 332860 - DNA, 25 bp, Rattus norvegicus
gagaattttaaactgctctgcattt

SEQ ID NO: 332861 - DNA, 25 bp, Rattus norvegicus
gagaattttaaagtgctctgcattt

SEQ ID NO: 332862 - DNA, 25 bp, Rattus norvegicus
gagaattttaagatcccatgccgtt

SEQ ID NO: 332863 - DNA, 25 bp, Rattus norvegicus
gagaattttaagttcccatgccgtt

SEQ ID NO: 332864 - DNA, 25 bp, Rattus norvegicus
gagaattttatgcttcttcccacag

SEQ ID NO: 332865 - DNA, 25 bp, Rattus norvegicus
gagaattttatggttcttcccacag

SEQ ID NO: 332866 - DNA, 25 bp, Rattus norvegicus
gagaattttccaagtaccagggact

SEQ ID NO: 332867 - DNA, 25 bp, Rattus norvegicus
gagaattttccatgtaccagggact

SEQ ID NO: 332868 - DNA, 25 bp, Rattus norvegicus
gagaattttctacactgtactttga

SEQ ID NO: 332869 - DNA, 25 bp, Rattus norvegicus
gagaattttctagactgtactttga

SEQ ID NO: 332870 - DNA, 25 bp, Rattus norvegicus
gagaattttctcactgacttcagtc

SEQ ID NO: 332871 - DNA, 25 bp, Rattus norvegicus
gagaattttctctctgacttcagtc

SEQ ID NO: 332872 - DNA, 25 bp, Rattus norvegicus
gagaattttctgatgcctttgaaca

SEQ ID NO: 332873 - DNA, 25 bp, Rattus norvegicus
gagaattttctgttgcctttgaaca

SEQ ID NO: 332874 - DNA, 25 bp, Rattus norvegicus
gagaattttgctccagtcacgaaag

SEQ ID NO: 332875 - DNA, 25 bp, Rattus norvegicus
gagaattttgctgcagtcacgaaag

SEQ ID NO: 332876 - DNA, 25 bp, Rattus norvegicus
gagaattttgttacacagtgtgctt

SEQ ID NO: 332877 - DNA, 25 bp, Rattus norvegicus
gagaattttgtttcacagtgtgctt

SEQ ID NO: 332878 - DNA, 25 bp, Rattus norvegicus
gagacaaaactgaagcttgcccctc

SEQ ID NO: 332879 - DNA, 25 bp, Rattus norvegicus
gagacaaaactgtagcttgcccctc

SEQ ID NO: 332880 - DNA, 25 bp, Rattus norvegicus
gagacaaaagcacccgatccaccag

SEQ ID NO: 332881 - DNA, 25 bp, Rattus norvegicus
gagacaaaagcagccgatccaccag

SEQ ID NO: 332882 - DNA, 25 bp, Rattus norvegicus
gagacaaacctgatcatcagcctgg

SEQ ID NO: 332883 - DNA, 25 bp, Rattus norvegicus
gagacaaacctgttcatcagcctgg

SEQ ID NO: 332884 - DNA, 25 bp, Rattus norvegicus
gagacaaactgcagtaggagcagca

SEQ ID NO: 332885 - DNA, 25 bp, Rattus norvegicus
gagacaaactgctgtaggagcagca

SEQ ID NO: 332886 - DNA, 25 bp, Rattus norvegicus
gagacaaactggatgtttctagtgt

SEQ ID NO: 332887 - DNA, 25 bp, Rattus norvegicus
gagacaaactggttgtttctagtgt

SEQ ID NO: 332888 - DNA, 25 bp, Rattus norvegicus
gagacaaactttatgcatcctgagc

SEQ ID NO: 332889 - DNA, 25 bp, Rattus norvegicus
gagacaaactttttgcatcctgagc

SEQ ID NO: 332890 - DNA, 25 bp, Rattus norvegicus
gagacaaagacaattttgggatcaa

SEQ ID NO: 332891 - DNA, 25 bp, Rattus norvegicus
gagacaaagacatttttgggatcaa

SEQ ID NO: 332892 - DNA, 25 bp, Rattus norvegicus
gagacaaagtacacctctggccgag

SEQ ID NO: 332893 - DNA, 25 bp, Rattus norvegicus
gagacaaagtactcctctggccgag

SEQ ID NO: 332894 - DNA, 25 bp, Rattus norvegicus
gagacaacacgcaggttatttctag

SEQ ID NO: 332895 - DNA, 25 bp, Rattus norvegicus
gagacaacacgctggttatttctag

SEQ ID NO: 332896 - DNA, 25 bp, Rattus norvegicus
gagacaacactccacgtttgagcaa

SEQ ID NO: 332897 - DNA, 25 bp, Rattus norvegicus
gagacaacactcgacgtttgagcaa

SEQ ID NO: 332898 - DNA, 25 bp, Rattus norvegicus
gagacaacatacaattccatcatga

SEQ ID NO: 332899 - DNA, 25 bp, Rattus norvegicus
gagacaacatactattccatcatga

SEQ ID NO: 332900 - DNA, 25 bp, Rattus norvegicus
gagacaacatggacctactgtgatg

SEQ ID NO: 332901 - DNA, 25 bp, Rattus norvegicus
gagacaacatggtcctactgtgatg

SEQ ID NO: 332902 - DNA, 25 bp, Rattus norvegicus
gagacaaccagcacatccgtggaaa

SEQ ID NO: 332903 - DNA, 25 bp, Rattus norvegicus
gagacaaccagcatgcacctggctg

SEQ ID NO: 332904 - DNA, 25 bp, Rattus norvegicus
gagacaaccagctcatccgtggaaa

SEQ ID NO: 332905 - DNA, 25 bp, Rattus norvegicus
gagacaaccagcttgcacctggctg

SEQ ID NO: 332906 - DNA, 25 bp, Rattus norvegicus
gagacaacccacatcatgcttgaag

SEQ ID NO: 332907 - DNA, 25 bp, Rattus norvegicus
gagacaacccacttcatgcttgaag

SEQ ID NO: 332908 - DNA, 25 bp, Rattus norvegicus
gagacaaccccgacccttatccagt

SEQ ID NO: 332909 - DNA, 25 bp, Rattus norvegicus
gagacaaccccgtcccttatccagt

SEQ ID NO: 332910 - DNA, 25 bp, Rattus norvegicus
gagacaacccggagcatggcacaga

SEQ ID NO: 332911 - DNA, 25 bp, Rattus norvegicus
gagacaacccggtgcatggcacaga

SEQ ID NO: 332912 - DNA, 25 bp, Rattus norvegicus
gagacaaccgttctggatccactgg

SEQ ID NO: 332913 - DNA, 25 bp, Rattus norvegicus
gagacaaccgttgtggatccactgg

SEQ ID NO: 332914 - DNA, 25 bp, Rattus norvegicus
gagacaactcagagctgtttcccta

SEQ ID NO: 332915 - DNA, 25 bp, Rattus norvegicus
gagacaactcagtgctgtttcccta

SEQ ID NO: 332916 - DNA, 25 bp, Rattus norvegicus
gagacaactctgatctaaattagaa

SEQ ID NO: 332917 - DNA, 25 bp, Rattus norvegicus
gagacaactctgcttgtcacaggtt

SEQ ID NO: 332918 - DNA, 25 bp, Rattus norvegicus
gagacaactctggttgtcacaggtt

SEQ ID NO: 332919 - DNA, 25 bp, Rattus norvegicus
gagacaactctgttctaaattagaa

SEQ ID NO: 332920 - DNA, 25 bp, Rattus norvegicus
gagacaactggtacagctccaggcc

SEQ ID NO: 332921 - DNA, 25 bp, Rattus norvegicus
gagacaactggttcagctccaggcc

SEQ ID NO: 332922 - DNA, 25 bp, Rattus norvegicus
gagacaactgtcaccaggaggctgc

SEQ ID NO: 332923 - DNA, 25 bp, Rattus norvegicus
gagacaactgtctccaggaggctgc

SEQ ID NO: 332924 - DNA, 25 bp, Rattus norvegicus
gagacaactgttagctctttcaaaa

SEQ ID NO: 332925 - DNA, 25 bp, Rattus norvegicus
gagacaactgtttgctctttcaaaa

SEQ ID NO: 332926 - DNA, 25 bp, Rattus norvegicus
gagacaagaaacataccacatgccc

SEQ ID NO: 332927 - DNA, 25 bp, Rattus norvegicus
gagacaagaaacttaccacatgccc

SEQ ID NO: 332928 - DNA, 25 bp, Rattus norvegicus
gagacaagaacaatctgcttccaga

SEQ ID NO: 332929 - DNA, 25 bp, Rattus norvegicus
gagacaagaacattctgcttccaga

SEQ ID NO: 332930 - DNA, 25 bp, Rattus norvegicus
gagacaagactaaaacaaggctgat

SEQ ID NO: 332931 - DNA, 25 bp, Rattus norvegicus
gagacaagactataacaaggctgat

SEQ ID NO: 332932 - DNA, 25 bp, Rattus norvegicus
gagacaagagccacagccaggtcta

SEQ ID NO: 332933 - DNA, 25 bp, Rattus norvegicus
gagacaagagcctcagccaggtcta

SEQ ID NO: 332934 - DNA, 25 bp, Rattus norvegicus
gagacaagatcaatctggcttacag

SEQ ID NO: 332935 - DNA, 25 bp, Rattus norvegicus
gagacaagatcattctggcttacag

SEQ ID NO: 332936 - DNA, 25 bp, Rattus norvegicus
gagacaagccacactttctgtgctg

SEQ ID NO: 332937 - DNA, 25 bp, Rattus norvegicus
gagacaagccactctttctgtgctg

SEQ ID NO: 332938 - DNA, 25 bp, Rattus norvegicus
gagacaagcctacttaccatcagag

SEQ ID NO: 332939 - DNA, 25 bp, Rattus norvegicus
gagacaagcctagttaccatcagag

SEQ ID NO: 332940 - DNA, 25 bp, Rattus norvegicus
gagacaagcctgaactacaacgtga

SEQ ID NO: 332941 - DNA, 25 bp, Rattus norvegicus
gagacaagcctgtactacaacgtga

SEQ ID NO: 332942 - DNA, 25 bp, Rattus norvegicus
gagacaagcggaactcttgagttcc

SEQ ID NO: 332943 - DNA, 25 bp, Rattus norvegicus
gagacaagcggatctcttgagttcc

SEQ ID NO: 332944 - DNA, 25 bp, Rattus norvegicus
gagacaagctaactgacccctgttc

SEQ ID NO: 332945 - DNA, 25 bp, Rattus norvegicus
gagacaagctaagtgacccctgttc

SEQ ID NO: 332946 - DNA, 25 bp, Rattus norvegicus
gagacaagctacatcatagcccttc

SEQ ID NO: 332947 - DNA, 25 bp, Rattus norvegicus
gagacaagctacttcatagcccttc

SEQ ID NO: 332948 - DNA, 25 bp, Rattus norvegicus
gagacaagctcaacaacactggcct

SEQ ID NO: 332949 - DNA, 25 bp, Rattus norvegicus
gagacaagctcatcaacactggcct

SEQ ID NO: 332950 - DNA, 25 bp, Rattus norvegicus
gagacaagctctcctgtctttatga

SEQ ID NO: 332951 - DNA, 25 bp, Rattus norvegicus
gagacaagctctgctgtctttatga

SEQ ID NO: 332952 - DNA, 25 bp, Rattus norvegicus
gagacaagctgaactcctgagttta

SEQ ID NO: 332953 - DNA, 25 bp, Rattus norvegicus
gagacaagctgatctcctgagttta

SEQ ID NO: 332954 - DNA, 25 bp, Rattus norvegicus
gagacaaggcgcagcacttctacac

SEQ ID NO: 332955 - DNA, 25 bp, Rattus norvegicus
gagacaaggcgctgcacttctacac

SEQ ID NO: 332956 - DNA, 25 bp, Rattus norvegicus
gagacaaggtctccaggttctggct

SEQ ID NO: 332957 - DNA, 25 bp, Rattus norvegicus
gagacaaggtctgcaggttctggct

SEQ ID NO: 332958 - DNA, 25 bp, Rattus norvegicus
gagacaaggttaacatttctttgcc

SEQ ID NO: 332959 - DNA, 25 bp, Rattus norvegicus
gagacaaggttatcatttctttgcc

SEQ ID NO: 332960 - DNA, 25 bp, Rattus norvegicus
gagacaagtaacattccaatcccct

SEQ ID NO: 332961 - DNA, 25 bp, Rattus norvegicus
gagacaagtaactttccaatcccct

SEQ ID NO: 332962 - DNA, 25 bp, Rattus norvegicus
gagacaagtactaacccagtcccaa

SEQ ID NO: 332963 - DNA, 25 bp, Rattus norvegicus
gagacaagtacttacccagtcccaa

SEQ ID NO: 332964 - DNA, 25 bp, Rattus norvegicus
gagacaagtagcagtgacacatcag

SEQ ID NO: 332965 - DNA, 25 bp, Rattus norvegicus
gagacaagtagctgtgacacatcag

SEQ ID NO: 332966 - DNA, 25 bp, Rattus norvegicus
gagacaagtagtcctaccaccagtc

SEQ ID NO: 332967 - DNA, 25 bp, Rattus norvegicus
gagacaagtagtgctaccaccagtc

SEQ ID NO: 332968 - DNA, 25 bp, Rattus norvegicus
gagacaagtctgatttctcccaact

SEQ ID NO: 332969 - DNA, 25 bp, Rattus norvegicus
gagacaagtctgttttctcccaact

SEQ ID NO: 332970 - DNA, 25 bp, Rattus norvegicus
gagacaagtgtgcttctttgcgaaa

SEQ ID NO: 332971 - DNA, 25 bp, Rattus norvegicus
gagacaagtgtggttctttgcgaaa

SEQ ID NO: 332972 - DNA, 25 bp, Rattus norvegicus
gagacaagttgtagcagagcccaga

SEQ ID NO: 332973 - DNA, 25 bp, Rattus norvegicus
gagacaagttgttgcagagcccaga

SEQ ID NO: 332974 - DNA, 25 bp, Rattus norvegicus
gagacaagtttgagctgcgctttgc

SEQ ID NO: 332975 - DNA, 25 bp, Rattus norvegicus
gagacaagtttgtgctgcgctttgc

SEQ ID NO: 332976 - DNA, 25 bp, Rattus norvegicus
gagacaagttttagctacgtagccc

SEQ ID NO: 332977 - DNA, 25 bp, Rattus norvegicus
gagacaagtttttgctacgtagccc

SEQ ID NO: 332978 - DNA, 25 bp, Rattus norvegicus
gagacaatatccaacgtgccaatcc

SEQ ID NO: 332979 - DNA, 25 bp, Rattus norvegicus
gagacaatatcctacgtgccaatcc

SEQ ID NO: 332980 - DNA, 25 bp, Rattus norvegicus
gagacaatcagaaaagccagaatgt

SEQ ID NO: 332981 - DNA, 25 bp, Rattus norvegicus
gagacaatcagataagccagaatgt

SEQ ID NO: 332982 - DNA, 25 bp, Rattus norvegicus
gagacaatcccaaccatctgaagta

SEQ ID NO: 332983 - DNA, 25 bp, Rattus norvegicus
gagacaatcccatccatctgaagta

SEQ ID NO: 332984 - DNA, 25 bp, Rattus norvegicus
gagacaatctatacccatgactaag

SEQ ID NO: 332985 - DNA, 25 bp, Rattus norvegicus
gagacaatctattcccatgactaag

SEQ ID NO: 332986 - DNA, 25 bp, Rattus norvegicus
gagacaatctctctaatggcttgca

SEQ ID NO: 332987 - DNA, 25 bp, Rattus norvegicus
gagacaatctctgtaatggcttgca

SEQ ID NO: 332988 - DNA, 25 bp, Rattus norvegicus
gagacaatctgtacccagtatgtgc

SEQ ID NO: 332989 - DNA, 25 bp, Rattus norvegicus
gagacaatctgttcccagtatgtgc

SEQ ID NO: 332990 - DNA, 25 bp, Rattus norvegicus
gagacaatgataatggccccaggat

SEQ ID NO: 332991 - DNA, 25 bp, Rattus norvegicus
gagacaatgatattggccccaggat

SEQ ID NO: 332992 - DNA, 25 bp, Rattus norvegicus
gagacaatgtcaaggtccctctcag

SEQ ID NO: 332993 - DNA, 25 bp, Rattus norvegicus
gagacaatgtcatggtccctctcag

SEQ ID NO: 332994 - DNA, 25 bp, Rattus norvegicus
gagacaatgtgaccacggcatccac

SEQ ID NO: 332995 - DNA, 25 bp, Rattus norvegicus
gagacaatgtgagcacggcatccac

SEQ ID NO: 332996 - DNA, 25 bp, Rattus norvegicus
gagacaatgtttagccctgatctgc

SEQ ID NO: 332997 - DNA, 25 bp, Rattus norvegicus
gagacaatgttttgccctgatctgc

SEQ ID NO: 332998 - DNA, 25 bp, Rattus norvegicus
gagacaattcctacatcactgagcg

SEQ ID NO: 332999 - DNA, 25 bp, Rattus norvegicus
gagacaattccttcatcactgagcg

SEQ ID NO: 333000 - DNA, 25 bp, Rattus norvegicus
gagacacaaagcaaccagtgtggcc

SEQ ID NO: 333001 - DNA, 25 bp, Rattus norvegicus
gagacacaaagctaccagtgtggcc

SEQ ID NO: 333002 - DNA, 25 bp, Rattus norvegicus
gagacacaacccatgttcttaggaa

SEQ ID NO: 333003 - DNA, 25 bp, Rattus norvegicus
gagacacaacccttgttcttaggaa

SEQ ID NO: 333004 - DNA, 25 bp, Rattus norvegicus
gagacacaagaaacaggcccggcat

SEQ ID NO: 333005 - DNA, 25 bp, Rattus norvegicus
gagacacaagaatcaggcccggcat

SEQ ID NO: 333006 - DNA, 25 bp, Rattus norvegicus
gagacacaataactagccgaattcg

SEQ ID NO: 333007 - DNA, 25 bp, Rattus norvegicus
gagacacaataagtagccgaattcg

SEQ ID NO: 333008 - DNA, 25 bp, Rattus norvegicus
gagacacacctgatggttatattta

SEQ ID NO: 333009 - DNA, 25 bp, Rattus norvegicus
gagacacacctgttggttatattta

SEQ ID NO: 333010 - DNA, 25 bp, Rattus norvegicus
gagacacactgaccatactccaagc

SEQ ID NO: 333011 - DNA, 25 bp, Rattus norvegicus
gagacacactgagcatactccaagc

SEQ ID NO: 333012 - DNA, 25 bp, Rattus norvegicus
gagacacactgcaatgacccaggaa

SEQ ID NO: 333013 - DNA, 25 bp, Rattus norvegicus
gagacacactgctatgacccaggaa

SEQ ID NO: 333014 - DNA, 25 bp, Rattus norvegicus
gagacacacttaccacttggctagt

SEQ ID NO: 333015 - DNA, 25 bp, Rattus norvegicus
gagacacacttagcacttggctagt

SEQ ID NO: 333016 - DNA, 25 bp, Rattus norvegicus
gagacacagaggaggccgagcgccg

SEQ ID NO: 333017 - DNA, 25 bp, Rattus norvegicus
gagacacagaggtggccgagcgccg

SEQ ID NO: 333018 - DNA, 25 bp, Rattus norvegicus
gagacacagcttcatgagtacggag

SEQ ID NO: 333019 - DNA, 25 bp, Rattus norvegicus
gagacacagcttgatgagtacggag

SEQ ID NO: 333020 - DNA, 25 bp, Rattus norvegicus
gagacacagggcattggcctcatgg

SEQ ID NO: 333021 - DNA, 25 bp, Rattus norvegicus
gagacacagggctttggcctcatgg

SEQ ID NO: 333022 - DNA, 25 bp, Rattus norvegicus
gagacacagtgccattcctgagtgg

SEQ ID NO: 333023 - DNA, 25 bp, Rattus norvegicus
gagacacagtgcgattcctgagtgg

SEQ ID NO: 333024 - DNA, 25 bp, Rattus norvegicus
gagacacagtgtctcactgaacctg

SEQ ID NO: 333025 - DNA, 25 bp, Rattus norvegicus
gagacacagtgtgtcactgaacctg

SEQ ID NO: 333026 - DNA, 25 bp, Rattus norvegicus
gagacacatagcatcctaattacta

SEQ ID NO: 333027 - DNA, 25 bp, Rattus norvegicus
gagacacatagcttcctaattacta

SEQ ID NO: 333028 - DNA, 25 bp, Rattus norvegicus
gagacacatgtacctggagaagctt

SEQ ID NO: 333029 - DNA, 25 bp, Rattus norvegicus
gagacacatgtagctggagaagctt

SEQ ID NO: 333030 - DNA, 25 bp, Rattus norvegicus
gagacacatgtcactgtcacacgta

SEQ ID NO: 333031 - DNA, 25 bp, Rattus norvegicus
gagacacatgtctctgtcacacgta

SEQ ID NO: 333032 - DNA, 25 bp, Rattus norvegicus
gagacaccaactcgaatcaacttgt

SEQ ID NO: 333033 - DNA, 25 bp, Rattus norvegicus
gagacaccaactggaatcaacttgt

SEQ ID NO: 333034 - DNA, 25 bp, Rattus norvegicus
gagacaccaagaatagcaaagcaag

SEQ ID NO: 333035 - DNA, 25 bp, Rattus norvegicus
gagacaccaagattagcaaagcaag

SEQ ID NO: 333036 - DNA, 25 bp, Rattus norvegicus
gagacaccaatccacaccgtagctg

SEQ ID NO: 333037 - DNA, 25 bp, Rattus norvegicus
gagacaccaatcgacaccgtagctg

SEQ ID NO: 333038 - DNA, 25 bp, Rattus norvegicus
gagacaccagcaaggcaaactttgt

SEQ ID NO: 333039 - DNA, 25 bp, Rattus norvegicus
gagacaccagcatggcaaactttgt

SEQ ID NO: 333040 - DNA, 25 bp, Rattus norvegicus
gagacaccatcactctgagggcaga

SEQ ID NO: 333041 - DNA, 25 bp, Rattus norvegicus
gagacaccatcagtctgagggcaga

SEQ ID NO: 333042 - DNA, 25 bp, Rattus norvegicus
gagacaccatgtcagctagtcccta

SEQ ID NO: 333043 - DNA, 25 bp, Rattus norvegicus
gagacaccatgtgagctagtcccta

SEQ ID NO: 333044 - DNA, 25 bp, Rattus norvegicus
gagacaccattgacctccaagagga

SEQ ID NO: 333045 - DNA, 25 bp, Rattus norvegicus
gagacaccattgtcctccaagagga

SEQ ID NO: 333046 - DNA, 25 bp, Rattus norvegicus
gagacacccactattgtgtattttg

SEQ ID NO: 333047 - DNA, 25 bp, Rattus norvegicus
gagacacccacttttgtgtattttg

SEQ ID NO: 333048 - DNA, 25 bp, Rattus norvegicus
gagacaccctatacatgagggccca

SEQ ID NO: 333049 - DNA, 25 bp, Rattus norvegicus
gagacaccctattcatgagggccca

SEQ ID NO: 333050 - DNA, 25 bp, Rattus norvegicus
gagacaccgaatagcatccacatat

SEQ ID NO: 333051 - DNA, 25 bp, Rattus norvegicus
gagacaccgaattgcatccacatat

SEQ ID NO: 333052 - DNA, 25 bp, Rattus norvegicus
gagacaccgcacctcagtgaagaat

SEQ ID NO: 333053 - DNA, 25 bp, Rattus norvegicus
gagacaccgcacgtcagtgaagaat

SEQ ID NO: 333054 - DNA, 25 bp, Rattus norvegicus
gagacaccgccacaacctaaaggga

SEQ ID NO: 333055 - DNA, 25 bp, Rattus norvegicus
gagacaccgccagaacctaaaggga

SEQ ID NO: 333056 - DNA, 25 bp, Rattus norvegicus
gagacaccggtcattggccagagaa

SEQ ID NO: 333057 - DNA, 25 bp, Rattus norvegicus
gagacaccggtctttggccagagaa

SEQ ID NO: 333058 - DNA, 25 bp, Rattus norvegicus
gagacacctcagatgttcactgtat

SEQ ID NO: 333059 - DNA, 25 bp, Rattus norvegicus
gagacacctcagttgttcactgtat

SEQ ID NO: 333060 - DNA, 25 bp, Rattus norvegicus
gagacacctcccaaggaacagcagt

SEQ ID NO: 333061 - DNA, 25 bp, Rattus norvegicus
gagacacctccctaggaacagcagt

SEQ ID NO: 333062 - DNA, 25 bp, Rattus norvegicus
gagacacctcttctgatctgagcca

SEQ ID NO: 333063 - DNA, 25 bp, Rattus norvegicus
gagacacctcttgtgatctgagcca

SEQ ID NO: 333064 - DNA, 25 bp, Rattus norvegicus
gagacacctggtatgtttactctat

SEQ ID NO: 333065 - DNA, 25 bp, Rattus norvegicus
gagacacctggtttgtttactctat

SEQ ID NO: 333066 - DNA, 25 bp, Rattus norvegicus
gagacacctttcacaatctgtgatg

SEQ ID NO: 333067 - DNA, 25 bp, Rattus norvegicus
gagacacctttcatcatgttgtttg

SEQ ID NO: 333068 - DNA, 25 bp, Rattus norvegicus
gagacacctttctcaatctgtgatg

SEQ ID NO: 333069 - DNA, 25 bp, Rattus norvegicus
gagacacctttcttcatgttgtttg

SEQ ID NO: 333070 - DNA, 25 bp, Rattus norvegicus
gagacacgactcagactttgatggg

SEQ ID NO: 333071 - DNA, 25 bp, Rattus norvegicus
gagacacgactctgactttgatggg

SEQ ID NO: 333072 - DNA, 25 bp, Rattus norvegicus
gagacacggctgctgttcctaacga

SEQ ID NO: 333073 - DNA, 25 bp, Rattus norvegicus
gagacacggctggtgttcctaacga

SEQ ID NO: 333074 - DNA, 25 bp, Rattus norvegicus
gagacacggtagagccacatctgat

SEQ ID NO: 333075 - DNA, 25 bp, Rattus norvegicus
gagacacggtagtgccacatctgat

SEQ ID NO: 333076 - DNA, 25 bp, Rattus norvegicus
gagacacggtggatgcctagtgacc

SEQ ID NO: 333077 - DNA, 25 bp, Rattus norvegicus
gagacacggtggttgcctagtgacc

SEQ ID NO: 333078 - DNA, 25 bp, Rattus norvegicus
gagacacgtccactgaagattgcca

SEQ ID NO: 333079 - DNA, 25 bp, Rattus norvegicus
gagacacgtccagtgaagattgcca

SEQ ID NO: 333080 - DNA, 25 bp, Rattus norvegicus
gagacactaacccaggactacatca

SEQ ID NO: 333081 - DNA, 25 bp, Rattus norvegicus
gagacactaaccgaggactacatca

SEQ ID NO: 333082 - DNA, 25 bp, Rattus norvegicus
gagacactacagacgatgacctttg

SEQ ID NO: 333083 - DNA, 25 bp, Rattus norvegicus
gagacactacagtcgatgacctttg

SEQ ID NO: 333084 - DNA, 25 bp, Rattus norvegicus
gagacactagatactttgcctttta

SEQ ID NO: 333085 - DNA, 25 bp, Rattus norvegicus
gagacactagattctttgcctttta

SEQ ID NO: 333086 - DNA, 25 bp, Rattus norvegicus
gagacactagcaaccagactctggg

SEQ ID NO: 333087 - DNA, 25 bp, Rattus norvegicus
gagacactagcatccagactctggg

SEQ ID NO: 333088 - DNA, 25 bp, Rattus norvegicus
gagacactatctcccagacaaaaga

SEQ ID NO: 333089 - DNA, 25 bp, Rattus norvegicus
gagacactatctgccagacaaaaga

SEQ ID NO: 333090 - DNA, 25 bp, Rattus norvegicus
gagacactcaacagtaaggcccatc

SEQ ID NO: 333091 - DNA, 25 bp, Rattus norvegicus
gagacactcaactgtaaggcccatc

SEQ ID NO: 333092 - DNA, 25 bp, Rattus norvegicus
gagacactcacacggttcaattaag

SEQ ID NO: 333093 - DNA, 25 bp, Rattus norvegicus
gagacactcacagggttcaattaag

SEQ ID NO: 333094 - DNA, 25 bp, Rattus norvegicus
gagacactcagcaccaaatgtcagg

SEQ ID NO: 333095 - DNA, 25 bp, Rattus norvegicus
gagacactcagctccaaatgtcagg

SEQ ID NO: 333096 - DNA, 25 bp, Rattus norvegicus
gagacactcaggcattccaggaaac

SEQ ID NO: 333097 - DNA, 25 bp, Rattus norvegicus
gagacactcagggattccaggaaac

SEQ ID NO: 333098 - DNA, 25 bp, Rattus norvegicus
gagacactcagtaattacagacatt

SEQ ID NO: 333099 - DNA, 25 bp, Rattus norvegicus
gagacactcagttattacagacatt

SEQ ID NO: 333100 - DNA, 25 bp, Rattus norvegicus
gagacactccagaagctgcggttct

SEQ ID NO: 333101 - DNA, 25 bp, Rattus norvegicus
gagacactccagtagctgcggttct

SEQ ID NO: 333102 - DNA, 25 bp, Rattus norvegicus
gagacactctcaacatccgacaggc

SEQ ID NO: 333103 - DNA, 25 bp, Rattus norvegicus
gagacactctcatcatccgacaggc

SEQ ID NO: 333104 - DNA, 25 bp, Rattus norvegicus
gagacactctccactgacacagatg

SEQ ID NO: 333105 - DNA, 25 bp, Rattus norvegicus
gagacactctcctctgacacagatg

SEQ ID NO: 333106 - DNA, 25 bp, Rattus norvegicus
gagacactgaagagctcacatactc

SEQ ID NO: 333107 - DNA, 25 bp, Rattus norvegicus
gagacactgaagattctctcggccc

SEQ ID NO: 333108 - DNA, 25 bp, Rattus norvegicus
gagacactgaagtgctcacatactc

SEQ ID NO: 333109 - DNA, 25 bp, Rattus norvegicus
gagacactgaagtttctctcggccc

SEQ ID NO: 333110 - DNA, 25 bp, Rattus norvegicus
gagacactgattacagatctcttaa

SEQ ID NO: 333111 - DNA, 25 bp, Rattus norvegicus
gagacactgatttcagatctcttaa

SEQ ID NO: 333112 - DNA, 25 bp, Rattus norvegicus
gagacactgccaaattttaaaccaa

SEQ ID NO: 333113 - DNA, 25 bp, Rattus norvegicus
gagacactgccatattttaaaccaa

SEQ ID NO: 333114 - DNA, 25 bp, Rattus norvegicus
gagacactgcccaggtggaaaacct

SEQ ID NO: 333115 - DNA, 25 bp, Rattus norvegicus
gagacactgccccaaaagtatgaaa

SEQ ID NO: 333116 - DNA, 25 bp, Rattus norvegicus
gagacactgcccgaaaagtatgaaa

SEQ ID NO: 333117 - DNA, 25 bp, Rattus norvegicus
gagacactgccctggtggaaaacct

SEQ ID NO: 333118 - DNA, 25 bp, Rattus norvegicus
gagacactgcctctgtagttaggga

SEQ ID NO: 333119 - DNA, 25 bp, Rattus norvegicus
gagacactgcctgtgtagttaggga

SEQ ID NO: 333120 - DNA, 25 bp, Rattus norvegicus
gagacactgcgtatggttcaagcct

SEQ ID NO: 333121 - DNA, 25 bp, Rattus norvegicus
gagacactgcgtttggttcaagcct

SEQ ID NO: 333122 - DNA, 25 bp, Rattus norvegicus
gagacactggacacgattccaacag

SEQ ID NO: 333123 - DNA, 25 bp, Rattus norvegicus
gagacactggacagattcctacaga

SEQ ID NO: 333124 - DNA, 25 bp, Rattus norvegicus
gagacactggactcgattccaacag

SEQ ID NO: 333125 - DNA, 25 bp, Rattus norvegicus
gagacactggactgattcctacaga

SEQ ID NO: 333126 - DNA, 25 bp, Rattus norvegicus
gagacactggcaatgactgggcctc

SEQ ID NO: 333127 - DNA, 25 bp, Rattus norvegicus
gagacactggcattgactgggcctc

SEQ ID NO: 333128 - DNA, 25 bp, Rattus norvegicus
gagacactggccctctatgaaggct

SEQ ID NO: 333129 - DNA, 25 bp, Rattus norvegicus
gagacactggccgtctatgaaggct

SEQ ID NO: 333130 - DNA, 25 bp, Rattus norvegicus
gagacactgggaatgccactggcct

SEQ ID NO: 333131 - DNA, 25 bp, Rattus norvegicus
gagacactgggattgccactggcct

SEQ ID NO: 333132 - DNA, 25 bp, Rattus norvegicus
gagacactgggcatctctgtgggcc

SEQ ID NO: 333133 - DNA, 25 bp, Rattus norvegicus
gagacactgggcttctctgtgggcc

SEQ ID NO: 333134 - DNA, 25 bp, Rattus norvegicus
gagacactgtcacagcagcttcagg

SEQ ID NO: 333135 - DNA, 25 bp, Rattus norvegicus
gagacactgtcagagcagcttcagg

SEQ ID NO: 333136 - DNA, 25 bp, Rattus norvegicus
gagacactgtctccatcgacctggt

SEQ ID NO: 333137 - DNA, 25 bp, Rattus norvegicus
gagacactgtctgcatcgacctggt

SEQ ID NO: 333138 - DNA, 25 bp, Rattus norvegicus
gagacactgttccagtccgggacac

SEQ ID NO: 333139 - DNA, 25 bp, Rattus norvegicus
gagacactgttcgagtccgggacac

SEQ ID NO: 333140 - DNA, 25 bp, Rattus norvegicus
gagacacttagacactatttttctt

SEQ ID NO: 333141 - DNA, 25 bp, Rattus norvegicus
gagacacttagagactatttttctt

SEQ ID NO: 333142 - DNA, 25 bp, Rattus norvegicus
gagacacttcagctctggttgagct

SEQ ID NO: 333143 - DNA, 25 bp, Rattus norvegicus
gagacacttcaggtctggttgagct

SEQ ID NO: 333144 - DNA, 25 bp, Rattus norvegicus
gagacacttctgatacgacttccac

SEQ ID NO: 333145 - DNA, 25 bp, Rattus norvegicus
gagacacttctgttacgacttccac

SEQ ID NO: 333146 - DNA, 25 bp, Rattus norvegicus
gagacacttgacagaaactgcatcc

SEQ ID NO: 333147 - DNA, 25 bp, Rattus norvegicus
gagacacttgactgaaactgcatcc

SEQ ID NO: 333148 - DNA, 25 bp, Rattus norvegicus
gagacacttggacgtcacgtgtgaa

SEQ ID NO: 333149 - DNA, 25 bp, Rattus norvegicus
gagacacttggaggtcacgtgtgaa

SEQ ID NO: 333150 - DNA, 25 bp, Rattus norvegicus
gagacacttggcacgtcatgggcct

SEQ ID NO: 333151 - DNA, 25 bp, Rattus norvegicus
gagacacttggctcgtcatgggcct

SEQ ID NO: 333152 - DNA, 25 bp, Rattus norvegicus
gagacacttgtgatagaagcttcag

SEQ ID NO: 333153 - DNA, 25 bp, Rattus norvegicus
gagacacttgtgttagaagcttcag

SEQ ID NO: 333154 - DNA, 25 bp, Rattus norvegicus
gagacacttgttagcgtcacgacac

SEQ ID NO: 333155 - DNA, 25 bp, Rattus norvegicus
gagacacttgtttgcgtcacgacac

SEQ ID NO: 333156 - DNA, 25 bp, Rattus norvegicus
gagacactttgacatttcctacctt

SEQ ID NO: 333157 - DNA, 25 bp, Rattus norvegicus
gagacactttgagatttcctacctt

SEQ ID NO: 333158 - DNA, 25 bp, Rattus norvegicus
gagacactttgtaaagcccttttat

SEQ ID NO: 333159 - DNA, 25 bp, Rattus norvegicus
gagacactttgttaagcccttttat

SEQ ID NO: 333160 - DNA, 25 bp, Rattus norvegicus
gagacagaactactgaccggctcca

SEQ ID NO: 333161 - DNA, 25 bp, Rattus norvegicus
gagacagaactagtgaccggctcca

SEQ ID NO: 333162 - DNA, 25 bp, Rattus norvegicus
gagacagaactgaacccgaacacgt

SEQ ID NO: 333163 - DNA, 25 bp, Rattus norvegicus
gagacagaactgtacccgaacacgt

SEQ ID NO: 333164 - DNA, 25 bp, Rattus norvegicus
gagacagaatatcgtccctgccgca

SEQ ID NO: 333165 - DNA, 25 bp, Rattus norvegicus
gagacagaatatggtccctgccgca

SEQ ID NO: 333166 - DNA, 25 bp, Rattus norvegicus
gagacagaatccagagttaatccat

SEQ ID NO: 333167 - DNA, 25 bp, Rattus norvegicus
gagacagaatcctgagttaatccat

SEQ ID NO: 333168 - DNA, 25 bp, Rattus norvegicus
gagacagacacaacctggtcctcat

SEQ ID NO: 333169 - DNA, 25 bp, Rattus norvegicus
gagacagacacatcctggtcctcat

SEQ ID NO: 333170 - DNA, 25 bp, Rattus norvegicus
gagacagacaggatttgagtccgtt

SEQ ID NO: 333171 - DNA, 25 bp, Rattus norvegicus
gagacagacaggcaccctctccgtg

SEQ ID NO: 333172 - DNA, 25 bp, Rattus norvegicus
gagacagacagggaccctctccgtg

SEQ ID NO: 333173 - DNA, 25 bp, Rattus norvegicus
gagacagacaggttttgagtccgtt

SEQ ID NO: 333174 - DNA, 25 bp, Rattus norvegicus
gagacagacatacatacggacgtga

SEQ ID NO: 333175 - DNA, 25 bp, Rattus norvegicus
gagacagacatagatacggacgtga

SEQ ID NO: 333176 - DNA, 25 bp, Rattus norvegicus
gagacagacatgcaccctccttgag

SEQ ID NO: 333177 - DNA, 25 bp, Rattus norvegicus
gagacagacatggaccctccttgag

SEQ ID NO: 333178 - DNA, 25 bp, Rattus norvegicus
gagacagaccgtcttagcttagcta

SEQ ID NO: 333179 - DNA, 25 bp, Rattus norvegicus
gagacagaccgtgttagcttagcta

SEQ ID NO: 333180 - DNA, 25 bp, Rattus norvegicus
gagacagactggatatgccctacat

SEQ ID NO: 333181 - DNA, 25 bp, Rattus norvegicus
gagacagactggttatgccctacat

SEQ ID NO: 333182 - DNA, 25 bp, Rattus norvegicus
gagacagactgtaggaagcactaat

SEQ ID NO: 333183 - DNA, 25 bp, Rattus norvegicus
gagacagactgttggaagcactaat

SEQ ID NO: 333184 - DNA, 25 bp, Rattus norvegicus
gagacagagcatcactgagcttagt

SEQ ID NO: 333185 - DNA, 25 bp, Rattus norvegicus
gagacagagcatgactgagcttagt

SEQ ID NO: 333186 - DNA, 25 bp, Rattus norvegicus
gagacagagcggctgcagtctacaa

SEQ ID NO: 333187 - DNA, 25 bp, Rattus norvegicus
gagacagagcgggtgcagtctacaa

SEQ ID NO: 333188 - DNA, 25 bp, Rattus norvegicus
gagacagaggaacgaattgcagact

SEQ ID NO: 333189 - DNA, 25 bp, Rattus norvegicus
gagacagaggaaggaattgcagact

SEQ ID NO: 333190 - DNA, 25 bp, Rattus norvegicus
gagacagaggagctgcaccacgaca

SEQ ID NO: 333191 - DNA, 25 bp, Rattus norvegicus
gagacagaggaggtgcaccacgaca

SEQ ID NO: 333192 - DNA, 25 bp, Rattus norvegicus
gagacagaggcccattttatcttgg

SEQ ID NO: 333193 - DNA, 25 bp, Rattus norvegicus
gagacagaggccgattttatcttgg

SEQ ID NO: 333194 - DNA, 25 bp, Rattus norvegicus
gagacagagggaattggacaagaat

SEQ ID NO: 333195 - DNA, 25 bp, Rattus norvegicus
gagacagagggatttggacaagaat

SEQ ID NO: 333196 - DNA, 25 bp, Rattus norvegicus
gagacagaggtcatccataggccag

SEQ ID NO: 333197 - DNA, 25 bp, Rattus norvegicus
gagacagaggtcttccataggccag

SEQ ID NO: 333198 - DNA, 25 bp, Rattus norvegicus
gagacagagtctcgccgagtatccc

SEQ ID NO: 333199 - DNA, 25 bp, Rattus norvegicus
gagacagagtctggccgagtatccc

SEQ ID NO: 333200 - DNA, 25 bp, Rattus norvegicus
gagacagatcccatacaccatgatg

SEQ ID NO: 333201 - DNA, 25 bp, Rattus norvegicus
gagacagatcccttacaccatgatg

SEQ ID NO: 333202 - DNA, 25 bp, Rattus norvegicus
gagacagatgcccactgacgcagac

SEQ ID NO: 333203 - DNA, 25 bp, Rattus norvegicus
gagacagatgccgactgacgcagac

SEQ ID NO: 333204 - DNA, 25 bp, Rattus norvegicus
gagacagatgggagctcacagatca

SEQ ID NO: 333205 - DNA, 25 bp, Rattus norvegicus
gagacagatgggtgctcacagatca

SEQ ID NO: 333206 - DNA, 25 bp, Rattus norvegicus
gagacagattaaccaggccctcctg

SEQ ID NO: 333207 - DNA, 25 bp, Rattus norvegicus
gagacagattaagcaggccctcctg

SEQ ID NO: 333208 - DNA, 25 bp, Rattus norvegicus
gagacagattgtaggctgtcctatt

SEQ ID NO: 333209 - DNA, 25 bp, Rattus norvegicus
gagacagattgttggctgtcctatt

SEQ ID NO: 333210 - DNA, 25 bp, Rattus norvegicus
gagacagatttcaattgcagccttc

SEQ ID NO: 333211 - DNA, 25 bp, Rattus norvegicus
gagacagatttctattgcagccttc

SEQ ID NO: 333212 - DNA, 25 bp, Rattus norvegicus
gagacagcaatcagtgtttccctct

SEQ ID NO: 333213 - DNA, 25 bp, Rattus norvegicus
gagacagcaatctgtgtttccctct

SEQ ID NO: 333214 - DNA, 25 bp, Rattus norvegicus
gagacagcacacctgactagggagc

SEQ ID NO: 333215 - DNA, 25 bp, Rattus norvegicus
gagacagcacacgtgactagggagc

SEQ ID NO: 333216 - DNA, 25 bp, Rattus norvegicus
gagacagcactcaactgagggcttg

SEQ ID NO: 333217 - DNA, 25 bp, Rattus norvegicus
gagacagcactctactgagggcttg

SEQ ID NO: 333218 - DNA, 25 bp, Rattus norvegicus
gagacagcagacagagtccgggtct

SEQ ID NO: 333219 - DNA, 25 bp, Rattus norvegicus
gagacagcagactgagtccgggtct

SEQ ID NO: 333220 - DNA, 25 bp, Rattus norvegicus
gagacagcagccctaggaccaagaa

SEQ ID NO: 333221 - DNA, 25 bp, Rattus norvegicus
gagacagcagccgtaggaccaagaa

SEQ ID NO: 333222 - DNA, 25 bp, Rattus norvegicus
gagacagcagttcccaagtggagta

SEQ ID NO: 333223 - DNA, 25 bp, Rattus norvegicus
gagacagcagttgccaagtggagta

SEQ ID NO: 333224 - DNA, 25 bp, Rattus norvegicus
gagacagcatttagtgccttccact

SEQ ID NO: 333225 - DNA, 25 bp, Rattus norvegicus
gagacagcattttgtgccttccact

SEQ ID NO: 333226 - DNA, 25 bp, Rattus norvegicus
gagacagccaaactcatctagtgcc

SEQ ID NO: 333227 - DNA, 25 bp, Rattus norvegicus
gagacagccaaagtcatctagtgcc

SEQ ID NO: 333228 - DNA, 25 bp, Rattus norvegicus
gagacagccagtcagacccagtgtt

SEQ ID NO: 333229 - DNA, 25 bp, Rattus norvegicus
gagacagccagtgagacccagtgtt

SEQ ID NO: 333230 - DNA, 25 bp, Rattus norvegicus
gagacagcccgtcagacgaatctca

SEQ ID NO: 333231 - DNA, 25 bp, Rattus norvegicus
gagacagcccgtgagacgaatctca

SEQ ID NO: 333232 - DNA, 25 bp, Rattus norvegicus
gagacagccgagattgcaatgggtt

SEQ ID NO: 333233 - DNA, 25 bp, Rattus norvegicus
gagacagccgagtttgcaatgggtt

SEQ ID NO: 333234 - DNA, 25 bp, Rattus norvegicus
gagacagcctgtaccactggagttc

SEQ ID NO: 333235 - DNA, 25 bp, Rattus norvegicus
gagacagcctgttccactggagttc

SEQ ID NO: 333236 - DNA, 25 bp, Rattus norvegicus
gagacagcctttctcagagaagaca

SEQ ID NO: 333237 - DNA, 25 bp, Rattus norvegicus
gagacagcctttgtcagagaagaca

SEQ ID NO: 333238 - DNA, 25 bp, Rattus norvegicus
gagacagcgctaacctgtttttatg

SEQ ID NO: 333239 - DNA, 25 bp, Rattus norvegicus
gagacagcgctatcctgtttttatg

SEQ ID NO: 333240 - DNA, 25 bp, Rattus norvegicus
gagacagcggtgatcctgagacctg

SEQ ID NO: 333241 - DNA, 25 bp, Rattus norvegicus
gagacagcggtgttcctgagacctg

SEQ ID NO: 333242 - DNA, 25 bp, Rattus norvegicus
gagacagctcaaatacttcatccac

SEQ ID NO: 333243 - DNA, 25 bp, Rattus norvegicus
gagacagctcaattacttcatccac

SEQ ID NO: 333244 - DNA, 25 bp, Rattus norvegicus
gagacagctcagacagcaaagttct

SEQ ID NO: 333245 - DNA, 25 bp, Rattus norvegicus
gagacagctcagctgagagctcagc

SEQ ID NO: 333246 - DNA, 25 bp, Rattus norvegicus
gagacagctcaggtgagagctcagc

SEQ ID NO: 333247 - DNA, 25 bp, Rattus norvegicus
gagacagctcagtcagcaaagttct

SEQ ID NO: 333248 - DNA, 25 bp, Rattus norvegicus
gagacagctctcaaaggaccaaggc

SEQ ID NO: 333249 - DNA, 25 bp, Rattus norvegicus
gagacagctctctaaggaccaaggc

SEQ ID NO: 333250 - DNA, 25 bp, Rattus norvegicus
gagacagctcttagagggtgtctgt

SEQ ID NO: 333251 - DNA, 25 bp, Rattus norvegicus
gagacagctcttcctgctttcctgt

SEQ ID NO: 333252 - DNA, 25 bp, Rattus norvegicus
gagacagctcttgctgctttcctgt

SEQ ID NO: 333253 - DNA, 25 bp, Rattus norvegicus
gagacagctctttgagggtgtctgt

SEQ ID NO: 333254 - DNA, 25 bp, Rattus norvegicus
gagacagctgacaccctcagagtgg

SEQ ID NO: 333255 - DNA, 25 bp, Rattus norvegicus
gagacagctgactccctcagagtgg

SEQ ID NO: 333256 - DNA, 25 bp, Rattus norvegicus
gagacagctgtcatattctatggtt

SEQ ID NO: 333257 - DNA, 25 bp, Rattus norvegicus
gagacagctgtcttattctatggtt

SEQ ID NO: 333258 - DNA, 25 bp, Rattus norvegicus
gagacagcttggacacataccagga

SEQ ID NO: 333259 - DNA, 25 bp, Rattus norvegicus
gagacagcttggtcacataccagga

SEQ ID NO: 333260 - DNA, 25 bp, Rattus norvegicus
gagacaggaactactgtgtaagtta

SEQ ID NO: 333261 - DNA, 25 bp, Rattus norvegicus
gagacaggaacttctgtgtaagtta

SEQ ID NO: 333262 - DNA, 25 bp, Rattus norvegicus
gagacaggaagcacctccaaacagg

SEQ ID NO: 333263 - DNA, 25 bp, Rattus norvegicus
gagacaggaagctcctccaaacagg

SEQ ID NO: 333264 - DNA, 25 bp, Rattus norvegicus
gagacaggactcctactactcgcag

SEQ ID NO: 333265 - DNA, 25 bp, Rattus norvegicus
gagacaggactcgtactactcgcag

SEQ ID NO: 333266 - DNA, 25 bp, Rattus norvegicus
gagacaggagctcccaaacccaagc

SEQ ID NO: 333267 - DNA, 25 bp, Rattus norvegicus
gagacaggagctgccaaacccaagc

SEQ ID NO: 333268 - DNA, 25 bp, Rattus norvegicus
gagacaggatctcaccgggtaacaa

SEQ ID NO: 333269 - DNA, 25 bp, Rattus norvegicus
gagacaggatctgaccgggtaacaa

SEQ ID NO: 333270 - DNA, 25 bp, Rattus norvegicus
gagacaggattaattctttgaatcc

SEQ ID NO: 333271 - DNA, 25 bp, Rattus norvegicus
gagacaggattatttctttgaatcc

SEQ ID NO: 333272 - DNA, 25 bp, Rattus norvegicus
gagacaggcatactatctatcctta

SEQ ID NO: 333273 - DNA, 25 bp, Rattus norvegicus
gagacaggcatagtatctatcctta

SEQ ID NO: 333274 - DNA, 25 bp, Rattus norvegicus
gagacaggccctacagcatgggtct

SEQ ID NO: 333275 - DNA, 25 bp, Rattus norvegicus
gagacaggcccttcagcatgggtct

SEQ ID NO: 333276 - DNA, 25 bp, Rattus norvegicus
gagacaggctgcaatgactgtgaga

SEQ ID NO: 333277 - DNA, 25 bp, Rattus norvegicus
gagacaggctgctatgactgtgaga

SEQ ID NO: 333278 - DNA, 25 bp, Rattus norvegicus
gagacaggctttctcattgacctta

SEQ ID NO: 333279 - DNA, 25 bp, Rattus norvegicus
gagacaggctttgtcattgacctta

SEQ ID NO: 333280 - DNA, 25 bp, Rattus norvegicus
gagacagggcctccgcagtgacttc

SEQ ID NO: 333281 - DNA, 25 bp, Rattus norvegicus
gagacagggcctgcgcagtgacttc

SEQ ID NO: 333282 - DNA, 25 bp, Rattus norvegicus
gagacagggtacatttcctcatgga

SEQ ID NO: 333283 - DNA, 25 bp, Rattus norvegicus
gagacagggtacttttcctcatgga

SEQ ID NO: 333284 - DNA, 25 bp, Rattus norvegicus
gagacagggtcacacaagacaagac

SEQ ID NO: 333285 - DNA, 25 bp, Rattus norvegicus
gagacagggtcagacaagacaagac

SEQ ID NO: 333286 - DNA, 25 bp, Rattus norvegicus
gagacagggtccctctaacatagcc

SEQ ID NO: 333287 - DNA, 25 bp, Rattus norvegicus
gagacagggtccgtctaacatagcc

SEQ ID NO: 333288 - DNA, 25 bp, Rattus norvegicus
gagacagggtctccttccatagccc

SEQ ID NO: 333289 - DNA, 25 bp, Rattus norvegicus
gagacagggtctgcttccatagccc

SEQ ID NO: 333290 - DNA, 25 bp, Rattus norvegicus
gagacagggtttagcactccagacc

SEQ ID NO: 333291 - DNA, 25 bp, Rattus norvegicus
gagacagggttttgcactccagacc

SEQ ID NO: 333292 - DNA, 25 bp, Rattus norvegicus
gagacaggtagtcgccggcaccaac

SEQ ID NO: 333293 - DNA, 25 bp, Rattus norvegicus
gagacaggtagtggccggcaccaac

SEQ ID NO: 333294 - DNA, 25 bp, Rattus norvegicus
gagacaggtgcaatgctcagcaata

SEQ ID NO: 333295 - DNA, 25 bp, Rattus norvegicus
gagacaggtgcattgctcagcaata

SEQ ID NO: 333296 - DNA, 25 bp, Rattus norvegicus
gagacaggtggtcccacagccacca

SEQ ID NO: 333297 - DNA, 25 bp, Rattus norvegicus
gagacaggtggtgccacagccacca

SEQ ID NO: 333298 - DNA, 25 bp, Rattus norvegicus
gagacaggtgtactcacagcgcaga

SEQ ID NO: 333299 - DNA, 25 bp, Rattus norvegicus
gagacaggtgtagtcacagcgcaga

SEQ ID NO: 333300 - DNA, 25 bp, Rattus norvegicus
gagacaggttgtaccacaggttctt

SEQ ID NO: 333301 - DNA, 25 bp, Rattus norvegicus
gagacaggttgttccacaggttctt

SEQ ID NO: 333302 - DNA, 25 bp, Rattus norvegicus
gagacaggtttaactagacaggatc

SEQ ID NO: 333303 - DNA, 25 bp, Rattus norvegicus
gagacaggtttatctagacaggatc

SEQ ID NO: 333304 - DNA, 25 bp, Rattus norvegicus
gagacagtacctaaaagccacgaga

SEQ ID NO: 333305 - DNA, 25 bp, Rattus norvegicus
gagacagtaccttaaagccacgaga

SEQ ID NO: 333306 - DNA, 25 bp, Rattus norvegicus
gagacagtagctcgacctgggtcta

SEQ ID NO: 333307 - DNA, 25 bp, Rattus norvegicus
gagacagtagctggacctgggtcta

SEQ ID NO: 333308 - DNA, 25 bp, Rattus norvegicus
gagacagtcaagacctggatccaat

SEQ ID NO: 333309 - DNA, 25 bp, Rattus norvegicus
gagacagtcaagtcctggatccaat

SEQ ID NO: 333310 - DNA, 25 bp, Rattus norvegicus
gagacagtcagtctgtccacataca

SEQ ID NO: 333311 - DNA, 25 bp, Rattus norvegicus
gagacagtcagtgtgtccacataca

SEQ ID NO: 333312 - DNA, 25 bp, Rattus norvegicus
gagacagtcatcagtaacttccaac

SEQ ID NO: 333313 - DNA, 25 bp, Rattus norvegicus
gagacagtcatctgtaacttccaac

SEQ ID NO: 333314 - DNA, 25 bp, Rattus norvegicus
gagacagtcatgcagggtcactact

SEQ ID NO: 333315 - DNA, 25 bp, Rattus norvegicus
gagacagtcatggagggtcactact

SEQ ID NO: 333316 - DNA, 25 bp, Rattus norvegicus
gagacagtcgtcctaaatgcattag

SEQ ID NO: 333317 - DNA, 25 bp, Rattus norvegicus
gagacagtcgtcgtaaatgcattag

SEQ ID NO: 333318 - DNA, 25 bp, Rattus norvegicus
gagacagtctcacatctctctgagt

SEQ ID NO: 333319 - DNA, 25 bp, Rattus norvegicus
gagacagtctcagatctctctgagt

SEQ ID NO: 333320 - DNA, 25 bp, Rattus norvegicus
gagacagtctccagggaatcctagg

SEQ ID NO: 333321 - DNA, 25 bp, Rattus norvegicus
gagacagtctcctgggaatcctagg

SEQ ID NO: 333322 - DNA, 25 bp, Rattus norvegicus
gagacagtctctctctacaggtcct

SEQ ID NO: 333323 - DNA, 25 bp, Rattus norvegicus
gagacagtctctgtctacaggtcct

SEQ ID NO: 333324 - DNA, 25 bp, Rattus norvegicus
gagacagtctgtctatgccctgggc

SEQ ID NO: 333325 - DNA, 25 bp, Rattus norvegicus
gagacagtctgtgtatgccctgggc

SEQ ID NO: 333326 - DNA, 25 bp, Rattus norvegicus
gagacagtcttcctagagccatgac

SEQ ID NO: 333327 - DNA, 25 bp, Rattus norvegicus
gagacagtcttcgtagagccatgac

SEQ ID NO: 333328 - DNA, 25 bp, Rattus norvegicus
gagacagtgaacaaatccgatttaa

SEQ ID NO: 333329 - DNA, 25 bp, Rattus norvegicus
gagacagtgaactaatccgatttaa

SEQ ID NO: 333330 - DNA, 25 bp, Rattus norvegicus
gagacagtgaccaatttcatcgaag

SEQ ID NO: 333331 - DNA, 25 bp, Rattus norvegicus
gagacagtgaccacagaagcccggc

SEQ ID NO: 333332 - DNA, 25 bp, Rattus norvegicus
gagacagtgaccaccatatgttaca

SEQ ID NO: 333333 - DNA, 25 bp, Rattus norvegicus
gagacagtgacctatttcatcgaag

SEQ ID NO: 333334 - DNA, 25 bp, Rattus norvegicus
gagacagtgacctcagaagcccggc

SEQ ID NO: 333335 - DNA, 25 bp, Rattus norvegicus
gagacagtgacctccatatgttaca

SEQ ID NO: 333336 - DNA, 25 bp, Rattus norvegicus
gagacagtgagaaaaccatggacaa

SEQ ID NO: 333337 - DNA, 25 bp, Rattus norvegicus
gagacagtgagataaccatggacaa

SEQ ID NO: 333338 - DNA, 25 bp, Rattus norvegicus
gagacagtgagcacaccagagagca

SEQ ID NO: 333339 - DNA, 25 bp, Rattus norvegicus
gagacagtgagctcaccagagagca

SEQ ID NO: 333340 - DNA, 25 bp, Rattus norvegicus
gagacagtgattccacggccaccat

SEQ ID NO: 333341 - DNA, 25 bp, Rattus norvegicus
gagacagtgattgcacggccaccat

SEQ ID NO: 333342 - DNA, 25 bp, Rattus norvegicus
gagacagtgccaaatcttttacaga

SEQ ID NO: 333343 - DNA, 25 bp, Rattus norvegicus
gagacagtgccatatcttttacaga

SEQ ID NO: 333344 - DNA, 25 bp, Rattus norvegicus
gagacagtgcctaagtgattaccga

SEQ ID NO: 333345 - DNA, 25 bp, Rattus norvegicus
gagacagtgccttagtgattaccga

SEQ ID NO: 333346 - DNA, 25 bp, Rattus norvegicus
gagacagtggaaaccctttggaagt

SEQ ID NO: 333347 - DNA, 25 bp, Rattus norvegicus
gagacagtggaatccctttggaagt

SEQ ID NO: 333348 - DNA, 25 bp, Rattus norvegicus
gagacagtgtgcagtgttcctagca

SEQ ID NO: 333349 - DNA, 25 bp, Rattus norvegicus
gagacagtgtgctgtgttcctagca

SEQ ID NO: 333350 - DNA, 25 bp, Rattus norvegicus
gagacagtgtgtcctacagcccaaa

SEQ ID NO: 333351 - DNA, 25 bp, Rattus norvegicus
gagacagtgtgtgctacagcccaaa

SEQ ID NO: 333352 - DNA, 25 bp, Rattus norvegicus
gagacagtgttcatggctcggatgt

SEQ ID NO: 333353 - DNA, 25 bp, Rattus norvegicus
gagacagtgttcttggctcggatgt

SEQ ID NO: 333354 - DNA, 25 bp, Rattus norvegicus
gagacagtgtttactttataccggg

SEQ ID NO: 333355 - DNA, 25 bp, Rattus norvegicus
gagacagtgttttctttataccggg

SEQ ID NO: 333356 - DNA, 25 bp, Rattus norvegicus
gagacagttccaaatttccatccaa

SEQ ID NO: 333357 - DNA, 25 bp, Rattus norvegicus
gagacagttccacactactcataag

SEQ ID NO: 333358 - DNA, 25 bp, Rattus norvegicus
gagacagttccagactactcataag

SEQ ID NO: 333359 - DNA, 25 bp, Rattus norvegicus
gagacagttccatatttccatccaa

SEQ ID NO: 333360 - DNA, 25 bp, Rattus norvegicus
gagacagttctgcagcatggctttt

SEQ ID NO: 333361 - DNA, 25 bp, Rattus norvegicus
gagacagttctggagcatggctttt

SEQ ID NO: 333362 - DNA, 25 bp, Rattus norvegicus
gagacagttgctatcagactcctca

SEQ ID NO: 333363 - DNA, 25 bp, Rattus norvegicus
gagacagttgctttcagactcctca

SEQ ID NO: 333364 - DNA, 25 bp, Rattus norvegicus
gagacagttggaacgtccctctgga

SEQ ID NO: 333365 - DNA, 25 bp, Rattus norvegicus
gagacagttggaccgcattattgcc

SEQ ID NO: 333366 - DNA, 25 bp, Rattus norvegicus
gagacagttggagcgcattattgcc

SEQ ID NO: 333367 - DNA, 25 bp, Rattus norvegicus
gagacagttggatcgtccctctgga

SEQ ID NO: 333368 - DNA, 25 bp, Rattus norvegicus
gagacagttgtcaccttctgactta

SEQ ID NO: 333369 - DNA, 25 bp, Rattus norvegicus
gagacagttgtctccttctgactta

SEQ ID NO: 333370 - DNA, 25 bp, Rattus norvegicus
gagacagtttagctcttgtttctat

SEQ ID NO: 333371 - DNA, 25 bp, Rattus norvegicus
gagacagtttaggtcttgtttctat

SEQ ID NO: 333372 - DNA, 25 bp, Rattus norvegicus
gagacagtttcactttcatactcga

SEQ ID NO: 333373 - DNA, 25 bp, Rattus norvegicus
gagacagtttcagtttcatactcga

SEQ ID NO: 333374 - DNA, 25 bp, Rattus norvegicus
gagacagtttttcttatcatgacac

SEQ ID NO: 333375 - DNA, 25 bp, Rattus norvegicus
gagacagtttttgttatcatgacac

SEQ ID NO: 333376 - DNA, 25 bp, Rattus norvegicus
gagacataaacgcatgctcctctta

SEQ ID NO: 333377 - DNA, 25 bp, Rattus norvegicus
gagacataaacggatgctcctctta

SEQ ID NO: 333378 - DNA, 25 bp, Rattus norvegicus
gagacataacagagatcccgtggca

SEQ ID NO: 333379 - DNA, 25 bp, Rattus norvegicus
gagacataacagtgatcccgtggca

SEQ ID NO: 333380 - DNA, 25 bp, Rattus norvegicus
gagacatacagtccacacatgagca

SEQ ID NO: 333381 - DNA, 25 bp, Rattus norvegicus
gagacatacagtgcacacatgagca

SEQ ID NO: 333382 - DNA, 25 bp, Rattus norvegicus
gagacatacctccacatagatcttc

SEQ ID NO: 333383 - DNA, 25 bp, Rattus norvegicus
gagacatacctcgacatagatcttc

SEQ ID NO: 333384 - DNA, 25 bp, Rattus norvegicus
gagacataggccctaccacatgcag

SEQ ID NO: 333385 - DNA, 25 bp, Rattus norvegicus
gagacataggccctttggattataa

SEQ ID NO: 333386 - DNA, 25 bp, Rattus norvegicus
gagacataggccgtaccacatgcag

SEQ ID NO: 333387 - DNA, 25 bp, Rattus norvegicus
gagacataggccgtttggattataa

SEQ ID NO: 333388 - DNA, 25 bp, Rattus norvegicus
gagacatcaccgagccattggcaga

SEQ ID NO: 333389 - DNA, 25 bp, Rattus norvegicus
gagacatcaccgtgccattggcaga

SEQ ID NO: 333390 - DNA, 25 bp, Rattus norvegicus
gagacatcactgaacatggcggcta

SEQ ID NO: 333391 - DNA, 25 bp, Rattus norvegicus
gagacatcactgtacatggcggcta

SEQ ID NO: 333392 - DNA, 25 bp, Rattus norvegicus
gagacatcagacaggtcctgggtct

SEQ ID NO: 333393 - DNA, 25 bp, Rattus norvegicus
gagacatcagactggtcctgggtct

SEQ ID NO: 333394 - DNA, 25 bp, Rattus norvegicus
gagacatcaggtctaagtgattaga

SEQ ID NO: 333395 - DNA, 25 bp, Rattus norvegicus
gagacatcaggtgtaagtgattaga

SEQ ID NO: 333396 - DNA, 25 bp, Rattus norvegicus
gagacatcatcaaagagaatccatg

SEQ ID NO: 333397 - DNA, 25 bp, Rattus norvegicus
gagacatcatcatagagaatccatg

SEQ ID NO: 333398 - DNA, 25 bp, Rattus norvegicus
gagacatccagaagatccatcccga

SEQ ID NO: 333399 - DNA, 25 bp, Rattus norvegicus
gagacatccagatgatccatcccga

SEQ ID NO: 333400 - DNA, 25 bp, Rattus norvegicus
gagacatccagccaggagtcctcat

SEQ ID NO: 333401 - DNA, 25 bp, Rattus norvegicus
gagacatccagcgaggagtcctcat

SEQ ID NO: 333402 - DNA, 25 bp, Rattus norvegicus
gagacatccgccatcatggactaaa

SEQ ID NO: 333403 - DNA, 25 bp, Rattus norvegicus
gagacatccgccttcatggactaaa

SEQ ID NO: 333404 - DNA, 25 bp, Rattus norvegicus
gagacatccgttctagaccaggctt

SEQ ID NO: 333405 - DNA, 25 bp, Rattus norvegicus
gagacatccgttgtagaccaggctt

SEQ ID NO: 333406 - DNA, 25 bp, Rattus norvegicus
gagacatcctcaatattcagcacgc

SEQ ID NO: 333407 - DNA, 25 bp, Rattus norvegicus
gagacatcctcattattcagcacgc

SEQ ID NO: 333408 - DNA, 25 bp, Rattus norvegicus
gagacatcgaggaacagaccttcaa

SEQ ID NO: 333409 - DNA, 25 bp, Rattus norvegicus
gagacatcgaggtacagaccttcaa

SEQ ID NO: 333410 - DNA, 25 bp, Rattus norvegicus
gagacatcggacatcacggtgaggt

SEQ ID NO: 333411 - DNA, 25 bp, Rattus norvegicus
gagacatcggacttcacggtgaggt

SEQ ID NO: 333412 - DNA, 25 bp, Rattus norvegicus
gagacatctatgacagaccacagca

SEQ ID NO: 333413 - DNA, 25 bp, Rattus norvegicus
gagacatctatgtcagaccacagca

SEQ ID NO: 333414 - DNA, 25 bp, Rattus norvegicus
gagacatctattaataaccaacctt

SEQ ID NO: 333415 - DNA, 25 bp, Rattus norvegicus
gagacatctatttataaccaacctt

SEQ ID NO: 333416 - DNA, 25 bp, Rattus norvegicus
gagacatctgctaccacactaggta

SEQ ID NO: 333417 - DNA, 25 bp, Rattus norvegicus
gagacatctgcttccacactaggta

SEQ ID NO: 333418 - DNA, 25 bp, Rattus norvegicus
gagacatctgtcctggttactgctt

SEQ ID NO: 333419 - DNA, 25 bp, Rattus norvegicus
gagacatctgtcgtggttactgctt

SEQ ID NO: 333420 - DNA, 25 bp, Rattus norvegicus
gagacatctgttcgtccaggaagca

SEQ ID NO: 333421 - DNA, 25 bp, Rattus norvegicus
gagacatctgttggtccaggaagca

SEQ ID NO: 333422 - DNA, 25 bp, Rattus norvegicus
gagacatcttgcatactagccacac

SEQ ID NO: 333423 - DNA, 25 bp, Rattus norvegicus
gagacatcttgcttactagccacac

SEQ ID NO: 333424 - DNA, 25 bp, Rattus norvegicus
gagacatgacaacaaagaggacact

SEQ ID NO: 333425 - DNA, 25 bp, Rattus norvegicus
gagacatgacaagaaagaggacact

SEQ ID NO: 333426 - DNA, 25 bp, Rattus norvegicus
gagacatgacctagtatgctttgag

SEQ ID NO: 333427 - DNA, 25 bp, Rattus norvegicus
gagacatgaccttgtatgctttgag

SEQ ID NO: 333428 - DNA, 25 bp, Rattus norvegicus
gagacatgacgacgcggtgcacttt

SEQ ID NO: 333429 - DNA, 25 bp, Rattus norvegicus
gagacatgacgaggcggtgcacttt

SEQ ID NO: 333430 - DNA, 25 bp, Rattus norvegicus
gagacatgactgctctttttgctga

SEQ ID NO: 333431 - DNA, 25 bp, Rattus norvegicus
gagacatgactggtctttttgctga

SEQ ID NO: 333432 - DNA, 25 bp, Rattus norvegicus
gagacatgaggcacagactccgttt

SEQ ID NO: 333433 - DNA, 25 bp, Rattus norvegicus
gagacatgaggcatcccgggaaagt

SEQ ID NO: 333434 - DNA, 25 bp, Rattus norvegicus
gagacatgaggctcagactccgttt

SEQ ID NO: 333435 - DNA, 25 bp, Rattus norvegicus
gagacatgaggcttcccgggaaagt

SEQ ID NO: 333436 - DNA, 25 bp, Rattus norvegicus
gagacatgcttcaggccagcttgtg

SEQ ID NO: 333437 - DNA, 25 bp, Rattus norvegicus
gagacatgcttctggccagcttgtg

SEQ ID NO: 333438 - DNA, 25 bp, Rattus norvegicus
gagacatggagtctccctcagcgag

SEQ ID NO: 333439 - DNA, 25 bp, Rattus norvegicus
gagacatggagtgtccctcagcgag

SEQ ID NO: 333440 - DNA, 25 bp, Rattus norvegicus
gagacatggctcactgtaagcctag

SEQ ID NO: 333441 - DNA, 25 bp, Rattus norvegicus
gagacatggctctctgtaagcctag

SEQ ID NO: 333442 - DNA, 25 bp, Rattus norvegicus
gagacatggtgaacatctggcagaa

SEQ ID NO: 333443 - DNA, 25 bp, Rattus norvegicus
gagacatggtgatcatctggcagaa

SEQ ID NO: 333444 - DNA, 25 bp, Rattus norvegicus
gagacatgtactcatttttcctgag

SEQ ID NO: 333445 - DNA, 25 bp, Rattus norvegicus
gagacatgtactgatttttcctgag

SEQ ID NO: 333446 - DNA, 25 bp, Rattus norvegicus
gagacatgtgaccagccagtcgcct

SEQ ID NO: 333447 - DNA, 25 bp, Rattus norvegicus
gagacatgtgacgagccagtcgcct

SEQ ID NO: 333448 - DNA, 25 bp, Rattus norvegicus
gagacatgtggcagctttactttct

SEQ ID NO: 333449 - DNA, 25 bp, Rattus norvegicus
gagacatgtggctgctttactttct

SEQ ID NO: 333450 - DNA, 25 bp, Rattus norvegicus
gagacatgttatacttcatagctaa

SEQ ID NO: 333451 - DNA, 25 bp, Rattus norvegicus
gagacatgttattcttcatagctaa

SEQ ID NO: 333452 - DNA, 25 bp, Rattus norvegicus
gagacattcaccatatcgactacta

SEQ ID NO: 333453 - DNA, 25 bp, Rattus norvegicus
gagacattcaccttatcgactacta

SEQ ID NO: 333454 - DNA, 25 bp, Rattus norvegicus
gagacattccgaaagttcacagagt

SEQ ID NO: 333455 - DNA, 25 bp, Rattus norvegicus
gagacattccgatagttcacagagt

SEQ ID NO: 333456 - DNA, 25 bp, Rattus norvegicus
gagacattctagaacagctctgtga

SEQ ID NO: 333457 - DNA, 25 bp, Rattus norvegicus
gagacattctagtacagctctgtga

SEQ ID NO: 333458 - DNA, 25 bp, Rattus norvegicus
gagacattctatatccagatccagg

SEQ ID NO: 333459 - DNA, 25 bp, Rattus norvegicus
gagacattctatttccagatccagg

SEQ ID NO: 333460 - DNA, 25 bp, Rattus norvegicus
gagacattcttacctcttctctttc

SEQ ID NO: 333461 - DNA, 25 bp, Rattus norvegicus
gagacattcttagctcttctctttc

SEQ ID NO: 333462 - DNA, 25 bp, Rattus norvegicus
gagacattggttccccacagtgtta

SEQ ID NO: 333463 - DNA, 25 bp, Rattus norvegicus
gagacattggttgcccacagtgtta

SEQ ID NO: 333464 - DNA, 25 bp, Rattus norvegicus
gagacattgtagacagttaccctgg

SEQ ID NO: 333465 - DNA, 25 bp, Rattus norvegicus
gagacattgtagtcagttaccctgg

SEQ ID NO: 333466 - DNA, 25 bp, Rattus norvegicus
gagacattgtgtcctttgtgactga

SEQ ID NO: 333467 - DNA, 25 bp, Rattus norvegicus
gagacattgtgtgctttgtgactga

SEQ ID NO: 333468 - DNA, 25 bp, Rattus norvegicus
gagacattgttcagtgccatgaccc

SEQ ID NO: 333469 - DNA, 25 bp, Rattus norvegicus
gagacattgttctgtgccatgaccc

SEQ ID NO: 333470 - DNA, 25 bp, Rattus norvegicus
gagacatttctcagctgaggctctt

SEQ ID NO: 333471 - DNA, 25 bp, Rattus norvegicus
gagacatttctctgctgaggctctt

SEQ ID NO: 333472 - DNA, 25 bp, Rattus norvegicus
gagacatttgacatttccttctgcc

SEQ ID NO: 333473 - DNA, 25 bp, Rattus norvegicus
gagacatttgacttttccttctgcc

SEQ ID NO: 333474 - DNA, 25 bp, Rattus norvegicus
gagacatttgccaaaaaacttgatg

SEQ ID NO: 333475 - DNA, 25 bp, Rattus norvegicus
gagacatttgcctaaaaacttgatg

SEQ ID NO: 333476 - DNA, 25 bp, Rattus norvegicus
gagacatttgctctagtatggtgta

SEQ ID NO: 333477 - DNA, 25 bp, Rattus norvegicus
gagacatttgctctgtagtcgtgct

SEQ ID NO: 333478 - DNA, 25 bp, Rattus norvegicus
gagacatttgctgtagtatggtgta

SEQ ID NO: 333479 - DNA, 25 bp, Rattus norvegicus
gagacatttgctgtgtagtcgtgct

SEQ ID NO: 333480 - DNA, 25 bp, Rattus norvegicus
gagacatttgtaaagggagcagcct

SEQ ID NO: 333481 - DNA, 25 bp, Rattus norvegicus
gagacatttgtatagggagcagcct

SEQ ID NO: 333482 - DNA, 25 bp, Rattus norvegicus
gagacattttctctttgaactatat

SEQ ID NO: 333483 - DNA, 25 bp, Rattus norvegicus
gagacattttctgtttgaactatat

SEQ ID NO: 333484 - DNA, 25 bp, Rattus norvegicus
gagaccaaaagcctctgatttttaa

SEQ ID NO: 333485 - DNA, 25 bp, Rattus norvegicus
gagaccaaaagcgtctgatttttaa

SEQ ID NO: 333486 - DNA, 25 bp, Rattus norvegicus
gagaccaaaagtccttgcttctgcc

SEQ ID NO: 333487 - DNA, 25 bp, Rattus norvegicus
gagaccaaaagtgcttgcttctgcc

SEQ ID NO: 333488 - DNA, 25 bp, Rattus norvegicus
gagaccaaactcctaaaatgccatt

SEQ ID NO: 333489 - DNA, 25 bp, Rattus norvegicus
gagaccaaactcgtaaaatgccatt

SEQ ID NO: 333490 - DNA, 25 bp, Rattus norvegicus
gagaccaaatttcctgcctttgact

SEQ ID NO: 333491 - DNA, 25 bp, Rattus norvegicus
gagaccaaatttgctgcctttgact

SEQ ID NO: 333492 - DNA, 25 bp, Rattus norvegicus
gagaccaacacaaggcgctacagga

SEQ ID NO: 333493 - DNA, 25 bp, Rattus norvegicus
gagaccaacacatggcgctacagga

SEQ ID NO: 333494 - DNA, 25 bp, Rattus norvegicus
gagaccaacactagggctctggaaa

SEQ ID NO: 333495 - DNA, 25 bp, Rattus norvegicus
gagaccaacacttgggctctggaaa

SEQ ID NO: 333496 - DNA, 25 bp, Rattus norvegicus
gagaccaacccaacgtattgcattt

SEQ ID NO: 333497 - DNA, 25 bp, Rattus norvegicus
gagaccaacccatcgtattgcattt

SEQ ID NO: 333498 - DNA, 25 bp, Rattus norvegicus
gagaccaacctgaggcacagctgta

SEQ ID NO: 333499 - DNA, 25 bp, Rattus norvegicus
gagaccaacctgtggcacagctgta

SEQ ID NO: 333500 - DNA, 25 bp, Rattus norvegicus
gagaccaaccttcaagccgatcttc

SEQ ID NO: 333501 - DNA, 25 bp, Rattus norvegicus
gagaccaaccttgaagccgatcttc

SEQ ID NO: 333502 - DNA, 25 bp, Rattus norvegicus
gagaccaagaacagaaatcgtttgt

SEQ ID NO: 333503 - DNA, 25 bp, Rattus norvegicus
gagaccaagaactgaaatcgtttgt

SEQ ID NO: 333504 - DNA, 25 bp, Rattus norvegicus
gagaccaagaagaaacccaaaccag

SEQ ID NO: 333505 - DNA, 25 bp, Rattus norvegicus
gagaccaagaagtaacccaaaccag

SEQ ID NO: 333506 - DNA, 25 bp, Rattus norvegicus
gagaccaagagcaggtactgcgctg

SEQ ID NO: 333507 - DNA, 25 bp, Rattus norvegicus
gagaccaagagctggtactgcgctg

SEQ ID NO: 333508 - DNA, 25 bp, Rattus norvegicus
gagaccaagattacagagcccatga

SEQ ID NO: 333509 - DNA, 25 bp, Rattus norvegicus
gagaccaagatttcagagcccatga

SEQ ID NO: 333510 - DNA, 25 bp, Rattus norvegicus
gagaccaatctgaggaatcttattt

SEQ ID NO: 333511 - DNA, 25 bp, Rattus norvegicus
gagaccaatctgtggaatcttattt

SEQ ID NO: 333512 - DNA, 25 bp, Rattus norvegicus
gagaccacacccacttggagcgtca

SEQ ID NO: 333513 - DNA, 25 bp, Rattus norvegicus
gagaccacaccctcttggagcgtca

SEQ ID NO: 333514 - DNA, 25 bp, Rattus norvegicus
gagaccacactcatggagctgagac

SEQ ID NO: 333515 - DNA, 25 bp, Rattus norvegicus
gagaccacactcttggagctgagac

SEQ ID NO: 333516 - DNA, 25 bp, Rattus norvegicus
gagaccacagaaagcacagatgtca

SEQ ID NO: 333517 - DNA, 25 bp, Rattus norvegicus
gagaccacagaatgcacagatgtca

SEQ ID NO: 333518 - DNA, 25 bp, Rattus norvegicus
gagaccacagccagggtgtactcga

SEQ ID NO: 333519 - DNA, 25 bp, Rattus norvegicus
gagaccacagcctgggtgtactcga

SEQ ID NO: 333520 - DNA, 25 bp, Rattus norvegicus
gagaccacatggctctgatatctgt

SEQ ID NO: 333521 - DNA, 25 bp, Rattus norvegicus
gagaccacatgggtctgatatctgt

SEQ ID NO: 333522 - DNA, 25 bp, Rattus norvegicus
gagaccacatttatcatagctcttt

SEQ ID NO: 333523 - DNA, 25 bp, Rattus norvegicus
gagaccacatttttcatagctcttt

SEQ ID NO: 333524 - DNA, 25 bp, Rattus norvegicus
gagaccaccaaactcattcctggag

SEQ ID NO: 333525 - DNA, 25 bp, Rattus norvegicus
gagaccaccaaagtcattcctggag

SEQ ID NO: 333526 - DNA, 25 bp, Rattus norvegicus
gagaccaccagtctgttcctaagat

SEQ ID NO: 333527 - DNA, 25 bp, Rattus norvegicus
gagaccaccagtgtgttcctaagat

SEQ ID NO: 333528 - DNA, 25 bp, Rattus norvegicus
gagaccacccatcggaggccatatg

SEQ ID NO: 333529 - DNA, 25 bp, Rattus norvegicus
gagaccacccatgggaggccatatg

SEQ ID NO: 333530 - DNA, 25 bp, Rattus norvegicus
gagaccacccgtcaagaggtccagt

SEQ ID NO: 333531 - DNA, 25 bp, Rattus norvegicus
gagaccacccgtgaagaggtccagt

SEQ ID NO: 333532 - DNA, 25 bp, Rattus norvegicus
gagaccacgagtattaggcatcgca

SEQ ID NO: 333533 - DNA, 25 bp, Rattus norvegicus
gagaccacgagttttaggcatcgca

SEQ ID NO: 333534 - DNA, 25 bp, Rattus norvegicus
gagaccacggctcctagagtcagaa

SEQ ID NO: 333535 - DNA, 25 bp, Rattus norvegicus
gagaccacggctgctagagtcagaa

SEQ ID NO: 333536 - DNA, 25 bp, Rattus norvegicus
gagaccacggtcacacagcgaatgt

SEQ ID NO: 333537 - DNA, 25 bp, Rattus norvegicus
gagaccacggtctcacagcgaatgt

SEQ ID NO: 333538 - DNA, 25 bp, Rattus norvegicus
gagaccacgtctaaaacgatagcaa

SEQ ID NO: 333539 - DNA, 25 bp, Rattus norvegicus
gagaccacgtcttaaacgatagcaa

SEQ ID NO: 333540 - DNA, 25 bp, Rattus norvegicus
gagaccacgtgcatttcggtcatga

SEQ ID NO: 333541 - DNA, 25 bp, Rattus norvegicus
gagaccacgtgcttttcggtcatga

SEQ ID NO: 333542 - DNA, 25 bp, Rattus norvegicus
gagaccactcacatgtaagaccttt

SEQ ID NO: 333543 - DNA, 25 bp, Rattus norvegicus
gagaccactcacttgtaagaccttt

SEQ ID NO: 333544 - DNA, 25 bp, Rattus norvegicus
gagaccactgcacacaaccggaaag

SEQ ID NO: 333545 - DNA, 25 bp, Rattus norvegicus
gagaccactgcagacaaccggaaag

SEQ ID NO: 333546 - DNA, 25 bp, Rattus norvegicus
gagaccactgtcaacactgaactgt

SEQ ID NO: 333547 - DNA, 25 bp, Rattus norvegicus
gagaccactgtctacactgaactgt

SEQ ID NO: 333548 - DNA, 25 bp, Rattus norvegicus
gagaccacttctcacaagagcaaag

SEQ ID NO: 333549 - DNA, 25 bp, Rattus norvegicus
gagaccacttctgacaagagcaaag

SEQ ID NO: 333550 - DNA, 25 bp, Rattus norvegicus
gagaccacttggagcacggtttaac

SEQ ID NO: 333551 - DNA, 25 bp, Rattus norvegicus
gagaccacttggtgcacggtttaac

SEQ ID NO: 333552 - DNA, 25 bp, Rattus norvegicus
gagaccactttaacctaatactgcc

SEQ ID NO: 333553 - DNA, 25 bp, Rattus norvegicus
gagaccactttatcctaatactgcc

SEQ ID NO: 333554 - DNA, 25 bp, Rattus norvegicus
gagaccagaaaaaaatgttccagac

SEQ ID NO: 333555 - DNA, 25 bp, Rattus norvegicus
gagaccagaaaataatgttccagac

SEQ ID NO: 333556 - DNA, 25 bp, Rattus norvegicus
gagaccagacatacatgcctgtcag

SEQ ID NO: 333557 - DNA, 25 bp, Rattus norvegicus
gagaccagacattcatgcctgtcag

SEQ ID NO: 333558 - DNA, 25 bp, Rattus norvegicus
gagaccagacccaggccatcgaggg

SEQ ID NO: 333559 - DNA, 25 bp, Rattus norvegicus
gagaccagaccctggccatcgaggg

SEQ ID NO: 333560 - DNA, 25 bp, Rattus norvegicus
gagaccagatagaggcctttcccaa

SEQ ID NO: 333561 - DNA, 25 bp, Rattus norvegicus
gagaccagatagtggcctttcccaa

SEQ ID NO: 333562 - DNA, 25 bp, Rattus norvegicus
gagaccagatctctcagcctgaggt

SEQ ID NO: 333563 - DNA, 25 bp, Rattus norvegicus
gagaccagatctgtcagcctgaggt

SEQ ID NO: 333564 - DNA, 25 bp, Rattus norvegicus
gagaccagcaacacccagaaaggga

SEQ ID NO: 333565 - DNA, 25 bp, Rattus norvegicus
gagaccagcaactcccagaaaggga

SEQ ID NO: 333566 - DNA, 25 bp, Rattus norvegicus
gagaccagcagtaagcgtgcccagc

SEQ ID NO: 333567 - DNA, 25 bp, Rattus norvegicus
gagaccagcagttagcgtgcccagc

SEQ ID NO: 333568 - DNA, 25 bp, Rattus norvegicus
gagaccagcctacagggaccgcact

SEQ ID NO: 333569 - DNA, 25 bp, Rattus norvegicus
gagaccagcctagagggaccgcact

SEQ ID NO: 333570 - DNA, 25 bp, Rattus norvegicus
gagaccagcctcatgaaagagccct

SEQ ID NO: 333571 - DNA, 25 bp, Rattus norvegicus
gagaccagcctcttgaaagagccct

SEQ ID NO: 333572 - DNA, 25 bp, Rattus norvegicus
gagaccagcctgagtcctaaggttt

SEQ ID NO: 333573 - DNA, 25 bp, Rattus norvegicus
gagaccagcctgtgtcctaaggttt

SEQ ID NO: 333574 - DNA, 25 bp, Rattus norvegicus
gagaccagctcaaatacctctaaga

SEQ ID NO: 333575 - DNA, 25 bp, Rattus norvegicus
gagaccagctcatatacctctaaga

SEQ ID NO: 333576 - DNA, 25 bp, Rattus norvegicus
gagaccaggaggagctcaaccctta

SEQ ID NO: 333577 - DNA, 25 bp, Rattus norvegicus
gagaccaggaggtgctcaaccctta

SEQ ID NO: 333578 - DNA, 25 bp, Rattus norvegicus
gagaccaggataagtaacgcctatg

SEQ ID NO: 333579 - DNA, 25 bp, Rattus norvegicus
gagaccaggatatgtaacgcctatg

SEQ ID NO: 333580 - DNA, 25 bp, Rattus norvegicus
gagaccaggctgatttgtgaataaa

SEQ ID NO: 333581 - DNA, 25 bp, Rattus norvegicus
gagaccaggctgttttgtgaataaa

SEQ ID NO: 333582 - DNA, 25 bp, Rattus norvegicus
gagaccagtagaccacttacacttc

SEQ ID NO: 333583 - DNA, 25 bp, Rattus norvegicus
gagaccagtagagcacttacacttc

SEQ ID NO: 333584 - DNA, 25 bp, Rattus norvegicus
gagaccagtataaatgcagctctat

SEQ ID NO: 333585 - DNA, 25 bp, Rattus norvegicus
gagaccagtatatatgcagctctat

SEQ ID NO: 333586 - DNA, 25 bp, Rattus norvegicus
gagaccagtcatcaccaccaaggag

SEQ ID NO: 333587 - DNA, 25 bp, Rattus norvegicus
gagaccagtcatgaccaccaaggag

SEQ ID NO: 333588 - DNA, 25 bp, Rattus norvegicus
gagaccagtgccagagggagaccct

SEQ ID NO: 333589 - DNA, 25 bp, Rattus norvegicus
gagaccagtgcctgagggagaccct

SEQ ID NO: 333590 - DNA, 25 bp, Rattus norvegicus
gagaccagtgctcctattcacacag

SEQ ID NO: 333591 - DNA, 25 bp, Rattus norvegicus
gagaccagtgctgctattcacacag

SEQ ID NO: 333592 - DNA, 25 bp, Rattus norvegicus
gagaccagttctctattgtcactga

SEQ ID NO: 333593 - DNA, 25 bp, Rattus norvegicus
gagaccagttctgtattgtcactga

SEQ ID NO: 333594 - DNA, 25 bp, Rattus norvegicus
gagaccagtttgatcctgcatcata

SEQ ID NO: 333595 - DNA, 25 bp, Rattus norvegicus
gagaccagtttgttcctgcatcata

SEQ ID NO: 333596 - DNA, 25 bp, Rattus norvegicus
gagaccataagaatgcctggctgtg

SEQ ID NO: 333597 - DNA, 25 bp, Rattus norvegicus
gagaccataagattgcctggctgtg

SEQ ID NO: 333598 - DNA, 25 bp, Rattus norvegicus
gagaccatcatgacgctgcgcacgt

SEQ ID NO: 333599 - DNA, 25 bp, Rattus norvegicus
gagaccatcatgtcgctgcgcacgt

SEQ ID NO: 333600 - DNA, 25 bp, Rattus norvegicus
gagaccatcccactgatgctgagat

SEQ ID NO: 333601 - DNA, 25 bp, Rattus norvegicus
gagaccatcccagtgatgctgagat

SEQ ID NO: 333602 - DNA, 25 bp, Rattus norvegicus
gagaccatcccgatgcaacgtgaag

SEQ ID NO: 333603 - DNA, 25 bp, Rattus norvegicus
gagaccatcccgttgcaacgtgaag

SEQ ID NO: 333604 - DNA, 25 bp, Rattus norvegicus
gagaccatcctaaaaagcatcttta

SEQ ID NO: 333605 - DNA, 25 bp, Rattus norvegicus
gagaccatcctataaagcatcttta

SEQ ID NO: 333606 - DNA, 25 bp, Rattus norvegicus
gagaccatcctcagtggtccagaga

SEQ ID NO: 333607 - DNA, 25 bp, Rattus norvegicus
gagaccatcctctgtggtccagaga

SEQ ID NO: 333608 - DNA, 25 bp, Rattus norvegicus
gagaccatcttacagtttctatcgc

SEQ ID NO: 333609 - DNA, 25 bp, Rattus norvegicus
gagaccatcttagagtttctatcgc

SEQ ID NO: 333610 - DNA, 25 bp, Rattus norvegicus
gagaccatgacacgcctgatgattt

SEQ ID NO: 333611 - DNA, 25 bp, Rattus norvegicus
gagaccatgacaggcctgatgattt

SEQ ID NO: 333612 - DNA, 25 bp, Rattus norvegicus
gagaccatgagacgttgcccatcat

SEQ ID NO: 333613 - DNA, 25 bp, Rattus norvegicus
gagaccatgagaggttgcccatcat

SEQ ID NO: 333614 - DNA, 25 bp, Rattus norvegicus
gagaccatgcggcagcttcgaaact

SEQ ID NO: 333615 - DNA, 25 bp, Rattus norvegicus
gagaccatgcgggagcttcgaaact

SEQ ID NO: 333616 - DNA, 25 bp, Rattus norvegicus
gagaccatgctaacaatcatcttta

SEQ ID NO: 333617 - DNA, 25 bp, Rattus norvegicus
gagaccatgctatcaatcatcttta

SEQ ID NO: 333618 - DNA, 25 bp, Rattus norvegicus
gagaccatgctgaatcccagggaaa

SEQ ID NO: 333619 - DNA, 25 bp, Rattus norvegicus
gagaccatgctgtatcccagggaaa

SEQ ID NO: 333620 - DNA, 25 bp, Rattus norvegicus
gagaccatggcactgagtgtgctca

SEQ ID NO: 333621 - DNA, 25 bp, Rattus norvegicus
gagaccatggcagtgagtgtgctca

SEQ ID NO: 333622 - DNA, 25 bp, Rattus norvegicus
gagaccatggctagacctctaaata

SEQ ID NO: 333623 - DNA, 25 bp, Rattus norvegicus
gagaccatggcttgacctctaaata

SEQ ID NO: 333624 - DNA, 25 bp, Rattus norvegicus
gagaccatggtacttgaatcgttca

SEQ ID NO: 333625 - DNA, 25 bp, Rattus norvegicus
gagaccatggtagttgaatcgttca

SEQ ID NO: 333626 - DNA, 25 bp, Rattus norvegicus
gagaccatgtccaaagccggagtaa

SEQ ID NO: 333627 - DNA, 25 bp, Rattus norvegicus
gagaccatgtcctaagccggagtaa

SEQ ID NO: 333628 - DNA, 25 bp, Rattus norvegicus
gagaccattactatcctctataaat

SEQ ID NO: 333629 - DNA, 25 bp, Rattus norvegicus
gagaccattactttcctctataaat

SEQ ID NO: 333630 - DNA, 25 bp, Rattus norvegicus
gagaccattataaatctgactcctg

SEQ ID NO: 333631 - DNA, 25 bp, Rattus norvegicus
gagaccattatatatctgactcctg

SEQ ID NO: 333632 - DNA, 25 bp, Rattus norvegicus
gagaccattgtgattgtaagccata

SEQ ID NO: 333633 - DNA, 25 bp, Rattus norvegicus
gagaccattgtgtttgtaagccata

SEQ ID NO: 333634 - DNA, 25 bp, Rattus norvegicus
gagaccatttgtatacctttgtgac

SEQ ID NO: 333635 - DNA, 25 bp, Rattus norvegicus
gagaccatttgtttacctttgtgac

SEQ ID NO: 333636 - DNA, 25 bp, Rattus norvegicus
gagaccattttaagagctaatcctt

SEQ ID NO: 333637 - DNA, 25 bp, Rattus norvegicus
gagaccattttatgagctaatcctt

SEQ ID NO: 333638 - DNA, 25 bp, Rattus norvegicus
gagaccatttttcctgcatcataat

SEQ ID NO: 333639 - DNA, 25 bp, Rattus norvegicus
gagaccatttttgctgcatcataat

SEQ ID NO: 333640 - DNA, 25 bp, Rattus norvegicus
gagacccaaaagcttggccccagtt

SEQ ID NO: 333641 - DNA, 25 bp, Rattus norvegicus
gagacccaaaaggttggccccagtt

SEQ ID NO: 333642 - DNA, 25 bp, Rattus norvegicus
gagacccaaagacacccaggttgta

SEQ ID NO: 333643 - DNA, 25 bp, Rattus norvegicus
gagacccaaagagacccaggttgta

SEQ ID NO: 333644 - DNA, 25 bp, Rattus norvegicus
gagacccaagaccttaatataagaa

SEQ ID NO: 333645 - DNA, 25 bp, Rattus norvegicus
gagacccaagacgttaatataagaa

SEQ ID NO: 333646 - DNA, 25 bp, Rattus norvegicus
gagacccaaggaaccaaataactta

SEQ ID NO: 333647 - DNA, 25 bp, Rattus norvegicus
gagacccaaggacaactatttttcg

SEQ ID NO: 333648 - DNA, 25 bp, Rattus norvegicus
gagacccaaggagaactatttttcg

SEQ ID NO: 333649 - DNA, 25 bp, Rattus norvegicus
gagacccaaggatccaaataactta

SEQ ID NO: 333650 - DNA, 25 bp, Rattus norvegicus
gagacccaaggcctgtactcaggat

SEQ ID NO: 333651 - DNA, 25 bp, Rattus norvegicus
gagacccaaggcgtgtactcaggat

SEQ ID NO: 333652 - DNA, 25 bp, Rattus norvegicus
gagacccacaagcatggcacagcta

SEQ ID NO: 333653 - DNA, 25 bp, Rattus norvegicus
gagacccacaaggatggcacagcta

SEQ ID NO: 333654 - DNA, 25 bp, Rattus norvegicus
gagacccacatcacgactactgtga

SEQ ID NO: 333655 - DNA, 25 bp, Rattus norvegicus
gagacccacatcatttctaaggcat

SEQ ID NO: 333656 - DNA, 25 bp, Rattus norvegicus
gagacccacatctcgactactgtga

SEQ ID NO: 333657 - DNA, 25 bp, Rattus norvegicus
gagacccacatcttttctaaggcat

SEQ ID NO: 333658 - DNA, 25 bp, Rattus norvegicus
gagacccacatgaactcttctggaa

SEQ ID NO: 333659 - DNA, 25 bp, Rattus norvegicus
gagacccacatgtactcttctggaa

SEQ ID NO: 333660 - DNA, 25 bp, Rattus norvegicus
gagacccactgcagccgctgctgga

SEQ ID NO: 333661 - DNA, 25 bp, Rattus norvegicus
gagacccactgctgccgctgctgga

SEQ ID NO: 333662 - DNA, 25 bp, Rattus norvegicus
gagacccactgtctgagctgtggat

SEQ ID NO: 333663 - DNA, 25 bp, Rattus norvegicus
gagacccactgtgtgagctgtggat

SEQ ID NO: 333664 - DNA, 25 bp, Rattus norvegicus
gagacccactttattcagttctgta

SEQ ID NO: 333665 - DNA, 25 bp, Rattus norvegicus
gagacccacttttttcagttctgta

SEQ ID NO: 333666 - DNA, 25 bp, Rattus norvegicus
gagacccagaaaaatgtactagtga

SEQ ID NO: 333667 - DNA, 25 bp, Rattus norvegicus
gagacccagaaatatgtactagtga

SEQ ID NO: 333668 - DNA, 25 bp, Rattus norvegicus
gagacccagaagcttctgcctctct

SEQ ID NO: 333669 - DNA, 25 bp, Rattus norvegicus
gagacccagaaggttctgcctctct

SEQ ID NO: 333670 - DNA, 25 bp, Rattus norvegicus
gagacccagaccctgattcagagtt

SEQ ID NO: 333671 - DNA, 25 bp, Rattus norvegicus
gagacccagaccgtgattcagagtt

SEQ ID NO: 333672 - DNA, 25 bp, Rattus norvegicus
gagacccagactaccgggagaggct

SEQ ID NO: 333673 - DNA, 25 bp, Rattus norvegicus
gagacccagacttccgggagaggct

SEQ ID NO: 333674 - DNA, 25 bp, Rattus norvegicus
gagacccagagacctcatttgttgt

SEQ ID NO: 333675 - DNA, 25 bp, Rattus norvegicus
gagacccagagagctcatttgttgt

SEQ ID NO: 333676 - DNA, 25 bp, Rattus norvegicus
gagacccagagcaaaagtcaccaga

SEQ ID NO: 333677 - DNA, 25 bp, Rattus norvegicus
gagacccagagctaaagtcaccaga

SEQ ID NO: 333678 - DNA, 25 bp, Rattus norvegicus
gagacccagcatattgaaacttcga

SEQ ID NO: 333679 - DNA, 25 bp, Rattus norvegicus
gagacccagcattttgaaacttcga

SEQ ID NO: 333680 - DNA, 25 bp, Rattus norvegicus
gagacccagctgagtgagctccgct

SEQ ID NO: 333681 - DNA, 25 bp, Rattus norvegicus
gagacccagctgtgtgagctccgct

SEQ ID NO: 333682 - DNA, 25 bp, Rattus norvegicus
gagacccaggaaaagcaggaacact

SEQ ID NO: 333683 - DNA, 25 bp, Rattus norvegicus
gagacccaggaatagcaggaacact

SEQ ID NO: 333684 - DNA, 25 bp, Rattus norvegicus
gagacccaggacctaggctcagagc

SEQ ID NO: 333685 - DNA, 25 bp, Rattus norvegicus
gagacccaggacgtaggctcagagc

SEQ ID NO: 333686 - DNA, 25 bp, Rattus norvegicus
gagacccagggaacatcaggcacca

SEQ ID NO: 333687 - DNA, 25 bp, Rattus norvegicus
gagacccagggacgctgaactcaga

SEQ ID NO: 333688 - DNA, 25 bp, Rattus norvegicus
gagacccagggaggctgaactcaga

SEQ ID NO: 333689 - DNA, 25 bp, Rattus norvegicus
gagacccagggatcatcaggcacca

SEQ ID NO: 333690 - DNA, 25 bp, Rattus norvegicus
gagacccaggttacaggttcttact

SEQ ID NO: 333691 - DNA, 25 bp, Rattus norvegicus
gagacccaggtttcaggttcttact

SEQ ID NO: 333692 - DNA, 25 bp, Rattus norvegicus
gagacccagtttacaagatctattt

SEQ ID NO: 333693 - DNA, 25 bp, Rattus norvegicus
gagacccagtttaggcctgtgtgac

SEQ ID NO: 333694 - DNA, 25 bp, Rattus norvegicus
gagacccagttttcaagatctattt

SEQ ID NO: 333695 - DNA, 25 bp, Rattus norvegicus
gagacccagttttggcctgtgtgac

SEQ ID NO: 333696 - DNA, 25 bp, Rattus norvegicus
gagacccatcaaagtggacagccag

SEQ ID NO: 333697 - DNA, 25 bp, Rattus norvegicus
gagacccatcaatgtggacagccag

SEQ ID NO: 333698 - DNA, 25 bp, Rattus norvegicus
gagacccatctcaaagaccagacaa

SEQ ID NO: 333699 - DNA, 25 bp, Rattus norvegicus
gagacccatctctaagaccagacaa

SEQ ID NO: 333700 - DNA, 25 bp, Rattus norvegicus
gagacccatgacacctaagtggact

SEQ ID NO: 333701 - DNA, 25 bp, Rattus norvegicus
gagacccatgactcctaagtggact

SEQ ID NO: 333702 - DNA, 25 bp, Rattus norvegicus
gagacccatgatcatttgatccctg

SEQ ID NO: 333703 - DNA, 25 bp, Rattus norvegicus
gagacccatgatgatttgatccctg

SEQ ID NO: 333704 - DNA, 25 bp, Rattus norvegicus
gagacccatgtccatgctgtattat

SEQ ID NO: 333705 - DNA, 25 bp, Rattus norvegicus
gagacccatgtcgatgctgtattat

SEQ ID NO: 333706 - DNA, 25 bp, Rattus norvegicus
gagacccatgtgaaaccaggaagag

SEQ ID NO: 333707 - DNA, 25 bp, Rattus norvegicus
gagacccatgtgtaaccaggaagag

SEQ ID NO: 333708 - DNA, 25 bp, Rattus norvegicus
gagacccattaacgagatcggctag

SEQ ID NO: 333709 - DNA, 25 bp, Rattus norvegicus
gagacccattaaggagatcggctag

SEQ ID NO: 333710 - DNA, 25 bp, Rattus norvegicus
gagacccattccagcatccatgtgt

SEQ ID NO: 333711 - DNA, 25 bp, Rattus norvegicus
gagacccattcctgcatccatgtgt

SEQ ID NO: 333712 - DNA, 25 bp, Rattus norvegicus
gagacccatttactaagcctcgttg

SEQ ID NO: 333713 - DNA, 25 bp, Rattus norvegicus
gagacccatttagtaagcctcgttg

SEQ ID NO: 333714 - DNA, 25 bp, Rattus norvegicus
gagacccatttcctttagagagctt

SEQ ID NO: 333715 - DNA, 25 bp, Rattus norvegicus
gagacccatttcgtttagagagctt

SEQ ID NO: 333716 - DNA, 25 bp, Rattus norvegicus
gagaccccaagaccctacaagattt

SEQ ID NO: 333717 - DNA, 25 bp, Rattus norvegicus
gagaccccaagagcctacaagattt

SEQ ID NO: 333718 - DNA, 25 bp, Rattus norvegicus
gagaccccacgaaggatgaagctaa

SEQ ID NO: 333719 - DNA, 25 bp, Rattus norvegicus
gagaccccacgatggatgaagctaa

SEQ ID NO: 333720 - DNA, 25 bp, Rattus norvegicus
gagaccccagacagtgtggttcatt

SEQ ID NO: 333721 - DNA, 25 bp, Rattus norvegicus
gagaccccagactgtgtggttcatt

SEQ ID NO: 333722 - DNA, 25 bp, Rattus norvegicus
gagaccccagcgcagaatgaccaga

SEQ ID NO: 333723 - DNA, 25 bp, Rattus norvegicus
gagaccccagcggagaatgaccaga

SEQ ID NO: 333724 - DNA, 25 bp, Rattus norvegicus
gagaccccagttatttctgggagct

SEQ ID NO: 333725 - DNA, 25 bp, Rattus norvegicus
gagaccccagttttttctgggagct

SEQ ID NO: 333726 - DNA, 25 bp, Rattus norvegicus
gagaccccattcagggcagtgctga

SEQ ID NO: 333727 - DNA, 25 bp, Rattus norvegicus
gagaccccattctgggcagtgctga

SEQ ID NO: 333728 - DNA, 25 bp, Rattus norvegicus
gagaccccgcctcgagagaagagta

SEQ ID NO: 333729 - DNA, 25 bp, Rattus norvegicus
gagaccccgcctggagagaagagta

SEQ ID NO: 333730 - DNA, 25 bp, Rattus norvegicus
gagaccccggaaatagagaacccag

SEQ ID NO: 333731 - DNA, 25 bp, Rattus norvegicus
gagaccccggaattagagaacccag

SEQ ID NO: 333732 - DNA, 25 bp, Rattus norvegicus
gagaccccgtgtacaagcaggcagt

SEQ ID NO: 333733 - DNA, 25 bp, Rattus norvegicus
gagaccccgtgttcaagcaggcagt

SEQ ID NO: 333734 - DNA, 25 bp, Rattus norvegicus
gagacccctaacaatcttcagatta

SEQ ID NO: 333735 - DNA, 25 bp, Rattus norvegicus
gagacccctaactatcttcagatta

SEQ ID NO: 333736 - DNA, 25 bp, Rattus norvegicus
gagacccctgcaagtaggaaattct

SEQ ID NO: 333737 - DNA, 25 bp, Rattus norvegicus
gagacccctgcatgtaggaaattct

SEQ ID NO: 333738 - DNA, 25 bp, Rattus norvegicus
gagacccctggacaaacctgatggc

SEQ ID NO: 333739 - DNA, 25 bp, Rattus norvegicus
gagacccctggagaaacctgatggc

SEQ ID NO: 333740 - DNA, 25 bp, Rattus norvegicus
gagaccccttccataggatgggcaa

SEQ ID NO: 333741 - DNA, 25 bp, Rattus norvegicus
gagaccccttccttaggatgggcaa

SEQ ID NO: 333742 - DNA, 25 bp, Rattus norvegicus
gagacccgaacgcaagcagctattg

SEQ ID NO: 333743 - DNA, 25 bp, Rattus norvegicus
gagacccgaacggaagcagctattg

SEQ ID NO: 333744 - DNA, 25 bp, Rattus norvegicus
gagacccgaagcctttactttgatg

SEQ ID NO: 333745 - DNA, 25 bp, Rattus norvegicus
gagacccgaagcgtttactttgatg

SEQ ID NO: 333746 - DNA, 25 bp, Rattus norvegicus
gagacccgactcagaacaagttaga

SEQ ID NO: 333747 - DNA, 25 bp, Rattus norvegicus
gagacccgactctgaacaagttaga

SEQ ID NO: 333748 - DNA, 25 bp, Rattus norvegicus
gagacccgagacaagctgcccagca

SEQ ID NO: 333749 - DNA, 25 bp, Rattus norvegicus
gagacccgagactagctgcccagca

SEQ ID NO: 333750 - DNA, 25 bp, Rattus norvegicus
gagacccgagatcctctcagattag

SEQ ID NO: 333751 - DNA, 25 bp, Rattus norvegicus
gagacccgagatgctctcagattag

SEQ ID NO: 333752 - DNA, 25 bp, Rattus norvegicus
gagacccgattgctgctggacacac

SEQ ID NO: 333753 - DNA, 25 bp, Rattus norvegicus
gagacccgattggtgctggacacac

SEQ ID NO: 333754 - DNA, 25 bp, Rattus norvegicus
gagacccgctggcagttcagagact

SEQ ID NO: 333755 - DNA, 25 bp, Rattus norvegicus
gagacccgctgggagttcagagact

SEQ ID NO: 333756 - DNA, 25 bp, Rattus norvegicus
gagacccggaaaacgtaccagacag

SEQ ID NO: 333757 - DNA, 25 bp, Rattus norvegicus
gagacccggaaatcgtaccagacag

SEQ ID NO: 333758 - DNA, 25 bp, Rattus norvegicus
gagacccggtctattgtagcttaag

SEQ ID NO: 333759 - DNA, 25 bp, Rattus norvegicus
gagacccggtcttttgtagcttaag

SEQ ID NO: 333760 - DNA, 25 bp, Rattus norvegicus
gagacccgtatgatgattccactgt

SEQ ID NO: 333761 - DNA, 25 bp, Rattus norvegicus
gagacccgtatgttgattccactgt

SEQ ID NO: 333762 - DNA, 25 bp, Rattus norvegicus
gagacccgtgacagcgagttcggac

SEQ ID NO: 333763 - DNA, 25 bp, Rattus norvegicus
gagacccgtgactgcgagttcggac

SEQ ID NO: 333764 - DNA, 25 bp, Rattus norvegicus
gagaccctacagaacaggactccat

SEQ ID NO: 333765 - DNA, 25 bp, Rattus norvegicus
gagaccctacagtacaggactccat

SEQ ID NO: 333766 - DNA, 25 bp, Rattus norvegicus
gagaccctagcacaaaagcccatgt

SEQ ID NO: 333767 - DNA, 25 bp, Rattus norvegicus
gagaccctagcagaaaagcccatgt

SEQ ID NO: 333768 - DNA, 25 bp, Rattus norvegicus
gagaccctattgacaaagtccagtt

SEQ ID NO: 333769 - DNA, 25 bp, Rattus norvegicus
gagaccctattgtcaaagtccagtt

SEQ ID NO: 333770 - DNA, 25 bp, Rattus norvegicus
gagaccctcatcaatgtgttccatg

SEQ ID NO: 333771 - DNA, 25 bp, Rattus norvegicus
gagaccctcatcacctgagttttat

SEQ ID NO: 333772 - DNA, 25 bp, Rattus norvegicus
gagaccctcatctatgtgttccatg

SEQ ID NO: 333773 - DNA, 25 bp, Rattus norvegicus
gagaccctcatctcctgagttttat

SEQ ID NO: 333774 - DNA, 25 bp, Rattus norvegicus
gagaccctcattcaaatttcttctt

SEQ ID NO: 333775 - DNA, 25 bp, Rattus norvegicus
gagaccctcattgaaatttcttctt

SEQ ID NO: 333776 - DNA, 25 bp, Rattus norvegicus
gagaccctccacagtcaaaattttt

SEQ ID NO: 333777 - DNA, 25 bp, Rattus norvegicus
gagaccctccactgtcaaaattttt

SEQ ID NO: 333778 - DNA, 25 bp, Rattus norvegicus
gagaccctcctaagatcagtgaata

SEQ ID NO: 333779 - DNA, 25 bp, Rattus norvegicus
gagaccctcctatgatcagtgaata

SEQ ID NO: 333780 - DNA, 25 bp, Rattus norvegicus
gagaccctcgagattatccgtggtt

SEQ ID NO: 333781 - DNA, 25 bp, Rattus norvegicus
gagaccctcgagtttatccgtggtt

SEQ ID NO: 333782 - DNA, 25 bp, Rattus norvegicus
gagaccctgagactgcagatccatg

SEQ ID NO: 333783 - DNA, 25 bp, Rattus norvegicus
gagaccctgagagtgcagatccatg

SEQ ID NO: 333784 - DNA, 25 bp, Rattus norvegicus
gagaccctgccccatttatggagca

SEQ ID NO: 333785 - DNA, 25 bp, Rattus norvegicus
gagaccctgcccgatttatggagca

SEQ ID NO: 333786 - DNA, 25 bp, Rattus norvegicus
gagaccctgcctatacaaaagactt

SEQ ID NO: 333787 - DNA, 25 bp, Rattus norvegicus
gagaccctgcctttacaaaagactt

SEQ ID NO: 333788 - DNA, 25 bp, Rattus norvegicus
gagaccctgctaatataacctattt

SEQ ID NO: 333789 - DNA, 25 bp, Rattus norvegicus
gagaccctgctattataacctattt

SEQ ID NO: 333790 - DNA, 25 bp, Rattus norvegicus
gagaccctgcttagagcacctgaaa

SEQ ID NO: 333791 - DNA, 25 bp, Rattus norvegicus
gagaccctgctttgagcacctgaaa

SEQ ID NO: 333792 - DNA, 25 bp, Rattus norvegicus
gagaccctggaactgatgtgtgcac

SEQ ID NO: 333793 - DNA, 25 bp, Rattus norvegicus
gagaccctggaagtgatgtgtgcac

SEQ ID NO: 333794 - DNA, 25 bp, Rattus norvegicus
gagaccctggcaatggctgagccaa

SEQ ID NO: 333795 - DNA, 25 bp, Rattus norvegicus
gagaccctggcaccaagcttgtgga

SEQ ID NO: 333796 - DNA, 25 bp, Rattus norvegicus
gagaccctggcactcgggtacacac

SEQ ID NO: 333797 - DNA, 25 bp, Rattus norvegicus
gagaccctggcagcaagcttgtgga

SEQ ID NO: 333798 - DNA, 25 bp, Rattus norvegicus
gagaccctggcagtcgggtacacac

SEQ ID NO: 333799 - DNA, 25 bp, Rattus norvegicus
gagaccctggcattggctgagccaa

SEQ ID NO: 333800 - DNA, 25 bp, Rattus norvegicus
gagaccctgggacttgtggctatct

SEQ ID NO: 333801 - DNA, 25 bp, Rattus norvegicus
gagaccctgggagttgtggctatct

SEQ ID NO: 333802 - DNA, 25 bp, Rattus norvegicus
gagaccctgggtcctactggaagct

SEQ ID NO: 333803 - DNA, 25 bp, Rattus norvegicus
gagaccctgggtgctactggaagct

SEQ ID NO: 333804 - DNA, 25 bp, Rattus norvegicus
gagaccctggtgaagcaaagcccac

SEQ ID NO: 333805 - DNA, 25 bp, Rattus norvegicus
gagaccctggtgtagcaaagcccac

SEQ ID NO: 333806 - DNA, 25 bp, Rattus norvegicus
gagaccctgtatatgtttgcgttca

SEQ ID NO: 333807 - DNA, 25 bp, Rattus norvegicus
gagaccctgtatttgtttgcgttca

SEQ ID NO: 333808 - DNA, 25 bp, Rattus norvegicus
gagaccctgtctctgatgacttctt

SEQ ID NO: 333809 - DNA, 25 bp, Rattus norvegicus
gagaccctgtctgtgatgacttctt

SEQ ID NO: 333810 - DNA, 25 bp, Rattus norvegicus
gagaccctgttcaatatcttttgta

SEQ ID NO: 333811 - DNA, 25 bp, Rattus norvegicus
gagaccctgttctatatcttttgta

SEQ ID NO: 333812 - DNA, 25 bp, Rattus norvegicus
gagacccttagaagctttgtaaaca

SEQ ID NO: 333813 - DNA, 25 bp, Rattus norvegicus
gagacccttagatgctttgtaaaca

SEQ ID NO: 333814 - DNA, 25 bp, Rattus norvegicus
gagacccttccccaaaagacacaag

SEQ ID NO: 333815 - DNA, 25 bp, Rattus norvegicus
gagacccttcccgaaaagacacaag

SEQ ID NO: 333816 - DNA, 25 bp, Rattus norvegicus
gagacccttcctaagaaactccagt

SEQ ID NO: 333817 - DNA, 25 bp, Rattus norvegicus
gagacccttccttagaaactccagt

SEQ ID NO: 333818 - DNA, 25 bp, Rattus norvegicus
gagacccttctcaagttaatcacag

SEQ ID NO: 333819 - DNA, 25 bp, Rattus norvegicus
gagacccttctctagttaatcacag

SEQ ID NO: 333820 - DNA, 25 bp, Rattus norvegicus
gagacccttctgaacacactgattt

SEQ ID NO: 333821 - DNA, 25 bp, Rattus norvegicus
gagacccttctgtacacactgattt

SEQ ID NO: 333822 - DNA, 25 bp, Rattus norvegicus
gagacccttgagaagatctctgcct

SEQ ID NO: 333823 - DNA, 25 bp, Rattus norvegicus
gagacccttgagtagatctctgcct

SEQ ID NO: 333824 - DNA, 25 bp, Rattus norvegicus
gagaccctttgaattgtgtacttaa

SEQ ID NO: 333825 - DNA, 25 bp, Rattus norvegicus
gagaccctttgatttgtgtacttaa

SEQ ID NO: 333826 - DNA, 25 bp, Rattus norvegicus
gagacccttttaaacaggtgaagtg

SEQ ID NO: 333827 - DNA, 25 bp, Rattus norvegicus
gagacccttttatacaggtgaagtg

SEQ ID NO: 333828 - DNA, 25 bp, Rattus norvegicus
gagaccgaaactacttcctgttgtt

SEQ ID NO: 333829 - DNA, 25 bp, Rattus norvegicus
gagaccgaaactagccaaggatcac

SEQ ID NO: 333830 - DNA, 25 bp, Rattus norvegicus
gagaccgaaacttcttcctgttgtt

SEQ ID NO: 333831 - DNA, 25 bp, Rattus norvegicus
gagaccgaaacttgccaaggatcac

SEQ ID NO: 333832 - DNA, 25 bp, Rattus norvegicus
gagaccgaaagtacatctgccaagc

SEQ ID NO: 333833 - DNA, 25 bp, Rattus norvegicus
gagaccgaaagttcatctgccaagc

SEQ ID NO: 333834 - DNA, 25 bp, Rattus norvegicus
gagaccgaccagagagacgccatca

SEQ ID NO: 333835 - DNA, 25 bp, Rattus norvegicus
gagaccgaccagtgagacgccatca

SEQ ID NO: 333836 - DNA, 25 bp, Rattus norvegicus
gagaccgagaagcacaccagcaata

SEQ ID NO: 333837 - DNA, 25 bp, Rattus norvegicus
gagaccgagaaggacaccagcaata

SEQ ID NO: 333838 - DNA, 25 bp, Rattus norvegicus
gagaccgagagcagcagagctctga

SEQ ID NO: 333839 - DNA, 25 bp, Rattus norvegicus
gagaccgagagctgcagagctctga

SEQ ID NO: 333840 - DNA, 25 bp, Rattus norvegicus
gagaccgaggtcaagcttgatcagc

SEQ ID NO: 333841 - DNA, 25 bp, Rattus norvegicus
gagaccgaggtctagcttgatcagc

SEQ ID NO: 333842 - DNA, 25 bp, Rattus norvegicus
gagaccgaggtgcactgcaatcgct

SEQ ID NO: 333843 - DNA, 25 bp, Rattus norvegicus
gagaccgaggtggactgcaatcgct

SEQ ID NO: 333844 - DNA, 25 bp, Rattus norvegicus
gagaccgagtctacacactggaatt

SEQ ID NO: 333845 - DNA, 25 bp, Rattus norvegicus
gagaccgagtcttcacactggaatt

SEQ ID NO: 333846 - DNA, 25 bp, Rattus norvegicus
gagaccgattggagctcttgtttat

SEQ ID NO: 333847 - DNA, 25 bp, Rattus norvegicus
gagaccgattggtgctcttgtttat

SEQ ID NO: 333848 - DNA, 25 bp, Rattus norvegicus
gagaccgcaccaaagattgctcagc

SEQ ID NO: 333849 - DNA, 25 bp, Rattus norvegicus
gagaccgcaccatagattgctcagc

SEQ ID NO: 333850 - DNA, 25 bp, Rattus norvegicus
gagaccgcagctcctatgctaagaa

SEQ ID NO: 333851 - DNA, 25 bp, Rattus norvegicus
gagaccgcagctgctatgctaagaa

SEQ ID NO: 333852 - DNA, 25 bp, Rattus norvegicus
gagaccgccaccacaaaaaacaaga

SEQ ID NO: 333853 - DNA, 25 bp, Rattus norvegicus
gagaccgccacctcaaaaaacaaga

SEQ ID NO: 333854 - DNA, 25 bp, Rattus norvegicus
gagaccgcgtcaacggcttgatgat

SEQ ID NO: 333855 - DNA, 25 bp, Rattus norvegicus
gagaccgcgtcatcggcttgatgat

SEQ ID NO: 333856 - DNA, 25 bp, Rattus norvegicus
gagaccgctctacggcccatgatta

SEQ ID NO: 333857 - DNA, 25 bp, Rattus norvegicus
gagaccgctctagggcccatgatta

SEQ ID NO: 333858 - DNA, 25 bp, Rattus norvegicus
gagaccggacagatttctatccagt

SEQ ID NO: 333859 - DNA, 25 bp, Rattus norvegicus
gagaccggacagttttctatccagt

SEQ ID NO: 333860 - DNA, 25 bp, Rattus norvegicus
gagaccggagccctctacagtaatt

SEQ ID NO: 333861 - DNA, 25 bp, Rattus norvegicus
gagaccggagccgtctacagtaatt

SEQ ID NO: 333862 - DNA, 25 bp, Rattus norvegicus
gagaccgggaacagcgattctatca

SEQ ID NO: 333863 - DNA, 25 bp, Rattus norvegicus
gagaccgggaactgcgattctatca

SEQ ID NO: 333864 - DNA, 25 bp, Rattus norvegicus
gagaccgtcaaaattctgattcctg

SEQ ID NO: 333865 - DNA, 25 bp, Rattus norvegicus
gagaccgtcaaatttctgattcctg

SEQ ID NO: 333866 - DNA, 25 bp, Rattus norvegicus
gagaccgtcccactaaaacagagag

SEQ ID NO: 333867 - DNA, 25 bp, Rattus norvegicus
gagaccgtcccagtaaaacagagag

SEQ ID NO: 333868 - DNA, 25 bp, Rattus norvegicus
gagaccgtctctataactttggact

SEQ ID NO: 333869 - DNA, 25 bp, Rattus norvegicus
gagaccgtctctctggaacttgcct

SEQ ID NO: 333870 - DNA, 25 bp, Rattus norvegicus
gagaccgtctctgtggaacttgcct

SEQ ID NO: 333871 - DNA, 25 bp, Rattus norvegicus
gagaccgtctctttaactttggact

SEQ ID NO: 333872 - DNA, 25 bp, Rattus norvegicus
gagaccgtgacaattcgaaactgga

SEQ ID NO: 333873 - DNA, 25 bp, Rattus norvegicus
gagaccgtgacatttcgaaactgga

SEQ ID NO: 333874 - DNA, 25 bp, Rattus norvegicus
gagaccgtgatcacaaagcatctga

SEQ ID NO: 333875 - DNA, 25 bp, Rattus norvegicus
gagaccgtgatctcaaagcatctga

SEQ ID NO: 333876 - DNA, 25 bp, Rattus norvegicus
gagaccgtgattcccaagactgact

SEQ ID NO: 333877 - DNA, 25 bp, Rattus norvegicus
gagaccgtgattgccaagactgact

SEQ ID NO: 333878 - DNA, 25 bp, Rattus norvegicus
gagaccgtgcaacacatcgtgtacc

SEQ ID NO: 333879 - DNA, 25 bp, Rattus norvegicus
gagaccgtgcaagacatcgtgtacc

SEQ ID NO: 333880 - DNA, 25 bp, Rattus norvegicus
gagaccgtgctacattcgtgtacaa

SEQ ID NO: 333881 - DNA, 25 bp, Rattus norvegicus
gagaccgtgctagattcgtgtacaa

SEQ ID NO: 333882 - DNA, 25 bp, Rattus norvegicus
gagaccgtgcttctacttgagcaga

SEQ ID NO: 333883 - DNA, 25 bp, Rattus norvegicus
gagaccgtgcttgtacttgagcaga

SEQ ID NO: 333884 - DNA, 25 bp, Rattus norvegicus
gagaccgtgtatctagccttcacta

SEQ ID NO: 333885 - DNA, 25 bp, Rattus norvegicus
gagaccgtgtatgtagccttcacta

SEQ ID NO: 333886 - DNA, 25 bp, Rattus norvegicus
gagaccgtgtgtagtccactggcag

SEQ ID NO: 333887 - DNA, 25 bp, Rattus norvegicus
gagaccgtgtgttgtccactggcag

SEQ ID NO: 333888 - DNA, 25 bp, Rattus norvegicus
gagaccgtttgaacagagttctgta

SEQ ID NO: 333889 - DNA, 25 bp, Rattus norvegicus
gagaccgtttgatcagagttctgta

SEQ ID NO: 333890 - DNA, 25 bp, Rattus norvegicus
gagaccgtttgtaatactcgatcat

SEQ ID NO: 333891 - DNA, 25 bp, Rattus norvegicus
gagaccgtttgttatactcgatcat

SEQ ID NO: 333892 - DNA, 25 bp, Rattus norvegicus
gagaccgttttactagaccatagac

SEQ ID NO: 333893 - DNA, 25 bp, Rattus norvegicus
gagaccgttttagtagaccatagac

SEQ ID NO: 333894 - DNA, 25 bp, Rattus norvegicus
gagacctaagggagagttatgtgca

SEQ ID NO: 333895 - DNA, 25 bp, Rattus norvegicus
gagacctaagggtgagttatgtgca

SEQ ID NO: 333896 - DNA, 25 bp, Rattus norvegicus
gagacctacattacaccactgaggg

SEQ ID NO: 333897 - DNA, 25 bp, Rattus norvegicus
gagacctacatttcaccactgaggg

SEQ ID NO: 333898 - DNA, 25 bp, Rattus norvegicus
gagacctactgtctgagctgagacc

SEQ ID NO: 333899 - DNA, 25 bp, Rattus norvegicus
gagacctactgtgtgagctgagacc

SEQ ID NO: 333900 - DNA, 25 bp, Rattus norvegicus
gagacctaggacaacacagtggcaa

SEQ ID NO: 333901 - DNA, 25 bp, Rattus norvegicus
gagacctaggactacacagtggcaa

SEQ ID NO: 333902 - DNA, 25 bp, Rattus norvegicus
gagacctagtacacatggcccagga

SEQ ID NO: 333903 - DNA, 25 bp, Rattus norvegicus
gagacctagtactcatggcccagga

SEQ ID NO: 333904 - DNA, 25 bp, Rattus norvegicus
gagacctatcctcctatgatgatgc

SEQ ID NO: 333905 - DNA, 25 bp, Rattus norvegicus
gagacctatcctgctatgatgatgc

SEQ ID NO: 333906 - DNA, 25 bp, Rattus norvegicus
gagacctatgaaagtgttccctatg

SEQ ID NO: 333907 - DNA, 25 bp, Rattus norvegicus
gagacctatgaatgtgttccctatg

SEQ ID NO: 333908 - DNA, 25 bp, Rattus norvegicus
gagacctatgtgcaatgtttaatga

SEQ ID NO: 333909 - DNA, 25 bp, Rattus norvegicus
gagacctatgtggaatgtttaatga

SEQ ID NO: 333910 - DNA, 25 bp, Rattus norvegicus
gagacctattgacctgcctgtagat

SEQ ID NO: 333911 - DNA, 25 bp, Rattus norvegicus
gagacctattgagctgcctgtagat

SEQ ID NO: 333912 - DNA, 25 bp, Rattus norvegicus
gagacctcaaaccagaccaagtgat

SEQ ID NO: 333913 - DNA, 25 bp, Rattus norvegicus
gagacctcaaacgagaccaagtgat

SEQ ID NO: 333914 - DNA, 25 bp, Rattus norvegicus
gagacctcaagcaacaattcccaga

SEQ ID NO: 333915 - DNA, 25 bp, Rattus norvegicus
gagacctcaagctacaattcccaga

SEQ ID NO: 333916 - DNA, 25 bp, Rattus norvegicus
gagacctcacataatgttcacattt

SEQ ID NO: 333917 - DNA, 25 bp, Rattus norvegicus
gagacctcacatatatagtgtgtct

SEQ ID NO: 333918 - DNA, 25 bp, Rattus norvegicus
gagacctcacattatgttcacattt

SEQ ID NO: 333919 - DNA, 25 bp, Rattus norvegicus
gagacctcacatttatagtgtgtct

SEQ ID NO: 333920 - DNA, 25 bp, Rattus norvegicus
gagacctcagagcagcacgaaagca

SEQ ID NO: 333921 - DNA, 25 bp, Rattus norvegicus
gagacctcagaggagcacgaaagca

SEQ ID NO: 333922 - DNA, 25 bp, Rattus norvegicus
gagacctcagataccagagtggctt

SEQ ID NO: 333923 - DNA, 25 bp, Rattus norvegicus
gagacctcagatatgccaggcctga

SEQ ID NO: 333924 - DNA, 25 bp, Rattus norvegicus
gagacctcagattccagagtggctt

SEQ ID NO: 333925 - DNA, 25 bp, Rattus norvegicus
gagacctcagatttgccaggcctga

SEQ ID NO: 333926 - DNA, 25 bp, Rattus norvegicus
gagacctcagtgctctgtaccaagt

SEQ ID NO: 333927 - DNA, 25 bp, Rattus norvegicus
gagacctcagtggtctgtaccaagt

SEQ ID NO: 333928 - DNA, 25 bp, Rattus norvegicus
gagacctcatttccttgtcttgtta

SEQ ID NO: 333929 - DNA, 25 bp, Rattus norvegicus
gagacctcatttgcttgtcttgtta

SEQ ID NO: 333930 - DNA, 25 bp, Rattus norvegicus
gagacctccaaaccagcctattgta

SEQ ID NO: 333931 - DNA, 25 bp, Rattus norvegicus
gagacctccaaagcagcctattgta

SEQ ID NO: 333932 - DNA, 25 bp, Rattus norvegicus
gagacctccataaggttgagaattt

SEQ ID NO: 333933 - DNA, 25 bp, Rattus norvegicus
gagacctccatatggttgagaattt

SEQ ID NO: 333934 - DNA, 25 bp, Rattus norvegicus
gagacctcccacaggtgtccacttt

SEQ ID NO: 333935 - DNA, 25 bp, Rattus norvegicus
gagacctcccactggtgtccacttt

SEQ ID NO: 333936 - DNA, 25 bp, Rattus norvegicus
gagacctccctgcttgttagataaa

SEQ ID NO: 333937 - DNA, 25 bp, Rattus norvegicus
gagacctccctggttgttagataaa

SEQ ID NO: 333938 - DNA, 25 bp, Rattus norvegicus
gagacctcgacccatcattggaaga

SEQ ID NO: 333939 - DNA, 25 bp, Rattus norvegicus
gagacctcgaccgatcattggaaga

SEQ ID NO: 333940 - DNA, 25 bp, Rattus norvegicus
gagacctcggcgatcatgagatgaa

SEQ ID NO: 333941 - DNA, 25 bp, Rattus norvegicus
gagacctcggcgttcatgagatgaa

SEQ ID NO: 333942 - DNA, 25 bp, Rattus norvegicus
gagacctctagaattttgtcatctg

SEQ ID NO: 333943 - DNA, 25 bp, Rattus norvegicus
gagacctctagatttttgtcatctg

SEQ ID NO: 333944 - DNA, 25 bp, Rattus norvegicus
gagacctctcttcaattttacaggc

SEQ ID NO: 333945 - DNA, 25 bp, Rattus norvegicus
gagacctctcttgaattttacaggc

SEQ ID NO: 333946 - DNA, 25 bp, Rattus norvegicus
gagacctctgctcaatagcaactta

SEQ ID NO: 333947 - DNA, 25 bp, Rattus norvegicus
gagacctctgctgaatagcaactta

SEQ ID NO: 333948 - DNA, 25 bp, Rattus norvegicus
gagacctctgtgacttaccgagaag

SEQ ID NO: 333949 - DNA, 25 bp, Rattus norvegicus
gagacctctgtgtcttaccgagaag

SEQ ID NO: 333950 - DNA, 25 bp, Rattus norvegicus
gagacctcttctatgactaggacaa

SEQ ID NO: 333951 - DNA, 25 bp, Rattus norvegicus
gagacctcttctttgactaggacaa

SEQ ID NO: 333952 - DNA, 25 bp, Rattus norvegicus
gagacctcttgtattcatctgtgaa

SEQ ID NO: 333953 - DNA, 25 bp, Rattus norvegicus
gagacctcttgttttcatctgtgaa

SEQ ID NO: 333954 - DNA, 25 bp, Rattus norvegicus
gagacctgaagccagccgtagtgaa

SEQ ID NO: 333955 - DNA, 25 bp, Rattus norvegicus
gagacctgaagcgagccgtagtgaa

SEQ ID NO: 333956 - DNA, 25 bp, Rattus norvegicus
gagacctgaatcatgtgttgtttct

SEQ ID NO: 333957 - DNA, 25 bp, Rattus norvegicus
gagacctgaatcttgtgttgtttct

SEQ ID NO: 333958 - DNA, 25 bp, Rattus norvegicus
gagacctgacacaaagtgcagattt

SEQ ID NO: 333959 - DNA, 25 bp, Rattus norvegicus
gagacctgacactaagtgcagattt

SEQ ID NO: 333960 - DNA, 25 bp, Rattus norvegicus
gagacctgacagacattatcacaga

SEQ ID NO: 333961 - DNA, 25 bp, Rattus norvegicus
gagacctgacagtcattatcacaga

SEQ ID NO: 333962 - DNA, 25 bp, Rattus norvegicus
gagacctgagctcggtcatatctcc

SEQ ID NO: 333963 - DNA, 25 bp, Rattus norvegicus
gagacctgagctgggtcatatctcc

SEQ ID NO: 333964 - DNA, 25 bp, Rattus norvegicus
gagacctgaggcaagccactgtgtg

SEQ ID NO: 333965 - DNA, 25 bp, Rattus norvegicus
gagacctgaggcctgtactgaccac

SEQ ID NO: 333966 - DNA, 25 bp, Rattus norvegicus
gagacctgaggcgtgtactgaccac

SEQ ID NO: 333967 - DNA, 25 bp, Rattus norvegicus
gagacctgaggctagccactgtgtg

SEQ ID NO: 333968 - DNA, 25 bp, Rattus norvegicus
gagacctgagtcagttttttataca

SEQ ID NO: 333969 - DNA, 25 bp, Rattus norvegicus
gagacctgagtctgttttttataca

SEQ ID NO: 333970 - DNA, 25 bp, Rattus norvegicus
gagacctgatcgagagagccctgta

SEQ ID NO: 333971 - DNA, 25 bp, Rattus norvegicus
gagacctgatcgtgagagccctgta

SEQ ID NO: 333972 - DNA, 25 bp, Rattus norvegicus
gagacctgcagcagtacagactcaa

SEQ ID NO: 333973 - DNA, 25 bp, Rattus norvegicus
gagacctgcagctgtacagactcaa

SEQ ID NO: 333974 - DNA, 25 bp, Rattus norvegicus
gagacctgcccaatgtgtcgtaaag

SEQ ID NO: 333975 - DNA, 25 bp, Rattus norvegicus
gagacctgcccattgtgtcgtaaag

SEQ ID NO: 333976 - DNA, 25 bp, Rattus norvegicus
gagacctgcgccatttttaacataa

SEQ ID NO: 333977 - DNA, 25 bp, Rattus norvegicus
gagacctgcgccttttttaacataa

SEQ ID NO: 333978 - DNA, 25 bp, Rattus norvegicus
gagacctgcgctcgcctaagcaagg

SEQ ID NO: 333979 - DNA, 25 bp, Rattus norvegicus
gagacctgcgctggcctaagcaagg

SEQ ID NO: 333980 - DNA, 25 bp, Rattus norvegicus
gagacctgcttccaatgttaactgt

SEQ ID NO: 333981 - DNA, 25 bp, Rattus norvegicus
gagacctgcttcgaatgttaactgt

SEQ ID NO: 333982 - DNA, 25 bp, Rattus norvegicus
gagacctggaaaccacctgagctgg

SEQ ID NO: 333983 - DNA, 25 bp, Rattus norvegicus
gagacctggaaagcacctgagctgg

SEQ ID NO: 333984 - DNA, 25 bp, Rattus norvegicus
gagacctggagaacgccttcctgaa

SEQ ID NO: 333985 - DNA, 25 bp, Rattus norvegicus
gagacctggagacatactgtagctt

SEQ ID NO: 333986 - DNA, 25 bp, Rattus norvegicus
gagacctggagagatactgtagctt

SEQ ID NO: 333987 - DNA, 25 bp, Rattus norvegicus
gagacctggagatcgccttcctgaa

SEQ ID NO: 333988 - DNA, 25 bp, Rattus norvegicus
gagacctggaggaaactcccagttt

SEQ ID NO: 333989 - DNA, 25 bp, Rattus norvegicus
gagacctggaggatgtggctggaca

SEQ ID NO: 333990 - DNA, 25 bp, Rattus norvegicus
gagacctggaggtaactcccagttt

SEQ ID NO: 333991 - DNA, 25 bp, Rattus norvegicus
gagacctggaggttgtggctggaca

SEQ ID NO: 333992 - DNA, 25 bp, Rattus norvegicus
gagacctggcagaaggctagccctg

SEQ ID NO: 333993 - DNA, 25 bp, Rattus norvegicus
gagacctggcagtaggctagccctg

SEQ ID NO: 333994 - DNA, 25 bp, Rattus norvegicus
gagacctggctgctccggagtcacc

SEQ ID NO: 333995 - DNA, 25 bp, Rattus norvegicus
gagacctggctggtccggagtcacc

SEQ ID NO: 333996 - DNA, 25 bp, Rattus norvegicus
gagacctgggcacacctggttcagc

SEQ ID NO: 333997 - DNA, 25 bp, Rattus norvegicus
gagacctgggcagacctggttcagc

SEQ ID NO: 333998 - DNA, 25 bp, Rattus norvegicus
gagacctgggtcctagttggacact

SEQ ID NO: 333999 - DNA, 25 bp, Rattus norvegicus
gagacctgggtcgtagttggacact

SEQ ID NO: 334000 - DNA, 25 bp, Rattus norvegicus
gagacctgggtgattttggccaaca

SEQ ID NO: 334001 - DNA, 25 bp, Rattus norvegicus
gagacctgggtgtttttggccaaca

SEQ ID NO: 334002 - DNA, 25 bp, Rattus norvegicus
gagacctggtctcactatgtcgtgc

SEQ ID NO: 334003 - DNA, 25 bp, Rattus norvegicus
gagacctggtctgactatgtcgtgc

SEQ ID NO: 334004 - DNA, 25 bp, Rattus norvegicus
gagacctgtcctaatcacagggtga

SEQ ID NO: 334005 - DNA, 25 bp, Rattus norvegicus
gagacctgtccttatcacagggtga

SEQ ID NO: 334006 - DNA, 25 bp, Rattus norvegicus
gagacctgtgcaaagatttctacct

SEQ ID NO: 334007 - DNA, 25 bp, Rattus norvegicus
gagacctgtgcatagatttctacct

SEQ ID NO: 334008 - DNA, 25 bp, Rattus norvegicus
gagacctgtggaacttgagagcttt

SEQ ID NO: 334009 - DNA, 25 bp, Rattus norvegicus
gagacctgtggatcttgagagcttt

SEQ ID NO: 334010 - DNA, 25 bp, Rattus norvegicus
gagacctgttgcagaacctgttgaa

SEQ ID NO: 334011 - DNA, 25 bp, Rattus norvegicus
gagacctgttgctgaacctgttgaa

SEQ ID NO: 334012 - DNA, 25 bp, Rattus norvegicus
gagacctgtttgaggaccttgtgga

SEQ ID NO: 334013 - DNA, 25 bp, Rattus norvegicus
gagacctgtttgctactgcttattc

SEQ ID NO: 334014 - DNA, 25 bp, Rattus norvegicus
gagacctgtttggtactgcttattc

SEQ ID NO: 334015 - DNA, 25 bp, Rattus norvegicus
gagacctgtttgtggaccttgtgga

SEQ ID NO: 334016 - DNA, 25 bp, Rattus norvegicus
gagaccttaaaacatcaccctgcag

SEQ ID NO: 334017 - DNA, 25 bp, Rattus norvegicus
gagaccttaaaagatcaccctgcag

SEQ ID NO: 334018 - DNA, 25 bp, Rattus norvegicus
gagaccttaatgactcagtcactca

SEQ ID NO: 334019 - DNA, 25 bp, Rattus norvegicus
gagaccttaatgtctcagtcactca

SEQ ID NO: 334020 - DNA, 25 bp, Rattus norvegicus
gagaccttagacattgcttttaact

SEQ ID NO: 334021 - DNA, 25 bp, Rattus norvegicus
gagaccttagactttgcttttaact

SEQ ID NO: 334022 - DNA, 25 bp, Rattus norvegicus
gagaccttagagattttcctattca

SEQ ID NO: 334023 - DNA, 25 bp, Rattus norvegicus
gagaccttagagtttttcctattca

SEQ ID NO: 334024 - DNA, 25 bp, Rattus norvegicus
gagaccttcagacaggctcgactct

SEQ ID NO: 334025 - DNA, 25 bp, Rattus norvegicus
gagaccttcagagaggctcgactct

SEQ ID NO: 334026 - DNA, 25 bp, Rattus norvegicus
gagaccttccacctctaaagtgcga

SEQ ID NO: 334027 - DNA, 25 bp, Rattus norvegicus
gagaccttccacgtctaaagtgcga

SEQ ID NO: 334028 - DNA, 25 bp, Rattus norvegicus
gagaccttcctcagtcgccgtgact

SEQ ID NO: 334029 - DNA, 25 bp, Rattus norvegicus
gagaccttcctctgtcgccgtgact

SEQ ID NO: 334030 - DNA, 25 bp, Rattus norvegicus
gagaccttcgaaacacatctgctgg

SEQ ID NO: 334031 - DNA, 25 bp, Rattus norvegicus
gagaccttcgaatcacatctgctgg

SEQ ID NO: 334032 - DNA, 25 bp, Rattus norvegicus
gagaccttcgagcactgaggagcca

SEQ ID NO: 334033 - DNA, 25 bp, Rattus norvegicus
gagaccttcgaggactgaggagcca

SEQ ID NO: 334034 - DNA, 25 bp, Rattus norvegicus
gagaccttcggtacagatggcatcc

SEQ ID NO: 334035 - DNA, 25 bp, Rattus norvegicus
gagaccttcggttcagatggcatcc

SEQ ID NO: 334036 - DNA, 25 bp, Rattus norvegicus
gagaccttctgccaaatatagtttc

SEQ ID NO: 334037 - DNA, 25 bp, Rattus norvegicus
gagaccttctgcgaaatatagtttc

SEQ ID NO: 334038 - DNA, 25 bp, Rattus norvegicus
gagaccttgccacctaaatccatgg

SEQ ID NO: 334039 - DNA, 25 bp, Rattus norvegicus
gagaccttgccagctaaatccatgg

SEQ ID NO: 334040 - DNA, 25 bp, Rattus norvegicus
gagaccttgcgaaacccaagaatag

SEQ ID NO: 334041 - DNA, 25 bp, Rattus norvegicus
gagaccttgcgatacccaagaatag

SEQ ID NO: 334042 - DNA, 25 bp, Rattus norvegicus
gagaccttgctgagtgattcaagca

SEQ ID NO: 334043 - DNA, 25 bp, Rattus norvegicus
gagaccttgctgtgtgattcaagca

SEQ ID NO: 334044 - DNA, 25 bp, Rattus norvegicus
gagaccttgcttagagatccatttt

SEQ ID NO: 334045 - DNA, 25 bp, Rattus norvegicus
gagaccttgctttgagatccatttt

SEQ ID NO: 334046 - DNA, 25 bp, Rattus norvegicus
gagaccttgggacaacaaagtcgtc

SEQ ID NO: 334047 - DNA, 25 bp, Rattus norvegicus
gagaccttgggagaacaaagtcgtc

SEQ ID NO: 334048 - DNA, 25 bp, Rattus norvegicus
gagaccttgtacatacccattttcc

SEQ ID NO: 334049 - DNA, 25 bp, Rattus norvegicus
gagaccttgtacttacccattttcc

SEQ ID NO: 334050 - DNA, 25 bp, Rattus norvegicus
gagaccttgtcaatttgttctcttc

SEQ ID NO: 334051 - DNA, 25 bp, Rattus norvegicus
gagaccttgtcattttgttctcttc

SEQ ID NO: 334052 - DNA, 25 bp, Rattus norvegicus
gagacctttctacagccgattagtt

SEQ ID NO: 334053 - DNA, 25 bp, Rattus norvegicus
gagacctttctagagccgattagtt

SEQ ID NO: 334054 - DNA, 25 bp, Rattus norvegicus
gagacctttctgattgtgtcagctt

SEQ ID NO: 334055 - DNA, 25 bp, Rattus norvegicus
gagacctttctgtttgtgtcagctt

SEQ ID NO: 334056 - DNA, 25 bp, Rattus norvegicus
gagacctttgaacccagctgtgtat

SEQ ID NO: 334057 - DNA, 25 bp, Rattus norvegicus
gagacctttgaagccagctgtgtat

SEQ ID NO: 334058 - DNA, 25 bp, Rattus norvegicus
gagaccttttcaaccctgtgtgtcc

SEQ ID NO: 334059 - DNA, 25 bp, Rattus norvegicus
gagaccttttcacctacttcttggc

SEQ ID NO: 334060 - DNA, 25 bp, Rattus norvegicus
gagaccttttcagctacttcttggc

SEQ ID NO: 334061 - DNA, 25 bp, Rattus norvegicus
gagaccttttcatccctgtgtgtcc

SEQ ID NO: 334062 - DNA, 25 bp, Rattus norvegicus
gagaccttttccagttacatcagtg

SEQ ID NO: 334063 - DNA, 25 bp, Rattus norvegicus
gagaccttttcctgttacatcagtg

SEQ ID NO: 334064 - DNA, 25 bp, Rattus norvegicus
gagacgaaacaacagaacacccaaa

SEQ ID NO: 334065 - DNA, 25 bp, Rattus norvegicus
gagacgaaacaagagaacacccaaa

SEQ ID NO: 334066 - DNA, 25 bp, Rattus norvegicus
gagacgaaaggccagactccttcac

SEQ ID NO: 334067 - DNA, 25 bp, Rattus norvegicus
gagacgaaaggcgagactccttcac

SEQ ID NO: 334068 - DNA, 25 bp, Rattus norvegicus
gagacgaacagacgccctatatcct

SEQ ID NO: 334069 - DNA, 25 bp, Rattus norvegicus
gagacgaacagaggccctatatcct

SEQ ID NO: 334070 - DNA, 25 bp, Rattus norvegicus
gagacgacacatcgccctgtgcttt

SEQ ID NO: 334071 - DNA, 25 bp, Rattus norvegicus
gagacgacacatggccctgtgcttt

SEQ ID NO: 334072 - DNA, 25 bp, Rattus norvegicus
gagacgacagtcatcttgatccaat

SEQ ID NO: 334073 - DNA, 25 bp, Rattus norvegicus
gagacgacagtcttcttgatccaat

SEQ ID NO: 334074 - DNA, 25 bp, Rattus norvegicus
gagacgacatcacaatcccacgatt

SEQ ID NO: 334075 - DNA, 25 bp, Rattus norvegicus
gagacgacatcagaatcccacgatt

SEQ ID NO: 334076 - DNA, 25 bp, Rattus norvegicus
gagacgacgtgtacatgaaggctat

SEQ ID NO: 334077 - DNA, 25 bp, Rattus norvegicus
gagacgacgtgttcatgaaggctat

SEQ ID NO: 334078 - DNA, 25 bp, Rattus norvegicus
gagacgactaataccagcatgcaga

SEQ ID NO: 334079 - DNA, 25 bp, Rattus norvegicus
gagacgactaattccagcatgcaga

SEQ ID NO: 334080 - DNA, 25 bp, Rattus norvegicus
gagacgactctaaatatcctgtgac

SEQ ID NO: 334081 - DNA, 25 bp, Rattus norvegicus
gagacgactctatatatcctgtgac

SEQ ID NO: 334082 - DNA, 25 bp, Rattus norvegicus
gagacgagccaactggagatcccag

SEQ ID NO: 334083 - DNA, 25 bp, Rattus norvegicus
gagacgagccaagtggagatcccag

SEQ ID NO: 334084 - DNA, 25 bp, Rattus norvegicus
gagacgagccatacgctgaaagaca

SEQ ID NO: 334085 - DNA, 25 bp, Rattus norvegicus
gagacgagccattcgctgaaagaca

SEQ ID NO: 334086 - DNA, 25 bp, Rattus norvegicus
gagacgagctgaagcaattccagaa

SEQ ID NO: 334087 - DNA, 25 bp, Rattus norvegicus
gagacgagctgatgcaattccagaa

SEQ ID NO: 334088 - DNA, 25 bp, Rattus norvegicus
gagacgagctggaggcttgcccaca

SEQ ID NO: 334089 - DNA, 25 bp, Rattus norvegicus
gagacgagctggtggcttgcccaca

SEQ ID NO: 334090 - DNA, 25 bp, Rattus norvegicus
gagacgaggagaaaacttacttgaa

SEQ ID NO: 334091 - DNA, 25 bp, Rattus norvegicus
gagacgaggagataacttacttgaa

SEQ ID NO: 334092 - DNA, 25 bp, Rattus norvegicus
gagacgagggatatggccgcccaaa

SEQ ID NO: 334093 - DNA, 25 bp, Rattus norvegicus
gagacgagggatttggccgcccaaa

SEQ ID NO: 334094 - DNA, 25 bp, Rattus norvegicus
gagacgatgatcacttgctatcaga

SEQ ID NO: 334095 - DNA, 25 bp, Rattus norvegicus
gagacgatgatctcttgctatcaga

SEQ ID NO: 334096 - DNA, 25 bp, Rattus norvegicus
gagacgatgctacacctgttaggga

SEQ ID NO: 334097 - DNA, 25 bp, Rattus norvegicus
gagacgatgctagacctgttaggga

SEQ ID NO: 334098 - DNA, 25 bp, Rattus norvegicus
gagacgatggctatgcctcattatc

SEQ ID NO: 334099 - DNA, 25 bp, Rattus norvegicus
gagacgatggctttgcctcattatc

SEQ ID NO: 334100 - DNA, 25 bp, Rattus norvegicus
gagacgattcggacttctacagaag

SEQ ID NO: 334101 - DNA, 25 bp, Rattus norvegicus
gagacgattcggtcttctacagaag

SEQ ID NO: 334102 - DNA, 25 bp, Rattus norvegicus
gagacgattgtaatatccaagggaa

SEQ ID NO: 334103 - DNA, 25 bp, Rattus norvegicus
gagacgattgtattatccaagggaa

SEQ ID NO: 334104 - DNA, 25 bp, Rattus norvegicus
gagacgcaataccattactttttag

SEQ ID NO: 334105 - DNA, 25 bp, Rattus norvegicus
gagacgcaatacgattactttttag

SEQ ID NO: 334106 - DNA, 25 bp, Rattus norvegicus
gagacgcagagtaaccacaacggca

SEQ ID NO: 334107 - DNA, 25 bp, Rattus norvegicus
gagacgcagagttaccacaacggca

SEQ ID NO: 334108 - DNA, 25 bp, Rattus norvegicus
gagacgcagcatcactagggacagt

SEQ ID NO: 334109 - DNA, 25 bp, Rattus norvegicus
gagacgcagcatgactagggacagt

SEQ ID NO: 334110 - DNA, 25 bp, Rattus norvegicus
gagacgcagcttctgttgccatgga

SEQ ID NO: 334111 - DNA, 25 bp, Rattus norvegicus
gagacgcagcttgtgttgccatgga

SEQ ID NO: 334112 - DNA, 25 bp, Rattus norvegicus
gagacgcaggcacaactctttatac

SEQ ID NO: 334113 - DNA, 25 bp, Rattus norvegicus
gagacgcaggcagaactctttatac

SEQ ID NO: 334114 - DNA, 25 bp, Rattus norvegicus
gagacgccacttcacataggctatg

SEQ ID NO: 334115 - DNA, 25 bp, Rattus norvegicus
gagacgccacttgacataggctatg

SEQ ID NO: 334116 - DNA, 25 bp, Rattus norvegicus
gagacgccaggacaaactagaagtg

SEQ ID NO: 334117 - DNA, 25 bp, Rattus norvegicus
gagacgccaggagaaactagaagtg

SEQ ID NO: 334118 - DNA, 25 bp, Rattus norvegicus
gagacgccatttcaagcagccctgt

SEQ ID NO: 334119 - DNA, 25 bp, Rattus norvegicus
gagacgccatttgaagcagccctgt

SEQ ID NO: 334120 - DNA, 25 bp, Rattus norvegicus
gagacgcccaagcagatggccagca

SEQ ID NO: 334121 - DNA, 25 bp, Rattus norvegicus
gagacgcccaaggagatggccagca

SEQ ID NO: 334122 - DNA, 25 bp, Rattus norvegicus
gagacgcccttgaatagtgtgtaac

SEQ ID NO: 334123 - DNA, 25 bp, Rattus norvegicus
gagacgcccttgtatagtgtgtaac

SEQ ID NO: 334124 - DNA, 25 bp, Rattus norvegicus
gagacgcctcacagagagaactgga

SEQ ID NO: 334125 - DNA, 25 bp, Rattus norvegicus
gagacgcctcactgagagaactgga

SEQ ID NO: 334126 - DNA, 25 bp, Rattus norvegicus
gagacgcctctgatttatttgggtt

SEQ ID NO: 334127 - DNA, 25 bp, Rattus norvegicus
gagacgcctctgttttatttgggtt

SEQ ID NO: 334128 - DNA, 25 bp, Rattus norvegicus
gagacgcgatggacactgccatgga

SEQ ID NO: 334129 - DNA, 25 bp, Rattus norvegicus
gagacgcgatggtcactgccatgga

SEQ ID NO: 334130 - DNA, 25 bp, Rattus norvegicus
gagacgcgggccacagttaggactt

SEQ ID NO: 334131 - DNA, 25 bp, Rattus norvegicus
gagacgcgggcctcagttaggactt

SEQ ID NO: 334132 - DNA, 25 bp, Rattus norvegicus
gagacgctactgaatattcctgtaa

SEQ ID NO: 334133 - DNA, 25 bp, Rattus norvegicus
gagacgctactgtatattcctgtaa

SEQ ID NO: 334134 - DNA, 25 bp, Rattus norvegicus
gagacgctagttctttagcccaggt

SEQ ID NO: 334135 - DNA, 25 bp, Rattus norvegicus
gagacgctagttgtttagcccaggt

SEQ ID NO: 334136 - DNA, 25 bp, Rattus norvegicus
gagacgctcactaacttgaaccaag

SEQ ID NO: 334137 - DNA, 25 bp, Rattus norvegicus
gagacgctcacttacttgaaccaag

SEQ ID NO: 334138 - DNA, 25 bp, Rattus norvegicus
gagacgctcgaacctctatcacggg

SEQ ID NO: 334139 - DNA, 25 bp, Rattus norvegicus
gagacgctcgaagctctatcacggg

SEQ ID NO: 334140 - DNA, 25 bp, Rattus norvegicus
gagacgctcgcgctcaagttcgaga

SEQ ID NO: 334141 - DNA, 25 bp, Rattus norvegicus
gagacgctcgcggtcaagttcgaga

SEQ ID NO: 334142 - DNA, 25 bp, Rattus norvegicus
gagacgctcgttcgtataaccggtt

SEQ ID NO: 334143 - DNA, 25 bp, Rattus norvegicus
gagacgctcgttggtataaccggtt

SEQ ID NO: 334144 - DNA, 25 bp, Rattus norvegicus
gagacgctctgcaaaactactcttt

SEQ ID NO: 334145 - DNA, 25 bp, Rattus norvegicus
gagacgctctgctaaactactcttt

SEQ ID NO: 334146 - DNA, 25 bp, Rattus norvegicus
gagacgctgaatcaagcctgcccca

SEQ ID NO: 334147 - DNA, 25 bp, Rattus norvegicus
gagacgctgaatgaagcctgcccca

SEQ ID NO: 334148 - DNA, 25 bp, Rattus norvegicus
gagacgctgaggaggcattgccctt

SEQ ID NO: 334149 - DNA, 25 bp, Rattus norvegicus
gagacgctgaggtggcattgccctt

SEQ ID NO: 334150 - DNA, 25 bp, Rattus norvegicus
gagacgctgggaaaaacctagcaga

SEQ ID NO: 334151 - DNA, 25 bp, Rattus norvegicus
gagacgctgggataaacctagcaga

SEQ ID NO: 334152 - DNA, 25 bp, Rattus norvegicus
gagacgctggttacttagtagacac

SEQ ID NO: 334153 - DNA, 25 bp, Rattus norvegicus
gagacgctggtttcttagtagacac

SEQ ID NO: 334154 - DNA, 25 bp, Rattus norvegicus
gagacgcttaagacccaagtccaga

SEQ ID NO: 334155 - DNA, 25 bp, Rattus norvegicus
gagacgcttaagtcccaagtccaga

SEQ ID NO: 334156 - DNA, 25 bp, Rattus norvegicus
gagacgctttgcactgcttgtgtgc

SEQ ID NO: 334157 - DNA, 25 bp, Rattus norvegicus
gagacgctttgcagactgaggatta

SEQ ID NO: 334158 - DNA, 25 bp, Rattus norvegicus
gagacgctttgctctgcttgtgtgc

SEQ ID NO: 334159 - DNA, 25 bp, Rattus norvegicus
gagacgctttgctgactgaggatta

SEQ ID NO: 334160 - DNA, 25 bp, Rattus norvegicus
gagacggaaggtatttctgatcact

SEQ ID NO: 334161 - DNA, 25 bp, Rattus norvegicus
gagacggaaggtttttctgatcact

SEQ ID NO: 334162 - DNA, 25 bp, Rattus norvegicus
gagacggacagaatgactccaccac

SEQ ID NO: 334163 - DNA, 25 bp, Rattus norvegicus
gagacggacagattgactccaccac

SEQ ID NO: 334164 - DNA, 25 bp, Rattus norvegicus
gagacggagttacccaccgcattaa

SEQ ID NO: 334165 - DNA, 25 bp, Rattus norvegicus
gagacggagttagccaccgcattaa

SEQ ID NO: 334166 - DNA, 25 bp, Rattus norvegicus
gagacggataatccctatcccagaa

SEQ ID NO: 334167 - DNA, 25 bp, Rattus norvegicus
gagacggataatgcctatcccagaa

SEQ ID NO: 334168 - DNA, 25 bp, Rattus norvegicus
gagacggataccatcgggagtcaag

SEQ ID NO: 334169 - DNA, 25 bp, Rattus norvegicus
gagacggataccttcgggagtcaag

SEQ ID NO: 334170 - DNA, 25 bp, Rattus norvegicus
gagacggcagccagctaactcccaa

SEQ ID NO: 334171 - DNA, 25 bp, Rattus norvegicus
gagacggcagcctgctaactcccaa

SEQ ID NO: 334172 - DNA, 25 bp, Rattus norvegicus
gagacggccagcagagcaccttgtg

SEQ ID NO: 334173 - DNA, 25 bp, Rattus norvegicus
gagacggccagctgagcaccttgtg

SEQ ID NO: 334174 - DNA, 25 bp, Rattus norvegicus
gagacggctccaacgacaacataaa

SEQ ID NO: 334175 - DNA, 25 bp, Rattus norvegicus
gagacggctccatcgacaacataaa

SEQ ID NO: 334176 - DNA, 25 bp, Rattus norvegicus
gagacgggagatactccttcctgga

SEQ ID NO: 334177 - DNA, 25 bp, Rattus norvegicus
gagacgggagattctccttcctgga

SEQ ID NO: 334178 - DNA, 25 bp, Rattus norvegicus
gagacgggtcatcgatttgtactaa

SEQ ID NO: 334179 - DNA, 25 bp, Rattus norvegicus
gagacgggtcatggatttgtactaa

SEQ ID NO: 334180 - DNA, 25 bp, Rattus norvegicus
gagacgggttaaactgccgagagct

SEQ ID NO: 334181 - DNA, 25 bp, Rattus norvegicus
gagacgggttaatctgccgagagct

SEQ ID NO: 334182 - DNA, 25 bp, Rattus norvegicus
gagacggtaagaactccacccacgg

SEQ ID NO: 334183 - DNA, 25 bp, Rattus norvegicus
gagacggtaagatctccacccacgg

SEQ ID NO: 334184 - DNA, 25 bp, Rattus norvegicus
gagacggtacaaattcagttcatag

SEQ ID NO: 334185 - DNA, 25 bp, Rattus norvegicus
gagacggtacaatttcagttcatag

SEQ ID NO: 334186 - DNA, 25 bp, Rattus norvegicus
gagacggtcgcccagatcaaagctc

SEQ ID NO: 334187 - DNA, 25 bp, Rattus norvegicus
gagacggtcgccgagatcaaagctc

SEQ ID NO: 334188 - DNA, 25 bp, Rattus norvegicus
gagacggtgcccatgagcttggcct

SEQ ID NO: 334189 - DNA, 25 bp, Rattus norvegicus
gagacggtgcccttgagcttggcct

SEQ ID NO: 334190 - DNA, 25 bp, Rattus norvegicus
gagacggttgtcaccttatcaggac

SEQ ID NO: 334191 - DNA, 25 bp, Rattus norvegicus
gagacggttgtctccttatcaggac

SEQ ID NO: 334192 - DNA, 25 bp, Rattus norvegicus
gagacggtttaacagtgctttctat

SEQ ID NO: 334193 - DNA, 25 bp, Rattus norvegicus
gagacggtttaagagtgctttctat

SEQ ID NO: 334194 - DNA, 25 bp, Rattus norvegicus
gagacgtaacttctcacagcctctg

SEQ ID NO: 334195 - DNA, 25 bp, Rattus norvegicus
gagacgtaacttgtcacagcctctg

SEQ ID NO: 334196 - DNA, 25 bp, Rattus norvegicus
gagacgtaccgcaccacgttgcgca

SEQ ID NO: 334197 - DNA, 25 bp, Rattus norvegicus
gagacgtaccgctccacgttgcgca

SEQ ID NO: 334198 - DNA, 25 bp, Rattus norvegicus
gagacgtactacaaattgcatcaga

SEQ ID NO: 334199 - DNA, 25 bp, Rattus norvegicus
gagacgtactactaattgcatcaga

SEQ ID NO: 334200 - DNA, 25 bp, Rattus norvegicus
gagacgtaggctctcttcgctgaga

SEQ ID NO: 334201 - DNA, 25 bp, Rattus norvegicus
gagacgtaggctgtcttcgctgaga

SEQ ID NO: 334202 - DNA, 25 bp, Rattus norvegicus
gagacgtcccatagtaaccaaagct

SEQ ID NO: 334203 - DNA, 25 bp, Rattus norvegicus
gagacgtcccattgtaaccaaagct

SEQ ID NO: 334204 - DNA, 25 bp, Rattus norvegicus
gagacgtcgtcaatatcagcatccc

SEQ ID NO: 334205 - DNA, 25 bp, Rattus norvegicus
gagacgtcgtcattatcagcatccc

SEQ ID NO: 334206 - DNA, 25 bp, Rattus norvegicus
gagacgtctcaaagttagacaggat

SEQ ID NO: 334207 - DNA, 25 bp, Rattus norvegicus
gagacgtctcaatgttagacaggat

SEQ ID NO: 334208 - DNA, 25 bp, Rattus norvegicus
gagacgtctcacagaacaccctgga

SEQ ID NO: 334209 - DNA, 25 bp, Rattus norvegicus
gagacgtctcactgaacaccctgga

SEQ ID NO: 334210 - DNA, 25 bp, Rattus norvegicus
gagacgtctcatacgtggtagagca

SEQ ID NO: 334211 - DNA, 25 bp, Rattus norvegicus
gagacgtctcattcgtggtagagca

SEQ ID NO: 334212 - DNA, 25 bp, Rattus norvegicus
gagacgtctccaaccgggttgggaa

SEQ ID NO: 334213 - DNA, 25 bp, Rattus norvegicus
gagacgtctccatccgggttgggaa

SEQ ID NO: 334214 - DNA, 25 bp, Rattus norvegicus
gagacgtgcagcagcattctgtgaa

SEQ ID NO: 334215 - DNA, 25 bp, Rattus norvegicus
gagacgtgcagctgcattctgtgaa

SEQ ID NO: 334216 - DNA, 25 bp, Rattus norvegicus
gagacgtgctctaccacatgtgatt

SEQ ID NO: 334217 - DNA, 25 bp, Rattus norvegicus
gagacgtgctcttccacatgtgatt

SEQ ID NO: 334218 - DNA, 25 bp, Rattus norvegicus
gagacgtgctttcttcttttattac

SEQ ID NO: 334219 - DNA, 25 bp, Rattus norvegicus
gagacgtgctttgttcttttattac

SEQ ID NO: 334220 - DNA, 25 bp, Rattus norvegicus
gagacgtggactctaaagcccaggt

SEQ ID NO: 334221 - DNA, 25 bp, Rattus norvegicus
gagacgtggactgtaaagcccaggt

SEQ ID NO: 334222 - DNA, 25 bp, Rattus norvegicus
gagacgtgggctccaagaccaccat

SEQ ID NO: 334223 - DNA, 25 bp, Rattus norvegicus
gagacgtgggctgcaagaccaccat

SEQ ID NO: 334224 - DNA, 25 bp, Rattus norvegicus
gagacgtggttgaggcacctgcaat

SEQ ID NO: 334225 - DNA, 25 bp, Rattus norvegicus
gagacgtggttgtggcacctgcaat

SEQ ID NO: 334226 - DNA, 25 bp, Rattus norvegicus
gagacgtgtctcaaaaaagccaaat

SEQ ID NO: 334227 - DNA, 25 bp, Rattus norvegicus
gagacgtgtctctaaaaagccaaat

SEQ ID NO: 334228 - DNA, 25 bp, Rattus norvegicus
gagacgtgtgctagtacccgagatt

SEQ ID NO: 334229 - DNA, 25 bp, Rattus norvegicus
gagacgtgtgcttgtacccgagatt

SEQ ID NO: 334230 - DNA, 25 bp, Rattus norvegicus
gagacgtgtggccattaacctggaa

SEQ ID NO: 334231 - DNA, 25 bp, Rattus norvegicus
gagacgtgtggcgattaacctggaa

SEQ ID NO: 334232 - DNA, 25 bp, Rattus norvegicus
gagacgttaaacatgggagccaaga

SEQ ID NO: 334233 - DNA, 25 bp, Rattus norvegicus
gagacgttaaacttgggagccaaga

SEQ ID NO: 334234 - DNA, 25 bp, Rattus norvegicus
gagacgttattcatgtactcgaatc

SEQ ID NO: 334235 - DNA, 25 bp, Rattus norvegicus
gagacgttattcttgtactcgaatc

SEQ ID NO: 334236 - DNA, 25 bp, Rattus norvegicus
gagacgttattgagcttctgtagta

SEQ ID NO: 334237 - DNA, 25 bp, Rattus norvegicus
gagacgttattgtgcttctgtagta

SEQ ID NO: 334238 - DNA, 25 bp, Rattus norvegicus
gagacgttcccactatcatgtgatc

SEQ ID NO: 334239 - DNA, 25 bp, Rattus norvegicus
gagacgttcccagtatcatgtgatc

SEQ ID NO: 334240 - DNA, 25 bp, Rattus norvegicus
gagacgttcgatcacttgccaaagt

SEQ ID NO: 334241 - DNA, 25 bp, Rattus norvegicus
gagacgttcgatgacttgccaaagt

SEQ ID NO: 334242 - DNA, 25 bp, Rattus norvegicus
gagacgttcttcaccggcggagcaa

SEQ ID NO: 334243 - DNA, 25 bp, Rattus norvegicus
gagacgttcttctccggcggagcaa

SEQ ID NO: 334244 - DNA, 25 bp, Rattus norvegicus
gagacgttgttccacattttgtttt

SEQ ID NO: 334245 - DNA, 25 bp, Rattus norvegicus
gagacgttgttcgacattttgtttt

SEQ ID NO: 334246 - DNA, 25 bp, Rattus norvegicus
gagacgtttattatggctaaccact

SEQ ID NO: 334247 - DNA, 25 bp, Rattus norvegicus
gagacgtttattttggctaaccact

SEQ ID NO: 334248 - DNA, 25 bp, Rattus norvegicus
gagacgtttgttaggacgcactccc

SEQ ID NO: 334249 - DNA, 25 bp, Rattus norvegicus
gagacgtttgtttggacgcactccc

SEQ ID NO: 334250 - DNA, 25 bp, Rattus norvegicus
gagacgttttcaccatgtagctctt

SEQ ID NO: 334251 - DNA, 25 bp, Rattus norvegicus
gagacgttttcagcatgtagctctt

SEQ ID NO: 334252 - DNA, 25 bp, Rattus norvegicus
gagactaaaagtcacgtgccccgta

SEQ ID NO: 334253 - DNA, 25 bp, Rattus norvegicus
gagactaaaagtctacctggcttca

SEQ ID NO: 334254 - DNA, 25 bp, Rattus norvegicus
gagactaaaagtgacgtgccccgta

SEQ ID NO: 334255 - DNA, 25 bp, Rattus norvegicus
gagactaaaagtgtacctggcttca

SEQ ID NO: 334256 - DNA, 25 bp, Rattus norvegicus
gagactaaagttacagctctccttt

SEQ ID NO: 334257 - DNA, 25 bp, Rattus norvegicus
gagactaaagtttcagctctccttt

SEQ ID NO: 334258 - DNA, 25 bp, Rattus norvegicus
gagactaaccatccggtcaaatgag

SEQ ID NO: 334259 - DNA, 25 bp, Rattus norvegicus
gagactaaccatgcggtcaaatgag

SEQ ID NO: 334260 - DNA, 25 bp, Rattus norvegicus
gagactaaccctcgaatgaccacgg

SEQ ID NO: 334261 - DNA, 25 bp, Rattus norvegicus
gagactaaccctggaatgaccacgg

SEQ ID NO: 334262 - DNA, 25 bp, Rattus norvegicus
gagactaaccgaaccgcaagggact

SEQ ID NO: 334263 - DNA, 25 bp, Rattus norvegicus
gagactaaccgatccgcaagggact

SEQ ID NO: 334264 - DNA, 25 bp, Rattus norvegicus
gagactaagaacagctacctgtatt

SEQ ID NO: 334265 - DNA, 25 bp, Rattus norvegicus
gagactaagaactgctacctgtatt

SEQ ID NO: 334266 - DNA, 25 bp, Rattus norvegicus
gagactaagaccctcctgttttgtc

SEQ ID NO: 334267 - DNA, 25 bp, Rattus norvegicus
gagactaagaccgtcctgttttgtc

SEQ ID NO: 334268 - DNA, 25 bp, Rattus norvegicus
gagactaaggagatctgacctcagt

SEQ ID NO: 334269 - DNA, 25 bp, Rattus norvegicus
gagactaaggagttctgacctcagt

SEQ ID NO: 334270 - DNA, 25 bp, Rattus norvegicus
gagactaatcagcttcgttggataa

SEQ ID NO: 334271 - DNA, 25 bp, Rattus norvegicus
gagactaatcaggttcgttggataa

SEQ ID NO: 334272 - DNA, 25 bp, Rattus norvegicus
gagactaatttgaaccctatactta

SEQ ID NO: 334273 - DNA, 25 bp, Rattus norvegicus
gagactaatttgtaccctatactta

SEQ ID NO: 334274 - DNA, 25 bp, Rattus norvegicus
gagactacaacaaggccaaagccaa

SEQ ID NO: 334275 - DNA, 25 bp, Rattus norvegicus
gagactacaacatggccaaagccaa

SEQ ID NO: 334276 - DNA, 25 bp, Rattus norvegicus
gagactacaggactccaagcagaag

SEQ ID NO: 334277 - DNA, 25 bp, Rattus norvegicus
gagactacaggagtccaagcagaag

SEQ ID NO: 334278 - DNA, 25 bp, Rattus norvegicus
gagactacaggccacaccgagcttg

SEQ ID NO: 334279 - DNA, 25 bp, Rattus norvegicus
gagactacaggcgacaccgagcttg

SEQ ID NO: 334280 - DNA, 25 bp, Rattus norvegicus
gagactaccaagcactctgttttcc

SEQ ID NO: 334281 - DNA, 25 bp, Rattus norvegicus
gagactaccaaggactctgttttcc

SEQ ID NO: 334282 - DNA, 25 bp, Rattus norvegicus
gagactacctggatgccactgagga

SEQ ID NO: 334283 - DNA, 25 bp, Rattus norvegicus
gagactacctggttgccactgagga

SEQ ID NO: 334284 - DNA, 25 bp, Rattus norvegicus
gagactacctgtacattctgtgaga

SEQ ID NO: 334285 - DNA, 25 bp, Rattus norvegicus
gagactacctgttcattctgtgaga

SEQ ID NO: 334286 - DNA, 25 bp, Rattus norvegicus
gagactacgcttacacgggaactaa

SEQ ID NO: 334287 - DNA, 25 bp, Rattus norvegicus
gagactacgctttcacgggaactaa

SEQ ID NO: 334288 - DNA, 25 bp, Rattus norvegicus
gagactacgtgaatgaactttctta

SEQ ID NO: 334289 - DNA, 25 bp, Rattus norvegicus
gagactacgtgattgaactttctta

SEQ ID NO: 334290 - DNA, 25 bp, Rattus norvegicus
gagactacttcgctttcagagactt

SEQ ID NO: 334291 - DNA, 25 bp, Rattus norvegicus
gagactacttcggtttcagagactt

SEQ ID NO: 334292 - DNA, 25 bp, Rattus norvegicus
gagactacttggctgtaacggaaag

SEQ ID NO: 334293 - DNA, 25 bp, Rattus norvegicus
gagactacttgggtgtaacggaaag

SEQ ID NO: 334294 - DNA, 25 bp, Rattus norvegicus
gagactactttgaattgtactgcca

SEQ ID NO: 334295 - DNA, 25 bp, Rattus norvegicus
gagactactttgtattgtactgcca

SEQ ID NO: 334296 - DNA, 25 bp, Rattus norvegicus
gagactagacgcattcctttctttt

SEQ ID NO: 334297 - DNA, 25 bp, Rattus norvegicus
gagactagacgctttcctttctttt

SEQ ID NO: 334298 - DNA, 25 bp, Rattus norvegicus
gagactagagctccaggatcccagg

SEQ ID NO: 334299 - DNA, 25 bp, Rattus norvegicus
gagactagagctgcaggatcccagg

SEQ ID NO: 334300 - DNA, 25 bp, Rattus norvegicus
gagactagatctcagttccgtgttt

SEQ ID NO: 334301 - DNA, 25 bp, Rattus norvegicus
gagactagatctgagttccgtgttt

SEQ ID NO: 334302 - DNA, 25 bp, Rattus norvegicus
gagactagcccacagacttatgact

SEQ ID NO: 334303 - DNA, 25 bp, Rattus norvegicus
gagactagcccagagacttatgact

SEQ ID NO: 334304 - DNA, 25 bp, Rattus norvegicus
gagactaggactctcgctctgtgaa

SEQ ID NO: 334305 - DNA, 25 bp, Rattus norvegicus
gagactaggactgtcgctctgtgaa

SEQ ID NO: 334306 - DNA, 25 bp, Rattus norvegicus
gagactaggttcaatcgacgggatt

SEQ ID NO: 334307 - DNA, 25 bp, Rattus norvegicus
gagactaggttctatcgacgggatt

SEQ ID NO: 334308 - DNA, 25 bp, Rattus norvegicus
gagactagtggcctgagtttcccaa

SEQ ID NO: 334309 - DNA, 25 bp, Rattus norvegicus
gagactagtggcgtgagtttcccaa

SEQ ID NO: 334310 - DNA, 25 bp, Rattus norvegicus
gagactagttttaattccttgtgaa

SEQ ID NO: 334311 - DNA, 25 bp, Rattus norvegicus
gagactagtttttattccttgtgaa

SEQ ID NO: 334312 - DNA, 25 bp, Rattus norvegicus
gagactatatcaactatttatttag

SEQ ID NO: 334313 - DNA, 25 bp, Rattus norvegicus
gagactatatcatctatttatttag

SEQ ID NO: 334314 - DNA, 25 bp, Rattus norvegicus
gagactatcctgaacagcatgagaa

SEQ ID NO: 334315 - DNA, 25 bp, Rattus norvegicus
gagactatcctgtacagcatgagaa

SEQ ID NO: 334316 - DNA, 25 bp, Rattus norvegicus
gagactatccttcctggagtgcctg

SEQ ID NO: 334317 - DNA, 25 bp, Rattus norvegicus
gagactatccttgctggagtgcctg

SEQ ID NO: 334318 - DNA, 25 bp, Rattus norvegicus
gagactatctctaccttgtttttga

SEQ ID NO: 334319 - DNA, 25 bp, Rattus norvegicus
gagactatctcttccttgtttttga

SEQ ID NO: 334320 - DNA, 25 bp, Rattus norvegicus
gagactatctttaccactggagtta

SEQ ID NO: 334321 - DNA, 25 bp, Rattus norvegicus
gagactatcttttccactggagtta

SEQ ID NO: 334322 - DNA, 25 bp, Rattus norvegicus
gagactatgagaaccacgacgggat

SEQ ID NO: 334323 - DNA, 25 bp, Rattus norvegicus
gagactatgagacatttggattgcc

SEQ ID NO: 334324 - DNA, 25 bp, Rattus norvegicus
gagactatgagagatttggattgcc

SEQ ID NO: 334325 - DNA, 25 bp, Rattus norvegicus
gagactatgagatccacgacgggat

SEQ ID NO: 334326 - DNA, 25 bp, Rattus norvegicus
gagactatgcaacagaaactttctt

SEQ ID NO: 334327 - DNA, 25 bp, Rattus norvegicus
gagactatgcaagagaaactttctt

SEQ ID NO: 334328 - DNA, 25 bp, Rattus norvegicus
gagactatggcaaccggaaccgaga

SEQ ID NO: 334329 - DNA, 25 bp, Rattus norvegicus
gagactatggcatccggaaccgaga

SEQ ID NO: 334330 - DNA, 25 bp, Rattus norvegicus
gagactatggccctatggaccacaa

SEQ ID NO: 334331 - DNA, 25 bp, Rattus norvegicus
gagactatggccgtatggaccacaa

SEQ ID NO: 334332 - DNA, 25 bp, Rattus norvegicus
gagactatggctctagctgctttga

SEQ ID NO: 334333 - DNA, 25 bp, Rattus norvegicus
gagactatggctgtagctgctttga

SEQ ID NO: 334334 - DNA, 25 bp, Rattus norvegicus
gagactatgtacaaacccttgccaa

SEQ ID NO: 334335 - DNA, 25 bp, Rattus norvegicus
gagactatgtactaacccttgccaa

SEQ ID NO: 334336 - DNA, 25 bp, Rattus norvegicus
gagactatgtccctgatggatccca

SEQ ID NO: 334337 - DNA, 25 bp, Rattus norvegicus
gagactatgtccgtgatggatccca

SEQ ID NO: 334338 - DNA, 25 bp, Rattus norvegicus
gagactatgtggaatttcttttacc

SEQ ID NO: 334339 - DNA, 25 bp, Rattus norvegicus
gagactatgtggtatttcttttacc

SEQ ID NO: 334340 - DNA, 25 bp, Rattus norvegicus
gagactattattatactctgatata

SEQ ID NO: 334341 - DNA, 25 bp, Rattus norvegicus
gagactattattttactctgatata

SEQ ID NO: 334342 - DNA, 25 bp, Rattus norvegicus
gagactattgaaagatgattcattt

SEQ ID NO: 334343 - DNA, 25 bp, Rattus norvegicus
gagactattgaatgatgattcattt

SEQ ID NO: 334344 - DNA, 25 bp, Rattus norvegicus
gagactcaaatcataaggcaatcct

SEQ ID NO: 334345 - DNA, 25 bp, Rattus norvegicus
gagactcaaatcttaaggcaatcct

SEQ ID NO: 334346 - DNA, 25 bp, Rattus norvegicus
gagactcacagcacctgagatctta

SEQ ID NO: 334347 - DNA, 25 bp, Rattus norvegicus
gagactcacagctcctgagatctta

SEQ ID NO: 334348 - DNA, 25 bp, Rattus norvegicus
gagactcaccaacttcatctcagga

SEQ ID NO: 334349 - DNA, 25 bp, Rattus norvegicus
gagactcaccaagttcatctcagga

SEQ ID NO: 334350 - DNA, 25 bp, Rattus norvegicus
gagactcaccagacgtttacattca

SEQ ID NO: 334351 - DNA, 25 bp, Rattus norvegicus
gagactcaccagtcgtttacattca

SEQ ID NO: 334352 - DNA, 25 bp, Rattus norvegicus
gagactcaccatagggatttctttt

SEQ ID NO: 334353 - DNA, 25 bp, Rattus norvegicus
gagactcaccattgggatttctttt

SEQ ID NO: 334354 - DNA, 25 bp, Rattus norvegicus
gagactcactgtctagcttatcctt

SEQ ID NO: 334355 - DNA, 25 bp, Rattus norvegicus
gagactcactgtgtagcttatcctt

SEQ ID NO: 334356 - DNA, 25 bp, Rattus norvegicus
gagactcagacacatatctaagttg

SEQ ID NO: 334357 - DNA, 25 bp, Rattus norvegicus
gagactcagacagatatctaagttg

SEQ ID NO: 334358 - DNA, 25 bp, Rattus norvegicus
gagactcagagcaactctccattgt

SEQ ID NO: 334359 - DNA, 25 bp, Rattus norvegicus
gagactcagagcattgcaaccttta

SEQ ID NO: 334360 - DNA, 25 bp, Rattus norvegicus
gagactcagagctactctccattgt

SEQ ID NO: 334361 - DNA, 25 bp, Rattus norvegicus
gagactcagagctttgcaaccttta

SEQ ID NO: 334362 - DNA, 25 bp, Rattus norvegicus
gagactcagctactcagtccaagca

SEQ ID NO: 334363 - DNA, 25 bp, Rattus norvegicus
gagactcagctagtcagtccaagca

SEQ ID NO: 334364 - DNA, 25 bp, Rattus norvegicus
gagactcaggccacagtttctttga

SEQ ID NO: 334365 - DNA, 25 bp, Rattus norvegicus
gagactcaggcctcagtttctttga

SEQ ID NO: 334366 - DNA, 25 bp, Rattus norvegicus
gagactcagtaaaatttccaactta

SEQ ID NO: 334367 - DNA, 25 bp, Rattus norvegicus
gagactcagtaatatttccaactta

SEQ ID NO: 334368 - DNA, 25 bp, Rattus norvegicus
gagactcatagtacaagccagattg

SEQ ID NO: 334369 - DNA, 25 bp, Rattus norvegicus
gagactcatagttcaagccagattg

SEQ ID NO: 334370 - DNA, 25 bp, Rattus norvegicus
gagactcatctaaaagccacctttg

SEQ ID NO: 334371 - DNA, 25 bp, Rattus norvegicus
gagactcatctataagccacctttg

SEQ ID NO: 334372 - DNA, 25 bp, Rattus norvegicus
gagactcatcttcgtatggcaggca

SEQ ID NO: 334373 - DNA, 25 bp, Rattus norvegicus
gagactcatcttggtatggcaggca

SEQ ID NO: 334374 - DNA, 25 bp, Rattus norvegicus
gagactcattgtaccgtttctgaaa

SEQ ID NO: 334375 - DNA, 25 bp, Rattus norvegicus
gagactcattgtcgccagttttgct

SEQ ID NO: 334376 - DNA, 25 bp, Rattus norvegicus
gagactcattgtggccagttttgct

SEQ ID NO: 334377 - DNA, 25 bp, Rattus norvegicus
gagactcattgttccgtttctgaaa

SEQ ID NO: 334378 - DNA, 25 bp, Rattus norvegicus
gagactcattttctttctgaggagt

SEQ ID NO: 334379 - DNA, 25 bp, Rattus norvegicus
gagactcattttgtttctgaggagt

SEQ ID NO: 334380 - DNA, 25 bp, Rattus norvegicus
gagactccaagcagatgacccggaa

SEQ ID NO: 334381 - DNA, 25 bp, Rattus norvegicus
gagactccaagctgatgacccggaa

SEQ ID NO: 334382 - DNA, 25 bp, Rattus norvegicus
gagactccaaggcatcatctactaa

SEQ ID NO: 334383 - DNA, 25 bp, Rattus norvegicus
gagactccaagggatcatctactaa

SEQ ID NO: 334384 - DNA, 25 bp, Rattus norvegicus
gagactccaccacagtgactcttgg

SEQ ID NO: 334385 - DNA, 25 bp, Rattus norvegicus
gagactccaccagagtgactcttgg

SEQ ID NO: 334386 - DNA, 25 bp, Rattus norvegicus
gagactccagagaccctttgtacag

SEQ ID NO: 334387 - DNA, 25 bp, Rattus norvegicus
gagactccagagctgctgtccatgg

SEQ ID NO: 334388 - DNA, 25 bp, Rattus norvegicus
gagactccagaggtgctgtccatgg

SEQ ID NO: 334389 - DNA, 25 bp, Rattus norvegicus
gagactccagagtccctttgtacag

SEQ ID NO: 334390 - DNA, 25 bp, Rattus norvegicus
gagactccagcgcagactgattgga

SEQ ID NO: 334391 - DNA, 25 bp, Rattus norvegicus
gagactccagcggagactgattgga

SEQ ID NO: 334392 - DNA, 25 bp, Rattus norvegicus
gagactccaggtctactcacgagcg

SEQ ID NO: 334393 - DNA, 25 bp, Rattus norvegicus
gagactccaggtgtactcacgagcg

SEQ ID NO: 334394 - DNA, 25 bp, Rattus norvegicus
gagactccatttacagaaccacaat

SEQ ID NO: 334395 - DNA, 25 bp, Rattus norvegicus
gagactccattttcagaaccacaat

SEQ ID NO: 334396 - DNA, 25 bp, Rattus norvegicus
gagactcccagccagggtctaaagt

SEQ ID NO: 334397 - DNA, 25 bp, Rattus norvegicus
gagactcccagcgagggtctaaagt

SEQ ID NO: 334398 - DNA, 25 bp, Rattus norvegicus
gagactcccatacttcctggtgact

SEQ ID NO: 334399 - DNA, 25 bp, Rattus norvegicus
gagactcccatagttcctggtgact

SEQ ID NO: 334400 - DNA, 25 bp, Rattus norvegicus
gagactccctgaccatgggtggcta

SEQ ID NO: 334401 - DNA, 25 bp, Rattus norvegicus
gagactccctgagcatgggtggcta

SEQ ID NO: 334402 - DNA, 25 bp, Rattus norvegicus
gagactccctgcagtggtggttcca

SEQ ID NO: 334403 - DNA, 25 bp, Rattus norvegicus
gagactccctgctgtggtggttcca

SEQ ID NO: 334404 - DNA, 25 bp, Rattus norvegicus
gagactcccttgctgcttgggaata

SEQ ID NO: 334405 - DNA, 25 bp, Rattus norvegicus
gagactcccttggtgcttgggaata

SEQ ID NO: 334406 - DNA, 25 bp, Rattus norvegicus
gagactccctttagcccagggtggt

SEQ ID NO: 334407 - DNA, 25 bp, Rattus norvegicus
gagactccctttctgttgctattac

SEQ ID NO: 334408 - DNA, 25 bp, Rattus norvegicus
gagactccctttgtgttgctattac

SEQ ID NO: 334409 - DNA, 25 bp, Rattus norvegicus
gagactcccttttgcccagggtggt

SEQ ID NO: 334410 - DNA, 25 bp, Rattus norvegicus
gagactccgagaagccatgacagtt

SEQ ID NO: 334411 - DNA, 25 bp, Rattus norvegicus
gagactccgagatgccatgacagtt

SEQ ID NO: 334412 - DNA, 25 bp, Rattus norvegicus
gagactccggaccagtttatgacag

SEQ ID NO: 334413 - DNA, 25 bp, Rattus norvegicus
gagactccggacgagtttatgacag

SEQ ID NO: 334414 - DNA, 25 bp, Rattus norvegicus
gagactccgggactgtgcgtaacac

SEQ ID NO: 334415 - DNA, 25 bp, Rattus norvegicus
gagactccgggagtgtgcgtaacac

SEQ ID NO: 334416 - DNA, 25 bp, Rattus norvegicus
gagactcctattatctgacttgtgc

SEQ ID NO: 334417 - DNA, 25 bp, Rattus norvegicus
gagactcctattttctgacttgtgc

SEQ ID NO: 334418 - DNA, 25 bp, Rattus norvegicus
gagactcctcagacgaagacagcaa

SEQ ID NO: 334419 - DNA, 25 bp, Rattus norvegicus
gagactcctcagtcgaagacagcaa

SEQ ID NO: 334420 - DNA, 25 bp, Rattus norvegicus
gagactcctcttcaaggatgcgccc

SEQ ID NO: 334421 - DNA, 25 bp, Rattus norvegicus
gagactcctcttgaaggatgcgccc

SEQ ID NO: 334422 - DNA, 25 bp, Rattus norvegicus
gagactcctgacattgaagttgctt

SEQ ID NO: 334423 - DNA, 25 bp, Rattus norvegicus
gagactcctgactttgaagttgctt

SEQ ID NO: 334424 - DNA, 25 bp, Rattus norvegicus
gagactcctgagagtatacctgctc

SEQ ID NO: 334425 - DNA, 25 bp, Rattus norvegicus
gagactcctgagataacactgggaa

SEQ ID NO: 334426 - DNA, 25 bp, Rattus norvegicus
gagactcctgagtgtatacctgctc

SEQ ID NO: 334427 - DNA, 25 bp, Rattus norvegicus
gagactcctgagttaacactgggaa

SEQ ID NO: 334428 - DNA, 25 bp, Rattus norvegicus
gagactcctgatctggaccctgagc

SEQ ID NO: 334429 - DNA, 25 bp, Rattus norvegicus
gagactcctgatgtggaccctgagc

SEQ ID NO: 334430 - DNA, 25 bp, Rattus norvegicus
gagactcctggtcatattttagggt

SEQ ID NO: 334431 - DNA, 25 bp, Rattus norvegicus
gagactcctggtgatattttagggt

SEQ ID NO: 334432 - DNA, 25 bp, Rattus norvegicus
gagactccttaaaggtgcattcttt

SEQ ID NO: 334433 - DNA, 25 bp, Rattus norvegicus
gagactccttaatggtgcattcttt

SEQ ID NO: 334434 - DNA, 25 bp, Rattus norvegicus
gagactccttgcattccgtcagata

SEQ ID NO: 334435 - DNA, 25 bp, Rattus norvegicus
gagactccttgctttccgtcagata

SEQ ID NO: 334436 - DNA, 25 bp, Rattus norvegicus
gagactcgacatacctcggtattta

SEQ ID NO: 334437 - DNA, 25 bp, Rattus norvegicus
gagactcgacattcctcggtattta

SEQ ID NO: 334438 - DNA, 25 bp, Rattus norvegicus
gagactcgagttagcgtccctgaga

SEQ ID NO: 334439 - DNA, 25 bp, Rattus norvegicus
gagactcgagtttgcgtccctgaga

SEQ ID NO: 334440 - DNA, 25 bp, Rattus norvegicus
gagactcgatgcattgtgctttcag

SEQ ID NO: 334441 - DNA, 25 bp, Rattus norvegicus
gagactcgatgctttgtgctttcag

SEQ ID NO: 334442 - DNA, 25 bp, Rattus norvegicus
gagactcgcggcacgcccaggaagg

SEQ ID NO: 334443 - DNA, 25 bp, Rattus norvegicus
gagactcgcggctcgcccaggaagg

SEQ ID NO: 334444 - DNA, 25 bp, Rattus norvegicus
gagactcggagcagtttatgactga

SEQ ID NO: 334445 - DNA, 25 bp, Rattus norvegicus
gagactcggagctgtttatgactga

SEQ ID NO: 334446 - DNA, 25 bp, Rattus norvegicus
gagactcggcgaacaggcacatgca

SEQ ID NO: 334447 - DNA, 25 bp, Rattus norvegicus
gagactcggcgatcaggcacatgca

SEQ ID NO: 334448 - DNA, 25 bp, Rattus norvegicus
gagactcggctacatacgatggcac

SEQ ID NO: 334449 - DNA, 25 bp, Rattus norvegicus
gagactcggctagatacgatggcac

SEQ ID NO: 334450 - DNA, 25 bp, Rattus norvegicus
gagactcgggcaatgatagtgcaaa

SEQ ID NO: 334451 - DNA, 25 bp, Rattus norvegicus
gagactcgggcattgatagtgcaaa

SEQ ID NO: 334452 - DNA, 25 bp, Rattus norvegicus
gagactcggtgaaagctgcagctgt

SEQ ID NO: 334453 - DNA, 25 bp, Rattus norvegicus
gagactcggtgatagctgcagctgt

SEQ ID NO: 334454 - DNA, 25 bp, Rattus norvegicus
gagactctaaacagcttcttcactg

SEQ ID NO: 334455 - DNA, 25 bp, Rattus norvegicus
gagactctaaactgcttcttcactg

SEQ ID NO: 334456 - DNA, 25 bp, Rattus norvegicus
gagactctaaatacaatctctagaa

SEQ ID NO: 334457 - DNA, 25 bp, Rattus norvegicus
gagactctaaatactgagcccttgg

SEQ ID NO: 334458 - DNA, 25 bp, Rattus norvegicus
gagactctaaattcaatctctagaa

SEQ ID NO: 334459 - DNA, 25 bp, Rattus norvegicus
gagactctaaattctgagcccttgg

SEQ ID NO: 334460 - DNA, 25 bp, Rattus norvegicus
gagactctacatcttggtttgggaa

SEQ ID NO: 334461 - DNA, 25 bp, Rattus norvegicus
gagactctacatgttggtttgggaa

SEQ ID NO: 334462 - DNA, 25 bp, Rattus norvegicus
gagactctacggatgtggcgctgct

SEQ ID NO: 334463 - DNA, 25 bp, Rattus norvegicus
gagactctacggttgtggcgctgct

SEQ ID NO: 334464 - DNA, 25 bp, Rattus norvegicus
gagactctactcaagtcattcctat

SEQ ID NO: 334465 - DNA, 25 bp, Rattus norvegicus
gagactctactctagtcattcctat

SEQ ID NO: 334466 - DNA, 25 bp, Rattus norvegicus
gagactctcagtagccaggtaggaa

SEQ ID NO: 334467 - DNA, 25 bp, Rattus norvegicus
gagactctcagtcgtattgcacagt

SEQ ID NO: 334468 - DNA, 25 bp, Rattus norvegicus
gagactctcagtggtattgcacagt

SEQ ID NO: 334469 - DNA, 25 bp, Rattus norvegicus
gagactctcagttgccaggtaggaa

SEQ ID NO: 334470 - DNA, 25 bp, Rattus norvegicus
gagactctcatcagaatactccctg

SEQ ID NO: 334471 - DNA, 25 bp, Rattus norvegicus
gagactctcatctgaatactccctg

SEQ ID NO: 334472 - DNA, 25 bp, Rattus norvegicus
gagactctccgtcacgtggataata

SEQ ID NO: 334473 - DNA, 25 bp, Rattus norvegicus
gagactctccgtgacgtggataata

SEQ ID NO: 334474 - DNA, 25 bp, Rattus norvegicus
gagactctcctaaattagccagaag

SEQ ID NO: 334475 - DNA, 25 bp, Rattus norvegicus
gagactctcctatattagccagaag

SEQ ID NO: 334476 - DNA, 25 bp, Rattus norvegicus
gagactctcgagactcttacttgga

SEQ ID NO: 334477 - DNA, 25 bp, Rattus norvegicus
gagactctcgagtctcttacttgga

SEQ ID NO: 334478 - DNA, 25 bp, Rattus norvegicus
gagactctcgcacccaaggaaagtt

SEQ ID NO: 334479 - DNA, 25 bp, Rattus norvegicus
gagactctcgcagccaaggaaagtt

SEQ ID NO: 334480 - DNA, 25 bp, Rattus norvegicus
gagactctctataacttcctaatca

SEQ ID NO: 334481 - DNA, 25 bp, Rattus norvegicus
gagactctctattacttcctaatca

SEQ ID NO: 334482 - DNA, 25 bp, Rattus norvegicus
gagactctctctatgtactagctgg

SEQ ID NO: 334483 - DNA, 25 bp, Rattus norvegicus
gagactctctctttgtactagctgg

SEQ ID NO: 334484 - DNA, 25 bp, Rattus norvegicus
gagactctgaagaaagcgccttaca

SEQ ID NO: 334485 - DNA, 25 bp, Rattus norvegicus
gagactctgaagtaagcgccttaca

SEQ ID NO: 334486 - DNA, 25 bp, Rattus norvegicus
gagactctgactccccagtgaggtg

SEQ ID NO: 334487 - DNA, 25 bp, Rattus norvegicus
gagactctgactgcccagtgaggtg

SEQ ID NO: 334488 - DNA, 25 bp, Rattus norvegicus
gagactctgccaatcagtgagcatg

SEQ ID NO: 334489 - DNA, 25 bp, Rattus norvegicus
gagactctgccattcagtgagcatg

SEQ ID NO: 334490 - DNA, 25 bp, Rattus norvegicus
gagactctgcctacgtggagccaaa

SEQ ID NO: 334491 - DNA, 25 bp, Rattus norvegicus
gagactctgccttcgtggagccaaa

SEQ ID NO: 334492 - DNA, 25 bp, Rattus norvegicus
gagactctggaacctcttatccagg

SEQ ID NO: 334493 - DNA, 25 bp, Rattus norvegicus
gagactctggaagctcttatccagg

SEQ ID NO: 334494 - DNA, 25 bp, Rattus norvegicus
gagactctggctctccttggcaaat

SEQ ID NO: 334495 - DNA, 25 bp, Rattus norvegicus
gagactctggctgtccttggcaaat

SEQ ID NO: 334496 - DNA, 25 bp, Rattus norvegicus
gagactctgtcaatattttccaatc

SEQ ID NO: 334497 - DNA, 25 bp, Rattus norvegicus
gagactctgtcattattttccaatc

SEQ ID NO: 334498 - DNA, 25 bp, Rattus norvegicus
gagactctgtctcaagcactggcaa

SEQ ID NO: 334499 - DNA, 25 bp, Rattus norvegicus
gagactctgtctgaagcactggcaa

SEQ ID NO: 334500 - DNA, 25 bp, Rattus norvegicus
gagactcttaagaaacgcagcctgt

SEQ ID NO: 334501 - DNA, 25 bp, Rattus norvegicus
gagactcttaagtaacgcagcctgt

SEQ ID NO: 334502 - DNA, 25 bp, Rattus norvegicus
gagactcttaccacttaatatcaga

SEQ ID NO: 334503 - DNA, 25 bp, Rattus norvegicus
gagactcttacctcttaatatcaga

SEQ ID NO: 334504 - DNA, 25 bp, Rattus norvegicus
gagactcttgaacacaatgtcagat

SEQ ID NO: 334505 - DNA, 25 bp, Rattus norvegicus
gagactcttgaagacaatgtcagat

SEQ ID NO: 334506 - DNA, 25 bp, Rattus norvegicus
gagactcttgggagctgtgcacaaa

SEQ ID NO: 334507 - DNA, 25 bp, Rattus norvegicus
gagactcttgggtgctgtgcacaaa

SEQ ID NO: 334508 - DNA, 25 bp, Rattus norvegicus
gagactctttcaaagccggaggctc

SEQ ID NO: 334509 - DNA, 25 bp, Rattus norvegicus
gagactctttcatagccggaggctc

SEQ ID NO: 334510 - DNA, 25 bp, Rattus norvegicus
gagactcttttacgatcagatctgt

SEQ ID NO: 334511 - DNA, 25 bp, Rattus norvegicus
gagactcttttaggatcagatctgt

SEQ ID NO: 334512 - DNA, 25 bp, Rattus norvegicus
gagactgaagaacagactccgcagc

SEQ ID NO: 334513 - DNA, 25 bp, Rattus norvegicus
gagactgaagaagagactccgcagc

SEQ ID NO: 334514 - DNA, 25 bp, Rattus norvegicus
gagactgaagcaagggctcctgcct

SEQ ID NO: 334515 - DNA, 25 bp, Rattus norvegicus
gagactgaagcatgggctcctgcct

SEQ ID NO: 334516 - DNA, 25 bp, Rattus norvegicus
gagactgaagggactgctggctcac

SEQ ID NO: 334517 - DNA, 25 bp, Rattus norvegicus
gagactgaagggtctgctggctcac

SEQ ID NO: 334518 - DNA, 25 bp, Rattus norvegicus
gagactgaataaacttctccgccct

SEQ ID NO: 334519 - DNA, 25 bp, Rattus norvegicus
gagactgaataatcttctccgccct

SEQ ID NO: 334520 - DNA, 25 bp, Rattus norvegicus
gagactgaatctcacagcatccatc

SEQ ID NO: 334521 - DNA, 25 bp, Rattus norvegicus
gagactgaatctgacagcatccatc

SEQ ID NO: 334522 - DNA, 25 bp, Rattus norvegicus
gagactgaatggacttgctagcgaa

SEQ ID NO: 334523 - DNA, 25 bp, Rattus norvegicus
gagactgaatggtcttgctagcgaa

SEQ ID NO: 334524 - DNA, 25 bp, Rattus norvegicus
gagactgacagaatttattgacctt

SEQ ID NO: 334525 - DNA, 25 bp, Rattus norvegicus
gagactgacagattttattgacctt

SEQ ID NO: 334526 - DNA, 25 bp, Rattus norvegicus
gagactgaccttaaagctagagcaa

SEQ ID NO: 334527 - DNA, 25 bp, Rattus norvegicus
gagactgaccttcgaaactaattag

SEQ ID NO: 334528 - DNA, 25 bp, Rattus norvegicus
gagactgaccttggaaactaattag

SEQ ID NO: 334529 - DNA, 25 bp, Rattus norvegicus
gagactgacctttaagctagagcaa

SEQ ID NO: 334530 - DNA, 25 bp, Rattus norvegicus
gagactgacgttagactcccaggag

SEQ ID NO: 334531 - DNA, 25 bp, Rattus norvegicus
gagactgacgtttgactcccaggag

SEQ ID NO: 334532 - DNA, 25 bp, Rattus norvegicus
gagactgactacagagcctcggcaa

SEQ ID NO: 334533 - DNA, 25 bp, Rattus norvegicus
gagactgactaccttaaaccaccga

SEQ ID NO: 334534 - DNA, 25 bp, Rattus norvegicus
gagactgactacgttaaaccaccga

SEQ ID NO: 334535 - DNA, 25 bp, Rattus norvegicus
gagactgactactgagcctcggcaa

SEQ ID NO: 334536 - DNA, 25 bp, Rattus norvegicus
gagactgactagaaatctttgccta

SEQ ID NO: 334537 - DNA, 25 bp, Rattus norvegicus
gagactgactagtaatctttgccta

SEQ ID NO: 334538 - DNA, 25 bp, Rattus norvegicus
gagactgactgcaactcagagttgt

SEQ ID NO: 334539 - DNA, 25 bp, Rattus norvegicus
gagactgactgccttatgatcactg

SEQ ID NO: 334540 - DNA, 25 bp, Rattus norvegicus
gagactgactgcgttatgatcactg

SEQ ID NO: 334541 - DNA, 25 bp, Rattus norvegicus
gagactgactgctactcagagttgt

SEQ ID NO: 334542 - DNA, 25 bp, Rattus norvegicus
gagactgactgtctgcactcaatgc

SEQ ID NO: 334543 - DNA, 25 bp, Rattus norvegicus
gagactgactgtgtgcactcaatgc

SEQ ID NO: 334544 - DNA, 25 bp, Rattus norvegicus
gagactgagacaatttaacttgcaa

SEQ ID NO: 334545 - DNA, 25 bp, Rattus norvegicus
gagactgagacattttaacttgcaa

SEQ ID NO: 334546 - DNA, 25 bp, Rattus norvegicus
gagactgagccaatttggatgactc

SEQ ID NO: 334547 - DNA, 25 bp, Rattus norvegicus
gagactgagccattttggatgactc

SEQ ID NO: 334548 - DNA, 25 bp, Rattus norvegicus
gagactgaggagaccttgctgcttt

SEQ ID NO: 334549 - DNA, 25 bp, Rattus norvegicus
gagactgaggagtccttgctgcttt

SEQ ID NO: 334550 - DNA, 25 bp, Rattus norvegicus
gagactgaggttccaacatgtgaat

SEQ ID NO: 334551 - DNA, 25 bp, Rattus norvegicus
gagactgaggttgcaacatgtgaat

SEQ ID NO: 334552 - DNA, 25 bp, Rattus norvegicus
gagactgagtggctccctgatcatc

SEQ ID NO: 334553 - DNA, 25 bp, Rattus norvegicus
gagactgagtgggtccctgatcatc

SEQ ID NO: 334554 - DNA, 25 bp, Rattus norvegicus
gagactgataaaacctcttaccctt

SEQ ID NO: 334555 - DNA, 25 bp, Rattus norvegicus
gagactgataaatcctcttaccctt

SEQ ID NO: 334556 - DNA, 25 bp, Rattus norvegicus
gagactgatacgaaacctgaaggct

SEQ ID NO: 334557 - DNA, 25 bp, Rattus norvegicus
gagactgatacgtaacctgaaggct

SEQ ID NO: 334558 - DNA, 25 bp, Rattus norvegicus
gagactgatactatgggcgttgata

SEQ ID NO: 334559 - DNA, 25 bp, Rattus norvegicus
gagactgatactttgggcgttgata

SEQ ID NO: 334560 - DNA, 25 bp, Rattus norvegicus
gagactgatcgaccttgacctcgaa

SEQ ID NO: 334561 - DNA, 25 bp, Rattus norvegicus
gagactgatcgagcttgacctcgaa

SEQ ID NO: 334562 - DNA, 25 bp, Rattus norvegicus
gagactgattacaatgtgctataag

SEQ ID NO: 334563 - DNA, 25 bp, Rattus norvegicus
gagactgattactatgtgctataag

SEQ ID NO: 334564 - DNA, 25 bp, Rattus norvegicus
gagactgcaaacaaccagtggtact

SEQ ID NO: 334565 - DNA, 25 bp, Rattus norvegicus
gagactgcaaactaccagtggtact

SEQ ID NO: 334566 - DNA, 25 bp, Rattus norvegicus
gagactgcaactactgaactctgtc

SEQ ID NO: 334567 - DNA, 25 bp, Rattus norvegicus
gagactgcaacttctgaactctgtc

SEQ ID NO: 334568 - DNA, 25 bp, Rattus norvegicus
gagactgcaagacttctatgattcc

SEQ ID NO: 334569 - DNA, 25 bp, Rattus norvegicus
gagactgcaagagttctatgattcc

SEQ ID NO: 334570 - DNA, 25 bp, Rattus norvegicus
gagactgcaatgaattccccgtatt

SEQ ID NO: 334571 - DNA, 25 bp, Rattus norvegicus
gagactgcaatgtattccccgtatt

SEQ ID NO: 334572 - DNA, 25 bp, Rattus norvegicus
gagactgcacaacacaatagccctg

SEQ ID NO: 334573 - DNA, 25 bp, Rattus norvegicus
gagactgcacaagacaatagccctg

SEQ ID NO: 334574 - DNA, 25 bp, Rattus norvegicus
gagactgcacgcattgtcaactacc

SEQ ID NO: 334575 - DNA, 25 bp, Rattus norvegicus
gagactgcacgctttgtcaactacc

SEQ ID NO: 334576 - DNA, 25 bp, Rattus norvegicus
gagactgcactcaaggctgaaccat

SEQ ID NO: 334577 - DNA, 25 bp, Rattus norvegicus
gagactgcactctaggctgaaccat

SEQ ID NO: 334578 - DNA, 25 bp, Rattus norvegicus
gagactgcaggaatgtgtcacctct

SEQ ID NO: 334579 - DNA, 25 bp, Rattus norvegicus
gagactgcaggattgtgtcacctct

SEQ ID NO: 334580 - DNA, 25 bp, Rattus norvegicus
gagactgcagttagcttctgtgcta

SEQ ID NO: 334581 - DNA, 25 bp, Rattus norvegicus
gagactgcagtttgcttctgtgcta

SEQ ID NO: 334582 - DNA, 25 bp, Rattus norvegicus
gagactgcatgtaaatgtactacag

SEQ ID NO: 334583 - DNA, 25 bp, Rattus norvegicus
gagactgcatgttaatgtactacag

SEQ ID NO: 334584 - DNA, 25 bp, Rattus norvegicus
gagactgccagtagctctgagccct

SEQ ID NO: 334585 - DNA, 25 bp, Rattus norvegicus
gagactgccagtcagtgatgcccct

SEQ ID NO: 334586 - DNA, 25 bp, Rattus norvegicus
gagactgccagtgagtgatgcccct

SEQ ID NO: 334587 - DNA, 25 bp, Rattus norvegicus
gagactgccagttgctctgagccct

SEQ ID NO: 334588 - DNA, 25 bp, Rattus norvegicus
gagactgcccatcaaggcttgggaa

SEQ ID NO: 334589 - DNA, 25 bp, Rattus norvegicus
gagactgcccatcctcaatgagtgg

SEQ ID NO: 334590 - DNA, 25 bp, Rattus norvegicus
gagactgcccatgaaggcttgggaa

SEQ ID NO: 334591 - DNA, 25 bp, Rattus norvegicus
gagactgcccatgctcaatgagtgg

SEQ ID NO: 334592 - DNA, 25 bp, Rattus norvegicus
gagactgccgatcctatgaaccgag

SEQ ID NO: 334593 - DNA, 25 bp, Rattus norvegicus
gagactgccgatgctatgaaccgag

SEQ ID NO: 334594 - DNA, 25 bp, Rattus norvegicus
gagactgccggaaacatcatgtcct

SEQ ID NO: 334595 - DNA, 25 bp, Rattus norvegicus
gagactgccggatacatcatgtcct

SEQ ID NO: 334596 - DNA, 25 bp, Rattus norvegicus
gagactgccggcagtggtctccaag

SEQ ID NO: 334597 - DNA, 25 bp, Rattus norvegicus
gagactgccggctgtggtctccaag

SEQ ID NO: 334598 - DNA, 25 bp, Rattus norvegicus
gagactgcctatcgtcaggacattt

SEQ ID NO: 334599 - DNA, 25 bp, Rattus norvegicus
gagactgcctatggtcaggacattt

SEQ ID NO: 334600 - DNA, 25 bp, Rattus norvegicus
gagactgcctgtattttacagacac

SEQ ID NO: 334601 - DNA, 25 bp, Rattus norvegicus
gagactgcctgttttttacagacac

SEQ ID NO: 334602 - DNA, 25 bp, Rattus norvegicus
gagactgccttaatttcagacgcat

SEQ ID NO: 334603 - DNA, 25 bp, Rattus norvegicus
gagactgccttattttcagacgcat

SEQ ID NO: 334604 - DNA, 25 bp, Rattus norvegicus
gagactgcgaacacttaaacagacc

SEQ ID NO: 334605 - DNA, 25 bp, Rattus norvegicus
gagactgcgaactcttaaacagacc

SEQ ID NO: 334606 - DNA, 25 bp, Rattus norvegicus
gagactgcgatcaattgttacttaa

SEQ ID NO: 334607 - DNA, 25 bp, Rattus norvegicus
gagactgcgatctattgttacttaa

SEQ ID NO: 334608 - DNA, 25 bp, Rattus norvegicus
gagactgcgcatcctttttatattc

SEQ ID NO: 334609 - DNA, 25 bp, Rattus norvegicus
gagactgcgcatgctttttatattc

SEQ ID NO: 334610 - DNA, 25 bp, Rattus norvegicus
gagactgctcaactctgggacttta

SEQ ID NO: 334611 - DNA, 25 bp, Rattus norvegicus
gagactgctcaactggtactttcaa

SEQ ID NO: 334612 - DNA, 25 bp, Rattus norvegicus
gagactgctcaagtctgggacttta

SEQ ID NO: 334613 - DNA, 25 bp, Rattus norvegicus
gagactgctcaagtggtactttcaa

SEQ ID NO: 334614 - DNA, 25 bp, Rattus norvegicus
gagactgctccccaatagagtcttc

SEQ ID NO: 334615 - DNA, 25 bp, Rattus norvegicus
gagactgctcccgaatagagtcttc

SEQ ID NO: 334616 - DNA, 25 bp, Rattus norvegicus
gagactgctctgaaacatcattctg

SEQ ID NO: 334617 - DNA, 25 bp, Rattus norvegicus
gagactgctctgattagttacctga

SEQ ID NO: 334618 - DNA, 25 bp, Rattus norvegicus
gagactgctctgtaacatcattctg

SEQ ID NO: 334619 - DNA, 25 bp, Rattus norvegicus
gagactgctctgtttagttacctga

SEQ ID NO: 334620 - DNA, 25 bp, Rattus norvegicus
gagactgctgggacaatttcctact

SEQ ID NO: 334621 - DNA, 25 bp, Rattus norvegicus
gagactgctgggtcaatttcctact

SEQ ID NO: 334622 - DNA, 25 bp, Rattus norvegicus
gagactgctgtcaatctcgcctgga

SEQ ID NO: 334623 - DNA, 25 bp, Rattus norvegicus
gagactgctgtctatctcgcctgga

SEQ ID NO: 334624 - DNA, 25 bp, Rattus norvegicus
gagactgctgtgagtagcctacggt

SEQ ID NO: 334625 - DNA, 25 bp, Rattus norvegicus
gagactgctgtgatcatgcaaccac

SEQ ID NO: 334626 - DNA, 25 bp, Rattus norvegicus
gagactgctgtgtgtagcctacggt

SEQ ID NO: 334627 - DNA, 25 bp, Rattus norvegicus
gagactgctgtgttcatgcaaccac

SEQ ID NO: 334628 - DNA, 25 bp, Rattus norvegicus
gagactgcttataatcacgtatgtt

SEQ ID NO: 334629 - DNA, 25 bp, Rattus norvegicus
gagactgcttatagcatcaccaggt

SEQ ID NO: 334630 - DNA, 25 bp, Rattus norvegicus
gagactgcttattatcacgtatgtt

SEQ ID NO: 334631 - DNA, 25 bp, Rattus norvegicus
gagactgcttattgcatcaccaggt

SEQ ID NO: 334632 - DNA, 25 bp, Rattus norvegicus
gagactgcttgaagcttctaccaca

SEQ ID NO: 334633 - DNA, 25 bp, Rattus norvegicus
gagactgcttgatgcttctaccaca

SEQ ID NO: 334634 - DNA, 25 bp, Rattus norvegicus
gagactggacacatgctgctaactg

SEQ ID NO: 334635 - DNA, 25 bp, Rattus norvegicus
gagactggacacttgctgctaactg

SEQ ID NO: 334636 - DNA, 25 bp, Rattus norvegicus
gagactggacagacattcttggaga

SEQ ID NO: 334637 - DNA, 25 bp, Rattus norvegicus
gagactggacagtcattcttggaga

SEQ ID NO: 334638 - DNA, 25 bp, Rattus norvegicus
gagactggaccacaaacacattatg

SEQ ID NO: 334639 - DNA, 25 bp, Rattus norvegicus
gagactggaccagaaacacattatg

SEQ ID NO: 334640 - DNA, 25 bp, Rattus norvegicus
gagactggacctaaatggcgcagca

SEQ ID NO: 334641 - DNA, 25 bp, Rattus norvegicus
gagactggaccttaatggcgcagca

SEQ ID NO: 334642 - DNA, 25 bp, Rattus norvegicus
gagactggagagagtcatgcaaaat

SEQ ID NO: 334643 - DNA, 25 bp, Rattus norvegicus
gagactggagagtgtcatgcaaaat

SEQ ID NO: 334644 - DNA, 25 bp, Rattus norvegicus
gagactggagctactataccgagac

SEQ ID NO: 334645 - DNA, 25 bp, Rattus norvegicus
gagactggagcttctataccgagac

SEQ ID NO: 334646 - DNA, 25 bp, Rattus norvegicus
gagactggatacctctgtaggagat

SEQ ID NO: 334647 - DNA, 25 bp, Rattus norvegicus
gagactggatacgtctgtaggagat

SEQ ID NO: 334648 - DNA, 25 bp, Rattus norvegicus
gagactggatctactatcattccaa

SEQ ID NO: 334649 - DNA, 25 bp, Rattus norvegicus
gagactggatcttctatcattccaa

SEQ ID NO: 334650 - DNA, 25 bp, Rattus norvegicus
gagactggatgacaattcctcccat

SEQ ID NO: 334651 - DNA, 25 bp, Rattus norvegicus
gagactggatgagaattcctcccat

SEQ ID NO: 334652 - DNA, 25 bp, Rattus norvegicus
gagactggattaatctgtgcacatc

SEQ ID NO: 334653 - DNA, 25 bp, Rattus norvegicus
gagactggattattctgtgcacatc

SEQ ID NO: 334654 - DNA, 25 bp, Rattus norvegicus
gagactggcactcctgaggactcca

SEQ ID NO: 334655 - DNA, 25 bp, Rattus norvegicus
gagactggcactgctgaggactcca

SEQ ID NO: 334656 - DNA, 25 bp, Rattus norvegicus
gagactggcatacctggacatccaa

SEQ ID NO: 334657 - DNA, 25 bp, Rattus norvegicus
gagactggcatagctggacatccaa

SEQ ID NO: 334658 - DNA, 25 bp, Rattus norvegicus
gagactggcctgagctgatacagca

SEQ ID NO: 334659 - DNA, 25 bp, Rattus norvegicus
gagactggcctgtgctgatacagca

SEQ ID NO: 334660 - DNA, 25 bp, Rattus norvegicus
gagactggctctcactgttggagta

SEQ ID NO: 334661 - DNA, 25 bp, Rattus norvegicus
gagactggctctgactgttggagta

SEQ ID NO: 334662 - DNA, 25 bp, Rattus norvegicus
gagactggctttatgtcttttccct

SEQ ID NO: 334663 - DNA, 25 bp, Rattus norvegicus
gagactggctttcgtcagtagctcc

SEQ ID NO: 334664 - DNA, 25 bp, Rattus norvegicus
gagactggctttggtcagtagctcc

SEQ ID NO: 334665 - DNA, 25 bp, Rattus norvegicus
gagactggctttttgtcttttccct

SEQ ID NO: 334666 - DNA, 25 bp, Rattus norvegicus
gagactgggtctattcaataaactt

SEQ ID NO: 334667 - DNA, 25 bp, Rattus norvegicus
gagactgggtctccacaacaacaaa

SEQ ID NO: 334668 - DNA, 25 bp, Rattus norvegicus
gagactgggtctgcacaacaacaaa

SEQ ID NO: 334669 - DNA, 25 bp, Rattus norvegicus
gagactgggtcttttcaataaactt

SEQ ID NO: 334670 - DNA, 25 bp, Rattus norvegicus
gagactggtctgagtgctggaactt

SEQ ID NO: 334671 - DNA, 25 bp, Rattus norvegicus
gagactggtctgtgtgctggaactt

SEQ ID NO: 334672 - DNA, 25 bp, Rattus norvegicus
gagactggtgatctgttgacctttt

SEQ ID NO: 334673 - DNA, 25 bp, Rattus norvegicus
gagactggtgatgtgttgacctttt

SEQ ID NO: 334674 - DNA, 25 bp, Rattus norvegicus
gagactggtggcacattgaaacaga

SEQ ID NO: 334675 - DNA, 25 bp, Rattus norvegicus
gagactggtggctcattgaaacaga

SEQ ID NO: 334676 - DNA, 25 bp, Rattus norvegicus
gagactggttacactcttggcttaa

SEQ ID NO: 334677 - DNA, 25 bp, Rattus norvegicus
gagactggttactctcttggcttaa

SEQ ID NO: 334678 - DNA, 25 bp, Rattus norvegicus
gagactgtacagaccgggctgtcct

SEQ ID NO: 334679 - DNA, 25 bp, Rattus norvegicus
gagactgtacagtccgggctgtcct

SEQ ID NO: 334680 - DNA, 25 bp, Rattus norvegicus
gagactgtacgcagggcgcggtggg

SEQ ID NO: 334681 - DNA, 25 bp, Rattus norvegicus
gagactgtacgctgggcgcggtggg

SEQ ID NO: 334682 - DNA, 25 bp, Rattus norvegicus
gagactgtacttccaaacctttatc

SEQ ID NO: 334683 - DNA, 25 bp, Rattus norvegicus
gagactgtacttgcaaacctttatc

SEQ ID NO: 334684 - DNA, 25 bp, Rattus norvegicus
gagactgtagacacctggtatcgta

SEQ ID NO: 334685 - DNA, 25 bp, Rattus norvegicus
gagactgtagacctgtgctaccatg

SEQ ID NO: 334686 - DNA, 25 bp, Rattus norvegicus
gagactgtagacgtgtgctaccatg

SEQ ID NO: 334687 - DNA, 25 bp, Rattus norvegicus
gagactgtagactcctggtatcgta

SEQ ID NO: 334688 - DNA, 25 bp, Rattus norvegicus
gagactgtagctcactgaatcctta

SEQ ID NO: 334689 - DNA, 25 bp, Rattus norvegicus
gagactgtagctgactgaatcctta

SEQ ID NO: 334690 - DNA, 25 bp, Rattus norvegicus
gagactgtagttaggccagctcctg

SEQ ID NO: 334691 - DNA, 25 bp, Rattus norvegicus
gagactgtagtttggccagctcctg

SEQ ID NO: 334692 - DNA, 25 bp, Rattus norvegicus
gagactgtattcagatgccaggaat

SEQ ID NO: 334693 - DNA, 25 bp, Rattus norvegicus
gagactgtattctgatgccaggaat

SEQ ID NO: 334694 - DNA, 25 bp, Rattus norvegicus
gagactgtcaccagtgtgagcgctt

SEQ ID NO: 334695 - DNA, 25 bp, Rattus norvegicus
gagactgtcacctgtgtgagcgctt

SEQ ID NO: 334696 - DNA, 25 bp, Rattus norvegicus
gagactgtcactcatgagaggccca

SEQ ID NO: 334697 - DNA, 25 bp, Rattus norvegicus
gagactgtcactgatgagaggccca

SEQ ID NO: 334698 - DNA, 25 bp, Rattus norvegicus
gagactgtcagaacgcacatggtgc

SEQ ID NO: 334699 - DNA, 25 bp, Rattus norvegicus
gagactgtcagatcgcacatggtgc

SEQ ID NO: 334700 - DNA, 25 bp, Rattus norvegicus
gagactgtcagtattcaagcttaaa

SEQ ID NO: 334701 - DNA, 25 bp, Rattus norvegicus
gagactgtcagttttcaagcttaaa

SEQ ID NO: 334702 - DNA, 25 bp, Rattus norvegicus
gagactgtcataaaccattttgtag

SEQ ID NO: 334703 - DNA, 25 bp, Rattus norvegicus
gagactgtcatataccattttgtag

SEQ ID NO: 334704 - DNA, 25 bp, Rattus norvegicus
gagactgtccacattcaagttgcaa

SEQ ID NO: 334705 - DNA, 25 bp, Rattus norvegicus
gagactgtccactttcaagttgcaa

SEQ ID NO: 334706 - DNA, 25 bp, Rattus norvegicus
gagactgtcccacagtgctcctcta

SEQ ID NO: 334707 - DNA, 25 bp, Rattus norvegicus
gagactgtcccagagtgctcctcta

SEQ ID NO: 334708 - DNA, 25 bp, Rattus norvegicus
gagactgtccccatgttcaggaagg

SEQ ID NO: 334709 - DNA, 25 bp, Rattus norvegicus
gagactgtccccttgttcaggaagg

SEQ ID NO: 334710 - DNA, 25 bp, Rattus norvegicus
gagactgtctccattgggaatggaa

SEQ ID NO: 334711 - DNA, 25 bp, Rattus norvegicus
gagactgtctcccaaacaaaactag

SEQ ID NO: 334712 - DNA, 25 bp, Rattus norvegicus
gagactgtctccgaaacaaaactag

SEQ ID NO: 334713 - DNA, 25 bp, Rattus norvegicus
gagactgtctcctttgggaatggaa

SEQ ID NO: 334714 - DNA, 25 bp, Rattus norvegicus
gagactgtctctagtgcttgggaac

SEQ ID NO: 334715 - DNA, 25 bp, Rattus norvegicus
gagactgtctcttgtgcttgggaac

SEQ ID NO: 334716 - DNA, 25 bp, Rattus norvegicus
gagactgtcttaattatctgtgtat

SEQ ID NO: 334717 - DNA, 25 bp, Rattus norvegicus
gagactgtcttatttatctgtgtat

SEQ ID NO: 334718 - DNA, 25 bp, Rattus norvegicus
gagactgtcttgatcttttcttatc

SEQ ID NO: 334719 - DNA, 25 bp, Rattus norvegicus
gagactgtcttgttcttttcttatc

SEQ ID NO: 334720 - DNA, 25 bp, Rattus norvegicus
gagactgtgattccctgttcatact

SEQ ID NO: 334721 - DNA, 25 bp, Rattus norvegicus
gagactgtgattgcctgttcatact

SEQ ID NO: 334722 - DNA, 25 bp, Rattus norvegicus
gagactgtgcagctgcctgtgccat

SEQ ID NO: 334723 - DNA, 25 bp, Rattus norvegicus
gagactgtgcaggtgcctgtgccat

SEQ ID NO: 334724 - DNA, 25 bp, Rattus norvegicus
gagactgtgcgtagcagacagccat

SEQ ID NO: 334725 - DNA, 25 bp, Rattus norvegicus
gagactgtgcgttgcagacagccat

SEQ ID NO: 334726 - DNA, 25 bp, Rattus norvegicus
gagactgtggaaagtcctcttccct

SEQ ID NO: 334727 - DNA, 25 bp, Rattus norvegicus
gagactgtggaatgtcctcttccct

SEQ ID NO: 334728 - DNA, 25 bp, Rattus norvegicus
gagactgtggcaaacggcttggaaa

SEQ ID NO: 334729 - DNA, 25 bp, Rattus norvegicus
gagactgtggcatacggcttggaaa

SEQ ID NO: 334730 - DNA, 25 bp, Rattus norvegicus
gagactgtgggcaagctcctcaaaa

SEQ ID NO: 334731 - DNA, 25 bp, Rattus norvegicus
gagactgtgggcaatgtaaactgtt

SEQ ID NO: 334732 - DNA, 25 bp, Rattus norvegicus
gagactgtgggctagctcctcaaaa

SEQ ID NO: 334733 - DNA, 25 bp, Rattus norvegicus
gagactgtgggctatgtaaactgtt

SEQ ID NO: 334734 - DNA, 25 bp, Rattus norvegicus
gagactgtgtctcccgtgtgtctac

SEQ ID NO: 334735 - DNA, 25 bp, Rattus norvegicus
gagactgtgtctgccgtgtgtctac

SEQ ID NO: 334736 - DNA, 25 bp, Rattus norvegicus
gagactgtgtgacatctgattcatg

SEQ ID NO: 334737 - DNA, 25 bp, Rattus norvegicus
gagactgtgtgagatctgattcatg

SEQ ID NO: 334738 - DNA, 25 bp, Rattus norvegicus
gagactgttaagagagcctccagat

SEQ ID NO: 334739 - DNA, 25 bp, Rattus norvegicus
gagactgttaagtgagcctccagat

SEQ ID NO: 334740 - DNA, 25 bp, Rattus norvegicus
gagactgttaatagctgggaagctt

SEQ ID NO: 334741 - DNA, 25 bp, Rattus norvegicus
gagactgttaattgctgggaagctt

SEQ ID NO: 334742 - DNA, 25 bp, Rattus norvegicus
gagactgttatgatctcggcggact

SEQ ID NO: 334743 - DNA, 25 bp, Rattus norvegicus
gagactgttatgttctcggcggact

SEQ ID NO: 334744 - DNA, 25 bp, Rattus norvegicus
gagactgttcagctctgctggctgc

SEQ ID NO: 334745 - DNA, 25 bp, Rattus norvegicus
gagactgttcaggtctgctggctgc

SEQ ID NO: 334746 - DNA, 25 bp, Rattus norvegicus
gagactgttcccagctcaaactgga

SEQ ID NO: 334747 - DNA, 25 bp, Rattus norvegicus
gagactgttccctgctcaaactgga

SEQ ID NO: 334748 - DNA, 25 bp, Rattus norvegicus
gagactgttctgagtatctacgatg

SEQ ID NO: 334749 - DNA, 25 bp, Rattus norvegicus
gagactgttctgtgtatctacgatg

SEQ ID NO: 334750 - DNA, 25 bp, Rattus norvegicus
gagactgttgtcagatggatactaa

SEQ ID NO: 334751 - DNA, 25 bp, Rattus norvegicus
gagactgttgtctgatggatactaa

SEQ ID NO: 334752 - DNA, 25 bp, Rattus norvegicus
gagactgtttccaatctgtgtcagg

SEQ ID NO: 334753 - DNA, 25 bp, Rattus norvegicus
gagactgtttcctatctgtgtcagg

SEQ ID NO: 334754 - DNA, 25 bp, Rattus norvegicus
gagactgtttgaagatacccgagaa

SEQ ID NO: 334755 - DNA, 25 bp, Rattus norvegicus
gagactgtttgaaggccggcaatga

SEQ ID NO: 334756 - DNA, 25 bp, Rattus norvegicus
gagactgtttgatgatacccgagaa

SEQ ID NO: 334757 - DNA, 25 bp, Rattus norvegicus
gagactgtttgatggccggcaatga

SEQ ID NO: 334758 - DNA, 25 bp, Rattus norvegicus
gagacttaaataatggcagacccat

SEQ ID NO: 334759 - DNA, 25 bp, Rattus norvegicus
gagacttaaatattggcagacccat

SEQ ID NO: 334760 - DNA, 25 bp, Rattus norvegicus
gagacttaagcgaatgaggccaaac

SEQ ID NO: 334761 - DNA, 25 bp, Rattus norvegicus
gagacttaagcgtatgaggccaaac

SEQ ID NO: 334762 - DNA, 25 bp, Rattus norvegicus
gagacttaatgactagtattactag

SEQ ID NO: 334763 - DNA, 25 bp, Rattus norvegicus
gagacttaatgagtagtattactag

SEQ ID NO: 334764 - DNA, 25 bp, Rattus norvegicus
gagacttaatgtccagcctttgtaa

SEQ ID NO: 334765 - DNA, 25 bp, Rattus norvegicus
gagacttaatgtgcagcctttgtaa

SEQ ID NO: 334766 - DNA, 25 bp, Rattus norvegicus
gagacttaattgcatcttggctgat

SEQ ID NO: 334767 - DNA, 25 bp, Rattus norvegicus
gagacttaattggatcttggctgat

SEQ ID NO: 334768 - DNA, 25 bp, Rattus norvegicus
gagacttacagacttgtcccaccaa

SEQ ID NO: 334769 - DNA, 25 bp, Rattus norvegicus
gagacttacagagttgtcccaccaa

SEQ ID NO: 334770 - DNA, 25 bp, Rattus norvegicus
gagacttacattacttacctagcca

SEQ ID NO: 334771 - DNA, 25 bp, Rattus norvegicus
gagacttacattagacttaaagccc

SEQ ID NO: 334772 - DNA, 25 bp, Rattus norvegicus
gagacttacattctgctcctcaggt

SEQ ID NO: 334773 - DNA, 25 bp, Rattus norvegicus
gagacttacattgtgctcctcaggt

SEQ ID NO: 334774 - DNA, 25 bp, Rattus norvegicus
gagacttacatttcttacctagcca

SEQ ID NO: 334775 - DNA, 25 bp, Rattus norvegicus
gagacttacatttgacttaaagccc

SEQ ID NO: 334776 - DNA, 25 bp, Rattus norvegicus
gagacttacctcaacaggcttggac

SEQ ID NO: 334777 - DNA, 25 bp, Rattus norvegicus
gagacttacctctacaggcttggac

SEQ ID NO: 334778 - DNA, 25 bp, Rattus norvegicus
gagacttacggaagagtaacattca

SEQ ID NO: 334779 - DNA, 25 bp, Rattus norvegicus
gagacttacggatgagtaacattca

SEQ ID NO: 334780 - DNA, 25 bp, Rattus norvegicus
gagacttactcaatggtgtttccat

SEQ ID NO: 334781 - DNA, 25 bp, Rattus norvegicus
gagacttactcattggtgtttccat

SEQ ID NO: 334782 - DNA, 25 bp, Rattus norvegicus
gagacttactgcaaagcattttgta

SEQ ID NO: 334783 - DNA, 25 bp, Rattus norvegicus
gagacttactgctaagcattttgta

SEQ ID NO: 334784 - DNA, 25 bp, Rattus norvegicus
gagacttagacgcagttggcaagca

SEQ ID NO: 334785 - DNA, 25 bp, Rattus norvegicus
gagacttagacggagttggcaagca

SEQ ID NO: 334786 - DNA, 25 bp, Rattus norvegicus
gagacttagcaaccatgcctggcaa

SEQ ID NO: 334787 - DNA, 25 bp, Rattus norvegicus
gagacttagcaagcatgcctggcaa

SEQ ID NO: 334788 - DNA, 25 bp, Rattus norvegicus
gagacttagcacatacctgtgctta

SEQ ID NO: 334789 - DNA, 25 bp, Rattus norvegicus
gagacttagcacttacctgtgctta

SEQ ID NO: 334790 - DNA, 25 bp, Rattus norvegicus
gagacttagcccctaggatactcga

SEQ ID NO: 334791 - DNA, 25 bp, Rattus norvegicus
gagacttagcccgtaggatactcga

SEQ ID NO: 334792 - DNA, 25 bp, Rattus norvegicus
gagacttaggttactttcacatttt

SEQ ID NO: 334793 - DNA, 25 bp, Rattus norvegicus
gagacttaggtttctttcacatttt

SEQ ID NO: 334794 - DNA, 25 bp, Rattus norvegicus
gagacttagtcaatgtagccacctt

SEQ ID NO: 334795 - DNA, 25 bp, Rattus norvegicus
gagacttagtcattgtagccacctt

SEQ ID NO: 334796 - DNA, 25 bp, Rattus norvegicus
gagacttagtccatttgaagctttc

SEQ ID NO: 334797 - DNA, 25 bp, Rattus norvegicus
gagacttagtccttttgaagctttc

SEQ ID NO: 334798 - DNA, 25 bp, Rattus norvegicus
gagacttagtcgcattgttttccga

SEQ ID NO: 334799 - DNA, 25 bp, Rattus norvegicus
gagacttagtcggattgttttccga

SEQ ID NO: 334800 - DNA, 25 bp, Rattus norvegicus
gagacttatataccacagccaactt

SEQ ID NO: 334801 - DNA, 25 bp, Rattus norvegicus
gagacttatatagcacagccaactt

SEQ ID NO: 334802 - DNA, 25 bp, Rattus norvegicus
gagacttatgcacgttacagaccag

SEQ ID NO: 334803 - DNA, 25 bp, Rattus norvegicus
gagacttatgcaggttacagaccag

SEQ ID NO: 334804 - DNA, 25 bp, Rattus norvegicus
gagacttatggcctgttactaacac

SEQ ID NO: 334805 - DNA, 25 bp, Rattus norvegicus
gagacttatggcgtgttactaacac

SEQ ID NO: 334806 - DNA, 25 bp, Rattus norvegicus
gagacttattctcgttgttggtaat

SEQ ID NO: 334807 - DNA, 25 bp, Rattus norvegicus
gagacttattctctcaccaaaggag

SEQ ID NO: 334808 - DNA, 25 bp, Rattus norvegicus
gagacttattctggttgttggtaat

SEQ ID NO: 334809 - DNA, 25 bp, Rattus norvegicus
gagacttattctgtcaccaaaggag

SEQ ID NO: 334810 - DNA, 25 bp, Rattus norvegicus
gagacttattgtcgacttcatggct

SEQ ID NO: 334811 - DNA, 25 bp, Rattus norvegicus
gagacttattgtggacttcatggct

SEQ ID NO: 334812 - DNA, 25 bp, Rattus norvegicus
gagacttatttcagtgaccactcag

SEQ ID NO: 334813 - DNA, 25 bp, Rattus norvegicus
gagacttatttctgtgaccactcag

SEQ ID NO: 334814 - DNA, 25 bp, Rattus norvegicus
gagacttcaaacatccaagtttctg

SEQ ID NO: 334815 - DNA, 25 bp, Rattus norvegicus
gagacttcaaacttccaagtttctg

SEQ ID NO: 334816 - DNA, 25 bp, Rattus norvegicus
gagacttcaagaagggctgcaacta

SEQ ID NO: 334817 - DNA, 25 bp, Rattus norvegicus
gagacttcaagatgggctgcaacta

SEQ ID NO: 334818 - DNA, 25 bp, Rattus norvegicus
gagacttcaagcaacccgccagtgc

SEQ ID NO: 334819 - DNA, 25 bp, Rattus norvegicus
gagacttcaagctacccgccagtgc

SEQ ID NO: 334820 - DNA, 25 bp, Rattus norvegicus
gagacttcaagtaactgtgcggctt

SEQ ID NO: 334821 - DNA, 25 bp, Rattus norvegicus
gagacttcaagttactgtgcggctt

SEQ ID NO: 334822 - DNA, 25 bp, Rattus norvegicus
gagacttcacagcactgatgccaat

SEQ ID NO: 334823 - DNA, 25 bp, Rattus norvegicus
gagacttcacaggactgatgccaat

SEQ ID NO: 334824 - DNA, 25 bp, Rattus norvegicus
gagacttcacggcaggcctcattag

SEQ ID NO: 334825 - DNA, 25 bp, Rattus norvegicus
gagacttcacgggaggcctcattag

SEQ ID NO: 334826 - DNA, 25 bp, Rattus norvegicus
gagacttcagcaccttagtttctac

SEQ ID NO: 334827 - DNA, 25 bp, Rattus norvegicus
gagacttcagcagcttagtttctac

SEQ ID NO: 334828 - DNA, 25 bp, Rattus norvegicus
gagacttcagctaccagtcacagtg

SEQ ID NO: 334829 - DNA, 25 bp, Rattus norvegicus
gagacttcagcttccagtcacagtg

SEQ ID NO: 334830 - DNA, 25 bp, Rattus norvegicus
gagacttcaggcacacattgcacgt

SEQ ID NO: 334831 - DNA, 25 bp, Rattus norvegicus
gagacttcaggctcacattgcacgt

SEQ ID NO: 334832 - DNA, 25 bp, Rattus norvegicus
gagacttcatagagttctttcctca

SEQ ID NO: 334833 - DNA, 25 bp, Rattus norvegicus
gagacttcatagtgttctttcctca

SEQ ID NO: 334834 - DNA, 25 bp, Rattus norvegicus
gagacttcattactacacttggctt

SEQ ID NO: 334835 - DNA, 25 bp, Rattus norvegicus
gagacttcattagtacacttggctt

SEQ ID NO: 334836 - DNA, 25 bp, Rattus norvegicus
gagacttcattgaatgacttcggtt

SEQ ID NO: 334837 - DNA, 25 bp, Rattus norvegicus
gagacttcattgtatgacttcggtt

SEQ ID NO: 334838 - DNA, 25 bp, Rattus norvegicus
gagacttccagaccaccagcgctta

SEQ ID NO: 334839 - DNA, 25 bp, Rattus norvegicus
gagacttccagagcaccagcgctta

SEQ ID NO: 334840 - DNA, 25 bp, Rattus norvegicus
gagacttcccacaggagttaatgac

SEQ ID NO: 334841 - DNA, 25 bp, Rattus norvegicus
gagacttcccactggagttaatgac

SEQ ID NO: 334842 - DNA, 25 bp, Rattus norvegicus
gagacttcccagaaaagcggcgagg

SEQ ID NO: 334843 - DNA, 25 bp, Rattus norvegicus
gagacttcccagtaaagcggcgagg

SEQ ID NO: 334844 - DNA, 25 bp, Rattus norvegicus
gagacttcccctcacttatgaagat

SEQ ID NO: 334845 - DNA, 25 bp, Rattus norvegicus
gagacttcccctgacttatgaagat

SEQ ID NO: 334846 - DNA, 25 bp, Rattus norvegicus
gagacttccctcataaatggtgaca

SEQ ID NO: 334847 - DNA, 25 bp, Rattus norvegicus
gagacttccctcttaaatggtgaca

SEQ ID NO: 334848 - DNA, 25 bp, Rattus norvegicus
gagacttcccttcaacatatccatg

SEQ ID NO: 334849 - DNA, 25 bp, Rattus norvegicus
gagacttcccttgaacatatccatg

SEQ ID NO: 334850 - DNA, 25 bp, Rattus norvegicus
gagacttccggcactggaacgagtg

SEQ ID NO: 334851 - DNA, 25 bp, Rattus norvegicus
gagacttccggctctggaacgagtg

SEQ ID NO: 334852 - DNA, 25 bp, Rattus norvegicus
gagacttccgttactctattacagg

SEQ ID NO: 334853 - DNA, 25 bp, Rattus norvegicus
gagacttccgtttctctattacagg

SEQ ID NO: 334854 - DNA, 25 bp, Rattus norvegicus
gagacttcctagaatcacggcatcc

SEQ ID NO: 334855 - DNA, 25 bp, Rattus norvegicus
gagacttcctagtatcacggcatcc

SEQ ID NO: 334856 - DNA, 25 bp, Rattus norvegicus
gagacttccttgcacaaagtcagtt

SEQ ID NO: 334857 - DNA, 25 bp, Rattus norvegicus
gagacttccttggacaaagtcagtt

SEQ ID NO: 334858 - DNA, 25 bp, Rattus norvegicus
gagacttcggataaatgaggccaca

SEQ ID NO: 334859 - DNA, 25 bp, Rattus norvegicus
gagacttcggattaatgaggccaca

SEQ ID NO: 334860 - DNA, 25 bp, Rattus norvegicus
gagacttcgtgcctcatgaactgaa

SEQ ID NO: 334861 - DNA, 25 bp, Rattus norvegicus
gagacttcgtgcgtcatgaactgaa

SEQ ID NO: 334862 - DNA, 25 bp, Rattus norvegicus
gagacttctaaccttaaatcatcct

SEQ ID NO: 334863 - DNA, 25 bp, Rattus norvegicus
gagacttctaacgttaaatcatcct

SEQ ID NO: 334864 - DNA, 25 bp, Rattus norvegicus
gagacttctattacccattgacact

SEQ ID NO: 334865 - DNA, 25 bp, Rattus norvegicus
gagacttctatttcccattgacact

SEQ ID NO: 334866 - DNA, 25 bp, Rattus norvegicus
gagacttctcagagtgatcgtttct

SEQ ID NO: 334867 - DNA, 25 bp, Rattus norvegicus
gagacttctcagtgtgatcgtttct

SEQ ID NO: 334868 - DNA, 25 bp, Rattus norvegicus
gagacttctggaatccaacagcaca

SEQ ID NO: 334869 - DNA, 25 bp, Rattus norvegicus
gagacttctggacaatccctagccc

SEQ ID NO: 334870 - DNA, 25 bp, Rattus norvegicus
gagacttctggagaatccctagccc

SEQ ID NO: 334871 - DNA, 25 bp, Rattus norvegicus
gagacttctggattccaacagcaca

SEQ ID NO: 334872 - DNA, 25 bp, Rattus norvegicus
gagacttgaacccaaaaccaggaca

SEQ ID NO: 334873 - DNA, 25 bp, Rattus norvegicus
gagacttgaaccgaaaaccaggaca

SEQ ID NO: 334874 - DNA, 25 bp, Rattus norvegicus
gagacttgactgagttgggtttcca

SEQ ID NO: 334875 - DNA, 25 bp, Rattus norvegicus
gagacttgactgctttgaggccaca

SEQ ID NO: 334876 - DNA, 25 bp, Rattus norvegicus
gagacttgactggtttgaggccaca

SEQ ID NO: 334877 - DNA, 25 bp, Rattus norvegicus
gagacttgactgtgttgggtttcca

SEQ ID NO: 334878 - DNA, 25 bp, Rattus norvegicus
gagacttgagcacttctagctacta

SEQ ID NO: 334879 - DNA, 25 bp, Rattus norvegicus
gagacttgagcagttctagctacta

SEQ ID NO: 334880 - DNA, 25 bp, Rattus norvegicus
gagacttgagttacattagcttact

SEQ ID NO: 334881 - DNA, 25 bp, Rattus norvegicus
gagacttgagtttcattagcttact

SEQ ID NO: 334882 - DNA, 25 bp, Rattus norvegicus
gagacttgatgacaccttgtgcgtg

SEQ ID NO: 334883 - DNA, 25 bp, Rattus norvegicus
gagacttgatgagaccttgtgcgtg

SEQ ID NO: 334884 - DNA, 25 bp, Rattus norvegicus
gagacttgattgaagtgttccgtcc

SEQ ID NO: 334885 - DNA, 25 bp, Rattus norvegicus
gagacttgattgtagtgttccgtcc

SEQ ID NO: 334886 - DNA, 25 bp, Rattus norvegicus
gagacttgccttccatatacatgaa

SEQ ID NO: 334887 - DNA, 25 bp, Rattus norvegicus
gagacttgccttgcatatacatgaa

SEQ ID NO: 334888 - DNA, 25 bp, Rattus norvegicus
gagacttgctctatagtcaaagaca

SEQ ID NO: 334889 - DNA, 25 bp, Rattus norvegicus
gagacttgctctttagtcaaagaca

SEQ ID NO: 334890 - DNA, 25 bp, Rattus norvegicus
gagacttggactccttaagccagtc

SEQ ID NO: 334891 - DNA, 25 bp, Rattus norvegicus
gagacttggactgcttaagccagtc

SEQ ID NO: 334892 - DNA, 25 bp, Rattus norvegicus
gagacttgggtaccacaaaagcagt

SEQ ID NO: 334893 - DNA, 25 bp, Rattus norvegicus
gagacttgggtagcacaaaagcagt

SEQ ID NO: 334894 - DNA, 25 bp, Rattus norvegicus
gagacttggtcaacaccagcagctg

SEQ ID NO: 334895 - DNA, 25 bp, Rattus norvegicus
gagacttggtcatcaccagcagctg

SEQ ID NO: 334896 - DNA, 25 bp, Rattus norvegicus
gagacttgtatactgggcctgtttt

SEQ ID NO: 334897 - DNA, 25 bp, Rattus norvegicus
gagacttgtatagtgggcctgtttt

SEQ ID NO: 334898 - DNA, 25 bp, Rattus norvegicus
gagacttgtcaccatcaagcagctt

SEQ ID NO: 334899 - DNA, 25 bp, Rattus norvegicus
gagacttgtcacgatcaagcagctt

SEQ ID NO: 334900 - DNA, 25 bp, Rattus norvegicus
gagacttgtcgccttatggtttcaa

SEQ ID NO: 334901 - DNA, 25 bp, Rattus norvegicus
gagacttgtcgcgttatggtttcaa

SEQ ID NO: 334902 - DNA, 25 bp, Rattus norvegicus
gagacttgtgacaatccttctgctt

SEQ ID NO: 334903 - DNA, 25 bp, Rattus norvegicus
gagacttgtgactatccttctgctt

SEQ ID NO: 334904 - DNA, 25 bp, Rattus norvegicus
gagacttgtgcaaaacatgatgaca

SEQ ID NO: 334905 - DNA, 25 bp, Rattus norvegicus
gagacttgtgcataacatgatgaca

SEQ ID NO: 334906 - DNA, 25 bp, Rattus norvegicus
gagacttgtggtcatgactggcctc

SEQ ID NO: 334907 - DNA, 25 bp, Rattus norvegicus
gagacttgtggtgatgactggcctc

SEQ ID NO: 334908 - DNA, 25 bp, Rattus norvegicus
gagacttgttggcactacagcctct

SEQ ID NO: 334909 - DNA, 25 bp, Rattus norvegicus
gagacttgttgggactacagcctct

SEQ ID NO: 334910 - DNA, 25 bp, Rattus norvegicus
gagactttaattccctccgtagagt

SEQ ID NO: 334911 - DNA, 25 bp, Rattus norvegicus
gagactttaattgcctccgtagagt

SEQ ID NO: 334912 - DNA, 25 bp, Rattus norvegicus
gagactttacagcatccagcacttt

SEQ ID NO: 334913 - DNA, 25 bp, Rattus norvegicus
gagactttacaggatccagcacttt

SEQ ID NO: 334914 - DNA, 25 bp, Rattus norvegicus
gagactttacccacataagatgatg

SEQ ID NO: 334915 - DNA, 25 bp, Rattus norvegicus
gagactttaccctcataagatgatg

SEQ ID NO: 334916 - DNA, 25 bp, Rattus norvegicus
gagactttagacatccaacacatta

SEQ ID NO: 334917 - DNA, 25 bp, Rattus norvegicus
gagactttagacttccaacacatta

SEQ ID NO: 334918 - DNA, 25 bp, Rattus norvegicus
gagactttagatacctttctggtta

SEQ ID NO: 334919 - DNA, 25 bp, Rattus norvegicus
gagactttagattcctttctggtta

SEQ ID NO: 334920 - DNA, 25 bp, Rattus norvegicus
gagactttagcccttagaaaccatt

SEQ ID NO: 334921 - DNA, 25 bp, Rattus norvegicus
gagactttagccgttagaaaccatt

SEQ ID NO: 334922 - DNA, 25 bp, Rattus norvegicus
gagactttaggtagtggtcaaggac

SEQ ID NO: 334923 - DNA, 25 bp, Rattus norvegicus
gagactttaggttgtggtcaaggac

SEQ ID NO: 334924 - DNA, 25 bp, Rattus norvegicus
gagactttcagcctgggagtctgtc

SEQ ID NO: 334925 - DNA, 25 bp, Rattus norvegicus
gagactttcagcgtgggagtctgtc

SEQ ID NO: 334926 - DNA, 25 bp, Rattus norvegicus
gagactttctaacccttactggaca

SEQ ID NO: 334927 - DNA, 25 bp, Rattus norvegicus
gagactttctaagccttactggaca

SEQ ID NO: 334928 - DNA, 25 bp, Rattus norvegicus
gagactttctgaatcttcaggactc

SEQ ID NO: 334929 - DNA, 25 bp, Rattus norvegicus
gagactttctgattcttcaggactc

SEQ ID NO: 334930 - DNA, 25 bp, Rattus norvegicus
gagactttctggatactttcacaca

SEQ ID NO: 334931 - DNA, 25 bp, Rattus norvegicus
gagactttctggatggtttccatag

SEQ ID NO: 334932 - DNA, 25 bp, Rattus norvegicus
gagactttctggttactttcacaca

SEQ ID NO: 334933 - DNA, 25 bp, Rattus norvegicus
gagactttctggttggtttccatag

SEQ ID NO: 334934 - DNA, 25 bp, Rattus norvegicus
gagactttgagcaatttccatataa

SEQ ID NO: 334935 - DNA, 25 bp, Rattus norvegicus
gagactttgagctatttccatataa

SEQ ID NO: 334936 - DNA, 25 bp, Rattus norvegicus
gagactttgcaaatgaacgagaatg

SEQ ID NO: 334937 - DNA, 25 bp, Rattus norvegicus
gagactttgcaattgaacgagaatg

SEQ ID NO: 334938 - DNA, 25 bp, Rattus norvegicus
gagactttgcatcgtatacaccttc

SEQ ID NO: 334939 - DNA, 25 bp, Rattus norvegicus
gagactttgcatggtatacaccttc

SEQ ID NO: 334940 - DNA, 25 bp, Rattus norvegicus
gagactttggagcagaactaccgac

SEQ ID NO: 334941 - DNA, 25 bp, Rattus norvegicus
gagactttggaggagaactaccgac

SEQ ID NO: 334942 - DNA, 25 bp, Rattus norvegicus
gagactttggctactgtcctcgagt

SEQ ID NO: 334943 - DNA, 25 bp, Rattus norvegicus
gagactttggcttctgtcctcgagt

SEQ ID NO: 334944 - DNA, 25 bp, Rattus norvegicus
gagactttgggacaccttttagcaa

SEQ ID NO: 334945 - DNA, 25 bp, Rattus norvegicus
gagactttgggagaccttttagcaa

SEQ ID NO: 334946 - DNA, 25 bp, Rattus norvegicus
gagactttgggtagttcgctgtcca

SEQ ID NO: 334947 - DNA, 25 bp, Rattus norvegicus
gagactttgggttgttcgctgtcca

SEQ ID NO: 334948 - DNA, 25 bp, Rattus norvegicus
gagacttttactcggattcctgaac

SEQ ID NO: 334949 - DNA, 25 bp, Rattus norvegicus
gagacttttactgggattcctgaac

SEQ ID NO: 334950 - DNA, 25 bp, Rattus norvegicus
gagacttttagcaacttgatccact

SEQ ID NO: 334951 - DNA, 25 bp, Rattus norvegicus
gagacttttagctacttgatccact

SEQ ID NO: 334952 - DNA, 25 bp, Rattus norvegicus
gagacttttcagatgcagcaattaa

SEQ ID NO: 334953 - DNA, 25 bp, Rattus norvegicus
gagacttttcagttgcagcaattaa

SEQ ID NO: 334954 - DNA, 25 bp, Rattus norvegicus
gagacttttcgtatgaaccgcgttg

SEQ ID NO: 334955 - DNA, 25 bp, Rattus norvegicus
gagacttttcgtttgaaccgcgttg

SEQ ID NO: 334956 - DNA, 25 bp, Rattus norvegicus
gagacttttctgcagccttatatac

SEQ ID NO: 334957 - DNA, 25 bp, Rattus norvegicus
gagacttttctggagccttatatac

SEQ ID NO: 334958 - DNA, 25 bp, Rattus norvegicus
gagactttttaactgcccctgctag

SEQ ID NO: 334959 - DNA, 25 bp, Rattus norvegicus
gagactttttaagtgcccctgctag

SEQ ID NO: 334960 - DNA, 25 bp, Rattus norvegicus
gagactttttacaactgtattcaga

SEQ ID NO: 334961 - DNA, 25 bp, Rattus norvegicus
gagactttttactactgtattcaga

SEQ ID NO: 334962 - DNA, 25 bp, Rattus norvegicus
gagagaaaactaactgtgtatacat

SEQ ID NO: 334963 - DNA, 25 bp, Rattus norvegicus
gagagaaaactatctgtgtatacat

SEQ ID NO: 334964 - DNA, 25 bp, Rattus norvegicus
gagagaaaactgaccttccatgctg

SEQ ID NO: 334965 - DNA, 25 bp, Rattus norvegicus
gagagaaaactgtccttccatgctg

SEQ ID NO: 334966 - DNA, 25 bp, Rattus norvegicus
gagagaaaaggcaggcctcgcctat

SEQ ID NO: 334967 - DNA, 25 bp, Rattus norvegicus
gagagaaaaggctggcctcgcctat

SEQ ID NO: 334968 - DNA, 25 bp, Rattus norvegicus
gagagaaacaagctggccgctgcca

SEQ ID NO: 334969 - DNA, 25 bp, Rattus norvegicus
gagagaaacaaggtggccgctgcca

SEQ ID NO: 334970 - DNA, 25 bp, Rattus norvegicus
gagagaaacagaccggccgggcccg

SEQ ID NO: 334971 - DNA, 25 bp, Rattus norvegicus
gagagaaacagagcggccgggcccg

SEQ ID NO: 334972 - DNA, 25 bp, Rattus norvegicus
gagagaaacattagccccatgagta

SEQ ID NO: 334973 - DNA, 25 bp, Rattus norvegicus
gagagaaacatttgccccatgagta

SEQ ID NO: 334974 - DNA, 25 bp, Rattus norvegicus
gagagaaacctcaaactgcctctaa

SEQ ID NO: 334975 - DNA, 25 bp, Rattus norvegicus
gagagaaacctcacactgttcctgc

SEQ ID NO: 334976 - DNA, 25 bp, Rattus norvegicus
gagagaaacctcatgattctaccaa

SEQ ID NO: 334977 - DNA, 25 bp, Rattus norvegicus
gagagaaacctctaactgcctctaa

SEQ ID NO: 334978 - DNA, 25 bp, Rattus norvegicus
gagagaaacctctcactgttcctgc

SEQ ID NO: 334979 - DNA, 25 bp, Rattus norvegicus
gagagaaacctcttgattctaccaa

SEQ ID NO: 334980 - DNA, 25 bp, Rattus norvegicus
gagagaaaccttacgcacgccatgt

SEQ ID NO: 334981 - DNA, 25 bp, Rattus norvegicus
gagagaaacctttcgcacgccatgt

SEQ ID NO: 334982 - DNA, 25 bp, Rattus norvegicus
gagagaaacgacaatcaaaggcttt

SEQ ID NO: 334983 - DNA, 25 bp, Rattus norvegicus
gagagaaacgactatcaaaggcttt

SEQ ID NO: 334984 - DNA, 25 bp, Rattus norvegicus
gagagaaactctagctcagcttcat

SEQ ID NO: 334985 - DNA, 25 bp, Rattus norvegicus
gagagaaactcttgctcagcttcat

SEQ ID NO: 334986 - DNA, 25 bp, Rattus norvegicus
gagagaaactgccttctcttacccc

SEQ ID NO: 334987 - DNA, 25 bp, Rattus norvegicus
gagagaaactgcgttctcttacccc

SEQ ID NO: 334988 - DNA, 25 bp, Rattus norvegicus
gagagaaagcctcacccaactatgt

SEQ ID NO: 334989 - DNA, 25 bp, Rattus norvegicus
gagagaaagcctgacccaactatgt

SEQ ID NO: 334990 - DNA, 25 bp, Rattus norvegicus
gagagaaagctcatgttctgtcccc

SEQ ID NO: 334991 - DNA, 25 bp, Rattus norvegicus
gagagaaagctcttgttctgtcccc

SEQ ID NO: 334992 - DNA, 25 bp, Rattus norvegicus
gagagaaagcttactgtgactaatc

SEQ ID NO: 334993 - DNA, 25 bp, Rattus norvegicus
gagagaaagctttctgtgactaatc

SEQ ID NO: 334994 - DNA, 25 bp, Rattus norvegicus
gagagaaaggcacttcctcccatga

SEQ ID NO: 334995 - DNA, 25 bp, Rattus norvegicus
gagagaaaggcagttcctcccatga

SEQ ID NO: 334996 - DNA, 25 bp, Rattus norvegicus
gagagaaataggctccattccaaag

SEQ ID NO: 334997 - DNA, 25 bp, Rattus norvegicus
gagagaaatagggtccattccaaag

SEQ ID NO: 334998 - DNA, 25 bp, Rattus norvegicus
gagagaaatcaccacaacctgtgtt

SEQ ID NO: 334999 - DNA, 25 bp, Rattus norvegicus
gagagaaatcaccacatgctatgct

SEQ ID NO: 335000 - DNA, 25 bp, Rattus norvegicus
gagagaaatcacgacaacctgtgtt

SEQ ID NO: 335001 - DNA, 25 bp, Rattus norvegicus
gagagaaatcacgacatgctatgct

SEQ ID NO: 335002 - DNA, 25 bp, Rattus norvegicus
gagagaaatcagctgtcttgcacta

SEQ ID NO: 335003 - DNA, 25 bp, Rattus norvegicus
gagagaaatcaggtgtcttgcacta

SEQ ID NO: 335004 - DNA, 25 bp, Rattus norvegicus
gagagaaatcgtctaccccgaggaa

SEQ ID NO: 335005 - DNA, 25 bp, Rattus norvegicus
gagagaaatcgtgtaccccgaggaa

SEQ ID NO: 335006 - DNA, 25 bp, Rattus norvegicus
gagagaaatctaacacacaaaacag

SEQ ID NO: 335007 - DNA, 25 bp, Rattus norvegicus
gagagaaatctatcacacaaaacag

SEQ ID NO: 335008 - DNA, 25 bp, Rattus norvegicus
gagagaaatctgacacgtgcccaca

SEQ ID NO: 335009 - DNA, 25 bp, Rattus norvegicus
gagagaaatctgtcacgtgcccaca

SEQ ID NO: 335010 - DNA, 25 bp, Rattus norvegicus
gagagaaatgctcccctgacaagag

SEQ ID NO: 335011 - DNA, 25 bp, Rattus norvegicus
gagagaaatgctgccctgacaagag

SEQ ID NO: 335012 - DNA, 25 bp, Rattus norvegicus
gagagaaatgtcaccttgctttgga

SEQ ID NO: 335013 - DNA, 25 bp, Rattus norvegicus
gagagaaatgtctccttgctttgga

SEQ ID NO: 335014 - DNA, 25 bp, Rattus norvegicus
gagagaacaaccaacaaatggcgtt

SEQ ID NO: 335015 - DNA, 25 bp, Rattus norvegicus
gagagaacaacctacaaatggcgtt

SEQ ID NO: 335016 - DNA, 25 bp, Rattus norvegicus
gagagaacagaacagatggtacagc

SEQ ID NO: 335017 - DNA, 25 bp, Rattus norvegicus
gagagaacagaagagatggtacagc

SEQ ID NO: 335018 - DNA, 25 bp, Rattus norvegicus
gagagaacagcaactccttccatgc

SEQ ID NO: 335019 - DNA, 25 bp, Rattus norvegicus
gagagaacagcatctccttccatgc

SEQ ID NO: 335020 - DNA, 25 bp, Rattus norvegicus
gagagaacagtaccgtttccagccg

SEQ ID NO: 335021 - DNA, 25 bp, Rattus norvegicus
gagagaacagtagcgtttccagccg

SEQ ID NO: 335022 - DNA, 25 bp, Rattus norvegicus
gagagaacatggatgcatgagtcat

SEQ ID NO: 335023 - DNA, 25 bp, Rattus norvegicus
gagagaacatggttgcatgagtcat

SEQ ID NO: 335024 - DNA, 25 bp, Rattus norvegicus
gagagaaccaataccatgctatttt

SEQ ID NO: 335025 - DNA, 25 bp, Rattus norvegicus
gagagaaccaattccatgctatttt

SEQ ID NO: 335026 - DNA, 25 bp, Rattus norvegicus
gagagaaccagcacggatttgttta

SEQ ID NO: 335027 - DNA, 25 bp, Rattus norvegicus
gagagaaccagctcggatttgttta

SEQ ID NO: 335028 - DNA, 25 bp, Rattus norvegicus
gagagaaccatcattacctcagctt

SEQ ID NO: 335029 - DNA, 25 bp, Rattus norvegicus
gagagaaccatctttacctcagctt

SEQ ID NO: 335030 - DNA, 25 bp, Rattus norvegicus
gagagaacccatacctttttagcta

SEQ ID NO: 335031 - DNA, 25 bp, Rattus norvegicus
gagagaacccattcctttttagcta

SEQ ID NO: 335032 - DNA, 25 bp, Rattus norvegicus
gagagaacccttcccatgattttag

SEQ ID NO: 335033 - DNA, 25 bp, Rattus norvegicus
gagagaacccttgccatgattttag

SEQ ID NO: 335034 - DNA, 25 bp, Rattus norvegicus
gagagaacctagctcaaggcctgac

SEQ ID NO: 335035 - DNA, 25 bp, Rattus norvegicus
gagagaacctaggtcaaggcctgac

SEQ ID NO: 335036 - DNA, 25 bp, Rattus norvegicus
gagagaacctctatgcttcaagtaa

SEQ ID NO: 335037 - DNA, 25 bp, Rattus norvegicus
gagagaacctctttgcttcaagtaa

SEQ ID NO: 335038 - DNA, 25 bp, Rattus norvegicus
gagagaacgaacacttacagttgtc

SEQ ID NO: 335039 - DNA, 25 bp, Rattus norvegicus
gagagaacgaactcttacagttgtc

SEQ ID NO: 335040 - DNA, 25 bp, Rattus norvegicus
gagagaacggagacttccctcagga

SEQ ID NO: 335041 - DNA, 25 bp, Rattus norvegicus
gagagaacggagtcttccctcagga

SEQ ID NO: 335042 - DNA, 25 bp, Rattus norvegicus
gagagaactacacatcccaggcgcc

SEQ ID NO: 335043 - DNA, 25 bp, Rattus norvegicus
gagagaactacagatcccaggcgcc

SEQ ID NO: 335044 - DNA, 25 bp, Rattus norvegicus
gagagaactagaccacttttgttgt

SEQ ID NO: 335045 - DNA, 25 bp, Rattus norvegicus
gagagaactagagcacttttgttgt

SEQ ID NO: 335046 - DNA, 25 bp, Rattus norvegicus
gagagaactcatccacagcagagct

SEQ ID NO: 335047 - DNA, 25 bp, Rattus norvegicus
gagagaactcatgcacagcagagct

SEQ ID NO: 335048 - DNA, 25 bp, Rattus norvegicus
gagagaactccaaggcaaaccacaa

SEQ ID NO: 335049 - DNA, 25 bp, Rattus norvegicus
gagagaactccacggcctatggact

SEQ ID NO: 335050 - DNA, 25 bp, Rattus norvegicus
gagagaactccagggcctatggact

SEQ ID NO: 335051 - DNA, 25 bp, Rattus norvegicus
gagagaactccatggcaaaccacaa

SEQ ID NO: 335052 - DNA, 25 bp, Rattus norvegicus
gagagaactggaaaccactgtgtat

SEQ ID NO: 335053 - DNA, 25 bp, Rattus norvegicus
gagagaactggataccactgtgtat

SEQ ID NO: 335054 - DNA, 25 bp, Rattus norvegicus
gagagaacttgaaattttccccaga

SEQ ID NO: 335055 - DNA, 25 bp, Rattus norvegicus
gagagaacttgatattttccccaga

SEQ ID NO: 335056 - DNA, 25 bp, Rattus norvegicus
gagagaactttcatctttcgttcta

SEQ ID NO: 335057 - DNA, 25 bp, Rattus norvegicus
gagagaactttcttctttcgttcta

SEQ ID NO: 335058 - DNA, 25 bp, Rattus norvegicus
gagagaagaccaagtacactcagtg

SEQ ID NO: 335059 - DNA, 25 bp, Rattus norvegicus
gagagaagaccatgtacactcagtg

SEQ ID NO: 335060 - DNA, 25 bp, Rattus norvegicus
gagagaagaccccaggaaattcttt

SEQ ID NO: 335061 - DNA, 25 bp, Rattus norvegicus
gagagaagacccgaggaaattcttt

SEQ ID NO: 335062 - DNA, 25 bp, Rattus norvegicus
gagagaagacctaattcaatattta

SEQ ID NO: 335063 - DNA, 25 bp, Rattus norvegicus
gagagaagaccttattcaatattta

SEQ ID NO: 335064 - DNA, 25 bp, Rattus norvegicus
gagagaagccccacacagtaaatta

SEQ ID NO: 335065 - DNA, 25 bp, Rattus norvegicus
gagagaagcccctcacagtaaatta

SEQ ID NO: 335066 - DNA, 25 bp, Rattus norvegicus
gagagaagccctaaggtcagtcaga

SEQ ID NO: 335067 - DNA, 25 bp, Rattus norvegicus
gagagaagcccttaggtcagtcaga

SEQ ID NO: 335068 - DNA, 25 bp, Rattus norvegicus
gagagaagccttactttctgtcaag

SEQ ID NO: 335069 - DNA, 25 bp, Rattus norvegicus
gagagaagcctttctttctgtcaag

SEQ ID NO: 335070 - DNA, 25 bp, Rattus norvegicus
gagagaagctacctgtttactgatc

SEQ ID NO: 335071 - DNA, 25 bp, Rattus norvegicus
gagagaagctacgtgtttactgatc

SEQ ID NO: 335072 - DNA, 25 bp, Rattus norvegicus
gagagaagctatacattctgataga

SEQ ID NO: 335073 - DNA, 25 bp, Rattus norvegicus
gagagaagctattcattctgataga

SEQ ID NO: 335074 - DNA, 25 bp, Rattus norvegicus
gagagaagctctaccaagcctgtgc

SEQ ID NO: 335075 - DNA, 25 bp, Rattus norvegicus
gagagaagctcttccaagcctgtgc

SEQ ID NO: 335076 - DNA, 25 bp, Rattus norvegicus
gagagaaggaatctggactccagct

SEQ ID NO: 335077 - DNA, 25 bp, Rattus norvegicus
gagagaaggaatgtggactccagct

SEQ ID NO: 335078 - DNA, 25 bp, Rattus norvegicus
gagagaaggaggcttccaccacata

SEQ ID NO: 335079 - DNA, 25 bp, Rattus norvegicus
gagagaaggagggttccaccacata

SEQ ID NO: 335080 - DNA, 25 bp, Rattus norvegicus
gagagaaggcatcccgggcccaaat

SEQ ID NO: 335081 - DNA, 25 bp, Rattus norvegicus
gagagaaggcatgccgggcccaaat

SEQ ID NO: 335082 - DNA, 25 bp, Rattus norvegicus
gagagaaggttgactttttgcactt

SEQ ID NO: 335083 - DNA, 25 bp, Rattus norvegicus
gagagaaggttgtctttttgcactt

SEQ ID NO: 335084 - DNA, 25 bp, Rattus norvegicus
gagagaagtccgattagctcctggg

SEQ ID NO: 335085 - DNA, 25 bp, Rattus norvegicus
gagagaagtccgtttagctcctggg

SEQ ID NO: 335086 - DNA, 25 bp, Rattus norvegicus
gagagaagtcgactcctttactaaa

SEQ ID NO: 335087 - DNA, 25 bp, Rattus norvegicus
gagagaagtcgagtcctttactaaa

SEQ ID NO: 335088 - DNA, 25 bp, Rattus norvegicus
gagagaatacagagggccagatatg

SEQ ID NO: 335089 - DNA, 25 bp, Rattus norvegicus
gagagaatacagtgggccagatatg

SEQ ID NO: 335090 - DNA, 25 bp, Rattus norvegicus
gagagaataccacctagtcaaacta

SEQ ID NO: 335091 - DNA, 25 bp, Rattus norvegicus
gagagaataccagctagtcaaacta

SEQ ID NO: 335092 - DNA, 25 bp, Rattus norvegicus
gagagaatagcaacttggaattttt

SEQ ID NO: 335093 - DNA, 25 bp, Rattus norvegicus
gagagaatagcatcttggaattttt

SEQ ID NO: 335094 - DNA, 25 bp, Rattus norvegicus
gagagaatcatcctggtctgagaca

SEQ ID NO: 335095 - DNA, 25 bp, Rattus norvegicus
gagagaatcatcgtggtctgagaca

SEQ ID NO: 335096 - DNA, 25 bp, Rattus norvegicus
gagagaatccagctagaacattgtg

SEQ ID NO: 335097 - DNA, 25 bp, Rattus norvegicus
gagagaatccaggtagaacattgtg

SEQ ID NO: 335098 - DNA, 25 bp, Rattus norvegicus
gagagaatcgtcaccatcacaggcc

SEQ ID NO: 335099 - DNA, 25 bp, Rattus norvegicus
gagagaatcgtctccatcacaggcc

SEQ ID NO: 335100 - DNA, 25 bp, Rattus norvegicus
gagagaatcgttcagaatcccaaca

SEQ ID NO: 335101 - DNA, 25 bp, Rattus norvegicus
gagagaatcgttgagaatcccaaca

SEQ ID NO: 335102 - DNA, 25 bp, Rattus norvegicus
gagagaatgagccatgctgcccttt

SEQ ID NO: 335103 - DNA, 25 bp, Rattus norvegicus
gagagaatgagcgatgctgcccttt

SEQ ID NO: 335104 - DNA, 25 bp, Rattus norvegicus
gagagaatgattccatgagaaccaa

SEQ ID NO: 335105 - DNA, 25 bp, Rattus norvegicus
gagagaatgattgcatgagaaccaa

SEQ ID NO: 335106 - DNA, 25 bp, Rattus norvegicus
gagagaatggtgacctgctactcca

SEQ ID NO: 335107 - DNA, 25 bp, Rattus norvegicus
gagagaatggtgtcctgctactcca

SEQ ID NO: 335108 - DNA, 25 bp, Rattus norvegicus
gagagaattcaaccgcgtagaccag

SEQ ID NO: 335109 - DNA, 25 bp, Rattus norvegicus
gagagaattcaagcgcgtagaccag

SEQ ID NO: 335110 - DNA, 25 bp, Rattus norvegicus
gagagaattgccaaccagcgagaga

SEQ ID NO: 335111 - DNA, 25 bp, Rattus norvegicus
gagagaattgcctaccagcgagaga

SEQ ID NO: 335112 - DNA, 25 bp, Rattus norvegicus
gagagaattttccaagaccatgaaa

SEQ ID NO: 335113 - DNA, 25 bp, Rattus norvegicus
gagagaattttcgaagaccatgaaa

SEQ ID NO: 335114 - DNA, 25 bp, Rattus norvegicus
gagagacaaactatccaaggcttat

SEQ ID NO: 335115 - DNA, 25 bp, Rattus norvegicus
gagagacaaactttccaaggcttat

SEQ ID NO: 335116 - DNA, 25 bp, Rattus norvegicus
gagagacaatagctggcctgtccct

SEQ ID NO: 335117 - DNA, 25 bp, Rattus norvegicus
gagagacaataggtggcctgtccct

SEQ ID NO: 335118 - DNA, 25 bp, Rattus norvegicus
gagagacacataattctgcccttgc

SEQ ID NO: 335119 - DNA, 25 bp, Rattus norvegicus
gagagacacatatttctgcccttgc

SEQ ID NO: 335120 - DNA, 25 bp, Rattus norvegicus
gagagacacattaatcaccccgaga

SEQ ID NO: 335121 - DNA, 25 bp, Rattus norvegicus
gagagacacatttatcaccccgaga

SEQ ID NO: 335122 - DNA, 25 bp, Rattus norvegicus
gagagacaccttatacgtgcactga

SEQ ID NO: 335123 - DNA, 25 bp, Rattus norvegicus
gagagacaccttttacgtgcactga

SEQ ID NO: 335124 - DNA, 25 bp, Rattus norvegicus
gagagacactgcattctgtattcaa

SEQ ID NO: 335125 - DNA, 25 bp, Rattus norvegicus
gagagacactgctttctgtattcaa

SEQ ID NO: 335126 - DNA, 25 bp, Rattus norvegicus
gagagacactgtatttctgtcccct

SEQ ID NO: 335127 - DNA, 25 bp, Rattus norvegicus
gagagacactgtttttctgtcccct

SEQ ID NO: 335128 - DNA, 25 bp, Rattus norvegicus
gagagacagctcagcttcctgcaga

SEQ ID NO: 335129 - DNA, 25 bp, Rattus norvegicus
gagagacagctctgcttcctgcaga

SEQ ID NO: 335130 - DNA, 25 bp, Rattus norvegicus
gagagacagctgaccttaaatgaca

SEQ ID NO: 335131 - DNA, 25 bp, Rattus norvegicus
gagagacagctgtccttaaatgaca

SEQ ID NO: 335132 - DNA, 25 bp, Rattus norvegicus
gagagacagcttcggctgacccagc

SEQ ID NO: 335133 - DNA, 25 bp, Rattus norvegicus
gagagacagcttgggctgacccagc

SEQ ID NO: 335134 - DNA, 25 bp, Rattus norvegicus
gagagacaggctataggtcactaaa

SEQ ID NO: 335135 - DNA, 25 bp, Rattus norvegicus
gagagacaggctttaggtcactaaa

SEQ ID NO: 335136 - DNA, 25 bp, Rattus norvegicus
gagagacagggaagaccgccacaca

SEQ ID NO: 335137 - DNA, 25 bp, Rattus norvegicus
gagagacagggatgaccgccacaca

SEQ ID NO: 335138 - DNA, 25 bp, Rattus norvegicus
gagagacagtcactgcattcctgca

SEQ ID NO: 335139 - DNA, 25 bp, Rattus norvegicus
gagagacagtcagtgcattcctgca

SEQ ID NO: 335140 - DNA, 25 bp, Rattus norvegicus
gagagacagtctactgtggtctgct

SEQ ID NO: 335141 - DNA, 25 bp, Rattus norvegicus
gagagacagtcttctgtggtctgct

SEQ ID NO: 335142 - DNA, 25 bp, Rattus norvegicus
gagagacagtgcatacacattcaga

SEQ ID NO: 335143 - DNA, 25 bp, Rattus norvegicus
gagagacagtgcttacacattcaga

SEQ ID NO: 335144 - DNA, 25 bp, Rattus norvegicus
gagagacagtgtcccttccttgtgg

SEQ ID NO: 335145 - DNA, 25 bp, Rattus norvegicus
gagagacagtgtgccttccttgtgg

SEQ ID NO: 335146 - DNA, 25 bp, Rattus norvegicus
gagagacatatgacctgcttctgcc

SEQ ID NO: 335147 - DNA, 25 bp, Rattus norvegicus
gagagacatatgtcctgcttctgcc

SEQ ID NO: 335148 - DNA, 25 bp, Rattus norvegicus
gagagacatcagatcctttttaata

SEQ ID NO: 335149 - DNA, 25 bp, Rattus norvegicus
gagagacatcagttcctttttaata

SEQ ID NO: 335150 - DNA, 25 bp, Rattus norvegicus
gagagacatcctcacaaatcatgga

SEQ ID NO: 335151 - DNA, 25 bp, Rattus norvegicus
gagagacatcctcgctcttttgatg

SEQ ID NO: 335152 - DNA, 25 bp, Rattus norvegicus
gagagacatcctgacaaatcatgga

SEQ ID NO: 335153 - DNA, 25 bp, Rattus norvegicus
gagagacatcctggctcttttgatg

SEQ ID NO: 335154 - DNA, 25 bp, Rattus norvegicus
gagagacatctgatggtccaggaag

SEQ ID NO: 335155 - DNA, 25 bp, Rattus norvegicus
gagagacatctgttggtccaggaag

SEQ ID NO: 335156 - DNA, 25 bp, Rattus norvegicus
gagagacatcttcttgtccattgtc

SEQ ID NO: 335157 - DNA, 25 bp, Rattus norvegicus
gagagacatcttgttgtccattgtc

SEQ ID NO: 335158 - DNA, 25 bp, Rattus norvegicus
gagagacatggcacagctacgatta

SEQ ID NO: 335159 - DNA, 25 bp, Rattus norvegicus
gagagacatggctcagctacgatta

SEQ ID NO: 335160 - DNA, 25 bp, Rattus norvegicus
gagagacattatcgcctaggacccc

SEQ ID NO: 335161 - DNA, 25 bp, Rattus norvegicus
gagagacattatggcctaggacccc

SEQ ID NO: 335162 - DNA, 25 bp, Rattus norvegicus
gagagacattgcatactgtcaccct

SEQ ID NO: 335163 - DNA, 25 bp, Rattus norvegicus
gagagacattgcttactgtcaccct

SEQ ID NO: 335164 - DNA, 25 bp, Rattus norvegicus
gagagaccaaagctcgactcctatt

SEQ ID NO: 335165 - DNA, 25 bp, Rattus norvegicus
gagagaccaaaggtcgactcctatt

SEQ ID NO: 335166 - DNA, 25 bp, Rattus norvegicus
gagagaccaactccagatccctgaa

SEQ ID NO: 335167 - DNA, 25 bp, Rattus norvegicus
gagagaccaactgcagatccctgaa

SEQ ID NO: 335168 - DNA, 25 bp, Rattus norvegicus
gagagaccacttacaaacttaacgt

SEQ ID NO: 335169 - DNA, 25 bp, Rattus norvegicus
gagagaccactttcaaacttaacgt

SEQ ID NO: 335170 - DNA, 25 bp, Rattus norvegicus
gagagaccagcacttctcgatcacc

SEQ ID NO: 335171 - DNA, 25 bp, Rattus norvegicus
gagagaccagcagttctcgatcacc

SEQ ID NO: 335172 - DNA, 25 bp, Rattus norvegicus
gagagaccagggatgcccagagaca

SEQ ID NO: 335173 - DNA, 25 bp, Rattus norvegicus
gagagaccagggttgcccagagaca

SEQ ID NO: 335174 - DNA, 25 bp, Rattus norvegicus
gagagaccagttccattcacaaata

SEQ ID NO: 335175 - DNA, 25 bp, Rattus norvegicus
gagagaccagttgcattcacaaata

SEQ ID NO: 335176 - DNA, 25 bp, Rattus norvegicus
gagagaccatctatctgggttgcca

SEQ ID NO: 335177 - DNA, 25 bp, Rattus norvegicus
gagagaccatctttctgggttgcca

SEQ ID NO: 335178 - DNA, 25 bp, Rattus norvegicus
gagagaccatgaagcgtcacctgcc

SEQ ID NO: 335179 - DNA, 25 bp, Rattus norvegicus
gagagaccatgatgcgtcacctgcc

SEQ ID NO: 335180 - DNA, 25 bp, Rattus norvegicus
gagagaccatttaccaaagctgttt

SEQ ID NO: 335181 - DNA, 25 bp, Rattus norvegicus
gagagaccattttccaaagctgttt

SEQ ID NO: 335182 - DNA, 25 bp, Rattus norvegicus
gagagacccaataactgctatgcgg

SEQ ID NO: 335183 - DNA, 25 bp, Rattus norvegicus
gagagacccaattactgctatgcgg

SEQ ID NO: 335184 - DNA, 25 bp, Rattus norvegicus
gagagaccccttcccgattgtcaat

SEQ ID NO: 335185 - DNA, 25 bp, Rattus norvegicus
gagagaccccttgccgattgtcaat

SEQ ID NO: 335186 - DNA, 25 bp, Rattus norvegicus
gagagacccggccaccaaagcgaag

SEQ ID NO: 335187 - DNA, 25 bp, Rattus norvegicus
gagagacccggcgaccaaagcgaag

SEQ ID NO: 335188 - DNA, 25 bp, Rattus norvegicus
gagagaccctccctgattactctga

SEQ ID NO: 335189 - DNA, 25 bp, Rattus norvegicus
gagagaccctccgtgattactctga

SEQ ID NO: 335190 - DNA, 25 bp, Rattus norvegicus
gagagaccctttatggagccgagcg

SEQ ID NO: 335191 - DNA, 25 bp, Rattus norvegicus
gagagaccctttttggagccgagcg

SEQ ID NO: 335192 - DNA, 25 bp, Rattus norvegicus
gagagaccgagcagaagcgcatcct

SEQ ID NO: 335193 - DNA, 25 bp, Rattus norvegicus
gagagaccgagctgaagcgcatcct

SEQ ID NO: 335194 - DNA, 25 bp, Rattus norvegicus
gagagacctatcactgtccatgaag

SEQ ID NO: 335195 - DNA, 25 bp, Rattus norvegicus
gagagacctatctctgtccatgaag

SEQ ID NO: 335196 - DNA, 25 bp, Rattus norvegicus
gagagacctcctctttaaaccagtg

SEQ ID NO: 335197 - DNA, 25 bp, Rattus norvegicus
gagagacctcctgtttaaaccagtg

SEQ ID NO: 335198 - DNA, 25 bp, Rattus norvegicus
gagagacctcgactgcaggtgtcct

SEQ ID NO: 335199 - DNA, 25 bp, Rattus norvegicus
gagagacctcgagtgcaggtgtcct

SEQ ID NO: 335200 - DNA, 25 bp, Rattus norvegicus
gagagacctcttcactgttcaggaa

SEQ ID NO: 335201 - DNA, 25 bp, Rattus norvegicus
gagagacctcttgactgttcaggaa

SEQ ID NO: 335202 - DNA, 25 bp, Rattus norvegicus
gagagacctgataccattccatgag

SEQ ID NO: 335203 - DNA, 25 bp, Rattus norvegicus
gagagacctgattccattccatgag

SEQ ID NO: 335204 - DNA, 25 bp, Rattus norvegicus
gagagacctgccaggagtatgcccc

SEQ ID NO: 335205 - DNA, 25 bp, Rattus norvegicus
gagagacctgcctggagtatgcccc

SEQ ID NO: 335206 - DNA, 25 bp, Rattus norvegicus
gagagacctgctatagaagagtgct

SEQ ID NO: 335207 - DNA, 25 bp, Rattus norvegicus
gagagacctgctttagaagagtgct

SEQ ID NO: 335208 - DNA, 25 bp, Rattus norvegicus
gagagacctgtgatcctgaaccatc

SEQ ID NO: 335209 - DNA, 25 bp, Rattus norvegicus
gagagacctgtgttcctgaaccatc

SEQ ID NO: 335210 - DNA, 25 bp, Rattus norvegicus
gagagacgactgctctggctcagat

SEQ ID NO: 335211 - DNA, 25 bp, Rattus norvegicus
gagagacgactggtctggctcagat

SEQ ID NO: 335212 - DNA, 25 bp, Rattus norvegicus
gagagacgatgactattcctgaaat

SEQ ID NO: 335213 - DNA, 25 bp, Rattus norvegicus
gagagacgatgagtattcctgaaat

SEQ ID NO: 335214 - DNA, 25 bp, Rattus norvegicus
gagagacggagtcgttctccctcct

SEQ ID NO: 335215 - DNA, 25 bp, Rattus norvegicus
gagagacggagtggttctccctcct

SEQ ID NO: 335216 - DNA, 25 bp, Rattus norvegicus
gagagacgtctacgtggacccttcc

SEQ ID NO: 335217 - DNA, 25 bp, Rattus norvegicus
gagagacgtctaggtggacccttcc

SEQ ID NO: 335218 - DNA, 25 bp, Rattus norvegicus
gagagactacagaccctgaagcggt

SEQ ID NO: 335219 - DNA, 25 bp, Rattus norvegicus
gagagactacagtccctgaagcggt

SEQ ID NO: 335220 - DNA, 25 bp, Rattus norvegicus
gagagactacgcctgacaagctttt

SEQ ID NO: 335221 - DNA, 25 bp, Rattus norvegicus
gagagactacgcgtgacaagctttt

SEQ ID NO: 335222 - DNA, 25 bp, Rattus norvegicus
gagagactagacaaaccctgtcccc

SEQ ID NO: 335223 - DNA, 25 bp, Rattus norvegicus
gagagactagactaaccctgtcccc

SEQ ID NO: 335224 - DNA, 25 bp, Rattus norvegicus
gagagactatctagcattatgactg

SEQ ID NO: 335225 - DNA, 25 bp, Rattus norvegicus
gagagactatcttgcattatgactg

SEQ ID NO: 335226 - DNA, 25 bp, Rattus norvegicus
gagagactatttaagccaggcaaag

SEQ ID NO: 335227 - DNA, 25 bp, Rattus norvegicus
gagagactattttagccaggcaaag

SEQ ID NO: 335228 - DNA, 25 bp, Rattus norvegicus
gagagactcaatctcacaaagatag

SEQ ID NO: 335229 - DNA, 25 bp, Rattus norvegicus
gagagactcaatgtcacaaagatag

SEQ ID NO: 335230 - DNA, 25 bp, Rattus norvegicus
gagagactcacacgcgtcagcatct

SEQ ID NO: 335231 - DNA, 25 bp, Rattus norvegicus
gagagactcacaggcgtcagcatct

SEQ ID NO: 335232 - DNA, 25 bp, Rattus norvegicus
gagagactcctgatgtgactgaatg

SEQ ID NO: 335233 - DNA, 25 bp, Rattus norvegicus
gagagactcctgttgtgactgaatg

SEQ ID NO: 335234 - DNA, 25 bp, Rattus norvegicus
gagagactcgaacactgacagcact

SEQ ID NO: 335235 - DNA, 25 bp, Rattus norvegicus
gagagactcgaagactgacagcact

SEQ ID NO: 335236 - DNA, 25 bp, Rattus norvegicus
gagagactctggcaagacaccacat

SEQ ID NO: 335237 - DNA, 25 bp, Rattus norvegicus
gagagactctgggaagacaccacat

SEQ ID NO: 335238 - DNA, 25 bp, Rattus norvegicus
gagagactctgtagcaaacaaacaa

SEQ ID NO: 335239 - DNA, 25 bp, Rattus norvegicus
gagagactctgttgcaaacaaacaa

SEQ ID NO: 335240 - DNA, 25 bp, Rattus norvegicus
gagagactctttcgcatgcaaggaa

SEQ ID NO: 335241 - DNA, 25 bp, Rattus norvegicus
gagagactctttggcatgcaaggaa

SEQ ID NO: 335242 - DNA, 25 bp, Rattus norvegicus
gagagactgaacactgtcactggtt

SEQ ID NO: 335243 - DNA, 25 bp, Rattus norvegicus
gagagactgaactctgtcactggtt

SEQ ID NO: 335244 - DNA, 25 bp, Rattus norvegicus
gagagactgcagaccagctccaaag

SEQ ID NO: 335245 - DNA, 25 bp, Rattus norvegicus
gagagactgcagtccagctccaaag

SEQ ID NO: 335246 - DNA, 25 bp, Rattus norvegicus
gagagactgcatcgccatccaaggt

SEQ ID NO: 335247 - DNA, 25 bp, Rattus norvegicus
gagagactgcatggccatccaaggt

SEQ ID NO: 335248 - DNA, 25 bp, Rattus norvegicus
gagagactgccccaacaaaaagaag

SEQ ID NO: 335249 - DNA, 25 bp, Rattus norvegicus
gagagactgcccgaacaaaaagaag

SEQ ID NO: 335250 - DNA, 25 bp, Rattus norvegicus
gagagactgtcgcaaggcaaaccct

SEQ ID NO: 335251 - DNA, 25 bp, Rattus norvegicus
gagagactgtcggaaggcaaaccct

SEQ ID NO: 335252 - DNA, 25 bp, Rattus norvegicus
gagagactgtctacatcagccggac

SEQ ID NO: 335253 - DNA, 25 bp, Rattus norvegicus
gagagactgtcttcatcagccggac

SEQ ID NO: 335254 - DNA, 25 bp, Rattus norvegicus
gagagacttccactttaggtcccag

SEQ ID NO: 335255 - DNA, 25 bp, Rattus norvegicus
gagagacttccagtttaggtcccag

SEQ ID NO: 335256 - DNA, 25 bp, Rattus norvegicus
gagagacttcctcgtcaagtacctg

SEQ ID NO: 335257 - DNA, 25 bp, Rattus norvegicus
gagagacttcctggtcaagtacctg

SEQ ID NO: 335258 - DNA, 25 bp, Rattus norvegicus
gagagacttcgacgatccctttgaa

SEQ ID NO: 335259 - DNA, 25 bp, Rattus norvegicus
gagagacttcgaggatccctttgaa

SEQ ID NO: 335260 - DNA, 25 bp, Rattus norvegicus
gagagacttcgcatccctgagggcc

SEQ ID NO: 335261 - DNA, 25 bp, Rattus norvegicus
gagagacttcgcttccctgagggcc

SEQ ID NO: 335262 - DNA, 25 bp, Rattus norvegicus
gagagacttctgaaacagctttgcc

SEQ ID NO: 335263 - DNA, 25 bp, Rattus norvegicus
gagagacttctgagcgtatacaagc

SEQ ID NO: 335264 - DNA, 25 bp, Rattus norvegicus
gagagacttctgtaacagctttgcc

SEQ ID NO: 335265 - DNA, 25 bp, Rattus norvegicus
gagagacttctgtgcgtatacaagc

SEQ ID NO: 335266 - DNA, 25 bp, Rattus norvegicus
gagagacttgttatggatgctcccc

SEQ ID NO: 335267 - DNA, 25 bp, Rattus norvegicus
gagagacttgttttggatgctcccc

SEQ ID NO: 335268 - DNA, 25 bp, Rattus norvegicus
gagagactttctacagctacggagg

SEQ ID NO: 335269 - DNA, 25 bp, Rattus norvegicus
gagagactttcttcagctacggagg

SEQ ID NO: 335270 - DNA, 25 bp, Rattus norvegicus
gagagactttgtcctaagcctccag

SEQ ID NO: 335271 - DNA, 25 bp, Rattus norvegicus
gagagactttgtgctaagcctccag

SEQ ID NO: 335272 - DNA, 25 bp, Rattus norvegicus
gagagacttttaataacttgcttcg

SEQ ID NO: 335273 - DNA, 25 bp, Rattus norvegicus
gagagacttttattaacttgcttcg

SEQ ID NO: 335274 - DNA, 25 bp, Rattus norvegicus
gagagagaacccacagttggacatt

SEQ ID NO: 335275 - DNA, 25 bp, Rattus norvegicus
gagagagaaccctcagttggacatt

SEQ ID NO: 335276 - DNA, 25 bp, Rattus norvegicus
gagagagaacctagttaccacccag

SEQ ID NO: 335277 - DNA, 25 bp, Rattus norvegicus
gagagagaaccttgttaccacccag

SEQ ID NO: 335278 - DNA, 25 bp, Rattus norvegicus
gagagagaactcagagcacccctgg

SEQ ID NO: 335279 - DNA, 25 bp, Rattus norvegicus
gagagagaactctgagcacccctgg

SEQ ID NO: 335280 - DNA, 25 bp, Rattus norvegicus
gagagagacaataacacccaagcaa

SEQ ID NO: 335281 - DNA, 25 bp, Rattus norvegicus
gagagagacaattacacccaagcaa

SEQ ID NO: 335282 - DNA, 25 bp, Rattus norvegicus
gagagagacatcagcagtgcccagc

SEQ ID NO: 335283 - DNA, 25 bp, Rattus norvegicus
gagagagacatctgcagtgcccagc

SEQ ID NO: 335284 - DNA, 25 bp, Rattus norvegicus
gagagagacatgagcgatcccttca

SEQ ID NO: 335285 - DNA, 25 bp, Rattus norvegicus
gagagagacatgtgcgatcccttca

SEQ ID NO: 335286 - DNA, 25 bp, Rattus norvegicus
gagagagaccacaagtccagctgct

SEQ ID NO: 335287 - DNA, 25 bp, Rattus norvegicus
gagagagaccactagtccagctgct

SEQ ID NO: 335288 - DNA, 25 bp, Rattus norvegicus
gagagagaccatctatctgtgtata

SEQ ID NO: 335289 - DNA, 25 bp, Rattus norvegicus
gagagagaccatgtatctgtgtata

SEQ ID NO: 335290 - DNA, 25 bp, Rattus norvegicus
gagagagacccactccatgacgaat

SEQ ID NO: 335291 - DNA, 25 bp, Rattus norvegicus
gagagagacccagtccatgacgaat

SEQ ID NO: 335292 - DNA, 25 bp, Rattus norvegicus
gagagagacctgaatgtgacatgct

SEQ ID NO: 335293 - DNA, 25 bp, Rattus norvegicus
gagagagacctgtatgtgacatgct

SEQ ID NO: 335294 - DNA, 25 bp, Rattus norvegicus
gagagagactcaaaacagatggtaa

SEQ ID NO: 335295 - DNA, 25 bp, Rattus norvegicus
gagagagactcataacagatggtaa

SEQ ID NO: 335296 - DNA, 25 bp, Rattus norvegicus
gagagagactccctcaaagaaggat

SEQ ID NO: 335297 - DNA, 25 bp, Rattus norvegicus
gagagagactccgtcaaagaaggat

SEQ ID NO: 335298 - DNA, 25 bp, Rattus norvegicus
gagagagactgcatggtgaacccca

SEQ ID NO: 335299 - DNA, 25 bp, Rattus norvegicus
gagagagactgcttggtgaacccca

SEQ ID NO: 335300 - DNA, 25 bp, Rattus norvegicus
gagagagagctacccacttatcttt

SEQ ID NO: 335301 - DNA, 25 bp, Rattus norvegicus
gagagagagctagccacttatcttt

SEQ ID NO: 335302 - DNA, 25 bp, Rattus norvegicus
gagagagaggcacagcatctcctca

SEQ ID NO: 335303 - DNA, 25 bp, Rattus norvegicus
gagagagaggcagagcatctcctca

SEQ ID NO: 335304 - DNA, 25 bp, Rattus norvegicus
gagagagaggccatgtgcgtacaca

SEQ ID NO: 335305 - DNA, 25 bp, Rattus norvegicus
gagagagaggccttgtgcgtacaca

SEQ ID NO: 335306 - DNA, 25 bp, Rattus norvegicus
gagagagagttcactcaccctttga

SEQ ID NO: 335307 - DNA, 25 bp, Rattus norvegicus
gagagagagttctctcaccctttga

SEQ ID NO: 335308 - DNA, 25 bp, Rattus norvegicus
gagagagattaaaatagcgactgta

SEQ ID NO: 335309 - DNA, 25 bp, Rattus norvegicus
gagagagattaatatagcgactgta

SEQ ID NO: 335310 - DNA, 25 bp, Rattus norvegicus
gagagagcaagaacatttctgtgaa

SEQ ID NO: 335311 - DNA, 25 bp, Rattus norvegicus
gagagagcaagatcatttctgtgaa

SEQ ID NO: 335312 - DNA, 25 bp, Rattus norvegicus
gagagagcactaacaggccctggct

SEQ ID NO: 335313 - DNA, 25 bp, Rattus norvegicus
gagagagcactatcaggccctggct

SEQ ID NO: 335314 - DNA, 25 bp, Rattus norvegicus
gagagagcacttagcagcttcctca

SEQ ID NO: 335315 - DNA, 25 bp, Rattus norvegicus
gagagagcactttgcagcttcctca

SEQ ID NO: 335316 - DNA, 25 bp, Rattus norvegicus
gagagagcagtcattacaggcgttc

SEQ ID NO: 335317 - DNA, 25 bp, Rattus norvegicus
gagagagcagtctttacaggcgttc

SEQ ID NO: 335318 - DNA, 25 bp, Rattus norvegicus
gagagagcagtgacccagccatctt

SEQ ID NO: 335319 - DNA, 25 bp, Rattus norvegicus
gagagagcagtgtcccagccatctt

SEQ ID NO: 335320 - DNA, 25 bp, Rattus norvegicus
gagagagcatcaagatcccgacacc

SEQ ID NO: 335321 - DNA, 25 bp, Rattus norvegicus
gagagagcatcaccatttcacatag

SEQ ID NO: 335322 - DNA, 25 bp, Rattus norvegicus
gagagagcatcagcatttcacatag

SEQ ID NO: 335323 - DNA, 25 bp, Rattus norvegicus
gagagagcatcatgatcccgacacc

SEQ ID NO: 335324 - DNA, 25 bp, Rattus norvegicus
gagagagcatccagtgttccaccag

SEQ ID NO: 335325 - DNA, 25 bp, Rattus norvegicus
gagagagcatcctgtgttccaccag

SEQ ID NO: 335326 - DNA, 25 bp, Rattus norvegicus
gagagagcatgtccagcctgctgta

SEQ ID NO: 335327 - DNA, 25 bp, Rattus norvegicus
gagagagcatgtgcagcctgctgta

SEQ ID NO: 335328 - DNA, 25 bp, Rattus norvegicus
gagagagccaacaacctgttagcaa

SEQ ID NO: 335329 - DNA, 25 bp, Rattus norvegicus
gagagagccaactacctgttagcaa

SEQ ID NO: 335330 - DNA, 25 bp, Rattus norvegicus
gagagagccccaagagctgtttctg

SEQ ID NO: 335331 - DNA, 25 bp, Rattus norvegicus
gagagagccccatgagctgtttctg

SEQ ID NO: 335332 - DNA, 25 bp, Rattus norvegicus
gagagagcccgacacccagaccgag

SEQ ID NO: 335333 - DNA, 25 bp, Rattus norvegicus
gagagagcccgacatggtgcaatcc

SEQ ID NO: 335334 - DNA, 25 bp, Rattus norvegicus
gagagagcccgagacccagaccgag

SEQ ID NO: 335335 - DNA, 25 bp, Rattus norvegicus
gagagagcccgagatggtgcaatcc

SEQ ID NO: 335336 - DNA, 25 bp, Rattus norvegicus
gagagagccctcaaccggaccaaat

SEQ ID NO: 335337 - DNA, 25 bp, Rattus norvegicus
gagagagccctctaccggaccaaat

SEQ ID NO: 335338 - DNA, 25 bp, Rattus norvegicus
gagagagcctccaatgtaatgtgtg

SEQ ID NO: 335339 - DNA, 25 bp, Rattus norvegicus
gagagagcctcctatgtaatgtgtg

SEQ ID NO: 335340 - DNA, 25 bp, Rattus norvegicus
gagagagcctgtattgaactcgcaa

SEQ ID NO: 335341 - DNA, 25 bp, Rattus norvegicus
gagagagcctgttttgaactcgcaa

SEQ ID NO: 335342 - DNA, 25 bp, Rattus norvegicus
gagagagcgaagatcagcagctagc

SEQ ID NO: 335343 - DNA, 25 bp, Rattus norvegicus
gagagagcgaagttcagcagctagc

SEQ ID NO: 335344 - DNA, 25 bp, Rattus norvegicus
gagagagcgagcagtttccaaaact

SEQ ID NO: 335345 - DNA, 25 bp, Rattus norvegicus
gagagagcgagctgtttccaaaact

SEQ ID NO: 335346 - DNA, 25 bp, Rattus norvegicus
gagagagcgcacatgtttataaact

SEQ ID NO: 335347 - DNA, 25 bp, Rattus norvegicus
gagagagcgcacttgtttataaact

SEQ ID NO: 335348 - DNA, 25 bp, Rattus norvegicus
gagagagctaccacgcatgtgcagt

SEQ ID NO: 335349 - DNA, 25 bp, Rattus norvegicus
gagagagctacctcgcatgtgcagt

SEQ ID NO: 335350 - DNA, 25 bp, Rattus norvegicus
gagagagctcgacctagttctaagc

SEQ ID NO: 335351 - DNA, 25 bp, Rattus norvegicus
gagagagctcgagctagttctaagc

SEQ ID NO: 335352 - DNA, 25 bp, Rattus norvegicus
gagagagctctacatcagcatctgt

SEQ ID NO: 335353 - DNA, 25 bp, Rattus norvegicus
gagagagctctagatcagcatctgt

SEQ ID NO: 335354 - DNA, 25 bp, Rattus norvegicus
gagagagctctgacaatacagcttt

SEQ ID NO: 335355 - DNA, 25 bp, Rattus norvegicus
gagagagctctgtcaatacagcttt

SEQ ID NO: 335356 - DNA, 25 bp, Rattus norvegicus
gagagagctgcgacccgcgcactaa

SEQ ID NO: 335357 - DNA, 25 bp, Rattus norvegicus
gagagagctgcgtcccgcgcactaa

SEQ ID NO: 335358 - DNA, 25 bp, Rattus norvegicus
gagagagctgttaccttgagcatca

SEQ ID NO: 335359 - DNA, 25 bp, Rattus norvegicus
gagagagctgtttccttgagcatca

SEQ ID NO: 335360 - DNA, 25 bp, Rattus norvegicus
gagagaggactgcacttaggcccct

SEQ ID NO: 335361 - DNA, 25 bp, Rattus norvegicus
gagagaggactggacttaggcccct

SEQ ID NO: 335362 - DNA, 25 bp, Rattus norvegicus
gagagaggagaacactgcagcttaa

SEQ ID NO: 335363 - DNA, 25 bp, Rattus norvegicus
gagagaggagaagactgcagcttaa

SEQ ID NO: 335364 - DNA, 25 bp, Rattus norvegicus
gagagaggccaccagatagagaatc

SEQ ID NO: 335365 - DNA, 25 bp, Rattus norvegicus
gagagaggccacgagatagagaatc

SEQ ID NO: 335366 - DNA, 25 bp, Rattus norvegicus
gagagaggcctgagcccattatcaa

SEQ ID NO: 335367 - DNA, 25 bp, Rattus norvegicus
gagagaggcctgtgcccattatcaa

SEQ ID NO: 335368 - DNA, 25 bp, Rattus norvegicus
gagagaggctttctagccgtgccaa

SEQ ID NO: 335369 - DNA, 25 bp, Rattus norvegicus
gagagaggctttgtagccgtgccaa

SEQ ID NO: 335370 - DNA, 25 bp, Rattus norvegicus
gagagagggaacacgggccccaaat

SEQ ID NO: 335371 - DNA, 25 bp, Rattus norvegicus
gagagagggaactcgggccccaaat

SEQ ID NO: 335372 - DNA, 25 bp, Rattus norvegicus
gagagagggccgctcttgcctctaa

SEQ ID NO: 335373 - DNA, 25 bp, Rattus norvegicus
gagagagggccggtcttgcctctaa

SEQ ID NO: 335374 - DNA, 25 bp, Rattus norvegicus
gagagagggcttcggacactttttc

SEQ ID NO: 335375 - DNA, 25 bp, Rattus norvegicus
gagagagggcttgggacactttttc

SEQ ID NO: 335376 - DNA, 25 bp, Rattus norvegicus
gagagaggtccactcccatgtggcc

SEQ ID NO: 335377 - DNA, 25 bp, Rattus norvegicus
gagagaggtccagtcccatgtggcc

SEQ ID NO: 335378 - DNA, 25 bp, Rattus norvegicus
gagagaggtgctatcacagactaaa

SEQ ID NO: 335379 - DNA, 25 bp, Rattus norvegicus
gagagaggtgctttcacagactaaa

SEQ ID NO: 335380 - DNA, 25 bp, Rattus norvegicus
gagagaggttcgaatacagctgcct

SEQ ID NO: 335381 - DNA, 25 bp, Rattus norvegicus
gagagaggttcgtatacagctgcct

SEQ ID NO: 335382 - DNA, 25 bp, Rattus norvegicus
gagagagtacttatcataaggactg

SEQ ID NO: 335383 - DNA, 25 bp, Rattus norvegicus
gagagagtacttcattgctgattaa

SEQ ID NO: 335384 - DNA, 25 bp, Rattus norvegicus
gagagagtacttgattgctgattaa

SEQ ID NO: 335385 - DNA, 25 bp, Rattus norvegicus
gagagagtacttttcataaggactg

SEQ ID NO: 335386 - DNA, 25 bp, Rattus norvegicus
gagagagtaggcaggcttctttgct

SEQ ID NO: 335387 - DNA, 25 bp, Rattus norvegicus
gagagagtaggctggcttctttgct

SEQ ID NO: 335388 - DNA, 25 bp, Rattus norvegicus
gagagagtcccaacttcaagcagtt

SEQ ID NO: 335389 - DNA, 25 bp, Rattus norvegicus
gagagagtcccacagttatacaaag

SEQ ID NO: 335390 - DNA, 25 bp, Rattus norvegicus
gagagagtcccagagttatacaaag

SEQ ID NO: 335391 - DNA, 25 bp, Rattus norvegicus
gagagagtcccatcttcaagcagtt

SEQ ID NO: 335392 - DNA, 25 bp, Rattus norvegicus
gagagagtccccagagttaagcagg

SEQ ID NO: 335393 - DNA, 25 bp, Rattus norvegicus
gagagagtcccctgagttaagcagg

SEQ ID NO: 335394 - DNA, 25 bp, Rattus norvegicus
gagagagtctctcctcctggtttcg

SEQ ID NO: 335395 - DNA, 25 bp, Rattus norvegicus
gagagagtctctgctcctggtttcg

SEQ ID NO: 335396 - DNA, 25 bp, Rattus norvegicus
gagagagtctgaactttcctcaatc

SEQ ID NO: 335397 - DNA, 25 bp, Rattus norvegicus
gagagagtctgatctttcctcaatc

SEQ ID NO: 335398 - DNA, 25 bp, Rattus norvegicus
gagagagtggccaacggaatcaccc

SEQ ID NO: 335399 - DNA, 25 bp, Rattus norvegicus
gagagagtggcctacggaatcaccc

SEQ ID NO: 335400 - DNA, 25 bp, Rattus norvegicus
gagagagtggctatccactactcag

SEQ ID NO: 335401 - DNA, 25 bp, Rattus norvegicus
gagagagtggctttccactactcag

SEQ ID NO: 335402 - DNA, 25 bp, Rattus norvegicus
gagagagtggtccagagctgctcag

SEQ ID NO: 335403 - DNA, 25 bp, Rattus norvegicus
gagagagtggtcgagagctgctcag

SEQ ID NO: 335404 - DNA, 25 bp, Rattus norvegicus
gagagagtgtgcctactgcctgacc

SEQ ID NO: 335405 - DNA, 25 bp, Rattus norvegicus
gagagagtgtgcgtactgcctgacc

SEQ ID NO: 335406 - DNA, 25 bp, Rattus norvegicus
gagagagttgtcaacttcccttaac

SEQ ID NO: 335407 - DNA, 25 bp, Rattus norvegicus
gagagagttgtctacttcccttaac

SEQ ID NO: 335408 - DNA, 25 bp, Rattus norvegicus
gagagagtttcacatctgccatcca

SEQ ID NO: 335409 - DNA, 25 bp, Rattus norvegicus
gagagagtttcagatctgccatcca

SEQ ID NO: 335410 - DNA, 25 bp, Rattus norvegicus
gagagagtttccaatgatccagtaa

SEQ ID NO: 335411 - DNA, 25 bp, Rattus norvegicus
gagagagtttcctatgatccagtaa

SEQ ID NO: 335412 - DNA, 25 bp, Rattus norvegicus
gagagagtttgcacacacctgtagt

SEQ ID NO: 335413 - DNA, 25 bp, Rattus norvegicus
gagagagtttgctcacacctgtagt

SEQ ID NO: 335414 - DNA, 25 bp, Rattus norvegicus
gagagagtttgtatccaccaatcca

SEQ ID NO: 335415 - DNA, 25 bp, Rattus norvegicus
gagagagtttgtttccaccaatcca

SEQ ID NO: 335416 - DNA, 25 bp, Rattus norvegicus
gagagataagctcatgtccatgaga

SEQ ID NO: 335417 - DNA, 25 bp, Rattus norvegicus
gagagataagctgatgtccatgaga

SEQ ID NO: 335418 - DNA, 25 bp, Rattus norvegicus
gagagataatgacacccaccttgct

SEQ ID NO: 335419 - DNA, 25 bp, Rattus norvegicus
gagagataatgagacccaccttgct

SEQ ID NO: 335420 - DNA, 25 bp, Rattus norvegicus
gagagatacactctgccctgttaaa

SEQ ID NO: 335421 - DNA, 25 bp, Rattus norvegicus
gagagatacactgtgccctgttaaa

SEQ ID NO: 335422 - DNA, 25 bp, Rattus norvegicus
gagagatactttctttctaaacttc

SEQ ID NO: 335423 - DNA, 25 bp, Rattus norvegicus
gagagatactttgtttctaaacttc

SEQ ID NO: 335424 - DNA, 25 bp, Rattus norvegicus
gagagatagcaaccatccaagagct

SEQ ID NO: 335425 - DNA, 25 bp, Rattus norvegicus
gagagatagcaagcatccaagagct

SEQ ID NO: 335426 - DNA, 25 bp, Rattus norvegicus
gagagataggctatgttcatgttga

SEQ ID NO: 335427 - DNA, 25 bp, Rattus norvegicus
gagagataggctttgttcatgttga

SEQ ID NO: 335428 - DNA, 25 bp, Rattus norvegicus
gagagatagggaaccagcccaacat

SEQ ID NO: 335429 - DNA, 25 bp, Rattus norvegicus
gagagatagggatccagcccaacat

SEQ ID NO: 335430 - DNA, 25 bp, Rattus norvegicus
gagagatagtacatcctgctgggag

SEQ ID NO: 335431 - DNA, 25 bp, Rattus norvegicus
gagagatagtacttcctgctgggag

SEQ ID NO: 335432 - DNA, 25 bp, Rattus norvegicus
gagagatatggaatcctccccgttc

SEQ ID NO: 335433 - DNA, 25 bp, Rattus norvegicus
gagagatatggattcctccccgttc

SEQ ID NO: 335434 - DNA, 25 bp, Rattus norvegicus
gagagatcaagacagcgctccaagg

SEQ ID NO: 335435 - DNA, 25 bp, Rattus norvegicus
gagagatcaagagagcgctccaagg

SEQ ID NO: 335436 - DNA, 25 bp, Rattus norvegicus
gagagatcaatgaaactgccagcac

SEQ ID NO: 335437 - DNA, 25 bp, Rattus norvegicus
gagagatcaatgtaactgccagcac

SEQ ID NO: 335438 - DNA, 25 bp, Rattus norvegicus
gagagatcacccatgcgtatatact

SEQ ID NO: 335439 - DNA, 25 bp, Rattus norvegicus
gagagatcacccttgcgtatatact

SEQ ID NO: 335440 - DNA, 25 bp, Rattus norvegicus
gagagatcagagatctcggaccatt

SEQ ID NO: 335441 - DNA, 25 bp, Rattus norvegicus
gagagatcagagttctcggaccatt

SEQ ID NO: 335442 - DNA, 25 bp, Rattus norvegicus
gagagatcagcgcatccttgctgag

SEQ ID NO: 335443 - DNA, 25 bp, Rattus norvegicus
gagagatcagcggatccttgctgag

SEQ ID NO: 335444 - DNA, 25 bp, Rattus norvegicus
gagagatcagctcttctgtagagag

SEQ ID NO: 335445 - DNA, 25 bp, Rattus norvegicus
gagagatcagctgttctgtagagag

SEQ ID NO: 335446 - DNA, 25 bp, Rattus norvegicus
gagagatcatacagcaaggaccaag

SEQ ID NO: 335447 - DNA, 25 bp, Rattus norvegicus
gagagatcatactgcaaggaccaag

SEQ ID NO: 335448 - DNA, 25 bp, Rattus norvegicus
gagagatcatgaagcagccgccctt

SEQ ID NO: 335449 - DNA, 25 bp, Rattus norvegicus
gagagatcatgatgcagccgccctt

SEQ ID NO: 335450 - DNA, 25 bp, Rattus norvegicus
gagagatcatgtactccctctgcta

SEQ ID NO: 335451 - DNA, 25 bp, Rattus norvegicus
gagagatcatgttctccctctgcta

SEQ ID NO: 335452 - DNA, 25 bp, Rattus norvegicus
gagagatccaataggctgtttatga

SEQ ID NO: 335453 - DNA, 25 bp, Rattus norvegicus
gagagatccaattggctgtttatga

SEQ ID NO: 335454 - DNA, 25 bp, Rattus norvegicus
gagagatccaccctgttgtgccagc

SEQ ID NO: 335455 - DNA, 25 bp, Rattus norvegicus
gagagatccaccgtgttgtgccagc

SEQ ID NO: 335456 - DNA, 25 bp, Rattus norvegicus
gagagatcccaacagttataacagc

SEQ ID NO: 335457 - DNA, 25 bp, Rattus norvegicus
gagagatcccaagagttataacagc

SEQ ID NO: 335458 - DNA, 25 bp, Rattus norvegicus
gagagatcccagagaaccgtaccag

SEQ ID NO: 335459 - DNA, 25 bp, Rattus norvegicus
gagagatcccagtgaaccgtaccag

SEQ ID NO: 335460 - DNA, 25 bp, Rattus norvegicus
gagagatcccatattaaagaacctt

SEQ ID NO: 335461 - DNA, 25 bp, Rattus norvegicus
gagagatcccattttaaagaacctt

SEQ ID NO: 335462 - DNA, 25 bp, Rattus norvegicus
gagagatcctctaagtcacaaagaa

SEQ ID NO: 335463 - DNA, 25 bp, Rattus norvegicus
gagagatcctcttagtcacaaagaa

SEQ ID NO: 335464 - DNA, 25 bp, Rattus norvegicus
gagagatcctgacttcagttcacaa

SEQ ID NO: 335465 - DNA, 25 bp, Rattus norvegicus
gagagatcctgagttcagttcacaa

SEQ ID NO: 335466 - DNA, 25 bp, Rattus norvegicus
gagagatcgcacaggttgccttctg

SEQ ID NO: 335467 - DNA, 25 bp, Rattus norvegicus
gagagatcgcactggttgccttctg

SEQ ID NO: 335468 - DNA, 25 bp, Rattus norvegicus
gagagatcgtgaatgctcccaccat

SEQ ID NO: 335469 - DNA, 25 bp, Rattus norvegicus
gagagatcgtgattgctcccaccat

SEQ ID NO: 335470 - DNA, 25 bp, Rattus norvegicus
gagagatctagaccatagcctccct

SEQ ID NO: 335471 - DNA, 25 bp, Rattus norvegicus
gagagatctagagcatagcctccct

SEQ ID NO: 335472 - DNA, 25 bp, Rattus norvegicus
gagagatctcacatggaaccaagcc

SEQ ID NO: 335473 - DNA, 25 bp, Rattus norvegicus
gagagatctcacttggaaccaagcc

SEQ ID NO: 335474 - DNA, 25 bp, Rattus norvegicus
gagagatctccaaattgtttatcaa

SEQ ID NO: 335475 - DNA, 25 bp, Rattus norvegicus
gagagatctccatattgtttatcaa

SEQ ID NO: 335476 - DNA, 25 bp, Rattus norvegicus
gagagatctctaatatatttaattc

SEQ ID NO: 335477 - DNA, 25 bp, Rattus norvegicus
gagagatctctattatatttaattc

SEQ ID NO: 335478 - DNA, 25 bp, Rattus norvegicus
gagagatctgacataatcccttgct

SEQ ID NO: 335479 - DNA, 25 bp, Rattus norvegicus
gagagatctgacttaatcccttgct

SEQ ID NO: 335480 - DNA, 25 bp, Rattus norvegicus
gagagatcttcaagcattctttgca

SEQ ID NO: 335481 - DNA, 25 bp, Rattus norvegicus
gagagatcttcacgtaccggcggtc

SEQ ID NO: 335482 - DNA, 25 bp, Rattus norvegicus
gagagatcttcaggtaccggcggtc

SEQ ID NO: 335483 - DNA, 25 bp, Rattus norvegicus
gagagatcttcatgcattctttgca

SEQ ID NO: 335484 - DNA, 25 bp, Rattus norvegicus
gagagatcttgtaagttcctggaaa

SEQ ID NO: 335485 - DNA, 25 bp, Rattus norvegicus
gagagatcttgtacatagagcatgg

SEQ ID NO: 335486 - DNA, 25 bp, Rattus norvegicus
gagagatcttgttagttcctggaaa

SEQ ID NO: 335487 - DNA, 25 bp, Rattus norvegicus
gagagatcttgttcatagagcatgg

SEQ ID NO: 335488 - DNA, 25 bp, Rattus norvegicus
gagagatctttgaaggcgccccagt

SEQ ID NO: 335489 - DNA, 25 bp, Rattus norvegicus
gagagatctttgtaggcgccccagt

SEQ ID NO: 335490 - DNA, 25 bp, Rattus norvegicus
gagagatgacccagaagaaccctat

SEQ ID NO: 335491 - DNA, 25 bp, Rattus norvegicus
gagagatgaccctgaagaaccctat

SEQ ID NO: 335492 - DNA, 25 bp, Rattus norvegicus
gagagatgaccgacctcaggtcctg

SEQ ID NO: 335493 - DNA, 25 bp, Rattus norvegicus
gagagatgaccgtcctcaggtcctg

SEQ ID NO: 335494 - DNA, 25 bp, Rattus norvegicus
gagagatgagtgctttcctgtccta

SEQ ID NO: 335495 - DNA, 25 bp, Rattus norvegicus
gagagatgagtggtttcctgtccta

SEQ ID NO: 335496 - DNA, 25 bp, Rattus norvegicus
gagagatgcataacacaccctgcca

SEQ ID NO: 335497 - DNA, 25 bp, Rattus norvegicus
gagagatgcatatcacaccctgcca

SEQ ID NO: 335498 - DNA, 25 bp, Rattus norvegicus
gagagatgcatgacttctggttaaa

SEQ ID NO: 335499 - DNA, 25 bp, Rattus norvegicus
gagagatgcatgtcttctggttaaa

SEQ ID NO: 335500 - DNA, 25 bp, Rattus norvegicus
gagagatgccatacctttactttct

SEQ ID NO: 335501 - DNA, 25 bp, Rattus norvegicus
gagagatgccattcctttactttct

SEQ ID NO: 335502 - DNA, 25 bp, Rattus norvegicus
gagagatgcctgactcaccatgaac

SEQ ID NO: 335503 - DNA, 25 bp, Rattus norvegicus
gagagatgcctgagctggactgccc

SEQ ID NO: 335504 - DNA, 25 bp, Rattus norvegicus
gagagatgcctgagttcaagttgaa

SEQ ID NO: 335505 - DNA, 25 bp, Rattus norvegicus
gagagatgcctgtctcaccatgaac

SEQ ID NO: 335506 - DNA, 25 bp, Rattus norvegicus
gagagatgcctgtgctggactgccc

SEQ ID NO: 335507 - DNA, 25 bp, Rattus norvegicus
gagagatgcctgtgttcaagttgaa

SEQ ID NO: 335508 - DNA, 25 bp, Rattus norvegicus
gagagatgcggcctgtgccattctc

SEQ ID NO: 335509 - DNA, 25 bp, Rattus norvegicus
gagagatgcggcgtgtgccattctc

SEQ ID NO: 335510 - DNA, 25 bp, Rattus norvegicus
gagagatgctcacagacccggaact

SEQ ID NO: 335511 - DNA, 25 bp, Rattus norvegicus
gagagatgctcagagacccggaact

SEQ ID NO: 335512 - DNA, 25 bp, Rattus norvegicus
gagagatgctgccaagtccgaccaa

SEQ ID NO: 335513 - DNA, 25 bp, Rattus norvegicus
gagagatgctgcgaagtccgaccaa

SEQ ID NO: 335514 - DNA, 25 bp, Rattus norvegicus
gagagatggatgctcaccccaaagc

SEQ ID NO: 335515 - DNA, 25 bp, Rattus norvegicus
gagagatggatggtcaccccaaagc

SEQ ID NO: 335516 - DNA, 25 bp, Rattus norvegicus
gagagatggcttactgtccccatag

SEQ ID NO: 335517 - DNA, 25 bp, Rattus norvegicus
gagagatggcttcctgtagacacaa

SEQ ID NO: 335518 - DNA, 25 bp, Rattus norvegicus
gagagatggcttgctgtagacacaa

SEQ ID NO: 335519 - DNA, 25 bp, Rattus norvegicus
gagagatggctttctgtccccatag

SEQ ID NO: 335520 - DNA, 25 bp, Rattus norvegicus
gagagatgggtcacccccaaatgaa

SEQ ID NO: 335521 - DNA, 25 bp, Rattus norvegicus
gagagatgggtctcccccaaatgaa

SEQ ID NO: 335522 - DNA, 25 bp, Rattus norvegicus
gagagatggtttacaagcctcctaa

SEQ ID NO: 335523 - DNA, 25 bp, Rattus norvegicus
gagagatggttttcaagcctcctaa

SEQ ID NO: 335524 - DNA, 25 bp, Rattus norvegicus
gagagatgtatcactggctgcattc

SEQ ID NO: 335525 - DNA, 25 bp, Rattus norvegicus
gagagatgtatcattcaagcttttt

SEQ ID NO: 335526 - DNA, 25 bp, Rattus norvegicus
gagagatgtatctctggctgcattc

SEQ ID NO: 335527 - DNA, 25 bp, Rattus norvegicus
gagagatgtatctttcaagcttttt

SEQ ID NO: 335528 - DNA, 25 bp, Rattus norvegicus
gagagatgtcacctcgacctgtgaa

SEQ ID NO: 335529 - DNA, 25 bp, Rattus norvegicus
gagagatgtcacgtcgacctgtgaa

SEQ ID NO: 335530 - DNA, 25 bp, Rattus norvegicus
gagagatgtccaacccggatatcac

SEQ ID NO: 335531 - DNA, 25 bp, Rattus norvegicus
gagagatgtccatcccggatatcac

SEQ ID NO: 335532 - DNA, 25 bp, Rattus norvegicus
gagagatgtcctcgtgtcacttttt

SEQ ID NO: 335533 - DNA, 25 bp, Rattus norvegicus
gagagatgtcctggtgtcacttttt

SEQ ID NO: 335534 - DNA, 25 bp, Rattus norvegicus
gagagatgtctcagagctcctgcat

SEQ ID NO: 335535 - DNA, 25 bp, Rattus norvegicus
gagagatgtctctgagctcctgcat

SEQ ID NO: 335536 - DNA, 25 bp, Rattus norvegicus
gagagattcggaccgcctcataggc

SEQ ID NO: 335537 - DNA, 25 bp, Rattus norvegicus
gagagattcggagcgcctcataggc

SEQ ID NO: 335538 - DNA, 25 bp, Rattus norvegicus
gagagattctgcacgctccttccgg

SEQ ID NO: 335539 - DNA, 25 bp, Rattus norvegicus
gagagattctgctcgctccttccgg

SEQ ID NO: 335540 - DNA, 25 bp, Rattus norvegicus
gagagattctgtacgctggtgtgat

SEQ ID NO: 335541 - DNA, 25 bp, Rattus norvegicus
gagagattctgttcgctggtgtgat

SEQ ID NO: 335542 - DNA, 25 bp, Rattus norvegicus
gagagattgatgagcgcaaccgccc

SEQ ID NO: 335543 - DNA, 25 bp, Rattus norvegicus
gagagattgatgtgcgcaaccgccc

SEQ ID NO: 335544 - DNA, 25 bp, Rattus norvegicus
gagagattgcgtattgtcacaggga

SEQ ID NO: 335545 - DNA, 25 bp, Rattus norvegicus
gagagattgcgttttgtcacaggga

SEQ ID NO: 335546 - DNA, 25 bp, Rattus norvegicus
gagagattgctgaaggccatcacat

SEQ ID NO: 335547 - DNA, 25 bp, Rattus norvegicus
gagagattgctgtaggccatcacat

SEQ ID NO: 335548 - DNA, 25 bp, Rattus norvegicus
gagagattgtctcgctgacttcctg

SEQ ID NO: 335549 - DNA, 25 bp, Rattus norvegicus
gagagattgtctggctgacttcctg

SEQ ID NO: 335550 - DNA, 25 bp, Rattus norvegicus
gagagattgtggatcgccttgacct

SEQ ID NO: 335551 - DNA, 25 bp, Rattus norvegicus
gagagattgtggttcgccttgacct

SEQ ID NO: 335552 - DNA, 25 bp, Rattus norvegicus
gagagatttactcctatcccaggat

SEQ ID NO: 335553 - DNA, 25 bp, Rattus norvegicus
gagagatttactgctatcccaggat

SEQ ID NO: 335554 - DNA, 25 bp, Rattus norvegicus
gagagatttcacatctttgccttgc

SEQ ID NO: 335555 - DNA, 25 bp, Rattus norvegicus
gagagatttcacttctttgccttgc

SEQ ID NO: 335556 - DNA, 25 bp, Rattus norvegicus
gagagatttcataggctgctccttt

SEQ ID NO: 335557 - DNA, 25 bp, Rattus norvegicus
gagagatttcattggctgctccttt

SEQ ID NO: 335558 - DNA, 25 bp, Rattus norvegicus
gagagatttcttcccagtgattatt

SEQ ID NO: 335559 - DNA, 25 bp, Rattus norvegicus
gagagatttcttgccagtgattatt

SEQ ID NO: 335560 - DNA, 25 bp, Rattus norvegicus
gagagatttggcatcagggtgtttt

SEQ ID NO: 335561 - DNA, 25 bp, Rattus norvegicus
gagagatttggcttcagggtgtttt

SEQ ID NO: 335562 - DNA, 25 bp, Rattus norvegicus
gagagattttctagggtatttggtt

SEQ ID NO: 335563 - DNA, 25 bp, Rattus norvegicus
gagagattttcttgggtatttggtt

SEQ ID NO: 335564 - DNA, 25 bp, Rattus norvegicus
gagagcaaaagaagctgctgaccaa

SEQ ID NO: 335565 - DNA, 25 bp, Rattus norvegicus
gagagcaaaagatgctgctgaccaa

SEQ ID NO: 335566 - DNA, 25 bp, Rattus norvegicus
gagagcaacattacctaaaattgga

SEQ ID NO: 335567 - DNA, 25 bp, Rattus norvegicus
gagagcaacatttcctaaaattgga

SEQ ID NO: 335568 - DNA, 25 bp, Rattus norvegicus
gagagcaaccgcagggacacttgca

SEQ ID NO: 335569 - DNA, 25 bp, Rattus norvegicus
gagagcaaccgctgggacacttgca

SEQ ID NO: 335570 - DNA, 25 bp, Rattus norvegicus
gagagcaacgtccaagtcagtacct

SEQ ID NO: 335571 - DNA, 25 bp, Rattus norvegicus
gagagcaacgtcgaagtcagtacct

SEQ ID NO: 335572 - DNA, 25 bp, Rattus norvegicus
gagagcaacgtgaggcccctgaata

SEQ ID NO: 335573 - DNA, 25 bp, Rattus norvegicus
gagagcaacgtgtggcccctgaata

SEQ ID NO: 335574 - DNA, 25 bp, Rattus norvegicus
gagagcaactcaaacccaagtgggt

SEQ ID NO: 335575 - DNA, 25 bp, Rattus norvegicus
gagagcaactcatacccaagtgggt

SEQ ID NO: 335576 - DNA, 25 bp, Rattus norvegicus
gagagcaactgtagacagtggttaa

SEQ ID NO: 335577 - DNA, 25 bp, Rattus norvegicus
gagagcaactgttgacagtggttaa

SEQ ID NO: 335578 - DNA, 25 bp, Rattus norvegicus
gagagcaagagcagtcacaccctag

SEQ ID NO: 335579 - DNA, 25 bp, Rattus norvegicus
gagagcaagagccagcaccaagtaa

SEQ ID NO: 335580 - DNA, 25 bp, Rattus norvegicus
gagagcaagagcgagcaccaagtaa

SEQ ID NO: 335581 - DNA, 25 bp, Rattus norvegicus
gagagcaagagctgtcacaccctag

SEQ ID NO: 335582 - DNA, 25 bp, Rattus norvegicus
gagagcaagcacaatcacacatgac

SEQ ID NO: 335583 - DNA, 25 bp, Rattus norvegicus
gagagcaagcactatcacacatgac

SEQ ID NO: 335584 - DNA, 25 bp, Rattus norvegicus
gagagcaagcatacagtcccaagag

SEQ ID NO: 335585 - DNA, 25 bp, Rattus norvegicus
gagagcaagcattcagtcccaagag

SEQ ID NO: 335586 - DNA, 25 bp, Rattus norvegicus
gagagcaagcggagactgccagcat

SEQ ID NO: 335587 - DNA, 25 bp, Rattus norvegicus
gagagcaagcggtgactgccagcat

SEQ ID NO: 335588 - DNA, 25 bp, Rattus norvegicus
gagagcaagctccatgtgtgatcca

SEQ ID NO: 335589 - DNA, 25 bp, Rattus norvegicus
gagagcaagctcctgtgtccaccaa

SEQ ID NO: 335590 - DNA, 25 bp, Rattus norvegicus
gagagcaagctcgatgtgtgatcca

SEQ ID NO: 335591 - DNA, 25 bp, Rattus norvegicus
gagagcaagctcgtgtgtccaccaa

SEQ ID NO: 335592 - DNA, 25 bp, Rattus norvegicus
gagagcaagtttactgtggcctcag

SEQ ID NO: 335593 - DNA, 25 bp, Rattus norvegicus
gagagcaagttttctgtggcctcag

SEQ ID NO: 335594 - DNA, 25 bp, Rattus norvegicus
gagagcaatactaatgttcccctat

SEQ ID NO: 335595 - DNA, 25 bp, Rattus norvegicus
gagagcaatacttatgttcccctat

SEQ ID NO: 335596 - DNA, 25 bp, Rattus norvegicus
gagagcaattccaaagaccttcgag

SEQ ID NO: 335597 - DNA, 25 bp, Rattus norvegicus
gagagcaattcctaagaccttcgag

SEQ ID NO: 335598 - DNA, 25 bp, Rattus norvegicus
gagagcacaaggaactggcagcaca

SEQ ID NO: 335599 - DNA, 25 bp, Rattus norvegicus
gagagcacaaggtactggcagcaca

SEQ ID NO: 335600 - DNA, 25 bp, Rattus norvegicus
gagagcacaagtacggactcacctc

SEQ ID NO: 335601 - DNA, 25 bp, Rattus norvegicus
gagagcacaagttcggactcacctc

SEQ ID NO: 335602 - DNA, 25 bp, Rattus norvegicus
gagagcacaatacccttaataatga

SEQ ID NO: 335603 - DNA, 25 bp, Rattus norvegicus
gagagcacaatagccttaataatga

SEQ ID NO: 335604 - DNA, 25 bp, Rattus norvegicus
gagagcacacttagccagttttcac

SEQ ID NO: 335605 - DNA, 25 bp, Rattus norvegicus
gagagcacacttcctgtgagtctag

SEQ ID NO: 335606 - DNA, 25 bp, Rattus norvegicus
gagagcacacttgctgtgagtctag

SEQ ID NO: 335607 - DNA, 25 bp, Rattus norvegicus
gagagcacactttgccagttttcac

SEQ ID NO: 335608 - DNA, 25 bp, Rattus norvegicus
gagagcacagaacctctggctctgt

SEQ ID NO: 335609 - DNA, 25 bp, Rattus norvegicus
gagagcacagaagctctggctctgt

SEQ ID NO: 335610 - DNA, 25 bp, Rattus norvegicus
gagagcacagaccattgcctggcat

SEQ ID NO: 335611 - DNA, 25 bp, Rattus norvegicus
gagagcacagacgattgcctggcat

SEQ ID NO: 335612 - DNA, 25 bp, Rattus norvegicus
gagagcacagttaacaatctgggac

SEQ ID NO: 335613 - DNA, 25 bp, Rattus norvegicus
gagagcacagtttacaatctgggac

SEQ ID NO: 335614 - DNA, 25 bp, Rattus norvegicus
gagagcacccatatggacgttatta

SEQ ID NO: 335615 - DNA, 25 bp, Rattus norvegicus
gagagcacccatttggacgttatta

SEQ ID NO: 335616 - DNA, 25 bp, Rattus norvegicus
gagagcaccgtgatcgaaggattca

SEQ ID NO: 335617 - DNA, 25 bp, Rattus norvegicus
gagagcaccgtgttcgaaggattca

SEQ ID NO: 335618 - DNA, 25 bp, Rattus norvegicus
gagagcactagccacaaacaagaat

SEQ ID NO: 335619 - DNA, 25 bp, Rattus norvegicus
gagagcactagcgacaaacaagaat

SEQ ID NO: 335620 - DNA, 25 bp, Rattus norvegicus
gagagcactgataacatgattgttt

SEQ ID NO: 335621 - DNA, 25 bp, Rattus norvegicus
gagagcactgattacatgattgttt

SEQ ID NO: 335622 - DNA, 25 bp, Rattus norvegicus
gagagcacttcaagttgattcctgc

SEQ ID NO: 335623 - DNA, 25 bp, Rattus norvegicus
gagagcacttcatgttgattcctgc

SEQ ID NO: 335624 - DNA, 25 bp, Rattus norvegicus
gagagcacttgtatattgcagtcat

SEQ ID NO: 335625 - DNA, 25 bp, Rattus norvegicus
gagagcacttgtttattgcagtcat

SEQ ID NO: 335626 - DNA, 25 bp, Rattus norvegicus
gagagcagaactaccttttcgtttg

SEQ ID NO: 335627 - DNA, 25 bp, Rattus norvegicus
gagagcagaacttccttttcgtttg

SEQ ID NO: 335628 - DNA, 25 bp, Rattus norvegicus
gagagcagaggcatcagattcctct

SEQ ID NO: 335629 - DNA, 25 bp, Rattus norvegicus
gagagcagaggcttcagattcctct

SEQ ID NO: 335630 - DNA, 25 bp, Rattus norvegicus
gagagcagagttccaccaggccgtt

SEQ ID NO: 335631 - DNA, 25 bp, Rattus norvegicus
gagagcagagttgcaccaggccgtt

SEQ ID NO: 335632 - DNA, 25 bp, Rattus norvegicus
gagagcagatgaacaaacccctaac

SEQ ID NO: 335633 - DNA, 25 bp, Rattus norvegicus
gagagcagatgatcaaacccctaac

SEQ ID NO: 335634 - DNA, 25 bp, Rattus norvegicus
gagagcagcatcagaagcctcacaa

SEQ ID NO: 335635 - DNA, 25 bp, Rattus norvegicus
gagagcagcatctgaagcctcacaa

SEQ ID NO: 335636 - DNA, 25 bp, Rattus norvegicus
gagagcagccagacatgctacatct

SEQ ID NO: 335637 - DNA, 25 bp, Rattus norvegicus
gagagcagccagtcatgctacatct

SEQ ID NO: 335638 - DNA, 25 bp, Rattus norvegicus
gagagcagccataaatgacatgtac

SEQ ID NO: 335639 - DNA, 25 bp, Rattus norvegicus
gagagcagccattaatgacatgtac

SEQ ID NO: 335640 - DNA, 25 bp, Rattus norvegicus
gagagcagcctgagccacatcatcc

SEQ ID NO: 335641 - DNA, 25 bp, Rattus norvegicus
gagagcagcctgtgccacatcatcc

SEQ ID NO: 335642 - DNA, 25 bp, Rattus norvegicus
gagagcagcgccaggttatctgtga

SEQ ID NO: 335643 - DNA, 25 bp, Rattus norvegicus
gagagcagcgcctggttatctgtga

SEQ ID NO: 335644 - DNA, 25 bp, Rattus norvegicus
gagagcagctgactgcctaaaggat

SEQ ID NO: 335645 - DNA, 25 bp, Rattus norvegicus
gagagcagctgagtgcctaaaggat

SEQ ID NO: 335646 - DNA, 25 bp, Rattus norvegicus
gagagcaggaagaaagcctcactgt

SEQ ID NO: 335647 - DNA, 25 bp, Rattus norvegicus
gagagcaggaagtaagcctcactgt

SEQ ID NO: 335648 - DNA, 25 bp, Rattus norvegicus
gagagcaggattactctgcctcttc

SEQ ID NO: 335649 - DNA, 25 bp, Rattus norvegicus
gagagcaggatttctctgcctcttc

SEQ ID NO: 335650 - DNA, 25 bp, Rattus norvegicus
gagagcaggccgaaaacatctgtgc

SEQ ID NO: 335651 - DNA, 25 bp, Rattus norvegicus
gagagcaggccgtaaacatctgtgc

SEQ ID NO: 335652 - DNA, 25 bp, Rattus norvegicus
gagagcaggcttaggcgaccacagt

SEQ ID NO: 335653 - DNA, 25 bp, Rattus norvegicus
gagagcaggcttagttctcctgtga

SEQ ID NO: 335654 - DNA, 25 bp, Rattus norvegicus
gagagcaggctttggcgaccacagt

SEQ ID NO: 335655 - DNA, 25 bp, Rattus norvegicus
gagagcaggctttgttctcctgtga

SEQ ID NO: 335656 - DNA, 25 bp, Rattus norvegicus
gagagcagggccctccaatgatttc

SEQ ID NO: 335657 - DNA, 25 bp, Rattus norvegicus
gagagcagggccgtccaatgatttc

SEQ ID NO: 335658 - DNA, 25 bp, Rattus norvegicus
gagagcagggtacactcacatccac

SEQ ID NO: 335659 - DNA, 25 bp, Rattus norvegicus
gagagcagggtagactcacatccac

SEQ ID NO: 335660 - DNA, 25 bp, Rattus norvegicus
gagagcaggttaccctccgccttaa

SEQ ID NO: 335661 - DNA, 25 bp, Rattus norvegicus
gagagcaggttagcctccgccttaa

SEQ ID NO: 335662 - DNA, 25 bp, Rattus norvegicus
gagagcagtcacattacttaccaat

SEQ ID NO: 335663 - DNA, 25 bp, Rattus norvegicus
gagagcagtcactttacttaccaat

SEQ ID NO: 335664 - DNA, 25 bp, Rattus norvegicus
gagagcagtgcgaagagtcctttgt

SEQ ID NO: 335665 - DNA, 25 bp, Rattus norvegicus
gagagcagtgcgtagagtcctttgt

SEQ ID NO: 335666 - DNA, 25 bp, Rattus norvegicus
gagagcatacaaccactactttgat

SEQ ID NO: 335667 - DNA, 25 bp, Rattus norvegicus
gagagcatacaagcactactttgat

SEQ ID NO: 335668 - DNA, 25 bp, Rattus norvegicus
gagagcatacataccaagccttgat

SEQ ID NO: 335669 - DNA, 25 bp, Rattus norvegicus
gagagcatacatcagcagctggaca

SEQ ID NO: 335670 - DNA, 25 bp, Rattus norvegicus
gagagcatacatgagcagctggaca

SEQ ID NO: 335671 - DNA, 25 bp, Rattus norvegicus
gagagcatacattccaagccttgat

SEQ ID NO: 335672 - DNA, 25 bp, Rattus norvegicus
gagagcataggcacacccaagaggt

SEQ ID NO: 335673 - DNA, 25 bp, Rattus norvegicus
gagagcataggctcacccaagaggt

SEQ ID NO: 335674 - DNA, 25 bp, Rattus norvegicus
gagagcatcaagcaatgtgtcgaca

SEQ ID NO: 335675 - DNA, 25 bp, Rattus norvegicus
gagagcatcaaggaatgtgtcgaca

SEQ ID NO: 335676 - DNA, 25 bp, Rattus norvegicus
gagagcatcatcagtggcatcacgt

SEQ ID NO: 335677 - DNA, 25 bp, Rattus norvegicus
gagagcatcatctgtggcatcacgt

SEQ ID NO: 335678 - DNA, 25 bp, Rattus norvegicus
gagagcatccagctcctagaggaat

SEQ ID NO: 335679 - DNA, 25 bp, Rattus norvegicus
gagagcatccaggtcctagaggaat

SEQ ID NO: 335680 - DNA, 25 bp, Rattus norvegicus
gagagcatccataaccaaactgact

SEQ ID NO: 335681 - DNA, 25 bp, Rattus norvegicus
gagagcatccattaccaaactgact

SEQ ID NO: 335682 - DNA, 25 bp, Rattus norvegicus
gagagcatccccaatgcagaccggg

SEQ ID NO: 335683 - DNA, 25 bp, Rattus norvegicus
gagagcatcccctatgcagaccggg

SEQ ID NO: 335684 - DNA, 25 bp, Rattus norvegicus
gagagcatcctgcattacttccggc

SEQ ID NO: 335685 - DNA, 25 bp, Rattus norvegicus
gagagcatcctggattacttccggc

SEQ ID NO: 335686 - DNA, 25 bp, Rattus norvegicus
gagagcatcgggagcagctaccagt

SEQ ID NO: 335687 - DNA, 25 bp, Rattus norvegicus
gagagcatcgggtgcagctaccagt

SEQ ID NO: 335688 - DNA, 25 bp, Rattus norvegicus
gagagcatcgtacatgcctctgtaa

SEQ ID NO: 335689 - DNA, 25 bp, Rattus norvegicus
gagagcatcgtagatgcctctgtaa

SEQ ID NO: 335690 - DNA, 25 bp, Rattus norvegicus
gagagcatctcaccatggtaccaaa

SEQ ID NO: 335691 - DNA, 25 bp, Rattus norvegicus
gagagcatctcagcatggtaccaaa

SEQ ID NO: 335692 - DNA, 25 bp, Rattus norvegicus
gagagcatctttccagatggcacaa

SEQ ID NO: 335693 - DNA, 25 bp, Rattus norvegicus
gagagcatctttgcagatggcacaa

SEQ ID NO: 335694 - DNA, 25 bp, Rattus norvegicus
gagagcatgagcagcctgattgtca

SEQ ID NO: 335695 - DNA, 25 bp, Rattus norvegicus
gagagcatgagctgcctgattgtca

SEQ ID NO: 335696 - DNA, 25 bp, Rattus norvegicus
gagagcatgcaaaggcccgcgtcga

SEQ ID NO: 335697 - DNA, 25 bp, Rattus norvegicus
gagagcatgcaatggcccgcgtcga

SEQ ID NO: 335698 - DNA, 25 bp, Rattus norvegicus
gagagcatgcctctagctgaagaat

SEQ ID NO: 335699 - DNA, 25 bp, Rattus norvegicus
gagagcatgcctgtagctgaagaat

SEQ ID NO: 335700 - DNA, 25 bp, Rattus norvegicus
gagagcatgctcagtcctggcttct

SEQ ID NO: 335701 - DNA, 25 bp, Rattus norvegicus
gagagcatgctctgtcctggcttct

SEQ ID NO: 335702 - DNA, 25 bp, Rattus norvegicus
gagagcatgcttataatgacatcca

SEQ ID NO: 335703 - DNA, 25 bp, Rattus norvegicus
gagagcatgcttttaatgacatcca

SEQ ID NO: 335704 - DNA, 25 bp, Rattus norvegicus
gagagcattagtacaactccaaaat

SEQ ID NO: 335705 - DNA, 25 bp, Rattus norvegicus
gagagcattagttcaactccaaaat

SEQ ID NO: 335706 - DNA, 25 bp, Rattus norvegicus
gagagcattcaaagccggccgaaga

SEQ ID NO: 335707 - DNA, 25 bp, Rattus norvegicus
gagagcattcaaagtgaactccaca

SEQ ID NO: 335708 - DNA, 25 bp, Rattus norvegicus
gagagcattcaatgccggccgaaga

SEQ ID NO: 335709 - DNA, 25 bp, Rattus norvegicus
gagagcattcaatgtgaactccaca

SEQ ID NO: 335710 - DNA, 25 bp, Rattus norvegicus
gagagcattcagatcaccttggtaa

SEQ ID NO: 335711 - DNA, 25 bp, Rattus norvegicus
gagagcattcagttcaccttggtaa

SEQ ID NO: 335712 - DNA, 25 bp, Rattus norvegicus
gagagcattcataatgtacttcgag

SEQ ID NO: 335713 - DNA, 25 bp, Rattus norvegicus
gagagcattcattatgtacttcgag

SEQ ID NO: 335714 - DNA, 25 bp, Rattus norvegicus
gagagcattgagcatgtcatcatag

SEQ ID NO: 335715 - DNA, 25 bp, Rattus norvegicus
gagagcattgaggatgtcatcatag

SEQ ID NO: 335716 - DNA, 25 bp, Rattus norvegicus
gagagcatttctaatgacttatttc

SEQ ID NO: 335717 - DNA, 25 bp, Rattus norvegicus
gagagcatttcttatgacttatttc

SEQ ID NO: 335718 - DNA, 25 bp, Rattus norvegicus
gagagccaaactatactgaggaatt

SEQ ID NO: 335719 - DNA, 25 bp, Rattus norvegicus
gagagccaaactttactgaggaatt

SEQ ID NO: 335720 - DNA, 25 bp, Rattus norvegicus
gagagccaaagcctagttccggaag

SEQ ID NO: 335721 - DNA, 25 bp, Rattus norvegicus
gagagccaaagcgtagttccggaag

SEQ ID NO: 335722 - DNA, 25 bp, Rattus norvegicus
gagagccaacatatcctttgctttg

SEQ ID NO: 335723 - DNA, 25 bp, Rattus norvegicus
gagagccaacatttcctttgctttg

SEQ ID NO: 335724 - DNA, 25 bp, Rattus norvegicus
gagagccaagccaacttgaatttag

SEQ ID NO: 335725 - DNA, 25 bp, Rattus norvegicus
gagagccaagcctacttgaatttag

SEQ ID NO: 335726 - DNA, 25 bp, Rattus norvegicus
gagagccaagctaccaaagagtaca

SEQ ID NO: 335727 - DNA, 25 bp, Rattus norvegicus
gagagccaagcttccaaagagtaca

SEQ ID NO: 335728 - DNA, 25 bp, Rattus norvegicus
gagagccaagttcagctgagactgc

SEQ ID NO: 335729 - DNA, 25 bp, Rattus norvegicus
gagagccaagttgagctgagactgc

SEQ ID NO: 335730 - DNA, 25 bp, Rattus norvegicus
gagagccacactcagaggatccctg

SEQ ID NO: 335731 - DNA, 25 bp, Rattus norvegicus
gagagccacactgagaggatccctg

SEQ ID NO: 335732 - DNA, 25 bp, Rattus norvegicus
gagagccacagtcttacttggtgaa

SEQ ID NO: 335733 - DNA, 25 bp, Rattus norvegicus
gagagccacagtgttacttggtgaa

SEQ ID NO: 335734 - DNA, 25 bp, Rattus norvegicus
gagagccacatcctgttgactgaga

SEQ ID NO: 335735 - DNA, 25 bp, Rattus norvegicus
gagagccacatcgtgttgactgaga

SEQ ID NO: 335736 - DNA, 25 bp, Rattus norvegicus
gagagccacattcttcaggtgctta

SEQ ID NO: 335737 - DNA, 25 bp, Rattus norvegicus
gagagccacattgttcaggtgctta

SEQ ID NO: 335738 - DNA, 25 bp, Rattus norvegicus
gagagccaccacaagcctaagggaa

SEQ ID NO: 335739 - DNA, 25 bp, Rattus norvegicus
gagagccaccactagcctaagggaa

SEQ ID NO: 335740 - DNA, 25 bp, Rattus norvegicus
gagagccacccaaacacaggcagga

SEQ ID NO: 335741 - DNA, 25 bp, Rattus norvegicus
gagagccacccatacacaggcagga

SEQ ID NO: 335742 - DNA, 25 bp, Rattus norvegicus
gagagccacgcgaatgagtcatact

SEQ ID NO: 335743 - DNA, 25 bp, Rattus norvegicus
gagagccacgcgtatgagtcatact

SEQ ID NO: 335744 - DNA, 25 bp, Rattus norvegicus
gagagccagaatccttatcacctac

SEQ ID NO: 335745 - DNA, 25 bp, Rattus norvegicus
gagagccagaatgcttatcacctac

SEQ ID NO: 335746 - DNA, 25 bp, Rattus norvegicus
gagagccagagaaaggacttgccaa

SEQ ID NO: 335747 - DNA, 25 bp, Rattus norvegicus
gagagccagagacttcagcagaaac

SEQ ID NO: 335748 - DNA, 25 bp, Rattus norvegicus
gagagccagagagttcagcagaaac

SEQ ID NO: 335749 - DNA, 25 bp, Rattus norvegicus
gagagccagagataggacttgccaa

SEQ ID NO: 335750 - DNA, 25 bp, Rattus norvegicus
gagagccaggacattccctaggaga

SEQ ID NO: 335751 - DNA, 25 bp, Rattus norvegicus
gagagccaggactttccctaggaga

SEQ ID NO: 335752 - DNA, 25 bp, Rattus norvegicus
gagagccaggttcggaactagccaa

SEQ ID NO: 335753 - DNA, 25 bp, Rattus norvegicus
gagagccaggttgggaactagccaa

SEQ ID NO: 335754 - DNA, 25 bp, Rattus norvegicus
gagagccagtagagaatcccctcat

SEQ ID NO: 335755 - DNA, 25 bp, Rattus norvegicus
gagagccagtagtgaatcccctcat

SEQ ID NO: 335756 - DNA, 25 bp, Rattus norvegicus
gagagccagtttagcactagctgct

SEQ ID NO: 335757 - DNA, 25 bp, Rattus norvegicus
gagagccagttttgcactagctgct

SEQ ID NO: 335758 - DNA, 25 bp, Rattus norvegicus
gagagccatattaacactttccaat

SEQ ID NO: 335759 - DNA, 25 bp, Rattus norvegicus
gagagccatatttacactttccaat

SEQ ID NO: 335760 - DNA, 25 bp, Rattus norvegicus
gagagccatcaaactgtgggccaaa

SEQ ID NO: 335761 - DNA, 25 bp, Rattus norvegicus
gagagccatcaaccatgctgttgtg

SEQ ID NO: 335762 - DNA, 25 bp, Rattus norvegicus
gagagccatcaagcatgctgttgtg

SEQ ID NO: 335763 - DNA, 25 bp, Rattus norvegicus
gagagccatcaatctgtgggccaaa

SEQ ID NO: 335764 - DNA, 25 bp, Rattus norvegicus
gagagccatcagatagctatcagaa

SEQ ID NO: 335765 - DNA, 25 bp, Rattus norvegicus
gagagccatcagcttatcatgtcct

SEQ ID NO: 335766 - DNA, 25 bp, Rattus norvegicus
gagagccatcaggttatcatgtcct

SEQ ID NO: 335767 - DNA, 25 bp, Rattus norvegicus
gagagccatcagttagctatcagaa

SEQ ID NO: 335768 - DNA, 25 bp, Rattus norvegicus
gagagccatgaacgctttctaatga

SEQ ID NO: 335769 - DNA, 25 bp, Rattus norvegicus
gagagccatgaaggctttctaatga

SEQ ID NO: 335770 - DNA, 25 bp, Rattus norvegicus
gagagccatgccctttaaaacagct

SEQ ID NO: 335771 - DNA, 25 bp, Rattus norvegicus
gagagccatgccgtttaaaacagct

SEQ ID NO: 335772 - DNA, 25 bp, Rattus norvegicus
gagagccatgctcccactgacaagt

SEQ ID NO: 335773 - DNA, 25 bp, Rattus norvegicus
gagagccatgctgccactgacaagt

SEQ ID NO: 335774 - DNA, 25 bp, Rattus norvegicus
gagagccatgtcactcaatatgctg

SEQ ID NO: 335775 - DNA, 25 bp, Rattus norvegicus
gagagccatgtctctcaatatgctg

SEQ ID NO: 335776 - DNA, 25 bp, Rattus norvegicus
gagagccattcccagcaagctagaa

SEQ ID NO: 335777 - DNA, 25 bp, Rattus norvegicus
gagagccattccgagcaagctagaa

SEQ ID NO: 335778 - DNA, 25 bp, Rattus norvegicus
gagagcccaacaagcaaatcctgta

SEQ ID NO: 335779 - DNA, 25 bp, Rattus norvegicus
gagagcccaacatgcaaatcctgta

SEQ ID NO: 335780 - DNA, 25 bp, Rattus norvegicus
gagagcccaagacctgccacagagc

SEQ ID NO: 335781 - DNA, 25 bp, Rattus norvegicus
gagagcccaagagctgccacagagc

SEQ ID NO: 335782 - DNA, 25 bp, Rattus norvegicus
gagagcccaatcacctggctttaga

SEQ ID NO: 335783 - DNA, 25 bp, Rattus norvegicus
gagagcccaatctcctggctttaga

SEQ ID NO: 335784 - DNA, 25 bp, Rattus norvegicus
gagagcccacagacaccaatgttct

SEQ ID NO: 335785 - DNA, 25 bp, Rattus norvegicus
gagagcccacagtcaccaatgttct

SEQ ID NO: 335786 - DNA, 25 bp, Rattus norvegicus
gagagcccagacagtatgttcatat

SEQ ID NO: 335787 - DNA, 25 bp, Rattus norvegicus
gagagcccagactgtatgttcatat

SEQ ID NO: 335788 - DNA, 25 bp, Rattus norvegicus
gagagcccaggtattaatattgtta

SEQ ID NO: 335789 - DNA, 25 bp, Rattus norvegicus
gagagcccaggttttaatattgtta

SEQ ID NO: 335790 - DNA, 25 bp, Rattus norvegicus
gagagcccagtaacctgctttgaaa

SEQ ID NO: 335791 - DNA, 25 bp, Rattus norvegicus
gagagcccagtactcagtgcgagtc

SEQ ID NO: 335792 - DNA, 25 bp, Rattus norvegicus
gagagcccagtagtcagtgcgagtc

SEQ ID NO: 335793 - DNA, 25 bp, Rattus norvegicus
gagagcccagtatcctgctttgaaa

SEQ ID NO: 335794 - DNA, 25 bp, Rattus norvegicus
gagagcccatgaactcttaggcagt

SEQ ID NO: 335795 - DNA, 25 bp, Rattus norvegicus
gagagcccatgatctcttaggcagt

SEQ ID NO: 335796 - DNA, 25 bp, Rattus norvegicus
gagagcccatttccttgattgtata

SEQ ID NO: 335797 - DNA, 25 bp, Rattus norvegicus
gagagcccatttgcttgattgtata

SEQ ID NO: 335798 - DNA, 25 bp, Rattus norvegicus
gagagccccatacaagtcatcactg

SEQ ID NO: 335799 - DNA, 25 bp, Rattus norvegicus
gagagccccatagaagtcatcactg

SEQ ID NO: 335800 - DNA, 25 bp, Rattus norvegicus
gagagccccttaaagtgtacagcct

SEQ ID NO: 335801 - DNA, 25 bp, Rattus norvegicus
gagagccccttatagtgtacagcct

SEQ ID NO: 335802 - DNA, 25 bp, Rattus norvegicus
gagagccctgcgaagcctgtggcca

SEQ ID NO: 335803 - DNA, 25 bp, Rattus norvegicus
gagagccctgcgtagcctgtggcca

SEQ ID NO: 335804 - DNA, 25 bp, Rattus norvegicus
gagagccctggaacattgagtgaat

SEQ ID NO: 335805 - DNA, 25 bp, Rattus norvegicus
gagagccctggatcattgagtgaat

SEQ ID NO: 335806 - DNA, 25 bp, Rattus norvegicus
gagagcccttttacttaaacacgat

SEQ ID NO: 335807 - DNA, 25 bp, Rattus norvegicus
gagagccctttttcttaaacacgat

SEQ ID NO: 335808 - DNA, 25 bp, Rattus norvegicus
gagagccgaactcttggagcagcaa

SEQ ID NO: 335809 - DNA, 25 bp, Rattus norvegicus
gagagccgaactgttggagcagcaa

SEQ ID NO: 335810 - DNA, 25 bp, Rattus norvegicus
gagagccgagaactaaccacatatc

SEQ ID NO: 335811 - DNA, 25 bp, Rattus norvegicus
gagagccgagaagtaaccacatatc

SEQ ID NO: 335812 - DNA, 25 bp, Rattus norvegicus
gagagccgagctacttgcttaacca

SEQ ID NO: 335813 - DNA, 25 bp, Rattus norvegicus
gagagccgagctcttggacttcctt

SEQ ID NO: 335814 - DNA, 25 bp, Rattus norvegicus
gagagccgagctgttggacttcctt

SEQ ID NO: 335815 - DNA, 25 bp, Rattus norvegicus
gagagccgagcttcttgcttaacca

SEQ ID NO: 335816 - DNA, 25 bp, Rattus norvegicus
gagagccgagtcctacagaatacca

SEQ ID NO: 335817 - DNA, 25 bp, Rattus norvegicus
gagagccgagtcgtacagaatacca

SEQ ID NO: 335818 - DNA, 25 bp, Rattus norvegicus
gagagccgcctcagaatgccagcat

SEQ ID NO: 335819 - DNA, 25 bp, Rattus norvegicus
gagagccgcctctgaatgccagcat

SEQ ID NO: 335820 - DNA, 25 bp, Rattus norvegicus
gagagccgcgcgctgggcaagagta

SEQ ID NO: 335821 - DNA, 25 bp, Rattus norvegicus
gagagccgcgcggtgggcaagagta

SEQ ID NO: 335822 - DNA, 25 bp, Rattus norvegicus
gagagccggtctcagtgaagccact

SEQ ID NO: 335823 - DNA, 25 bp, Rattus norvegicus
gagagccggtctgagtgaagccact

SEQ ID NO: 335824 - DNA, 25 bp, Rattus norvegicus
gagagccgtgctattctgaaatgtc

SEQ ID NO: 335825 - DNA, 25 bp, Rattus norvegicus
gagagccgtgcttttctgaaatgtc

SEQ ID NO: 335826 - DNA, 25 bp, Rattus norvegicus
gagagcctaatgcaagtgtgccttg

SEQ ID NO: 335827 - DNA, 25 bp, Rattus norvegicus
gagagcctaatggaagtgtgccttg

SEQ ID NO: 335828 - DNA, 25 bp, Rattus norvegicus
gagagcctaccccatggacctgaaa

SEQ ID NO: 335829 - DNA, 25 bp, Rattus norvegicus
gagagcctacccgatggacctgaaa

SEQ ID NO: 335830 - DNA, 25 bp, Rattus norvegicus
gagagcctactaaatgccagagaat

SEQ ID NO: 335831 - DNA, 25 bp, Rattus norvegicus
gagagcctactatatgccagagaat

SEQ ID NO: 335832 - DNA, 25 bp, Rattus norvegicus
gagagcctactcagtatgtcaagaa

SEQ ID NO: 335833 - DNA, 25 bp, Rattus norvegicus
gagagcctactctgtatgtcaagaa

SEQ ID NO: 335834 - DNA, 25 bp, Rattus norvegicus
gagagcctcaaacgtcatgtgaaaa

SEQ ID NO: 335835 - DNA, 25 bp, Rattus norvegicus
gagagcctcaaaggtcatgtgaaaa

SEQ ID NO: 335836 - DNA, 25 bp, Rattus norvegicus
gagagcctcaagagctgcaccagga

SEQ ID NO: 335837 - DNA, 25 bp, Rattus norvegicus
gagagcctcaagtgctgcaccagga

SEQ ID NO: 335838 - DNA, 25 bp, Rattus norvegicus
gagagcctcagaacttccagagaca

SEQ ID NO: 335839 - DNA, 25 bp, Rattus norvegicus
gagagcctcagacatcaagcagcac

SEQ ID NO: 335840 - DNA, 25 bp, Rattus norvegicus
gagagcctcagagatcaagcagcac

SEQ ID NO: 335841 - DNA, 25 bp, Rattus norvegicus
gagagcctcagatcttccagagaca

SEQ ID NO: 335842 - DNA, 25 bp, Rattus norvegicus
gagagcctcatgcacagctaaactg

SEQ ID NO: 335843 - DNA, 25 bp, Rattus norvegicus
gagagcctcatgcagtcctctgtgg

SEQ ID NO: 335844 - DNA, 25 bp, Rattus norvegicus
gagagcctcatggacagctaaactg

SEQ ID NO: 335845 - DNA, 25 bp, Rattus norvegicus
gagagcctcatggagtcctctgtgg

SEQ ID NO: 335846 - DNA, 25 bp, Rattus norvegicus
gagagcctcattcgcaggagttcca

SEQ ID NO: 335847 - DNA, 25 bp, Rattus norvegicus
gagagcctcattggcaggagttcca

SEQ ID NO: 335848 - DNA, 25 bp, Rattus norvegicus
gagagcctccaacgttgtcctctgg

SEQ ID NO: 335849 - DNA, 25 bp, Rattus norvegicus
gagagcctccaaggttgtcctctgg

SEQ ID NO: 335850 - DNA, 25 bp, Rattus norvegicus
gagagcctcccgcattatgatgaga

SEQ ID NO: 335851 - DNA, 25 bp, Rattus norvegicus
gagagcctcccggattatgatgaga

SEQ ID NO: 335852 - DNA, 25 bp, Rattus norvegicus
gagagcctccctagctccatacgga

SEQ ID NO: 335853 - DNA, 25 bp, Rattus norvegicus
gagagcctcccttgctccatacgga

SEQ ID NO: 335854 - DNA, 25 bp, Rattus norvegicus
gagagcctgagcacggtgctcactg

SEQ ID NO: 335855 - DNA, 25 bp, Rattus norvegicus
gagagcctgagctcggtgctcactg

SEQ ID NO: 335856 - DNA, 25 bp, Rattus norvegicus
gagagcctgagtaggcattcgtata

SEQ ID NO: 335857 - DNA, 25 bp, Rattus norvegicus
gagagcctgagttggcattcgtata

SEQ ID NO: 335858 - DNA, 25 bp, Rattus norvegicus
gagagcctgatgctcaacttgcaat

SEQ ID NO: 335859 - DNA, 25 bp, Rattus norvegicus
gagagcctgatggtcaacttgcaat

SEQ ID NO: 335860 - DNA, 25 bp, Rattus norvegicus
gagagcctgcaaaaaacagtatttg

SEQ ID NO: 335861 - DNA, 25 bp, Rattus norvegicus
gagagcctgcaataaacagtatttg

SEQ ID NO: 335862 - DNA, 25 bp, Rattus norvegicus
gagagcctgcagactctgtttctgt

SEQ ID NO: 335863 - DNA, 25 bp, Rattus norvegicus
gagagcctgcagtctctgtttctgt

SEQ ID NO: 335864 - DNA, 25 bp, Rattus norvegicus
gagagcctgcccatagttagctaaa

SEQ ID NO: 335865 - DNA, 25 bp, Rattus norvegicus
gagagcctgcccttagttagctaaa

SEQ ID NO: 335866 - DNA, 25 bp, Rattus norvegicus
gagagcctgcctcagaatgcaaggt

SEQ ID NO: 335867 - DNA, 25 bp, Rattus norvegicus
gagagcctgcctcagtaggaaaact

SEQ ID NO: 335868 - DNA, 25 bp, Rattus norvegicus
gagagcctgcctgagaatgcaaggt

SEQ ID NO: 335869 - DNA, 25 bp, Rattus norvegicus
gagagcctgcctgagtaggaaaact

SEQ ID NO: 335870 - DNA, 25 bp, Rattus norvegicus
gagagcctgctgctcagagcttagc

SEQ ID NO: 335871 - DNA, 25 bp, Rattus norvegicus
gagagcctgctggtcagagcttagc

SEQ ID NO: 335872 - DNA, 25 bp, Rattus norvegicus
gagagcctggcaatccataggaccg

SEQ ID NO: 335873 - DNA, 25 bp, Rattus norvegicus
gagagcctggcattccataggaccg

SEQ ID NO: 335874 - DNA, 25 bp, Rattus norvegicus
gagagcctgtccctcccacaagagg

SEQ ID NO: 335875 - DNA, 25 bp, Rattus norvegicus
gagagcctgtccgtcccacaagagg

SEQ ID NO: 335876 - DNA, 25 bp, Rattus norvegicus
gagagcctgtttcgaggttctagca

SEQ ID NO: 335877 - DNA, 25 bp, Rattus norvegicus
gagagcctgtttggaggttctagca

SEQ ID NO: 335878 - DNA, 25 bp, Rattus norvegicus
gagagccttaccattgatgtctgaa

SEQ ID NO: 335879 - DNA, 25 bp, Rattus norvegicus
gagagccttacctttgatgtctgaa

SEQ ID NO: 335880 - DNA, 25 bp, Rattus norvegicus
gagagccttcatcctggaggagctt

SEQ ID NO: 335881 - DNA, 25 bp, Rattus norvegicus
gagagccttcatgctggaggagctt

SEQ ID NO: 335882 - DNA, 25 bp, Rattus norvegicus
gagagccttctaagctgagcttcat

SEQ ID NO: 335883 - DNA, 25 bp, Rattus norvegicus
gagagccttctatgctgagcttcat

SEQ ID NO: 335884 - DNA, 25 bp, Rattus norvegicus
gagagcctttgtcctttgctcgcaa

SEQ ID NO: 335885 - DNA, 25 bp, Rattus norvegicus
gagagcctttgtgctttgctcgcaa

SEQ ID NO: 335886 - DNA, 25 bp, Rattus norvegicus
gagagcgacagcatggatccgttca

SEQ ID NO: 335887 - DNA, 25 bp, Rattus norvegicus
gagagcgacagcttggatccgttca

SEQ ID NO: 335888 - DNA, 25 bp, Rattus norvegicus
gagagcgagagaagcataaggacaa

SEQ ID NO: 335889 - DNA, 25 bp, Rattus norvegicus
gagagcgagagatgcataaggacaa

SEQ ID NO: 335890 - DNA, 25 bp, Rattus norvegicus
gagagcgagctcacctaaacaccat

SEQ ID NO: 335891 - DNA, 25 bp, Rattus norvegicus
gagagcgagctctcctaaacaccat

SEQ ID NO: 335892 - DNA, 25 bp, Rattus norvegicus
gagagcgaggacaaaatatgtgaaa

SEQ ID NO: 335893 - DNA, 25 bp, Rattus norvegicus
gagagcgaggactaaatatgtgaaa

SEQ ID NO: 335894 - DNA, 25 bp, Rattus norvegicus
gagagcgagtataactagcactgat

SEQ ID NO: 335895 - DNA, 25 bp, Rattus norvegicus
gagagcgagtattactagcactgat

SEQ ID NO: 335896 - DNA, 25 bp, Rattus norvegicus
gagagcgcacgcctttaggaacatc

SEQ ID NO: 335897 - DNA, 25 bp, Rattus norvegicus
gagagcgcacgcgtttaggaacatc

SEQ ID NO: 335898 - DNA, 25 bp, Rattus norvegicus
gagagcgcactgaggtccagacaga

SEQ ID NO: 335899 - DNA, 25 bp, Rattus norvegicus
gagagcgcactgtggtccagacaga

SEQ ID NO: 335900 - DNA, 25 bp, Rattus norvegicus
gagagcgccaacaaccagtgggctc

SEQ ID NO: 335901 - DNA, 25 bp, Rattus norvegicus
gagagcgccaactaccagtgggctc

SEQ ID NO: 335902 - DNA, 25 bp, Rattus norvegicus
gagagcgcgtcccacctggaagtca

SEQ ID NO: 335903 - DNA, 25 bp, Rattus norvegicus
gagagcgcgtccgacctggaagtca

SEQ ID NO: 335904 - DNA, 25 bp, Rattus norvegicus
gagagcgctcacactaaacacctgg

SEQ ID NO: 335905 - DNA, 25 bp, Rattus norvegicus
gagagcgctcactctaaacacctgg

SEQ ID NO: 335906 - DNA, 25 bp, Rattus norvegicus
gagagcgctgccaagcagacctgga

SEQ ID NO: 335907 - DNA, 25 bp, Rattus norvegicus
gagagcgctgcctagcagacctgga

SEQ ID NO: 335908 - DNA, 25 bp, Rattus norvegicus
gagagcggaaggatttcagtatctt

SEQ ID NO: 335909 - DNA, 25 bp, Rattus norvegicus
gagagcggaaggttttcagtatctt

SEQ ID NO: 335910 - DNA, 25 bp, Rattus norvegicus
gagagcggattccacagcgcatgaa

SEQ ID NO: 335911 - DNA, 25 bp, Rattus norvegicus
gagagcggattcgacagcgcatgaa

SEQ ID NO: 335912 - DNA, 25 bp, Rattus norvegicus
gagagcggccaaacacatccaaaga

SEQ ID NO: 335913 - DNA, 25 bp, Rattus norvegicus
gagagcggccaatcacatccaaaga

SEQ ID NO: 335914 - DNA, 25 bp, Rattus norvegicus
gagagcggccttcaattgttgaaat

SEQ ID NO: 335915 - DNA, 25 bp, Rattus norvegicus
gagagcggccttgaattgttgaaat

SEQ ID NO: 335916 - DNA, 25 bp, Rattus norvegicus
gagagcgggtacaacaagtgcgcca

SEQ ID NO: 335917 - DNA, 25 bp, Rattus norvegicus
gagagcgggtactacaagtgcgcca

SEQ ID NO: 335918 - DNA, 25 bp, Rattus norvegicus
gagagcggtgccatcctgtcaggat

SEQ ID NO: 335919 - DNA, 25 bp, Rattus norvegicus
gagagcggtgccttcctgtcaggat

SEQ ID NO: 335920 - DNA, 25 bp, Rattus norvegicus
gagagcggttacctccccgagtaga

SEQ ID NO: 335921 - DNA, 25 bp, Rattus norvegicus
gagagcggttacgtccccgagtaga

SEQ ID NO: 335922 - DNA, 25 bp, Rattus norvegicus
gagagcggttttcacacagaagcct

SEQ ID NO: 335923 - DNA, 25 bp, Rattus norvegicus
gagagcggttttgacacagaagcct

SEQ ID NO: 335924 - DNA, 25 bp, Rattus norvegicus
gagagcgtcaggcttgtccagccat

SEQ ID NO: 335925 - DNA, 25 bp, Rattus norvegicus
gagagcgtcagggttgtccagccat

SEQ ID NO: 335926 - DNA, 25 bp, Rattus norvegicus
gagagcgtcctcagggaattcatcc

SEQ ID NO: 335927 - DNA, 25 bp, Rattus norvegicus
gagagcgtcctctgggaattcatcc

SEQ ID NO: 335928 - DNA, 25 bp, Rattus norvegicus
gagagcgtgcccaacgtcgaggaac

SEQ ID NO: 335929 - DNA, 25 bp, Rattus norvegicus
gagagcgtgccctacgtcgaggaac

SEQ ID NO: 335930 - DNA, 25 bp, Rattus norvegicus
gagagcgtggagaacctgccctacc

SEQ ID NO: 335931 - DNA, 25 bp, Rattus norvegicus
gagagcgtggagtacctgccctacc

SEQ ID NO: 335932 - DNA, 25 bp, Rattus norvegicus
gagagcgtggttctgtcttcaatac

SEQ ID NO: 335933 - DNA, 25 bp, Rattus norvegicus
gagagcgtggttgtgtcttcaatac

SEQ ID NO: 335934 - DNA, 25 bp, Rattus norvegicus
gagagcgttgtaaaccgtctagtgc

SEQ ID NO: 335935 - DNA, 25 bp, Rattus norvegicus
gagagcgttgtataccgtctagtgc

SEQ ID NO: 335936 - DNA, 25 bp, Rattus norvegicus
gagagctaaacaccactcggacagg

SEQ ID NO: 335937 - DNA, 25 bp, Rattus norvegicus
gagagctaaacagcactcggacagg

SEQ ID NO: 335938 - DNA, 25 bp, Rattus norvegicus
gagagctaaccaatgcttacattgt

SEQ ID NO: 335939 - DNA, 25 bp, Rattus norvegicus
gagagctaaccattgcttacattgt

SEQ ID NO: 335940 - DNA, 25 bp, Rattus norvegicus
gagagctaagtcacttcctgatgtc

SEQ ID NO: 335941 - DNA, 25 bp, Rattus norvegicus
gagagctaagtctcttcctgatgtc

SEQ ID NO: 335942 - DNA, 25 bp, Rattus norvegicus
gagagctaatttcgcccaagcctgg

SEQ ID NO: 335943 - DNA, 25 bp, Rattus norvegicus
gagagctaatttggcccaagcctgg

SEQ ID NO: 335944 - DNA, 25 bp, Rattus norvegicus
gagagctacattagaagcctgtaca

SEQ ID NO: 335945 - DNA, 25 bp, Rattus norvegicus
gagagctacatttgaagcctgtaca

SEQ ID NO: 335946 - DNA, 25 bp, Rattus norvegicus
gagagctaccacagtactatatcta

SEQ ID NO: 335947 - DNA, 25 bp, Rattus norvegicus
gagagctaccactgtactatatcta

SEQ ID NO: 335948 - DNA, 25 bp, Rattus norvegicus
gagagctaccagaggcagccctaat

SEQ ID NO: 335949 - DNA, 25 bp, Rattus norvegicus
gagagctaccagtggcagccctaat

SEQ ID NO: 335950 - DNA, 25 bp, Rattus norvegicus
gagagctacgaccatgtctccagct

SEQ ID NO: 335951 - DNA, 25 bp, Rattus norvegicus
gagagctacgacgatgtctccagct

SEQ ID NO: 335952 - DNA, 25 bp, Rattus norvegicus
gagagctactcgagccgcgactacc

SEQ ID NO: 335953 - DNA, 25 bp, Rattus norvegicus
gagagctactcgtgccgcgactacc

SEQ ID NO: 335954 - DNA, 25 bp, Rattus norvegicus
gagagctactgaagcatcctgtctt

SEQ ID NO: 335955 - DNA, 25 bp, Rattus norvegicus
gagagctactgatgcatcctgtctt

SEQ ID NO: 335956 - DNA, 25 bp, Rattus norvegicus
gagagctactgcagcaactgatcgt

SEQ ID NO: 335957 - DNA, 25 bp, Rattus norvegicus
gagagctactgctgcaactgatcgt

SEQ ID NO: 335958 - DNA, 25 bp, Rattus norvegicus
gagagctagcgaatacaccgttcag

SEQ ID NO: 335959 - DNA, 25 bp, Rattus norvegicus
gagagctagcgattacaccgttcag

SEQ ID NO: 335960 - DNA, 25 bp, Rattus norvegicus
gagagctaggtcactgctggattct

SEQ ID NO: 335961 - DNA, 25 bp, Rattus norvegicus
gagagctaggtctctgctggattct

SEQ ID NO: 335962 - DNA, 25 bp, Rattus norvegicus
gagagctagtctacatgttgtgcag

SEQ ID NO: 335963 - DNA, 25 bp, Rattus norvegicus
gagagctagtcttcatgttgtgcag

SEQ ID NO: 335964 - DNA, 25 bp, Rattus norvegicus
gagagctatatacggctgttgcagc

SEQ ID NO: 335965 - DNA, 25 bp, Rattus norvegicus
gagagctatatacttttacacactt

SEQ ID NO: 335966 - DNA, 25 bp, Rattus norvegicus
gagagctatatagggctgttgcagc

SEQ ID NO: 335967 - DNA, 25 bp, Rattus norvegicus
gagagctatatagttttacacactt

SEQ ID NO: 335968 - DNA, 25 bp, Rattus norvegicus
gagagctatcatcatgtccatgtgg

SEQ ID NO: 335969 - DNA, 25 bp, Rattus norvegicus
gagagctatcatgatgtccatgtgg

SEQ ID NO: 335970 - DNA, 25 bp, Rattus norvegicus
gagagctatgatcacctttctccaa

SEQ ID NO: 335971 - DNA, 25 bp, Rattus norvegicus
gagagctatgatgacctttctccaa

SEQ ID NO: 335972 - DNA, 25 bp, Rattus norvegicus
gagagctatggtatttaatttattg

SEQ ID NO: 335973 - DNA, 25 bp, Rattus norvegicus
gagagctatggtttttaatttattg

SEQ ID NO: 335974 - DNA, 25 bp, Rattus norvegicus
gagagctatgtgaggttcttacctt

SEQ ID NO: 335975 - DNA, 25 bp, Rattus norvegicus
gagagctatgtgtggttcttacctt

SEQ ID NO: 335976 - DNA, 25 bp, Rattus norvegicus
gagagctcaaccagtacagcgccaa

SEQ ID NO: 335977 - DNA, 25 bp, Rattus norvegicus
gagagctcaacctgtacagcgccaa

SEQ ID NO: 335978 - DNA, 25 bp, Rattus norvegicus
gagagctcaagaaccatcactgacc

SEQ ID NO: 335979 - DNA, 25 bp, Rattus norvegicus
gagagctcaagaattttgggtgtca

SEQ ID NO: 335980 - DNA, 25 bp, Rattus norvegicus
gagagctcaagatccatcactgacc

SEQ ID NO: 335981 - DNA, 25 bp, Rattus norvegicus
gagagctcaagatttttgggtgtca

SEQ ID NO: 335982 - DNA, 25 bp, Rattus norvegicus
gagagctcaatgcagaactacccat

SEQ ID NO: 335983 - DNA, 25 bp, Rattus norvegicus
gagagctcaatggagaactacccat

SEQ ID NO: 335984 - DNA, 25 bp, Rattus norvegicus
gagagctcactactcagagacttgg

SEQ ID NO: 335985 - DNA, 25 bp, Rattus norvegicus
gagagctcactagtcagagacttgg

SEQ ID NO: 335986 - DNA, 25 bp, Rattus norvegicus
gagagctcactgacaacacagacgc

SEQ ID NO: 335987 - DNA, 25 bp, Rattus norvegicus
gagagctcactgtcaacacagacgc

SEQ ID NO: 335988 - DNA, 25 bp, Rattus norvegicus
gagagctcagccacagggcaacaag

SEQ ID NO: 335989 - DNA, 25 bp, Rattus norvegicus
gagagctcagccactgtgatatctt

SEQ ID NO: 335990 - DNA, 25 bp, Rattus norvegicus
gagagctcagcctcagggcaacaag

SEQ ID NO: 335991 - DNA, 25 bp, Rattus norvegicus
gagagctcagcctctgtgatatctt

SEQ ID NO: 335992 - DNA, 25 bp, Rattus norvegicus
gagagctcagcgcatggcccaagaa

SEQ ID NO: 335993 - DNA, 25 bp, Rattus norvegicus
gagagctcagcggatggcccaagaa

SEQ ID NO: 335994 - DNA, 25 bp, Rattus norvegicus
gagagctcagtacccaagagcactt

SEQ ID NO: 335995 - DNA, 25 bp, Rattus norvegicus
gagagctcagtagccaagagcactt

SEQ ID NO: 335996 - DNA, 25 bp, Rattus norvegicus
gagagctcatatagcgtggaccaag

SEQ ID NO: 335997 - DNA, 25 bp, Rattus norvegicus
gagagctcatattgcgtggaccaag

SEQ ID NO: 335998 - DNA, 25 bp, Rattus norvegicus
gagagctcatgcacttgaccctggg

SEQ ID NO: 335999 - DNA, 25 bp, Rattus norvegicus
gagagctcatgctcttgaccctggg

SEQ ID NO: 336000 - DNA, 25 bp, Rattus norvegicus
gagagctccagcacactgtcaactt

SEQ ID NO: 336001 - DNA, 25 bp, Rattus norvegicus
gagagctccagctcactgtcaactt

SEQ ID NO: 336002 - DNA, 25 bp, Rattus norvegicus
gagagctcccagcattttactcagg

SEQ ID NO: 336003 - DNA, 25 bp, Rattus norvegicus
gagagctcccaggattttactcagg

SEQ ID NO: 336004 - DNA, 25 bp, Rattus norvegicus
gagagctcccatagaattgctgtta

SEQ ID NO: 336005 - DNA, 25 bp, Rattus norvegicus
gagagctcccattgaattgctgtta

SEQ ID NO: 336006 - DNA, 25 bp, Rattus norvegicus
gagagctcccttccaatttgcacaa

SEQ ID NO: 336007 - DNA, 25 bp, Rattus norvegicus
gagagctcccttgcaatttgcacaa

SEQ ID NO: 336008 - DNA, 25 bp, Rattus norvegicus
gagagctccgcacaggccagatcct

SEQ ID NO: 336009 - DNA, 25 bp, Rattus norvegicus
gagagctccgcagaggccagatcct

SEQ ID NO: 336010 - DNA, 25 bp, Rattus norvegicus
gagagctccgctcaagcagctgaag

SEQ ID NO: 336011 - DNA, 25 bp, Rattus norvegicus
gagagctccgctgaagcagctgaag

SEQ ID NO: 336012 - DNA, 25 bp, Rattus norvegicus
gagagctccggcagcccaagctacg

SEQ ID NO: 336013 - DNA, 25 bp, Rattus norvegicus
gagagctccggctgcccaagctacg

SEQ ID NO: 336014 - DNA, 25 bp, Rattus norvegicus
gagagctcctgcaataacaacttca

SEQ ID NO: 336015 - DNA, 25 bp, Rattus norvegicus
gagagctcctgctataacaacttca

SEQ ID NO: 336016 - DNA, 25 bp, Rattus norvegicus
gagagctcctttaccaataaagcca

SEQ ID NO: 336017 - DNA, 25 bp, Rattus norvegicus
gagagctccttttccaataaagcca

SEQ ID NO: 336018 - DNA, 25 bp, Rattus norvegicus
gagagctcggttaactcccaagaga

SEQ ID NO: 336019 - DNA, 25 bp, Rattus norvegicus
gagagctcggtttactcccaagaga

SEQ ID NO: 336020 - DNA, 25 bp, Rattus norvegicus
gagagctcgtaaccagcttgtggct

SEQ ID NO: 336021 - DNA, 25 bp, Rattus norvegicus
gagagctcgtaagcagcttgtggct

SEQ ID NO: 336022 - DNA, 25 bp, Rattus norvegicus
gagagctctagcatttaccagtgag

SEQ ID NO: 336023 - DNA, 25 bp, Rattus norvegicus
gagagctctagcttttaccagtgag

SEQ ID NO: 336024 - DNA, 25 bp, Rattus norvegicus
gagagctctccaatgtgttgtgaaa

SEQ ID NO: 336025 - DNA, 25 bp, Rattus norvegicus
gagagctctccattgtgttgtgaaa

SEQ ID NO: 336026 - DNA, 25 bp, Rattus norvegicus
gagagctctcgactacatttttaaa

SEQ ID NO: 336027 - DNA, 25 bp, Rattus norvegicus
gagagctctcgagtacatttttaaa

SEQ ID NO: 336028 - DNA, 25 bp, Rattus norvegicus
gagagctctcttctaagtgacaaac

SEQ ID NO: 336029 - DNA, 25 bp, Rattus norvegicus
gagagctctcttgtaagtgacaaac

SEQ ID NO: 336030 - DNA, 25 bp, Rattus norvegicus
gagagctctgacatcaccattgatt

SEQ ID NO: 336031 - DNA, 25 bp, Rattus norvegicus
gagagctctgacttcaccattgatt

SEQ ID NO: 336032 - DNA, 25 bp, Rattus norvegicus
gagagctctgagatgtacctccagc

SEQ ID NO: 336033 - DNA, 25 bp, Rattus norvegicus
gagagctctgagttgtacctccagc

SEQ ID NO: 336034 - DNA, 25 bp, Rattus norvegicus
gagagctctgtgagcactttcatac

SEQ ID NO: 336035 - DNA, 25 bp, Rattus norvegicus
gagagctctgtgtgcactttcatac

SEQ ID NO: 336036 - DNA, 25 bp, Rattus norvegicus
gagagctctgttaggtgtatacgac

SEQ ID NO: 336037 - DNA, 25 bp, Rattus norvegicus
gagagctctgtttggtgtatacgac

SEQ ID NO: 336038 - DNA, 25 bp, Rattus norvegicus
gagagctcttgaaaagcccacagcc

SEQ ID NO: 336039 - DNA, 25 bp, Rattus norvegicus
gagagctcttgataagcccacagcc

SEQ ID NO: 336040 - DNA, 25 bp, Rattus norvegicus
gagagctgagacaattgcattttac

SEQ ID NO: 336041 - DNA, 25 bp, Rattus norvegicus
gagagctgagacaccacatgaggat

SEQ ID NO: 336042 - DNA, 25 bp, Rattus norvegicus
gagagctgagactattgcattttac

SEQ ID NO: 336043 - DNA, 25 bp, Rattus norvegicus
gagagctgagactccacatgaggat

SEQ ID NO: 336044 - DNA, 25 bp, Rattus norvegicus
gagagctgagctacaaaattcatca

SEQ ID NO: 336045 - DNA, 25 bp, Rattus norvegicus
gagagctgagcttcaaaattcatca

SEQ ID NO: 336046 - DNA, 25 bp, Rattus norvegicus
gagagctgcagtcatgttgacaacc

SEQ ID NO: 336047 - DNA, 25 bp, Rattus norvegicus
gagagctgcagtgatgttgacaacc

SEQ ID NO: 336048 - DNA, 25 bp, Rattus norvegicus
gagagctgccacaggacatgtgccc

SEQ ID NO: 336049 - DNA, 25 bp, Rattus norvegicus
gagagctgccactggacatgtgccc

SEQ ID NO: 336050 - DNA, 25 bp, Rattus norvegicus
gagagctgccgactcatagaaccaa

SEQ ID NO: 336051 - DNA, 25 bp, Rattus norvegicus
gagagctgccgagtcatagaaccaa

SEQ ID NO: 336052 - DNA, 25 bp, Rattus norvegicus
gagagctgcctaatggcctgtcaga

SEQ ID NO: 336053 - DNA, 25 bp, Rattus norvegicus
gagagctgcctattggcctgtcaga

SEQ ID NO: 336054 - DNA, 25 bp, Rattus norvegicus
gagagctgctgaagtggagtcccac

SEQ ID NO: 336055 - DNA, 25 bp, Rattus norvegicus
gagagctgctgatgtggagtcccac

SEQ ID NO: 336056 - DNA, 25 bp, Rattus norvegicus
gagagctgctggaacgcggccatca

SEQ ID NO: 336057 - DNA, 25 bp, Rattus norvegicus
gagagctgctggtacgcggccatca

SEQ ID NO: 336058 - DNA, 25 bp, Rattus norvegicus
gagagctggaatcaccggcctatgt

SEQ ID NO: 336059 - DNA, 25 bp, Rattus norvegicus
gagagctggaatgaccggcctatgt

SEQ ID NO: 336060 - DNA, 25 bp, Rattus norvegicus
gagagctggacaacctgcagtacag

SEQ ID NO: 336061 - DNA, 25 bp, Rattus norvegicus
gagagctggacatcctgcagtacag

SEQ ID NO: 336062 - DNA, 25 bp, Rattus norvegicus
gagagctggatgacagcgtcgcttt

SEQ ID NO: 336063 - DNA, 25 bp, Rattus norvegicus
gagagctggatgacccgctgtcgca

SEQ ID NO: 336064 - DNA, 25 bp, Rattus norvegicus
gagagctggatgacctccaagaaga

SEQ ID NO: 336065 - DNA, 25 bp, Rattus norvegicus
gagagctggatgtcagcgtcgcttt

SEQ ID NO: 336066 - DNA, 25 bp, Rattus norvegicus
gagagctggatgtcccgctgtcgca

SEQ ID NO: 336067 - DNA, 25 bp, Rattus norvegicus
gagagctggatgtcctccaagaaga

SEQ ID NO: 336068 - DNA, 25 bp, Rattus norvegicus
gagagctggcaacttcatgttctta

SEQ ID NO: 336069 - DNA, 25 bp, Rattus norvegicus
gagagctggcaagttcatgttctta

SEQ ID NO: 336070 - DNA, 25 bp, Rattus norvegicus
gagagctggctaatatggccatctc

SEQ ID NO: 336071 - DNA, 25 bp, Rattus norvegicus
gagagctggctattatggccatctc

SEQ ID NO: 336072 - DNA, 25 bp, Rattus norvegicus
gagagctgggctaccagacaacgga

SEQ ID NO: 336073 - DNA, 25 bp, Rattus norvegicus
gagagctgggcttccagacaacgga

SEQ ID NO: 336074 - DNA, 25 bp, Rattus norvegicus
gagagctggtataccatgccattga

SEQ ID NO: 336075 - DNA, 25 bp, Rattus norvegicus
gagagctggtattccatgccattga

SEQ ID NO: 336076 - DNA, 25 bp, Rattus norvegicus
gagagctggtgaataacaagtgttt

SEQ ID NO: 336077 - DNA, 25 bp, Rattus norvegicus
gagagctggtgaccacgtctgacca

SEQ ID NO: 336078 - DNA, 25 bp, Rattus norvegicus
gagagctggtgagcacgtctgacca

SEQ ID NO: 336079 - DNA, 25 bp, Rattus norvegicus
gagagctggtgattaacaagtgttt

SEQ ID NO: 336080 - DNA, 25 bp, Rattus norvegicus
gagagctggttgaagatgtttgtaa

SEQ ID NO: 336081 - DNA, 25 bp, Rattus norvegicus
gagagctggttgaggtaactcatat

SEQ ID NO: 336082 - DNA, 25 bp, Rattus norvegicus
gagagctggttgtagatgtttgtaa

SEQ ID NO: 336083 - DNA, 25 bp, Rattus norvegicus
gagagctggttgtggtaactcatat

SEQ ID NO: 336084 - DNA, 25 bp, Rattus norvegicus
gagagctggtttcttcctgatcctg

SEQ ID NO: 336085 - DNA, 25 bp, Rattus norvegicus
gagagctggtttgttcctgatcctg

SEQ ID NO: 336086 - DNA, 25 bp, Rattus norvegicus
gagagctgtaaacagccttcgccac

SEQ ID NO: 336087 - DNA, 25 bp, Rattus norvegicus
gagagctgtaaagagccttcgccac

SEQ ID NO: 336088 - DNA, 25 bp, Rattus norvegicus
gagagctgtaccagtcagaaccttg

SEQ ID NO: 336089 - DNA, 25 bp, Rattus norvegicus
gagagctgtacctgtcagaaccttg

SEQ ID NO: 336090 - DNA, 25 bp, Rattus norvegicus
gagagctgtagcagagcccgccaga

SEQ ID NO: 336091 - DNA, 25 bp, Rattus norvegicus
gagagctgtagctgagcccgccaga

SEQ ID NO: 336092 - DNA, 25 bp, Rattus norvegicus
gagagctgtcaaccagccgcacggt

SEQ ID NO: 336093 - DNA, 25 bp, Rattus norvegicus
gagagctgtcaagcagccgcacggt

SEQ ID NO: 336094 - DNA, 25 bp, Rattus norvegicus
gagagctgtccaatgccttacaaca

SEQ ID NO: 336095 - DNA, 25 bp, Rattus norvegicus
gagagctgtccattgccttacaaca

SEQ ID NO: 336096 - DNA, 25 bp, Rattus norvegicus
gagagctgtcttagagaccagaggc

SEQ ID NO: 336097 - DNA, 25 bp, Rattus norvegicus
gagagctgtctttgagaccagaggc

SEQ ID NO: 336098 - DNA, 25 bp, Rattus norvegicus
gagagctgtgaacatgggtctttat

SEQ ID NO: 336099 - DNA, 25 bp, Rattus norvegicus
gagagctgtgaagatgggtctttat

SEQ ID NO: 336100 - DNA, 25 bp, Rattus norvegicus
gagagctgtgtaaaaccccaggact

SEQ ID NO: 336101 - DNA, 25 bp, Rattus norvegicus
gagagctgtgtataaccccaggact

SEQ ID NO: 336102 - DNA, 25 bp, Rattus norvegicus
gagagctgtgtgctcatgctagcaa

SEQ ID NO: 336103 - DNA, 25 bp, Rattus norvegicus
gagagctgtgtggtcatgctagcaa

SEQ ID NO: 336104 - DNA, 25 bp, Rattus norvegicus
gagagctgtgttctgtcactcaagt

SEQ ID NO: 336105 - DNA, 25 bp, Rattus norvegicus
gagagctgtgttgtgtcactcaagt

SEQ ID NO: 336106 - DNA, 25 bp, Rattus norvegicus
gagagctgttaactccatgctgcag

SEQ ID NO: 336107 - DNA, 25 bp, Rattus norvegicus
gagagctgttaagtccatgctgcag

SEQ ID NO: 336108 - DNA, 25 bp, Rattus norvegicus
gagagctgtttaatcatttcattag

SEQ ID NO: 336109 - DNA, 25 bp, Rattus norvegicus
gagagctgtttattcatttcattag

SEQ ID NO: 336110 - DNA, 25 bp, Rattus norvegicus
gagagctgttttacctccaatggct

SEQ ID NO: 336111 - DNA, 25 bp, Rattus norvegicus
gagagctgtttttcctccaatggct

SEQ ID NO: 336112 - DNA, 25 bp, Rattus norvegicus
gagagcttactacatctattctggg

SEQ ID NO: 336113 - DNA, 25 bp, Rattus norvegicus
gagagcttactagatctattctggg

SEQ ID NO: 336114 - DNA, 25 bp, Rattus norvegicus
gagagcttactcagcctctatagta

SEQ ID NO: 336115 - DNA, 25 bp, Rattus norvegicus
gagagcttactctgcctctatagta

SEQ ID NO: 336116 - DNA, 25 bp, Rattus norvegicus
gagagcttacttacagcacatggaa

SEQ ID NO: 336117 - DNA, 25 bp, Rattus norvegicus
gagagcttactttcagcacatggaa

SEQ ID NO: 336118 - DNA, 25 bp, Rattus norvegicus
gagagcttatccagcaaacccaagg

SEQ ID NO: 336119 - DNA, 25 bp, Rattus norvegicus
gagagcttatcctgcaaacccaagg

SEQ ID NO: 336120 - DNA, 25 bp, Rattus norvegicus
gagagcttatggctcctatctccat

SEQ ID NO: 336121 - DNA, 25 bp, Rattus norvegicus
gagagcttatgggtcctatctccat

SEQ ID NO: 336122 - DNA, 25 bp, Rattus norvegicus
gagagcttcactattttgtcttggc

SEQ ID NO: 336123 - DNA, 25 bp, Rattus norvegicus
gagagcttcacttttttgtcttggc

SEQ ID NO: 336124 - DNA, 25 bp, Rattus norvegicus
gagagcttcagtcctcttgtacaga

SEQ ID NO: 336125 - DNA, 25 bp, Rattus norvegicus
gagagcttcagtgctcttgtacaga

SEQ ID NO: 336126 - DNA, 25 bp, Rattus norvegicus
gagagcttcatcagcaactgtgacc

SEQ ID NO: 336127 - DNA, 25 bp, Rattus norvegicus
gagagcttcatctgcaactgtgacc

SEQ ID NO: 336128 - DNA, 25 bp, Rattus norvegicus
gagagcttcatgatcgcatgtcagc

SEQ ID NO: 336129 - DNA, 25 bp, Rattus norvegicus
gagagcttcatgttcgcatgtcagc

SEQ ID NO: 336130 - DNA, 25 bp, Rattus norvegicus
gagagcttcccacaggcgacagaac

SEQ ID NO: 336131 - DNA, 25 bp, Rattus norvegicus
gagagcttcccagaggcgacagaac

SEQ ID NO: 336132 - DNA, 25 bp, Rattus norvegicus
gagagcttccggaacattctgagag

SEQ ID NO: 336133 - DNA, 25 bp, Rattus norvegicus
gagagcttccggtacattctgagag

SEQ ID NO: 336134 - DNA, 25 bp, Rattus norvegicus
gagagcttcgagaactaccgcagga

SEQ ID NO: 336135 - DNA, 25 bp, Rattus norvegicus
gagagcttcgagtactaccgcagga

SEQ ID NO: 336136 - DNA, 25 bp, Rattus norvegicus
gagagcttcggcatcgcggatgaaa

SEQ ID NO: 336137 - DNA, 25 bp, Rattus norvegicus
gagagcttcggcttcgcggatgaaa

SEQ ID NO: 336138 - DNA, 25 bp, Rattus norvegicus
gagagcttctcgattttctggatgc

SEQ ID NO: 336139 - DNA, 25 bp, Rattus norvegicus
gagagcttctcgtttttctggatgc

SEQ ID NO: 336140 - DNA, 25 bp, Rattus norvegicus
gagagcttctgcaggattggaattg

SEQ ID NO: 336141 - DNA, 25 bp, Rattus norvegicus
gagagcttctgctggattggaattg

SEQ ID NO: 336142 - DNA, 25 bp, Rattus norvegicus
gagagcttctgtatgtgcattttca

SEQ ID NO: 336143 - DNA, 25 bp, Rattus norvegicus
gagagcttctgtcttctggcctcaa

SEQ ID NO: 336144 - DNA, 25 bp, Rattus norvegicus
gagagcttctgtgttctggcctcaa

SEQ ID NO: 336145 - DNA, 25 bp, Rattus norvegicus
gagagcttctgtttgtgcattttca

SEQ ID NO: 336146 - DNA, 25 bp, Rattus norvegicus
gagagcttgacccaccctagtaaac

SEQ ID NO: 336147 - DNA, 25 bp, Rattus norvegicus
gagagcttgaccgaccctagtaaac

SEQ ID NO: 336148 - DNA, 25 bp, Rattus norvegicus
gagagcttgaggacctgcagctgca

SEQ ID NO: 336149 - DNA, 25 bp, Rattus norvegicus
gagagcttgaggtcctgcagctgca

SEQ ID NO: 336150 - DNA, 25 bp, Rattus norvegicus
gagagcttgcacacagtccaccaaa

SEQ ID NO: 336151 - DNA, 25 bp, Rattus norvegicus
gagagcttgcactcagtccaccaaa

SEQ ID NO: 336152 - DNA, 25 bp, Rattus norvegicus
gagagcttgcctcccaaattgaaga

SEQ ID NO: 336153 - DNA, 25 bp, Rattus norvegicus
gagagcttgcctgccaaattgaaga

SEQ ID NO: 336154 - DNA, 25 bp, Rattus norvegicus
gagagcttggagactgacccagcca

SEQ ID NO: 336155 - DNA, 25 bp, Rattus norvegicus
gagagcttggagtctgacccagcca

SEQ ID NO: 336156 - DNA, 25 bp, Rattus norvegicus
gagagcttggccattttactgttgg

SEQ ID NO: 336157 - DNA, 25 bp, Rattus norvegicus
gagagcttggcctttttactgttgg

SEQ ID NO: 336158 - DNA, 25 bp, Rattus norvegicus
gagagcttggtaatctgccaatcca

SEQ ID NO: 336159 - DNA, 25 bp, Rattus norvegicus
gagagcttggtattctgccaatcca

SEQ ID NO: 336160 - DNA, 25 bp, Rattus norvegicus
gagagcttgtctaacccataggatt

SEQ ID NO: 336161 - DNA, 25 bp, Rattus norvegicus
gagagcttgtcttacccataggatt

SEQ ID NO: 336162 - DNA, 25 bp, Rattus norvegicus
gagagcttgtttcaaatcctccttg

SEQ ID NO: 336163 - DNA, 25 bp, Rattus norvegicus
gagagcttgtttgaaatcctccttg

SEQ ID NO: 336164 - DNA, 25 bp, Rattus norvegicus
gagagctttaggacaggctatctgt

SEQ ID NO: 336165 - DNA, 25 bp, Rattus norvegicus
gagagctttaggtcaggctatctgt

SEQ ID NO: 336166 - DNA, 25 bp, Rattus norvegicus
gagagctttccaagtcggtgacacc

SEQ ID NO: 336167 - DNA, 25 bp, Rattus norvegicus
gagagctttccatgtcggtgacacc

SEQ ID NO: 336168 - DNA, 25 bp, Rattus norvegicus
gagagcttttcaagtactgcacctg

SEQ ID NO: 336169 - DNA, 25 bp, Rattus norvegicus
gagagcttttcatgtactgcacctg

SEQ ID NO: 336170 - DNA, 25 bp, Rattus norvegicus
gagagcttttgcatgagtctcctct

SEQ ID NO: 336171 - DNA, 25 bp, Rattus norvegicus
gagagcttttgcttgagtctcctct

SEQ ID NO: 336172 - DNA, 25 bp, Rattus norvegicus
gagagctttttgcaccatgcatttt

SEQ ID NO: 336173 - DNA, 25 bp, Rattus norvegicus
gagagctttttggaccatgcatttt

SEQ ID NO: 336174 - DNA, 25 bp, Rattus norvegicus
gagaggaaatcacccaatgcccgtt

SEQ ID NO: 336175 - DNA, 25 bp, Rattus norvegicus
gagaggaaatcagccaatgcccgtt

SEQ ID NO: 336176 - DNA, 25 bp, Rattus norvegicus
gagaggaaatgaacgagcccttttg

SEQ ID NO: 336177 - DNA, 25 bp, Rattus norvegicus
gagaggaaatgatcgagcccttttg

SEQ ID NO: 336178 - DNA, 25 bp, Rattus norvegicus
gagaggaactcacccattgacttag

SEQ ID NO: 336179 - DNA, 25 bp, Rattus norvegicus
gagaggaactcagccattgacttag

SEQ ID NO: 336180 - DNA, 25 bp, Rattus norvegicus
gagaggaactcgatatcactccgct

SEQ ID NO: 336181 - DNA, 25 bp, Rattus norvegicus
gagaggaactcgttatcactccgct

SEQ ID NO: 336182 - DNA, 25 bp, Rattus norvegicus
gagaggaactctaaatcacccacag

SEQ ID NO: 336183 - DNA, 25 bp, Rattus norvegicus
gagaggaactcttaatcacccacag

SEQ ID NO: 336184 - DNA, 25 bp, Rattus norvegicus
gagaggaactggctccttaccccaa

SEQ ID NO: 336185 - DNA, 25 bp, Rattus norvegicus
gagaggaactgggtccttaccccaa

SEQ ID NO: 336186 - DNA, 25 bp, Rattus norvegicus
gagaggaagcacactgagtccactt

SEQ ID NO: 336187 - DNA, 25 bp, Rattus norvegicus
gagaggaagcactctgagtccactt

SEQ ID NO: 336188 - DNA, 25 bp, Rattus norvegicus
gagaggaagcttacagcgcagctat

SEQ ID NO: 336189 - DNA, 25 bp, Rattus norvegicus
gagaggaagctttcagcgcagctat

SEQ ID NO: 336190 - DNA, 25 bp, Rattus norvegicus
gagaggaagggcatccacctaccac

SEQ ID NO: 336191 - DNA, 25 bp, Rattus norvegicus
gagaggaagggcttccacctaccac

SEQ ID NO: 336192 - DNA, 25 bp, Rattus norvegicus
gagaggaagtcaaggaagatgccaa

SEQ ID NO: 336193 - DNA, 25 bp, Rattus norvegicus
gagaggaagtcaccagtccaccttg

SEQ ID NO: 336194 - DNA, 25 bp, Rattus norvegicus
gagaggaagtcagcagtccaccttg

SEQ ID NO: 336195 - DNA, 25 bp, Rattus norvegicus
gagaggaagtcatggaagatgccaa

SEQ ID NO: 336196 - DNA, 25 bp, Rattus norvegicus
gagaggaatacacccttcttgtgaa

SEQ ID NO: 336197 - DNA, 25 bp, Rattus norvegicus
gagaggaatacagccttcttgtgaa

SEQ ID NO: 336198 - DNA, 25 bp, Rattus norvegicus
gagaggaatcacaaaaatccctcaa

SEQ ID NO: 336199 - DNA, 25 bp, Rattus norvegicus
gagaggaatcactaaaatccctcaa

SEQ ID NO: 336200 - DNA, 25 bp, Rattus norvegicus
gagaggaatccgaacatttgtttgt

SEQ ID NO: 336201 - DNA, 25 bp, Rattus norvegicus
gagaggaatccgtacatttgtttgt

SEQ ID NO: 336202 - DNA, 25 bp, Rattus norvegicus
gagaggaatctcatggccatatttt

SEQ ID NO: 336203 - DNA, 25 bp, Rattus norvegicus
gagaggaatctcttggccatatttt

SEQ ID NO: 336204 - DNA, 25 bp, Rattus norvegicus
gagaggaattcccacacctatggct

SEQ ID NO: 336205 - DNA, 25 bp, Rattus norvegicus
gagaggaattccgacacctatggct

SEQ ID NO: 336206 - DNA, 25 bp, Rattus norvegicus
gagaggacacccaaaattccaagaa

SEQ ID NO: 336207 - DNA, 25 bp, Rattus norvegicus
gagaggacacccactgtaatggaca

SEQ ID NO: 336208 - DNA, 25 bp, Rattus norvegicus
gagaggacaccctaaattccaagaa

SEQ ID NO: 336209 - DNA, 25 bp, Rattus norvegicus
gagaggacaccctctgtaatggaca

SEQ ID NO: 336210 - DNA, 25 bp, Rattus norvegicus
gagaggacactcaagctgtttccct

SEQ ID NO: 336211 - DNA, 25 bp, Rattus norvegicus
gagaggacactctagctgtttccct

SEQ ID NO: 336212 - DNA, 25 bp, Rattus norvegicus
gagaggacagagagaaccgttcaaa

SEQ ID NO: 336213 - DNA, 25 bp, Rattus norvegicus
gagaggacagagtgaaccgttcaaa

SEQ ID NO: 336214 - DNA, 25 bp, Rattus norvegicus
gagaggacagccatgcactgcttga

SEQ ID NO: 336215 - DNA, 25 bp, Rattus norvegicus
gagaggacagccttgcactgcttga

SEQ ID NO: 336216 - DNA, 25 bp, Rattus norvegicus
gagaggacagcgagggctttttcca

SEQ ID NO: 336217 - DNA, 25 bp, Rattus norvegicus
gagaggacagcgtgggctttttcca

SEQ ID NO: 336218 - DNA, 25 bp, Rattus norvegicus
gagaggacaggcatgagctcctcgc

SEQ ID NO: 336219 - DNA, 25 bp, Rattus norvegicus
gagaggacaggcttgagctcctcgc

SEQ ID NO: 336220 - DNA, 25 bp, Rattus norvegicus
gagaggacaggtattgccccacaga

SEQ ID NO: 336221 - DNA, 25 bp, Rattus norvegicus
gagaggacaggttttgccccacaga

SEQ ID NO: 336222 - DNA, 25 bp, Rattus norvegicus
gagaggacatcaaacacacagcaat

SEQ ID NO: 336223 - DNA, 25 bp, Rattus norvegicus
gagaggacatcatacacacagcaat

SEQ ID NO: 336224 - DNA, 25 bp, Rattus norvegicus
gagaggaccaacactgaactgctat

SEQ ID NO: 336225 - DNA, 25 bp, Rattus norvegicus
gagaggaccaactctgaactgctat

SEQ ID NO: 336226 - DNA, 25 bp, Rattus norvegicus
gagaggaccaccatagctgcacatt

SEQ ID NO: 336227 - DNA, 25 bp, Rattus norvegicus
gagaggaccaccttagctgcacatt

SEQ ID NO: 336228 - DNA, 25 bp, Rattus norvegicus
gagaggaccaggatttcccacagac

SEQ ID NO: 336229 - DNA, 25 bp, Rattus norvegicus
gagaggaccaggttttcccacagac

SEQ ID NO: 336230 - DNA, 25 bp, Rattus norvegicus
gagaggaccagtatgacaaactaac

SEQ ID NO: 336231 - DNA, 25 bp, Rattus norvegicus
gagaggaccagtttgacaaactaac

SEQ ID NO: 336232 - DNA, 25 bp, Rattus norvegicus
gagaggacccataacccggatgctt

SEQ ID NO: 336233 - DNA, 25 bp, Rattus norvegicus
gagaggacccattacccggatgctt

SEQ ID NO: 336234 - DNA, 25 bp, Rattus norvegicus
gagaggaccccgaatacaaacgaga

SEQ ID NO: 336235 - DNA, 25 bp, Rattus norvegicus
gagaggaccccgtatacaaacgaga

SEQ ID NO: 336236 - DNA, 25 bp, Rattus norvegicus
gagaggacccctctggaaggattcc

SEQ ID NO: 336237 - DNA, 25 bp, Rattus norvegicus
gagaggacccctgtggaaggattcc

SEQ ID NO: 336238 - DNA, 25 bp, Rattus norvegicus
gagaggaccctacagccactatggg

SEQ ID NO: 336239 - DNA, 25 bp, Rattus norvegicus
gagaggaccctagagccactatggg

SEQ ID NO: 336240 - DNA, 25 bp, Rattus norvegicus
gagaggacctctaggtagctggatt

SEQ ID NO: 336241 - DNA, 25 bp, Rattus norvegicus
gagaggacctctatgcctagttact

SEQ ID NO: 336242 - DNA, 25 bp, Rattus norvegicus
gagaggacctcttggtagctggatt

SEQ ID NO: 336243 - DNA, 25 bp, Rattus norvegicus
gagaggacctctttgcctagttact

SEQ ID NO: 336244 - DNA, 25 bp, Rattus norvegicus
gagaggacgcacaggaccacagcat

SEQ ID NO: 336245 - DNA, 25 bp, Rattus norvegicus
gagaggacgcactggaccacagcat

SEQ ID NO: 336246 - DNA, 25 bp, Rattus norvegicus
gagaggactaatcccaggctatact

SEQ ID NO: 336247 - DNA, 25 bp, Rattus norvegicus
gagaggactaatgccaggctatact

SEQ ID NO: 336248 - DNA, 25 bp, Rattus norvegicus
gagaggactgatagcttattcatgt

SEQ ID NO: 336249 - DNA, 25 bp, Rattus norvegicus
gagaggactgattgcttattcatgt

SEQ ID NO: 336250 - DNA, 25 bp, Rattus norvegicus
gagaggacttacattcttttgtctt

SEQ ID NO: 336251 - DNA, 25 bp, Rattus norvegicus
gagaggacttactttcttttgtctt

SEQ ID NO: 336252 - DNA, 25 bp, Rattus norvegicus
gagaggagaagaccgccttacccta

SEQ ID NO: 336253 - DNA, 25 bp, Rattus norvegicus
gagaggagaagagcgccttacccta

SEQ ID NO: 336254 - DNA, 25 bp, Rattus norvegicus
gagaggagagaccagccccaccatg

SEQ ID NO: 336255 - DNA, 25 bp, Rattus norvegicus
gagaggagagacgagccccaccatg

SEQ ID NO: 336256 - DNA, 25 bp, Rattus norvegicus
gagaggagcatgactggccactcag

SEQ ID NO: 336257 - DNA, 25 bp, Rattus norvegicus
gagaggagcatgtctggccactcag

SEQ ID NO: 336258 - DNA, 25 bp, Rattus norvegicus
gagaggagcccacaattctgtactc

SEQ ID NO: 336259 - DNA, 25 bp, Rattus norvegicus
gagaggagcccagaattctgtactc

SEQ ID NO: 336260 - DNA, 25 bp, Rattus norvegicus
gagaggagctgcacatttccagaca

SEQ ID NO: 336261 - DNA, 25 bp, Rattus norvegicus
gagaggagctgctcatttccagaca

SEQ ID NO: 336262 - DNA, 25 bp, Rattus norvegicus
gagaggagcttgaccagagacttaa

SEQ ID NO: 336263 - DNA, 25 bp, Rattus norvegicus
gagaggagcttgtccagagacttaa

SEQ ID NO: 336264 - DNA, 25 bp, Rattus norvegicus
gagaggagctttatcgtcggtattt

SEQ ID NO: 336265 - DNA, 25 bp, Rattus norvegicus
gagaggagctttcttctggcctgct

SEQ ID NO: 336266 - DNA, 25 bp, Rattus norvegicus
gagaggagctttgttctggcctgct

SEQ ID NO: 336267 - DNA, 25 bp, Rattus norvegicus
gagaggagctttttcgtcggtattt

SEQ ID NO: 336268 - DNA, 25 bp, Rattus norvegicus
gagaggaggactacaccgtgcacgt

SEQ ID NO: 336269 - DNA, 25 bp, Rattus norvegicus
gagaggaggactcggcggcagctgc

SEQ ID NO: 336270 - DNA, 25 bp, Rattus norvegicus
gagaggaggactgggcggcagctgc

SEQ ID NO: 336271 - DNA, 25 bp, Rattus norvegicus
gagaggaggacttcaccgtgcacgt

SEQ ID NO: 336272 - DNA, 25 bp, Rattus norvegicus
gagaggagggccatacccttgcccg

SEQ ID NO: 336273 - DNA, 25 bp, Rattus norvegicus
gagaggagggccttacccttgcccg

SEQ ID NO: 336274 - DNA, 25 bp, Rattus norvegicus
gagaggagggtcatccatcctctga

SEQ ID NO: 336275 - DNA, 25 bp, Rattus norvegicus
gagaggagggtcttccatcctctga

SEQ ID NO: 336276 - DNA, 25 bp, Rattus norvegicus
gagaggaggtcaccagcaccctgct

SEQ ID NO: 336277 - DNA, 25 bp, Rattus norvegicus
gagaggaggtcagcagcaccctgct

SEQ ID NO: 336278 - DNA, 25 bp, Rattus norvegicus
gagaggagtgccaccctggaagcca

SEQ ID NO: 336279 - DNA, 25 bp, Rattus norvegicus
gagaggagtgcctccctggaagcca

SEQ ID NO: 336280 - DNA, 25 bp, Rattus norvegicus
gagaggatccctaacattctgtact

SEQ ID NO: 336281 - DNA, 25 bp, Rattus norvegicus
gagaggatcccttacattctgtact

SEQ ID NO: 336282 - DNA, 25 bp, Rattus norvegicus
gagaggatccggaaggcacaccaca

SEQ ID NO: 336283 - DNA, 25 bp, Rattus norvegicus
gagaggatccggtaggcacaccaca

SEQ ID NO: 336284 - DNA, 25 bp, Rattus norvegicus
gagaggatgcacatagtcatgcttt

SEQ ID NO: 336285 - DNA, 25 bp, Rattus norvegicus
gagaggatgcacttagtcatgcttt

SEQ ID NO: 336286 - DNA, 25 bp, Rattus norvegicus
gagaggatgccgagttcctgccaga

SEQ ID NO: 336287 - DNA, 25 bp, Rattus norvegicus
gagaggatgccgtgttcctgccaga

SEQ ID NO: 336288 - DNA, 25 bp, Rattus norvegicus
gagaggatgcctctgtagtttcccc

SEQ ID NO: 336289 - DNA, 25 bp, Rattus norvegicus
gagaggatgcctgtgtagtttcccc

SEQ ID NO: 336290 - DNA, 25 bp, Rattus norvegicus
gagaggatggagaccgtcttgccca

SEQ ID NO: 336291 - DNA, 25 bp, Rattus norvegicus
gagaggatggagtccgtcttgccca

SEQ ID NO: 336292 - DNA, 25 bp, Rattus norvegicus
gagaggatgttacagcaccagcaat

SEQ ID NO: 336293 - DNA, 25 bp, Rattus norvegicus
gagaggatgttacatcacccgttaa

SEQ ID NO: 336294 - DNA, 25 bp, Rattus norvegicus
gagaggatgttagagcaccagcaat

SEQ ID NO: 336295 - DNA, 25 bp, Rattus norvegicus
gagaggatgttagatcacccgttaa

SEQ ID NO: 336296 - DNA, 25 bp, Rattus norvegicus
gagaggatgttccttccctgaatac

SEQ ID NO: 336297 - DNA, 25 bp, Rattus norvegicus
gagaggatgttcgttccctgaatac

SEQ ID NO: 336298 - DNA, 25 bp, Rattus norvegicus
gagaggattgttaggtatccttacc

SEQ ID NO: 336299 - DNA, 25 bp, Rattus norvegicus
gagaggattgtttggtatccttacc

SEQ ID NO: 336300 - DNA, 25 bp, Rattus norvegicus
gagaggatttccagagaccagttga

SEQ ID NO: 336301 - DNA, 25 bp, Rattus norvegicus
gagaggatttcctgagaccagttga

SEQ ID NO: 336302 - DNA, 25 bp, Rattus norvegicus
gagaggatttctattcacctttaat

SEQ ID NO: 336303 - DNA, 25 bp, Rattus norvegicus
gagaggatttcttttcacctttaat

SEQ ID NO: 336304 - DNA, 25 bp, Rattus norvegicus
gagaggcaaacaagaacccattccc

SEQ ID NO: 336305 - DNA, 25 bp, Rattus norvegicus
gagaggcaaacatgaacccattccc

SEQ ID NO: 336306 - DNA, 25 bp, Rattus norvegicus
gagaggcaaaccatgtgacatttca

SEQ ID NO: 336307 - DNA, 25 bp, Rattus norvegicus
gagaggcaaaccttgtgacatttca

SEQ ID NO: 336308 - DNA, 25 bp, Rattus norvegicus
gagaggcaaattactactgtgtgta

SEQ ID NO: 336309 - DNA, 25 bp, Rattus norvegicus
gagaggcaaatttctactgtgtgta

SEQ ID NO: 336310 - DNA, 25 bp, Rattus norvegicus
gagaggcaaggccaccctgtacata

SEQ ID NO: 336311 - DNA, 25 bp, Rattus norvegicus
gagaggcaaggccagctccactttt

SEQ ID NO: 336312 - DNA, 25 bp, Rattus norvegicus
gagaggcaaggcgaccctgtacata

SEQ ID NO: 336313 - DNA, 25 bp, Rattus norvegicus
gagaggcaaggcgagctccactttt

SEQ ID NO: 336314 - DNA, 25 bp, Rattus norvegicus
gagaggcaagtgatctatctttgat

SEQ ID NO: 336315 - DNA, 25 bp, Rattus norvegicus
gagaggcaagtgttctatctttgat

SEQ ID NO: 336316 - DNA, 25 bp, Rattus norvegicus
gagaggcaagttaactcactcaccc

SEQ ID NO: 336317 - DNA, 25 bp, Rattus norvegicus
gagaggcaagtttactcactcaccc

SEQ ID NO: 336318 - DNA, 25 bp, Rattus norvegicus
gagaggcaatagctacccagtgaaa

SEQ ID NO: 336319 - DNA, 25 bp, Rattus norvegicus
gagaggcaataggtacccagtgaaa

SEQ ID NO: 336320 - DNA, 25 bp, Rattus norvegicus
gagaggcacagaagtcgcagtcgca

SEQ ID NO: 336321 - DNA, 25 bp, Rattus norvegicus
gagaggcacagatgtcgcagtcgca

SEQ ID NO: 336322 - DNA, 25 bp, Rattus norvegicus
gagaggcacagtctgacctgaacaa

SEQ ID NO: 336323 - DNA, 25 bp, Rattus norvegicus
gagaggcacagtgtgacctgaacaa

SEQ ID NO: 336324 - DNA, 25 bp, Rattus norvegicus
gagaggcaccggcatttcgaacact

SEQ ID NO: 336325 - DNA, 25 bp, Rattus norvegicus
gagaggcaccgggatttcgaacact

SEQ ID NO: 336326 - DNA, 25 bp, Rattus norvegicus
gagaggcaggctcgagccgggacgc

SEQ ID NO: 336327 - DNA, 25 bp, Rattus norvegicus
gagaggcaggctggagccgggacgc

SEQ ID NO: 336328 - DNA, 25 bp, Rattus norvegicus
gagaggcatacccaagcgcatgcat

SEQ ID NO: 336329 - DNA, 25 bp, Rattus norvegicus
gagaggcataccgaagcgcatgcat

SEQ ID NO: 336330 - DNA, 25 bp, Rattus norvegicus
gagaggcatagccatgttcatctgt

SEQ ID NO: 336331 - DNA, 25 bp, Rattus norvegicus
gagaggcatagcgatgttcatctgt

SEQ ID NO: 336332 - DNA, 25 bp, Rattus norvegicus
gagaggcatcctcaccctgaagtac

SEQ ID NO: 336333 - DNA, 25 bp, Rattus norvegicus
gagaggcatcctgaccctgaagtac

SEQ ID NO: 336334 - DNA, 25 bp, Rattus norvegicus
gagaggcatggtctgtgcttacaaa

SEQ ID NO: 336335 - DNA, 25 bp, Rattus norvegicus
gagaggcatggtgtgtgcttacaaa

SEQ ID NO: 336336 - DNA, 25 bp, Rattus norvegicus
gagaggcattatatatactcagcaa

SEQ ID NO: 336337 - DNA, 25 bp, Rattus norvegicus
gagaggcattatttatactcagcaa

SEQ ID NO: 336338 - DNA, 25 bp, Rattus norvegicus
gagaggccaattaaacgcttccagt

SEQ ID NO: 336339 - DNA, 25 bp, Rattus norvegicus
gagaggccaatttaacgcttccagt

SEQ ID NO: 336340 - DNA, 25 bp, Rattus norvegicus
gagaggccacatcctttgttcaatg

SEQ ID NO: 336341 - DNA, 25 bp, Rattus norvegicus
gagaggccacatgctttgttcaatg

SEQ ID NO: 336342 - DNA, 25 bp, Rattus norvegicus
gagaggccacgcacactcaaaaggg

SEQ ID NO: 336343 - DNA, 25 bp, Rattus norvegicus
gagaggccacgctcactcaaaaggg

SEQ ID NO: 336344 - DNA, 25 bp, Rattus norvegicus
gagaggccactaagggtcctttcca

SEQ ID NO: 336345 - DNA, 25 bp, Rattus norvegicus
gagaggccactatgggtcctttcca

SEQ ID NO: 336346 - DNA, 25 bp, Rattus norvegicus
gagaggccactcagtgatcactgct

SEQ ID NO: 336347 - DNA, 25 bp, Rattus norvegicus
gagaggccactctgtgatcactgct

SEQ ID NO: 336348 - DNA, 25 bp, Rattus norvegicus
gagaggccactgattgaagccctta

SEQ ID NO: 336349 - DNA, 25 bp, Rattus norvegicus
gagaggccactgtttgaagccctta

SEQ ID NO: 336350 - DNA, 25 bp, Rattus norvegicus
gagaggccagagaccctttaagaga

SEQ ID NO: 336351 - DNA, 25 bp, Rattus norvegicus
gagaggccagagtccctttaagaga

SEQ ID NO: 336352 - DNA, 25 bp, Rattus norvegicus
gagaggccagatcttaaacctcact

SEQ ID NO: 336353 - DNA, 25 bp, Rattus norvegicus
gagaggccagatgttaaacctcact

SEQ ID NO: 336354 - DNA, 25 bp, Rattus norvegicus
gagaggccagcgcttacatgtatta

SEQ ID NO: 336355 - DNA, 25 bp, Rattus norvegicus
gagaggccagcggttacatgtatta

SEQ ID NO: 336356 - DNA, 25 bp, Rattus norvegicus
gagaggccaggccacaaaccacata

SEQ ID NO: 336357 - DNA, 25 bp, Rattus norvegicus
gagaggccaggcgacaaaccacata

SEQ ID NO: 336358 - DNA, 25 bp, Rattus norvegicus
gagaggccattcaatgccttcaaag

SEQ ID NO: 336359 - DNA, 25 bp, Rattus norvegicus
gagaggccattctatgccttcaaag

SEQ ID NO: 336360 - DNA, 25 bp, Rattus norvegicus
gagaggccatttctactttgaagtc

SEQ ID NO: 336361 - DNA, 25 bp, Rattus norvegicus
gagaggccatttgtactttgaagtc

SEQ ID NO: 336362 - DNA, 25 bp, Rattus norvegicus
gagaggcccagcaccataggtagag

SEQ ID NO: 336363 - DNA, 25 bp, Rattus norvegicus
gagaggcccagctccataggtagag

SEQ ID NO: 336364 - DNA, 25 bp, Rattus norvegicus
gagaggccccgaaggcagcgtccta

SEQ ID NO: 336365 - DNA, 25 bp, Rattus norvegicus
gagaggccccgatggcagcgtccta

SEQ ID NO: 336366 - DNA, 25 bp, Rattus norvegicus
gagaggccctaacacttgagggaac

SEQ ID NO: 336367 - DNA, 25 bp, Rattus norvegicus
gagaggccctaagacttgagggaac

SEQ ID NO: 336368 - DNA, 25 bp, Rattus norvegicus
gagaggccctacacgtgtgttgaat

SEQ ID NO: 336369 - DNA, 25 bp, Rattus norvegicus
gagaggccctactcgtgtgttgaat

SEQ ID NO: 336370 - DNA, 25 bp, Rattus norvegicus
gagaggccctgaattttgtgcaaaa

SEQ ID NO: 336371 - DNA, 25 bp, Rattus norvegicus
gagaggccctgatttttgtgcaaaa

SEQ ID NO: 336372 - DNA, 25 bp, Rattus norvegicus
gagaggccctggactattctaactg

SEQ ID NO: 336373 - DNA, 25 bp, Rattus norvegicus
gagaggccctggtctattctaactg

SEQ ID NO: 336374 - DNA, 25 bp, Rattus norvegicus
gagaggccgcaaacttcaagctcaa

SEQ ID NO: 336375 - DNA, 25 bp, Rattus norvegicus
gagaggccgcaatcttcaagctcaa

SEQ ID NO: 336376 - DNA, 25 bp, Rattus norvegicus
gagaggccgtggcactcgtcactac

SEQ ID NO: 336377 - DNA, 25 bp, Rattus norvegicus
gagaggccgtgggactcgtcactac

SEQ ID NO: 336378 - DNA, 25 bp, Rattus norvegicus
gagaggcctaaactctgcagaccct

SEQ ID NO: 336379 - DNA, 25 bp, Rattus norvegicus
gagaggcctaaagtctgcagaccct

SEQ ID NO: 336380 - DNA, 25 bp, Rattus norvegicus
gagaggcctagaattcctggtcctg

SEQ ID NO: 336381 - DNA, 25 bp, Rattus norvegicus
gagaggcctagatttcctggtcctg

SEQ ID NO: 336382 - DNA, 25 bp, Rattus norvegicus
gagaggcctcctcgcagatacgata

SEQ ID NO: 336383 - DNA, 25 bp, Rattus norvegicus
gagaggcctcctggcagatacgata

SEQ ID NO: 336384 - DNA, 25 bp, Rattus norvegicus
gagaggcctgcaaactggaattttt

SEQ ID NO: 336385 - DNA, 25 bp, Rattus norvegicus
gagaggcctgcatactggaattttt

SEQ ID NO: 336386 - DNA, 25 bp, Rattus norvegicus
gagaggcctggcacttatctactgt

SEQ ID NO: 336387 - DNA, 25 bp, Rattus norvegicus
gagaggcctggctcttatctactgt

SEQ ID NO: 336388 - DNA, 25 bp, Rattus norvegicus
gagaggcctgggatttcaaaccagt

SEQ ID NO: 336389 - DNA, 25 bp, Rattus norvegicus
gagaggcctgggttttcaaaccagt

SEQ ID NO: 336390 - DNA, 25 bp, Rattus norvegicus
gagaggcctgtgacttgctcatgca

SEQ ID NO: 336391 - DNA, 25 bp, Rattus norvegicus
gagaggcctgtgtcttgctcatgca

SEQ ID NO: 336392 - DNA, 25 bp, Rattus norvegicus
gagaggccttctatttggcggagcc

SEQ ID NO: 336393 - DNA, 25 bp, Rattus norvegicus
gagaggccttctttttggcggagcc

SEQ ID NO: 336394 - DNA, 25 bp, Rattus norvegicus
gagaggcgctgcacataattacagg

SEQ ID NO: 336395 - DNA, 25 bp, Rattus norvegicus
gagaggcgctgctcataattacagg

SEQ ID NO: 336396 - DNA, 25 bp, Rattus norvegicus
gagaggctaaggctctagccctatt

SEQ ID NO: 336397 - DNA, 25 bp, Rattus norvegicus
gagaggctaagggtctagccctatt

SEQ ID NO: 336398 - DNA, 25 bp, Rattus norvegicus
gagaggctaatacttctatttcctt

SEQ ID NO: 336399 - DNA, 25 bp, Rattus norvegicus
gagaggctaatagttctatttcctt

SEQ ID NO: 336400 - DNA, 25 bp, Rattus norvegicus
gagaggctacttcccaatggtgata

SEQ ID NO: 336401 - DNA, 25 bp, Rattus norvegicus
gagaggctacttgccaatggtgata

SEQ ID NO: 336402 - DNA, 25 bp, Rattus norvegicus
gagaggctagatcaactacaggaca

SEQ ID NO: 336403 - DNA, 25 bp, Rattus norvegicus
gagaggctagatgaactacaggaca

SEQ ID NO: 336404 - DNA, 25 bp, Rattus norvegicus
gagaggctatgacaaccctaacttt

SEQ ID NO: 336405 - DNA, 25 bp, Rattus norvegicus
gagaggctatgaccggtattacaac

SEQ ID NO: 336406 - DNA, 25 bp, Rattus norvegicus
gagaggctatgagaaccctaacttt

SEQ ID NO: 336407 - DNA, 25 bp, Rattus norvegicus
gagaggctatgagcggtattacaac

SEQ ID NO: 336408 - DNA, 25 bp, Rattus norvegicus
gagaggctcaagatctgtgctgccc

SEQ ID NO: 336409 - DNA, 25 bp, Rattus norvegicus
gagaggctcaagttctgtgctgccc

SEQ ID NO: 336410 - DNA, 25 bp, Rattus norvegicus
gagaggctcacacaggcttcataga

SEQ ID NO: 336411 - DNA, 25 bp, Rattus norvegicus
gagaggctcacagaggcttcataga

SEQ ID NO: 336412 - DNA, 25 bp, Rattus norvegicus
gagaggctcaggatcacagtgcagt

SEQ ID NO: 336413 - DNA, 25 bp, Rattus norvegicus
gagaggctcaggttcacagtgcagt

SEQ ID NO: 336414 - DNA, 25 bp, Rattus norvegicus
gagaggctcagtccctgaactcatt

SEQ ID NO: 336415 - DNA, 25 bp, Rattus norvegicus
gagaggctcagtgcctgaactcatt

SEQ ID NO: 336416 - DNA, 25 bp, Rattus norvegicus
gagaggctcccaaagcaggatgcaa

SEQ ID NO: 336417 - DNA, 25 bp, Rattus norvegicus
gagaggctcccatagcaggatgcaa

SEQ ID NO: 336418 - DNA, 25 bp, Rattus norvegicus
gagaggctcggtatactccagaaaa

SEQ ID NO: 336419 - DNA, 25 bp, Rattus norvegicus
gagaggctcggtttactccagaaaa

SEQ ID NO: 336420 - DNA, 25 bp, Rattus norvegicus
gagaggctcttcagctacatgtact

SEQ ID NO: 336421 - DNA, 25 bp, Rattus norvegicus
gagaggctcttctgctacatgtact

SEQ ID NO: 336422 - DNA, 25 bp, Rattus norvegicus
gagaggctcttgaaattctggaaac

SEQ ID NO: 336423 - DNA, 25 bp, Rattus norvegicus
gagaggctcttgtaattctggaaac

SEQ ID NO: 336424 - DNA, 25 bp, Rattus norvegicus
gagaggctgaaacccaccagccgca

SEQ ID NO: 336425 - DNA, 25 bp, Rattus norvegicus
gagaggctgaaagccaccagccgca

SEQ ID NO: 336426 - DNA, 25 bp, Rattus norvegicus
gagaggctgagcaacccaatggaga

SEQ ID NO: 336427 - DNA, 25 bp, Rattus norvegicus
gagaggctgagctacccaatggaga

SEQ ID NO: 336428 - DNA, 25 bp, Rattus norvegicus
gagaggctgattccttcttgtgtaa

SEQ ID NO: 336429 - DNA, 25 bp, Rattus norvegicus
gagaggctgattgcttcttgtgtaa

SEQ ID NO: 336430 - DNA, 25 bp, Rattus norvegicus
gagaggctgcacaagctagtatgtt

SEQ ID NO: 336431 - DNA, 25 bp, Rattus norvegicus
gagaggctgcactagctagtatgtt

SEQ ID NO: 336432 - DNA, 25 bp, Rattus norvegicus
gagaggctgctgattatctgacaaa

SEQ ID NO: 336433 - DNA, 25 bp, Rattus norvegicus
gagaggctgctgtttatctgacaaa

SEQ ID NO: 336434 - DNA, 25 bp, Rattus norvegicus
gagaggctggaactactggtaaact

SEQ ID NO: 336435 - DNA, 25 bp, Rattus norvegicus
gagaggctggaagtactggtaaact

SEQ ID NO: 336436 - DNA, 25 bp, Rattus norvegicus
gagaggcttaaacatctcatggttt

SEQ ID NO: 336437 - DNA, 25 bp, Rattus norvegicus
gagaggcttaaagatctcatggttt

SEQ ID NO: 336438 - DNA, 25 bp, Rattus norvegicus
gagaggcttcttcttggaacaagac

SEQ ID NO: 336439 - DNA, 25 bp, Rattus norvegicus
gagaggcttcttgttggaacaagac

SEQ ID NO: 336440 - DNA, 25 bp, Rattus norvegicus
gagaggctttgtactgtgtcaacta

SEQ ID NO: 336441 - DNA, 25 bp, Rattus norvegicus
gagaggctttgttctgtgtcaacta

SEQ ID NO: 336442 - DNA, 25 bp, Rattus norvegicus
gagaggctttttaacttctaacaca

SEQ ID NO: 336443 - DNA, 25 bp, Rattus norvegicus
gagaggcttttttacttctaacaca

SEQ ID NO: 336444 - DNA, 25 bp, Rattus norvegicus
gagagggaaatcctgcgtgacatta

SEQ ID NO: 336445 - DNA, 25 bp, Rattus norvegicus
gagagggaaatcgtgcgtgacatta

SEQ ID NO: 336446 - DNA, 25 bp, Rattus norvegicus
gagagggaacgtccttctaagtgtt

SEQ ID NO: 336447 - DNA, 25 bp, Rattus norvegicus
gagagggaacgtgcttctaagtgtt

SEQ ID NO: 336448 - DNA, 25 bp, Rattus norvegicus
gagagggaagctctttacgccctga

SEQ ID NO: 336449 - DNA, 25 bp, Rattus norvegicus
gagagggaagctgtttacgccctga

SEQ ID NO: 336450 - DNA, 25 bp, Rattus norvegicus
gagagggacaacaccagctaccacg

SEQ ID NO: 336451 - DNA, 25 bp, Rattus norvegicus
gagagggacaactccagctaccacg

SEQ ID NO: 336452 - DNA, 25 bp, Rattus norvegicus
gagagggacgccatcagagccatgc

SEQ ID NO: 336453 - DNA, 25 bp, Rattus norvegicus
gagagggacgccttcagagccatgc

SEQ ID NO: 336454 - DNA, 25 bp, Rattus norvegicus
gagagggacttgcagctgtattatt

SEQ ID NO: 336455 - DNA, 25 bp, Rattus norvegicus
gagagggacttggagctgtattatt

SEQ ID NO: 336456 - DNA, 25 bp, Rattus norvegicus
gagagggagaccagcctcaccatgc

SEQ ID NO: 336457 - DNA, 25 bp, Rattus norvegicus
gagagggagacctgcctcaccatgc

SEQ ID NO: 336458 - DNA, 25 bp, Rattus norvegicus
gagagggagctcctgcttctgcttc

SEQ ID NO: 336459 - DNA, 25 bp, Rattus norvegicus
gagagggagctcgtgcttctgcttc

SEQ ID NO: 336460 - DNA, 25 bp, Rattus norvegicus
gagagggagctgaccttctgacctt

SEQ ID NO: 336461 - DNA, 25 bp, Rattus norvegicus
gagagggagctgatcataacccaag

SEQ ID NO: 336462 - DNA, 25 bp, Rattus norvegicus
gagagggagctgtccttctgacctt

SEQ ID NO: 336463 - DNA, 25 bp, Rattus norvegicus
gagagggagctgttcataacccaag

SEQ ID NO: 336464 - DNA, 25 bp, Rattus norvegicus
gagagggaggctacgggcccaggca

SEQ ID NO: 336465 - DNA, 25 bp, Rattus norvegicus
gagagggaggcttcgggcccaggca

SEQ ID NO: 336466 - DNA, 25 bp, Rattus norvegicus
gagagggagtaaacacagcatggac

SEQ ID NO: 336467 - DNA, 25 bp, Rattus norvegicus
gagagggagtaatcacagcatggac

SEQ ID NO: 336468 - DNA, 25 bp, Rattus norvegicus
gagagggagtccattgccaactgat

SEQ ID NO: 336469 - DNA, 25 bp, Rattus norvegicus
gagagggagtcctttgccaactgat

SEQ ID NO: 336470 - DNA, 25 bp, Rattus norvegicus
gagagggagtgacctcacttgccct

SEQ ID NO: 336471 - DNA, 25 bp, Rattus norvegicus
gagagggagtgagctcacttgccct

SEQ ID NO: 336472 - DNA, 25 bp, Rattus norvegicus
gagagggatcatcgcccatcaaaac

SEQ ID NO: 336473 - DNA, 25 bp, Rattus norvegicus
gagagggatcatggcccatcaaaac

SEQ ID NO: 336474 - DNA, 25 bp, Rattus norvegicus
gagagggatctcacctgctctgaag

SEQ ID NO: 336475 - DNA, 25 bp, Rattus norvegicus
gagagggatctctcctgctctgaag

SEQ ID NO: 336476 - DNA, 25 bp, Rattus norvegicus
gagagggattaaatgcaagctggac

SEQ ID NO: 336477 - DNA, 25 bp, Rattus norvegicus
gagagggattaattgcaagctggac

SEQ ID NO: 336478 - DNA, 25 bp, Rattus norvegicus
gagagggcaacccttgtcctcagac

SEQ ID NO: 336479 - DNA, 25 bp, Rattus norvegicus
gagagggcaaccgttgtcctcagac

SEQ ID NO: 336480 - DNA, 25 bp, Rattus norvegicus
gagagggcacacaaagctacaggaa

SEQ ID NO: 336481 - DNA, 25 bp, Rattus norvegicus
gagagggcacactaagctacaggaa

SEQ ID NO: 336482 - DNA, 25 bp, Rattus norvegicus
gagagggcagccatgtcacttccat

SEQ ID NO: 336483 - DNA, 25 bp, Rattus norvegicus
gagagggcagccttgtcacttccat

SEQ ID NO: 336484 - DNA, 25 bp, Rattus norvegicus
gagagggcatcaaaccccatagaaa

SEQ ID NO: 336485 - DNA, 25 bp, Rattus norvegicus
gagagggcatcataccccatagaaa

SEQ ID NO: 336486 - DNA, 25 bp, Rattus norvegicus
gagagggcattactcccctgaccat

SEQ ID NO: 336487 - DNA, 25 bp, Rattus norvegicus
gagagggcattagtcccctgaccat

SEQ ID NO: 336488 - DNA, 25 bp, Rattus norvegicus
gagagggcattgaatccgctagaat

SEQ ID NO: 336489 - DNA, 25 bp, Rattus norvegicus
gagagggcattgtatccgctagaat

SEQ ID NO: 336490 - DNA, 25 bp, Rattus norvegicus
gagagggcccacactgtagccaagg

SEQ ID NO: 336491 - DNA, 25 bp, Rattus norvegicus
gagagggcccactctgtagccaagg

SEQ ID NO: 336492 - DNA, 25 bp, Rattus norvegicus
gagagggccctcactagcagttaac

SEQ ID NO: 336493 - DNA, 25 bp, Rattus norvegicus
gagagggccctctctagcagttaac

SEQ ID NO: 336494 - DNA, 25 bp, Rattus norvegicus
gagagggccgagagatgttcccact

SEQ ID NO: 336495 - DNA, 25 bp, Rattus norvegicus
gagagggccgagtgatgttcccact

SEQ ID NO: 336496 - DNA, 25 bp, Rattus norvegicus
gagagggctaaactcccttgggatt

SEQ ID NO: 336497 - DNA, 25 bp, Rattus norvegicus
gagagggctaaagtcccttgggatt

SEQ ID NO: 336498 - DNA, 25 bp, Rattus norvegicus
gagagggctagtacagtacttcaaa

SEQ ID NO: 336499 - DNA, 25 bp, Rattus norvegicus
gagagggctagttcagtacttcaaa

SEQ ID NO: 336500 - DNA, 25 bp, Rattus norvegicus
gagagggctcagctgttaacagcat

SEQ ID NO: 336501 - DNA, 25 bp, Rattus norvegicus
gagagggctcaggtgttaacagcat

SEQ ID NO: 336502 - DNA, 25 bp, Rattus norvegicus
gagagggctcgcaggctctctagtc

SEQ ID NO: 336503 - DNA, 25 bp, Rattus norvegicus
gagagggctcgctggctctctagtc

SEQ ID NO: 336504 - DNA, 25 bp, Rattus norvegicus
gagagggctgctataaagtcgtcac

SEQ ID NO: 336505 - DNA, 25 bp, Rattus norvegicus
gagagggctgctttaaagtcgtcac

SEQ ID NO: 336506 - DNA, 25 bp, Rattus norvegicus
gagagggctgtgctatcataagtaa

SEQ ID NO: 336507 - DNA, 25 bp, Rattus norvegicus
gagagggctgtggtatcataagtaa

SEQ ID NO: 336508 - DNA, 25 bp, Rattus norvegicus
gagagggtatgcaggtaccttgccc

SEQ ID NO: 336509 - DNA, 25 bp, Rattus norvegicus
gagagggtatgctggtaccttgccc

SEQ ID NO: 336510 - DNA, 25 bp, Rattus norvegicus
gagagggtcaccatcactgtgtcta

SEQ ID NO: 336511 - DNA, 25 bp, Rattus norvegicus
gagagggtcaccttcactgtgtcta

SEQ ID NO: 336512 - DNA, 25 bp, Rattus norvegicus
gagagggtcagtcctggttttattt

SEQ ID NO: 336513 - DNA, 25 bp, Rattus norvegicus
gagagggtcagtgctggttttattt

SEQ ID NO: 336514 - DNA, 25 bp, Rattus norvegicus
gagagggtccttcctagctctggtc

SEQ ID NO: 336515 - DNA, 25 bp, Rattus norvegicus
gagagggtccttgctagctctggtc

SEQ ID NO: 336516 - DNA, 25 bp, Rattus norvegicus
gagagggtctctagggcccctatat

SEQ ID NO: 336517 - DNA, 25 bp, Rattus norvegicus
gagagggtctcttgggcccctatat

SEQ ID NO: 336518 - DNA, 25 bp, Rattus norvegicus
gagagggttcacattcgtctaactc

SEQ ID NO: 336519 - DNA, 25 bp, Rattus norvegicus
gagagggttcactttcgtctaactc

SEQ ID NO: 336520 - DNA, 25 bp, Rattus norvegicus
gagaggtacccacaggcagagacca

SEQ ID NO: 336521 - DNA, 25 bp, Rattus norvegicus
gagaggtacccagaggcagagacca

SEQ ID NO: 336522 - DNA, 25 bp, Rattus norvegicus
gagaggtagcagatagccgtcttga

SEQ ID NO: 336523 - DNA, 25 bp, Rattus norvegicus
gagaggtagcagttagccgtcttga

SEQ ID NO: 336524 - DNA, 25 bp, Rattus norvegicus
gagaggtagctcaagggccctttct

SEQ ID NO: 336525 - DNA, 25 bp, Rattus norvegicus
gagaggtagctctagggccctttct

SEQ ID NO: 336526 - DNA, 25 bp, Rattus norvegicus
gagaggtagtaacttctttccagta

SEQ ID NO: 336527 - DNA, 25 bp, Rattus norvegicus
gagaggtagtaagttctttccagta

SEQ ID NO: 336528 - DNA, 25 bp, Rattus norvegicus
gagaggtattgaacctagatcttct

SEQ ID NO: 336529 - DNA, 25 bp, Rattus norvegicus
gagaggtattgatcctagatcttct

SEQ ID NO: 336530 - DNA, 25 bp, Rattus norvegicus
gagaggtcaatgaacttggccagta

SEQ ID NO: 336531 - DNA, 25 bp, Rattus norvegicus
gagaggtcaatgtacttggccagta

SEQ ID NO: 336532 - DNA, 25 bp, Rattus norvegicus
gagaggtcagctccccgaggtcaca

SEQ ID NO: 336533 - DNA, 25 bp, Rattus norvegicus
gagaggtcagctgcccgaggtcaca

SEQ ID NO: 336534 - DNA, 25 bp, Rattus norvegicus
gagaggtccaacactgttctcgagt

SEQ ID NO: 336535 - DNA, 25 bp, Rattus norvegicus
gagaggtccaactctgttctcgagt

SEQ ID NO: 336536 - DNA, 25 bp, Rattus norvegicus
gagaggtcctcactcctgtgaagac

SEQ ID NO: 336537 - DNA, 25 bp, Rattus norvegicus
gagaggtcctcagtcctgtgaagac

SEQ ID NO: 336538 - DNA, 25 bp, Rattus norvegicus
gagaggtcctgaaaagagccctttt

SEQ ID NO: 336539 - DNA, 25 bp, Rattus norvegicus
gagaggtcctgataagagccctttt

SEQ ID NO: 336540 - DNA, 25 bp, Rattus norvegicus
gagaggtctactcttcatgggttat

SEQ ID NO: 336541 - DNA, 25 bp, Rattus norvegicus
gagaggtctactgttcatgggttat

SEQ ID NO: 336542 - DNA, 25 bp, Rattus norvegicus
gagaggtctccacaaataaatgaat

SEQ ID NO: 336543 - DNA, 25 bp, Rattus norvegicus
gagaggtctccagaaataaatgaat

SEQ ID NO: 336544 - DNA, 25 bp, Rattus norvegicus
gagaggtctcctcagatctgtccag

SEQ ID NO: 336545 - DNA, 25 bp, Rattus norvegicus
gagaggtctcctgagatctgtccag

SEQ ID NO: 336546 - DNA, 25 bp, Rattus norvegicus
gagaggtctctaatacataggtcaa

SEQ ID NO: 336547 - DNA, 25 bp, Rattus norvegicus
gagaggtctctattacataggtcaa

SEQ ID NO: 336548 - DNA, 25 bp, Rattus norvegicus
gagaggtctgacaggttctagccat

SEQ ID NO: 336549 - DNA, 25 bp, Rattus norvegicus
gagaggtctgactggttctagccat

SEQ ID NO: 336550 - DNA, 25 bp, Rattus norvegicus
gagaggtctgcaatttaatctatag

SEQ ID NO: 336551 - DNA, 25 bp, Rattus norvegicus
gagaggtctgcattttaatctatag

SEQ ID NO: 336552 - DNA, 25 bp, Rattus norvegicus
gagaggtcttctaggagttcctagt

SEQ ID NO: 336553 - DNA, 25 bp, Rattus norvegicus
gagaggtcttcttggagttcctagt

SEQ ID NO: 336554 - DNA, 25 bp, Rattus norvegicus
gagaggtctttcctcattgctgagg

SEQ ID NO: 336555 - DNA, 25 bp, Rattus norvegicus
gagaggtctttcgtcattgctgagg

SEQ ID NO: 336556 - DNA, 25 bp, Rattus norvegicus
gagaggtgaagtaccaggaccacaa

SEQ ID NO: 336557 - DNA, 25 bp, Rattus norvegicus
gagaggtgaagttccaggaccacaa

SEQ ID NO: 336558 - DNA, 25 bp, Rattus norvegicus
gagaggtgacccactaaagctacca

SEQ ID NO: 336559 - DNA, 25 bp, Rattus norvegicus
gagaggtgaccctctaaagctacca

SEQ ID NO: 336560 - DNA, 25 bp, Rattus norvegicus
gagaggtgacctaggtggctaccat

SEQ ID NO: 336561 - DNA, 25 bp, Rattus norvegicus
gagaggtgaccttggtggctaccat

SEQ ID NO: 336562 - DNA, 25 bp, Rattus norvegicus
gagaggtgcaggaggtttccccttc

SEQ ID NO: 336563 - DNA, 25 bp, Rattus norvegicus
gagaggtgcaggtggtttccccttc

SEQ ID NO: 336564 - DNA, 25 bp, Rattus norvegicus
gagaggtgcccgagacagcttgtca

SEQ ID NO: 336565 - DNA, 25 bp, Rattus norvegicus
gagaggtgcccgtgacagcttgtca

SEQ ID NO: 336566 - DNA, 25 bp, Rattus norvegicus
gagaggtgccgccacagaaacttca

SEQ ID NO: 336567 - DNA, 25 bp, Rattus norvegicus
gagaggtgccgcgacagaaacttca

SEQ ID NO: 336568 - DNA, 25 bp, Rattus norvegicus
gagaggtgtcctactacagtgtgaa

SEQ ID NO: 336569 - DNA, 25 bp, Rattus norvegicus
gagaggtgtccttctacagtgtgaa

SEQ ID NO: 336570 - DNA, 25 bp, Rattus norvegicus
gagaggtgtgctatctaccaagcct

SEQ ID NO: 336571 - DNA, 25 bp, Rattus norvegicus
gagaggtgtgctttctaccaagcct

SEQ ID NO: 336572 - DNA, 25 bp, Rattus norvegicus
gagaggtgtgtgaccatacgtccgc

SEQ ID NO: 336573 - DNA, 25 bp, Rattus norvegicus
gagaggtgtgtgtccatacgtccgc

SEQ ID NO: 336574 - DNA, 25 bp, Rattus norvegicus
gagaggttacagatgctatgttcaa

SEQ ID NO: 336575 - DNA, 25 bp, Rattus norvegicus
gagaggttacagttgctatgttcaa

SEQ ID NO: 336576 - DNA, 25 bp, Rattus norvegicus
gagaggttatgcagacctccctatt

SEQ ID NO: 336577 - DNA, 25 bp, Rattus norvegicus
gagaggttatgctgacctccctatt

SEQ ID NO: 336578 - DNA, 25 bp, Rattus norvegicus
gagaggttcattattaatgccataa

SEQ ID NO: 336579 - DNA, 25 bp, Rattus norvegicus
gagaggttcatttttaatgccataa

SEQ ID NO: 336580 - DNA, 25 bp, Rattus norvegicus
gagaggttcctgcacatgccaccgc

SEQ ID NO: 336581 - DNA, 25 bp, Rattus norvegicus
gagaggttcctggacatgccaccgc

SEQ ID NO: 336582 - DNA, 25 bp, Rattus norvegicus
gagaggttctccctgagaaatccat

SEQ ID NO: 336583 - DNA, 25 bp, Rattus norvegicus
gagaggttctccgtgagaaatccat

SEQ ID NO: 336584 - DNA, 25 bp, Rattus norvegicus
gagaggttgctccattacgtcccca

SEQ ID NO: 336585 - DNA, 25 bp, Rattus norvegicus
gagaggttgctcgattacgtcccca

SEQ ID NO: 336586 - DNA, 25 bp, Rattus norvegicus
gagaggttggagcatttccctcact

SEQ ID NO: 336587 - DNA, 25 bp, Rattus norvegicus
gagaggttggaggatttccctcact

SEQ ID NO: 336588 - DNA, 25 bp, Rattus norvegicus
gagaggttggctcatacccagtccc

SEQ ID NO: 336589 - DNA, 25 bp, Rattus norvegicus
gagaggttggctgatacccagtccc

SEQ ID NO: 336590 - DNA, 25 bp, Rattus norvegicus
gagaggttgtcaatgacctttcccc

SEQ ID NO: 336591 - DNA, 25 bp, Rattus norvegicus
gagaggttgtcattgacctttcccc

SEQ ID NO: 336592 - DNA, 25 bp, Rattus norvegicus
gagaggtttaccaaggccctgccaa

SEQ ID NO: 336593 - DNA, 25 bp, Rattus norvegicus
gagaggtttacctaggccctgccaa

SEQ ID NO: 336594 - DNA, 25 bp, Rattus norvegicus
gagaggtttatgctatcacttcaga

SEQ ID NO: 336595 - DNA, 25 bp, Rattus norvegicus
gagaggtttatggtatcacttcaga

SEQ ID NO: 336596 - DNA, 25 bp, Rattus norvegicus
gagaggtttggtattcatttactgt

SEQ ID NO: 336597 - DNA, 25 bp, Rattus norvegicus
gagaggtttggttttcatttactgt

SEQ ID NO: 336598 - DNA, 25 bp, Rattus norvegicus
gagagtaacttaactgcttcttaat

SEQ ID NO: 336599 - DNA, 25 bp, Rattus norvegicus
gagagtaacttatctgcttcttaat

SEQ ID NO: 336600 - DNA, 25 bp, Rattus norvegicus
gagagtaactttcctttcttctcct

SEQ ID NO: 336601 - DNA, 25 bp, Rattus norvegicus
gagagtaactttgctttcttctcct

SEQ ID NO: 336602 - DNA, 25 bp, Rattus norvegicus
gagagtaagctcagtccaacacaat

SEQ ID NO: 336603 - DNA, 25 bp, Rattus norvegicus
gagagtaagctctgtccaacacaat

SEQ ID NO: 336604 - DNA, 25 bp, Rattus norvegicus
gagagtacaggcagctggtcccagc

SEQ ID NO: 336605 - DNA, 25 bp, Rattus norvegicus
gagagtacaggctgctggtcccagc

SEQ ID NO: 336606 - DNA, 25 bp, Rattus norvegicus
gagagtaccatgacaagatagagat

SEQ ID NO: 336607 - DNA, 25 bp, Rattus norvegicus
gagagtaccatgtcaagatagagat

SEQ ID NO: 336608 - DNA, 25 bp, Rattus norvegicus
gagagtaccattcttggttgccgaa

SEQ ID NO: 336609 - DNA, 25 bp, Rattus norvegicus
gagagtaccattgttggttgccgaa

SEQ ID NO: 336610 - DNA, 25 bp, Rattus norvegicus
gagagtacccaacaggaagcacgtt

SEQ ID NO: 336611 - DNA, 25 bp, Rattus norvegicus
gagagtacccaagaggaagcacgtt

SEQ ID NO: 336612 - DNA, 25 bp, Rattus norvegicus
gagagtacctctctgacaaatggac

SEQ ID NO: 336613 - DNA, 25 bp, Rattus norvegicus
gagagtacctctgtgacaaatggac

SEQ ID NO: 336614 - DNA, 25 bp, Rattus norvegicus
gagagtacctgtcctcagatgtctg

SEQ ID NO: 336615 - DNA, 25 bp, Rattus norvegicus
gagagtacctgtgctcagatgtctg

SEQ ID NO: 336616 - DNA, 25 bp, Rattus norvegicus
gagagtacctttaagtgagggccct

SEQ ID NO: 336617 - DNA, 25 bp, Rattus norvegicus
gagagtaccttttagtgagggccct

SEQ ID NO: 336618 - DNA, 25 bp, Rattus norvegicus
gagagtactgggactatgaatcaca

SEQ ID NO: 336619 - DNA, 25 bp, Rattus norvegicus
gagagtactgggtctatgaatcaca

SEQ ID NO: 336620 - DNA, 25 bp, Rattus norvegicus
gagagtacttccagtattttcttca

SEQ ID NO: 336621 - DNA, 25 bp, Rattus norvegicus
gagagtacttcctgtattttcttca

SEQ ID NO: 336622 - DNA, 25 bp, Rattus norvegicus
gagagtactttaacaggccagccat

SEQ ID NO: 336623 - DNA, 25 bp, Rattus norvegicus
gagagtactttatcaggccagccat

SEQ ID NO: 336624 - DNA, 25 bp, Rattus norvegicus
gagagtactttcctgatcactacaa

SEQ ID NO: 336625 - DNA, 25 bp, Rattus norvegicus
gagagtactttcgtgatcactacaa

SEQ ID NO: 336626 - DNA, 25 bp, Rattus norvegicus
gagagtagccaccatcttaaagcaa

SEQ ID NO: 336627 - DNA, 25 bp, Rattus norvegicus
gagagtagccacgatcttaaagcaa

SEQ ID NO: 336628 - DNA, 25 bp, Rattus norvegicus
gagagtagcccacgccatggcaaaa

SEQ ID NO: 336629 - DNA, 25 bp, Rattus norvegicus
gagagtagcccaggccatggcaaaa

SEQ ID NO: 336630 - DNA, 25 bp, Rattus norvegicus
gagagtagcctaagccacacagcaa

SEQ ID NO: 336631 - DNA, 25 bp, Rattus norvegicus
gagagtagcctacacacttttccac

SEQ ID NO: 336632 - DNA, 25 bp, Rattus norvegicus
gagagtagcctagacacttttccac

SEQ ID NO: 336633 - DNA, 25 bp, Rattus norvegicus
gagagtagcctatgccacacagcaa

SEQ ID NO: 336634 - DNA, 25 bp, Rattus norvegicus
gagagtagcgtgacattccctctgt

SEQ ID NO: 336635 - DNA, 25 bp, Rattus norvegicus
gagagtagcgtgtcattccctctgt

SEQ ID NO: 336636 - DNA, 25 bp, Rattus norvegicus
gagagtagctctcagcaagcatcag

SEQ ID NO: 336637 - DNA, 25 bp, Rattus norvegicus
gagagtagctctgagcaagcatcag

SEQ ID NO: 336638 - DNA, 25 bp, Rattus norvegicus
gagagtagctgaactccatgtccag

SEQ ID NO: 336639 - DNA, 25 bp, Rattus norvegicus
gagagtagctgatctccatgtccag

SEQ ID NO: 336640 - DNA, 25 bp, Rattus norvegicus
gagagtagcttcacacagctttcca

SEQ ID NO: 336641 - DNA, 25 bp, Rattus norvegicus
gagagtagcttctcacagctttcca

SEQ ID NO: 336642 - DNA, 25 bp, Rattus norvegicus
gagagtaggctcactagccacccca

SEQ ID NO: 336643 - DNA, 25 bp, Rattus norvegicus
gagagtaggctctctagccacccca

SEQ ID NO: 336644 - DNA, 25 bp, Rattus norvegicus
gagagtatactgataatcttacaac

SEQ ID NO: 336645 - DNA, 25 bp, Rattus norvegicus
gagagtatactgttaatcttacaac

SEQ ID NO: 336646 - DNA, 25 bp, Rattus norvegicus
gagagtatagccatggcagccatac

SEQ ID NO: 336647 - DNA, 25 bp, Rattus norvegicus
gagagtatagccttggcagccatac

SEQ ID NO: 336648 - DNA, 25 bp, Rattus norvegicus
gagagtatattcattagaccagctt

SEQ ID NO: 336649 - DNA, 25 bp, Rattus norvegicus
gagagtatattctttagaccagctt

SEQ ID NO: 336650 - DNA, 25 bp, Rattus norvegicus
gagagtatcactcagtgccacatgt

SEQ ID NO: 336651 - DNA, 25 bp, Rattus norvegicus
gagagtatcactgagtgccacatgt

SEQ ID NO: 336652 - DNA, 25 bp, Rattus norvegicus
gagagtatcagtatgcatgacattt

SEQ ID NO: 336653 - DNA, 25 bp, Rattus norvegicus
gagagtatcagtttgcatgacattt

SEQ ID NO: 336654 - DNA, 25 bp, Rattus norvegicus
gagagtatcatgctccttgcttcac

SEQ ID NO: 336655 - DNA, 25 bp, Rattus norvegicus
gagagtatcatggtccttgcttcac

SEQ ID NO: 336656 - DNA, 25 bp, Rattus norvegicus
gagagtatccatctggtaacattgg

SEQ ID NO: 336657 - DNA, 25 bp, Rattus norvegicus
gagagtatccatgtggtaacattgg

SEQ ID NO: 336658 - DNA, 25 bp, Rattus norvegicus
gagagtatcgataccttacaacttt

SEQ ID NO: 336659 - DNA, 25 bp, Rattus norvegicus
gagagtatcgattccttacaacttt

SEQ ID NO: 336660 - DNA, 25 bp, Rattus norvegicus
gagagtatctgtaatctcgcagtat

SEQ ID NO: 336661 - DNA, 25 bp, Rattus norvegicus
gagagtatctgttatctcgcagtat

SEQ ID NO: 336662 - DNA, 25 bp, Rattus norvegicus
gagagtatttgtactgcctattgta

SEQ ID NO: 336663 - DNA, 25 bp, Rattus norvegicus
gagagtatttgttctgcctattgta

SEQ ID NO: 336664 - DNA, 25 bp, Rattus norvegicus
gagagtcaacatcgtcttcaactat

SEQ ID NO: 336665 - DNA, 25 bp, Rattus norvegicus
gagagtcaacatggtcttcaactat

SEQ ID NO: 336666 - DNA, 25 bp, Rattus norvegicus
gagagtcaagcgatccatcactaga

SEQ ID NO: 336667 - DNA, 25 bp, Rattus norvegicus
gagagtcaagcgttccatcactaga

SEQ ID NO: 336668 - DNA, 25 bp, Rattus norvegicus
gagagtcaagttccgtcttcataat

SEQ ID NO: 336669 - DNA, 25 bp, Rattus norvegicus
gagagtcaagttgcgtcttcataat

SEQ ID NO: 336670 - DNA, 25 bp, Rattus norvegicus
gagagtcacagaaggtgtcccacgt

SEQ ID NO: 336671 - DNA, 25 bp, Rattus norvegicus
gagagtcacagatggtgtcccacgt

SEQ ID NO: 336672 - DNA, 25 bp, Rattus norvegicus
gagagtcaccaacacctctagttgt

SEQ ID NO: 336673 - DNA, 25 bp, Rattus norvegicus
gagagtcaccaagacctctagttgt

SEQ ID NO: 336674 - DNA, 25 bp, Rattus norvegicus
gagagtcaccgacagctcagtggaa

SEQ ID NO: 336675 - DNA, 25 bp, Rattus norvegicus
gagagtcaccgagagctcagtggaa

SEQ ID NO: 336676 - DNA, 25 bp, Rattus norvegicus
gagagtcagatcactggttctgcat

SEQ ID NO: 336677 - DNA, 25 bp, Rattus norvegicus
gagagtcagatctctggttctgcat

SEQ ID NO: 336678 - DNA, 25 bp, Rattus norvegicus
gagagtcagcctcaagggtgtcttt

SEQ ID NO: 336679 - DNA, 25 bp, Rattus norvegicus
gagagtcagcctgaagggtgtcttt

SEQ ID NO: 336680 - DNA, 25 bp, Rattus norvegicus
gagagtcagtgaagctgataagaat

SEQ ID NO: 336681 - DNA, 25 bp, Rattus norvegicus
gagagtcagtgatgctgataagaat

SEQ ID NO: 336682 - DNA, 25 bp, Rattus norvegicus
gagagtcagtgcatcagaacagcat

SEQ ID NO: 336683 - DNA, 25 bp, Rattus norvegicus
gagagtcagtgcttcagaacagcat

SEQ ID NO: 336684 - DNA, 25 bp, Rattus norvegicus
gagagtcatccactcagacatgctc

SEQ ID NO: 336685 - DNA, 25 bp, Rattus norvegicus
gagagtcatccagtcagacatgctc

SEQ ID NO: 336686 - DNA, 25 bp, Rattus norvegicus
gagagtcatcctaaaggcaccagat

SEQ ID NO: 336687 - DNA, 25 bp, Rattus norvegicus
gagagtcatccttaaggcaccagat

SEQ ID NO: 336688 - DNA, 25 bp, Rattus norvegicus
gagagtcatcttcaaccagctcctt

SEQ ID NO: 336689 - DNA, 25 bp, Rattus norvegicus
gagagtcatcttgaaccagctcctt

SEQ ID NO: 336690 - DNA, 25 bp, Rattus norvegicus
gagagtcattaccagctccagctgt

SEQ ID NO: 336691 - DNA, 25 bp, Rattus norvegicus
gagagtcattacgagctccagctgt

SEQ ID NO: 336692 - DNA, 25 bp, Rattus norvegicus
gagagtcattgaaaacccacaggat

SEQ ID NO: 336693 - DNA, 25 bp, Rattus norvegicus
gagagtcattgataacccacaggat

SEQ ID NO: 336694 - DNA, 25 bp, Rattus norvegicus
gagagtccaagcctgaggagccacc

SEQ ID NO: 336695 - DNA, 25 bp, Rattus norvegicus
gagagtccaagcgtgaggagccacc

SEQ ID NO: 336696 - DNA, 25 bp, Rattus norvegicus
gagagtccaccaccatcattttagc

SEQ ID NO: 336697 - DNA, 25 bp, Rattus norvegicus
gagagtccaccagcatcattttagc

SEQ ID NO: 336698 - DNA, 25 bp, Rattus norvegicus
gagagtccactgaccaaggagtgct

SEQ ID NO: 336699 - DNA, 25 bp, Rattus norvegicus
gagagtccactgtccaaggagtgct

SEQ ID NO: 336700 - DNA, 25 bp, Rattus norvegicus
gagagtccacttctatcaggccaca

SEQ ID NO: 336701 - DNA, 25 bp, Rattus norvegicus
gagagtccacttgtatcaggccaca

SEQ ID NO: 336702 - DNA, 25 bp, Rattus norvegicus
gagagtccagacaccttgagtgcta

SEQ ID NO: 336703 - DNA, 25 bp, Rattus norvegicus
gagagtccagactccttgagtgcta

SEQ ID NO: 336704 - DNA, 25 bp, Rattus norvegicus
gagagtccagccatgttcattttat

SEQ ID NO: 336705 - DNA, 25 bp, Rattus norvegicus
gagagtccagccttgttcattttat

SEQ ID NO: 336706 - DNA, 25 bp, Rattus norvegicus
gagagtccagctccccaaagaaaaa

SEQ ID NO: 336707 - DNA, 25 bp, Rattus norvegicus
gagagtccagctgcccaaagaaaaa

SEQ ID NO: 336708 - DNA, 25 bp, Rattus norvegicus
gagagtccagtaaccattttgatct

SEQ ID NO: 336709 - DNA, 25 bp, Rattus norvegicus
gagagtccagtatccattttgatct

SEQ ID NO: 336710 - DNA, 25 bp, Rattus norvegicus
gagagtccagtgatgtccgtggtca

SEQ ID NO: 336711 - DNA, 25 bp, Rattus norvegicus
gagagtccagtgttgtccgtggtca

SEQ ID NO: 336712 - DNA, 25 bp, Rattus norvegicus
gagagtccagttaccattatttaga

SEQ ID NO: 336713 - DNA, 25 bp, Rattus norvegicus
gagagtccagttcccgacatattgc

SEQ ID NO: 336714 - DNA, 25 bp, Rattus norvegicus
gagagtccagttgccgacatattgc

SEQ ID NO: 336715 - DNA, 25 bp, Rattus norvegicus
gagagtccagtttccattatttaga

SEQ ID NO: 336716 - DNA, 25 bp, Rattus norvegicus
gagagtccattacccgtttcccaga

SEQ ID NO: 336717 - DNA, 25 bp, Rattus norvegicus
gagagtccattagccgtttcccaga

SEQ ID NO: 336718 - DNA, 25 bp, Rattus norvegicus
gagagtcccatcctggtggtactga

SEQ ID NO: 336719 - DNA, 25 bp, Rattus norvegicus
gagagtcccatcgtggtggtactga

SEQ ID NO: 336720 - DNA, 25 bp, Rattus norvegicus
gagagtcccgagacagttgcctgta

SEQ ID NO: 336721 - DNA, 25 bp, Rattus norvegicus
gagagtcccgagtcagttgcctgta

SEQ ID NO: 336722 - DNA, 25 bp, Rattus norvegicus
gagagtcccggacccagagtcgctt

SEQ ID NO: 336723 - DNA, 25 bp, Rattus norvegicus
gagagtcccggagccagagtcgctt

SEQ ID NO: 336724 - DNA, 25 bp, Rattus norvegicus
gagagtcccgttcttcatgtaagtc

SEQ ID NO: 336725 - DNA, 25 bp, Rattus norvegicus
gagagtcccgttgttcatgtaagtc

SEQ ID NO: 336726 - DNA, 25 bp, Rattus norvegicus
gagagtccgcaaacacgggtcttca

SEQ ID NO: 336727 - DNA, 25 bp, Rattus norvegicus
gagagtccgcaatcacgggtcttca

SEQ ID NO: 336728 - DNA, 25 bp, Rattus norvegicus
gagagtcctaaaagggcctcccatg

SEQ ID NO: 336729 - DNA, 25 bp, Rattus norvegicus
gagagtcctaaatgggcctcccatg

SEQ ID NO: 336730 - DNA, 25 bp, Rattus norvegicus
gagagtcctaagatggcagaggcca

SEQ ID NO: 336731 - DNA, 25 bp, Rattus norvegicus
gagagtcctaagttggcagaggcca

SEQ ID NO: 336732 - DNA, 25 bp, Rattus norvegicus
gagagtcctaatcaactcggccctc

SEQ ID NO: 336733 - DNA, 25 bp, Rattus norvegicus
gagagtcctaatgaactcggccctc

SEQ ID NO: 336734 - DNA, 25 bp, Rattus norvegicus
gagagtcctataacttgtgtctgag

SEQ ID NO: 336735 - DNA, 25 bp, Rattus norvegicus
gagagtcctatatcttgtgtctgag

SEQ ID NO: 336736 - DNA, 25 bp, Rattus norvegicus
gagagtcctcctaccgcataactta

SEQ ID NO: 336737 - DNA, 25 bp, Rattus norvegicus
gagagtcctccttccgcataactta

SEQ ID NO: 336738 - DNA, 25 bp, Rattus norvegicus
gagagtcctgaaatcctactgggtt

SEQ ID NO: 336739 - DNA, 25 bp, Rattus norvegicus
gagagtcctgaattcctactgggtt

SEQ ID NO: 336740 - DNA, 25 bp, Rattus norvegicus
gagagtcctgcaacagtcataacta

SEQ ID NO: 336741 - DNA, 25 bp, Rattus norvegicus
gagagtcctgcatcagtcataacta

SEQ ID NO: 336742 - DNA, 25 bp, Rattus norvegicus
gagagtcctggccatgcatatgcaa

SEQ ID NO: 336743 - DNA, 25 bp, Rattus norvegicus
gagagtcctggcgatgcatatgcaa

SEQ ID NO: 336744 - DNA, 25 bp, Rattus norvegicus
gagagtccttgcctcagtgaataag

SEQ ID NO: 336745 - DNA, 25 bp, Rattus norvegicus
gagagtccttgcgtcagtgaataag

SEQ ID NO: 336746 - DNA, 25 bp, Rattus norvegicus
gagagtcgaagtacagcactataca

SEQ ID NO: 336747 - DNA, 25 bp, Rattus norvegicus
gagagtcgaagttcagcactataca

SEQ ID NO: 336748 - DNA, 25 bp, Rattus norvegicus
gagagtcgactgaccaacttgcaga

SEQ ID NO: 336749 - DNA, 25 bp, Rattus norvegicus
gagagtcgactgtccaacttgcaga

SEQ ID NO: 336750 - DNA, 25 bp, Rattus norvegicus
gagagtcgattgaatccacacgcaa

SEQ ID NO: 336751 - DNA, 25 bp, Rattus norvegicus
gagagtcgattgtatccacacgcaa

SEQ ID NO: 336752 - DNA, 25 bp, Rattus norvegicus
gagagtcgggtcacagaccgtctct

SEQ ID NO: 336753 - DNA, 25 bp, Rattus norvegicus
gagagtcgggtctcagaccgtctct

SEQ ID NO: 336754 - DNA, 25 bp, Rattus norvegicus
gagagtcggtatccagttatcctgc

SEQ ID NO: 336755 - DNA, 25 bp, Rattus norvegicus
gagagtcggtatgcagttatcctgc

SEQ ID NO: 336756 - DNA, 25 bp, Rattus norvegicus
gagagtcgtatcaattgtttcttaa

SEQ ID NO: 336757 - DNA, 25 bp, Rattus norvegicus
gagagtcgtatctattgtttcttaa

SEQ ID NO: 336758 - DNA, 25 bp, Rattus norvegicus
gagagtctaagcctacctgtggaat

SEQ ID NO: 336759 - DNA, 25 bp, Rattus norvegicus
gagagtctaagcgtacctgtggaat

SEQ ID NO: 336760 - DNA, 25 bp, Rattus norvegicus
gagagtctaccactcttggtttcca

SEQ ID NO: 336761 - DNA, 25 bp, Rattus norvegicus
gagagtctaccagtcttggtttcca

SEQ ID NO: 336762 - DNA, 25 bp, Rattus norvegicus
gagagtctacgtaattactttgcac

SEQ ID NO: 336763 - DNA, 25 bp, Rattus norvegicus
gagagtctacgttattactttgcac

SEQ ID NO: 336764 - DNA, 25 bp, Rattus norvegicus
gagagtctcagactttctgatcgga

SEQ ID NO: 336765 - DNA, 25 bp, Rattus norvegicus
gagagtctcagagtttctgatcgga

SEQ ID NO: 336766 - DNA, 25 bp, Rattus norvegicus
gagagtctccagagggtgccaacta

SEQ ID NO: 336767 - DNA, 25 bp, Rattus norvegicus
gagagtctccagtgggtgccaacta

SEQ ID NO: 336768 - DNA, 25 bp, Rattus norvegicus
gagagtctcgttacctaaaagcaaa

SEQ ID NO: 336769 - DNA, 25 bp, Rattus norvegicus
gagagtctcgtttcctaaaagcaaa

SEQ ID NO: 336770 - DNA, 25 bp, Rattus norvegicus
gagagtctctccagaccaaggtcag

SEQ ID NO: 336771 - DNA, 25 bp, Rattus norvegicus
gagagtctctcctgaccaaggtcag

SEQ ID NO: 336772 - DNA, 25 bp, Rattus norvegicus
gagagtctctgtaaaatccgtagga

SEQ ID NO: 336773 - DNA, 25 bp, Rattus norvegicus
gagagtctctgttaaatccgtagga

SEQ ID NO: 336774 - DNA, 25 bp, Rattus norvegicus
gagagtctgctcactacaatgctac

SEQ ID NO: 336775 - DNA, 25 bp, Rattus norvegicus
gagagtctgctctctacaatgctac

SEQ ID NO: 336776 - DNA, 25 bp, Rattus norvegicus
gagagtctgctgattcttcaaaggc

SEQ ID NO: 336777 - DNA, 25 bp, Rattus norvegicus
gagagtctgctgtttcttcaaaggc

SEQ ID NO: 336778 - DNA, 25 bp, Rattus norvegicus
gagagtctgtctcctattgattgtg

SEQ ID NO: 336779 - DNA, 25 bp, Rattus norvegicus
gagagtctgtctgctattgattgtg

SEQ ID NO: 336780 - DNA, 25 bp, Rattus norvegicus
gagagtctgtgcatttgagtccctg

SEQ ID NO: 336781 - DNA, 25 bp, Rattus norvegicus
gagagtctgtgcttttgagtccctg

SEQ ID NO: 336782 - DNA, 25 bp, Rattus norvegicus
gagagtcttagccattagccagcat

SEQ ID NO: 336783 - DNA, 25 bp, Rattus norvegicus
gagagtcttagcgattagccagcat

SEQ ID NO: 336784 - DNA, 25 bp, Rattus norvegicus
gagagtcttcataatcattttccaa

SEQ ID NO: 336785 - DNA, 25 bp, Rattus norvegicus
gagagtcttcattatcattttccaa

SEQ ID NO: 336786 - DNA, 25 bp, Rattus norvegicus
gagagtcttgagcaccttcagctag

SEQ ID NO: 336787 - DNA, 25 bp, Rattus norvegicus
gagagtcttgaggaccttcagctag

SEQ ID NO: 336788 - DNA, 25 bp, Rattus norvegicus
gagagtcttggcctatgaatatttt

SEQ ID NO: 336789 - DNA, 25 bp, Rattus norvegicus
gagagtcttggcgtatgaatatttt

SEQ ID NO: 336790 - DNA, 25 bp, Rattus norvegicus
gagagtcttgtcaaatgcttgtgaa

SEQ ID NO: 336791 - DNA, 25 bp, Rattus norvegicus
gagagtcttgtctaatgcttgtgaa

SEQ ID NO: 336792 - DNA, 25 bp, Rattus norvegicus
gagagtctttgccagttttatcccc

SEQ ID NO: 336793 - DNA, 25 bp, Rattus norvegicus
gagagtctttgccttcagtgacctg

SEQ ID NO: 336794 - DNA, 25 bp, Rattus norvegicus
gagagtctttgcgagttttatcccc

SEQ ID NO: 336795 - DNA, 25 bp, Rattus norvegicus
gagagtctttgcgttcagtgacctg

SEQ ID NO: 336796 - DNA, 25 bp, Rattus norvegicus
gagagtcttttaacacaggaaggaa

SEQ ID NO: 336797 - DNA, 25 bp, Rattus norvegicus
gagagtcttttatcacaggaaggaa

SEQ ID NO: 336798 - DNA, 25 bp, Rattus norvegicus
gagagtctttttaaatcactgataa

SEQ ID NO: 336799 - DNA, 25 bp, Rattus norvegicus
gagagtcttttttaatcactgataa

SEQ ID NO: 336800 - DNA, 25 bp, Rattus norvegicus
gagagtgaaataccacaccctttcc

SEQ ID NO: 336801 - DNA, 25 bp, Rattus norvegicus
gagagtgaaatagcacaccctttcc

SEQ ID NO: 336802 - DNA, 25 bp, Rattus norvegicus
gagagtgaaattcctcctcggtaca

SEQ ID NO: 336803 - DNA, 25 bp, Rattus norvegicus
gagagtgaaattgctcctcggtaca

SEQ ID NO: 336804 - DNA, 25 bp, Rattus norvegicus
gagagtgaacggaccattccttcag

SEQ ID NO: 336805 - DNA, 25 bp, Rattus norvegicus
gagagtgaacggtccattccttcag

SEQ ID NO: 336806 - DNA, 25 bp, Rattus norvegicus
gagagtgaaggcaaacaccccatcc

SEQ ID NO: 336807 - DNA, 25 bp, Rattus norvegicus
gagagtgaaggctaacaccccatcc

SEQ ID NO: 336808 - DNA, 25 bp, Rattus norvegicus
gagagtgaatccacatctttttaaa

SEQ ID NO: 336809 - DNA, 25 bp, Rattus norvegicus
gagagtgaatcctcatctttttaaa

SEQ ID NO: 336810 - DNA, 25 bp, Rattus norvegicus
gagagtgacaaaactcattgaagtt

SEQ ID NO: 336811 - DNA, 25 bp, Rattus norvegicus
gagagtgacaaatctcattgaagtt

SEQ ID NO: 336812 - DNA, 25 bp, Rattus norvegicus
gagagtgacacaaatgatgctagta

SEQ ID NO: 336813 - DNA, 25 bp, Rattus norvegicus
gagagtgacacatatgatgctagta

SEQ ID NO: 336814 - DNA, 25 bp, Rattus norvegicus
gagagtgacccaatacagcagtccc

SEQ ID NO: 336815 - DNA, 25 bp, Rattus norvegicus
gagagtgacccattacagcagtccc

SEQ ID NO: 336816 - DNA, 25 bp, Rattus norvegicus
gagagtgactgcatgactaccaaac

SEQ ID NO: 336817 - DNA, 25 bp, Rattus norvegicus
gagagtgactgcttgactaccaaac

SEQ ID NO: 336818 - DNA, 25 bp, Rattus norvegicus
gagagtgactttaacctacgttact

SEQ ID NO: 336819 - DNA, 25 bp, Rattus norvegicus
gagagtgacttttacctacgttact

SEQ ID NO: 336820 - DNA, 25 bp, Rattus norvegicus
gagagtgagacaactgagacgcccc

SEQ ID NO: 336821 - DNA, 25 bp, Rattus norvegicus
gagagtgagacatctgagacgcccc

SEQ ID NO: 336822 - DNA, 25 bp, Rattus norvegicus
gagagtgagcaaccttccagtaaac

SEQ ID NO: 336823 - DNA, 25 bp, Rattus norvegicus
gagagtgagcaagcttccagtaaac

SEQ ID NO: 336824 - DNA, 25 bp, Rattus norvegicus
gagagtgaggacattccgcgcccat

SEQ ID NO: 336825 - DNA, 25 bp, Rattus norvegicus
gagagtgaggactttccgcgcccat

SEQ ID NO: 336826 - DNA, 25 bp, Rattus norvegicus
gagagtgatgaccagccagtcagca

SEQ ID NO: 336827 - DNA, 25 bp, Rattus norvegicus
gagagtgatgacgagccagtcagca

SEQ ID NO: 336828 - DNA, 25 bp, Rattus norvegicus
gagagtgattaccagccagtgatta

SEQ ID NO: 336829 - DNA, 25 bp, Rattus norvegicus
gagagtgattacgagccagtgatta

SEQ ID NO: 336830 - DNA, 25 bp, Rattus norvegicus
gagagtgcaagtctatcctggataa

SEQ ID NO: 336831 - DNA, 25 bp, Rattus norvegicus
gagagtgcaagtgtatcctggataa

SEQ ID NO: 336832 - DNA, 25 bp, Rattus norvegicus
gagagtgcaatgaccaagcctgttc

SEQ ID NO: 336833 - DNA, 25 bp, Rattus norvegicus
gagagtgcaatgtccaagcctgttc

SEQ ID NO: 336834 - DNA, 25 bp, Rattus norvegicus
gagagtgcagctagaatccgctcac

SEQ ID NO: 336835 - DNA, 25 bp, Rattus norvegicus
gagagtgcagcttgaatccgctcac

SEQ ID NO: 336836 - DNA, 25 bp, Rattus norvegicus
gagagtgcagtaacgatgtttattt

SEQ ID NO: 336837 - DNA, 25 bp, Rattus norvegicus
gagagtgcagtatcgatgtttattt

SEQ ID NO: 336838 - DNA, 25 bp, Rattus norvegicus
gagagtgccacaataacttcttggt

SEQ ID NO: 336839 - DNA, 25 bp, Rattus norvegicus
gagagtgccacattaacttcttggt

SEQ ID NO: 336840 - DNA, 25 bp, Rattus norvegicus
gagagtgccatcagctctgaagcaa

SEQ ID NO: 336841 - DNA, 25 bp, Rattus norvegicus
gagagtgccatctgctctgaagcaa

SEQ ID NO: 336842 - DNA, 25 bp, Rattus norvegicus
gagagtgcctcaactgagaaccccg

SEQ ID NO: 336843 - DNA, 25 bp, Rattus norvegicus
gagagtgcctcacctgcagttaaag

SEQ ID NO: 336844 - DNA, 25 bp, Rattus norvegicus
gagagtgcctcagctgcagttaaag

SEQ ID NO: 336845 - DNA, 25 bp, Rattus norvegicus
gagagtgcctcatctgagaaccccg

SEQ ID NO: 336846 - DNA, 25 bp, Rattus norvegicus
gagagtgccttaacctgcaaaactt

SEQ ID NO: 336847 - DNA, 25 bp, Rattus norvegicus
gagagtgccttatcctgcaaaactt

SEQ ID NO: 336848 - DNA, 25 bp, Rattus norvegicus
gagagtgccttgcttttgtttcaaa

SEQ ID NO: 336849 - DNA, 25 bp, Rattus norvegicus
gagagtgccttggttttgtttcaaa

SEQ ID NO: 336850 - DNA, 25 bp, Rattus norvegicus
gagagtgcctttctaagccacacag

SEQ ID NO: 336851 - DNA, 25 bp, Rattus norvegicus
gagagtgcctttgtaagccacacag

SEQ ID NO: 336852 - DNA, 25 bp, Rattus norvegicus
gagagtgcgattaagtaccacacaa

SEQ ID NO: 336853 - DNA, 25 bp, Rattus norvegicus
gagagtgcgatttagtaccacacaa

SEQ ID NO: 336854 - DNA, 25 bp, Rattus norvegicus
gagagtgctcccatctgtgttagga

SEQ ID NO: 336855 - DNA, 25 bp, Rattus norvegicus
gagagtgctcccttctgtgttagga

SEQ ID NO: 336856 - DNA, 25 bp, Rattus norvegicus
gagagtgctgctaacagtcgaaact

SEQ ID NO: 336857 - DNA, 25 bp, Rattus norvegicus
gagagtgctgctactctgcactctg

SEQ ID NO: 336858 - DNA, 25 bp, Rattus norvegicus
gagagtgctgcttacagtcgaaact

SEQ ID NO: 336859 - DNA, 25 bp, Rattus norvegicus
gagagtgctgcttctctgcactctg

SEQ ID NO: 336860 - DNA, 25 bp, Rattus norvegicus
gagagtgcttcaagccagtcaaaag

SEQ ID NO: 336861 - DNA, 25 bp, Rattus norvegicus
gagagtgcttcatgccagtcaaaag

SEQ ID NO: 336862 - DNA, 25 bp, Rattus norvegicus
gagagtgcttccagatgagtcatga

SEQ ID NO: 336863 - DNA, 25 bp, Rattus norvegicus
gagagtgcttcctgatgagtcatga

SEQ ID NO: 336864 - DNA, 25 bp, Rattus norvegicus
gagagtggcgtaaccattgcatgga

SEQ ID NO: 336865 - DNA, 25 bp, Rattus norvegicus
gagagtggcgtatccattgcatgga

SEQ ID NO: 336866 - DNA, 25 bp, Rattus norvegicus
gagagtggctacatacacatccaag

SEQ ID NO: 336867 - DNA, 25 bp, Rattus norvegicus
gagagtggctacttacacatccaag

SEQ ID NO: 336868 - DNA, 25 bp, Rattus norvegicus
gagagtggctatacagtggtctgta

SEQ ID NO: 336869 - DNA, 25 bp, Rattus norvegicus
gagagtggctattcagtggtctgta

SEQ ID NO: 336870 - DNA, 25 bp, Rattus norvegicus
gagagtggctgtaaatgcccagaga

SEQ ID NO: 336871 - DNA, 25 bp, Rattus norvegicus
gagagtggctgttaatgcccagaga

SEQ ID NO: 336872 - DNA, 25 bp, Rattus norvegicus
gagagtgggagcaacagcattgtca

SEQ ID NO: 336873 - DNA, 25 bp, Rattus norvegicus
gagagtgggagctacagcattgtca

SEQ ID NO: 336874 - DNA, 25 bp, Rattus norvegicus
gagagtggtccacagagtctgctcc

SEQ ID NO: 336875 - DNA, 25 bp, Rattus norvegicus
gagagtggtccagagagtctgctcc

SEQ ID NO: 336876 - DNA, 25 bp, Rattus norvegicus
gagagtggtctaaaggctccaccag

SEQ ID NO: 336877 - DNA, 25 bp, Rattus norvegicus
gagagtggtctactgaacccaaaca

SEQ ID NO: 336878 - DNA, 25 bp, Rattus norvegicus
gagagtggtctagtgaacccaaaca

SEQ ID NO: 336879 - DNA, 25 bp, Rattus norvegicus
gagagtggtctataggctccaccag

SEQ ID NO: 336880 - DNA, 25 bp, Rattus norvegicus
gagagtggttttaattcagatccta

SEQ ID NO: 336881 - DNA, 25 bp, Rattus norvegicus
gagagtggttttctttcctccaggg

SEQ ID NO: 336882 - DNA, 25 bp, Rattus norvegicus
gagagtggttttgtttcctccaggg

SEQ ID NO: 336883 - DNA, 25 bp, Rattus norvegicus
gagagtggtttttattcagatccta

SEQ ID NO: 336884 - DNA, 25 bp, Rattus norvegicus
gagagtgtaactagggtctagccca

SEQ ID NO: 336885 - DNA, 25 bp, Rattus norvegicus
gagagtgtaacttgggtctagccca

SEQ ID NO: 336886 - DNA, 25 bp, Rattus norvegicus
gagagtgtacacctcctatgtcatg

SEQ ID NO: 336887 - DNA, 25 bp, Rattus norvegicus
gagagtgtacacgtcctatgtcatg

SEQ ID NO: 336888 - DNA, 25 bp, Rattus norvegicus
gagagtgtagcaacatctattgaaa

SEQ ID NO: 336889 - DNA, 25 bp, Rattus norvegicus
gagagtgtagcatcatctattgaaa

SEQ ID NO: 336890 - DNA, 25 bp, Rattus norvegicus
gagagtgtcagcatgattcagaact

SEQ ID NO: 336891 - DNA, 25 bp, Rattus norvegicus
gagagtgtcagcttgattcagaact

SEQ ID NO: 336892 - DNA, 25 bp, Rattus norvegicus
gagagtgtcaggactttttctagct

SEQ ID NO: 336893 - DNA, 25 bp, Rattus norvegicus
gagagtgtcaggtctttttctagct

SEQ ID NO: 336894 - DNA, 25 bp, Rattus norvegicus
gagagtgtccttaatagcagtgagc

SEQ ID NO: 336895 - DNA, 25 bp, Rattus norvegicus
gagagtgtcctttatagcagtgagc

SEQ ID NO: 336896 - DNA, 25 bp, Rattus norvegicus
gagagtgtctggcagtccattcctc

SEQ ID NO: 336897 - DNA, 25 bp, Rattus norvegicus
gagagtgtctgggagtccattcctc

SEQ ID NO: 336898 - DNA, 25 bp, Rattus norvegicus
gagagtgtgcccaaggactaggaaa

SEQ ID NO: 336899 - DNA, 25 bp, Rattus norvegicus
gagagtgtgccctaggactaggaaa

SEQ ID NO: 336900 - DNA, 25 bp, Rattus norvegicus
gagagtgtgtaccatccaaaggcag

SEQ ID NO: 336901 - DNA, 25 bp, Rattus norvegicus
gagagtgtgtacctgacacgcgcca

SEQ ID NO: 336902 - DNA, 25 bp, Rattus norvegicus
gagagtgtgtacgatccaaaggcag

SEQ ID NO: 336903 - DNA, 25 bp, Rattus norvegicus
gagagtgtgtacgtgacacgcgcca

SEQ ID NO: 336904 - DNA, 25 bp, Rattus norvegicus
gagagtgtgtccagagccgagtcct

SEQ ID NO: 336905 - DNA, 25 bp, Rattus norvegicus
gagagtgtgtcctgagccgagtcct

SEQ ID NO: 336906 - DNA, 25 bp, Rattus norvegicus
gagagtgtgtctcagctccatgtca

SEQ ID NO: 336907 - DNA, 25 bp, Rattus norvegicus
gagagtgtgtctgagctccatgtca

SEQ ID NO: 336908 - DNA, 25 bp, Rattus norvegicus
gagagtgttattactttcagattat

SEQ ID NO: 336909 - DNA, 25 bp, Rattus norvegicus
gagagtgttatttctttcagattat

SEQ ID NO: 336910 - DNA, 25 bp, Rattus norvegicus
gagagtgttcagaaacacacagttt

SEQ ID NO: 336911 - DNA, 25 bp, Rattus norvegicus
gagagtgttcagtaacacacagttt

SEQ ID NO: 336912 - DNA, 25 bp, Rattus norvegicus
gagagtgttccactgacacagtgtt

SEQ ID NO: 336913 - DNA, 25 bp, Rattus norvegicus
gagagtgttccagtgacacagtgtt

SEQ ID NO: 336914 - DNA, 25 bp, Rattus norvegicus
gagagtgttctgcttcattgagtca

SEQ ID NO: 336915 - DNA, 25 bp, Rattus norvegicus
gagagtgttctggttcattgagtca

SEQ ID NO: 336916 - DNA, 25 bp, Rattus norvegicus
gagagtgttgaaacctccagaactg

SEQ ID NO: 336917 - DNA, 25 bp, Rattus norvegicus
gagagtgttgaatcctccagaactg

SEQ ID NO: 336918 - DNA, 25 bp, Rattus norvegicus
gagagtgttggaactcattctggat

SEQ ID NO: 336919 - DNA, 25 bp, Rattus norvegicus
gagagtgttggatctcattctggat

SEQ ID NO: 336920 - DNA, 25 bp, Rattus norvegicus
gagagtgtttctacactcaactcag

SEQ ID NO: 336921 - DNA, 25 bp, Rattus norvegicus
gagagtgtttcttcactcaactcag

SEQ ID NO: 336922 - DNA, 25 bp, Rattus norvegicus
gagagtgttttcaaccctagtggtc

SEQ ID NO: 336923 - DNA, 25 bp, Rattus norvegicus
gagagtgttttctaccctagtggtc

SEQ ID NO: 336924 - DNA, 25 bp, Rattus norvegicus
gagagttaaagcagaccctccagct

SEQ ID NO: 336925 - DNA, 25 bp, Rattus norvegicus
gagagttaaagctgaccctccagct

SEQ ID NO: 336926 - DNA, 25 bp, Rattus norvegicus
gagagttaagctaccatttctaaga

SEQ ID NO: 336927 - DNA, 25 bp, Rattus norvegicus
gagagttaagcttccatttctaaga

SEQ ID NO: 336928 - DNA, 25 bp, Rattus norvegicus
gagagttaatctcctacactagtga

SEQ ID NO: 336929 - DNA, 25 bp, Rattus norvegicus
gagagttaatctgctacactagtga

SEQ ID NO: 336930 - DNA, 25 bp, Rattus norvegicus
gagagttaattgactccccaagcca

SEQ ID NO: 336931 - DNA, 25 bp, Rattus norvegicus
gagagttaattgtctccccaagcca

SEQ ID NO: 336932 - DNA, 25 bp, Rattus norvegicus
gagagttacaagctggactgtctaa

SEQ ID NO: 336933 - DNA, 25 bp, Rattus norvegicus
gagagttacaaggtggactgtctaa

SEQ ID NO: 336934 - DNA, 25 bp, Rattus norvegicus
gagagttaccatcgcaactgtatca

SEQ ID NO: 336935 - DNA, 25 bp, Rattus norvegicus
gagagttaccatggcaactgtatca

SEQ ID NO: 336936 - DNA, 25 bp, Rattus norvegicus
gagagttactccatctacatttata

SEQ ID NO: 336937 - DNA, 25 bp, Rattus norvegicus
gagagttactccttctacatttata

SEQ ID NO: 336938 - DNA, 25 bp, Rattus norvegicus
gagagttactgacgccatctcacat

SEQ ID NO: 336939 - DNA, 25 bp, Rattus norvegicus
gagagttactgaggccatctcacat

SEQ ID NO: 336940 - DNA, 25 bp, Rattus norvegicus
gagagttactgtctgaacgcacttt

SEQ ID NO: 336941 - DNA, 25 bp, Rattus norvegicus
gagagttactgtgtgaacgcacttt

SEQ ID NO: 336942 - DNA, 25 bp, Rattus norvegicus
gagagttagacgctcccatgtaaat

SEQ ID NO: 336943 - DNA, 25 bp, Rattus norvegicus
gagagttagacggtcccatgtaaat

SEQ ID NO: 336944 - DNA, 25 bp, Rattus norvegicus
gagagttagctcagtcggttaagga

SEQ ID NO: 336945 - DNA, 25 bp, Rattus norvegicus
gagagttagctctgtcggttaagga

SEQ ID NO: 336946 - DNA, 25 bp, Rattus norvegicus
gagagttatgatcagcacacacaat

SEQ ID NO: 336947 - DNA, 25 bp, Rattus norvegicus
gagagttatgatgagcacacacaat

SEQ ID NO: 336948 - DNA, 25 bp, Rattus norvegicus
gagagttcaccaagcatcagctgaa

SEQ ID NO: 336949 - DNA, 25 bp, Rattus norvegicus
gagagttcaccatgcatcagctgaa

SEQ ID NO: 336950 - DNA, 25 bp, Rattus norvegicus
gagagttcactgagtatttggtgtg

SEQ ID NO: 336951 - DNA, 25 bp, Rattus norvegicus
gagagttcactgtgtatttggtgtg

SEQ ID NO: 336952 - DNA, 25 bp, Rattus norvegicus
gagagttcatatcctcagttgctca

SEQ ID NO: 336953 - DNA, 25 bp, Rattus norvegicus
gagagttcatatgctcagttgctca

SEQ ID NO: 336954 - DNA, 25 bp, Rattus norvegicus
gagagttcatctctgctctgtccat

SEQ ID NO: 336955 - DNA, 25 bp, Rattus norvegicus
gagagttcatctgtgctctgtccat

SEQ ID NO: 336956 - DNA, 25 bp, Rattus norvegicus
gagagttccacaacgggatcccagg

SEQ ID NO: 336957 - DNA, 25 bp, Rattus norvegicus
gagagttccacacaacaaacgtttt

SEQ ID NO: 336958 - DNA, 25 bp, Rattus norvegicus
gagagttccacagaacaaacgtttt

SEQ ID NO: 336959 - DNA, 25 bp, Rattus norvegicus
gagagttccacatcgggatcccagg

SEQ ID NO: 336960 - DNA, 25 bp, Rattus norvegicus
gagagttccacccaaggaaacttgt

SEQ ID NO: 336961 - DNA, 25 bp, Rattus norvegicus
gagagttccaccgaaggaaacttgt

SEQ ID NO: 336962 - DNA, 25 bp, Rattus norvegicus
gagagttccctcagcctagaaaaat

SEQ ID NO: 336963 - DNA, 25 bp, Rattus norvegicus
gagagttccctctgcctagaaaaat

SEQ ID NO: 336964 - DNA, 25 bp, Rattus norvegicus
gagagttccgcaatgcagccaaaga

SEQ ID NO: 336965 - DNA, 25 bp, Rattus norvegicus
gagagttccgcattgcagccaaaga

SEQ ID NO: 336966 - DNA, 25 bp, Rattus norvegicus
gagagttccgttagtgatccctaca

SEQ ID NO: 336967 - DNA, 25 bp, Rattus norvegicus
gagagttccgtttgtgatccctaca

SEQ ID NO: 336968 - DNA, 25 bp, Rattus norvegicus
gagagttccttcctggctagtgcgc

SEQ ID NO: 336969 - DNA, 25 bp, Rattus norvegicus
gagagttccttcgtggctagtgcgc

SEQ ID NO: 336970 - DNA, 25 bp, Rattus norvegicus
gagagttctagaccactggcatcct

SEQ ID NO: 336971 - DNA, 25 bp, Rattus norvegicus
gagagttctagagcactggcatcct

SEQ ID NO: 336972 - DNA, 25 bp, Rattus norvegicus
gagagttctccgatttacattattc

SEQ ID NO: 336973 - DNA, 25 bp, Rattus norvegicus
gagagttctccgttttacattattc

SEQ ID NO: 336974 - DNA, 25 bp, Rattus norvegicus
gagagttctctccataaaccaacat

SEQ ID NO: 336975 - DNA, 25 bp, Rattus norvegicus
gagagttctctcgataaaccaacat

SEQ ID NO: 336976 - DNA, 25 bp, Rattus norvegicus
gagagttctgagcatcctgaataca

SEQ ID NO: 336977 - DNA, 25 bp, Rattus norvegicus
gagagttctgaggatcctgaataca

SEQ ID NO: 336978 - DNA, 25 bp, Rattus norvegicus
gagagttctgatctgtacctacggt

SEQ ID NO: 336979 - DNA, 25 bp, Rattus norvegicus
gagagttctgatgtgtacctacggt

SEQ ID NO: 336980 - DNA, 25 bp, Rattus norvegicus
gagagttctgtaataccttacacaa

SEQ ID NO: 336981 - DNA, 25 bp, Rattus norvegicus
gagagttctgtaatcctgtggcgtt

SEQ ID NO: 336982 - DNA, 25 bp, Rattus norvegicus
gagagttctgtattaccttacacaa

SEQ ID NO: 336983 - DNA, 25 bp, Rattus norvegicus
gagagttctgtattcctgtggcgtt

SEQ ID NO: 336984 - DNA, 25 bp, Rattus norvegicus
gagagttctgtcagtacttctagtt

SEQ ID NO: 336985 - DNA, 25 bp, Rattus norvegicus
gagagttctgtctgtacttctagtt

SEQ ID NO: 336986 - DNA, 25 bp, Rattus norvegicus
gagagttctgtgcatcactgccatg

SEQ ID NO: 336987 - DNA, 25 bp, Rattus norvegicus
gagagttctgtggatcactgccatg

SEQ ID NO: 336988 - DNA, 25 bp, Rattus norvegicus
gagagttcttcaaggaatgatccga

SEQ ID NO: 336989 - DNA, 25 bp, Rattus norvegicus
gagagttcttcacagaccttgactt

SEQ ID NO: 336990 - DNA, 25 bp, Rattus norvegicus
gagagttcttcagagaccttgactt

SEQ ID NO: 336991 - DNA, 25 bp, Rattus norvegicus
gagagttcttcatggaatgatccga

SEQ ID NO: 336992 - DNA, 25 bp, Rattus norvegicus
gagagttgaagactaccctggccga

SEQ ID NO: 336993 - DNA, 25 bp, Rattus norvegicus
gagagttgaagagtaccctggccga

SEQ ID NO: 336994 - DNA, 25 bp, Rattus norvegicus
gagagttgacagaccatctaggcac

SEQ ID NO: 336995 - DNA, 25 bp, Rattus norvegicus
gagagttgacagtccatctaggcac

SEQ ID NO: 336996 - DNA, 25 bp, Rattus norvegicus
gagagttgcacccaagctcaagaaa

SEQ ID NO: 336997 - DNA, 25 bp, Rattus norvegicus
gagagttgcaccgaagctcaagaaa

SEQ ID NO: 336998 - DNA, 25 bp, Rattus norvegicus
gagagttgcatccagaagccccaat

SEQ ID NO: 336999 - DNA, 25 bp, Rattus norvegicus
gagagttgcatcgagaagccccaat

SEQ ID NO: 337000 - DNA, 25 bp, Rattus norvegicus
gagagttgctagcacacatactgaa

SEQ ID NO: 337001 - DNA, 25 bp, Rattus norvegicus
gagagttgctaggacacatactgaa

SEQ ID NO: 337002 - DNA, 25 bp, Rattus norvegicus
gagagttgctcacgctgcatagtaa

SEQ ID NO: 337003 - DNA, 25 bp, Rattus norvegicus
gagagttgctcaggctgcatagtaa

SEQ ID NO: 337004 - DNA, 25 bp, Rattus norvegicus
gagagttgctttctctgtacaaaag

SEQ ID NO: 337005 - DNA, 25 bp, Rattus norvegicus
gagagttgctttgtctgtacaaaag

SEQ ID NO: 337006 - DNA, 25 bp, Rattus norvegicus
gagagttggacaaatcccagctcct

SEQ ID NO: 337007 - DNA, 25 bp, Rattus norvegicus
gagagttggacatatcccagctcct

SEQ ID NO: 337008 - DNA, 25 bp, Rattus norvegicus
gagagttgtgatagtcaaccttcca

SEQ ID NO: 337009 - DNA, 25 bp, Rattus norvegicus
gagagttgtgattgtcaaccttcca

SEQ ID NO: 337010 - DNA, 25 bp, Rattus norvegicus
gagagttgttcaatatgtgtcatta

SEQ ID NO: 337011 - DNA, 25 bp, Rattus norvegicus
gagagttgttcattatgtgtcatta

SEQ ID NO: 337012 - DNA, 25 bp, Rattus norvegicus
gagagtttaacaaagccttcaccct

SEQ ID NO: 337013 - DNA, 25 bp, Rattus norvegicus
gagagtttaacatagccttcaccct

SEQ ID NO: 337014 - DNA, 25 bp, Rattus norvegicus
gagagtttaaggagcctgagctaca

SEQ ID NO: 337015 - DNA, 25 bp, Rattus norvegicus
gagagtttaaggtgcctgagctaca

SEQ ID NO: 337016 - DNA, 25 bp, Rattus norvegicus
gagagtttacttattgccaaatgtc

SEQ ID NO: 337017 - DNA, 25 bp, Rattus norvegicus
gagagtttactttttgccaaatgtc

SEQ ID NO: 337018 - DNA, 25 bp, Rattus norvegicus
gagagtttccagaggttccatcctg

SEQ ID NO: 337019 - DNA, 25 bp, Rattus norvegicus
gagagtttccagtggttccatcctg

SEQ ID NO: 337020 - DNA, 25 bp, Rattus norvegicus
gagagtttccctacaggatttggat

SEQ ID NO: 337021 - DNA, 25 bp, Rattus norvegicus
gagagtttcccttcaggatttggat

SEQ ID NO: 337022 - DNA, 25 bp, Rattus norvegicus
gagagtttccttacgcttgcttcct

SEQ ID NO: 337023 - DNA, 25 bp, Rattus norvegicus
gagagtttcctttcgcttgcttcct

SEQ ID NO: 337024 - DNA, 25 bp, Rattus norvegicus
gagagtttcgtcaagcatctgctga

SEQ ID NO: 337025 - DNA, 25 bp, Rattus norvegicus
gagagtttcgtctagcatctgctga

SEQ ID NO: 337026 - DNA, 25 bp, Rattus norvegicus
gagagtttctataggcttacctagc

SEQ ID NO: 337027 - DNA, 25 bp, Rattus norvegicus
gagagtttctattggcttacctagc

SEQ ID NO: 337028 - DNA, 25 bp, Rattus norvegicus
gagagtttctcacatgagttgtctt

SEQ ID NO: 337029 - DNA, 25 bp, Rattus norvegicus
gagagtttctcagatgagttgtctt

SEQ ID NO: 337030 - DNA, 25 bp, Rattus norvegicus
gagagtttctccactgtgtccagaa

SEQ ID NO: 337031 - DNA, 25 bp, Rattus norvegicus
gagagtttctcctctgtgtccagaa

SEQ ID NO: 337032 - DNA, 25 bp, Rattus norvegicus
gagagtttctctctgactgttaaag

SEQ ID NO: 337033 - DNA, 25 bp, Rattus norvegicus
gagagtttctctgtgactgttaaag

SEQ ID NO: 337034 - DNA, 25 bp, Rattus norvegicus
gagagtttctgtaatgttcctatgg

SEQ ID NO: 337035 - DNA, 25 bp, Rattus norvegicus
gagagtttctgttatgttcctatgg

SEQ ID NO: 337036 - DNA, 25 bp, Rattus norvegicus
gagagtttgcgtcagtctctgatga

SEQ ID NO: 337037 - DNA, 25 bp, Rattus norvegicus
gagagtttgcgtgagtctctgatga

SEQ ID NO: 337038 - DNA, 25 bp, Rattus norvegicus
gagagtttggaaccctcccagaagt

SEQ ID NO: 337039 - DNA, 25 bp, Rattus norvegicus
gagagtttggaagcctcccagaagt

SEQ ID NO: 337040 - DNA, 25 bp, Rattus norvegicus
gagagtttggtcatgagcgctatga

SEQ ID NO: 337041 - DNA, 25 bp, Rattus norvegicus
gagagtttggtcttgagcgctatga

SEQ ID NO: 337042 - DNA, 25 bp, Rattus norvegicus
gagagtttgttgatctgtgtcaccc

SEQ ID NO: 337043 - DNA, 25 bp, Rattus norvegicus
gagagtttgttgttctgtgtcaccc

SEQ ID NO: 337044 - DNA, 25 bp, Rattus norvegicus
gagagttttaacatagccctgggta

SEQ ID NO: 337045 - DNA, 25 bp, Rattus norvegicus
gagagttttaacttagccctgggta

SEQ ID NO: 337046 - DNA, 25 bp, Rattus norvegicus
gagagttttcaaaacccaggcagga

SEQ ID NO: 337047 - DNA, 25 bp, Rattus norvegicus
gagagttttcaatacccaggcagga

SEQ ID NO: 337048 - DNA, 25 bp, Rattus norvegicus
gagagttttctcatcttctactgtt

SEQ ID NO: 337049 - DNA, 25 bp, Rattus norvegicus
gagagttttctcttcttctactgtt

SEQ ID NO: 337050 - DNA, 25 bp, Rattus norvegicus
gagagttttggcctgtttaataatt

SEQ ID NO: 337051 - DNA, 25 bp, Rattus norvegicus
gagagttttggcgtgtttaataatt

SEQ ID NO: 337052 - DNA, 25 bp, Rattus norvegicus
gagagttttggtcgtgcctcccagc

SEQ ID NO: 337053 - DNA, 25 bp, Rattus norvegicus
gagagttttggtggtgcctcccagc

SEQ ID NO: 337054 - DNA, 25 bp, Rattus norvegicus
gagataaaagagctggctaaaccag

SEQ ID NO: 337055 - DNA, 25 bp, Rattus norvegicus
gagataaaagaggtggctaaaccag

SEQ ID NO: 337056 - DNA, 25 bp, Rattus norvegicus
gagataaaccccaacttcataagca

SEQ ID NO: 337057 - DNA, 25 bp, Rattus norvegicus
gagataaacccctacttcataagca

SEQ ID NO: 337058 - DNA, 25 bp, Rattus norvegicus
gagataaagacacactggccacccc

SEQ ID NO: 337059 - DNA, 25 bp, Rattus norvegicus
gagataaagacagactggccacccc

SEQ ID NO: 337060 - DNA, 25 bp, Rattus norvegicus
gagataaatccaagccacagaggtg

SEQ ID NO: 337061 - DNA, 25 bp, Rattus norvegicus
gagataaatccatgccacagaggtg

SEQ ID NO: 337062 - DNA, 25 bp, Rattus norvegicus
gagataacacaaacttctgaaccta

SEQ ID NO: 337063 - DNA, 25 bp, Rattus norvegicus
gagataacacaatcttctgaaccta

SEQ ID NO: 337064 - DNA, 25 bp, Rattus norvegicus
gagataaccagcacttgcttcgagc

SEQ ID NO: 337065 - DNA, 25 bp, Rattus norvegicus
gagataaccagctcttgcttcgagc

SEQ ID NO: 337066 - DNA, 25 bp, Rattus norvegicus
gagataaccaggagcttacacttaa

SEQ ID NO: 337067 - DNA, 25 bp, Rattus norvegicus
gagataaccaggtgcttacacttaa

SEQ ID NO: 337068 - DNA, 25 bp, Rattus norvegicus
gagataaccagtcagcgtgatgtaa

SEQ ID NO: 337069 - DNA, 25 bp, Rattus norvegicus
gagataaccagtgagcgtgatgtaa

SEQ ID NO: 337070 - DNA, 25 bp, Rattus norvegicus
gagataacccatcgcaagtagcact

SEQ ID NO: 337071 - DNA, 25 bp, Rattus norvegicus
gagataacccatggcaagtagcact

SEQ ID NO: 337072 - DNA, 25 bp, Rattus norvegicus
gagataacctacagcctataagatg

SEQ ID NO: 337073 - DNA, 25 bp, Rattus norvegicus
gagataacctactgcctataagatg

SEQ ID NO: 337074 - DNA, 25 bp, Rattus norvegicus
gagataactcaccactgtccaaaga

SEQ ID NO: 337075 - DNA, 25 bp, Rattus norvegicus
gagataactcacgactgtccaaaga

SEQ ID NO: 337076 - DNA, 25 bp, Rattus norvegicus
gagataactttgatgcaattccttt

SEQ ID NO: 337077 - DNA, 25 bp, Rattus norvegicus
gagataactttgttgcaattccttt

SEQ ID NO: 337078 - DNA, 25 bp, Rattus norvegicus
gagataagaaccctgagcggtcaga

SEQ ID NO: 337079 - DNA, 25 bp, Rattus norvegicus
gagataagaaccgtgagcggtcaga

SEQ ID NO: 337080 - DNA, 25 bp, Rattus norvegicus
gagataagaccacagccacggacat

SEQ ID NO: 337081 - DNA, 25 bp, Rattus norvegicus
gagataagaccagagccacggacat

SEQ ID NO: 337082 - DNA, 25 bp, Rattus norvegicus
gagataagcaccaatactgagggag

SEQ ID NO: 337083 - DNA, 25 bp, Rattus norvegicus
gagataagcacctatactgagggag

SEQ ID NO: 337084 - DNA, 25 bp, Rattus norvegicus
gagataagctcaagaaggtcttctg

SEQ ID NO: 337085 - DNA, 25 bp, Rattus norvegicus
gagataagctcatgaaggtcttctg

SEQ ID NO: 337086 - DNA, 25 bp, Rattus norvegicus
gagataaggcaccagacacttccgt

SEQ ID NO: 337087 - DNA, 25 bp, Rattus norvegicus
gagataaggcacgagacacttccgt

SEQ ID NO: 337088 - DNA, 25 bp, Rattus norvegicus
gagataagtcataactgcctccttc

SEQ ID NO: 337089 - DNA, 25 bp, Rattus norvegicus
gagataagtcattactgcctccttc

SEQ ID NO: 337090 - DNA, 25 bp, Rattus norvegicus
gagataagtcgacagttcctgcctg

SEQ ID NO: 337091 - DNA, 25 bp, Rattus norvegicus
gagataagtcgagagttcctgcctg

SEQ ID NO: 337092 - DNA, 25 bp, Rattus norvegicus
gagataagtctcatgacttcagaga

SEQ ID NO: 337093 - DNA, 25 bp, Rattus norvegicus
gagataagtctcttgacttcagaga

SEQ ID NO: 337094 - DNA, 25 bp, Rattus norvegicus
gagataatagtacacccagcagcat

SEQ ID NO: 337095 - DNA, 25 bp, Rattus norvegicus
gagataatagtagacccagcagcat

SEQ ID NO: 337096 - DNA, 25 bp, Rattus norvegicus
gagataatcccaccattctttaaaa

SEQ ID NO: 337097 - DNA, 25 bp, Rattus norvegicus
gagataatcccagcattctttaaaa

SEQ ID NO: 337098 - DNA, 25 bp, Rattus norvegicus
gagataatccgtctcctgggcgtga

SEQ ID NO: 337099 - DNA, 25 bp, Rattus norvegicus
gagataatccgtgtcctgggcgtga

SEQ ID NO: 337100 - DNA, 25 bp, Rattus norvegicus
gagataatgagcagactgtctattt

SEQ ID NO: 337101 - DNA, 25 bp, Rattus norvegicus
gagataatgagctgactgtctattt

SEQ ID NO: 337102 - DNA, 25 bp, Rattus norvegicus
gagataatgtgtacaacaccccttc

SEQ ID NO: 337103 - DNA, 25 bp, Rattus norvegicus
gagataatgtgttcaacaccccttc

SEQ ID NO: 337104 - DNA, 25 bp, Rattus norvegicus
gagataattaatcccaccaaccctg

SEQ ID NO: 337105 - DNA, 25 bp, Rattus norvegicus
gagataattaatgccaccaaccctg

SEQ ID NO: 337106 - DNA, 25 bp, Rattus norvegicus
gagataattctcaggcattcatttg

SEQ ID NO: 337107 - DNA, 25 bp, Rattus norvegicus
gagataattctctggcattcatttg

SEQ ID NO: 337108 - DNA, 25 bp, Rattus norvegicus
gagataatttctactccaactcacc

SEQ ID NO: 337109 - DNA, 25 bp, Rattus norvegicus
gagataatttcttctccaactcacc

SEQ ID NO: 337110 - DNA, 25 bp, Rattus norvegicus
gagatacaaactctcctcttgcaca

SEQ ID NO: 337111 - DNA, 25 bp, Rattus norvegicus
gagatacaaactgtcctcttgcaca

SEQ ID NO: 337112 - DNA, 25 bp, Rattus norvegicus
gagatacaaagcaaatcccaccgca

SEQ ID NO: 337113 - DNA, 25 bp, Rattus norvegicus
gagatacaaagctaatcccaccgca

SEQ ID NO: 337114 - DNA, 25 bp, Rattus norvegicus
gagatacaatctctacagcacgtgg

SEQ ID NO: 337115 - DNA, 25 bp, Rattus norvegicus
gagatacaatctgtacagcacgtgg

SEQ ID NO: 337116 - DNA, 25 bp, Rattus norvegicus
gagatacacataacggttagtcggg

SEQ ID NO: 337117 - DNA, 25 bp, Rattus norvegicus
gagatacacatatcggttagtcggg

SEQ ID NO: 337118 - DNA, 25 bp, Rattus norvegicus
gagatacactataacccatgggtcc

SEQ ID NO: 337119 - DNA, 25 bp, Rattus norvegicus
gagatacactatccaacctgacctt

SEQ ID NO: 337120 - DNA, 25 bp, Rattus norvegicus
gagatacactatgcaacctgacctt

SEQ ID NO: 337121 - DNA, 25 bp, Rattus norvegicus
gagatacactattacccatgggtcc

SEQ ID NO: 337122 - DNA, 25 bp, Rattus norvegicus
gagatacagcacaactgcacaccaa

SEQ ID NO: 337123 - DNA, 25 bp, Rattus norvegicus
gagatacagcactactgcacaccaa

SEQ ID NO: 337124 - DNA, 25 bp, Rattus norvegicus
gagatacaggacacgcctaacgcct

SEQ ID NO: 337125 - DNA, 25 bp, Rattus norvegicus
gagatacaggactcgcctaacgcct

SEQ ID NO: 337126 - DNA, 25 bp, Rattus norvegicus
gagatacatcaaatattccaattca

SEQ ID NO: 337127 - DNA, 25 bp, Rattus norvegicus
gagatacatcaattattccaattca

SEQ ID NO: 337128 - DNA, 25 bp, Rattus norvegicus
gagatacatgtaattgccaggacag

SEQ ID NO: 337129 - DNA, 25 bp, Rattus norvegicus
gagatacatgtatttgccaggacag

SEQ ID NO: 337130 - DNA, 25 bp, Rattus norvegicus
gagataccactcagggtgccaagtt

SEQ ID NO: 337131 - DNA, 25 bp, Rattus norvegicus
gagataccactctgggtgccaagtt

SEQ ID NO: 337132 - DNA, 25 bp, Rattus norvegicus
gagataccagagctgtctctcccac

SEQ ID NO: 337133 - DNA, 25 bp, Rattus norvegicus
gagataccagaggtgtctctcccac

SEQ ID NO: 337134 - DNA, 25 bp, Rattus norvegicus
gagataccagcaaaacttgctctcc

SEQ ID NO: 337135 - DNA, 25 bp, Rattus norvegicus
gagataccagcataacttgctctcc

SEQ ID NO: 337136 - DNA, 25 bp, Rattus norvegicus
gagataccaggcagctcacagacag

SEQ ID NO: 337137 - DNA, 25 bp, Rattus norvegicus
gagataccaggctgctcacagacag

SEQ ID NO: 337138 - DNA, 25 bp, Rattus norvegicus
gagatacccatgaggtagaacctaa

SEQ ID NO: 337139 - DNA, 25 bp, Rattus norvegicus
gagatacccatgtggtagaacctaa

SEQ ID NO: 337140 - DNA, 25 bp, Rattus norvegicus
gagataccgtgaagtcgcagacgaa

SEQ ID NO: 337141 - DNA, 25 bp, Rattus norvegicus
gagataccgtgatgtcgcagacgaa

SEQ ID NO: 337142 - DNA, 25 bp, Rattus norvegicus
gagatacctagtcggcagagctcag

SEQ ID NO: 337143 - DNA, 25 bp, Rattus norvegicus
gagatacctagtgggcagagctcag

SEQ ID NO: 337144 - DNA, 25 bp, Rattus norvegicus
gagatacctcggagccaggtggacc

SEQ ID NO: 337145 - DNA, 25 bp, Rattus norvegicus
gagatacctcggtgccaggtggacc

SEQ ID NO: 337146 - DNA, 25 bp, Rattus norvegicus
gagatacctcgtcggtttaaccaga

SEQ ID NO: 337147 - DNA, 25 bp, Rattus norvegicus
gagatacctcgtgggtttaaccaga

SEQ ID NO: 337148 - DNA, 25 bp, Rattus norvegicus
gagatacgcttgatccatcgtcact

SEQ ID NO: 337149 - DNA, 25 bp, Rattus norvegicus
gagatacgcttgttccatcgtcact

SEQ ID NO: 337150 - DNA, 25 bp, Rattus norvegicus
gagatacgtccaatgtacacactga

SEQ ID NO: 337151 - DNA, 25 bp, Rattus norvegicus
gagatacgtccattgtacacactga

SEQ ID NO: 337152 - DNA, 25 bp, Rattus norvegicus
gagatacgtgtccacccgggatccc

SEQ ID NO: 337153 - DNA, 25 bp, Rattus norvegicus
gagatacgtgtcgacccgggatccc

SEQ ID NO: 337154 - DNA, 25 bp, Rattus norvegicus
gagatactagttcctcaaagagtcc

SEQ ID NO: 337155 - DNA, 25 bp, Rattus norvegicus
gagatactagttgctcaaagagtcc

SEQ ID NO: 337156 - DNA, 25 bp, Rattus norvegicus
gagatactcactaaagtgccacagg

SEQ ID NO: 337157 - DNA, 25 bp, Rattus norvegicus
gagatactcactagggacatttgga

SEQ ID NO: 337158 - DNA, 25 bp, Rattus norvegicus
gagatactcacttaagtgccacagg

SEQ ID NO: 337159 - DNA, 25 bp, Rattus norvegicus
gagatactcacttgggacatttgga

SEQ ID NO: 337160 - DNA, 25 bp, Rattus norvegicus
gagatactcagcagaacaggcatat

SEQ ID NO: 337161 - DNA, 25 bp, Rattus norvegicus
gagatactcagctgaacaggcatat

SEQ ID NO: 337162 - DNA, 25 bp, Rattus norvegicus
gagatactcctcctgacatttaatt

SEQ ID NO: 337163 - DNA, 25 bp, Rattus norvegicus
gagatactcctcgtgacatttaatt

SEQ ID NO: 337164 - DNA, 25 bp, Rattus norvegicus
gagatactcttactaggcagacatt

SEQ ID NO: 337165 - DNA, 25 bp, Rattus norvegicus
gagatactcttagtaggcagacatt

SEQ ID NO: 337166 - DNA, 25 bp, Rattus norvegicus
gagatactgcacacacaaggctggg

SEQ ID NO: 337167 - DNA, 25 bp, Rattus norvegicus
gagatactgcactcacaaggctggg

SEQ ID NO: 337168 - DNA, 25 bp, Rattus norvegicus
gagatactgcttatagtgtccattt

SEQ ID NO: 337169 - DNA, 25 bp, Rattus norvegicus
gagatactgcttttagtgtccattt

SEQ ID NO: 337170 - DNA, 25 bp, Rattus norvegicus
gagatacttagtcaagcttttccct

SEQ ID NO: 337171 - DNA, 25 bp, Rattus norvegicus
gagatacttagtgaagcttttccct

SEQ ID NO: 337172 - DNA, 25 bp, Rattus norvegicus
gagatacttttacactacattccaa

SEQ ID NO: 337173 - DNA, 25 bp, Rattus norvegicus
gagatacttttagactacattccaa

SEQ ID NO: 337174 - DNA, 25 bp, Rattus norvegicus
gagatagaatctcaccgccaagagc

SEQ ID NO: 337175 - DNA, 25 bp, Rattus norvegicus
gagatagaatctgaccgccaagagc

SEQ ID NO: 337176 - DNA, 25 bp, Rattus norvegicus
gagatagacctcactgtgtagccaa

SEQ ID NO: 337177 - DNA, 25 bp, Rattus norvegicus
gagatagacctctctgtgtagccaa

SEQ ID NO: 337178 - DNA, 25 bp, Rattus norvegicus
gagatagaggccatccgttgagctt

SEQ ID NO: 337179 - DNA, 25 bp, Rattus norvegicus
gagatagaggccttccgttgagctt

SEQ ID NO: 337180 - DNA, 25 bp, Rattus norvegicus
gagatagattctatgctgggatcct

SEQ ID NO: 337181 - DNA, 25 bp, Rattus norvegicus
gagatagattctcggctccctgaac

SEQ ID NO: 337182 - DNA, 25 bp, Rattus norvegicus
gagatagattctgggctccctgaac

SEQ ID NO: 337183 - DNA, 25 bp, Rattus norvegicus
gagatagattctttgctgggatcct

SEQ ID NO: 337184 - DNA, 25 bp, Rattus norvegicus
gagatagcagcaatcctgtccaggc

SEQ ID NO: 337185 - DNA, 25 bp, Rattus norvegicus
gagatagcagcattcctgtccaggc

SEQ ID NO: 337186 - DNA, 25 bp, Rattus norvegicus
gagatagcataacaactgaagcaag

SEQ ID NO: 337187 - DNA, 25 bp, Rattus norvegicus
gagatagcataagaactgaagcaag

SEQ ID NO: 337188 - DNA, 25 bp, Rattus norvegicus
gagatagcatctcactccgtagtgc

SEQ ID NO: 337189 - DNA, 25 bp, Rattus norvegicus
gagatagcatctgactccgtagtgc

SEQ ID NO: 337190 - DNA, 25 bp, Rattus norvegicus
gagatagcctacatgactgacacag

SEQ ID NO: 337191 - DNA, 25 bp, Rattus norvegicus
gagatagcctacttgactgacacag

SEQ ID NO: 337192 - DNA, 25 bp, Rattus norvegicus
gagatagcgctcctcactagatagc

SEQ ID NO: 337193 - DNA, 25 bp, Rattus norvegicus
gagatagcgctcgtcactagatagc

SEQ ID NO: 337194 - DNA, 25 bp, Rattus norvegicus
gagatagctctgaccaatcggaccg

SEQ ID NO: 337195 - DNA, 25 bp, Rattus norvegicus
gagatagctctgcacttaagaatcc

SEQ ID NO: 337196 - DNA, 25 bp, Rattus norvegicus
gagatagctctggacttaagaatcc

SEQ ID NO: 337197 - DNA, 25 bp, Rattus norvegicus
gagatagctctgtccaatcggaccg

SEQ ID NO: 337198 - DNA, 25 bp, Rattus norvegicus
gagataggaccgaatgggaccatat

SEQ ID NO: 337199 - DNA, 25 bp, Rattus norvegicus
gagataggaccgtatgggaccatat

SEQ ID NO: 337200 - DNA, 25 bp, Rattus norvegicus
gagataggacttcccaaaccagcta

SEQ ID NO: 337201 - DNA, 25 bp, Rattus norvegicus
gagataggacttgccaaaccagcta

SEQ ID NO: 337202 - DNA, 25 bp, Rattus norvegicus
gagataggcagtctgtacctgtgaa

SEQ ID NO: 337203 - DNA, 25 bp, Rattus norvegicus
gagataggcagtgtgtacctgtgaa

SEQ ID NO: 337204 - DNA, 25 bp, Rattus norvegicus
gagataggcatgaatccctacccat

SEQ ID NO: 337205 - DNA, 25 bp, Rattus norvegicus
gagataggcatgactctaccacgtt

SEQ ID NO: 337206 - DNA, 25 bp, Rattus norvegicus
gagataggcatgtatccctacccat

SEQ ID NO: 337207 - DNA, 25 bp, Rattus norvegicus
gagataggcatgtctctaccacgtt

SEQ ID NO: 337208 - DNA, 25 bp, Rattus norvegicus
gagataggccaactatttcccatga

SEQ ID NO: 337209 - DNA, 25 bp, Rattus norvegicus
gagataggccaagtatttcccatga

SEQ ID NO: 337210 - DNA, 25 bp, Rattus norvegicus
gagataggcccaaggaatccacagt

SEQ ID NO: 337211 - DNA, 25 bp, Rattus norvegicus
gagataggcccatggaatccacagt

SEQ ID NO: 337212 - DNA, 25 bp, Rattus norvegicus
gagataggcctaaggtacgcaaaaa

SEQ ID NO: 337213 - DNA, 25 bp, Rattus norvegicus
gagataggcctatggtacgcaaaaa

SEQ ID NO: 337214 - DNA, 25 bp, Rattus norvegicus
gagataggcctgagcagcagacctc

SEQ ID NO: 337215 - DNA, 25 bp, Rattus norvegicus
gagataggcctgtgcagcagacctc

SEQ ID NO: 337216 - DNA, 25 bp, Rattus norvegicus
gagatagtcaacactgtggttcccc

SEQ ID NO: 337217 - DNA, 25 bp, Rattus norvegicus
gagatagtcaactctgtggttcccc

SEQ ID NO: 337218 - DNA, 25 bp, Rattus norvegicus
gagatagtcagtcccaaatcttctg

SEQ ID NO: 337219 - DNA, 25 bp, Rattus norvegicus
gagatagtcagtgccaaatcttctg

SEQ ID NO: 337220 - DNA, 25 bp, Rattus norvegicus
gagatagtccataggtgcctcctac

SEQ ID NO: 337221 - DNA, 25 bp, Rattus norvegicus
gagatagtccattggtgcctcctac

SEQ ID NO: 337222 - DNA, 25 bp, Rattus norvegicus
gagatagtctctcacagtgaacaag

SEQ ID NO: 337223 - DNA, 25 bp, Rattus norvegicus
gagatagtctctgacagtgaacaag

SEQ ID NO: 337224 - DNA, 25 bp, Rattus norvegicus
gagatagtctttcagtccatttgga

SEQ ID NO: 337225 - DNA, 25 bp, Rattus norvegicus
gagatagtctttgagtccatttgga

SEQ ID NO: 337226 - DNA, 25 bp, Rattus norvegicus
gagatagtttgtatgttcccttagt

SEQ ID NO: 337227 - DNA, 25 bp, Rattus norvegicus
gagatagtttgtttgttcccttagt

SEQ ID NO: 337228 - DNA, 25 bp, Rattus norvegicus
gagatataactccacccagcaaact

SEQ ID NO: 337229 - DNA, 25 bp, Rattus norvegicus
gagatataactcgacccagcaaact

SEQ ID NO: 337230 - DNA, 25 bp, Rattus norvegicus
gagatataatacctcttgttcataa

SEQ ID NO: 337231 - DNA, 25 bp, Rattus norvegicus
gagatataatacgtcttgttcataa

SEQ ID NO: 337232 - DNA, 25 bp, Rattus norvegicus
gagatataccgccagtcacaatgtc

SEQ ID NO: 337233 - DNA, 25 bp, Rattus norvegicus
gagatataccgcgagtcacaatgtc

SEQ ID NO: 337234 - DNA, 25 bp, Rattus norvegicus
gagatatatgccattgttccctttt

SEQ ID NO: 337235 - DNA, 25 bp, Rattus norvegicus
gagatatatgcctttgttccctttt

SEQ ID NO: 337236 - DNA, 25 bp, Rattus norvegicus
gagatatcaaatacctcctttgccc

SEQ ID NO: 337237 - DNA, 25 bp, Rattus norvegicus
gagatatcaaattcctcctttgccc

SEQ ID NO: 337238 - DNA, 25 bp, Rattus norvegicus
gagatatcaatacccctccttcatg

SEQ ID NO: 337239 - DNA, 25 bp, Rattus norvegicus
gagatatcaatagccctccttcatg

SEQ ID NO: 337240 - DNA, 25 bp, Rattus norvegicus
gagatatcagtcacggaaacttctg

SEQ ID NO: 337241 - DNA, 25 bp, Rattus norvegicus
gagatatcagtctcggaaacttctg

SEQ ID NO: 337242 - DNA, 25 bp, Rattus norvegicus
gagatatcgactaagctaccaccat

SEQ ID NO: 337243 - DNA, 25 bp, Rattus norvegicus
gagatatcgacttagctaccaccat

SEQ ID NO: 337244 - DNA, 25 bp, Rattus norvegicus
gagatatctgaccttgtaccgtttc

SEQ ID NO: 337245 - DNA, 25 bp, Rattus norvegicus
gagatatctgacgttgtaccgtttc

SEQ ID NO: 337246 - DNA, 25 bp, Rattus norvegicus
gagatatcttctccattatcccaaa

SEQ ID NO: 337247 - DNA, 25 bp, Rattus norvegicus
gagatatcttctgcattatcccaaa

SEQ ID NO: 337248 - DNA, 25 bp, Rattus norvegicus
gagatatcttggcttccatttgtaa

SEQ ID NO: 337249 - DNA, 25 bp, Rattus norvegicus
gagatatcttgggttccatttgtaa

SEQ ID NO: 337250 - DNA, 25 bp, Rattus norvegicus
gagatatctttgatgctgagtcagc

SEQ ID NO: 337251 - DNA, 25 bp, Rattus norvegicus
gagatatctttgttgctgagtcagc

SEQ ID NO: 337252 - DNA, 25 bp, Rattus norvegicus
gagatatgctaacctaattatacct

SEQ ID NO: 337253 - DNA, 25 bp, Rattus norvegicus
gagatatgctaagctaattatacct

SEQ ID NO: 337254 - DNA, 25 bp, Rattus norvegicus
gagatatggacgatctgctgaccca

SEQ ID NO: 337255 - DNA, 25 bp, Rattus norvegicus
gagatatggacgttctgctgaccca

SEQ ID NO: 337256 - DNA, 25 bp, Rattus norvegicus
gagatatggagtacccagctcagct

SEQ ID NO: 337257 - DNA, 25 bp, Rattus norvegicus
gagatatggagttcccagctcagct

SEQ ID NO: 337258 - DNA, 25 bp, Rattus norvegicus
gagatatggctgacctgggtaccga

SEQ ID NO: 337259 - DNA, 25 bp, Rattus norvegicus
gagatatggctgtcctgggtaccga

SEQ ID NO: 337260 - DNA, 25 bp, Rattus norvegicus
gagatatgggacaccagcctggacc

SEQ ID NO: 337261 - DNA, 25 bp, Rattus norvegicus
gagatatgggactccagcctggacc

SEQ ID NO: 337262 - DNA, 25 bp, Rattus norvegicus
gagatatgggtcacctccaggtaga

SEQ ID NO: 337263 - DNA, 25 bp, Rattus norvegicus
gagatatgggtctcctccaggtaga

SEQ ID NO: 337264 - DNA, 25 bp, Rattus norvegicus
gagatattaactccgccttgtggcc

SEQ ID NO: 337265 - DNA, 25 bp, Rattus norvegicus
gagatattaactgcgccttgtggcc

SEQ ID NO: 337266 - DNA, 25 bp, Rattus norvegicus
gagatattactgatctgttaacaat

SEQ ID NO: 337267 - DNA, 25 bp, Rattus norvegicus
gagatattactgttctgttaacaat

SEQ ID NO: 337268 - DNA, 25 bp, Rattus norvegicus
gagatattagctatggctgttcaca

SEQ ID NO: 337269 - DNA, 25 bp, Rattus norvegicus
gagatattagctttggctgttcaca

SEQ ID NO: 337270 - DNA, 25 bp, Rattus norvegicus
gagatattcaagctcatgtcattat

SEQ ID NO: 337271 - DNA, 25 bp, Rattus norvegicus
gagatattcaaggtcatgtcattat

SEQ ID NO: 337272 - DNA, 25 bp, Rattus norvegicus
gagatattccagagcctcatgctcg

SEQ ID NO: 337273 - DNA, 25 bp, Rattus norvegicus
gagatattccagtgcctcatgctcg

SEQ ID NO: 337274 - DNA, 25 bp, Rattus norvegicus
gagatattccatatgagcacgacga

SEQ ID NO: 337275 - DNA, 25 bp, Rattus norvegicus
gagatattccatttgagcacgacga

SEQ ID NO: 337276 - DNA, 25 bp, Rattus norvegicus
gagatattcctgatgtcagattcca

SEQ ID NO: 337277 - DNA, 25 bp, Rattus norvegicus
gagatattcctgttgtcagattcca

SEQ ID NO: 337278 - DNA, 25 bp, Rattus norvegicus
gagatattcgaacacagttcctgtt

SEQ ID NO: 337279 - DNA, 25 bp, Rattus norvegicus
gagatattcgaagacagttcctgtt

SEQ ID NO: 337280 - DNA, 25 bp, Rattus norvegicus
gagatattctcaatagcacctgaca

SEQ ID NO: 337281 - DNA, 25 bp, Rattus norvegicus
gagatattctcattagcacctgaca

SEQ ID NO: 337282 - DNA, 25 bp, Rattus norvegicus
gagatattctgaagcggcccacagc

SEQ ID NO: 337283 - DNA, 25 bp, Rattus norvegicus
gagatattctgatgcggcccacagc

SEQ ID NO: 337284 - DNA, 25 bp, Rattus norvegicus
gagatattcttcaatcgattccttt

SEQ ID NO: 337285 - DNA, 25 bp, Rattus norvegicus
gagatattcttcaggcttccagtct

SEQ ID NO: 337286 - DNA, 25 bp, Rattus norvegicus
gagatattcttctatcgattccttt

SEQ ID NO: 337287 - DNA, 25 bp, Rattus norvegicus
gagatattcttctggcttccagtct

SEQ ID NO: 337288 - DNA, 25 bp, Rattus norvegicus
gagatatttattagaacccgtgtta

SEQ ID NO: 337289 - DNA, 25 bp, Rattus norvegicus
gagatatttatttgaacccgtgtta

SEQ ID NO: 337290 - DNA, 25 bp, Rattus norvegicus
gagatatttctgataccgatctgaa

SEQ ID NO: 337291 - DNA, 25 bp, Rattus norvegicus
gagatatttctgatgctaactgttg

SEQ ID NO: 337292 - DNA, 25 bp, Rattus norvegicus
gagatatttctgttaccgatctgaa

SEQ ID NO: 337293 - DNA, 25 bp, Rattus norvegicus
gagatatttctgttgctaactgttg

SEQ ID NO: 337294 - DNA, 25 bp, Rattus norvegicus
gagatatttgccaagtgcctatccc

SEQ ID NO: 337295 - DNA, 25 bp, Rattus norvegicus
gagatatttgccagcgggaaggaaa

SEQ ID NO: 337296 - DNA, 25 bp, Rattus norvegicus
gagatatttgcctagtgcctatccc

SEQ ID NO: 337297 - DNA, 25 bp, Rattus norvegicus
gagatatttgcctgcgggaaggaaa

SEQ ID NO: 337298 - DNA, 25 bp, Rattus norvegicus
gagatcaaatacctctagcctccaa

SEQ ID NO: 337299 - DNA, 25 bp, Rattus norvegicus
gagatcaaatacgtctagcctccaa

SEQ ID NO: 337300 - DNA, 25 bp, Rattus norvegicus
gagatcaactttataacggacgcgg

SEQ ID NO: 337301 - DNA, 25 bp, Rattus norvegicus
gagatcaactttttaacggacgcgg

SEQ ID NO: 337302 - DNA, 25 bp, Rattus norvegicus
gagatcaagaggctcagctcccata

SEQ ID NO: 337303 - DNA, 25 bp, Rattus norvegicus
gagatcaagagggtcagctcccata

SEQ ID NO: 337304 - DNA, 25 bp, Rattus norvegicus
gagatcaagtcactgttcgtgcacc

SEQ ID NO: 337305 - DNA, 25 bp, Rattus norvegicus
gagatcaagtcagtgttcgtgcacc

SEQ ID NO: 337306 - DNA, 25 bp, Rattus norvegicus
gagatcaatggcatcagacagtctt

SEQ ID NO: 337307 - DNA, 25 bp, Rattus norvegicus
gagatcaatggcttcagacagtctt

SEQ ID NO: 337308 - DNA, 25 bp, Rattus norvegicus
gagatcaatttaaccgacttcatga

SEQ ID NO: 337309 - DNA, 25 bp, Rattus norvegicus
gagatcaatttatccgacttcatga

SEQ ID NO: 337310 - DNA, 25 bp, Rattus norvegicus
gagatcacacttcacgatggcgcgg

SEQ ID NO: 337311 - DNA, 25 bp, Rattus norvegicus
gagatcacacttgacgatggcgcgg

SEQ ID NO: 337312 - DNA, 25 bp, Rattus norvegicus
gagatcacagaaaccagtccttcaa

SEQ ID NO: 337313 - DNA, 25 bp, Rattus norvegicus
gagatcacagaatccagtccttcaa

SEQ ID NO: 337314 - DNA, 25 bp, Rattus norvegicus
gagatcacaggcatgggacaccagg

SEQ ID NO: 337315 - DNA, 25 bp, Rattus norvegicus
gagatcacaggcttgggacaccagg

SEQ ID NO: 337316 - DNA, 25 bp, Rattus norvegicus
gagatcacatatcacctgcttaagt

SEQ ID NO: 337317 - DNA, 25 bp, Rattus norvegicus
gagatcacatatgacctgcttaagt

SEQ ID NO: 337318 - DNA, 25 bp, Rattus norvegicus
gagatcacatcccttaagcagaata

SEQ ID NO: 337319 - DNA, 25 bp, Rattus norvegicus
gagatcacatccgttaagcagaata

SEQ ID NO: 337320 - DNA, 25 bp, Rattus norvegicus
gagatcaccaccaccttggagaaga

SEQ ID NO: 337321 - DNA, 25 bp, Rattus norvegicus
gagatcaccaccatcatcgatgaga

SEQ ID NO: 337322 - DNA, 25 bp, Rattus norvegicus
gagatcaccacctccttggagaaga

SEQ ID NO: 337323 - DNA, 25 bp, Rattus norvegicus
gagatcaccaccttcatcgatgaga

SEQ ID NO: 337324 - DNA, 25 bp, Rattus norvegicus
gagatcaccatcctgagctttggct

SEQ ID NO: 337325 - DNA, 25 bp, Rattus norvegicus
gagatcaccatcgtgagctttggct

SEQ ID NO: 337326 - DNA, 25 bp, Rattus norvegicus
gagatcaccattaagttacatgctt

SEQ ID NO: 337327 - DNA, 25 bp, Rattus norvegicus
gagatcaccattcataatttacttt

SEQ ID NO: 337328 - DNA, 25 bp, Rattus norvegicus
gagatcaccattgataatttacttt

SEQ ID NO: 337329 - DNA, 25 bp, Rattus norvegicus
gagatcaccatttagttacatgctt

SEQ ID NO: 337330 - DNA, 25 bp, Rattus norvegicus
gagatcacctctaaactcaaggagc

SEQ ID NO: 337331 - DNA, 25 bp, Rattus norvegicus
gagatcacctcttaactcaaggagc

SEQ ID NO: 337332 - DNA, 25 bp, Rattus norvegicus
gagatcacgtcaccatcaatcatga

SEQ ID NO: 337333 - DNA, 25 bp, Rattus norvegicus
gagatcacgtcagcatcaatcatga

SEQ ID NO: 337334 - DNA, 25 bp, Rattus norvegicus
gagatcactcctccctagagaaggg

SEQ ID NO: 337335 - DNA, 25 bp, Rattus norvegicus
gagatcactcctgcctagagaaggg

SEQ ID NO: 337336 - DNA, 25 bp, Rattus norvegicus
gagatcactgtaaacctacgtccag

SEQ ID NO: 337337 - DNA, 25 bp, Rattus norvegicus
gagatcactgtatacctacgtccag

SEQ ID NO: 337338 - DNA, 25 bp, Rattus norvegicus
gagatcacttctcttagccagagga

SEQ ID NO: 337339 - DNA, 25 bp, Rattus norvegicus
gagatcacttctgttagccagagga

SEQ ID NO: 337340 - DNA, 25 bp, Rattus norvegicus
gagatcagagacacaaagctaccag

SEQ ID NO: 337341 - DNA, 25 bp, Rattus norvegicus
gagatcagagactcaaagctaccag

SEQ ID NO: 337342 - DNA, 25 bp, Rattus norvegicus
gagatcagatcgctgacttctgctc

SEQ ID NO: 337343 - DNA, 25 bp, Rattus norvegicus
gagatcagatcggtgacttctgctc

SEQ ID NO: 337344 - DNA, 25 bp, Rattus norvegicus
gagatcagatctcatctcattcctc

SEQ ID NO: 337345 - DNA, 25 bp, Rattus norvegicus
gagatcagatctgatctcattcctc

SEQ ID NO: 337346 - DNA, 25 bp, Rattus norvegicus
gagatcagatgaacctagtgctttt

SEQ ID NO: 337347 - DNA, 25 bp, Rattus norvegicus
gagatcagatgatcctagtgctttt

SEQ ID NO: 337348 - DNA, 25 bp, Rattus norvegicus
gagatcagcagccaggcatatgcat

SEQ ID NO: 337349 - DNA, 25 bp, Rattus norvegicus
gagatcagcagcgaggcatatgcat

SEQ ID NO: 337350 - DNA, 25 bp, Rattus norvegicus
gagatcagcatcacaggctccaggg

SEQ ID NO: 337351 - DNA, 25 bp, Rattus norvegicus
gagatcagcatctcaggctccaggg

SEQ ID NO: 337352 - DNA, 25 bp, Rattus norvegicus
gagatcagcgctaaggtcaaggaac

SEQ ID NO: 337353 - DNA, 25 bp, Rattus norvegicus
gagatcagcgcttaggtcaaggaac

SEQ ID NO: 337354 - DNA, 25 bp, Rattus norvegicus
gagatcagctccattctgttaatgg

SEQ ID NO: 337355 - DNA, 25 bp, Rattus norvegicus
gagatcagctcctttctgttaatgg

SEQ ID NO: 337356 - DNA, 25 bp, Rattus norvegicus
gagatcagctggacttacctataag

SEQ ID NO: 337357 - DNA, 25 bp, Rattus norvegicus
gagatcagctggtcttacctataag

SEQ ID NO: 337358 - DNA, 25 bp, Rattus norvegicus
gagatcagggttacaggcaacctca

SEQ ID NO: 337359 - DNA, 25 bp, Rattus norvegicus
gagatcagggtttcaggcaacctca

SEQ ID NO: 337360 - DNA, 25 bp, Rattus norvegicus
gagatcagtccaagttgcaattagc

SEQ ID NO: 337361 - DNA, 25 bp, Rattus norvegicus
gagatcagtccatgttgcaattagc

SEQ ID NO: 337362 - DNA, 25 bp, Rattus norvegicus
gagatcagtgcgagatcccggctct

SEQ ID NO: 337363 - DNA, 25 bp, Rattus norvegicus
gagatcagtgcgtgatcccggctct

SEQ ID NO: 337364 - DNA, 25 bp, Rattus norvegicus
gagatcagttccacatgtgactcct

SEQ ID NO: 337365 - DNA, 25 bp, Rattus norvegicus
gagatcagttcctcatgtgactcct

SEQ ID NO: 337366 - DNA, 25 bp, Rattus norvegicus
gagatcatcaacaatgctatcgtgc

SEQ ID NO: 337367 - DNA, 25 bp, Rattus norvegicus
gagatcatcaacatgtaaccagggt

SEQ ID NO: 337368 - DNA, 25 bp, Rattus norvegicus
gagatcatcaactatgctatcgtgc

SEQ ID NO: 337369 - DNA, 25 bp, Rattus norvegicus
gagatcatcaacttgtaaccagggt

SEQ ID NO: 337370 - DNA, 25 bp, Rattus norvegicus
gagatcatcaagactctgtccaagg

SEQ ID NO: 337371 - DNA, 25 bp, Rattus norvegicus
gagatcatcaagtctctgtccaagg

SEQ ID NO: 337372 - DNA, 25 bp, Rattus norvegicus
gagatcatcaggaaacccacagcca

SEQ ID NO: 337373 - DNA, 25 bp, Rattus norvegicus
gagatcatcaggtaacccacagcca

SEQ ID NO: 337374 - DNA, 25 bp, Rattus norvegicus
gagatcatcagtccaaggcttcctg

SEQ ID NO: 337375 - DNA, 25 bp, Rattus norvegicus
gagatcatcagtgcaaggcttcctg

SEQ ID NO: 337376 - DNA, 25 bp, Rattus norvegicus
gagatcatcattcagggagacttca

SEQ ID NO: 337377 - DNA, 25 bp, Rattus norvegicus
gagatcatcattgagggagacttca

SEQ ID NO: 337378 - DNA, 25 bp, Rattus norvegicus
gagatcatcctcagcaagggttaca

SEQ ID NO: 337379 - DNA, 25 bp, Rattus norvegicus
gagatcatcctctgcaagggttaca

SEQ ID NO: 337380 - DNA, 25 bp, Rattus norvegicus
gagatcatcgaaaggaaatcacaat

SEQ ID NO: 337381 - DNA, 25 bp, Rattus norvegicus
gagatcatcgaatggaaatcacaat

SEQ ID NO: 337382 - DNA, 25 bp, Rattus norvegicus
gagatcatctctctaatagccttat

SEQ ID NO: 337383 - DNA, 25 bp, Rattus norvegicus
gagatcatctctgtaatagccttat

SEQ ID NO: 337384 - DNA, 25 bp, Rattus norvegicus
gagatcatctgtacgcattaaccac

SEQ ID NO: 337385 - DNA, 25 bp, Rattus norvegicus
gagatcatctgtagtcatgggttca

SEQ ID NO: 337386 - DNA, 25 bp, Rattus norvegicus
gagatcatctgttcgcattaaccac

SEQ ID NO: 337387 - DNA, 25 bp, Rattus norvegicus
gagatcatctgttgtcatgggttca

SEQ ID NO: 337388 - DNA, 25 bp, Rattus norvegicus
gagatcatctttcaataactgactt

SEQ ID NO: 337389 - DNA, 25 bp, Rattus norvegicus
gagatcatctttgaataactgactt

SEQ ID NO: 337390 - DNA, 25 bp, Rattus norvegicus
gagatcatgtatagcctccagtggc

SEQ ID NO: 337391 - DNA, 25 bp, Rattus norvegicus
gagatcatgtattgcctccagtggc

SEQ ID NO: 337392 - DNA, 25 bp, Rattus norvegicus
gagatcatgttccaagcacggttga

SEQ ID NO: 337393 - DNA, 25 bp, Rattus norvegicus
gagatcatgttcgaagcacggttga

SEQ ID NO: 337394 - DNA, 25 bp, Rattus norvegicus
gagatcattaaaattgtaaccacaa

SEQ ID NO: 337395 - DNA, 25 bp, Rattus norvegicus
gagatcattaaatttgtaaccacaa

SEQ ID NO: 337396 - DNA, 25 bp, Rattus norvegicus
gagatcattacgacttcattacttg

SEQ ID NO: 337397 - DNA, 25 bp, Rattus norvegicus
gagatcattacgtcttcattacttg

SEQ ID NO: 337398 - DNA, 25 bp, Rattus norvegicus
gagatcattctgcatcactgttata

SEQ ID NO: 337399 - DNA, 25 bp, Rattus norvegicus
gagatcattctggatcactgttata

SEQ ID NO: 337400 - DNA, 25 bp, Rattus norvegicus
gagatcattgagatccgggcagctg

SEQ ID NO: 337401 - DNA, 25 bp, Rattus norvegicus
gagatcattgagttccgggcagctg

SEQ ID NO: 337402 - DNA, 25 bp, Rattus norvegicus
gagatcattggtcactccactttga

SEQ ID NO: 337403 - DNA, 25 bp, Rattus norvegicus
gagatcattggtgactccactttga

SEQ ID NO: 337404 - DNA, 25 bp, Rattus norvegicus
gagatccaacccagagcactgcgat

SEQ ID NO: 337405 - DNA, 25 bp, Rattus norvegicus
gagatccaaccctgagcactgcgat

SEQ ID NO: 337406 - DNA, 25 bp, Rattus norvegicus
gagatccaacgccagctttgtgctg

SEQ ID NO: 337407 - DNA, 25 bp, Rattus norvegicus
gagatccaacgcgagctttgtgctg

SEQ ID NO: 337408 - DNA, 25 bp, Rattus norvegicus
gagatccaagtcataccaggtccac

SEQ ID NO: 337409 - DNA, 25 bp, Rattus norvegicus
gagatccaagtcttaccaggtccac

SEQ ID NO: 337410 - DNA, 25 bp, Rattus norvegicus
gagatccacaaacgagaagtctcct

SEQ ID NO: 337411 - DNA, 25 bp, Rattus norvegicus
gagatccacaaaggagaagtctcct

SEQ ID NO: 337412 - DNA, 25 bp, Rattus norvegicus
gagatccacacgaggagatcctgaa

SEQ ID NO: 337413 - DNA, 25 bp, Rattus norvegicus
gagatccacacgtggagatcctgaa

SEQ ID NO: 337414 - DNA, 25 bp, Rattus norvegicus
gagatccaccagaaggcaccagtta

SEQ ID NO: 337415 - DNA, 25 bp, Rattus norvegicus
gagatccaccagtaggcaccagtta

SEQ ID NO: 337416 - DNA, 25 bp, Rattus norvegicus
gagatccacgggacagaactactgt

SEQ ID NO: 337417 - DNA, 25 bp, Rattus norvegicus
gagatccacgggtcagaactactgt

SEQ ID NO: 337418 - DNA, 25 bp, Rattus norvegicus
gagatccactagaatctgcctggag

SEQ ID NO: 337419 - DNA, 25 bp, Rattus norvegicus
gagatccactagtatctgcctggag

SEQ ID NO: 337420 - DNA, 25 bp, Rattus norvegicus
gagatccactcacatgcttgtgtag

SEQ ID NO: 337421 - DNA, 25 bp, Rattus norvegicus
gagatccactcagatgcttgtgtag

SEQ ID NO: 337422 - DNA, 25 bp, Rattus norvegicus
gagatccacttgaacggtttctggc

SEQ ID NO: 337423 - DNA, 25 bp, Rattus norvegicus
gagatccacttgtacggtttctggc

SEQ ID NO: 337424 - DNA, 25 bp, Rattus norvegicus
gagatccagacaacggagcttcgaa

SEQ ID NO: 337425 - DNA, 25 bp, Rattus norvegicus
gagatccagacatcggagcttcgaa

SEQ ID NO: 337426 - DNA, 25 bp, Rattus norvegicus
gagatccagcagagcaatcctacga

SEQ ID NO: 337427 - DNA, 25 bp, Rattus norvegicus
gagatccagcagtgcaatcctacga

SEQ ID NO: 337428 - DNA, 25 bp, Rattus norvegicus
gagatccagctaattggatatcctt

SEQ ID NO: 337429 - DNA, 25 bp, Rattus norvegicus
gagatccagctatttggatatcctt

SEQ ID NO: 337430 - DNA, 25 bp, Rattus norvegicus
gagatccaggacaatgtctgtctac

SEQ ID NO: 337431 - DNA, 25 bp, Rattus norvegicus
gagatccaggacatcttcgattgtt

SEQ ID NO: 337432 - DNA, 25 bp, Rattus norvegicus
gagatccaggactatgtctgtctac

SEQ ID NO: 337433 - DNA, 25 bp, Rattus norvegicus
gagatccaggacttcttcgattgtt

SEQ ID NO: 337434 - DNA, 25 bp, Rattus norvegicus
gagatccaggataaaagagtgcatt

SEQ ID NO: 337435 - DNA, 25 bp, Rattus norvegicus
gagatccaggattaaagagtgcatt

SEQ ID NO: 337436 - DNA, 25 bp, Rattus norvegicus
gagatccagtgccactttttgggct

SEQ ID NO: 337437 - DNA, 25 bp, Rattus norvegicus
gagatccagtgcgactttttgggct

SEQ ID NO: 337438 - DNA, 25 bp, Rattus norvegicus
gagatccatctaactgttaagtgct

SEQ ID NO: 337439 - DNA, 25 bp, Rattus norvegicus
gagatccatctatctgttaagtgct

SEQ ID NO: 337440 - DNA, 25 bp, Rattus norvegicus
gagatccatctcctgtgaggatagt

SEQ ID NO: 337441 - DNA, 25 bp, Rattus norvegicus
gagatccatctcgtgtgaggatagt

SEQ ID NO: 337442 - DNA, 25 bp, Rattus norvegicus
gagatccatctgaacctccaaaagg

SEQ ID NO: 337443 - DNA, 25 bp, Rattus norvegicus
gagatccatctgtacctccaaaagg

SEQ ID NO: 337444 - DNA, 25 bp, Rattus norvegicus
gagatccatgacaagctgcaacggg

SEQ ID NO: 337445 - DNA, 25 bp, Rattus norvegicus
gagatccatgactagctgcaacggg

SEQ ID NO: 337446 - DNA, 25 bp, Rattus norvegicus
gagatccatgcactcttcaaaagat

SEQ ID NO: 337447 - DNA, 25 bp, Rattus norvegicus
gagatccatgcagtcttcaaaagat

SEQ ID NO: 337448 - DNA, 25 bp, Rattus norvegicus
gagatccatgtcaatgactgcccaa

SEQ ID NO: 337449 - DNA, 25 bp, Rattus norvegicus
gagatccatgtctatgactgcccaa

SEQ ID NO: 337450 - DNA, 25 bp, Rattus norvegicus
gagatcccaagtattactccacccg

SEQ ID NO: 337451 - DNA, 25 bp, Rattus norvegicus
gagatcccaagttttactccacccg

SEQ ID NO: 337452 - DNA, 25 bp, Rattus norvegicus
gagatcccagctcagaaggttccca

SEQ ID NO: 337453 - DNA, 25 bp, Rattus norvegicus
gagatcccagctgagaaggttccca

SEQ ID NO: 337454 - DNA, 25 bp, Rattus norvegicus
gagatccccacgatagacaagacag

SEQ ID NO: 337455 - DNA, 25 bp, Rattus norvegicus
gagatccccacgttagacaagacag

SEQ ID NO: 337456 - DNA, 25 bp, Rattus norvegicus
gagatccccactattatgacgacat

SEQ ID NO: 337457 - DNA, 25 bp, Rattus norvegicus
gagatccccacttttatgacgacat

SEQ ID NO: 337458 - DNA, 25 bp, Rattus norvegicus
gagatccccatgagcacagtggtga

SEQ ID NO: 337459 - DNA, 25 bp, Rattus norvegicus
gagatccccatgtgcacagtggtga

SEQ ID NO: 337460 - DNA, 25 bp, Rattus norvegicus
gagatcccccctctggaaggcgatg

SEQ ID NO: 337461 - DNA, 25 bp, Rattus norvegicus
gagatcccccctgtggaaggcgatg

SEQ ID NO: 337462 - DNA, 25 bp, Rattus norvegicus
gagatcccctagcagttctaatggt

SEQ ID NO: 337463 - DNA, 25 bp, Rattus norvegicus
gagatcccctaggagttctaatggt

SEQ ID NO: 337464 - DNA, 25 bp, Rattus norvegicus
gagatcccctccatcatgcaagatg

SEQ ID NO: 337465 - DNA, 25 bp, Rattus norvegicus
gagatcccctccttcatgcaagatg

SEQ ID NO: 337466 - DNA, 25 bp, Rattus norvegicus
gagatcccctggcttgcagaaaatc

SEQ ID NO: 337467 - DNA, 25 bp, Rattus norvegicus
gagatcccctgggttgcagaaaatc

SEQ ID NO: 337468 - DNA, 25 bp, Rattus norvegicus
gagatcccgatcatggtcctataat

SEQ ID NO: 337469 - DNA, 25 bp, Rattus norvegicus
gagatcccgatcttggtcctataat

SEQ ID NO: 337470 - DNA, 25 bp, Rattus norvegicus
gagatcccgctgataagagaggtaa

SEQ ID NO: 337471 - DNA, 25 bp, Rattus norvegicus
gagatcccgctgttaagagaggtaa

SEQ ID NO: 337472 - DNA, 25 bp, Rattus norvegicus
gagatcccggagcaactcagacttg

SEQ ID NO: 337473 - DNA, 25 bp, Rattus norvegicus
gagatcccggaggaactcagacttg

SEQ ID NO: 337474 - DNA, 25 bp, Rattus norvegicus
gagatccctatgcttcaggaggcca

SEQ ID NO: 337475 - DNA, 25 bp, Rattus norvegicus
gagatccctatggttcaggaggcca

SEQ ID NO: 337476 - DNA, 25 bp, Rattus norvegicus
gagatccctcaaagggcctgggagt

SEQ ID NO: 337477 - DNA, 25 bp, Rattus norvegicus
gagatccctcaatgggcctgggagt

SEQ ID NO: 337478 - DNA, 25 bp, Rattus norvegicus
gagatccctcccatcggtcctcaaa

SEQ ID NO: 337479 - DNA, 25 bp, Rattus norvegicus
gagatccctcccttcggtcctcaaa

SEQ ID NO: 337480 - DNA, 25 bp, Rattus norvegicus
gagatccctgaacagaccttttcat

SEQ ID NO: 337481 - DNA, 25 bp, Rattus norvegicus
gagatccctgaagagaccttttcat

SEQ ID NO: 337482 - DNA, 25 bp, Rattus norvegicus
gagatccctgagatggacacgtcca

SEQ ID NO: 337483 - DNA, 25 bp, Rattus norvegicus
gagatccctgagttggacacgtcca

SEQ ID NO: 337484 - DNA, 25 bp, Rattus norvegicus
gagatccctgcacctaaggcggaaa

SEQ ID NO: 337485 - DNA, 25 bp, Rattus norvegicus
gagatccctgcagctaaggcggaaa

SEQ ID NO: 337486 - DNA, 25 bp, Rattus norvegicus
gagatccctggacctaccagatcct

SEQ ID NO: 337487 - DNA, 25 bp, Rattus norvegicus
gagatccctggagctaccagatcct

SEQ ID NO: 337488 - DNA, 25 bp, Rattus norvegicus
gagatcccttagagctactgtagga

SEQ ID NO: 337489 - DNA, 25 bp, Rattus norvegicus
gagatcccttagtgctactgtagga

SEQ ID NO: 337490 - DNA, 25 bp, Rattus norvegicus
gagatcccttgactgcaggctgcaa

SEQ ID NO: 337491 - DNA, 25 bp, Rattus norvegicus
gagatcccttgagtgcaggctgcaa

SEQ ID NO: 337492 - DNA, 25 bp, Rattus norvegicus
gagatccgaattacttttgcgcacc

SEQ ID NO: 337493 - DNA, 25 bp, Rattus norvegicus
gagatccgaatttcttttgcgcacc

SEQ ID NO: 337494 - DNA, 25 bp, Rattus norvegicus
gagatccgcagtatgttccggaagc

SEQ ID NO: 337495 - DNA, 25 bp, Rattus norvegicus
gagatccgcagtttgttccggaagc

SEQ ID NO: 337496 - DNA, 25 bp, Rattus norvegicus
gagatcctaagtctcaggacactgg

SEQ ID NO: 337497 - DNA, 25 bp, Rattus norvegicus
gagatcctaagtgtcaggacactgg

SEQ ID NO: 337498 - DNA, 25 bp, Rattus norvegicus
gagatcctaattccctttcaagata

SEQ ID NO: 337499 - DNA, 25 bp, Rattus norvegicus
gagatcctaattgcctttcaagata

SEQ ID NO: 337500 - DNA, 25 bp, Rattus norvegicus
gagatcctacccaacggcgaggaca

SEQ ID NO: 337501 - DNA, 25 bp, Rattus norvegicus
gagatcctaccctacggcgaggaca

SEQ ID NO: 337502 - DNA, 25 bp, Rattus norvegicus
gagatcctatcaccagcactgagaa

SEQ ID NO: 337503 - DNA, 25 bp, Rattus norvegicus
gagatcctatcagcagcactgagaa

SEQ ID NO: 337504 - DNA, 25 bp, Rattus norvegicus
gagatcctattccagccaaatgcag

SEQ ID NO: 337505 - DNA, 25 bp, Rattus norvegicus
gagatcctattcgagccaaatgcag

SEQ ID NO: 337506 - DNA, 25 bp, Rattus norvegicus
gagatcctcaagacggcctttatga

SEQ ID NO: 337507 - DNA, 25 bp, Rattus norvegicus
gagatcctcaagtcggcctttatga

SEQ ID NO: 337508 - DNA, 25 bp, Rattus norvegicus
gagatcctcaggcagtaaccaactg

SEQ ID NO: 337509 - DNA, 25 bp, Rattus norvegicus
gagatcctcagggagtaaccaactg

SEQ ID NO: 337510 - DNA, 25 bp, Rattus norvegicus
gagatcctcctgaacaccaaagtga

SEQ ID NO: 337511 - DNA, 25 bp, Rattus norvegicus
gagatcctcctgtacaccaaagtga

SEQ ID NO: 337512 - DNA, 25 bp, Rattus norvegicus
gagatcctcgacaatctctgtgagg

SEQ ID NO: 337513 - DNA, 25 bp, Rattus norvegicus
gagatcctcgactatctctgtgagg

SEQ ID NO: 337514 - DNA, 25 bp, Rattus norvegicus
gagatcctctaactcatgctctaag

SEQ ID NO: 337515 - DNA, 25 bp, Rattus norvegicus
gagatcctctaagtcatgctctaag

SEQ ID NO: 337516 - DNA, 25 bp, Rattus norvegicus
gagatcctctgaaactgaagttctg

SEQ ID NO: 337517 - DNA, 25 bp, Rattus norvegicus
gagatcctctgaactagggtttttt

SEQ ID NO: 337518 - DNA, 25 bp, Rattus norvegicus
gagatcctctgatactgaagttctg

SEQ ID NO: 337519 - DNA, 25 bp, Rattus norvegicus
gagatcctctgatctagggtttttt

SEQ ID NO: 337520 - DNA, 25 bp, Rattus norvegicus
gagatcctgcgcaacatggatgctg

SEQ ID NO: 337521 - DNA, 25 bp, Rattus norvegicus
gagatcctgcgctacatggatgctg

SEQ ID NO: 337522 - DNA, 25 bp, Rattus norvegicus
gagatcctgctcattaccatggtgc

SEQ ID NO: 337523 - DNA, 25 bp, Rattus norvegicus
gagatcctgctctttaccatggtgc

SEQ ID NO: 337524 - DNA, 25 bp, Rattus norvegicus
gagatcctgggtaccgttgtctaca

SEQ ID NO: 337525 - DNA, 25 bp, Rattus norvegicus
gagatcctgggttccgttgtctaca

SEQ ID NO: 337526 - DNA, 25 bp, Rattus norvegicus
gagatcctggttagatcacttcctg

SEQ ID NO: 337527 - DNA, 25 bp, Rattus norvegicus
gagatcctggtttgatcacttcctg

SEQ ID NO: 337528 - DNA, 25 bp, Rattus norvegicus
gagatcctgtaacacagctctgaga

SEQ ID NO: 337529 - DNA, 25 bp, Rattus norvegicus
gagatcctgtaagacagctctgaga

SEQ ID NO: 337530 - DNA, 25 bp, Rattus norvegicus
gagatcctgtatcacttactgggca

SEQ ID NO: 337531 - DNA, 25 bp, Rattus norvegicus
gagatcctgtatgacttactgggca

SEQ ID NO: 337532 - DNA, 25 bp, Rattus norvegicus
gagatcctgtctatcaacatcagat

SEQ ID NO: 337533 - DNA, 25 bp, Rattus norvegicus
gagatcctgtctcataagtctaaaa

SEQ ID NO: 337534 - DNA, 25 bp, Rattus norvegicus
gagatcctgtctgataagtctaaaa

SEQ ID NO: 337535 - DNA, 25 bp, Rattus norvegicus
gagatcctgtctttcaacatcagat

SEQ ID NO: 337536 - DNA, 25 bp, Rattus norvegicus
gagatcctgttacatctgtgctctt

SEQ ID NO: 337537 - DNA, 25 bp, Rattus norvegicus
gagatcctgttagatctgtgctctt

SEQ ID NO: 337538 - DNA, 25 bp, Rattus norvegicus
gagatccttattaggcagcacatat

SEQ ID NO: 337539 - DNA, 25 bp, Rattus norvegicus
gagatccttatttggcagcacatat

SEQ ID NO: 337540 - DNA, 25 bp, Rattus norvegicus
gagatccttggaccactgacagatt

SEQ ID NO: 337541 - DNA, 25 bp, Rattus norvegicus
gagatccttggagcactgacagatt

SEQ ID NO: 337542 - DNA, 25 bp, Rattus norvegicus
gagatcgaataacacccttcctggt

SEQ ID NO: 337543 - DNA, 25 bp, Rattus norvegicus
gagatcgaataagacccttcctggt

SEQ ID NO: 337544 - DNA, 25 bp, Rattus norvegicus
gagatcgaccaccttttacctgaaa

SEQ ID NO: 337545 - DNA, 25 bp, Rattus norvegicus
gagatcgaccacgttttacctgaaa

SEQ ID NO: 337546 - DNA, 25 bp, Rattus norvegicus
gagatcgagagcctggatgactact

SEQ ID NO: 337547 - DNA, 25 bp, Rattus norvegicus
gagatcgagagcgtggatgactact

SEQ ID NO: 337548 - DNA, 25 bp, Rattus norvegicus
gagatcgagccaatctgcagattat

SEQ ID NO: 337549 - DNA, 25 bp, Rattus norvegicus
gagatcgagccattctgcagattat

SEQ ID NO: 337550 - DNA, 25 bp, Rattus norvegicus
gagatcgagctgaccatggagacat

SEQ ID NO: 337551 - DNA, 25 bp, Rattus norvegicus
gagatcgagctgtccatggagacat

SEQ ID NO: 337552 - DNA, 25 bp, Rattus norvegicus
gagatcgatctgacctggcagttaa

SEQ ID NO: 337553 - DNA, 25 bp, Rattus norvegicus
gagatcgatctgtcctggcagttaa

SEQ ID NO: 337554 - DNA, 25 bp, Rattus norvegicus
gagatcgatgatccattcccactta

SEQ ID NO: 337555 - DNA, 25 bp, Rattus norvegicus
gagatcgatgatgcattcccactta

SEQ ID NO: 337556 - DNA, 25 bp, Rattus norvegicus
gagatcgcagagatgtccttaaaag

SEQ ID NO: 337557 - DNA, 25 bp, Rattus norvegicus
gagatcgcagagttgtccttaaaag

SEQ ID NO: 337558 - DNA, 25 bp, Rattus norvegicus
gagatcgcaggtaagcgcgggcccg

SEQ ID NO: 337559 - DNA, 25 bp, Rattus norvegicus
gagatcgcaggttagcgcgggcccg

SEQ ID NO: 337560 - DNA, 25 bp, Rattus norvegicus
gagatcgcataaatctggacatact

SEQ ID NO: 337561 - DNA, 25 bp, Rattus norvegicus
gagatcgcataattctggacatact

SEQ ID NO: 337562 - DNA, 25 bp, Rattus norvegicus
gagatcgccacaaaagccagtgctt

SEQ ID NO: 337563 - DNA, 25 bp, Rattus norvegicus
gagatcgccacataagccagtgctt

SEQ ID NO: 337564 - DNA, 25 bp, Rattus norvegicus
gagatcgcctttaccgggctcggaa

SEQ ID NO: 337565 - DNA, 25 bp, Rattus norvegicus
gagatcgccttttccgggctcggaa

SEQ ID NO: 337566 - DNA, 25 bp, Rattus norvegicus
gagatcgcgatgatgcccagtacag

SEQ ID NO: 337567 - DNA, 25 bp, Rattus norvegicus
gagatcgcgatgttgcccagtacag

SEQ ID NO: 337568 - DNA, 25 bp, Rattus norvegicus
gagatcgctcctaacacttgtacag

SEQ ID NO: 337569 - DNA, 25 bp, Rattus norvegicus
gagatcgctccttacacttgtacag

SEQ ID NO: 337570 - DNA, 25 bp, Rattus norvegicus
gagatcgctgctcgtgtggatttta

SEQ ID NO: 337571 - DNA, 25 bp, Rattus norvegicus
gagatcgctgctggtgtggatttta

SEQ ID NO: 337572 - DNA, 25 bp, Rattus norvegicus
gagatcggaagtcccagccaagaca

SEQ ID NO: 337573 - DNA, 25 bp, Rattus norvegicus
gagatcggaagtgccagccaagaca

SEQ ID NO: 337574 - DNA, 25 bp, Rattus norvegicus
gagatcggcgacctgatgtgcaact

SEQ ID NO: 337575 - DNA, 25 bp, Rattus norvegicus
gagatcggcgacgtgatgtgcaact

SEQ ID NO: 337576 - DNA, 25 bp, Rattus norvegicus
gagatcgtcaacattcagggcctat

SEQ ID NO: 337577 - DNA, 25 bp, Rattus norvegicus
gagatcgtcaactttcagggcctat

SEQ ID NO: 337578 - DNA, 25 bp, Rattus norvegicus
gagatcgtgcagatgcacccactag

SEQ ID NO: 337579 - DNA, 25 bp, Rattus norvegicus
gagatcgtgcagttgcacccactag

SEQ ID NO: 337580 - DNA, 25 bp, Rattus norvegicus
gagatcgttgacaccaatggagctg

SEQ ID NO: 337581 - DNA, 25 bp, Rattus norvegicus
gagatcgttgactccaatggagctg

SEQ ID NO: 337582 - DNA, 25 bp, Rattus norvegicus
gagatctaatgcactttgccaggcc

SEQ ID NO: 337583 - DNA, 25 bp, Rattus norvegicus
gagatctaatgctctttgccaggcc

SEQ ID NO: 337584 - DNA, 25 bp, Rattus norvegicus
gagatctaatttatccatggtactt

SEQ ID NO: 337585 - DNA, 25 bp, Rattus norvegicus
gagatctaatttttccatggtactt

SEQ ID NO: 337586 - DNA, 25 bp, Rattus norvegicus
gagatctacaacaatgacccagcca

SEQ ID NO: 337587 - DNA, 25 bp, Rattus norvegicus
gagatctacaactatgacccagcca

SEQ ID NO: 337588 - DNA, 25 bp, Rattus norvegicus
gagatctacaggaccttcctggaga

SEQ ID NO: 337589 - DNA, 25 bp, Rattus norvegicus
gagatctacaggtccttcctggaga

SEQ ID NO: 337590 - DNA, 25 bp, Rattus norvegicus
gagatctacctgagcttgactctgc

SEQ ID NO: 337591 - DNA, 25 bp, Rattus norvegicus
gagatctacctgtgcttgactctgc

SEQ ID NO: 337592 - DNA, 25 bp, Rattus norvegicus
gagatctactatagctctttccaag

SEQ ID NO: 337593 - DNA, 25 bp, Rattus norvegicus
gagatctactattgctctttccaag

SEQ ID NO: 337594 - DNA, 25 bp, Rattus norvegicus
gagatctactccatgcatgtgctag

SEQ ID NO: 337595 - DNA, 25 bp, Rattus norvegicus
gagatctactccttgcatgtgctag

SEQ ID NO: 337596 - DNA, 25 bp, Rattus norvegicus
gagatctacttgctttggtcacaac

SEQ ID NO: 337597 - DNA, 25 bp, Rattus norvegicus
gagatctacttggtttggtcacaac

SEQ ID NO: 337598 - DNA, 25 bp, Rattus norvegicus
gagatctagatgcagcagcctccgc

SEQ ID NO: 337599 - DNA, 25 bp, Rattus norvegicus
gagatctagatggagcagcctccgc

SEQ ID NO: 337600 - DNA, 25 bp, Rattus norvegicus
gagatctaggcactacatatgtaat

SEQ ID NO: 337601 - DNA, 25 bp, Rattus norvegicus
gagatctaggcagtacatatgtaat

SEQ ID NO: 337602 - DNA, 25 bp, Rattus norvegicus
gagatctaggccatgtggagtgaca

SEQ ID NO: 337603 - DNA, 25 bp, Rattus norvegicus
gagatctaggcccactgacagggat

SEQ ID NO: 337604 - DNA, 25 bp, Rattus norvegicus
gagatctaggccgactgacagggat

SEQ ID NO: 337605 - DNA, 25 bp, Rattus norvegicus
gagatctaggccttgtggagtgaca

SEQ ID NO: 337606 - DNA, 25 bp, Rattus norvegicus
gagatctatctgaagctgcatgaca

SEQ ID NO: 337607 - DNA, 25 bp, Rattus norvegicus
gagatctatctgtagctgcatgaca

SEQ ID NO: 337608 - DNA, 25 bp, Rattus norvegicus
gagatctcaaatcaactggatgtag

SEQ ID NO: 337609 - DNA, 25 bp, Rattus norvegicus
gagatctcaaatgaactggatgtag

SEQ ID NO: 337610 - DNA, 25 bp, Rattus norvegicus
gagatctcaaggctcagcagctcta

SEQ ID NO: 337611 - DNA, 25 bp, Rattus norvegicus
gagatctcaaggctctaggtcagtt

SEQ ID NO: 337612 - DNA, 25 bp, Rattus norvegicus
gagatctcaagggtcagcagctcta

SEQ ID NO: 337613 - DNA, 25 bp, Rattus norvegicus
gagatctcaagggtctaggtcagtt

SEQ ID NO: 337614 - DNA, 25 bp, Rattus norvegicus
gagatctcacatctcaacagcaaca

SEQ ID NO: 337615 - DNA, 25 bp, Rattus norvegicus
gagatctcacatgtcaacagcaaca

SEQ ID NO: 337616 - DNA, 25 bp, Rattus norvegicus
gagatctcaccacaagcttacgaac

SEQ ID NO: 337617 - DNA, 25 bp, Rattus norvegicus
gagatctcaccagaagcttacgaac

SEQ ID NO: 337618 - DNA, 25 bp, Rattus norvegicus
gagatctcagacatctatctgcatg

SEQ ID NO: 337619 - DNA, 25 bp, Rattus norvegicus
gagatctcagacttctatctgcatg

SEQ ID NO: 337620 - DNA, 25 bp, Rattus norvegicus
gagatctcagctcagaggacaccgg

SEQ ID NO: 337621 - DNA, 25 bp, Rattus norvegicus
gagatctcagctgagaggacaccgg

SEQ ID NO: 337622 - DNA, 25 bp, Rattus norvegicus
gagatctcattcaactatttgcagg

SEQ ID NO: 337623 - DNA, 25 bp, Rattus norvegicus
gagatctcattctactatttgcagg

SEQ ID NO: 337624 - DNA, 25 bp, Rattus norvegicus
gagatctcatttcagaagaacggca

SEQ ID NO: 337625 - DNA, 25 bp, Rattus norvegicus
gagatctcatttgagaagaacggca

SEQ ID NO: 337626 - DNA, 25 bp, Rattus norvegicus
gagatctccactcatggcctgggtg

SEQ ID NO: 337627 - DNA, 25 bp, Rattus norvegicus
gagatctccactgatggcctgggtg

SEQ ID NO: 337628 - DNA, 25 bp, Rattus norvegicus
gagatctcccaaattgttctttacc

SEQ ID NO: 337629 - DNA, 25 bp, Rattus norvegicus
gagatctcccaatttgttctttacc

SEQ ID NO: 337630 - DNA, 25 bp, Rattus norvegicus
gagatctcccatatcaagacagcag

SEQ ID NO: 337631 - DNA, 25 bp, Rattus norvegicus
gagatctcccatttcaagacagcag

SEQ ID NO: 337632 - DNA, 25 bp, Rattus norvegicus
gagatctcctggctctagaggaagt

SEQ ID NO: 337633 - DNA, 25 bp, Rattus norvegicus
gagatctcctgggtctagaggaagt

SEQ ID NO: 337634 - DNA, 25 bp, Rattus norvegicus
gagatctccttaatctggttttggt

SEQ ID NO: 337635 - DNA, 25 bp, Rattus norvegicus
gagatctccttattctggttttggt

SEQ ID NO: 337636 - DNA, 25 bp, Rattus norvegicus
gagatctctattctttcctcttgaa

SEQ ID NO: 337637 - DNA, 25 bp, Rattus norvegicus
gagatctctattgtttcctcttgaa

SEQ ID NO: 337638 - DNA, 25 bp, Rattus norvegicus
gagatctctccaatccaaaacaggt

SEQ ID NO: 337639 - DNA, 25 bp, Rattus norvegicus
gagatctctccattccaaaacaggt

SEQ ID NO: 337640 - DNA, 25 bp, Rattus norvegicus
gagatctctgagatcaggctagcct

SEQ ID NO: 337641 - DNA, 25 bp, Rattus norvegicus
gagatctctgagttcaggctagcct

SEQ ID NO: 337642 - DNA, 25 bp, Rattus norvegicus
gagatctctgcacatggagtcttct

SEQ ID NO: 337643 - DNA, 25 bp, Rattus norvegicus
gagatctctgcagatggagtcttct

SEQ ID NO: 337644 - DNA, 25 bp, Rattus norvegicus
gagatctcttacaattctacatatt

SEQ ID NO: 337645 - DNA, 25 bp, Rattus norvegicus
gagatctcttactattctacatatt

SEQ ID NO: 337646 - DNA, 25 bp, Rattus norvegicus
gagatctcttagacattgagccacc

SEQ ID NO: 337647 - DNA, 25 bp, Rattus norvegicus
gagatctcttagtcattgagccacc

SEQ ID NO: 337648 - DNA, 25 bp, Rattus norvegicus
gagatctctttcaactcatctatga

SEQ ID NO: 337649 - DNA, 25 bp, Rattus norvegicus
gagatctctttctactcatctatga

SEQ ID NO: 337650 - DNA, 25 bp, Rattus norvegicus
gagatctgaaatccttctgtcgaag

SEQ ID NO: 337651 - DNA, 25 bp, Rattus norvegicus
gagatctgaaatgcttctgtcgaag

SEQ ID NO: 337652 - DNA, 25 bp, Rattus norvegicus
gagatctgaatacaaagtgcccctt

SEQ ID NO: 337653 - DNA, 25 bp, Rattus norvegicus
gagatctgaatagaaagtgcccctt

SEQ ID NO: 337654 - DNA, 25 bp, Rattus norvegicus
gagatctgacaaactctgcctcaaa

SEQ ID NO: 337655 - DNA, 25 bp, Rattus norvegicus
gagatctgacaatctctgcctcaaa

SEQ ID NO: 337656 - DNA, 25 bp, Rattus norvegicus
gagatctgaccccagtgatgttgcc

SEQ ID NO: 337657 - DNA, 25 bp, Rattus norvegicus
gagatctgacccgagtgatgttgcc

SEQ ID NO: 337658 - DNA, 25 bp, Rattus norvegicus
gagatctgcggtcagctaacattct

SEQ ID NO: 337659 - DNA, 25 bp, Rattus norvegicus
gagatctgcggtgagctaacattct

SEQ ID NO: 337660 - DNA, 25 bp, Rattus norvegicus
gagatctggaaaaccaccactctac

SEQ ID NO: 337661 - DNA, 25 bp, Rattus norvegicus
gagatctggaaatccaccactctac

SEQ ID NO: 337662 - DNA, 25 bp, Rattus norvegicus
gagatctggacacgatcgccggaca

SEQ ID NO: 337663 - DNA, 25 bp, Rattus norvegicus
gagatctggacaggatcgccggaca

SEQ ID NO: 337664 - DNA, 25 bp, Rattus norvegicus
gagatctggactctgttttggcaag

SEQ ID NO: 337665 - DNA, 25 bp, Rattus norvegicus
gagatctggactgtgttttggcaag

SEQ ID NO: 337666 - DNA, 25 bp, Rattus norvegicus
gagatctggcctcacacaaatgtgt

SEQ ID NO: 337667 - DNA, 25 bp, Rattus norvegicus
gagatctggcctgacacaaatgtgt

SEQ ID NO: 337668 - DNA, 25 bp, Rattus norvegicus
gagatctggcttctgattcccagga

SEQ ID NO: 337669 - DNA, 25 bp, Rattus norvegicus
gagatctggcttgtgattcccagga

SEQ ID NO: 337670 - DNA, 25 bp, Rattus norvegicus
gagatctgggcaatgttcacgctga

SEQ ID NO: 337671 - DNA, 25 bp, Rattus norvegicus
gagatctgggcattgttcacgctga

SEQ ID NO: 337672 - DNA, 25 bp, Rattus norvegicus
gagatctgtgacatccccaggagac

SEQ ID NO: 337673 - DNA, 25 bp, Rattus norvegicus
gagatctgtgacttccccaggagac

SEQ ID NO: 337674 - DNA, 25 bp, Rattus norvegicus
gagatctgtgcaacacatctgtaca

SEQ ID NO: 337675 - DNA, 25 bp, Rattus norvegicus
gagatctgtgcatcacatctgtaca

SEQ ID NO: 337676 - DNA, 25 bp, Rattus norvegicus
gagatctgtgccaagatcaccgatg

SEQ ID NO: 337677 - DNA, 25 bp, Rattus norvegicus
gagatctgtgcctagatcaccgatg

SEQ ID NO: 337678 - DNA, 25 bp, Rattus norvegicus
gagatctgtgtcaacgtgctcaaga

SEQ ID NO: 337679 - DNA, 25 bp, Rattus norvegicus
gagatctgtgtctacgtgctcaaga

SEQ ID NO: 337680 - DNA, 25 bp, Rattus norvegicus
gagatcttactcacttttctaccca

SEQ ID NO: 337681 - DNA, 25 bp, Rattus norvegicus
gagatcttactctcttttctaccca

SEQ ID NO: 337682 - DNA, 25 bp, Rattus norvegicus
gagatcttagatacaggcccctaaa

SEQ ID NO: 337683 - DNA, 25 bp, Rattus norvegicus
gagatcttagattcaggcccctaaa

SEQ ID NO: 337684 - DNA, 25 bp, Rattus norvegicus
gagatcttagtgactgcctcacaga

SEQ ID NO: 337685 - DNA, 25 bp, Rattus norvegicus
gagatcttagtgtctgcctcacaga

SEQ ID NO: 337686 - DNA, 25 bp, Rattus norvegicus
gagatcttatacaagcccagtggaa

SEQ ID NO: 337687 - DNA, 25 bp, Rattus norvegicus
gagatcttatactagcccagtggaa

SEQ ID NO: 337688 - DNA, 25 bp, Rattus norvegicus
gagatcttcaacaggaacgcttggt

SEQ ID NO: 337689 - DNA, 25 bp, Rattus norvegicus
gagatcttcaactggaacgcttggt

SEQ ID NO: 337690 - DNA, 25 bp, Rattus norvegicus
gagatcttcagcaacttctgagccc

SEQ ID NO: 337691 - DNA, 25 bp, Rattus norvegicus
gagatcttcagctacttctgagccc

SEQ ID NO: 337692 - DNA, 25 bp, Rattus norvegicus
gagatcttcatcagcagtccacagg

SEQ ID NO: 337693 - DNA, 25 bp, Rattus norvegicus
gagatcttcatctgcagtccacagg

SEQ ID NO: 337694 - DNA, 25 bp, Rattus norvegicus
gagatcttcatgaaccaggctgcca

SEQ ID NO: 337695 - DNA, 25 bp, Rattus norvegicus
gagatcttcatgtaccaggctgcca

SEQ ID NO: 337696 - DNA, 25 bp, Rattus norvegicus
gagatcttcctgattatgtgcacca

SEQ ID NO: 337697 - DNA, 25 bp, Rattus norvegicus
gagatcttcctgtttatgtgcacca

SEQ ID NO: 337698 - DNA, 25 bp, Rattus norvegicus
gagatcttctcaccttccttataca

SEQ ID NO: 337699 - DNA, 25 bp, Rattus norvegicus
gagatcttctcagcttccttataca

SEQ ID NO: 337700 - DNA, 25 bp, Rattus norvegicus
gagatcttgaaccagactgctattt

SEQ ID NO: 337701 - DNA, 25 bp, Rattus norvegicus
gagatcttgaacgagactgctattt

SEQ ID NO: 337702 - DNA, 25 bp, Rattus norvegicus
gagatcttgactaagctggtggcca

SEQ ID NO: 337703 - DNA, 25 bp, Rattus norvegicus
gagatcttgacttagctggtggcca

SEQ ID NO: 337704 - DNA, 25 bp, Rattus norvegicus
gagatctttagtcgctgcatcacag

SEQ ID NO: 337705 - DNA, 25 bp, Rattus norvegicus
gagatctttagtggctgcatcacag

SEQ ID NO: 337706 - DNA, 25 bp, Rattus norvegicus
gagatctttctgaaactcgttgatg

SEQ ID NO: 337707 - DNA, 25 bp, Rattus norvegicus
gagatctttctgaactcctgttgta

SEQ ID NO: 337708 - DNA, 25 bp, Rattus norvegicus
gagatctttctgatctgtcatacca

SEQ ID NO: 337709 - DNA, 25 bp, Rattus norvegicus
gagatctttctgtaactcgttgatg

SEQ ID NO: 337710 - DNA, 25 bp, Rattus norvegicus
gagatctttctgtactcctgttgta

SEQ ID NO: 337711 - DNA, 25 bp, Rattus norvegicus
gagatctttctgttctgtcatacca

SEQ ID NO: 337712 - DNA, 25 bp, Rattus norvegicus
gagatctttgcaccttggttcatgg

SEQ ID NO: 337713 - DNA, 25 bp, Rattus norvegicus
gagatctttgcagcttggttcatgg

SEQ ID NO: 337714 - DNA, 25 bp, Rattus norvegicus
gagatcttttcgactttgtccctat

SEQ ID NO: 337715 - DNA, 25 bp, Rattus norvegicus
gagatcttttcgtctttgtccctat

SEQ ID NO: 337716 - DNA, 25 bp, Rattus norvegicus
gagatgaaattaactttgtccccaa

SEQ ID NO: 337717 - DNA, 25 bp, Rattus norvegicus
gagatgaaattaagtcatgatctcc

SEQ ID NO: 337718 - DNA, 25 bp, Rattus norvegicus
gagatgaaattatctttgtccccaa

SEQ ID NO: 337719 - DNA, 25 bp, Rattus norvegicus
gagatgaaattatgtcatgatctcc

SEQ ID NO: 337720 - DNA, 25 bp, Rattus norvegicus
gagatgaaccatcgctccaacgaat

SEQ ID NO: 337721 - DNA, 25 bp, Rattus norvegicus
gagatgaaccatggctccaacgaat

SEQ ID NO: 337722 - DNA, 25 bp, Rattus norvegicus
gagatgaactctctgtaggaccttg

SEQ ID NO: 337723 - DNA, 25 bp, Rattus norvegicus
gagatgaactctgtgtaggaccttg

SEQ ID NO: 337724 - DNA, 25 bp, Rattus norvegicus
gagatgaagatcactttcgcataaa

SEQ ID NO: 337725 - DNA, 25 bp, Rattus norvegicus
gagatgaagatctctttcgcataaa

SEQ ID NO: 337726 - DNA, 25 bp, Rattus norvegicus
gagatgaagattagccaggccctcc

SEQ ID NO: 337727 - DNA, 25 bp, Rattus norvegicus
gagatgaagatttgccaggccctcc

SEQ ID NO: 337728 - DNA, 25 bp, Rattus norvegicus
gagatgaatcccatgaggcgaacaa

SEQ ID NO: 337729 - DNA, 25 bp, Rattus norvegicus
gagatgaatcccttgaggcgaacaa

SEQ ID NO: 337730 - DNA, 25 bp, Rattus norvegicus
gagatgaattggatccttgtccttt

SEQ ID NO: 337731 - DNA, 25 bp, Rattus norvegicus
gagatgaattggttccttgtccttt

SEQ ID NO: 337732 - DNA, 25 bp, Rattus norvegicus
gagatgacaatgatctgacagcaag

SEQ ID NO: 337733 - DNA, 25 bp, Rattus norvegicus
gagatgacaatgttctgacagcaag

SEQ ID NO: 337734 - DNA, 25 bp, Rattus norvegicus
gagatgacaccaagctccagctgga

SEQ ID NO: 337735 - DNA, 25 bp, Rattus norvegicus
gagatgacaccatgctccagctgga

SEQ ID NO: 337736 - DNA, 25 bp, Rattus norvegicus
gagatgacacctaaatgatagcctt

SEQ ID NO: 337737 - DNA, 25 bp, Rattus norvegicus
gagatgacaccttaatgatagcctt

SEQ ID NO: 337738 - DNA, 25 bp, Rattus norvegicus
gagatgacacgcacaacttgtaaat

SEQ ID NO: 337739 - DNA, 25 bp, Rattus norvegicus
gagatgacacgctcaacttgtaaat

SEQ ID NO: 337740 - DNA, 25 bp, Rattus norvegicus
gagatgacagccacatgcatgcagt

SEQ ID NO: 337741 - DNA, 25 bp, Rattus norvegicus
gagatgacagcctcatgcatgcagt

SEQ ID NO: 337742 - DNA, 25 bp, Rattus norvegicus
gagatgacagttagctttgtgggat

SEQ ID NO: 337743 - DNA, 25 bp, Rattus norvegicus
gagatgacagtttgctttgtgggat

SEQ ID NO: 337744 - DNA, 25 bp, Rattus norvegicus
gagatgaccaaccacctgtgtttgt

SEQ ID NO: 337745 - DNA, 25 bp, Rattus norvegicus
gagatgaccaacgacctgtgtttgt

SEQ ID NO: 337746 - DNA, 25 bp, Rattus norvegicus
gagatgaccaagaaccacagcgacg

SEQ ID NO: 337747 - DNA, 25 bp, Rattus norvegicus
gagatgaccaagtaccacagcgacg

SEQ ID NO: 337748 - DNA, 25 bp, Rattus norvegicus
gagatgaccagaagtccttcttgtc

SEQ ID NO: 337749 - DNA, 25 bp, Rattus norvegicus
gagatgaccagatgtccttcttgtc

SEQ ID NO: 337750 - DNA, 25 bp, Rattus norvegicus
gagatgaccagtcctcagtgatcac

SEQ ID NO: 337751 - DNA, 25 bp, Rattus norvegicus
gagatgaccagtgctcagtgatcac

SEQ ID NO: 337752 - DNA, 25 bp, Rattus norvegicus
gagatgaccatcaaggacctttctt

SEQ ID NO: 337753 - DNA, 25 bp, Rattus norvegicus
gagatgaccatctaggacctttctt

SEQ ID NO: 337754 - DNA, 25 bp, Rattus norvegicus
gagatgacccagcagagccgttttc

SEQ ID NO: 337755 - DNA, 25 bp, Rattus norvegicus
gagatgacccaggagagccgttttc

SEQ ID NO: 337756 - DNA, 25 bp, Rattus norvegicus
gagatgacctacacaattcgtgggt

SEQ ID NO: 337757 - DNA, 25 bp, Rattus norvegicus
gagatgacctactcaattcgtgggt

SEQ ID NO: 337758 - DNA, 25 bp, Rattus norvegicus
gagatgacggaccttgttgttcctg

SEQ ID NO: 337759 - DNA, 25 bp, Rattus norvegicus
gagatgacggacgttgttgttcctg

SEQ ID NO: 337760 - DNA, 25 bp, Rattus norvegicus
gagatgacggctagctttgttttaa

SEQ ID NO: 337761 - DNA, 25 bp, Rattus norvegicus
gagatgacggcttgctttgttttaa

SEQ ID NO: 337762 - DNA, 25 bp, Rattus norvegicus
gagatgactacacggatgatcccac

SEQ ID NO: 337763 - DNA, 25 bp, Rattus norvegicus
gagatgactacagggatgatcccac

SEQ ID NO: 337764 - DNA, 25 bp, Rattus norvegicus
gagatgactctgcacaagcgtccat

SEQ ID NO: 337765 - DNA, 25 bp, Rattus norvegicus
gagatgactctggacaagcgtccat

SEQ ID NO: 337766 - DNA, 25 bp, Rattus norvegicus
gagatgactgcgaacccgggttgct

SEQ ID NO: 337767 - DNA, 25 bp, Rattus norvegicus
gagatgactgcgtacccgggttgct

SEQ ID NO: 337768 - DNA, 25 bp, Rattus norvegicus
gagatgactgtaactggttgtatac

SEQ ID NO: 337769 - DNA, 25 bp, Rattus norvegicus
gagatgactgtatctggttgtatac

SEQ ID NO: 337770 - DNA, 25 bp, Rattus norvegicus
gagatgacttccatgagaacccata

SEQ ID NO: 337771 - DNA, 25 bp, Rattus norvegicus
gagatgacttccttgagaacccata

SEQ ID NO: 337772 - DNA, 25 bp, Rattus norvegicus
gagatgactttgaaaccacgaacga

SEQ ID NO: 337773 - DNA, 25 bp, Rattus norvegicus
gagatgactttgtaaccacgaacga

SEQ ID NO: 337774 - DNA, 25 bp, Rattus norvegicus
gagatgagaaatcgccgagcacctt

SEQ ID NO: 337775 - DNA, 25 bp, Rattus norvegicus
gagatgagaaatggccgagcacctt

SEQ ID NO: 337776 - DNA, 25 bp, Rattus norvegicus
gagatgagacttacaagccccacct

SEQ ID NO: 337777 - DNA, 25 bp, Rattus norvegicus
gagatgagactttcaagccccacct

SEQ ID NO: 337778 - DNA, 25 bp, Rattus norvegicus
gagatgagatagctcttacttcaaa

SEQ ID NO: 337779 - DNA, 25 bp, Rattus norvegicus
gagatgagataggtcttacttcaaa

SEQ ID NO: 337780 - DNA, 25 bp, Rattus norvegicus
gagatgagcaacaccagaggcgctg

SEQ ID NO: 337781 - DNA, 25 bp, Rattus norvegicus
gagatgagcaactccagaggcgctg

SEQ ID NO: 337782 - DNA, 25 bp, Rattus norvegicus
gagatgagcactctcctagagaaga

SEQ ID NO: 337783 - DNA, 25 bp, Rattus norvegicus
gagatgagcactgtcctagagaaga

SEQ ID NO: 337784 - DNA, 25 bp, Rattus norvegicus
gagatgagccttcttcaagccttag

SEQ ID NO: 337785 - DNA, 25 bp, Rattus norvegicus
gagatgagccttgttcaagccttag

SEQ ID NO: 337786 - DNA, 25 bp, Rattus norvegicus
gagatgagcgacagcccttgcctga

SEQ ID NO: 337787 - DNA, 25 bp, Rattus norvegicus
gagatgagcgactgcccttgcctga

SEQ ID NO: 337788 - DNA, 25 bp, Rattus norvegicus
gagatgagctgaagatcaccgcaca

SEQ ID NO: 337789 - DNA, 25 bp, Rattus norvegicus
gagatgagctgatgatcaccgcaca

SEQ ID NO: 337790 - DNA, 25 bp, Rattus norvegicus
gagatgagtcacatcaagtcccgtg

SEQ ID NO: 337791 - DNA, 25 bp, Rattus norvegicus
gagatgagtcacttcaagtcccgtg

SEQ ID NO: 337792 - DNA, 25 bp, Rattus norvegicus
gagatgagtgtccatgtcacctctg

SEQ ID NO: 337793 - DNA, 25 bp, Rattus norvegicus
gagatgagtgtcgatgtcacctctg

SEQ ID NO: 337794 - DNA, 25 bp, Rattus norvegicus
gagatgagtttacaccaccactgtt

SEQ ID NO: 337795 - DNA, 25 bp, Rattus norvegicus
gagatgagtttagaccaccactgtt

SEQ ID NO: 337796 - DNA, 25 bp, Rattus norvegicus
gagatgatccagacctatgtggaac

SEQ ID NO: 337797 - DNA, 25 bp, Rattus norvegicus
gagatgatccagtcctatgtggaac

SEQ ID NO: 337798 - DNA, 25 bp, Rattus norvegicus
gagatgatccttagtgtggctagca

SEQ ID NO: 337799 - DNA, 25 bp, Rattus norvegicus
gagatgatcctttgtgtggctagca

SEQ ID NO: 337800 - DNA, 25 bp, Rattus norvegicus
gagatgatcgcccttgctggtctgc

SEQ ID NO: 337801 - DNA, 25 bp, Rattus norvegicus
gagatgatcgccgttgctggtctgc

SEQ ID NO: 337802 - DNA, 25 bp, Rattus norvegicus
gagatgatctctcagcaagccccag

SEQ ID NO: 337803 - DNA, 25 bp, Rattus norvegicus
gagatgatctctgagcaagccccag

SEQ ID NO: 337804 - DNA, 25 bp, Rattus norvegicus
gagatgatgcaacctcactgacgag

SEQ ID NO: 337805 - DNA, 25 bp, Rattus norvegicus
gagatgatgcaagctcactgacgag

SEQ ID NO: 337806 - DNA, 25 bp, Rattus norvegicus
gagatgatgtttaagtccccttttc

SEQ ID NO: 337807 - DNA, 25 bp, Rattus norvegicus
gagatgatgttttagtccccttttc

SEQ ID NO: 337808 - DNA, 25 bp, Rattus norvegicus
gagatgattcatctaccttcaacat

SEQ ID NO: 337809 - DNA, 25 bp, Rattus norvegicus
gagatgattcatgtaccttcaacat

SEQ ID NO: 337810 - DNA, 25 bp, Rattus norvegicus
gagatgattccgctgctaacttctt

SEQ ID NO: 337811 - DNA, 25 bp, Rattus norvegicus
gagatgattccggtgctaacttctt

SEQ ID NO: 337812 - DNA, 25 bp, Rattus norvegicus
gagatgattctgcaaccccgaattt

SEQ ID NO: 337813 - DNA, 25 bp, Rattus norvegicus
gagatgattctggaaccccgaattt

SEQ ID NO: 337814 - DNA, 25 bp, Rattus norvegicus
gagatgcaacatccactacacaggt

SEQ ID NO: 337815 - DNA, 25 bp, Rattus norvegicus
gagatgcaacatgcactacacaggt

SEQ ID NO: 337816 - DNA, 25 bp, Rattus norvegicus
gagatgcaatccatgcggactggaa

SEQ ID NO: 337817 - DNA, 25 bp, Rattus norvegicus
gagatgcaatccttgcggactggaa

SEQ ID NO: 337818 - DNA, 25 bp, Rattus norvegicus
gagatgcacaagattccactctgga

SEQ ID NO: 337819 - DNA, 25 bp, Rattus norvegicus
gagatgcacaagtttccactctgga

SEQ ID NO: 337820 - DNA, 25 bp, Rattus norvegicus
gagatgcacagacagttgcctggaa

SEQ ID NO: 337821 - DNA, 25 bp, Rattus norvegicus
gagatgcacagagagttgcctggaa

SEQ ID NO: 337822 - DNA, 25 bp, Rattus norvegicus
gagatgcacattacttttttgcccc

SEQ ID NO: 337823 - DNA, 25 bp, Rattus norvegicus
gagatgcacatttcttttttgcccc

SEQ ID NO: 337824 - DNA, 25 bp, Rattus norvegicus
gagatgcactctcccaacatggagg

SEQ ID NO: 337825 - DNA, 25 bp, Rattus norvegicus
gagatgcactctgccaacatggagg

SEQ ID NO: 337826 - DNA, 25 bp, Rattus norvegicus
gagatgcacttcctgaccatctgag

SEQ ID NO: 337827 - DNA, 25 bp, Rattus norvegicus
gagatgcacttcgtgaccatctgag

SEQ ID NO: 337828 - DNA, 25 bp, Rattus norvegicus
gagatgcagcaaacccagagaccct

SEQ ID NO: 337829 - DNA, 25 bp, Rattus norvegicus
gagatgcagcaatcccagagaccct

SEQ ID NO: 337830 - DNA, 25 bp, Rattus norvegicus
gagatgcagcatcaggttcttcccc

SEQ ID NO: 337831 - DNA, 25 bp, Rattus norvegicus
gagatgcagcatgaggttcttcccc

SEQ ID NO: 337832 - DNA, 25 bp, Rattus norvegicus
gagatgcagcctattgtcacagaca

SEQ ID NO: 337833 - DNA, 25 bp, Rattus norvegicus
gagatgcagccttttgtcacagaca

SEQ ID NO: 337834 - DNA, 25 bp, Rattus norvegicus
gagatgcagcgaatcaaggccacag

SEQ ID NO: 337835 - DNA, 25 bp, Rattus norvegicus
gagatgcagcgattcaaggccacag

SEQ ID NO: 337836 - DNA, 25 bp, Rattus norvegicus
gagatgcaggctcttgccttaggac

SEQ ID NO: 337837 - DNA, 25 bp, Rattus norvegicus
gagatgcaggctgttgccttaggac

SEQ ID NO: 337838 - DNA, 25 bp, Rattus norvegicus
gagatgcataacctcctgggtgagt

SEQ ID NO: 337839 - DNA, 25 bp, Rattus norvegicus
gagatgcataacgtcctgggtgagt

SEQ ID NO: 337840 - DNA, 25 bp, Rattus norvegicus
gagatgcatataccacaccatgata

SEQ ID NO: 337841 - DNA, 25 bp, Rattus norvegicus
gagatgcatatagcacaccatgata

SEQ ID NO: 337842 - DNA, 25 bp, Rattus norvegicus
gagatgcatggcacatattccctgt

SEQ ID NO: 337843 - DNA, 25 bp, Rattus norvegicus
gagatgcatggctcatattccctgt

SEQ ID NO: 337844 - DNA, 25 bp, Rattus norvegicus
gagatgcatgtgatgaaccctaact

SEQ ID NO: 337845 - DNA, 25 bp, Rattus norvegicus
gagatgcatgtgttgaaccctaact

SEQ ID NO: 337846 - DNA, 25 bp, Rattus norvegicus
gagatgcatttgagtatgctatcaa

SEQ ID NO: 337847 - DNA, 25 bp, Rattus norvegicus
gagatgcatttgtgtatgctatcaa

SEQ ID NO: 337848 - DNA, 25 bp, Rattus norvegicus
gagatgccacttactttgtcatcct

SEQ ID NO: 337849 - DNA, 25 bp, Rattus norvegicus
gagatgccactttctttgtcatcct

SEQ ID NO: 337850 - DNA, 25 bp, Rattus norvegicus
gagatgccagaaaccgtcttctctg

SEQ ID NO: 337851 - DNA, 25 bp, Rattus norvegicus
gagatgccagaatccgtcttctctg

SEQ ID NO: 337852 - DNA, 25 bp, Rattus norvegicus
gagatgccagcgagttctgaggtct

SEQ ID NO: 337853 - DNA, 25 bp, Rattus norvegicus
gagatgccagcgtgttctgaggtct

SEQ ID NO: 337854 - DNA, 25 bp, Rattus norvegicus
gagatgccatacctgaaatgcccac

SEQ ID NO: 337855 - DNA, 25 bp, Rattus norvegicus
gagatgccatacgtgaaatgcccac

SEQ ID NO: 337856 - DNA, 25 bp, Rattus norvegicus
gagatgccatctctttgggttttag

SEQ ID NO: 337857 - DNA, 25 bp, Rattus norvegicus
gagatgccatctgtttgggttttag

SEQ ID NO: 337858 - DNA, 25 bp, Rattus norvegicus
gagatgccattcacaggacacacag

SEQ ID NO: 337859 - DNA, 25 bp, Rattus norvegicus
gagatgccattcattgggccattgg

SEQ ID NO: 337860 - DNA, 25 bp, Rattus norvegicus
gagatgccattctcaggacacacag

SEQ ID NO: 337861 - DNA, 25 bp, Rattus norvegicus
gagatgccattctttgggccattgg

SEQ ID NO: 337862 - DNA, 25 bp, Rattus norvegicus
gagatgcccaagaacctggaataat

SEQ ID NO: 337863 - DNA, 25 bp, Rattus norvegicus
gagatgcccaagtacctggaataat

SEQ ID NO: 337864 - DNA, 25 bp, Rattus norvegicus
gagatgcccagcatacctgctattt

SEQ ID NO: 337865 - DNA, 25 bp, Rattus norvegicus
gagatgcccagcttacctgctattt

SEQ ID NO: 337866 - DNA, 25 bp, Rattus norvegicus
gagatgcccatacaggtccaaatgt

SEQ ID NO: 337867 - DNA, 25 bp, Rattus norvegicus
gagatgcccatagaggtccaaatgt

SEQ ID NO: 337868 - DNA, 25 bp, Rattus norvegicus
gagatgcccatgcagagcggccaca

SEQ ID NO: 337869 - DNA, 25 bp, Rattus norvegicus
gagatgcccatggagagcggccaca

SEQ ID NO: 337870 - DNA, 25 bp, Rattus norvegicus
gagatgccctgcaaggcttcaagat

SEQ ID NO: 337871 - DNA, 25 bp, Rattus norvegicus
gagatgccctgctaggcttcaagat

SEQ ID NO: 337872 - DNA, 25 bp, Rattus norvegicus
gagatgcctaggacccacttaaatg

SEQ ID NO: 337873 - DNA, 25 bp, Rattus norvegicus
gagatgcctaggtcccacttaaatg

SEQ ID NO: 337874 - DNA, 25 bp, Rattus norvegicus
gagatgcctgagacgtaaattacct

SEQ ID NO: 337875 - DNA, 25 bp, Rattus norvegicus
gagatgcctgagtcgtaaattacct

SEQ ID NO: 337876 - DNA, 25 bp, Rattus norvegicus
gagatgcctgtacatcccgaattcc

SEQ ID NO: 337877 - DNA, 25 bp, Rattus norvegicus
gagatgcctgtagatcccgaattcc

SEQ ID NO: 337878 - DNA, 25 bp, Rattus norvegicus
gagatgcgatttaggactacctcat

SEQ ID NO: 337879 - DNA, 25 bp, Rattus norvegicus
gagatgcgattttggactacctcat

SEQ ID NO: 337880 - DNA, 25 bp, Rattus norvegicus
gagatgcgctgtccctacgaagtga

SEQ ID NO: 337881 - DNA, 25 bp, Rattus norvegicus
gagatgcgctgtgcctacgaagtga

SEQ ID NO: 337882 - DNA, 25 bp, Rattus norvegicus
gagatgcgtgttattgcaggcccac

SEQ ID NO: 337883 - DNA, 25 bp, Rattus norvegicus
gagatgcgtgtttttgcaggcccac

SEQ ID NO: 337884 - DNA, 25 bp, Rattus norvegicus
gagatgctaaaaaacccacgccggc

SEQ ID NO: 337885 - DNA, 25 bp, Rattus norvegicus
gagatgctaaaatacccacgccggc

SEQ ID NO: 337886 - DNA, 25 bp, Rattus norvegicus
gagatgctactgatggtgaaaaatt

SEQ ID NO: 337887 - DNA, 25 bp, Rattus norvegicus
gagatgctactgttggtgaaaaatt

SEQ ID NO: 337888 - DNA, 25 bp, Rattus norvegicus
gagatgctagcgaggcttgtcaaca

SEQ ID NO: 337889 - DNA, 25 bp, Rattus norvegicus
gagatgctagcgtggcttgtcaaca

SEQ ID NO: 337890 - DNA, 25 bp, Rattus norvegicus
gagatgctatttaaccaccagagac

SEQ ID NO: 337891 - DNA, 25 bp, Rattus norvegicus
gagatgctattttaccaccagagac

SEQ ID NO: 337892 - DNA, 25 bp, Rattus norvegicus
gagatgctcaagagtgctagtgtat

SEQ ID NO: 337893 - DNA, 25 bp, Rattus norvegicus
gagatgctcaagtgtgctagtgtat

SEQ ID NO: 337894 - DNA, 25 bp, Rattus norvegicus
gagatgctcacacatggcgaattca

SEQ ID NO: 337895 - DNA, 25 bp, Rattus norvegicus
gagatgctcacagatggcgaattca

SEQ ID NO: 337896 - DNA, 25 bp, Rattus norvegicus
gagatgctcaggcatgctcactgaa

SEQ ID NO: 337897 - DNA, 25 bp, Rattus norvegicus
gagatgctcagggatgctcactgaa

SEQ ID NO: 337898 - DNA, 25 bp, Rattus norvegicus
gagatgctccaaactacttgaggac

SEQ ID NO: 337899 - DNA, 25 bp, Rattus norvegicus
gagatgctccaatctacttgaggac

SEQ ID NO: 337900 - DNA, 25 bp, Rattus norvegicus
gagatgctctccatagccaatagaa

SEQ ID NO: 337901 - DNA, 25 bp, Rattus norvegicus
gagatgctctccttagccaatagaa

SEQ ID NO: 337902 - DNA, 25 bp, Rattus norvegicus
gagatgctgactatgtagtgctatg

SEQ ID NO: 337903 - DNA, 25 bp, Rattus norvegicus
gagatgctgactttgtagtgctatg

SEQ ID NO: 337904 - DNA, 25 bp, Rattus norvegicus
gagatgctgcacaggcttgctgagc

SEQ ID NO: 337905 - DNA, 25 bp, Rattus norvegicus
gagatgctgcactggcttgctgagc

SEQ ID NO: 337906 - DNA, 25 bp, Rattus norvegicus
gagatgctggcacacctctgggaaa

SEQ ID NO: 337907 - DNA, 25 bp, Rattus norvegicus
gagatgctggcagacctctgggaaa

SEQ ID NO: 337908 - DNA, 25 bp, Rattus norvegicus
gagatgctgtctccagtggaaatga

SEQ ID NO: 337909 - DNA, 25 bp, Rattus norvegicus
gagatgctgtctgcagtggaaatga

SEQ ID NO: 337910 - DNA, 25 bp, Rattus norvegicus
gagatgctgttcatagtcctctttg

SEQ ID NO: 337911 - DNA, 25 bp, Rattus norvegicus
gagatgctgttcttagtcctctttg

SEQ ID NO: 337912 - DNA, 25 bp, Rattus norvegicus
gagatgcttcaccatgtaggacacg

SEQ ID NO: 337913 - DNA, 25 bp, Rattus norvegicus
gagatgcttcacgatgtaggacacg

SEQ ID NO: 337914 - DNA, 25 bp, Rattus norvegicus
gagatgcttcagatcaaacagcggt

SEQ ID NO: 337915 - DNA, 25 bp, Rattus norvegicus
gagatgcttcagttcaaacagcggt

SEQ ID NO: 337916 - DNA, 25 bp, Rattus norvegicus
gagatgcttctcagatggccatgag

SEQ ID NO: 337917 - DNA, 25 bp, Rattus norvegicus
gagatgcttctctgatggccatgag

SEQ ID NO: 337918 - DNA, 25 bp, Rattus norvegicus
gagatgcttggtcagctcttcacgc

SEQ ID NO: 337919 - DNA, 25 bp, Rattus norvegicus
gagatgcttggtgagctcttcacgc

SEQ ID NO: 337920 - DNA, 25 bp, Rattus norvegicus
gagatggaacttagacctccttcat

SEQ ID NO: 337921 - DNA, 25 bp, Rattus norvegicus
gagatggaactttgacctccttcat

SEQ ID NO: 337922 - DNA, 25 bp, Rattus norvegicus
gagatggaatctccacgacagccgg

SEQ ID NO: 337923 - DNA, 25 bp, Rattus norvegicus
gagatggaatctgcacgacagccgg

SEQ ID NO: 337924 - DNA, 25 bp, Rattus norvegicus
gagatggacaacaacgaggccccat

SEQ ID NO: 337925 - DNA, 25 bp, Rattus norvegicus
gagatggacaactacgaggccccat

SEQ ID NO: 337926 - DNA, 25 bp, Rattus norvegicus
gagatggacacacctctgaaccacc

SEQ ID NO: 337927 - DNA, 25 bp, Rattus norvegicus
gagatggacacagctctgaaccacc

SEQ ID NO: 337928 - DNA, 25 bp, Rattus norvegicus
gagatggaccatcctgctcatgtag

SEQ ID NO: 337929 - DNA, 25 bp, Rattus norvegicus
gagatggaccatgctgctcatgtag

SEQ ID NO: 337930 - DNA, 25 bp, Rattus norvegicus
gagatggacctgagtatcccaggct

SEQ ID NO: 337931 - DNA, 25 bp, Rattus norvegicus
gagatggacctgtgtatcccaggct

SEQ ID NO: 337932 - DNA, 25 bp, Rattus norvegicus
gagatggacgtcactgttgtcccat

SEQ ID NO: 337933 - DNA, 25 bp, Rattus norvegicus
gagatggacgtctctgttgtcccat

SEQ ID NO: 337934 - DNA, 25 bp, Rattus norvegicus
gagatggactgcactctcctggcag

SEQ ID NO: 337935 - DNA, 25 bp, Rattus norvegicus
gagatggactgctctctcctggcag

SEQ ID NO: 337936 - DNA, 25 bp, Rattus norvegicus
gagatggaggtgagcaaactgcccc

SEQ ID NO: 337937 - DNA, 25 bp, Rattus norvegicus
gagatggaggtgtgcaaactgcccc

SEQ ID NO: 337938 - DNA, 25 bp, Rattus norvegicus
gagatggagtccattgcagctacag

SEQ ID NO: 337939 - DNA, 25 bp, Rattus norvegicus
gagatggagtcctttgcagctacag

SEQ ID NO: 337940 - DNA, 25 bp, Rattus norvegicus
gagatggataccactacctgacatg

SEQ ID NO: 337941 - DNA, 25 bp, Rattus norvegicus
gagatggatacctctacctgacatg

SEQ ID NO: 337942 - DNA, 25 bp, Rattus norvegicus
gagatggatgccctggctcccagca

SEQ ID NO: 337943 - DNA, 25 bp, Rattus norvegicus
gagatggatgccgtggctcccagca

SEQ ID NO: 337944 - DNA, 25 bp, Rattus norvegicus
gagatggatgtcagcgtttctggca

SEQ ID NO: 337945 - DNA, 25 bp, Rattus norvegicus
gagatggatgtctgcgtttctggca

SEQ ID NO: 337946 - DNA, 25 bp, Rattus norvegicus
gagatggcaaaaccagcagctcctt

SEQ ID NO: 337947 - DNA, 25 bp, Rattus norvegicus
gagatggcaaaagcagcagctcctt

SEQ ID NO: 337948 - DNA, 25 bp, Rattus norvegicus
gagatggcaaagatgggtaccctct

SEQ ID NO: 337949 - DNA, 25 bp, Rattus norvegicus
gagatggcaaagttgggtaccctct

SEQ ID NO: 337950 - DNA, 25 bp, Rattus norvegicus
gagatggcaattcatttttccctag

SEQ ID NO: 337951 - DNA, 25 bp, Rattus norvegicus
gagatggcaattgatttttccctag

SEQ ID NO: 337952 - DNA, 25 bp, Rattus norvegicus
gagatggcacagcacactgccccta

SEQ ID NO: 337953 - DNA, 25 bp, Rattus norvegicus
gagatggcacaggacactgccccta

SEQ ID NO: 337954 - DNA, 25 bp, Rattus norvegicus
gagatggcagaaatcctacaggcag

SEQ ID NO: 337955 - DNA, 25 bp, Rattus norvegicus
gagatggcagaattcctacaggcag

SEQ ID NO: 337956 - DNA, 25 bp, Rattus norvegicus
gagatggcagggacctcccttacac

SEQ ID NO: 337957 - DNA, 25 bp, Rattus norvegicus
gagatggcagggtcctcccttacac

SEQ ID NO: 337958 - DNA, 25 bp, Rattus norvegicus
gagatggcagtactctcagccgtgc

SEQ ID NO: 337959 - DNA, 25 bp, Rattus norvegicus
gagatggcagtagtctcagccgtgc

SEQ ID NO: 337960 - DNA, 25 bp, Rattus norvegicus
gagatggccaagagacccacaacct

SEQ ID NO: 337961 - DNA, 25 bp, Rattus norvegicus
gagatggccaagtgacccacaacct

SEQ ID NO: 337962 - DNA, 25 bp, Rattus norvegicus
gagatggccacactggtccaaggaa

SEQ ID NO: 337963 - DNA, 25 bp, Rattus norvegicus
gagatggccacagtggtccaaggaa

SEQ ID NO: 337964 - DNA, 25 bp, Rattus norvegicus
gagatggccactctgctagagcagt

SEQ ID NO: 337965 - DNA, 25 bp, Rattus norvegicus
gagatggccactgtgctagagcagt

SEQ ID NO: 337966 - DNA, 25 bp, Rattus norvegicus
gagatggccgacattagtcttccgc

SEQ ID NO: 337967 - DNA, 25 bp, Rattus norvegicus
gagatggccgactttagtcttccgc

SEQ ID NO: 337968 - DNA, 25 bp, Rattus norvegicus
gagatggcctcgagactagacctgt

SEQ ID NO: 337969 - DNA, 25 bp, Rattus norvegicus
gagatggcctcgtgactagacctgt

SEQ ID NO: 337970 - DNA, 25 bp, Rattus norvegicus
gagatggcctgacctgccgccaaaa

SEQ ID NO: 337971 - DNA, 25 bp, Rattus norvegicus
gagatggcctgagctgccgccaaaa

SEQ ID NO: 337972 - DNA, 25 bp, Rattus norvegicus
gagatggcgctcctggcttcagtaa

SEQ ID NO: 337973 - DNA, 25 bp, Rattus norvegicus
gagatggcgctcgtggcttcagtaa

SEQ ID NO: 337974 - DNA, 25 bp, Rattus norvegicus
gagatggcggagctcatcttcgacc

SEQ ID NO: 337975 - DNA, 25 bp, Rattus norvegicus
gagatggcggaggtcatcttcgacc

SEQ ID NO: 337976 - DNA, 25 bp, Rattus norvegicus
gagatggctaacctgctgaacctca

SEQ ID NO: 337977 - DNA, 25 bp, Rattus norvegicus
gagatggctaacgtgctgaacctca

SEQ ID NO: 337978 - DNA, 25 bp, Rattus norvegicus
gagatggctctcaggtggaacaacc

SEQ ID NO: 337979 - DNA, 25 bp, Rattus norvegicus
gagatggctctctggtggaacaacc

SEQ ID NO: 337980 - DNA, 25 bp, Rattus norvegicus
gagatggctctgattttgagaaata

SEQ ID NO: 337981 - DNA, 25 bp, Rattus norvegicus
gagatggctctgtttttgagaaata

SEQ ID NO: 337982 - DNA, 25 bp, Rattus norvegicus
gagatggctcttaagatcctcaagt

SEQ ID NO: 337983 - DNA, 25 bp, Rattus norvegicus
gagatggctctttagatcctcaagt

SEQ ID NO: 337984 - DNA, 25 bp, Rattus norvegicus
gagatggctgaaatgtcctctgcat

SEQ ID NO: 337985 - DNA, 25 bp, Rattus norvegicus
gagatggctgaattgtcctctgcat

SEQ ID NO: 337986 - DNA, 25 bp, Rattus norvegicus
gagatggctgccatgagatagacaa

SEQ ID NO: 337987 - DNA, 25 bp, Rattus norvegicus
gagatggctgccttgagatagacaa

SEQ ID NO: 337988 - DNA, 25 bp, Rattus norvegicus
gagatgggaccaaagcccttacact

SEQ ID NO: 337989 - DNA, 25 bp, Rattus norvegicus
gagatgggaccatagcccttacact

SEQ ID NO: 337990 - DNA, 25 bp, Rattus norvegicus
gagatgggactgaccgctgacccgt

SEQ ID NO: 337991 - DNA, 25 bp, Rattus norvegicus
gagatgggactgaggatccttcttt

SEQ ID NO: 337992 - DNA, 25 bp, Rattus norvegicus
gagatgggactgtccgctgacccgt

SEQ ID NO: 337993 - DNA, 25 bp, Rattus norvegicus
gagatgggactgtggatccttcttt

SEQ ID NO: 337994 - DNA, 25 bp, Rattus norvegicus
gagatgggagttactgtgcatttcc

SEQ ID NO: 337995 - DNA, 25 bp, Rattus norvegicus
gagatgggagtttctgtgcatttcc

SEQ ID NO: 337996 - DNA, 25 bp, Rattus norvegicus
gagatgggatccatctgagaatgct

SEQ ID NO: 337997 - DNA, 25 bp, Rattus norvegicus
gagatgggatccttctgagaatgct

SEQ ID NO: 337998 - DNA, 25 bp, Rattus norvegicus
gagatgggatttcgcgtctcgtttt

SEQ ID NO: 337999 - DNA, 25 bp, Rattus norvegicus
gagatgggatttggcgtctcgtttt

SEQ ID NO: 338000 - DNA, 25 bp, Rattus norvegicus
gagatgggcagtcattcagctttta

SEQ ID NO: 338001 - DNA, 25 bp, Rattus norvegicus
gagatgggcagtgattcagctttta

SEQ ID NO: 338002 - DNA, 25 bp, Rattus norvegicus
gagatgggcattaccctcaatgaaa

SEQ ID NO: 338003 - DNA, 25 bp, Rattus norvegicus
gagatgggcatttccctcaatgaaa

SEQ ID NO: 338004 - DNA, 25 bp, Rattus norvegicus
gagatgggccgcacgatttgtaaga

SEQ ID NO: 338005 - DNA, 25 bp, Rattus norvegicus
gagatgggccgctcgatttgtaaga

SEQ ID NO: 338006 - DNA, 25 bp, Rattus norvegicus
gagatgggcctcaaaaagtcttacg

SEQ ID NO: 338007 - DNA, 25 bp, Rattus norvegicus
gagatgggcctctaaaagtcttacg

SEQ ID NO: 338008 - DNA, 25 bp, Rattus norvegicus
gagatgggggttacctctgtgcttc

SEQ ID NO: 338009 - DNA, 25 bp, Rattus norvegicus
gagatgggggtttcctctgtgcttc

SEQ ID NO: 338010 - DNA, 25 bp, Rattus norvegicus
gagatggtaaccataccctcttcca

SEQ ID NO: 338011 - DNA, 25 bp, Rattus norvegicus
gagatggtaaccttaccctcttcca

SEQ ID NO: 338012 - DNA, 25 bp, Rattus norvegicus
gagatggtacgcattccacagctaa

SEQ ID NO: 338013 - DNA, 25 bp, Rattus norvegicus
gagatggtacgctttccacagctaa

SEQ ID NO: 338014 - DNA, 25 bp, Rattus norvegicus
gagatggtatctaggctttctcccc

SEQ ID NO: 338015 - DNA, 25 bp, Rattus norvegicus
gagatggtatcttggctttctcccc

SEQ ID NO: 338016 - DNA, 25 bp, Rattus norvegicus
gagatggtcaatacctcacgggaca

SEQ ID NO: 338017 - DNA, 25 bp, Rattus norvegicus
gagatggtcaattcctcacgggaca

SEQ ID NO: 338018 - DNA, 25 bp, Rattus norvegicus
gagatggtcattacactgttgagca

SEQ ID NO: 338019 - DNA, 25 bp, Rattus norvegicus
gagatggtcattcagctcctggcca

SEQ ID NO: 338020 - DNA, 25 bp, Rattus norvegicus
gagatggtcattgagctcctggcca

SEQ ID NO: 338021 - DNA, 25 bp, Rattus norvegicus
gagatggtcatttcactgttgagca

SEQ ID NO: 338022 - DNA, 25 bp, Rattus norvegicus
gagatggtcctgaaccgccatgtag

SEQ ID NO: 338023 - DNA, 25 bp, Rattus norvegicus
gagatggtcctgtaccgccatgtag

SEQ ID NO: 338024 - DNA, 25 bp, Rattus norvegicus
gagatggtcgatattgtccacaaca

SEQ ID NO: 338025 - DNA, 25 bp, Rattus norvegicus
gagatggtcgattttgtccacaaca

SEQ ID NO: 338026 - DNA, 25 bp, Rattus norvegicus
gagatggtgaacacctagggcccac

SEQ ID NO: 338027 - DNA, 25 bp, Rattus norvegicus
gagatggtgaactcctagggcccac

SEQ ID NO: 338028 - DNA, 25 bp, Rattus norvegicus
gagatggtgcaacccattgctagaa

SEQ ID NO: 338029 - DNA, 25 bp, Rattus norvegicus
gagatggtgcaagccattgctagaa

SEQ ID NO: 338030 - DNA, 25 bp, Rattus norvegicus
gagatggtggacacttggcctgctc

SEQ ID NO: 338031 - DNA, 25 bp, Rattus norvegicus
gagatggtggactcttggcctgctc

SEQ ID NO: 338032 - DNA, 25 bp, Rattus norvegicus
gagatggtgttgatctagtcgcccc

SEQ ID NO: 338033 - DNA, 25 bp, Rattus norvegicus
gagatggtgttgttctagtcgcccc

SEQ ID NO: 338034 - DNA, 25 bp, Rattus norvegicus
gagatggttaagaaccctgactgct

SEQ ID NO: 338035 - DNA, 25 bp, Rattus norvegicus
gagatggttaagtaccctgactgct

SEQ ID NO: 338036 - DNA, 25 bp, Rattus norvegicus
gagatggttatgatgctcgtcttca

SEQ ID NO: 338037 - DNA, 25 bp, Rattus norvegicus
gagatggttatgttgctcgtcttca

SEQ ID NO: 338038 - DNA, 25 bp, Rattus norvegicus
gagatggttcagagatctagatcac

SEQ ID NO: 338039 - DNA, 25 bp, Rattus norvegicus
gagatggttcagtgatctagatcac

SEQ ID NO: 338040 - DNA, 25 bp, Rattus norvegicus
gagatggttgacaaactagccagga

SEQ ID NO: 338041 - DNA, 25 bp, Rattus norvegicus
gagatggttgactaactagccagga

SEQ ID NO: 338042 - DNA, 25 bp, Rattus norvegicus
gagatgtaaaccatcttccctctgt

SEQ ID NO: 338043 - DNA, 25 bp, Rattus norvegicus
gagatgtaaaccttcttccctctgt

SEQ ID NO: 338044 - DNA, 25 bp, Rattus norvegicus
gagatgtacaatccaccgaggcgaa

SEQ ID NO: 338045 - DNA, 25 bp, Rattus norvegicus
gagatgtacaatgcaccgaggcgaa

SEQ ID NO: 338046 - DNA, 25 bp, Rattus norvegicus
gagatgtacaggacactcccagaga

SEQ ID NO: 338047 - DNA, 25 bp, Rattus norvegicus
gagatgtacaggtcactcccagaga

SEQ ID NO: 338048 - DNA, 25 bp, Rattus norvegicus
gagatgtaccgtaggaactctgctc

SEQ ID NO: 338049 - DNA, 25 bp, Rattus norvegicus
gagatgtaccgttggaactctgctc

SEQ ID NO: 338050 - DNA, 25 bp, Rattus norvegicus
gagatgtacgttcgtttttacttgg

SEQ ID NO: 338051 - DNA, 25 bp, Rattus norvegicus
gagatgtacgttggtttttacttgg

SEQ ID NO: 338052 - DNA, 25 bp, Rattus norvegicus
gagatgtagaccatccccatccctg

SEQ ID NO: 338053 - DNA, 25 bp, Rattus norvegicus
gagatgtagaccttccccatccctg

SEQ ID NO: 338054 - DNA, 25 bp, Rattus norvegicus
gagatgtagcaacctatctgtccct

SEQ ID NO: 338055 - DNA, 25 bp, Rattus norvegicus
gagatgtagcaagctatctgtccct

SEQ ID NO: 338056 - DNA, 25 bp, Rattus norvegicus
gagatgtagtgacccgcgctgcctt

SEQ ID NO: 338057 - DNA, 25 bp, Rattus norvegicus
gagatgtagtgagccgcgctgcctt

SEQ ID NO: 338058 - DNA, 25 bp, Rattus norvegicus
gagatgtagttgacctggcttcctt

SEQ ID NO: 338059 - DNA, 25 bp, Rattus norvegicus
gagatgtagttgtcctggcttcctt

SEQ ID NO: 338060 - DNA, 25 bp, Rattus norvegicus
gagatgtatcttcaagcagcagcag

SEQ ID NO: 338061 - DNA, 25 bp, Rattus norvegicus
gagatgtatcttgaagcagcagcag

SEQ ID NO: 338062 - DNA, 25 bp, Rattus norvegicus
gagatgtattccacagtatccatgt

SEQ ID NO: 338063 - DNA, 25 bp, Rattus norvegicus
gagatgtattcctcagtatccatgt

SEQ ID NO: 338064 - DNA, 25 bp, Rattus norvegicus
gagatgtcaaagcactcccttctgg

SEQ ID NO: 338065 - DNA, 25 bp, Rattus norvegicus
gagatgtcaaaggactcccttctgg

SEQ ID NO: 338066 - DNA, 25 bp, Rattus norvegicus
gagatgtcacttctccaagaggaca

SEQ ID NO: 338067 - DNA, 25 bp, Rattus norvegicus
gagatgtcacttgtccaagaggaca

SEQ ID NO: 338068 - DNA, 25 bp, Rattus norvegicus
gagatgtcagatctgtccttcagca

SEQ ID NO: 338069 - DNA, 25 bp, Rattus norvegicus
gagatgtcagatgtgtccttcagca

SEQ ID NO: 338070 - DNA, 25 bp, Rattus norvegicus
gagatgtcaggaatcactaacttgt

SEQ ID NO: 338071 - DNA, 25 bp, Rattus norvegicus
gagatgtcaggattcactaacttgt

SEQ ID NO: 338072 - DNA, 25 bp, Rattus norvegicus
gagatgtcaggcctttccctcaggt

SEQ ID NO: 338073 - DNA, 25 bp, Rattus norvegicus
gagatgtcaggcgtttccctcaggt

SEQ ID NO: 338074 - DNA, 25 bp, Rattus norvegicus
gagatgtcataaacattgcaggaag

SEQ ID NO: 338075 - DNA, 25 bp, Rattus norvegicus
gagatgtcataatcattgcaggaag

SEQ ID NO: 338076 - DNA, 25 bp, Rattus norvegicus
gagatgtcctaacctgaatgtcccg

SEQ ID NO: 338077 - DNA, 25 bp, Rattus norvegicus
gagatgtcctaagctgaatgtcccg

SEQ ID NO: 338078 - DNA, 25 bp, Rattus norvegicus
gagatgtcgctcagtatcggctgat

SEQ ID NO: 338079 - DNA, 25 bp, Rattus norvegicus
gagatgtcgctctgtatcggctgat

SEQ ID NO: 338080 - DNA, 25 bp, Rattus norvegicus
gagatgtctgagacaggccagtcct

SEQ ID NO: 338081 - DNA, 25 bp, Rattus norvegicus
gagatgtctgagtcaggccagtcct

SEQ ID NO: 338082 - DNA, 25 bp, Rattus norvegicus
gagatgtctgcaagtgaccttgtta

SEQ ID NO: 338083 - DNA, 25 bp, Rattus norvegicus
gagatgtctgcatgtgaccttgtta

SEQ ID NO: 338084 - DNA, 25 bp, Rattus norvegicus
gagatgtctgttacacttttatatt

SEQ ID NO: 338085 - DNA, 25 bp, Rattus norvegicus
gagatgtctgtttcacttttatatt

SEQ ID NO: 338086 - DNA, 25 bp, Rattus norvegicus
gagatgtcttacagcacaatgtatt

SEQ ID NO: 338087 - DNA, 25 bp, Rattus norvegicus
gagatgtcttactgcacaatgtatt

SEQ ID NO: 338088 - DNA, 25 bp, Rattus norvegicus
gagatgtcttcccagagattccagc

SEQ ID NO: 338089 - DNA, 25 bp, Rattus norvegicus
gagatgtcttccgagagattccagc

SEQ ID NO: 338090 - DNA, 25 bp, Rattus norvegicus
gagatgtcttcgctctgctgtttga

SEQ ID NO: 338091 - DNA, 25 bp, Rattus norvegicus
gagatgtcttcggtctgctgtttga

SEQ ID NO: 338092 - DNA, 25 bp, Rattus norvegicus
gagatgtgacatatggcccttagct

SEQ ID NO: 338093 - DNA, 25 bp, Rattus norvegicus
gagatgtgacatttggcccttagct

SEQ ID NO: 338094 - DNA, 25 bp, Rattus norvegicus
gagatgtgacctagtaacctactaa

SEQ ID NO: 338095 - DNA, 25 bp, Rattus norvegicus
gagatgtgaccttgtaacctactaa

SEQ ID NO: 338096 - DNA, 25 bp, Rattus norvegicus
gagatgtgactcagatatcctccca

SEQ ID NO: 338097 - DNA, 25 bp, Rattus norvegicus
gagatgtgactctgatatcctccca

SEQ ID NO: 338098 - DNA, 25 bp, Rattus norvegicus
gagatgtgagccatctctggaggga

SEQ ID NO: 338099 - DNA, 25 bp, Rattus norvegicus
gagatgtgagccttctctggaggga

SEQ ID NO: 338100 - DNA, 25 bp, Rattus norvegicus
gagatgtgaggaccctctatcccta

SEQ ID NO: 338101 - DNA, 25 bp, Rattus norvegicus
gagatgtgaggagcctctatcccta

SEQ ID NO: 338102 - DNA, 25 bp, Rattus norvegicus
gagatgtgccaccattttgatgaga

SEQ ID NO: 338103 - DNA, 25 bp, Rattus norvegicus
gagatgtgccacgattttgatgaga

SEQ ID NO: 338104 - DNA, 25 bp, Rattus norvegicus
gagatgtgcctcctaagtgcagctc

SEQ ID NO: 338105 - DNA, 25 bp, Rattus norvegicus
gagatgtgcctcgtaagtgcagctc

SEQ ID NO: 338106 - DNA, 25 bp, Rattus norvegicus
gagatgtgctccacgggttggactc

SEQ ID NO: 338107 - DNA, 25 bp, Rattus norvegicus
gagatgtgctcctcgggttggactc

SEQ ID NO: 338108 - DNA, 25 bp, Rattus norvegicus
gagatgtggaccagtggctgcatcc

SEQ ID NO: 338109 - DNA, 25 bp, Rattus norvegicus
gagatgtggacctgtggctgcatcc

SEQ ID NO: 338110 - DNA, 25 bp, Rattus norvegicus
gagatgtggagaagttgcccgcccc

SEQ ID NO: 338111 - DNA, 25 bp, Rattus norvegicus
gagatgtggagatgttgcccgcccc

SEQ ID NO: 338112 - DNA, 25 bp, Rattus norvegicus
gagatgtggcttatcagtatgtgaa

SEQ ID NO: 338113 - DNA, 25 bp, Rattus norvegicus
gagatgtggcttttcagtatgtgaa

SEQ ID NO: 338114 - DNA, 25 bp, Rattus norvegicus
gagatgtggtctccagccccacgca

SEQ ID NO: 338115 - DNA, 25 bp, Rattus norvegicus
gagatgtggtctgcagccccacgca

SEQ ID NO: 338116 - DNA, 25 bp, Rattus norvegicus
gagatgtggttccagattctccctg

SEQ ID NO: 338117 - DNA, 25 bp, Rattus norvegicus
gagatgtggttcgagattctccctg

SEQ ID NO: 338118 - DNA, 25 bp, Rattus norvegicus
gagatgtgtagcacccaaaggccct

SEQ ID NO: 338119 - DNA, 25 bp, Rattus norvegicus
gagatgtgtagctcccaaaggccct

SEQ ID NO: 338120 - DNA, 25 bp, Rattus norvegicus
gagatgtgtctcagcactcgactga

SEQ ID NO: 338121 - DNA, 25 bp, Rattus norvegicus
gagatgtgtctctgcactcgactga

SEQ ID NO: 338122 - DNA, 25 bp, Rattus norvegicus
gagatgttaacacgcactgtcggag

SEQ ID NO: 338123 - DNA, 25 bp, Rattus norvegicus
gagatgttaacaggcactgtcggag

SEQ ID NO: 338124 - DNA, 25 bp, Rattus norvegicus
gagatgttacgcctacactgtacat

SEQ ID NO: 338125 - DNA, 25 bp, Rattus norvegicus
gagatgttacgcgtacactgtacat

SEQ ID NO: 338126 - DNA, 25 bp, Rattus norvegicus
gagatgttactgagggtttctaccc

SEQ ID NO: 338127 - DNA, 25 bp, Rattus norvegicus
gagatgttactgtgggtttctaccc

SEQ ID NO: 338128 - DNA, 25 bp, Rattus norvegicus
gagatgttagatactgcaagatcag

SEQ ID NO: 338129 - DNA, 25 bp, Rattus norvegicus
gagatgttagattctgcaagatcag

SEQ ID NO: 338130 - DNA, 25 bp, Rattus norvegicus
gagatgttatgtatgttgattgcta

SEQ ID NO: 338131 - DNA, 25 bp, Rattus norvegicus
gagatgttatgtttgttgattgcta

SEQ ID NO: 338132 - DNA, 25 bp, Rattus norvegicus
gagatgttcaagaagcccacgccgt

SEQ ID NO: 338133 - DNA, 25 bp, Rattus norvegicus
gagatgttcaagtagcccacgccgt

SEQ ID NO: 338134 - DNA, 25 bp, Rattus norvegicus
gagatgttcatgcaggctccttagg

SEQ ID NO: 338135 - DNA, 25 bp, Rattus norvegicus
gagatgttcatggaggctccttagg

SEQ ID NO: 338136 - DNA, 25 bp, Rattus norvegicus
gagatgttccctctaggcatttcct

SEQ ID NO: 338137 - DNA, 25 bp, Rattus norvegicus
gagatgttccctgtaggcatttcct

SEQ ID NO: 338138 - DNA, 25 bp, Rattus norvegicus
gagatgttcctcagcttgaagtgta

SEQ ID NO: 338139 - DNA, 25 bp, Rattus norvegicus
gagatgttcctctgcttgaagtgta

SEQ ID NO: 338140 - DNA, 25 bp, Rattus norvegicus
gagatgttcctgcactacagagcag

SEQ ID NO: 338141 - DNA, 25 bp, Rattus norvegicus
gagatgttcctgctattgttaatta

SEQ ID NO: 338142 - DNA, 25 bp, Rattus norvegicus
gagatgttcctggactacagagcag

SEQ ID NO: 338143 - DNA, 25 bp, Rattus norvegicus
gagatgttcctggtattgttaatta

SEQ ID NO: 338144 - DNA, 25 bp, Rattus norvegicus
gagatgttctagatcttcctaagaa

SEQ ID NO: 338145 - DNA, 25 bp, Rattus norvegicus
gagatgttctagttcttcctaagaa

SEQ ID NO: 338146 - DNA, 25 bp, Rattus norvegicus
gagatgttctgaaggtgtttccaat

SEQ ID NO: 338147 - DNA, 25 bp, Rattus norvegicus
gagatgttctgatggtgtttccaat

SEQ ID NO: 338148 - DNA, 25 bp, Rattus norvegicus
gagatgttcttaatcctgaccagca

SEQ ID NO: 338149 - DNA, 25 bp, Rattus norvegicus
gagatgttcttaatgtagcccaagc

SEQ ID NO: 338150 - DNA, 25 bp, Rattus norvegicus
gagatgttcttattcctgaccagca

SEQ ID NO: 338151 - DNA, 25 bp, Rattus norvegicus
gagatgttcttattgtagcccaagc

SEQ ID NO: 338152 - DNA, 25 bp, Rattus norvegicus
gagatgttgagcatactgcccataa

SEQ ID NO: 338153 - DNA, 25 bp, Rattus norvegicus
gagatgttgagcctcctgtaagtca

SEQ ID NO: 338154 - DNA, 25 bp, Rattus norvegicus
gagatgttgagcgtcctgtaagtca

SEQ ID NO: 338155 - DNA, 25 bp, Rattus norvegicus
gagatgttgagcttactgcccataa

SEQ ID NO: 338156 - DNA, 25 bp, Rattus norvegicus
gagatgttgatcctttctgttacaa

SEQ ID NO: 338157 - DNA, 25 bp, Rattus norvegicus
gagatgttgatcgtttctgttacaa

SEQ ID NO: 338158 - DNA, 25 bp, Rattus norvegicus
gagatgttgcagagactgtcacaaa

SEQ ID NO: 338159 - DNA, 25 bp, Rattus norvegicus
gagatgttgcagtgactgtcacaaa

SEQ ID NO: 338160 - DNA, 25 bp, Rattus norvegicus
gagatgttgcatagtcctcaggaca

SEQ ID NO: 338161 - DNA, 25 bp, Rattus norvegicus
gagatgttgcattgtcctcaggaca

SEQ ID NO: 338162 - DNA, 25 bp, Rattus norvegicus
gagatgttggagacccctctgcaga

SEQ ID NO: 338163 - DNA, 25 bp, Rattus norvegicus
gagatgttggagtcccctctgcaga

SEQ ID NO: 338164 - DNA, 25 bp, Rattus norvegicus
gagatgttggcaatttctgaccctg

SEQ ID NO: 338165 - DNA, 25 bp, Rattus norvegicus
gagatgttggcattttctgaccctg

SEQ ID NO: 338166 - DNA, 25 bp, Rattus norvegicus
gagatgtttaacaactcctccgcag

SEQ ID NO: 338167 - DNA, 25 bp, Rattus norvegicus
gagatgtttaactactcctccgcag

SEQ ID NO: 338168 - DNA, 25 bp, Rattus norvegicus
gagatgtttaccattcttatgtaca

SEQ ID NO: 338169 - DNA, 25 bp, Rattus norvegicus
gagatgtttacctttcttatgtaca

SEQ ID NO: 338170 - DNA, 25 bp, Rattus norvegicus
gagatgtttattattctaacagaac

SEQ ID NO: 338171 - DNA, 25 bp, Rattus norvegicus
gagatgtttatttttctaacagaac

SEQ ID NO: 338172 - DNA, 25 bp, Rattus norvegicus
gagatgtttcatcttcctgacatgt

SEQ ID NO: 338173 - DNA, 25 bp, Rattus norvegicus
gagatgtttcatgttcctgacatgt

SEQ ID NO: 338174 - DNA, 25 bp, Rattus norvegicus
gagatgtttctgctactgctgagtt

SEQ ID NO: 338175 - DNA, 25 bp, Rattus norvegicus
gagatgtttctggtactgctgagtt

SEQ ID NO: 338176 - DNA, 25 bp, Rattus norvegicus
gagatgtttgcaccacccatgggcc

SEQ ID NO: 338177 - DNA, 25 bp, Rattus norvegicus
gagatgtttgcagcacccatgggcc

SEQ ID NO: 338178 - DNA, 25 bp, Rattus norvegicus
gagatgtttgtaccagacgtcctta

SEQ ID NO: 338179 - DNA, 25 bp, Rattus norvegicus
gagatgtttgtagcagacgtcctta

SEQ ID NO: 338180 - DNA, 25 bp, Rattus norvegicus
gagatgttttgaatgtgccctttta

SEQ ID NO: 338181 - DNA, 25 bp, Rattus norvegicus
gagatgttttgattgtgccctttta

SEQ ID NO: 338182 - DNA, 25 bp, Rattus norvegicus
gagattaaacaaaatccccttcgga

SEQ ID NO: 338183 - DNA, 25 bp, Rattus norvegicus
gagattaaacaatatccccttcgga

SEQ ID NO: 338184 - DNA, 25 bp, Rattus norvegicus
gagattaaacccaaggctaccctgg

SEQ ID NO: 338185 - DNA, 25 bp, Rattus norvegicus
gagattaaaccctaggctaccctgg

SEQ ID NO: 338186 - DNA, 25 bp, Rattus norvegicus
gagattaacgtaaccagaggcttca

SEQ ID NO: 338187 - DNA, 25 bp, Rattus norvegicus
gagattaacgtatccagaggcttca

SEQ ID NO: 338188 - DNA, 25 bp, Rattus norvegicus
gagattaagaaaaacccaggatgcc

SEQ ID NO: 338189 - DNA, 25 bp, Rattus norvegicus
gagattaagaaacacaacttgtaca

SEQ ID NO: 338190 - DNA, 25 bp, Rattus norvegicus
gagattaagaaagacaacttgtaca

SEQ ID NO: 338191 - DNA, 25 bp, Rattus norvegicus
gagattaagaaatacccaggatgcc

SEQ ID NO: 338192 - DNA, 25 bp, Rattus norvegicus
gagattaagcccagtggaagaaggt

SEQ ID NO: 338193 - DNA, 25 bp, Rattus norvegicus
gagattaagccctgtggaagaaggt

SEQ ID NO: 338194 - DNA, 25 bp, Rattus norvegicus
gagattacacatagcattgtaccaa

SEQ ID NO: 338195 - DNA, 25 bp, Rattus norvegicus
gagattacacattgcattgtaccaa

SEQ ID NO: 338196 - DNA, 25 bp, Rattus norvegicus
gagattacagctcctatgacagcag

SEQ ID NO: 338197 - DNA, 25 bp, Rattus norvegicus
gagattacagctgctatgacagcag

SEQ ID NO: 338198 - DNA, 25 bp, Rattus norvegicus
gagattacatttcatgctacccagc

SEQ ID NO: 338199 - DNA, 25 bp, Rattus norvegicus
gagattacatttgatgctacccagc

SEQ ID NO: 338200 - DNA, 25 bp, Rattus norvegicus
gagattaccacacggctcagctgct

SEQ ID NO: 338201 - DNA, 25 bp, Rattus norvegicus
gagattaccacagggctcagctgct

SEQ ID NO: 338202 - DNA, 25 bp, Rattus norvegicus
gagattaccatccaaaatcccgtcc

SEQ ID NO: 338203 - DNA, 25 bp, Rattus norvegicus
gagattaccatcgaaaatcccgtcc

SEQ ID NO: 338204 - DNA, 25 bp, Rattus norvegicus
gagattacctctcaatagtccagta

SEQ ID NO: 338205 - DNA, 25 bp, Rattus norvegicus
gagattacctctgaatagtccagta

SEQ ID NO: 338206 - DNA, 25 bp, Rattus norvegicus
gagattacgacgcaacccgacggcg

SEQ ID NO: 338207 - DNA, 25 bp, Rattus norvegicus
gagattacgacggaacccgacggcg

SEQ ID NO: 338208 - DNA, 25 bp, Rattus norvegicus
gagattacgactccagaacagccct

SEQ ID NO: 338209 - DNA, 25 bp, Rattus norvegicus
gagattacgactgcagaacagccct

SEQ ID NO: 338210 - DNA, 25 bp, Rattus norvegicus
gagattactaggaagctggagaaac

SEQ ID NO: 338211 - DNA, 25 bp, Rattus norvegicus
gagattactaggtagctggagaaac

SEQ ID NO: 338212 - DNA, 25 bp, Rattus norvegicus
gagattactcaaagcctctggaata

SEQ ID NO: 338213 - DNA, 25 bp, Rattus norvegicus
gagattactcaatgcctctggaata

SEQ ID NO: 338214 - DNA, 25 bp, Rattus norvegicus
gagattagaggcctgtgccatcaca

SEQ ID NO: 338215 - DNA, 25 bp, Rattus norvegicus
gagattagaggcgtgtgccatcaca

SEQ ID NO: 338216 - DNA, 25 bp, Rattus norvegicus
gagattagcagcaggcttgtttttt

SEQ ID NO: 338217 - DNA, 25 bp, Rattus norvegicus
gagattagcagctggcttgtttttt

SEQ ID NO: 338218 - DNA, 25 bp, Rattus norvegicus
gagattagccagcaaagccgaccat

SEQ ID NO: 338219 - DNA, 25 bp, Rattus norvegicus
gagattagccaggaaagccgaccat

SEQ ID NO: 338220 - DNA, 25 bp, Rattus norvegicus
gagattagccctcaactctacgttc

SEQ ID NO: 338221 - DNA, 25 bp, Rattus norvegicus
gagattagccctgaactctacgttc

SEQ ID NO: 338222 - DNA, 25 bp, Rattus norvegicus
gagattagttcaatctgaataccaa

SEQ ID NO: 338223 - DNA, 25 bp, Rattus norvegicus
gagattagttcacggccacagacaa

SEQ ID NO: 338224 - DNA, 25 bp, Rattus norvegicus
gagattagttcagggccacagacaa

SEQ ID NO: 338225 - DNA, 25 bp, Rattus norvegicus
gagattagttcattctgaataccaa

SEQ ID NO: 338226 - DNA, 25 bp, Rattus norvegicus
gagattataactataactgaccacc

SEQ ID NO: 338227 - DNA, 25 bp, Rattus norvegicus
gagattataactttaactgaccacc

SEQ ID NO: 338228 - DNA, 25 bp, Rattus norvegicus
gagattatatttagtcttctatcca

SEQ ID NO: 338229 - DNA, 25 bp, Rattus norvegicus
gagattatattttgtcttctatcca

SEQ ID NO: 338230 - DNA, 25 bp, Rattus norvegicus
gagattatcctcagtgcatgtgccc

SEQ ID NO: 338231 - DNA, 25 bp, Rattus norvegicus
gagattatcctctgtgcatgtgccc

SEQ ID NO: 338232 - DNA, 25 bp, Rattus norvegicus
gagattatctctcaggtaacccaag

SEQ ID NO: 338233 - DNA, 25 bp, Rattus norvegicus
gagattatctctgaggtaacccaag

SEQ ID NO: 338234 - DNA, 25 bp, Rattus norvegicus
gagattatctgtagttgtcacaaac

SEQ ID NO: 338235 - DNA, 25 bp, Rattus norvegicus
gagattatctgttgttgtcacaaac

SEQ ID NO: 338236 - DNA, 25 bp, Rattus norvegicus
gagattatgcttcgtcctggtacca

SEQ ID NO: 338237 - DNA, 25 bp, Rattus norvegicus
gagattatgcttggtcctggtacca

SEQ ID NO: 338238 - DNA, 25 bp, Rattus norvegicus
gagattattcaaaggcagccttcct

SEQ ID NO: 338239 - DNA, 25 bp, Rattus norvegicus
gagattattcaatggcagccttcct

SEQ ID NO: 338240 - DNA, 25 bp, Rattus norvegicus
gagattattcagctggtccccaact

SEQ ID NO: 338241 - DNA, 25 bp, Rattus norvegicus
gagattattcaggtggtccccaact

SEQ ID NO: 338242 - DNA, 25 bp, Rattus norvegicus
gagattattgagcttcatcatgacc

SEQ ID NO: 338243 - DNA, 25 bp, Rattus norvegicus
gagattattgaggttcatcatgacc

SEQ ID NO: 338244 - DNA, 25 bp, Rattus norvegicus
gagattatttatacactggtcccat

SEQ ID NO: 338245 - DNA, 25 bp, Rattus norvegicus
gagattatttatagccacagccgat

SEQ ID NO: 338246 - DNA, 25 bp, Rattus norvegicus
gagattatttattcactggtcccat

SEQ ID NO: 338247 - DNA, 25 bp, Rattus norvegicus
gagattatttattgccacagccgat

SEQ ID NO: 338248 - DNA, 25 bp, Rattus norvegicus
gagattcaaatcaacacctcgtgaa

SEQ ID NO: 338249 - DNA, 25 bp, Rattus norvegicus
gagattcaaatctacacctcgtgaa

SEQ ID NO: 338250 - DNA, 25 bp, Rattus norvegicus
gagattcaacgactccgggactctt

SEQ ID NO: 338251 - DNA, 25 bp, Rattus norvegicus
gagattcaacgagtccgggactctt

SEQ ID NO: 338252 - DNA, 25 bp, Rattus norvegicus
gagattcaagaacccattgccgtgg

SEQ ID NO: 338253 - DNA, 25 bp, Rattus norvegicus
gagattcaagaagccattgccgtgg

SEQ ID NO: 338254 - DNA, 25 bp, Rattus norvegicus
gagattcaagttcattccgtggata

SEQ ID NO: 338255 - DNA, 25 bp, Rattus norvegicus
gagattcaagttgattccgtggata

SEQ ID NO: 338256 - DNA, 25 bp, Rattus norvegicus
gagattcacacaattgttcaagtac

SEQ ID NO: 338257 - DNA, 25 bp, Rattus norvegicus
gagattcacacatttgttcaagtac

SEQ ID NO: 338258 - DNA, 25 bp, Rattus norvegicus
gagattcacattataatgacatcat

SEQ ID NO: 338259 - DNA, 25 bp, Rattus norvegicus
gagattcacattttaatgacatcat

SEQ ID NO: 338260 - DNA, 25 bp, Rattus norvegicus
gagattcaccagaccttggaccaga

SEQ ID NO: 338261 - DNA, 25 bp, Rattus norvegicus
gagattcaccagtccttggaccaga

SEQ ID NO: 338262 - DNA, 25 bp, Rattus norvegicus
gagattcactccctcaatgtaatgg

SEQ ID NO: 338263 - DNA, 25 bp, Rattus norvegicus
gagattcactccgtcaatgtaatgg

SEQ ID NO: 338264 - DNA, 25 bp, Rattus norvegicus
gagattcagaaaattcacctgacca

SEQ ID NO: 338265 - DNA, 25 bp, Rattus norvegicus
gagattcagaaatttcacctgacca

SEQ ID NO: 338266 - DNA, 25 bp, Rattus norvegicus
gagattcagaaccaagccaaggctt

SEQ ID NO: 338267 - DNA, 25 bp, Rattus norvegicus
gagattcagaacgaagccaaggctt

SEQ ID NO: 338268 - DNA, 25 bp, Rattus norvegicus
gagattcagaccatgatcagctaac

SEQ ID NO: 338269 - DNA, 25 bp, Rattus norvegicus
gagattcagaccttgatcagctaac

SEQ ID NO: 338270 - DNA, 25 bp, Rattus norvegicus
gagattcagattccctcccttgagg

SEQ ID NO: 338271 - DNA, 25 bp, Rattus norvegicus
gagattcagattgcctcccttgagg

SEQ ID NO: 338272 - DNA, 25 bp, Rattus norvegicus
gagattcagcataacctcttattgg

SEQ ID NO: 338273 - DNA, 25 bp, Rattus norvegicus
gagattcagcattacctcttattgg

SEQ ID NO: 338274 - DNA, 25 bp, Rattus norvegicus
gagattcaggtgcagacactcaacc

SEQ ID NO: 338275 - DNA, 25 bp, Rattus norvegicus
gagattcaggtggagacactcaacc

SEQ ID NO: 338276 - DNA, 25 bp, Rattus norvegicus
gagattcagtgaagtggccacccaa

SEQ ID NO: 338277 - DNA, 25 bp, Rattus norvegicus
gagattcagtgatgtggccacccaa

SEQ ID NO: 338278 - DNA, 25 bp, Rattus norvegicus
gagattcataaacagaccgtccctg

SEQ ID NO: 338279 - DNA, 25 bp, Rattus norvegicus
gagattcataaagagaccgtccctg

SEQ ID NO: 338280 - DNA, 25 bp, Rattus norvegicus
gagattcatgcaccttacctggtaa

SEQ ID NO: 338281 - DNA, 25 bp, Rattus norvegicus
gagattcatgcagcttacctggtaa

SEQ ID NO: 338282 - DNA, 25 bp, Rattus norvegicus
gagattcatgctacagtcacaagag

SEQ ID NO: 338283 - DNA, 25 bp, Rattus norvegicus
gagattcatgcttcagtcacaagag

SEQ ID NO: 338284 - DNA, 25 bp, Rattus norvegicus
gagattcattccacaggctacagtc

SEQ ID NO: 338285 - DNA, 25 bp, Rattus norvegicus
gagattcattcctcaggctacagtc

SEQ ID NO: 338286 - DNA, 25 bp, Rattus norvegicus
gagattccagagatcccactgggaa

SEQ ID NO: 338287 - DNA, 25 bp, Rattus norvegicus
gagattccagagttcccactgggaa

SEQ ID NO: 338288 - DNA, 25 bp, Rattus norvegicus
gagattccagttattctgtagcgtg

SEQ ID NO: 338289 - DNA, 25 bp, Rattus norvegicus
gagattccagtttttctgtagcgtg

SEQ ID NO: 338290 - DNA, 25 bp, Rattus norvegicus
gagattccatttctccagtagattg

SEQ ID NO: 338291 - DNA, 25 bp, Rattus norvegicus
gagattccatttgtccagtagattg

SEQ ID NO: 338292 - DNA, 25 bp, Rattus norvegicus
gagattcccaagctctacttttcat

SEQ ID NO: 338293 - DNA, 25 bp, Rattus norvegicus
gagattcccaaggtctacttttcat

SEQ ID NO: 338294 - DNA, 25 bp, Rattus norvegicus
gagattcccaatccaggtgctgagc

SEQ ID NO: 338295 - DNA, 25 bp, Rattus norvegicus
gagattcccaatgcaggtgctgagc

SEQ ID NO: 338296 - DNA, 25 bp, Rattus norvegicus
gagattcccagacgcaacggcatca

SEQ ID NO: 338297 - DNA, 25 bp, Rattus norvegicus
gagattcccagaggcaacggcatca

SEQ ID NO: 338298 - DNA, 25 bp, Rattus norvegicus
gagattcccagcattggtgccttgg

SEQ ID NO: 338299 - DNA, 25 bp, Rattus norvegicus
gagattcccagctttggtgccttgg

SEQ ID NO: 338300 - DNA, 25 bp, Rattus norvegicus
gagattccctctagaatgtctgcga

SEQ ID NO: 338301 - DNA, 25 bp, Rattus norvegicus
gagattccctcttgaatgtctgcga

SEQ ID NO: 338302 - DNA, 25 bp, Rattus norvegicus
gagattccgcatcgactctagattt

SEQ ID NO: 338303 - DNA, 25 bp, Rattus norvegicus
gagattccgcatggactctagattt

SEQ ID NO: 338304 - DNA, 25 bp, Rattus norvegicus
gagattccggcaagctcagctggaa

SEQ ID NO: 338305 - DNA, 25 bp, Rattus norvegicus
gagattccggcatgctcagctggaa

SEQ ID NO: 338306 - DNA, 25 bp, Rattus norvegicus
gagattcctaaccttgatcagcaag

SEQ ID NO: 338307 - DNA, 25 bp, Rattus norvegicus
gagattcctaacgttgatcagcaag

SEQ ID NO: 338308 - DNA, 25 bp, Rattus norvegicus
gagattcctagtataactcgccttg

SEQ ID NO: 338309 - DNA, 25 bp, Rattus norvegicus
gagattcctagtttaactcgccttg

SEQ ID NO: 338310 - DNA, 25 bp, Rattus norvegicus
gagattcctcgacttctgggcattc

SEQ ID NO: 338311 - DNA, 25 bp, Rattus norvegicus
gagattcctcgagttctgggcattc

SEQ ID NO: 338312 - DNA, 25 bp, Rattus norvegicus
gagattcctgaaccttgtgcgtcct

SEQ ID NO: 338313 - DNA, 25 bp, Rattus norvegicus
gagattcctgaagcttgtgcgtcct

SEQ ID NO: 338314 - DNA, 25 bp, Rattus norvegicus
gagattcctggcctcctgaagggaa

SEQ ID NO: 338315 - DNA, 25 bp, Rattus norvegicus
gagattcctggcgtcctgaagggaa

SEQ ID NO: 338316 - DNA, 25 bp, Rattus norvegicus
gagattcctgtaattattgtggctt

SEQ ID NO: 338317 - DNA, 25 bp, Rattus norvegicus
gagattcctgtatttattgtggctt

SEQ ID NO: 338318 - DNA, 25 bp, Rattus norvegicus
gagattcgaggactcagcccttgca

SEQ ID NO: 338319 - DNA, 25 bp, Rattus norvegicus
gagattcgaggagtcagcccttgca

SEQ ID NO: 338320 - DNA, 25 bp, Rattus norvegicus
gagattcgatcaagcctttgtgaaa

SEQ ID NO: 338321 - DNA, 25 bp, Rattus norvegicus
gagattcgatcatgcctttgtgaaa

SEQ ID NO: 338322 - DNA, 25 bp, Rattus norvegicus
gagattcgtgaaagcggtgccaagc

SEQ ID NO: 338323 - DNA, 25 bp, Rattus norvegicus
gagattcgtgaaagctctcccagct

SEQ ID NO: 338324 - DNA, 25 bp, Rattus norvegicus
gagattcgtgaatgcggtgccaagc

SEQ ID NO: 338325 - DNA, 25 bp, Rattus norvegicus
gagattcgtgaatgctctcccagct

SEQ ID NO: 338326 - DNA, 25 bp, Rattus norvegicus
gagattctaagcagtagtggatcaa

SEQ ID NO: 338327 - DNA, 25 bp, Rattus norvegicus
gagattctaagctgtagtggatcaa

SEQ ID NO: 338328 - DNA, 25 bp, Rattus norvegicus
gagattctatatactccctagtaac

SEQ ID NO: 338329 - DNA, 25 bp, Rattus norvegicus
gagattctatattctccctagtaac

SEQ ID NO: 338330 - DNA, 25 bp, Rattus norvegicus
gagattctcctaactagatgccaaa

SEQ ID NO: 338331 - DNA, 25 bp, Rattus norvegicus
gagattctcctatctagatgccaaa

SEQ ID NO: 338332 - DNA, 25 bp, Rattus norvegicus
gagattctcctcacaagagcaactt

SEQ ID NO: 338333 - DNA, 25 bp, Rattus norvegicus
gagattctcctctcaagagcaactt

SEQ ID NO: 338334 - DNA, 25 bp, Rattus norvegicus
gagattctctccctatacctgtatt

SEQ ID NO: 338335 - DNA, 25 bp, Rattus norvegicus
gagattctctccgtatacctgtatt

SEQ ID NO: 338336 - DNA, 25 bp, Rattus norvegicus
gagattctgagccttacatgcgtat

SEQ ID NO: 338337 - DNA, 25 bp, Rattus norvegicus
gagattctgagcgttacatgcgtat

SEQ ID NO: 338338 - DNA, 25 bp, Rattus norvegicus
gagattctgctgacacctcaaatac

SEQ ID NO: 338339 - DNA, 25 bp, Rattus norvegicus
gagattctgctgtcacctcaaatac

SEQ ID NO: 338340 - DNA, 25 bp, Rattus norvegicus
gagattctggagcacccactttctg

SEQ ID NO: 338341 - DNA, 25 bp, Rattus norvegicus
gagattctggaggacccactttctg

SEQ ID NO: 338342 - DNA, 25 bp, Rattus norvegicus
gagattctgtgaaactgctgccctt

SEQ ID NO: 338343 - DNA, 25 bp, Rattus norvegicus
gagattctgtgatactgctgccctt

SEQ ID NO: 338344 - DNA, 25 bp, Rattus norvegicus
gagattctgtgtccagtatcgtttt

SEQ ID NO: 338345 - DNA, 25 bp, Rattus norvegicus
gagattctgtgtgcagtatcgtttt

SEQ ID NO: 338346 - DNA, 25 bp, Rattus norvegicus
gagattctgttacctcagatgttca

SEQ ID NO: 338347 - DNA, 25 bp, Rattus norvegicus
gagattctgttagctcagatgttca

SEQ ID NO: 338348 - DNA, 25 bp, Rattus norvegicus
gagattcttaccacgtattctgttt

SEQ ID NO: 338349 - DNA, 25 bp, Rattus norvegicus
gagattcttacctcgtattctgttt

SEQ ID NO: 338350 - DNA, 25 bp, Rattus norvegicus
gagattcttaggaaccacacagtag

SEQ ID NO: 338351 - DNA, 25 bp, Rattus norvegicus
gagattcttaggtaccacacagtag

SEQ ID NO: 338352 - DNA, 25 bp, Rattus norvegicus
gagattcttcacattacagagcata

SEQ ID NO: 338353 - DNA, 25 bp, Rattus norvegicus
gagattcttcaccaacatttcattt

SEQ ID NO: 338354 - DNA, 25 bp, Rattus norvegicus
gagattcttcacgaacatttcattt

SEQ ID NO: 338355 - DNA, 25 bp, Rattus norvegicus
gagattcttcactttacagagcata

SEQ ID NO: 338356 - DNA, 25 bp, Rattus norvegicus
gagattcttcagatgggctgggtcc

SEQ ID NO: 338357 - DNA, 25 bp, Rattus norvegicus
gagattcttcagttgggctgggtcc

SEQ ID NO: 338358 - DNA, 25 bp, Rattus norvegicus
gagattcttcatatcagggtttaga

SEQ ID NO: 338359 - DNA, 25 bp, Rattus norvegicus
gagattcttcatttcagggtttaga

SEQ ID NO: 338360 - DNA, 25 bp, Rattus norvegicus
gagattcttcttctgatatttattc

SEQ ID NO: 338361 - DNA, 25 bp, Rattus norvegicus
gagattcttcttgtgatatttattc

SEQ ID NO: 338362 - DNA, 25 bp, Rattus norvegicus
gagattcttgccaacaatcacctgg

SEQ ID NO: 338363 - DNA, 25 bp, Rattus norvegicus
gagattcttgcctacaatcacctgg

SEQ ID NO: 338364 - DNA, 25 bp, Rattus norvegicus
gagattcttggcattgaaccggatc

SEQ ID NO: 338365 - DNA, 25 bp, Rattus norvegicus
gagattcttggctttgaaccggatc

SEQ ID NO: 338366 - DNA, 25 bp, Rattus norvegicus
gagattgaatacatgctggtttttt

SEQ ID NO: 338367 - DNA, 25 bp, Rattus norvegicus
gagattgaatacttgctggtttttt

SEQ ID NO: 338368 - DNA, 25 bp, Rattus norvegicus
gagattgaatataacctctgcccct

SEQ ID NO: 338369 - DNA, 25 bp, Rattus norvegicus
gagattgaatattacctctgcccct

SEQ ID NO: 338370 - DNA, 25 bp, Rattus norvegicus
gagattgacacaatggtcctaccag

SEQ ID NO: 338371 - DNA, 25 bp, Rattus norvegicus
gagattgacacattggtcctaccag

SEQ ID NO: 338372 - DNA, 25 bp, Rattus norvegicus
gagattgacagtacacttctgtgtg

SEQ ID NO: 338373 - DNA, 25 bp, Rattus norvegicus
gagattgacagttcacttctgtgtg

SEQ ID NO: 338374 - DNA, 25 bp, Rattus norvegicus
gagattgacatccaacccacagaca

SEQ ID NO: 338375 - DNA, 25 bp, Rattus norvegicus
gagattgacatcgaacccacagaca

SEQ ID NO: 338376 - DNA, 25 bp, Rattus norvegicus
gagattgacattattctcaacagga

SEQ ID NO: 338377 - DNA, 25 bp, Rattus norvegicus
gagattgacatttttctcaacagga

SEQ ID NO: 338378 - DNA, 25 bp, Rattus norvegicus
gagattgacccacttttgttccaag

SEQ ID NO: 338379 - DNA, 25 bp, Rattus norvegicus
gagattgacccagttttgttccaag

SEQ ID NO: 338380 - DNA, 25 bp, Rattus norvegicus
gagattgacggcagccatctgccaa

SEQ ID NO: 338381 - DNA, 25 bp, Rattus norvegicus
gagattgacggctgccatctgccaa

SEQ ID NO: 338382 - DNA, 25 bp, Rattus norvegicus
gagattgactaaaacctcattcttt

SEQ ID NO: 338383 - DNA, 25 bp, Rattus norvegicus
gagattgactaatacctcattcttt

SEQ ID NO: 338384 - DNA, 25 bp, Rattus norvegicus
gagattgagccaacatgtctttttt

SEQ ID NO: 338385 - DNA, 25 bp, Rattus norvegicus
gagattgagccatcatgtctttttt

SEQ ID NO: 338386 - DNA, 25 bp, Rattus norvegicus
gagattgagtacctaatgcctgttg

SEQ ID NO: 338387 - DNA, 25 bp, Rattus norvegicus
gagattgagtacgtaatgcctgttg

SEQ ID NO: 338388 - DNA, 25 bp, Rattus norvegicus
gagattgatctgcacacctctgacc

SEQ ID NO: 338389 - DNA, 25 bp, Rattus norvegicus
gagattgatctggacacctctgacc

SEQ ID NO: 338390 - DNA, 25 bp, Rattus norvegicus
gagattgattgcagggtccctcagc

SEQ ID NO: 338391 - DNA, 25 bp, Rattus norvegicus
gagattgattgctgggtccctcagc

SEQ ID NO: 338392 - DNA, 25 bp, Rattus norvegicus
gagattgcacttcacacacactcct

SEQ ID NO: 338393 - DNA, 25 bp, Rattus norvegicus
gagattgcacttgacacacactcct

SEQ ID NO: 338394 - DNA, 25 bp, Rattus norvegicus
gagattgcagaaccttctgctccgg

SEQ ID NO: 338395 - DNA, 25 bp, Rattus norvegicus
gagattgcagaagcttctgctccgg

SEQ ID NO: 338396 - DNA, 25 bp, Rattus norvegicus
gagattgccacgatttactctgaga

SEQ ID NO: 338397 - DNA, 25 bp, Rattus norvegicus
gagattgccacgttttactctgaga

SEQ ID NO: 338398 - DNA, 25 bp, Rattus norvegicus
gagattgccagtcttacctagtctt

SEQ ID NO: 338399 - DNA, 25 bp, Rattus norvegicus
gagattgccagtgttacctagtctt

SEQ ID NO: 338400 - DNA, 25 bp, Rattus norvegicus
gagattgcctgcaccagactaagat

SEQ ID NO: 338401 - DNA, 25 bp, Rattus norvegicus
gagattgcctgctccagactaagat

SEQ ID NO: 338402 - DNA, 25 bp, Rattus norvegicus
gagattgccttgctttagaccactt

SEQ ID NO: 338403 - DNA, 25 bp, Rattus norvegicus
gagattgccttggtttagaccactt

SEQ ID NO: 338404 - DNA, 25 bp, Rattus norvegicus
gagattgcggcgattgtcgtaaaga

SEQ ID NO: 338405 - DNA, 25 bp, Rattus norvegicus
gagattgcggcgtttgtcgtaaaga

SEQ ID NO: 338406 - DNA, 25 bp, Rattus norvegicus
gagattgctccaccaaaggactcac

SEQ ID NO: 338407 - DNA, 25 bp, Rattus norvegicus
gagattgctccagcaaaggactcac

SEQ ID NO: 338408 - DNA, 25 bp, Rattus norvegicus
gagattgctgccaatatccctgagg

SEQ ID NO: 338409 - DNA, 25 bp, Rattus norvegicus
gagattgctgcctatatccctgagg

SEQ ID NO: 338410 - DNA, 25 bp, Rattus norvegicus
gagattgctgctcaactctacatga

SEQ ID NO: 338411 - DNA, 25 bp, Rattus norvegicus
gagattgctgctgaactctacatga

SEQ ID NO: 338412 - DNA, 25 bp, Rattus norvegicus
gagattgctttacaccttatattta

SEQ ID NO: 338413 - DNA, 25 bp, Rattus norvegicus
gagattgctttagaccttatattta

SEQ ID NO: 338414 - DNA, 25 bp, Rattus norvegicus
gagattgctttcatgatagttcact

SEQ ID NO: 338415 - DNA, 25 bp, Rattus norvegicus
gagattgctttcttgatagttcact

SEQ ID NO: 338416 - DNA, 25 bp, Rattus norvegicus
gagattggaactattcagcatgaag

SEQ ID NO: 338417 - DNA, 25 bp, Rattus norvegicus
gagattggaacttttcagcatgaag

SEQ ID NO: 338418 - DNA, 25 bp, Rattus norvegicus
gagattggactgaaggttccagaaa

SEQ ID NO: 338419 - DNA, 25 bp, Rattus norvegicus
gagattggactgcaacacctcacac

SEQ ID NO: 338420 - DNA, 25 bp, Rattus norvegicus
gagattggactggaacacctcacac

SEQ ID NO: 338421 - DNA, 25 bp, Rattus norvegicus
gagattggactgtaggttccagaaa

SEQ ID NO: 338422 - DNA, 25 bp, Rattus norvegicus
gagattggagtacccctctatgagt

SEQ ID NO: 338423 - DNA, 25 bp, Rattus norvegicus
gagattggagtagccctctatgagt

SEQ ID NO: 338424 - DNA, 25 bp, Rattus norvegicus
gagattggcctcaaagtcttgtatt

SEQ ID NO: 338425 - DNA, 25 bp, Rattus norvegicus
gagattggcctctaagtcttgtatt

SEQ ID NO: 338426 - DNA, 25 bp, Rattus norvegicus
gagattggtactatattccatttct

SEQ ID NO: 338427 - DNA, 25 bp, Rattus norvegicus
gagattggtactttattccatttct

SEQ ID NO: 338428 - DNA, 25 bp, Rattus norvegicus
gagattggtctccattggaaaccag

SEQ ID NO: 338429 - DNA, 25 bp, Rattus norvegicus
gagattggtctcgattggaaaccag

SEQ ID NO: 338430 - DNA, 25 bp, Rattus norvegicus
gagattggttctcctacaccaggaa

SEQ ID NO: 338431 - DNA, 25 bp, Rattus norvegicus
gagattggttctgctacaccaggaa

SEQ ID NO: 338432 - DNA, 25 bp, Rattus norvegicus
gagattgtacaacctctccaagagc

SEQ ID NO: 338433 - DNA, 25 bp, Rattus norvegicus
gagattgtacaagctctccaagagc

SEQ ID NO: 338434 - DNA, 25 bp, Rattus norvegicus
gagattgtacctatcataccagtgt

SEQ ID NO: 338435 - DNA, 25 bp, Rattus norvegicus
gagattgtacctttcataccagtgt

SEQ ID NO: 338436 - DNA, 25 bp, Rattus norvegicus
gagattgtacttcgctccatgtcac

SEQ ID NO: 338437 - DNA, 25 bp, Rattus norvegicus
gagattgtacttggctccatgtcac

SEQ ID NO: 338438 - DNA, 25 bp, Rattus norvegicus
gagattgtatggctaattgttccta

SEQ ID NO: 338439 - DNA, 25 bp, Rattus norvegicus
gagattgtatgggtaattgttccta

SEQ ID NO: 338440 - DNA, 25 bp, Rattus norvegicus
gagattgtcaacattgcccggcaga

SEQ ID NO: 338441 - DNA, 25 bp, Rattus norvegicus
gagattgtcaactttgcccggcaga

SEQ ID NO: 338442 - DNA, 25 bp, Rattus norvegicus
gagattgtcacaagcaggtgtctaa

SEQ ID NO: 338443 - DNA, 25 bp, Rattus norvegicus
gagattgtcacacgatgtcatctga

SEQ ID NO: 338444 - DNA, 25 bp, Rattus norvegicus
gagattgtcacaggatgtcatctga

SEQ ID NO: 338445 - DNA, 25 bp, Rattus norvegicus
gagattgtcacatgcaggtgtctaa

SEQ ID NO: 338446 - DNA, 25 bp, Rattus norvegicus
gagattgtcaccaggcaaacagctt

SEQ ID NO: 338447 - DNA, 25 bp, Rattus norvegicus
gagattgtcacctggcaaacagctt

SEQ ID NO: 338448 - DNA, 25 bp, Rattus norvegicus
gagattgtccagagcagcaacacca

SEQ ID NO: 338449 - DNA, 25 bp, Rattus norvegicus
gagattgtccagtgcagcaacacca

SEQ ID NO: 338450 - DNA, 25 bp, Rattus norvegicus
gagattgtgcatattctcagaaagc

SEQ ID NO: 338451 - DNA, 25 bp, Rattus norvegicus
gagattgtgcattttctcagaaagc

SEQ ID NO: 338452 - DNA, 25 bp, Rattus norvegicus
gagattgtggtacacatcttccgaa

SEQ ID NO: 338453 - DNA, 25 bp, Rattus norvegicus
gagattgtggtagacatcttccgaa

SEQ ID NO: 338454 - DNA, 25 bp, Rattus norvegicus
gagattgtggtcatagaggattaac

SEQ ID NO: 338455 - DNA, 25 bp, Rattus norvegicus
gagattgtggtcttagaggattaac

SEQ ID NO: 338456 - DNA, 25 bp, Rattus norvegicus
gagattgtggttacgtggtgaccca

SEQ ID NO: 338457 - DNA, 25 bp, Rattus norvegicus
gagattgtggtttcgtggtgaccca

SEQ ID NO: 338458 - DNA, 25 bp, Rattus norvegicus
gagattgtgtatacctgcagttcag

SEQ ID NO: 338459 - DNA, 25 bp, Rattus norvegicus
gagattgtgtattcctgcagttcag

SEQ ID NO: 338460 - DNA, 25 bp, Rattus norvegicus
gagattgttacaaactagccggaaa

SEQ ID NO: 338461 - DNA, 25 bp, Rattus norvegicus
gagattgttacatactagccggaaa

SEQ ID NO: 338462 - DNA, 25 bp, Rattus norvegicus
gagattgttcttccttatgtcatta

SEQ ID NO: 338463 - DNA, 25 bp, Rattus norvegicus
gagattgttcttcgcatagagtctg

SEQ ID NO: 338464 - DNA, 25 bp, Rattus norvegicus
gagattgttcttgcttatgtcatta

SEQ ID NO: 338465 - DNA, 25 bp, Rattus norvegicus
gagattgttcttggcatagagtctg

SEQ ID NO: 338466 - DNA, 25 bp, Rattus norvegicus
gagattgttgtccttgttcaaacat

SEQ ID NO: 338467 - DNA, 25 bp, Rattus norvegicus
gagattgttgtcgttgttcaaacat

SEQ ID NO: 338468 - DNA, 25 bp, Rattus norvegicus
gagatttacaaacccgttcgttctg

SEQ ID NO: 338469 - DNA, 25 bp, Rattus norvegicus
gagatttacaaagccgttcgttctg

SEQ ID NO: 338470 - DNA, 25 bp, Rattus norvegicus
gagatttacacacaccgcaaactta

SEQ ID NO: 338471 - DNA, 25 bp, Rattus norvegicus
gagatttacacagaccgcaaactta

SEQ ID NO: 338472 - DNA, 25 bp, Rattus norvegicus
gagatttacagaaagtggcaaccat

SEQ ID NO: 338473 - DNA, 25 bp, Rattus norvegicus
gagatttacagaccttcctttcaag

SEQ ID NO: 338474 - DNA, 25 bp, Rattus norvegicus
gagatttacagagcttcctttcaag

SEQ ID NO: 338475 - DNA, 25 bp, Rattus norvegicus
gagatttacagatagtggcaaccat

SEQ ID NO: 338476 - DNA, 25 bp, Rattus norvegicus
gagatttacagcattgacctctgag

SEQ ID NO: 338477 - DNA, 25 bp, Rattus norvegicus
gagatttacagctttgacctctgag

SEQ ID NO: 338478 - DNA, 25 bp, Rattus norvegicus
gagatttacagtatggcttccccag

SEQ ID NO: 338479 - DNA, 25 bp, Rattus norvegicus
gagatttacagtttggcttccccag

SEQ ID NO: 338480 - DNA, 25 bp, Rattus norvegicus
gagatttacctaattctgcctttaa

SEQ ID NO: 338481 - DNA, 25 bp, Rattus norvegicus
gagatttacctatttctgcctttaa

SEQ ID NO: 338482 - DNA, 25 bp, Rattus norvegicus
gagatttacctcaatgcttgcggtc

SEQ ID NO: 338483 - DNA, 25 bp, Rattus norvegicus
gagatttacctctatgcttgcggtc

SEQ ID NO: 338484 - DNA, 25 bp, Rattus norvegicus
gagatttacttccttataccagcct

SEQ ID NO: 338485 - DNA, 25 bp, Rattus norvegicus
gagatttacttcgttataccagcct

SEQ ID NO: 338486 - DNA, 25 bp, Rattus norvegicus
gagatttacttgagtctgaactaat

SEQ ID NO: 338487 - DNA, 25 bp, Rattus norvegicus
gagatttacttgtgtctgaactaat

SEQ ID NO: 338488 - DNA, 25 bp, Rattus norvegicus
gagatttatcacaactacagattat

SEQ ID NO: 338489 - DNA, 25 bp, Rattus norvegicus
gagatttatcactactacagattat

SEQ ID NO: 338490 - DNA, 25 bp, Rattus norvegicus
gagatttatctactgctcttggtag

SEQ ID NO: 338491 - DNA, 25 bp, Rattus norvegicus
gagatttatctagtgctcttggtag

SEQ ID NO: 338492 - DNA, 25 bp, Rattus norvegicus
gagatttatgttccatatactgtca

SEQ ID NO: 338493 - DNA, 25 bp, Rattus norvegicus
gagatttatgttgcatatactgtca

SEQ ID NO: 338494 - DNA, 25 bp, Rattus norvegicus
gagatttcaactcagcctggacggt

SEQ ID NO: 338495 - DNA, 25 bp, Rattus norvegicus
gagatttcaactgagcctggacggt

SEQ ID NO: 338496 - DNA, 25 bp, Rattus norvegicus
gagatttcacaaacctgattgctat

SEQ ID NO: 338497 - DNA, 25 bp, Rattus norvegicus
gagatttcacaatcctgattgctat

SEQ ID NO: 338498 - DNA, 25 bp, Rattus norvegicus
gagatttcagatagacttattggca

SEQ ID NO: 338499 - DNA, 25 bp, Rattus norvegicus
gagatttcagattgacttattggca

SEQ ID NO: 338500 - DNA, 25 bp, Rattus norvegicus
gagatttcagtgagtcaatattcta

SEQ ID NO: 338501 - DNA, 25 bp, Rattus norvegicus
gagatttcagtgtgtcaatattcta

SEQ ID NO: 338502 - DNA, 25 bp, Rattus norvegicus
gagatttcatccagcaacggtacgt

SEQ ID NO: 338503 - DNA, 25 bp, Rattus norvegicus
gagatttcatcctgcaacggtacgt

SEQ ID NO: 338504 - DNA, 25 bp, Rattus norvegicus
gagatttcattcctggactgagggt

SEQ ID NO: 338505 - DNA, 25 bp, Rattus norvegicus
gagatttcattcgtggactgagggt

SEQ ID NO: 338506 - DNA, 25 bp, Rattus norvegicus
gagatttcccagcacttttggacct

SEQ ID NO: 338507 - DNA, 25 bp, Rattus norvegicus
gagatttcccaggacttttggacct

SEQ ID NO: 338508 - DNA, 25 bp, Rattus norvegicus
gagatttccctacgacctgagttct

SEQ ID NO: 338509 - DNA, 25 bp, Rattus norvegicus
gagatttccctaggacctgagttct

SEQ ID NO: 338510 - DNA, 25 bp, Rattus norvegicus
gagatttcctgtatggtcttattgc

SEQ ID NO: 338511 - DNA, 25 bp, Rattus norvegicus
gagatttcctgtttggtcttattgc

SEQ ID NO: 338512 - DNA, 25 bp, Rattus norvegicus
gagatttcctttaagaagtacttga

SEQ ID NO: 338513 - DNA, 25 bp, Rattus norvegicus
gagatttccttttagaagtacttga

SEQ ID NO: 338514 - DNA, 25 bp, Rattus norvegicus
gagatttcgtctcttggtttgctaa

SEQ ID NO: 338515 - DNA, 25 bp, Rattus norvegicus
gagatttcgtctgttggtttgctaa

SEQ ID NO: 338516 - DNA, 25 bp, Rattus norvegicus
gagatttctactagaaactgataga

SEQ ID NO: 338517 - DNA, 25 bp, Rattus norvegicus
gagatttctacttgaaactgataga

SEQ ID NO: 338518 - DNA, 25 bp, Rattus norvegicus
gagatttctgccaagctaccaagct

SEQ ID NO: 338519 - DNA, 25 bp, Rattus norvegicus
gagatttctgccatattgtttcaat

SEQ ID NO: 338520 - DNA, 25 bp, Rattus norvegicus
gagatttctgcctagctaccaagct

SEQ ID NO: 338521 - DNA, 25 bp, Rattus norvegicus
gagatttctgccttattgtttcaat

SEQ ID NO: 338522 - DNA, 25 bp, Rattus norvegicus
gagatttctggtcgctgtctgctcc

SEQ ID NO: 338523 - DNA, 25 bp, Rattus norvegicus
gagatttctggtggctgtctgctcc

SEQ ID NO: 338524 - DNA, 25 bp, Rattus norvegicus
gagatttctgtaaggcgaaagccag

SEQ ID NO: 338525 - DNA, 25 bp, Rattus norvegicus
gagatttctgtatggcgaaagccag

SEQ ID NO: 338526 - DNA, 25 bp, Rattus norvegicus
gagatttctgtgatgtttactgctg

SEQ ID NO: 338527 - DNA, 25 bp, Rattus norvegicus
gagatttctgtgttgtttactgctg

SEQ ID NO: 338528 - DNA, 25 bp, Rattus norvegicus
gagatttctgttaccagccaacatt

SEQ ID NO: 338529 - DNA, 25 bp, Rattus norvegicus
gagatttctgtttccagccaacatt

SEQ ID NO: 338530 - DNA, 25 bp, Rattus norvegicus
gagatttcttttacctcacgtgatt

SEQ ID NO: 338531 - DNA, 25 bp, Rattus norvegicus
gagatttcttttccttgtttatgct

SEQ ID NO: 338532 - DNA, 25 bp, Rattus norvegicus
gagatttcttttgcttgtttatgct

SEQ ID NO: 338533 - DNA, 25 bp, Rattus norvegicus
gagatttctttttcctcacgtgatt

SEQ ID NO: 338534 - DNA, 25 bp, Rattus norvegicus
gagatttgaacacagcccttgacaa

SEQ ID NO: 338535 - DNA, 25 bp, Rattus norvegicus
gagatttgaacagagcccttgacaa

SEQ ID NO: 338536 - DNA, 25 bp, Rattus norvegicus
gagatttgaaccacggttggacgaa

SEQ ID NO: 338537 - DNA, 25 bp, Rattus norvegicus
gagatttgaacctcggttggacgaa

SEQ ID NO: 338538 - DNA, 25 bp, Rattus norvegicus
gagatttgaccgaacacagtagtaa

SEQ ID NO: 338539 - DNA, 25 bp, Rattus norvegicus
gagatttgaccgtacacagtagtaa

SEQ ID NO: 338540 - DNA, 25 bp, Rattus norvegicus
gagatttgatatactacatgtctta

SEQ ID NO: 338541 - DNA, 25 bp, Rattus norvegicus
gagatttgatattctacatgtctta

SEQ ID NO: 338542 - DNA, 25 bp, Rattus norvegicus
gagatttgctccattcattgttttt

SEQ ID NO: 338543 - DNA, 25 bp, Rattus norvegicus
gagatttgctcctttcattgttttt

SEQ ID NO: 338544 - DNA, 25 bp, Rattus norvegicus
gagatttgctgacagcctcagctac

SEQ ID NO: 338545 - DNA, 25 bp, Rattus norvegicus
gagatttgctgagagcctcagctac

SEQ ID NO: 338546 - DNA, 25 bp, Rattus norvegicus
gagatttgctgtatataaggtgttc

SEQ ID NO: 338547 - DNA, 25 bp, Rattus norvegicus
gagatttgctgtttataaggtgttc

SEQ ID NO: 338548 - DNA, 25 bp, Rattus norvegicus
gagatttggcctcaggtctttgtaa

SEQ ID NO: 338549 - DNA, 25 bp, Rattus norvegicus
gagatttggcctgaggtctttgtaa

SEQ ID NO: 338550 - DNA, 25 bp, Rattus norvegicus
gagatttggtttcctacatcagaaa

SEQ ID NO: 338551 - DNA, 25 bp, Rattus norvegicus
gagatttggtttgctacatcagaaa

SEQ ID NO: 338552 - DNA, 25 bp, Rattus norvegicus
gagatttgtcatcgaagagcctgaa

SEQ ID NO: 338553 - DNA, 25 bp, Rattus norvegicus
gagatttgtcatggaagagcctgaa

SEQ ID NO: 338554 - DNA, 25 bp, Rattus norvegicus
gagattttaaggatccaactgtgtt

SEQ ID NO: 338555 - DNA, 25 bp, Rattus norvegicus
gagattttaaggttccaactgtgtt

SEQ ID NO: 338556 - DNA, 25 bp, Rattus norvegicus
gagattttacaactcacacagtgat

SEQ ID NO: 338557 - DNA, 25 bp, Rattus norvegicus
gagattttacaagtcacacagtgat

SEQ ID NO: 338558 - DNA, 25 bp, Rattus norvegicus
gagattttattaaagctccttcctc

SEQ ID NO: 338559 - DNA, 25 bp, Rattus norvegicus
gagattttattatagctccttcctc

SEQ ID NO: 338560 - DNA, 25 bp, Rattus norvegicus
gagattttctatagtagtgcttttt

SEQ ID NO: 338561 - DNA, 25 bp, Rattus norvegicus
gagattttctattgtagtgcttttt

SEQ ID NO: 338562 - DNA, 25 bp, Rattus norvegicus
gagattttctttattgctgttctga

SEQ ID NO: 338563 - DNA, 25 bp, Rattus norvegicus
gagattttcttttttgctgttctga

SEQ ID NO: 338564 - DNA, 25 bp, Rattus norvegicus
gagattttgaacatcacctagacaa

SEQ ID NO: 338565 - DNA, 25 bp, Rattus norvegicus
gagattttgaacttcacctagacaa

SEQ ID NO: 338566 - DNA, 25 bp, Rattus norvegicus
gagattttgatgaacactttgcaca

SEQ ID NO: 338567 - DNA, 25 bp, Rattus norvegicus
gagattttgatgtacactttgcaca

SEQ ID NO: 338568 - DNA, 25 bp, Rattus norvegicus
gagattttgccaagtcacacttttg

SEQ ID NO: 338569 - DNA, 25 bp, Rattus norvegicus
gagattttgccatgtcacacttttg

SEQ ID NO: 338570 - DNA, 25 bp, Rattus norvegicus
gagatttttatacactaaagcgttc

SEQ ID NO: 338571 - DNA, 25 bp, Rattus norvegicus
gagatttttatagactaaagcgttc

SEQ ID NO: 338572 - DNA, 25 bp, Rattus norvegicus
gagatttttcccactatattctttt

SEQ ID NO: 338573 - DNA, 25 bp, Rattus norvegicus
gagatttttccctctatattctttt

SEQ ID NO: 338574 - DNA, 25 bp, Rattus norvegicus
gagattttttatagctagtatttga

SEQ ID NO: 338575 - DNA, 25 bp, Rattus norvegicus
gagattttttattgctagtatttga

SEQ ID NO: 338576 - DNA, 25 bp, Rattus norvegicus
gagcaaaaacttaaacccacattct

SEQ ID NO: 338577 - DNA, 25 bp, Rattus norvegicus
gagcaaaaactttaacccacattct

SEQ ID NO: 338578 - DNA, 25 bp, Rattus norvegicus
gagcaaaaatgccacacctggtgtt

SEQ ID NO: 338579 - DNA, 25 bp, Rattus norvegicus
gagcaaaaatgcgacacctggtgtt

SEQ ID NO: 338580 - DNA, 25 bp, Rattus norvegicus
gagcaaaagccaaccgattcttcat

SEQ ID NO: 338581 - DNA, 25 bp, Rattus norvegicus
gagcaaaagccatccgattcttcat

SEQ ID NO: 338582 - DNA, 25 bp, Rattus norvegicus
gagcaaaagtggcatggacttctga

SEQ ID NO: 338583 - DNA, 25 bp, Rattus norvegicus
gagcaaaagtgggatggacttctga

SEQ ID NO: 338584 - DNA, 25 bp, Rattus norvegicus
gagcaaaatacacatccggacccag

SEQ ID NO: 338585 - DNA, 25 bp, Rattus norvegicus
gagcaaaatacagatccggacccag

SEQ ID NO: 338586 - DNA, 25 bp, Rattus norvegicus
gagcaaaattttagtgccacttggt

SEQ ID NO: 338587 - DNA, 25 bp, Rattus norvegicus
gagcaaaatttttgtgccacttggt

SEQ ID NO: 338588 - DNA, 25 bp, Rattus norvegicus
gagcaaacaccaactgatctttctc

SEQ ID NO: 338589 - DNA, 25 bp, Rattus norvegicus
gagcaaacaccatctgatctttctc

SEQ ID NO: 338590 - DNA, 25 bp, Rattus norvegicus
gagcaaacagagaccctaaccatga

SEQ ID NO: 338591 - DNA, 25 bp, Rattus norvegicus
gagcaaacagagtccctaaccatga

SEQ ID NO: 338592 - DNA, 25 bp, Rattus norvegicus
gagcaaacaggtaccccatgaggca

SEQ ID NO: 338593 - DNA, 25 bp, Rattus norvegicus
gagcaaacaggttccccatgaggca

SEQ ID NO: 338594 - DNA, 25 bp, Rattus norvegicus
gagcaaacagtacatctctgttctc

SEQ ID NO: 338595 - DNA, 25 bp, Rattus norvegicus
gagcaaacagtagatctctgttctc

SEQ ID NO: 338596 - DNA, 25 bp, Rattus norvegicus
gagcaaacagtgacctcgatatact

SEQ ID NO: 338597 - DNA, 25 bp, Rattus norvegicus
gagcaaacagtgtcctcgatatact

SEQ ID NO: 338598 - DNA, 25 bp, Rattus norvegicus
gagcaaacatctagcaccaaagtac

SEQ ID NO: 338599 - DNA, 25 bp, Rattus norvegicus
gagcaaacatcttgcaccaaagtac

SEQ ID NO: 338600 - DNA, 25 bp, Rattus norvegicus
gagcaaacatgcacccagacagatg

SEQ ID NO: 338601 - DNA, 25 bp, Rattus norvegicus
gagcaaacatgctcccagacagatg

SEQ ID NO: 338602 - DNA, 25 bp, Rattus norvegicus
gagcaaaccttaatcaaccggacct

SEQ ID NO: 338603 - DNA, 25 bp, Rattus norvegicus
gagcaaaccttattcaaccggacct

SEQ ID NO: 338604 - DNA, 25 bp, Rattus norvegicus
gagcaaacctttctttggagtcttt

SEQ ID NO: 338605 - DNA, 25 bp, Rattus norvegicus
gagcaaacctttgtttggagtcttt

SEQ ID NO: 338606 - DNA, 25 bp, Rattus norvegicus
gagcaaacgtgacgtagggtcccct

SEQ ID NO: 338607 - DNA, 25 bp, Rattus norvegicus
gagcaaacgtgaggtagggtcccct

SEQ ID NO: 338608 - DNA, 25 bp, Rattus norvegicus
gagcaaacgtgtacgtcactgtggg

SEQ ID NO: 338609 - DNA, 25 bp, Rattus norvegicus
gagcaaacgtgttcgtcactgtggg

SEQ ID NO: 338610 - DNA, 25 bp, Rattus norvegicus
gagcaaactggtccttgccaggctc

SEQ ID NO: 338611 - DNA, 25 bp, Rattus norvegicus
gagcaaactggtgcttgccaggctc

SEQ ID NO: 338612 - DNA, 25 bp, Rattus norvegicus
gagcaaactttcatgttcctaacaa

SEQ ID NO: 338613 - DNA, 25 bp, Rattus norvegicus
gagcaaactttcctatctgaatcct

SEQ ID NO: 338614 - DNA, 25 bp, Rattus norvegicus
gagcaaactttcgtatctgaatcct

SEQ ID NO: 338615 - DNA, 25 bp, Rattus norvegicus
gagcaaactttcttgttcctaacaa

SEQ ID NO: 338616 - DNA, 25 bp, Rattus norvegicus
gagcaaagaactcctgcaagctata

SEQ ID NO: 338617 - DNA, 25 bp, Rattus norvegicus
gagcaaagaactgctgcaagctata

SEQ ID NO: 338618 - DNA, 25 bp, Rattus norvegicus
gagcaaagagatatcctcccttacc

SEQ ID NO: 338619 - DNA, 25 bp, Rattus norvegicus
gagcaaagagatttcctcccttacc

SEQ ID NO: 338620 - DNA, 25 bp, Rattus norvegicus
gagcaaagagcaaaaatcctagttt

SEQ ID NO: 338621 - DNA, 25 bp, Rattus norvegicus
gagcaaagagcataaatcctagttt

SEQ ID NO: 338622 - DNA, 25 bp, Rattus norvegicus
gagcaaagatcacctgcacagtgca

SEQ ID NO: 338623 - DNA, 25 bp, Rattus norvegicus
gagcaaagatcagctgcacagtgca

SEQ ID NO: 338624 - DNA, 25 bp, Rattus norvegicus
gagcaaagatgtctttcttctgaca

SEQ ID NO: 338625 - DNA, 25 bp, Rattus norvegicus
gagcaaagatgtgtttcttctgaca

SEQ ID NO: 338626 - DNA, 25 bp, Rattus norvegicus
gagcaaagcaatcatatcgctcggg

SEQ ID NO: 338627 - DNA, 25 bp, Rattus norvegicus
gagcaaagcaatgatatcgctcggg

SEQ ID NO: 338628 - DNA, 25 bp, Rattus norvegicus
gagcaaagcactctgctcaacagag

SEQ ID NO: 338629 - DNA, 25 bp, Rattus norvegicus
gagcaaagcactgtgctcaacagag

SEQ ID NO: 338630 - DNA, 25 bp, Rattus norvegicus
gagcaaagcagactacgagaaacac

SEQ ID NO: 338631 - DNA, 25 bp, Rattus norvegicus
gagcaaagcagagtacgagaaacac

SEQ ID NO: 338632 - DNA, 25 bp, Rattus norvegicus
gagcaaagcagtcctgagccagaga

SEQ ID NO: 338633 - DNA, 25 bp, Rattus norvegicus
gagcaaagcagtgctgagccagaga

SEQ ID NO: 338634 - DNA, 25 bp, Rattus norvegicus
gagcaaagccggatttcttctggaa

SEQ ID NO: 338635 - DNA, 25 bp, Rattus norvegicus
gagcaaagccggttttcttctggaa

SEQ ID NO: 338636 - DNA, 25 bp, Rattus norvegicus
gagcaaagcctgacattgccttgcc

SEQ ID NO: 338637 - DNA, 25 bp, Rattus norvegicus
gagcaaagcctgatccgatgtttta

SEQ ID NO: 338638 - DNA, 25 bp, Rattus norvegicus
gagcaaagcctgcttacatccgaac

SEQ ID NO: 338639 - DNA, 25 bp, Rattus norvegicus
gagcaaagcctggttacatccgaac

SEQ ID NO: 338640 - DNA, 25 bp, Rattus norvegicus
gagcaaagcctgtcattgccttgcc

SEQ ID NO: 338641 - DNA, 25 bp, Rattus norvegicus
gagcaaagcctgttccgatgtttta

SEQ ID NO: 338642 - DNA, 25 bp, Rattus norvegicus
gagcaaagctctctagccacatggc

SEQ ID NO: 338643 - DNA, 25 bp, Rattus norvegicus
gagcaaagctctgtagccacatggc

SEQ ID NO: 338644 - DNA, 25 bp, Rattus norvegicus
gagcaaaggctacttgtaccgttgt

SEQ ID NO: 338645 - DNA, 25 bp, Rattus norvegicus
gagcaaaggctagttgtaccgttgt

SEQ ID NO: 338646 - DNA, 25 bp, Rattus norvegicus
gagcaaaggtcccactctggaggca

SEQ ID NO: 338647 - DNA, 25 bp, Rattus norvegicus
gagcaaaggtccgactctggaggca

SEQ ID NO: 338648 - DNA, 25 bp, Rattus norvegicus
gagcaaaggttcagcctagcaatgt

SEQ ID NO: 338649 - DNA, 25 bp, Rattus norvegicus
gagcaaaggttctgcctagcaatgt

SEQ ID NO: 338650 - DNA, 25 bp, Rattus norvegicus
gagcaaagtctcctagcgacagcaa

SEQ ID NO: 338651 - DNA, 25 bp, Rattus norvegicus
gagcaaagtctcgtagcgacagcaa

SEQ ID NO: 338652 - DNA, 25 bp, Rattus norvegicus
gagcaaagtttcctcaatgtccgaa

SEQ ID NO: 338653 - DNA, 25 bp, Rattus norvegicus
gagcaaagtttcgtcaatgtccgaa

SEQ ID NO: 338654 - DNA, 25 bp, Rattus norvegicus
gagcaaataaagagccggctttcct

SEQ ID NO: 338655 - DNA, 25 bp, Rattus norvegicus
gagcaaataaagtgccggctttcct

SEQ ID NO: 338656 - DNA, 25 bp, Rattus norvegicus
gagcaaataactcacctgtcagatt

SEQ ID NO: 338657 - DNA, 25 bp, Rattus norvegicus
gagcaaataactgacctgtcagatt

SEQ ID NO: 338658 - DNA, 25 bp, Rattus norvegicus
gagcaaatcagcaacctcttcaagt

SEQ ID NO: 338659 - DNA, 25 bp, Rattus norvegicus
gagcaaatcagctacctcttcaagt

SEQ ID NO: 338660 - DNA, 25 bp, Rattus norvegicus
gagcaaatgaaacaccagcccctat

SEQ ID NO: 338661 - DNA, 25 bp, Rattus norvegicus
gagcaaatgaaagaccagcccctat

SEQ ID NO: 338662 - DNA, 25 bp, Rattus norvegicus
gagcaaatgccacaaccagaaaatg

SEQ ID NO: 338663 - DNA, 25 bp, Rattus norvegicus
gagcaaatgccagaaccagaaaatg

SEQ ID NO: 338664 - DNA, 25 bp, Rattus norvegicus
gagcaaatgcttaccagtgacccat

SEQ ID NO: 338665 - DNA, 25 bp, Rattus norvegicus
gagcaaatgctttccagtgacccat

SEQ ID NO: 338666 - DNA, 25 bp, Rattus norvegicus
gagcaaattcacacctttgagaggc

SEQ ID NO: 338667 - DNA, 25 bp, Rattus norvegicus
gagcaaattcactcctttgagaggc

SEQ ID NO: 338668 - DNA, 25 bp, Rattus norvegicus
gagcaaattcgaatctcttgacttt

SEQ ID NO: 338669 - DNA, 25 bp, Rattus norvegicus
gagcaaattcgattctcttgacttt

SEQ ID NO: 338670 - DNA, 25 bp, Rattus norvegicus
gagcaaatttaaacccaatcagagg

SEQ ID NO: 338671 - DNA, 25 bp, Rattus norvegicus
gagcaaatttaatcccaatcagagg

SEQ ID NO: 338672 - DNA, 25 bp, Rattus norvegicus
gagcaacaagttcaccattggcaaa

SEQ ID NO: 338673 - DNA, 25 bp, Rattus norvegicus
gagcaacaagttgaccattggcaaa

SEQ ID NO: 338674 - DNA, 25 bp, Rattus norvegicus
gagcaacaatgacctgtttctggca

SEQ ID NO: 338675 - DNA, 25 bp, Rattus norvegicus
gagcaacaatgagctgtttctggca

SEQ ID NO: 338676 - DNA, 25 bp, Rattus norvegicus
gagcaacacagaagaccttacctag

SEQ ID NO: 338677 - DNA, 25 bp, Rattus norvegicus
gagcaacacagaattatttccgttc

SEQ ID NO: 338678 - DNA, 25 bp, Rattus norvegicus
gagcaacacagatgaccttacctag

SEQ ID NO: 338679 - DNA, 25 bp, Rattus norvegicus
gagcaacacagatttatttccgttc

SEQ ID NO: 338680 - DNA, 25 bp, Rattus norvegicus
gagcaacacattagccctgaggctt

SEQ ID NO: 338681 - DNA, 25 bp, Rattus norvegicus
gagcaacacatttgccctgaggctt

SEQ ID NO: 338682 - DNA, 25 bp, Rattus norvegicus
gagcaacaccacagcaatcgcagag

SEQ ID NO: 338683 - DNA, 25 bp, Rattus norvegicus
gagcaacaccactgcaatcgcagag

SEQ ID NO: 338684 - DNA, 25 bp, Rattus norvegicus
gagcaacaccatcttgctttggcag

SEQ ID NO: 338685 - DNA, 25 bp, Rattus norvegicus
gagcaacaccatgttgctttggcag

SEQ ID NO: 338686 - DNA, 25 bp, Rattus norvegicus
gagcaacacttaccacatggacaaa

SEQ ID NO: 338687 - DNA, 25 bp, Rattus norvegicus
gagcaacacttagcacatggacaaa

SEQ ID NO: 338688 - DNA, 25 bp, Rattus norvegicus
gagcaacactttctctcagcaacag

SEQ ID NO: 338689 - DNA, 25 bp, Rattus norvegicus
gagcaacactttgtctcagcaacag

SEQ ID NO: 338690 - DNA, 25 bp, Rattus norvegicus
gagcaacagccaatctctggtttca

SEQ ID NO: 338691 - DNA, 25 bp, Rattus norvegicus
gagcaacagccattctctggtttca

SEQ ID NO: 338692 - DNA, 25 bp, Rattus norvegicus
gagcaacagcgaaggagtctattac

SEQ ID NO: 338693 - DNA, 25 bp, Rattus norvegicus
gagcaacagcgatggagtctattac

SEQ ID NO: 338694 - DNA, 25 bp, Rattus norvegicus
gagcaacaggaactccgtcccagag

SEQ ID NO: 338695 - DNA, 25 bp, Rattus norvegicus
gagcaacaggaagtccgtcccagag

SEQ ID NO: 338696 - DNA, 25 bp, Rattus norvegicus
gagcaacatcaaccgcaagcacaag

SEQ ID NO: 338697 - DNA, 25 bp, Rattus norvegicus
gagcaacatcaagcgcaagcacaag

SEQ ID NO: 338698 - DNA, 25 bp, Rattus norvegicus
gagcaacatctgaatgagctaatga

SEQ ID NO: 338699 - DNA, 25 bp, Rattus norvegicus
gagcaacatctgtatgagctaatga

SEQ ID NO: 338700 - DNA, 25 bp, Rattus norvegicus
gagcaacatgaaaccgagtgacaga

SEQ ID NO: 338701 - DNA, 25 bp, Rattus norvegicus
gagcaacatgaatccgagtgacaga

SEQ ID NO: 338702 - DNA, 25 bp, Rattus norvegicus
gagcaaccactgagcaaccatgcat

SEQ ID NO: 338703 - DNA, 25 bp, Rattus norvegicus
gagcaaccactgtgcaaccatgcat

SEQ ID NO: 338704 - DNA, 25 bp, Rattus norvegicus
gagcaaccagccaggacagtgaaga

SEQ ID NO: 338705 - DNA, 25 bp, Rattus norvegicus
gagcaaccagcctggacagtgaaga

SEQ ID NO: 338706 - DNA, 25 bp, Rattus norvegicus
gagcaaccagtcaagcaaaatgagt

SEQ ID NO: 338707 - DNA, 25 bp, Rattus norvegicus
gagcaaccagtctagcaaaatgagt

SEQ ID NO: 338708 - DNA, 25 bp, Rattus norvegicus
gagcaaccagttagggtgccatttt

SEQ ID NO: 338709 - DNA, 25 bp, Rattus norvegicus
gagcaaccagtttgggtgccatttt

SEQ ID NO: 338710 - DNA, 25 bp, Rattus norvegicus
gagcaaccatgtatctgattactac

SEQ ID NO: 338711 - DNA, 25 bp, Rattus norvegicus
gagcaaccatgtttctgattactac

SEQ ID NO: 338712 - DNA, 25 bp, Rattus norvegicus
gagcaaccccacctaggactcaagg

SEQ ID NO: 338713 - DNA, 25 bp, Rattus norvegicus
gagcaaccccacgtaggactcaagg

SEQ ID NO: 338714 - DNA, 25 bp, Rattus norvegicus
gagcaaccccatccgcatggatcaa

SEQ ID NO: 338715 - DNA, 25 bp, Rattus norvegicus
gagcaaccccatgcgcatggatcaa

SEQ ID NO: 338716 - DNA, 25 bp, Rattus norvegicus
gagcaaccctgcattaactatggag

SEQ ID NO: 338717 - DNA, 25 bp, Rattus norvegicus
gagcaaccctgctttaactatggag

SEQ ID NO: 338718 - DNA, 25 bp, Rattus norvegicus
gagcaaccctttcctttagacaaag

SEQ ID NO: 338719 - DNA, 25 bp, Rattus norvegicus
gagcaaccctttgctttagacaaag

SEQ ID NO: 338720 - DNA, 25 bp, Rattus norvegicus
gagcaaccggctattatcaaaacaa

SEQ ID NO: 338721 - DNA, 25 bp, Rattus norvegicus
gagcaaccggcttttatcaaaacaa

SEQ ID NO: 338722 - DNA, 25 bp, Rattus norvegicus
gagcaacctactcaaggatttattt

SEQ ID NO: 338723 - DNA, 25 bp, Rattus norvegicus
gagcaacctactgaaggatttattt

SEQ ID NO: 338724 - DNA, 25 bp, Rattus norvegicus
gagcaacctctcctcgcgaagactg

SEQ ID NO: 338725 - DNA, 25 bp, Rattus norvegicus
gagcaacctctcgtcgcgaagactg

SEQ ID NO: 338726 - DNA, 25 bp, Rattus norvegicus
gagcaacctgagctattccctgcta

SEQ ID NO: 338727 - DNA, 25 bp, Rattus norvegicus
gagcaacctgaggtattccctgcta

SEQ ID NO: 338728 - DNA, 25 bp, Rattus norvegicus
gagcaacctgcaagtgcgaggccat

SEQ ID NO: 338729 - DNA, 25 bp, Rattus norvegicus
gagcaacctgcatgtgcgaggccat

SEQ ID NO: 338730 - DNA, 25 bp, Rattus norvegicus
gagcaacctggtaagggcctacgtc

SEQ ID NO: 338731 - DNA, 25 bp, Rattus norvegicus
gagcaacctggttagggcctacgtc

SEQ ID NO: 338732 - DNA, 25 bp, Rattus norvegicus
gagcaacctgttccatattcgcagg

SEQ ID NO: 338733 - DNA, 25 bp, Rattus norvegicus
gagcaacctgttgcatattcgcagg

SEQ ID NO: 338734 - DNA, 25 bp, Rattus norvegicus
gagcaacgactgactttgaccgaag

SEQ ID NO: 338735 - DNA, 25 bp, Rattus norvegicus
gagcaacgactgtctttgaccgaag

SEQ ID NO: 338736 - DNA, 25 bp, Rattus norvegicus
gagcaacgcgggacctaaagctact

SEQ ID NO: 338737 - DNA, 25 bp, Rattus norvegicus
gagcaacgcgggtcctaaagctact

SEQ ID NO: 338738 - DNA, 25 bp, Rattus norvegicus
gagcaacgcttcagatatacatgac

SEQ ID NO: 338739 - DNA, 25 bp, Rattus norvegicus
gagcaacgcttctgatatacatgac

SEQ ID NO: 338740 - DNA, 25 bp, Rattus norvegicus
gagcaactaaccaccatgtttaact

SEQ ID NO: 338741 - DNA, 25 bp, Rattus norvegicus
gagcaactaacctccatgtttaact

SEQ ID NO: 338742 - DNA, 25 bp, Rattus norvegicus
gagcaactccttcgaaaacctcgtt

SEQ ID NO: 338743 - DNA, 25 bp, Rattus norvegicus
gagcaactccttggaaaacctcgtt

SEQ ID NO: 338744 - DNA, 25 bp, Rattus norvegicus
gagcaactcggccaaggcgtcgtcc

SEQ ID NO: 338745 - DNA, 25 bp, Rattus norvegicus
gagcaactcggcgaaggcgtcgtcc

SEQ ID NO: 338746 - DNA, 25 bp, Rattus norvegicus
gagcaactctgaaatccctgagcca

SEQ ID NO: 338747 - DNA, 25 bp, Rattus norvegicus
gagcaactctgatatccctgagcca

SEQ ID NO: 338748 - DNA, 25 bp, Rattus norvegicus
gagcaactctgtatcaaggcactgg

SEQ ID NO: 338749 - DNA, 25 bp, Rattus norvegicus
gagcaactctgtttcaaggcactgg

SEQ ID NO: 338750 - DNA, 25 bp, Rattus norvegicus
gagcaactgatacctcttggattga

SEQ ID NO: 338751 - DNA, 25 bp, Rattus norvegicus
gagcaactgatagctcttggattga

SEQ ID NO: 338752 - DNA, 25 bp, Rattus norvegicus
gagcaactgctgagtgatcctgtaa

SEQ ID NO: 338753 - DNA, 25 bp, Rattus norvegicus
gagcaactgctgtgtgatcctgtaa

SEQ ID NO: 338754 - DNA, 25 bp, Rattus norvegicus
gagcaactggaacagtatgcacagt

SEQ ID NO: 338755 - DNA, 25 bp, Rattus norvegicus
gagcaactggaagagtatgcacagt

SEQ ID NO: 338756 - DNA, 25 bp, Rattus norvegicus
gagcaactgtggcttccctagggac

SEQ ID NO: 338757 - DNA, 25 bp, Rattus norvegicus
gagcaactgtgggttccctagggac

SEQ ID NO: 338758 - DNA, 25 bp, Rattus norvegicus
gagcaactgtgtcagcagaccacat

SEQ ID NO: 338759 - DNA, 25 bp, Rattus norvegicus
gagcaactgtgtgagcagaccacat

SEQ ID NO: 338760 - DNA, 25 bp, Rattus norvegicus
gagcaacttacacagcacaacggaa

SEQ ID NO: 338761 - DNA, 25 bp, Rattus norvegicus
gagcaacttacagagcacaacggaa

SEQ ID NO: 338762 - DNA, 25 bp, Rattus norvegicus
gagcaacttaggattacctcaattt

SEQ ID NO: 338763 - DNA, 25 bp, Rattus norvegicus
gagcaacttaggtttacctcaattt

SEQ ID NO: 338764 - DNA, 25 bp, Rattus norvegicus
gagcaacttctgaactgaaccgagc

SEQ ID NO: 338765 - DNA, 25 bp, Rattus norvegicus
gagcaacttctgtactgaaccgagc

SEQ ID NO: 338766 - DNA, 25 bp, Rattus norvegicus
gagcaacttgatcgttggaactgta

SEQ ID NO: 338767 - DNA, 25 bp, Rattus norvegicus
gagcaacttgatggttggaactgta

SEQ ID NO: 338768 - DNA, 25 bp, Rattus norvegicus
gagcaacttggacttgtcatccact

SEQ ID NO: 338769 - DNA, 25 bp, Rattus norvegicus
gagcaacttggagttgtcatccact

SEQ ID NO: 338770 - DNA, 25 bp, Rattus norvegicus
gagcaacttgggattgacttctttg

SEQ ID NO: 338771 - DNA, 25 bp, Rattus norvegicus
gagcaacttgggtttgacttctttg

SEQ ID NO: 338772 - DNA, 25 bp, Rattus norvegicus
gagcaactttaaacacttgggtggg

SEQ ID NO: 338773 - DNA, 25 bp, Rattus norvegicus
gagcaactttaatcacttgggtggg

SEQ ID NO: 338774 - DNA, 25 bp, Rattus norvegicus
gagcaactttagcagaaagcccagc

SEQ ID NO: 338775 - DNA, 25 bp, Rattus norvegicus
gagcaactttaggagaaagcccagc

SEQ ID NO: 338776 - DNA, 25 bp, Rattus norvegicus
gagcaactttcaaccagaggcatgg

SEQ ID NO: 338777 - DNA, 25 bp, Rattus norvegicus
gagcaactttcatccagaggcatgg

SEQ ID NO: 338778 - DNA, 25 bp, Rattus norvegicus
gagcaactttgactaattccgtgat

SEQ ID NO: 338779 - DNA, 25 bp, Rattus norvegicus
gagcaactttgagtaattccgtgat

SEQ ID NO: 338780 - DNA, 25 bp, Rattus norvegicus
gagcaacttttcaccgtgcaagcga

SEQ ID NO: 338781 - DNA, 25 bp, Rattus norvegicus
gagcaacttttctccgtgcaagcga

SEQ ID NO: 338782 - DNA, 25 bp, Rattus norvegicus
gagcaagaaataccccttccagatt

SEQ ID NO: 338783 - DNA, 25 bp, Rattus norvegicus
gagcaagaaatagcccttccagatt

SEQ ID NO: 338784 - DNA, 25 bp, Rattus norvegicus
gagcaagaagctatttacccaaagt

SEQ ID NO: 338785 - DNA, 25 bp, Rattus norvegicus
gagcaagaagctttttacccaaagt

SEQ ID NO: 338786 - DNA, 25 bp, Rattus norvegicus
gagcaagacattacccttcattttg

SEQ ID NO: 338787 - DNA, 25 bp, Rattus norvegicus
gagcaagacatttcccttcattttg

SEQ ID NO: 338788 - DNA, 25 bp, Rattus norvegicus
gagcaagacgtaaccgttgttcaaa

SEQ ID NO: 338789 - DNA, 25 bp, Rattus norvegicus
gagcaagacgtatccgttgttcaaa

SEQ ID NO: 338790 - DNA, 25 bp, Rattus norvegicus
gagcaagagagacagtaaaagcact

SEQ ID NO: 338791 - DNA, 25 bp, Rattus norvegicus
gagcaagagagagagtaaaagcact

SEQ ID NO: 338792 - DNA, 25 bp, Rattus norvegicus
gagcaagagcatactcatagatatt

SEQ ID NO: 338793 - DNA, 25 bp, Rattus norvegicus
gagcaagagcatctctagctaccct

SEQ ID NO: 338794 - DNA, 25 bp, Rattus norvegicus
gagcaagagcatgtctagctaccct

SEQ ID NO: 338795 - DNA, 25 bp, Rattus norvegicus
gagcaagagcattctcatagatatt

SEQ ID NO: 338796 - DNA, 25 bp, Rattus norvegicus
gagcaagagctaccctatctggaga

SEQ ID NO: 338797 - DNA, 25 bp, Rattus norvegicus
gagcaagagctagcctatctggaga

SEQ ID NO: 338798 - DNA, 25 bp, Rattus norvegicus
gagcaagagttacgctcctgctgcc

SEQ ID NO: 338799 - DNA, 25 bp, Rattus norvegicus
gagcaagagttaggctcctgctgcc

SEQ ID NO: 338800 - DNA, 25 bp, Rattus norvegicus
gagcaagatcatagccctttagttc

SEQ ID NO: 338801 - DNA, 25 bp, Rattus norvegicus
gagcaagatcattgccctttagttc

SEQ ID NO: 338802 - DNA, 25 bp, Rattus norvegicus
gagcaagatgacacagctgccatgc

SEQ ID NO: 338803 - DNA, 25 bp, Rattus norvegicus
gagcaagatgactcagctgccatgc

SEQ ID NO: 338804 - DNA, 25 bp, Rattus norvegicus
gagcaagatggtctctgcccaggcc

SEQ ID NO: 338805 - DNA, 25 bp, Rattus norvegicus
gagcaagatggtgtctgcccaggcc

SEQ ID NO: 338806 - DNA, 25 bp, Rattus norvegicus
gagcaagcaaacagtgctgcatttg

SEQ ID NO: 338807 - DNA, 25 bp, Rattus norvegicus
gagcaagcaaactgtgctgcatttg

SEQ ID NO: 338808 - DNA, 25 bp, Rattus norvegicus
gagcaagcaagactcctgcctagcg

SEQ ID NO: 338809 - DNA, 25 bp, Rattus norvegicus
gagcaagcaagagtcctgcctagcg

SEQ ID NO: 338810 - DNA, 25 bp, Rattus norvegicus
gagcaagcaccccaagtttgaggag

SEQ ID NO: 338811 - DNA, 25 bp, Rattus norvegicus
gagcaagcacccgaagtttgaggag

SEQ ID NO: 338812 - DNA, 25 bp, Rattus norvegicus
gagcaagcacctcgttttcactttt

SEQ ID NO: 338813 - DNA, 25 bp, Rattus norvegicus
gagcaagcacctggttttcactttt

SEQ ID NO: 338814 - DNA, 25 bp, Rattus norvegicus
gagcaagcacgtaactgccagagca

SEQ ID NO: 338815 - DNA, 25 bp, Rattus norvegicus
gagcaagcacgttactgccagagca

SEQ ID NO: 338816 - DNA, 25 bp, Rattus norvegicus
gagcaagcactgaactttgtcgatt

SEQ ID NO: 338817 - DNA, 25 bp, Rattus norvegicus
gagcaagcactgtactttgtcgatt

SEQ ID NO: 338818 - DNA, 25 bp, Rattus norvegicus
gagcaagcatctaagaggacctggc

SEQ ID NO: 338819 - DNA, 25 bp, Rattus norvegicus
gagcaagcatcttagaggacctggc

SEQ ID NO: 338820 - DNA, 25 bp, Rattus norvegicus
gagcaagccaatacgcagtgttcct

SEQ ID NO: 338821 - DNA, 25 bp, Rattus norvegicus
gagcaagccaattcgcagtgttcct

SEQ ID NO: 338822 - DNA, 25 bp, Rattus norvegicus
gagcaagccagaagtccagcaccaa

SEQ ID NO: 338823 - DNA, 25 bp, Rattus norvegicus
gagcaagccagatgtccagcaccaa

SEQ ID NO: 338824 - DNA, 25 bp, Rattus norvegicus
gagcaagcccaacagttccaactgg

SEQ ID NO: 338825 - DNA, 25 bp, Rattus norvegicus
gagcaagcccaagagttccaactgg

SEQ ID NO: 338826 - DNA, 25 bp, Rattus norvegicus
gagcaagcccagaacatgcacgtgg

SEQ ID NO: 338827 - DNA, 25 bp, Rattus norvegicus
gagcaagcccagctgtgctggaatt

SEQ ID NO: 338828 - DNA, 25 bp, Rattus norvegicus
gagcaagcccagcttgaccttgtga

SEQ ID NO: 338829 - DNA, 25 bp, Rattus norvegicus
gagcaagcccaggtgtgctggaatt

SEQ ID NO: 338830 - DNA, 25 bp, Rattus norvegicus
gagcaagcccaggttgaccttgtga

SEQ ID NO: 338831 - DNA, 25 bp, Rattus norvegicus
gagcaagcccagtacatgcacgtgg

SEQ ID NO: 338832 - DNA, 25 bp, Rattus norvegicus
gagcaagcctgaagcagcagtgcgt

SEQ ID NO: 338833 - DNA, 25 bp, Rattus norvegicus
gagcaagcctgatgcagcagtgcgt

SEQ ID NO: 338834 - DNA, 25 bp, Rattus norvegicus
gagcaagccttgcttgggcaccagc

SEQ ID NO: 338835 - DNA, 25 bp, Rattus norvegicus
gagcaagccttggttgggcaccagc

SEQ ID NO: 338836 - DNA, 25 bp, Rattus norvegicus
gagcaagcgcagcaggtcacacaaa

SEQ ID NO: 338837 - DNA, 25 bp, Rattus norvegicus
gagcaagcgcaggaggtcacacaaa

SEQ ID NO: 338838 - DNA, 25 bp, Rattus norvegicus
gagcaagcgctgcatttccaataaa

SEQ ID NO: 338839 - DNA, 25 bp, Rattus norvegicus
gagcaagcgctggatttccaataaa

SEQ ID NO: 338840 - DNA, 25 bp, Rattus norvegicus
gagcaagcggcgcaaatacgtcttc

SEQ ID NO: 338841 - DNA, 25 bp, Rattus norvegicus
gagcaagcggcggaaatacgtcttc

SEQ ID NO: 338842 - DNA, 25 bp, Rattus norvegicus
gagcaagctattactactacacatt

SEQ ID NO: 338843 - DNA, 25 bp, Rattus norvegicus
gagcaagctatttctactacacatt

SEQ ID NO: 338844 - DNA, 25 bp, Rattus norvegicus
gagcaagctcacaaggatgttttca

SEQ ID NO: 338845 - DNA, 25 bp, Rattus norvegicus
gagcaagctcactaggatgttttca

SEQ ID NO: 338846 - DNA, 25 bp, Rattus norvegicus
gagcaagctgatctcatctaatagt

SEQ ID NO: 338847 - DNA, 25 bp, Rattus norvegicus
gagcaagctgatgtcatctaatagt

SEQ ID NO: 338848 - DNA, 25 bp, Rattus norvegicus
gagcaagctggaaagcggacagaca

SEQ ID NO: 338849 - DNA, 25 bp, Rattus norvegicus
gagcaagctggatagcggacagaca

SEQ ID NO: 338850 - DNA, 25 bp, Rattus norvegicus
gagcaagctgggattaagaggcaat

SEQ ID NO: 338851 - DNA, 25 bp, Rattus norvegicus
gagcaagctgggtttaagaggcaat

SEQ ID NO: 338852 - DNA, 25 bp, Rattus norvegicus
gagcaagctgtcaccattctaaagc

SEQ ID NO: 338853 - DNA, 25 bp, Rattus norvegicus
gagcaagctgtctccattctaaagc

SEQ ID NO: 338854 - DNA, 25 bp, Rattus norvegicus
gagcaagctgttcaactactgtaag

SEQ ID NO: 338855 - DNA, 25 bp, Rattus norvegicus
gagcaagctgttgaactactgtaag

SEQ ID NO: 338856 - DNA, 25 bp, Rattus norvegicus
gagcaagcttctaacagccagcatc

SEQ ID NO: 338857 - DNA, 25 bp, Rattus norvegicus
gagcaagcttcttacagccagcatc

SEQ ID NO: 338858 - DNA, 25 bp, Rattus norvegicus
gagcaagcttggaagcagcattttt

SEQ ID NO: 338859 - DNA, 25 bp, Rattus norvegicus
gagcaagcttggtagcagcattttt

SEQ ID NO: 338860 - DNA, 25 bp, Rattus norvegicus
gagcaaggacaaagcccacatctca

SEQ ID NO: 338861 - DNA, 25 bp, Rattus norvegicus
gagcaaggacaatgcccacatctca

SEQ ID NO: 338862 - DNA, 25 bp, Rattus norvegicus
gagcaaggacttactcagcactggc

SEQ ID NO: 338863 - DNA, 25 bp, Rattus norvegicus
gagcaaggactttctcagcactggc

SEQ ID NO: 338864 - DNA, 25 bp, Rattus norvegicus
gagcaaggagcacctaagtccccag

SEQ ID NO: 338865 - DNA, 25 bp, Rattus norvegicus
gagcaaggagcagctaagtccccag

SEQ ID NO: 338866 - DNA, 25 bp, Rattus norvegicus
gagcaaggatccaccagggcttcac

SEQ ID NO: 338867 - DNA, 25 bp, Rattus norvegicus
gagcaaggatcctccagggcttcac

SEQ ID NO: 338868 - DNA, 25 bp, Rattus norvegicus
gagcaaggcaacacagcaggagctg

SEQ ID NO: 338869 - DNA, 25 bp, Rattus norvegicus
gagcaaggcaactcagcaggagctg

SEQ ID NO: 338870 - DNA, 25 bp, Rattus norvegicus
gagcaaggcccactttctgaggatc

SEQ ID NO: 338871 - DNA, 25 bp, Rattus norvegicus
gagcaaggcccagtttctgaggatc

SEQ ID NO: 338872 - DNA, 25 bp, Rattus norvegicus
gagcaagggactcttgagaccaaga

SEQ ID NO: 338873 - DNA, 25 bp, Rattus norvegicus
gagcaagggactgttgagaccaaga

SEQ ID NO: 338874 - DNA, 25 bp, Rattus norvegicus
gagcaagggcagaaccaggcagcat

SEQ ID NO: 338875 - DNA, 25 bp, Rattus norvegicus
gagcaagggcagtaccaggcagcat

SEQ ID NO: 338876 - DNA, 25 bp, Rattus norvegicus
gagcaagggcatcaggataaagact

SEQ ID NO: 338877 - DNA, 25 bp, Rattus norvegicus
gagcaagggcatgaggataaagact

SEQ ID NO: 338878 - DNA, 25 bp, Rattus norvegicus
gagcaagggtacagtggtcatcatt

SEQ ID NO: 338879 - DNA, 25 bp, Rattus norvegicus
gagcaagggtactgtggtcatcatt

SEQ ID NO: 338880 - DNA, 25 bp, Rattus norvegicus
gagcaagggtcactggcttgtcaca

SEQ ID NO: 338881 - DNA, 25 bp, Rattus norvegicus
gagcaagggtcagtggcttgtcaca

SEQ ID NO: 338882 - DNA, 25 bp, Rattus norvegicus
gagcaagtaaagatcgctgtaacag

SEQ ID NO: 338883 - DNA, 25 bp, Rattus norvegicus
gagcaagtaaagttcgctgtaacag

SEQ ID NO: 338884 - DNA, 25 bp, Rattus norvegicus
gagcaagtatttcacctgccagtgt

SEQ ID NO: 338885 - DNA, 25 bp, Rattus norvegicus
gagcaagtatttgacctgccagtgt

SEQ ID NO: 338886 - DNA, 25 bp, Rattus norvegicus
gagcaagtccagcatactatttccc

SEQ ID NO: 338887 - DNA, 25 bp, Rattus norvegicus
gagcaagtccaggatactatttccc

SEQ ID NO: 338888 - DNA, 25 bp, Rattus norvegicus
gagcaagtccccattgtggacatca

SEQ ID NO: 338889 - DNA, 25 bp, Rattus norvegicus
gagcaagtcccctttgtggacatca

SEQ ID NO: 338890 - DNA, 25 bp, Rattus norvegicus
gagcaagtctcccattgattcctgg

SEQ ID NO: 338891 - DNA, 25 bp, Rattus norvegicus
gagcaagtctccgattgattcctgg

SEQ ID NO: 338892 - DNA, 25 bp, Rattus norvegicus
gagcaagtctgccaccaacttaggt

SEQ ID NO: 338893 - DNA, 25 bp, Rattus norvegicus
gagcaagtctgcgaccaacttaggt

SEQ ID NO: 338894 - DNA, 25 bp, Rattus norvegicus
gagcaagtcttgagtctacagaaca

SEQ ID NO: 338895 - DNA, 25 bp, Rattus norvegicus
gagcaagtcttgtgtctacagaaca

SEQ ID NO: 338896 - DNA, 25 bp, Rattus norvegicus
gagcaagtgaggacttcagcactca

SEQ ID NO: 338897 - DNA, 25 bp, Rattus norvegicus
gagcaagtgaggtcttcagcactca

SEQ ID NO: 338898 - DNA, 25 bp, Rattus norvegicus
gagcaagtgagtctttccaaagcgc

SEQ ID NO: 338899 - DNA, 25 bp, Rattus norvegicus
gagcaagtgagtgtttccaaagcgc

SEQ ID NO: 338900 - DNA, 25 bp, Rattus norvegicus
gagcaagtggccagggctctcaaat

SEQ ID NO: 338901 - DNA, 25 bp, Rattus norvegicus
gagcaagtggcctgggctctcaaat

SEQ ID NO: 338902 - DNA, 25 bp, Rattus norvegicus
gagcaagtgggccatcggttcctac

SEQ ID NO: 338903 - DNA, 25 bp, Rattus norvegicus
gagcaagtgggcgatcggttcctac

SEQ ID NO: 338904 - DNA, 25 bp, Rattus norvegicus
gagcaagtgtaacttttttctgaaa

SEQ ID NO: 338905 - DNA, 25 bp, Rattus norvegicus
gagcaagtgtaagttttttctgaaa

SEQ ID NO: 338906 - DNA, 25 bp, Rattus norvegicus
gagcaagtgttaccaaagttctgtt

SEQ ID NO: 338907 - DNA, 25 bp, Rattus norvegicus
gagcaagtgttagcaaagttctgtt

SEQ ID NO: 338908 - DNA, 25 bp, Rattus norvegicus
gagcaagttacaagagactgcatgt

SEQ ID NO: 338909 - DNA, 25 bp, Rattus norvegicus
gagcaagttacatgagactgcatgt

SEQ ID NO: 338910 - DNA, 25 bp, Rattus norvegicus
gagcaagttattcggtattaccgtc

SEQ ID NO: 338911 - DNA, 25 bp, Rattus norvegicus
gagcaagttattgggtattaccgtc

SEQ ID NO: 338912 - DNA, 25 bp, Rattus norvegicus
gagcaagttcatctccagcatcagg

SEQ ID NO: 338913 - DNA, 25 bp, Rattus norvegicus
gagcaagttcatgtccagcatcagg

SEQ ID NO: 338914 - DNA, 25 bp, Rattus norvegicus
gagcaagttcctacaatcatcttta

SEQ ID NO: 338915 - DNA, 25 bp, Rattus norvegicus
gagcaagttccttcaatcatcttta

SEQ ID NO: 338916 - DNA, 25 bp, Rattus norvegicus
gagcaagttcttcgagcacttcata

SEQ ID NO: 338917 - DNA, 25 bp, Rattus norvegicus
gagcaagttcttggagcacttcata

SEQ ID NO: 338918 - DNA, 25 bp, Rattus norvegicus
gagcaagttgcgcttcagcactgtt

SEQ ID NO: 338919 - DNA, 25 bp, Rattus norvegicus
gagcaagttgcggttcagcactgtt

SEQ ID NO: 338920 - DNA, 25 bp, Rattus norvegicus
gagcaagttggtactttcacttctg

SEQ ID NO: 338921 - DNA, 25 bp, Rattus norvegicus
gagcaagttggttctttcacttctg

SEQ ID NO: 338922 - DNA, 25 bp, Rattus norvegicus
gagcaagtttctctccagcatgaac

SEQ ID NO: 338923 - DNA, 25 bp, Rattus norvegicus
gagcaagtttctgtccagcatgaac

SEQ ID NO: 338924 - DNA, 25 bp, Rattus norvegicus
gagcaatacattacagggtcccaac

SEQ ID NO: 338925 - DNA, 25 bp, Rattus norvegicus
gagcaatacatttcagggtcccaac

SEQ ID NO: 338926 - DNA, 25 bp, Rattus norvegicus
gagcaatagactatttccatcattt

SEQ ID NO: 338927 - DNA, 25 bp, Rattus norvegicus
gagcaatagactttttccatcattt

SEQ ID NO: 338928 - DNA, 25 bp, Rattus norvegicus
gagcaatagctcatccttatcagga

SEQ ID NO: 338929 - DNA, 25 bp, Rattus norvegicus
gagcaatagctcttccttatcagga

SEQ ID NO: 338930 - DNA, 25 bp, Rattus norvegicus
gagcaataggaccagccgtacacgt

SEQ ID NO: 338931 - DNA, 25 bp, Rattus norvegicus
gagcaataggacgagccgtacacgt

SEQ ID NO: 338932 - DNA, 25 bp, Rattus norvegicus
gagcaatagtcaatctctgcaatat

SEQ ID NO: 338933 - DNA, 25 bp, Rattus norvegicus
gagcaatagtcattctctgcaatat

SEQ ID NO: 338934 - DNA, 25 bp, Rattus norvegicus
gagcaatatccccataggctttgga

SEQ ID NO: 338935 - DNA, 25 bp, Rattus norvegicus
gagcaatatcccgataggctttgga

SEQ ID NO: 338936 - DNA, 25 bp, Rattus norvegicus
gagcaatatctcagctgaaataccg

SEQ ID NO: 338937 - DNA, 25 bp, Rattus norvegicus
gagcaatatctctgctgaaataccg

SEQ ID NO: 338938 - DNA, 25 bp, Rattus norvegicus
gagcaatcccagcagcgaaccaagg

SEQ ID NO: 338939 - DNA, 25 bp, Rattus norvegicus
gagcaatcccaggagcgaaccaagg

SEQ ID NO: 338940 - DNA, 25 bp, Rattus norvegicus
gagcaatctctcatatacaagtctt

SEQ ID NO: 338941 - DNA, 25 bp, Rattus norvegicus
gagcaatctctcttatacaagtctt

SEQ ID NO: 338942 - DNA, 25 bp, Rattus norvegicus
gagcaatgaataaaggcacacacca

SEQ ID NO: 338943 - DNA, 25 bp, Rattus norvegicus
gagcaatgaatataggcacacacca

SEQ ID NO: 338944 - DNA, 25 bp, Rattus norvegicus
gagcaatgagacctgcatgcagcca

SEQ ID NO: 338945 - DNA, 25 bp, Rattus norvegicus
gagcaatgagacgtgcatgcagcca

SEQ ID NO: 338946 - DNA, 25 bp, Rattus norvegicus
gagcaatgatcacaagctgcctgtg

SEQ ID NO: 338947 - DNA, 25 bp, Rattus norvegicus
gagcaatgatcagaagctgcctgtg

SEQ ID NO: 338948 - DNA, 25 bp, Rattus norvegicus
gagcaatgcctacttataccgcaag

SEQ ID NO: 338949 - DNA, 25 bp, Rattus norvegicus
gagcaatgcctagttataccgcaag

SEQ ID NO: 338950 - DNA, 25 bp, Rattus norvegicus
gagcaatgcttccagagcacaccaa

SEQ ID NO: 338951 - DNA, 25 bp, Rattus norvegicus
gagcaatgcttcgagagcacaccaa

SEQ ID NO: 338952 - DNA, 25 bp, Rattus norvegicus
gagcaatgcttgactgtttggcttt

SEQ ID NO: 338953 - DNA, 25 bp, Rattus norvegicus
gagcaatgcttgtctgtttggcttt

SEQ ID NO: 338954 - DNA, 25 bp, Rattus norvegicus
gagcaatggatcaccctttgagtct

SEQ ID NO: 338955 - DNA, 25 bp, Rattus norvegicus
gagcaatggatctccctttgagtct

SEQ ID NO: 338956 - DNA, 25 bp, Rattus norvegicus
gagcaatggctcctgtttggcagtc

SEQ ID NO: 338957 - DNA, 25 bp, Rattus norvegicus
gagcaatggctcgtgtttggcagtc

SEQ ID NO: 338958 - DNA, 25 bp, Rattus norvegicus
gagcaatggtttacatagcaagaat

SEQ ID NO: 338959 - DNA, 25 bp, Rattus norvegicus
gagcaatggttttcatagcaagaat

SEQ ID NO: 338960 - DNA, 25 bp, Rattus norvegicus
gagcaatgtgctatccaatgaaatg

SEQ ID NO: 338961 - DNA, 25 bp, Rattus norvegicus
gagcaatgtgctttccaatgaaatg

SEQ ID NO: 338962 - DNA, 25 bp, Rattus norvegicus
gagcaatgtggaagacttctggtga

SEQ ID NO: 338963 - DNA, 25 bp, Rattus norvegicus
gagcaatgtggatgacttctggtga

SEQ ID NO: 338964 - DNA, 25 bp, Rattus norvegicus
gagcaattcaccactatggcattta

SEQ ID NO: 338965 - DNA, 25 bp, Rattus norvegicus
gagcaattcacctctatggcattta

SEQ ID NO: 338966 - DNA, 25 bp, Rattus norvegicus
gagcaattcatcataattttccaac

SEQ ID NO: 338967 - DNA, 25 bp, Rattus norvegicus
gagcaattcatcttaattttccaac

SEQ ID NO: 338968 - DNA, 25 bp, Rattus norvegicus
gagcaattcggtagctctcgctctc

SEQ ID NO: 338969 - DNA, 25 bp, Rattus norvegicus
gagcaattcggttgctctcgctctc

SEQ ID NO: 338970 - DNA, 25 bp, Rattus norvegicus
gagcaattctatccatttatgagtt

SEQ ID NO: 338971 - DNA, 25 bp, Rattus norvegicus
gagcaattctatgcatttatgagtt

SEQ ID NO: 338972 - DNA, 25 bp, Rattus norvegicus
gagcaattctgaatttgttggcctt

SEQ ID NO: 338973 - DNA, 25 bp, Rattus norvegicus
gagcaattctgattttgttggcctt

SEQ ID NO: 338974 - DNA, 25 bp, Rattus norvegicus
gagcaattctgcatctactgaatct

SEQ ID NO: 338975 - DNA, 25 bp, Rattus norvegicus
gagcaattctgcttctactgaatct

SEQ ID NO: 338976 - DNA, 25 bp, Rattus norvegicus
gagcaattgcatcagtccaccagag

SEQ ID NO: 338977 - DNA, 25 bp, Rattus norvegicus
gagcaattgcatgagtccaccagag

SEQ ID NO: 338978 - DNA, 25 bp, Rattus norvegicus
gagcaattgcttaggccgtaatagg

SEQ ID NO: 338979 - DNA, 25 bp, Rattus norvegicus
gagcaattgctttggccgtaatagg

SEQ ID NO: 338980 - DNA, 25 bp, Rattus norvegicus
gagcaattggtgcaactcctcctgc

SEQ ID NO: 338981 - DNA, 25 bp, Rattus norvegicus
gagcaattggtggaactcctcctgc

SEQ ID NO: 338982 - DNA, 25 bp, Rattus norvegicus
gagcaattgtctccaacgtatcaga

SEQ ID NO: 338983 - DNA, 25 bp, Rattus norvegicus
gagcaattgtctgcaacgtatcaga

SEQ ID NO: 338984 - DNA, 25 bp, Rattus norvegicus
gagcaattgtttatcgtccgtttgg

SEQ ID NO: 338985 - DNA, 25 bp, Rattus norvegicus
gagcaattgtttttcgtccgtttgg

SEQ ID NO: 338986 - DNA, 25 bp, Rattus norvegicus
gagcaatttatacctctggatatat

SEQ ID NO: 338987 - DNA, 25 bp, Rattus norvegicus
gagcaatttatagctctggatatat

SEQ ID NO: 338988 - DNA, 25 bp, Rattus norvegicus
gagcaatttccgcatctcctttaga

SEQ ID NO: 338989 - DNA, 25 bp, Rattus norvegicus
gagcaatttccggatctcctttaga

SEQ ID NO: 338990 - DNA, 25 bp, Rattus norvegicus
gagcaatttctgatccagctttgaa

SEQ ID NO: 338991 - DNA, 25 bp, Rattus norvegicus
gagcaatttctgttccagctttgaa

SEQ ID NO: 338992 - DNA, 25 bp, Rattus norvegicus
gagcaatttgacctttagtgcccaa

SEQ ID NO: 338993 - DNA, 25 bp, Rattus norvegicus
gagcaatttgacgtttagtgcccaa

SEQ ID NO: 338994 - DNA, 25 bp, Rattus norvegicus
gagcacaaaaccaacactgtatctt

SEQ ID NO: 338995 - DNA, 25 bp, Rattus norvegicus
gagcacaaaacctacactgtatctt

SEQ ID NO: 338996 - DNA, 25 bp, Rattus norvegicus
gagcacaacaccagcgtcgtcaaga

SEQ ID NO: 338997 - DNA, 25 bp, Rattus norvegicus
gagcacaacacctgcgtcgtcaaga

SEQ ID NO: 338998 - DNA, 25 bp, Rattus norvegicus
gagcacaacagcatttcttgtctgc

SEQ ID NO: 338999 - DNA, 25 bp, Rattus norvegicus
gagcacaacagcttttcttgtctgc

SEQ ID NO: 339000 - DNA, 25 bp, Rattus norvegicus
gagcacaacgtacacagactttatt

SEQ ID NO: 339001 - DNA, 25 bp, Rattus norvegicus
gagcacaacgtagacagactttatt

SEQ ID NO: 339002 - DNA, 25 bp, Rattus norvegicus
gagcacaactatatcttaacaactg

SEQ ID NO: 339003 - DNA, 25 bp, Rattus norvegicus
gagcacaactatattcttatgaagg

SEQ ID NO: 339004 - DNA, 25 bp, Rattus norvegicus
gagcacaactatttcttaacaactg

SEQ ID NO: 339005 - DNA, 25 bp, Rattus norvegicus
gagcacaactattttcttatgaagg

SEQ ID NO: 339006 - DNA, 25 bp, Rattus norvegicus
gagcacaatctaacatggcacctga

SEQ ID NO: 339007 - DNA, 25 bp, Rattus norvegicus
gagcacaatctatcatggcacctga

SEQ ID NO: 339008 - DNA, 25 bp, Rattus norvegicus
gagcacaatgaactttgcaacccat

SEQ ID NO: 339009 - DNA, 25 bp, Rattus norvegicus
gagcacaatgaagtttgcaacccat

SEQ ID NO: 339010 - DNA, 25 bp, Rattus norvegicus
gagcacaatgcccacaataaattcc

SEQ ID NO: 339011 - DNA, 25 bp, Rattus norvegicus
gagcacaatgccgacaataaattcc

SEQ ID NO: 339012 - DNA, 25 bp, Rattus norvegicus
gagcacaatgctaattaaggcccaa

SEQ ID NO: 339013 - DNA, 25 bp, Rattus norvegicus
gagcacaatgcttattaaggcccaa

SEQ ID NO: 339014 - DNA, 25 bp, Rattus norvegicus
gagcacaatgtgacgccaagaacga

SEQ ID NO: 339015 - DNA, 25 bp, Rattus norvegicus
gagcacaatgtgtcgccaagaacga

SEQ ID NO: 339016 - DNA, 25 bp, Rattus norvegicus
gagcacaattacagtttcctatgag

SEQ ID NO: 339017 - DNA, 25 bp, Rattus norvegicus
gagcacaattactgtttcctatgag

SEQ ID NO: 339018 - DNA, 25 bp, Rattus norvegicus
gagcacaattgaagacccctgtaat

SEQ ID NO: 339019 - DNA, 25 bp, Rattus norvegicus
gagcacaattgatgacccctgtaat

SEQ ID NO: 339020 - DNA, 25 bp, Rattus norvegicus
gagcacacagaaaattgccacatgg

SEQ ID NO: 339021 - DNA, 25 bp, Rattus norvegicus
gagcacacagaatattgccacatgg

SEQ ID NO: 339022 - DNA, 25 bp, Rattus norvegicus
gagcacacaggtaagttcaaaccat

SEQ ID NO: 339023 - DNA, 25 bp, Rattus norvegicus
gagcacacaggttagttcaaaccat

SEQ ID NO: 339024 - DNA, 25 bp, Rattus norvegicus
gagcacacagtgactacgtacatct

SEQ ID NO: 339025 - DNA, 25 bp, Rattus norvegicus
gagcacacagtgtctacgtacatct

SEQ ID NO: 339026 - DNA, 25 bp, Rattus norvegicus
gagcacaccaatcactcaggactga

SEQ ID NO: 339027 - DNA, 25 bp, Rattus norvegicus
gagcacaccaatgactcaggactga

SEQ ID NO: 339028 - DNA, 25 bp, Rattus norvegicus
gagcacaccagtaagcagtgttcct

SEQ ID NO: 339029 - DNA, 25 bp, Rattus norvegicus
gagcacaccagttagcagtgttcct

SEQ ID NO: 339030 - DNA, 25 bp, Rattus norvegicus
gagcacacctaaagccctgaggatg

SEQ ID NO: 339031 - DNA, 25 bp, Rattus norvegicus
gagcacacctaatgccctgaggatg

SEQ ID NO: 339032 - DNA, 25 bp, Rattus norvegicus
gagcacacctggcaatgcacatcca

SEQ ID NO: 339033 - DNA, 25 bp, Rattus norvegicus
gagcacacctgggaatgcacatcca

SEQ ID NO: 339034 - DNA, 25 bp, Rattus norvegicus
gagcacactcagagcatatgtgaaa

SEQ ID NO: 339035 - DNA, 25 bp, Rattus norvegicus
gagcacactcagtgcatatgtgaaa

SEQ ID NO: 339036 - DNA, 25 bp, Rattus norvegicus
gagcacactgaacaccttgacaaga

SEQ ID NO: 339037 - DNA, 25 bp, Rattus norvegicus
gagcacactgaagaccttgacaaga

SEQ ID NO: 339038 - DNA, 25 bp, Rattus norvegicus
gagcacacttggctgacttattttt

SEQ ID NO: 339039 - DNA, 25 bp, Rattus norvegicus
gagcacacttgggtgacttattttt

SEQ ID NO: 339040 - DNA, 25 bp, Rattus norvegicus
gagcacagaacacacattccactga

SEQ ID NO: 339041 - DNA, 25 bp, Rattus norvegicus
gagcacagaacagacattccactga

SEQ ID NO: 339042 - DNA, 25 bp, Rattus norvegicus
gagcacagacccagtttgatgttaa

SEQ ID NO: 339043 - DNA, 25 bp, Rattus norvegicus
gagcacagaccctgtttgatgttaa

SEQ ID NO: 339044 - DNA, 25 bp, Rattus norvegicus
gagcacagacctattagactcatct

SEQ ID NO: 339045 - DNA, 25 bp, Rattus norvegicus
gagcacagaccttttagactcatct

SEQ ID NO: 339046 - DNA, 25 bp, Rattus norvegicus
gagcacagatgcagggcactgacag

SEQ ID NO: 339047 - DNA, 25 bp, Rattus norvegicus
gagcacagatgctgggcactgacag

SEQ ID NO: 339048 - DNA, 25 bp, Rattus norvegicus
gagcacagcaacacttacagtcagt

SEQ ID NO: 339049 - DNA, 25 bp, Rattus norvegicus
gagcacagcaactcttacagtcagt

SEQ ID NO: 339050 - DNA, 25 bp, Rattus norvegicus
gagcacagccaaaaatttttcctgg

SEQ ID NO: 339051 - DNA, 25 bp, Rattus norvegicus
gagcacagccaataatttttcctgg

SEQ ID NO: 339052 - DNA, 25 bp, Rattus norvegicus
gagcacagccgcaggagcccgaaga

SEQ ID NO: 339053 - DNA, 25 bp, Rattus norvegicus
gagcacagccgctggagcccgaaga

SEQ ID NO: 339054 - DNA, 25 bp, Rattus norvegicus
gagcacagcctcagaacaacaatga

SEQ ID NO: 339055 - DNA, 25 bp, Rattus norvegicus
gagcacagcctctgaacaacaatga

SEQ ID NO: 339056 - DNA, 25 bp, Rattus norvegicus
gagcacagccttagtaagcctttga

SEQ ID NO: 339057 - DNA, 25 bp, Rattus norvegicus
gagcacagccttcacggaacaagga

SEQ ID NO: 339058 - DNA, 25 bp, Rattus norvegicus
gagcacagccttgacggaacaagga

SEQ ID NO: 339059 - DNA, 25 bp, Rattus norvegicus
gagcacagcctttgtaagcctttga

SEQ ID NO: 339060 - DNA, 25 bp, Rattus norvegicus
gagcacagctcacacatcctgctgg

SEQ ID NO: 339061 - DNA, 25 bp, Rattus norvegicus
gagcacagctcagacatcctgctgg

SEQ ID NO: 339062 - DNA, 25 bp, Rattus norvegicus
gagcacaggtccaacttcagtgaca

SEQ ID NO: 339063 - DNA, 25 bp, Rattus norvegicus
gagcacaggtcctacttcagtgaca

SEQ ID NO: 339064 - DNA, 25 bp, Rattus norvegicus
gagcacagtaatagtcttgaccttt

SEQ ID NO: 339065 - DNA, 25 bp, Rattus norvegicus
gagcacagtaattgtcttgaccttt

SEQ ID NO: 339066 - DNA, 25 bp, Rattus norvegicus
gagcacagtagcagtggccttcaca

SEQ ID NO: 339067 - DNA, 25 bp, Rattus norvegicus
gagcacagtagctgtggccttcaca

SEQ ID NO: 339068 - DNA, 25 bp, Rattus norvegicus
gagcacagtctcagtaggcagcgcc

SEQ ID NO: 339069 - DNA, 25 bp, Rattus norvegicus
gagcacagtctctgtaggcagcgcc

SEQ ID NO: 339070 - DNA, 25 bp, Rattus norvegicus
gagcacagtgtgctgtgacctgtcc

SEQ ID NO: 339071 - DNA, 25 bp, Rattus norvegicus
gagcacagtgtggtgtgacctgtcc

SEQ ID NO: 339072 - DNA, 25 bp, Rattus norvegicus
gagcacagtgttacccaagtgtcat

SEQ ID NO: 339073 - DNA, 25 bp, Rattus norvegicus
gagcacagtgtttcccaagtgtcat

SEQ ID NO: 339074 - DNA, 25 bp, Rattus norvegicus
gagcacagttctcagactccgagat

SEQ ID NO: 339075 - DNA, 25 bp, Rattus norvegicus
gagcacagttctgagactccgagat

SEQ ID NO: 339076 - DNA, 25 bp, Rattus norvegicus
gagcacatacacatgccagacacgg

SEQ ID NO: 339077 - DNA, 25 bp, Rattus norvegicus
gagcacatacacttgccagacacgg

SEQ ID NO: 339078 - DNA, 25 bp, Rattus norvegicus
gagcacataccaagcggattttata

SEQ ID NO: 339079 - DNA, 25 bp, Rattus norvegicus
gagcacataccatgcggattttata

SEQ ID NO: 339080 - DNA, 25 bp, Rattus norvegicus
gagcacatagatatttagtatctct

SEQ ID NO: 339081 - DNA, 25 bp, Rattus norvegicus
gagcacatagatttttagtatctct

SEQ ID NO: 339082 - DNA, 25 bp, Rattus norvegicus
gagcacatagccattcatgacactt

SEQ ID NO: 339083 - DNA, 25 bp, Rattus norvegicus
gagcacatagcctttcatgacactt

SEQ ID NO: 339084 - DNA, 25 bp, Rattus norvegicus
gagcacatatcactcattgggtcct

SEQ ID NO: 339085 - DNA, 25 bp, Rattus norvegicus
gagcacatatcagtcattgggtcct

SEQ ID NO: 339086 - DNA, 25 bp, Rattus norvegicus
gagcacatatgtcttgctcttccag

SEQ ID NO: 339087 - DNA, 25 bp, Rattus norvegicus
gagcacatatgtgttgctcttccag

SEQ ID NO: 339088 - DNA, 25 bp, Rattus norvegicus
gagcacatcactcatggacatacct

SEQ ID NO: 339089 - DNA, 25 bp, Rattus norvegicus
gagcacatcactgatggacatacct

SEQ ID NO: 339090 - DNA, 25 bp, Rattus norvegicus
gagcacatccgacatctagcgagca

SEQ ID NO: 339091 - DNA, 25 bp, Rattus norvegicus
gagcacatccgagatctagcgagca

SEQ ID NO: 339092 - DNA, 25 bp, Rattus norvegicus
gagcacatcgacagctttgaggact

SEQ ID NO: 339093 - DNA, 25 bp, Rattus norvegicus
gagcacatcgactgctttgaggact

SEQ ID NO: 339094 - DNA, 25 bp, Rattus norvegicus
gagcacatctccaatgattttcata

SEQ ID NO: 339095 - DNA, 25 bp, Rattus norvegicus
gagcacatctcctatgattttcata

SEQ ID NO: 339096 - DNA, 25 bp, Rattus norvegicus
gagcacatctgtcttccaaaatttt

SEQ ID NO: 339097 - DNA, 25 bp, Rattus norvegicus
gagcacatctgtgttccaaaatttt

SEQ ID NO: 339098 - DNA, 25 bp, Rattus norvegicus
gagcacatcttcataaagtccaggc

SEQ ID NO: 339099 - DNA, 25 bp, Rattus norvegicus
gagcacatcttcttaaagtccaggc

SEQ ID NO: 339100 - DNA, 25 bp, Rattus norvegicus
gagcacatgaccagacactgccaaa

SEQ ID NO: 339101 - DNA, 25 bp, Rattus norvegicus
gagcacatgacctgacactgccaaa

SEQ ID NO: 339102 - DNA, 25 bp, Rattus norvegicus
gagcacatgctaattctggtttgag

SEQ ID NO: 339103 - DNA, 25 bp, Rattus norvegicus
gagcacatgctatttctggtttgag

SEQ ID NO: 339104 - DNA, 25 bp, Rattus norvegicus
gagcacatgctcagaaaactcccca

SEQ ID NO: 339105 - DNA, 25 bp, Rattus norvegicus
gagcacatgctcagtattttctgcc

SEQ ID NO: 339106 - DNA, 25 bp, Rattus norvegicus
gagcacatgctctgaaaactcccca

SEQ ID NO: 339107 - DNA, 25 bp, Rattus norvegicus
gagcacatgctctgtattttctgcc

SEQ ID NO: 339108 - DNA, 25 bp, Rattus norvegicus
gagcacatggctactaactttcaaa

SEQ ID NO: 339109 - DNA, 25 bp, Rattus norvegicus
gagcacatggcttctaactttcaaa

SEQ ID NO: 339110 - DNA, 25 bp, Rattus norvegicus
gagcacatgggcaagaccacgtcac

SEQ ID NO: 339111 - DNA, 25 bp, Rattus norvegicus
gagcacatgggctagaccacgtcac

SEQ ID NO: 339112 - DNA, 25 bp, Rattus norvegicus
gagcacatgtccaggcaacaataca

SEQ ID NO: 339113 - DNA, 25 bp, Rattus norvegicus
gagcacatgtcctggcaacaataca

SEQ ID NO: 339114 - DNA, 25 bp, Rattus norvegicus
gagcacatgtgtccagcattctcta

SEQ ID NO: 339115 - DNA, 25 bp, Rattus norvegicus
gagcacatgtgtgcagcattctcta

SEQ ID NO: 339116 - DNA, 25 bp, Rattus norvegicus
gagcacatgttcattgcagcataca

SEQ ID NO: 339117 - DNA, 25 bp, Rattus norvegicus
gagcacatgttctttgcagcataca

SEQ ID NO: 339118 - DNA, 25 bp, Rattus norvegicus
gagcacatgttgacagtatacacaa

SEQ ID NO: 339119 - DNA, 25 bp, Rattus norvegicus
gagcacatgttgtcagtatacacaa

SEQ ID NO: 339120 - DNA, 25 bp, Rattus norvegicus
gagcacattgatagtttctgaccca

SEQ ID NO: 339121 - DNA, 25 bp, Rattus norvegicus
gagcacattgattgtttctgaccca

SEQ ID NO: 339122 - DNA, 25 bp, Rattus norvegicus
gagcacattgttagcccttagtatg

SEQ ID NO: 339123 - DNA, 25 bp, Rattus norvegicus
gagcacattgtttgcccttagtatg

SEQ ID NO: 339124 - DNA, 25 bp, Rattus norvegicus
gagcacatttctattacaacatcaa

SEQ ID NO: 339125 - DNA, 25 bp, Rattus norvegicus
gagcacatttcttttacaacatcaa

SEQ ID NO: 339126 - DNA, 25 bp, Rattus norvegicus
gagcacatttgcctgcacttcgctt

SEQ ID NO: 339127 - DNA, 25 bp, Rattus norvegicus
gagcacatttgcgtgcacttcgctt

SEQ ID NO: 339128 - DNA, 25 bp, Rattus norvegicus
gagcaccaacttaacagattcgagg

SEQ ID NO: 339129 - DNA, 25 bp, Rattus norvegicus
gagcaccaactttacagattcgagg

SEQ ID NO: 339130 - DNA, 25 bp, Rattus norvegicus
gagcaccaccagagtccaggtagag

SEQ ID NO: 339131 - DNA, 25 bp, Rattus norvegicus
gagcaccaccagtgtccaggtagag

SEQ ID NO: 339132 - DNA, 25 bp, Rattus norvegicus
gagcaccaccgccatggagatactg

SEQ ID NO: 339133 - DNA, 25 bp, Rattus norvegicus
gagcaccaccgcgatggagatactg

SEQ ID NO: 339134 - DNA, 25 bp, Rattus norvegicus
gagcaccagaaaccaacagactttt

SEQ ID NO: 339135 - DNA, 25 bp, Rattus norvegicus
gagcaccagaaagcaacagactttt

SEQ ID NO: 339136 - DNA, 25 bp, Rattus norvegicus
gagcaccagaagcagtattcagcca

SEQ ID NO: 339137 - DNA, 25 bp, Rattus norvegicus
gagcaccagaaggagtattcagcca

SEQ ID NO: 339138 - DNA, 25 bp, Rattus norvegicus
gagcaccagacaagcatgtggcggt

SEQ ID NO: 339139 - DNA, 25 bp, Rattus norvegicus
gagcaccagacatgcatgtggcggt

SEQ ID NO: 339140 - DNA, 25 bp, Rattus norvegicus
gagcaccagcctagtttggaatcac

SEQ ID NO: 339141 - DNA, 25 bp, Rattus norvegicus
gagcaccagccttgtttggaatcac

SEQ ID NO: 339142 - DNA, 25 bp, Rattus norvegicus
gagcaccattctaggatggcaacac

SEQ ID NO: 339143 - DNA, 25 bp, Rattus norvegicus
gagcaccattcttggatggcaacac

SEQ ID NO: 339144 - DNA, 25 bp, Rattus norvegicus
gagcacccaagtcatgtcgaaagga

SEQ ID NO: 339145 - DNA, 25 bp, Rattus norvegicus
gagcacccaagtgatgtcgaaagga

SEQ ID NO: 339146 - DNA, 25 bp, Rattus norvegicus
gagcacccagatagactctccggga

SEQ ID NO: 339147 - DNA, 25 bp, Rattus norvegicus
gagcacccagattgactctccggga

SEQ ID NO: 339148 - DNA, 25 bp, Rattus norvegicus
gagcaccccggcaaaatgcagtgtg

SEQ ID NO: 339149 - DNA, 25 bp, Rattus norvegicus
gagcaccccggctaaatgcagtgtg

SEQ ID NO: 339150 - DNA, 25 bp, Rattus norvegicus
gagcacccctgtctggagagcatga

SEQ ID NO: 339151 - DNA, 25 bp, Rattus norvegicus
gagcacccctgtgtggagagcatga

SEQ ID NO: 339152 - DNA, 25 bp, Rattus norvegicus
gagcacccggacagggcgggaccac

SEQ ID NO: 339153 - DNA, 25 bp, Rattus norvegicus
gagcacccggactgggcgggaccac

SEQ ID NO: 339154 - DNA, 25 bp, Rattus norvegicus
gagcaccctataaaggccctttatt

SEQ ID NO: 339155 - DNA, 25 bp, Rattus norvegicus
gagcaccctatataggccctttatt

SEQ ID NO: 339156 - DNA, 25 bp, Rattus norvegicus
gagcaccctcaactgaaactccata

SEQ ID NO: 339157 - DNA, 25 bp, Rattus norvegicus
gagcaccctcaagtgaaactccata

SEQ ID NO: 339158 - DNA, 25 bp, Rattus norvegicus
gagcaccctgaaaaagccgtgccac

SEQ ID NO: 339159 - DNA, 25 bp, Rattus norvegicus
gagcaccctgaataagccgtgccac

SEQ ID NO: 339160 - DNA, 25 bp, Rattus norvegicus
gagcaccgagcgctcttccagaaga

SEQ ID NO: 339161 - DNA, 25 bp, Rattus norvegicus
gagcaccgagcggtcttccagaaga

SEQ ID NO: 339162 - DNA, 25 bp, Rattus norvegicus
gagcaccgagctcaccaaagatgtt

SEQ ID NO: 339163 - DNA, 25 bp, Rattus norvegicus
gagcaccgagctgaccaaagatgtt

SEQ ID NO: 339164 - DNA, 25 bp, Rattus norvegicus
gagcaccgagtgattctcaagtaca

SEQ ID NO: 339165 - DNA, 25 bp, Rattus norvegicus
gagcaccgagtgtttctcaagtaca

SEQ ID NO: 339166 - DNA, 25 bp, Rattus norvegicus
gagcaccgagttcgttctaggtatt

SEQ ID NO: 339167 - DNA, 25 bp, Rattus norvegicus
gagcaccgagttggttctaggtatt

SEQ ID NO: 339168 - DNA, 25 bp, Rattus norvegicus
gagcaccgcgtacgtcactagcagt

SEQ ID NO: 339169 - DNA, 25 bp, Rattus norvegicus
gagcaccgcgtaggtcactagcagt

SEQ ID NO: 339170 - DNA, 25 bp, Rattus norvegicus
gagcacctaagtaatccagatagaa

SEQ ID NO: 339171 - DNA, 25 bp, Rattus norvegicus
gagcacctaagttatccagatagaa

SEQ ID NO: 339172 - DNA, 25 bp, Rattus norvegicus
gagcacctatacaccggagaattta

SEQ ID NO: 339173 - DNA, 25 bp, Rattus norvegicus
gagcacctatactccggagaattta

SEQ ID NO: 339174 - DNA, 25 bp, Rattus norvegicus
gagcacctcaagacaatcccgaaga

SEQ ID NO: 339175 - DNA, 25 bp, Rattus norvegicus
gagcacctcaagtcaatcccgaaga

SEQ ID NO: 339176 - DNA, 25 bp, Rattus norvegicus
gagcacctcagcagtatacgaacct

SEQ ID NO: 339177 - DNA, 25 bp, Rattus norvegicus
gagcacctcagctgtatacgaacct

SEQ ID NO: 339178 - DNA, 25 bp, Rattus norvegicus
gagcacctcagtcagtgtggcatta

SEQ ID NO: 339179 - DNA, 25 bp, Rattus norvegicus
gagcacctcagtgagtgtggcatta

SEQ ID NO: 339180 - DNA, 25 bp, Rattus norvegicus
gagcacctccagagatgagttctgc

SEQ ID NO: 339181 - DNA, 25 bp, Rattus norvegicus
gagcacctccagtgatgagttctgc

SEQ ID NO: 339182 - DNA, 25 bp, Rattus norvegicus
gagcacctctaaaaattatgtctta

SEQ ID NO: 339183 - DNA, 25 bp, Rattus norvegicus
gagcacctctaataattatgtctta

SEQ ID NO: 339184 - DNA, 25 bp, Rattus norvegicus
gagcacctcttcaataagtctcaga

SEQ ID NO: 339185 - DNA, 25 bp, Rattus norvegicus
gagcacctcttcattagtttccaat

SEQ ID NO: 339186 - DNA, 25 bp, Rattus norvegicus
gagcacctcttctataagtctcaga

SEQ ID NO: 339187 - DNA, 25 bp, Rattus norvegicus
gagcacctcttctttagtttccaat

SEQ ID NO: 339188 - DNA, 25 bp, Rattus norvegicus
gagcacctgaagactaatgttttac

SEQ ID NO: 339189 - DNA, 25 bp, Rattus norvegicus
gagcacctgaagtctaatgttttac

SEQ ID NO: 339190 - DNA, 25 bp, Rattus norvegicus
gagcacctgcacaagatggcgtcat

SEQ ID NO: 339191 - DNA, 25 bp, Rattus norvegicus
gagcacctgcacacatgggtacaga

SEQ ID NO: 339192 - DNA, 25 bp, Rattus norvegicus
gagcacctgcacatatatacacata

SEQ ID NO: 339193 - DNA, 25 bp, Rattus norvegicus
gagcacctgcactagatggcgtcat

SEQ ID NO: 339194 - DNA, 25 bp, Rattus norvegicus
gagcacctgcactcatgggtacaga

SEQ ID NO: 339195 - DNA, 25 bp, Rattus norvegicus
gagcacctgcacttatatacacata

SEQ ID NO: 339196 - DNA, 25 bp, Rattus norvegicus
gagcacctgcgtatgaatctatgat

SEQ ID NO: 339197 - DNA, 25 bp, Rattus norvegicus
gagcacctgcgtttgaatctatgat

SEQ ID NO: 339198 - DNA, 25 bp, Rattus norvegicus
gagcacctggatcgaatcccttgag

SEQ ID NO: 339199 - DNA, 25 bp, Rattus norvegicus
gagcacctggatggaatcccttgag

SEQ ID NO: 339200 - DNA, 25 bp, Rattus norvegicus
gagcacctgggacaacagatccaaa

SEQ ID NO: 339201 - DNA, 25 bp, Rattus norvegicus
gagcacctgggagaacagatccaaa

SEQ ID NO: 339202 - DNA, 25 bp, Rattus norvegicus
gagcacctgttgcaggactcggaaa

SEQ ID NO: 339203 - DNA, 25 bp, Rattus norvegicus
gagcacctgttgcagtctgacctct

SEQ ID NO: 339204 - DNA, 25 bp, Rattus norvegicus
gagcacctgttggaggactcggaaa

SEQ ID NO: 339205 - DNA, 25 bp, Rattus norvegicus
gagcacctgttggagtctgacctct

SEQ ID NO: 339206 - DNA, 25 bp, Rattus norvegicus
gagcaccttgagagccatgcactgg

SEQ ID NO: 339207 - DNA, 25 bp, Rattus norvegicus
gagcaccttgagtgccatgcactgg

SEQ ID NO: 339208 - DNA, 25 bp, Rattus norvegicus
gagcaccttgtgagaggtgtctccc

SEQ ID NO: 339209 - DNA, 25 bp, Rattus norvegicus
gagcaccttgtgaggagagctacca

SEQ ID NO: 339210 - DNA, 25 bp, Rattus norvegicus
gagcaccttgtgtgaggtgtctccc

SEQ ID NO: 339211 - DNA, 25 bp, Rattus norvegicus
gagcaccttgtgtggagagctacca

SEQ ID NO: 339212 - DNA, 25 bp, Rattus norvegicus
gagcacctttacaaggtgacccgct

SEQ ID NO: 339213 - DNA, 25 bp, Rattus norvegicus
gagcacctttactaggtgacccgct

SEQ ID NO: 339214 - DNA, 25 bp, Rattus norvegicus
gagcacctttgacccattcgagaaa

SEQ ID NO: 339215 - DNA, 25 bp, Rattus norvegicus
gagcacctttgagccattcgagaaa

SEQ ID NO: 339216 - DNA, 25 bp, Rattus norvegicus
gagcacgactttcatggatcctggg

SEQ ID NO: 339217 - DNA, 25 bp, Rattus norvegicus
gagcacgactttgatggatcctggg

SEQ ID NO: 339218 - DNA, 25 bp, Rattus norvegicus
gagcacgagcgacaagtcctccaga

SEQ ID NO: 339219 - DNA, 25 bp, Rattus norvegicus
gagcacgagcgagaagtcctccaga

SEQ ID NO: 339220 - DNA, 25 bp, Rattus norvegicus
gagcacgaggctcaaggaaacccct

SEQ ID NO: 339221 - DNA, 25 bp, Rattus norvegicus
gagcacgaggctgaaggaaacccct

SEQ ID NO: 339222 - DNA, 25 bp, Rattus norvegicus
gagcacgcacacagttaccggtgta

SEQ ID NO: 339223 - DNA, 25 bp, Rattus norvegicus
gagcacgcacactgttaccggtgta

SEQ ID NO: 339224 - DNA, 25 bp, Rattus norvegicus
gagcacgcacatccatacgtacaca

SEQ ID NO: 339225 - DNA, 25 bp, Rattus norvegicus
gagcacgcacatgcatacgtacaca

SEQ ID NO: 339226 - DNA, 25 bp, Rattus norvegicus
gagcacgcgggaactggtttttcaa

SEQ ID NO: 339227 - DNA, 25 bp, Rattus norvegicus
gagcacgcgggatctggtttttcaa

SEQ ID NO: 339228 - DNA, 25 bp, Rattus norvegicus
gagcacggacagcacgcagctaaca

SEQ ID NO: 339229 - DNA, 25 bp, Rattus norvegicus
gagcacggacaggacgcagctaaca

SEQ ID NO: 339230 - DNA, 25 bp, Rattus norvegicus
gagcacggagatccgaagagtaccc

SEQ ID NO: 339231 - DNA, 25 bp, Rattus norvegicus
gagcacggagatgcgaagagtaccc

SEQ ID NO: 339232 - DNA, 25 bp, Rattus norvegicus
gagcacgggaagaacagacagaatt

SEQ ID NO: 339233 - DNA, 25 bp, Rattus norvegicus
gagcacgggaagtacagacagaatt

SEQ ID NO: 339234 - DNA, 25 bp, Rattus norvegicus
gagcacggtaaaatctctttccctg

SEQ ID NO: 339235 - DNA, 25 bp, Rattus norvegicus
gagcacggtaaattctctttccctg

SEQ ID NO: 339236 - DNA, 25 bp, Rattus norvegicus
gagcacggtcctccttagtaagtac

SEQ ID NO: 339237 - DNA, 25 bp, Rattus norvegicus
gagcacggtcctgcttagtaagtac

SEQ ID NO: 339238 - DNA, 25 bp, Rattus norvegicus
gagcacggttagcactgtaacagaa

SEQ ID NO: 339239 - DNA, 25 bp, Rattus norvegicus
gagcacggttaggactgtaacagaa

SEQ ID NO: 339240 - DNA, 25 bp, Rattus norvegicus
gagcacgtaagtacctacctaagaa

SEQ ID NO: 339241 - DNA, 25 bp, Rattus norvegicus
gagcacgtaagttcctacctaagaa

SEQ ID NO: 339242 - DNA, 25 bp, Rattus norvegicus
gagcacgtctatatgtaaagccagc

SEQ ID NO: 339243 - DNA, 25 bp, Rattus norvegicus
gagcacgtctatttgtaaagccagc

SEQ ID NO: 339244 - DNA, 25 bp, Rattus norvegicus
gagcacgtgccgagtgttaacccct

SEQ ID NO: 339245 - DNA, 25 bp, Rattus norvegicus
gagcacgtgccgtgtgttaacccct

SEQ ID NO: 339246 - DNA, 25 bp, Rattus norvegicus
gagcacgttcacattgactgttaca

SEQ ID NO: 339247 - DNA, 25 bp, Rattus norvegicus
gagcacgttcactttgactgttaca

SEQ ID NO: 339248 - DNA, 25 bp, Rattus norvegicus
gagcacgttgtaactgtccgggagc

SEQ ID NO: 339249 - DNA, 25 bp, Rattus norvegicus
gagcacgttgtatctgtccgggagc

SEQ ID NO: 339250 - DNA, 25 bp, Rattus norvegicus
gagcactacagtccgcatggtttgt

SEQ ID NO: 339251 - DNA, 25 bp, Rattus norvegicus
gagcactacagtgcgcatggtttgt

SEQ ID NO: 339252 - DNA, 25 bp, Rattus norvegicus
gagcactaccggaagttggtcatcc

SEQ ID NO: 339253 - DNA, 25 bp, Rattus norvegicus
gagcactaccggtagttggtcatcc

SEQ ID NO: 339254 - DNA, 25 bp, Rattus norvegicus
gagcactactggaaaacatcagcaa

SEQ ID NO: 339255 - DNA, 25 bp, Rattus norvegicus
gagcactactggtaaacatcagcaa

SEQ ID NO: 339256 - DNA, 25 bp, Rattus norvegicus
gagcactaggctatttccaatctta

SEQ ID NO: 339257 - DNA, 25 bp, Rattus norvegicus
gagcactaggctcttcttttattga

SEQ ID NO: 339258 - DNA, 25 bp, Rattus norvegicus
gagcactaggctgttcttttattga

SEQ ID NO: 339259 - DNA, 25 bp, Rattus norvegicus
gagcactaggctttttccaatctta

SEQ ID NO: 339260 - DNA, 25 bp, Rattus norvegicus
gagcactcaagaacctgggacttca

SEQ ID NO: 339261 - DNA, 25 bp, Rattus norvegicus
gagcactcaagatcctgggacttca

SEQ ID NO: 339262 - DNA, 25 bp, Rattus norvegicus
gagcactcacctaccgatctagagg

SEQ ID NO: 339263 - DNA, 25 bp, Rattus norvegicus
gagcactcaccttccgatctagagg

SEQ ID NO: 339264 - DNA, 25 bp, Rattus norvegicus
gagcactcagctagtaggcaggctt

SEQ ID NO: 339265 - DNA, 25 bp, Rattus norvegicus
gagcactcagcttgtaggcaggctt

SEQ ID NO: 339266 - DNA, 25 bp, Rattus norvegicus
gagcactcatccaggctgaagagac

SEQ ID NO: 339267 - DNA, 25 bp, Rattus norvegicus
gagcactcatcctggctgaagagac

SEQ ID NO: 339268 - DNA, 25 bp, Rattus norvegicus
gagcactcattacagtcttgttgac

SEQ ID NO: 339269 - DNA, 25 bp, Rattus norvegicus
gagcactcattagagtcttgttgac

SEQ ID NO: 339270 - DNA, 25 bp, Rattus norvegicus
gagcactccaaaagcccatcaagag

SEQ ID NO: 339271 - DNA, 25 bp, Rattus norvegicus
gagcactccaaatgcccatcaagag

SEQ ID NO: 339272 - DNA, 25 bp, Rattus norvegicus
gagcactccagtagatttttacttg

SEQ ID NO: 339273 - DNA, 25 bp, Rattus norvegicus
gagcactccagttgatttttacttg

SEQ ID NO: 339274 - DNA, 25 bp, Rattus norvegicus
gagcactcccaacggtttgtgcaaa

SEQ ID NO: 339275 - DNA, 25 bp, Rattus norvegicus
gagcactcccaagggtttgtgcaaa

SEQ ID NO: 339276 - DNA, 25 bp, Rattus norvegicus
gagcactcccgtatttgtatgtgga

SEQ ID NO: 339277 - DNA, 25 bp, Rattus norvegicus
gagcactcccgtttttgtatgtgga

SEQ ID NO: 339278 - DNA, 25 bp, Rattus norvegicus
gagcactccttcaggagatcctttc

SEQ ID NO: 339279 - DNA, 25 bp, Rattus norvegicus
gagcactccttctggagatcctttc

SEQ ID NO: 339280 - DNA, 25 bp, Rattus norvegicus
gagcactcggtgaactgtctacagc

SEQ ID NO: 339281 - DNA, 25 bp, Rattus norvegicus
gagcactcggtgtactgtctacagc

SEQ ID NO: 339282 - DNA, 25 bp, Rattus norvegicus
gagcactctgcaccaggttctacag

SEQ ID NO: 339283 - DNA, 25 bp, Rattus norvegicus
gagcactctgcagcaggttctacag

SEQ ID NO: 339284 - DNA, 25 bp, Rattus norvegicus
gagcactctttgatgcatgcagatt

SEQ ID NO: 339285 - DNA, 25 bp, Rattus norvegicus
gagcactctttgttgcatgcagatt

SEQ ID NO: 339286 - DNA, 25 bp, Rattus norvegicus
gagcactgaacacagttctactttt

SEQ ID NO: 339287 - DNA, 25 bp, Rattus norvegicus
gagcactgaacagagttctactttt

SEQ ID NO: 339288 - DNA, 25 bp, Rattus norvegicus
gagcactgactgcagatcgatagct

SEQ ID NO: 339289 - DNA, 25 bp, Rattus norvegicus
gagcactgactggagatcgatagct

SEQ ID NO: 339290 - DNA, 25 bp, Rattus norvegicus
gagcactgagcacctacttagtgga

SEQ ID NO: 339291 - DNA, 25 bp, Rattus norvegicus
gagcactgagcagctacttagtgga

SEQ ID NO: 339292 - DNA, 25 bp, Rattus norvegicus
gagcactgaggaaacccctgtattt

SEQ ID NO: 339293 - DNA, 25 bp, Rattus norvegicus
gagcactgaggatacccctgtattt

SEQ ID NO: 339294 - DNA, 25 bp, Rattus norvegicus
gagcactgatgcatgggatcctcta

SEQ ID NO: 339295 - DNA, 25 bp, Rattus norvegicus
gagcactgatgcttgggatcctcta

SEQ ID NO: 339296 - DNA, 25 bp, Rattus norvegicus
gagcactgcaaacccacgtgggtca

SEQ ID NO: 339297 - DNA, 25 bp, Rattus norvegicus
gagcactgcaaagccacgtgggtca

SEQ ID NO: 339298 - DNA, 25 bp, Rattus norvegicus
gagcactgcaagacattgttatcca

SEQ ID NO: 339299 - DNA, 25 bp, Rattus norvegicus
gagcactgcaagtcattgttatcca

SEQ ID NO: 339300 - DNA, 25 bp, Rattus norvegicus
gagcactgcacaagtacggcctgat

SEQ ID NO: 339301 - DNA, 25 bp, Rattus norvegicus
gagcactgcacatgtacggcctgat

SEQ ID NO: 339302 - DNA, 25 bp, Rattus norvegicus
gagcactgcctcactaaaatacaga

SEQ ID NO: 339303 - DNA, 25 bp, Rattus norvegicus
gagcactgcctctctaaaatacaga

SEQ ID NO: 339304 - DNA, 25 bp, Rattus norvegicus
gagcactgcctgaaccttatgcaaa

SEQ ID NO: 339305 - DNA, 25 bp, Rattus norvegicus
gagcactgcctgtaccttatgcaaa

SEQ ID NO: 339306 - DNA, 25 bp, Rattus norvegicus
gagcactgctctaacactgtaggaa

SEQ ID NO: 339307 - DNA, 25 bp, Rattus norvegicus
gagcactgctcttacactgtaggaa

SEQ ID NO: 339308 - DNA, 25 bp, Rattus norvegicus
gagcactgctttacaaggcactggc

SEQ ID NO: 339309 - DNA, 25 bp, Rattus norvegicus
gagcactgcttttcaaggcactggc

SEQ ID NO: 339310 - DNA, 25 bp, Rattus norvegicus
gagcactggaaaacagacgtctcca

SEQ ID NO: 339311 - DNA, 25 bp, Rattus norvegicus
gagcactggaaatcagacgtctcca

SEQ ID NO: 339312 - DNA, 25 bp, Rattus norvegicus
gagcactggactcgatcttcagcca

SEQ ID NO: 339313 - DNA, 25 bp, Rattus norvegicus
gagcactggactggatcttcagcca

SEQ ID NO: 339314 - DNA, 25 bp, Rattus norvegicus
gagcactggctacccttcttgagga

SEQ ID NO: 339315 - DNA, 25 bp, Rattus norvegicus
gagcactggctagccttcttgagga

SEQ ID NO: 339316 - DNA, 25 bp, Rattus norvegicus
gagcactggctgagatactacacaa

SEQ ID NO: 339317 - DNA, 25 bp, Rattus norvegicus
gagcactggctgtgatactacacaa

SEQ ID NO: 339318 - DNA, 25 bp, Rattus norvegicus
gagcactggcttaagttcctggagt

SEQ ID NO: 339319 - DNA, 25 bp, Rattus norvegicus
gagcactggcttctcaggatatata

SEQ ID NO: 339320 - DNA, 25 bp, Rattus norvegicus
gagcactggcttgtcaggatatata

SEQ ID NO: 339321 - DNA, 25 bp, Rattus norvegicus
gagcactggctttagttcctggagt

SEQ ID NO: 339322 - DNA, 25 bp, Rattus norvegicus
gagcactgggaaaccaaactccgac

SEQ ID NO: 339323 - DNA, 25 bp, Rattus norvegicus
gagcactgggaatccaaactccgac

SEQ ID NO: 339324 - DNA, 25 bp, Rattus norvegicus
gagcactgggctaagatgcacacta

SEQ ID NO: 339325 - DNA, 25 bp, Rattus norvegicus
gagcactgggcttagatgcacacta

SEQ ID NO: 339326 - DNA, 25 bp, Rattus norvegicus
gagcactgtcatacctaagttcaca

SEQ ID NO: 339327 - DNA, 25 bp, Rattus norvegicus
gagcactgtcattcctaagttcaca

SEQ ID NO: 339328 - DNA, 25 bp, Rattus norvegicus
gagcactgtgcgagagattgacccc

SEQ ID NO: 339329 - DNA, 25 bp, Rattus norvegicus
gagcactgtgcgtgagattgacccc

SEQ ID NO: 339330 - DNA, 25 bp, Rattus norvegicus
gagcactgtgtcaggcttcttacca

SEQ ID NO: 339331 - DNA, 25 bp, Rattus norvegicus
gagcactgtgtctggcttcttacca

SEQ ID NO: 339332 - DNA, 25 bp, Rattus norvegicus
gagcactgttacacttgcaaacaag

SEQ ID NO: 339333 - DNA, 25 bp, Rattus norvegicus
gagcactgttactcttgcaaacaag

SEQ ID NO: 339334 - DNA, 25 bp, Rattus norvegicus
gagcacttacctaacctggtttgaa

SEQ ID NO: 339335 - DNA, 25 bp, Rattus norvegicus
gagcacttaccttacctggtttgaa

SEQ ID NO: 339336 - DNA, 25 bp, Rattus norvegicus
gagcacttacttaacaggacgacca

SEQ ID NO: 339337 - DNA, 25 bp, Rattus norvegicus
gagcacttactttacaggacgacca

SEQ ID NO: 339338 - DNA, 25 bp, Rattus norvegicus
gagcacttatggcaaggcatcccga

SEQ ID NO: 339339 - DNA, 25 bp, Rattus norvegicus
gagcacttatgggaaggcatcccga

SEQ ID NO: 339340 - DNA, 25 bp, Rattus norvegicus
gagcacttccacagacagatagcat

SEQ ID NO: 339341 - DNA, 25 bp, Rattus norvegicus
gagcacttccactgacagatagcat

SEQ ID NO: 339342 - DNA, 25 bp, Rattus norvegicus
gagcacttccagaaaggacctttcc

SEQ ID NO: 339343 - DNA, 25 bp, Rattus norvegicus
gagcacttccagtaaggacctttcc

SEQ ID NO: 339344 - DNA, 25 bp, Rattus norvegicus
gagcacttcctaatagatcgtcttc

SEQ ID NO: 339345 - DNA, 25 bp, Rattus norvegicus
gagcacttcctattagatcgtcttc

SEQ ID NO: 339346 - DNA, 25 bp, Rattus norvegicus
gagcacttgaaaccgtacaaagtaa

SEQ ID NO: 339347 - DNA, 25 bp, Rattus norvegicus
gagcacttgaaagcgtacaaagtaa

SEQ ID NO: 339348 - DNA, 25 bp, Rattus norvegicus
gagcacttgcggcaggacaacctga

SEQ ID NO: 339349 - DNA, 25 bp, Rattus norvegicus
gagcacttgcgggaggacaacctga

SEQ ID NO: 339350 - DNA, 25 bp, Rattus norvegicus
gagcacttgctgagttgttcaaaac

SEQ ID NO: 339351 - DNA, 25 bp, Rattus norvegicus
gagcacttgctgtgttgttcaaaac

SEQ ID NO: 339352 - DNA, 25 bp, Rattus norvegicus
gagcacttggagacacctggagaat

SEQ ID NO: 339353 - DNA, 25 bp, Rattus norvegicus
gagcacttggagtcacctggagaat

SEQ ID NO: 339354 - DNA, 25 bp, Rattus norvegicus
gagcacttggataatggatctgaat

SEQ ID NO: 339355 - DNA, 25 bp, Rattus norvegicus
gagcacttggattatggatctgaat

SEQ ID NO: 339356 - DNA, 25 bp, Rattus norvegicus
gagcacttggcaaacaaatgcttct

SEQ ID NO: 339357 - DNA, 25 bp, Rattus norvegicus
gagcacttggcatacaaatgcttct

SEQ ID NO: 339358 - DNA, 25 bp, Rattus norvegicus
gagcacttggctcttactgataaat

SEQ ID NO: 339359 - DNA, 25 bp, Rattus norvegicus
gagcacttggctgttactgataaat

SEQ ID NO: 339360 - DNA, 25 bp, Rattus norvegicus
gagcactttaatactcattactatg

SEQ ID NO: 339361 - DNA, 25 bp, Rattus norvegicus
gagcactttaattctcattactatg

SEQ ID NO: 339362 - DNA, 25 bp, Rattus norvegicus
gagcactttatactcagctgagcct

SEQ ID NO: 339363 - DNA, 25 bp, Rattus norvegicus
gagcactttatagtcagctgagcct

SEQ ID NO: 339364 - DNA, 25 bp, Rattus norvegicus
gagcactttctcagaagcgactgct

SEQ ID NO: 339365 - DNA, 25 bp, Rattus norvegicus
gagcactttctctgaagcgactgct

SEQ ID NO: 339366 - DNA, 25 bp, Rattus norvegicus
gagcactttgagaaacacccacaag

SEQ ID NO: 339367 - DNA, 25 bp, Rattus norvegicus
gagcactttgagtaacacccacaag

SEQ ID NO: 339368 - DNA, 25 bp, Rattus norvegicus
gagcactttgcacagccatcagaga

SEQ ID NO: 339369 - DNA, 25 bp, Rattus norvegicus
gagcactttgcagagccatcagaga

SEQ ID NO: 339370 - DNA, 25 bp, Rattus norvegicus
gagcactttgtgaaggttagaggtt

SEQ ID NO: 339371 - DNA, 25 bp, Rattus norvegicus
gagcactttgtgtaggttagaggtt

SEQ ID NO: 339372 - DNA, 25 bp, Rattus norvegicus
gagcacttttccatacattgactgt

SEQ ID NO: 339373 - DNA, 25 bp, Rattus norvegicus
gagcacttttccttacattgactgt

SEQ ID NO: 339374 - DNA, 25 bp, Rattus norvegicus
gagcacttttgaaacacttcctctg

SEQ ID NO: 339375 - DNA, 25 bp, Rattus norvegicus
gagcacttttgatacacttcctctg

SEQ ID NO: 339376 - DNA, 25 bp, Rattus norvegicus
gagcacttttgtagtgtttgtatgt

SEQ ID NO: 339377 - DNA, 25 bp, Rattus norvegicus
gagcacttttgttgtgtttgtatgt

SEQ ID NO: 339378 - DNA, 25 bp, Rattus norvegicus
gagcagaaacttccctggtcaccag

SEQ ID NO: 339379 - DNA, 25 bp, Rattus norvegicus
gagcagaaacttctagaacaggctt

SEQ ID NO: 339380 - DNA, 25 bp, Rattus norvegicus
gagcagaaacttgcctggtcaccag

SEQ ID NO: 339381 - DNA, 25 bp, Rattus norvegicus
gagcagaaacttgtagaacaggctt

SEQ ID NO: 339382 - DNA, 25 bp, Rattus norvegicus
gagcagaaagatcctagccagctga

SEQ ID NO: 339383 - DNA, 25 bp, Rattus norvegicus
gagcagaaagatgctagccagctga

SEQ ID NO: 339384 - DNA, 25 bp, Rattus norvegicus
gagcagaaagcactaaacttagcat

SEQ ID NO: 339385 - DNA, 25 bp, Rattus norvegicus
gagcagaaagcagtaaacttagcat

SEQ ID NO: 339386 - DNA, 25 bp, Rattus norvegicus
gagcagaaccgcatcatattcgatt

SEQ ID NO: 339387 - DNA, 25 bp, Rattus norvegicus
gagcagaaccgcttcatattcgatt

SEQ ID NO: 339388 - DNA, 25 bp, Rattus norvegicus
gagcagaactccaccgacaccttat

SEQ ID NO: 339389 - DNA, 25 bp, Rattus norvegicus
gagcagaactcctccgacaccttat

SEQ ID NO: 339390 - DNA, 25 bp, Rattus norvegicus
gagcagaacttcatttgcactcagt

SEQ ID NO: 339391 - DNA, 25 bp, Rattus norvegicus
gagcagaacttcttttgcactcagt

SEQ ID NO: 339392 - DNA, 25 bp, Rattus norvegicus
gagcagaactttattcagtcacgat

SEQ ID NO: 339393 - DNA, 25 bp, Rattus norvegicus
gagcagaacttttttcagtcacgat

SEQ ID NO: 339394 - DNA, 25 bp, Rattus norvegicus
gagcagaagctgacagtttccctat

SEQ ID NO: 339395 - DNA, 25 bp, Rattus norvegicus
gagcagaagctgctcatgtccgcca

SEQ ID NO: 339396 - DNA, 25 bp, Rattus norvegicus
gagcagaagctggtcatgtccgcca

SEQ ID NO: 339397 - DNA, 25 bp, Rattus norvegicus
gagcagaagctgtcagtttccctat

SEQ ID NO: 339398 - DNA, 25 bp, Rattus norvegicus
gagcagaagggacaagcagtctacc

SEQ ID NO: 339399 - DNA, 25 bp, Rattus norvegicus
gagcagaagggagaagcagtctacc

SEQ ID NO: 339400 - DNA, 25 bp, Rattus norvegicus
gagcagaaggtaccccattgtcaaa

SEQ ID NO: 339401 - DNA, 25 bp, Rattus norvegicus
gagcagaaggtagcccattgtcaaa

SEQ ID NO: 339402 - DNA, 25 bp, Rattus norvegicus
gagcagaagtccaggaacctccctc

SEQ ID NO: 339403 - DNA, 25 bp, Rattus norvegicus
gagcagaagtcctggaacctccctc

SEQ ID NO: 339404 - DNA, 25 bp, Rattus norvegicus
gagcagaatagcatcagcccatgtt

SEQ ID NO: 339405 - DNA, 25 bp, Rattus norvegicus
gagcagaatagcttcagcccatgtt

SEQ ID NO: 339406 - DNA, 25 bp, Rattus norvegicus
gagcagacaagaaccatcacgattt

SEQ ID NO: 339407 - DNA, 25 bp, Rattus norvegicus
gagcagacaagatccatcacgattt

SEQ ID NO: 339408 - DNA, 25 bp, Rattus norvegicus
gagcagacaagtctatgtacccctt

SEQ ID NO: 339409 - DNA, 25 bp, Rattus norvegicus
gagcagacaagtgtatgtacccctt

SEQ ID NO: 339410 - DNA, 25 bp, Rattus norvegicus
gagcagacaccacgttttgcctcag

SEQ ID NO: 339411 - DNA, 25 bp, Rattus norvegicus
gagcagacaccaggttttgcctcag

SEQ ID NO: 339412 - DNA, 25 bp, Rattus norvegicus
gagcagacactcataagtggcacag

SEQ ID NO: 339413 - DNA, 25 bp, Rattus norvegicus
gagcagacactcttaagtggcacag

SEQ ID NO: 339414 - DNA, 25 bp, Rattus norvegicus
gagcagacagacacgaatacttcca

SEQ ID NO: 339415 - DNA, 25 bp, Rattus norvegicus
gagcagacagactcgaatacttcca

SEQ ID NO: 339416 - DNA, 25 bp, Rattus norvegicus
gagcagacagctagcatgttgtaag

SEQ ID NO: 339417 - DNA, 25 bp, Rattus norvegicus
gagcagacagctcatggaacaactc

SEQ ID NO: 339418 - DNA, 25 bp, Rattus norvegicus
gagcagacagctgatggaacaactc

SEQ ID NO: 339419 - DNA, 25 bp, Rattus norvegicus
gagcagacagcttgcatgttgtaag

SEQ ID NO: 339420 - DNA, 25 bp, Rattus norvegicus
gagcagacaggactccacaggaaat

SEQ ID NO: 339421 - DNA, 25 bp, Rattus norvegicus
gagcagacaggagtccacaggaaat

SEQ ID NO: 339422 - DNA, 25 bp, Rattus norvegicus
gagcagacattcactttgagcccaa

SEQ ID NO: 339423 - DNA, 25 bp, Rattus norvegicus
gagcagacattctctttgagcccaa

SEQ ID NO: 339424 - DNA, 25 bp, Rattus norvegicus
gagcagaccatccagagacatttga

SEQ ID NO: 339425 - DNA, 25 bp, Rattus norvegicus
gagcagaccatcgagagacatttga

SEQ ID NO: 339426 - DNA, 25 bp, Rattus norvegicus
gagcagaccatgaggttcacttcgg

SEQ ID NO: 339427 - DNA, 25 bp, Rattus norvegicus
gagcagaccatgtggttcacttcgg

SEQ ID NO: 339428 - DNA, 25 bp, Rattus norvegicus
gagcagaccattaggctttccttaa

SEQ ID NO: 339429 - DNA, 25 bp, Rattus norvegicus
gagcagaccatttggctttccttaa

SEQ ID NO: 339430 - DNA, 25 bp, Rattus norvegicus
gagcagacccagaagtccaaacctg

SEQ ID NO: 339431 - DNA, 25 bp, Rattus norvegicus
gagcagacccagtagtccaaacctg

SEQ ID NO: 339432 - DNA, 25 bp, Rattus norvegicus
gagcagaccctgctaaagctgtcat

SEQ ID NO: 339433 - DNA, 25 bp, Rattus norvegicus
gagcagaccctggtaaagctgtcat

SEQ ID NO: 339434 - DNA, 25 bp, Rattus norvegicus
gagcagaccgcaccttgtggaagaa

SEQ ID NO: 339435 - DNA, 25 bp, Rattus norvegicus
gagcagaccgcagcttgtggaagaa

SEQ ID NO: 339436 - DNA, 25 bp, Rattus norvegicus
gagcagacctatcctctaagcaaga

SEQ ID NO: 339437 - DNA, 25 bp, Rattus norvegicus
gagcagacctatgctctaagcaaga

SEQ ID NO: 339438 - DNA, 25 bp, Rattus norvegicus
gagcagacgtcaatgcacctcctgt

SEQ ID NO: 339439 - DNA, 25 bp, Rattus norvegicus
gagcagacgtcattgcacctcctgt

SEQ ID NO: 339440 - DNA, 25 bp, Rattus norvegicus
gagcagactctgcacaaagtgaaca

SEQ ID NO: 339441 - DNA, 25 bp, Rattus norvegicus
gagcagactctggacaaagtgaaca

SEQ ID NO: 339442 - DNA, 25 bp, Rattus norvegicus
gagcagactgagcagggcaaacatt

SEQ ID NO: 339443 - DNA, 25 bp, Rattus norvegicus
gagcagactgaggagggcaaacatt

SEQ ID NO: 339444 - DNA, 25 bp, Rattus norvegicus
gagcagactgcacttcagctagccc

SEQ ID NO: 339445 - DNA, 25 bp, Rattus norvegicus
gagcagactgcagttcagctagccc

SEQ ID NO: 339446 - DNA, 25 bp, Rattus norvegicus
gagcagactgttagagacaccttct

SEQ ID NO: 339447 - DNA, 25 bp, Rattus norvegicus
gagcagactgtttgagacaccttct

SEQ ID NO: 339448 - DNA, 25 bp, Rattus norvegicus
gagcagacttgactggccgtgacct

SEQ ID NO: 339449 - DNA, 25 bp, Rattus norvegicus
gagcagacttgagtggccgtgacct

SEQ ID NO: 339450 - DNA, 25 bp, Rattus norvegicus
gagcagactttacgaactccgagca

SEQ ID NO: 339451 - DNA, 25 bp, Rattus norvegicus
gagcagactttaggaactccgagca

SEQ ID NO: 339452 - DNA, 25 bp, Rattus norvegicus
gagcagactttcacagtgtgataca

SEQ ID NO: 339453 - DNA, 25 bp, Rattus norvegicus
gagcagactttctcagtgtgataca

SEQ ID NO: 339454 - DNA, 25 bp, Rattus norvegicus
gagcagagaggacttcctgcgccaa

SEQ ID NO: 339455 - DNA, 25 bp, Rattus norvegicus
gagcagagaggagttcctgcgccaa

SEQ ID NO: 339456 - DNA, 25 bp, Rattus norvegicus
gagcagagcaaccttcccatggaag

SEQ ID NO: 339457 - DNA, 25 bp, Rattus norvegicus
gagcagagcaacgttcccatggaag

SEQ ID NO: 339458 - DNA, 25 bp, Rattus norvegicus
gagcagagcacaaaaacgacacatt

SEQ ID NO: 339459 - DNA, 25 bp, Rattus norvegicus
gagcagagcacataaacgacacatt

SEQ ID NO: 339460 - DNA, 25 bp, Rattus norvegicus
gagcagagcagtccccggatcacca

SEQ ID NO: 339461 - DNA, 25 bp, Rattus norvegicus
gagcagagcagtgcccggatcacca

SEQ ID NO: 339462 - DNA, 25 bp, Rattus norvegicus
gagcagagccacaatctccagtgaa

SEQ ID NO: 339463 - DNA, 25 bp, Rattus norvegicus
gagcagagccacctggttctgtgca

SEQ ID NO: 339464 - DNA, 25 bp, Rattus norvegicus
gagcagagccacgtggttctgtgca

SEQ ID NO: 339465 - DNA, 25 bp, Rattus norvegicus
gagcagagccactatctccagtgaa

SEQ ID NO: 339466 - DNA, 25 bp, Rattus norvegicus
gagcagagccagcttctcagacagg

SEQ ID NO: 339467 - DNA, 25 bp, Rattus norvegicus
gagcagagccaggttctcagacagg

SEQ ID NO: 339468 - DNA, 25 bp, Rattus norvegicus
gagcagagcctgcagcttttagtaa

SEQ ID NO: 339469 - DNA, 25 bp, Rattus norvegicus
gagcagagcctggagcttttagtaa

SEQ ID NO: 339470 - DNA, 25 bp, Rattus norvegicus
gagcagagcgttatgggattgcata

SEQ ID NO: 339471 - DNA, 25 bp, Rattus norvegicus
gagcagagcgttttgggattgcata

SEQ ID NO: 339472 - DNA, 25 bp, Rattus norvegicus
gagcagagctagactcagcagtaga

SEQ ID NO: 339473 - DNA, 25 bp, Rattus norvegicus
gagcagagctagtctcagcagtaga

SEQ ID NO: 339474 - DNA, 25 bp, Rattus norvegicus
gagcagagctcaattgtcctcaagt

SEQ ID NO: 339475 - DNA, 25 bp, Rattus norvegicus
gagcagagctcatttgtcctcaagt

SEQ ID NO: 339476 - DNA, 25 bp, Rattus norvegicus
gagcagaggcacagacaggagatcc

SEQ ID NO: 339477 - DNA, 25 bp, Rattus norvegicus
gagcagaggcactgacaggagatcc

SEQ ID NO: 339478 - DNA, 25 bp, Rattus norvegicus
gagcagaggctcaccttatagagaa

SEQ ID NO: 339479 - DNA, 25 bp, Rattus norvegicus
gagcagaggctctccttatagagaa

SEQ ID NO: 339480 - DNA, 25 bp, Rattus norvegicus
gagcagagggaacctgaactccaga

SEQ ID NO: 339481 - DNA, 25 bp, Rattus norvegicus
gagcagagggaagctgaactccaga

SEQ ID NO: 339482 - DNA, 25 bp, Rattus norvegicus
gagcagagtcctaggttttattcat

SEQ ID NO: 339483 - DNA, 25 bp, Rattus norvegicus
gagcagagtccttggttttattcat

SEQ ID NO: 339484 - DNA, 25 bp, Rattus norvegicus
gagcagagtgatccagcgcaacagt

SEQ ID NO: 339485 - DNA, 25 bp, Rattus norvegicus
gagcagagtgatgcagcgcaacagt

SEQ ID NO: 339486 - DNA, 25 bp, Rattus norvegicus
gagcagagttttcacactctcactg

SEQ ID NO: 339487 - DNA, 25 bp, Rattus norvegicus
gagcagagttttgacactctcactg

SEQ ID NO: 339488 - DNA, 25 bp, Rattus norvegicus
gagcagatacacactcttacattct

SEQ ID NO: 339489 - DNA, 25 bp, Rattus norvegicus
gagcagatacactctcttacattct

SEQ ID NO: 339490 - DNA, 25 bp, Rattus norvegicus
gagcagatacctcggacagccttca

SEQ ID NO: 339491 - DNA, 25 bp, Rattus norvegicus
gagcagatacctgggacagccttca

SEQ ID NO: 339492 - DNA, 25 bp, Rattus norvegicus
gagcagatacgaatttggcagcaaa

SEQ ID NO: 339493 - DNA, 25 bp, Rattus norvegicus
gagcagatacgattttggcagcaaa

SEQ ID NO: 339494 - DNA, 25 bp, Rattus norvegicus
gagcagatactgaccctccaagtgt

SEQ ID NO: 339495 - DNA, 25 bp, Rattus norvegicus
gagcagatactgtccctccaagtgt

SEQ ID NO: 339496 - DNA, 25 bp, Rattus norvegicus
gagcagataggcctgatgcccacag

SEQ ID NO: 339497 - DNA, 25 bp, Rattus norvegicus
gagcagataggcgtgatgcccacag

SEQ ID NO: 339498 - DNA, 25 bp, Rattus norvegicus
gagcagatattgaatgcctctctat

SEQ ID NO: 339499 - DNA, 25 bp, Rattus norvegicus
gagcagatattgtatgcctctctat

SEQ ID NO: 339500 - DNA, 25 bp, Rattus norvegicus
gagcagatcaagcagggaactttcc

SEQ ID NO: 339501 - DNA, 25 bp, Rattus norvegicus
gagcagatcaaggagggaactttcc

SEQ ID NO: 339502 - DNA, 25 bp, Rattus norvegicus
gagcagatccataagtttgcccagt

SEQ ID NO: 339503 - DNA, 25 bp, Rattus norvegicus
gagcagatccattagtttgcccagt

SEQ ID NO: 339504 - DNA, 25 bp, Rattus norvegicus
gagcagatcccgctgaaaggcaagc

SEQ ID NO: 339505 - DNA, 25 bp, Rattus norvegicus
gagcagatcccggtgaaaggcaagc

SEQ ID NO: 339506 - DNA, 25 bp, Rattus norvegicus
gagcagatcgctcttgctagtgcaa

SEQ ID NO: 339507 - DNA, 25 bp, Rattus norvegicus
gagcagatcgctgttgctagtgcaa

SEQ ID NO: 339508 - DNA, 25 bp, Rattus norvegicus
gagcagatctttccaaatcgtctat

SEQ ID NO: 339509 - DNA, 25 bp, Rattus norvegicus
gagcagatctttgcaaatcgtctat

SEQ ID NO: 339510 - DNA, 25 bp, Rattus norvegicus
gagcagatgacgacaggagccccac

SEQ ID NO: 339511 - DNA, 25 bp, Rattus norvegicus
gagcagatgacgtcaggagccccac

SEQ ID NO: 339512 - DNA, 25 bp, Rattus norvegicus
gagcagatgatcagccccgaacaag

SEQ ID NO: 339513 - DNA, 25 bp, Rattus norvegicus
gagcagatgatctgccccgaacaag

SEQ ID NO: 339514 - DNA, 25 bp, Rattus norvegicus
gagcagatgtcacgtggttacccag

SEQ ID NO: 339515 - DNA, 25 bp, Rattus norvegicus
gagcagatgtcaggtggttacccag

SEQ ID NO: 339516 - DNA, 25 bp, Rattus norvegicus
gagcagatgtctagttctcacagac

SEQ ID NO: 339517 - DNA, 25 bp, Rattus norvegicus
gagcagatgtctcatttccgtaaac

SEQ ID NO: 339518 - DNA, 25 bp, Rattus norvegicus
gagcagatgtctgatttccgtaaac

SEQ ID NO: 339519 - DNA, 25 bp, Rattus norvegicus
gagcagatgtcttgttctcacagac

SEQ ID NO: 339520 - DNA, 25 bp, Rattus norvegicus
gagcagattagtaaccgggtcccag

SEQ ID NO: 339521 - DNA, 25 bp, Rattus norvegicus
gagcagattagttaccgggtcccag

SEQ ID NO: 339522 - DNA, 25 bp, Rattus norvegicus
gagcagattcaaccactggcctggc

SEQ ID NO: 339523 - DNA, 25 bp, Rattus norvegicus
gagcagattcaagcactggcctggc

SEQ ID NO: 339524 - DNA, 25 bp, Rattus norvegicus
gagcagattccaaagacgttccaat

SEQ ID NO: 339525 - DNA, 25 bp, Rattus norvegicus
gagcagattccatagacgttccaat

SEQ ID NO: 339526 - DNA, 25 bp, Rattus norvegicus
gagcagattcctcaccttttcaaag

SEQ ID NO: 339527 - DNA, 25 bp, Rattus norvegicus
gagcagattcctgaccttttcaaag

SEQ ID NO: 339528 - DNA, 25 bp, Rattus norvegicus
gagcagattctcaatggacacaagt

SEQ ID NO: 339529 - DNA, 25 bp, Rattus norvegicus
gagcagattctctatggacacaagt

SEQ ID NO: 339530 - DNA, 25 bp, Rattus norvegicus
gagcagattgccaatgccatgcaga

SEQ ID NO: 339531 - DNA, 25 bp, Rattus norvegicus
gagcagattgcctatgccatgcaga

SEQ ID NO: 339532 - DNA, 25 bp, Rattus norvegicus
gagcagatttatcacctacaggaac

SEQ ID NO: 339533 - DNA, 25 bp, Rattus norvegicus
gagcagatttatgacctacaggaac

SEQ ID NO: 339534 - DNA, 25 bp, Rattus norvegicus
gagcagatttccaaaggccactgtt

SEQ ID NO: 339535 - DNA, 25 bp, Rattus norvegicus
gagcagatttccagtgtttccagca

SEQ ID NO: 339536 - DNA, 25 bp, Rattus norvegicus
gagcagatttcctaaggccactgtt

SEQ ID NO: 339537 - DNA, 25 bp, Rattus norvegicus
gagcagatttcctgtgtttccagca

SEQ ID NO: 339538 - DNA, 25 bp, Rattus norvegicus
gagcagcaaaggctgtacattttac

SEQ ID NO: 339539 - DNA, 25 bp, Rattus norvegicus
gagcagcaaagggtgtacattttac

SEQ ID NO: 339540 - DNA, 25 bp, Rattus norvegicus
gagcagcaaccaacagagagtcaga

SEQ ID NO: 339541 - DNA, 25 bp, Rattus norvegicus
gagcagcaaccatcagagagtcaga

SEQ ID NO: 339542 - DNA, 25 bp, Rattus norvegicus
gagcagcaactaccaccatcagtgg

SEQ ID NO: 339543 - DNA, 25 bp, Rattus norvegicus
gagcagcaactagcaccatcagtgg

SEQ ID NO: 339544 - DNA, 25 bp, Rattus norvegicus
gagcagcaagatcgcccaggacgct

SEQ ID NO: 339545 - DNA, 25 bp, Rattus norvegicus
gagcagcaagatggcccaggacgct

SEQ ID NO: 339546 - DNA, 25 bp, Rattus norvegicus
gagcagcaagcaagcaacatgcatg

SEQ ID NO: 339547 - DNA, 25 bp, Rattus norvegicus
gagcagcaagcatgcaacatgcatg

SEQ ID NO: 339548 - DNA, 25 bp, Rattus norvegicus
gagcagcaagcgactcatgtttgag

SEQ ID NO: 339549 - DNA, 25 bp, Rattus norvegicus
gagcagcaagcgtctcatgtttgag

SEQ ID NO: 339550 - DNA, 25 bp, Rattus norvegicus
gagcagcaattcactctcacatgta

SEQ ID NO: 339551 - DNA, 25 bp, Rattus norvegicus
gagcagcaattctctctcacatgta

SEQ ID NO: 339552 - DNA, 25 bp, Rattus norvegicus
gagcagcacagcatgtccttgtaga

SEQ ID NO: 339553 - DNA, 25 bp, Rattus norvegicus
gagcagcacagcttgtccttgtaga

SEQ ID NO: 339554 - DNA, 25 bp, Rattus norvegicus
gagcagcacataagtgtagtcagta

SEQ ID NO: 339555 - DNA, 25 bp, Rattus norvegicus
gagcagcacatatgtgtagtcagta

SEQ ID NO: 339556 - DNA, 25 bp, Rattus norvegicus
gagcagcacgttcaactcccaggaa

SEQ ID NO: 339557 - DNA, 25 bp, Rattus norvegicus
gagcagcacgttgaactcccaggaa

SEQ ID NO: 339558 - DNA, 25 bp, Rattus norvegicus
gagcagcactgacccgtgtgtataa

SEQ ID NO: 339559 - DNA, 25 bp, Rattus norvegicus
gagcagcactgagccgtgtgtataa

SEQ ID NO: 339560 - DNA, 25 bp, Rattus norvegicus
gagcagcactgtatgtgatgcgctt

SEQ ID NO: 339561 - DNA, 25 bp, Rattus norvegicus
gagcagcactgtttgtgatgcgctt

SEQ ID NO: 339562 - DNA, 25 bp, Rattus norvegicus
gagcagcactttcgacatttgtttt

SEQ ID NO: 339563 - DNA, 25 bp, Rattus norvegicus
gagcagcactttggacatttgtttt

SEQ ID NO: 339564 - DNA, 25 bp, Rattus norvegicus
gagcagcagagcacctacactgcca

SEQ ID NO: 339565 - DNA, 25 bp, Rattus norvegicus
gagcagcagagcagtgggtcccctc

SEQ ID NO: 339566 - DNA, 25 bp, Rattus norvegicus
gagcagcagagctcctacactgcca

SEQ ID NO: 339567 - DNA, 25 bp, Rattus norvegicus
gagcagcagagctgtgggtcccctc

SEQ ID NO: 339568 - DNA, 25 bp, Rattus norvegicus
gagcagcagcaacaatacacgggac

SEQ ID NO: 339569 - DNA, 25 bp, Rattus norvegicus
gagcagcagcaagaatacacgggac

SEQ ID NO: 339570 - DNA, 25 bp, Rattus norvegicus
gagcagcagcccagaactctgaggt

SEQ ID NO: 339571 - DNA, 25 bp, Rattus norvegicus
gagcagcagccctgaactctgaggt

SEQ ID NO: 339572 - DNA, 25 bp, Rattus norvegicus
gagcagcagctcaaggtttctaatc

SEQ ID NO: 339573 - DNA, 25 bp, Rattus norvegicus
gagcagcagctccagtaacagtctc

SEQ ID NO: 339574 - DNA, 25 bp, Rattus norvegicus
gagcagcagctcgagtaacagtctc

SEQ ID NO: 339575 - DNA, 25 bp, Rattus norvegicus
gagcagcagctctaggtttctaatc

SEQ ID NO: 339576 - DNA, 25 bp, Rattus norvegicus
gagcagcaggccagcctcggaaatg

SEQ ID NO: 339577 - DNA, 25 bp, Rattus norvegicus
gagcagcaggcctgcctcggaaatg

SEQ ID NO: 339578 - DNA, 25 bp, Rattus norvegicus
gagcagcagggtaactgcccaggaa

SEQ ID NO: 339579 - DNA, 25 bp, Rattus norvegicus
gagcagcagggttactgcccaggaa

SEQ ID NO: 339580 - DNA, 25 bp, Rattus norvegicus
gagcagcaggtgagaactaatattt

SEQ ID NO: 339581 - DNA, 25 bp, Rattus norvegicus
gagcagcaggtgtgaactaatattt

SEQ ID NO: 339582 - DNA, 25 bp, Rattus norvegicus
gagcagcagtcaacagaaccaccag

SEQ ID NO: 339583 - DNA, 25 bp, Rattus norvegicus
gagcagcagtcaccccaatggacga

SEQ ID NO: 339584 - DNA, 25 bp, Rattus norvegicus
gagcagcagtcagcccaatggacga

SEQ ID NO: 339585 - DNA, 25 bp, Rattus norvegicus
gagcagcagtcatcagaaccaccag

SEQ ID NO: 339586 - DNA, 25 bp, Rattus norvegicus
gagcagcagtgacagcttcaggcct

SEQ ID NO: 339587 - DNA, 25 bp, Rattus norvegicus
gagcagcagtgagagcttcaggcct

SEQ ID NO: 339588 - DNA, 25 bp, Rattus norvegicus
gagcagcagtgtaattcccatttta

SEQ ID NO: 339589 - DNA, 25 bp, Rattus norvegicus
gagcagcagtgttattcccatttta

SEQ ID NO: 339590 - DNA, 25 bp, Rattus norvegicus
gagcagcataatcccaggcagcggt

SEQ ID NO: 339591 - DNA, 25 bp, Rattus norvegicus
gagcagcataatgccaggcagcggt

SEQ ID NO: 339592 - DNA, 25 bp, Rattus norvegicus
gagcagcatgctatgagtcacacac

SEQ ID NO: 339593 - DNA, 25 bp, Rattus norvegicus
gagcagcatgctttgagtcacacac

SEQ ID NO: 339594 - DNA, 25 bp, Rattus norvegicus
gagcagcatgttctaaccctgactg

SEQ ID NO: 339595 - DNA, 25 bp, Rattus norvegicus
gagcagcatgttgtaaccctgactg

SEQ ID NO: 339596 - DNA, 25 bp, Rattus norvegicus
gagcagcattatattcatcttcact

SEQ ID NO: 339597 - DNA, 25 bp, Rattus norvegicus
gagcagcattattttcatcttcact

SEQ ID NO: 339598 - DNA, 25 bp, Rattus norvegicus
gagcagccacagaccagaagtcaga

SEQ ID NO: 339599 - DNA, 25 bp, Rattus norvegicus
gagcagccacagctagatgaggtca

SEQ ID NO: 339600 - DNA, 25 bp, Rattus norvegicus
gagcagccacaggtagatgaggtca

SEQ ID NO: 339601 - DNA, 25 bp, Rattus norvegicus
gagcagccacagtccagaagtcaga

SEQ ID NO: 339602 - DNA, 25 bp, Rattus norvegicus
gagcagccaggacgtttaaccactg

SEQ ID NO: 339603 - DNA, 25 bp, Rattus norvegicus
gagcagccaggaggtttaaccactg

SEQ ID NO: 339604 - DNA, 25 bp, Rattus norvegicus
gagcagccagtaccttccagagaca

SEQ ID NO: 339605 - DNA, 25 bp, Rattus norvegicus
gagcagccagtagcttccagagaca

SEQ ID NO: 339606 - DNA, 25 bp, Rattus norvegicus
gagcagccatcaacccttacgattg

SEQ ID NO: 339607 - DNA, 25 bp, Rattus norvegicus
gagcagccatcatcccttacgattg

SEQ ID NO: 339608 - DNA, 25 bp, Rattus norvegicus
gagcagccatttaaaagtgacacct

SEQ ID NO: 339609 - DNA, 25 bp, Rattus norvegicus
gagcagccattttaaagtgacacct

SEQ ID NO: 339610 - DNA, 25 bp, Rattus norvegicus
gagcagcccagaaaaaacatgacaa

SEQ ID NO: 339611 - DNA, 25 bp, Rattus norvegicus
gagcagcccagataaaacatgacaa

SEQ ID NO: 339612 - DNA, 25 bp, Rattus norvegicus
gagcagccgcacctcgccgttgaga

SEQ ID NO: 339613 - DNA, 25 bp, Rattus norvegicus
gagcagccgcacgtcgccgttgaga

SEQ ID NO: 339614 - DNA, 25 bp, Rattus norvegicus
gagcagccgggcctaagcgataaca

SEQ ID NO: 339615 - DNA, 25 bp, Rattus norvegicus
gagcagccgggcgtaagcgataaca

SEQ ID NO: 339616 - DNA, 25 bp, Rattus norvegicus
gagcagcctaaaaacttgccctttt

SEQ ID NO: 339617 - DNA, 25 bp, Rattus norvegicus
gagcagcctaaatacttgccctttt

SEQ ID NO: 339618 - DNA, 25 bp, Rattus norvegicus
gagcagcctaagacatgtggtatca

SEQ ID NO: 339619 - DNA, 25 bp, Rattus norvegicus
gagcagcctaagtcatgtggtatca

SEQ ID NO: 339620 - DNA, 25 bp, Rattus norvegicus
gagcagcctaatatgaacctatgag

SEQ ID NO: 339621 - DNA, 25 bp, Rattus norvegicus
gagcagcctaatttgaacctatgag

SEQ ID NO: 339622 - DNA, 25 bp, Rattus norvegicus
gagcagcctctacaatcattctgag

SEQ ID NO: 339623 - DNA, 25 bp, Rattus norvegicus
gagcagcctctagaatcattctgag

SEQ ID NO: 339624 - DNA, 25 bp, Rattus norvegicus
gagcagcctgatcatgagccaagtg

SEQ ID NO: 339625 - DNA, 25 bp, Rattus norvegicus
gagcagcctgatgatgagccaagtg

SEQ ID NO: 339626 - DNA, 25 bp, Rattus norvegicus
gagcagcctgccaagggaactgctt

SEQ ID NO: 339627 - DNA, 25 bp, Rattus norvegicus
gagcagcctgcctagggaactgctt

SEQ ID NO: 339628 - DNA, 25 bp, Rattus norvegicus
gagcagcctggaaagcttaccacca

SEQ ID NO: 339629 - DNA, 25 bp, Rattus norvegicus
gagcagcctggatagcttaccacca

SEQ ID NO: 339630 - DNA, 25 bp, Rattus norvegicus
gagcagccttagaccaaatgttgta

SEQ ID NO: 339631 - DNA, 25 bp, Rattus norvegicus
gagcagccttagtccaaatgttgta

SEQ ID NO: 339632 - DNA, 25 bp, Rattus norvegicus
gagcagccttggagaccaccagaaa

SEQ ID NO: 339633 - DNA, 25 bp, Rattus norvegicus
gagcagccttggtgaccaccagaaa

SEQ ID NO: 339634 - DNA, 25 bp, Rattus norvegicus
gagcagcctttccagaaacgttcat

SEQ ID NO: 339635 - DNA, 25 bp, Rattus norvegicus
gagcagcctttccagggatgagaaa

SEQ ID NO: 339636 - DNA, 25 bp, Rattus norvegicus
gagcagcctttcgagaaacgttcat

SEQ ID NO: 339637 - DNA, 25 bp, Rattus norvegicus
gagcagcctttcgagggatgagaaa

SEQ ID NO: 339638 - DNA, 25 bp, Rattus norvegicus
gagcagcgaaagactgtctttgacc

SEQ ID NO: 339639 - DNA, 25 bp, Rattus norvegicus
gagcagcgaaagtctgtctttgacc

SEQ ID NO: 339640 - DNA, 25 bp, Rattus norvegicus
gagcagcgcagcatagccccgcgtc

SEQ ID NO: 339641 - DNA, 25 bp, Rattus norvegicus
gagcagcgcagcttagccccgcgtc

SEQ ID NO: 339642 - DNA, 25 bp, Rattus norvegicus
gagcagcgcagtctgaatctgccca

SEQ ID NO: 339643 - DNA, 25 bp, Rattus norvegicus
gagcagcgcagtgtgaatctgccca

SEQ ID NO: 339644 - DNA, 25 bp, Rattus norvegicus
gagcagcgcattcttaatcacggaa

SEQ ID NO: 339645 - DNA, 25 bp, Rattus norvegicus
gagcagcgcattgttaatcacggaa

SEQ ID NO: 339646 - DNA, 25 bp, Rattus norvegicus
gagcagcgcttcataaagtctattg

SEQ ID NO: 339647 - DNA, 25 bp, Rattus norvegicus
gagcagcgcttcttaaagtctattg

SEQ ID NO: 339648 - DNA, 25 bp, Rattus norvegicus
gagcagcggaggaatatacttattt

SEQ ID NO: 339649 - DNA, 25 bp, Rattus norvegicus
gagcagcggaggtatatacttattt

SEQ ID NO: 339650 - DNA, 25 bp, Rattus norvegicus
gagcagcggcatcgcacatcagata

SEQ ID NO: 339651 - DNA, 25 bp, Rattus norvegicus
gagcagcggcatggcacatcagata

SEQ ID NO: 339652 - DNA, 25 bp, Rattus norvegicus
gagcagcggcctctctgttaatgac

SEQ ID NO: 339653 - DNA, 25 bp, Rattus norvegicus
gagcagcggcctgtctgttaatgac

SEQ ID NO: 339654 - DNA, 25 bp, Rattus norvegicus
gagcagcggctacaacacatcatga

SEQ ID NO: 339655 - DNA, 25 bp, Rattus norvegicus
gagcagcggctagaacacatcatga

SEQ ID NO: 339656 - DNA, 25 bp, Rattus norvegicus
gagcagcgggagctttgtccccaca

SEQ ID NO: 339657 - DNA, 25 bp, Rattus norvegicus
gagcagcgggaggtttgtccccaca

SEQ ID NO: 339658 - DNA, 25 bp, Rattus norvegicus
gagcagcgggcgactcgtcttcttc

SEQ ID NO: 339659 - DNA, 25 bp, Rattus norvegicus
gagcagcgggcgtctcgtcttcttc

SEQ ID NO: 339660 - DNA, 25 bp, Rattus norvegicus
gagcagcggtgcctatctccggcaa

SEQ ID NO: 339661 - DNA, 25 bp, Rattus norvegicus
gagcagcggtgcgtatctccggcaa

SEQ ID NO: 339662 - DNA, 25 bp, Rattus norvegicus
gagcagcgtcacaatactggacctc

SEQ ID NO: 339663 - DNA, 25 bp, Rattus norvegicus
gagcagcgtcactatactggacctc

SEQ ID NO: 339664 - DNA, 25 bp, Rattus norvegicus
gagcagctaaagctcacgtgtctac

SEQ ID NO: 339665 - DNA, 25 bp, Rattus norvegicus
gagcagctaaaggtcacgtgtctac

SEQ ID NO: 339666 - DNA, 25 bp, Rattus norvegicus
gagcagctaataagcctcaccttac

SEQ ID NO: 339667 - DNA, 25 bp, Rattus norvegicus
gagcagctaatatgcctcaccttac

SEQ ID NO: 339668 - DNA, 25 bp, Rattus norvegicus
gagcagctcaaacatgtatatcttc

SEQ ID NO: 339669 - DNA, 25 bp, Rattus norvegicus
gagcagctcaaagatgtatatcttc

SEQ ID NO: 339670 - DNA, 25 bp, Rattus norvegicus
gagcagctccagactcaagacagga

SEQ ID NO: 339671 - DNA, 25 bp, Rattus norvegicus
gagcagctccagtctcaagacagga

SEQ ID NO: 339672 - DNA, 25 bp, Rattus norvegicus
gagcagctccttcagagaacacttt

SEQ ID NO: 339673 - DNA, 25 bp, Rattus norvegicus
gagcagctccttgagagaacacttt

SEQ ID NO: 339674 - DNA, 25 bp, Rattus norvegicus
gagcagctctcaagcgtgaacggga

SEQ ID NO: 339675 - DNA, 25 bp, Rattus norvegicus
gagcagctctcatgcgtgaacggga

SEQ ID NO: 339676 - DNA, 25 bp, Rattus norvegicus
gagcagctctgaaacctacaagggc

SEQ ID NO: 339677 - DNA, 25 bp, Rattus norvegicus
gagcagctctgatacctacaagggc

SEQ ID NO: 339678 - DNA, 25 bp, Rattus norvegicus
gagcagctctggacatggatcttag

SEQ ID NO: 339679 - DNA, 25 bp, Rattus norvegicus
gagcagctctggctattggtgttcc

SEQ ID NO: 339680 - DNA, 25 bp, Rattus norvegicus
gagcagctctgggtattggtgttcc

SEQ ID NO: 339681 - DNA, 25 bp, Rattus norvegicus
gagcagctctggtcatggatcttag

SEQ ID NO: 339682 - DNA, 25 bp, Rattus norvegicus
gagcagctctttcttctaaatacga

SEQ ID NO: 339683 - DNA, 25 bp, Rattus norvegicus
gagcagctctttgttctaaatacga

SEQ ID NO: 339684 - DNA, 25 bp, Rattus norvegicus
gagcagctgaggagccaattatgaa

SEQ ID NO: 339685 - DNA, 25 bp, Rattus norvegicus
gagcagctgaggtgccaattatgaa

SEQ ID NO: 339686 - DNA, 25 bp, Rattus norvegicus
gagcagctgagtactccaggagaca

SEQ ID NO: 339687 - DNA, 25 bp, Rattus norvegicus
gagcagctgagttctccaggagaca

SEQ ID NO: 339688 - DNA, 25 bp, Rattus norvegicus
gagcagctgcacactaagggtcgtc

SEQ ID NO: 339689 - DNA, 25 bp, Rattus norvegicus
gagcagctgcactctaagggtcgtc

SEQ ID NO: 339690 - DNA, 25 bp, Rattus norvegicus
gagcagctgcagcacttgataacgc

SEQ ID NO: 339691 - DNA, 25 bp, Rattus norvegicus
gagcagctgcaggacttgataacgc

SEQ ID NO: 339692 - DNA, 25 bp, Rattus norvegicus
gagcagctgctgattcacggagtcc

SEQ ID NO: 339693 - DNA, 25 bp, Rattus norvegicus
gagcagctgctgtttcacggagtcc

SEQ ID NO: 339694 - DNA, 25 bp, Rattus norvegicus
gagcagctgcttacctgacagagaa

SEQ ID NO: 339695 - DNA, 25 bp, Rattus norvegicus
gagcagctgcttattactgtggcat

SEQ ID NO: 339696 - DNA, 25 bp, Rattus norvegicus
gagcagctgctttcctgacagagaa

SEQ ID NO: 339697 - DNA, 25 bp, Rattus norvegicus
gagcagctgctttttactgtggcat

SEQ ID NO: 339698 - DNA, 25 bp, Rattus norvegicus
gagcagctggaaaatcgtcttgaga

SEQ ID NO: 339699 - DNA, 25 bp, Rattus norvegicus
gagcagctggaatatcgtcttgaga

SEQ ID NO: 339700 - DNA, 25 bp, Rattus norvegicus
gagcagctggacagagaccggacct

SEQ ID NO: 339701 - DNA, 25 bp, Rattus norvegicus
gagcagctggacagtgcttgtcact

SEQ ID NO: 339702 - DNA, 25 bp, Rattus norvegicus
gagcagctggactgagaccggacct

SEQ ID NO: 339703 - DNA, 25 bp, Rattus norvegicus
gagcagctggactgtgcttgtcact

SEQ ID NO: 339704 - DNA, 25 bp, Rattus norvegicus
gagcagctggccaatgagcgactcc

SEQ ID NO: 339705 - DNA, 25 bp, Rattus norvegicus
gagcagctggcctatgagcgactcc

SEQ ID NO: 339706 - DNA, 25 bp, Rattus norvegicus
gagcagctgggtatgtacctgcagc

SEQ ID NO: 339707 - DNA, 25 bp, Rattus norvegicus
gagcagctgggtttgtacctgcagc

SEQ ID NO: 339708 - DNA, 25 bp, Rattus norvegicus
gagcagctgtcaacacaatgtacat

SEQ ID NO: 339709 - DNA, 25 bp, Rattus norvegicus
gagcagctgtcatcacaatgtacat

SEQ ID NO: 339710 - DNA, 25 bp, Rattus norvegicus
gagcagcttaatctgtctgtctcca

SEQ ID NO: 339711 - DNA, 25 bp, Rattus norvegicus
gagcagcttaatgtgtctgtctcca

SEQ ID NO: 339712 - DNA, 25 bp, Rattus norvegicus
gagcagcttacaatttttatacaga

SEQ ID NO: 339713 - DNA, 25 bp, Rattus norvegicus
gagcagcttacattttttatacaga

SEQ ID NO: 339714 - DNA, 25 bp, Rattus norvegicus
gagcagcttactcgtgtcgcagagc

SEQ ID NO: 339715 - DNA, 25 bp, Rattus norvegicus
gagcagcttactggtgtcgcagagc

SEQ ID NO: 339716 - DNA, 25 bp, Rattus norvegicus
gagcagcttaggcaccaaggcaaga

SEQ ID NO: 339717 - DNA, 25 bp, Rattus norvegicus
gagcagcttagggaccaaggcaaga

SEQ ID NO: 339718 - DNA, 25 bp, Rattus norvegicus
gagcagcttctgatataaggacaca

SEQ ID NO: 339719 - DNA, 25 bp, Rattus norvegicus
gagcagcttctgttataaggacaca

SEQ ID NO: 339720 - DNA, 25 bp, Rattus norvegicus
gagcagcttgagcttcacagtgagc

SEQ ID NO: 339721 - DNA, 25 bp, Rattus norvegicus
gagcagcttgaggttcacagtgagc

SEQ ID NO: 339722 - DNA, 25 bp, Rattus norvegicus
gagcagcttgtactgtcaccataag

SEQ ID NO: 339723 - DNA, 25 bp, Rattus norvegicus
gagcagcttgtagtgtcaccataag

SEQ ID NO: 339724 - DNA, 25 bp, Rattus norvegicus
gagcagctttagcacgggcagccat

SEQ ID NO: 339725 - DNA, 25 bp, Rattus norvegicus
gagcagctttaggacgggcagccat

SEQ ID NO: 339726 - DNA, 25 bp, Rattus norvegicus
gagcagctttcactcgtcagtaatg

SEQ ID NO: 339727 - DNA, 25 bp, Rattus norvegicus
gagcagctttcagtcgtcagtaatg

SEQ ID NO: 339728 - DNA, 25 bp, Rattus norvegicus
gagcagctttgccaaactctcatgg

SEQ ID NO: 339729 - DNA, 25 bp, Rattus norvegicus
gagcagctttgcgaaactctcatgg

SEQ ID NO: 339730 - DNA, 25 bp, Rattus norvegicus
gagcagctttttaaaccgcaaatca

SEQ ID NO: 339731 - DNA, 25 bp, Rattus norvegicus
gagcagcttttttaaccgcaaatca

SEQ ID NO: 339732 - DNA, 25 bp, Rattus norvegicus
gagcaggaaagacctgcttcctttt

SEQ ID NO: 339733 - DNA, 25 bp, Rattus norvegicus
gagcaggaaagagctgcttcctttt

SEQ ID NO: 339734 - DNA, 25 bp, Rattus norvegicus
gagcaggaactgcttcccacaggtt

SEQ ID NO: 339735 - DNA, 25 bp, Rattus norvegicus
gagcaggaactggttcccacaggtt

SEQ ID NO: 339736 - DNA, 25 bp, Rattus norvegicus
gagcaggaagtgagctacaacataa

SEQ ID NO: 339737 - DNA, 25 bp, Rattus norvegicus
gagcaggaagtgtgctacaacataa

SEQ ID NO: 339738 - DNA, 25 bp, Rattus norvegicus
gagcaggaatcaacacgcatccgaa

SEQ ID NO: 339739 - DNA, 25 bp, Rattus norvegicus
gagcaggaatcatcacgcatccgaa

SEQ ID NO: 339740 - DNA, 25 bp, Rattus norvegicus
gagcaggacacaccagcagctggtt

SEQ ID NO: 339741 - DNA, 25 bp, Rattus norvegicus
gagcaggacacagcagcagctggtt

SEQ ID NO: 339742 - DNA, 25 bp, Rattus norvegicus
gagcaggaccggattacggacatca

SEQ ID NO: 339743 - DNA, 25 bp, Rattus norvegicus
gagcaggaccggtttacggacatca

SEQ ID NO: 339744 - DNA, 25 bp, Rattus norvegicus
gagcaggacctgactcagaacagca

SEQ ID NO: 339745 - DNA, 25 bp, Rattus norvegicus
gagcaggacctgtctcagaacagca

SEQ ID NO: 339746 - DNA, 25 bp, Rattus norvegicus
gagcaggaccttatgtactcggtga

SEQ ID NO: 339747 - DNA, 25 bp, Rattus norvegicus
gagcaggaccttttgtactcggtga

SEQ ID NO: 339748 - DNA, 25 bp, Rattus norvegicus
gagcaggacgacagtgcccttggcc

SEQ ID NO: 339749 - DNA, 25 bp, Rattus norvegicus
gagcaggacgactgtgcccttggcc

SEQ ID NO: 339750 - DNA, 25 bp, Rattus norvegicus
gagcaggacgagcacgccagcaaaa

SEQ ID NO: 339751 - DNA, 25 bp, Rattus norvegicus
gagcaggacgaggacgccagcaaaa

SEQ ID NO: 339752 - DNA, 25 bp, Rattus norvegicus
gagcaggactcacatcagcaagcgc

SEQ ID NO: 339753 - DNA, 25 bp, Rattus norvegicus
gagcaggactcagatcagcaagcgc

SEQ ID NO: 339754 - DNA, 25 bp, Rattus norvegicus
gagcaggactgcaccatgttacatt

SEQ ID NO: 339755 - DNA, 25 bp, Rattus norvegicus
gagcaggactgctccatgttacatt

SEQ ID NO: 339756 - DNA, 25 bp, Rattus norvegicus
gagcaggactttcttgcgatcaaca

SEQ ID NO: 339757 - DNA, 25 bp, Rattus norvegicus
gagcaggactttgttgcgatcaaca

SEQ ID NO: 339758 - DNA, 25 bp, Rattus norvegicus
gagcaggagaacagactctgtccct

SEQ ID NO: 339759 - DNA, 25 bp, Rattus norvegicus
gagcaggagaactgactctgtccct

SEQ ID NO: 339760 - DNA, 25 bp, Rattus norvegicus
gagcaggagacccagcgtcacaaga

SEQ ID NO: 339761 - DNA, 25 bp, Rattus norvegicus
gagcaggagaccgagcgtcacaaga

SEQ ID NO: 339762 - DNA, 25 bp, Rattus norvegicus
gagcaggagcaaagccagccatgga

SEQ ID NO: 339763 - DNA, 25 bp, Rattus norvegicus
gagcaggagcaatgccagccatgga

SEQ ID NO: 339764 - DNA, 25 bp, Rattus norvegicus
gagcaggagcacactaagtcttgtt

SEQ ID NO: 339765 - DNA, 25 bp, Rattus norvegicus
gagcaggagcactctaagtcttgtt

SEQ ID NO: 339766 - DNA, 25 bp, Rattus norvegicus
gagcaggagccaccaaaccagccag

SEQ ID NO: 339767 - DNA, 25 bp, Rattus norvegicus
gagcaggagccagcaaaccagccag

SEQ ID NO: 339768 - DNA, 25 bp, Rattus norvegicus
gagcaggaggacatggactttctct

SEQ ID NO: 339769 - DNA, 25 bp, Rattus norvegicus
gagcaggaggacttggactttctct

SEQ ID NO: 339770 - DNA, 25 bp, Rattus norvegicus
gagcaggagtctctggcattaccct

SEQ ID NO: 339771 - DNA, 25 bp, Rattus norvegicus
gagcaggagtctgtggcattaccct

SEQ ID NO: 339772 - DNA, 25 bp, Rattus norvegicus
gagcaggatccacagagcacccaat

SEQ ID NO: 339773 - DNA, 25 bp, Rattus norvegicus
gagcaggatccagagagcacccaat

SEQ ID NO: 339774 - DNA, 25 bp, Rattus norvegicus
gagcaggattctatttaaaaccatt

SEQ ID NO: 339775 - DNA, 25 bp, Rattus norvegicus
gagcaggattctcggaccacctcaa

SEQ ID NO: 339776 - DNA, 25 bp, Rattus norvegicus
gagcaggattctgggaccacctcaa

SEQ ID NO: 339777 - DNA, 25 bp, Rattus norvegicus
gagcaggattctttttaaaaccatt

SEQ ID NO: 339778 - DNA, 25 bp, Rattus norvegicus
gagcaggcagagcactgtatatata

SEQ ID NO: 339779 - DNA, 25 bp, Rattus norvegicus
gagcaggcagaggactgtatatata

SEQ ID NO: 339780 - DNA, 25 bp, Rattus norvegicus
gagcaggcataaagtcacacacctt

SEQ ID NO: 339781 - DNA, 25 bp, Rattus norvegicus
gagcaggcataatgtcacacacctt

SEQ ID NO: 339782 - DNA, 25 bp, Rattus norvegicus
gagcaggccaagcaggttccctcag

SEQ ID NO: 339783 - DNA, 25 bp, Rattus norvegicus
gagcaggccaaggaggttccctcag

SEQ ID NO: 339784 - DNA, 25 bp, Rattus norvegicus
gagcaggccatgacgccctcagaaa

SEQ ID NO: 339785 - DNA, 25 bp, Rattus norvegicus
gagcaggccatgtcgccctcagaaa

SEQ ID NO: 339786 - DNA, 25 bp, Rattus norvegicus
gagcaggcccagaacttgcaagtga

SEQ ID NO: 339787 - DNA, 25 bp, Rattus norvegicus
gagcaggcccagtacttgcaagtga

SEQ ID NO: 339788 - DNA, 25 bp, Rattus norvegicus
gagcaggccctgaagcagccgtaga

SEQ ID NO: 339789 - DNA, 25 bp, Rattus norvegicus
gagcaggccctgtagcagccgtaga

SEQ ID NO: 339790 - DNA, 25 bp, Rattus norvegicus
gagcaggcgcagagattcataccca

SEQ ID NO: 339791 - DNA, 25 bp, Rattus norvegicus
gagcaggcgcagatttttggtcctt

SEQ ID NO: 339792 - DNA, 25 bp, Rattus norvegicus
gagcaggcgcagtgattcataccca

SEQ ID NO: 339793 - DNA, 25 bp, Rattus norvegicus
gagcaggcgcagttttttggtcctt

SEQ ID NO: 339794 - DNA, 25 bp, Rattus norvegicus
gagcaggcggcacactcactgaaca

SEQ ID NO: 339795 - DNA, 25 bp, Rattus norvegicus
gagcaggcggcagactcactgaaca

SEQ ID NO: 339796 - DNA, 25 bp, Rattus norvegicus
gagcaggctcagaggtgtctaagaa

SEQ ID NO: 339797 - DNA, 25 bp, Rattus norvegicus
gagcaggctcagtggtgtctaagaa

SEQ ID NO: 339798 - DNA, 25 bp, Rattus norvegicus
gagcaggctctacgcagtctgcagt

SEQ ID NO: 339799 - DNA, 25 bp, Rattus norvegicus
gagcaggctctaggcagtctgcagt

SEQ ID NO: 339800 - DNA, 25 bp, Rattus norvegicus
gagcaggctctgatttctaggatga

SEQ ID NO: 339801 - DNA, 25 bp, Rattus norvegicus
gagcaggctctgttttctaggatga

SEQ ID NO: 339802 - DNA, 25 bp, Rattus norvegicus
gagcagggaacaattctgttcaatt

SEQ ID NO: 339803 - DNA, 25 bp, Rattus norvegicus
gagcagggaacatttctgttcaatt

SEQ ID NO: 339804 - DNA, 25 bp, Rattus norvegicus
gagcagggaagaaaggccgcttcca

SEQ ID NO: 339805 - DNA, 25 bp, Rattus norvegicus
gagcagggaagataggccgcttcca

SEQ ID NO: 339806 - DNA, 25 bp, Rattus norvegicus
gagcagggaaggacctcctttcggt

SEQ ID NO: 339807 - DNA, 25 bp, Rattus norvegicus
gagcagggaaggtcctcctttcggt

SEQ ID NO: 339808 - DNA, 25 bp, Rattus norvegicus
gagcagggaatcaatgtatcactat

SEQ ID NO: 339809 - DNA, 25 bp, Rattus norvegicus
gagcagggaatctatgtatcactat

SEQ ID NO: 339810 - DNA, 25 bp, Rattus norvegicus
gagcagggacagatgttgccattga

SEQ ID NO: 339811 - DNA, 25 bp, Rattus norvegicus
gagcagggacagttgttgccattga

SEQ ID NO: 339812 - DNA, 25 bp, Rattus norvegicus
gagcagggacatcgcatctctccgg

SEQ ID NO: 339813 - DNA, 25 bp, Rattus norvegicus
gagcagggacatggcatctctccgg

SEQ ID NO: 339814 - DNA, 25 bp, Rattus norvegicus
gagcagggacccactctgtaatgtg

SEQ ID NO: 339815 - DNA, 25 bp, Rattus norvegicus
gagcagggaccctctctgtaatgtg

SEQ ID NO: 339816 - DNA, 25 bp, Rattus norvegicus
gagcagggactcctccttcacaaac

SEQ ID NO: 339817 - DNA, 25 bp, Rattus norvegicus
gagcagggactcgtccttcacaaac

SEQ ID NO: 339818 - DNA, 25 bp, Rattus norvegicus
gagcagggatctacagagcaacttt

SEQ ID NO: 339819 - DNA, 25 bp, Rattus norvegicus
gagcagggatctacttggaggtcca

SEQ ID NO: 339820 - DNA, 25 bp, Rattus norvegicus
gagcagggatcttcagagcaacttt

SEQ ID NO: 339821 - DNA, 25 bp, Rattus norvegicus
gagcagggatcttcttggaggtcca

SEQ ID NO: 339822 - DNA, 25 bp, Rattus norvegicus
gagcagggattaatcctctagcaca

SEQ ID NO: 339823 - DNA, 25 bp, Rattus norvegicus
gagcagggattattcctctagcaca

SEQ ID NO: 339824 - DNA, 25 bp, Rattus norvegicus
gagcagggcaagcaatctctccagc

SEQ ID NO: 339825 - DNA, 25 bp, Rattus norvegicus
gagcagggcaaggaatctctccagc

SEQ ID NO: 339826 - DNA, 25 bp, Rattus norvegicus
gagcagggcctgaatattcacacat

SEQ ID NO: 339827 - DNA, 25 bp, Rattus norvegicus
gagcagggcctgtatattcacacat

SEQ ID NO: 339828 - DNA, 25 bp, Rattus norvegicus
gagcagggctcgcacagcccttcag

SEQ ID NO: 339829 - DNA, 25 bp, Rattus norvegicus
gagcagggctcggacagcccttcag

SEQ ID NO: 339830 - DNA, 25 bp, Rattus norvegicus
gagcagggctgtcaaccgacccgca

SEQ ID NO: 339831 - DNA, 25 bp, Rattus norvegicus
gagcagggctgtgaaccgacccgca

SEQ ID NO: 339832 - DNA, 25 bp, Rattus norvegicus
gagcagggtcagactccaaacaggg

SEQ ID NO: 339833 - DNA, 25 bp, Rattus norvegicus
gagcagggtcagtctccaaacaggg

SEQ ID NO: 339834 - DNA, 25 bp, Rattus norvegicus
gagcagggtctcatgcatgtgtaca

SEQ ID NO: 339835 - DNA, 25 bp, Rattus norvegicus
gagcagggtctcttgcatgtgtaca

SEQ ID NO: 339836 - DNA, 25 bp, Rattus norvegicus
gagcagggtttaaactcacatcctt

SEQ ID NO: 339837 - DNA, 25 bp, Rattus norvegicus
gagcagggtttatactcacatcctt

SEQ ID NO: 339838 - DNA, 25 bp, Rattus norvegicus
gagcaggtaatcaccatcatcgaga

SEQ ID NO: 339839 - DNA, 25 bp, Rattus norvegicus
gagcaggtaatctccatcatcgaga

SEQ ID NO: 339840 - DNA, 25 bp, Rattus norvegicus
gagcaggtctccattagagagaatc

SEQ ID NO: 339841 - DNA, 25 bp, Rattus norvegicus
gagcaggtctcctttagagagaatc

SEQ ID NO: 339842 - DNA, 25 bp, Rattus norvegicus
gagcaggtcttcaccaagtatgggc

SEQ ID NO: 339843 - DNA, 25 bp, Rattus norvegicus
gagcaggtcttctccaagtatgggc

SEQ ID NO: 339844 - DNA, 25 bp, Rattus norvegicus
gagcaggtgaaaactctcccatcat

SEQ ID NO: 339845 - DNA, 25 bp, Rattus norvegicus
gagcaggtgaaatctctcccatcat

SEQ ID NO: 339846 - DNA, 25 bp, Rattus norvegicus
gagcaggtgatcagggccctttgac

SEQ ID NO: 339847 - DNA, 25 bp, Rattus norvegicus
gagcaggtgatctgggccctttgac

SEQ ID NO: 339848 - DNA, 25 bp, Rattus norvegicus
gagcaggtgattatgccctgtccac

SEQ ID NO: 339849 - DNA, 25 bp, Rattus norvegicus
gagcaggtgattttgccctgtccac

SEQ ID NO: 339850 - DNA, 25 bp, Rattus norvegicus
gagcaggtgcatctttggtcactgt

SEQ ID NO: 339851 - DNA, 25 bp, Rattus norvegicus
gagcaggtgcatgtttggtcactgt

SEQ ID NO: 339852 - DNA, 25 bp, Rattus norvegicus
gagcaggtgctgacttaattatgtg

SEQ ID NO: 339853 - DNA, 25 bp, Rattus norvegicus
gagcaggtgctgtcttaattatgtg

SEQ ID NO: 339854 - DNA, 25 bp, Rattus norvegicus
gagcaggtggacatcacatgtttta

SEQ ID NO: 339855 - DNA, 25 bp, Rattus norvegicus
gagcaggtggacttcacatgtttta

SEQ ID NO: 339856 - DNA, 25 bp, Rattus norvegicus
gagcaggtggatcgtgtttaattct

SEQ ID NO: 339857 - DNA, 25 bp, Rattus norvegicus
gagcaggtggatggtgtttaattct

SEQ ID NO: 339858 - DNA, 25 bp, Rattus norvegicus
gagcaggtgtctccaagcctgtttt

SEQ ID NO: 339859 - DNA, 25 bp, Rattus norvegicus
gagcaggtgtctgcaagcctgtttt

SEQ ID NO: 339860 - DNA, 25 bp, Rattus norvegicus
gagcaggttaacaaacctccctggc

SEQ ID NO: 339861 - DNA, 25 bp, Rattus norvegicus
gagcaggttaactaacctccctggc

SEQ ID NO: 339862 - DNA, 25 bp, Rattus norvegicus
gagcaggttacaacatgcccatgaa

SEQ ID NO: 339863 - DNA, 25 bp, Rattus norvegicus
gagcaggttacatcatgcccatgaa

SEQ ID NO: 339864 - DNA, 25 bp, Rattus norvegicus
gagcaggttatcactccacatggct

SEQ ID NO: 339865 - DNA, 25 bp, Rattus norvegicus
gagcaggttatctctccacatggct

SEQ ID NO: 339866 - DNA, 25 bp, Rattus norvegicus
gagcaggttgctatggtctacagac

SEQ ID NO: 339867 - DNA, 25 bp, Rattus norvegicus
gagcaggttgctttggtctacagac

SEQ ID NO: 339868 - DNA, 25 bp, Rattus norvegicus
gagcaggtttttcaattctacttat

SEQ ID NO: 339869 - DNA, 25 bp, Rattus norvegicus
gagcaggtttttgaattctacttat

SEQ ID NO: 339870 - DNA, 25 bp, Rattus norvegicus
gagcagtaagtcctggaacccaaca

SEQ ID NO: 339871 - DNA, 25 bp, Rattus norvegicus
gagcagtaagtcgtggaacccaaca

SEQ ID NO: 339872 - DNA, 25 bp, Rattus norvegicus
gagcagtacctcctaactgatccgg

SEQ ID NO: 339873 - DNA, 25 bp, Rattus norvegicus
gagcagtacctcgtaactgatccgg

SEQ ID NO: 339874 - DNA, 25 bp, Rattus norvegicus
gagcagtacgccagggagtcctcag

SEQ ID NO: 339875 - DNA, 25 bp, Rattus norvegicus
gagcagtacgcctgggagtcctcag

SEQ ID NO: 339876 - DNA, 25 bp, Rattus norvegicus
gagcagtactatagctatcctccca

SEQ ID NO: 339877 - DNA, 25 bp, Rattus norvegicus
gagcagtactattgctatcctccca

SEQ ID NO: 339878 - DNA, 25 bp, Rattus norvegicus
gagcagtagtccaaagcctgagtct

SEQ ID NO: 339879 - DNA, 25 bp, Rattus norvegicus
gagcagtagtcctaagcctgagtct

SEQ ID NO: 339880 - DNA, 25 bp, Rattus norvegicus
gagcagtatataatttggtctttga

SEQ ID NO: 339881 - DNA, 25 bp, Rattus norvegicus
gagcagtatatattttggtctttga

SEQ ID NO: 339882 - DNA, 25 bp, Rattus norvegicus
gagcagtatcacaatcaggtcttct

SEQ ID NO: 339883 - DNA, 25 bp, Rattus norvegicus
gagcagtatcactatcaggtcttct

SEQ ID NO: 339884 - DNA, 25 bp, Rattus norvegicus
gagcagtatcagaggcactccaagt

SEQ ID NO: 339885 - DNA, 25 bp, Rattus norvegicus
gagcagtatcagtggcactccaagt

SEQ ID NO: 339886 - DNA, 25 bp, Rattus norvegicus
gagcagtatgacctctaactacgga

SEQ ID NO: 339887 - DNA, 25 bp, Rattus norvegicus
gagcagtatgacgtctaactacgga

SEQ ID NO: 339888 - DNA, 25 bp, Rattus norvegicus
gagcagtatttgagtagggttttaa

SEQ ID NO: 339889 - DNA, 25 bp, Rattus norvegicus
gagcagtatttgtgtagggttttaa

SEQ ID NO: 339890 - DNA, 25 bp, Rattus norvegicus
gagcagtcacacacaggaagagcat

SEQ ID NO: 339891 - DNA, 25 bp, Rattus norvegicus
gagcagtcacactcaggaagagcat

SEQ ID NO: 339892 - DNA, 25 bp, Rattus norvegicus
gagcagtcacctctgaaactcagtt

SEQ ID NO: 339893 - DNA, 25 bp, Rattus norvegicus
gagcagtcacctgtgaaactcagtt

SEQ ID NO: 339894 - DNA, 25 bp, Rattus norvegicus
gagcagtcactacttgtgcgcaaca

SEQ ID NO: 339895 - DNA, 25 bp, Rattus norvegicus
gagcagtcactagttgtgcgcaaca

SEQ ID NO: 339896 - DNA, 25 bp, Rattus norvegicus
gagcagtcactcatttaaggtgcac

SEQ ID NO: 339897 - DNA, 25 bp, Rattus norvegicus
gagcagtcactcttttaaggtgcac

SEQ ID NO: 339898 - DNA, 25 bp, Rattus norvegicus
gagcagtcagacatcgaggagcctt

SEQ ID NO: 339899 - DNA, 25 bp, Rattus norvegicus
gagcagtcagacttcgaggagcctt

SEQ ID NO: 339900 - DNA, 25 bp, Rattus norvegicus
gagcagtcatatactaaccttttct

SEQ ID NO: 339901 - DNA, 25 bp, Rattus norvegicus
gagcagtcatattctaaccttttct

SEQ ID NO: 339902 - DNA, 25 bp, Rattus norvegicus
gagcagtcatgaattccagctggta

SEQ ID NO: 339903 - DNA, 25 bp, Rattus norvegicus
gagcagtcatgatttccagctggta

SEQ ID NO: 339904 - DNA, 25 bp, Rattus norvegicus
gagcagtcatgtcagttgtccagga

SEQ ID NO: 339905 - DNA, 25 bp, Rattus norvegicus
gagcagtcatgtgagttgtccagga

SEQ ID NO: 339906 - DNA, 25 bp, Rattus norvegicus
gagcagtccactcttctgtgtaaac

SEQ ID NO: 339907 - DNA, 25 bp, Rattus norvegicus
gagcagtccactgttctgtgtaaac

SEQ ID NO: 339908 - DNA, 25 bp, Rattus norvegicus
gagcagtccagtcctgtcctgaaga

SEQ ID NO: 339909 - DNA, 25 bp, Rattus norvegicus
gagcagtccagtgctgtcctgaaga

SEQ ID NO: 339910 - DNA, 25 bp, Rattus norvegicus
gagcagtcctctaagtattagttta

SEQ ID NO: 339911 - DNA, 25 bp, Rattus norvegicus
gagcagtcctcttagtattagttta

SEQ ID NO: 339912 - DNA, 25 bp, Rattus norvegicus
gagcagtcctttcgagtccttttgc

SEQ ID NO: 339913 - DNA, 25 bp, Rattus norvegicus
gagcagtcctttggagtccttttgc

SEQ ID NO: 339914 - DNA, 25 bp, Rattus norvegicus
gagcagtcgctaagctttcagtcct

SEQ ID NO: 339915 - DNA, 25 bp, Rattus norvegicus
gagcagtcgctatgctttcagtcct

SEQ ID NO: 339916 - DNA, 25 bp, Rattus norvegicus
gagcagtcgtgcacttggtccatga

SEQ ID NO: 339917 - DNA, 25 bp, Rattus norvegicus
gagcagtcgtgctcttggtccatga

SEQ ID NO: 339918 - DNA, 25 bp, Rattus norvegicus
gagcagtctaccatgtttatgacca

SEQ ID NO: 339919 - DNA, 25 bp, Rattus norvegicus
gagcagtctaccttgtttatgacca

SEQ ID NO: 339920 - DNA, 25 bp, Rattus norvegicus
gagcagtctcttcatggtttctata

SEQ ID NO: 339921 - DNA, 25 bp, Rattus norvegicus
gagcagtctcttgatggtttctata

SEQ ID NO: 339922 - DNA, 25 bp, Rattus norvegicus
gagcagtctgaaataataccatggt

SEQ ID NO: 339923 - DNA, 25 bp, Rattus norvegicus
gagcagtctgaattaataccatggt

SEQ ID NO: 339924 - DNA, 25 bp, Rattus norvegicus
gagcagtctgcactgtgccaaggcc

SEQ ID NO: 339925 - DNA, 25 bp, Rattus norvegicus
gagcagtctgcagtgtgccaaggcc

SEQ ID NO: 339926 - DNA, 25 bp, Rattus norvegicus
gagcagtctggacctttcatctgga

SEQ ID NO: 339927 - DNA, 25 bp, Rattus norvegicus
gagcagtctggagctttcatctgga

SEQ ID NO: 339928 - DNA, 25 bp, Rattus norvegicus
gagcagtcttttcgctcagaccatt

SEQ ID NO: 339929 - DNA, 25 bp, Rattus norvegicus
gagcagtcttttggctcagaccatt

SEQ ID NO: 339930 - DNA, 25 bp, Rattus norvegicus
gagcagtgacaccaagttcaggcca

SEQ ID NO: 339931 - DNA, 25 bp, Rattus norvegicus
gagcagtgacacgaagttcaggcca

SEQ ID NO: 339932 - DNA, 25 bp, Rattus norvegicus
gagcagtgacagagattttcctggg

SEQ ID NO: 339933 - DNA, 25 bp, Rattus norvegicus
gagcagtgacagtgattttcctggg

SEQ ID NO: 339934 - DNA, 25 bp, Rattus norvegicus
gagcagtgaccgagccgctgaagct

SEQ ID NO: 339935 - DNA, 25 bp, Rattus norvegicus
gagcagtgaccgtgccgctgaagct

SEQ ID NO: 339936 - DNA, 25 bp, Rattus norvegicus
gagcagtgagcactggttccaaacc

SEQ ID NO: 339937 - DNA, 25 bp, Rattus norvegicus
gagcagtgagcagtggttccaaacc

SEQ ID NO: 339938 - DNA, 25 bp, Rattus norvegicus
gagcagtgagccaaccaggcagtat

SEQ ID NO: 339939 - DNA, 25 bp, Rattus norvegicus
gagcagtgagcctaccaggcagtat

SEQ ID NO: 339940 - DNA, 25 bp, Rattus norvegicus
gagcagtgaggtcatcttctagaat

SEQ ID NO: 339941 - DNA, 25 bp, Rattus norvegicus
gagcagtgaggtgatcttctagaat

SEQ ID NO: 339942 - DNA, 25 bp, Rattus norvegicus
gagcagtgagttacggagccaaata

SEQ ID NO: 339943 - DNA, 25 bp, Rattus norvegicus
gagcagtgagtttcggagccaaata

SEQ ID NO: 339944 - DNA, 25 bp, Rattus norvegicus
gagcagtgatatatggcacacgcca

SEQ ID NO: 339945 - DNA, 25 bp, Rattus norvegicus
gagcagtgatatttggcacacgcca

SEQ ID NO: 339946 - DNA, 25 bp, Rattus norvegicus
gagcagtgatctcggaggttccttt

SEQ ID NO: 339947 - DNA, 25 bp, Rattus norvegicus
gagcagtgatctgggaggttccttt

SEQ ID NO: 339948 - DNA, 25 bp, Rattus norvegicus
gagcagtgcatcagagtgttcccag

SEQ ID NO: 339949 - DNA, 25 bp, Rattus norvegicus
gagcagtgcatctgagtgttcccag

SEQ ID NO: 339950 - DNA, 25 bp, Rattus norvegicus
gagcagtgcattatgtacctctgag

SEQ ID NO: 339951 - DNA, 25 bp, Rattus norvegicus
gagcagtgcattttgtacctctgag

SEQ ID NO: 339952 - DNA, 25 bp, Rattus norvegicus
gagcagtgctccctgggtccttaga

SEQ ID NO: 339953 - DNA, 25 bp, Rattus norvegicus
gagcagtgctccgtgggtccttaga

SEQ ID NO: 339954 - DNA, 25 bp, Rattus norvegicus
gagcagtgctctctcaccgcaagcg

SEQ ID NO: 339955 - DNA, 25 bp, Rattus norvegicus
gagcagtgctctgtcaccgcaagcg

SEQ ID NO: 339956 - DNA, 25 bp, Rattus norvegicus
gagcagtgctgtacataacatctat

SEQ ID NO: 339957 - DNA, 25 bp, Rattus norvegicus
gagcagtgctgttcataacatctat

SEQ ID NO: 339958 - DNA, 25 bp, Rattus norvegicus
gagcagtgctttcgtattcccagga

SEQ ID NO: 339959 - DNA, 25 bp, Rattus norvegicus
gagcagtgctttggtattcccagga

SEQ ID NO: 339960 - DNA, 25 bp, Rattus norvegicus
gagcagtgggcaaataccaccttgc

SEQ ID NO: 339961 - DNA, 25 bp, Rattus norvegicus
gagcagtgggcatataccaccttgc

SEQ ID NO: 339962 - DNA, 25 bp, Rattus norvegicus
gagcagtggtgaacttttcttctaa

SEQ ID NO: 339963 - DNA, 25 bp, Rattus norvegicus
gagcagtggtgatcttttcttctaa

SEQ ID NO: 339964 - DNA, 25 bp, Rattus norvegicus
gagcagtgtaaacctcacaggactt

SEQ ID NO: 339965 - DNA, 25 bp, Rattus norvegicus
gagcagtgtaaagctcacaggactt

SEQ ID NO: 339966 - DNA, 25 bp, Rattus norvegicus
gagcagtgtcaactcctggaggtcc

SEQ ID NO: 339967 - DNA, 25 bp, Rattus norvegicus
gagcagtgtcaagtcctggaggtcc

SEQ ID NO: 339968 - DNA, 25 bp, Rattus norvegicus
gagcagtgtcacactactaattgag

SEQ ID NO: 339969 - DNA, 25 bp, Rattus norvegicus
gagcagtgtcactctactaattgag

SEQ ID NO: 339970 - DNA, 25 bp, Rattus norvegicus
gagcagtgtcctcactcatgtgaaa

SEQ ID NO: 339971 - DNA, 25 bp, Rattus norvegicus
gagcagtgtcctgactcatgtgaaa

SEQ ID NO: 339972 - DNA, 25 bp, Rattus norvegicus
gagcagtgtctcctgggatttgtac

SEQ ID NO: 339973 - DNA, 25 bp, Rattus norvegicus
gagcagtgtctcgtgggatttgtac

SEQ ID NO: 339974 - DNA, 25 bp, Rattus norvegicus
gagcagtgtcttccataatgtataa

SEQ ID NO: 339975 - DNA, 25 bp, Rattus norvegicus
gagcagtgtcttctctctttagcac

SEQ ID NO: 339976 - DNA, 25 bp, Rattus norvegicus
gagcagtgtcttgcataatgtataa

SEQ ID NO: 339977 - DNA, 25 bp, Rattus norvegicus
gagcagtgtcttgtctctttagcac

SEQ ID NO: 339978 - DNA, 25 bp, Rattus norvegicus
gagcagtgtgcaactactatttcca

SEQ ID NO: 339979 - DNA, 25 bp, Rattus norvegicus
gagcagtgtgcatctactatttcca

SEQ ID NO: 339980 - DNA, 25 bp, Rattus norvegicus
gagcagtgtgctacattaaccaaac

SEQ ID NO: 339981 - DNA, 25 bp, Rattus norvegicus
gagcagtgtgcttcattaaccaaac

SEQ ID NO: 339982 - DNA, 25 bp, Rattus norvegicus
gagcagtgtggaccccatctccctt

SEQ ID NO: 339983 - DNA, 25 bp, Rattus norvegicus
gagcagtgtggagcccatctccctt

SEQ ID NO: 339984 - DNA, 25 bp, Rattus norvegicus
gagcagttaaagaaggttaccgcca

SEQ ID NO: 339985 - DNA, 25 bp, Rattus norvegicus
gagcagttaaagtaggttaccgcca

SEQ ID NO: 339986 - DNA, 25 bp, Rattus norvegicus
gagcagttaccgacagttaccgtga

SEQ ID NO: 339987 - DNA, 25 bp, Rattus norvegicus
gagcagttaccgtcagttaccgtga

SEQ ID NO: 339988 - DNA, 25 bp, Rattus norvegicus
gagcagttatgcatttatctaaagg

SEQ ID NO: 339989 - DNA, 25 bp, Rattus norvegicus
gagcagttatgcttttatctaaagg

SEQ ID NO: 339990 - DNA, 25 bp, Rattus norvegicus
gagcagttcaaccaccacatgagga

SEQ ID NO: 339991 - DNA, 25 bp, Rattus norvegicus
gagcagttcaacgaccacatgagga

SEQ ID NO: 339992 - DNA, 25 bp, Rattus norvegicus
gagcagttcaagactgccttttcct

SEQ ID NO: 339993 - DNA, 25 bp, Rattus norvegicus
gagcagttcaagcaccaggccgaca

SEQ ID NO: 339994 - DNA, 25 bp, Rattus norvegicus
gagcagttcaaggaccaggccgaca

SEQ ID NO: 339995 - DNA, 25 bp, Rattus norvegicus
gagcagttcaagtctgccttttcct

SEQ ID NO: 339996 - DNA, 25 bp, Rattus norvegicus
gagcagttcaggaggctctagcctc

SEQ ID NO: 339997 - DNA, 25 bp, Rattus norvegicus
gagcagttcaggtggctctagcctc

SEQ ID NO: 339998 - DNA, 25 bp, Rattus norvegicus
gagcagttcagtattggaagattat

SEQ ID NO: 339999 - DNA, 25 bp, Rattus norvegicus
gagcagttcagttttggaagattat

SEQ ID NO: 340000 - DNA, 25 bp, Rattus norvegicus
gagcagttcatcctgagccatctga

SEQ ID NO: 340001 - DNA, 25 bp, Rattus norvegicus
gagcagttcatcgtgagccatctga

SEQ ID NO: 340002 - DNA, 25 bp, Rattus norvegicus
gagcagttcctcaaagttgttattc

SEQ ID NO: 340003 - DNA, 25 bp, Rattus norvegicus
gagcagttcctctaagttgttattc

SEQ ID NO: 340004 - DNA, 25 bp, Rattus norvegicus
gagcagttcggaagatcttcgccgt

SEQ ID NO: 340005 - DNA, 25 bp, Rattus norvegicus
gagcagttcggatgatcttcgccgt

SEQ ID NO: 340006 - DNA, 25 bp, Rattus norvegicus
gagcagttctaacgtatctacatga

SEQ ID NO: 340007 - DNA, 25 bp, Rattus norvegicus
gagcagttctaaggtatctacatga

SEQ ID NO: 340008 - DNA, 25 bp, Rattus norvegicus
gagcagttctccaaaagacagcatt

SEQ ID NO: 340009 - DNA, 25 bp, Rattus norvegicus
gagcagttctcctaaagacagcatt

SEQ ID NO: 340010 - DNA, 25 bp, Rattus norvegicus
gagcagttctctaatgtgtcaccag

SEQ ID NO: 340011 - DNA, 25 bp, Rattus norvegicus
gagcagttctcttatgtgtcaccag

SEQ ID NO: 340012 - DNA, 25 bp, Rattus norvegicus
gagcagttctgcaagttcacaagag

SEQ ID NO: 340013 - DNA, 25 bp, Rattus norvegicus
gagcagttctgcaggacctaagccg

SEQ ID NO: 340014 - DNA, 25 bp, Rattus norvegicus
gagcagttctgctagttcacaagag

SEQ ID NO: 340015 - DNA, 25 bp, Rattus norvegicus
gagcagttctgctggacctaagccg

SEQ ID NO: 340016 - DNA, 25 bp, Rattus norvegicus
gagcagttgctgacaactcctggag

SEQ ID NO: 340017 - DNA, 25 bp, Rattus norvegicus
gagcagttgctgtcaactcctggag

SEQ ID NO: 340018 - DNA, 25 bp, Rattus norvegicus
gagcagttgttgataataccaccat

SEQ ID NO: 340019 - DNA, 25 bp, Rattus norvegicus
gagcagttgttgttaataccaccat

SEQ ID NO: 340020 - DNA, 25 bp, Rattus norvegicus
gagcagtttaatactgaaagtccca

SEQ ID NO: 340021 - DNA, 25 bp, Rattus norvegicus
gagcagtttaattctgaaagtccca

SEQ ID NO: 340022 - DNA, 25 bp, Rattus norvegicus
gagcagtttccaaccggcatgggca

SEQ ID NO: 340023 - DNA, 25 bp, Rattus norvegicus
gagcagtttccatccggcatgggca

SEQ ID NO: 340024 - DNA, 25 bp, Rattus norvegicus
gagcagtttctcagcattggcattg

SEQ ID NO: 340025 - DNA, 25 bp, Rattus norvegicus
gagcagtttctctgcattggcattg

SEQ ID NO: 340026 - DNA, 25 bp, Rattus norvegicus
gagcagtttgccctgaacatgacta

SEQ ID NO: 340027 - DNA, 25 bp, Rattus norvegicus
gagcagtttgccgtgaacatgacta

SEQ ID NO: 340028 - DNA, 25 bp, Rattus norvegicus
gagcagtttgctaggagacatttct

SEQ ID NO: 340029 - DNA, 25 bp, Rattus norvegicus
gagcagtttgcttggagacatttct

SEQ ID NO: 340030 - DNA, 25 bp, Rattus norvegicus
gagcagtttgtaatgtccctaagtc

SEQ ID NO: 340031 - DNA, 25 bp, Rattus norvegicus
gagcagtttgtattgtccctaagtc

SEQ ID NO: 340032 - DNA, 25 bp, Rattus norvegicus
gagcagtttttaaatgccaaccagg

SEQ ID NO: 340033 - DNA, 25 bp, Rattus norvegicus
gagcagtttttatatgccaaccagg

SEQ ID NO: 340034 - DNA, 25 bp, Rattus norvegicus
gagcagtttttcatacaatccatat

SEQ ID NO: 340035 - DNA, 25 bp, Rattus norvegicus
gagcagtttttcttacaatccatat

SEQ ID NO: 340036 - DNA, 25 bp, Rattus norvegicus
gagcataaaaccctaagttcctgga

SEQ ID NO: 340037 - DNA, 25 bp, Rattus norvegicus
gagcataaaaccgtaagttcctgga

SEQ ID NO: 340038 - DNA, 25 bp, Rattus norvegicus
gagcataaacagaacttcctgcagt

SEQ ID NO: 340039 - DNA, 25 bp, Rattus norvegicus
gagcataaacagtacttcctgcagt

SEQ ID NO: 340040 - DNA, 25 bp, Rattus norvegicus
gagcataacttgacttgagagcctt

SEQ ID NO: 340041 - DNA, 25 bp, Rattus norvegicus
gagcataacttgtcttgagagcctt

SEQ ID NO: 340042 - DNA, 25 bp, Rattus norvegicus
gagcataagaatcacctctcagtct

SEQ ID NO: 340043 - DNA, 25 bp, Rattus norvegicus
gagcataagaatgacctctcagtct

SEQ ID NO: 340044 - DNA, 25 bp, Rattus norvegicus
gagcataaggcaaccagttaggttt

SEQ ID NO: 340045 - DNA, 25 bp, Rattus norvegicus
gagcataaggcatccagttaggttt

SEQ ID NO: 340046 - DNA, 25 bp, Rattus norvegicus
gagcataatttgatgtcagcaagca

SEQ ID NO: 340047 - DNA, 25 bp, Rattus norvegicus
gagcataatttgttgtcagcaagca

SEQ ID NO: 340048 - DNA, 25 bp, Rattus norvegicus
gagcataccactcatgaatctggat

SEQ ID NO: 340049 - DNA, 25 bp, Rattus norvegicus
gagcataccactgatgaatctggat

SEQ ID NO: 340050 - DNA, 25 bp, Rattus norvegicus
gagcataccatccttctaggacagt

SEQ ID NO: 340051 - DNA, 25 bp, Rattus norvegicus
gagcataccatcgttctaggacagt

SEQ ID NO: 340052 - DNA, 25 bp, Rattus norvegicus
gagcataccggtctggtactcgcag

SEQ ID NO: 340053 - DNA, 25 bp, Rattus norvegicus
gagcataccggtgtggtactcgcag

SEQ ID NO: 340054 - DNA, 25 bp, Rattus norvegicus
gagcatacctgtcctttgtcagctc

SEQ ID NO: 340055 - DNA, 25 bp, Rattus norvegicus
gagcatacctgtgctttgtcagctc

SEQ ID NO: 340056 - DNA, 25 bp, Rattus norvegicus
gagcatactacgatagggtaccact

SEQ ID NO: 340057 - DNA, 25 bp, Rattus norvegicus
gagcatactacgttagggtaccact

SEQ ID NO: 340058 - DNA, 25 bp, Rattus norvegicus
gagcatactgctatcaaatacttat

SEQ ID NO: 340059 - DNA, 25 bp, Rattus norvegicus
gagcatactgctttcaaatacttat

SEQ ID NO: 340060 - DNA, 25 bp, Rattus norvegicus
gagcatacttctactggcagatcgg

SEQ ID NO: 340061 - DNA, 25 bp, Rattus norvegicus
gagcatacttcttctggcagatcgg

SEQ ID NO: 340062 - DNA, 25 bp, Rattus norvegicus
gagcatagacttactgtggacacgt

SEQ ID NO: 340063 - DNA, 25 bp, Rattus norvegicus
gagcatagactttctgtggacacgt

SEQ ID NO: 340064 - DNA, 25 bp, Rattus norvegicus
gagcatagcatgatttcccagagca

SEQ ID NO: 340065 - DNA, 25 bp, Rattus norvegicus
gagcatagcatgttttcccagagca

SEQ ID NO: 340066 - DNA, 25 bp, Rattus norvegicus
gagcatagcctgctgatcgatacgc

SEQ ID NO: 340067 - DNA, 25 bp, Rattus norvegicus
gagcatagcctggtgatcgatacgc

SEQ ID NO: 340068 - DNA, 25 bp, Rattus norvegicus
gagcatagctcacacaagactttat

SEQ ID NO: 340069 - DNA, 25 bp, Rattus norvegicus
gagcatagctcagacaagactttat

SEQ ID NO: 340070 - DNA, 25 bp, Rattus norvegicus
gagcatagctctcaaggagtccatt

SEQ ID NO: 340071 - DNA, 25 bp, Rattus norvegicus
gagcatagctctgaaggagtccatt

SEQ ID NO: 340072 - DNA, 25 bp, Rattus norvegicus
gagcataggaggactctctctctct

SEQ ID NO: 340073 - DNA, 25 bp, Rattus norvegicus
gagcataggaggtctctctctctct

SEQ ID NO: 340074 - DNA, 25 bp, Rattus norvegicus
gagcataggcatctacgtgcaggaa

SEQ ID NO: 340075 - DNA, 25 bp, Rattus norvegicus
gagcataggcatgtacgtgcaggaa

SEQ ID NO: 340076 - DNA, 25 bp, Rattus norvegicus
gagcatagtttaatacagcacacag

SEQ ID NO: 340077 - DNA, 25 bp, Rattus norvegicus
gagcatagtttattacagcacacag

SEQ ID NO: 340078 - DNA, 25 bp, Rattus norvegicus
gagcatatacttattcctataccaa

SEQ ID NO: 340079 - DNA, 25 bp, Rattus norvegicus
gagcatatactttttcctataccaa

SEQ ID NO: 340080 - DNA, 25 bp, Rattus norvegicus
gagcatatagaaatgcacctgtttt

SEQ ID NO: 340081 - DNA, 25 bp, Rattus norvegicus
gagcatatagaattgcacctgtttt

SEQ ID NO: 340082 - DNA, 25 bp, Rattus norvegicus
gagcatatcatgcagccactcttga

SEQ ID NO: 340083 - DNA, 25 bp, Rattus norvegicus
gagcatatcatggagccactcttga

SEQ ID NO: 340084 - DNA, 25 bp, Rattus norvegicus
gagcatatccgccaaggctcagctg

SEQ ID NO: 340085 - DNA, 25 bp, Rattus norvegicus
gagcatatccgcgaaggctcagctg

SEQ ID NO: 340086 - DNA, 25 bp, Rattus norvegicus
gagcatatgaacatcgtcctcagct

SEQ ID NO: 340087 - DNA, 25 bp, Rattus norvegicus
gagcatatgaacttcgtcctcagct

SEQ ID NO: 340088 - DNA, 25 bp, Rattus norvegicus
gagcatatgggtctgacatccttca

SEQ ID NO: 340089 - DNA, 25 bp, Rattus norvegicus
gagcatatgggtgtgacatccttca

SEQ ID NO: 340090 - DNA, 25 bp, Rattus norvegicus
gagcatattgttctctcccaaaggc

SEQ ID NO: 340091 - DNA, 25 bp, Rattus norvegicus
gagcatattgttgtctcccaaaggc

SEQ ID NO: 340092 - DNA, 25 bp, Rattus norvegicus
gagcatcaagaaaaccgccagacaa

SEQ ID NO: 340093 - DNA, 25 bp, Rattus norvegicus
gagcatcaagaataccgccagacaa

SEQ ID NO: 340094 - DNA, 25 bp, Rattus norvegicus
gagcatcacagtccggctgtttcta

SEQ ID NO: 340095 - DNA, 25 bp, Rattus norvegicus
gagcatcacagtgcggctgtttcta

SEQ ID NO: 340096 - DNA, 25 bp, Rattus norvegicus
gagcatcacctcagagcgaagtgtg

SEQ ID NO: 340097 - DNA, 25 bp, Rattus norvegicus
gagcatcacctctgagcgaagtgtg

SEQ ID NO: 340098 - DNA, 25 bp, Rattus norvegicus
gagcatcagcacagtgccaggagct

SEQ ID NO: 340099 - DNA, 25 bp, Rattus norvegicus
gagcatcagcactgtgccaggagct

SEQ ID NO: 340100 - DNA, 25 bp, Rattus norvegicus
gagcatcaggacatgggttttctat

SEQ ID NO: 340101 - DNA, 25 bp, Rattus norvegicus
gagcatcaggacttgggttttctat

SEQ ID NO: 340102 - DNA, 25 bp, Rattus norvegicus
gagcatcagtctaagcccagaacag

SEQ ID NO: 340103 - DNA, 25 bp, Rattus norvegicus
gagcatcagtcttagcccagaacag

SEQ ID NO: 340104 - DNA, 25 bp, Rattus norvegicus
gagcatcagttcacctgaccttaaa

SEQ ID NO: 340105 - DNA, 25 bp, Rattus norvegicus
gagcatcagttctcctgaccttaaa

SEQ ID NO: 340106 - DNA, 25 bp, Rattus norvegicus
gagcatcatctcagtgaaaactcaa

SEQ ID NO: 340107 - DNA, 25 bp, Rattus norvegicus
gagcatcatctctgtgaaaactcaa

SEQ ID NO: 340108 - DNA, 25 bp, Rattus norvegicus
gagcatcatgatcacgttactatgt

SEQ ID NO: 340109 - DNA, 25 bp, Rattus norvegicus
gagcatcatgatgacgttactatgt

SEQ ID NO: 340110 - DNA, 25 bp, Rattus norvegicus
gagcatcatgcgatgtacacagact

SEQ ID NO: 340111 - DNA, 25 bp, Rattus norvegicus
gagcatcatgcgttgtacacagact

SEQ ID NO: 340112 - DNA, 25 bp, Rattus norvegicus
gagcatcatgctattgaaggtggac

SEQ ID NO: 340113 - DNA, 25 bp, Rattus norvegicus
gagcatcatgcttttgaaggtggac

SEQ ID NO: 340114 - DNA, 25 bp, Rattus norvegicus
gagcatcattgaactgagccacaag

SEQ ID NO: 340115 - DNA, 25 bp, Rattus norvegicus
gagcatcattgatctgagccacaag

SEQ ID NO: 340116 - DNA, 25 bp, Rattus norvegicus
gagcatcattgccaatgcagtcaac

SEQ ID NO: 340117 - DNA, 25 bp, Rattus norvegicus
gagcatcattgcgaatgcagtcaac

SEQ ID NO: 340118 - DNA, 25 bp, Rattus norvegicus
gagcatcatttaaattctaacccag

SEQ ID NO: 340119 - DNA, 25 bp, Rattus norvegicus
gagcatcatttatattctaacccag

SEQ ID NO: 340120 - DNA, 25 bp, Rattus norvegicus
gagcatccaagtctgcagtctggga

SEQ ID NO: 340121 - DNA, 25 bp, Rattus norvegicus
gagcatccaagtgtgcagtctggga

SEQ ID NO: 340122 - DNA, 25 bp, Rattus norvegicus
gagcatccaattagcattcacgagg

SEQ ID NO: 340123 - DNA, 25 bp, Rattus norvegicus
gagcatccaatttgcattcacgagg

SEQ ID NO: 340124 - DNA, 25 bp, Rattus norvegicus
gagcatccacgacaatcttccagag

SEQ ID NO: 340125 - DNA, 25 bp, Rattus norvegicus
gagcatccacgagaatcttccagag

SEQ ID NO: 340126 - DNA, 25 bp, Rattus norvegicus
gagcatccagtgataaagtgcagaa

SEQ ID NO: 340127 - DNA, 25 bp, Rattus norvegicus
gagcatccagtgttaaagtgcagaa

SEQ ID NO: 340128 - DNA, 25 bp, Rattus norvegicus
gagcatccataaatgtgtcctcctc

SEQ ID NO: 340129 - DNA, 25 bp, Rattus norvegicus
gagcatccataattgtgtcctcctc

SEQ ID NO: 340130 - DNA, 25 bp, Rattus norvegicus
gagcatccatgcagttcctggacaa

SEQ ID NO: 340131 - DNA, 25 bp, Rattus norvegicus
gagcatccatgctgttcctggacaa

SEQ ID NO: 340132 - DNA, 25 bp, Rattus norvegicus
gagcatccatttctgaagccacaca

SEQ ID NO: 340133 - DNA, 25 bp, Rattus norvegicus
gagcatccatttgtgaagccacaca

SEQ ID NO: 340134 - DNA, 25 bp, Rattus norvegicus
gagcatcccctgaatgatgtgttct

SEQ ID NO: 340135 - DNA, 25 bp, Rattus norvegicus
gagcatcccctgtatgatgtgttct

SEQ ID NO: 340136 - DNA, 25 bp, Rattus norvegicus
gagcatccctgcaggccagtcgata

SEQ ID NO: 340137 - DNA, 25 bp, Rattus norvegicus
gagcatccctgctggccagtcgata

SEQ ID NO: 340138 - DNA, 25 bp, Rattus norvegicus
gagcatccgattacttcactaaagg

SEQ ID NO: 340139 - DNA, 25 bp, Rattus norvegicus
gagcatccgatttcttcactaaagg

SEQ ID NO: 340140 - DNA, 25 bp, Rattus norvegicus
gagcatccggcacacagctacaatt

SEQ ID NO: 340141 - DNA, 25 bp, Rattus norvegicus
gagcatccggcagacagctacaatt

SEQ ID NO: 340142 - DNA, 25 bp, Rattus norvegicus
gagcatcctaggagagctggcccag

SEQ ID NO: 340143 - DNA, 25 bp, Rattus norvegicus
gagcatcctaggtgagctggcccag

SEQ ID NO: 340144 - DNA, 25 bp, Rattus norvegicus
gagcatcctagtagaagcagggaga

SEQ ID NO: 340145 - DNA, 25 bp, Rattus norvegicus
gagcatcctagttgaagcagggaga

SEQ ID NO: 340146 - DNA, 25 bp, Rattus norvegicus
gagcatcctgcacaaaatcctttga

SEQ ID NO: 340147 - DNA, 25 bp, Rattus norvegicus
gagcatcctgcagaaaatcctttga

SEQ ID NO: 340148 - DNA, 25 bp, Rattus norvegicus
gagcatcctgctctttgaagggaaa

SEQ ID NO: 340149 - DNA, 25 bp, Rattus norvegicus
gagcatcctgctgtttgaagggaaa

SEQ ID NO: 340150 - DNA, 25 bp, Rattus norvegicus
gagcatcctggacactgtcatcaag

SEQ ID NO: 340151 - DNA, 25 bp, Rattus norvegicus
gagcatcctggagactgtcatcaag

SEQ ID NO: 340152 - DNA, 25 bp, Rattus norvegicus
gagcatcctggcctggttgcctttc

SEQ ID NO: 340153 - DNA, 25 bp, Rattus norvegicus
gagcatcctggcgtggttgcctttc

SEQ ID NO: 340154 - DNA, 25 bp, Rattus norvegicus
gagcatcctgttatatgtcttaaat

SEQ ID NO: 340155 - DNA, 25 bp, Rattus norvegicus
gagcatcctgttttatgtcttaaat

SEQ ID NO: 340156 - DNA, 25 bp, Rattus norvegicus
gagcatcctttactgaactcttagt

SEQ ID NO: 340157 - DNA, 25 bp, Rattus norvegicus
gagcatcctttagtgaactcttagt

SEQ ID NO: 340158 - DNA, 25 bp, Rattus norvegicus
gagcatcggagaacagggactgact

SEQ ID NO: 340159 - DNA, 25 bp, Rattus norvegicus
gagcatcggagatcagggactgact

SEQ ID NO: 340160 - DNA, 25 bp, Rattus norvegicus
gagcatcgtgtacatccaccagcag

SEQ ID NO: 340161 - DNA, 25 bp, Rattus norvegicus
gagcatcgtgtagatccaccagcag

SEQ ID NO: 340162 - DNA, 25 bp, Rattus norvegicus
gagcatctactgaattcttggagtt

SEQ ID NO: 340163 - DNA, 25 bp, Rattus norvegicus
gagcatctactgtattcttggagtt

SEQ ID NO: 340164 - DNA, 25 bp, Rattus norvegicus
gagcatctacttaagactgctaagt

SEQ ID NO: 340165 - DNA, 25 bp, Rattus norvegicus
gagcatctactttagactgctaagt

SEQ ID NO: 340166 - DNA, 25 bp, Rattus norvegicus
gagcatctaggacttgttgtagctt

SEQ ID NO: 340167 - DNA, 25 bp, Rattus norvegicus
gagcatctaggagttgttgtagctt

SEQ ID NO: 340168 - DNA, 25 bp, Rattus norvegicus
gagcatctatgtcaaatgccccagc

SEQ ID NO: 340169 - DNA, 25 bp, Rattus norvegicus
gagcatctatgtgaaatgccccagc

SEQ ID NO: 340170 - DNA, 25 bp, Rattus norvegicus
gagcatctcaccctaagccaggcag

SEQ ID NO: 340171 - DNA, 25 bp, Rattus norvegicus
gagcatctcaccgtaagccaggcag

SEQ ID NO: 340172 - DNA, 25 bp, Rattus norvegicus
gagcatctcactctggtagtgcttc

SEQ ID NO: 340173 - DNA, 25 bp, Rattus norvegicus
gagcatctcactgtggtagtgcttc

SEQ ID NO: 340174 - DNA, 25 bp, Rattus norvegicus
gagcatctctcgcatattaaagaaa

SEQ ID NO: 340175 - DNA, 25 bp, Rattus norvegicus
gagcatctctcggatattaaagaaa

SEQ ID NO: 340176 - DNA, 25 bp, Rattus norvegicus
gagcatctgaaaagccacgccagcg

SEQ ID NO: 340177 - DNA, 25 bp, Rattus norvegicus
gagcatctgaaatgccacgccagcg

SEQ ID NO: 340178 - DNA, 25 bp, Rattus norvegicus
gagcatctgaacatgtcctcagtac

SEQ ID NO: 340179 - DNA, 25 bp, Rattus norvegicus
gagcatctgaacttgtcctcagtac

SEQ ID NO: 340180 - DNA, 25 bp, Rattus norvegicus
gagcatctgaatcttgactatatta

SEQ ID NO: 340181 - DNA, 25 bp, Rattus norvegicus
gagcatctgaatgttgactatatta

SEQ ID NO: 340182 - DNA, 25 bp, Rattus norvegicus
gagcatctgctcagttcttaaggag

SEQ ID NO: 340183 - DNA, 25 bp, Rattus norvegicus
gagcatctgctctgttcttaaggag

SEQ ID NO: 340184 - DNA, 25 bp, Rattus norvegicus
gagcatctgtcaaacggcgacgcgc

SEQ ID NO: 340185 - DNA, 25 bp, Rattus norvegicus
gagcatctgtcatacggcgacgcgc

SEQ ID NO: 340186 - DNA, 25 bp, Rattus norvegicus
gagcatcttattatatagatccaaa

SEQ ID NO: 340187 - DNA, 25 bp, Rattus norvegicus
gagcatcttattttatagatccaaa

SEQ ID NO: 340188 - DNA, 25 bp, Rattus norvegicus
gagcatcttcaacaatattcctaca

SEQ ID NO: 340189 - DNA, 25 bp, Rattus norvegicus
gagcatcttcaagaatattcctaca

SEQ ID NO: 340190 - DNA, 25 bp, Rattus norvegicus
gagcatcttgccagaactgatcctt

SEQ ID NO: 340191 - DNA, 25 bp, Rattus norvegicus
gagcatcttgcctgaactgatcctt

SEQ ID NO: 340192 - DNA, 25 bp, Rattus norvegicus
gagcatcttgtactgtcactgtttt

SEQ ID NO: 340193 - DNA, 25 bp, Rattus norvegicus
gagcatcttgtagtgtcactgtttt

SEQ ID NO: 340194 - DNA, 25 bp, Rattus norvegicus
gagcatcttgttacatagccagggt

SEQ ID NO: 340195 - DNA, 25 bp, Rattus norvegicus
gagcatcttgtttcatagccagggt

SEQ ID NO: 340196 - DNA, 25 bp, Rattus norvegicus
gagcatctttaccagacacttctag

SEQ ID NO: 340197 - DNA, 25 bp, Rattus norvegicus
gagcatctttacgagacacttctag

SEQ ID NO: 340198 - DNA, 25 bp, Rattus norvegicus
gagcatctttgaagttaaaacattt

SEQ ID NO: 340199 - DNA, 25 bp, Rattus norvegicus
gagcatctttgatgttaaaacattt

SEQ ID NO: 340200 - DNA, 25 bp, Rattus norvegicus
gagcatcttttgatacctgctggta

SEQ ID NO: 340201 - DNA, 25 bp, Rattus norvegicus
gagcatcttttgttacctgctggta

SEQ ID NO: 340202 - DNA, 25 bp, Rattus norvegicus
gagcatgaacacaatctttggaaca

SEQ ID NO: 340203 - DNA, 25 bp, Rattus norvegicus
gagcatgaacactatctttggaaca

SEQ ID NO: 340204 - DNA, 25 bp, Rattus norvegicus
gagcatgaagcaaggcccatgtctg

SEQ ID NO: 340205 - DNA, 25 bp, Rattus norvegicus
gagcatgaagcatggcccatgtctg

SEQ ID NO: 340206 - DNA, 25 bp, Rattus norvegicus
gagcatgaccaacccatggctgctt

SEQ ID NO: 340207 - DNA, 25 bp, Rattus norvegicus
gagcatgaccaagccatggctgctt

SEQ ID NO: 340208 - DNA, 25 bp, Rattus norvegicus
gagcatgacctcagtgacctctgtg

SEQ ID NO: 340209 - DNA, 25 bp, Rattus norvegicus
gagcatgacctcctctaattctacg

SEQ ID NO: 340210 - DNA, 25 bp, Rattus norvegicus
gagcatgacctcgtctaattctacg

SEQ ID NO: 340211 - DNA, 25 bp, Rattus norvegicus
gagcatgacctctgtgacctctgtg

SEQ ID NO: 340212 - DNA, 25 bp, Rattus norvegicus
gagcatgactctatttccagacagt

SEQ ID NO: 340213 - DNA, 25 bp, Rattus norvegicus
gagcatgactctttttccagacagt

SEQ ID NO: 340214 - DNA, 25 bp, Rattus norvegicus
gagcatgactgcagagttctacccc

SEQ ID NO: 340215 - DNA, 25 bp, Rattus norvegicus
gagcatgactgctgagttctacccc

SEQ ID NO: 340216 - DNA, 25 bp, Rattus norvegicus
gagcatgactttatacatacagaaa

SEQ ID NO: 340217 - DNA, 25 bp, Rattus norvegicus
gagcatgactttttacatacagaaa

SEQ ID NO: 340218 - DNA, 25 bp, Rattus norvegicus
gagcatgagcacctaaaccattata

SEQ ID NO: 340219 - DNA, 25 bp, Rattus norvegicus
gagcatgagcacgtaaaccattata

SEQ ID NO: 340220 - DNA, 25 bp, Rattus norvegicus
gagcatgagcctcgccgccattaat

SEQ ID NO: 340221 - DNA, 25 bp, Rattus norvegicus
gagcatgagcctggccgccattaat

SEQ ID NO: 340222 - DNA, 25 bp, Rattus norvegicus
gagcatgagtcaaagcctggtagtt

SEQ ID NO: 340223 - DNA, 25 bp, Rattus norvegicus
gagcatgagtcatagcctggtagtt

SEQ ID NO: 340224 - DNA, 25 bp, Rattus norvegicus
gagcatgatctcagtcaggcttgaa

SEQ ID NO: 340225 - DNA, 25 bp, Rattus norvegicus
gagcatgatctctgtcaggcttgaa

SEQ ID NO: 340226 - DNA, 25 bp, Rattus norvegicus
gagcatgatgacaagttaacaccta

SEQ ID NO: 340227 - DNA, 25 bp, Rattus norvegicus
gagcatgatgactagttaacaccta

SEQ ID NO: 340228 - DNA, 25 bp, Rattus norvegicus
gagcatgattctaacccagacagtg

SEQ ID NO: 340229 - DNA, 25 bp, Rattus norvegicus
gagcatgattcttacccagacagtg

SEQ ID NO: 340230 - DNA, 25 bp, Rattus norvegicus
gagcatgcaaaactccagaccttgt

SEQ ID NO: 340231 - DNA, 25 bp, Rattus norvegicus
gagcatgcaaaagtccagaccttgt

SEQ ID NO: 340232 - DNA, 25 bp, Rattus norvegicus
gagcatgcaaatccctggtggcaaa

SEQ ID NO: 340233 - DNA, 25 bp, Rattus norvegicus
gagcatgcaaatgcctggtggcaaa

SEQ ID NO: 340234 - DNA, 25 bp, Rattus norvegicus
gagcatgcacaacagcctggcttct

SEQ ID NO: 340235 - DNA, 25 bp, Rattus norvegicus
gagcatgcacaagagcctggcttct

SEQ ID NO: 340236 - DNA, 25 bp, Rattus norvegicus
gagcatgcacagacacaccttatgt

SEQ ID NO: 340237 - DNA, 25 bp, Rattus norvegicus
gagcatgcacagtcacaccttatgt

SEQ ID NO: 340238 - DNA, 25 bp, Rattus norvegicus
gagcatgcacataagattccccaat

SEQ ID NO: 340239 - DNA, 25 bp, Rattus norvegicus
gagcatgcacattagattccccaat

SEQ ID NO: 340240 - DNA, 25 bp, Rattus norvegicus
gagcatgcaggaactccgaggctaa

SEQ ID NO: 340241 - DNA, 25 bp, Rattus norvegicus
gagcatgcaggatctccgaggctaa

SEQ ID NO: 340242 - DNA, 25 bp, Rattus norvegicus
gagcatgcagtaaccaccagtctta

SEQ ID NO: 340243 - DNA, 25 bp, Rattus norvegicus
gagcatgcagtatccaccagtctta

SEQ ID NO: 340244 - DNA, 25 bp, Rattus norvegicus
gagcatgcatttatccggtatatcg

SEQ ID NO: 340245 - DNA, 25 bp, Rattus norvegicus
gagcatgcatttttccggtatatcg

SEQ ID NO: 340246 - DNA, 25 bp, Rattus norvegicus
gagcatgccaccagaatgtgtgtgg

SEQ ID NO: 340247 - DNA, 25 bp, Rattus norvegicus
gagcatgccacctgaatgtgtgtgg

SEQ ID NO: 340248 - DNA, 25 bp, Rattus norvegicus
gagcatgcccagagcagagcaggcc

SEQ ID NO: 340249 - DNA, 25 bp, Rattus norvegicus
gagcatgcccagtgcagagcaggcc

SEQ ID NO: 340250 - DNA, 25 bp, Rattus norvegicus
gagcatgcgactctcttagcaacta

SEQ ID NO: 340251 - DNA, 25 bp, Rattus norvegicus
gagcatgcgactgtcttagcaacta

SEQ ID NO: 340252 - DNA, 25 bp, Rattus norvegicus
gagcatgcgcatatggaaaagccaa

SEQ ID NO: 340253 - DNA, 25 bp, Rattus norvegicus
gagcatgcgcatttggaaaagccaa

SEQ ID NO: 340254 - DNA, 25 bp, Rattus norvegicus
gagcatgcggagactttcgtccctg

SEQ ID NO: 340255 - DNA, 25 bp, Rattus norvegicus
gagcatgcggagtctttcgtccctg

SEQ ID NO: 340256 - DNA, 25 bp, Rattus norvegicus
gagcatgcgtacattttactgttct

SEQ ID NO: 340257 - DNA, 25 bp, Rattus norvegicus
gagcatgcgtactttttactgttct

SEQ ID NO: 340258 - DNA, 25 bp, Rattus norvegicus
gagcatgctatgacagtgatttggc

SEQ ID NO: 340259 - DNA, 25 bp, Rattus norvegicus
gagcatgctatgtcagtgatttggc

SEQ ID NO: 340260 - DNA, 25 bp, Rattus norvegicus
gagcatgctcacactttaatataag

SEQ ID NO: 340261 - DNA, 25 bp, Rattus norvegicus
gagcatgctcactctttaatataag

SEQ ID NO: 340262 - DNA, 25 bp, Rattus norvegicus
gagcatgctctgagtagctcttgct

SEQ ID NO: 340263 - DNA, 25 bp, Rattus norvegicus
gagcatgctctgtgtagctcttgct

SEQ ID NO: 340264 - DNA, 25 bp, Rattus norvegicus
gagcatgcttggagaatcttgcaaa

SEQ ID NO: 340265 - DNA, 25 bp, Rattus norvegicus
gagcatgcttggtgaatcttgcaaa

SEQ ID NO: 340266 - DNA, 25 bp, Rattus norvegicus
gagcatgcttgtctctagtgagctg

SEQ ID NO: 340267 - DNA, 25 bp, Rattus norvegicus
gagcatgcttgtgtctagtgagctg

SEQ ID NO: 340268 - DNA, 25 bp, Rattus norvegicus
gagcatgctttacacgtgtatttaa

SEQ ID NO: 340269 - DNA, 25 bp, Rattus norvegicus
gagcatgctttagacgtgtatttaa

SEQ ID NO: 340270 - DNA, 25 bp, Rattus norvegicus
gagcatgcttttcattgctggctgt

SEQ ID NO: 340271 - DNA, 25 bp, Rattus norvegicus
gagcatgcttttcttcttatcttcc

SEQ ID NO: 340272 - DNA, 25 bp, Rattus norvegicus
gagcatgcttttgattgctggctgt

SEQ ID NO: 340273 - DNA, 25 bp, Rattus norvegicus
gagcatgcttttgttcttatcttcc

SEQ ID NO: 340274 - DNA, 25 bp, Rattus norvegicus
gagcatggaaccagccgtattatca

SEQ ID NO: 340275 - DNA, 25 bp, Rattus norvegicus
gagcatggaacctgccgtattatca

SEQ ID NO: 340276 - DNA, 25 bp, Rattus norvegicus
gagcatggaagcatccgggtcacct

SEQ ID NO: 340277 - DNA, 25 bp, Rattus norvegicus
gagcatggaagcttccgggtcacct

SEQ ID NO: 340278 - DNA, 25 bp, Rattus norvegicus
gagcatggacgacacagactacttt

SEQ ID NO: 340279 - DNA, 25 bp, Rattus norvegicus
gagcatggacgagacagactacttt

SEQ ID NO: 340280 - DNA, 25 bp, Rattus norvegicus
gagcatggagacacactttcattcc

SEQ ID NO: 340281 - DNA, 25 bp, Rattus norvegicus
gagcatggagactcactttcattcc

SEQ ID NO: 340282 - DNA, 25 bp, Rattus norvegicus
gagcatggagcaattctctgtgatc

SEQ ID NO: 340283 - DNA, 25 bp, Rattus norvegicus
gagcatggagcatttctctgtgatc

SEQ ID NO: 340284 - DNA, 25 bp, Rattus norvegicus
gagcatggccttagagcctggtcaa

SEQ ID NO: 340285 - DNA, 25 bp, Rattus norvegicus
gagcatggcctttgagcctggtcaa

SEQ ID NO: 340286 - DNA, 25 bp, Rattus norvegicus
gagcatggctataactgtaccacct

SEQ ID NO: 340287 - DNA, 25 bp, Rattus norvegicus
gagcatggctattactgtaccacct

SEQ ID NO: 340288 - DNA, 25 bp, Rattus norvegicus
gagcatggctttctcaggccattaa

SEQ ID NO: 340289 - DNA, 25 bp, Rattus norvegicus
gagcatggctttgtcaggccattaa

SEQ ID NO: 340290 - DNA, 25 bp, Rattus norvegicus
gagcatgggctcagaacccacagaa

SEQ ID NO: 340291 - DNA, 25 bp, Rattus norvegicus
gagcatgggctctgaacccacagaa

SEQ ID NO: 340292 - DNA, 25 bp, Rattus norvegicus
gagcatgggtgcagctgtcccagaa

SEQ ID NO: 340293 - DNA, 25 bp, Rattus norvegicus
gagcatgggtgctgctgtcccagaa

SEQ ID NO: 340294 - DNA, 25 bp, Rattus norvegicus
gagcatgggttcaaactgtttcctt

SEQ ID NO: 340295 - DNA, 25 bp, Rattus norvegicus
gagcatgggttctaactgtttcctt

SEQ ID NO: 340296 - DNA, 25 bp, Rattus norvegicus
gagcatggtactcaggaagccactg

SEQ ID NO: 340297 - DNA, 25 bp, Rattus norvegicus
gagcatggtactgaggaagccactg

SEQ ID NO: 340298 - DNA, 25 bp, Rattus norvegicus
gagcatggtccaacagaaaaggcaa

SEQ ID NO: 340299 - DNA, 25 bp, Rattus norvegicus
gagcatggtccatcagaaaaggcaa

SEQ ID NO: 340300 - DNA, 25 bp, Rattus norvegicus
gagcatgtacttaacctccagaaga

SEQ ID NO: 340301 - DNA, 25 bp, Rattus norvegicus
gagcatgtactttacctccagaaga

SEQ ID NO: 340302 - DNA, 25 bp, Rattus norvegicus
gagcatgtatctccaggtcatcctt

SEQ ID NO: 340303 - DNA, 25 bp, Rattus norvegicus
gagcatgtatctgcaggtcatcctt

SEQ ID NO: 340304 - DNA, 25 bp, Rattus norvegicus
gagcatgtatttcgcacctaagtac

SEQ ID NO: 340305 - DNA, 25 bp, Rattus norvegicus
gagcatgtatttggcacctaagtac

SEQ ID NO: 340306 - DNA, 25 bp, Rattus norvegicus
gagcatgtcagccagcattctacta

SEQ ID NO: 340307 - DNA, 25 bp, Rattus norvegicus
gagcatgtcagcgagcattctacta

SEQ ID NO: 340308 - DNA, 25 bp, Rattus norvegicus
gagcatgtccggaacgggccataga

SEQ ID NO: 340309 - DNA, 25 bp, Rattus norvegicus
gagcatgtccggtacgggccataga

SEQ ID NO: 340310 - DNA, 25 bp, Rattus norvegicus
gagcatgtccttatgagctggaaaa

SEQ ID NO: 340311 - DNA, 25 bp, Rattus norvegicus
gagcatgtccttttgagctggaaaa

SEQ ID NO: 340312 - DNA, 25 bp, Rattus norvegicus
gagcatgtctccacttggagatcct

SEQ ID NO: 340313 - DNA, 25 bp, Rattus norvegicus
gagcatgtctcctcttggagatcct

SEQ ID NO: 340314 - DNA, 25 bp, Rattus norvegicus
gagcatgtctgactctgaccagcag

SEQ ID NO: 340315 - DNA, 25 bp, Rattus norvegicus
gagcatgtctgactggatgactctc

SEQ ID NO: 340316 - DNA, 25 bp, Rattus norvegicus
gagcatgtctgagtctgaccagcag

SEQ ID NO: 340317 - DNA, 25 bp, Rattus norvegicus
gagcatgtctgagtggatgactctc

SEQ ID NO: 340318 - DNA, 25 bp, Rattus norvegicus
gagcatgtcttcattggttctggga

SEQ ID NO: 340319 - DNA, 25 bp, Rattus norvegicus
gagcatgtcttctttggttctggga

SEQ ID NO: 340320 - DNA, 25 bp, Rattus norvegicus
gagcatgtctttatactcattttaa

SEQ ID NO: 340321 - DNA, 25 bp, Rattus norvegicus
gagcatgtctttttactcattttaa

SEQ ID NO: 340322 - DNA, 25 bp, Rattus norvegicus
gagcatgtgcagaagaactgaccgt

SEQ ID NO: 340323 - DNA, 25 bp, Rattus norvegicus
gagcatgtgcagctgtttgacctga

SEQ ID NO: 340324 - DNA, 25 bp, Rattus norvegicus
gagcatgtgcaggtgtttgacctga

SEQ ID NO: 340325 - DNA, 25 bp, Rattus norvegicus
gagcatgtgcagtagaactgaccgt

SEQ ID NO: 340326 - DNA, 25 bp, Rattus norvegicus
gagcatgtgcctaatctcattcatt

SEQ ID NO: 340327 - DNA, 25 bp, Rattus norvegicus
gagcatgtgccttatctcattcatt

SEQ ID NO: 340328 - DNA, 25 bp, Rattus norvegicus
gagcatgtgctaatttctgcttcct

SEQ ID NO: 340329 - DNA, 25 bp, Rattus norvegicus
gagcatgtgctattttctgcttcct

SEQ ID NO: 340330 - DNA, 25 bp, Rattus norvegicus
gagcatgtggacaatgcccagcaat

SEQ ID NO: 340331 - DNA, 25 bp, Rattus norvegicus
gagcatgtggactatgcccagcaat

SEQ ID NO: 340332 - DNA, 25 bp, Rattus norvegicus
gagcatgtggccagaaacctggaga

SEQ ID NO: 340333 - DNA, 25 bp, Rattus norvegicus
gagcatgtggcctgaaacctggaga

SEQ ID NO: 340334 - DNA, 25 bp, Rattus norvegicus
gagcatgtggctctcctgaggttcc

SEQ ID NO: 340335 - DNA, 25 bp, Rattus norvegicus
gagcatgtggctgtcctgaggttcc

SEQ ID NO: 340336 - DNA, 25 bp, Rattus norvegicus
gagcatgtgtcccatctagaaagca

SEQ ID NO: 340337 - DNA, 25 bp, Rattus norvegicus
gagcatgtgtccgatctagaaagca

SEQ ID NO: 340338 - DNA, 25 bp, Rattus norvegicus
gagcatgttattactgtcacatcaa

SEQ ID NO: 340339 - DNA, 25 bp, Rattus norvegicus
gagcatgttatttctgtcacatcaa

SEQ ID NO: 340340 - DNA, 25 bp, Rattus norvegicus
gagcatgttcatcttttcttgtcac

SEQ ID NO: 340341 - DNA, 25 bp, Rattus norvegicus
gagcatgttcatgttttcttgtcac

SEQ ID NO: 340342 - DNA, 25 bp, Rattus norvegicus
gagcatgttccacaaaagccacagc

SEQ ID NO: 340343 - DNA, 25 bp, Rattus norvegicus
gagcatgttccagaaaagccacagc

SEQ ID NO: 340344 - DNA, 25 bp, Rattus norvegicus
gagcatgttggtcactgtcgtctgt

SEQ ID NO: 340345 - DNA, 25 bp, Rattus norvegicus
gagcatgttggtgactgtcgtctgt

SEQ ID NO: 340346 - DNA, 25 bp, Rattus norvegicus
gagcatgttgtaccactggacctgt

SEQ ID NO: 340347 - DNA, 25 bp, Rattus norvegicus
gagcatgttgtagcactggacctgt

SEQ ID NO: 340348 - DNA, 25 bp, Rattus norvegicus
gagcattaaacgctgccacagtggt

SEQ ID NO: 340349 - DNA, 25 bp, Rattus norvegicus
gagcattaaacggtgccacagtggt

SEQ ID NO: 340350 - DNA, 25 bp, Rattus norvegicus
gagcattaaactcgtctccacatcc

SEQ ID NO: 340351 - DNA, 25 bp, Rattus norvegicus
gagcattaaactggtctccacatcc

SEQ ID NO: 340352 - DNA, 25 bp, Rattus norvegicus
gagcattaacagagcgttcgcggag

SEQ ID NO: 340353 - DNA, 25 bp, Rattus norvegicus
gagcattaacagtgcgttcgcggag

SEQ ID NO: 340354 - DNA, 25 bp, Rattus norvegicus
gagcattaacggctctttaactctg

SEQ ID NO: 340355 - DNA, 25 bp, Rattus norvegicus
gagcattaacgggtctttaactctg

SEQ ID NO: 340356 - DNA, 25 bp, Rattus norvegicus
gagcattaactgaatcactgtgtat

SEQ ID NO: 340357 - DNA, 25 bp, Rattus norvegicus
gagcattaactgtatcactgtgtat

SEQ ID NO: 340358 - DNA, 25 bp, Rattus norvegicus
gagcattaagcaaccaccaagcatg

SEQ ID NO: 340359 - DNA, 25 bp, Rattus norvegicus
gagcattaagcatccaccaagcatg

SEQ ID NO: 340360 - DNA, 25 bp, Rattus norvegicus
gagcattaagcccaatctatgttgt

SEQ ID NO: 340361 - DNA, 25 bp, Rattus norvegicus
gagcattaagccgaatctatgttgt

SEQ ID NO: 340362 - DNA, 25 bp, Rattus norvegicus
gagcattaattccatctgagttttg

SEQ ID NO: 340363 - DNA, 25 bp, Rattus norvegicus
gagcattaattcgatctgagttttg

SEQ ID NO: 340364 - DNA, 25 bp, Rattus norvegicus
gagcattacatccagatggacccat

SEQ ID NO: 340365 - DNA, 25 bp, Rattus norvegicus
gagcattacatcgagatggacccat

SEQ ID NO: 340366 - DNA, 25 bp, Rattus norvegicus
gagcattagggaagccccaggttcc

SEQ ID NO: 340367 - DNA, 25 bp, Rattus norvegicus
gagcattagggatgccccaggttcc

SEQ ID NO: 340368 - DNA, 25 bp, Rattus norvegicus
gagcattagtgaaatgaccctattt

SEQ ID NO: 340369 - DNA, 25 bp, Rattus norvegicus
gagcattagtgatatgaccctattt

SEQ ID NO: 340370 - DNA, 25 bp, Rattus norvegicus
gagcattagttcatttccctggagg

SEQ ID NO: 340371 - DNA, 25 bp, Rattus norvegicus
gagcattagttcttttccctggagg

SEQ ID NO: 340372 - DNA, 25 bp, Rattus norvegicus
gagcattcaaataaccaggaacgga

SEQ ID NO: 340373 - DNA, 25 bp, Rattus norvegicus
gagcattcaaattaccaggaacgga

SEQ ID NO: 340374 - DNA, 25 bp, Rattus norvegicus
gagcattcaagacgtctcccatggc

SEQ ID NO: 340375 - DNA, 25 bp, Rattus norvegicus
gagcattcaagaggtctcccatggc

SEQ ID NO: 340376 - DNA, 25 bp, Rattus norvegicus
gagcattcagtcacagtagtccttc

SEQ ID NO: 340377 - DNA, 25 bp, Rattus norvegicus
gagcattcagtctcagtagtccttc

SEQ ID NO: 340378 - DNA, 25 bp, Rattus norvegicus
gagcattcatggacagctgcatctg

SEQ ID NO: 340379 - DNA, 25 bp, Rattus norvegicus
gagcattcatggtcagctgcatctg

SEQ ID NO: 340380 - DNA, 25 bp, Rattus norvegicus
gagcattccaccatccagttgtttt

SEQ ID NO: 340381 - DNA, 25 bp, Rattus norvegicus
gagcattccaccttccagttgtttt

SEQ ID NO: 340382 - DNA, 25 bp, Rattus norvegicus
gagcattccagcaagtgtaataaac

SEQ ID NO: 340383 - DNA, 25 bp, Rattus norvegicus
gagcattccagctagtgtaataaac

SEQ ID NO: 340384 - DNA, 25 bp, Rattus norvegicus
gagcattcccaaaggcaaaatttcc

SEQ ID NO: 340385 - DNA, 25 bp, Rattus norvegicus
gagcattcccaatggcaaaatttcc

SEQ ID NO: 340386 - DNA, 25 bp, Rattus norvegicus
gagcattcccatcggaacaggcagt

SEQ ID NO: 340387 - DNA, 25 bp, Rattus norvegicus
gagcattcccatgggaacaggcagt

SEQ ID NO: 340388 - DNA, 25 bp, Rattus norvegicus
gagcattccgatcggcattctgcat

SEQ ID NO: 340389 - DNA, 25 bp, Rattus norvegicus
gagcattccgatgggcattctgcat

SEQ ID NO: 340390 - DNA, 25 bp, Rattus norvegicus
gagcattcctataattccaacactg

SEQ ID NO: 340391 - DNA, 25 bp, Rattus norvegicus
gagcattcctattattccaacactg

SEQ ID NO: 340392 - DNA, 25 bp, Rattus norvegicus
gagcattcgtgacgtggatgatcct

SEQ ID NO: 340393 - DNA, 25 bp, Rattus norvegicus
gagcattcgtgaggtggatgatcct

SEQ ID NO: 340394 - DNA, 25 bp, Rattus norvegicus
gagcattctaacacttcctaggacc

SEQ ID NO: 340395 - DNA, 25 bp, Rattus norvegicus
gagcattctaactcttcctaggacc

SEQ ID NO: 340396 - DNA, 25 bp, Rattus norvegicus
gagcattctactcactgagccattt

SEQ ID NO: 340397 - DNA, 25 bp, Rattus norvegicus
gagcattctactgactgagccattt

SEQ ID NO: 340398 - DNA, 25 bp, Rattus norvegicus
gagcattctgctaggaggactgttt

SEQ ID NO: 340399 - DNA, 25 bp, Rattus norvegicus
gagcattctgcttggaggactgttt

SEQ ID NO: 340400 - DNA, 25 bp, Rattus norvegicus
gagcattctggccactatgaacgtc

SEQ ID NO: 340401 - DNA, 25 bp, Rattus norvegicus
gagcattctggcgactatgaacgtc

SEQ ID NO: 340402 - DNA, 25 bp, Rattus norvegicus
gagcattcttcaaaggcatcacttg

SEQ ID NO: 340403 - DNA, 25 bp, Rattus norvegicus
gagcattcttcataggcatcacttg

SEQ ID NO: 340404 - DNA, 25 bp, Rattus norvegicus
gagcattgaacccatgtgccagggt

SEQ ID NO: 340405 - DNA, 25 bp, Rattus norvegicus
gagcattgaaccgatgtgccagggt

SEQ ID NO: 340406 - DNA, 25 bp, Rattus norvegicus
gagcattgacttcctacggtgttcc

SEQ ID NO: 340407 - DNA, 25 bp, Rattus norvegicus
gagcattgacttgctacggtgttcc

SEQ ID NO: 340408 - DNA, 25 bp, Rattus norvegicus
gagcattgaggaattgtcttttact

SEQ ID NO: 340409 - DNA, 25 bp, Rattus norvegicus
gagcattgaggatttgtcttttact

SEQ ID NO: 340410 - DNA, 25 bp, Rattus norvegicus
gagcattgccatcatctgaggtctg

SEQ ID NO: 340411 - DNA, 25 bp, Rattus norvegicus
gagcattgccatgatctgaggtctg

SEQ ID NO: 340412 - DNA, 25 bp, Rattus norvegicus
gagcattgcgctctcaccagctaaa

SEQ ID NO: 340413 - DNA, 25 bp, Rattus norvegicus
gagcattgcgctgtcaccagctaaa

SEQ ID NO: 340414 - DNA, 25 bp, Rattus norvegicus
gagcattgctgtataggtccatgtt

SEQ ID NO: 340415 - DNA, 25 bp, Rattus norvegicus
gagcattgctgtttaggtccatgtt

SEQ ID NO: 340416 - DNA, 25 bp, Rattus norvegicus
gagcattggacaactctgtgaggaa

SEQ ID NO: 340417 - DNA, 25 bp, Rattus norvegicus
gagcattggacatctctgtgaggaa

SEQ ID NO: 340418 - DNA, 25 bp, Rattus norvegicus
gagcattggcacctggtctgtacgt

SEQ ID NO: 340419 - DNA, 25 bp, Rattus norvegicus
gagcattggcacgtggtctgtacgt

SEQ ID NO: 340420 - DNA, 25 bp, Rattus norvegicus
gagcattggctgaatattttcacat

SEQ ID NO: 340421 - DNA, 25 bp, Rattus norvegicus
gagcattggctgtatattttcacat

SEQ ID NO: 340422 - DNA, 25 bp, Rattus norvegicus
gagcattggttgctattggcactca

SEQ ID NO: 340423 - DNA, 25 bp, Rattus norvegicus
gagcattggttggtattggcactca

SEQ ID NO: 340424 - DNA, 25 bp, Rattus norvegicus
gagcattgtgagcattcggttgtta

SEQ ID NO: 340425 - DNA, 25 bp, Rattus norvegicus
gagcattgtgaggattcggttgtta

SEQ ID NO: 340426 - DNA, 25 bp, Rattus norvegicus
gagcattgttcccaattttttcaaa

SEQ ID NO: 340427 - DNA, 25 bp, Rattus norvegicus
gagcattgttccgaattttttcaaa

SEQ ID NO: 340428 - DNA, 25 bp, Rattus norvegicus
gagcatttacctaacgtgcacatgg

SEQ ID NO: 340429 - DNA, 25 bp, Rattus norvegicus
gagcatttaccttacgtgcacatgg

SEQ ID NO: 340430 - DNA, 25 bp, Rattus norvegicus
gagcatttatgtaattcccctgaaa

SEQ ID NO: 340431 - DNA, 25 bp, Rattus norvegicus
gagcatttatgttattcccctgaaa

SEQ ID NO: 340432 - DNA, 25 bp, Rattus norvegicus
gagcatttatttaacaatcgactga

SEQ ID NO: 340433 - DNA, 25 bp, Rattus norvegicus
gagcatttattttacaatcgactga

SEQ ID NO: 340434 - DNA, 25 bp, Rattus norvegicus
gagcatttctacagcatgcgattct

SEQ ID NO: 340435 - DNA, 25 bp, Rattus norvegicus
gagcatttctactgcatgcgattct

SEQ ID NO: 340436 - DNA, 25 bp, Rattus norvegicus
gagcatttctatattatcacccttc

SEQ ID NO: 340437 - DNA, 25 bp, Rattus norvegicus
gagcatttctattttatcacccttc

SEQ ID NO: 340438 - DNA, 25 bp, Rattus norvegicus
gagcatttctgcatatctgaatttc

SEQ ID NO: 340439 - DNA, 25 bp, Rattus norvegicus
gagcatttctgcttatctgaatttc

SEQ ID NO: 340440 - DNA, 25 bp, Rattus norvegicus
gagcatttcttaatcctacttgttg

SEQ ID NO: 340441 - DNA, 25 bp, Rattus norvegicus
gagcatttcttattcctacttgttg

SEQ ID NO: 340442 - DNA, 25 bp, Rattus norvegicus
gagcatttcttgactttcaaaagga

SEQ ID NO: 340443 - DNA, 25 bp, Rattus norvegicus
gagcatttcttgtctttcaaaagga

SEQ ID NO: 340444 - DNA, 25 bp, Rattus norvegicus
gagcatttgaacattcaggaccctg

SEQ ID NO: 340445 - DNA, 25 bp, Rattus norvegicus
gagcatttgaactttcaggaccctg

SEQ ID NO: 340446 - DNA, 25 bp, Rattus norvegicus
gagcatttgaataccctgggagaga

SEQ ID NO: 340447 - DNA, 25 bp, Rattus norvegicus
gagcatttgaatcccaacctgcaat

SEQ ID NO: 340448 - DNA, 25 bp, Rattus norvegicus
gagcatttgaatgccaacctgcaat

SEQ ID NO: 340449 - DNA, 25 bp, Rattus norvegicus
gagcatttgaattccctgggagaga

SEQ ID NO: 340450 - DNA, 25 bp, Rattus norvegicus
gagcatttgcatattggcacctttt

SEQ ID NO: 340451 - DNA, 25 bp, Rattus norvegicus
gagcatttgcattttggcacctttt

SEQ ID NO: 340452 - DNA, 25 bp, Rattus norvegicus
gagcatttgccaaccaaggccacta

SEQ ID NO: 340453 - DNA, 25 bp, Rattus norvegicus
gagcatttgccatccaaggccacta

SEQ ID NO: 340454 - DNA, 25 bp, Rattus norvegicus
gagcatttgcctaacatcgttttgt

SEQ ID NO: 340455 - DNA, 25 bp, Rattus norvegicus
gagcatttgccttacatcgttttgt

SEQ ID NO: 340456 - DNA, 25 bp, Rattus norvegicus
gagcatttgcttatgatctctgcat

SEQ ID NO: 340457 - DNA, 25 bp, Rattus norvegicus
gagcatttgcttttgatctctgcat

SEQ ID NO: 340458 - DNA, 25 bp, Rattus norvegicus
gagcatttggccctgttaataatca

SEQ ID NO: 340459 - DNA, 25 bp, Rattus norvegicus
gagcatttggccgtgttaataatca

SEQ ID NO: 340460 - DNA, 25 bp, Rattus norvegicus
gagcatttggttagtattgacacga

SEQ ID NO: 340461 - DNA, 25 bp, Rattus norvegicus
gagcatttggtttgtattgacacga

SEQ ID NO: 340462 - DNA, 25 bp, Rattus norvegicus
gagcattttaaacctttgcacacaa

SEQ ID NO: 340463 - DNA, 25 bp, Rattus norvegicus
gagcattttaaagctttgcacacaa

SEQ ID NO: 340464 - DNA, 25 bp, Rattus norvegicus
gagcatttttgtctttccagtataa

SEQ ID NO: 340465 - DNA, 25 bp, Rattus norvegicus
gagcatttttgtgtttccagtataa

SEQ ID NO: 340466 - DNA, 25 bp, Rattus norvegicus
gagccaaaacctcccgaagtacctg

SEQ ID NO: 340467 - DNA, 25 bp, Rattus norvegicus
gagccaaaacctgccgaagtacctg

SEQ ID NO: 340468 - DNA, 25 bp, Rattus norvegicus
gagccaaaaggcctctgccgagcat

SEQ ID NO: 340469 - DNA, 25 bp, Rattus norvegicus
gagccaaaaggcgtctgccgagcat

SEQ ID NO: 340470 - DNA, 25 bp, Rattus norvegicus
gagccaaaaggtctctgcactctca

SEQ ID NO: 340471 - DNA, 25 bp, Rattus norvegicus
gagccaaaaggtgtctgcactctca

SEQ ID NO: 340472 - DNA, 25 bp, Rattus norvegicus
gagccaaaagtaccacagacctaag

SEQ ID NO: 340473 - DNA, 25 bp, Rattus norvegicus
gagccaaaagtagcacagacctaag

SEQ ID NO: 340474 - DNA, 25 bp, Rattus norvegicus
gagccaaaattccagtgcagacgca

SEQ ID NO: 340475 - DNA, 25 bp, Rattus norvegicus
gagccaaaattcgagtgcagacgca

SEQ ID NO: 340476 - DNA, 25 bp, Rattus norvegicus
gagccaaactgaaaatctccccaga

SEQ ID NO: 340477 - DNA, 25 bp, Rattus norvegicus
gagccaaactgataatctccccaga

SEQ ID NO: 340478 - DNA, 25 bp, Rattus norvegicus
gagccaaacttaaccttgagccttg

SEQ ID NO: 340479 - DNA, 25 bp, Rattus norvegicus
gagccaaacttatccttgagccttg

SEQ ID NO: 340480 - DNA, 25 bp, Rattus norvegicus
gagccaaagacaacactgggccttc

SEQ ID NO: 340481 - DNA, 25 bp, Rattus norvegicus
gagccaaagacacggttgtgcctta

SEQ ID NO: 340482 - DNA, 25 bp, Rattus norvegicus
gagccaaagacagggttgtgcctta

SEQ ID NO: 340483 - DNA, 25 bp, Rattus norvegicus
gagccaaagacatcactgggccttc

SEQ ID NO: 340484 - DNA, 25 bp, Rattus norvegicus
gagccaaagactccgccttgggagc

SEQ ID NO: 340485 - DNA, 25 bp, Rattus norvegicus
gagccaaagactgcgccttgggagc

SEQ ID NO: 340486 - DNA, 25 bp, Rattus norvegicus
gagccaaagccaaccaggcggagct

SEQ ID NO: 340487 - DNA, 25 bp, Rattus norvegicus
gagccaaagccatccaggcggagct

SEQ ID NO: 340488 - DNA, 25 bp, Rattus norvegicus
gagccaaagtgcaacaatcgtgtga

SEQ ID NO: 340489 - DNA, 25 bp, Rattus norvegicus
gagccaaagtgctacaatcgtgtga

SEQ ID NO: 340490 - DNA, 25 bp, Rattus norvegicus
gagccaaagttgcattttgacttcc

SEQ ID NO: 340491 - DNA, 25 bp, Rattus norvegicus
gagccaaagttggattttgacttcc

SEQ ID NO: 340492 - DNA, 25 bp, Rattus norvegicus
gagccaaatggcctacatcctgatg

SEQ ID NO: 340493 - DNA, 25 bp, Rattus norvegicus
gagccaaatggcgtacatcctgatg

SEQ ID NO: 340494 - DNA, 25 bp, Rattus norvegicus
gagccaaatggtactgcctctgtga

SEQ ID NO: 340495 - DNA, 25 bp, Rattus norvegicus
gagccaaatggttctgcctctgtga

SEQ ID NO: 340496 - DNA, 25 bp, Rattus norvegicus
gagccaaattttacatggcccctca

SEQ ID NO: 340497 - DNA, 25 bp, Rattus norvegicus
gagccaaatttttcatggcccctca

SEQ ID NO: 340498 - DNA, 25 bp, Rattus norvegicus
gagccaacagatccttgcttttctc

SEQ ID NO: 340499 - DNA, 25 bp, Rattus norvegicus
gagccaacagatgcttgcttttctc

SEQ ID NO: 340500 - DNA, 25 bp, Rattus norvegicus
gagccaacagcaaagggccgcccga

SEQ ID NO: 340501 - DNA, 25 bp, Rattus norvegicus
gagccaacagcatagggccgcccga
